United States Patent 7,314,750 (ADDRESSABLE OLIGONUCLEOTIDE ARRAY OF THE RAT GENOME) - sequence listing, part 11

SEQ ID NO: 378328 - DNA, 25 bp, Rattus norvegicus
gcaatgaggtagactgtccatgcta

SEQ ID NO: 378329 - DNA, 25 bp, Rattus norvegicus
gcaatgaggtagtctgtccatgcta

SEQ ID NO: 378330 - DNA, 25 bp, Rattus norvegicus
gcaatgatcacacgacacccatgta

SEQ ID NO: 378331 - DNA, 25 bp, Rattus norvegicus
gcaatgatcacaggacacccatgta

SEQ ID NO: 378332 - DNA, 25 bp, Rattus norvegicus
gcaatgatcatgactcttattctaa

SEQ ID NO: 378333 - DNA, 25 bp, Rattus norvegicus
gcaatgatcatgtctcttattctaa

SEQ ID NO: 378334 - DNA, 25 bp, Rattus norvegicus
gcaatgattactctgtgctgaaaat

SEQ ID NO: 378335 - DNA, 25 bp, Rattus norvegicus
gcaatgattactgtgtgctgaaaat

SEQ ID NO: 378336 - DNA, 25 bp, Rattus norvegicus
gcaatgattctgattggtaccaact

SEQ ID NO: 378337 - DNA, 25 bp, Rattus norvegicus
gcaatgattctgtttggtaccaact

SEQ ID NO: 378338 - DNA, 25 bp, Rattus norvegicus
gcaatgcatagacctgtcagccata

SEQ ID NO: 378339 - DNA, 25 bp, Rattus norvegicus
gcaatgcatagagctgtcagccata

SEQ ID NO: 378340 - DNA, 25 bp, Rattus norvegicus
gcaatgcatggccttccaataaaag

SEQ ID NO: 378341 - DNA, 25 bp, Rattus norvegicus
gcaatgcatggcgttccaataaaag

SEQ ID NO: 378342 - DNA, 25 bp, Rattus norvegicus
gcaatgccagacatccagggtttga

SEQ ID NO: 378343 - DNA, 25 bp, Rattus norvegicus
gcaatgccagacttccagggtttga

SEQ ID NO: 378344 - DNA, 25 bp, Rattus norvegicus
gcaatgcccctgcagaccaaaagag

SEQ ID NO: 378345 - DNA, 25 bp, Rattus norvegicus
gcaatgcccctggagaccaaaagag

SEQ ID NO: 378346 - DNA, 25 bp, Rattus norvegicus
gcaatgccccttatggagcatggaa

SEQ ID NO: 378347 - DNA, 25 bp, Rattus norvegicus
gcaatgccccttttggagcatggaa

SEQ ID NO: 378348 - DNA, 25 bp, Rattus norvegicus
gcaatgccgaaaagatccgccagat

SEQ ID NO: 378349 - DNA, 25 bp, Rattus norvegicus
gcaatgccgaaatgatccgccagat

SEQ ID NO: 378350 - DNA, 25 bp, Rattus norvegicus
gcaatgcctccaaggtattgggttt

SEQ ID NO: 378351 - DNA, 25 bp, Rattus norvegicus
gcaatgcctccatggtattgggttt

SEQ ID NO: 378352 - DNA, 25 bp, Rattus norvegicus
gcaatgcctgctcttctaaagccat

SEQ ID NO: 378353 - DNA, 25 bp, Rattus norvegicus
gcaatgcctgctgttctaaagccat

SEQ ID NO: 378354 - DNA, 25 bp, Rattus norvegicus
gcaatgccttacctggatagcttta

SEQ ID NO: 378355 - DNA, 25 bp, Rattus norvegicus
gcaatgccttacgtggatagcttta

SEQ ID NO: 378356 - DNA, 25 bp, Rattus norvegicus
gcaatgcgacgaatggaccctcctg

SEQ ID NO: 378357 - DNA, 25 bp, Rattus norvegicus
gcaatgcgacgattggaccctcctg

SEQ ID NO: 378358 - DNA, 25 bp, Rattus norvegicus
gcaatgcgggttcgtttgttattaa

SEQ ID NO: 378359 - DNA, 25 bp, Rattus norvegicus
gcaatgcgggttggtttgttattaa

SEQ ID NO: 378360 - DNA, 25 bp, Rattus norvegicus
gcaatgctaaagacatggatggcta

SEQ ID NO: 378361 - DNA, 25 bp, Rattus norvegicus
gcaatgctaaagtcatggatggcta

SEQ ID NO: 378362 - DNA, 25 bp, Rattus norvegicus
gcaatgctatccacatcactggaat

SEQ ID NO: 378363 - DNA, 25 bp, Rattus norvegicus
gcaatgctatcctcatcactggaat

SEQ ID NO: 378364 - DNA, 25 bp, Rattus norvegicus
gcaatgctgcctatgtatggacact

SEQ ID NO: 378365 - DNA, 25 bp, Rattus norvegicus
gcaatgctgcctttgtatggacact

SEQ ID NO: 378366 - DNA, 25 bp, Rattus norvegicus
gcaatgcttcagagctcgtaagtgc

SEQ ID NO: 378367 - DNA, 25 bp, Rattus norvegicus
gcaatgcttcagtgctcgtaagtgc

SEQ ID NO: 378368 - DNA, 25 bp, Rattus norvegicus
gcaatgcttgttatacagccaaagg

SEQ ID NO: 378369 - DNA, 25 bp, Rattus norvegicus
gcaatgcttgttttacagccaaagg

SEQ ID NO: 378370 - DNA, 25 bp, Rattus norvegicus
gcaatggacactaccccttcttaaa

SEQ ID NO: 378371 - DNA, 25 bp, Rattus norvegicus
gcaatggacacttccccttcttaaa

SEQ ID NO: 378372 - DNA, 25 bp, Rattus norvegicus
gcaatggaccccagaagttctgcat

SEQ ID NO: 378373 - DNA, 25 bp, Rattus norvegicus
gcaatggacccctgaagttctgcat

SEQ ID NO: 378374 - DNA, 25 bp, Rattus norvegicus
gcaatggagagcataccggataaac

SEQ ID NO: 378375 - DNA, 25 bp, Rattus norvegicus
gcaatggagagcttaccggataaac

SEQ ID NO: 378376 - DNA, 25 bp, Rattus norvegicus
gcaatggatatcacgggctactcag

SEQ ID NO: 378377 - DNA, 25 bp, Rattus norvegicus
gcaatggatatctcgggctactcag

SEQ ID NO: 378378 - DNA, 25 bp, Rattus norvegicus
gcaatggcaagtagcggtcctactt

SEQ ID NO: 378379 - DNA, 25 bp, Rattus norvegicus
gcaatggcaagttgcggtcctactt

SEQ ID NO: 378380 - DNA, 25 bp, Rattus norvegicus
gcaatggcagcactgactgatcacc

SEQ ID NO: 378381 - DNA, 25 bp, Rattus norvegicus
gcaatggcagcagtgactgatcacc

SEQ ID NO: 378382 - DNA, 25 bp, Rattus norvegicus
gcaatggcagtaccggtctctctta

SEQ ID NO: 378383 - DNA, 25 bp, Rattus norvegicus
gcaatggcagtagcggtctctctta

SEQ ID NO: 378384 - DNA, 25 bp, Rattus norvegicus
gcaatggccttactgcatgctatga

SEQ ID NO: 378385 - DNA, 25 bp, Rattus norvegicus
gcaatggccttagtgcatgctatga

SEQ ID NO: 378386 - DNA, 25 bp, Rattus norvegicus
gcaatggcttggagtggtcttgcca

SEQ ID NO: 378387 - DNA, 25 bp, Rattus norvegicus
gcaatggcttggtgtggtcttgcca

SEQ ID NO: 378388 - DNA, 25 bp, Rattus norvegicus
gcaatgggaaccacagcagcttata

SEQ ID NO: 378389 - DNA, 25 bp, Rattus norvegicus
gcaatgggaacctcagcagcttata

SEQ ID NO: 378390 - DNA, 25 bp, Rattus norvegicus
gcaatgggacaaccaaagttgacta

SEQ ID NO: 378391 - DNA, 25 bp, Rattus norvegicus
gcaatgggacaagcaaagttgacta

SEQ ID NO: 378392 - DNA, 25 bp, Rattus norvegicus
gcaatgggcacacatgcgttgtact

SEQ ID NO: 378393 - DNA, 25 bp, Rattus norvegicus
gcaatgggcacagatgcgttgtact

SEQ ID NO: 378394 - DNA, 25 bp, Rattus norvegicus
gcaatgggccttaggttcagtgtcc

SEQ ID NO: 378395 - DNA, 25 bp, Rattus norvegicus
gcaatgggcctttggttcagtgtcc

SEQ ID NO: 378396 - DNA, 25 bp, Rattus norvegicus
gcaatgggcgttagtgtcctggcaa

SEQ ID NO: 378397 - DNA, 25 bp, Rattus norvegicus
gcaatgggcgtttgtgtcctggcaa

SEQ ID NO: 378398 - DNA, 25 bp, Rattus norvegicus
gcaatgggtagcactctggtggaaa

SEQ ID NO: 378399 - DNA, 25 bp, Rattus norvegicus
gcaatgggtagctctctggtggaaa

SEQ ID NO: 378400 - DNA, 25 bp, Rattus norvegicus
gcaatgggttctattctttaggtcg

SEQ ID NO: 378401 - DNA, 25 bp, Rattus norvegicus
gcaatgggttcttttctttaggtcg

SEQ ID NO: 378402 - DNA, 25 bp, Rattus norvegicus
gcaatgggttgcatttctctggatg

SEQ ID NO: 378403 - DNA, 25 bp, Rattus norvegicus
gcaatgggttgcttttctctggatg

SEQ ID NO: 378404 - DNA, 25 bp, Rattus norvegicus
gcaatggtaatactgcctgcacgac

SEQ ID NO: 378405 - DNA, 25 bp, Rattus norvegicus
gcaatggtaatagtgcctgcacgac

SEQ ID NO: 378406 - DNA, 25 bp, Rattus norvegicus
gcaatggtatctctcttgtactcac

SEQ ID NO: 378407 - DNA, 25 bp, Rattus norvegicus
gcaatggtatctgtcttgtactcac

SEQ ID NO: 378408 - DNA, 25 bp, Rattus norvegicus
gcaatggtcgaaagcactgttgaaa

SEQ ID NO: 378409 - DNA, 25 bp, Rattus norvegicus
gcaatggtcgaatgcactgttgaaa

SEQ ID NO: 378410 - DNA, 25 bp, Rattus norvegicus
gcaatggtgtatagtccagaggatt

SEQ ID NO: 378411 - DNA, 25 bp, Rattus norvegicus
gcaatggtgtattgtccagaggatt

SEQ ID NO: 378412 - DNA, 25 bp, Rattus norvegicus
gcaatggttactattttctgattct

SEQ ID NO: 378413 - DNA, 25 bp, Rattus norvegicus
gcaatggttacttttttctgattct

SEQ ID NO: 378414 - DNA, 25 bp, Rattus norvegicus
gcaatggttcctcctgtaggtgaat

SEQ ID NO: 378415 - DNA, 25 bp, Rattus norvegicus
gcaatggttcctgctgtaggtgaat

SEQ ID NO: 378416 - DNA, 25 bp, Rattus norvegicus
gcaatgtaaagacgtgtcccgcctg

SEQ ID NO: 378417 - DNA, 25 bp, Rattus norvegicus
gcaatgtaaagaggtgtcccgcctg

SEQ ID NO: 378418 - DNA, 25 bp, Rattus norvegicus
gcaatgtaagctagcgtgtacgtta

SEQ ID NO: 378419 - DNA, 25 bp, Rattus norvegicus
gcaatgtaagcttgcgtgtacgtta

SEQ ID NO: 378420 - DNA, 25 bp, Rattus norvegicus
gcaatgtagaacagactccttccaa

SEQ ID NO: 378421 - DNA, 25 bp, Rattus norvegicus
gcaatgtagaactgactccttccaa

SEQ ID NO: 378422 - DNA, 25 bp, Rattus norvegicus
gcaatgtaggacacagctttctccc

SEQ ID NO: 378423 - DNA, 25 bp, Rattus norvegicus
gcaatgtaggactcagctttctccc

SEQ ID NO: 378424 - DNA, 25 bp, Rattus norvegicus
gcaatgtcaattacttacttttaac

SEQ ID NO: 378425 - DNA, 25 bp, Rattus norvegicus
gcaatgtcaatttcttacttttaac

SEQ ID NO: 378426 - DNA, 25 bp, Rattus norvegicus
gcaatgtcaccgcaagcaacgctgt

SEQ ID NO: 378427 - DNA, 25 bp, Rattus norvegicus
gcaatgtcaccggaagcaacgctgt

SEQ ID NO: 378428 - DNA, 25 bp, Rattus norvegicus
gcaatgtcactgcagcatatcgctt

SEQ ID NO: 378429 - DNA, 25 bp, Rattus norvegicus
gcaatgtcactggagcatatcgctt

SEQ ID NO: 378430 - DNA, 25 bp, Rattus norvegicus
gcaatgtcagacacgttttcagcct

SEQ ID NO: 378431 - DNA, 25 bp, Rattus norvegicus
gcaatgtcagactcgttttcagcct

SEQ ID NO: 378432 - DNA, 25 bp, Rattus norvegicus
gcaatgtcagagatggccgtgtctt

SEQ ID NO: 378433 - DNA, 25 bp, Rattus norvegicus
gcaatgtcagagttggccgtgtctt

SEQ ID NO: 378434 - DNA, 25 bp, Rattus norvegicus
gcaatgtccttcactttgggtcagt

SEQ ID NO: 378435 - DNA, 25 bp, Rattus norvegicus
gcaatgtccttctctttgggtcagt

SEQ ID NO: 378436 - DNA, 25 bp, Rattus norvegicus
gcaatgtctcataccgaaggttcta

SEQ ID NO: 378437 - DNA, 25 bp, Rattus norvegicus
gcaatgtctcattccgaaggttcta

SEQ ID NO: 378438 - DNA, 25 bp, Rattus norvegicus
gcaatgtctgcaagctgaccaggga

SEQ ID NO: 378439 - DNA, 25 bp, Rattus norvegicus
gcaatgtctgcatgctgaccaggga

SEQ ID NO: 378440 - DNA, 25 bp, Rattus norvegicus
gcaatgtgagagagaccccgagttt

SEQ ID NO: 378441 - DNA, 25 bp, Rattus norvegicus
gcaatgtgagagtgaccccgagttt

SEQ ID NO: 378442 - DNA, 25 bp, Rattus norvegicus
gcaatgtgagcacctgcctcaagct

SEQ ID NO: 378443 - DNA, 25 bp, Rattus norvegicus
gcaatgtgagcagctgcctcaagct

SEQ ID NO: 378444 - DNA, 25 bp, Rattus norvegicus
gcaatgtgcagcaaccaacgtgtac

SEQ ID NO: 378445 - DNA, 25 bp, Rattus norvegicus
gcaatgtgcagctaccaacgtgtac

SEQ ID NO: 378446 - DNA, 25 bp, Rattus norvegicus
gcaatgtgctctattcaaattttgt

SEQ ID NO: 378447 - DNA, 25 bp, Rattus norvegicus
gcaatgtgctcttttcaaattttgt

SEQ ID NO: 378448 - DNA, 25 bp, Rattus norvegicus
gcaatgtgctgtaagaactcaatac

SEQ ID NO: 378449 - DNA, 25 bp, Rattus norvegicus
gcaatgtgctgttagaactcaatac

SEQ ID NO: 378450 - DNA, 25 bp, Rattus norvegicus
gcaatgtgggtaaggacccaggctt

SEQ ID NO: 378451 - DNA, 25 bp, Rattus norvegicus
gcaatgtgggtatggacccaggctt

SEQ ID NO: 378452 - DNA, 25 bp, Rattus norvegicus
gcaatgtgtcacatgagaggcatca

SEQ ID NO: 378453 - DNA, 25 bp, Rattus norvegicus
gcaatgtgtcacttgagaggcatca

SEQ ID NO: 378454 - DNA, 25 bp, Rattus norvegicus
gcaatgtgtgttatggcccaattct

SEQ ID NO: 378455 - DNA, 25 bp, Rattus norvegicus
gcaatgtgtgttttggcccaattct

SEQ ID NO: 378456 - DNA, 25 bp, Rattus norvegicus
gcaatgtgttcaacttcctttcata

SEQ ID NO: 378457 - DNA, 25 bp, Rattus norvegicus
gcaatgtgttcatcttcctttcata

SEQ ID NO: 378458 - DNA, 25 bp, Rattus norvegicus
gcaatgttcaacatgagctttcatt

SEQ ID NO: 378459 - DNA, 25 bp, Rattus norvegicus
gcaatgttcaacttgagctttcatt

SEQ ID NO: 378460 - DNA, 25 bp, Rattus norvegicus
gcaatgttcaggacatactcactgt

SEQ ID NO: 378461 - DNA, 25 bp, Rattus norvegicus
gcaatgttcaggtcatactcactgt

SEQ ID NO: 378462 - DNA, 25 bp, Rattus norvegicus
gcaatgttcagtaggtcaaccgcgt

SEQ ID NO: 378463 - DNA, 25 bp, Rattus norvegicus
gcaatgttcagttggtcaaccgcgt

SEQ ID NO: 378464 - DNA, 25 bp, Rattus norvegicus
gcaatgttcctgactgctgaaccat

SEQ ID NO: 378465 - DNA, 25 bp, Rattus norvegicus
gcaatgttcctgtctgctgaaccat

SEQ ID NO: 378466 - DNA, 25 bp, Rattus norvegicus
gcaatgttccttcagacctaggcag

SEQ ID NO: 378467 - DNA, 25 bp, Rattus norvegicus
gcaatgttccttgagacctaggcag

SEQ ID NO: 378468 - DNA, 25 bp, Rattus norvegicus
gcaatgttctctagactggctttat

SEQ ID NO: 378469 - DNA, 25 bp, Rattus norvegicus
gcaatgttctcttgactggctttat

SEQ ID NO: 378470 - DNA, 25 bp, Rattus norvegicus
gcaatgttcttcacccttgatttta

SEQ ID NO: 378471 - DNA, 25 bp, Rattus norvegicus
gcaatgttcttctcccttgatttta

SEQ ID NO: 378472 - DNA, 25 bp, Rattus norvegicus
gcaatgttgggtatcatgcatgaaa

SEQ ID NO: 378473 - DNA, 25 bp, Rattus norvegicus
gcaatgttgggtttcatgcatgaaa

SEQ ID NO: 378474 - DNA, 25 bp, Rattus norvegicus
gcaatgttgtacaatggctgattta

SEQ ID NO: 378475 - DNA, 25 bp, Rattus norvegicus
gcaatgttgtactatggctgattta

SEQ ID NO: 378476 - DNA, 25 bp, Rattus norvegicus
gcaatgtttactctatccgtttcta

SEQ ID NO: 378477 - DNA, 25 bp, Rattus norvegicus
gcaatgtttactgtatccgtttcta

SEQ ID NO: 378478 - DNA, 25 bp, Rattus norvegicus
gcaatgtttatcatcctggagttcc

SEQ ID NO: 378479 - DNA, 25 bp, Rattus norvegicus
gcaatgtttatcttcctggagttcc

SEQ ID NO: 378480 - DNA, 25 bp, Rattus norvegicus
gcaatgtttccgaggtattatgtca

SEQ ID NO: 378481 - DNA, 25 bp, Rattus norvegicus
gcaatgtttccgtggtattatgtca

SEQ ID NO: 378482 - DNA, 25 bp, Rattus norvegicus
gcaatgtttcttctgatattcccaa

SEQ ID NO: 378483 - DNA, 25 bp, Rattus norvegicus
gcaatgtttcttgtgatattcccaa

SEQ ID NO: 378484 - DNA, 25 bp, Rattus norvegicus
gcaatgtttgttcttgtctccccct

SEQ ID NO: 378485 - DNA, 25 bp, Rattus norvegicus
gcaatgtttgttgttgtctccccct

SEQ ID NO: 378486 - DNA, 25 bp, Rattus norvegicus
gcaatgttttgcctcagtcagaaca

SEQ ID NO: 378487 - DNA, 25 bp, Rattus norvegicus
gcaatgttttgcgtcagtcagaaca

SEQ ID NO: 378488 - DNA, 25 bp, Rattus norvegicus
gcaattaacccacgagatgtttccc

SEQ ID NO: 378489 - DNA, 25 bp, Rattus norvegicus
gcaattaacccaggagatgtttccc

SEQ ID NO: 378490 - DNA, 25 bp, Rattus norvegicus
gcaattaaccctatgacagctcaga

SEQ ID NO: 378491 - DNA, 25 bp, Rattus norvegicus
gcaattaaccctttgacagctcaga

SEQ ID NO: 378492 - DNA, 25 bp, Rattus norvegicus
gcaattaactgtactcctcagctgg

SEQ ID NO: 378493 - DNA, 25 bp, Rattus norvegicus
gcaattaactgttctcctcagctgg

SEQ ID NO: 378494 - DNA, 25 bp, Rattus norvegicus
gcaattaacttccaagagttccttg

SEQ ID NO: 378495 - DNA, 25 bp, Rattus norvegicus
gcaattaacttcgaagagttccttg

SEQ ID NO: 378496 - DNA, 25 bp, Rattus norvegicus
gcaattaatccaaaagacgctgtgt

SEQ ID NO: 378497 - DNA, 25 bp, Rattus norvegicus
gcaattaatccataagacgctgtgt

SEQ ID NO: 378498 - DNA, 25 bp, Rattus norvegicus
gcaattaccaatcgcctttttacat

SEQ ID NO: 378499 - DNA, 25 bp, Rattus norvegicus
gcaattaccaatggcctttttacat

SEQ ID NO: 378500 - DNA, 25 bp, Rattus norvegicus
gcaattaccttccatgttggttctt

SEQ ID NO: 378501 - DNA, 25 bp, Rattus norvegicus
gcaattaccttcgatgttggttctt

SEQ ID NO: 378502 - DNA, 25 bp, Rattus norvegicus
gcaattacgttgcttctgggtttgt

SEQ ID NO: 378503 - DNA, 25 bp, Rattus norvegicus
gcaattacgttggttctgggtttgt

SEQ ID NO: 378504 - DNA, 25 bp, Rattus norvegicus
gcaattacttctctaccttgacctt

SEQ ID NO: 378505 - DNA, 25 bp, Rattus norvegicus
gcaattacttctgtaccttgacctt

SEQ ID NO: 378506 - DNA, 25 bp, Rattus norvegicus
gcaattagaagcacttgctcctcaa

SEQ ID NO: 378507 - DNA, 25 bp, Rattus norvegicus
gcaattagaagctcttgctcctcaa

SEQ ID NO: 378508 - DNA, 25 bp, Rattus norvegicus
gcaattagggaactgatgcctcata

SEQ ID NO: 378509 - DNA, 25 bp, Rattus norvegicus
gcaattagggaagtgatgcctcata

SEQ ID NO: 378510 - DNA, 25 bp, Rattus norvegicus
gcaattagttctcggttagaatccc

SEQ ID NO: 378511 - DNA, 25 bp, Rattus norvegicus
gcaattagttctgggttagaatccc

SEQ ID NO: 378512 - DNA, 25 bp, Rattus norvegicus
gcaattattcgaccagcctgagtca

SEQ ID NO: 378513 - DNA, 25 bp, Rattus norvegicus
gcaattattcgagcagcctgagtca

SEQ ID NO: 378514 - DNA, 25 bp, Rattus norvegicus
gcaattatttttaaggtgtacacca

SEQ ID NO: 378515 - DNA, 25 bp, Rattus norvegicus
gcaattattttttaggtgtacacca

SEQ ID NO: 378516 - DNA, 25 bp, Rattus norvegicus
gcaattcaagtccaaattaccaggt

SEQ ID NO: 378517 - DNA, 25 bp, Rattus norvegicus
gcaattcaagtcgaaattaccaggt

SEQ ID NO: 378518 - DNA, 25 bp, Rattus norvegicus
gcaattcactggactagtgtctcac

SEQ ID NO: 378519 - DNA, 25 bp, Rattus norvegicus
gcaattcactggtctagtgtctcac

SEQ ID NO: 378520 - DNA, 25 bp, Rattus norvegicus
gcaattcagcaaagcccactgcagt

SEQ ID NO: 378521 - DNA, 25 bp, Rattus norvegicus
gcaattcagcaatgcccactgcagt

SEQ ID NO: 378522 - DNA, 25 bp, Rattus norvegicus
gcaattcagtttaggatgtcagtcc

SEQ ID NO: 378523 - DNA, 25 bp, Rattus norvegicus
gcaattcagttttggatgtcagtcc

SEQ ID NO: 378524 - DNA, 25 bp, Rattus norvegicus
gcaattcatattccttgtagctgaa

SEQ ID NO: 378525 - DNA, 25 bp, Rattus norvegicus
gcaattcatattgcttgtagctgaa

SEQ ID NO: 378526 - DNA, 25 bp, Rattus norvegicus
gcaattcatttgcattcagacccca

SEQ ID NO: 378527 - DNA, 25 bp, Rattus norvegicus
gcaattcatttggattcagacccca

SEQ ID NO: 378528 - DNA, 25 bp, Rattus norvegicus
gcaattccagagactctgctgtggg

SEQ ID NO: 378529 - DNA, 25 bp, Rattus norvegicus
gcaattccagagtctctgctgtggg

SEQ ID NO: 378530 - DNA, 25 bp, Rattus norvegicus
gcaattccagttccaaggctgtcgc

SEQ ID NO: 378531 - DNA, 25 bp, Rattus norvegicus
gcaattccagttgcaaggctgtcgc

SEQ ID NO: 378532 - DNA, 25 bp, Rattus norvegicus
gcaattcccagtcggagggctccga

SEQ ID NO: 378533 - DNA, 25 bp, Rattus norvegicus
gcaattcccagtgggagggctccga

SEQ ID NO: 378534 - DNA, 25 bp, Rattus norvegicus
gcaattcctcatcgatgctgtgctc

SEQ ID NO: 378535 - DNA, 25 bp, Rattus norvegicus
gcaattcctcatggatgctgtgctc

SEQ ID NO: 378536 - DNA, 25 bp, Rattus norvegicus
gcaattcctcgcagttttaactcct

SEQ ID NO: 378537 - DNA, 25 bp, Rattus norvegicus
gcaattcctcgctgttttaactcct

SEQ ID NO: 378538 - DNA, 25 bp, Rattus norvegicus
gcaattcctgagactgatcggtcac

SEQ ID NO: 378539 - DNA, 25 bp, Rattus norvegicus
gcaattcctgagtctgatcggtcac

SEQ ID NO: 378540 - DNA, 25 bp, Rattus norvegicus
gcaattctacatcagtctgccagtg

SEQ ID NO: 378541 - DNA, 25 bp, Rattus norvegicus
gcaattctacatgagtctgccagtg

SEQ ID NO: 378542 - DNA, 25 bp, Rattus norvegicus
gcaattctagtgctggtgtggattt

SEQ ID NO: 378543 - DNA, 25 bp, Rattus norvegicus
gcaattctagtggtggtgtggattt

SEQ ID NO: 378544 - DNA, 25 bp, Rattus norvegicus
gcaattctcttaaaaaccaaacagg

SEQ ID NO: 378545 - DNA, 25 bp, Rattus norvegicus
gcaattctcttataaaccaaacagg

SEQ ID NO: 378546 - DNA, 25 bp, Rattus norvegicus
gcaattctcttgactgacgactgtt

SEQ ID NO: 378547 - DNA, 25 bp, Rattus norvegicus
gcaattctcttgtctgacgactgtt

SEQ ID NO: 378548 - DNA, 25 bp, Rattus norvegicus
gcaattctgaacagggctagctcct

SEQ ID NO: 378549 - DNA, 25 bp, Rattus norvegicus
gcaattctgaactgggctagctcct

SEQ ID NO: 378550 - DNA, 25 bp, Rattus norvegicus
gcaattctgcacaaaccctaggtct

SEQ ID NO: 378551 - DNA, 25 bp, Rattus norvegicus
gcaattctgcactaaccctaggtct

SEQ ID NO: 378552 - DNA, 25 bp, Rattus norvegicus
gcaattctgcatatcttcgagtggt

SEQ ID NO: 378553 - DNA, 25 bp, Rattus norvegicus
gcaattctgcatttcttcgagtggt

SEQ ID NO: 378554 - DNA, 25 bp, Rattus norvegicus
gcaattctggttcgaggaagctact

SEQ ID NO: 378555 - DNA, 25 bp, Rattus norvegicus
gcaattctggttggaggaagctact

SEQ ID NO: 378556 - DNA, 25 bp, Rattus norvegicus
gcaattcttggaacagccatgcctt

SEQ ID NO: 378557 - DNA, 25 bp, Rattus norvegicus
gcaattcttggatcagccatgcctt

SEQ ID NO: 378558 - DNA, 25 bp, Rattus norvegicus
gcaattcttgttattcaccacttgt

SEQ ID NO: 378559 - DNA, 25 bp, Rattus norvegicus
gcaattcttgtttttcaccacttgt

SEQ ID NO: 378560 - DNA, 25 bp, Rattus norvegicus
gcaattctttccacttgaagtgctt

SEQ ID NO: 378561 - DNA, 25 bp, Rattus norvegicus
gcaattctttcctcttgaagtgctt

SEQ ID NO: 378562 - DNA, 25 bp, Rattus norvegicus
gcaattctttgacagagggttccaa

SEQ ID NO: 378563 - DNA, 25 bp, Rattus norvegicus
gcaattctttgagagagggttccaa

SEQ ID NO: 378564 - DNA, 25 bp, Rattus norvegicus
gcaattgaacgacaatgatcataat

SEQ ID NO: 378565 - DNA, 25 bp, Rattus norvegicus
gcaattgaacgagaatgatcataat

SEQ ID NO: 378566 - DNA, 25 bp, Rattus norvegicus
gcaattgaatcaaactcatcagaat

SEQ ID NO: 378567 - DNA, 25 bp, Rattus norvegicus
gcaattgaatcatactcatcagaat

SEQ ID NO: 378568 - DNA, 25 bp, Rattus norvegicus
gcaattgaccaaagttcttcagagg

SEQ ID NO: 378569 - DNA, 25 bp, Rattus norvegicus
gcaattgaccaatgttcttcagagg

SEQ ID NO: 378570 - DNA, 25 bp, Rattus norvegicus
gcaattgacgtgaagaaccgtacat

SEQ ID NO: 378571 - DNA, 25 bp, Rattus norvegicus
gcaattgacgtgtagaaccgtacat

SEQ ID NO: 378572 - DNA, 25 bp, Rattus norvegicus
gcaattgcactcagcgtggtatggt

SEQ ID NO: 378573 - DNA, 25 bp, Rattus norvegicus
gcaattgcactctgcgtggtatggt

SEQ ID NO: 378574 - DNA, 25 bp, Rattus norvegicus
gcaattgcagagcatttgggttcaa

SEQ ID NO: 378575 - DNA, 25 bp, Rattus norvegicus
gcaattgcagaggatttgggttcaa

SEQ ID NO: 378576 - DNA, 25 bp, Rattus norvegicus
gcaattgcatggacttagattttaa

SEQ ID NO: 378577 - DNA, 25 bp, Rattus norvegicus
gcaattgcatggtcttagattttaa

SEQ ID NO: 378578 - DNA, 25 bp, Rattus norvegicus
gcaattgcattcacaactctatagt

SEQ ID NO: 378579 - DNA, 25 bp, Rattus norvegicus
gcaattgcattctcaactctatagt

SEQ ID NO: 378580 - DNA, 25 bp, Rattus norvegicus
gcaattgctggcaatctggaccaca

SEQ ID NO: 378581 - DNA, 25 bp, Rattus norvegicus
gcaattgctggctatctggaccaca

SEQ ID NO: 378582 - DNA, 25 bp, Rattus norvegicus
gcaattgctgtcagactgcctgtaa

SEQ ID NO: 378583 - DNA, 25 bp, Rattus norvegicus
gcaattgctgtctgactgcctgtaa

SEQ ID NO: 378584 - DNA, 25 bp, Rattus norvegicus
gcaattgctttacggacgcttttaa

SEQ ID NO: 378585 - DNA, 25 bp, Rattus norvegicus
gcaattgctttagggacgcttttaa

SEQ ID NO: 378586 - DNA, 25 bp, Rattus norvegicus
gcaattggacatcctcatcctgagc

SEQ ID NO: 378587 - DNA, 25 bp, Rattus norvegicus
gcaattggacatgctcatcctgagc

SEQ ID NO: 378588 - DNA, 25 bp, Rattus norvegicus
gcaattggccctctgggtagctgct

SEQ ID NO: 378589 - DNA, 25 bp, Rattus norvegicus
gcaattggccctgtgggtagctgct

SEQ ID NO: 378590 - DNA, 25 bp, Rattus norvegicus
gcaattgggagcagcctaacatggc

SEQ ID NO: 378591 - DNA, 25 bp, Rattus norvegicus
gcaattgggagctgcctaacatggc

SEQ ID NO: 378592 - DNA, 25 bp, Rattus norvegicus
gcaattgtactgatctactaccaaa

SEQ ID NO: 378593 - DNA, 25 bp, Rattus norvegicus
gcaattgtactgttctactaccaaa

SEQ ID NO: 378594 - DNA, 25 bp, Rattus norvegicus
gcaattgtcaagctacggactctga

SEQ ID NO: 378595 - DNA, 25 bp, Rattus norvegicus
gcaattgtcaaggtacggactctga

SEQ ID NO: 378596 - DNA, 25 bp, Rattus norvegicus
gcaattgtcatgatgggccggcacc

SEQ ID NO: 378597 - DNA, 25 bp, Rattus norvegicus
gcaattgtcatgttgggccggcacc

SEQ ID NO: 378598 - DNA, 25 bp, Rattus norvegicus
gcaattgtccataatccagttacct

SEQ ID NO: 378599 - DNA, 25 bp, Rattus norvegicus
gcaattgtccattatccagttacct

SEQ ID NO: 378600 - DNA, 25 bp, Rattus norvegicus
gcaattgtctggacagctcccgaga

SEQ ID NO: 378601 - DNA, 25 bp, Rattus norvegicus
gcaattgtctggtcagctcccgaga

SEQ ID NO: 378602 - DNA, 25 bp, Rattus norvegicus
gcaattgtctgtatttctcagtggg

SEQ ID NO: 378603 - DNA, 25 bp, Rattus norvegicus
gcaattgtctgtttttctcagtggg

SEQ ID NO: 378604 - DNA, 25 bp, Rattus norvegicus
gcaattgttcttaactggctttctg

SEQ ID NO: 378605 - DNA, 25 bp, Rattus norvegicus
gcaattgttctttactggctttctg

SEQ ID NO: 378606 - DNA, 25 bp, Rattus norvegicus
gcaattgtttgcaggtgcttttgta

SEQ ID NO: 378607 - DNA, 25 bp, Rattus norvegicus
gcaattgtttgctggtgcttttgta

SEQ ID NO: 378608 - DNA, 25 bp, Rattus norvegicus
gcaattgttttcagtggcatgggca

SEQ ID NO: 378609 - DNA, 25 bp, Rattus norvegicus
gcaattgttttctgtggcatgggca

SEQ ID NO: 378610 - DNA, 25 bp, Rattus norvegicus
gcaatttacctaagtgttccttctt

SEQ ID NO: 378611 - DNA, 25 bp, Rattus norvegicus
gcaatttacctatgtgttccttctt

SEQ ID NO: 378612 - DNA, 25 bp, Rattus norvegicus
gcaatttagatgctcctgtcgtgag

SEQ ID NO: 378613 - DNA, 25 bp, Rattus norvegicus
gcaatttagatggtcctgtcgtgag

SEQ ID NO: 378614 - DNA, 25 bp, Rattus norvegicus
gcaatttcagggaaaaccagtcctt

SEQ ID NO: 378615 - DNA, 25 bp, Rattus norvegicus
gcaatttcagggtaaaccagtcctt

SEQ ID NO: 378616 - DNA, 25 bp, Rattus norvegicus
gcaatttcagttatctaacacacac

SEQ ID NO: 378617 - DNA, 25 bp, Rattus norvegicus
gcaatttcagttttctaacacacac

SEQ ID NO: 378618 - DNA, 25 bp, Rattus norvegicus
gcaatttccaacaattagggctaga

SEQ ID NO: 378619 - DNA, 25 bp, Rattus norvegicus
gcaatttccaactattagggctaga

SEQ ID NO: 378620 - DNA, 25 bp, Rattus norvegicus
gcaatttcccatccaaggccggtgg

SEQ ID NO: 378621 - DNA, 25 bp, Rattus norvegicus
gcaatttcccatgcaaggccggtgg

SEQ ID NO: 378622 - DNA, 25 bp, Rattus norvegicus
gcaatttcccctatgggtctgattg

SEQ ID NO: 378623 - DNA, 25 bp, Rattus norvegicus
gcaatttcccctttgggtctgattg

SEQ ID NO: 378624 - DNA, 25 bp, Rattus norvegicus
gcaatttcgcataccttacaaggca

SEQ ID NO: 378625 - DNA, 25 bp, Rattus norvegicus
gcaatttcgcattccttacaaggca

SEQ ID NO: 378626 - DNA, 25 bp, Rattus norvegicus
gcaatttctcagatttcattcctca

SEQ ID NO: 378627 - DNA, 25 bp, Rattus norvegicus
gcaatttctcagttttcattcctca

SEQ ID NO: 378628 - DNA, 25 bp, Rattus norvegicus
gcaatttctcctctgttttcgaaga

SEQ ID NO: 378629 - DNA, 25 bp, Rattus norvegicus
gcaatttctcctgtgttttcgaaga

SEQ ID NO: 378630 - DNA, 25 bp, Rattus norvegicus
gcaatttctgccagtgagttcatgt

SEQ ID NO: 378631 - DNA, 25 bp, Rattus norvegicus
gcaatttctgcctgtgagttcatgt

SEQ ID NO: 378632 - DNA, 25 bp, Rattus norvegicus
gcaatttctgttagttccggtcttc

SEQ ID NO: 378633 - DNA, 25 bp, Rattus norvegicus
gcaatttctgtttgttccggtcttc

SEQ ID NO: 378634 - DNA, 25 bp, Rattus norvegicus
gcaatttcttttccagctagatgag

SEQ ID NO: 378635 - DNA, 25 bp, Rattus norvegicus
gcaatttcttttgcagctagatgag

SEQ ID NO: 378636 - DNA, 25 bp, Rattus norvegicus
gcaatttgattgctttccttctatt

SEQ ID NO: 378637 - DNA, 25 bp, Rattus norvegicus
gcaatttgattggtttccttctatt

SEQ ID NO: 378638 - DNA, 25 bp, Rattus norvegicus
gcaatttggcaaccttttatacctt

SEQ ID NO: 378639 - DNA, 25 bp, Rattus norvegicus
gcaatttggcaagcttttatacctt

SEQ ID NO: 378640 - DNA, 25 bp, Rattus norvegicus
gcaatttgggctagtgttctcacta

SEQ ID NO: 378641 - DNA, 25 bp, Rattus norvegicus
gcaatttgggcttgtgttctcacta

SEQ ID NO: 378642 - DNA, 25 bp, Rattus norvegicus
gcaatttgtggaaacttctctctat

SEQ ID NO: 378643 - DNA, 25 bp, Rattus norvegicus
gcaatttgtggatacttctctctat

SEQ ID NO: 378644 - DNA, 25 bp, Rattus norvegicus
gcaattttaagcatagtatttcggg

SEQ ID NO: 378645 - DNA, 25 bp, Rattus norvegicus
gcaattttaagcttagtatttcggg

SEQ ID NO: 378646 - DNA, 25 bp, Rattus norvegicus
gcaattttactgctgccggtatagc

SEQ ID NO: 378647 - DNA, 25 bp, Rattus norvegicus
gcaattttactggtgccggtatagc

SEQ ID NO: 378648 - DNA, 25 bp, Rattus norvegicus
gcaattttcgtaatttcctgagtag

SEQ ID NO: 378649 - DNA, 25 bp, Rattus norvegicus
gcaattttcgtattttcctgagtag

SEQ ID NO: 378650 - DNA, 25 bp, Rattus norvegicus
gcaattttcttcaaagtcctctgac

SEQ ID NO: 378651 - DNA, 25 bp, Rattus norvegicus
gcaattttcttctaagtcctctgac

SEQ ID NO: 378652 - DNA, 25 bp, Rattus norvegicus
gcaattttctttcttgtgcgcatga

SEQ ID NO: 378653 - DNA, 25 bp, Rattus norvegicus
gcaattttctttgttgtgcgcatga

SEQ ID NO: 378654 - DNA, 25 bp, Rattus norvegicus
gcaattttgcatatttgtgtctcaa

SEQ ID NO: 378655 - DNA, 25 bp, Rattus norvegicus
gcaattttgcatttttgtgtctcaa

SEQ ID NO: 378656 - DNA, 25 bp, Rattus norvegicus
gcaattttgtcacctgctacagcct

SEQ ID NO: 378657 - DNA, 25 bp, Rattus norvegicus
gcaattttgtcagctgctacagcct

SEQ ID NO: 378658 - DNA, 25 bp, Rattus norvegicus
gcaattttttcacctcgtctgtcaa

SEQ ID NO: 378659 - DNA, 25 bp, Rattus norvegicus
gcaattttttcagctcgtctgtcaa

SEQ ID NO: 378660 - DNA, 25 bp, Rattus norvegicus
gcacaaaaaaccaagctgtctcctt

SEQ ID NO: 378661 - DNA, 25 bp, Rattus norvegicus
gcacaaaaaacctagctgtctcctt

SEQ ID NO: 378662 - DNA, 25 bp, Rattus norvegicus
gcacaaaaactcacatgctgccgtt

SEQ ID NO: 378663 - DNA, 25 bp, Rattus norvegicus
gcacaaaaactctcatgctgccgtt

SEQ ID NO: 378664 - DNA, 25 bp, Rattus norvegicus
gcacaaaaagtgctgcctcagccac

SEQ ID NO: 378665 - DNA, 25 bp, Rattus norvegicus
gcacaaaaagtggtgcctcagccac

SEQ ID NO: 378666 - DNA, 25 bp, Rattus norvegicus
gcacaaaatggcactcctgcaatgg

SEQ ID NO: 378667 - DNA, 25 bp, Rattus norvegicus
gcacaaaatggctctcctgcaatgg

SEQ ID NO: 378668 - DNA, 25 bp, Rattus norvegicus
gcacaaacctaacactcataacact

SEQ ID NO: 378669 - DNA, 25 bp, Rattus norvegicus
gcacaaacctaagactcataacact

SEQ ID NO: 378670 - DNA, 25 bp, Rattus norvegicus
gcacaaactggcagtcatcactgat

SEQ ID NO: 378671 - DNA, 25 bp, Rattus norvegicus
gcacaaactggctgtcatcactgat

SEQ ID NO: 378672 - DNA, 25 bp, Rattus norvegicus
gcacaaagaactagcttggttggac

SEQ ID NO: 378673 - DNA, 25 bp, Rattus norvegicus
gcacaaagaacttgcttggttggac

SEQ ID NO: 378674 - DNA, 25 bp, Rattus norvegicus
gcacaaagagaccttctaggctgag

SEQ ID NO: 378675 - DNA, 25 bp, Rattus norvegicus
gcacaaagagacgttctaggctgag

SEQ ID NO: 378676 - DNA, 25 bp, Rattus norvegicus
gcacaaagatcccagtggcctttat

SEQ ID NO: 378677 - DNA, 25 bp, Rattus norvegicus
gcacaaagatccgagtggcctttat

SEQ ID NO: 378678 - DNA, 25 bp, Rattus norvegicus
gcacaaagcaacaagccccggaggc

SEQ ID NO: 378679 - DNA, 25 bp, Rattus norvegicus
gcacaaagcaactagccccggaggc

SEQ ID NO: 378680 - DNA, 25 bp, Rattus norvegicus
gcacaaagcagtatttatccctggg

SEQ ID NO: 378681 - DNA, 25 bp, Rattus norvegicus
gcacaaagcagtttttatccctggg

SEQ ID NO: 378682 - DNA, 25 bp, Rattus norvegicus
gcacaaaggcaaacatttagcatag

SEQ ID NO: 378683 - DNA, 25 bp, Rattus norvegicus
gcacaaaggcaatcatttagcatag

SEQ ID NO: 378684 - DNA, 25 bp, Rattus norvegicus
gcacaaaggcatcaacagcttaggt

SEQ ID NO: 378685 - DNA, 25 bp, Rattus norvegicus
gcacaaaggcatgaacagcttaggt

SEQ ID NO: 378686 - DNA, 25 bp, Rattus norvegicus
gcacaaagtcctctggaacctttta

SEQ ID NO: 378687 - DNA, 25 bp, Rattus norvegicus
gcacaaagtcctgtggaacctttta

SEQ ID NO: 378688 - DNA, 25 bp, Rattus norvegicus
gcacaaagtcttcgcccgagatgag

SEQ ID NO: 378689 - DNA, 25 bp, Rattus norvegicus
gcacaaagtcttggcccgagatgag

SEQ ID NO: 378690 - DNA, 25 bp, Rattus norvegicus
gcacaaagttttcctggatttatca

SEQ ID NO: 378691 - DNA, 25 bp, Rattus norvegicus
gcacaaagttttgctggatttatca

SEQ ID NO: 378692 - DNA, 25 bp, Rattus norvegicus
gcacaaatatctctttcctacatgt

SEQ ID NO: 378693 - DNA, 25 bp, Rattus norvegicus
gcacaaatatctgtttcctacatgt

SEQ ID NO: 378694 - DNA, 25 bp, Rattus norvegicus
gcacaaatggccaggtctgcttctg

SEQ ID NO: 378695 - DNA, 25 bp, Rattus norvegicus
gcacaaatggcctggtctgcttctg

SEQ ID NO: 378696 - DNA, 25 bp, Rattus norvegicus
gcacaaatgtccatcagtgattcct

SEQ ID NO: 378697 - DNA, 25 bp, Rattus norvegicus
gcacaaatgtccttcagtgattcct

SEQ ID NO: 378698 - DNA, 25 bp, Rattus norvegicus
gcacaaatgtgtatccttaggcctc

SEQ ID NO: 378699 - DNA, 25 bp, Rattus norvegicus
gcacaaatgtgtttccttaggcctc

SEQ ID NO: 378700 - DNA, 25 bp, Rattus norvegicus
gcacaaattagaaaactgtcccggt

SEQ ID NO: 378701 - DNA, 25 bp, Rattus norvegicus
gcacaaattagataactgtcccggt

SEQ ID NO: 378702 - DNA, 25 bp, Rattus norvegicus
gcacaaattccaatgagtctattca

SEQ ID NO: 378703 - DNA, 25 bp, Rattus norvegicus
gcacaaattccattgagtctattca

SEQ ID NO: 378704 - DNA, 25 bp, Rattus norvegicus
gcacaaattgttcgtgagtcccact

SEQ ID NO: 378705 - DNA, 25 bp, Rattus norvegicus
gcacaaattgttggtgagtcccact

SEQ ID NO: 378706 - DNA, 25 bp, Rattus norvegicus
gcacaaatttgtagataggcatcct

SEQ ID NO: 378707 - DNA, 25 bp, Rattus norvegicus
gcacaaatttgttgataggcatcct

SEQ ID NO: 378708 - DNA, 25 bp, Rattus norvegicus
gcacaacacagtcatattcaacagt

SEQ ID NO: 378709 - DNA, 25 bp, Rattus norvegicus
gcacaacacagtgatattcaacagt

SEQ ID NO: 378710 - DNA, 25 bp, Rattus norvegicus
gcacaacatgcccttctggaggata

SEQ ID NO: 378711 - DNA, 25 bp, Rattus norvegicus
gcacaacatgccgttctggaggata

SEQ ID NO: 378712 - DNA, 25 bp, Rattus norvegicus
gcacaacattatcatttgaagcgct

SEQ ID NO: 378713 - DNA, 25 bp, Rattus norvegicus
gcacaacattatgatttgaagcgct

SEQ ID NO: 378714 - DNA, 25 bp, Rattus norvegicus
gcacaacattttactgtaacgttca

SEQ ID NO: 378715 - DNA, 25 bp, Rattus norvegicus
gcacaacatttttctgtaacgttca

SEQ ID NO: 378716 - DNA, 25 bp, Rattus norvegicus
gcacaaccaggtcactgtcagggat

SEQ ID NO: 378717 - DNA, 25 bp, Rattus norvegicus
gcacaaccaggtgactgtcagggat

SEQ ID NO: 378718 - DNA, 25 bp, Rattus norvegicus
gcacaaccatttcagcagattccat

SEQ ID NO: 378719 - DNA, 25 bp, Rattus norvegicus
gcacaaccatttgagcagattccat

SEQ ID NO: 378720 - DNA, 25 bp, Rattus norvegicus
gcacaacccaccaggttgctgtaaa

SEQ ID NO: 378721 - DNA, 25 bp, Rattus norvegicus
gcacaacccacctggttgctgtaaa

SEQ ID NO: 378722 - DNA, 25 bp, Rattus norvegicus
gcacaaccgctactatggctaagga

SEQ ID NO: 378723 - DNA, 25 bp, Rattus norvegicus
gcacaaccgctagtatggctaagga

SEQ ID NO: 378724 - DNA, 25 bp, Rattus norvegicus
gcacaacctctcattactggatatt

SEQ ID NO: 378725 - DNA, 25 bp, Rattus norvegicus
gcacaacctctctttactggatatt

SEQ ID NO: 378726 - DNA, 25 bp, Rattus norvegicus
gcacaacctcttaacaaccggagag

SEQ ID NO: 378727 - DNA, 25 bp, Rattus norvegicus
gcacaacctctttacaaccggagag

SEQ ID NO: 378728 - DNA, 25 bp, Rattus norvegicus
gcacaacctttacctcagtttcttt

SEQ ID NO: 378729 - DNA, 25 bp, Rattus norvegicus
gcacaacctttagctcagtttcttt

SEQ ID NO: 378730 - DNA, 25 bp, Rattus norvegicus
gcacaacgcagtcatggagcagctt

SEQ ID NO: 378731 - DNA, 25 bp, Rattus norvegicus
gcacaacgcagtgatggagcagctt

SEQ ID NO: 378732 - DNA, 25 bp, Rattus norvegicus
gcacaacgtgacagagctcttcgaa

SEQ ID NO: 378733 - DNA, 25 bp, Rattus norvegicus
gcacaacgtgactgagctcttcgaa

SEQ ID NO: 378734 - DNA, 25 bp, Rattus norvegicus
gcacaactatgcaaccatgacttca

SEQ ID NO: 378735 - DNA, 25 bp, Rattus norvegicus
gcacaactatgctaccatgacttca

SEQ ID NO: 378736 - DNA, 25 bp, Rattus norvegicus
gcacaactcattattacaggtacag

SEQ ID NO: 378737 - DNA, 25 bp, Rattus norvegicus
gcacaactcatttttacaggtacag

SEQ ID NO: 378738 - DNA, 25 bp, Rattus norvegicus
gcacaactctggcttccatatccat

SEQ ID NO: 378739 - DNA, 25 bp, Rattus norvegicus
gcacaactctgggttccatatccat

SEQ ID NO: 378740 - DNA, 25 bp, Rattus norvegicus
gcacaactctttatacggttggctc

SEQ ID NO: 378741 - DNA, 25 bp, Rattus norvegicus
gcacaactctttttacggttggctc

SEQ ID NO: 378742 - DNA, 25 bp, Rattus norvegicus
gcacaactgaatatgcctcaactat

SEQ ID NO: 378743 - DNA, 25 bp, Rattus norvegicus
gcacaactgaatttgcctcaactat

SEQ ID NO: 378744 - DNA, 25 bp, Rattus norvegicus
gcacaactgacacttctgtagacac

SEQ ID NO: 378745 - DNA, 25 bp, Rattus norvegicus
gcacaactgacagttctgtagacac

SEQ ID NO: 378746 - DNA, 25 bp, Rattus norvegicus
gcacaactgggactggcctgcttga

SEQ ID NO: 378747 - DNA, 25 bp, Rattus norvegicus
gcacaactgggagtggcctgcttga

SEQ ID NO: 378748 - DNA, 25 bp, Rattus norvegicus
gcacaactgtgaaggaaatctggtt

SEQ ID NO: 378749 - DNA, 25 bp, Rattus norvegicus
gcacaactgtgatggaaatctggtt

SEQ ID NO: 378750 - DNA, 25 bp, Rattus norvegicus
gcacaactgttgagtcggcagtgct

SEQ ID NO: 378751 - DNA, 25 bp, Rattus norvegicus
gcacaactgttgtgtcggcagtgct

SEQ ID NO: 378752 - DNA, 25 bp, Rattus norvegicus
gcacaacttactatcttcggccttt

SEQ ID NO: 378753 - DNA, 25 bp, Rattus norvegicus
gcacaacttactttcttcggccttt

SEQ ID NO: 378754 - DNA, 25 bp, Rattus norvegicus
gcacaacttgtccttacttcagaat

SEQ ID NO: 378755 - DNA, 25 bp, Rattus norvegicus
gcacaacttgtcgttacttcagaat

SEQ ID NO: 378756 - DNA, 25 bp, Rattus norvegicus
gcacaagagggcattccccgggccg

SEQ ID NO: 378757 - DNA, 25 bp, Rattus norvegicus
gcacaagagggctttccccgggccg

SEQ ID NO: 378758 - DNA, 25 bp, Rattus norvegicus
gcacaagagtctaagcaggcaaaac

SEQ ID NO: 378759 - DNA, 25 bp, Rattus norvegicus
gcacaagagtcttagcaggcaaaac

SEQ ID NO: 378760 - DNA, 25 bp, Rattus norvegicus
gcacaagataaactccagctgattc

SEQ ID NO: 378761 - DNA, 25 bp, Rattus norvegicus
gcacaagataaagtccagctgattc

SEQ ID NO: 378762 - DNA, 25 bp, Rattus norvegicus
gcacaagatcaactcggccaaaatt

SEQ ID NO: 378763 - DNA, 25 bp, Rattus norvegicus
gcacaagatcaagtcggccaaaatt

SEQ ID NO: 378764 - DNA, 25 bp, Rattus norvegicus
gcacaagatgagcacagtgggaaaa

SEQ ID NO: 378765 - DNA, 25 bp, Rattus norvegicus
gcacaagatgaggacagtgggaaaa

SEQ ID NO: 378766 - DNA, 25 bp, Rattus norvegicus
gcacaagcggtgacaacttccaagt

SEQ ID NO: 378767 - DNA, 25 bp, Rattus norvegicus
gcacaagcggtgtcaacttccaagt

SEQ ID NO: 378768 - DNA, 25 bp, Rattus norvegicus
gcacaagctaacaaggcctacagaa

SEQ ID NO: 378769 - DNA, 25 bp, Rattus norvegicus
gcacaagctaactaggcctacagaa

SEQ ID NO: 378770 - DNA, 25 bp, Rattus norvegicus
gcacaagctatgaaccaagggttct

SEQ ID NO: 378771 - DNA, 25 bp, Rattus norvegicus
gcacaagctatgtaccaagggttct

SEQ ID NO: 378772 - DNA, 25 bp, Rattus norvegicus
gcacaagctgagaaggacggcactg

SEQ ID NO: 378773 - DNA, 25 bp, Rattus norvegicus
gcacaagctgagtaggacggcactg

SEQ ID NO: 378774 - DNA, 25 bp, Rattus norvegicus
gcacaagctgcactctctcaaaaag

SEQ ID NO: 378775 - DNA, 25 bp, Rattus norvegicus
gcacaagctgcagtctctcaaaaag

SEQ ID NO: 378776 - DNA, 25 bp, Rattus norvegicus
gcacaagcttgcctctctagagaag

SEQ ID NO: 378777 - DNA, 25 bp, Rattus norvegicus
gcacaagcttgcgtctctagagaag

SEQ ID NO: 378778 - DNA, 25 bp, Rattus norvegicus
gcacaagcttttcttcttgttaggg

SEQ ID NO: 378779 - DNA, 25 bp, Rattus norvegicus
gcacaagcttttgttcttgttaggg

SEQ ID NO: 378780 - DNA, 25 bp, Rattus norvegicus
gcacaaggcacacaatgggctccta

SEQ ID NO: 378781 - DNA, 25 bp, Rattus norvegicus
gcacaaggcacagaatgggctccta

SEQ ID NO: 378782 - DNA, 25 bp, Rattus norvegicus
gcacaaggctgacctgaggatgaat

SEQ ID NO: 378783 - DNA, 25 bp, Rattus norvegicus
gcacaaggctgagctgaggatgaat

SEQ ID NO: 378784 - DNA, 25 bp, Rattus norvegicus
gcacaagggcccaagtttgatcttc

SEQ ID NO: 378785 - DNA, 25 bp, Rattus norvegicus
gcacaagggccctagtttgatcttc

SEQ ID NO: 378786 - DNA, 25 bp, Rattus norvegicus
gcacaagggctcacgaaagaaaagt

SEQ ID NO: 378787 - DNA, 25 bp, Rattus norvegicus
gcacaagggctctcgaaagaaaagt

SEQ ID NO: 378788 - DNA, 25 bp, Rattus norvegicus
gcacaaggtgagattgactccctaa

SEQ ID NO: 378789 - DNA, 25 bp, Rattus norvegicus
gcacaaggtgagtttgactccctaa

SEQ ID NO: 378790 - DNA, 25 bp, Rattus norvegicus
gcacaagtacctacttataggccct

SEQ ID NO: 378791 - DNA, 25 bp, Rattus norvegicus
gcacaagtaccttcttataggccct

SEQ ID NO: 378792 - DNA, 25 bp, Rattus norvegicus
gcacaagtaggacccaagagtcaag

SEQ ID NO: 378793 - DNA, 25 bp, Rattus norvegicus
gcacaagtaggagccaagagtcaag

SEQ ID NO: 378794 - DNA, 25 bp, Rattus norvegicus
gcacaagtgtgaagtccagcgccca

SEQ ID NO: 378795 - DNA, 25 bp, Rattus norvegicus
gcacaagtgtgatgtccagcgccca

SEQ ID NO: 378796 - DNA, 25 bp, Rattus norvegicus
gcacaagtgtgtctcccgtggacag

SEQ ID NO: 378797 - DNA, 25 bp, Rattus norvegicus
gcacaagtgtgtgtcccgtggacag

SEQ ID NO: 378798 - DNA, 25 bp, Rattus norvegicus
gcacaagttcttccgtgaagctgag

SEQ ID NO: 378799 - DNA, 25 bp, Rattus norvegicus
gcacaagttcttgcgtgaagctgag

SEQ ID NO: 378800 - DNA, 25 bp, Rattus norvegicus
gcacaagtttcccacctatttctta

SEQ ID NO: 378801 - DNA, 25 bp, Rattus norvegicus
gcacaagtttccgacctatttctta

SEQ ID NO: 378802 - DNA, 25 bp, Rattus norvegicus
gcacaagttttgatttgaacactta

SEQ ID NO: 378803 - DNA, 25 bp, Rattus norvegicus
gcacaagttttgttttgaacactta

SEQ ID NO: 378804 - DNA, 25 bp, Rattus norvegicus
gcacaataaaacagaacttcacaga

SEQ ID NO: 378805 - DNA, 25 bp, Rattus norvegicus
gcacaataaaactgaacttcacaga

SEQ ID NO: 378806 - DNA, 25 bp, Rattus norvegicus
gcacaataacccctgatccaattga

SEQ ID NO: 378807 - DNA, 25 bp, Rattus norvegicus
gcacaataacccgtgatccaattga

SEQ ID NO: 378808 - DNA, 25 bp, Rattus norvegicus
gcacaatactgcatgctactaaaat

SEQ ID NO: 378809 - DNA, 25 bp, Rattus norvegicus
gcacaatactgcttgctactaaaat

SEQ ID NO: 378810 - DNA, 25 bp, Rattus norvegicus
gcacaatagcaccagctcctcggag

SEQ ID NO: 378811 - DNA, 25 bp, Rattus norvegicus
gcacaatagcacgagctcctcggag

SEQ ID NO: 378812 - DNA, 25 bp, Rattus norvegicus
gcacaatatcttattacaggtccag

SEQ ID NO: 378813 - DNA, 25 bp, Rattus norvegicus
gcacaatatctttttacaggtccag

SEQ ID NO: 378814 - DNA, 25 bp, Rattus norvegicus
gcacaatatttgatgcactttggca

SEQ ID NO: 378815 - DNA, 25 bp, Rattus norvegicus
gcacaatatttgttgcactttggca

SEQ ID NO: 378816 - DNA, 25 bp, Rattus norvegicus
gcacaatccagacggactttcatga

SEQ ID NO: 378817 - DNA, 25 bp, Rattus norvegicus
gcacaatccagagggactttcatga

SEQ ID NO: 378818 - DNA, 25 bp, Rattus norvegicus
gcacaatcccttaacaagcttgctt

SEQ ID NO: 378819 - DNA, 25 bp, Rattus norvegicus
gcacaatccctttacaagcttgctt

SEQ ID NO: 378820 - DNA, 25 bp, Rattus norvegicus
gcacaatcgaggaaccagagactaa

SEQ ID NO: 378821 - DNA, 25 bp, Rattus norvegicus
gcacaatcgaggtaccagagactaa

SEQ ID NO: 378822 - DNA, 25 bp, Rattus norvegicus
gcacaatcttgtatcggagagtcta

SEQ ID NO: 378823 - DNA, 25 bp, Rattus norvegicus
gcacaatcttgtttcggagagtcta

SEQ ID NO: 378824 - DNA, 25 bp, Rattus norvegicus
gcacaatgagtgattctgggtccaa

SEQ ID NO: 378825 - DNA, 25 bp, Rattus norvegicus
gcacaatgagtgtttctgggtccaa

SEQ ID NO: 378826 - DNA, 25 bp, Rattus norvegicus
gcacaatggacgacagagcactcta

SEQ ID NO: 378827 - DNA, 25 bp, Rattus norvegicus
gcacaatggacgtcagagcactcta

SEQ ID NO: 378828 - DNA, 25 bp, Rattus norvegicus
gcacaatgtcgtaaatatcaggctt

SEQ ID NO: 378829 - DNA, 25 bp, Rattus norvegicus
gcacaatgtcgttaatatcaggctt

SEQ ID NO: 378830 - DNA, 25 bp, Rattus norvegicus
gcacaatgtcttaggttgcaagtca

SEQ ID NO: 378831 - DNA, 25 bp, Rattus norvegicus
gcacaatgtctttggttgcaagtca

SEQ ID NO: 378832 - DNA, 25 bp, Rattus norvegicus
gcacaatgtgccacaagttcacaca

SEQ ID NO: 378833 - DNA, 25 bp, Rattus norvegicus
gcacaatgtgcctcaagttcacaca

SEQ ID NO: 378834 - DNA, 25 bp, Rattus norvegicus
gcacaatgttgacccttctgtaatt

SEQ ID NO: 378835 - DNA, 25 bp, Rattus norvegicus
gcacaatgttgagccttctgtaatt

SEQ ID NO: 378836 - DNA, 25 bp, Rattus norvegicus
gcacaattactaagcctgccttttt

SEQ ID NO: 378837 - DNA, 25 bp, Rattus norvegicus
gcacaattactatgcctgccttttt

SEQ ID NO: 378838 - DNA, 25 bp, Rattus norvegicus
gcacaattcattacatgtcaactta

SEQ ID NO: 378839 - DNA, 25 bp, Rattus norvegicus
gcacaattcatttcatgtcaactta

SEQ ID NO: 378840 - DNA, 25 bp, Rattus norvegicus
gcacaattctgtaaatgtctttgga

SEQ ID NO: 378841 - DNA, 25 bp, Rattus norvegicus
gcacaattctgttaatgtctttgga

SEQ ID NO: 378842 - DNA, 25 bp, Rattus norvegicus
gcacaattcttccacctggaatgaa

SEQ ID NO: 378843 - DNA, 25 bp, Rattus norvegicus
gcacaattcttcgacctggaatgaa

SEQ ID NO: 378844 - DNA, 25 bp, Rattus norvegicus
gcacaatttttgcatttttacctga

SEQ ID NO: 378845 - DNA, 25 bp, Rattus norvegicus
gcacaatttttggatttttacctga

SEQ ID NO: 378846 - DNA, 25 bp, Rattus norvegicus
gcacacaaccataggccttcatcat

SEQ ID NO: 378847 - DNA, 25 bp, Rattus norvegicus
gcacacaaccattggccttcatcat

SEQ ID NO: 378848 - DNA, 25 bp, Rattus norvegicus
gcacacaactggctggcatttggaa

SEQ ID NO: 378849 - DNA, 25 bp, Rattus norvegicus
gcacacaactgggtggcatttggaa

SEQ ID NO: 378850 - DNA, 25 bp, Rattus norvegicus
gcacacaatctgcttttcgtttttg

SEQ ID NO: 378851 - DNA, 25 bp, Rattus norvegicus
gcacacaatctggttttcgtttttg

SEQ ID NO: 378852 - DNA, 25 bp, Rattus norvegicus
gcacacaatgccctcatggagttaa

SEQ ID NO: 378853 - DNA, 25 bp, Rattus norvegicus
gcacacaatgccgtcatggagttaa

SEQ ID NO: 378854 - DNA, 25 bp, Rattus norvegicus
gcacacacaatcaagcttagggcca

SEQ ID NO: 378855 - DNA, 25 bp, Rattus norvegicus
gcacacacaatctagcttagggcca

SEQ ID NO: 378856 - DNA, 25 bp, Rattus norvegicus
gcacacacactaatgccaattcatc

SEQ ID NO: 378857 - DNA, 25 bp, Rattus norvegicus
gcacacacactattgccaattcatc

SEQ ID NO: 378858 - DNA, 25 bp, Rattus norvegicus
gcacacacagagaggccatagggat

SEQ ID NO: 378859 - DNA, 25 bp, Rattus norvegicus
gcacacacagagtggccatagggat

SEQ ID NO: 378860 - DNA, 25 bp, Rattus norvegicus
gcacacacagtcacacattgttttg

SEQ ID NO: 378861 - DNA, 25 bp, Rattus norvegicus
gcacacacagtcactttgggagagt

SEQ ID NO: 378862 - DNA, 25 bp, Rattus norvegicus
gcacacacagtctcacattgttttg

SEQ ID NO: 378863 - DNA, 25 bp, Rattus norvegicus
gcacacacagtctctttgggagagt

SEQ ID NO: 378864 - DNA, 25 bp, Rattus norvegicus
gcacacacatgtcaccgcgagtagt

SEQ ID NO: 378865 - DNA, 25 bp, Rattus norvegicus
gcacacacatgtgaccgcgagtagt

SEQ ID NO: 378866 - DNA, 25 bp, Rattus norvegicus
gcacacaccagcagtatccagtgga

SEQ ID NO: 378867 - DNA, 25 bp, Rattus norvegicus
gcacacaccagctgtatccagtgga

SEQ ID NO: 378868 - DNA, 25 bp, Rattus norvegicus
gcacacaccagtcagcaggtggcct

SEQ ID NO: 378869 - DNA, 25 bp, Rattus norvegicus
gcacacaccagtgagcaggtggcct

SEQ ID NO: 378870 - DNA, 25 bp, Rattus norvegicus
gcacacaccatgcatgtcgaggtca

SEQ ID NO: 378871 - DNA, 25 bp, Rattus norvegicus
gcacacaccatggatgtcgaggtca

SEQ ID NO: 378872 - DNA, 25 bp, Rattus norvegicus
gcacacacccacagttgtcattatt

SEQ ID NO: 378873 - DNA, 25 bp, Rattus norvegicus
gcacacacccactgttgtcattatt

SEQ ID NO: 378874 - DNA, 25 bp, Rattus norvegicus
gcacacacctgtaacgctggacctg

SEQ ID NO: 378875 - DNA, 25 bp, Rattus norvegicus
gcacacacctgttacgctggacctg

SEQ ID NO: 378876 - DNA, 25 bp, Rattus norvegicus
gcacacacctttaattttaccactt

SEQ ID NO: 378877 - DNA, 25 bp, Rattus norvegicus
gcacacaccttttattttaccactt

SEQ ID NO: 378878 - DNA, 25 bp, Rattus norvegicus
gcacacacgaacaccggcggatgat

SEQ ID NO: 378879 - DNA, 25 bp, Rattus norvegicus
gcacacacgaactccggcggatgat

SEQ ID NO: 378880 - DNA, 25 bp, Rattus norvegicus
gcacacacgtgcaacccagagttag

SEQ ID NO: 378881 - DNA, 25 bp, Rattus norvegicus
gcacacacgtgctacccagagttag

SEQ ID NO: 378882 - DNA, 25 bp, Rattus norvegicus
gcacacactccactagtgtcttcaa

SEQ ID NO: 378883 - DNA, 25 bp, Rattus norvegicus
gcacacactccagtagtgtcttcaa

SEQ ID NO: 378884 - DNA, 25 bp, Rattus norvegicus
gcacacactggccatatgagaatag

SEQ ID NO: 378885 - DNA, 25 bp, Rattus norvegicus
gcacacactggcgatatgagaatag

SEQ ID NO: 378886 - DNA, 25 bp, Rattus norvegicus
gcacacacttagaaactgaatagct

SEQ ID NO: 378887 - DNA, 25 bp, Rattus norvegicus
gcacacacttagtaactgaatagct

SEQ ID NO: 378888 - DNA, 25 bp, Rattus norvegicus
gcacacacttctcttttttctctta

SEQ ID NO: 378889 - DNA, 25 bp, Rattus norvegicus
gcacacacttctgttttttctctta

SEQ ID NO: 378890 - DNA, 25 bp, Rattus norvegicus
gcacacagactaagtaaacagccat

SEQ ID NO: 378891 - DNA, 25 bp, Rattus norvegicus
gcacacagactatgtaaacagccat

SEQ ID NO: 378892 - DNA, 25 bp, Rattus norvegicus
gcacacagactgctatacgcacaac

SEQ ID NO: 378893 - DNA, 25 bp, Rattus norvegicus
gcacacagactggtatacgcacaac

SEQ ID NO: 378894 - DNA, 25 bp, Rattus norvegicus
gcacacagcagcatatctccgggag

SEQ ID NO: 378895 - DNA, 25 bp, Rattus norvegicus
gcacacagcagcttatctccgggag

SEQ ID NO: 378896 - DNA, 25 bp, Rattus norvegicus
gcacacagcgtgactcagatcaatc

SEQ ID NO: 378897 - DNA, 25 bp, Rattus norvegicus
gcacacagcgtgtctcagatcaatc

SEQ ID NO: 378898 - DNA, 25 bp, Rattus norvegicus
gcacacaggactaacccggtattct

SEQ ID NO: 378899 - DNA, 25 bp, Rattus norvegicus
gcacacaggacttacccggtattct

SEQ ID NO: 378900 - DNA, 25 bp, Rattus norvegicus
gcacacaggcagactcacagagctc

SEQ ID NO: 378901 - DNA, 25 bp, Rattus norvegicus
gcacacaggcagtctcacagagctc

SEQ ID NO: 378902 - DNA, 25 bp, Rattus norvegicus
gcacacaggctgattttatggtttt

SEQ ID NO: 378903 - DNA, 25 bp, Rattus norvegicus
gcacacaggctgtttttatggtttt

SEQ ID NO: 378904 - DNA, 25 bp, Rattus norvegicus
gcacacagggctacaactatcagat

SEQ ID NO: 378905 - DNA, 25 bp, Rattus norvegicus
gcacacagggcttcaactatcagat

SEQ ID NO: 378906 - DNA, 25 bp, Rattus norvegicus
gcacacaggtcacgtgttgtctgga

SEQ ID NO: 378907 - DNA, 25 bp, Rattus norvegicus
gcacacaggtcaggtgttgtctgga

SEQ ID NO: 378908 - DNA, 25 bp, Rattus norvegicus
gcacacaggtgtaagctcaagacag

SEQ ID NO: 378909 - DNA, 25 bp, Rattus norvegicus
gcacacaggtgttagctcaagacag

SEQ ID NO: 378910 - DNA, 25 bp, Rattus norvegicus
gcacacatatagagaaggaccccaa

SEQ ID NO: 378911 - DNA, 25 bp, Rattus norvegicus
gcacacatatagtgaaggaccccaa

SEQ ID NO: 378912 - DNA, 25 bp, Rattus norvegicus
gcacacatcaggagccatctgtagc

SEQ ID NO: 378913 - DNA, 25 bp, Rattus norvegicus
gcacacatcaggtgccatctgtagc

SEQ ID NO: 378914 - DNA, 25 bp, Rattus norvegicus
gcacacatctttaggaacgctggtt

SEQ ID NO: 378915 - DNA, 25 bp, Rattus norvegicus
gcacacatcttttggaacgctggtt

SEQ ID NO: 378916 - DNA, 25 bp, Rattus norvegicus
gcacacatgactaccaatttcgctt

SEQ ID NO: 378917 - DNA, 25 bp, Rattus norvegicus
gcacacatgacttccaatttcgctt

SEQ ID NO: 378918 - DNA, 25 bp, Rattus norvegicus
gcacacatgtgcagttctagagtca

SEQ ID NO: 378919 - DNA, 25 bp, Rattus norvegicus
gcacacatgtgcctttgcaattgta

SEQ ID NO: 378920 - DNA, 25 bp, Rattus norvegicus
gcacacatgtgcgtttgcaattgta

SEQ ID NO: 378921 - DNA, 25 bp, Rattus norvegicus
gcacacatgtgctgttctagagtca

SEQ ID NO: 378922 - DNA, 25 bp, Rattus norvegicus
gcacacattacaaaacagaacacat

SEQ ID NO: 378923 - DNA, 25 bp, Rattus norvegicus
gcacacattacataacagaacacat

SEQ ID NO: 378924 - DNA, 25 bp, Rattus norvegicus
gcacacattccaaatgcaagatgca

SEQ ID NO: 378925 - DNA, 25 bp, Rattus norvegicus
gcacacattccatatgcaagatgca

SEQ ID NO: 378926 - DNA, 25 bp, Rattus norvegicus
gcacacattgagctggcacacacgt

SEQ ID NO: 378927 - DNA, 25 bp, Rattus norvegicus
gcacacattgaggtggcacacacgt

SEQ ID NO: 378928 - DNA, 25 bp, Rattus norvegicus
gcacaccaacttagtggagttccgg

SEQ ID NO: 378929 - DNA, 25 bp, Rattus norvegicus
gcacaccaactttgtggagttccgg

SEQ ID NO: 378930 - DNA, 25 bp, Rattus norvegicus
gcacaccaaggcacaggcttattca

SEQ ID NO: 378931 - DNA, 25 bp, Rattus norvegicus
gcacaccaaggctcaggcttattca

SEQ ID NO: 378932 - DNA, 25 bp, Rattus norvegicus
gcacaccacacacatacattataac

SEQ ID NO: 378933 - DNA, 25 bp, Rattus norvegicus
gcacaccacacagatacattataac

SEQ ID NO: 378934 - DNA, 25 bp, Rattus norvegicus
gcacaccacagacggcaggacttac

SEQ ID NO: 378935 - DNA, 25 bp, Rattus norvegicus
gcacaccacagagggcaggacttac

SEQ ID NO: 378936 - DNA, 25 bp, Rattus norvegicus
gcacaccacagcaggctggtacaat

SEQ ID NO: 378937 - DNA, 25 bp, Rattus norvegicus
gcacaccacagctggctggtacaat

SEQ ID NO: 378938 - DNA, 25 bp, Rattus norvegicus
gcacaccacatgaatgtgcctggta

SEQ ID NO: 378939 - DNA, 25 bp, Rattus norvegicus
gcacaccacatgtatgtgcctggta

SEQ ID NO: 378940 - DNA, 25 bp, Rattus norvegicus
gcacaccacccacaaggagcttttt

SEQ ID NO: 378941 - DNA, 25 bp, Rattus norvegicus
gcacaccacccagaaggagcttttt

SEQ ID NO: 378942 - DNA, 25 bp, Rattus norvegicus
gcacaccagctgaactcttgagtaa

SEQ ID NO: 378943 - DNA, 25 bp, Rattus norvegicus
gcacaccagctgagaggacactgtc

SEQ ID NO: 378944 - DNA, 25 bp, Rattus norvegicus
gcacaccagctgcagaggcggtact

SEQ ID NO: 378945 - DNA, 25 bp, Rattus norvegicus
gcacaccagctggagaggcggtact

SEQ ID NO: 378946 - DNA, 25 bp, Rattus norvegicus
gcacaccagctgtactcttgagtaa

SEQ ID NO: 378947 - DNA, 25 bp, Rattus norvegicus
gcacaccagctgtgaggacactgtc

SEQ ID NO: 378948 - DNA, 25 bp, Rattus norvegicus
gcacaccatttcacacattacaggg

SEQ ID NO: 378949 - DNA, 25 bp, Rattus norvegicus
gcacaccatttctcacattacaggg

SEQ ID NO: 378950 - DNA, 25 bp, Rattus norvegicus
gcacaccccaaaatttctattcagt

SEQ ID NO: 378951 - DNA, 25 bp, Rattus norvegicus
gcacaccccaaattttctattcagt

SEQ ID NO: 378952 - DNA, 25 bp, Rattus norvegicus
gcacacccctttatgtggacaagga

SEQ ID NO: 378953 - DNA, 25 bp, Rattus norvegicus
gcacacccctttttgtggacaagga

SEQ ID NO: 378954 - DNA, 25 bp, Rattus norvegicus
gcacaccctccaccaaattttaagt

SEQ ID NO: 378955 - DNA, 25 bp, Rattus norvegicus
gcacaccctccagcaaattttaagt

SEQ ID NO: 378956 - DNA, 25 bp, Rattus norvegicus
gcacaccctgaaactgaccgtgtaa

SEQ ID NO: 378957 - DNA, 25 bp, Rattus norvegicus
gcacaccctgaatctgaccgtgtaa

SEQ ID NO: 378958 - DNA, 25 bp, Rattus norvegicus
gcacaccgacatcggcactgggaat

SEQ ID NO: 378959 - DNA, 25 bp, Rattus norvegicus
gcacaccgacatgggcactgggaat

SEQ ID NO: 378960 - DNA, 25 bp, Rattus norvegicus
gcacaccgatgcaatccgcagaggt

SEQ ID NO: 378961 - DNA, 25 bp, Rattus norvegicus
gcacaccgatgctatccgcagaggt

SEQ ID NO: 378962 - DNA, 25 bp, Rattus norvegicus
gcacaccgtggaaattactgatgaa

SEQ ID NO: 378963 - DNA, 25 bp, Rattus norvegicus
gcacaccgtggatattactgatgaa

SEQ ID NO: 378964 - DNA, 25 bp, Rattus norvegicus
gcacacctaaaaaccttgcactaag

SEQ ID NO: 378965 - DNA, 25 bp, Rattus norvegicus
gcacacctaaaatccttgcactaag

SEQ ID NO: 378966 - DNA, 25 bp, Rattus norvegicus
gcacacctgactagggagcccggct

SEQ ID NO: 378967 - DNA, 25 bp, Rattus norvegicus
gcacacctgacttgggagcccggct

SEQ ID NO: 378968 - DNA, 25 bp, Rattus norvegicus
gcacacctgcctataagaacagaga

SEQ ID NO: 378969 - DNA, 25 bp, Rattus norvegicus
gcacacctgcctttaagaacagaga

SEQ ID NO: 378970 - DNA, 25 bp, Rattus norvegicus
gcacacctgtgtccaaaaactctaa

SEQ ID NO: 378971 - DNA, 25 bp, Rattus norvegicus
gcacacctgtgtgcaaaaactctaa

SEQ ID NO: 378972 - DNA, 25 bp, Rattus norvegicus
gcacaccttctcctatttttatgat

SEQ ID NO: 378973 - DNA, 25 bp, Rattus norvegicus
gcacaccttctcgtatttttatgat

SEQ ID NO: 378974 - DNA, 25 bp, Rattus norvegicus
gcacaccttctgaaagagatgcggt

SEQ ID NO: 378975 - DNA, 25 bp, Rattus norvegicus
gcacaccttctgtaagagatgcggt

SEQ ID NO: 378976 - DNA, 25 bp, Rattus norvegicus
gcacacgaaacgcagtcaccacttt

SEQ ID NO: 378977 - DNA, 25 bp, Rattus norvegicus
gcacacgaaacggagtcaccacttt

SEQ ID NO: 378978 - DNA, 25 bp, Rattus norvegicus
gcacacgactcactgatgccaactt

SEQ ID NO: 378979 - DNA, 25 bp, Rattus norvegicus
gcacacgactcagtgatgccaactt

SEQ ID NO: 378980 - DNA, 25 bp, Rattus norvegicus
gcacacgagcaaagccagtatcttt

SEQ ID NO: 378981 - DNA, 25 bp, Rattus norvegicus
gcacacgagcaatgccagtatcttt

SEQ ID NO: 378982 - DNA, 25 bp, Rattus norvegicus
gcacacgatgctctatttattgtag

SEQ ID NO: 378983 - DNA, 25 bp, Rattus norvegicus
gcacacgatgctgtatttattgtag

SEQ ID NO: 378984 - DNA, 25 bp, Rattus norvegicus
gcacacgcagtaagagcgcttcatt

SEQ ID NO: 378985 - DNA, 25 bp, Rattus norvegicus
gcacacgcagtatgagcgcttcatt

SEQ ID NO: 378986 - DNA, 25 bp, Rattus norvegicus
gcacacgccctaaagatggcctaaa

SEQ ID NO: 378987 - DNA, 25 bp, Rattus norvegicus
gcacacgccctatagatggcctaaa

SEQ ID NO: 378988 - DNA, 25 bp, Rattus norvegicus
gcacacgctttgattggacgcggag

SEQ ID NO: 378989 - DNA, 25 bp, Rattus norvegicus
gcacacgctttgtttggacgcggag

SEQ ID NO: 378990 - DNA, 25 bp, Rattus norvegicus
gcacacggcccactggtttctttaa

SEQ ID NO: 378991 - DNA, 25 bp, Rattus norvegicus
gcacacggcccagtggtttctttaa

SEQ ID NO: 378992 - DNA, 25 bp, Rattus norvegicus
gcacacggtcggcattaagaccgat

SEQ ID NO: 378993 - DNA, 25 bp, Rattus norvegicus
gcacacggtcgggattaagaccgat

SEQ ID NO: 378994 - DNA, 25 bp, Rattus norvegicus
gcacacggtggccacgaggaatcta

SEQ ID NO: 378995 - DNA, 25 bp, Rattus norvegicus
gcacacggtggcgacgaggaatcta

SEQ ID NO: 378996 - DNA, 25 bp, Rattus norvegicus
gcacacgtctgaaagagcggttatg

SEQ ID NO: 378997 - DNA, 25 bp, Rattus norvegicus
gcacacgtctgatagagcggttatg

SEQ ID NO: 378998 - DNA, 25 bp, Rattus norvegicus
gcacacgtgactcagagctttatct

SEQ ID NO: 378999 - DNA, 25 bp, Rattus norvegicus
gcacacgtgactgagagctttatct

SEQ ID NO: 379000 - DNA, 25 bp, Rattus norvegicus
gcacacgtgcacaggaactttcaga

SEQ ID NO: 379001 - DNA, 25 bp, Rattus norvegicus
gcacacgtgcactggaactttcaga

SEQ ID NO: 379002 - DNA, 25 bp, Rattus norvegicus
gcacacgtgcgcaatgatcaccaag

SEQ ID NO: 379003 - DNA, 25 bp, Rattus norvegicus
gcacacgtgcgctatgatcaccaag

SEQ ID NO: 379004 - DNA, 25 bp, Rattus norvegicus
gcacacgtgtaaaccctcaggcagg

SEQ ID NO: 379005 - DNA, 25 bp, Rattus norvegicus
gcacacgtgtaatccctcaggcagg

SEQ ID NO: 379006 - DNA, 25 bp, Rattus norvegicus
gcacacgtgtgtatttactaaccct

SEQ ID NO: 379007 - DNA, 25 bp, Rattus norvegicus
gcacacgtgtgtttttactaaccct

SEQ ID NO: 379008 - DNA, 25 bp, Rattus norvegicus
gcacacgttagccaagtacctgatg

SEQ ID NO: 379009 - DNA, 25 bp, Rattus norvegicus
gcacacgttagcgaagtacctgatg

SEQ ID NO: 379010 - DNA, 25 bp, Rattus norvegicus
gcacactaacacctttgtaggaact

SEQ ID NO: 379011 - DNA, 25 bp, Rattus norvegicus
gcacactaacacgtttgtaggaact

SEQ ID NO: 379012 - DNA, 25 bp, Rattus norvegicus
gcacactccacacagtaggctgatg

SEQ ID NO: 379013 - DNA, 25 bp, Rattus norvegicus
gcacactccacagagtaggctgatg

SEQ ID NO: 379014 - DNA, 25 bp, Rattus norvegicus
gcacactccgagatatcgtctatgg

SEQ ID NO: 379015 - DNA, 25 bp, Rattus norvegicus
gcacactccgagttatcgtctatgg

SEQ ID NO: 379016 - DNA, 25 bp, Rattus norvegicus
gcacactcctggctggttatgaata

SEQ ID NO: 379017 - DNA, 25 bp, Rattus norvegicus
gcacactcctgggtggttatgaata

SEQ ID NO: 379018 - DNA, 25 bp, Rattus norvegicus
gcacactctcaacctttccttgaaa

SEQ ID NO: 379019 - DNA, 25 bp, Rattus norvegicus
gcacactctcaagctttccttgaaa

SEQ ID NO: 379020 - DNA, 25 bp, Rattus norvegicus
gcacactctccaaagtgagttctag

SEQ ID NO: 379021 - DNA, 25 bp, Rattus norvegicus
gcacactctccatagtgagttctag

SEQ ID NO: 379022 - DNA, 25 bp, Rattus norvegicus
gcacactctcctctggatagtgata

SEQ ID NO: 379023 - DNA, 25 bp, Rattus norvegicus
gcacactctcctgtggatagtgata

SEQ ID NO: 379024 - DNA, 25 bp, Rattus norvegicus
gcacactcttatatggccatggctg

SEQ ID NO: 379025 - DNA, 25 bp, Rattus norvegicus
gcacactcttatttggccatggctg

SEQ ID NO: 379026 - DNA, 25 bp, Rattus norvegicus
gcacactgagatcgttgggccaacg

SEQ ID NO: 379027 - DNA, 25 bp, Rattus norvegicus
gcacactgagatggttgggccaacg

SEQ ID NO: 379028 - DNA, 25 bp, Rattus norvegicus
gcacactgagctcttgcagaggcaa

SEQ ID NO: 379029 - DNA, 25 bp, Rattus norvegicus
gcacactgagctgttgcagaggcaa

SEQ ID NO: 379030 - DNA, 25 bp, Rattus norvegicus
gcacactgcgctcttagttttttat

SEQ ID NO: 379031 - DNA, 25 bp, Rattus norvegicus
gcacactgcgctgttagttttttat

SEQ ID NO: 379032 - DNA, 25 bp, Rattus norvegicus
gcacactgctttcccaggcaagtgt

SEQ ID NO: 379033 - DNA, 25 bp, Rattus norvegicus
gcacactgctttgccaggcaagtgt

SEQ ID NO: 379034 - DNA, 25 bp, Rattus norvegicus
gcacactggcagaggtctactgatt

SEQ ID NO: 379035 - DNA, 25 bp, Rattus norvegicus
gcacactggcagtggtctactgatt

SEQ ID NO: 379036 - DNA, 25 bp, Rattus norvegicus
gcacactggtatctcactggcttat

SEQ ID NO: 379037 - DNA, 25 bp, Rattus norvegicus
gcacactggtatgtcactggcttat

SEQ ID NO: 379038 - DNA, 25 bp, Rattus norvegicus
gcacactgtatgctacgaggcgttt

SEQ ID NO: 379039 - DNA, 25 bp, Rattus norvegicus
gcacactgtatggtacgaggcgttt

SEQ ID NO: 379040 - DNA, 25 bp, Rattus norvegicus
gcacactgtgcccttgatacaaaca

SEQ ID NO: 379041 - DNA, 25 bp, Rattus norvegicus
gcacactgtgccgttgatacaaaca

SEQ ID NO: 379042 - DNA, 25 bp, Rattus norvegicus
gcacactgtgtcagttatgcacatg

SEQ ID NO: 379043 - DNA, 25 bp, Rattus norvegicus
gcacactgtgtctgttatgcacatg

SEQ ID NO: 379044 - DNA, 25 bp, Rattus norvegicus
gcacactgttctcttgttcaggtac

SEQ ID NO: 379045 - DNA, 25 bp, Rattus norvegicus
gcacactgttctgttgttcaggtac

SEQ ID NO: 379046 - DNA, 25 bp, Rattus norvegicus
gcacactgttgaattttatgggaaa

SEQ ID NO: 379047 - DNA, 25 bp, Rattus norvegicus
gcacactgttgatttttatgggaaa

SEQ ID NO: 379048 - DNA, 25 bp, Rattus norvegicus
gcacactgtttgcttcatcaagtca

SEQ ID NO: 379049 - DNA, 25 bp, Rattus norvegicus
gcacactgtttggttcatcaagtca

SEQ ID NO: 379050 - DNA, 25 bp, Rattus norvegicus
gcacacttacatacacataacagcg

SEQ ID NO: 379051 - DNA, 25 bp, Rattus norvegicus
gcacacttacatactacaactacgg

SEQ ID NO: 379052 - DNA, 25 bp, Rattus norvegicus
gcacacttacattcacataacagcg

SEQ ID NO: 379053 - DNA, 25 bp, Rattus norvegicus
gcacacttacattctacaactacgg

SEQ ID NO: 379054 - DNA, 25 bp, Rattus norvegicus
gcacacttagctatattaatttccc

SEQ ID NO: 379055 - DNA, 25 bp, Rattus norvegicus
gcacacttagctttattaatttccc

SEQ ID NO: 379056 - DNA, 25 bp, Rattus norvegicus
gcacacttatgtaatgacctattct

SEQ ID NO: 379057 - DNA, 25 bp, Rattus norvegicus
gcacacttatgttatgacctattct

SEQ ID NO: 379058 - DNA, 25 bp, Rattus norvegicus
gcacacttcctcctgtatatgattt

SEQ ID NO: 379059 - DNA, 25 bp, Rattus norvegicus
gcacacttcctcgtgtatatgattt

SEQ ID NO: 379060 - DNA, 25 bp, Rattus norvegicus
gcacacttcgctcaggcacaacaga

SEQ ID NO: 379061 - DNA, 25 bp, Rattus norvegicus
gcacacttcgctgaggcacaacaga

SEQ ID NO: 379062 - DNA, 25 bp, Rattus norvegicus
gcacacttgaaaacctagcacctga

SEQ ID NO: 379063 - DNA, 25 bp, Rattus norvegicus
gcacacttgaaatcctagcacctga

SEQ ID NO: 379064 - DNA, 25 bp, Rattus norvegicus
gcacacttggatacttacttcgttt

SEQ ID NO: 379065 - DNA, 25 bp, Rattus norvegicus
gcacacttggatcttcacgtgacat

SEQ ID NO: 379066 - DNA, 25 bp, Rattus norvegicus
gcacacttggatgttcacgtgacat

SEQ ID NO: 379067 - DNA, 25 bp, Rattus norvegicus
gcacacttggattcttacttcgttt

SEQ ID NO: 379068 - DNA, 25 bp, Rattus norvegicus
gcacacttgtttctactgttttctt

SEQ ID NO: 379069 - DNA, 25 bp, Rattus norvegicus
gcacacttgtttgtactgttttctt

SEQ ID NO: 379070 - DNA, 25 bp, Rattus norvegicus
gcacactttagcaaccagatggtta

SEQ ID NO: 379071 - DNA, 25 bp, Rattus norvegicus
gcacactttagctaccagatggtta

SEQ ID NO: 379072 - DNA, 25 bp, Rattus norvegicus
gcacacttttaacaaggaccctcgt

SEQ ID NO: 379073 - DNA, 25 bp, Rattus norvegicus
gcacacttttaagaaggaccctcgt

SEQ ID NO: 379074 - DNA, 25 bp, Rattus norvegicus
gcacacttttgcatgtgttctgata

SEQ ID NO: 379075 - DNA, 25 bp, Rattus norvegicus
gcacacttttgcttgtgttctgata

SEQ ID NO: 379076 - DNA, 25 bp, Rattus norvegicus
gcacagaaccctctcttttggaaaa

SEQ ID NO: 379077 - DNA, 25 bp, Rattus norvegicus
gcacagaaccctgtcttttggaaaa

SEQ ID NO: 379078 - DNA, 25 bp, Rattus norvegicus
gcacagaactgacctgcttcctaag

SEQ ID NO: 379079 - DNA, 25 bp, Rattus norvegicus
gcacagaactgagctgcttcctaag

SEQ ID NO: 379080 - DNA, 25 bp, Rattus norvegicus
gcacagaagatgaagtacaaggcca

SEQ ID NO: 379081 - DNA, 25 bp, Rattus norvegicus
gcacagaagatgagcaccccgagtt

SEQ ID NO: 379082 - DNA, 25 bp, Rattus norvegicus
gcacagaagatgtagtacaaggcca

SEQ ID NO: 379083 - DNA, 25 bp, Rattus norvegicus
gcacagaagatgtgcaccccgagtt

SEQ ID NO: 379084 - DNA, 25 bp, Rattus norvegicus
gcacagaagctaattcaccttgcct

SEQ ID NO: 379085 - DNA, 25 bp, Rattus norvegicus
gcacagaagctatttcaccttgcct

SEQ ID NO: 379086 - DNA, 25 bp, Rattus norvegicus
gcacagacacagacggaaacacaga

SEQ ID NO: 379087 - DNA, 25 bp, Rattus norvegicus
gcacagacacagtcggaaacacaga

SEQ ID NO: 379088 - DNA, 25 bp, Rattus norvegicus
gcacagacacttatggagaccgtaa

SEQ ID NO: 379089 - DNA, 25 bp, Rattus norvegicus
gcacagacacttttggagaccgtaa

SEQ ID NO: 379090 - DNA, 25 bp, Rattus norvegicus
gcacagaccctgatggcaagagata

SEQ ID NO: 379091 - DNA, 25 bp, Rattus norvegicus
gcacagaccctgttggcaagagata

SEQ ID NO: 379092 - DNA, 25 bp, Rattus norvegicus
gcacagaccgtgctttctattgtac

SEQ ID NO: 379093 - DNA, 25 bp, Rattus norvegicus
gcacagaccgtggtttctattgtac

SEQ ID NO: 379094 - DNA, 25 bp, Rattus norvegicus
gcacagacgagacggagactcctgc

SEQ ID NO: 379095 - DNA, 25 bp, Rattus norvegicus
gcacagacgagagggagactcctgc

SEQ ID NO: 379096 - DNA, 25 bp, Rattus norvegicus
gcacagacgtcaccaacttcgatga

SEQ ID NO: 379097 - DNA, 25 bp, Rattus norvegicus
gcacagacgtcagcaacttcgatga

SEQ ID NO: 379098 - DNA, 25 bp, Rattus norvegicus
gcacagactactatagggcccagga

SEQ ID NO: 379099 - DNA, 25 bp, Rattus norvegicus
gcacagactactttagggcccagga

SEQ ID NO: 379100 - DNA, 25 bp, Rattus norvegicus
gcacagactgagcaggcgatattta

SEQ ID NO: 379101 - DNA, 25 bp, Rattus norvegicus
gcacagactgaggaggcgatattta

SEQ ID NO: 379102 - DNA, 25 bp, Rattus norvegicus
gcacagactgcgctaagacttaaaa

SEQ ID NO: 379103 - DNA, 25 bp, Rattus norvegicus
gcacagactgcggtaagacttaaaa

SEQ ID NO: 379104 - DNA, 25 bp, Rattus norvegicus
gcacagactgttatccatattcatc

SEQ ID NO: 379105 - DNA, 25 bp, Rattus norvegicus
gcacagactgttttccatattcatc

SEQ ID NO: 379106 - DNA, 25 bp, Rattus norvegicus
gcacagacttcaccaagagccacgt

SEQ ID NO: 379107 - DNA, 25 bp, Rattus norvegicus
gcacagacttcagcaagagccacgt

SEQ ID NO: 379108 - DNA, 25 bp, Rattus norvegicus
gcacagactttcattgccttgatac

SEQ ID NO: 379109 - DNA, 25 bp, Rattus norvegicus
gcacagactttctttgccttgatac

SEQ ID NO: 379110 - DNA, 25 bp, Rattus norvegicus
gcacagagactcaccaaagtcaaca

SEQ ID NO: 379111 - DNA, 25 bp, Rattus norvegicus
gcacagagactctccaaagtcaaca

SEQ ID NO: 379112 - DNA, 25 bp, Rattus norvegicus
gcacagagcaatccagctcatctga

SEQ ID NO: 379113 - DNA, 25 bp, Rattus norvegicus
gcacagagcaatgcagctcatctga

SEQ ID NO: 379114 - DNA, 25 bp, Rattus norvegicus
gcacagagcacacagtccttcacag

SEQ ID NO: 379115 - DNA, 25 bp, Rattus norvegicus
gcacagagcacagagtccttcacag

SEQ ID NO: 379116 - DNA, 25 bp, Rattus norvegicus
gcacagagcagaacctttgagggca

SEQ ID NO: 379117 - DNA, 25 bp, Rattus norvegicus
gcacagagcagatcctttgagggca

SEQ ID NO: 379118 - DNA, 25 bp, Rattus norvegicus
gcacagagcagcattgctaggctta

SEQ ID NO: 379119 - DNA, 25 bp, Rattus norvegicus
gcacagagcagctttgctaggctta

SEQ ID NO: 379120 - DNA, 25 bp, Rattus norvegicus
gcacagagctaaccaagtccaaaga

SEQ ID NO: 379121 - DNA, 25 bp, Rattus norvegicus
gcacagagctaagcaagtccaaaga

SEQ ID NO: 379122 - DNA, 25 bp, Rattus norvegicus
gcacagagctgcaattaaattcatg

SEQ ID NO: 379123 - DNA, 25 bp, Rattus norvegicus
gcacagagctgctattaaattcatg

SEQ ID NO: 379124 - DNA, 25 bp, Rattus norvegicus
gcacagaggaagatctctcctgagc

SEQ ID NO: 379125 - DNA, 25 bp, Rattus norvegicus
gcacagaggaagttctctcctgagc

SEQ ID NO: 379126 - DNA, 25 bp, Rattus norvegicus
gcacagagtattacgcctaaaccaa

SEQ ID NO: 379127 - DNA, 25 bp, Rattus norvegicus
gcacagagtatttcgcctaaaccaa

SEQ ID NO: 379128 - DNA, 25 bp, Rattus norvegicus
gcacagataggtattcagctactcc

SEQ ID NO: 379129 - DNA, 25 bp, Rattus norvegicus
gcacagataggttttcagctactcc

SEQ ID NO: 379130 - DNA, 25 bp, Rattus norvegicus
gcacagatcatcacctactgaagga

SEQ ID NO: 379131 - DNA, 25 bp, Rattus norvegicus
gcacagatcatctcctactgaagga

SEQ ID NO: 379132 - DNA, 25 bp, Rattus norvegicus
gcacagatcctgattcgggagcgaa

SEQ ID NO: 379133 - DNA, 25 bp, Rattus norvegicus
gcacagatcctgtttcgggagcgaa

SEQ ID NO: 379134 - DNA, 25 bp, Rattus norvegicus
gcacagatctttcccaccgtgagaa

SEQ ID NO: 379135 - DNA, 25 bp, Rattus norvegicus
gcacagatctttgccaccgtgagaa

SEQ ID NO: 379136 - DNA, 25 bp, Rattus norvegicus
gcacagatgagtctcaagtatccat

SEQ ID NO: 379137 - DNA, 25 bp, Rattus norvegicus
gcacagatgagtgtcaagtatccat

SEQ ID NO: 379138 - DNA, 25 bp, Rattus norvegicus
gcacagatgcgtctctgcgtgtgaa

SEQ ID NO: 379139 - DNA, 25 bp, Rattus norvegicus
gcacagatgcgtgtctgcgtgtgaa

SEQ ID NO: 379140 - DNA, 25 bp, Rattus norvegicus
gcacagatggacagatttgagcttt

SEQ ID NO: 379141 - DNA, 25 bp, Rattus norvegicus
gcacagatggactgatttgagcttt

SEQ ID NO: 379142 - DNA, 25 bp, Rattus norvegicus
gcacagattcatcctgctagctcgg

SEQ ID NO: 379143 - DNA, 25 bp, Rattus norvegicus
gcacagattcatgctgctagctcgg

SEQ ID NO: 379144 - DNA, 25 bp, Rattus norvegicus
gcacagattgttcttgcatttttgt

SEQ ID NO: 379145 - DNA, 25 bp, Rattus norvegicus
gcacagattgttgttgcatttttgt

SEQ ID NO: 379146 - DNA, 25 bp, Rattus norvegicus
gcacagatttatacttgatccttct

SEQ ID NO: 379147 - DNA, 25 bp, Rattus norvegicus
gcacagatttattcttgatccttct

SEQ ID NO: 379148 - DNA, 25 bp, Rattus norvegicus
gcacagcaaaccatgtaaacccgtt

SEQ ID NO: 379149 - DNA, 25 bp, Rattus norvegicus
gcacagcaaaccttgtaaacccgtt

SEQ ID NO: 379150 - DNA, 25 bp, Rattus norvegicus
gcacagcaacctccatgaaccgaag

SEQ ID NO: 379151 - DNA, 25 bp, Rattus norvegicus
gcacagcaacctgcatgaaccgaag

SEQ ID NO: 379152 - DNA, 25 bp, Rattus norvegicus
gcacagcaactcatacagtcagtct

SEQ ID NO: 379153 - DNA, 25 bp, Rattus norvegicus
gcacagcaactcttacagtcagtct

SEQ ID NO: 379154 - DNA, 25 bp, Rattus norvegicus
gcacagcacgtgcacttgtccgagg

SEQ ID NO: 379155 - DNA, 25 bp, Rattus norvegicus
gcacagcacgtggacttgtccgagg

SEQ ID NO: 379156 - DNA, 25 bp, Rattus norvegicus
gcacagcagacacccagacttgact

SEQ ID NO: 379157 - DNA, 25 bp, Rattus norvegicus
gcacagcagacagccagacttgact

SEQ ID NO: 379158 - DNA, 25 bp, Rattus norvegicus
gcacagcaggtgatggagtccattt

SEQ ID NO: 379159 - DNA, 25 bp, Rattus norvegicus
gcacagcaggtgttggagtccattt

SEQ ID NO: 379160 - DNA, 25 bp, Rattus norvegicus
gcacagcatagcataccgagattat

SEQ ID NO: 379161 - DNA, 25 bp, Rattus norvegicus
gcacagcatagcttaccgagattat

SEQ ID NO: 379162 - DNA, 25 bp, Rattus norvegicus
gcacagcatctgagagtcactcagt

SEQ ID NO: 379163 - DNA, 25 bp, Rattus norvegicus
gcacagcatctgctctaggcaggat

SEQ ID NO: 379164 - DNA, 25 bp, Rattus norvegicus
gcacagcatctggtctaggcaggat

SEQ ID NO: 379165 - DNA, 25 bp, Rattus norvegicus
gcacagcatctgtgagtcactcagt

SEQ ID NO: 379166 - DNA, 25 bp, Rattus norvegicus
gcacagcatggtcagtgtgtccaca

SEQ ID NO: 379167 - DNA, 25 bp, Rattus norvegicus
gcacagcatggtgagtgtgtccaca

SEQ ID NO: 379168 - DNA, 25 bp, Rattus norvegicus
gcacagcatttcagcagagggactg

SEQ ID NO: 379169 - DNA, 25 bp, Rattus norvegicus
gcacagcatttctgcagagggactg

SEQ ID NO: 379170 - DNA, 25 bp, Rattus norvegicus
gcacagcattttctctctcatagaa

SEQ ID NO: 379171 - DNA, 25 bp, Rattus norvegicus
gcacagcattttgtctctcatagaa

SEQ ID NO: 379172 - DNA, 25 bp, Rattus norvegicus
gcacagccaagactcagactcggta

SEQ ID NO: 379173 - DNA, 25 bp, Rattus norvegicus
gcacagccaagagtcagactcggta

SEQ ID NO: 379174 - DNA, 25 bp, Rattus norvegicus
gcacagccagtgattctcagttagt

SEQ ID NO: 379175 - DNA, 25 bp, Rattus norvegicus
gcacagccagtgtttctcagttagt

SEQ ID NO: 379176 - DNA, 25 bp, Rattus norvegicus
gcacagccccaaatggaggccatga

SEQ ID NO: 379177 - DNA, 25 bp, Rattus norvegicus
gcacagccccaattggaggccatga

SEQ ID NO: 379178 - DNA, 25 bp, Rattus norvegicus
gcacagcccctgacaatgtagagat

SEQ ID NO: 379179 - DNA, 25 bp, Rattus norvegicus
gcacagcccctgtcaatgtagagat

SEQ ID NO: 379180 - DNA, 25 bp, Rattus norvegicus
gcacagccctagatataatcccttt

SEQ ID NO: 379181 - DNA, 25 bp, Rattus norvegicus
gcacagccctagttataatcccttt

SEQ ID NO: 379182 - DNA, 25 bp, Rattus norvegicus
gcacagccgcatcccattggcggag

SEQ ID NO: 379183 - DNA, 25 bp, Rattus norvegicus
gcacagccgcatgccattggcggag

SEQ ID NO: 379184 - DNA, 25 bp, Rattus norvegicus
gcacagccgggtacttaacactaaa

SEQ ID NO: 379185 - DNA, 25 bp, Rattus norvegicus
gcacagccgggttcttaacactaaa

SEQ ID NO: 379186 - DNA, 25 bp, Rattus norvegicus
gcacagccgtgtcaagctcatttta

SEQ ID NO: 379187 - DNA, 25 bp, Rattus norvegicus
gcacagccgtgtgaagctcatttta

SEQ ID NO: 379188 - DNA, 25 bp, Rattus norvegicus
gcacagcctcaacttccagaggaaa

SEQ ID NO: 379189 - DNA, 25 bp, Rattus norvegicus
gcacagcctcaagttccagaggaaa

SEQ ID NO: 379190 - DNA, 25 bp, Rattus norvegicus
gcacagcctctacacaacagcatgg

SEQ ID NO: 379191 - DNA, 25 bp, Rattus norvegicus
gcacagcctctagacaacagcatgg

SEQ ID NO: 379192 - DNA, 25 bp, Rattus norvegicus
gcacagcctggacacagggacagtt

SEQ ID NO: 379193 - DNA, 25 bp, Rattus norvegicus
gcacagcctggagacagggacagtt

SEQ ID NO: 379194 - DNA, 25 bp, Rattus norvegicus
gcacagcctgggacattccatttat

SEQ ID NO: 379195 - DNA, 25 bp, Rattus norvegicus
gcacagcctgggtcattccatttat

SEQ ID NO: 379196 - DNA, 25 bp, Rattus norvegicus
gcacagccttgacaagtcggagact

SEQ ID NO: 379197 - DNA, 25 bp, Rattus norvegicus
gcacagccttgactccatagcatag

SEQ ID NO: 379198 - DNA, 25 bp, Rattus norvegicus
gcacagccttgagaagtcggagact

SEQ ID NO: 379199 - DNA, 25 bp, Rattus norvegicus
gcacagccttgagtccatagcatag

SEQ ID NO: 379200 - DNA, 25 bp, Rattus norvegicus
gcacagcgactcatatccaaaggga

SEQ ID NO: 379201 - DNA, 25 bp, Rattus norvegicus
gcacagcgactcttatccaaaggga

SEQ ID NO: 379202 - DNA, 25 bp, Rattus norvegicus
gcacagcgcacgctcttgtggatgc

SEQ ID NO: 379203 - DNA, 25 bp, Rattus norvegicus
gcacagcgcacggtcttgtggatgc

SEQ ID NO: 379204 - DNA, 25 bp, Rattus norvegicus
gcacagcgccggaatctgtcagcca

SEQ ID NO: 379205 - DNA, 25 bp, Rattus norvegicus
gcacagcgccggtatctgtcagcca

SEQ ID NO: 379206 - DNA, 25 bp, Rattus norvegicus
gcacagcgtgtgcaaaatactacag

SEQ ID NO: 379207 - DNA, 25 bp, Rattus norvegicus
gcacagcgtgtggaaaatactacag

SEQ ID NO: 379208 - DNA, 25 bp, Rattus norvegicus
gcacagctagctccttgtttacaaa

SEQ ID NO: 379209 - DNA, 25 bp, Rattus norvegicus
gcacagctagctgcttgtttacaaa

SEQ ID NO: 379210 - DNA, 25 bp, Rattus norvegicus
gcacagctatgtcgaagccctgcac

SEQ ID NO: 379211 - DNA, 25 bp, Rattus norvegicus
gcacagctatgtggaagccctgcac

SEQ ID NO: 379212 - DNA, 25 bp, Rattus norvegicus
gcacagctcaaaccctttatggtga

SEQ ID NO: 379213 - DNA, 25 bp, Rattus norvegicus
gcacagctcaaagcctttatggtga

SEQ ID NO: 379214 - DNA, 25 bp, Rattus norvegicus
gcacagctcacaacattcttacaat

SEQ ID NO: 379215 - DNA, 25 bp, Rattus norvegicus
gcacagctcacatcattcttacaat

SEQ ID NO: 379216 - DNA, 25 bp, Rattus norvegicus
gcacagctcagaactttgctgccag

SEQ ID NO: 379217 - DNA, 25 bp, Rattus norvegicus
gcacagctcagatctttgctgccag

SEQ ID NO: 379218 - DNA, 25 bp, Rattus norvegicus
gcacagctcctgaagtagacttttc

SEQ ID NO: 379219 - DNA, 25 bp, Rattus norvegicus
gcacagctcctgtagtagacttttc

SEQ ID NO: 379220 - DNA, 25 bp, Rattus norvegicus
gcacagctccttactgtgacaggag

SEQ ID NO: 379221 - DNA, 25 bp, Rattus norvegicus
gcacagctcctttctgtgacaggag

SEQ ID NO: 379222 - DNA, 25 bp, Rattus norvegicus
gcacagctctatctgcatatcttgg

SEQ ID NO: 379223 - DNA, 25 bp, Rattus norvegicus
gcacagctctatgtgcatatcttgg

SEQ ID NO: 379224 - DNA, 25 bp, Rattus norvegicus
gcacagctgatgataggctccatct

SEQ ID NO: 379225 - DNA, 25 bp, Rattus norvegicus
gcacagctgatgttaggctccatct

SEQ ID NO: 379226 - DNA, 25 bp, Rattus norvegicus
gcacagctgggaacctgcatgtata

SEQ ID NO: 379227 - DNA, 25 bp, Rattus norvegicus
gcacagctgggatcctgcatgtata

SEQ ID NO: 379228 - DNA, 25 bp, Rattus norvegicus
gcacagctgtgcaactttgagcgat

SEQ ID NO: 379229 - DNA, 25 bp, Rattus norvegicus
gcacagctgtgcacggtttaacggg

SEQ ID NO: 379230 - DNA, 25 bp, Rattus norvegicus
gcacagctgtgcctatgggaccgta

SEQ ID NO: 379231 - DNA, 25 bp, Rattus norvegicus
gcacagctgtgccttttcccggaca

SEQ ID NO: 379232 - DNA, 25 bp, Rattus norvegicus
gcacagctgtgcgtatgggaccgta

SEQ ID NO: 379233 - DNA, 25 bp, Rattus norvegicus
gcacagctgtgcgttttcccggaca

SEQ ID NO: 379234 - DNA, 25 bp, Rattus norvegicus
gcacagctgtgctactttgagcgat

SEQ ID NO: 379235 - DNA, 25 bp, Rattus norvegicus
gcacagctgtgctcggtttaacggg

SEQ ID NO: 379236 - DNA, 25 bp, Rattus norvegicus
gcacagctgtggcttcttgactgaa

SEQ ID NO: 379237 - DNA, 25 bp, Rattus norvegicus
gcacagctgtgggttcttgactgaa

SEQ ID NO: 379238 - DNA, 25 bp, Rattus norvegicus
gcacagctgtgtatccatagagttg

SEQ ID NO: 379239 - DNA, 25 bp, Rattus norvegicus
gcacagctgtgtttccatagagttg

SEQ ID NO: 379240 - DNA, 25 bp, Rattus norvegicus
gcacagctgttcacgcttcaaaagg

SEQ ID NO: 379241 - DNA, 25 bp, Rattus norvegicus
gcacagctgttctcgcttcaaaagg

SEQ ID NO: 379242 - DNA, 25 bp, Rattus norvegicus
gcacagcttctcaaatctaggatca

SEQ ID NO: 379243 - DNA, 25 bp, Rattus norvegicus
gcacagcttctctaatctaggatca

SEQ ID NO: 379244 - DNA, 25 bp, Rattus norvegicus
gcacaggaaacaataagttgcacaa

SEQ ID NO: 379245 - DNA, 25 bp, Rattus norvegicus
gcacaggaaacattaagttgcacaa

SEQ ID NO: 379246 - DNA, 25 bp, Rattus norvegicus
gcacaggaagaactgctgctctctt

SEQ ID NO: 379247 - DNA, 25 bp, Rattus norvegicus
gcacaggaagaagtgctgctctctt

SEQ ID NO: 379248 - DNA, 25 bp, Rattus norvegicus
gcacaggaaggcattcaggtttcaa

SEQ ID NO: 379249 - DNA, 25 bp, Rattus norvegicus
gcacaggaaggctttcaggtttcaa

SEQ ID NO: 379250 - DNA, 25 bp, Rattus norvegicus
gcacaggactccatgacatgggact

SEQ ID NO: 379251 - DNA, 25 bp, Rattus norvegicus
gcacaggactccttgacatgggact

SEQ ID NO: 379252 - DNA, 25 bp, Rattus norvegicus
gcacaggagcctatagactgtcagt

SEQ ID NO: 379253 - DNA, 25 bp, Rattus norvegicus
gcacaggagcctttagactgtcagt

SEQ ID NO: 379254 - DNA, 25 bp, Rattus norvegicus
gcacaggaggctatagtccccaggg

SEQ ID NO: 379255 - DNA, 25 bp, Rattus norvegicus
gcacaggaggctttagtccccaggg

SEQ ID NO: 379256 - DNA, 25 bp, Rattus norvegicus
gcacaggatggtctcaaacttggaa

SEQ ID NO: 379257 - DNA, 25 bp, Rattus norvegicus
gcacaggatggtgtcaaacttggaa

SEQ ID NO: 379258 - DNA, 25 bp, Rattus norvegicus
gcacaggcacaaccacaggcataca

SEQ ID NO: 379259 - DNA, 25 bp, Rattus norvegicus
gcacaggcacaagcacaggcataca

SEQ ID NO: 379260 - DNA, 25 bp, Rattus norvegicus
gcacaggcaccaaaaataaagtcgt

SEQ ID NO: 379261 - DNA, 25 bp, Rattus norvegicus
gcacaggcaccataaataaagtcgt

SEQ ID NO: 379262 - DNA, 25 bp, Rattus norvegicus
gcacaggcaccgctccagtatttct

SEQ ID NO: 379263 - DNA, 25 bp, Rattus norvegicus
gcacaggcaccggtccagtatttct

SEQ ID NO: 379264 - DNA, 25 bp, Rattus norvegicus
gcacaggcactgctcatgttccaga

SEQ ID NO: 379265 - DNA, 25 bp, Rattus norvegicus
gcacaggcactggtcatgttccaga

SEQ ID NO: 379266 - DNA, 25 bp, Rattus norvegicus
gcacaggcagcgagtgagccacaga

SEQ ID NO: 379267 - DNA, 25 bp, Rattus norvegicus
gcacaggcagcgtgtgagccacaga

SEQ ID NO: 379268 - DNA, 25 bp, Rattus norvegicus
gcacaggcctcaacgctggccatgg

SEQ ID NO: 379269 - DNA, 25 bp, Rattus norvegicus
gcacaggcctcatcgctggccatgg

SEQ ID NO: 379270 - DNA, 25 bp, Rattus norvegicus
gcacaggcctgtcacaaggactaag

SEQ ID NO: 379271 - DNA, 25 bp, Rattus norvegicus
gcacaggcctgtctttgttttaggg

SEQ ID NO: 379272 - DNA, 25 bp, Rattus norvegicus
gcacaggcctgtgacaaggactaag

SEQ ID NO: 379273 - DNA, 25 bp, Rattus norvegicus
gcacaggcctgtgtttgttttaggg

SEQ ID NO: 379274 - DNA, 25 bp, Rattus norvegicus
gcacaggccttgacagtaacacagc

SEQ ID NO: 379275 - DNA, 25 bp, Rattus norvegicus
gcacaggccttgtcagtaacacagc

SEQ ID NO: 379276 - DNA, 25 bp, Rattus norvegicus
gcacaggcgacaacatccgagagtt

SEQ ID NO: 379277 - DNA, 25 bp, Rattus norvegicus
gcacaggcgacatcatccgagagtt

SEQ ID NO: 379278 - DNA, 25 bp, Rattus norvegicus
gcacaggctcacacagtggttacaa

SEQ ID NO: 379279 - DNA, 25 bp, Rattus norvegicus
gcacaggctcactcagtggttacaa

SEQ ID NO: 379280 - DNA, 25 bp, Rattus norvegicus
gcacaggcttcgataaaggcatttt

SEQ ID NO: 379281 - DNA, 25 bp, Rattus norvegicus
gcacaggcttcgttaaaggcatttt

SEQ ID NO: 379282 - DNA, 25 bp, Rattus norvegicus
gcacaggcttctaaaatgggttatt

SEQ ID NO: 379283 - DNA, 25 bp, Rattus norvegicus
gcacaggcttcttaaatgggttatt

SEQ ID NO: 379284 - DNA, 25 bp, Rattus norvegicus
gcacagggacacacacgacatgaga

SEQ ID NO: 379285 - DNA, 25 bp, Rattus norvegicus
gcacagggacactcacgacatgaga

SEQ ID NO: 379286 - DNA, 25 bp, Rattus norvegicus
gcacagggagttagcctcgtgttat

SEQ ID NO: 379287 - DNA, 25 bp, Rattus norvegicus
gcacagggagtttgcctcgtgttat

SEQ ID NO: 379288 - DNA, 25 bp, Rattus norvegicus
gcacagggcaaaagtttacccctta

SEQ ID NO: 379289 - DNA, 25 bp, Rattus norvegicus
gcacagggcaaatgtttacccctta

SEQ ID NO: 379290 - DNA, 25 bp, Rattus norvegicus
gcacagggctcaagggaagtagaaa

SEQ ID NO: 379291 - DNA, 25 bp, Rattus norvegicus
gcacagggctcatgggaagtagaaa

SEQ ID NO: 379292 - DNA, 25 bp, Rattus norvegicus
gcacagggctggcttagaacatgtt

SEQ ID NO: 379293 - DNA, 25 bp, Rattus norvegicus
gcacagggctgggttagaacatgtt

SEQ ID NO: 379294 - DNA, 25 bp, Rattus norvegicus
gcacagggtcggactgaaattctga

SEQ ID NO: 379295 - DNA, 25 bp, Rattus norvegicus
gcacagggtcggtctgaaattctga

SEQ ID NO: 379296 - DNA, 25 bp, Rattus norvegicus
gcacaggtatcaatggctccaaggt

SEQ ID NO: 379297 - DNA, 25 bp, Rattus norvegicus
gcacaggtatcattggctccaaggt

SEQ ID NO: 379298 - DNA, 25 bp, Rattus norvegicus
gcacaggtattgctcttagcttcgg

SEQ ID NO: 379299 - DNA, 25 bp, Rattus norvegicus
gcacaggtattggtcttagcttcgg

SEQ ID NO: 379300 - DNA, 25 bp, Rattus norvegicus
gcacaggtccgtattgtgaccggaa

SEQ ID NO: 379301 - DNA, 25 bp, Rattus norvegicus
gcacaggtccgttttgtgaccggaa

SEQ ID NO: 379302 - DNA, 25 bp, Rattus norvegicus
gcacaggtctctatggttctaggca

SEQ ID NO: 379303 - DNA, 25 bp, Rattus norvegicus
gcacaggtctctttggttctaggca

SEQ ID NO: 379304 - DNA, 25 bp, Rattus norvegicus
gcacaggtctttaagaaccccaagt

SEQ ID NO: 379305 - DNA, 25 bp, Rattus norvegicus
gcacaggtcttttagaaccccaagt

SEQ ID NO: 379306 - DNA, 25 bp, Rattus norvegicus
gcacaggttaatactttcccaacta

SEQ ID NO: 379307 - DNA, 25 bp, Rattus norvegicus
gcacaggttaattctttcccaacta

SEQ ID NO: 379308 - DNA, 25 bp, Rattus norvegicus
gcacagtaataacctctggcttctc

SEQ ID NO: 379309 - DNA, 25 bp, Rattus norvegicus
gcacagtaataagctctggcttctc

SEQ ID NO: 379310 - DNA, 25 bp, Rattus norvegicus
gcacagtacagcaccatcagttcag

SEQ ID NO: 379311 - DNA, 25 bp, Rattus norvegicus
gcacagtacagctccatcagttcag

SEQ ID NO: 379312 - DNA, 25 bp, Rattus norvegicus
gcacagtagcatatcagttctcttt

SEQ ID NO: 379313 - DNA, 25 bp, Rattus norvegicus
gcacagtagcatttcagttctcttt

SEQ ID NO: 379314 - DNA, 25 bp, Rattus norvegicus
gcacagtattgcaatccaattttat

SEQ ID NO: 379315 - DNA, 25 bp, Rattus norvegicus
gcacagtattgctatccaattttat

SEQ ID NO: 379316 - DNA, 25 bp, Rattus norvegicus
gcacagtcaggcctttgtattaaaa

SEQ ID NO: 379317 - DNA, 25 bp, Rattus norvegicus
gcacagtcaggcgtttgtattaaaa

SEQ ID NO: 379318 - DNA, 25 bp, Rattus norvegicus
gcacagtccacaaacaaaggcattt

SEQ ID NO: 379319 - DNA, 25 bp, Rattus norvegicus
gcacagtccacatacaaaggcattt

SEQ ID NO: 379320 - DNA, 25 bp, Rattus norvegicus
gcacagtcccttaacaagcagctat

SEQ ID NO: 379321 - DNA, 25 bp, Rattus norvegicus
gcacagtccctttacaagcagctat

SEQ ID NO: 379322 - DNA, 25 bp, Rattus norvegicus
gcacagtcctaaattcctatggtca

SEQ ID NO: 379323 - DNA, 25 bp, Rattus norvegicus
gcacagtcctaatttcctatggtca

SEQ ID NO: 379324 - DNA, 25 bp, Rattus norvegicus
gcacagtctcatatgaggtcactat

SEQ ID NO: 379325 - DNA, 25 bp, Rattus norvegicus
gcacagtctcatttgaggtcactat

SEQ ID NO: 379326 - DNA, 25 bp, Rattus norvegicus
gcacagtctgtcaccagtagcagag

SEQ ID NO: 379327 - DNA, 25 bp, Rattus norvegicus
gcacagtctgtctccagtagcagag

SEQ ID NO: 379328 - DNA, 25 bp, Rattus norvegicus
gcacagtcttgacaactttggcctt

SEQ ID NO: 379329 - DNA, 25 bp, Rattus norvegicus
gcacagtcttgagaactttggcctt

SEQ ID NO: 379330 - DNA, 25 bp, Rattus norvegicus
gcacagtgagatcctttaccaagca

SEQ ID NO: 379331 - DNA, 25 bp, Rattus norvegicus
gcacagtgagatgctttaccaagca

SEQ ID NO: 379332 - DNA, 25 bp, Rattus norvegicus
gcacagtgagcaactgctgtagttt

SEQ ID NO: 379333 - DNA, 25 bp, Rattus norvegicus
gcacagtgagcacatcgattttcat

SEQ ID NO: 379334 - DNA, 25 bp, Rattus norvegicus
gcacagtgagcagatcgattttcat

SEQ ID NO: 379335 - DNA, 25 bp, Rattus norvegicus
gcacagtgagcatctgctgtagttt

SEQ ID NO: 379336 - DNA, 25 bp, Rattus norvegicus
gcacagtgaggcatttcaggcagtt

SEQ ID NO: 379337 - DNA, 25 bp, Rattus norvegicus
gcacagtgaggcttttcaggcagtt

SEQ ID NO: 379338 - DNA, 25 bp, Rattus norvegicus
gcacagtgcaatcagcaaatcatct

SEQ ID NO: 379339 - DNA, 25 bp, Rattus norvegicus
gcacagtgcaatgagcaaatcatct

SEQ ID NO: 379340 - DNA, 25 bp, Rattus norvegicus
gcacagtgccatatcagtctcaaga

SEQ ID NO: 379341 - DNA, 25 bp, Rattus norvegicus
gcacagtgccatttcagtctcaaga

SEQ ID NO: 379342 - DNA, 25 bp, Rattus norvegicus
gcacagtgcgtgcagtattcgctat

SEQ ID NO: 379343 - DNA, 25 bp, Rattus norvegicus
gcacagtgcgtggagtattcgctat

SEQ ID NO: 379344 - DNA, 25 bp, Rattus norvegicus
gcacagtgctctatgagggccctgt

SEQ ID NO: 379345 - DNA, 25 bp, Rattus norvegicus
gcacagtgctctttgagggccctgt

SEQ ID NO: 379346 - DNA, 25 bp, Rattus norvegicus
gcacagtgctggatcaatacactaa

SEQ ID NO: 379347 - DNA, 25 bp, Rattus norvegicus
gcacagtgctggatccgattctgat

SEQ ID NO: 379348 - DNA, 25 bp, Rattus norvegicus
gcacagtgctggttcaatacactaa

SEQ ID NO: 379349 - DNA, 25 bp, Rattus norvegicus
gcacagtgctggttccgattctgat

SEQ ID NO: 379350 - DNA, 25 bp, Rattus norvegicus
gcacagtggaaaaggcagcagtcaa

SEQ ID NO: 379351 - DNA, 25 bp, Rattus norvegicus
gcacagtggaaatggcagcagtcaa

SEQ ID NO: 379352 - DNA, 25 bp, Rattus norvegicus
gcacagtggcacaggcctataacct

SEQ ID NO: 379353 - DNA, 25 bp, Rattus norvegicus
gcacagtggcactggcctataacct

SEQ ID NO: 379354 - DNA, 25 bp, Rattus norvegicus
gcacagtggcctccagatcctgcta

SEQ ID NO: 379355 - DNA, 25 bp, Rattus norvegicus
gcacagtggcctgcagatcctgcta

SEQ ID NO: 379356 - DNA, 25 bp, Rattus norvegicus
gcacagtgtaacatagggcaggctc

SEQ ID NO: 379357 - DNA, 25 bp, Rattus norvegicus
gcacagtgtaacttagggcaggctc

SEQ ID NO: 379358 - DNA, 25 bp, Rattus norvegicus
gcacagtgtattcctgcttaagatt

SEQ ID NO: 379359 - DNA, 25 bp, Rattus norvegicus
gcacagtgtattgctgcttaagatt

SEQ ID NO: 379360 - DNA, 25 bp, Rattus norvegicus
gcacagttacctcggagaacgacaa

SEQ ID NO: 379361 - DNA, 25 bp, Rattus norvegicus
gcacagttacctgggagaacgacaa

SEQ ID NO: 379362 - DNA, 25 bp, Rattus norvegicus
gcacagttagggaggttttgtaaat

SEQ ID NO: 379363 - DNA, 25 bp, Rattus norvegicus
gcacagttagggtggttttgtaaat

SEQ ID NO: 379364 - DNA, 25 bp, Rattus norvegicus
gcacagttagtccttgtctcggaaa

SEQ ID NO: 379365 - DNA, 25 bp, Rattus norvegicus
gcacagttagtcgttgtctcggaaa

SEQ ID NO: 379366 - DNA, 25 bp, Rattus norvegicus
gcacagttataacactcacctaata

SEQ ID NO: 379367 - DNA, 25 bp, Rattus norvegicus
gcacagttataagactcacctaata

SEQ ID NO: 379368 - DNA, 25 bp, Rattus norvegicus
gcacagttattgctgtgtcctcagc

SEQ ID NO: 379369 - DNA, 25 bp, Rattus norvegicus
gcacagttattggtgtgtcctcagc

SEQ ID NO: 379370 - DNA, 25 bp, Rattus norvegicus
gcacagttcagccttagatctgcag

SEQ ID NO: 379371 - DNA, 25 bp, Rattus norvegicus
gcacagttcagcgttagatctgcag

SEQ ID NO: 379372 - DNA, 25 bp, Rattus norvegicus
gcacagttccagcagatcgtagcca

SEQ ID NO: 379373 - DNA, 25 bp, Rattus norvegicus
gcacagttccaggagatcgtagcca

SEQ ID NO: 379374 - DNA, 25 bp, Rattus norvegicus
gcacagttcgttaaagcccattagt

SEQ ID NO: 379375 - DNA, 25 bp, Rattus norvegicus
gcacagttcgtttaagcccattagt

SEQ ID NO: 379376 - DNA, 25 bp, Rattus norvegicus
gcacagttgctaagatcaagtgaca

SEQ ID NO: 379377 - DNA, 25 bp, Rattus norvegicus
gcacagttgctatgatcaagtgaca

SEQ ID NO: 379378 - DNA, 25 bp, Rattus norvegicus
gcacagttggctcagtcttttctgc

SEQ ID NO: 379379 - DNA, 25 bp, Rattus norvegicus
gcacagttggctgagtcttttctgc

SEQ ID NO: 379380 - DNA, 25 bp, Rattus norvegicus
gcacagttgtggcaatagccagtat

SEQ ID NO: 379381 - DNA, 25 bp, Rattus norvegicus
gcacagttgtgggaatagccagtat

SEQ ID NO: 379382 - DNA, 25 bp, Rattus norvegicus
gcacagtttagcattacctctctga

SEQ ID NO: 379383 - DNA, 25 bp, Rattus norvegicus
gcacagtttagctttacctctctga

SEQ ID NO: 379384 - DNA, 25 bp, Rattus norvegicus
gcacagtttcatctatgggctacta

SEQ ID NO: 379385 - DNA, 25 bp, Rattus norvegicus
gcacagtttcatgtatgggctacta

SEQ ID NO: 379386 - DNA, 25 bp, Rattus norvegicus
gcacagtttgctagttgagctcagc

SEQ ID NO: 379387 - DNA, 25 bp, Rattus norvegicus
gcacagtttgcttgttgagctcagc

SEQ ID NO: 379388 - DNA, 25 bp, Rattus norvegicus
gcacagtttttaaccaggacacatg

SEQ ID NO: 379389 - DNA, 25 bp, Rattus norvegicus
gcacagtttttatccaggacacatg

SEQ ID NO: 379390 - DNA, 25 bp, Rattus norvegicus
gcacagttttttcaatggtgaagaa

SEQ ID NO: 379391 - DNA, 25 bp, Rattus norvegicus
gcacagttttttgaatggtgaagaa

SEQ ID NO: 379392 - DNA, 25 bp, Rattus norvegicus
gcacataatacacttcatgtactaa

SEQ ID NO: 379393 - DNA, 25 bp, Rattus norvegicus
gcacataatacagttcatgtactaa

SEQ ID NO: 379394 - DNA, 25 bp, Rattus norvegicus
gcacataattctcctgttacgggta

SEQ ID NO: 379395 - DNA, 25 bp, Rattus norvegicus
gcacataattctgctgttacgggta

SEQ ID NO: 379396 - DNA, 25 bp, Rattus norvegicus
gcacataccatcaggagccacggga

SEQ ID NO: 379397 - DNA, 25 bp, Rattus norvegicus
gcacataccatctggagccacggga

SEQ ID NO: 379398 - DNA, 25 bp, Rattus norvegicus
gcacatacccttagctttcttttgt

SEQ ID NO: 379399 - DNA, 25 bp, Rattus norvegicus
gcacataccctttgctttcttttgt

SEQ ID NO: 379400 - DNA, 25 bp, Rattus norvegicus
gcacatacctgtacccggaaacaga

SEQ ID NO: 379401 - DNA, 25 bp, Rattus norvegicus
gcacatacctgttcccggaaacaga

SEQ ID NO: 379402 - DNA, 25 bp, Rattus norvegicus
gcacatacgaagacctgagttccat

SEQ ID NO: 379403 - DNA, 25 bp, Rattus norvegicus
gcacatacgaagtcctgagttccat

SEQ ID NO: 379404 - DNA, 25 bp, Rattus norvegicus
gcacatactttgctggatataacta

SEQ ID NO: 379405 - DNA, 25 bp, Rattus norvegicus
gcacatactttggtggatataacta

SEQ ID NO: 379406 - DNA, 25 bp, Rattus norvegicus
gcacatagaccccatgtcaataaca

SEQ ID NO: 379407 - DNA, 25 bp, Rattus norvegicus
gcacatagacccgatgtcaataaca

SEQ ID NO: 379408 - DNA, 25 bp, Rattus norvegicus
gcacataggtacaccatagcagttc

SEQ ID NO: 379409 - DNA, 25 bp, Rattus norvegicus
gcacataggtactccatagcagttc

SEQ ID NO: 379410 - DNA, 25 bp, Rattus norvegicus
gcacatagtagtcggccccgcacag

SEQ ID NO: 379411 - DNA, 25 bp, Rattus norvegicus
gcacatagtagtgggccccgcacag

SEQ ID NO: 379412 - DNA, 25 bp, Rattus norvegicus
gcacatatcccacatttctgtggca

SEQ ID NO: 379413 - DNA, 25 bp, Rattus norvegicus
gcacatatcccagatttctgtggca

SEQ ID NO: 379414 - DNA, 25 bp, Rattus norvegicus
gcacatatgcatatattgtattcac

SEQ ID NO: 379415 - DNA, 25 bp, Rattus norvegicus
gcacatatgcatttattgtattcac

SEQ ID NO: 379416 - DNA, 25 bp, Rattus norvegicus
gcacatattccaactatccacatag

SEQ ID NO: 379417 - DNA, 25 bp, Rattus norvegicus
gcacatattccatctatccacatag

SEQ ID NO: 379418 - DNA, 25 bp, Rattus norvegicus
gcacatattccccagcagccatggg

SEQ ID NO: 379419 - DNA, 25 bp, Rattus norvegicus
gcacatattcccgagcagccatggg

SEQ ID NO: 379420 - DNA, 25 bp, Rattus norvegicus
gcacatatttatattcggagtttct

SEQ ID NO: 379421 - DNA, 25 bp, Rattus norvegicus
gcacatatttattttcggagtttct

SEQ ID NO: 379422 - DNA, 25 bp, Rattus norvegicus
gcacatattttactttagatcgtcg

SEQ ID NO: 379423 - DNA, 25 bp, Rattus norvegicus
gcacatattttagtttagatcgtcg

SEQ ID NO: 379424 - DNA, 25 bp, Rattus norvegicus
gcacatatttttccaagcccagtag

SEQ ID NO: 379425 - DNA, 25 bp, Rattus norvegicus
gcacatatttttgcaagcccagtag

SEQ ID NO: 379426 - DNA, 25 bp, Rattus norvegicus
gcacatcaacatccttagtcattag

SEQ ID NO: 379427 - DNA, 25 bp, Rattus norvegicus
gcacatcaacatgcttagtcattag

SEQ ID NO: 379428 - DNA, 25 bp, Rattus norvegicus
gcacatcaggacactggttctttct

SEQ ID NO: 379429 - DNA, 25 bp, Rattus norvegicus
gcacatcaggactctggttctttct

SEQ ID NO: 379430 - DNA, 25 bp, Rattus norvegicus
gcacatccacaactctctgatcgga

SEQ ID NO: 379431 - DNA, 25 bp, Rattus norvegicus
gcacatccacaagtctctgatcgga

SEQ ID NO: 379432 - DNA, 25 bp, Rattus norvegicus
gcacatccactgcaaagctgtctta

SEQ ID NO: 379433 - DNA, 25 bp, Rattus norvegicus
gcacatccactggaaagctgtctta

SEQ ID NO: 379434 - DNA, 25 bp, Rattus norvegicus
gcacatccatctagacactttgttt

SEQ ID NO: 379435 - DNA, 25 bp, Rattus norvegicus
gcacatccatcttgacactttgttt

SEQ ID NO: 379436 - DNA, 25 bp, Rattus norvegicus
gcacatccatgcctttgagcagaaa

SEQ ID NO: 379437 - DNA, 25 bp, Rattus norvegicus
gcacatccatgcgtttgagcagaaa

SEQ ID NO: 379438 - DNA, 25 bp, Rattus norvegicus
gcacatccccagagatggtgaatct

SEQ ID NO: 379439 - DNA, 25 bp, Rattus norvegicus
gcacatccccagtgatggtgaatct

SEQ ID NO: 379440 - DNA, 25 bp, Rattus norvegicus
gcacatccctggctgacttgataaa

SEQ ID NO: 379441 - DNA, 25 bp, Rattus norvegicus
gcacatccctgggtgacttgataaa

SEQ ID NO: 379442 - DNA, 25 bp, Rattus norvegicus
gcacatccggaacccttggttacaa

SEQ ID NO: 379443 - DNA, 25 bp, Rattus norvegicus
gcacatccggaagccttggttacaa

SEQ ID NO: 379444 - DNA, 25 bp, Rattus norvegicus
gcacatccgggaaactgtcgaaacg

SEQ ID NO: 379445 - DNA, 25 bp, Rattus norvegicus
gcacatccgggatactgtcgaaacg

SEQ ID NO: 379446 - DNA, 25 bp, Rattus norvegicus
gcacatcctcataatacgttattct

SEQ ID NO: 379447 - DNA, 25 bp, Rattus norvegicus
gcacatcctcattatacgttattct

SEQ ID NO: 379448 - DNA, 25 bp, Rattus norvegicus
gcacatcctgatctgggtggtacat

SEQ ID NO: 379449 - DNA, 25 bp, Rattus norvegicus
gcacatcctgatgtgggtggtacat

SEQ ID NO: 379450 - DNA, 25 bp, Rattus norvegicus
gcacatcgaggaacctgccttgatt

SEQ ID NO: 379451 - DNA, 25 bp, Rattus norvegicus
gcacatcgaggatcctgccttgatt

SEQ ID NO: 379452 - DNA, 25 bp, Rattus norvegicus
gcacatcgcggccaattggtatgag

SEQ ID NO: 379453 - DNA, 25 bp, Rattus norvegicus
gcacatcgcggcgaattggtatgag

SEQ ID NO: 379454 - DNA, 25 bp, Rattus norvegicus
gcacatcgtcccaagaaccatgaaa

SEQ ID NO: 379455 - DNA, 25 bp, Rattus norvegicus
gcacatcgtccctagaaccatgaaa

SEQ ID NO: 379456 - DNA, 25 bp, Rattus norvegicus
gcacatcgttacacaattttagcag

SEQ ID NO: 379457 - DNA, 25 bp, Rattus norvegicus
gcacatcgttactcaattttagcag

SEQ ID NO: 379458 - DNA, 25 bp, Rattus norvegicus
gcacatctccatcttatctgtgtga

SEQ ID NO: 379459 - DNA, 25 bp, Rattus norvegicus
gcacatctccatcttgtatgttttc

SEQ ID NO: 379460 - DNA, 25 bp, Rattus norvegicus
gcacatctccatgttatctgtgtga

SEQ ID NO: 379461 - DNA, 25 bp, Rattus norvegicus
gcacatctccatgttgtatgttttc

SEQ ID NO: 379462 - DNA, 25 bp, Rattus norvegicus
gcacatctccccagtatgtatttat

SEQ ID NO: 379463 - DNA, 25 bp, Rattus norvegicus
gcacatctcccctgtatgtatttat

SEQ ID NO: 379464 - DNA, 25 bp, Rattus norvegicus
gcacatctgctgacatttgtaactc

SEQ ID NO: 379465 - DNA, 25 bp, Rattus norvegicus
gcacatctgctgtcatttgtaactc

SEQ ID NO: 379466 - DNA, 25 bp, Rattus norvegicus
gcacatctgcttaggagttctgagt

SEQ ID NO: 379467 - DNA, 25 bp, Rattus norvegicus
gcacatctgctttggagttctgagt

SEQ ID NO: 379468 - DNA, 25 bp, Rattus norvegicus
gcacatcttcatagcagctggagac

SEQ ID NO: 379469 - DNA, 25 bp, Rattus norvegicus
gcacatcttcattgcagctggagac

SEQ ID NO: 379470 - DNA, 25 bp, Rattus norvegicus
gcacatcttcccaattaagcttttg

SEQ ID NO: 379471 - DNA, 25 bp, Rattus norvegicus
gcacatcttccctattaagcttttg

SEQ ID NO: 379472 - DNA, 25 bp, Rattus norvegicus
gcacatgacaaaagcttacagtgga

SEQ ID NO: 379473 - DNA, 25 bp, Rattus norvegicus
gcacatgacaaatgcttacagtgga

SEQ ID NO: 379474 - DNA, 25 bp, Rattus norvegicus
gcacatgacattcctagcctttcca

SEQ ID NO: 379475 - DNA, 25 bp, Rattus norvegicus
gcacatgacattgctagcctttcca

SEQ ID NO: 379476 - DNA, 25 bp, Rattus norvegicus
gcacatgacctacagagcttggaaa

SEQ ID NO: 379477 - DNA, 25 bp, Rattus norvegicus
gcacatgacctagagagcttggaaa

SEQ ID NO: 379478 - DNA, 25 bp, Rattus norvegicus
gcacatgcagtgaaaatcagcatcg

SEQ ID NO: 379479 - DNA, 25 bp, Rattus norvegicus
gcacatgcagtgtaaatcagcatcg

SEQ ID NO: 379480 - DNA, 25 bp, Rattus norvegicus
gcacatgcatccaatttcagatcta

SEQ ID NO: 379481 - DNA, 25 bp, Rattus norvegicus
gcacatgcatcctatttcagatcta

SEQ ID NO: 379482 - DNA, 25 bp, Rattus norvegicus
gcacatgcctgtaacctgagctgaa

SEQ ID NO: 379483 - DNA, 25 bp, Rattus norvegicus
gcacatgcctgttacctgagctgaa

SEQ ID NO: 379484 - DNA, 25 bp, Rattus norvegicus
gcacatgccttgcatccagcattca

SEQ ID NO: 379485 - DNA, 25 bp, Rattus norvegicus
gcacatgccttggatccagcattca

SEQ ID NO: 379486 - DNA, 25 bp, Rattus norvegicus
gcacatgcgactcagctgtgggctt

SEQ ID NO: 379487 - DNA, 25 bp, Rattus norvegicus
gcacatgcgactgagctgtgggctt

SEQ ID NO: 379488 - DNA, 25 bp, Rattus norvegicus
gcacatgctatgaatctgagacacg

SEQ ID NO: 379489 - DNA, 25 bp, Rattus norvegicus
gcacatgctatgtatctgagacacg

SEQ ID NO: 379490 - DNA, 25 bp, Rattus norvegicus
gcacatgctattattatagttgctt

SEQ ID NO: 379491 - DNA, 25 bp, Rattus norvegicus
gcacatgctatttttatagttgctt

SEQ ID NO: 379492 - DNA, 25 bp, Rattus norvegicus
gcacatgctcacacagactgcgtta

SEQ ID NO: 379493 - DNA, 25 bp, Rattus norvegicus
gcacatgctcactcagactgcgtta

SEQ ID NO: 379494 - DNA, 25 bp, Rattus norvegicus
gcacatgctgtacaaggaatcccct

SEQ ID NO: 379495 - DNA, 25 bp, Rattus norvegicus
gcacatgctgtagaaggaatcccct

SEQ ID NO: 379496 - DNA, 25 bp, Rattus norvegicus
gcacatgcttgcctgcacagagagc

SEQ ID NO: 379497 - DNA, 25 bp, Rattus norvegicus
gcacatgcttgcgtgcacagagagc

SEQ ID NO: 379498 - DNA, 25 bp, Rattus norvegicus
gcacatgctttgcaccaagttaatt

SEQ ID NO: 379499 - DNA, 25 bp, Rattus norvegicus
gcacatgctttggaccaagttaatt

SEQ ID NO: 379500 - DNA, 25 bp, Rattus norvegicus
gcacatggactgcagggttgccacc

SEQ ID NO: 379501 - DNA, 25 bp, Rattus norvegicus
gcacatggactggagggttgccacc

SEQ ID NO: 379502 - DNA, 25 bp, Rattus norvegicus
gcacatggatgtatttaagagggat

SEQ ID NO: 379503 - DNA, 25 bp, Rattus norvegicus
gcacatggatgtttttaagagggat

SEQ ID NO: 379504 - DNA, 25 bp, Rattus norvegicus
gcacatggattaagactctgacatc

SEQ ID NO: 379505 - DNA, 25 bp, Rattus norvegicus
gcacatggattatgactctgacatc

SEQ ID NO: 379506 - DNA, 25 bp, Rattus norvegicus
gcacatggcatgctctgtggagcta

SEQ ID NO: 379507 - DNA, 25 bp, Rattus norvegicus
gcacatggcatggtctgtggagcta

SEQ ID NO: 379508 - DNA, 25 bp, Rattus norvegicus
gcacatggccctctcaaatgttcag

SEQ ID NO: 379509 - DNA, 25 bp, Rattus norvegicus
gcacatggccctgtcaaatgttcag

SEQ ID NO: 379510 - DNA, 25 bp, Rattus norvegicus
gcacatggctttaggacagacttca

SEQ ID NO: 379511 - DNA, 25 bp, Rattus norvegicus
gcacatggcttttggacagacttca

SEQ ID NO: 379512 - DNA, 25 bp, Rattus norvegicus
gcacatgggaggctgccatctttac

SEQ ID NO: 379513 - DNA, 25 bp, Rattus norvegicus
gcacatgggagggtgccatctttac

SEQ ID NO: 379514 - DNA, 25 bp, Rattus norvegicus
gcacatggtcaacaggactacccaa

SEQ ID NO: 379515 - DNA, 25 bp, Rattus norvegicus
gcacatggtcaagaggactacccaa

SEQ ID NO: 379516 - DNA, 25 bp, Rattus norvegicus
gcacatggtgtgctaccctccaggg

SEQ ID NO: 379517 - DNA, 25 bp, Rattus norvegicus
gcacatggtgtggtaccctccaggg

SEQ ID NO: 379518 - DNA, 25 bp, Rattus norvegicus
gcacatgtaacaccaactccaaaga

SEQ ID NO: 379519 - DNA, 25 bp, Rattus norvegicus
gcacatgtaacagcaactccaaaga

SEQ ID NO: 379520 - DNA, 25 bp, Rattus norvegicus
gcacatgtaggacattgtcagacta

SEQ ID NO: 379521 - DNA, 25 bp, Rattus norvegicus
gcacatgtaggagattgtcagacta

SEQ ID NO: 379522 - DNA, 25 bp, Rattus norvegicus
gcacatgtattccttccgtataaat

SEQ ID NO: 379523 - DNA, 25 bp, Rattus norvegicus
gcacatgtattcgttccgtataaat

SEQ ID NO: 379524 - DNA, 25 bp, Rattus norvegicus
gcacatgtctcaagcccgcagggag

SEQ ID NO: 379525 - DNA, 25 bp, Rattus norvegicus
gcacatgtctcatgcccgcagggag

SEQ ID NO: 379526 - DNA, 25 bp, Rattus norvegicus
gcacatgtgtgcaagatacattgga

SEQ ID NO: 379527 - DNA, 25 bp, Rattus norvegicus
gcacatgtgtgcaggcctactggga

SEQ ID NO: 379528 - DNA, 25 bp, Rattus norvegicus
gcacatgtgtgctagatacattgga

SEQ ID NO: 379529 - DNA, 25 bp, Rattus norvegicus
gcacatgtgtgctggcctactggga

SEQ ID NO: 379530 - DNA, 25 bp, Rattus norvegicus
gcacatgtgttaaggctgtctgtac

SEQ ID NO: 379531 - DNA, 25 bp, Rattus norvegicus
gcacatgtgttatggctgtctgtac

SEQ ID NO: 379532 - DNA, 25 bp, Rattus norvegicus
gcacatgttcatctgctcatgtata

SEQ ID NO: 379533 - DNA, 25 bp, Rattus norvegicus
gcacatgttcatgtgctcatgtata

SEQ ID NO: 379534 - DNA, 25 bp, Rattus norvegicus
gcacattaaatgacgtagctaccta

SEQ ID NO: 379535 - DNA, 25 bp, Rattus norvegicus
gcacattaaatgactcttccctcag

SEQ ID NO: 379536 - DNA, 25 bp, Rattus norvegicus
gcacattaaatgtcgtagctaccta

SEQ ID NO: 379537 - DNA, 25 bp, Rattus norvegicus
gcacattaaatgtctcttccctcag

SEQ ID NO: 379538 - DNA, 25 bp, Rattus norvegicus
gcacattaactcattactactcaat

SEQ ID NO: 379539 - DNA, 25 bp, Rattus norvegicus
gcacattaactctttactactcaat

SEQ ID NO: 379540 - DNA, 25 bp, Rattus norvegicus
gcacattagcagacagtcctggaga

SEQ ID NO: 379541 - DNA, 25 bp, Rattus norvegicus
gcacattagcagtcagtcctggaga

SEQ ID NO: 379542 - DNA, 25 bp, Rattus norvegicus
gcacattatattcagtaagttccga

SEQ ID NO: 379543 - DNA, 25 bp, Rattus norvegicus
gcacattatattgagtaagttccga

SEQ ID NO: 379544 - DNA, 25 bp, Rattus norvegicus
gcacattattacaattagctctttg

SEQ ID NO: 379545 - DNA, 25 bp, Rattus norvegicus
gcacattattactattagctctttg

SEQ ID NO: 379546 - DNA, 25 bp, Rattus norvegicus
gcacattcatgcagatcatacccca

SEQ ID NO: 379547 - DNA, 25 bp, Rattus norvegicus
gcacattcatgctgatcatacccca

SEQ ID NO: 379548 - DNA, 25 bp, Rattus norvegicus
gcacattcccacattaaaactcagg

SEQ ID NO: 379549 - DNA, 25 bp, Rattus norvegicus
gcacattcccactttaaaactcagg

SEQ ID NO: 379550 - DNA, 25 bp, Rattus norvegicus
gcacattcccttagctatctaggag

SEQ ID NO: 379551 - DNA, 25 bp, Rattus norvegicus
gcacattccctttgctatctaggag

SEQ ID NO: 379552 - DNA, 25 bp, Rattus norvegicus
gcacattctcctcgtcattacttaa

SEQ ID NO: 379553 - DNA, 25 bp, Rattus norvegicus
gcacattctcctggtcattacttaa

SEQ ID NO: 379554 - DNA, 25 bp, Rattus norvegicus
gcacattctgatcccttcttttaca

SEQ ID NO: 379555 - DNA, 25 bp, Rattus norvegicus
gcacattctgatgccttcttttaca

SEQ ID NO: 379556 - DNA, 25 bp, Rattus norvegicus
gcacattctgcacactagagcatat

SEQ ID NO: 379557 - DNA, 25 bp, Rattus norvegicus
gcacattctgcagactagagcatat

SEQ ID NO: 379558 - DNA, 25 bp, Rattus norvegicus
gcacattctgccattcagatataat

SEQ ID NO: 379559 - DNA, 25 bp, Rattus norvegicus
gcacattctgcctttcagatataat

SEQ ID NO: 379560 - DNA, 25 bp, Rattus norvegicus
gcacattctgcgcaactccggagtt

SEQ ID NO: 379561 - DNA, 25 bp, Rattus norvegicus
gcacattctgcggaactccggagtt

SEQ ID NO: 379562 - DNA, 25 bp, Rattus norvegicus
gcacattcttagcttatcttccttt

SEQ ID NO: 379563 - DNA, 25 bp, Rattus norvegicus
gcacattcttaggttatcttccttt

SEQ ID NO: 379564 - DNA, 25 bp, Rattus norvegicus
gcacattcttccactgacttaaggt

SEQ ID NO: 379565 - DNA, 25 bp, Rattus norvegicus
gcacattcttcctctgacttaaggt

SEQ ID NO: 379566 - DNA, 25 bp, Rattus norvegicus
gcacattctttactctgcgagcatg

SEQ ID NO: 379567 - DNA, 25 bp, Rattus norvegicus
gcacattctttagtctgcgagcatg

SEQ ID NO: 379568 - DNA, 25 bp, Rattus norvegicus
gcacattgactgagctattacccca

SEQ ID NO: 379569 - DNA, 25 bp, Rattus norvegicus
gcacattgactgtgctattacccca

SEQ ID NO: 379570 - DNA, 25 bp, Rattus norvegicus
gcacattgagcgctttcagtcagag

SEQ ID NO: 379571 - DNA, 25 bp, Rattus norvegicus
gcacattgagcggtttcagtcagag

SEQ ID NO: 379572 - DNA, 25 bp, Rattus norvegicus
gcacattgccatcagtacgttctgt

SEQ ID NO: 379573 - DNA, 25 bp, Rattus norvegicus
gcacattgccatgagtacgttctgt

SEQ ID NO: 379574 - DNA, 25 bp, Rattus norvegicus
gcacattgctgaagatgctgaccga

SEQ ID NO: 379575 - DNA, 25 bp, Rattus norvegicus
gcacattgctgatgatgctgaccga

SEQ ID NO: 379576 - DNA, 25 bp, Rattus norvegicus
gcacattgggctcgtttcttcgtca

SEQ ID NO: 379577 - DNA, 25 bp, Rattus norvegicus
gcacattgggctggtttcttcgtca

SEQ ID NO: 379578 - DNA, 25 bp, Rattus norvegicus
gcacatttaaatcgcctcttagctt

SEQ ID NO: 379579 - DNA, 25 bp, Rattus norvegicus
gcacatttaaatggcctcttagctt

SEQ ID NO: 379580 - DNA, 25 bp, Rattus norvegicus
gcacatttccaaagcaaggtctgag

SEQ ID NO: 379581 - DNA, 25 bp, Rattus norvegicus
gcacatttccaatgcaaggtctgag

SEQ ID NO: 379582 - DNA, 25 bp, Rattus norvegicus
gcacatttcctgcatggctgtaata

SEQ ID NO: 379583 - DNA, 25 bp, Rattus norvegicus
gcacatttcctggatggctgtaata

SEQ ID NO: 379584 - DNA, 25 bp, Rattus norvegicus
gcacatttctctaggctggataggg

SEQ ID NO: 379585 - DNA, 25 bp, Rattus norvegicus
gcacatttctctcaggaacacgaca

SEQ ID NO: 379586 - DNA, 25 bp, Rattus norvegicus
gcacatttctctcctgaacaggact

SEQ ID NO: 379587 - DNA, 25 bp, Rattus norvegicus
gcacatttctctgaggaacacgaca

SEQ ID NO: 379588 - DNA, 25 bp, Rattus norvegicus
gcacatttctctgctgaacaggact

SEQ ID NO: 379589 - DNA, 25 bp, Rattus norvegicus
gcacatttctcttggctggataggg

SEQ ID NO: 379590 - DNA, 25 bp, Rattus norvegicus
gcacatttctgtacatcttagtcac

SEQ ID NO: 379591 - DNA, 25 bp, Rattus norvegicus
gcacatttctgttcatcttagtcac

SEQ ID NO: 379592 - DNA, 25 bp, Rattus norvegicus
gcacatttgcacagttctacagggt

SEQ ID NO: 379593 - DNA, 25 bp, Rattus norvegicus
gcacatttgcactgttctacagggt

SEQ ID NO: 379594 - DNA, 25 bp, Rattus norvegicus
gcacatttgcagattttgaacaaga

SEQ ID NO: 379595 - DNA, 25 bp, Rattus norvegicus
gcacatttgcagtttttgaacaaga

SEQ ID NO: 379596 - DNA, 25 bp, Rattus norvegicus
gcacattttgccaagccacttttag

SEQ ID NO: 379597 - DNA, 25 bp, Rattus norvegicus
gcacattttgcctagccacttttag

SEQ ID NO: 379598 - DNA, 25 bp, Rattus norvegicus
gcacatttttagaaggcatctttgt

SEQ ID NO: 379599 - DNA, 25 bp, Rattus norvegicus
gcacatttttagtaggcatctttgt

SEQ ID NO: 379600 - DNA, 25 bp, Rattus norvegicus
gcacatttttatagtaaccgtccac

SEQ ID NO: 379601 - DNA, 25 bp, Rattus norvegicus
gcacatttttattgtaaccgtccac

SEQ ID NO: 379602 - DNA, 25 bp, Rattus norvegicus
gcacatttttcaacaaggtcctcct

SEQ ID NO: 379603 - DNA, 25 bp, Rattus norvegicus
gcacatttttcatcaaggtcctcct

SEQ ID NO: 379604 - DNA, 25 bp, Rattus norvegicus
gcacatttttccagtcgaatcaggt

SEQ ID NO: 379605 - DNA, 25 bp, Rattus norvegicus
gcacatttttcctgtcgaatcaggt

SEQ ID NO: 379606 - DNA, 25 bp, Rattus norvegicus
gcacatttttgtagtaactgtccat

SEQ ID NO: 379607 - DNA, 25 bp, Rattus norvegicus
gcacatttttgttgtaactgtccat

SEQ ID NO: 379608 - DNA, 25 bp, Rattus norvegicus
gcaccaaaccccagaattgggaatt

SEQ ID NO: 379609 - DNA, 25 bp, Rattus norvegicus
gcaccaaacccctgaattgggaatt

SEQ ID NO: 379610 - DNA, 25 bp, Rattus norvegicus
gcaccaaacctcagtcatttttatt

SEQ ID NO: 379611 - DNA, 25 bp, Rattus norvegicus
gcaccaaacctctgtcatttttatt

SEQ ID NO: 379612 - DNA, 25 bp, Rattus norvegicus
gcaccaaactggctactgcttgggc

SEQ ID NO: 379613 - DNA, 25 bp, Rattus norvegicus
gcaccaaactgggtactgcttgggc

SEQ ID NO: 379614 - DNA, 25 bp, Rattus norvegicus
gcaccaaagcctaaccagatggagg

SEQ ID NO: 379615 - DNA, 25 bp, Rattus norvegicus
gcaccaaagcctattcctagctaaa

SEQ ID NO: 379616 - DNA, 25 bp, Rattus norvegicus
gcaccaaagccttaccagatggagg

SEQ ID NO: 379617 - DNA, 25 bp, Rattus norvegicus
gcaccaaagccttttcctagctaaa

SEQ ID NO: 379618 - DNA, 25 bp, Rattus norvegicus
gcaccaaagtgcatcattattttgt

SEQ ID NO: 379619 - DNA, 25 bp, Rattus norvegicus
gcaccaaagtgcttcattattttgt

SEQ ID NO: 379620 - DNA, 25 bp, Rattus norvegicus
gcaccaaagtggagtctcagctgac

SEQ ID NO: 379621 - DNA, 25 bp, Rattus norvegicus
gcaccaaagtggtgtctcagctgac

SEQ ID NO: 379622 - DNA, 25 bp, Rattus norvegicus
gcaccaacagcacaggctaaacttg

SEQ ID NO: 379623 - DNA, 25 bp, Rattus norvegicus
gcaccaacagcagaggctaaacttg

SEQ ID NO: 379624 - DNA, 25 bp, Rattus norvegicus
gcaccaaccacacaagacaacaatt

SEQ ID NO: 379625 - DNA, 25 bp, Rattus norvegicus
gcaccaaccacagaagacaacaatt

SEQ ID NO: 379626 - DNA, 25 bp, Rattus norvegicus
gcaccaaccaccactcttagttttt

SEQ ID NO: 379627 - DNA, 25 bp, Rattus norvegicus
gcaccaaccacctctcttagttttt

SEQ ID NO: 379628 - DNA, 25 bp, Rattus norvegicus
gcaccaacctgcattttaacgattt

SEQ ID NO: 379629 - DNA, 25 bp, Rattus norvegicus
gcaccaacctgctttttaacgattt

SEQ ID NO: 379630 - DNA, 25 bp, Rattus norvegicus
gcaccaacctgtactacttcaaaag

SEQ ID NO: 379631 - DNA, 25 bp, Rattus norvegicus
gcaccaacctgttctacttcaaaag

SEQ ID NO: 379632 - DNA, 25 bp, Rattus norvegicus
gcaccaacgcagaagccgggaggct

SEQ ID NO: 379633 - DNA, 25 bp, Rattus norvegicus
gcaccaacgcagtagccgggaggct

SEQ ID NO: 379634 - DNA, 25 bp, Rattus norvegicus
gcaccaactgagaatgcacaccatg

SEQ ID NO: 379635 - DNA, 25 bp, Rattus norvegicus
gcaccaactgagtatgcacaccatg

SEQ ID NO: 379636 - DNA, 25 bp, Rattus norvegicus
gcaccaacttttcactgtcaaacat

SEQ ID NO: 379637 - DNA, 25 bp, Rattus norvegicus
gcaccaacttttgactgtcaaacat

SEQ ID NO: 379638 - DNA, 25 bp, Rattus norvegicus
gcaccaagatgcctccaatgagctg

SEQ ID NO: 379639 - DNA, 25 bp, Rattus norvegicus
gcaccaagatgcgtccaatgagctg

SEQ ID NO: 379640 - DNA, 25 bp, Rattus norvegicus
gcaccaagccatccgggcagctgga

SEQ ID NO: 379641 - DNA, 25 bp, Rattus norvegicus
gcaccaagccatgcgggcagctgga

SEQ ID NO: 379642 - DNA, 25 bp, Rattus norvegicus
gcaccaagcccgaggcgcgcagtgt

SEQ ID NO: 379643 - DNA, 25 bp, Rattus norvegicus
gcaccaagcccgtggcgcgcagtgt

SEQ ID NO: 379644 - DNA, 25 bp, Rattus norvegicus
gcaccaagctcgatgatgacttcaa

SEQ ID NO: 379645 - DNA, 25 bp, Rattus norvegicus
gcaccaagctcgttgatgacttcaa

SEQ ID NO: 379646 - DNA, 25 bp, Rattus norvegicus
gcaccaaggcccacagaaatgcttt

SEQ ID NO: 379647 - DNA, 25 bp, Rattus norvegicus
gcaccaaggccctcagaaatgcttt

SEQ ID NO: 379648 - DNA, 25 bp, Rattus norvegicus
gcaccaagtgcaatggtttccacgg

SEQ ID NO: 379649 - DNA, 25 bp, Rattus norvegicus
gcaccaagtgcattggtttccacgg

SEQ ID NO: 379650 - DNA, 25 bp, Rattus norvegicus
gcaccaatctaacaaacttccattt

SEQ ID NO: 379651 - DNA, 25 bp, Rattus norvegicus
gcaccaatctaagaaacttccattt

SEQ ID NO: 379652 - DNA, 25 bp, Rattus norvegicus
gcaccaatgcatagagcgctgccat

SEQ ID NO: 379653 - DNA, 25 bp, Rattus norvegicus
gcaccaatgcattgagcgctgccat

SEQ ID NO: 379654 - DNA, 25 bp, Rattus norvegicus
gcaccaatgctgctttcagacatta

SEQ ID NO: 379655 - DNA, 25 bp, Rattus norvegicus
gcaccaatgctggtttcagacatta

SEQ ID NO: 379656 - DNA, 25 bp, Rattus norvegicus
gcaccaatgggtaccccgagcggga

SEQ ID NO: 379657 - DNA, 25 bp, Rattus norvegicus
gcaccaatgggttccccgagcggga

SEQ ID NO: 379658 - DNA, 25 bp, Rattus norvegicus
gcaccaatgtgcactacgaactggc

SEQ ID NO: 379659 - DNA, 25 bp, Rattus norvegicus
gcaccaatgtgctctacgaactggc

SEQ ID NO: 379660 - DNA, 25 bp, Rattus norvegicus
gcaccaatgtgtccctgtgaactaa

SEQ ID NO: 379661 - DNA, 25 bp, Rattus norvegicus
gcaccaatgtgtgcctgtgaactaa

SEQ ID NO: 379662 - DNA, 25 bp, Rattus norvegicus
gcaccaattgggacaggcttcgaca

SEQ ID NO: 379663 - DNA, 25 bp, Rattus norvegicus
gcaccaattgggtcaggcttcgaca

SEQ ID NO: 379664 - DNA, 25 bp, Rattus norvegicus
gcaccacaaaggctgctgacgaata

SEQ ID NO: 379665 - DNA, 25 bp, Rattus norvegicus
gcaccacaaagggtgctgacgaata

SEQ ID NO: 379666 - DNA, 25 bp, Rattus norvegicus
gcaccacaatttagagccactgact

SEQ ID NO: 379667 - DNA, 25 bp, Rattus norvegicus
gcaccacaattttgagccactgact

SEQ ID NO: 379668 - DNA, 25 bp, Rattus norvegicus
gcaccacaccacatcatgtattttt

SEQ ID NO: 379669 - DNA, 25 bp, Rattus norvegicus
gcaccacaccacttcatgtattttt

SEQ ID NO: 379670 - DNA, 25 bp, Rattus norvegicus
gcaccacactcaagtcttacagaag

SEQ ID NO: 379671 - DNA, 25 bp, Rattus norvegicus
gcaccacactcatgtcttacagaag

SEQ ID NO: 379672 - DNA, 25 bp, Rattus norvegicus
gcaccacactttctacaatgagctg

SEQ ID NO: 379673 - DNA, 25 bp, Rattus norvegicus
gcaccacactttgtacaatgagctg

SEQ ID NO: 379674 - DNA, 25 bp, Rattus norvegicus
gcaccacaggaacctacgtcaaaaa

SEQ ID NO: 379675 - DNA, 25 bp, Rattus norvegicus
gcaccacaggaagctacgtcaaaaa

SEQ ID NO: 379676 - DNA, 25 bp, Rattus norvegicus
gcaccacagtctcccaagataaaga

SEQ ID NO: 379677 - DNA, 25 bp, Rattus norvegicus
gcaccacagtctgccaagataaaga

SEQ ID NO: 379678 - DNA, 25 bp, Rattus norvegicus
gcaccacagtggcatggcttagtca

SEQ ID NO: 379679 - DNA, 25 bp, Rattus norvegicus
gcaccacagtgggatggcttagtca

SEQ ID NO: 379680 - DNA, 25 bp, Rattus norvegicus
gcaccacattagcagaaggcatttt

SEQ ID NO: 379681 - DNA, 25 bp, Rattus norvegicus
gcaccacattaggagaaggcatttt

SEQ ID NO: 379682 - DNA, 25 bp, Rattus norvegicus
gcaccaccactcatgctggtaaagt

SEQ ID NO: 379683 - DNA, 25 bp, Rattus norvegicus
gcaccaccactcttgctggtaaagt

SEQ ID NO: 379684 - DNA, 25 bp, Rattus norvegicus
gcaccaccgaagaaacactcagaga

SEQ ID NO: 379685 - DNA, 25 bp, Rattus norvegicus
gcaccaccgaagtaacactcagaga

SEQ ID NO: 379686 - DNA, 25 bp, Rattus norvegicus
gcaccaccttcgacagggaggatga

SEQ ID NO: 379687 - DNA, 25 bp, Rattus norvegicus
gcaccaccttcgtcagggaggatga

SEQ ID NO: 379688 - DNA, 25 bp, Rattus norvegicus
gcaccacgcagacagaggcttcagg

SEQ ID NO: 379689 - DNA, 25 bp, Rattus norvegicus
gcaccacgcagagagaggcttcagg

SEQ ID NO: 379690 - DNA, 25 bp, Rattus norvegicus
gcaccacggtggaagtcgctcagga

SEQ ID NO: 379691 - DNA, 25 bp, Rattus norvegicus
gcaccacggtggtagtcgctcagga

SEQ ID NO: 379692 - DNA, 25 bp, Rattus norvegicus
gcaccacgtgcccaacatggtggct

SEQ ID NO: 379693 - DNA, 25 bp, Rattus norvegicus
gcaccacgtgccgaacatggtggct

SEQ ID NO: 379694 - DNA, 25 bp, Rattus norvegicus
gcaccactcggaaaccaaggactat

SEQ ID NO: 379695 - DNA, 25 bp, Rattus norvegicus
gcaccactcggataccaaggactat

SEQ ID NO: 379696 - DNA, 25 bp, Rattus norvegicus
gcaccactcgtcatctggaggaaac

SEQ ID NO: 379697 - DNA, 25 bp, Rattus norvegicus
gcaccactcgtcttctggaggaaac

SEQ ID NO: 379698 - DNA, 25 bp, Rattus norvegicus
gcaccactggaccaattacctttga

SEQ ID NO: 379699 - DNA, 25 bp, Rattus norvegicus
gcaccactggacgaattacctttga

SEQ ID NO: 379700 - DNA, 25 bp, Rattus norvegicus
gcaccactggctcttgttagtctaa

SEQ ID NO: 379701 - DNA, 25 bp, Rattus norvegicus
gcaccactggctgttgttagtctaa

SEQ ID NO: 379702 - DNA, 25 bp, Rattus norvegicus
gcaccactgtctactttgtgaacac

SEQ ID NO: 379703 - DNA, 25 bp, Rattus norvegicus
gcaccactgtcttctttgtgaacac

SEQ ID NO: 379704 - DNA, 25 bp, Rattus norvegicus
gcaccagaagacctatgccttcagt

SEQ ID NO: 379705 - DNA, 25 bp, Rattus norvegicus
gcaccagaagacgtatgccttcagt

SEQ ID NO: 379706 - DNA, 25 bp, Rattus norvegicus
gcaccagaatgcatcaacttccgga

SEQ ID NO: 379707 - DNA, 25 bp, Rattus norvegicus
gcaccagaatgcttcaacttccgga

SEQ ID NO: 379708 - DNA, 25 bp, Rattus norvegicus
gcaccagacactaccgtgggaacga

SEQ ID NO: 379709 - DNA, 25 bp, Rattus norvegicus
gcaccagacacttccgtgggaacga

SEQ ID NO: 379710 - DNA, 25 bp, Rattus norvegicus
gcaccagaccatctttacacaagat

SEQ ID NO: 379711 - DNA, 25 bp, Rattus norvegicus
gcaccagaccatgtttacacaagat

SEQ ID NO: 379712 - DNA, 25 bp, Rattus norvegicus
gcaccagaggatccatgtttctttt

SEQ ID NO: 379713 - DNA, 25 bp, Rattus norvegicus
gcaccagaggatgcatgtttctttt

SEQ ID NO: 379714 - DNA, 25 bp, Rattus norvegicus
gcaccagagttcaacccacaaggaa

SEQ ID NO: 379715 - DNA, 25 bp, Rattus norvegicus
gcaccagagttctacccacaaggaa

SEQ ID NO: 379716 - DNA, 25 bp, Rattus norvegicus
gcaccagcctgcagtttgatgacat

SEQ ID NO: 379717 - DNA, 25 bp, Rattus norvegicus
gcaccagcctgctgtttgatgacat

SEQ ID NO: 379718 - DNA, 25 bp, Rattus norvegicus
gcaccagctacaagttacccaagga

SEQ ID NO: 379719 - DNA, 25 bp, Rattus norvegicus
gcaccagctacatgttacccaagga

SEQ ID NO: 379720 - DNA, 25 bp, Rattus norvegicus
gcaccagctgcgagggcggcgcggc

SEQ ID NO: 379721 - DNA, 25 bp, Rattus norvegicus
gcaccagctgcgtgggcggcgcggc

SEQ ID NO: 379722 - DNA, 25 bp, Rattus norvegicus
gcaccagcttgtccagagcttgtgc

SEQ ID NO: 379723 - DNA, 25 bp, Rattus norvegicus
gcaccagcttgtcggagattcaggc

SEQ ID NO: 379724 - DNA, 25 bp, Rattus norvegicus
gcaccagcttgtgcagagcttgtgc

SEQ ID NO: 379725 - DNA, 25 bp, Rattus norvegicus
gcaccagcttgtgggagattcaggc

SEQ ID NO: 379726 - DNA, 25 bp, Rattus norvegicus
gcaccaggaagaacaggaccccatt

SEQ ID NO: 379727 - DNA, 25 bp, Rattus norvegicus
gcaccaggaagatcaggaccccatt

SEQ ID NO: 379728 - DNA, 25 bp, Rattus norvegicus
gcaccaggaccaccgatcacagatg

SEQ ID NO: 379729 - DNA, 25 bp, Rattus norvegicus
gcaccaggaccagcgatcacagatg

SEQ ID NO: 379730 - DNA, 25 bp, Rattus norvegicus
gcaccaggagtacctcaacagcatt

SEQ ID NO: 379731 - DNA, 25 bp, Rattus norvegicus
gcaccaggagtagctcaacagcatt

SEQ ID NO: 379732 - DNA, 25 bp, Rattus norvegicus
gcaccaggcacacacgatatatgaa

SEQ ID NO: 379733 - DNA, 25 bp, Rattus norvegicus
gcaccaggcacagacgatatatgaa

SEQ ID NO: 379734 - DNA, 25 bp, Rattus norvegicus
gcaccaggcacgcatgttaagatat

SEQ ID NO: 379735 - DNA, 25 bp, Rattus norvegicus
gcaccaggcacggatgttaagatat

SEQ ID NO: 379736 - DNA, 25 bp, Rattus norvegicus
gcaccaggcgtgattatctaaatac

SEQ ID NO: 379737 - DNA, 25 bp, Rattus norvegicus
gcaccaggcgtgtttatctaaatac

SEQ ID NO: 379738 - DNA, 25 bp, Rattus norvegicus
gcaccaggctttcctcacttaaaaa

SEQ ID NO: 379739 - DNA, 25 bp, Rattus norvegicus
gcaccaggctttgctcacttaaaaa

SEQ ID NO: 379740 - DNA, 25 bp, Rattus norvegicus
gcaccagggcctccaggaaaagctg

SEQ ID NO: 379741 - DNA, 25 bp, Rattus norvegicus
gcaccagggcctgcaggaaaagctg

SEQ ID NO: 379742 - DNA, 25 bp, Rattus norvegicus
gcaccagggtgcaagtttcgaacag

SEQ ID NO: 379743 - DNA, 25 bp, Rattus norvegicus
gcaccagggtgctagtttcgaacag

SEQ ID NO: 379744 - DNA, 25 bp, Rattus norvegicus
gcaccaggtccacagtactgagatt

SEQ ID NO: 379745 - DNA, 25 bp, Rattus norvegicus
gcaccaggtccagagtactgagatt

SEQ ID NO: 379746 - DNA, 25 bp, Rattus norvegicus
gcaccagtccaccttattttatgag

SEQ ID NO: 379747 - DNA, 25 bp, Rattus norvegicus
gcaccagtccacgttattttatgag

SEQ ID NO: 379748 - DNA, 25 bp, Rattus norvegicus
gcaccagtcgctcgaagaccagcaa

SEQ ID NO: 379749 - DNA, 25 bp, Rattus norvegicus
gcaccagtcgctggaagaccagcaa

SEQ ID NO: 379750 - DNA, 25 bp, Rattus norvegicus
gcaccagtctgactgaaggcacgga

SEQ ID NO: 379751 - DNA, 25 bp, Rattus norvegicus
gcaccagtctgagtgaaggcacgga

SEQ ID NO: 379752 - DNA, 25 bp, Rattus norvegicus
gcaccagtgatgcagtccagctcaa

SEQ ID NO: 379753 - DNA, 25 bp, Rattus norvegicus
gcaccagtgatggagtccagctcaa

SEQ ID NO: 379754 - DNA, 25 bp, Rattus norvegicus
gcaccagtgcaccagtaggcaggca

SEQ ID NO: 379755 - DNA, 25 bp, Rattus norvegicus
gcaccagtgcacgagtaggcaggca

SEQ ID NO: 379756 - DNA, 25 bp, Rattus norvegicus
gcaccagtggtacaactgccaggta

SEQ ID NO: 379757 - DNA, 25 bp, Rattus norvegicus
gcaccagtggtagaactgccaggta

SEQ ID NO: 379758 - DNA, 25 bp, Rattus norvegicus
gcaccagtgtgtactgcaggtctgt

SEQ ID NO: 379759 - DNA, 25 bp, Rattus norvegicus
gcaccagtgtgttctgcaggtctgt

SEQ ID NO: 379760 - DNA, 25 bp, Rattus norvegicus
gcaccagttacaattttacaaagaa

SEQ ID NO: 379761 - DNA, 25 bp, Rattus norvegicus
gcaccagttacatttttacaaagaa

SEQ ID NO: 379762 - DNA, 25 bp, Rattus norvegicus
gcaccagttggaaacacatctctgt

SEQ ID NO: 379763 - DNA, 25 bp, Rattus norvegicus
gcaccagttggatacacatctctgt

SEQ ID NO: 379764 - DNA, 25 bp, Rattus norvegicus
gcaccagttttaccatccaaagctt

SEQ ID NO: 379765 - DNA, 25 bp, Rattus norvegicus
gcaccagttttagcatccaaagctt

SEQ ID NO: 379766 - DNA, 25 bp, Rattus norvegicus
gcaccataactgacggcgtgtacga

SEQ ID NO: 379767 - DNA, 25 bp, Rattus norvegicus
gcaccataactgtcggcgtgtacga

SEQ ID NO: 379768 - DNA, 25 bp, Rattus norvegicus
gcaccataggttaaagataatcaag

SEQ ID NO: 379769 - DNA, 25 bp, Rattus norvegicus
gcaccataggtttaagataatcaag

SEQ ID NO: 379770 - DNA, 25 bp, Rattus norvegicus
gcaccatattaaaagcccagctctt

SEQ ID NO: 379771 - DNA, 25 bp, Rattus norvegicus
gcaccatattaatagcccagctctt

SEQ ID NO: 379772 - DNA, 25 bp, Rattus norvegicus
gcaccatcacccctgagaaatatgt

SEQ ID NO: 379773 - DNA, 25 bp, Rattus norvegicus
gcaccatcacccgtgagaaatatgt

SEQ ID NO: 379774 - DNA, 25 bp, Rattus norvegicus
gcaccatcatccataattttgtctc

SEQ ID NO: 379775 - DNA, 25 bp, Rattus norvegicus
gcaccatcatccttaattttgtctc

SEQ ID NO: 379776 - DNA, 25 bp, Rattus norvegicus
gcaccatcccagatgacaactgctg

SEQ ID NO: 379777 - DNA, 25 bp, Rattus norvegicus
gcaccatcccagttgacaactgctg

SEQ ID NO: 379778 - DNA, 25 bp, Rattus norvegicus
gcaccatccggaacgtcacagtggg

SEQ ID NO: 379779 - DNA, 25 bp, Rattus norvegicus
gcaccatccggatcgtcacagtggg

SEQ ID NO: 379780 - DNA, 25 bp, Rattus norvegicus
gcaccatccttaaggctcctgacat

SEQ ID NO: 379781 - DNA, 25 bp, Rattus norvegicus
gcaccatccttatggctcctgacat

SEQ ID NO: 379782 - DNA, 25 bp, Rattus norvegicus
gcaccatctaccagtggagctggag

SEQ ID NO: 379783 - DNA, 25 bp, Rattus norvegicus
gcaccatctacctgtggagctggag

SEQ ID NO: 379784 - DNA, 25 bp, Rattus norvegicus
gcaccatctctaagcccattttata

SEQ ID NO: 379785 - DNA, 25 bp, Rattus norvegicus
gcaccatctctatgcccattttata

SEQ ID NO: 379786 - DNA, 25 bp, Rattus norvegicus
gcaccatctctgacattattttacc

SEQ ID NO: 379787 - DNA, 25 bp, Rattus norvegicus
gcaccatctctgcaggctttggata

SEQ ID NO: 379788 - DNA, 25 bp, Rattus norvegicus
gcaccatctctggaggctttggata

SEQ ID NO: 379789 - DNA, 25 bp, Rattus norvegicus
gcaccatctctgtcattattttacc

SEQ ID NO: 379790 - DNA, 25 bp, Rattus norvegicus
gcaccatctgagaagccgtcacgat

SEQ ID NO: 379791 - DNA, 25 bp, Rattus norvegicus
gcaccatctgagtagccgtcacgat

SEQ ID NO: 379792 - DNA, 25 bp, Rattus norvegicus
gcaccatgaagcaggagttggccca

SEQ ID NO: 379793 - DNA, 25 bp, Rattus norvegicus
gcaccatgaagctggagttggccca

SEQ ID NO: 379794 - DNA, 25 bp, Rattus norvegicus
gcaccatgctgtagggaaataggca

SEQ ID NO: 379795 - DNA, 25 bp, Rattus norvegicus
gcaccatgctgttgggaaataggca

SEQ ID NO: 379796 - DNA, 25 bp, Rattus norvegicus
gcaccatgcttgatgaagcacttgt

SEQ ID NO: 379797 - DNA, 25 bp, Rattus norvegicus
gcaccatgcttgttgaagcacttgt

SEQ ID NO: 379798 - DNA, 25 bp, Rattus norvegicus
gcaccatggatgctggagccatcaa

SEQ ID NO: 379799 - DNA, 25 bp, Rattus norvegicus
gcaccatggatggtggagccatcaa

SEQ ID NO: 379800 - DNA, 25 bp, Rattus norvegicus
gcaccatggccccaaatgcagaaaa

SEQ ID NO: 379801 - DNA, 25 bp, Rattus norvegicus
gcaccatggcccgaaatgcagaaaa

SEQ ID NO: 379802 - DNA, 25 bp, Rattus norvegicus
gcaccatggctgatcagctgactga

SEQ ID NO: 379803 - DNA, 25 bp, Rattus norvegicus
gcaccatggctgttcagctgactga

SEQ ID NO: 379804 - DNA, 25 bp, Rattus norvegicus
gcaccatgggtcattgctcacgaaa

SEQ ID NO: 379805 - DNA, 25 bp, Rattus norvegicus
gcaccatgggtctttgctcacgaaa

SEQ ID NO: 379806 - DNA, 25 bp, Rattus norvegicus
gcaccatgtagaaggctcaagccct

SEQ ID NO: 379807 - DNA, 25 bp, Rattus norvegicus
gcaccatgtagatggctcaagccct

SEQ ID NO: 379808 - DNA, 25 bp, Rattus norvegicus
gcaccatgtctgctggctgtgcaca

SEQ ID NO: 379809 - DNA, 25 bp, Rattus norvegicus
gcaccatgtctggtggctgtgcaca

SEQ ID NO: 379810 - DNA, 25 bp, Rattus norvegicus
gcaccatgtgccataggatctgggt

SEQ ID NO: 379811 - DNA, 25 bp, Rattus norvegicus
gcaccatgtgccttaggatctgggt

SEQ ID NO: 379812 - DNA, 25 bp, Rattus norvegicus
gcaccatgttgcaagcaggagcctt

SEQ ID NO: 379813 - DNA, 25 bp, Rattus norvegicus
gcaccatgttgctagcaggagcctt

SEQ ID NO: 379814 - DNA, 25 bp, Rattus norvegicus
gcaccattaactcctctagagccta

SEQ ID NO: 379815 - DNA, 25 bp, Rattus norvegicus
gcaccattaactgctctagagccta

SEQ ID NO: 379816 - DNA, 25 bp, Rattus norvegicus
gcaccattccttaagccagatgcaa

SEQ ID NO: 379817 - DNA, 25 bp, Rattus norvegicus
gcaccattcctttagccagatgcaa

SEQ ID NO: 379818 - DNA, 25 bp, Rattus norvegicus
gcaccattcgcaacctcaaagagag

SEQ ID NO: 379819 - DNA, 25 bp, Rattus norvegicus
gcaccattcgcatcctcaaagagag

SEQ ID NO: 379820 - DNA, 25 bp, Rattus norvegicus
gcaccatttataaagtactaggcac

SEQ ID NO: 379821 - DNA, 25 bp, Rattus norvegicus
gcaccatttatatagtactaggcac

SEQ ID NO: 379822 - DNA, 25 bp, Rattus norvegicus
gcaccatttgatccagtgtgactta

SEQ ID NO: 379823 - DNA, 25 bp, Rattus norvegicus
gcaccatttgatgcagtgtgactta

SEQ ID NO: 379824 - DNA, 25 bp, Rattus norvegicus
gcaccatttgctatttacaatcaga

SEQ ID NO: 379825 - DNA, 25 bp, Rattus norvegicus
gcaccatttgctttttacaatcaga

SEQ ID NO: 379826 - DNA, 25 bp, Rattus norvegicus
gcacccaaactgacatttcctgatt

SEQ ID NO: 379827 - DNA, 25 bp, Rattus norvegicus
gcacccaaactgtcatttcctgatt

SEQ ID NO: 379828 - DNA, 25 bp, Rattus norvegicus
gcacccaaggtgcatcactaatgag

SEQ ID NO: 379829 - DNA, 25 bp, Rattus norvegicus
gcacccaaggtggatcactaatgag

SEQ ID NO: 379830 - DNA, 25 bp, Rattus norvegicus
gcacccaatgttcaaccagactttt

SEQ ID NO: 379831 - DNA, 25 bp, Rattus norvegicus
gcacccaatgttgaaccagactttt

SEQ ID NO: 379832 - DNA, 25 bp, Rattus norvegicus
gcacccacatcactgtatgaagcca

SEQ ID NO: 379833 - DNA, 25 bp, Rattus norvegicus
gcacccacatcagtgtatgaagcca

SEQ ID NO: 379834 - DNA, 25 bp, Rattus norvegicus
gcacccacccaccatatatatatat

SEQ ID NO: 379835 - DNA, 25 bp, Rattus norvegicus
gcacccacccacgatatatatatat

SEQ ID NO: 379836 - DNA, 25 bp, Rattus norvegicus
gcacccacgtcaaacggtttcaaat

SEQ ID NO: 379837 - DNA, 25 bp, Rattus norvegicus
gcacccacgtcatacggtttcaaat

SEQ ID NO: 379838 - DNA, 25 bp, Rattus norvegicus
gcacccacgtggacgttaactatga

SEQ ID NO: 379839 - DNA, 25 bp, Rattus norvegicus
gcacccacgtggtcgttaactatga

SEQ ID NO: 379840 - DNA, 25 bp, Rattus norvegicus
gcacccacgttcacagatagacatt

SEQ ID NO: 379841 - DNA, 25 bp, Rattus norvegicus
gcacccacgttctcagatagacatt

SEQ ID NO: 379842 - DNA, 25 bp, Rattus norvegicus
gcacccactgggagatgcgctgaaa

SEQ ID NO: 379843 - DNA, 25 bp, Rattus norvegicus
gcacccactgggtgatgcgctgaaa

SEQ ID NO: 379844 - DNA, 25 bp, Rattus norvegicus
gcacccacttaaataacacagctca

SEQ ID NO: 379845 - DNA, 25 bp, Rattus norvegicus
gcacccacttaattaacacagctca

SEQ ID NO: 379846 - DNA, 25 bp, Rattus norvegicus
gcacccacttttatgtaacagcctt

SEQ ID NO: 379847 - DNA, 25 bp, Rattus norvegicus
gcacccacttttttgtaacagcctt

SEQ ID NO: 379848 - DNA, 25 bp, Rattus norvegicus
gcacccagatccagcagacattaag

SEQ ID NO: 379849 - DNA, 25 bp, Rattus norvegicus
gcacccagatcctgcagacattaag

SEQ ID NO: 379850 - DNA, 25 bp, Rattus norvegicus
gcacccagcagtataagcccaatga

SEQ ID NO: 379851 - DNA, 25 bp, Rattus norvegicus
gcacccagcagtttaagcccaatga

SEQ ID NO: 379852 - DNA, 25 bp, Rattus norvegicus
gcacccagctctcttctaagaatat

SEQ ID NO: 379853 - DNA, 25 bp, Rattus norvegicus
gcacccagctctgttctaagaatat

SEQ ID NO: 379854 - DNA, 25 bp, Rattus norvegicus
gcacccaggcccaatctggtaggaa

SEQ ID NO: 379855 - DNA, 25 bp, Rattus norvegicus
gcacccaggccctatctggtaggaa

SEQ ID NO: 379856 - DNA, 25 bp, Rattus norvegicus
gcacccagtgcaaatcatgacagac

SEQ ID NO: 379857 - DNA, 25 bp, Rattus norvegicus
gcacccagtgcatatcatgacagac

SEQ ID NO: 379858 - DNA, 25 bp, Rattus norvegicus
gcacccagtttacttagagccagat

SEQ ID NO: 379859 - DNA, 25 bp, Rattus norvegicus
gcacccagtttagttagagccagat

SEQ ID NO: 379860 - DNA, 25 bp, Rattus norvegicus
gcacccatactaattgcctaggatg

SEQ ID NO: 379861 - DNA, 25 bp, Rattus norvegicus
gcacccatactatttgcctaggatg

SEQ ID NO: 379862 - DNA, 25 bp, Rattus norvegicus
gcacccatcgtcactgccgagaaag

SEQ ID NO: 379863 - DNA, 25 bp, Rattus norvegicus
gcacccatcgtctctgccgagaaag

SEQ ID NO: 379864 - DNA, 25 bp, Rattus norvegicus
gcacccatgatgcagggcctaccag

SEQ ID NO: 379865 - DNA, 25 bp, Rattus norvegicus
gcacccatgatggagggcctaccag

SEQ ID NO: 379866 - DNA, 25 bp, Rattus norvegicus
gcacccatgcacatttacaaaacaa

SEQ ID NO: 379867 - DNA, 25 bp, Rattus norvegicus
gcacccatgcacttttacaaaacaa

SEQ ID NO: 379868 - DNA, 25 bp, Rattus norvegicus
gcacccattgtaaaaagatgtccct

SEQ ID NO: 379869 - DNA, 25 bp, Rattus norvegicus
gcacccattgtataaagatgtccct

SEQ ID NO: 379870 - DNA, 25 bp, Rattus norvegicus
gcacccatttctaattggcatcatc

SEQ ID NO: 379871 - DNA, 25 bp, Rattus norvegicus
gcacccatttcttattggcatcatc

SEQ ID NO: 379872 - DNA, 25 bp, Rattus norvegicus
gcacccattttgaactaataggtca

SEQ ID NO: 379873 - DNA, 25 bp, Rattus norvegicus
gcacccattttgtactaataggtca

SEQ ID NO: 379874 - DNA, 25 bp, Rattus norvegicus
gcacccatttttcccttgtatagta

SEQ ID NO: 379875 - DNA, 25 bp, Rattus norvegicus
gcacccatttttgccttgtatagta

SEQ ID NO: 379876 - DNA, 25 bp, Rattus norvegicus
gcaccccagagccacttaacttagt

SEQ ID NO: 379877 - DNA, 25 bp, Rattus norvegicus
gcaccccagagcgacttaacttagt

SEQ ID NO: 379878 - DNA, 25 bp, Rattus norvegicus
gcaccccagaggcagaaggatttct

SEQ ID NO: 379879 - DNA, 25 bp, Rattus norvegicus
gcaccccagagggagaaggatttct

SEQ ID NO: 379880 - DNA, 25 bp, Rattus norvegicus
gcaccccagcaaaagcaaggattat

SEQ ID NO: 379881 - DNA, 25 bp, Rattus norvegicus
gcaccccagcaatagcaaggattat

SEQ ID NO: 379882 - DNA, 25 bp, Rattus norvegicus
gcaccccagcagcaagattactaat

SEQ ID NO: 379883 - DNA, 25 bp, Rattus norvegicus
gcaccccagcaggaagattactaat

SEQ ID NO: 379884 - DNA, 25 bp, Rattus norvegicus
gcaccccagggactcaacagctggt

SEQ ID NO: 379885 - DNA, 25 bp, Rattus norvegicus
gcaccccagggagtcaacagctggt

SEQ ID NO: 379886 - DNA, 25 bp, Rattus norvegicus
gcaccccagtggacgacttagacag

SEQ ID NO: 379887 - DNA, 25 bp, Rattus norvegicus
gcaccccagtggtcgacttagacag

SEQ ID NO: 379888 - DNA, 25 bp, Rattus norvegicus
gcaccccagtttctatgctcgagaa

SEQ ID NO: 379889 - DNA, 25 bp, Rattus norvegicus
gcaccccagtttgtatgctcgagaa

SEQ ID NO: 379890 - DNA, 25 bp, Rattus norvegicus
gcaccccatcttagaagatttctgt

SEQ ID NO: 379891 - DNA, 25 bp, Rattus norvegicus
gcaccccatctttgaagatttctgt

SEQ ID NO: 379892 - DNA, 25 bp, Rattus norvegicus
gcaccccgattcactagctgagaag

SEQ ID NO: 379893 - DNA, 25 bp, Rattus norvegicus
gcaccccgattctctagctgagaag

SEQ ID NO: 379894 - DNA, 25 bp, Rattus norvegicus
gcaccccggatgcattgtgtggcat

SEQ ID NO: 379895 - DNA, 25 bp, Rattus norvegicus
gcaccccggatggattgtgtggcat

SEQ ID NO: 379896 - DNA, 25 bp, Rattus norvegicus
gcacccctccataaactaaagacag

SEQ ID NO: 379897 - DNA, 25 bp, Rattus norvegicus
gcacccctccattaactaaagacag

SEQ ID NO: 379898 - DNA, 25 bp, Rattus norvegicus
gcacccctctttcatgtactaaaat

SEQ ID NO: 379899 - DNA, 25 bp, Rattus norvegicus
gcacccctctttgatgtactaaaat

SEQ ID NO: 379900 - DNA, 25 bp, Rattus norvegicus
gcacccctgaagaggagtgaacaac

SEQ ID NO: 379901 - DNA, 25 bp, Rattus norvegicus
gcacccctgaagtggagtgaacaac

SEQ ID NO: 379902 - DNA, 25 bp, Rattus norvegicus
gcacccctgtttatgagctgaaagt

SEQ ID NO: 379903 - DNA, 25 bp, Rattus norvegicus
gcacccctgtttttgagctgaaagt

SEQ ID NO: 379904 - DNA, 25 bp, Rattus norvegicus
gcaccccttaatctcctaataaatg

SEQ ID NO: 379905 - DNA, 25 bp, Rattus norvegicus
gcaccccttaatgtcctaataaatg

SEQ ID NO: 379906 - DNA, 25 bp, Rattus norvegicus
gcacccgagtatagacaccaggctt

SEQ ID NO: 379907 - DNA, 25 bp, Rattus norvegicus
gcacccgagtattgacaccaggctt

SEQ ID NO: 379908 - DNA, 25 bp, Rattus norvegicus
gcacccgcaaggatccaaggcagat

SEQ ID NO: 379909 - DNA, 25 bp, Rattus norvegicus
gcacccgcaaggttccaaggcagat

SEQ ID NO: 379910 - DNA, 25 bp, Rattus norvegicus
gcacccgcagagaaggtcgagactc

SEQ ID NO: 379911 - DNA, 25 bp, Rattus norvegicus
gcacccgcagagtaggtcgagactc

SEQ ID NO: 379912 - DNA, 25 bp, Rattus norvegicus
gcacccgcggtgcacttcttttcag

SEQ ID NO: 379913 - DNA, 25 bp, Rattus norvegicus
gcacccgcggtggacttcttttcag

SEQ ID NO: 379914 - DNA, 25 bp, Rattus norvegicus
gcacccggcagtagtaggagactct

SEQ ID NO: 379915 - DNA, 25 bp, Rattus norvegicus
gcacccggcagttgtaggagactct

SEQ ID NO: 379916 - DNA, 25 bp, Rattus norvegicus
gcacccgggccactcaaggttttga

SEQ ID NO: 379917 - DNA, 25 bp, Rattus norvegicus
gcacccgggccagtcaaggttttga

SEQ ID NO: 379918 - DNA, 25 bp, Rattus norvegicus
gcacccggggtgacaccagcattga

SEQ ID NO: 379919 - DNA, 25 bp, Rattus norvegicus
gcacccggggtgtcaccagcattga

SEQ ID NO: 379920 - DNA, 25 bp, Rattus norvegicus
gcacccgggtaactgttgcgcactg

SEQ ID NO: 379921 - DNA, 25 bp, Rattus norvegicus
gcacccgggtaagtgttgcgcactg

SEQ ID NO: 379922 - DNA, 25 bp, Rattus norvegicus
gcacccgggtaccacatggctaaga

SEQ ID NO: 379923 - DNA, 25 bp, Rattus norvegicus
gcacccgggtacgacatggctaaga

SEQ ID NO: 379924 - DNA, 25 bp, Rattus norvegicus
gcacccgtgtttcttcttatggaac

SEQ ID NO: 379925 - DNA, 25 bp, Rattus norvegicus
gcacccgtgtttgttcttatggaac

SEQ ID NO: 379926 - DNA, 25 bp, Rattus norvegicus
gcaccctacggactcctattttatt

SEQ ID NO: 379927 - DNA, 25 bp, Rattus norvegicus
gcaccctacggagtcctattttatt

SEQ ID NO: 379928 - DNA, 25 bp, Rattus norvegicus
gcaccctaggcacactgagtttgag

SEQ ID NO: 379929 - DNA, 25 bp, Rattus norvegicus
gcaccctaggcagactgagtttgag

SEQ ID NO: 379930 - DNA, 25 bp, Rattus norvegicus
gcaccctatcttatcatgttgttca

SEQ ID NO: 379931 - DNA, 25 bp, Rattus norvegicus
gcaccctatcttttcatgttgttca

SEQ ID NO: 379932 - DNA, 25 bp, Rattus norvegicus
gcaccctatgaaacgatgtcgcatc

SEQ ID NO: 379933 - DNA, 25 bp, Rattus norvegicus
gcaccctatgaatcgatgtcgcatc

SEQ ID NO: 379934 - DNA, 25 bp, Rattus norvegicus
gcaccctcataactaatgctgtgaa

SEQ ID NO: 379935 - DNA, 25 bp, Rattus norvegicus
gcaccctcataagtaatgctgtgaa

SEQ ID NO: 379936 - DNA, 25 bp, Rattus norvegicus
gcaccctcctttcgctcataaaata

SEQ ID NO: 379937 - DNA, 25 bp, Rattus norvegicus
gcaccctcctttggctcataaaata

SEQ ID NO: 379938 - DNA, 25 bp, Rattus norvegicus
gcaccctctgcaattgggaacagga

SEQ ID NO: 379939 - DNA, 25 bp, Rattus norvegicus
gcaccctctgcatttgggaacagga

SEQ ID NO: 379940 - DNA, 25 bp, Rattus norvegicus
gcaccctgagcgcactgagacaatc

SEQ ID NO: 379941 - DNA, 25 bp, Rattus norvegicus
gcaccctgagcggactgagacaatc

SEQ ID NO: 379942 - DNA, 25 bp, Rattus norvegicus
gcaccctgcgatcgagctgagactt

SEQ ID NO: 379943 - DNA, 25 bp, Rattus norvegicus
gcaccctgcgatggagctgagactt

SEQ ID NO: 379944 - DNA, 25 bp, Rattus norvegicus
gcaccctgcgtaacactgtggagga

SEQ ID NO: 379945 - DNA, 25 bp, Rattus norvegicus
gcaccctgcgtatcactgtggagga

SEQ ID NO: 379946 - DNA, 25 bp, Rattus norvegicus
gcaccctggagaaagcaaaagccaa

SEQ ID NO: 379947 - DNA, 25 bp, Rattus norvegicus
gcaccctggagatagcaaaagccaa

SEQ ID NO: 379948 - DNA, 25 bp, Rattus norvegicus
gcaccctgggtgaggactccaccag

SEQ ID NO: 379949 - DNA, 25 bp, Rattus norvegicus
gcaccctgggtgtggactccaccag

SEQ ID NO: 379950 - DNA, 25 bp, Rattus norvegicus
gcaccctgtcgtctaatgtgtctaa

SEQ ID NO: 379951 - DNA, 25 bp, Rattus norvegicus
gcaccctgtcgtgtaatgtgtctaa

SEQ ID NO: 379952 - DNA, 25 bp, Rattus norvegicus
gcaccctgtcttactaattctgtag

SEQ ID NO: 379953 - DNA, 25 bp, Rattus norvegicus
gcaccctgtctttctaattctgtag

SEQ ID NO: 379954 - DNA, 25 bp, Rattus norvegicus
gcaccctgtgtacctaatgttcaag

SEQ ID NO: 379955 - DNA, 25 bp, Rattus norvegicus
gcaccctgtgtagctaatgttcaag

SEQ ID NO: 379956 - DNA, 25 bp, Rattus norvegicus
gcaccctgttttccagaccagagaa

SEQ ID NO: 379957 - DNA, 25 bp, Rattus norvegicus
gcaccctgttttgcagaccagagaa

SEQ ID NO: 379958 - DNA, 25 bp, Rattus norvegicus
gcacccttaagcactgactaacaaa

SEQ ID NO: 379959 - DNA, 25 bp, Rattus norvegicus
gcacccttaagctctgactaacaaa

SEQ ID NO: 379960 - DNA, 25 bp, Rattus norvegicus
gcacccttaatgcagacaggcctaa

SEQ ID NO: 379961 - DNA, 25 bp, Rattus norvegicus
gcacccttaatggagacaggcctaa

SEQ ID NO: 379962 - DNA, 25 bp, Rattus norvegicus
gcacccttagtcagctgtgatctaa

SEQ ID NO: 379963 - DNA, 25 bp, Rattus norvegicus
gcacccttagtctgctgtgatctaa

SEQ ID NO: 379964 - DNA, 25 bp, Rattus norvegicus
gcacccttagtgaacttctgttgtc

SEQ ID NO: 379965 - DNA, 25 bp, Rattus norvegicus
gcacccttagtgtacttctgttgtc

SEQ ID NO: 379966 - DNA, 25 bp, Rattus norvegicus
gcacccttccaccagtgaaatcaaa

SEQ ID NO: 379967 - DNA, 25 bp, Rattus norvegicus
gcacccttccacgagtgaaatcaaa

SEQ ID NO: 379968 - DNA, 25 bp, Rattus norvegicus
gcacccttgggaccatctggaaaga

SEQ ID NO: 379969 - DNA, 25 bp, Rattus norvegicus
gcacccttgggagcatctggaaaga

SEQ ID NO: 379970 - DNA, 25 bp, Rattus norvegicus
gcaccgacagagattgggcctatga

SEQ ID NO: 379971 - DNA, 25 bp, Rattus norvegicus
gcaccgacagagtttgggcctatga

SEQ ID NO: 379972 - DNA, 25 bp, Rattus norvegicus
gcaccgaccacaaaaatacctacta

SEQ ID NO: 379973 - DNA, 25 bp, Rattus norvegicus
gcaccgaccacataaatacctacta

SEQ ID NO: 379974 - DNA, 25 bp, Rattus norvegicus
gcaccgacctgaccataatctgcat

SEQ ID NO: 379975 - DNA, 25 bp, Rattus norvegicus
gcaccgacctgagcataatctgcat

SEQ ID NO: 379976 - DNA, 25 bp, Rattus norvegicus
gcaccgactgcactgtaagaggcct

SEQ ID NO: 379977 - DNA, 25 bp, Rattus norvegicus
gcaccgactgcagtgtaagaggcct

SEQ ID NO: 379978 - DNA, 25 bp, Rattus norvegicus
gcaccgactttaagagcaacctgag

SEQ ID NO: 379979 - DNA, 25 bp, Rattus norvegicus
gcaccgactttatgagcaacctgag

SEQ ID NO: 379980 - DNA, 25 bp, Rattus norvegicus
gcaccgagaacccacatggagtgaa

SEQ ID NO: 379981 - DNA, 25 bp, Rattus norvegicus
gcaccgagaaccgacatggagtgaa

SEQ ID NO: 379982 - DNA, 25 bp, Rattus norvegicus
gcaccgaggtctattagagcggcat

SEQ ID NO: 379983 - DNA, 25 bp, Rattus norvegicus
gcaccgaggtcttttagagcggcat

SEQ ID NO: 379984 - DNA, 25 bp, Rattus norvegicus
gcaccgagtggcagggcaaagccat

SEQ ID NO: 379985 - DNA, 25 bp, Rattus norvegicus
gcaccgagtggctgggcaaagccat

SEQ ID NO: 379986 - DNA, 25 bp, Rattus norvegicus
gcaccgagttgccaattgattcttg

SEQ ID NO: 379987 - DNA, 25 bp, Rattus norvegicus
gcaccgagttgcgaattgattcttg

SEQ ID NO: 379988 - DNA, 25 bp, Rattus norvegicus
gcaccgatgctccagagttcgtaga

SEQ ID NO: 379989 - DNA, 25 bp, Rattus norvegicus
gcaccgatgctcgagagttcgtaga

SEQ ID NO: 379990 - DNA, 25 bp, Rattus norvegicus
gcaccgcaaagcaccatgatctgga

SEQ ID NO: 379991 - DNA, 25 bp, Rattus norvegicus
gcaccgcaaagctccatgatctgga

SEQ ID NO: 379992 - DNA, 25 bp, Rattus norvegicus
gcaccgcactccaaacttatgaggt

SEQ ID NO: 379993 - DNA, 25 bp, Rattus norvegicus
gcaccgcactcctaacttatgaggt

SEQ ID NO: 379994 - DNA, 25 bp, Rattus norvegicus
gcaccgcagcgcctggaaagttgct

SEQ ID NO: 379995 - DNA, 25 bp, Rattus norvegicus
gcaccgcagcgcgtggaaagttgct

SEQ ID NO: 379996 - DNA, 25 bp, Rattus norvegicus
gcaccgcaggtgaaacttgatggag

SEQ ID NO: 379997 - DNA, 25 bp, Rattus norvegicus
gcaccgcaggtgtaacttgatggag

SEQ ID NO: 379998 - DNA, 25 bp, Rattus norvegicus
gcaccgcatcggctgcattgtggtg

SEQ ID NO: 379999 - DNA, 25 bp, Rattus norvegicus
gcaccgcatcgggtgcattgtggtg

SEQ ID NO: 380000 - DNA, 25 bp, Rattus norvegicus
gcaccgccatctagtcagtggaaaa

SEQ ID NO: 380001 - DNA, 25 bp, Rattus norvegicus
gcaccgccatcttgtcagtggaaaa

SEQ ID NO: 380002 - DNA, 25 bp, Rattus norvegicus
gcaccgcccaggctgaggatgcttc

SEQ ID NO: 380003 - DNA, 25 bp, Rattus norvegicus
gcaccgcccagggtgaggatgcttc

SEQ ID NO: 380004 - DNA, 25 bp, Rattus norvegicus
gcaccgcccgtccaggagctgaagt

SEQ ID NO: 380005 - DNA, 25 bp, Rattus norvegicus
gcaccgcccgtcgaggagctgaagt

SEQ ID NO: 380006 - DNA, 25 bp, Rattus norvegicus
gcaccgccgtatacatacgggcgag

SEQ ID NO: 380007 - DNA, 25 bp, Rattus norvegicus
gcaccgccgtattcatacgggcgag

SEQ ID NO: 380008 - DNA, 25 bp, Rattus norvegicus
gcaccgcctgctagaaatcgttcta

SEQ ID NO: 380009 - DNA, 25 bp, Rattus norvegicus
gcaccgcctgcttgaaatcgttcta

SEQ ID NO: 380010 - DNA, 25 bp, Rattus norvegicus
gcaccgcgggtgatctgtgtagaat

SEQ ID NO: 380011 - DNA, 25 bp, Rattus norvegicus
gcaccgcgggtgttctgtgtagaat

SEQ ID NO: 380012 - DNA, 25 bp, Rattus norvegicus
gcaccgctgctgacggaatctggaa

SEQ ID NO: 380013 - DNA, 25 bp, Rattus norvegicus
gcaccgctgctgtcggaatctggaa

SEQ ID NO: 380014 - DNA, 25 bp, Rattus norvegicus
gcaccgctttccagcatgtctggcg

SEQ ID NO: 380015 - DNA, 25 bp, Rattus norvegicus
gcaccgctttcctgcatgtctggcg

SEQ ID NO: 380016 - DNA, 25 bp, Rattus norvegicus
gcaccggaagcacaactcggcacaa

SEQ ID NO: 380017 - DNA, 25 bp, Rattus norvegicus
gcaccggaagcagaactcggcacaa

SEQ ID NO: 380018 - DNA, 25 bp, Rattus norvegicus
gcaccggaggacattaggccgtcgt

SEQ ID NO: 380019 - DNA, 25 bp, Rattus norvegicus
gcaccggaggactttaggccgtcgt

SEQ ID NO: 380020 - DNA, 25 bp, Rattus norvegicus
gcaccggatcctccaacagttaaaa

SEQ ID NO: 380021 - DNA, 25 bp, Rattus norvegicus
gcaccggatcctgcaacagttaaaa

SEQ ID NO: 380022 - DNA, 25 bp, Rattus norvegicus
gcaccggattagctggaaacctcct

SEQ ID NO: 380023 - DNA, 25 bp, Rattus norvegicus
gcaccggattaggtggaaacctcct

SEQ ID NO: 380024 - DNA, 25 bp, Rattus norvegicus
gcaccggcagagcatcgcgcaaact

SEQ ID NO: 380025 - DNA, 25 bp, Rattus norvegicus
gcaccggcagaggatcgcgcaaact

SEQ ID NO: 380026 - DNA, 25 bp, Rattus norvegicus
gcaccggcatgccaaagcgtgtgtc

SEQ ID NO: 380027 - DNA, 25 bp, Rattus norvegicus
gcaccggcatgcgaaagcgtgtgtc

SEQ ID NO: 380028 - DNA, 25 bp, Rattus norvegicus
gcaccggcccatctgtatggcagta

SEQ ID NO: 380029 - DNA, 25 bp, Rattus norvegicus
gcaccggcccatgtgtatggcagta

SEQ ID NO: 380030 - DNA, 25 bp, Rattus norvegicus
gcaccggcctcaacgacattaaaag

SEQ ID NO: 380031 - DNA, 25 bp, Rattus norvegicus
gcaccggcctcatcgacattaaaag

SEQ ID NO: 380032 - DNA, 25 bp, Rattus norvegicus
gcaccggcgaagcacagcaggcatt

SEQ ID NO: 380033 - DNA, 25 bp, Rattus norvegicus
gcaccggcgaaggacagcaggcatt

SEQ ID NO: 380034 - DNA, 25 bp, Rattus norvegicus
gcaccggcgatccattcggcgaagt

SEQ ID NO: 380035 - DNA, 25 bp, Rattus norvegicus
gcaccggcgatcgattcggcgaagt

SEQ ID NO: 380036 - DNA, 25 bp, Rattus norvegicus
gcaccggctgagattgctcacctat

SEQ ID NO: 380037 - DNA, 25 bp, Rattus norvegicus
gcaccggctgagtttgctcacctat

SEQ ID NO: 380038 - DNA, 25 bp, Rattus norvegicus
gcaccggcttttactcaagactaat

SEQ ID NO: 380039 - DNA, 25 bp, Rattus norvegicus
gcaccggctttttctcaagactaat

SEQ ID NO: 380040 - DNA, 25 bp, Rattus norvegicus
gcaccgggattcctgcgttaatcaa

SEQ ID NO: 380041 - DNA, 25 bp, Rattus norvegicus
gcaccgggattcgtgcgttaatcaa

SEQ ID NO: 380042 - DNA, 25 bp, Rattus norvegicus
gcaccgggcactcaaggcaatgtca

SEQ ID NO: 380043 - DNA, 25 bp, Rattus norvegicus
gcaccgggcactgaaggcaatgtca

SEQ ID NO: 380044 - DNA, 25 bp, Rattus norvegicus
gcaccgggctgaagcaggtttaact

SEQ ID NO: 380045 - DNA, 25 bp, Rattus norvegicus
gcaccgggctgatgcaggtttaact

SEQ ID NO: 380046 - DNA, 25 bp, Rattus norvegicus
gcaccggtatttattgttaatcact

SEQ ID NO: 380047 - DNA, 25 bp, Rattus norvegicus
gcaccggtattttttgttaatcact

SEQ ID NO: 380048 - DNA, 25 bp, Rattus norvegicus
gcaccggtgacaaagccagctaatt

SEQ ID NO: 380049 - DNA, 25 bp, Rattus norvegicus
gcaccggtgacatagccagctaatt

SEQ ID NO: 380050 - DNA, 25 bp, Rattus norvegicus
gcaccggttcagatcttaagactac

SEQ ID NO: 380051 - DNA, 25 bp, Rattus norvegicus
gcaccggttcagttcttaagactac

SEQ ID NO: 380052 - DNA, 25 bp, Rattus norvegicus
gcaccggttcatacacaggattttc

SEQ ID NO: 380053 - DNA, 25 bp, Rattus norvegicus
gcaccggttcattcacaggattttc

SEQ ID NO: 380054 - DNA, 25 bp, Rattus norvegicus
gcaccgtagtgcaaacctgagtcgt

SEQ ID NO: 380055 - DNA, 25 bp, Rattus norvegicus
gcaccgtagtgctaacctgagtcgt

SEQ ID NO: 380056 - DNA, 25 bp, Rattus norvegicus
gcaccgtcaatgatggcctgggcca

SEQ ID NO: 380057 - DNA, 25 bp, Rattus norvegicus
gcaccgtcaatgttggcctgggcca

SEQ ID NO: 380058 - DNA, 25 bp, Rattus norvegicus
gcaccgtcagggagtgaatgtgtcc

SEQ ID NO: 380059 - DNA, 25 bp, Rattus norvegicus
gcaccgtcagggtgtgaatgtgtcc

SEQ ID NO: 380060 - DNA, 25 bp, Rattus norvegicus
gcaccgtccagtaatccagcgggag

SEQ ID NO: 380061 - DNA, 25 bp, Rattus norvegicus
gcaccgtccagttatccagcgggag

SEQ ID NO: 380062 - DNA, 25 bp, Rattus norvegicus
gcaccgtctgctatacaagggcaac

SEQ ID NO: 380063 - DNA, 25 bp, Rattus norvegicus
gcaccgtctgctttacaagggcaac

SEQ ID NO: 380064 - DNA, 25 bp, Rattus norvegicus
gcaccgtctgttccgcaagggaaac

SEQ ID NO: 380065 - DNA, 25 bp, Rattus norvegicus
gcaccgtctgttgcgcaagggaaac

SEQ ID NO: 380066 - DNA, 25 bp, Rattus norvegicus
gcaccgtgatccaggaggctggaaa

SEQ ID NO: 380067 - DNA, 25 bp, Rattus norvegicus
gcaccgtgatcctggaggctggaaa

SEQ ID NO: 380068 - DNA, 25 bp, Rattus norvegicus
gcaccgtggagaagcttggcgatca

SEQ ID NO: 380069 - DNA, 25 bp, Rattus norvegicus
gcaccgtggagatgcttggcgatca

SEQ ID NO: 380070 - DNA, 25 bp, Rattus norvegicus
gcaccgtgtacgagctggagaacga

SEQ ID NO: 380071 - DNA, 25 bp, Rattus norvegicus
gcaccgtgtacgtgctggagaacga

SEQ ID NO: 380072 - DNA, 25 bp, Rattus norvegicus
gcaccgttacagaaaagcctacaat

SEQ ID NO: 380073 - DNA, 25 bp, Rattus norvegicus
gcaccgttacagtaaagcctacaat

SEQ ID NO: 380074 - DNA, 25 bp, Rattus norvegicus
gcaccgtttcagattataaagtctc

SEQ ID NO: 380075 - DNA, 25 bp, Rattus norvegicus
gcaccgtttcagtttataaagtctc

SEQ ID NO: 380076 - DNA, 25 bp, Rattus norvegicus
gcacctaaaattagtcatttattac

SEQ ID NO: 380077 - DNA, 25 bp, Rattus norvegicus
gcacctaaaatttgtcatttattac

SEQ ID NO: 380078 - DNA, 25 bp, Rattus norvegicus
gcacctaaggcgcagttcatcttgc

SEQ ID NO: 380079 - DNA, 25 bp, Rattus norvegicus
gcacctaaggcggagttcatcttgc

SEQ ID NO: 380080 - DNA, 25 bp, Rattus norvegicus
gcacctacacagaggttcatcacca

SEQ ID NO: 380081 - DNA, 25 bp, Rattus norvegicus
gcacctacacagtggttcatcacca

SEQ ID NO: 380082 - DNA, 25 bp, Rattus norvegicus
gcacctacacatctgtggtacgcca

SEQ ID NO: 380083 - DNA, 25 bp, Rattus norvegicus
gcacctacacatgtgtggtacgcca

SEQ ID NO: 380084 - DNA, 25 bp, Rattus norvegicus
gcacctacactcatatgtactcttt

SEQ ID NO: 380085 - DNA, 25 bp, Rattus norvegicus
gcacctacactcttatgtactcttt

SEQ ID NO: 380086 - DNA, 25 bp, Rattus norvegicus
gcacctaccaacacttgtagcgggt

SEQ ID NO: 380087 - DNA, 25 bp, Rattus norvegicus
gcacctaccaactcttgtagcgggt

SEQ ID NO: 380088 - DNA, 25 bp, Rattus norvegicus
gcacctaccttacatccaaagcatg

SEQ ID NO: 380089 - DNA, 25 bp, Rattus norvegicus
gcacctaccttagatccaaagcatg

SEQ ID NO: 380090 - DNA, 25 bp, Rattus norvegicus
gcacctacggacactacttaacagt

SEQ ID NO: 380091 - DNA, 25 bp, Rattus norvegicus
gcacctacggactctacttaacagt

SEQ ID NO: 380092 - DNA, 25 bp, Rattus norvegicus
gcacctactgtcactaactcaggag

SEQ ID NO: 380093 - DNA, 25 bp, Rattus norvegicus
gcacctactgtctctaactcaggag

SEQ ID NO: 380094 - DNA, 25 bp, Rattus norvegicus
gcacctactgtgagctctgcagcaa

SEQ ID NO: 380095 - DNA, 25 bp, Rattus norvegicus
gcacctactgtgtgctctgcagcaa

SEQ ID NO: 380096 - DNA, 25 bp, Rattus norvegicus
gcacctagctggcttgctttactgg

SEQ ID NO: 380097 - DNA, 25 bp, Rattus norvegicus
gcacctagctgggttgctttactgg

SEQ ID NO: 380098 - DNA, 25 bp, Rattus norvegicus
gcacctagcttgattgtgtctgata

SEQ ID NO: 380099 - DNA, 25 bp, Rattus norvegicus
gcacctagcttgtttgtgtctgata

SEQ ID NO: 380100 - DNA, 25 bp, Rattus norvegicus
gcacctagtgtaagggaggcctcca

SEQ ID NO: 380101 - DNA, 25 bp, Rattus norvegicus
gcacctagtgtatgggaggcctcca

SEQ ID NO: 380102 - DNA, 25 bp, Rattus norvegicus
gcacctagtgtgacaggcctcagaa

SEQ ID NO: 380103 - DNA, 25 bp, Rattus norvegicus
gcacctagtgtgtcaggcctcagaa

SEQ ID NO: 380104 - DNA, 25 bp, Rattus norvegicus
gcacctatagctcccaaagttgggt

SEQ ID NO: 380105 - DNA, 25 bp, Rattus norvegicus
gcacctatagctgccaaagttgggt

SEQ ID NO: 380106 - DNA, 25 bp, Rattus norvegicus
gcacctatcctgaagagacttgatg

SEQ ID NO: 380107 - DNA, 25 bp, Rattus norvegicus
gcacctatcctgtagagacttgatg

SEQ ID NO: 380108 - DNA, 25 bp, Rattus norvegicus
gcacctatctctctgattctttcaa

SEQ ID NO: 380109 - DNA, 25 bp, Rattus norvegicus
gcacctatctctgtgattctttcaa

SEQ ID NO: 380110 - DNA, 25 bp, Rattus norvegicus
gcacctatgaggacagattcttcga

SEQ ID NO: 380111 - DNA, 25 bp, Rattus norvegicus
gcacctatgaggtcagattcttcga

SEQ ID NO: 380112 - DNA, 25 bp, Rattus norvegicus
gcacctatgcctccagagccaggaa

SEQ ID NO: 380113 - DNA, 25 bp, Rattus norvegicus
gcacctatgcctgcagagccaggaa

SEQ ID NO: 380114 - DNA, 25 bp, Rattus norvegicus
gcacctatgcgaatgcagctgaatt

SEQ ID NO: 380115 - DNA, 25 bp, Rattus norvegicus
gcacctatgcgattgcagctgaatt

SEQ ID NO: 380116 - DNA, 25 bp, Rattus norvegicus
gcacctatgggtctcagtattacct

SEQ ID NO: 380117 - DNA, 25 bp, Rattus norvegicus
gcacctatgggtgtcagtattacct

SEQ ID NO: 380118 - DNA, 25 bp, Rattus norvegicus
gcacctatgtctacccagagactga

SEQ ID NO: 380119 - DNA, 25 bp, Rattus norvegicus
gcacctatgtcttcccagagactga

SEQ ID NO: 380120 - DNA, 25 bp, Rattus norvegicus
gcacctatgtttctaggtacaagag

SEQ ID NO: 380121 - DNA, 25 bp, Rattus norvegicus
gcacctatgtttgtaggtacaagag

SEQ ID NO: 380122 - DNA, 25 bp, Rattus norvegicus
gcacctattgaccaggagccatcta

SEQ ID NO: 380123 - DNA, 25 bp, Rattus norvegicus
gcacctattgacgaggagccatcta

SEQ ID NO: 380124 - DNA, 25 bp, Rattus norvegicus
gcacctcacatcagggtcaagcagg

SEQ ID NO: 380125 - DNA, 25 bp, Rattus norvegicus
gcacctcacatctgggtcaagcagg

SEQ ID NO: 380126 - DNA, 25 bp, Rattus norvegicus
gcacctcacctgaatagtcgttctg

SEQ ID NO: 380127 - DNA, 25 bp, Rattus norvegicus
gcacctcacctgtatagtcgttctg

SEQ ID NO: 380128 - DNA, 25 bp, Rattus norvegicus
gcacctcagaggatgggcagaccat

SEQ ID NO: 380129 - DNA, 25 bp, Rattus norvegicus
gcacctcagaggttgggcagaccat

SEQ ID NO: 380130 - DNA, 25 bp, Rattus norvegicus
gcacctcagatcacctttagttttt

SEQ ID NO: 380131 - DNA, 25 bp, Rattus norvegicus
gcacctcagatctcctttagttttt

SEQ ID NO: 380132 - DNA, 25 bp, Rattus norvegicus
gcacctcagattctaggttcctgta

SEQ ID NO: 380133 - DNA, 25 bp, Rattus norvegicus
gcacctcagattgtaggttcctgta

SEQ ID NO: 380134 - DNA, 25 bp, Rattus norvegicus
gcacctcagtccataacttgtgatt

SEQ ID NO: 380135 - DNA, 25 bp, Rattus norvegicus
gcacctcagtccttaacttgtgatt

SEQ ID NO: 380136 - DNA, 25 bp, Rattus norvegicus
gcacctcatgttaacctagcttttg

SEQ ID NO: 380137 - DNA, 25 bp, Rattus norvegicus
gcacctcatgtttacctagcttttg

SEQ ID NO: 380138 - DNA, 25 bp, Rattus norvegicus
gcacctcccaaacagatagtcattt

SEQ ID NO: 380139 - DNA, 25 bp, Rattus norvegicus
gcacctcccaaagagatagtcattt

SEQ ID NO: 380140 - DNA, 25 bp, Rattus norvegicus
gcacctcccagccagttacagttgt

SEQ ID NO: 380141 - DNA, 25 bp, Rattus norvegicus
gcacctcccagcgagttacagttgt

SEQ ID NO: 380142 - DNA, 25 bp, Rattus norvegicus
gcacctccgaagcactttccagtaa

SEQ ID NO: 380143 - DNA, 25 bp, Rattus norvegicus
gcacctccgaaggactttccagtaa

SEQ ID NO: 380144 - DNA, 25 bp, Rattus norvegicus
gcacctccggagctggattgtccgt

SEQ ID NO: 380145 - DNA, 25 bp, Rattus norvegicus
gcacctccggaggtggattgtccgt

SEQ ID NO: 380146 - DNA, 25 bp, Rattus norvegicus
gcacctccgtttcttggttttgtat

SEQ ID NO: 380147 - DNA, 25 bp, Rattus norvegicus
gcacctccgtttgttggttttgtat

SEQ ID NO: 380148 - DNA, 25 bp, Rattus norvegicus
gcacctcctagcaccatgatattaa

SEQ ID NO: 380149 - DNA, 25 bp, Rattus norvegicus
gcacctcctagctccatgatattaa

SEQ ID NO: 380150 - DNA, 25 bp, Rattus norvegicus
gcacctcctatcaggctgacgagat

SEQ ID NO: 380151 - DNA, 25 bp, Rattus norvegicus
gcacctcctatctggctgacgagat

SEQ ID NO: 380152 - DNA, 25 bp, Rattus norvegicus
gcacctcctgtgctgttgtttaagg

SEQ ID NO: 380153 - DNA, 25 bp, Rattus norvegicus
gcacctcctgtggtgttgtttaagg

SEQ ID NO: 380154 - DNA, 25 bp, Rattus norvegicus
gcacctcgagtgaaaaagcctaaag

SEQ ID NO: 380155 - DNA, 25 bp, Rattus norvegicus
gcacctcgagtgtaaaagcctaaag

SEQ ID NO: 380156 - DNA, 25 bp, Rattus norvegicus
gcacctcgcggaaagcgcacagtgg

SEQ ID NO: 380157 - DNA, 25 bp, Rattus norvegicus
gcacctcgcggatagcgcacagtgg

SEQ ID NO: 380158 - DNA, 25 bp, Rattus norvegicus
gcacctcgggttacatctacaaatt

SEQ ID NO: 380159 - DNA, 25 bp, Rattus norvegicus
gcacctcgggtttcatctacaaatt

SEQ ID NO: 380160 - DNA, 25 bp, Rattus norvegicus
gcacctcgtgttcataccgttttgt

SEQ ID NO: 380161 - DNA, 25 bp, Rattus norvegicus
gcacctcgtgttgataccgttttgt

SEQ ID NO: 380162 - DNA, 25 bp, Rattus norvegicus
gcacctctgctgatctagaagtcga

SEQ ID NO: 380163 - DNA, 25 bp, Rattus norvegicus
gcacctctgctgttctagaagtcga

SEQ ID NO: 380164 - DNA, 25 bp, Rattus norvegicus
gcacctctgggaatgctgctggaga

SEQ ID NO: 380165 - DNA, 25 bp, Rattus norvegicus
gcacctctgggattgctgctggaga

SEQ ID NO: 380166 - DNA, 25 bp, Rattus norvegicus
gcacctctgtcaaacttaattctct

SEQ ID NO: 380167 - DNA, 25 bp, Rattus norvegicus
gcacctctgtcatacttaattctct

SEQ ID NO: 380168 - DNA, 25 bp, Rattus norvegicus
gcacctcttactcctgtaacttaaa

SEQ ID NO: 380169 - DNA, 25 bp, Rattus norvegicus
gcacctcttactgctgtaacttaaa

SEQ ID NO: 380170 - DNA, 25 bp, Rattus norvegicus
gcacctcttcataagtttccaatgg

SEQ ID NO: 380171 - DNA, 25 bp, Rattus norvegicus
gcacctcttcattagtttccaatgg

SEQ ID NO: 380172 - DNA, 25 bp, Rattus norvegicus
gcacctctttggagactgctcaagt

SEQ ID NO: 380173 - DNA, 25 bp, Rattus norvegicus
gcacctctttggtgactgctcaagt

SEQ ID NO: 380174 - DNA, 25 bp, Rattus norvegicus
gcacctctttttccatcaggtattg

SEQ ID NO: 380175 - DNA, 25 bp, Rattus norvegicus
gcacctctttttgcatcaggtattg

SEQ ID NO: 380176 - DNA, 25 bp, Rattus norvegicus
gcacctgacattagcttcacattgg

SEQ ID NO: 380177 - DNA, 25 bp, Rattus norvegicus
gcacctgacatttgcttcacattgg

SEQ ID NO: 380178 - DNA, 25 bp, Rattus norvegicus
gcacctgagaacagacttttcttgg

SEQ ID NO: 380179 - DNA, 25 bp, Rattus norvegicus
gcacctgagaactgacttttcttgg

SEQ ID NO: 380180 - DNA, 25 bp, Rattus norvegicus
gcacctgatataccgctggtagcaa

SEQ ID NO: 380181 - DNA, 25 bp, Rattus norvegicus
gcacctgatatagcgctggtagcaa

SEQ ID NO: 380182 - DNA, 25 bp, Rattus norvegicus
gcacctgatccccaagattgaggac

SEQ ID NO: 380183 - DNA, 25 bp, Rattus norvegicus
gcacctgatcccgaagattgaggac

SEQ ID NO: 380184 - DNA, 25 bp, Rattus norvegicus
gcacctgcaaccaattctgaaccga

SEQ ID NO: 380185 - DNA, 25 bp, Rattus norvegicus
gcacctgcaacctattctgaaccga

SEQ ID NO: 380186 - DNA, 25 bp, Rattus norvegicus
gcacctgcaggcactacactcatgt

SEQ ID NO: 380187 - DNA, 25 bp, Rattus norvegicus
gcacctgcaggctctacactcatgt

SEQ ID NO: 380188 - DNA, 25 bp, Rattus norvegicus
gcacctgcagtcaagcaatggataa

SEQ ID NO: 380189 - DNA, 25 bp, Rattus norvegicus
gcacctgcagtcaaggaggaggaac

SEQ ID NO: 380190 - DNA, 25 bp, Rattus norvegicus
gcacctgcagtctagcaatggataa

SEQ ID NO: 380191 - DNA, 25 bp, Rattus norvegicus
gcacctgcagtctaggaggaggaac

SEQ ID NO: 380192 - DNA, 25 bp, Rattus norvegicus
gcacctgcagtgaccttgacaattt

SEQ ID NO: 380193 - DNA, 25 bp, Rattus norvegicus
gcacctgcagtgtccttgacaattt

SEQ ID NO: 380194 - DNA, 25 bp, Rattus norvegicus
gcacctgcatatcctgtacctaagg

SEQ ID NO: 380195 - DNA, 25 bp, Rattus norvegicus
gcacctgcatatgctgtacctaagg

SEQ ID NO: 380196 - DNA, 25 bp, Rattus norvegicus
gcacctgcatctccgagaatcgagg

SEQ ID NO: 380197 - DNA, 25 bp, Rattus norvegicus
gcacctgcatctgcgagaatcgagg

SEQ ID NO: 380198 - DNA, 25 bp, Rattus norvegicus
gcacctgcctaccaaccagaaataa

SEQ ID NO: 380199 - DNA, 25 bp, Rattus norvegicus
gcacctgcctacgaaccagaaataa

SEQ ID NO: 380200 - DNA, 25 bp, Rattus norvegicus
gcacctgcctcacttgattgcaaaa

SEQ ID NO: 380201 - DNA, 25 bp, Rattus norvegicus
gcacctgcctcagttgattgcaaaa

SEQ ID NO: 380202 - DNA, 25 bp, Rattus norvegicus
gcacctgcgttcacttttatttaaa

SEQ ID NO: 380203 - DNA, 25 bp, Rattus norvegicus
gcacctgcgttctcttttatttaaa

SEQ ID NO: 380204 - DNA, 25 bp, Rattus norvegicus
gcacctgctacgcttggataacaag

SEQ ID NO: 380205 - DNA, 25 bp, Rattus norvegicus
gcacctgctacggttggataacaag

SEQ ID NO: 380206 - DNA, 25 bp, Rattus norvegicus
gcacctgctactcccgaggaaaaga

SEQ ID NO: 380207 - DNA, 25 bp, Rattus norvegicus
gcacctgctactgccgaggaaaaga

SEQ ID NO: 380208 - DNA, 25 bp, Rattus norvegicus
gcacctgctcggacaaatgcaaatg

SEQ ID NO: 380209 - DNA, 25 bp, Rattus norvegicus
gcacctgctcggtcaaatgcaaatg

SEQ ID NO: 380210 - DNA, 25 bp, Rattus norvegicus
gcacctgctgctcgacgaagtagta

SEQ ID NO: 380211 - DNA, 25 bp, Rattus norvegicus
gcacctgctgctggacgaagtagta

SEQ ID NO: 380212 - DNA, 25 bp, Rattus norvegicus
gcacctgctgtgcaatctgaacttt

SEQ ID NO: 380213 - DNA, 25 bp, Rattus norvegicus
gcacctgctgtggaatctgaacttt

SEQ ID NO: 380214 - DNA, 25 bp, Rattus norvegicus
gcacctgctttcagtcaaagttcca

SEQ ID NO: 380215 - DNA, 25 bp, Rattus norvegicus
gcacctgctttctgtcaaagttcca

SEQ ID NO: 380216 - DNA, 25 bp, Rattus norvegicus
gcacctggaatgaacttttgaataa

SEQ ID NO: 380217 - DNA, 25 bp, Rattus norvegicus
gcacctggaatgtacttttgaataa

SEQ ID NO: 380218 - DNA, 25 bp, Rattus norvegicus
gcacctggacctccatggtttattt

SEQ ID NO: 380219 - DNA, 25 bp, Rattus norvegicus
gcacctggacctgcatggtttattt

SEQ ID NO: 380220 - DNA, 25 bp, Rattus norvegicus
gcacctggagtgaagtcggctgatt

SEQ ID NO: 380221 - DNA, 25 bp, Rattus norvegicus
gcacctggagtgtagtcggctgatt

SEQ ID NO: 380222 - DNA, 25 bp, Rattus norvegicus
gcacctggccttactatagctctgt

SEQ ID NO: 380223 - DNA, 25 bp, Rattus norvegicus
gcacctggcctttctatagctctgt

SEQ ID NO: 380224 - DNA, 25 bp, Rattus norvegicus
gcacctgggcctaatgggctaccaa

SEQ ID NO: 380225 - DNA, 25 bp, Rattus norvegicus
gcacctgggccttatgggctaccaa

SEQ ID NO: 380226 - DNA, 25 bp, Rattus norvegicus
gcacctgggtatctggcagcgatct

SEQ ID NO: 380227 - DNA, 25 bp, Rattus norvegicus
gcacctgggtatgtggcagcgatct

SEQ ID NO: 380228 - DNA, 25 bp, Rattus norvegicus
gcacctgggtctagcagctgatgca

SEQ ID NO: 380229 - DNA, 25 bp, Rattus norvegicus
gcacctgggtcttgcagctgatgca

SEQ ID NO: 380230 - DNA, 25 bp, Rattus norvegicus
gcacctgggtgaacctacatcataa

SEQ ID NO: 380231 - DNA, 25 bp, Rattus norvegicus
gcacctgggtgatcctacatcataa

SEQ ID NO: 380232 - DNA, 25 bp, Rattus norvegicus
gcacctggttccactgtaaactata

SEQ ID NO: 380233 - DNA, 25 bp, Rattus norvegicus
gcacctggttcctctgtaaactata

SEQ ID NO: 380234 - DNA, 25 bp, Rattus norvegicus
gcacctgtaactccacagttgatgt

SEQ ID NO: 380235 - DNA, 25 bp, Rattus norvegicus
gcacctgtaactgcacagttgatgt

SEQ ID NO: 380236 - DNA, 25 bp, Rattus norvegicus
gcacctgtacctcttgcaaatgctg

SEQ ID NO: 380237 - DNA, 25 bp, Rattus norvegicus
gcacctgtacctgttgcaaatgctg

SEQ ID NO: 380238 - DNA, 25 bp, Rattus norvegicus
gcacctgtatttaaatttctatcat

SEQ ID NO: 380239 - DNA, 25 bp, Rattus norvegicus
gcacctgtattttaatttctatcat

SEQ ID NO: 380240 - DNA, 25 bp, Rattus norvegicus
gcacctgtcagcatgcctgaaatta

SEQ ID NO: 380241 - DNA, 25 bp, Rattus norvegicus
gcacctgtcagcttgcctgaaatta

SEQ ID NO: 380242 - DNA, 25 bp, Rattus norvegicus
gcacctgtcctgacctgtgaggagg

SEQ ID NO: 380243 - DNA, 25 bp, Rattus norvegicus
gcacctgtcctgtcctgtgaggagg

SEQ ID NO: 380244 - DNA, 25 bp, Rattus norvegicus
gcacctgtcttgataacagactaaa

SEQ ID NO: 380245 - DNA, 25 bp, Rattus norvegicus
gcacctgtcttgttaacagactaaa

SEQ ID NO: 380246 - DNA, 25 bp, Rattus norvegicus
gcacctgtgacgacttccatgaaaa

SEQ ID NO: 380247 - DNA, 25 bp, Rattus norvegicus
gcacctgtgacgtcttccatgaaaa

SEQ ID NO: 380248 - DNA, 25 bp, Rattus norvegicus
gcacctgtgcagagcgacgccatga

SEQ ID NO: 380249 - DNA, 25 bp, Rattus norvegicus
gcacctgtgcagtgcgacgccatga

SEQ ID NO: 380250 - DNA, 25 bp, Rattus norvegicus
gcacctgtgcttagcaacttaccta

SEQ ID NO: 380251 - DNA, 25 bp, Rattus norvegicus
gcacctgtgctttgcaacttaccta

SEQ ID NO: 380252 - DNA, 25 bp, Rattus norvegicus
gcacctgtgtgccaagttctctaaa

SEQ ID NO: 380253 - DNA, 25 bp, Rattus norvegicus
gcacctgtgtgcgaagttctctaaa

SEQ ID NO: 380254 - DNA, 25 bp, Rattus norvegicus
gcacctgtgtttaaggattgtcctt

SEQ ID NO: 380255 - DNA, 25 bp, Rattus norvegicus
gcacctgtgttttaggattgtcctt

SEQ ID NO: 380256 - DNA, 25 bp, Rattus norvegicus
gcacctgttaccatgttagcatcat

SEQ ID NO: 380257 - DNA, 25 bp, Rattus norvegicus
gcacctgttaccttgttagcatcat

SEQ ID NO: 380258 - DNA, 25 bp, Rattus norvegicus
gcacctgttagcatttgccatgtat

SEQ ID NO: 380259 - DNA, 25 bp, Rattus norvegicus
gcacctgttagcttttgccatgtat

SEQ ID NO: 380260 - DNA, 25 bp, Rattus norvegicus
gcacctgttagtctccagactgtga

SEQ ID NO: 380261 - DNA, 25 bp, Rattus norvegicus
gcacctgttagtgtccagactgtga

SEQ ID NO: 380262 - DNA, 25 bp, Rattus norvegicus
gcacctgttgttctatgtggtcctg

SEQ ID NO: 380263 - DNA, 25 bp, Rattus norvegicus
gcacctgttgttgtatgtggtcctg

SEQ ID NO: 380264 - DNA, 25 bp, Rattus norvegicus
gcaccttaagctcctgtcagattta

SEQ ID NO: 380265 - DNA, 25 bp, Rattus norvegicus
gcaccttaagctgctgtcagattta

SEQ ID NO: 380266 - DNA, 25 bp, Rattus norvegicus
gcaccttagacgctttttagaagtt

SEQ ID NO: 380267 - DNA, 25 bp, Rattus norvegicus
gcaccttagacggtttttagaagtt

SEQ ID NO: 380268 - DNA, 25 bp, Rattus norvegicus
gcaccttagcgacagtctgcattta

SEQ ID NO: 380269 - DNA, 25 bp, Rattus norvegicus
gcaccttagcgagagtctgcattta

SEQ ID NO: 380270 - DNA, 25 bp, Rattus norvegicus
gcaccttaggtcatccttagtgata

SEQ ID NO: 380271 - DNA, 25 bp, Rattus norvegicus
gcaccttaggtcttccttagtgata

SEQ ID NO: 380272 - DNA, 25 bp, Rattus norvegicus
gcaccttagtgccagaaatattcaa

SEQ ID NO: 380273 - DNA, 25 bp, Rattus norvegicus
gcaccttagtgcgagaaatattcaa

SEQ ID NO: 380274 - DNA, 25 bp, Rattus norvegicus
gcaccttcaaggatttctcagagca

SEQ ID NO: 380275 - DNA, 25 bp, Rattus norvegicus
gcaccttcaaggttttctcagagca

SEQ ID NO: 380276 - DNA, 25 bp, Rattus norvegicus
gcaccttcactcattttggatttgt

SEQ ID NO: 380277 - DNA, 25 bp, Rattus norvegicus
gcaccttcactctttttggatttgt

SEQ ID NO: 380278 - DNA, 25 bp, Rattus norvegicus
gcaccttcagaaatgtcaggagatt

SEQ ID NO: 380279 - DNA, 25 bp, Rattus norvegicus
gcaccttcagaattgtcaggagatt

SEQ ID NO: 380280 - DNA, 25 bp, Rattus norvegicus
gcaccttcatttaccctacatagaa

SEQ ID NO: 380281 - DNA, 25 bp, Rattus norvegicus
gcaccttcattttccctacatagaa

SEQ ID NO: 380282 - DNA, 25 bp, Rattus norvegicus
gcaccttcccaacggctcagaatga

SEQ ID NO: 380283 - DNA, 25 bp, Rattus norvegicus
gcaccttcccaagggctcagaatga

SEQ ID NO: 380284 - DNA, 25 bp, Rattus norvegicus
gcaccttccgttccaaagaaaactg

SEQ ID NO: 380285 - DNA, 25 bp, Rattus norvegicus
gcaccttccgttgcaaagaaaactg

SEQ ID NO: 380286 - DNA, 25 bp, Rattus norvegicus
gcaccttcctgaagacatatctgac

SEQ ID NO: 380287 - DNA, 25 bp, Rattus norvegicus
gcaccttcctgatgacatatctgac

SEQ ID NO: 380288 - DNA, 25 bp, Rattus norvegicus
gcaccttcgagaaacttctacaaaa

SEQ ID NO: 380289 - DNA, 25 bp, Rattus norvegicus
gcaccttcgagatacttctacaaaa

SEQ ID NO: 380290 - DNA, 25 bp, Rattus norvegicus
gcaccttctactccaatcttagtat

SEQ ID NO: 380291 - DNA, 25 bp, Rattus norvegicus
gcaccttctactgcaatcttagtat

SEQ ID NO: 380292 - DNA, 25 bp, Rattus norvegicus
gcaccttctccacgttcttaaggga

SEQ ID NO: 380293 - DNA, 25 bp, Rattus norvegicus
gcaccttctccaggttcttaaggga

SEQ ID NO: 380294 - DNA, 25 bp, Rattus norvegicus
gcaccttctgggaagtatgttcaca

SEQ ID NO: 380295 - DNA, 25 bp, Rattus norvegicus
gcaccttctgggtagtatgttcaca

SEQ ID NO: 380296 - DNA, 25 bp, Rattus norvegicus
gcaccttctggtaatgactcagggc

SEQ ID NO: 380297 - DNA, 25 bp, Rattus norvegicus
gcaccttctggttatgactcagggc

SEQ ID NO: 380298 - DNA, 25 bp, Rattus norvegicus
gcaccttgagccctgacagtgtata

SEQ ID NO: 380299 - DNA, 25 bp, Rattus norvegicus
gcaccttgagccgtgacagtgtata

SEQ ID NO: 380300 - DNA, 25 bp, Rattus norvegicus
gcaccttgatgacagtgagtgttca

SEQ ID NO: 380301 - DNA, 25 bp, Rattus norvegicus
gcaccttgatgagagtgagtgttca

SEQ ID NO: 380302 - DNA, 25 bp, Rattus norvegicus
gcaccttgccctagaggaactggac

SEQ ID NO: 380303 - DNA, 25 bp, Rattus norvegicus
gcaccttgcccttgaggaactggac

SEQ ID NO: 380304 - DNA, 25 bp, Rattus norvegicus
gcaccttgctggatttaagtacaac

SEQ ID NO: 380305 - DNA, 25 bp, Rattus norvegicus
gcaccttgctggttttaagtacaac

SEQ ID NO: 380306 - DNA, 25 bp, Rattus norvegicus
gcaccttgggcactgtgtacatgtg

SEQ ID NO: 380307 - DNA, 25 bp, Rattus norvegicus
gcaccttgggcagtgtgtacatgtg

SEQ ID NO: 380308 - DNA, 25 bp, Rattus norvegicus
gcaccttgggccacagaatactggt

SEQ ID NO: 380309 - DNA, 25 bp, Rattus norvegicus
gcaccttgggcctcagaatactggt

SEQ ID NO: 380310 - DNA, 25 bp, Rattus norvegicus
gcaccttgtctgaacggcggcccgg

SEQ ID NO: 380311 - DNA, 25 bp, Rattus norvegicus
gcaccttgtctgtacggcggcccgg

SEQ ID NO: 380312 - DNA, 25 bp, Rattus norvegicus
gcaccttgttaccacttttgtagtc

SEQ ID NO: 380313 - DNA, 25 bp, Rattus norvegicus
gcaccttgttacgacttttgtagtc

SEQ ID NO: 380314 - DNA, 25 bp, Rattus norvegicus
gcacctttaagacaaccaccgtttg

SEQ ID NO: 380315 - DNA, 25 bp, Rattus norvegicus
gcacctttaagagaaccaccgtttg

SEQ ID NO: 380316 - DNA, 25 bp, Rattus norvegicus
gcacctttaaggacccacatacata

SEQ ID NO: 380317 - DNA, 25 bp, Rattus norvegicus
gcacctttaaggtcccacatacata

SEQ ID NO: 380318 - DNA, 25 bp, Rattus norvegicus
gcacctttacagaggcctattttaa

SEQ ID NO: 380319 - DNA, 25 bp, Rattus norvegicus
gcacctttacagtggcctattttaa

SEQ ID NO: 380320 - DNA, 25 bp, Rattus norvegicus
gcacctttaggcacacttgtttcag

SEQ ID NO: 380321 - DNA, 25 bp, Rattus norvegicus
gcacctttaggctcacttgtttcag

SEQ ID NO: 380322 - DNA, 25 bp, Rattus norvegicus
gcacctttatatagtggttcacagt

SEQ ID NO: 380323 - DNA, 25 bp, Rattus norvegicus
gcacctttatattgtggttcacagt

SEQ ID NO: 380324 - DNA, 25 bp, Rattus norvegicus
gcacctttattgaccttggagggca

SEQ ID NO: 380325 - DNA, 25 bp, Rattus norvegicus
gcacctttattgtccttggagggca

SEQ ID NO: 380326 - DNA, 25 bp, Rattus norvegicus
gcacctttcagtccaggaacacgat

SEQ ID NO: 380327 - DNA, 25 bp, Rattus norvegicus
gcacctttcagtgcaggaacacgat

SEQ ID NO: 380328 - DNA, 25 bp, Rattus norvegicus
gcacctttccccagatcaagaatgg

SEQ ID NO: 380329 - DNA, 25 bp, Rattus norvegicus
gcacctttcccctgatcaagaatgg

SEQ ID NO: 380330 - DNA, 25 bp, Rattus norvegicus
gcacctttctcacaatttccttcgt

SEQ ID NO: 380331 - DNA, 25 bp, Rattus norvegicus
gcacctttctcagaatttccttcgt

SEQ ID NO: 380332 - DNA, 25 bp, Rattus norvegicus
gcacctttggcaactacctttataa

SEQ ID NO: 380333 - DNA, 25 bp, Rattus norvegicus
gcacctttggcatctacctttataa

SEQ ID NO: 380334 - DNA, 25 bp, Rattus norvegicus
gcacctttgggtagtagcttgttgt

SEQ ID NO: 380335 - DNA, 25 bp, Rattus norvegicus
gcacctttgggttgtagcttgttgt

SEQ ID NO: 380336 - DNA, 25 bp, Rattus norvegicus
gcacctttgtaaatacacctttgtg

SEQ ID NO: 380337 - DNA, 25 bp, Rattus norvegicus
gcacctttgtaattacacctttgtg

SEQ ID NO: 380338 - DNA, 25 bp, Rattus norvegicus
gcacctttgtccctggtcatataca

SEQ ID NO: 380339 - DNA, 25 bp, Rattus norvegicus
gcacctttgtccgtggtcatataca

SEQ ID NO: 380340 - DNA, 25 bp, Rattus norvegicus
gcacctttgttcacaatcctactat

SEQ ID NO: 380341 - DNA, 25 bp, Rattus norvegicus
gcacctttgttctcaatcctactat

SEQ ID NO: 380342 - DNA, 25 bp, Rattus norvegicus
gcaccttttattagactattccgtc

SEQ ID NO: 380343 - DNA, 25 bp, Rattus norvegicus
gcaccttttatttgactattccgtc

SEQ ID NO: 380344 - DNA, 25 bp, Rattus norvegicus
gcaccttttctaaatctacttccag

SEQ ID NO: 380345 - DNA, 25 bp, Rattus norvegicus
gcaccttttctatatctacttccag

SEQ ID NO: 380346 - DNA, 25 bp, Rattus norvegicus
gcaccttttctcacactgaatttga

SEQ ID NO: 380347 - DNA, 25 bp, Rattus norvegicus
gcaccttttctctcactgaatttga

SEQ ID NO: 380348 - DNA, 25 bp, Rattus norvegicus
gcaccttttgggaagtgatttacta

SEQ ID NO: 380349 - DNA, 25 bp, Rattus norvegicus
gcaccttttgggtagtgatttacta

SEQ ID NO: 380350 - DNA, 25 bp, Rattus norvegicus
gcacgaaaacaaattcctttggaga

SEQ ID NO: 380351 - DNA, 25 bp, Rattus norvegicus
gcacgaaaacaatttcctttggaga

SEQ ID NO: 380352 - DNA, 25 bp, Rattus norvegicus
gcacgaaaccgtattcctcaccttg

SEQ ID NO: 380353 - DNA, 25 bp, Rattus norvegicus
gcacgaaaccgttttcctcaccttg

SEQ ID NO: 380354 - DNA, 25 bp, Rattus norvegicus
gcacgaacagcaaaagatattgatg

SEQ ID NO: 380355 - DNA, 25 bp, Rattus norvegicus
gcacgaacagcataagatattgatg

SEQ ID NO: 380356 - DNA, 25 bp, Rattus norvegicus
gcacgaacagctcgctccagctgag

SEQ ID NO: 380357 - DNA, 25 bp, Rattus norvegicus
gcacgaacagctggctccagctgag

SEQ ID NO: 380358 - DNA, 25 bp, Rattus norvegicus
gcacgaaccatgatgtaggcaccat

SEQ ID NO: 380359 - DNA, 25 bp, Rattus norvegicus
gcacgaaccatgttgtaggcaccat

SEQ ID NO: 380360 - DNA, 25 bp, Rattus norvegicus
gcacgaactctgcaagtggctctta

SEQ ID NO: 380361 - DNA, 25 bp, Rattus norvegicus
gcacgaactctggaagtggctctta

SEQ ID NO: 380362 - DNA, 25 bp, Rattus norvegicus
gcacgaagcagaaacctatgaccaa

SEQ ID NO: 380363 - DNA, 25 bp, Rattus norvegicus
gcacgaagcagatacctatgaccaa

SEQ ID NO: 380364 - DNA, 25 bp, Rattus norvegicus
gcacgaagccttactgttatccaga

SEQ ID NO: 380365 - DNA, 25 bp, Rattus norvegicus
gcacgaagcctttctgttatccaga

SEQ ID NO: 380366 - DNA, 25 bp, Rattus norvegicus
gcacgaagtgggagtagcagctaca

SEQ ID NO: 380367 - DNA, 25 bp, Rattus norvegicus
gcacgaagtgggtgtagcagctaca

SEQ ID NO: 380368 - DNA, 25 bp, Rattus norvegicus
gcacgaatcaacaaggtagccagga

SEQ ID NO: 380369 - DNA, 25 bp, Rattus norvegicus
gcacgaatcaactaggtagccagga

SEQ ID NO: 380370 - DNA, 25 bp, Rattus norvegicus
gcacgaattggcataaactcaagag

SEQ ID NO: 380371 - DNA, 25 bp, Rattus norvegicus
gcacgaattggcttaaactcaagag

SEQ ID NO: 380372 - DNA, 25 bp, Rattus norvegicus
gcacgacaagtacccattctggtta

SEQ ID NO: 380373 - DNA, 25 bp, Rattus norvegicus
gcacgacaagtagccattctggtta

SEQ ID NO: 380374 - DNA, 25 bp, Rattus norvegicus
gcacgacaggacattgtagctttca

SEQ ID NO: 380375 - DNA, 25 bp, Rattus norvegicus
gcacgacaggactttgtagctttca

SEQ ID NO: 380376 - DNA, 25 bp, Rattus norvegicus
gcacgacctgtgaccgaatcaagca

SEQ ID NO: 380377 - DNA, 25 bp, Rattus norvegicus
gcacgacctgtgtccgaatcaagca

SEQ ID NO: 380378 - DNA, 25 bp, Rattus norvegicus
gcacgacgtctaagagaaccgcacc

SEQ ID NO: 380379 - DNA, 25 bp, Rattus norvegicus
gcacgacgtctatgagaaccgcacc

SEQ ID NO: 380380 - DNA, 25 bp, Rattus norvegicus
gcacgactgaggacaagcctggcta

SEQ ID NO: 380381 - DNA, 25 bp, Rattus norvegicus
gcacgactgaggtcaagcctggcta

SEQ ID NO: 380382 - DNA, 25 bp, Rattus norvegicus
gcacgactgcatacaaactactaca

SEQ ID NO: 380383 - DNA, 25 bp, Rattus norvegicus
gcacgactgcattcaaactactaca

SEQ ID NO: 380384 - DNA, 25 bp, Rattus norvegicus
gcacgacttgtacgccaggatgcta

SEQ ID NO: 380385 - DNA, 25 bp, Rattus norvegicus
gcacgacttgtaggccaggatgcta

SEQ ID NO: 380386 - DNA, 25 bp, Rattus norvegicus
gcacgactttgtagaattttgatag

SEQ ID NO: 380387 - DNA, 25 bp, Rattus norvegicus
gcacgactttgttgaattttgatag

SEQ ID NO: 380388 - DNA, 25 bp, Rattus norvegicus
gcacgagaccaaccccaagaggaat

SEQ ID NO: 380389 - DNA, 25 bp, Rattus norvegicus
gcacgagaccaagcccaagaggaat

SEQ ID NO: 380390 - DNA, 25 bp, Rattus norvegicus
gcacgagactgcactgcaaggcaat

SEQ ID NO: 380391 - DNA, 25 bp, Rattus norvegicus
gcacgagactgctctgcaaggcaat

SEQ ID NO: 380392 - DNA, 25 bp, Rattus norvegicus
gcacgagagcatcgacttatcttca

SEQ ID NO: 380393 - DNA, 25 bp, Rattus norvegicus
gcacgagagcatggacttatcttca

SEQ ID NO: 380394 - DNA, 25 bp, Rattus norvegicus
gcacgagggactcactgccttcttt

SEQ ID NO: 380395 - DNA, 25 bp, Rattus norvegicus
gcacgagggactgactgccttcttt

SEQ ID NO: 380396 - DNA, 25 bp, Rattus norvegicus
gcacgaggtgataggcagctcactc

SEQ ID NO: 380397 - DNA, 25 bp, Rattus norvegicus
gcacgaggtgatccctgttggtatt

SEQ ID NO: 380398 - DNA, 25 bp, Rattus norvegicus
gcacgaggtgatgcctgttggtatt

SEQ ID NO: 380399 - DNA, 25 bp, Rattus norvegicus
gcacgaggtgattggcagctcactc

SEQ ID NO: 380400 - DNA, 25 bp, Rattus norvegicus
gcacgagtacagatagccccttgaa

SEQ ID NO: 380401 - DNA, 25 bp, Rattus norvegicus
gcacgagtacagttagccccttgaa

SEQ ID NO: 380402 - DNA, 25 bp, Rattus norvegicus
gcacgagtacttcttatgagccagg

SEQ ID NO: 380403 - DNA, 25 bp, Rattus norvegicus
gcacgagtacttgttatgagccagg

SEQ ID NO: 380404 - DNA, 25 bp, Rattus norvegicus
gcacgagtccaaagcctcctgaggg

SEQ ID NO: 380405 - DNA, 25 bp, Rattus norvegicus
gcacgagtccaatgcctcctgaggg

SEQ ID NO: 380406 - DNA, 25 bp, Rattus norvegicus
gcacgagtcttcatacagtagcatc

SEQ ID NO: 380407 - DNA, 25 bp, Rattus norvegicus
gcacgagtcttcttacagtagcatc

SEQ ID NO: 380408 - DNA, 25 bp, Rattus norvegicus
gcacgagttaaaattatccgaggcg

SEQ ID NO: 380409 - DNA, 25 bp, Rattus norvegicus
gcacgagttaaatttatccgaggcg

SEQ ID NO: 380410 - DNA, 25 bp, Rattus norvegicus
gcacgatagcggctgtggcatctct

SEQ ID NO: 380411 - DNA, 25 bp, Rattus norvegicus
gcacgatagcgggtgtggcatctct

SEQ ID NO: 380412 - DNA, 25 bp, Rattus norvegicus
gcacgatcgtctccttccgatcagc

SEQ ID NO: 380413 - DNA, 25 bp, Rattus norvegicus
gcacgatcgtctgcttccgatcagc

SEQ ID NO: 380414 - DNA, 25 bp, Rattus norvegicus
gcacgatgacttcgtcagcacacca

SEQ ID NO: 380415 - DNA, 25 bp, Rattus norvegicus
gcacgatgacttggtcagcacacca

SEQ ID NO: 380416 - DNA, 25 bp, Rattus norvegicus
gcacgatgagtgcatgactgttgat

SEQ ID NO: 380417 - DNA, 25 bp, Rattus norvegicus
gcacgatgagtggatgactgttgat

SEQ ID NO: 380418 - DNA, 25 bp, Rattus norvegicus
gcacgatggcttagaatattgggtt

SEQ ID NO: 380419 - DNA, 25 bp, Rattus norvegicus
gcacgatggctttgaatattgggtt

SEQ ID NO: 380420 - DNA, 25 bp, Rattus norvegicus
gcacgattacagacacacacgacaa

SEQ ID NO: 380421 - DNA, 25 bp, Rattus norvegicus
gcacgattacagtcacacacgacaa

SEQ ID NO: 380422 - DNA, 25 bp, Rattus norvegicus
gcacgattcagtcgcttctacagca

SEQ ID NO: 380423 - DNA, 25 bp, Rattus norvegicus
gcacgattcagtggcttctacagca

SEQ ID NO: 380424 - DNA, 25 bp, Rattus norvegicus
gcacgatttcatattctgccaatgg

SEQ ID NO: 380425 - DNA, 25 bp, Rattus norvegicus
gcacgatttcattttctgccaatgg

SEQ ID NO: 380426 - DNA, 25 bp, Rattus norvegicus
gcacgatttgtaattcacactggca

SEQ ID NO: 380427 - DNA, 25 bp, Rattus norvegicus
gcacgatttgtatttcacactggca

SEQ ID NO: 380428 - DNA, 25 bp, Rattus norvegicus
gcacgcacatagatggcttggttct

SEQ ID NO: 380429 - DNA, 25 bp, Rattus norvegicus
gcacgcacatagttggcttggttct

SEQ ID NO: 380430 - DNA, 25 bp, Rattus norvegicus
gcacgcacatgcattgggatcggat

SEQ ID NO: 380431 - DNA, 25 bp, Rattus norvegicus
gcacgcacatgctttgggatcggat

SEQ ID NO: 380432 - DNA, 25 bp, Rattus norvegicus
gcacgcagtgtgaacatggagctta

SEQ ID NO: 380433 - DNA, 25 bp, Rattus norvegicus
gcacgcagtgtgtacatggagctta

SEQ ID NO: 380434 - DNA, 25 bp, Rattus norvegicus
gcacgcatcttgcaggacacgatac

SEQ ID NO: 380435 - DNA, 25 bp, Rattus norvegicus
gcacgcatcttggaggacacgatac

SEQ ID NO: 380436 - DNA, 25 bp, Rattus norvegicus
gcacgcattgtacacacgcactcaa

SEQ ID NO: 380437 - DNA, 25 bp, Rattus norvegicus
gcacgcattgtagacacgcactcaa

SEQ ID NO: 380438 - DNA, 25 bp, Rattus norvegicus
gcacgccagggaattgtccttaatt

SEQ ID NO: 380439 - DNA, 25 bp, Rattus norvegicus
gcacgccagggatttgtccttaatt

SEQ ID NO: 380440 - DNA, 25 bp, Rattus norvegicus
gcacgccatgtgaaaagcctttagt

SEQ ID NO: 380441 - DNA, 25 bp, Rattus norvegicus
gcacgccatgtgtaaagcctttagt

SEQ ID NO: 380442 - DNA, 25 bp, Rattus norvegicus
gcacgccattggaagttctcacagg

SEQ ID NO: 380443 - DNA, 25 bp, Rattus norvegicus
gcacgccattggtagttctcacagg

SEQ ID NO: 380444 - DNA, 25 bp, Rattus norvegicus
gcacgccggaccagcaagatgcctt

SEQ ID NO: 380445 - DNA, 25 bp, Rattus norvegicus
gcacgccggacctgcaagatgcctt

SEQ ID NO: 380446 - DNA, 25 bp, Rattus norvegicus
gcacgcctcccgcttcttcttttat

SEQ ID NO: 380447 - DNA, 25 bp, Rattus norvegicus
gcacgcctcccggttcttcttttat

SEQ ID NO: 380448 - DNA, 25 bp, Rattus norvegicus
gcacgcctcctaattagatgctggg

SEQ ID NO: 380449 - DNA, 25 bp, Rattus norvegicus
gcacgcctcctatttagatgctggg

SEQ ID NO: 380450 - DNA, 25 bp, Rattus norvegicus
gcacgcctgcacattgaattcttat

SEQ ID NO: 380451 - DNA, 25 bp, Rattus norvegicus
gcacgcctgcactttgaattcttat

SEQ ID NO: 380452 - DNA, 25 bp, Rattus norvegicus
gcacgcgcgcatatctatagctata

SEQ ID NO: 380453 - DNA, 25 bp, Rattus norvegicus
gcacgcgcgcatttctatagctata

SEQ ID NO: 380454 - DNA, 25 bp, Rattus norvegicus
gcacgcggttttcaaatttgtagct

SEQ ID NO: 380455 - DNA, 25 bp, Rattus norvegicus
gcacgcggttttgaaatttgtagct

SEQ ID NO: 380456 - DNA, 25 bp, Rattus norvegicus
gcacgcgtgtatctcaagggactta

SEQ ID NO: 380457 - DNA, 25 bp, Rattus norvegicus
gcacgcgtgtatgtcaagggactta

SEQ ID NO: 380458 - DNA, 25 bp, Rattus norvegicus
gcacgctaatagacggcaactctaa

SEQ ID NO: 380459 - DNA, 25 bp, Rattus norvegicus
gcacgctaatagtcggcaactctaa

SEQ ID NO: 380460 - DNA, 25 bp, Rattus norvegicus
gcacgctacttaaatacgttgcttc

SEQ ID NO: 380461 - DNA, 25 bp, Rattus norvegicus
gcacgctacttatatacgttgcttc

SEQ ID NO: 380462 - DNA, 25 bp, Rattus norvegicus
gcacgctcagtcattccttaccagt

SEQ ID NO: 380463 - DNA, 25 bp, Rattus norvegicus
gcacgctcagtctttccttaccagt

SEQ ID NO: 380464 - DNA, 25 bp, Rattus norvegicus
gcacgctcttataagcatctagatg

SEQ ID NO: 380465 - DNA, 25 bp, Rattus norvegicus
gcacgctcttattagcatctagatg

SEQ ID NO: 380466 - DNA, 25 bp, Rattus norvegicus
gcacgctgagcactgaatgccagga

SEQ ID NO: 380467 - DNA, 25 bp, Rattus norvegicus
gcacgctgagcacttttcgaaacta

SEQ ID NO: 380468 - DNA, 25 bp, Rattus norvegicus
gcacgctgagcagtgaatgccagga

SEQ ID NO: 380469 - DNA, 25 bp, Rattus norvegicus
gcacgctgagcagttttcgaaacta

SEQ ID NO: 380470 - DNA, 25 bp, Rattus norvegicus
gcacgctgatctccgcctggaggct

SEQ ID NO: 380471 - DNA, 25 bp, Rattus norvegicus
gcacgctgatctgcgcctggaggct

SEQ ID NO: 380472 - DNA, 25 bp, Rattus norvegicus
gcacgctgccttcgaacgctggcta

SEQ ID NO: 380473 - DNA, 25 bp, Rattus norvegicus
gcacgctgccttggaacgctggcta

SEQ ID NO: 380474 - DNA, 25 bp, Rattus norvegicus
gcacgctgtgcgaggcctgcaacat

SEQ ID NO: 380475 - DNA, 25 bp, Rattus norvegicus
gcacgctgtgcgtggcctgcaacat

SEQ ID NO: 380476 - DNA, 25 bp, Rattus norvegicus
gcacgctgtgctaccagagaacatg

SEQ ID NO: 380477 - DNA, 25 bp, Rattus norvegicus
gcacgctgtgcttccagagaacatg

SEQ ID NO: 380478 - DNA, 25 bp, Rattus norvegicus
gcacgcttatgacacccttaactga

SEQ ID NO: 380479 - DNA, 25 bp, Rattus norvegicus
gcacgcttatgagacccttaactga

SEQ ID NO: 380480 - DNA, 25 bp, Rattus norvegicus
gcacgcttgactcctggcggaagat

SEQ ID NO: 380481 - DNA, 25 bp, Rattus norvegicus
gcacgcttgactgctggcggaagat

SEQ ID NO: 380482 - DNA, 25 bp, Rattus norvegicus
gcacgctttaacatgatagacacca

SEQ ID NO: 380483 - DNA, 25 bp, Rattus norvegicus
gcacgctttaacttgatagacacca

SEQ ID NO: 380484 - DNA, 25 bp, Rattus norvegicus
gcacggaaataaacccacgtctctt

SEQ ID NO: 380485 - DNA, 25 bp, Rattus norvegicus
gcacggaaataatcccacgtctctt

SEQ ID NO: 380486 - DNA, 25 bp, Rattus norvegicus
gcacggaaggcgagaatgacagctt

SEQ ID NO: 380487 - DNA, 25 bp, Rattus norvegicus
gcacggaaggcgtgaatgacagctt

SEQ ID NO: 380488 - DNA, 25 bp, Rattus norvegicus
gcacggaaggtacgactggttcaac

SEQ ID NO: 380489 - DNA, 25 bp, Rattus norvegicus
gcacggaaggtaggactggttcaac

SEQ ID NO: 380490 - DNA, 25 bp, Rattus norvegicus
gcacggacaaatatgacttcacaac

SEQ ID NO: 380491 - DNA, 25 bp, Rattus norvegicus
gcacggacaaatttgacttcacaac

SEQ ID NO: 380492 - DNA, 25 bp, Rattus norvegicus
gcacggacagttagaagcaggttct

SEQ ID NO: 380493 - DNA, 25 bp, Rattus norvegicus
gcacggacagtttgaagcaggttct

SEQ ID NO: 380494 - DNA, 25 bp, Rattus norvegicus
gcacggacgtaaagctgagcctcaa

SEQ ID NO: 380495 - DNA, 25 bp, Rattus norvegicus
gcacggacgtaatgctgagcctcaa

SEQ ID NO: 380496 - DNA, 25 bp, Rattus norvegicus
gcacggacgtccaacaaaagttctg

SEQ ID NO: 380497 - DNA, 25 bp, Rattus norvegicus
gcacggacgtcctacaaaagttctg

SEQ ID NO: 380498 - DNA, 25 bp, Rattus norvegicus
gcacggactctcagttttgtttaag

SEQ ID NO: 380499 - DNA, 25 bp, Rattus norvegicus
gcacggactctctgttttgtttaag

SEQ ID NO: 380500 - DNA, 25 bp, Rattus norvegicus
gcacggagcccacgtcatttttgta

SEQ ID NO: 380501 - DNA, 25 bp, Rattus norvegicus
gcacggagcccaggtcatttttgta

SEQ ID NO: 380502 - DNA, 25 bp, Rattus norvegicus
gcacggatgaatcgtctttccccac

SEQ ID NO: 380503 - DNA, 25 bp, Rattus norvegicus
gcacggatgaatggtctttccccac

SEQ ID NO: 380504 - DNA, 25 bp, Rattus norvegicus
gcacggatgctgaatgtttgggaat

SEQ ID NO: 380505 - DNA, 25 bp, Rattus norvegicus
gcacggatgctgtatgtttgggaat

SEQ ID NO: 380506 - DNA, 25 bp, Rattus norvegicus
gcacggattaaactcttcctccttc

SEQ ID NO: 380507 - DNA, 25 bp, Rattus norvegicus
gcacggattaaagtcttcctccttc

SEQ ID NO: 380508 - DNA, 25 bp, Rattus norvegicus
gcacggcagccaatttaacttctga

SEQ ID NO: 380509 - DNA, 25 bp, Rattus norvegicus
gcacggcagccattttaacttctga

SEQ ID NO: 380510 - DNA, 25 bp, Rattus norvegicus
gcacggcctttgagctttgggagaa

SEQ ID NO: 380511 - DNA, 25 bp, Rattus norvegicus
gcacggcctttgtgctttgggagaa

SEQ ID NO: 380512 - DNA, 25 bp, Rattus norvegicus
gcacggcgatcaaggcccgggttct

SEQ ID NO: 380513 - DNA, 25 bp, Rattus norvegicus
gcacggcgatcatggcccgggttct

SEQ ID NO: 380514 - DNA, 25 bp, Rattus norvegicus
gcacggctaagcaccaacagaacat

SEQ ID NO: 380515 - DNA, 25 bp, Rattus norvegicus
gcacggctaagctccaacagaacat

SEQ ID NO: 380516 - DNA, 25 bp, Rattus norvegicus
gcacggctagttccacatagtgatt

SEQ ID NO: 380517 - DNA, 25 bp, Rattus norvegicus
gcacggctagttgcacatagtgatt

SEQ ID NO: 380518 - DNA, 25 bp, Rattus norvegicus
gcacggctcatgatgaaatcatccc

SEQ ID NO: 380519 - DNA, 25 bp, Rattus norvegicus
gcacggctcatgttgaaatcatccc

SEQ ID NO: 380520 - DNA, 25 bp, Rattus norvegicus
gcacggctggctctatatttggagt

SEQ ID NO: 380521 - DNA, 25 bp, Rattus norvegicus
gcacggctggctgtatatttggagt

SEQ ID NO: 380522 - DNA, 25 bp, Rattus norvegicus
gcacggctgtgcctaagcggctggt

SEQ ID NO: 380523 - DNA, 25 bp, Rattus norvegicus
gcacggctgtgcgtaagcggctggt

SEQ ID NO: 380524 - DNA, 25 bp, Rattus norvegicus
gcacgggaacttcgtcagcttgact

SEQ ID NO: 380525 - DNA, 25 bp, Rattus norvegicus
gcacgggaacttggtcagcttgact

SEQ ID NO: 380526 - DNA, 25 bp, Rattus norvegicus
gcacgggacccacgtttgacttttg

SEQ ID NO: 380527 - DNA, 25 bp, Rattus norvegicus
gcacgggacccaggtttgacttttg

SEQ ID NO: 380528 - DNA, 25 bp, Rattus norvegicus
gcacgggactgcaaatgactgactg

SEQ ID NO: 380529 - DNA, 25 bp, Rattus norvegicus
gcacgggactgctaatgactgactg

SEQ ID NO: 380530 - DNA, 25 bp, Rattus norvegicus
gcacgggatacaccgcatgaagaaa

SEQ ID NO: 380531 - DNA, 25 bp, Rattus norvegicus
gcacgggatacagcgcatgaagaaa

SEQ ID NO: 380532 - DNA, 25 bp, Rattus norvegicus
gcacgggatgatctgcaaagcctat

SEQ ID NO: 380533 - DNA, 25 bp, Rattus norvegicus
gcacgggatgatgtgcaaagcctat

SEQ ID NO: 380534 - DNA, 25 bp, Rattus norvegicus
gcacgggcgttaagtacgtttctaa

SEQ ID NO: 380535 - DNA, 25 bp, Rattus norvegicus
gcacgggcgttatgtacgtttctaa

SEQ ID NO: 380536 - DNA, 25 bp, Rattus norvegicus
gcacgggtattcagccaagttcaac

SEQ ID NO: 380537 - DNA, 25 bp, Rattus norvegicus
gcacgggtattctgccaagttcaac

SEQ ID NO: 380538 - DNA, 25 bp, Rattus norvegicus
gcacgggtcgctcatttctgataaa

SEQ ID NO: 380539 - DNA, 25 bp, Rattus norvegicus
gcacgggtcgctgatttctgataaa

SEQ ID NO: 380540 - DNA, 25 bp, Rattus norvegicus
gcacgggttcagagaaggcttttct

SEQ ID NO: 380541 - DNA, 25 bp, Rattus norvegicus
gcacgggttcagtgaaggcttttct

SEQ ID NO: 380542 - DNA, 25 bp, Rattus norvegicus
gcacgggttgccaaagaagctaaaa

SEQ ID NO: 380543 - DNA, 25 bp, Rattus norvegicus
gcacgggttgcctaagaagctaaaa

SEQ ID NO: 380544 - DNA, 25 bp, Rattus norvegicus
gcacggtaagcacgacttggcagta

SEQ ID NO: 380545 - DNA, 25 bp, Rattus norvegicus
gcacggtaagcaggacttggcagta

SEQ ID NO: 380546 - DNA, 25 bp, Rattus norvegicus
gcacggtattgtcagctttggctcc

SEQ ID NO: 380547 - DNA, 25 bp, Rattus norvegicus
gcacggtattgtgagctttggctcc

SEQ ID NO: 380548 - DNA, 25 bp, Rattus norvegicus
gcacggtgagctatttgtacttttt

SEQ ID NO: 380549 - DNA, 25 bp, Rattus norvegicus
gcacggtgagctttttgtacttttt

SEQ ID NO: 380550 - DNA, 25 bp, Rattus norvegicus
gcacggtgttcgaactgaagcgcat

SEQ ID NO: 380551 - DNA, 25 bp, Rattus norvegicus
gcacggtgttcgtactgaagcgcat

SEQ ID NO: 380552 - DNA, 25 bp, Rattus norvegicus
gcacggttccatacagccagagaaa

SEQ ID NO: 380553 - DNA, 25 bp, Rattus norvegicus
gcacggttccattcagccagagaaa

SEQ ID NO: 380554 - DNA, 25 bp, Rattus norvegicus
gcacggttgatcaaagacttgttat

SEQ ID NO: 380555 - DNA, 25 bp, Rattus norvegicus
gcacggttgatctaagacttgttat

SEQ ID NO: 380556 - DNA, 25 bp, Rattus norvegicus
gcacggttgcagagcacagccatga

SEQ ID NO: 380557 - DNA, 25 bp, Rattus norvegicus
gcacggttgcagtgcacagccatga

SEQ ID NO: 380558 - DNA, 25 bp, Rattus norvegicus
gcacggttgtccattctttctaaag

SEQ ID NO: 380559 - DNA, 25 bp, Rattus norvegicus
gcacggttgtcctttctttctaaag

SEQ ID NO: 380560 - DNA, 25 bp, Rattus norvegicus
gcacggtttgctccagtcacattga

SEQ ID NO: 380561 - DNA, 25 bp, Rattus norvegicus
gcacggtttgctgcagtcacattga

SEQ ID NO: 380562 - DNA, 25 bp, Rattus norvegicus
gcacggttttctatggtacagcctc

SEQ ID NO: 380563 - DNA, 25 bp, Rattus norvegicus
gcacggttttctttggtacagcctc

SEQ ID NO: 380564 - DNA, 25 bp, Rattus norvegicus
gcacgtaatgtacacctattctgaa

SEQ ID NO: 380565 - DNA, 25 bp, Rattus norvegicus
gcacgtaatgtagacctattctgaa

SEQ ID NO: 380566 - DNA, 25 bp, Rattus norvegicus
gcacgtacacacaccaaactggaaa

SEQ ID NO: 380567 - DNA, 25 bp, Rattus norvegicus
gcacgtacacactccaaactggaaa

SEQ ID NO: 380568 - DNA, 25 bp, Rattus norvegicus
gcacgtacagcaagagcagcaccct

SEQ ID NO: 380569 - DNA, 25 bp, Rattus norvegicus
gcacgtacagcatgagcagcaccct

SEQ ID NO: 380570 - DNA, 25 bp, Rattus norvegicus
gcacgtaggcatactctgttatcaa

SEQ ID NO: 380571 - DNA, 25 bp, Rattus norvegicus
gcacgtaggcattctctgttatcaa

SEQ ID NO: 380572 - DNA, 25 bp, Rattus norvegicus
gcacgtcaccttcaggtggtcacaa

SEQ ID NO: 380573 - DNA, 25 bp, Rattus norvegicus
gcacgtcaccttgaggtggtcacaa

SEQ ID NO: 380574 - DNA, 25 bp, Rattus norvegicus
gcacgtcagaatctccagaacctat

SEQ ID NO: 380575 - DNA, 25 bp, Rattus norvegicus
gcacgtcagaatgtccagaacctat

SEQ ID NO: 380576 - DNA, 25 bp, Rattus norvegicus
gcacgtcagatcagaggcactcatt

SEQ ID NO: 380577 - DNA, 25 bp, Rattus norvegicus
gcacgtcagatctgaggcactcatt

SEQ ID NO: 380578 - DNA, 25 bp, Rattus norvegicus
gcacgtcaggcacaagcgactgtat

SEQ ID NO: 380579 - DNA, 25 bp, Rattus norvegicus
gcacgtcaggcagaagcgactgtat

SEQ ID NO: 380580 - DNA, 25 bp, Rattus norvegicus
gcacgtcattttaattgtccgttga

SEQ ID NO: 380581 - DNA, 25 bp, Rattus norvegicus
gcacgtcatttttattgtccgttga

SEQ ID NO: 380582 - DNA, 25 bp, Rattus norvegicus
gcacgtccagcaaggtagacatttt

SEQ ID NO: 380583 - DNA, 25 bp, Rattus norvegicus
gcacgtccagcatggtagacatttt

SEQ ID NO: 380584 - DNA, 25 bp, Rattus norvegicus
gcacgtccatggcttatccgacatg

SEQ ID NO: 380585 - DNA, 25 bp, Rattus norvegicus
gcacgtccatgggttatccgacatg

SEQ ID NO: 380586 - DNA, 25 bp, Rattus norvegicus
gcacgtcctgtccaaagatgacttt

SEQ ID NO: 380587 - DNA, 25 bp, Rattus norvegicus
gcacgtcctgtcgaaagatgacttt

SEQ ID NO: 380588 - DNA, 25 bp, Rattus norvegicus
gcacgtccttggaagatgtctgcca

SEQ ID NO: 380589 - DNA, 25 bp, Rattus norvegicus
gcacgtccttggtagatgtctgcca

SEQ ID NO: 380590 - DNA, 25 bp, Rattus norvegicus
gcacgtctatgtagccaggatttct

SEQ ID NO: 380591 - DNA, 25 bp, Rattus norvegicus
gcacgtctatgttgccaggatttct

SEQ ID NO: 380592 - DNA, 25 bp, Rattus norvegicus
gcacgtctccgtagtgtttaattta

SEQ ID NO: 380593 - DNA, 25 bp, Rattus norvegicus
gcacgtctccgttgtgtttaattta

SEQ ID NO: 380594 - DNA, 25 bp, Rattus norvegicus
gcacgtctgtcacgtggtgatctgt

SEQ ID NO: 380595 - DNA, 25 bp, Rattus norvegicus
gcacgtctgtcaggtggtgatctgt

SEQ ID NO: 380596 - DNA, 25 bp, Rattus norvegicus
gcacgtgaagctctctcatgagttt

SEQ ID NO: 380597 - DNA, 25 bp, Rattus norvegicus
gcacgtgaagctgtctcatgagttt

SEQ ID NO: 380598 - DNA, 25 bp, Rattus norvegicus
gcacgtgagtgtacactttcacctt

SEQ ID NO: 380599 - DNA, 25 bp, Rattus norvegicus
gcacgtgagtgttcactttcacctt

SEQ ID NO: 380600 - DNA, 25 bp, Rattus norvegicus
gcacgtgcacacctatacgttctgt

SEQ ID NO: 380601 - DNA, 25 bp, Rattus norvegicus
gcacgtgcacacgtatacgttctgt

SEQ ID NO: 380602 - DNA, 25 bp, Rattus norvegicus
gcacgtgctcggaccaagtggagtt

SEQ ID NO: 380603 - DNA, 25 bp, Rattus norvegicus
gcacgtgctcggtccaagtggagtt

SEQ ID NO: 380604 - DNA, 25 bp, Rattus norvegicus
gcacgtgctggaaataactgcagta

SEQ ID NO: 380605 - DNA, 25 bp, Rattus norvegicus
gcacgtgctggatataactgcagta

SEQ ID NO: 380606 - DNA, 25 bp, Rattus norvegicus
gcacgtggaccaccaagagcgcagc

SEQ ID NO: 380607 - DNA, 25 bp, Rattus norvegicus
gcacgtggaccagcaagagcgcagc

SEQ ID NO: 380608 - DNA, 25 bp, Rattus norvegicus
gcacgtggagccctgcattagcaga

SEQ ID NO: 380609 - DNA, 25 bp, Rattus norvegicus
gcacgtggagccgtgcattagcaga

SEQ ID NO: 380610 - DNA, 25 bp, Rattus norvegicus
gcacgtgtagtcaaacgagccctga

SEQ ID NO: 380611 - DNA, 25 bp, Rattus norvegicus
gcacgtgtagtctaacgagccctga

SEQ ID NO: 380612 - DNA, 25 bp, Rattus norvegicus
gcacgtgtccccagttggataaata

SEQ ID NO: 380613 - DNA, 25 bp, Rattus norvegicus
gcacgtgtcccctgttggataaata

SEQ ID NO: 380614 - DNA, 25 bp, Rattus norvegicus
gcacgtgtgaacagaacgctgatca

SEQ ID NO: 380615 - DNA, 25 bp, Rattus norvegicus
gcacgtgtgaactgaacgctgatca

SEQ ID NO: 380616 - DNA, 25 bp, Rattus norvegicus
gcacgtgtgacaactctgggtttca

SEQ ID NO: 380617 - DNA, 25 bp, Rattus norvegicus
gcacgtgtgacatctctgggtttca

SEQ ID NO: 380618 - DNA, 25 bp, Rattus norvegicus
gcacgtgtgacgacagtatcctggt

SEQ ID NO: 380619 - DNA, 25 bp, Rattus norvegicus
gcacgtgtgacgtcagtatcctggt

SEQ ID NO: 380620 - DNA, 25 bp, Rattus norvegicus
gcacgtgtgtccaagttcttcagga

SEQ ID NO: 380621 - DNA, 25 bp, Rattus norvegicus
gcacgtgtgtcctagttcttcagga

SEQ ID NO: 380622 - DNA, 25 bp, Rattus norvegicus
gcacgtgttatcagaggccttgact

SEQ ID NO: 380623 - DNA, 25 bp, Rattus norvegicus
gcacgtgttatctgaggccttgact

SEQ ID NO: 380624 - DNA, 25 bp, Rattus norvegicus
gcacgttcacttagactgttacagg

SEQ ID NO: 380625 - DNA, 25 bp, Rattus norvegicus
gcacgttcactttgactgttacagg

SEQ ID NO: 380626 - DNA, 25 bp, Rattus norvegicus
gcacgttctccgaatgtgtgtgtat

SEQ ID NO: 380627 - DNA, 25 bp, Rattus norvegicus
gcacgttctccgtatgtgtgtgtat

SEQ ID NO: 380628 - DNA, 25 bp, Rattus norvegicus
gcacgttctgctcactctttaaaac

SEQ ID NO: 380629 - DNA, 25 bp, Rattus norvegicus
gcacgttctgctgactctttaaaac

SEQ ID NO: 380630 - DNA, 25 bp, Rattus norvegicus
gcacgttgattcctaaatggccctg

SEQ ID NO: 380631 - DNA, 25 bp, Rattus norvegicus
gcacgttgattcgtaaatggccctg

SEQ ID NO: 380632 - DNA, 25 bp, Rattus norvegicus
gcacgttgcaaaagagcggcaggct

SEQ ID NO: 380633 - DNA, 25 bp, Rattus norvegicus
gcacgttgcaaatgagcggcaggct

SEQ ID NO: 380634 - DNA, 25 bp, Rattus norvegicus
gcacgttggtgaaggcatcgtcctc

SEQ ID NO: 380635 - DNA, 25 bp, Rattus norvegicus
gcacgttggtgatggcatcgtcctc

SEQ ID NO: 380636 - DNA, 25 bp, Rattus norvegicus
gcacgtttcgtgcactgttaccaaa

SEQ ID NO: 380637 - DNA, 25 bp, Rattus norvegicus
gcacgtttcgtggactgttaccaaa

SEQ ID NO: 380638 - DNA, 25 bp, Rattus norvegicus
gcacgtttgcacattttgttgagta

SEQ ID NO: 380639 - DNA, 25 bp, Rattus norvegicus
gcacgtttgcactttttgttgagta

SEQ ID NO: 380640 - DNA, 25 bp, Rattus norvegicus
gcacgttttcctagcaacttagagc

SEQ ID NO: 380641 - DNA, 25 bp, Rattus norvegicus
gcacgttttccttgcaacttagagc

SEQ ID NO: 380642 - DNA, 25 bp, Rattus norvegicus
gcacgttttgggaatatcactttat

SEQ ID NO: 380643 - DNA, 25 bp, Rattus norvegicus
gcacgttttgggtatatcactttat

SEQ ID NO: 380644 - DNA, 25 bp, Rattus norvegicus
gcactaaaaatcatcctttgtgtag

SEQ ID NO: 380645 - DNA, 25 bp, Rattus norvegicus
gcactaaaaatcttcctttgtgtag

SEQ ID NO: 380646 - DNA, 25 bp, Rattus norvegicus
gcactaaactggctgctttgacaca

SEQ ID NO: 380647 - DNA, 25 bp, Rattus norvegicus
gcactaaactgggtgctttgacaca

SEQ ID NO: 380648 - DNA, 25 bp, Rattus norvegicus
gcactaaagcccagcatcaggatat

SEQ ID NO: 380649 - DNA, 25 bp, Rattus norvegicus
gcactaaagccctgcatcaggatat

SEQ ID NO: 380650 - DNA, 25 bp, Rattus norvegicus
gcactaagaaatcctgcttcccggc

SEQ ID NO: 380651 - DNA, 25 bp, Rattus norvegicus
gcactaagaaatgctgcttcccggc

SEQ ID NO: 380652 - DNA, 25 bp, Rattus norvegicus
gcactaagctgtatttcttttacac

SEQ ID NO: 380653 - DNA, 25 bp, Rattus norvegicus
gcactaagctgtttttcttttacac

SEQ ID NO: 380654 - DNA, 25 bp, Rattus norvegicus
gcactaaggctgaccctgaaggagt

SEQ ID NO: 380655 - DNA, 25 bp, Rattus norvegicus
gcactaaggctgtccctgaaggagt

SEQ ID NO: 380656 - DNA, 25 bp, Rattus norvegicus
gcactaagtctcatttttacaaagg

SEQ ID NO: 380657 - DNA, 25 bp, Rattus norvegicus
gcactaagtctcttttttacaaagg

SEQ ID NO: 380658 - DNA, 25 bp, Rattus norvegicus
gcactaataaataactctccttgca

SEQ ID NO: 380659 - DNA, 25 bp, Rattus norvegicus
gcactaataaattactctccttgca

SEQ ID NO: 380660 - DNA, 25 bp, Rattus norvegicus
gcactaatcacaacacttctgctaa

SEQ ID NO: 380661 - DNA, 25 bp, Rattus norvegicus
gcactaatcacatcacttctgctaa

SEQ ID NO: 380662 - DNA, 25 bp, Rattus norvegicus
gcactaatctgaaccagcagctgtg

SEQ ID NO: 380663 - DNA, 25 bp, Rattus norvegicus
gcactaatctgatccagcagctgtg

SEQ ID NO: 380664 - DNA, 25 bp, Rattus norvegicus
gcactaatgtctccttcacttttta

SEQ ID NO: 380665 - DNA, 25 bp, Rattus norvegicus
gcactaatgtctctcatgccttcag

SEQ ID NO: 380666 - DNA, 25 bp, Rattus norvegicus
gcactaatgtctgcttcacttttta

SEQ ID NO: 380667 - DNA, 25 bp, Rattus norvegicus
gcactaatgtctgtcatgccttcag

SEQ ID NO: 380668 - DNA, 25 bp, Rattus norvegicus
gcactaatgtgcctgcgtcagtagt

SEQ ID NO: 380669 - DNA, 25 bp, Rattus norvegicus
gcactaatgtgcgtgcgtcagtagt

SEQ ID NO: 380670 - DNA, 25 bp, Rattus norvegicus
gcactaatttacctggtttcgtaga

SEQ ID NO: 380671 - DNA, 25 bp, Rattus norvegicus
gcactaatttacgtggtttcgtaga

SEQ ID NO: 380672 - DNA, 25 bp, Rattus norvegicus
gcactacaagaccatgtttgcctta

SEQ ID NO: 380673 - DNA, 25 bp, Rattus norvegicus
gcactacaagacgatgtttgcctta

SEQ ID NO: 380674 - DNA, 25 bp, Rattus norvegicus
gcactacagaggaagcaaggtcact

SEQ ID NO: 380675 - DNA, 25 bp, Rattus norvegicus
gcactacagaggtagcaaggtcact

SEQ ID NO: 380676 - DNA, 25 bp, Rattus norvegicus
gcactaccgatacaagttcagcctc

SEQ ID NO: 380677 - DNA, 25 bp, Rattus norvegicus
gcactaccgatagaagttcagcctc

SEQ ID NO: 380678 - DNA, 25 bp, Rattus norvegicus
gcactacgccaacgttgagctggtt

SEQ ID NO: 380679 - DNA, 25 bp, Rattus norvegicus
gcactacgccaaggttgagctggtt

SEQ ID NO: 380680 - DNA, 25 bp, Rattus norvegicus
gcactacgggacctctggctggctt

SEQ ID NO: 380681 - DNA, 25 bp, Rattus norvegicus
gcactacgggacgtctggctggctt

SEQ ID NO: 380682 - DNA, 25 bp, Rattus norvegicus
gcactacgtggacagcgcttcagca

SEQ ID NO: 380683 - DNA, 25 bp, Rattus norvegicus
gcactacgtggagagcgcttcagca

SEQ ID NO: 380684 - DNA, 25 bp, Rattus norvegicus
gcactactagtgatcagcggctcaa

SEQ ID NO: 380685 - DNA, 25 bp, Rattus norvegicus
gcactactagtgttcagcggctcaa

SEQ ID NO: 380686 - DNA, 25 bp, Rattus norvegicus
gcactactcattaacacacattcac

SEQ ID NO: 380687 - DNA, 25 bp, Rattus norvegicus
gcactactcatttacacacattcac

SEQ ID NO: 380688 - DNA, 25 bp, Rattus norvegicus
gcactactctagctcattttgggtt

SEQ ID NO: 380689 - DNA, 25 bp, Rattus norvegicus
gcactactctaggtcattttgggtt

SEQ ID NO: 380690 - DNA, 25 bp, Rattus norvegicus
gcactactggacaaagaccttatat

SEQ ID NO: 380691 - DNA, 25 bp, Rattus norvegicus
gcactactggactaagaccttatat

SEQ ID NO: 380692 - DNA, 25 bp, Rattus norvegicus
gcactactggtaaattaagcccaaa

SEQ ID NO: 380693 - DNA, 25 bp, Rattus norvegicus
gcactactggtatattaagcccaaa

SEQ ID NO: 380694 - DNA, 25 bp, Rattus norvegicus
gcactacttctaaaggtctctctga

SEQ ID NO: 380695 - DNA, 25 bp, Rattus norvegicus
gcactacttctataggtctctctga

SEQ ID NO: 380696 - DNA, 25 bp, Rattus norvegicus
gcactacttctcaagtcgccgaggc

SEQ ID NO: 380697 - DNA, 25 bp, Rattus norvegicus
gcactacttctctagtcgccgaggc

SEQ ID NO: 380698 - DNA, 25 bp, Rattus norvegicus
gcactagaactcaacaccatggact

SEQ ID NO: 380699 - DNA, 25 bp, Rattus norvegicus
gcactagaactctacaccatggact

SEQ ID NO: 380700 - DNA, 25 bp, Rattus norvegicus
gcactagaggcgctttcttaccaaa

SEQ ID NO: 380701 - DNA, 25 bp, Rattus norvegicus
gcactagaggcggtttcttaccaaa

SEQ ID NO: 380702 - DNA, 25 bp, Rattus norvegicus
gcactagcacaaacattgcccacag

SEQ ID NO: 380703 - DNA, 25 bp, Rattus norvegicus
gcactagcacaatcattgcccacag

SEQ ID NO: 380704 - DNA, 25 bp, Rattus norvegicus
gcactagcactgctcagttttgtat

SEQ ID NO: 380705 - DNA, 25 bp, Rattus norvegicus
gcactagcactggtcagttttgtat

SEQ ID NO: 380706 - DNA, 25 bp, Rattus norvegicus
gcactagccctactgagctacttta

SEQ ID NO: 380707 - DNA, 25 bp, Rattus norvegicus
gcactagccctagtgagctacttta

SEQ ID NO: 380708 - DNA, 25 bp, Rattus norvegicus
gcactagctgcacatgggtccttga

SEQ ID NO: 380709 - DNA, 25 bp, Rattus norvegicus
gcactagctgcagatgggtccttga

SEQ ID NO: 380710 - DNA, 25 bp, Rattus norvegicus
gcactaggacctacgaaagggtgta

SEQ ID NO: 380711 - DNA, 25 bp, Rattus norvegicus
gcactaggaccttcgaaagggtgta

SEQ ID NO: 380712 - DNA, 25 bp, Rattus norvegicus
gcactaggatcaaggctgctgccag

SEQ ID NO: 380713 - DNA, 25 bp, Rattus norvegicus
gcactaggatcatggctgctgccag

SEQ ID NO: 380714 - DNA, 25 bp, Rattus norvegicus
gcactaggcgtcctttatgccggta

SEQ ID NO: 380715 - DNA, 25 bp, Rattus norvegicus
gcactaggcgtcgtttatgccggta

SEQ ID NO: 380716 - DNA, 25 bp, Rattus norvegicus
gcactagggaacattaatgctttca

SEQ ID NO: 380717 - DNA, 25 bp, Rattus norvegicus
gcactagggaactttaatgctttca

SEQ ID NO: 380718 - DNA, 25 bp, Rattus norvegicus
gcactagtacttcagcttcgttaca

SEQ ID NO: 380719 - DNA, 25 bp, Rattus norvegicus
gcactagtacttgagcttcgttaca

SEQ ID NO: 380720 - DNA, 25 bp, Rattus norvegicus
gcactagtatttaaccaccagatgg

SEQ ID NO: 380721 - DNA, 25 bp, Rattus norvegicus
gcactagtattttaccaccagatgg

SEQ ID NO: 380722 - DNA, 25 bp, Rattus norvegicus
gcactagtccctaacatatgtcata

SEQ ID NO: 380723 - DNA, 25 bp, Rattus norvegicus
gcactagtcccttacatatgtcata

SEQ ID NO: 380724 - DNA, 25 bp, Rattus norvegicus
gcactagtcgccaaaacctcaaata

SEQ ID NO: 380725 - DNA, 25 bp, Rattus norvegicus
gcactagtcgcctaaacctcaaata

SEQ ID NO: 380726 - DNA, 25 bp, Rattus norvegicus
gcactagtgactatctcttaccatg

SEQ ID NO: 380727 - DNA, 25 bp, Rattus norvegicus
gcactagtgactttctcttaccatg

SEQ ID NO: 380728 - DNA, 25 bp, Rattus norvegicus
gcactatacgcaccttttcagggtt

SEQ ID NO: 380729 - DNA, 25 bp, Rattus norvegicus
gcactatacgcagcttttcagggtt

SEQ ID NO: 380730 - DNA, 25 bp, Rattus norvegicus
gcactatatgcacacagggtaacta

SEQ ID NO: 380731 - DNA, 25 bp, Rattus norvegicus
gcactatatgcagacagggtaacta

SEQ ID NO: 380732 - DNA, 25 bp, Rattus norvegicus
gcactatatgctatgtggtccttat

SEQ ID NO: 380733 - DNA, 25 bp, Rattus norvegicus
gcactatatgctttgtggtccttat

SEQ ID NO: 380734 - DNA, 25 bp, Rattus norvegicus
gcactatcacatcaagtacttccat

SEQ ID NO: 380735 - DNA, 25 bp, Rattus norvegicus
gcactatcacatgaagtacttccat

SEQ ID NO: 380736 - DNA, 25 bp, Rattus norvegicus
gcactatctgtaacaaggccttcca

SEQ ID NO: 380737 - DNA, 25 bp, Rattus norvegicus
gcactatctgtatcaaggccttcca

SEQ ID NO: 380738 - DNA, 25 bp, Rattus norvegicus
gcactatctgtcaggcatagaaacc

SEQ ID NO: 380739 - DNA, 25 bp, Rattus norvegicus
gcactatctgtctggcatagaaacc

SEQ ID NO: 380740 - DNA, 25 bp, Rattus norvegicus
gcactatgataacgcaagaccatca

SEQ ID NO: 380741 - DNA, 25 bp, Rattus norvegicus
gcactatgataaggcaagaccatca

SEQ ID NO: 380742 - DNA, 25 bp, Rattus norvegicus
gcactatgcctcacttgatgttacg

SEQ ID NO: 380743 - DNA, 25 bp, Rattus norvegicus
gcactatgcctctcttgatgttacg

SEQ ID NO: 380744 - DNA, 25 bp, Rattus norvegicus
gcactatgctggctgtgttgtttca

SEQ ID NO: 380745 - DNA, 25 bp, Rattus norvegicus
gcactatgctgggtgtgttgtttca

SEQ ID NO: 380746 - DNA, 25 bp, Rattus norvegicus
gcactatggcacatcactcaagcaa

SEQ ID NO: 380747 - DNA, 25 bp, Rattus norvegicus
gcactatggcacttcactcaagcaa

SEQ ID NO: 380748 - DNA, 25 bp, Rattus norvegicus
gcactattactcacgttgggcaggt

SEQ ID NO: 380749 - DNA, 25 bp, Rattus norvegicus
gcactattactctcgttgggcaggt

SEQ ID NO: 380750 - DNA, 25 bp, Rattus norvegicus
gcactattgcgaatccagttactgg

SEQ ID NO: 380751 - DNA, 25 bp, Rattus norvegicus
gcactattgcgattccagttactgg

SEQ ID NO: 380752 - DNA, 25 bp, Rattus norvegicus
gcactattgttcaaagggtcttctg

SEQ ID NO: 380753 - DNA, 25 bp, Rattus norvegicus
gcactattgttctaagggtcttctg

SEQ ID NO: 380754 - DNA, 25 bp, Rattus norvegicus
gcactattttggaaggcgcagcaca

SEQ ID NO: 380755 - DNA, 25 bp, Rattus norvegicus
gcactattttggtaggcgcagcaca

SEQ ID NO: 380756 - DNA, 25 bp, Rattus norvegicus
gcactcaaaaggctggctgtaaggc

SEQ ID NO: 380757 - DNA, 25 bp, Rattus norvegicus
gcactcaaaagggtggctgtaaggc

SEQ ID NO: 380758 - DNA, 25 bp, Rattus norvegicus
gcactcaaactcaaattggtgtgtt

SEQ ID NO: 380759 - DNA, 25 bp, Rattus norvegicus
gcactcaaactctaattggtgtgtt

SEQ ID NO: 380760 - DNA, 25 bp, Rattus norvegicus
gcactcaaacttccaaaagcgtcgc

SEQ ID NO: 380761 - DNA, 25 bp, Rattus norvegicus
gcactcaaacttgcaaaagcgtcgc

SEQ ID NO: 380762 - DNA, 25 bp, Rattus norvegicus
gcactcaaccgcaatagtcaaaatg

SEQ ID NO: 380763 - DNA, 25 bp, Rattus norvegicus
gcactcaaccgctatagtcaaaatg

SEQ ID NO: 380764 - DNA, 25 bp, Rattus norvegicus
gcactcaactgaaagtcaaggcatt

SEQ ID NO: 380765 - DNA, 25 bp, Rattus norvegicus
gcactcaactgatagtcaaggcatt

SEQ ID NO: 380766 - DNA, 25 bp, Rattus norvegicus
gcactcaagagtagctagtcctaac

SEQ ID NO: 380767 - DNA, 25 bp, Rattus norvegicus
gcactcaagagttgctagtcctaac

SEQ ID NO: 380768 - DNA, 25 bp, Rattus norvegicus
gcactcacaggtaggcagcaaatat

SEQ ID NO: 380769 - DNA, 25 bp, Rattus norvegicus
gcactcacaggttggcagcaaatat

SEQ ID NO: 380770 - DNA, 25 bp, Rattus norvegicus
gcactcacccctaggtgaaagcaga

SEQ ID NO: 380771 - DNA, 25 bp, Rattus norvegicus
gcactcaccccttggtgaaagcaga

SEQ ID NO: 380772 - DNA, 25 bp, Rattus norvegicus
gcactcacgtgtagaaaagcatctt

SEQ ID NO: 380773 - DNA, 25 bp, Rattus norvegicus
gcactcacgtgttgaaaagcatctt

SEQ ID NO: 380774 - DNA, 25 bp, Rattus norvegicus
gcactcactgagaatgctgggcatt

SEQ ID NO: 380775 - DNA, 25 bp, Rattus norvegicus
gcactcactgagtatgctgggcatt

SEQ ID NO: 380776 - DNA, 25 bp, Rattus norvegicus
gcactcactggtaccatttgggtga

SEQ ID NO: 380777 - DNA, 25 bp, Rattus norvegicus
gcactcactggttccatttgggtga

SEQ ID NO: 380778 - DNA, 25 bp, Rattus norvegicus
gcactcactgtgacctggagaacag

SEQ ID NO: 380779 - DNA, 25 bp, Rattus norvegicus
gcactcactgtgtcctggagaacag

SEQ ID NO: 380780 - DNA, 25 bp, Rattus norvegicus
gcactcactttgcagacctcagaaa

SEQ ID NO: 380781 - DNA, 25 bp, Rattus norvegicus
gcactcactttggagacctcagaaa

SEQ ID NO: 380782 - DNA, 25 bp, Rattus norvegicus
gcactcagacaaatccaggcttatt

SEQ ID NO: 380783 - DNA, 25 bp, Rattus norvegicus
gcactcagacaattccaggcttatt

SEQ ID NO: 380784 - DNA, 25 bp, Rattus norvegicus
gcactcagacacatcaggttctggt

SEQ ID NO: 380785 - DNA, 25 bp, Rattus norvegicus
gcactcagacacttcaggttctggt

SEQ ID NO: 380786 - DNA, 25 bp, Rattus norvegicus
gcactcagcagcagtgggctgtaaa

SEQ ID NO: 380787 - DNA, 25 bp, Rattus norvegicus
gcactcagcagctgtgggctgtaaa

SEQ ID NO: 380788 - DNA, 25 bp, Rattus norvegicus
gcactcagccccataactggaagaa

SEQ ID NO: 380789 - DNA, 25 bp, Rattus norvegicus
gcactcagccccttaactggaagaa

SEQ ID NO: 380790 - DNA, 25 bp, Rattus norvegicus
gcactcagcggtaccgtgtagctta

SEQ ID NO: 380791 - DNA, 25 bp, Rattus norvegicus
gcactcagcggttccgtgtagctta

SEQ ID NO: 380792 - DNA, 25 bp, Rattus norvegicus
gcactcagcttcatttgatgcagag

SEQ ID NO: 380793 - DNA, 25 bp, Rattus norvegicus
gcactcagcttcttttgatgcagag

SEQ ID NO: 380794 - DNA, 25 bp, Rattus norvegicus
gcactcaggcaaccaaccatagatt

SEQ ID NO: 380795 - DNA, 25 bp, Rattus norvegicus
gcactcaggcaagcaaccatagatt

SEQ ID NO: 380796 - DNA, 25 bp, Rattus norvegicus
gcactcagtccaaataaacatttaa

SEQ ID NO: 380797 - DNA, 25 bp, Rattus norvegicus
gcactcagtccatataaacatttaa

SEQ ID NO: 380798 - DNA, 25 bp, Rattus norvegicus
gcactcagtgagctttctttttaaa

SEQ ID NO: 380799 - DNA, 25 bp, Rattus norvegicus
gcactcagtgaggtttctttttaaa

SEQ ID NO: 380800 - DNA, 25 bp, Rattus norvegicus
gcactcagtggccacgtttggacat

SEQ ID NO: 380801 - DNA, 25 bp, Rattus norvegicus
gcactcagtggcgacgtttggacat

SEQ ID NO: 380802 - DNA, 25 bp, Rattus norvegicus
gcactcagttcgctgcaggccggtc

SEQ ID NO: 380803 - DNA, 25 bp, Rattus norvegicus
gcactcagttcggtgcaggccggtc

SEQ ID NO: 380804 - DNA, 25 bp, Rattus norvegicus
gcactcagttgtatctattgcagta

SEQ ID NO: 380805 - DNA, 25 bp, Rattus norvegicus
gcactcagttgtttctattgcagta

SEQ ID NO: 380806 - DNA, 25 bp, Rattus norvegicus
gcactcatctacatccagacagttg

SEQ ID NO: 380807 - DNA, 25 bp, Rattus norvegicus
gcactcatctacttccagacagttg

SEQ ID NO: 380808 - DNA, 25 bp, Rattus norvegicus
gcactcatgacgctctgcctgaaaa

SEQ ID NO: 380809 - DNA, 25 bp, Rattus norvegicus
gcactcatgacggtctgcctgaaaa

SEQ ID NO: 380810 - DNA, 25 bp, Rattus norvegicus
gcactcatgaggacagggcagctat

SEQ ID NO: 380811 - DNA, 25 bp, Rattus norvegicus
gcactcatgaggtcagggcagctat

SEQ ID NO: 380812 - DNA, 25 bp, Rattus norvegicus
gcactcatgatcacttacaaggacg

SEQ ID NO: 380813 - DNA, 25 bp, Rattus norvegicus
gcactcatgatctcttacaaggacg

SEQ ID NO: 380814 - DNA, 25 bp, Rattus norvegicus
gcactcatggacagcaagcatcctg

SEQ ID NO: 380815 - DNA, 25 bp, Rattus norvegicus
gcactcatggactgcaagcatcctg

SEQ ID NO: 380816 - DNA, 25 bp, Rattus norvegicus
gcactcatgtcgaatctgtgactat

SEQ ID NO: 380817 - DNA, 25 bp, Rattus norvegicus
gcactcatgtcgtatctgtgactat

SEQ ID NO: 380818 - DNA, 25 bp, Rattus norvegicus
gcactcattcagcatcttggaacca

SEQ ID NO: 380819 - DNA, 25 bp, Rattus norvegicus
gcactcattcaggatcttggaacca

SEQ ID NO: 380820 - DNA, 25 bp, Rattus norvegicus
gcactcatttctaattccaaacacg

SEQ ID NO: 380821 - DNA, 25 bp, Rattus norvegicus
gcactcatttcttattccaaacacg

SEQ ID NO: 380822 - DNA, 25 bp, Rattus norvegicus
gcactccaaggcacaggctttaaag

SEQ ID NO: 380823 - DNA, 25 bp, Rattus norvegicus
gcactccaaggctcaggctttaaag

SEQ ID NO: 380824 - DNA, 25 bp, Rattus norvegicus
gcactccaatggacagcgttagaaa

SEQ ID NO: 380825 - DNA, 25 bp, Rattus norvegicus
gcactccaatggtcagcgttagaaa

SEQ ID NO: 380826 - DNA, 25 bp, Rattus norvegicus
gcactccagagtattctattttgta

SEQ ID NO: 380827 - DNA, 25 bp, Rattus norvegicus
gcactccagagttttctattttgta

SEQ ID NO: 380828 - DNA, 25 bp, Rattus norvegicus
gcactccagctcactgatagcagga

SEQ ID NO: 380829 - DNA, 25 bp, Rattus norvegicus
gcactccagctctctgatagcagga

SEQ ID NO: 380830 - DNA, 25 bp, Rattus norvegicus
gcactcccgttcacaagtttattga

SEQ ID NO: 380831 - DNA, 25 bp, Rattus norvegicus
gcactcccgttctcaagtttattga

SEQ ID NO: 380832 - DNA, 25 bp, Rattus norvegicus
gcactccctagcatagttggtacag

SEQ ID NO: 380833 - DNA, 25 bp, Rattus norvegicus
gcactccctagcttagttggtacag

SEQ ID NO: 380834 - DNA, 25 bp, Rattus norvegicus
gcactccctcacaggagggttggga

SEQ ID NO: 380835 - DNA, 25 bp, Rattus norvegicus
gcactccctcactggagggttggga

SEQ ID NO: 380836 - DNA, 25 bp, Rattus norvegicus
gcactcccttgccagaaacttgtaa

SEQ ID NO: 380837 - DNA, 25 bp, Rattus norvegicus
gcactcccttgcgagaaacttgtaa

SEQ ID NO: 380838 - DNA, 25 bp, Rattus norvegicus
gcactccgtgtgcatagcagtttat

SEQ ID NO: 380839 - DNA, 25 bp, Rattus norvegicus
gcactccgtgtggatagcagtttat

SEQ ID NO: 380840 - DNA, 25 bp, Rattus norvegicus
gcactcctagcaaatgattgtctca

SEQ ID NO: 380841 - DNA, 25 bp, Rattus norvegicus
gcactcctagcatatgattgtctca

SEQ ID NO: 380842 - DNA, 25 bp, Rattus norvegicus
gcactcctaggacgagcctgtgaga

SEQ ID NO: 380843 - DNA, 25 bp, Rattus norvegicus
gcactcctaggaggagcctgtgaga

SEQ ID NO: 380844 - DNA, 25 bp, Rattus norvegicus
gcactcctatgcctgcatgcatata

SEQ ID NO: 380845 - DNA, 25 bp, Rattus norvegicus
gcactcctatgcgtgcatgcatata

SEQ ID NO: 380846 - DNA, 25 bp, Rattus norvegicus
gcactcctgtgtctgtgagagctat

SEQ ID NO: 380847 - DNA, 25 bp, Rattus norvegicus
gcactcctgtgtgtgtgagagctat

SEQ ID NO: 380848 - DNA, 25 bp, Rattus norvegicus
gcactcctttggagaagattaagca

SEQ ID NO: 380849 - DNA, 25 bp, Rattus norvegicus
gcactcctttggtgaagattaagca

SEQ ID NO: 380850 - DNA, 25 bp, Rattus norvegicus
gcactcgagataaccggcagctggg

SEQ ID NO: 380851 - DNA, 25 bp, Rattus norvegicus
gcactcgagatatccggcagctggg

SEQ ID NO: 380852 - DNA, 25 bp, Rattus norvegicus
gcactcgagcagaagtactaccgct

SEQ ID NO: 380853 - DNA, 25 bp, Rattus norvegicus
gcactcgagcagtagtactaccgct

SEQ ID NO: 380854 - DNA, 25 bp, Rattus norvegicus
gcactcgatgcacttgtttctgtaa

SEQ ID NO: 380855 - DNA, 25 bp, Rattus norvegicus
gcactcgatgcagttgtttctgtaa

SEQ ID NO: 380856 - DNA, 25 bp, Rattus norvegicus
gcactcgcagcactctcataaaaaa

SEQ ID NO: 380857 - DNA, 25 bp, Rattus norvegicus
gcactcgcagcagtctcataaaaaa

SEQ ID NO: 380858 - DNA, 25 bp, Rattus norvegicus
gcactcgcagtactgttccttaaaa

SEQ ID NO: 380859 - DNA, 25 bp, Rattus norvegicus
gcactcgcagtagtgttccttaaaa

SEQ ID NO: 380860 - DNA, 25 bp, Rattus norvegicus
gcactcgcagttcctgcgaagtgtg

SEQ ID NO: 380861 - DNA, 25 bp, Rattus norvegicus
gcactcgcagttgctgcgaagtgtg

SEQ ID NO: 380862 - DNA, 25 bp, Rattus norvegicus
gcactcgcctgacggaaagttgaat

SEQ ID NO: 380863 - DNA, 25 bp, Rattus norvegicus
gcactcgcctgagggaaagttgaat

SEQ ID NO: 380864 - DNA, 25 bp, Rattus norvegicus
gcactcgctctgcaagctaaacatt

SEQ ID NO: 380865 - DNA, 25 bp, Rattus norvegicus
gcactcgctctggaagctaaacatt

SEQ ID NO: 380866 - DNA, 25 bp, Rattus norvegicus
gcactcgggaggataaggacaaact

SEQ ID NO: 380867 - DNA, 25 bp, Rattus norvegicus
gcactcgggaggttaaggacaaact

SEQ ID NO: 380868 - DNA, 25 bp, Rattus norvegicus
gcactcgggtgcaacctgacaggga

SEQ ID NO: 380869 - DNA, 25 bp, Rattus norvegicus
gcactcgggtgctacctgacaggga

SEQ ID NO: 380870 - DNA, 25 bp, Rattus norvegicus
gcactcgtatgaccgggaccctgtc

SEQ ID NO: 380871 - DNA, 25 bp, Rattus norvegicus
gcactcgtatgagcgggaccctgtc

SEQ ID NO: 380872 - DNA, 25 bp, Rattus norvegicus
gcactcgtgcatatacctacacata

SEQ ID NO: 380873 - DNA, 25 bp, Rattus norvegicus
gcactcgtgcatttacctacacata

SEQ ID NO: 380874 - DNA, 25 bp, Rattus norvegicus
gcactctaacttatgtgaactgaga

SEQ ID NO: 380875 - DNA, 25 bp, Rattus norvegicus
gcactctaacttttgtgaactgaga

SEQ ID NO: 380876 - DNA, 25 bp, Rattus norvegicus
gcactctaagcaataacagtctccc

SEQ ID NO: 380877 - DNA, 25 bp, Rattus norvegicus
gcactctaagcattaacagtctccc

SEQ ID NO: 380878 - DNA, 25 bp, Rattus norvegicus
gcactctacttactcatagcagcat

SEQ ID NO: 380879 - DNA, 25 bp, Rattus norvegicus
gcactctacttagtcatagcagcat

SEQ ID NO: 380880 - DNA, 25 bp, Rattus norvegicus
gcactctagcttagcacctaagtag

SEQ ID NO: 380881 - DNA, 25 bp, Rattus norvegicus
gcactctagctttgcacctaagtag

SEQ ID NO: 380882 - DNA, 25 bp, Rattus norvegicus
gcactctagtgcacatacaattaat

SEQ ID NO: 380883 - DNA, 25 bp, Rattus norvegicus
gcactctagtgcctccagaagattg

SEQ ID NO: 380884 - DNA, 25 bp, Rattus norvegicus
gcactctagtgcgtccagaagattg

SEQ ID NO: 380885 - DNA, 25 bp, Rattus norvegicus
gcactctagtgctcatacaattaat

SEQ ID NO: 380886 - DNA, 25 bp, Rattus norvegicus
gcactctcaagcaaatcgaagacag

SEQ ID NO: 380887 - DNA, 25 bp, Rattus norvegicus
gcactctcaagctaatcgaagacag

SEQ ID NO: 380888 - DNA, 25 bp, Rattus norvegicus
gcactctccaagcactttgtgcata

SEQ ID NO: 380889 - DNA, 25 bp, Rattus norvegicus
gcactctccaaggactttgtgcata

SEQ ID NO: 380890 - DNA, 25 bp, Rattus norvegicus
gcactctctgcaaacaatatatggg

SEQ ID NO: 380891 - DNA, 25 bp, Rattus norvegicus
gcactctctgcatacaatatatggg

SEQ ID NO: 380892 - DNA, 25 bp, Rattus norvegicus
gcactctcttcaatttggtatccac

SEQ ID NO: 380893 - DNA, 25 bp, Rattus norvegicus
gcactctcttcattttggtatccac

SEQ ID NO: 380894 - DNA, 25 bp, Rattus norvegicus
gcactctgaagaccactcgtatcaa

SEQ ID NO: 380895 - DNA, 25 bp, Rattus norvegicus
gcactctgaagagcactcgtatcaa

SEQ ID NO: 380896 - DNA, 25 bp, Rattus norvegicus
gcactctgagggaggcgcctgctct

SEQ ID NO: 380897 - DNA, 25 bp, Rattus norvegicus
gcactctgagggtggcgcctgctct

SEQ ID NO: 380898 - DNA, 25 bp, Rattus norvegicus
gcactctgatctcactggcacaaat

SEQ ID NO: 380899 - DNA, 25 bp, Rattus norvegicus
gcactctgatctgactggcacaaat

SEQ ID NO: 380900 - DNA, 25 bp, Rattus norvegicus
gcactctgcgtcagactggtcagat

SEQ ID NO: 380901 - DNA, 25 bp, Rattus norvegicus
gcactctgcgtctgactggtcagat

SEQ ID NO: 380902 - DNA, 25 bp, Rattus norvegicus
gcactctggaatcgcacaatcacgt

SEQ ID NO: 380903 - DNA, 25 bp, Rattus norvegicus
gcactctggaatggcacaatcacgt

SEQ ID NO: 380904 - DNA, 25 bp, Rattus norvegicus
gcactctggagccaaagacaggttg

SEQ ID NO: 380905 - DNA, 25 bp, Rattus norvegicus
gcactctggagcgaaagacaggttg

SEQ ID NO: 380906 - DNA, 25 bp, Rattus norvegicus
gcactctggaggctatccgtgttaa

SEQ ID NO: 380907 - DNA, 25 bp, Rattus norvegicus
gcactctggagggtatccgtgttaa

SEQ ID NO: 380908 - DNA, 25 bp, Rattus norvegicus
gcactctggatgctgcggaagaaat

SEQ ID NO: 380909 - DNA, 25 bp, Rattus norvegicus
gcactctggatggtgcggaagaaat

SEQ ID NO: 380910 - DNA, 25 bp, Rattus norvegicus
gcactctgggacagccatctaagat

SEQ ID NO: 380911 - DNA, 25 bp, Rattus norvegicus
gcactctgggactgccatctaagat

SEQ ID NO: 380912 - DNA, 25 bp, Rattus norvegicus
gcactctgggccatcagggctgaat

SEQ ID NO: 380913 - DNA, 25 bp, Rattus norvegicus
gcactctgggccttcagggctgaat

SEQ ID NO: 380914 - DNA, 25 bp, Rattus norvegicus
gcactctgtgttcgaagcctatcaa

SEQ ID NO: 380915 - DNA, 25 bp, Rattus norvegicus
gcactctgtgttggaagcctatcaa

SEQ ID NO: 380916 - DNA, 25 bp, Rattus norvegicus
gcactctgttcacattgcctgtgtt

SEQ ID NO: 380917 - DNA, 25 bp, Rattus norvegicus
gcactctgttcagattgcctgtgtt

SEQ ID NO: 380918 - DNA, 25 bp, Rattus norvegicus
gcactctgttgtcctgatagtctat

SEQ ID NO: 380919 - DNA, 25 bp, Rattus norvegicus
gcactctgttgtgctgatagtctat

SEQ ID NO: 380920 - DNA, 25 bp, Rattus norvegicus
gcactctgtttgaaaactcactgct

SEQ ID NO: 380921 - DNA, 25 bp, Rattus norvegicus
gcactctgtttgtaaactcactgct

SEQ ID NO: 380922 - DNA, 25 bp, Rattus norvegicus
gcactcttgccaattggatctggat

SEQ ID NO: 380923 - DNA, 25 bp, Rattus norvegicus
gcactcttgccatttggatctggat

SEQ ID NO: 380924 - DNA, 25 bp, Rattus norvegicus
gcactcttgggcaccacgtgtgagg

SEQ ID NO: 380925 - DNA, 25 bp, Rattus norvegicus
gcactcttgggctccacgtgtgagg

SEQ ID NO: 380926 - DNA, 25 bp, Rattus norvegicus
gcactcttggttctttggagccttg

SEQ ID NO: 380927 - DNA, 25 bp, Rattus norvegicus
gcactcttggttgtttggagccttg

SEQ ID NO: 380928 - DNA, 25 bp, Rattus norvegicus
gcactctttccaccttgtggctata

SEQ ID NO: 380929 - DNA, 25 bp, Rattus norvegicus
gcactctttccagcttgtggctata

SEQ ID NO: 380930 - DNA, 25 bp, Rattus norvegicus
gcactctttcggaattctgcagatg

SEQ ID NO: 380931 - DNA, 25 bp, Rattus norvegicus
gcactctttcggtattctgcagatg

SEQ ID NO: 380932 - DNA, 25 bp, Rattus norvegicus
gcactctttggcagcatgcaggaca

SEQ ID NO: 380933 - DNA, 25 bp, Rattus norvegicus
gcactctttggctgcatgcaggaca

SEQ ID NO: 380934 - DNA, 25 bp, Rattus norvegicus
gcactgaaaaccaatgatgccctgg

SEQ ID NO: 380935 - DNA, 25 bp, Rattus norvegicus
gcactgaaaacctatgatgccctgg

SEQ ID NO: 380936 - DNA, 25 bp, Rattus norvegicus
gcactgaaactgctgactgtagtca

SEQ ID NO: 380937 - DNA, 25 bp, Rattus norvegicus
gcactgaaactggtgactgtagtca

SEQ ID NO: 380938 - DNA, 25 bp, Rattus norvegicus
gcactgaaatggaggctactttaat

SEQ ID NO: 380939 - DNA, 25 bp, Rattus norvegicus
gcactgaaatggtggctactttaat

SEQ ID NO: 380940 - DNA, 25 bp, Rattus norvegicus
gcactgaacattatgcaaattctag

SEQ ID NO: 380941 - DNA, 25 bp, Rattus norvegicus
gcactgaacattttgcaaattctag

SEQ ID NO: 380942 - DNA, 25 bp, Rattus norvegicus
gcactgaagataaaccatcggcctt

SEQ ID NO: 380943 - DNA, 25 bp, Rattus norvegicus
gcactgaagataatcggcggacccc

SEQ ID NO: 380944 - DNA, 25 bp, Rattus norvegicus
gcactgaagatataccatcggcctt

SEQ ID NO: 380945 - DNA, 25 bp, Rattus norvegicus
gcactgaagatattcggcggacccc

SEQ ID NO: 380946 - DNA, 25 bp, Rattus norvegicus
gcactgaagcggaagcattgggttt

SEQ ID NO: 380947 - DNA, 25 bp, Rattus norvegicus
gcactgaagcggtagcattgggttt

SEQ ID NO: 380948 - DNA, 25 bp, Rattus norvegicus
gcactgaaggacatttgaacccata

SEQ ID NO: 380949 - DNA, 25 bp, Rattus norvegicus
gcactgaaggacttttgaacccata

SEQ ID NO: 380950 - DNA, 25 bp, Rattus norvegicus
gcactgaagtgcaatggtctccctg

SEQ ID NO: 380951 - DNA, 25 bp, Rattus norvegicus
gcactgaagtgctatggtctccctg

SEQ ID NO: 380952 - DNA, 25 bp, Rattus norvegicus
gcactgacacagcacttacgttgat

SEQ ID NO: 380953 - DNA, 25 bp, Rattus norvegicus
gcactgacacaggacttacgttgat

SEQ ID NO: 380954 - DNA, 25 bp, Rattus norvegicus
gcactgacagtcaataacctcaacc

SEQ ID NO: 380955 - DNA, 25 bp, Rattus norvegicus
gcactgacagtctataacctcaacc

SEQ ID NO: 380956 - DNA, 25 bp, Rattus norvegicus
gcactgacatgcctggttcacatag

SEQ ID NO: 380957 - DNA, 25 bp, Rattus norvegicus
gcactgacatgcgtggttcacatag

SEQ ID NO: 380958 - DNA, 25 bp, Rattus norvegicus
gcactgaccaaaccccagggtgtat

SEQ ID NO: 380959 - DNA, 25 bp, Rattus norvegicus
gcactgaccaaagcccagggtgtat

SEQ ID NO: 380960 - DNA, 25 bp, Rattus norvegicus
gcactgacccagcagttaacactca

SEQ ID NO: 380961 - DNA, 25 bp, Rattus norvegicus
gcactgacccaggagttaacactca

SEQ ID NO: 380962 - DNA, 25 bp, Rattus norvegicus
gcactgacgtggaattgcatagcac

SEQ ID NO: 380963 - DNA, 25 bp, Rattus norvegicus
gcactgacgtggtattgcatagcac

SEQ ID NO: 380964 - DNA, 25 bp, Rattus norvegicus
gcactgactagtcgctggaggccca

SEQ ID NO: 380965 - DNA, 25 bp, Rattus norvegicus
gcactgactagtggctggaggccca

SEQ ID NO: 380966 - DNA, 25 bp, Rattus norvegicus
gcactgactcgactgaacgcaactg

SEQ ID NO: 380967 - DNA, 25 bp, Rattus norvegicus
gcactgactcgagtgaacgcaactg

SEQ ID NO: 380968 - DNA, 25 bp, Rattus norvegicus
gcactgacttgcactgctttaagaa

SEQ ID NO: 380969 - DNA, 25 bp, Rattus norvegicus
gcactgacttgctctgctttaagaa

SEQ ID NO: 380970 - DNA, 25 bp, Rattus norvegicus
gcactgagaccgattctggagcgat

SEQ ID NO: 380971 - DNA, 25 bp, Rattus norvegicus
gcactgagaccgtttctggagcgat

SEQ ID NO: 380972 - DNA, 25 bp, Rattus norvegicus
gcactgagacttaaaacctccgagg

SEQ ID NO: 380973 - DNA, 25 bp, Rattus norvegicus
gcactgagactttaaacctccgagg

SEQ ID NO: 380974 - DNA, 25 bp, Rattus norvegicus
gcactgagattaagtctgggccatt

SEQ ID NO: 380975 - DNA, 25 bp, Rattus norvegicus
gcactgagattatgtctgggccatt

SEQ ID NO: 380976 - DNA, 25 bp, Rattus norvegicus
gcactgagcaggcagcaccaactct

SEQ ID NO: 380977 - DNA, 25 bp, Rattus norvegicus
gcactgagcagggagcaccaactct

SEQ ID NO: 380978 - DNA, 25 bp, Rattus norvegicus
gcactgagcattatctctgctgaga

SEQ ID NO: 380979 - DNA, 25 bp, Rattus norvegicus
gcactgagcattttctctgctgaga

SEQ ID NO: 380980 - DNA, 25 bp, Rattus norvegicus
gcactgaggagacacgccttccaat

SEQ ID NO: 380981 - DNA, 25 bp, Rattus norvegicus
gcactgaggagagacgccttccaat

SEQ ID NO: 380982 - DNA, 25 bp, Rattus norvegicus
gcactgaggtgaagcccaaggcgac

SEQ ID NO: 380983 - DNA, 25 bp, Rattus norvegicus
gcactgaggtgatgcccaaggcgac

SEQ ID NO: 380984 - DNA, 25 bp, Rattus norvegicus
gcactgagtcttatagagtcttcgt

SEQ ID NO: 380985 - DNA, 25 bp, Rattus norvegicus
gcactgagtcttttagagtcttcgt

SEQ ID NO: 380986 - DNA, 25 bp, Rattus norvegicus
gcactgagtgctcggaaactgccat

SEQ ID NO: 380987 - DNA, 25 bp, Rattus norvegicus
gcactgagtgctgggaaactgccat

SEQ ID NO: 380988 - DNA, 25 bp, Rattus norvegicus
gcactgatatttcagctgccttgat

SEQ ID NO: 380989 - DNA, 25 bp, Rattus norvegicus
gcactgatatttgagctgccttgat

SEQ ID NO: 380990 - DNA, 25 bp, Rattus norvegicus
gcactgatctagatgcatggttagt

SEQ ID NO: 380991 - DNA, 25 bp, Rattus norvegicus
gcactgatctagttgcatggttagt

SEQ ID NO: 380992 - DNA, 25 bp, Rattus norvegicus
gcactgatgctgcacctgattttta

SEQ ID NO: 380993 - DNA, 25 bp, Rattus norvegicus
gcactgatgctggacctgattttta

SEQ ID NO: 380994 - DNA, 25 bp, Rattus norvegicus
gcactgatgcttacgaggctctgaa

SEQ ID NO: 380995 - DNA, 25 bp, Rattus norvegicus
gcactgatgctttcgaggctctgaa

SEQ ID NO: 380996 - DNA, 25 bp, Rattus norvegicus
gcactgatggttaccgttttaattt

SEQ ID NO: 380997 - DNA, 25 bp, Rattus norvegicus
gcactgatggtttccgttttaattt

SEQ ID NO: 380998 - DNA, 25 bp, Rattus norvegicus
gcactgatgtgtccctttcttttgt

SEQ ID NO: 380999 - DNA, 25 bp, Rattus norvegicus
gcactgatgtgtgcctttcttttgt

SEQ ID NO: 381000 - DNA, 25 bp, Rattus norvegicus
gcactgattgtgatcacttgtcctg

SEQ ID NO: 381001 - DNA, 25 bp, Rattus norvegicus
gcactgattgtgttcacttgtcctg

SEQ ID NO: 381002 - DNA, 25 bp, Rattus norvegicus
gcactgatttcccagctgacccggg

SEQ ID NO: 381003 - DNA, 25 bp, Rattus norvegicus
gcactgatttccgagctgacccggg

SEQ ID NO: 381004 - DNA, 25 bp, Rattus norvegicus
gcactgatttcgaccaggttcgttc

SEQ ID NO: 381005 - DNA, 25 bp, Rattus norvegicus
gcactgatttcgtccaggttcgttc

SEQ ID NO: 381006 - DNA, 25 bp, Rattus norvegicus
gcactgcaaatgagcttgtctcaga

SEQ ID NO: 381007 - DNA, 25 bp, Rattus norvegicus
gcactgcaaatgtgcttgtctcaga

SEQ ID NO: 381008 - DNA, 25 bp, Rattus norvegicus
gcactgcaatctactgttgtagcta

SEQ ID NO: 381009 - DNA, 25 bp, Rattus norvegicus
gcactgcaatcttctgttgtagcta

SEQ ID NO: 381010 - DNA, 25 bp, Rattus norvegicus
gcactgcacactctgttccaaacta

SEQ ID NO: 381011 - DNA, 25 bp, Rattus norvegicus
gcactgcacactgtgttccaaacta

SEQ ID NO: 381012 - DNA, 25 bp, Rattus norvegicus
gcactgcactcacgatgttccaatt

SEQ ID NO: 381013 - DNA, 25 bp, Rattus norvegicus
gcactgcactcaggatgttccaatt

SEQ ID NO: 381014 - DNA, 25 bp, Rattus norvegicus
gcactgcactgcaccatgggaatta

SEQ ID NO: 381015 - DNA, 25 bp, Rattus norvegicus
gcactgcactgcagtttacatgggc

SEQ ID NO: 381016 - DNA, 25 bp, Rattus norvegicus
gcactgcactgctccatgggaatta

SEQ ID NO: 381017 - DNA, 25 bp, Rattus norvegicus
gcactgcactgctgtttacatgggc

SEQ ID NO: 381018 - DNA, 25 bp, Rattus norvegicus
gcactgcaggttccatttggatcac

SEQ ID NO: 381019 - DNA, 25 bp, Rattus norvegicus
gcactgcaggttgcatttggatcac

SEQ ID NO: 381020 - DNA, 25 bp, Rattus norvegicus
gcactgcatagtcgtatattcaact

SEQ ID NO: 381021 - DNA, 25 bp, Rattus norvegicus
gcactgcatagtggtatattcaact

SEQ ID NO: 381022 - DNA, 25 bp, Rattus norvegicus
gcactgcatgtacaatggtacccat

SEQ ID NO: 381023 - DNA, 25 bp, Rattus norvegicus
gcactgcatgtagaatggtacccat

SEQ ID NO: 381024 - DNA, 25 bp, Rattus norvegicus
gcactgcattaccacgtgatgtttt

SEQ ID NO: 381025 - DNA, 25 bp, Rattus norvegicus
gcactgcattacgacgtgatgtttt

SEQ ID NO: 381026 - DNA, 25 bp, Rattus norvegicus
gcactgcatttcattgggcgcgatg

SEQ ID NO: 381027 - DNA, 25 bp, Rattus norvegicus
gcactgcatttctttgggcgcgatg

SEQ ID NO: 381028 - DNA, 25 bp, Rattus norvegicus
gcactgcatttgattgtcactagct

SEQ ID NO: 381029 - DNA, 25 bp, Rattus norvegicus
gcactgcatttgtttgtcactagct

SEQ ID NO: 381030 - DNA, 25 bp, Rattus norvegicus
gcactgccaacaatttaggccaaat

SEQ ID NO: 381031 - DNA, 25 bp, Rattus norvegicus
gcactgccaacattttaggccaaat

SEQ ID NO: 381032 - DNA, 25 bp, Rattus norvegicus
gcactgccatgcactgaggacatag

SEQ ID NO: 381033 - DNA, 25 bp, Rattus norvegicus
gcactgccatgctctgaggacatag

SEQ ID NO: 381034 - DNA, 25 bp, Rattus norvegicus
gcactgcccaacatgtacttgaagt

SEQ ID NO: 381035 - DNA, 25 bp, Rattus norvegicus
gcactgcccaacttgtacttgaagt

SEQ ID NO: 381036 - DNA, 25 bp, Rattus norvegicus
gcactgcccagacttacagtttttt

SEQ ID NO: 381037 - DNA, 25 bp, Rattus norvegicus
gcactgcccagagttacagtttttt

SEQ ID NO: 381038 - DNA, 25 bp, Rattus norvegicus
gcactgcccaggcttaggagacttc

SEQ ID NO: 381039 - DNA, 25 bp, Rattus norvegicus
gcactgcccagggttaggagacttc

SEQ ID NO: 381040 - DNA, 25 bp, Rattus norvegicus
gcactgccccaaagcgttctcgttt

SEQ ID NO: 381041 - DNA, 25 bp, Rattus norvegicus
gcactgccccaatgcgttctcgttt

SEQ ID NO: 381042 - DNA, 25 bp, Rattus norvegicus
gcactgcccttgagaaagcctgtta

SEQ ID NO: 381043 - DNA, 25 bp, Rattus norvegicus
gcactgcccttgtgaaagcctgtta

SEQ ID NO: 381044 - DNA, 25 bp, Rattus norvegicus
gcactgccctttcattgcttatgta

SEQ ID NO: 381045 - DNA, 25 bp, Rattus norvegicus
gcactgccctttgattgcttatgta

SEQ ID NO: 381046 - DNA, 25 bp, Rattus norvegicus
gcactgccgagcagcctgggtgatt

SEQ ID NO: 381047 - DNA, 25 bp, Rattus norvegicus
gcactgccgagctgcctgggtgatt

SEQ ID NO: 381048 - DNA, 25 bp, Rattus norvegicus
gcactgcctcttcagctgttaagca

SEQ ID NO: 381049 - DNA, 25 bp, Rattus norvegicus
gcactgcctcttgagctgttaagca

SEQ ID NO: 381050 - DNA, 25 bp, Rattus norvegicus
gcactgcctgcacttgatggatgga

SEQ ID NO: 381051 - DNA, 25 bp, Rattus norvegicus
gcactgcctgcagttgatggatgga

SEQ ID NO: 381052 - DNA, 25 bp, Rattus norvegicus
gcactgcggtccacacaaaacaaaa

SEQ ID NO: 381053 - DNA, 25 bp, Rattus norvegicus
gcactgcggtcctcacaaaacaaaa

SEQ ID NO: 381054 - DNA, 25 bp, Rattus norvegicus
gcactgcggttaatttatctgttgt

SEQ ID NO: 381055 - DNA, 25 bp, Rattus norvegicus
gcactgcggttattttatctgttgt

SEQ ID NO: 381056 - DNA, 25 bp, Rattus norvegicus
gcactgctagcactcacgggttctg

SEQ ID NO: 381057 - DNA, 25 bp, Rattus norvegicus
gcactgctagcagtcacgggttctg

SEQ ID NO: 381058 - DNA, 25 bp, Rattus norvegicus
gcactgctcctaccaaatgatgtta

SEQ ID NO: 381059 - DNA, 25 bp, Rattus norvegicus
gcactgctcctagcaaatgatgtta

SEQ ID NO: 381060 - DNA, 25 bp, Rattus norvegicus
gcactgctcctgaaatgacaaaccc

SEQ ID NO: 381061 - DNA, 25 bp, Rattus norvegicus
gcactgctcctgtaatgacaaaccc

SEQ ID NO: 381062 - DNA, 25 bp, Rattus norvegicus
gcactgctcgggagtcacttatgga

SEQ ID NO: 381063 - DNA, 25 bp, Rattus norvegicus
gcactgctcgggtgtcacttatgga

SEQ ID NO: 381064 - DNA, 25 bp, Rattus norvegicus
gcactgctctacagttgcaaagctc

SEQ ID NO: 381065 - DNA, 25 bp, Rattus norvegicus
gcactgctctactgttgcaaagctc

SEQ ID NO: 381066 - DNA, 25 bp, Rattus norvegicus
gcactgctgaacaagactccaatat

SEQ ID NO: 381067 - DNA, 25 bp, Rattus norvegicus
gcactgctgaactagactccaatat

SEQ ID NO: 381068 - DNA, 25 bp, Rattus norvegicus
gcactgctgctgcagaagtccacag

SEQ ID NO: 381069 - DNA, 25 bp, Rattus norvegicus
gcactgctgctggagaagtccacag

SEQ ID NO: 381070 - DNA, 25 bp, Rattus norvegicus
gcactgctgcttcgtgtcttatgaa

SEQ ID NO: 381071 - DNA, 25 bp, Rattus norvegicus
gcactgctgcttggtgtcttatgaa

SEQ ID NO: 381072 - DNA, 25 bp, Rattus norvegicus
gcactgctggagacatcgatcatga

SEQ ID NO: 381073 - DNA, 25 bp, Rattus norvegicus
gcactgctggagtcatcgatcatga

SEQ ID NO: 381074 - DNA, 25 bp, Rattus norvegicus
gcactgctggccaagacaacttaaa

SEQ ID NO: 381075 - DNA, 25 bp, Rattus norvegicus
gcactgctggcctagacaacttaaa

SEQ ID NO: 381076 - DNA, 25 bp, Rattus norvegicus
gcactgctggctcaagggtttatgt

SEQ ID NO: 381077 - DNA, 25 bp, Rattus norvegicus
gcactgctggctgaagggtttatgt

SEQ ID NO: 381078 - DNA, 25 bp, Rattus norvegicus
gcactgctgtcaacagaggtttcct

SEQ ID NO: 381079 - DNA, 25 bp, Rattus norvegicus
gcactgctgtcatcagaggtttcct

SEQ ID NO: 381080 - DNA, 25 bp, Rattus norvegicus
gcactgctgttacagggaatcaaga

SEQ ID NO: 381081 - DNA, 25 bp, Rattus norvegicus
gcactgctgttagagggaatcaaga

SEQ ID NO: 381082 - DNA, 25 bp, Rattus norvegicus
gcactgcttaccagccaatttggag

SEQ ID NO: 381083 - DNA, 25 bp, Rattus norvegicus
gcactgcttacctgccaatttggag

SEQ ID NO: 381084 - DNA, 25 bp, Rattus norvegicus
gcactgcttaggagacctgtctgga

SEQ ID NO: 381085 - DNA, 25 bp, Rattus norvegicus
gcactgcttaggtgacctgtctgga

SEQ ID NO: 381086 - DNA, 25 bp, Rattus norvegicus
gcactggaactgaagagatctgtct

SEQ ID NO: 381087 - DNA, 25 bp, Rattus norvegicus
gcactggaactgtagagatctgtct

SEQ ID NO: 381088 - DNA, 25 bp, Rattus norvegicus
gcactggacgctcactgggatgatt

SEQ ID NO: 381089 - DNA, 25 bp, Rattus norvegicus
gcactggacgctgactgggatgatt

SEQ ID NO: 381090 - DNA, 25 bp, Rattus norvegicus
gcactggatcttccgcagcagcggt

SEQ ID NO: 381091 - DNA, 25 bp, Rattus norvegicus
gcactggatcttcttttgaccggtc

SEQ ID NO: 381092 - DNA, 25 bp, Rattus norvegicus
gcactggatcttgcgcagcagcggt

SEQ ID NO: 381093 - DNA, 25 bp, Rattus norvegicus
gcactggatcttgttttgaccggtc

SEQ ID NO: 381094 - DNA, 25 bp, Rattus norvegicus
gcactggattctacccagggaacta

SEQ ID NO: 381095 - DNA, 25 bp, Rattus norvegicus
gcactggattctatcactgagcaca

SEQ ID NO: 381096 - DNA, 25 bp, Rattus norvegicus
gcactggattcttcccagggaacta

SEQ ID NO: 381097 - DNA, 25 bp, Rattus norvegicus
gcactggattctttcactgagcaca

SEQ ID NO: 381098 - DNA, 25 bp, Rattus norvegicus
gcactggcaatgataggactggatt

SEQ ID NO: 381099 - DNA, 25 bp, Rattus norvegicus
gcactggcaatgttaggactggatt

SEQ ID NO: 381100 - DNA, 25 bp, Rattus norvegicus
gcactggccactctagttcgaaggg

SEQ ID NO: 381101 - DNA, 25 bp, Rattus norvegicus
gcactggccactgtagttcgaaggg

SEQ ID NO: 381102 - DNA, 25 bp, Rattus norvegicus
gcactggccaggcttatgacctcca

SEQ ID NO: 381103 - DNA, 25 bp, Rattus norvegicus
gcactggccagggttatgacctcca

SEQ ID NO: 381104 - DNA, 25 bp, Rattus norvegicus
gcactggcctggcaccttcatggag

SEQ ID NO: 381105 - DNA, 25 bp, Rattus norvegicus
gcactggcctgggaccttcatggag

SEQ ID NO: 381106 - DNA, 25 bp, Rattus norvegicus
gcactggcgactcctcagacgagga

SEQ ID NO: 381107 - DNA, 25 bp, Rattus norvegicus
gcactggcgactgctcagacgagga

SEQ ID NO: 381108 - DNA, 25 bp, Rattus norvegicus
gcactggcgatgacctagatctgat

SEQ ID NO: 381109 - DNA, 25 bp, Rattus norvegicus
gcactggcgatgtcctagatctgat

SEQ ID NO: 381110 - DNA, 25 bp, Rattus norvegicus
gcactggctatgcttatcggctatc

SEQ ID NO: 381111 - DNA, 25 bp, Rattus norvegicus
gcactggctatggttatcggctatc

SEQ ID NO: 381112 - DNA, 25 bp, Rattus norvegicus
gcactggcttgcactataactaggc

SEQ ID NO: 381113 - DNA, 25 bp, Rattus norvegicus
gcactggcttgctctataactaggc

SEQ ID NO: 381114 - DNA, 25 bp, Rattus norvegicus
gcactggctttaatgctgaggtcca

SEQ ID NO: 381115 - DNA, 25 bp, Rattus norvegicus
gcactggctttattgctgaggtcca

SEQ ID NO: 381116 - DNA, 25 bp, Rattus norvegicus
gcactggcttttctctgctaagaac

SEQ ID NO: 381117 - DNA, 25 bp, Rattus norvegicus
gcactggcttttgtctgctaagaac

SEQ ID NO: 381118 - DNA, 25 bp, Rattus norvegicus
gcactgggaaatctagcgcctgtaa

SEQ ID NO: 381119 - DNA, 25 bp, Rattus norvegicus
gcactgggaaatgtagcgcctgtaa

SEQ ID NO: 381120 - DNA, 25 bp, Rattus norvegicus
gcactgggacagaacagactttgta

SEQ ID NO: 381121 - DNA, 25 bp, Rattus norvegicus
gcactgggacagtacagactttgta

SEQ ID NO: 381122 - DNA, 25 bp, Rattus norvegicus
gcactgggacccatctttttctaat

SEQ ID NO: 381123 - DNA, 25 bp, Rattus norvegicus
gcactgggacccttctttttctaat

SEQ ID NO: 381124 - DNA, 25 bp, Rattus norvegicus
gcactgggagaccagcaggactcct

SEQ ID NO: 381125 - DNA, 25 bp, Rattus norvegicus
gcactgggagacgagcaggactcct

SEQ ID NO: 381126 - DNA, 25 bp, Rattus norvegicus
gcactgggtgccagtgactgtacaa

SEQ ID NO: 381127 - DNA, 25 bp, Rattus norvegicus
gcactgggtgcctgtgactgtacaa

SEQ ID NO: 381128 - DNA, 25 bp, Rattus norvegicus
gcactggtatttagtcctgaatata

SEQ ID NO: 381129 - DNA, 25 bp, Rattus norvegicus
gcactggtattttgtcctgaatata

SEQ ID NO: 381130 - DNA, 25 bp, Rattus norvegicus
gcactggtccaaattccaagtaaaa

SEQ ID NO: 381131 - DNA, 25 bp, Rattus norvegicus
gcactggtccaatttccaagtaaaa

SEQ ID NO: 381132 - DNA, 25 bp, Rattus norvegicus
gcactggtctccaaggatcgctgaa

SEQ ID NO: 381133 - DNA, 25 bp, Rattus norvegicus
gcactggtctcctaggatcgctgaa

SEQ ID NO: 381134 - DNA, 25 bp, Rattus norvegicus
gcactggtcttcatgtgttttaact

SEQ ID NO: 381135 - DNA, 25 bp, Rattus norvegicus
gcactggtcttcttgtgttttaact

SEQ ID NO: 381136 - DNA, 25 bp, Rattus norvegicus
gcactggtggcaattcatcatggaa

SEQ ID NO: 381137 - DNA, 25 bp, Rattus norvegicus
gcactggtggcatttcatcatggaa

SEQ ID NO: 381138 - DNA, 25 bp, Rattus norvegicus
gcactggtgtccacaatgcatttga

SEQ ID NO: 381139 - DNA, 25 bp, Rattus norvegicus
gcactggtgtcctcaatgcatttga

SEQ ID NO: 381140 - DNA, 25 bp, Rattus norvegicus
gcactggtttgcagcttcgggaaac

SEQ ID NO: 381141 - DNA, 25 bp, Rattus norvegicus
gcactggtttgctgcttcgggaaac

SEQ ID NO: 381142 - DNA, 25 bp, Rattus norvegicus
gcactgtaacaacctattccgtcat

SEQ ID NO: 381143 - DNA, 25 bp, Rattus norvegicus
gcactgtaacaagctattccgtcat

SEQ ID NO: 381144 - DNA, 25 bp, Rattus norvegicus
gcactgtacatcaataccttcatat

SEQ ID NO: 381145 - DNA, 25 bp, Rattus norvegicus
gcactgtacatctataccttcatat

SEQ ID NO: 381146 - DNA, 25 bp, Rattus norvegicus
gcactgtagcttaagaagacgtgtc

SEQ ID NO: 381147 - DNA, 25 bp, Rattus norvegicus
gcactgtagctttagaagacgtgtc

SEQ ID NO: 381148 - DNA, 25 bp, Rattus norvegicus
gcactgtaggaaaaactcccacgga

SEQ ID NO: 381149 - DNA, 25 bp, Rattus norvegicus
gcactgtaggaataactcccacgga

SEQ ID NO: 381150 - DNA, 25 bp, Rattus norvegicus
gcactgtagggaacttgggtctcca

SEQ ID NO: 381151 - DNA, 25 bp, Rattus norvegicus
gcactgtagggatcttgggtctcca

SEQ ID NO: 381152 - DNA, 25 bp, Rattus norvegicus
gcactgtagtctccgaccggtggct

SEQ ID NO: 381153 - DNA, 25 bp, Rattus norvegicus
gcactgtagtctgcgaccggtggct

SEQ ID NO: 381154 - DNA, 25 bp, Rattus norvegicus
gcactgtatattatttcatttggta

SEQ ID NO: 381155 - DNA, 25 bp, Rattus norvegicus
gcactgtatattttttcatttggta

SEQ ID NO: 381156 - DNA, 25 bp, Rattus norvegicus
gcactgtatgatatgtcttcctttg

SEQ ID NO: 381157 - DNA, 25 bp, Rattus norvegicus
gcactgtatgatttgtcttcctttg

SEQ ID NO: 381158 - DNA, 25 bp, Rattus norvegicus
gcactgtatgcaccctaattgcaaa

SEQ ID NO: 381159 - DNA, 25 bp, Rattus norvegicus
gcactgtatgcagcctaattgcaaa

SEQ ID NO: 381160 - DNA, 25 bp, Rattus norvegicus
gcactgtatggcaggatattcttag

SEQ ID NO: 381161 - DNA, 25 bp, Rattus norvegicus
gcactgtatggctggatattcttag

SEQ ID NO: 381162 - DNA, 25 bp, Rattus norvegicus
gcactgtatgttatctctctgtagt

SEQ ID NO: 381163 - DNA, 25 bp, Rattus norvegicus
gcactgtatgttttctctctgtagt

SEQ ID NO: 381164 - DNA, 25 bp, Rattus norvegicus
gcactgtcacctccctaatatggga

SEQ ID NO: 381165 - DNA, 25 bp, Rattus norvegicus
gcactgtcacctgcctaatatggga

SEQ ID NO: 381166 - DNA, 25 bp, Rattus norvegicus
gcactgtcactgagggccctttatt

SEQ ID NO: 381167 - DNA, 25 bp, Rattus norvegicus
gcactgtcactgtgggccctttatt

SEQ ID NO: 381168 - DNA, 25 bp, Rattus norvegicus
gcactgtcagaaaacccgactgcac

SEQ ID NO: 381169 - DNA, 25 bp, Rattus norvegicus
gcactgtcagaatacccgactgcac

SEQ ID NO: 381170 - DNA, 25 bp, Rattus norvegicus
gcactgtcaggactacagagaccct

SEQ ID NO: 381171 - DNA, 25 bp, Rattus norvegicus
gcactgtcaggagtacagagaccct

SEQ ID NO: 381172 - DNA, 25 bp, Rattus norvegicus
gcactgtcaggcattctgtaggcac

SEQ ID NO: 381173 - DNA, 25 bp, Rattus norvegicus
gcactgtcaggctttctgtaggcac

SEQ ID NO: 381174 - DNA, 25 bp, Rattus norvegicus
gcactgtcagtgctttgtgtagatg

SEQ ID NO: 381175 - DNA, 25 bp, Rattus norvegicus
gcactgtcagtggtttgtgtagatg

SEQ ID NO: 381176 - DNA, 25 bp, Rattus norvegicus
gcactgtcatttcctaacttgctga

SEQ ID NO: 381177 - DNA, 25 bp, Rattus norvegicus
gcactgtcatttgctaacttgctga

SEQ ID NO: 381178 - DNA, 25 bp, Rattus norvegicus
gcactgtcccttcctagggcagtaa

SEQ ID NO: 381179 - DNA, 25 bp, Rattus norvegicus
gcactgtcccttgctagggcagtaa

SEQ ID NO: 381180 - DNA, 25 bp, Rattus norvegicus
gcactgtcctttctctgaaatttga

SEQ ID NO: 381181 - DNA, 25 bp, Rattus norvegicus
gcactgtcctttgtctgaaatttga

SEQ ID NO: 381182 - DNA, 25 bp, Rattus norvegicus
gcactgtcggcgacatgttgggtct

SEQ ID NO: 381183 - DNA, 25 bp, Rattus norvegicus
gcactgtcggcgtcatgttgggtct

SEQ ID NO: 381184 - DNA, 25 bp, Rattus norvegicus
gcactgtcgggtactctgaagtcat

SEQ ID NO: 381185 - DNA, 25 bp, Rattus norvegicus
gcactgtcgggttctctgaagtcat

SEQ ID NO: 381186 - DNA, 25 bp, Rattus norvegicus
gcactgtctaacagggaatcctcta

SEQ ID NO: 381187 - DNA, 25 bp, Rattus norvegicus
gcactgtctaactgggaatcctcta

SEQ ID NO: 381188 - DNA, 25 bp, Rattus norvegicus
gcactgtctagaagtttctttctta

SEQ ID NO: 381189 - DNA, 25 bp, Rattus norvegicus
gcactgtctagatgtttctttctta

SEQ ID NO: 381190 - DNA, 25 bp, Rattus norvegicus
gcactgtctcaaccaggacttctga

SEQ ID NO: 381191 - DNA, 25 bp, Rattus norvegicus
gcactgtctcaagcaggacttctga

SEQ ID NO: 381192 - DNA, 25 bp, Rattus norvegicus
gcactgtctttgagtagagcgccgt

SEQ ID NO: 381193 - DNA, 25 bp, Rattus norvegicus
gcactgtctttgtgtagagcgccgt

SEQ ID NO: 381194 - DNA, 25 bp, Rattus norvegicus
gcactgtgaacaatcctttatttta

SEQ ID NO: 381195 - DNA, 25 bp, Rattus norvegicus
gcactgtgaacattcctttatttta

SEQ ID NO: 381196 - DNA, 25 bp, Rattus norvegicus
gcactgtgaagcattagacactttg

SEQ ID NO: 381197 - DNA, 25 bp, Rattus norvegicus
gcactgtgaagctttagacactttg

SEQ ID NO: 381198 - DNA, 25 bp, Rattus norvegicus
gcactgtgaatgatcctactctgga

SEQ ID NO: 381199 - DNA, 25 bp, Rattus norvegicus
gcactgtgaatgttcctactctgga

SEQ ID NO: 381200 - DNA, 25 bp, Rattus norvegicus
gcactgtgacatatctggctggcaa

SEQ ID NO: 381201 - DNA, 25 bp, Rattus norvegicus
gcactgtgacatttctggctggcaa

SEQ ID NO: 381202 - DNA, 25 bp, Rattus norvegicus
gcactgtgaggcaggacctgttgat

SEQ ID NO: 381203 - DNA, 25 bp, Rattus norvegicus
gcactgtgaggctggacctgttgat

SEQ ID NO: 381204 - DNA, 25 bp, Rattus norvegicus
gcactgtgcattaaccaaaggctat

SEQ ID NO: 381205 - DNA, 25 bp, Rattus norvegicus
gcactgtgcatttaccaaaggctat

SEQ ID NO: 381206 - DNA, 25 bp, Rattus norvegicus
gcactgtgctggctaaattttgact

SEQ ID NO: 381207 - DNA, 25 bp, Rattus norvegicus
gcactgtgctgggtaaattttgact

SEQ ID NO: 381208 - DNA, 25 bp, Rattus norvegicus
gcactgtgcttgctcctaagcagga

SEQ ID NO: 381209 - DNA, 25 bp, Rattus norvegicus
gcactgtgcttggtcctaagcagga

SEQ ID NO: 381210 - DNA, 25 bp, Rattus norvegicus
gcactgtggagcagacgcccaagaa

SEQ ID NO: 381211 - DNA, 25 bp, Rattus norvegicus
gcactgtggagctgacgcccaagaa

SEQ ID NO: 381212 - DNA, 25 bp, Rattus norvegicus
gcactgtggatgataatgtacttct

SEQ ID NO: 381213 - DNA, 25 bp, Rattus norvegicus
gcactgtggatgttaatgtacttct

SEQ ID NO: 381214 - DNA, 25 bp, Rattus norvegicus
gcactgtggttgcaacccgggttct

SEQ ID NO: 381215 - DNA, 25 bp, Rattus norvegicus
gcactgtggttggaacccgggttct

SEQ ID NO: 381216 - DNA, 25 bp, Rattus norvegicus
gcactgtgtgaaagctgttcttaga

SEQ ID NO: 381217 - DNA, 25 bp, Rattus norvegicus
gcactgtgtgaatgctgttcttaga

SEQ ID NO: 381218 - DNA, 25 bp, Rattus norvegicus
gcactgtgtggcagtaacgggaaca

SEQ ID NO: 381219 - DNA, 25 bp, Rattus norvegicus
gcactgtgtggctgtaacgggaaca

SEQ ID NO: 381220 - DNA, 25 bp, Rattus norvegicus
gcactgttactgagccccattgaga

SEQ ID NO: 381221 - DNA, 25 bp, Rattus norvegicus
gcactgttactgtgccccattgaga

SEQ ID NO: 381222 - DNA, 25 bp, Rattus norvegicus
gcactgttcgtcacttcaggcacag

SEQ ID NO: 381223 - DNA, 25 bp, Rattus norvegicus
gcactgttcgtctcttcaggcacag

SEQ ID NO: 381224 - DNA, 25 bp, Rattus norvegicus
gcactgttcttaaagcacatctgtc

SEQ ID NO: 381225 - DNA, 25 bp, Rattus norvegicus
gcactgttcttatagcacatctgtc

SEQ ID NO: 381226 - DNA, 25 bp, Rattus norvegicus
gcactgttgaacactgagggtcctg

SEQ ID NO: 381227 - DNA, 25 bp, Rattus norvegicus
gcactgttgaactctgagggtcctg

SEQ ID NO: 381228 - DNA, 25 bp, Rattus norvegicus
gcactgttgccccttactaaaatgt

SEQ ID NO: 381229 - DNA, 25 bp, Rattus norvegicus
gcactgttgcccgttactaaaatgt

SEQ ID NO: 381230 - DNA, 25 bp, Rattus norvegicus
gcactgttgcttaatctgagccaga

SEQ ID NO: 381231 - DNA, 25 bp, Rattus norvegicus
gcactgttgctttatctgagccaga

SEQ ID NO: 381232 - DNA, 25 bp, Rattus norvegicus
gcactgttggtaaccggtactactt

SEQ ID NO: 381233 - DNA, 25 bp, Rattus norvegicus
gcactgttggtatccggtactactt

SEQ ID NO: 381234 - DNA, 25 bp, Rattus norvegicus
gcactgtttaacacattcctcttag

SEQ ID NO: 381235 - DNA, 25 bp, Rattus norvegicus
gcactgtttaactcattcctcttag

SEQ ID NO: 381236 - DNA, 25 bp, Rattus norvegicus
gcactgtttagcacattatctttct

SEQ ID NO: 381237 - DNA, 25 bp, Rattus norvegicus
gcactgtttagctcattatctttct

SEQ ID NO: 381238 - DNA, 25 bp, Rattus norvegicus
gcactgtttggaccactgcggatga

SEQ ID NO: 381239 - DNA, 25 bp, Rattus norvegicus
gcactgtttggagcactgcggatga

SEQ ID NO: 381240 - DNA, 25 bp, Rattus norvegicus
gcactgttttggcagttacatcctg

SEQ ID NO: 381241 - DNA, 25 bp, Rattus norvegicus
gcactgttttgggagttacatcctg

SEQ ID NO: 381242 - DNA, 25 bp, Rattus norvegicus
gcacttaaaagcacatcctgggaaa

SEQ ID NO: 381243 - DNA, 25 bp, Rattus norvegicus
gcacttaaaagctcatcctgggaaa

SEQ ID NO: 381244 - DNA, 25 bp, Rattus norvegicus
gcacttaaagtgacggtagggctgt

SEQ ID NO: 381245 - DNA, 25 bp, Rattus norvegicus
gcacttaaagtgtcggtagggctgt

SEQ ID NO: 381246 - DNA, 25 bp, Rattus norvegicus
gcacttaacaaacacgggactccaa

SEQ ID NO: 381247 - DNA, 25 bp, Rattus norvegicus
gcacttaacaaagacgggactccaa

SEQ ID NO: 381248 - DNA, 25 bp, Rattus norvegicus
gcacttaaccttccctgtttactat

SEQ ID NO: 381249 - DNA, 25 bp, Rattus norvegicus
gcacttaaccttgcctgtttactat

SEQ ID NO: 381250 - DNA, 25 bp, Rattus norvegicus
gcacttaagatgatgtcccagcccc

SEQ ID NO: 381251 - DNA, 25 bp, Rattus norvegicus
gcacttaagatgttgtcccagcccc

SEQ ID NO: 381252 - DNA, 25 bp, Rattus norvegicus
gcacttaagcacctacttttgacag

SEQ ID NO: 381253 - DNA, 25 bp, Rattus norvegicus
gcacttaagcacgtacttttgacag

SEQ ID NO: 381254 - DNA, 25 bp, Rattus norvegicus
gcacttaagcctaggcaggagccaa

SEQ ID NO: 381255 - DNA, 25 bp, Rattus norvegicus
gcacttaagccttggcaggagccaa

SEQ ID NO: 381256 - DNA, 25 bp, Rattus norvegicus
gcacttaatttaattctttctttga

SEQ ID NO: 381257 - DNA, 25 bp, Rattus norvegicus
gcacttaatttatttctttctttga

SEQ ID NO: 381258 - DNA, 25 bp, Rattus norvegicus
gcacttacacagatagtcatggaga

SEQ ID NO: 381259 - DNA, 25 bp, Rattus norvegicus
gcacttacacagttagtcatggaga

SEQ ID NO: 381260 - DNA, 25 bp, Rattus norvegicus
gcacttacagtcatcgttacatgag

SEQ ID NO: 381261 - DNA, 25 bp, Rattus norvegicus
gcacttacagtcttcgttacatgag

SEQ ID NO: 381262 - DNA, 25 bp, Rattus norvegicus
gcacttacatctctattgctttaac

SEQ ID NO: 381263 - DNA, 25 bp, Rattus norvegicus
gcacttacatctgtattgctttaac

SEQ ID NO: 381264 - DNA, 25 bp, Rattus norvegicus
gcacttaccataatctgccttgtat

SEQ ID NO: 381265 - DNA, 25 bp, Rattus norvegicus
gcacttaccatattctgccttgtat

SEQ ID NO: 381266 - DNA, 25 bp, Rattus norvegicus
gcacttactgtaatcggtttccatc

SEQ ID NO: 381267 - DNA, 25 bp, Rattus norvegicus
gcacttactgtattcggtttccatc

SEQ ID NO: 381268 - DNA, 25 bp, Rattus norvegicus
gcacttactgttagcaagaagccat

SEQ ID NO: 381269 - DNA, 25 bp, Rattus norvegicus
gcacttactgtttgcaagaagccat

SEQ ID NO: 381270 - DNA, 25 bp, Rattus norvegicus
gcacttacttttcaaacttcaggga

SEQ ID NO: 381271 - DNA, 25 bp, Rattus norvegicus
gcacttacttttgaaacttcaggga

SEQ ID NO: 381272 - DNA, 25 bp, Rattus norvegicus
gcacttagaaggaatatcacactca

SEQ ID NO: 381273 - DNA, 25 bp, Rattus norvegicus
gcacttagaaggtatatcacactca

SEQ ID NO: 381274 - DNA, 25 bp, Rattus norvegicus
gcacttagactaagcactttttctg

SEQ ID NO: 381275 - DNA, 25 bp, Rattus norvegicus
gcacttagactatgcactttttctg

SEQ ID NO: 381276 - DNA, 25 bp, Rattus norvegicus
gcacttagcaaaacagagatctcag

SEQ ID NO: 381277 - DNA, 25 bp, Rattus norvegicus
gcacttagcaaatcagagatctcag

SEQ ID NO: 381278 - DNA, 25 bp, Rattus norvegicus
gcacttagcatgatgacttgctcat

SEQ ID NO: 381279 - DNA, 25 bp, Rattus norvegicus
gcacttagcatgttgacttgctcat

SEQ ID NO: 381280 - DNA, 25 bp, Rattus norvegicus
gcacttaggtggctctctgagattg

SEQ ID NO: 381281 - DNA, 25 bp, Rattus norvegicus
gcacttaggtgggtctctgagattg

SEQ ID NO: 381282 - DNA, 25 bp, Rattus norvegicus
gcacttagtaaaacgtaagcactat

SEQ ID NO: 381283 - DNA, 25 bp, Rattus norvegicus
gcacttagtaaatcgtaagcactat

SEQ ID NO: 381284 - DNA, 25 bp, Rattus norvegicus
gcacttagtggcatcttcggaggga

SEQ ID NO: 381285 - DNA, 25 bp, Rattus norvegicus
gcacttagtggcttcttcggaggga

SEQ ID NO: 381286 - DNA, 25 bp, Rattus norvegicus
gcacttatgggcagggtatgtcaaa

SEQ ID NO: 381287 - DNA, 25 bp, Rattus norvegicus
gcacttatgggctgggtatgtcaaa

SEQ ID NO: 381288 - DNA, 25 bp, Rattus norvegicus
gcacttcaaaccatgtcttcaccta

SEQ ID NO: 381289 - DNA, 25 bp, Rattus norvegicus
gcacttcaaaccttgtcttcaccta

SEQ ID NO: 381290 - DNA, 25 bp, Rattus norvegicus
gcacttcacaaaagccagagtcaaa

SEQ ID NO: 381291 - DNA, 25 bp, Rattus norvegicus
gcacttcacaaatgccagagtcaaa

SEQ ID NO: 381292 - DNA, 25 bp, Rattus norvegicus
gcacttcagagtacagcagatggtt

SEQ ID NO: 381293 - DNA, 25 bp, Rattus norvegicus
gcacttcagagttcagcagatggtt

SEQ ID NO: 381294 - DNA, 25 bp, Rattus norvegicus
gcacttcagcgacgtgagcagcgat

SEQ ID NO: 381295 - DNA, 25 bp, Rattus norvegicus
gcacttcagcgaggtgagcagcgat

SEQ ID NO: 381296 - DNA, 25 bp, Rattus norvegicus
gcacttcagggcatttaactccaag

SEQ ID NO: 381297 - DNA, 25 bp, Rattus norvegicus
gcacttcagggcttttaactccaag

SEQ ID NO: 381298 - DNA, 25 bp, Rattus norvegicus
gcacttcaggttcagcgtctttaaa

SEQ ID NO: 381299 - DNA, 25 bp, Rattus norvegicus
gcacttcaggttgagcgtctttaaa

SEQ ID NO: 381300 - DNA, 25 bp, Rattus norvegicus
gcacttcataacaactgaggtactc

SEQ ID NO: 381301 - DNA, 25 bp, Rattus norvegicus
gcacttcataactactgaggtactc

SEQ ID NO: 381302 - DNA, 25 bp, Rattus norvegicus
gcacttcatagacggtggccggact

SEQ ID NO: 381303 - DNA, 25 bp, Rattus norvegicus
gcacttcatagagggtggccggact

SEQ ID NO: 381304 - DNA, 25 bp, Rattus norvegicus
gcacttcatctaattttacttgggt

SEQ ID NO: 381305 - DNA, 25 bp, Rattus norvegicus
gcacttcatctatttttacttgggt

SEQ ID NO: 381306 - DNA, 25 bp, Rattus norvegicus
gcacttcattttcattctcatgtgg

SEQ ID NO: 381307 - DNA, 25 bp, Rattus norvegicus
gcacttcattttgattctcatgtgg

SEQ ID NO: 381308 - DNA, 25 bp, Rattus norvegicus
gcacttccagaacctgctgcgtgta

SEQ ID NO: 381309 - DNA, 25 bp, Rattus norvegicus
gcacttccagaagctgctgcgtgta

SEQ ID NO: 381310 - DNA, 25 bp, Rattus norvegicus
gcacttccaggtctgcttggagcag

SEQ ID NO: 381311 - DNA, 25 bp, Rattus norvegicus
gcacttccaggtgtgcttggagcag

SEQ ID NO: 381312 - DNA, 25 bp, Rattus norvegicus
gcacttccctgtaaagattgtacct

SEQ ID NO: 381313 - DNA, 25 bp, Rattus norvegicus
gcacttccctgttaagattgtacct

SEQ ID NO: 381314 - DNA, 25 bp, Rattus norvegicus
gcacttccgagaaccaccagatcga

SEQ ID NO: 381315 - DNA, 25 bp, Rattus norvegicus
gcacttccgagatccaccagatcga

SEQ ID NO: 381316 - DNA, 25 bp, Rattus norvegicus
gcacttccggccatgggaaatgtta

SEQ ID NO: 381317 - DNA, 25 bp, Rattus norvegicus
gcacttccggccttgggaaatgtta

SEQ ID NO: 381318 - DNA, 25 bp, Rattus norvegicus
gcacttcctaatagatcgtcttcta

SEQ ID NO: 381319 - DNA, 25 bp, Rattus norvegicus
gcacttcctaattgatcgtcttcta

SEQ ID NO: 381320 - DNA, 25 bp, Rattus norvegicus
gcacttcctatcaaccggaggagat

SEQ ID NO: 381321 - DNA, 25 bp, Rattus norvegicus
gcacttcctatctaccggaggagat

SEQ ID NO: 381322 - DNA, 25 bp, Rattus norvegicus
gcacttcctcttagtgtgcagcaag

SEQ ID NO: 381323 - DNA, 25 bp, Rattus norvegicus
gcacttcctctttgtgtgcagcaag

SEQ ID NO: 381324 - DNA, 25 bp, Rattus norvegicus
gcacttcggctcctttgtgaaatgg

SEQ ID NO: 381325 - DNA, 25 bp, Rattus norvegicus
gcacttcggctcgtttgtgaaatgg

SEQ ID NO: 381326 - DNA, 25 bp, Rattus norvegicus
gcacttcgggtgaccgacaggagtt

SEQ ID NO: 381327 - DNA, 25 bp, Rattus norvegicus
gcacttcgggtgtccgacaggagtt

SEQ ID NO: 381328 - DNA, 25 bp, Rattus norvegicus
gcacttcggtgcatgtgatacagac

SEQ ID NO: 381329 - DNA, 25 bp, Rattus norvegicus
gcacttcggtgcttgtgatacagac

SEQ ID NO: 381330 - DNA, 25 bp, Rattus norvegicus
gcacttctatttaggcgtctaggca

SEQ ID NO: 381331 - DNA, 25 bp, Rattus norvegicus
gcacttctattttggcgtctaggca

SEQ ID NO: 381332 - DNA, 25 bp, Rattus norvegicus
gcacttctcatcagagctgtggtta

SEQ ID NO: 381333 - DNA, 25 bp, Rattus norvegicus
gcacttctcatctgagctgtggtta

SEQ ID NO: 381334 - DNA, 25 bp, Rattus norvegicus
gcacttctctatcgtctttattttc

SEQ ID NO: 381335 - DNA, 25 bp, Rattus norvegicus
gcacttctctatggtctttattttc

SEQ ID NO: 381336 - DNA, 25 bp, Rattus norvegicus
gcacttctgtgcacctagtataagg

SEQ ID NO: 381337 - DNA, 25 bp, Rattus norvegicus
gcacttctgtgcctattagactatt

SEQ ID NO: 381338 - DNA, 25 bp, Rattus norvegicus
gcacttctgtgcgtattagactatt

SEQ ID NO: 381339 - DNA, 25 bp, Rattus norvegicus
gcacttctgtgctcctagtataagg

SEQ ID NO: 381340 - DNA, 25 bp, Rattus norvegicus
gcacttctgtttaatgtttcagctt

SEQ ID NO: 381341 - DNA, 25 bp, Rattus norvegicus
gcacttctgttttatgtttcagctt

SEQ ID NO: 381342 - DNA, 25 bp, Rattus norvegicus
gcacttcttcccatttgatttcttt

SEQ ID NO: 381343 - DNA, 25 bp, Rattus norvegicus
gcacttcttcccttttgatttcttt

SEQ ID NO: 381344 - DNA, 25 bp, Rattus norvegicus
gcacttgaagtgcacctgtgtctgg

SEQ ID NO: 381345 - DNA, 25 bp, Rattus norvegicus
gcacttgaagtggacctgtgtctgg

SEQ ID NO: 381346 - DNA, 25 bp, Rattus norvegicus
gcacttgaataaatctccccatggc

SEQ ID NO: 381347 - DNA, 25 bp, Rattus norvegicus
gcacttgaataattctccccatggc

SEQ ID NO: 381348 - DNA, 25 bp, Rattus norvegicus
gcacttgaatgtagtatcttttaaa

SEQ ID NO: 381349 - DNA, 25 bp, Rattus norvegicus
gcacttgaatgttgtatcttttaaa

SEQ ID NO: 381350 - DNA, 25 bp, Rattus norvegicus
gcacttgaggcaccttgtttcctta

SEQ ID NO: 381351 - DNA, 25 bp, Rattus norvegicus
gcacttgaggcagcttgtttcctta

SEQ ID NO: 381352 - DNA, 25 bp, Rattus norvegicus
gcacttgaggccatgcttcttggag

SEQ ID NO: 381353 - DNA, 25 bp, Rattus norvegicus
gcacttgaggccttgcttcttggag

SEQ ID NO: 381354 - DNA, 25 bp, Rattus norvegicus
gcacttgaggctactccgggagaaa

SEQ ID NO: 381355 - DNA, 25 bp, Rattus norvegicus
gcacttgaggcttctccgggagaaa

SEQ ID NO: 381356 - DNA, 25 bp, Rattus norvegicus
gcacttgatgacattcttgccatga

SEQ ID NO: 381357 - DNA, 25 bp, Rattus norvegicus
gcacttgatgactttcttgccatga

SEQ ID NO: 381358 - DNA, 25 bp, Rattus norvegicus
gcacttgatgccatagttctgtaga

SEQ ID NO: 381359 - DNA, 25 bp, Rattus norvegicus
gcacttgatgccttagttctgtaga

SEQ ID NO: 381360 - DNA, 25 bp, Rattus norvegicus
gcacttgattttagcatgggttcca

SEQ ID NO: 381361 - DNA, 25 bp, Rattus norvegicus
gcacttgattttcgcatttagggtc

SEQ ID NO: 381362 - DNA, 25 bp, Rattus norvegicus
gcacttgattttggcatttagggtc

SEQ ID NO: 381363 - DNA, 25 bp, Rattus norvegicus
gcacttgatttttgcatgggttcca

SEQ ID NO: 381364 - DNA, 25 bp, Rattus norvegicus
gcacttgcacataactcctcagaat

SEQ ID NO: 381365 - DNA, 25 bp, Rattus norvegicus
gcacttgcacattactcctcagaat

SEQ ID NO: 381366 - DNA, 25 bp, Rattus norvegicus
gcacttgcactaatactcagcagca

SEQ ID NO: 381367 - DNA, 25 bp, Rattus norvegicus
gcacttgcactattactcagcagca

SEQ ID NO: 381368 - DNA, 25 bp, Rattus norvegicus
gcacttgcagttccggcatggacag

SEQ ID NO: 381369 - DNA, 25 bp, Rattus norvegicus
gcacttgcagttgcggcatggacag

SEQ ID NO: 381370 - DNA, 25 bp, Rattus norvegicus
gcacttgcctagactgtgtgaggta

SEQ ID NO: 381371 - DNA, 25 bp, Rattus norvegicus
gcacttgcctagtctgtgtgaggta

SEQ ID NO: 381372 - DNA, 25 bp, Rattus norvegicus
gcacttgcgccaatgatcctaagga

SEQ ID NO: 381373 - DNA, 25 bp, Rattus norvegicus
gcacttgcgccattgatcctaagga

SEQ ID NO: 381374 - DNA, 25 bp, Rattus norvegicus
gcacttgcgcttaaagagttctttc

SEQ ID NO: 381375 - DNA, 25 bp, Rattus norvegicus
gcacttgcgctttaagagttctttc

SEQ ID NO: 381376 - DNA, 25 bp, Rattus norvegicus
gcacttgcgggaccagtggctacaa

SEQ ID NO: 381377 - DNA, 25 bp, Rattus norvegicus
gcacttgcgggagcagtggctacaa

SEQ ID NO: 381378 - DNA, 25 bp, Rattus norvegicus
gcacttgctgacactagggagccat

SEQ ID NO: 381379 - DNA, 25 bp, Rattus norvegicus
gcacttgctgactctagggagccat

SEQ ID NO: 381380 - DNA, 25 bp, Rattus norvegicus
gcacttgctgatctcatattgctag

SEQ ID NO: 381381 - DNA, 25 bp, Rattus norvegicus
gcacttgctgatgtcatattgctag

SEQ ID NO: 381382 - DNA, 25 bp, Rattus norvegicus
gcacttgctgctcacggagacacaa

SEQ ID NO: 381383 - DNA, 25 bp, Rattus norvegicus
gcacttgctgctgacggagacacaa

SEQ ID NO: 381384 - DNA, 25 bp, Rattus norvegicus
gcacttggaccaaaaatgacccttg

SEQ ID NO: 381385 - DNA, 25 bp, Rattus norvegicus
gcacttggaccataaatgacccttg

SEQ ID NO: 381386 - DNA, 25 bp, Rattus norvegicus
gcacttggacctacttagggcgttt

SEQ ID NO: 381387 - DNA, 25 bp, Rattus norvegicus
gcacttggacctctggccagatggt

SEQ ID NO: 381388 - DNA, 25 bp, Rattus norvegicus
gcacttggacctgtggccagatggt

SEQ ID NO: 381389 - DNA, 25 bp, Rattus norvegicus
gcacttggaccttcttagggcgttt

SEQ ID NO: 381390 - DNA, 25 bp, Rattus norvegicus
gcacttggactccttgctggtctct

SEQ ID NO: 381391 - DNA, 25 bp, Rattus norvegicus
gcacttggactcgttgctggtctct

SEQ ID NO: 381392 - DNA, 25 bp, Rattus norvegicus
gcacttggcactacatctgctataa

SEQ ID NO: 381393 - DNA, 25 bp, Rattus norvegicus
gcacttggcacttcatctgctataa

SEQ ID NO: 381394 - DNA, 25 bp, Rattus norvegicus
gcacttggcatgatggtgaccgagt

SEQ ID NO: 381395 - DNA, 25 bp, Rattus norvegicus
gcacttggcatgttggtgaccgagt

SEQ ID NO: 381396 - DNA, 25 bp, Rattus norvegicus
gcacttggcattcgcttgctctgaa

SEQ ID NO: 381397 - DNA, 25 bp, Rattus norvegicus
gcacttggcattggcttgctctgaa

SEQ ID NO: 381398 - DNA, 25 bp, Rattus norvegicus
gcacttggctccacgtgggtaccgt

SEQ ID NO: 381399 - DNA, 25 bp, Rattus norvegicus
gcacttggctcctcgtgggtaccgt

SEQ ID NO: 381400 - DNA, 25 bp, Rattus norvegicus
gcacttggctttattctattctgat

SEQ ID NO: 381401 - DNA, 25 bp, Rattus norvegicus
gcacttggcttttttctattctgat

SEQ ID NO: 381402 - DNA, 25 bp, Rattus norvegicus
gcacttgggagaaggaagcaacaga

SEQ ID NO: 381403 - DNA, 25 bp, Rattus norvegicus
gcacttgggagatggaagcaacaga

SEQ ID NO: 381404 - DNA, 25 bp, Rattus norvegicus
gcacttgggattagagctcggcaca

SEQ ID NO: 381405 - DNA, 25 bp, Rattus norvegicus
gcacttgggatttgagctcggcaca

SEQ ID NO: 381406 - DNA, 25 bp, Rattus norvegicus
gcacttggtgctaacctgatgggag

SEQ ID NO: 381407 - DNA, 25 bp, Rattus norvegicus
gcacttggtgctcccagagtgtgac

SEQ ID NO: 381408 - DNA, 25 bp, Rattus norvegicus
gcacttggtgctgccagagtgtgac

SEQ ID NO: 381409 - DNA, 25 bp, Rattus norvegicus
gcacttggtgcttacctgatgggag

SEQ ID NO: 381410 - DNA, 25 bp, Rattus norvegicus
gcacttgtaagtagagagaccatta

SEQ ID NO: 381411 - DNA, 25 bp, Rattus norvegicus
gcacttgtaagttgagagaccatta

SEQ ID NO: 381412 - DNA, 25 bp, Rattus norvegicus
gcacttgtaggccaaactctctttt

SEQ ID NO: 381413 - DNA, 25 bp, Rattus norvegicus
gcacttgtaggcgaaactctctttt

SEQ ID NO: 381414 - DNA, 25 bp, Rattus norvegicus
gcacttgtatctcctttgcgtgcag

SEQ ID NO: 381415 - DNA, 25 bp, Rattus norvegicus
gcacttgtatctgctttgcgtgcag

SEQ ID NO: 381416 - DNA, 25 bp, Rattus norvegicus
gcacttgtatggctttttgttgaac

SEQ ID NO: 381417 - DNA, 25 bp, Rattus norvegicus
gcacttgtatgggtttttgttgaac

SEQ ID NO: 381418 - DNA, 25 bp, Rattus norvegicus
gcacttgtcgttcgtaggtagtcat

SEQ ID NO: 381419 - DNA, 25 bp, Rattus norvegicus
gcacttgtcgttggtaggtagtcat

SEQ ID NO: 381420 - DNA, 25 bp, Rattus norvegicus
gcacttgtgacccaggtgatactgc

SEQ ID NO: 381421 - DNA, 25 bp, Rattus norvegicus
gcacttgtgaccgaggtgatactgc

SEQ ID NO: 381422 - DNA, 25 bp, Rattus norvegicus
gcacttgtgctgctcgaggttttca

SEQ ID NO: 381423 - DNA, 25 bp, Rattus norvegicus
gcacttgtgctggtcgaggttttca

SEQ ID NO: 381424 - DNA, 25 bp, Rattus norvegicus
gcacttgtgggtacacatgatcctc

SEQ ID NO: 381425 - DNA, 25 bp, Rattus norvegicus
gcacttgtgggttcacatgatcctc

SEQ ID NO: 381426 - DNA, 25 bp, Rattus norvegicus
gcacttgtgtctcataagatttctg

SEQ ID NO: 381427 - DNA, 25 bp, Rattus norvegicus
gcacttgtgtctgataagatttctg

SEQ ID NO: 381428 - DNA, 25 bp, Rattus norvegicus
gcacttgtgtgcatgctgtcaaaag

SEQ ID NO: 381429 - DNA, 25 bp, Rattus norvegicus
gcacttgtgtgcttgctgtcaaaag

SEQ ID NO: 381430 - DNA, 25 bp, Rattus norvegicus
gcacttgttactctgttgctctgta

SEQ ID NO: 381431 - DNA, 25 bp, Rattus norvegicus
gcacttgttactgtgttgctctgta

SEQ ID NO: 381432 - DNA, 25 bp, Rattus norvegicus
gcacttgtttctagcccacaaatat

SEQ ID NO: 381433 - DNA, 25 bp, Rattus norvegicus
gcacttgtttcttgcccacaaatat

SEQ ID NO: 381434 - DNA, 25 bp, Rattus norvegicus
gcactttaacggacttgtgactgta

SEQ ID NO: 381435 - DNA, 25 bp, Rattus norvegicus
gcactttaacggtcttgtgactgta

SEQ ID NO: 381436 - DNA, 25 bp, Rattus norvegicus
gcactttaagctatttgactcggat

SEQ ID NO: 381437 - DNA, 25 bp, Rattus norvegicus
gcactttaagctttttgactcggat

SEQ ID NO: 381438 - DNA, 25 bp, Rattus norvegicus
gcactttaatgcaagctactggttt

SEQ ID NO: 381439 - DNA, 25 bp, Rattus norvegicus
gcactttaatgctagctactggttt

SEQ ID NO: 381440 - DNA, 25 bp, Rattus norvegicus
gcactttacacgaaaggccagtctt

SEQ ID NO: 381441 - DNA, 25 bp, Rattus norvegicus
gcactttacacgtaaggccagtctt

SEQ ID NO: 381442 - DNA, 25 bp, Rattus norvegicus
gcactttaccttatggttgcttaga

SEQ ID NO: 381443 - DNA, 25 bp, Rattus norvegicus
gcactttaccttttggttgcttaga

SEQ ID NO: 381444 - DNA, 25 bp, Rattus norvegicus
gcactttagcaaactccctttagaa

SEQ ID NO: 381445 - DNA, 25 bp, Rattus norvegicus
gcactttagcaatctccctttagaa

SEQ ID NO: 381446 - DNA, 25 bp, Rattus norvegicus
gcactttagcttaccctggacagaa

SEQ ID NO: 381447 - DNA, 25 bp, Rattus norvegicus
gcactttagctttccctggacagaa

SEQ ID NO: 381448 - DNA, 25 bp, Rattus norvegicus
gcactttagtcaagctagcccagat

SEQ ID NO: 381449 - DNA, 25 bp, Rattus norvegicus
gcactttagtcatgctagcccagat

SEQ ID NO: 381450 - DNA, 25 bp, Rattus norvegicus
gcactttatctgctcaggactctgg

SEQ ID NO: 381451 - DNA, 25 bp, Rattus norvegicus
gcactttatctggtcaggactctgg

SEQ ID NO: 381452 - DNA, 25 bp, Rattus norvegicus
gcactttatggactgggctgccact

SEQ ID NO: 381453 - DNA, 25 bp, Rattus norvegicus
gcactttatggagtgggctgccact

SEQ ID NO: 381454 - DNA, 25 bp, Rattus norvegicus
gcactttatgtgcacgacctcttaa

SEQ ID NO: 381455 - DNA, 25 bp, Rattus norvegicus
gcactttatgtggacgacctcttaa

SEQ ID NO: 381456 - DNA, 25 bp, Rattus norvegicus
gcactttatgttcctgcacaggcag

SEQ ID NO: 381457 - DNA, 25 bp, Rattus norvegicus
gcactttatgttgctgcacaggcag

SEQ ID NO: 381458 - DNA, 25 bp, Rattus norvegicus
gcactttcaatgagatccgcctggt

SEQ ID NO: 381459 - DNA, 25 bp, Rattus norvegicus
gcactttcaatgtgatccgcctggt

SEQ ID NO: 381460 - DNA, 25 bp, Rattus norvegicus
gcactttcagaaaccaactgtcctt

SEQ ID NO: 381461 - DNA, 25 bp, Rattus norvegicus
gcactttcagaatccaactgtcctt

SEQ ID NO: 381462 - DNA, 25 bp, Rattus norvegicus
gcactttcagttcctccatttggaa

SEQ ID NO: 381463 - DNA, 25 bp, Rattus norvegicus
gcactttcagttgctccatttggaa

SEQ ID NO: 381464 - DNA, 25 bp, Rattus norvegicus
gcactttccgctcaatggactttgt

SEQ ID NO: 381465 - DNA, 25 bp, Rattus norvegicus
gcactttccgctgaatggactttgt

SEQ ID NO: 381466 - DNA, 25 bp, Rattus norvegicus
gcactttcttgccagatacaatttc

SEQ ID NO: 381467 - DNA, 25 bp, Rattus norvegicus
gcactttcttgcgagatacaatttc

SEQ ID NO: 381468 - DNA, 25 bp, Rattus norvegicus
gcactttctttgcaaaacacacagg

SEQ ID NO: 381469 - DNA, 25 bp, Rattus norvegicus
gcactttctttggaaaacacacagg

SEQ ID NO: 381470 - DNA, 25 bp, Rattus norvegicus
gcactttgaagcaatccccatgaat

SEQ ID NO: 381471 - DNA, 25 bp, Rattus norvegicus
gcactttgaagctatccccatgaat

SEQ ID NO: 381472 - DNA, 25 bp, Rattus norvegicus
gcactttgattacacaaccttctct

SEQ ID NO: 381473 - DNA, 25 bp, Rattus norvegicus
gcactttgattagacaaccttctct

SEQ ID NO: 381474 - DNA, 25 bp, Rattus norvegicus
gcactttgccacagctgtattttat

SEQ ID NO: 381475 - DNA, 25 bp, Rattus norvegicus
gcactttgccactgctgtattttat

SEQ ID NO: 381476 - DNA, 25 bp, Rattus norvegicus
gcactttgccagcatgaccaatgtt

SEQ ID NO: 381477 - DNA, 25 bp, Rattus norvegicus
gcactttgccaggatgaccaatgtt

SEQ ID NO: 381478 - DNA, 25 bp, Rattus norvegicus
gcactttgccttctaaattcctggg

SEQ ID NO: 381479 - DNA, 25 bp, Rattus norvegicus
gcactttgccttgtaaattcctggg

SEQ ID NO: 381480 - DNA, 25 bp, Rattus norvegicus
gcactttgctcaaacttaggctggg

SEQ ID NO: 381481 - DNA, 25 bp, Rattus norvegicus
gcactttgctcatacttaggctggg

SEQ ID NO: 381482 - DNA, 25 bp, Rattus norvegicus
gcactttggacacttggtggctgct

SEQ ID NO: 381483 - DNA, 25 bp, Rattus norvegicus
gcactttggacagttggtggctgct

SEQ ID NO: 381484 - DNA, 25 bp, Rattus norvegicus
gcactttggcacatttctcatcaag

SEQ ID NO: 381485 - DNA, 25 bp, Rattus norvegicus
gcactttggcacttttctcatcaag

SEQ ID NO: 381486 - DNA, 25 bp, Rattus norvegicus
gcactttgggacacagcaccggcgt

SEQ ID NO: 381487 - DNA, 25 bp, Rattus norvegicus
gcactttgggactcagcaccggcgt

SEQ ID NO: 381488 - DNA, 25 bp, Rattus norvegicus
gcactttggttaatgctttattagg

SEQ ID NO: 381489 - DNA, 25 bp, Rattus norvegicus
gcactttggttattgctttattagg

SEQ ID NO: 381490 - DNA, 25 bp, Rattus norvegicus
gcactttggtttcgtatgttccttt

SEQ ID NO: 381491 - DNA, 25 bp, Rattus norvegicus
gcactttggtttggtatgttccttt

SEQ ID NO: 381492 - DNA, 25 bp, Rattus norvegicus
gcactttgtccacaggatactcact

SEQ ID NO: 381493 - DNA, 25 bp, Rattus norvegicus
gcactttgtccagaggatactcact

SEQ ID NO: 381494 - DNA, 25 bp, Rattus norvegicus
gcactttgtcctatcattgtaaagg

SEQ ID NO: 381495 - DNA, 25 bp, Rattus norvegicus
gcactttgtcctttcattgtaaagg

SEQ ID NO: 381496 - DNA, 25 bp, Rattus norvegicus
gcactttgtcgcaattaacatcctt

SEQ ID NO: 381497 - DNA, 25 bp, Rattus norvegicus
gcactttgtcgctattaacatcctt

SEQ ID NO: 381498 - DNA, 25 bp, Rattus norvegicus
gcactttgtgctatatgaggaccca

SEQ ID NO: 381499 - DNA, 25 bp, Rattus norvegicus
gcactttgtgctttatgaggaccca

SEQ ID NO: 381500 - DNA, 25 bp, Rattus norvegicus
gcactttgtgtaagaggatctggat

SEQ ID NO: 381501 - DNA, 25 bp, Rattus norvegicus
gcactttgtgtatgaggatctggat

SEQ ID NO: 381502 - DNA, 25 bp, Rattus norvegicus
gcacttttaaatcaatgaaccctgt

SEQ ID NO: 381503 - DNA, 25 bp, Rattus norvegicus
gcacttttaaatgaatgaaccctgt

SEQ ID NO: 381504 - DNA, 25 bp, Rattus norvegicus
gcacttttatccactacagacttta

SEQ ID NO: 381505 - DNA, 25 bp, Rattus norvegicus
gcacttttatcctctacagacttta

SEQ ID NO: 381506 - DNA, 25 bp, Rattus norvegicus
gcacttttattgctaattgtctata

SEQ ID NO: 381507 - DNA, 25 bp, Rattus norvegicus
gcacttttattggtaattgtctata

SEQ ID NO: 381508 - DNA, 25 bp, Rattus norvegicus
gcacttttcctactacacaacttct

SEQ ID NO: 381509 - DNA, 25 bp, Rattus norvegicus
gcacttttcctagtacacaacttct

SEQ ID NO: 381510 - DNA, 25 bp, Rattus norvegicus
gcacttttccttaaagtactcctag

SEQ ID NO: 381511 - DNA, 25 bp, Rattus norvegicus
gcacttttcctttaagtactcctag

SEQ ID NO: 381512 - DNA, 25 bp, Rattus norvegicus
gcacttttgaatacacatgaccttg

SEQ ID NO: 381513 - DNA, 25 bp, Rattus norvegicus
gcacttttgaattcacatgaccttg

SEQ ID NO: 381514 - DNA, 25 bp, Rattus norvegicus
gcacttttgattaagctaccagcca

SEQ ID NO: 381515 - DNA, 25 bp, Rattus norvegicus
gcacttttgatttagctaccagcca

SEQ ID NO: 381516 - DNA, 25 bp, Rattus norvegicus
gcacttttgctcatgctatgtagct

SEQ ID NO: 381517 - DNA, 25 bp, Rattus norvegicus
gcacttttgctcttgctatgtagct

SEQ ID NO: 381518 - DNA, 25 bp, Rattus norvegicus
gcacttttggagcaactttctgcaa

SEQ ID NO: 381519 - DNA, 25 bp, Rattus norvegicus
gcacttttggaggaactttctgcaa

SEQ ID NO: 381520 - DNA, 25 bp, Rattus norvegicus
gcacttttggtgcatattttttagt

SEQ ID NO: 381521 - DNA, 25 bp, Rattus norvegicus
gcacttttggtggatattttttagt

SEQ ID NO: 381522 - DNA, 25 bp, Rattus norvegicus
gcacttttgtggacatttcccagaa

SEQ ID NO: 381523 - DNA, 25 bp, Rattus norvegicus
gcacttttgtggtcatttcccagaa

SEQ ID NO: 381524 - DNA, 25 bp, Rattus norvegicus
gcactttttcttctaactgtggaca

SEQ ID NO: 381525 - DNA, 25 bp, Rattus norvegicus
gcactttttcttgtaactgtggaca

SEQ ID NO: 381526 - DNA, 25 bp, Rattus norvegicus
gcacttttttaactgatccatcctc

SEQ ID NO: 381527 - DNA, 25 bp, Rattus norvegicus
gcacttttttaagtgatccatcctc

SEQ ID NO: 381528 - DNA, 25 bp, Rattus norvegicus
gcagaaaaatccatgcacgtctatg

SEQ ID NO: 381529 - DNA, 25 bp, Rattus norvegicus
gcagaaaaatccttgcacgtctatg

SEQ ID NO: 381530 - DNA, 25 bp, Rattus norvegicus
gcagaaaacgctaaaccacatgatg

SEQ ID NO: 381531 - DNA, 25 bp, Rattus norvegicus
gcagaaaacgcttaaccacatgatg

SEQ ID NO: 381532 - DNA, 25 bp, Rattus norvegicus
gcagaaaactcaaggccacactagc

SEQ ID NO: 381533 - DNA, 25 bp, Rattus norvegicus
gcagaaaactcatggccacactagc

SEQ ID NO: 381534 - DNA, 25 bp, Rattus norvegicus
gcagaaaatgggaatcgcctcaact

SEQ ID NO: 381535 - DNA, 25 bp, Rattus norvegicus
gcagaaaatgggtatcgcctcaact

SEQ ID NO: 381536 - DNA, 25 bp, Rattus norvegicus
gcagaaaattccaacctgccatttt

SEQ ID NO: 381537 - DNA, 25 bp, Rattus norvegicus
gcagaaaattcctacctgccatttt

SEQ ID NO: 381538 - DNA, 25 bp, Rattus norvegicus
gcagaaacactgctatacatttttt

SEQ ID NO: 381539 - DNA, 25 bp, Rattus norvegicus
gcagaaacactggtatacatttttt

SEQ ID NO: 381540 - DNA, 25 bp, Rattus norvegicus
gcagaaacagccaccaagatacacg

SEQ ID NO: 381541 - DNA, 25 bp, Rattus norvegicus
gcagaaacagcctccaagatacacg

SEQ ID NO: 381542 - DNA, 25 bp, Rattus norvegicus
gcagaaaccaaaaccctgtgctgag

SEQ ID NO: 381543 - DNA, 25 bp, Rattus norvegicus
gcagaaaccaaatccctgtgctgag

SEQ ID NO: 381544 - DNA, 25 bp, Rattus norvegicus
gcagaaaccccacgtgtgcgcgagt

SEQ ID NO: 381545 - DNA, 25 bp, Rattus norvegicus
gcagaaaccccaggtgtgcgcgagt

SEQ ID NO: 381546 - DNA, 25 bp, Rattus norvegicus
gcagaaagagccacgctgttgctat

SEQ ID NO: 381547 - DNA, 25 bp, Rattus norvegicus
gcagaaagagcctcgctgttgctat

SEQ ID NO: 381548 - DNA, 25 bp, Rattus norvegicus
gcagaaagaggactccccgggacaa

SEQ ID NO: 381549 - DNA, 25 bp, Rattus norvegicus
gcagaaagaggagtccccgggacaa

SEQ ID NO: 381550 - DNA, 25 bp, Rattus norvegicus
gcagaaagatccatactccttgctt

SEQ ID NO: 381551 - DNA, 25 bp, Rattus norvegicus
gcagaaagatccttactccttgctt

SEQ ID NO: 381552 - DNA, 25 bp, Rattus norvegicus
gcagaaagcattaaaatacaaggga

SEQ ID NO: 381553 - DNA, 25 bp, Rattus norvegicus
gcagaaagcatttaaatacaaggga

SEQ ID NO: 381554 - DNA, 25 bp, Rattus norvegicus
gcagaaagctccctataacaaatga

SEQ ID NO: 381555 - DNA, 25 bp, Rattus norvegicus
gcagaaagctccgtataacaaatga

SEQ ID NO: 381556 - DNA, 25 bp, Rattus norvegicus
gcagaaagcttgacacatacccaat

SEQ ID NO: 381557 - DNA, 25 bp, Rattus norvegicus
gcagaaagcttgtcacatacccaat

SEQ ID NO: 381558 - DNA, 25 bp, Rattus norvegicus
gcagaaaggatcctcggccctgagt

SEQ ID NO: 381559 - DNA, 25 bp, Rattus norvegicus
gcagaaaggatcgtcggccctgagt

SEQ ID NO: 381560 - DNA, 25 bp, Rattus norvegicus
gcagaaagtgcccttgacccataag

SEQ ID NO: 381561 - DNA, 25 bp, Rattus norvegicus
gcagaaagtgccgttgacccataag

SEQ ID NO: 381562 - DNA, 25 bp, Rattus norvegicus
gcagaaatgcagacagcctgggccc

SEQ ID NO: 381563 - DNA, 25 bp, Rattus norvegicus
gcagaaatgcagtcagcctgggccc

SEQ ID NO: 381564 - DNA, 25 bp, Rattus norvegicus
gcagaaattactctgggcccaccgt

SEQ ID NO: 381565 - DNA, 25 bp, Rattus norvegicus
gcagaaattactgtgggcccaccgt

SEQ ID NO: 381566 - DNA, 25 bp, Rattus norvegicus
gcagaacaaatcaatccacggatgg

SEQ ID NO: 381567 - DNA, 25 bp, Rattus norvegicus
gcagaacaaatctatccacggatgg

SEQ ID NO: 381568 - DNA, 25 bp, Rattus norvegicus
gcagaacaagtcacatttgaagggt

SEQ ID NO: 381569 - DNA, 25 bp, Rattus norvegicus
gcagaacaagtctcatttgaagggt

SEQ ID NO: 381570 - DNA, 25 bp, Rattus norvegicus
gcagaacaattaattatggtgacat

SEQ ID NO: 381571 - DNA, 25 bp, Rattus norvegicus
gcagaacaattatttatggtgacat

SEQ ID NO: 381572 - DNA, 25 bp, Rattus norvegicus
gcagaacaattcagtcagaggccta

SEQ ID NO: 381573 - DNA, 25 bp, Rattus norvegicus
gcagaacaattctgtcagaggccta

SEQ ID NO: 381574 - DNA, 25 bp, Rattus norvegicus
gcagaacacatgacccagattaaag

SEQ ID NO: 381575 - DNA, 25 bp, Rattus norvegicus
gcagaacacatgtcccagattaaag

SEQ ID NO: 381576 - DNA, 25 bp, Rattus norvegicus
gcagaacactctatgggtgcatccc

SEQ ID NO: 381577 - DNA, 25 bp, Rattus norvegicus
gcagaacactctttgggtgcatccc

SEQ ID NO: 381578 - DNA, 25 bp, Rattus norvegicus
gcagaacactgcattcccatggatt

SEQ ID NO: 381579 - DNA, 25 bp, Rattus norvegicus
gcagaacactgctttcccatggatt

SEQ ID NO: 381580 - DNA, 25 bp, Rattus norvegicus
gcagaacaggacaggcccacagatg

SEQ ID NO: 381581 - DNA, 25 bp, Rattus norvegicus
gcagaacaggactggcccacagatg

SEQ ID NO: 381582 - DNA, 25 bp, Rattus norvegicus
gcagaacatcacattgtcattgtaa

SEQ ID NO: 381583 - DNA, 25 bp, Rattus norvegicus
gcagaacatcactttgtcattgtaa

SEQ ID NO: 381584 - DNA, 25 bp, Rattus norvegicus
gcagaacatcctaagcagccacaag

SEQ ID NO: 381585 - DNA, 25 bp, Rattus norvegicus
gcagaacatccttagcagccacaag

SEQ ID NO: 381586 - DNA, 25 bp, Rattus norvegicus
gcagaacatgccagaggtcctcagt

SEQ ID NO: 381587 - DNA, 25 bp, Rattus norvegicus
gcagaacatgcctgaggtcctcagt

SEQ ID NO: 381588 - DNA, 25 bp, Rattus norvegicus
gcagaaccagcactcttttggacct

SEQ ID NO: 381589 - DNA, 25 bp, Rattus norvegicus
gcagaaccagcagtcttttggacct

SEQ ID NO: 381590 - DNA, 25 bp, Rattus norvegicus
gcagaaccagggagcactttatgtt

SEQ ID NO: 381591 - DNA, 25 bp, Rattus norvegicus
gcagaaccagggtgcactttatgtt

SEQ ID NO: 381592 - DNA, 25 bp, Rattus norvegicus
gcagaaccgaggacgggagcctatt

SEQ ID NO: 381593 - DNA, 25 bp, Rattus norvegicus
gcagaaccgaggtcgggagcctatt

SEQ ID NO: 381594 - DNA, 25 bp, Rattus norvegicus
gcagaaccgggaaggccacccgtcg

SEQ ID NO: 381595 - DNA, 25 bp, Rattus norvegicus
gcagaaccgggatggccacccgtcg

SEQ ID NO: 381596 - DNA, 25 bp, Rattus norvegicus
gcagaacctcaaccgcagcaagcag

SEQ ID NO: 381597 - DNA, 25 bp, Rattus norvegicus
gcagaacctcaagcgcagcaagcag

SEQ ID NO: 381598 - DNA, 25 bp, Rattus norvegicus
gcagaacctgggacagctttggtgt

SEQ ID NO: 381599 - DNA, 25 bp, Rattus norvegicus
gcagaacctgggtcagctttggtgt

SEQ ID NO: 381600 - DNA, 25 bp, Rattus norvegicus
gcagaacgctaacggccgtttcctg

SEQ ID NO: 381601 - DNA, 25 bp, Rattus norvegicus
gcagaacgctaagggccgtttcctg

SEQ ID NO: 381602 - DNA, 25 bp, Rattus norvegicus
gcagaacgctgccttggatttgcac

SEQ ID NO: 381603 - DNA, 25 bp, Rattus norvegicus
gcagaacgctgcgttggatttgcac

SEQ ID NO: 381604 - DNA, 25 bp, Rattus norvegicus
gcagaacggcatctagcagctaaca

SEQ ID NO: 381605 - DNA, 25 bp, Rattus norvegicus
gcagaacggcatgtagcagctaaca

SEQ ID NO: 381606 - DNA, 25 bp, Rattus norvegicus
gcagaactacccctgtactttagag

SEQ ID NO: 381607 - DNA, 25 bp, Rattus norvegicus
gcagaactacccgtgtactttagag

SEQ ID NO: 381608 - DNA, 25 bp, Rattus norvegicus
gcagaactccaaaatgcccttcaag

SEQ ID NO: 381609 - DNA, 25 bp, Rattus norvegicus
gcagaactccaatatgcccttcaag

SEQ ID NO: 381610 - DNA, 25 bp, Rattus norvegicus
gcagaactctctcggtggcagtgcc

SEQ ID NO: 381611 - DNA, 25 bp, Rattus norvegicus
gcagaactctctgggtggcagtgcc

SEQ ID NO: 381612 - DNA, 25 bp, Rattus norvegicus
gcagaactctggcttcttgtcagat

SEQ ID NO: 381613 - DNA, 25 bp, Rattus norvegicus
gcagaactctgggttcttgtcagat

SEQ ID NO: 381614 - DNA, 25 bp, Rattus norvegicus
gcagaactgcaaccttttgtacctt

SEQ ID NO: 381615 - DNA, 25 bp, Rattus norvegicus
gcagaactgcaagcttttgtacctt

SEQ ID NO: 381616 - DNA, 25 bp, Rattus norvegicus
gcagaactgcatcgagagctcaatg

SEQ ID NO: 381617 - DNA, 25 bp, Rattus norvegicus
gcagaactgcatggagagctcaatg

SEQ ID NO: 381618 - DNA, 25 bp, Rattus norvegicus
gcagaactgccacagactcttgttt

SEQ ID NO: 381619 - DNA, 25 bp, Rattus norvegicus
gcagaactgccagagactcttgttt

SEQ ID NO: 381620 - DNA, 25 bp, Rattus norvegicus
gcagaactgctgatgggttattagt

SEQ ID NO: 381621 - DNA, 25 bp, Rattus norvegicus
gcagaactgctgttgggttattagt

SEQ ID NO: 381622 - DNA, 25 bp, Rattus norvegicus
gcagaacttcagagcgccttatggc

SEQ ID NO: 381623 - DNA, 25 bp, Rattus norvegicus
gcagaacttcagtgcgccttatggc

SEQ ID NO: 381624 - DNA, 25 bp, Rattus norvegicus
gcagaacttgaaccctgatgccaac

SEQ ID NO: 381625 - DNA, 25 bp, Rattus norvegicus
gcagaacttgaagcctgatgccaac

SEQ ID NO: 381626 - DNA, 25 bp, Rattus norvegicus
gcagaacttgccaacaaaatgggtt

SEQ ID NO: 381627 - DNA, 25 bp, Rattus norvegicus
gcagaacttgcctacaaaatgggtt

SEQ ID NO: 381628 - DNA, 25 bp, Rattus norvegicus
gcagaacttgtgattttctcatctt

SEQ ID NO: 381629 - DNA, 25 bp, Rattus norvegicus
gcagaacttgtgtttttctcatctt

SEQ ID NO: 381630 - DNA, 25 bp, Rattus norvegicus
gcagaacttgttctcttagatgttt

SEQ ID NO: 381631 - DNA, 25 bp, Rattus norvegicus
gcagaacttgttgtcttagatgttt

SEQ ID NO: 381632 - DNA, 25 bp, Rattus norvegicus
gcagaactttttactttccaattgt

SEQ ID NO: 381633 - DNA, 25 bp, Rattus norvegicus
gcagaacttttttctttccaattgt

SEQ ID NO: 381634 - DNA, 25 bp, Rattus norvegicus
gcagaagaatctcgccccgctggtg

SEQ ID NO: 381635 - DNA, 25 bp, Rattus norvegicus
gcagaagaatctggccccgctggtg

SEQ ID NO: 381636 - DNA, 25 bp, Rattus norvegicus
gcagaagacaccagaggccttgacc

SEQ ID NO: 381637 - DNA, 25 bp, Rattus norvegicus
gcagaagacacctgaggccttgacc

SEQ ID NO: 381638 - DNA, 25 bp, Rattus norvegicus
gcagaagacatacatctctgtgatg

SEQ ID NO: 381639 - DNA, 25 bp, Rattus norvegicus
gcagaagacatagatctctgtgatg

SEQ ID NO: 381640 - DNA, 25 bp, Rattus norvegicus
gcagaagaccttatgtttggtcaag

SEQ ID NO: 381641 - DNA, 25 bp, Rattus norvegicus
gcagaagaccttttgtttggtcaag

SEQ ID NO: 381642 - DNA, 25 bp, Rattus norvegicus
gcagaagacttgcaaaccctttaat

SEQ ID NO: 381643 - DNA, 25 bp, Rattus norvegicus
gcagaagacttggaaaccctttaat

SEQ ID NO: 381644 - DNA, 25 bp, Rattus norvegicus
gcagaagactttctcctttaaggcc

SEQ ID NO: 381645 - DNA, 25 bp, Rattus norvegicus
gcagaagactttgtcctttaaggcc

SEQ ID NO: 381646 - DNA, 25 bp, Rattus norvegicus
gcagaagagccccagcgttttgcct

SEQ ID NO: 381647 - DNA, 25 bp, Rattus norvegicus
gcagaagagcccgagcgttttgcct

SEQ ID NO: 381648 - DNA, 25 bp, Rattus norvegicus
gcagaagcagctatgtgcatcccaa

SEQ ID NO: 381649 - DNA, 25 bp, Rattus norvegicus
gcagaagcagctttgtgcatcccaa

SEQ ID NO: 381650 - DNA, 25 bp, Rattus norvegicus
gcagaagcagtacctcatcaaacat

SEQ ID NO: 381651 - DNA, 25 bp, Rattus norvegicus
gcagaagcagtagctcatcaaacat

SEQ ID NO: 381652 - DNA, 25 bp, Rattus norvegicus
gcagaagcagttccctggcctggct

SEQ ID NO: 381653 - DNA, 25 bp, Rattus norvegicus
gcagaagcagttgcctggcctggct

SEQ ID NO: 381654 - DNA, 25 bp, Rattus norvegicus
gcagaagcatgtcgtagctctctta

SEQ ID NO: 381655 - DNA, 25 bp, Rattus norvegicus
gcagaagcatgtggtagctctctta

SEQ ID NO: 381656 - DNA, 25 bp, Rattus norvegicus
gcagaagccagaatcttccatgtga

SEQ ID NO: 381657 - DNA, 25 bp, Rattus norvegicus
gcagaagccagattcttccatgtga

SEQ ID NO: 381658 - DNA, 25 bp, Rattus norvegicus
gcagaagccaggcatttctactgaa

SEQ ID NO: 381659 - DNA, 25 bp, Rattus norvegicus
gcagaagccagggatttctactgaa

SEQ ID NO: 381660 - DNA, 25 bp, Rattus norvegicus
gcagaagccgatccctgtcaacctt

SEQ ID NO: 381661 - DNA, 25 bp, Rattus norvegicus
gcagaagccgatgcctgtcaacctt

SEQ ID NO: 381662 - DNA, 25 bp, Rattus norvegicus
gcagaagcctacaggcctgagactt

SEQ ID NO: 381663 - DNA, 25 bp, Rattus norvegicus
gcagaagcctactggcctgagactt

SEQ ID NO: 381664 - DNA, 25 bp, Rattus norvegicus
gcagaagcctcaccgctcaggagct

SEQ ID NO: 381665 - DNA, 25 bp, Rattus norvegicus
gcagaagcctcagcgctcaggagct

SEQ ID NO: 381666 - DNA, 25 bp, Rattus norvegicus
gcagaagcctgaatccactgtttat

SEQ ID NO: 381667 - DNA, 25 bp, Rattus norvegicus
gcagaagcctgattccactgtttat

SEQ ID NO: 381668 - DNA, 25 bp, Rattus norvegicus
gcagaagcggctcagatctttcaaa

SEQ ID NO: 381669 - DNA, 25 bp, Rattus norvegicus
gcagaagcggctgagatctttcaaa

SEQ ID NO: 381670 - DNA, 25 bp, Rattus norvegicus
gcagaagctcacagtttttcttatt

SEQ ID NO: 381671 - DNA, 25 bp, Rattus norvegicus
gcagaagctcactgtttttcttatt

SEQ ID NO: 381672 - DNA, 25 bp, Rattus norvegicus
gcagaagctcctccagtctctgttc

SEQ ID NO: 381673 - DNA, 25 bp, Rattus norvegicus
gcagaagctcctgcagtctctgttc

SEQ ID NO: 381674 - DNA, 25 bp, Rattus norvegicus
gcagaagctgccaagaagtgttgta

SEQ ID NO: 381675 - DNA, 25 bp, Rattus norvegicus
gcagaagctgcctagaagtgttgta

SEQ ID NO: 381676 - DNA, 25 bp, Rattus norvegicus
gcagaagctgggagatttcagatca

SEQ ID NO: 381677 - DNA, 25 bp, Rattus norvegicus
gcagaagctgggtgatttcagatca

SEQ ID NO: 381678 - DNA, 25 bp, Rattus norvegicus
gcagaagctgttagcaacccaaaat

SEQ ID NO: 381679 - DNA, 25 bp, Rattus norvegicus
gcagaagctgtttgcaacccaaaat

SEQ ID NO: 381680 - DNA, 25 bp, Rattus norvegicus
gcagaagcttatctccttacttttt

SEQ ID NO: 381681 - DNA, 25 bp, Rattus norvegicus
gcagaagcttatgtccttacttttt

SEQ ID NO: 381682 - DNA, 25 bp, Rattus norvegicus
gcagaagcttgcagccactgaggaa

SEQ ID NO: 381683 - DNA, 25 bp, Rattus norvegicus
gcagaagcttgccttgttcacaaca

SEQ ID NO: 381684 - DNA, 25 bp, Rattus norvegicus
gcagaagcttgcgttgttcacaaca

SEQ ID NO: 381685 - DNA, 25 bp, Rattus norvegicus
gcagaagcttgctgccactgaggaa

SEQ ID NO: 381686 - DNA, 25 bp, Rattus norvegicus
gcagaaggatggactcccacaagct

SEQ ID NO: 381687 - DNA, 25 bp, Rattus norvegicus
gcagaaggatggtctcccacaagct

SEQ ID NO: 381688 - DNA, 25 bp, Rattus norvegicus
gcagaaggcaacaccttgggaccta

SEQ ID NO: 381689 - DNA, 25 bp, Rattus norvegicus
gcagaaggcaactccttgggaccta

SEQ ID NO: 381690 - DNA, 25 bp, Rattus norvegicus
gcagaaggcaagaatgtcagatatc

SEQ ID NO: 381691 - DNA, 25 bp, Rattus norvegicus
gcagaaggcaagtatgtcagatatc

SEQ ID NO: 381692 - DNA, 25 bp, Rattus norvegicus
gcagaagggctaacctgatgagatt

SEQ ID NO: 381693 - DNA, 25 bp, Rattus norvegicus
gcagaagggctatcctgatgagatt

SEQ ID NO: 381694 - DNA, 25 bp, Rattus norvegicus
gcagaaggtatgctttttagcccct

SEQ ID NO: 381695 - DNA, 25 bp, Rattus norvegicus
gcagaaggtatggtttttagcccct

SEQ ID NO: 381696 - DNA, 25 bp, Rattus norvegicus
gcagaaggtcccaggcatagacagg

SEQ ID NO: 381697 - DNA, 25 bp, Rattus norvegicus
gcagaaggtccctggcatagacagg

SEQ ID NO: 381698 - DNA, 25 bp, Rattus norvegicus
gcagaaggttgtatggcacggctcc

SEQ ID NO: 381699 - DNA, 25 bp, Rattus norvegicus
gcagaaggttgtttggcacggctcc

SEQ ID NO: 381700 - DNA, 25 bp, Rattus norvegicus
gcagaagtaatgaacccctttcccg

SEQ ID NO: 381701 - DNA, 25 bp, Rattus norvegicus
gcagaagtaatgtacccctttcccg

SEQ ID NO: 381702 - DNA, 25 bp, Rattus norvegicus
gcagaagtacacagatcacgcccaa

SEQ ID NO: 381703 - DNA, 25 bp, Rattus norvegicus
gcagaagtacactgatcacgcccaa

SEQ ID NO: 381704 - DNA, 25 bp, Rattus norvegicus
gcagaagtagggacgccgctccccg

SEQ ID NO: 381705 - DNA, 25 bp, Rattus norvegicus
gcagaagtagggtcgccgctccccg

SEQ ID NO: 381706 - DNA, 25 bp, Rattus norvegicus
gcagaagtattgacggtgtcctcac

SEQ ID NO: 381707 - DNA, 25 bp, Rattus norvegicus
gcagaagtattgtcggtgtcctcac

SEQ ID NO: 381708 - DNA, 25 bp, Rattus norvegicus
gcagaagtcacacaactgtcaccct

SEQ ID NO: 381709 - DNA, 25 bp, Rattus norvegicus
gcagaagtcacactcagcgtcttga

SEQ ID NO: 381710 - DNA, 25 bp, Rattus norvegicus
gcagaagtcacagaactgtcaccct

SEQ ID NO: 381711 - DNA, 25 bp, Rattus norvegicus
gcagaagtcacagtcagcgtcttga

SEQ ID NO: 381712 - DNA, 25 bp, Rattus norvegicus
gcagaagtcatacgctagggctcta

SEQ ID NO: 381713 - DNA, 25 bp, Rattus norvegicus
gcagaagtcataggctagggctcta

SEQ ID NO: 381714 - DNA, 25 bp, Rattus norvegicus
gcagaagtcatgaagccagcagagc

SEQ ID NO: 381715 - DNA, 25 bp, Rattus norvegicus
gcagaagtcatgtagccagcagagc

SEQ ID NO: 381716 - DNA, 25 bp, Rattus norvegicus
gcagaagtgcacctgtgctcagact

SEQ ID NO: 381717 - DNA, 25 bp, Rattus norvegicus
gcagaagtgcacgtgtgctcagact

SEQ ID NO: 381718 - DNA, 25 bp, Rattus norvegicus
gcagaagtgcagatagtcccttaga

SEQ ID NO: 381719 - DNA, 25 bp, Rattus norvegicus
gcagaagtgcagttagtcccttaga

SEQ ID NO: 381720 - DNA, 25 bp, Rattus norvegicus
gcagaagtgcatatcggacagtttt

SEQ ID NO: 381721 - DNA, 25 bp, Rattus norvegicus
gcagaagtgcatttcggacagtttt

SEQ ID NO: 381722 - DNA, 25 bp, Rattus norvegicus
gcagaagtgcgaccatcgctgcaga

SEQ ID NO: 381723 - DNA, 25 bp, Rattus norvegicus
gcagaagtgcgagcatcgctgcaga

SEQ ID NO: 381724 - DNA, 25 bp, Rattus norvegicus
gcagaagttaccacttacctctttg

SEQ ID NO: 381725 - DNA, 25 bp, Rattus norvegicus
gcagaagttacctcttacctctttg

SEQ ID NO: 381726 - DNA, 25 bp, Rattus norvegicus
gcagaagttcaaagtcactcccagc

SEQ ID NO: 381727 - DNA, 25 bp, Rattus norvegicus
gcagaagttcaatgtcactcccagc

SEQ ID NO: 381728 - DNA, 25 bp, Rattus norvegicus
gcagaagttcatattggcaggtaca

SEQ ID NO: 381729 - DNA, 25 bp, Rattus norvegicus
gcagaagttcattttggcaggtaca

SEQ ID NO: 381730 - DNA, 25 bp, Rattus norvegicus
gcagaagttgacaggcgctttcctt

SEQ ID NO: 381731 - DNA, 25 bp, Rattus norvegicus
gcagaagttgactggcgctttcctt

SEQ ID NO: 381732 - DNA, 25 bp, Rattus norvegicus
gcagaagtttcgaagtgagaccatc

SEQ ID NO: 381733 - DNA, 25 bp, Rattus norvegicus
gcagaagtttcgtagtgagaccatc

SEQ ID NO: 381734 - DNA, 25 bp, Rattus norvegicus
gcagaataaaacaccgctagacaaa

SEQ ID NO: 381735 - DNA, 25 bp, Rattus norvegicus
gcagaataaaactccgctagacaaa

SEQ ID NO: 381736 - DNA, 25 bp, Rattus norvegicus
gcagaataaacgctcactccattag

SEQ ID NO: 381737 - DNA, 25 bp, Rattus norvegicus
gcagaataaacggtcactccattag

SEQ ID NO: 381738 - DNA, 25 bp, Rattus norvegicus
gcagaatacagcagtacctgtcctc

SEQ ID NO: 381739 - DNA, 25 bp, Rattus norvegicus
gcagaatacagctgtacctgtcctc

SEQ ID NO: 381740 - DNA, 25 bp, Rattus norvegicus
gcagaatagcaacctttccagcatt

SEQ ID NO: 381741 - DNA, 25 bp, Rattus norvegicus
gcagaatagcaagctttccagcatt

SEQ ID NO: 381742 - DNA, 25 bp, Rattus norvegicus
gcagaatatcagaaagcctaggttc

SEQ ID NO: 381743 - DNA, 25 bp, Rattus norvegicus
gcagaatatcagtaagcctaggttc

SEQ ID NO: 381744 - DNA, 25 bp, Rattus norvegicus
gcagaatatctgcatgccttaaatt

SEQ ID NO: 381745 - DNA, 25 bp, Rattus norvegicus
gcagaatatctggatgccttaaatt

SEQ ID NO: 381746 - DNA, 25 bp, Rattus norvegicus
gcagaatcagtcacacattgcggta

SEQ ID NO: 381747 - DNA, 25 bp, Rattus norvegicus
gcagaatcagtctcacattgcggta

SEQ ID NO: 381748 - DNA, 25 bp, Rattus norvegicus
gcagaatccagaagtttcccacaag

SEQ ID NO: 381749 - DNA, 25 bp, Rattus norvegicus
gcagaatccagatgtttcccacaag

SEQ ID NO: 381750 - DNA, 25 bp, Rattus norvegicus
gcagaatccatcaccggtgggatga

SEQ ID NO: 381751 - DNA, 25 bp, Rattus norvegicus
gcagaatccatctccggtgggatga

SEQ ID NO: 381752 - DNA, 25 bp, Rattus norvegicus
gcagaatccgccactatttaaaggg

SEQ ID NO: 381753 - DNA, 25 bp, Rattus norvegicus
gcagaatccgcctctatttaaaggg

SEQ ID NO: 381754 - DNA, 25 bp, Rattus norvegicus
gcagaatcctgcagcaagggtgcat

SEQ ID NO: 381755 - DNA, 25 bp, Rattus norvegicus
gcagaatcctgctgcaagggtgcat

SEQ ID NO: 381756 - DNA, 25 bp, Rattus norvegicus
gcagaatcgtttcctcgcagatgga

SEQ ID NO: 381757 - DNA, 25 bp, Rattus norvegicus
gcagaatcgtttgctcgcagatgga

SEQ ID NO: 381758 - DNA, 25 bp, Rattus norvegicus
gcagaatctccgactagtcccgtga

SEQ ID NO: 381759 - DNA, 25 bp, Rattus norvegicus
gcagaatctccgtctagtcccgtga

SEQ ID NO: 381760 - DNA, 25 bp, Rattus norvegicus
gcagaatctggaaggcacctgtgca

SEQ ID NO: 381761 - DNA, 25 bp, Rattus norvegicus
gcagaatctggatggcacctgtgca

SEQ ID NO: 381762 - DNA, 25 bp, Rattus norvegicus
gcagaatgacataccataccagggt

SEQ ID NO: 381763 - DNA, 25 bp, Rattus norvegicus
gcagaatgacattccataccagggt

SEQ ID NO: 381764 - DNA, 25 bp, Rattus norvegicus
gcagaatgacttaccttgattccat

SEQ ID NO: 381765 - DNA, 25 bp, Rattus norvegicus
gcagaatgactttccttgattccat

SEQ ID NO: 381766 - DNA, 25 bp, Rattus norvegicus
gcagaatgctgacttccaggaagct

SEQ ID NO: 381767 - DNA, 25 bp, Rattus norvegicus
gcagaatgctgagttccaggaagct

SEQ ID NO: 381768 - DNA, 25 bp, Rattus norvegicus
gcagaatgggccctgtcctttaatt

SEQ ID NO: 381769 - DNA, 25 bp, Rattus norvegicus
gcagaatgggccgtgtcctttaatt

SEQ ID NO: 381770 - DNA, 25 bp, Rattus norvegicus
gcagaattactcatagaaaccccag

SEQ ID NO: 381771 - DNA, 25 bp, Rattus norvegicus
gcagaattactcttagaaaccccag

SEQ ID NO: 381772 - DNA, 25 bp, Rattus norvegicus
gcagaattaggaagggcacccgccc

SEQ ID NO: 381773 - DNA, 25 bp, Rattus norvegicus
gcagaattaggatgggcacccgccc

SEQ ID NO: 381774 - DNA, 25 bp, Rattus norvegicus
gcagaattatatcaaggaggcccta

SEQ ID NO: 381775 - DNA, 25 bp, Rattus norvegicus
gcagaattatatgaaggaggcccta

SEQ ID NO: 381776 - DNA, 25 bp, Rattus norvegicus
gcagaattattgatcttcctggaat

SEQ ID NO: 381777 - DNA, 25 bp, Rattus norvegicus
gcagaattattgttcttcctggaat

SEQ ID NO: 381778 - DNA, 25 bp, Rattus norvegicus
gcagaattctaacggcccagttacc

SEQ ID NO: 381779 - DNA, 25 bp, Rattus norvegicus
gcagaattctaagggcccagttacc

SEQ ID NO: 381780 - DNA, 25 bp, Rattus norvegicus
gcagaattgttgaactgggcaaact

SEQ ID NO: 381781 - DNA, 25 bp, Rattus norvegicus
gcagaattgttgtactgggcaaact

SEQ ID NO: 381782 - DNA, 25 bp, Rattus norvegicus
gcagaatttcacactttatggctaa

SEQ ID NO: 381783 - DNA, 25 bp, Rattus norvegicus
gcagaatttcactctttatggctaa

SEQ ID NO: 381784 - DNA, 25 bp, Rattus norvegicus
gcagaatttctaatcttgtattaac

SEQ ID NO: 381785 - DNA, 25 bp, Rattus norvegicus
gcagaatttctattcttgtattaac

SEQ ID NO: 381786 - DNA, 25 bp, Rattus norvegicus
gcagaatttgaaaatggagcccatt

SEQ ID NO: 381787 - DNA, 25 bp, Rattus norvegicus
gcagaatttgaatatggagcccatt

SEQ ID NO: 381788 - DNA, 25 bp, Rattus norvegicus
gcagacaaaatcaacatggtcattt

SEQ ID NO: 381789 - DNA, 25 bp, Rattus norvegicus
gcagacaaaatctacatggtcattt

SEQ ID NO: 381790 - DNA, 25 bp, Rattus norvegicus
gcagacaaactccaaggtcgtctct

SEQ ID NO: 381791 - DNA, 25 bp, Rattus norvegicus
gcagacaaactcgaaggtcgtctct

SEQ ID NO: 381792 - DNA, 25 bp, Rattus norvegicus
gcagacaactagacatacacgccta

SEQ ID NO: 381793 - DNA, 25 bp, Rattus norvegicus
gcagacaactagtcatacacgccta

SEQ ID NO: 381794 - DNA, 25 bp, Rattus norvegicus
gcagacaagatgcatgccctccaac

SEQ ID NO: 381795 - DNA, 25 bp, Rattus norvegicus
gcagacaagatggatgccctccaac

SEQ ID NO: 381796 - DNA, 25 bp, Rattus norvegicus
gcagacaaggctcctgccagagcat

SEQ ID NO: 381797 - DNA, 25 bp, Rattus norvegicus
gcagacaaggctgctgccagagcat

SEQ ID NO: 381798 - DNA, 25 bp, Rattus norvegicus
gcagacaagttcctcagttccatga

SEQ ID NO: 381799 - DNA, 25 bp, Rattus norvegicus
gcagacaagttcgtcagttccatga

SEQ ID NO: 381800 - DNA, 25 bp, Rattus norvegicus
gcagacaatgtcctctgtgctgtat

SEQ ID NO: 381801 - DNA, 25 bp, Rattus norvegicus
gcagacaatgtcgtctgtgctgtat

SEQ ID NO: 381802 - DNA, 25 bp, Rattus norvegicus
gcagacaattgtccagcaccactta

SEQ ID NO: 381803 - DNA, 25 bp, Rattus norvegicus
gcagacaattgtgcagcaccactta

SEQ ID NO: 381804 - DNA, 25 bp, Rattus norvegicus
gcagacacacttcgtttatggatag

SEQ ID NO: 381805 - DNA, 25 bp, Rattus norvegicus
gcagacacacttggtttatggatag

SEQ ID NO: 381806 - DNA, 25 bp, Rattus norvegicus
gcagacacagagcacgcatgatcat

SEQ ID NO: 381807 - DNA, 25 bp, Rattus norvegicus
gcagacacagaggacgcatgatcat

SEQ ID NO: 381808 - DNA, 25 bp, Rattus norvegicus
gcagacacagctacgaacccggatg

SEQ ID NO: 381809 - DNA, 25 bp, Rattus norvegicus
gcagacacagcttcgaacccggatg

SEQ ID NO: 381810 - DNA, 25 bp, Rattus norvegicus
gcagacacagtgaagggccgattca

SEQ ID NO: 381811 - DNA, 25 bp, Rattus norvegicus
gcagacacagtgtagggccgattca

SEQ ID NO: 381812 - DNA, 25 bp, Rattus norvegicus
gcagacaccaagactcgctgagatt

SEQ ID NO: 381813 - DNA, 25 bp, Rattus norvegicus
gcagacaccaagtctcgctgagatt

SEQ ID NO: 381814 - DNA, 25 bp, Rattus norvegicus
gcagacaccactattgaagctgtta

SEQ ID NO: 381815 - DNA, 25 bp, Rattus norvegicus
gcagacaccacttttgaagctgtta

SEQ ID NO: 381816 - DNA, 25 bp, Rattus norvegicus
gcagacaccatgcagaacattgagt

SEQ ID NO: 381817 - DNA, 25 bp, Rattus norvegicus
gcagacaccatggagaacattgagt

SEQ ID NO: 381818 - DNA, 25 bp, Rattus norvegicus
gcagacaccctgaacttgacgggat

SEQ ID NO: 381819 - DNA, 25 bp, Rattus norvegicus
gcagacaccctgtacttgacgggat

SEQ ID NO: 381820 - DNA, 25 bp, Rattus norvegicus
gcagacacccttcgcttttaatgat

SEQ ID NO: 381821 - DNA, 25 bp, Rattus norvegicus
gcagacacccttggcttttaatgat

SEQ ID NO: 381822 - DNA, 25 bp, Rattus norvegicus
gcagacaccgttctgaactcacgaa

SEQ ID NO: 381823 - DNA, 25 bp, Rattus norvegicus
gcagacaccgttgtgaactcacgaa

SEQ ID NO: 381824 - DNA, 25 bp, Rattus norvegicus
gcagacacgctcagtggccggccag

SEQ ID NO: 381825 - DNA, 25 bp, Rattus norvegicus
gcagacacgctctgtggccggccag

SEQ ID NO: 381826 - DNA, 25 bp, Rattus norvegicus
gcagacacgtgacatggagagacca

SEQ ID NO: 381827 - DNA, 25 bp, Rattus norvegicus
gcagacacgtgagatggagagacca

SEQ ID NO: 381828 - DNA, 25 bp, Rattus norvegicus
gcagacacgtggcatattctcacag

SEQ ID NO: 381829 - DNA, 25 bp, Rattus norvegicus
gcagacacgtgggatattctcacag

SEQ ID NO: 381830 - DNA, 25 bp, Rattus norvegicus
gcagacactgccatagttagacaca

SEQ ID NO: 381831 - DNA, 25 bp, Rattus norvegicus
gcagacactgccctgataagagcat

SEQ ID NO: 381832 - DNA, 25 bp, Rattus norvegicus
gcagacactgccgtgataagagcat

SEQ ID NO: 381833 - DNA, 25 bp, Rattus norvegicus
gcagacactgccttagttagacaca

SEQ ID NO: 381834 - DNA, 25 bp, Rattus norvegicus
gcagacactttgctgaaggaccctt

SEQ ID NO: 381835 - DNA, 25 bp, Rattus norvegicus
gcagacactttggtgaaggaccctt

SEQ ID NO: 381836 - DNA, 25 bp, Rattus norvegicus
gcagacagacatctactgactatga

SEQ ID NO: 381837 - DNA, 25 bp, Rattus norvegicus
gcagacagacatgtactgactatga

SEQ ID NO: 381838 - DNA, 25 bp, Rattus norvegicus
gcagacagattcagttttcccactt

SEQ ID NO: 381839 - DNA, 25 bp, Rattus norvegicus
gcagacagattctgttttcccactt

SEQ ID NO: 381840 - DNA, 25 bp, Rattus norvegicus
gcagacagcaaaatcctcacgtgag

SEQ ID NO: 381841 - DNA, 25 bp, Rattus norvegicus
gcagacagcaaattcctcacgtgag

SEQ ID NO: 381842 - DNA, 25 bp, Rattus norvegicus
gcagacagccgtaaaggttcctggg

SEQ ID NO: 381843 - DNA, 25 bp, Rattus norvegicus
gcagacagccgttaaggttcctggg

SEQ ID NO: 381844 - DNA, 25 bp, Rattus norvegicus
gcagacagcctaccttcatggtgct

SEQ ID NO: 381845 - DNA, 25 bp, Rattus norvegicus
gcagacagcctagcttcatggtgct

SEQ ID NO: 381846 - DNA, 25 bp, Rattus norvegicus
gcagacaggcgtagtctcggttgtc

SEQ ID NO: 381847 - DNA, 25 bp, Rattus norvegicus
gcagacaggcgttgtctcggttgtc

SEQ ID NO: 381848 - DNA, 25 bp, Rattus norvegicus
gcagacagggctcgatggcgcgctt

SEQ ID NO: 381849 - DNA, 25 bp, Rattus norvegicus
gcagacagggctggatggcgcgctt

SEQ ID NO: 381850 - DNA, 25 bp, Rattus norvegicus
gcagacagttctaagtgatcgactc

SEQ ID NO: 381851 - DNA, 25 bp, Rattus norvegicus
gcagacagttcttagtgatcgactc

SEQ ID NO: 381852 - DNA, 25 bp, Rattus norvegicus
gcagacatagtccatactctttgtg

SEQ ID NO: 381853 - DNA, 25 bp, Rattus norvegicus
gcagacatagtcgatactctttgtg

SEQ ID NO: 381854 - DNA, 25 bp, Rattus norvegicus
gcagacatcacgagtgtggttcaca

SEQ ID NO: 381855 - DNA, 25 bp, Rattus norvegicus
gcagacatcacgtgtgtggttcaca

SEQ ID NO: 381856 - DNA, 25 bp, Rattus norvegicus
gcagacatcagcaagactacacaga

SEQ ID NO: 381857 - DNA, 25 bp, Rattus norvegicus
gcagacatcagctagactacacaga

SEQ ID NO: 381858 - DNA, 25 bp, Rattus norvegicus
gcagacatcataattggcttcgcaa

SEQ ID NO: 381859 - DNA, 25 bp, Rattus norvegicus
gcagacatcatatttggcttcgcaa

SEQ ID NO: 381860 - DNA, 25 bp, Rattus norvegicus
gcagacatccaactgcaaggcatgc

SEQ ID NO: 381861 - DNA, 25 bp, Rattus norvegicus
gcagacatccaagtgcaaggcatgc

SEQ ID NO: 381862 - DNA, 25 bp, Rattus norvegicus
gcagacatctgacaacggattcctt

SEQ ID NO: 381863 - DNA, 25 bp, Rattus norvegicus
gcagacatctgagaacggattcctt

SEQ ID NO: 381864 - DNA, 25 bp, Rattus norvegicus
gcagacattaatcctagttctggaa

SEQ ID NO: 381865 - DNA, 25 bp, Rattus norvegicus
gcagacattaatgctagttctggaa

SEQ ID NO: 381866 - DNA, 25 bp, Rattus norvegicus
gcagacattagcagaccctgtttgg

SEQ ID NO: 381867 - DNA, 25 bp, Rattus norvegicus
gcagacattagctgaccctgtttgg

SEQ ID NO: 381868 - DNA, 25 bp, Rattus norvegicus
gcagacattcaccatagctaggctt

SEQ ID NO: 381869 - DNA, 25 bp, Rattus norvegicus
gcagacattcacgatagctaggctt

SEQ ID NO: 381870 - DNA, 25 bp, Rattus norvegicus
gcagacattcatctgctcagccaaa

SEQ ID NO: 381871 - DNA, 25 bp, Rattus norvegicus
gcagacattcatgtgctcagccaaa

SEQ ID NO: 381872 - DNA, 25 bp, Rattus norvegicus
gcagacattgcacctctggcaagtt

SEQ ID NO: 381873 - DNA, 25 bp, Rattus norvegicus
gcagacattgcagctctggcaagtt

SEQ ID NO: 381874 - DNA, 25 bp, Rattus norvegicus
gcagacattttgcaacccttttgtg

SEQ ID NO: 381875 - DNA, 25 bp, Rattus norvegicus
gcagacattttggaacccttttgtg

SEQ ID NO: 381876 - DNA, 25 bp, Rattus norvegicus
gcagacatttttcagggatcccatt

SEQ ID NO: 381877 - DNA, 25 bp, Rattus norvegicus
gcagacatttttgagggatcccatt

SEQ ID NO: 381878 - DNA, 25 bp, Rattus norvegicus
gcagaccaagcaacgaggccaacaa

SEQ ID NO: 381879 - DNA, 25 bp, Rattus norvegicus
gcagaccaagcatcgaggccaacaa

SEQ ID NO: 381880 - DNA, 25 bp, Rattus norvegicus
gcagaccaattccacatcctgaatg

SEQ ID NO: 381881 - DNA, 25 bp, Rattus norvegicus
gcagaccaattcgacatcctgaatg

SEQ ID NO: 381882 - DNA, 25 bp, Rattus norvegicus
gcagaccagagccttagaaaccgtg

SEQ ID NO: 381883 - DNA, 25 bp, Rattus norvegicus
gcagaccagagcgttagaaaccgtg

SEQ ID NO: 381884 - DNA, 25 bp, Rattus norvegicus
gcagaccagggacatctcatatagg

SEQ ID NO: 381885 - DNA, 25 bp, Rattus norvegicus
gcagaccagggagatctcatatagg

SEQ ID NO: 381886 - DNA, 25 bp, Rattus norvegicus
gcagaccagggtcagccatgagtaa

SEQ ID NO: 381887 - DNA, 25 bp, Rattus norvegicus
gcagaccagggtcctcattggatac

SEQ ID NO: 381888 - DNA, 25 bp, Rattus norvegicus
gcagaccagggtgagccatgagtaa

SEQ ID NO: 381889 - DNA, 25 bp, Rattus norvegicus
gcagaccagggtgctcattggatac

SEQ ID NO: 381890 - DNA, 25 bp, Rattus norvegicus
gcagaccatattcagttttcactaa

SEQ ID NO: 381891 - DNA, 25 bp, Rattus norvegicus
gcagaccatattgagttttcactaa

SEQ ID NO: 381892 - DNA, 25 bp, Rattus norvegicus
gcagaccatctgacgtacttgagag

SEQ ID NO: 381893 - DNA, 25 bp, Rattus norvegicus
gcagaccatctgtcgtacttgagag

SEQ ID NO: 381894 - DNA, 25 bp, Rattus norvegicus
gcagacccactgattcattcaggtg

SEQ ID NO: 381895 - DNA, 25 bp, Rattus norvegicus
gcagacccactgtttcattcaggtg

SEQ ID NO: 381896 - DNA, 25 bp, Rattus norvegicus
gcagacccaggaacaaactgctcca

SEQ ID NO: 381897 - DNA, 25 bp, Rattus norvegicus
gcagacccaggatcaaactgctcca

SEQ ID NO: 381898 - DNA, 25 bp, Rattus norvegicus
gcagaccccaatctcaatgtggcct

SEQ ID NO: 381899 - DNA, 25 bp, Rattus norvegicus
gcagaccccaatgtcaatgtggcct

SEQ ID NO: 381900 - DNA, 25 bp, Rattus norvegicus
gcagacccctacagtggtgcaaggt

SEQ ID NO: 381901 - DNA, 25 bp, Rattus norvegicus
gcagacccctactgtggtgcaaggt

SEQ ID NO: 381902 - DNA, 25 bp, Rattus norvegicus
gcagaccctcctacatttgtaaatg

SEQ ID NO: 381903 - DNA, 25 bp, Rattus norvegicus
gcagaccctcctatacaaagagaga

SEQ ID NO: 381904 - DNA, 25 bp, Rattus norvegicus
gcagaccctccttcatttgtaaatg

SEQ ID NO: 381905 - DNA, 25 bp, Rattus norvegicus
gcagaccctcctttacaaagagaga

SEQ ID NO: 381906 - DNA, 25 bp, Rattus norvegicus
gcagaccgctgacagtttgacttgt

SEQ ID NO: 381907 - DNA, 25 bp, Rattus norvegicus
gcagaccgctgagagtttgacttgt

SEQ ID NO: 381908 - DNA, 25 bp, Rattus norvegicus
gcagaccggttaacacaacacttca

SEQ ID NO: 381909 - DNA, 25 bp, Rattus norvegicus
gcagaccggttatcacaacacttca

SEQ ID NO: 381910 - DNA, 25 bp, Rattus norvegicus
gcagaccgtcagagtcaaggacatt

SEQ ID NO: 381911 - DNA, 25 bp, Rattus norvegicus
gcagaccgtcagtgtcaaggacatt

SEQ ID NO: 381912 - DNA, 25 bp, Rattus norvegicus
gcagacctaaggctcagcataccat

SEQ ID NO: 381913 - DNA, 25 bp, Rattus norvegicus
gcagacctaagggtcagcataccat

SEQ ID NO: 381914 - DNA, 25 bp, Rattus norvegicus
gcagacctacccatcagaggacgta

SEQ ID NO: 381915 - DNA, 25 bp, Rattus norvegicus
gcagacctacccttcagaggacgta

SEQ ID NO: 381916 - DNA, 25 bp, Rattus norvegicus
gcagacctagatatgttctcctcag

SEQ ID NO: 381917 - DNA, 25 bp, Rattus norvegicus
gcagacctagatttgttctcctcag

SEQ ID NO: 381918 - DNA, 25 bp, Rattus norvegicus
gcagacctaggtcctttacaaaagt

SEQ ID NO: 381919 - DNA, 25 bp, Rattus norvegicus
gcagacctaggtgctttacaaaagt

SEQ ID NO: 381920 - DNA, 25 bp, Rattus norvegicus
gcagacctatcgctatcacaccaga

SEQ ID NO: 381921 - DNA, 25 bp, Rattus norvegicus
gcagacctatcggtatcacaccaga

SEQ ID NO: 381922 - DNA, 25 bp, Rattus norvegicus
gcagacctcactatgatcgcagaaa

SEQ ID NO: 381923 - DNA, 25 bp, Rattus norvegicus
gcagacctcactttgatcgcagaaa

SEQ ID NO: 381924 - DNA, 25 bp, Rattus norvegicus
gcagacctgccccaaacaaatatga

SEQ ID NO: 381925 - DNA, 25 bp, Rattus norvegicus
gcagacctgcccgaaacaaatatga

SEQ ID NO: 381926 - DNA, 25 bp, Rattus norvegicus
gcagacctgggcaacctgtgccaga

SEQ ID NO: 381927 - DNA, 25 bp, Rattus norvegicus
gcagacctgggcctaggaccctatt

SEQ ID NO: 381928 - DNA, 25 bp, Rattus norvegicus
gcagacctgggcgtaggaccctatt

SEQ ID NO: 381929 - DNA, 25 bp, Rattus norvegicus
gcagacctgggctacctgtgccaga

SEQ ID NO: 381930 - DNA, 25 bp, Rattus norvegicus
gcagacctgggtcatcatggcagtc

SEQ ID NO: 381931 - DNA, 25 bp, Rattus norvegicus
gcagacctgggtgatcatggcagtc

SEQ ID NO: 381932 - DNA, 25 bp, Rattus norvegicus
gcagacctgtctaaacagcttccaa

SEQ ID NO: 381933 - DNA, 25 bp, Rattus norvegicus
gcagacctgtcttaacagcttccaa

SEQ ID NO: 381934 - DNA, 25 bp, Rattus norvegicus
gcagacctttaaacagttgtcatta

SEQ ID NO: 381935 - DNA, 25 bp, Rattus norvegicus
gcagacctttaatcagttgtcatta

SEQ ID NO: 381936 - DNA, 25 bp, Rattus norvegicus
gcagacgagacaacactattccgtt

SEQ ID NO: 381937 - DNA, 25 bp, Rattus norvegicus
gcagacgagacatcactattccgtt

SEQ ID NO: 381938 - DNA, 25 bp, Rattus norvegicus
gcagacgatgctaaaagtgtcctgt

SEQ ID NO: 381939 - DNA, 25 bp, Rattus norvegicus
gcagacgatgcttaaagtgtcctgt

SEQ ID NO: 381940 - DNA, 25 bp, Rattus norvegicus
gcagacgatggcacagcaggacagt

SEQ ID NO: 381941 - DNA, 25 bp, Rattus norvegicus
gcagacgatggctcagcaggacagt

SEQ ID NO: 381942 - DNA, 25 bp, Rattus norvegicus
gcagacgatgggagcatccggctct

SEQ ID NO: 381943 - DNA, 25 bp, Rattus norvegicus
gcagacgatgggtgcatccggctct

SEQ ID NO: 381944 - DNA, 25 bp, Rattus norvegicus
gcagacgattgtagtcctgacacgt

SEQ ID NO: 381945 - DNA, 25 bp, Rattus norvegicus
gcagacgattgttgtcctgacacgt

SEQ ID NO: 381946 - DNA, 25 bp, Rattus norvegicus
gcagacgcagcgctaagagtagacc

SEQ ID NO: 381947 - DNA, 25 bp, Rattus norvegicus
gcagacgcagcggtaagagtagacc

SEQ ID NO: 381948 - DNA, 25 bp, Rattus norvegicus
gcagacgccaccattggctgcgctg

SEQ ID NO: 381949 - DNA, 25 bp, Rattus norvegicus
gcagacgccacctttggctgcgctg

SEQ ID NO: 381950 - DNA, 25 bp, Rattus norvegicus
gcagacgccagtcctgtatgccatg

SEQ ID NO: 381951 - DNA, 25 bp, Rattus norvegicus
gcagacgccagtgctgtatgccatg

SEQ ID NO: 381952 - DNA, 25 bp, Rattus norvegicus
gcagacgccgacagtccaagaggag

SEQ ID NO: 381953 - DNA, 25 bp, Rattus norvegicus
gcagacgccgactgtccaagaggag

SEQ ID NO: 381954 - DNA, 25 bp, Rattus norvegicus
gcagacgcgcatctgcttcagaaaa

SEQ ID NO: 381955 - DNA, 25 bp, Rattus norvegicus
gcagacgcgcatgtgcttcagaaaa

SEQ ID NO: 381956 - DNA, 25 bp, Rattus norvegicus
gcagacgcgcgtcgtagaaagactt

SEQ ID NO: 381957 - DNA, 25 bp, Rattus norvegicus
gcagacgcgcgtggtagaaagactt

SEQ ID NO: 381958 - DNA, 25 bp, Rattus norvegicus
gcagacgctactctcaagcatttga

SEQ ID NO: 381959 - DNA, 25 bp, Rattus norvegicus
gcagacgctactgtcaagcatttga

SEQ ID NO: 381960 - DNA, 25 bp, Rattus norvegicus
gcagacggcaccaggagccataaga

SEQ ID NO: 381961 - DNA, 25 bp, Rattus norvegicus
gcagacggcacctggagccataaga

SEQ ID NO: 381962 - DNA, 25 bp, Rattus norvegicus
gcagacggctacaactcgtgcagga

SEQ ID NO: 381963 - DNA, 25 bp, Rattus norvegicus
gcagacggctactactcgtgcagga

SEQ ID NO: 381964 - DNA, 25 bp, Rattus norvegicus
gcagacggtagcatgggtgacctca

SEQ ID NO: 381965 - DNA, 25 bp, Rattus norvegicus
gcagacggtagcttgggtgacctca

SEQ ID NO: 381966 - DNA, 25 bp, Rattus norvegicus
gcagacggtgttcttcattggctac

SEQ ID NO: 381967 - DNA, 25 bp, Rattus norvegicus
gcagacggtgttgttcattggctac

SEQ ID NO: 381968 - DNA, 25 bp, Rattus norvegicus
gcagacggttgcctttgcgtcgcct

SEQ ID NO: 381969 - DNA, 25 bp, Rattus norvegicus
gcagacggttgcgtttgcgtcgcct

SEQ ID NO: 381970 - DNA, 25 bp, Rattus norvegicus
gcagacgtaacgatgcgtgcgtttt

SEQ ID NO: 381971 - DNA, 25 bp, Rattus norvegicus
gcagacgtaacgttgcgtgcgtttt

SEQ ID NO: 381972 - DNA, 25 bp, Rattus norvegicus
gcagacgtaggccactcaggatatc

SEQ ID NO: 381973 - DNA, 25 bp, Rattus norvegicus
gcagacgtaggcgactcaggatatc

SEQ ID NO: 381974 - DNA, 25 bp, Rattus norvegicus
gcagacgtctttaaccaaacttcca

SEQ ID NO: 381975 - DNA, 25 bp, Rattus norvegicus
gcagacgtcttttaccaaacttcca

SEQ ID NO: 381976 - DNA, 25 bp, Rattus norvegicus
gcagactaaggaagaccacgctaca

SEQ ID NO: 381977 - DNA, 25 bp, Rattus norvegicus
gcagactaaggatgaccacgctaca

SEQ ID NO: 381978 - DNA, 25 bp, Rattus norvegicus
gcagactaagttctctccttgccag

SEQ ID NO: 381979 - DNA, 25 bp, Rattus norvegicus
gcagactaagttgtctccttgccag

SEQ ID NO: 381980 - DNA, 25 bp, Rattus norvegicus
gcagactacactctttctacaagtt

SEQ ID NO: 381981 - DNA, 25 bp, Rattus norvegicus
gcagactacactgtttctacaagtt

SEQ ID NO: 381982 - DNA, 25 bp, Rattus norvegicus
gcagactacatcaggcaacagaaaa

SEQ ID NO: 381983 - DNA, 25 bp, Rattus norvegicus
gcagactacatctggcaacagaaaa

SEQ ID NO: 381984 - DNA, 25 bp, Rattus norvegicus
gcagactcaaagaacttccctgggt

SEQ ID NO: 381985 - DNA, 25 bp, Rattus norvegicus
gcagactcaaagtacttccctgggt

SEQ ID NO: 381986 - DNA, 25 bp, Rattus norvegicus
gcagactctaatagcctttctttga

SEQ ID NO: 381987 - DNA, 25 bp, Rattus norvegicus
gcagactctaattgcctttctttga

SEQ ID NO: 381988 - DNA, 25 bp, Rattus norvegicus
gcagactctgaacccggtagctgac

SEQ ID NO: 381989 - DNA, 25 bp, Rattus norvegicus
gcagactctgaagccggtagctgac

SEQ ID NO: 381990 - DNA, 25 bp, Rattus norvegicus
gcagactctgacaataaagcacaaa

SEQ ID NO: 381991 - DNA, 25 bp, Rattus norvegicus
gcagactctgactataaagcacaaa

SEQ ID NO: 381992 - DNA, 25 bp, Rattus norvegicus
gcagactctgggattggattcatac

SEQ ID NO: 381993 - DNA, 25 bp, Rattus norvegicus
gcagactctgggtttggattcatac

SEQ ID NO: 381994 - DNA, 25 bp, Rattus norvegicus
gcagactcttgtccccttttaaagt

SEQ ID NO: 381995 - DNA, 25 bp, Rattus norvegicus
gcagactcttgtgcccttttaaagt

SEQ ID NO: 381996 - DNA, 25 bp, Rattus norvegicus
gcagactgacttatgcgtgggtcca

SEQ ID NO: 381997 - DNA, 25 bp, Rattus norvegicus
gcagactgacttttgcgtgggtcca

SEQ ID NO: 381998 - DNA, 25 bp, Rattus norvegicus
gcagactgccagaaaaacacttaaa

SEQ ID NO: 381999 - DNA, 25 bp, Rattus norvegicus
gcagactgccagtaaaacacttaaa

SEQ ID NO: 382000 - DNA, 25 bp, Rattus norvegicus
gcagactgcttaatggttagggttt

SEQ ID NO: 382001 - DNA, 25 bp, Rattus norvegicus
gcagactgcttattggttagggttt

SEQ ID NO: 382002 - DNA, 25 bp, Rattus norvegicus
gcagactggctgcacatgtacgtta

SEQ ID NO: 382003 - DNA, 25 bp, Rattus norvegicus
gcagactggctggacatgtacgtta

SEQ ID NO: 382004 - DNA, 25 bp, Rattus norvegicus
gcagactgtggaatcacctcagcat

SEQ ID NO: 382005 - DNA, 25 bp, Rattus norvegicus
gcagactgtggattcacctcagcat

SEQ ID NO: 382006 - DNA, 25 bp, Rattus norvegicus
gcagactgtgttaatctgtccagat

SEQ ID NO: 382007 - DNA, 25 bp, Rattus norvegicus
gcagactgtgttcaattcatctcaa

SEQ ID NO: 382008 - DNA, 25 bp, Rattus norvegicus
gcagactgtgttgaattcatctcaa

SEQ ID NO: 382009 - DNA, 25 bp, Rattus norvegicus
gcagactgtgtttatctgtccagat

SEQ ID NO: 382010 - DNA, 25 bp, Rattus norvegicus
gcagactgttctagagttccgttct

SEQ ID NO: 382011 - DNA, 25 bp, Rattus norvegicus
gcagactgttcttgagttccgttct

SEQ ID NO: 382012 - DNA, 25 bp, Rattus norvegicus
gcagacttactgcagacggtctcat

SEQ ID NO: 382013 - DNA, 25 bp, Rattus norvegicus
gcagacttactggagacggtctcat

SEQ ID NO: 382014 - DNA, 25 bp, Rattus norvegicus
gcagacttcagcatgtgccttgcag

SEQ ID NO: 382015 - DNA, 25 bp, Rattus norvegicus
gcagacttcagcttgtgccttgcag

SEQ ID NO: 382016 - DNA, 25 bp, Rattus norvegicus
gcagacttcaggatgttctgtataa

SEQ ID NO: 382017 - DNA, 25 bp, Rattus norvegicus
gcagacttcaggttgttctgtataa

SEQ ID NO: 382018 - DNA, 25 bp, Rattus norvegicus
gcagacttcctaaccaagtctctga

SEQ ID NO: 382019 - DNA, 25 bp, Rattus norvegicus
gcagacttcctatccaagtctctga

SEQ ID NO: 382020 - DNA, 25 bp, Rattus norvegicus
gcagacttcgatctactttctcaag

SEQ ID NO: 382021 - DNA, 25 bp, Rattus norvegicus
gcagacttcgatgtactttctcaag

SEQ ID NO: 382022 - DNA, 25 bp, Rattus norvegicus
gcagacttctgcatcgaaatcaaag

SEQ ID NO: 382023 - DNA, 25 bp, Rattus norvegicus
gcagacttctgcttcgaaatcaaag

SEQ ID NO: 382024 - DNA, 25 bp, Rattus norvegicus
gcagacttcttcctgattctcggag

SEQ ID NO: 382025 - DNA, 25 bp, Rattus norvegicus
gcagacttcttcgtgattctcggag

SEQ ID NO: 382026 - DNA, 25 bp, Rattus norvegicus
gcagacttctttccgatgcatacat

SEQ ID NO: 382027 - DNA, 25 bp, Rattus norvegicus
gcagacttctttgcgatgcatacat

SEQ ID NO: 382028 - DNA, 25 bp, Rattus norvegicus
gcagacttgataagggcttctctct

SEQ ID NO: 382029 - DNA, 25 bp, Rattus norvegicus
gcagacttgatatgggcttctctct

SEQ ID NO: 382030 - DNA, 25 bp, Rattus norvegicus
gcagacttgcagctgtttcgttgtt

SEQ ID NO: 382031 - DNA, 25 bp, Rattus norvegicus
gcagacttgcaggtgtttcgttgtt

SEQ ID NO: 382032 - DNA, 25 bp, Rattus norvegicus
gcagacttggttctcaccctggcgg

SEQ ID NO: 382033 - DNA, 25 bp, Rattus norvegicus
gcagacttggttgtcaccctggcgg

SEQ ID NO: 382034 - DNA, 25 bp, Rattus norvegicus
gcagacttgtttagagccagcacta

SEQ ID NO: 382035 - DNA, 25 bp, Rattus norvegicus
gcagacttgttttgagccagcacta

SEQ ID NO: 382036 - DNA, 25 bp, Rattus norvegicus
gcagactttaatctcgggtcagttc

SEQ ID NO: 382037 - DNA, 25 bp, Rattus norvegicus
gcagactttaatgtcgggtcagttc

SEQ ID NO: 382038 - DNA, 25 bp, Rattus norvegicus
gcagactttcagaaagtacccacct

SEQ ID NO: 382039 - DNA, 25 bp, Rattus norvegicus
gcagactttcagtaagtacccacct

SEQ ID NO: 382040 - DNA, 25 bp, Rattus norvegicus
gcagactttcctatagtccttgtaa

SEQ ID NO: 382041 - DNA, 25 bp, Rattus norvegicus
gcagactttcctttagtccttgtaa

SEQ ID NO: 382042 - DNA, 25 bp, Rattus norvegicus
gcagactttgtacttgtcctggaac

SEQ ID NO: 382043 - DNA, 25 bp, Rattus norvegicus
gcagactttgtagttgtcctggaac

SEQ ID NO: 382044 - DNA, 25 bp, Rattus norvegicus
gcagactttgtgctgctcgacgaca

SEQ ID NO: 382045 - DNA, 25 bp, Rattus norvegicus
gcagactttgtggtgctcgacgaca

SEQ ID NO: 382046 - DNA, 25 bp, Rattus norvegicus
gcagacttttgcagcattctctcac

SEQ ID NO: 382047 - DNA, 25 bp, Rattus norvegicus
gcagacttttgctgcattctctcac

SEQ ID NO: 382048 - DNA, 25 bp, Rattus norvegicus
gcagagaacattcctccattctgag

SEQ ID NO: 382049 - DNA, 25 bp, Rattus norvegicus
gcagagaacattgctccattctgag

SEQ ID NO: 382050 - DNA, 25 bp, Rattus norvegicus
gcagagaaccctagagtcgtatccg

SEQ ID NO: 382051 - DNA, 25 bp, Rattus norvegicus
gcagagaacccttgagtcgtatccg

SEQ ID NO: 382052 - DNA, 25 bp, Rattus norvegicus
gcagagaactcgctgcttttcatgt

SEQ ID NO: 382053 - DNA, 25 bp, Rattus norvegicus
gcagagaactcggtgcttttcatgt

SEQ ID NO: 382054 - DNA, 25 bp, Rattus norvegicus
gcagagaactctctgaagcctccgc

SEQ ID NO: 382055 - DNA, 25 bp, Rattus norvegicus
gcagagaactctgtgaagcctccgc

SEQ ID NO: 382056 - DNA, 25 bp, Rattus norvegicus
gcagagaagcgcaccaggagctcaa

SEQ ID NO: 382057 - DNA, 25 bp, Rattus norvegicus
gcagagaagcgctccaggagctcaa

SEQ ID NO: 382058 - DNA, 25 bp, Rattus norvegicus
gcagagaattttagaccgccacccg

SEQ ID NO: 382059 - DNA, 25 bp, Rattus norvegicus
gcagagaatttttgaccgccacccg

SEQ ID NO: 382060 - DNA, 25 bp, Rattus norvegicus
gcagagacacccaactgtgtagaat

SEQ ID NO: 382061 - DNA, 25 bp, Rattus norvegicus
gcagagacaccctactgtgtagaat

SEQ ID NO: 382062 - DNA, 25 bp, Rattus norvegicus
gcagagacagctacacccagaggtt

SEQ ID NO: 382063 - DNA, 25 bp, Rattus norvegicus
gcagagacagcttcacccagaggtt

SEQ ID NO: 382064 - DNA, 25 bp, Rattus norvegicus
gcagagaccaaaatccttgtcgcac

SEQ ID NO: 382065 - DNA, 25 bp, Rattus norvegicus
gcagagaccaaattccttgtcgcac

SEQ ID NO: 382066 - DNA, 25 bp, Rattus norvegicus
gcagagaccacaagtacagatccca

SEQ ID NO: 382067 - DNA, 25 bp, Rattus norvegicus
gcagagaccacatgtacagatccca

SEQ ID NO: 382068 - DNA, 25 bp, Rattus norvegicus
gcagagaccagcacaggccggaagt

SEQ ID NO: 382069 - DNA, 25 bp, Rattus norvegicus
gcagagaccagctcaggccggaagt

SEQ ID NO: 382070 - DNA, 25 bp, Rattus norvegicus
gcagagacccaaagctcatagtcag

SEQ ID NO: 382071 - DNA, 25 bp, Rattus norvegicus
gcagagacccaatgctcatagtcag

SEQ ID NO: 382072 - DNA, 25 bp, Rattus norvegicus
gcagagacggccagtgtgtctcaaa

SEQ ID NO: 382073 - DNA, 25 bp, Rattus norvegicus
gcagagacggcctgtgtgtctcaaa

SEQ ID NO: 382074 - DNA, 25 bp, Rattus norvegicus
gcagagactcaactctttcatcctt

SEQ ID NO: 382075 - DNA, 25 bp, Rattus norvegicus
gcagagactcaagtctttcatcctt

SEQ ID NO: 382076 - DNA, 25 bp, Rattus norvegicus
gcagagactcagacatatcctataa

SEQ ID NO: 382077 - DNA, 25 bp, Rattus norvegicus
gcagagactcagtcatatcctataa

SEQ ID NO: 382078 - DNA, 25 bp, Rattus norvegicus
gcagagactgtcctagctcctggag

SEQ ID NO: 382079 - DNA, 25 bp, Rattus norvegicus
gcagagactgtcgtagctcctggag

SEQ ID NO: 382080 - DNA, 25 bp, Rattus norvegicus
gcagagacttaaatttacttctaaa

SEQ ID NO: 382081 - DNA, 25 bp, Rattus norvegicus
gcagagacttaattttacttctaaa

SEQ ID NO: 382082 - DNA, 25 bp, Rattus norvegicus
gcagagagacttcagcaatccttaa

SEQ ID NO: 382083 - DNA, 25 bp, Rattus norvegicus
gcagagagacttgagcaatccttaa

SEQ ID NO: 382084 - DNA, 25 bp, Rattus norvegicus
gcagagagatccaaccagaacagcc

SEQ ID NO: 382085 - DNA, 25 bp, Rattus norvegicus
gcagagagatcctaccagaacagcc

SEQ ID NO: 382086 - DNA, 25 bp, Rattus norvegicus
gcagagagcagccattgtcactact

SEQ ID NO: 382087 - DNA, 25 bp, Rattus norvegicus
gcagagagcagcgattgtcactact

SEQ ID NO: 382088 - DNA, 25 bp, Rattus norvegicus
gcagagaggttacttttgatttcat

SEQ ID NO: 382089 - DNA, 25 bp, Rattus norvegicus
gcagagaggttagttttgatttcat

SEQ ID NO: 382090 - DNA, 25 bp, Rattus norvegicus
gcagagagtcttcagtgtggacatt

SEQ ID NO: 382091 - DNA, 25 bp, Rattus norvegicus
gcagagagtcttgagtgtggacatt

SEQ ID NO: 382092 - DNA, 25 bp, Rattus norvegicus
gcagagataacaccatctttcctcc

SEQ ID NO: 382093 - DNA, 25 bp, Rattus norvegicus
gcagagataacagcatctttcctcc

SEQ ID NO: 382094 - DNA, 25 bp, Rattus norvegicus
gcagagataataaacttagccatgg

SEQ ID NO: 382095 - DNA, 25 bp, Rattus norvegicus
gcagagataatatacttagccatgg

SEQ ID NO: 382096 - DNA, 25 bp, Rattus norvegicus
gcagagatcatcagccccaagaacg

SEQ ID NO: 382097 - DNA, 25 bp, Rattus norvegicus
gcagagatcatctgccccaagaacg

SEQ ID NO: 382098 - DNA, 25 bp, Rattus norvegicus
gcagagatcctgcaagagtcccgga

SEQ ID NO: 382099 - DNA, 25 bp, Rattus norvegicus
gcagagatcctggaagagtcccgga

SEQ ID NO: 382100 - DNA, 25 bp, Rattus norvegicus
gcagagatctcacatgtgactcctg

SEQ ID NO: 382101 - DNA, 25 bp, Rattus norvegicus
gcagagatctcagatgtgactcctg

SEQ ID NO: 382102 - DNA, 25 bp, Rattus norvegicus
gcagagatctctcgtttgcaaaatc

SEQ ID NO: 382103 - DNA, 25 bp, Rattus norvegicus
gcagagatctctggtttgcaaaatc

SEQ ID NO: 382104 - DNA, 25 bp, Rattus norvegicus
gcagagatctgcacagtgagtacca

SEQ ID NO: 382105 - DNA, 25 bp, Rattus norvegicus
gcagagatctgcataagtgcccagt

SEQ ID NO: 382106 - DNA, 25 bp, Rattus norvegicus
gcagagatctgctcagtgagtacca

SEQ ID NO: 382107 - DNA, 25 bp, Rattus norvegicus
gcagagatctgcttaagtgcccagt

SEQ ID NO: 382108 - DNA, 25 bp, Rattus norvegicus
gcagagatgatcctggctctccgca

SEQ ID NO: 382109 - DNA, 25 bp, Rattus norvegicus
gcagagatgatcgtggctctccgca

SEQ ID NO: 382110 - DNA, 25 bp, Rattus norvegicus
gcagagatgattagccagctccaca

SEQ ID NO: 382111 - DNA, 25 bp, Rattus norvegicus
gcagagatgattctctgtcagcccc

SEQ ID NO: 382112 - DNA, 25 bp, Rattus norvegicus
gcagagatgattgtctgtcagcccc

SEQ ID NO: 382113 - DNA, 25 bp, Rattus norvegicus
gcagagatgatttgccagctccaca

SEQ ID NO: 382114 - DNA, 25 bp, Rattus norvegicus
gcagagatgcgcatggccattattt

SEQ ID NO: 382115 - DNA, 25 bp, Rattus norvegicus
gcagagatgcgcttggccattattt

SEQ ID NO: 382116 - DNA, 25 bp, Rattus norvegicus
gcagagatggcgacggctaaaaaga

SEQ ID NO: 382117 - DNA, 25 bp, Rattus norvegicus
gcagagatggcgtcggctaaaaaga

SEQ ID NO: 382118 - DNA, 25 bp, Rattus norvegicus
gcagagatgtgcacagacccagtgg

SEQ ID NO: 382119 - DNA, 25 bp, Rattus norvegicus
gcagagatgtgctcagacccagtgg

SEQ ID NO: 382120 - DNA, 25 bp, Rattus norvegicus
gcagagattaaaaacagccaacaaa

SEQ ID NO: 382121 - DNA, 25 bp, Rattus norvegicus
gcagagattaaatacagccaacaaa

SEQ ID NO: 382122 - DNA, 25 bp, Rattus norvegicus
gcagagattctccacttataataaa

SEQ ID NO: 382123 - DNA, 25 bp, Rattus norvegicus
gcagagattctcgacttataataaa

SEQ ID NO: 382124 - DNA, 25 bp, Rattus norvegicus
gcagagattgtactcctgtctaaag

SEQ ID NO: 382125 - DNA, 25 bp, Rattus norvegicus
gcagagattgtagtcctgtctaaag

SEQ ID NO: 382126 - DNA, 25 bp, Rattus norvegicus
gcagagcaaccacatctgcttctgg

SEQ ID NO: 382127 - DNA, 25 bp, Rattus norvegicus
gcagagcaaccagatctgcttctgg

SEQ ID NO: 382128 - DNA, 25 bp, Rattus norvegicus
gcagagcaagccagatttttcaaag

SEQ ID NO: 382129 - DNA, 25 bp, Rattus norvegicus
gcagagcaagcctgatttttcaaag

SEQ ID NO: 382130 - DNA, 25 bp, Rattus norvegicus
gcagagcaagcgaccccggagagca

SEQ ID NO: 382131 - DNA, 25 bp, Rattus norvegicus
gcagagcaagcgtccccggagagca

SEQ ID NO: 382132 - DNA, 25 bp, Rattus norvegicus
gcagagcagcaacaggcgttctatg

SEQ ID NO: 382133 - DNA, 25 bp, Rattus norvegicus
gcagagcagcaagaggcgttctatg

SEQ ID NO: 382134 - DNA, 25 bp, Rattus norvegicus
gcagagcagcatatccgacatgttg

SEQ ID NO: 382135 - DNA, 25 bp, Rattus norvegicus
gcagagcagcatttccgacatgttg

SEQ ID NO: 382136 - DNA, 25 bp, Rattus norvegicus
gcagagcagctgacacagatgggtc

SEQ ID NO: 382137 - DNA, 25 bp, Rattus norvegicus
gcagagcagctgtcacagatgggtc

SEQ ID NO: 382138 - DNA, 25 bp, Rattus norvegicus
gcagagcaggcaacatcacaacctt

SEQ ID NO: 382139 - DNA, 25 bp, Rattus norvegicus
gcagagcaggcatcatcacaacctt

SEQ ID NO: 382140 - DNA, 25 bp, Rattus norvegicus
gcagagcaggctcttgctttagagt

SEQ ID NO: 382141 - DNA, 25 bp, Rattus norvegicus
gcagagcaggctgttgctttagagt

SEQ ID NO: 382142 - DNA, 25 bp, Rattus norvegicus
gcagagcagtggaccagccagaatt

SEQ ID NO: 382143 - DNA, 25 bp, Rattus norvegicus
gcagagcagtggcattcctttgtca

SEQ ID NO: 382144 - DNA, 25 bp, Rattus norvegicus
gcagagcagtgggattcctttgtca

SEQ ID NO: 382145 - DNA, 25 bp, Rattus norvegicus
gcagagcagtggtccagccagaatt

SEQ ID NO: 382146 - DNA, 25 bp, Rattus norvegicus
gcagagcatcctagggactacattt

SEQ ID NO: 382147 - DNA, 25 bp, Rattus norvegicus
gcagagcatccttgggactacattt

SEQ ID NO: 382148 - DNA, 25 bp, Rattus norvegicus
gcagagcattcaaaccttaccagga

SEQ ID NO: 382149 - DNA, 25 bp, Rattus norvegicus
gcagagcattcataccttaccagga

SEQ ID NO: 382150 - DNA, 25 bp, Rattus norvegicus
gcagagcattgcatgctgctggccg

SEQ ID NO: 382151 - DNA, 25 bp, Rattus norvegicus
gcagagcattgccattgacaaacaa

SEQ ID NO: 382152 - DNA, 25 bp, Rattus norvegicus
gcagagcattgcgattgacaaacaa

SEQ ID NO: 382153 - DNA, 25 bp, Rattus norvegicus
gcagagcattgcttgctgctggccg

SEQ ID NO: 382154 - DNA, 25 bp, Rattus norvegicus
gcagagcattggaaactcctgatcc

SEQ ID NO: 382155 - DNA, 25 bp, Rattus norvegicus
gcagagcattggcttgtcactagca

SEQ ID NO: 382156 - DNA, 25 bp, Rattus norvegicus
gcagagcattgggttgtcactagca

SEQ ID NO: 382157 - DNA, 25 bp, Rattus norvegicus
gcagagcattggtaactcctgatcc

SEQ ID NO: 382158 - DNA, 25 bp, Rattus norvegicus
gcagagccaagaagcatcagcaagt

SEQ ID NO: 382159 - DNA, 25 bp, Rattus norvegicus
gcagagccaagatgcatcagcaagt

SEQ ID NO: 382160 - DNA, 25 bp, Rattus norvegicus
gcagagccagcgagtgcccgcatag

SEQ ID NO: 382161 - DNA, 25 bp, Rattus norvegicus
gcagagccagcgtgtgcccgcatag

SEQ ID NO: 382162 - DNA, 25 bp, Rattus norvegicus
gcagagccagtaccaattgtatgtt

SEQ ID NO: 382163 - DNA, 25 bp, Rattus norvegicus
gcagagccagtagcaattgtatgtt

SEQ ID NO: 382164 - DNA, 25 bp, Rattus norvegicus
gcagagccatttaaagacaactggt

SEQ ID NO: 382165 - DNA, 25 bp, Rattus norvegicus
gcagagccattttaagacaactggt

SEQ ID NO: 382166 - DNA, 25 bp, Rattus norvegicus
gcagagccctataacctgtacggat

SEQ ID NO: 382167 - DNA, 25 bp, Rattus norvegicus
gcagagccctattacctgtacggat

SEQ ID NO: 382168 - DNA, 25 bp, Rattus norvegicus
gcagagccctgactcaaaggacaat

SEQ ID NO: 382169 - DNA, 25 bp, Rattus norvegicus
gcagagccctgagtcaaaggacaat

SEQ ID NO: 382170 - DNA, 25 bp, Rattus norvegicus
gcagagccctgtcctactggagttt

SEQ ID NO: 382171 - DNA, 25 bp, Rattus norvegicus
gcagagccctgtgctactggagttt

SEQ ID NO: 382172 - DNA, 25 bp, Rattus norvegicus
gcagagccggatctccaaattctac

SEQ ID NO: 382173 - DNA, 25 bp, Rattus norvegicus
gcagagccggatgtccaaattctac

SEQ ID NO: 382174 - DNA, 25 bp, Rattus norvegicus
gcagagccggttaacatacattgat

SEQ ID NO: 382175 - DNA, 25 bp, Rattus norvegicus
gcagagccggtttacatacattgat

SEQ ID NO: 382176 - DNA, 25 bp, Rattus norvegicus
gcagagccgtctactcagagttata

SEQ ID NO: 382177 - DNA, 25 bp, Rattus norvegicus
gcagagccgtcttctcagagttata

SEQ ID NO: 382178 - DNA, 25 bp, Rattus norvegicus
gcagagcctgacacctcagaggttt

SEQ ID NO: 382179 - DNA, 25 bp, Rattus norvegicus
gcagagcctgactcctcagaggttt

SEQ ID NO: 382180 - DNA, 25 bp, Rattus norvegicus
gcagagcctgatagacattgtcaca

SEQ ID NO: 382181 - DNA, 25 bp, Rattus norvegicus
gcagagcctgattgacattgtcaca

SEQ ID NO: 382182 - DNA, 25 bp, Rattus norvegicus
gcagagcctgggatctcaagctgta

SEQ ID NO: 382183 - DNA, 25 bp, Rattus norvegicus
gcagagcctgggttctcaagctgta

SEQ ID NO: 382184 - DNA, 25 bp, Rattus norvegicus
gcagagcctggtatttgggattaaa

SEQ ID NO: 382185 - DNA, 25 bp, Rattus norvegicus
gcagagcctggtcatgcagcagcat

SEQ ID NO: 382186 - DNA, 25 bp, Rattus norvegicus
gcagagcctggtgatgcagcagcat

SEQ ID NO: 382187 - DNA, 25 bp, Rattus norvegicus
gcagagcctggtttttgggattaaa

SEQ ID NO: 382188 - DNA, 25 bp, Rattus norvegicus
gcagagccttctagatgatgcaaat

SEQ ID NO: 382189 - DNA, 25 bp, Rattus norvegicus
gcagagccttcttgatgatgcaaat

SEQ ID NO: 382190 - DNA, 25 bp, Rattus norvegicus
gcagagcggtgacgcccgcacggtt

SEQ ID NO: 382191 - DNA, 25 bp, Rattus norvegicus
gcagagcggtgaggcccgcacggtt

SEQ ID NO: 382192 - DNA, 25 bp, Rattus norvegicus
gcagagcgttatccacttcagtcca

SEQ ID NO: 382193 - DNA, 25 bp, Rattus norvegicus
gcagagcgttatgcacttcagtcca

SEQ ID NO: 382194 - DNA, 25 bp, Rattus norvegicus
gcagagctccttattgacagacact

SEQ ID NO: 382195 - DNA, 25 bp, Rattus norvegicus
gcagagctcctttttgacagacact

SEQ ID NO: 382196 - DNA, 25 bp, Rattus norvegicus
gcagagctctgacagtttaacatca

SEQ ID NO: 382197 - DNA, 25 bp, Rattus norvegicus
gcagagctctgagagtttaacatca

SEQ ID NO: 382198 - DNA, 25 bp, Rattus norvegicus
gcagagctgaacctgagctggcttt

SEQ ID NO: 382199 - DNA, 25 bp, Rattus norvegicus
gcagagctgaacgtgagctggcttt

SEQ ID NO: 382200 - DNA, 25 bp, Rattus norvegicus
gcagagctgataccatccgtaggaa

SEQ ID NO: 382201 - DNA, 25 bp, Rattus norvegicus
gcagagctgatagcatccgtaggaa

SEQ ID NO: 382202 - DNA, 25 bp, Rattus norvegicus
gcagagctgcaaagttccggatcga

SEQ ID NO: 382203 - DNA, 25 bp, Rattus norvegicus
gcagagctgcaatgttccggatcga

SEQ ID NO: 382204 - DNA, 25 bp, Rattus norvegicus
gcagagctgcatagacgaccagatt

SEQ ID NO: 382205 - DNA, 25 bp, Rattus norvegicus
gcagagctgcattgacgaccagatt

SEQ ID NO: 382206 - DNA, 25 bp, Rattus norvegicus
gcagagctgcttaaattatgcatta

SEQ ID NO: 382207 - DNA, 25 bp, Rattus norvegicus
gcagagctgcttcactgattcacaa

SEQ ID NO: 382208 - DNA, 25 bp, Rattus norvegicus
gcagagctgcttgactgattcacaa

SEQ ID NO: 382209 - DNA, 25 bp, Rattus norvegicus
gcagagctgctttaattatgcatta

SEQ ID NO: 382210 - DNA, 25 bp, Rattus norvegicus
gcagagctggaacaaggtgtcccac

SEQ ID NO: 382211 - DNA, 25 bp, Rattus norvegicus
gcagagctggaagaaggtgtcccac

SEQ ID NO: 382212 - DNA, 25 bp, Rattus norvegicus
gcagagctgggaatcatggtacaat

SEQ ID NO: 382213 - DNA, 25 bp, Rattus norvegicus
gcagagctgggattcatggtacaat

SEQ ID NO: 382214 - DNA, 25 bp, Rattus norvegicus
gcagagctgtcgcagtgtgcactac

SEQ ID NO: 382215 - DNA, 25 bp, Rattus norvegicus
gcagagctgtcggagtgtgcactac

SEQ ID NO: 382216 - DNA, 25 bp, Rattus norvegicus
gcagagctgtggattatctcagtac

SEQ ID NO: 382217 - DNA, 25 bp, Rattus norvegicus
gcagagctgtggtttatctcagtac

SEQ ID NO: 382218 - DNA, 25 bp, Rattus norvegicus
gcagagctgttaatttatggccttt

SEQ ID NO: 382219 - DNA, 25 bp, Rattus norvegicus
gcagagctgttattttatggccttt

SEQ ID NO: 382220 - DNA, 25 bp, Rattus norvegicus
gcagagcttatacaggtgaggtcaa

SEQ ID NO: 382221 - DNA, 25 bp, Rattus norvegicus
gcagagcttatagaggtgaggtcaa

SEQ ID NO: 382222 - DNA, 25 bp, Rattus norvegicus
gcagagcttcgaaatgacctaccag

SEQ ID NO: 382223 - DNA, 25 bp, Rattus norvegicus
gcagagcttcgatatgacctaccag

SEQ ID NO: 382224 - DNA, 25 bp, Rattus norvegicus
gcagagctttctcagtatatccagt

SEQ ID NO: 382225 - DNA, 25 bp, Rattus norvegicus
gcagagctttctcggagtcactcag

SEQ ID NO: 382226 - DNA, 25 bp, Rattus norvegicus
gcagagctttctgagtatatccagt

SEQ ID NO: 382227 - DNA, 25 bp, Rattus norvegicus
gcagagctttctgggagtcactcag

SEQ ID NO: 382228 - DNA, 25 bp, Rattus norvegicus
gcagagcttttacccttgacattgt

SEQ ID NO: 382229 - DNA, 25 bp, Rattus norvegicus
gcagagcttttagccttgacattgt

SEQ ID NO: 382230 - DNA, 25 bp, Rattus norvegicus
gcagaggaaagacttcccttttaat

SEQ ID NO: 382231 - DNA, 25 bp, Rattus norvegicus
gcagaggaaagagttcccttttaat

SEQ ID NO: 382232 - DNA, 25 bp, Rattus norvegicus
gcagaggaacgcaagcacctggcta

SEQ ID NO: 382233 - DNA, 25 bp, Rattus norvegicus
gcagaggaacgctagcacctggcta

SEQ ID NO: 382234 - DNA, 25 bp, Rattus norvegicus
gcagaggaatttaaccgcacacaaa

SEQ ID NO: 382235 - DNA, 25 bp, Rattus norvegicus
gcagaggaattttaccgcacacaaa

SEQ ID NO: 382236 - DNA, 25 bp, Rattus norvegicus
gcagaggacaacaacaacacagtaa

SEQ ID NO: 382237 - DNA, 25 bp, Rattus norvegicus
gcagaggacaacactccgcttcggg

SEQ ID NO: 382238 - DNA, 25 bp, Rattus norvegicus
gcagaggacaactacaacacagtaa

SEQ ID NO: 382239 - DNA, 25 bp, Rattus norvegicus
gcagaggacaactctccgcttcggg

SEQ ID NO: 382240 - DNA, 25 bp, Rattus norvegicus
gcagaggacatactgtgactcgggt

SEQ ID NO: 382241 - DNA, 25 bp, Rattus norvegicus
gcagaggacatagtgtgactcgggt

SEQ ID NO: 382242 - DNA, 25 bp, Rattus norvegicus
gcagaggaccatccggtgtgcaaaa

SEQ ID NO: 382243 - DNA, 25 bp, Rattus norvegicus
gcagaggaccatgcggtgtgcaaaa

SEQ ID NO: 382244 - DNA, 25 bp, Rattus norvegicus
gcagaggaccctatagacggcacaa

SEQ ID NO: 382245 - DNA, 25 bp, Rattus norvegicus
gcagaggaccctcttttggttccca

SEQ ID NO: 382246 - DNA, 25 bp, Rattus norvegicus
gcagaggaccctgttttggttccca

SEQ ID NO: 382247 - DNA, 25 bp, Rattus norvegicus
gcagaggaccctttagacggcacaa

SEQ ID NO: 382248 - DNA, 25 bp, Rattus norvegicus
gcagaggacgaaccccaagttttct

SEQ ID NO: 382249 - DNA, 25 bp, Rattus norvegicus
gcagaggacgaagcccaagttttct

SEQ ID NO: 382250 - DNA, 25 bp, Rattus norvegicus
gcagaggactcaagattgtgccact

SEQ ID NO: 382251 - DNA, 25 bp, Rattus norvegicus
gcagaggactcatgattgtgccact

SEQ ID NO: 382252 - DNA, 25 bp, Rattus norvegicus
gcagaggactttagttcatgtctca

SEQ ID NO: 382253 - DNA, 25 bp, Rattus norvegicus
gcagaggactttatcaaccatttca

SEQ ID NO: 382254 - DNA, 25 bp, Rattus norvegicus
gcagaggacttttgttcatgtctca

SEQ ID NO: 382255 - DNA, 25 bp, Rattus norvegicus
gcagaggactttttcaaccatttca

SEQ ID NO: 382256 - DNA, 25 bp, Rattus norvegicus
gcagaggagcagagatgcatcagct

SEQ ID NO: 382257 - DNA, 25 bp, Rattus norvegicus
gcagaggagcagtgatgcatcagct

SEQ ID NO: 382258 - DNA, 25 bp, Rattus norvegicus
gcagaggagccacacatgcacctgc

SEQ ID NO: 382259 - DNA, 25 bp, Rattus norvegicus
gcagaggagccagacatgcacctgc

SEQ ID NO: 382260 - DNA, 25 bp, Rattus norvegicus
gcagaggagcctctaccgaaggtaa

SEQ ID NO: 382261 - DNA, 25 bp, Rattus norvegicus
gcagaggagcctgtaccgaaggtaa

SEQ ID NO: 382262 - DNA, 25 bp, Rattus norvegicus
gcagaggaggaccactccgatgtct

SEQ ID NO: 382263 - DNA, 25 bp, Rattus norvegicus
gcagaggaggacgactccgatgtct

SEQ ID NO: 382264 - DNA, 25 bp, Rattus norvegicus
gcagaggatagccttcccacctaat

SEQ ID NO: 382265 - DNA, 25 bp, Rattus norvegicus
gcagaggatagcgttcccacctaat

SEQ ID NO: 382266 - DNA, 25 bp, Rattus norvegicus
gcagaggattgcatcattgtgtgac

SEQ ID NO: 382267 - DNA, 25 bp, Rattus norvegicus
gcagaggattgcttcattgtgtgac

SEQ ID NO: 382268 - DNA, 25 bp, Rattus norvegicus
gcagaggcaaaacagaacacgctaa

SEQ ID NO: 382269 - DNA, 25 bp, Rattus norvegicus
gcagaggcaaaagagaacacgctaa

SEQ ID NO: 382270 - DNA, 25 bp, Rattus norvegicus
gcagaggcacccctcatgaaggaag

SEQ ID NO: 382271 - DNA, 25 bp, Rattus norvegicus
gcagaggcacccgtcatgaaggaag

SEQ ID NO: 382272 - DNA, 25 bp, Rattus norvegicus
gcagaggcagcgacaacccagggaa

SEQ ID NO: 382273 - DNA, 25 bp, Rattus norvegicus
gcagaggcagcgtcaacccagggaa

SEQ ID NO: 382274 - DNA, 25 bp, Rattus norvegicus
gcagaggcatgccattgtttcacat

SEQ ID NO: 382275 - DNA, 25 bp, Rattus norvegicus
gcagaggcatgcgattgtttcacat

SEQ ID NO: 382276 - DNA, 25 bp, Rattus norvegicus
gcagaggcctcgcaacaccagagat

SEQ ID NO: 382277 - DNA, 25 bp, Rattus norvegicus
gcagaggcctcggaacaccagagat

SEQ ID NO: 382278 - DNA, 25 bp, Rattus norvegicus
gcagaggctccacagacggatctat

SEQ ID NO: 382279 - DNA, 25 bp, Rattus norvegicus
gcagaggctccagagacggatctat

SEQ ID NO: 382280 - DNA, 25 bp, Rattus norvegicus
gcagaggctctcacaggacttaaaa

SEQ ID NO: 382281 - DNA, 25 bp, Rattus norvegicus
gcagaggctctctcaggacttaaaa

SEQ ID NO: 382282 - DNA, 25 bp, Rattus norvegicus
gcagaggctctgaacaggcagctga

SEQ ID NO: 382283 - DNA, 25 bp, Rattus norvegicus
gcagaggctctgaagaaactcattt

SEQ ID NO: 382284 - DNA, 25 bp, Rattus norvegicus
gcagaggctctgtacaggcagctga

SEQ ID NO: 382285 - DNA, 25 bp, Rattus norvegicus
gcagaggctctgtagaaactcattt

SEQ ID NO: 382286 - DNA, 25 bp, Rattus norvegicus
gcagagggaagcaccagagttcaac

SEQ ID NO: 382287 - DNA, 25 bp, Rattus norvegicus
gcagagggaagctccagagttcaac

SEQ ID NO: 382288 - DNA, 25 bp, Rattus norvegicus
gcagagggacctcaactccttcctg

SEQ ID NO: 382289 - DNA, 25 bp, Rattus norvegicus
gcagagggacctgaactccttcctg

SEQ ID NO: 382290 - DNA, 25 bp, Rattus norvegicus
gcagagggactcaggacctcagagc

SEQ ID NO: 382291 - DNA, 25 bp, Rattus norvegicus
gcagagggactcagtccaggcaata

SEQ ID NO: 382292 - DNA, 25 bp, Rattus norvegicus
gcagagggactctggacctcagagc

SEQ ID NO: 382293 - DNA, 25 bp, Rattus norvegicus
gcagagggactctgtccaggcaata

SEQ ID NO: 382294 - DNA, 25 bp, Rattus norvegicus
gcagagggatttctgcttcagccac

SEQ ID NO: 382295 - DNA, 25 bp, Rattus norvegicus
gcagagggatttgtgcttcagccac

SEQ ID NO: 382296 - DNA, 25 bp, Rattus norvegicus
gcagagggcccaaaagcttggctca

SEQ ID NO: 382297 - DNA, 25 bp, Rattus norvegicus
gcagagggcccataagcttggctca

SEQ ID NO: 382298 - DNA, 25 bp, Rattus norvegicus
gcagagggcgaacctgacctgcacc

SEQ ID NO: 382299 - DNA, 25 bp, Rattus norvegicus
gcagagggcgaagctgacctgcacc

SEQ ID NO: 382300 - DNA, 25 bp, Rattus norvegicus
gcagaggtaaccaggtccagcagtt

SEQ ID NO: 382301 - DNA, 25 bp, Rattus norvegicus
gcagaggtaacctggtccagcagtt

SEQ ID NO: 382302 - DNA, 25 bp, Rattus norvegicus
gcagaggtagctccccagggttatt

SEQ ID NO: 382303 - DNA, 25 bp, Rattus norvegicus
gcagaggtagctgcccagggttatt

SEQ ID NO: 382304 - DNA, 25 bp, Rattus norvegicus
gcagaggtcagacgttatctacaca

SEQ ID NO: 382305 - DNA, 25 bp, Rattus norvegicus
gcagaggtcagaggttatctacaca

SEQ ID NO: 382306 - DNA, 25 bp, Rattus norvegicus
gcagaggtctgcagacaaaccaaag

SEQ ID NO: 382307 - DNA, 25 bp, Rattus norvegicus
gcagaggtctgctgacaaaccaaag

SEQ ID NO: 382308 - DNA, 25 bp, Rattus norvegicus
gcagaggtttgacctttctacgtaa

SEQ ID NO: 382309 - DNA, 25 bp, Rattus norvegicus
gcagaggtttgagctttctacgtaa

SEQ ID NO: 382310 - DNA, 25 bp, Rattus norvegicus
gcagaggtttgcagttgcccttggc

SEQ ID NO: 382311 - DNA, 25 bp, Rattus norvegicus
gcagaggtttgctgttgcccttggc

SEQ ID NO: 382312 - DNA, 25 bp, Rattus norvegicus
gcagagtaaggaattcacagagcat

SEQ ID NO: 382313 - DNA, 25 bp, Rattus norvegicus
gcagagtaaggatttcacagagcat

SEQ ID NO: 382314 - DNA, 25 bp, Rattus norvegicus
gcagagtattacagcccagaatgct

SEQ ID NO: 382315 - DNA, 25 bp, Rattus norvegicus
gcagagtattactgcccagaatgct

SEQ ID NO: 382316 - DNA, 25 bp, Rattus norvegicus
gcagagtcaaatacgccatttccaa

SEQ ID NO: 382317 - DNA, 25 bp, Rattus norvegicus
gcagagtcaaattcgccatttccaa

SEQ ID NO: 382318 - DNA, 25 bp, Rattus norvegicus
gcagagtcacctccattcataatga

SEQ ID NO: 382319 - DNA, 25 bp, Rattus norvegicus
gcagagtcacctgcattcataatga

SEQ ID NO: 382320 - DNA, 25 bp, Rattus norvegicus
gcagagtcagcacagccttggccag

SEQ ID NO: 382321 - DNA, 25 bp, Rattus norvegicus
gcagagtcagcagagccttggccag

SEQ ID NO: 382322 - DNA, 25 bp, Rattus norvegicus
gcagagtcagctaaattgcccttct

SEQ ID NO: 382323 - DNA, 25 bp, Rattus norvegicus
gcagagtcagcttaattgcccttct

SEQ ID NO: 382324 - DNA, 25 bp, Rattus norvegicus
gcagagtcaggcacatatggcaaga

SEQ ID NO: 382325 - DNA, 25 bp, Rattus norvegicus
gcagagtcaggctcatatggcaaga

SEQ ID NO: 382326 - DNA, 25 bp, Rattus norvegicus
gcagagtcccagctttacaagccat

SEQ ID NO: 382327 - DNA, 25 bp, Rattus norvegicus
gcagagtcccaggtttacaagccat

SEQ ID NO: 382328 - DNA, 25 bp, Rattus norvegicus
gcagagtctactccccttgaatcta

SEQ ID NO: 382329 - DNA, 25 bp, Rattus norvegicus
gcagagtctactgcccttgaatcta

SEQ ID NO: 382330 - DNA, 25 bp, Rattus norvegicus
gcagagtctcaaaattgcccaggct

SEQ ID NO: 382331 - DNA, 25 bp, Rattus norvegicus
gcagagtctcaatattgcccaggct

SEQ ID NO: 382332 - DNA, 25 bp, Rattus norvegicus
gcagagtctccccaagaaagagcta

SEQ ID NO: 382333 - DNA, 25 bp, Rattus norvegicus
gcagagtctcccgaagaaagagcta

SEQ ID NO: 382334 - DNA, 25 bp, Rattus norvegicus
gcagagtctgttccagcgaagctgt

SEQ ID NO: 382335 - DNA, 25 bp, Rattus norvegicus
gcagagtctgttgcagcgaagctgt

SEQ ID NO: 382336 - DNA, 25 bp, Rattus norvegicus
gcagagtgccacagagatcccgctg

SEQ ID NO: 382337 - DNA, 25 bp, Rattus norvegicus
gcagagtgccactgagatcccgctg

SEQ ID NO: 382338 - DNA, 25 bp, Rattus norvegicus
gcagagtgcctgagatttggctcaa

SEQ ID NO: 382339 - DNA, 25 bp, Rattus norvegicus
gcagagtgcctgatggatactttat

SEQ ID NO: 382340 - DNA, 25 bp, Rattus norvegicus
gcagagtgcctgtgatttggctcaa

SEQ ID NO: 382341 - DNA, 25 bp, Rattus norvegicus
gcagagtgcctgttggatactttat

SEQ ID NO: 382342 - DNA, 25 bp, Rattus norvegicus
gcagagtgccttatatgtatgtcta

SEQ ID NO: 382343 - DNA, 25 bp, Rattus norvegicus
gcagagtgccttttatgtatgtcta

SEQ ID NO: 382344 - DNA, 25 bp, Rattus norvegicus
gcagagtgtgcaagtctcagctctt

SEQ ID NO: 382345 - DNA, 25 bp, Rattus norvegicus
gcagagtgtgcatgtctcagctctt

SEQ ID NO: 382346 - DNA, 25 bp, Rattus norvegicus
gcagagtgttctatcactgtccatt

SEQ ID NO: 382347 - DNA, 25 bp, Rattus norvegicus
gcagagtgttctttcactgtccatt

SEQ ID NO: 382348 - DNA, 25 bp, Rattus norvegicus
gcagagttaagcatgatgtatccac

SEQ ID NO: 382349 - DNA, 25 bp, Rattus norvegicus
gcagagttaagcttgatgtatccac

SEQ ID NO: 382350 - DNA, 25 bp, Rattus norvegicus
gcagagttagtgctgaccaccaggt

SEQ ID NO: 382351 - DNA, 25 bp, Rattus norvegicus
gcagagttagtggtgaccaccaggt

SEQ ID NO: 382352 - DNA, 25 bp, Rattus norvegicus
gcagagttccccaataatacagtta

SEQ ID NO: 382353 - DNA, 25 bp, Rattus norvegicus
gcagagttcccctataatacagtta

SEQ ID NO: 382354 - DNA, 25 bp, Rattus norvegicus
gcagagttcccgcagtctcagcttt

SEQ ID NO: 382355 - DNA, 25 bp, Rattus norvegicus
gcagagttcccggagtctcagcttt

SEQ ID NO: 382356 - DNA, 25 bp, Rattus norvegicus
gcagagttcctgactggccttaggg

SEQ ID NO: 382357 - DNA, 25 bp, Rattus norvegicus
gcagagttcctgtctggccttaggg

SEQ ID NO: 382358 - DNA, 25 bp, Rattus norvegicus
gcagagttgatcactgagccgtgtt

SEQ ID NO: 382359 - DNA, 25 bp, Rattus norvegicus
gcagagttgatctctgagccgtgtt

SEQ ID NO: 382360 - DNA, 25 bp, Rattus norvegicus
gcagagttgctgcagcttattttaa

SEQ ID NO: 382361 - DNA, 25 bp, Rattus norvegicus
gcagagttgctggagcttattttaa

SEQ ID NO: 382362 - DNA, 25 bp, Rattus norvegicus
gcagagttgcttagctcagatccta

SEQ ID NO: 382363 - DNA, 25 bp, Rattus norvegicus
gcagagttgctttgctcagatccta

SEQ ID NO: 382364 - DNA, 25 bp, Rattus norvegicus
gcagagttggcgatcttagttggtt

SEQ ID NO: 382365 - DNA, 25 bp, Rattus norvegicus
gcagagttggcgttcttagttggtt

SEQ ID NO: 382366 - DNA, 25 bp, Rattus norvegicus
gcagagttgtacatgccaacctttc

SEQ ID NO: 382367 - DNA, 25 bp, Rattus norvegicus
gcagagttgtacttgccaacctttc

SEQ ID NO: 382368 - DNA, 25 bp, Rattus norvegicus
gcagagttgtgtaccagcttgagtt

SEQ ID NO: 382369 - DNA, 25 bp, Rattus norvegicus
gcagagttgtgttccagcttgagtt

SEQ ID NO: 382370 - DNA, 25 bp, Rattus norvegicus
gcagagtttaacatgtccatgataa

SEQ ID NO: 382371 - DNA, 25 bp, Rattus norvegicus
gcagagtttaacttgtccatgataa

SEQ ID NO: 382372 - DNA, 25 bp, Rattus norvegicus
gcagataaaggtcttgctaccaaac

SEQ ID NO: 382373 - DNA, 25 bp, Rattus norvegicus
gcagataaaggtgttgctaccaaac

SEQ ID NO: 382374 - DNA, 25 bp, Rattus norvegicus
gcagataaatggctgggcctcttcc

SEQ ID NO: 382375 - DNA, 25 bp, Rattus norvegicus
gcagataaatgggtgggcctcttcc

SEQ ID NO: 382376 - DNA, 25 bp, Rattus norvegicus
gcagataacagtcccttctgttgta

SEQ ID NO: 382377 - DNA, 25 bp, Rattus norvegicus
gcagataacagtgccttctgttgta

SEQ ID NO: 382378 - DNA, 25 bp, Rattus norvegicus
gcagataagagccatcttccagggc

SEQ ID NO: 382379 - DNA, 25 bp, Rattus norvegicus
gcagataagagcgatcttccagggc

SEQ ID NO: 382380 - DNA, 25 bp, Rattus norvegicus
gcagataagcagcagccactcacat

SEQ ID NO: 382381 - DNA, 25 bp, Rattus norvegicus
gcagataagcaggagccactcacat

SEQ ID NO: 382382 - DNA, 25 bp, Rattus norvegicus
gcagataagccacgagcagctacct

SEQ ID NO: 382383 - DNA, 25 bp, Rattus norvegicus
gcagataagccaggagcagctacct

SEQ ID NO: 382384 - DNA, 25 bp, Rattus norvegicus
gcagatacaagtacatctttccctt

SEQ ID NO: 382385 - DNA, 25 bp, Rattus norvegicus
gcagatacaagttcatctttccctt

SEQ ID NO: 382386 - DNA, 25 bp, Rattus norvegicus
gcagatacagcacagcaggaaccat

SEQ ID NO: 382387 - DNA, 25 bp, Rattus norvegicus
gcagatacagcagagcaggaaccat

SEQ ID NO: 382388 - DNA, 25 bp, Rattus norvegicus
gcagatacaggcagtcggcaacatt

SEQ ID NO: 382389 - DNA, 25 bp, Rattus norvegicus
gcagatacaggctgtcggcaacatt

SEQ ID NO: 382390 - DNA, 25 bp, Rattus norvegicus
gcagataccatcaggcctctataaa

SEQ ID NO: 382391 - DNA, 25 bp, Rattus norvegicus
gcagataccatctggcctctataaa

SEQ ID NO: 382392 - DNA, 25 bp, Rattus norvegicus
gcagatacccagcaatacacagttc

SEQ ID NO: 382393 - DNA, 25 bp, Rattus norvegicus
gcagatacccaggaatacacagttc

SEQ ID NO: 382394 - DNA, 25 bp, Rattus norvegicus
gcagatacgctgaacattctagaga

SEQ ID NO: 382395 - DNA, 25 bp, Rattus norvegicus
gcagatacgctgtacattctagaga

SEQ ID NO: 382396 - DNA, 25 bp, Rattus norvegicus
gcagatactgtgaaatgcccaccag

SEQ ID NO: 382397 - DNA, 25 bp, Rattus norvegicus
gcagatactgtgtaatgcccaccag

SEQ ID NO: 382398 - DNA, 25 bp, Rattus norvegicus
gcagatagattcagcctcaggacct

SEQ ID NO: 382399 - DNA, 25 bp, Rattus norvegicus
gcagatagattctgcctcaggacct

SEQ ID NO: 382400 - DNA, 25 bp, Rattus norvegicus
gcagatagcagtccagctggcctct

SEQ ID NO: 382401 - DNA, 25 bp, Rattus norvegicus
gcagatagcagtgcagctggcctct

SEQ ID NO: 382402 - DNA, 25 bp, Rattus norvegicus
gcagatagttgaaaggaaggcccag

SEQ ID NO: 382403 - DNA, 25 bp, Rattus norvegicus
gcagatagttgataggaaggcccag

SEQ ID NO: 382404 - DNA, 25 bp, Rattus norvegicus
gcagatatccaaagggtgcagcccc

SEQ ID NO: 382405 - DNA, 25 bp, Rattus norvegicus
gcagatatccaatgggtgcagcccc

SEQ ID NO: 382406 - DNA, 25 bp, Rattus norvegicus
gcagatattctgatggcttgcaaat

SEQ ID NO: 382407 - DNA, 25 bp, Rattus norvegicus
gcagatattctgttggcttgcaaat

SEQ ID NO: 382408 - DNA, 25 bp, Rattus norvegicus
gcagatcaacaaccgtgcttccggc

SEQ ID NO: 382409 - DNA, 25 bp, Rattus norvegicus
gcagatcaacaagcgtgcttccggc

SEQ ID NO: 382410 - DNA, 25 bp, Rattus norvegicus
gcagatcaacatagccatggcctca

SEQ ID NO: 382411 - DNA, 25 bp, Rattus norvegicus
gcagatcaacattgccatggcctca

SEQ ID NO: 382412 - DNA, 25 bp, Rattus norvegicus
gcagatcaccaacagcaagccaaca

SEQ ID NO: 382413 - DNA, 25 bp, Rattus norvegicus
gcagatcaccaagagcaagccaaca

SEQ ID NO: 382414 - DNA, 25 bp, Rattus norvegicus
gcagatcaccgaatcatgtgcgttt

SEQ ID NO: 382415 - DNA, 25 bp, Rattus norvegicus
gcagatcaccgattcatgtgcgttt

SEQ ID NO: 382416 - DNA, 25 bp, Rattus norvegicus
gcagatcacctgagtgggttggcct

SEQ ID NO: 382417 - DNA, 25 bp, Rattus norvegicus
gcagatcacctgtgtgggttggcct

SEQ ID NO: 382418 - DNA, 25 bp, Rattus norvegicus
gcagatcactctccttttgtattat

SEQ ID NO: 382419 - DNA, 25 bp, Rattus norvegicus
gcagatcactctgcttttgtattat

SEQ ID NO: 382420 - DNA, 25 bp, Rattus norvegicus
gcagatcagactcaaatcctcttgt

SEQ ID NO: 382421 - DNA, 25 bp, Rattus norvegicus
gcagatcagactgaaatcctcttgt

SEQ ID NO: 382422 - DNA, 25 bp, Rattus norvegicus
gcagatcaggctcttgctgagctca

SEQ ID NO: 382423 - DNA, 25 bp, Rattus norvegicus
gcagatcaggctgttgctgagctca

SEQ ID NO: 382424 - DNA, 25 bp, Rattus norvegicus
gcagatcagggtaccttgttttcaa

SEQ ID NO: 382425 - DNA, 25 bp, Rattus norvegicus
gcagatcagggttccttgttttcaa

SEQ ID NO: 382426 - DNA, 25 bp, Rattus norvegicus
gcagatcataggaagccggcctagt

SEQ ID NO: 382427 - DNA, 25 bp, Rattus norvegicus
gcagatcataggtagccggcctagt

SEQ ID NO: 382428 - DNA, 25 bp, Rattus norvegicus
gcagatcatccaattctatttctca

SEQ ID NO: 382429 - DNA, 25 bp, Rattus norvegicus
gcagatcatccatttctatttctca

SEQ ID NO: 382430 - DNA, 25 bp, Rattus norvegicus
gcagatcatgatacaattttggcat

SEQ ID NO: 382431 - DNA, 25 bp, Rattus norvegicus
gcagatcatgattcaattttggcat

SEQ ID NO: 382432 - DNA, 25 bp, Rattus norvegicus
gcagatcatgctaagcggctacttt

SEQ ID NO: 382433 - DNA, 25 bp, Rattus norvegicus
gcagatcatgcttagcggctacttt

SEQ ID NO: 382434 - DNA, 25 bp, Rattus norvegicus
gcagatccaatcactttgtttccaa

SEQ ID NO: 382435 - DNA, 25 bp, Rattus norvegicus
gcagatccaatctctttgtttccaa

SEQ ID NO: 382436 - DNA, 25 bp, Rattus norvegicus
gcagatccatgcatcttatgacatt

SEQ ID NO: 382437 - DNA, 25 bp, Rattus norvegicus
gcagatccatgcttcttatgacatt

SEQ ID NO: 382438 - DNA, 25 bp, Rattus norvegicus
gcagatcccaatcagtgactagttt

SEQ ID NO: 382439 - DNA, 25 bp, Rattus norvegicus
gcagatcccaatgagtgactagttt

SEQ ID NO: 382440 - DNA, 25 bp, Rattus norvegicus
gcagatcccagacgctttttgcagc

SEQ ID NO: 382441 - DNA, 25 bp, Rattus norvegicus
gcagatcccagaggctttttgcagc

SEQ ID NO: 382442 - DNA, 25 bp, Rattus norvegicus
gcagatccccaactggcggtacaaa

SEQ ID NO: 382443 - DNA, 25 bp, Rattus norvegicus
gcagatccccaacttccaggatgga

SEQ ID NO: 382444 - DNA, 25 bp, Rattus norvegicus
gcagatccccaagtggcggtacaaa

SEQ ID NO: 382445 - DNA, 25 bp, Rattus norvegicus
gcagatccccaagttccaggatgga

SEQ ID NO: 382446 - DNA, 25 bp, Rattus norvegicus
gcagatcccgttaccaggtggctaa

SEQ ID NO: 382447 - DNA, 25 bp, Rattus norvegicus
gcagatcccgtttccaggtggctaa

SEQ ID NO: 382448 - DNA, 25 bp, Rattus norvegicus
gcagatccgtcccagactgtggagc

SEQ ID NO: 382449 - DNA, 25 bp, Rattus norvegicus
gcagatccgtccgagactgtggagc

SEQ ID NO: 382450 - DNA, 25 bp, Rattus norvegicus
gcagatcctcgacgtttcttctgga

SEQ ID NO: 382451 - DNA, 25 bp, Rattus norvegicus
gcagatcctcgaggtttcttctgga

SEQ ID NO: 382452 - DNA, 25 bp, Rattus norvegicus
gcagatcctctgatggcgccaaagg

SEQ ID NO: 382453 - DNA, 25 bp, Rattus norvegicus
gcagatcctctgttggcgccaaagg

SEQ ID NO: 382454 - DNA, 25 bp, Rattus norvegicus
gcagatcgtgagagctgagccagca

SEQ ID NO: 382455 - DNA, 25 bp, Rattus norvegicus
gcagatcgtgagtgctgagccagca

SEQ ID NO: 382456 - DNA, 25 bp, Rattus norvegicus
gcagatctacccattcgtgtttgaa

SEQ ID NO: 382457 - DNA, 25 bp, Rattus norvegicus
gcagatctaccctttcgtgtttgaa

SEQ ID NO: 382458 - DNA, 25 bp, Rattus norvegicus
gcagatctatatccccaatgtgtag

SEQ ID NO: 382459 - DNA, 25 bp, Rattus norvegicus
gcagatctatatgcccaatgtgtag

SEQ ID NO: 382460 - DNA, 25 bp, Rattus norvegicus
gcagatctcaagagtacagggtcag

SEQ ID NO: 382461 - DNA, 25 bp, Rattus norvegicus
gcagatctcaagtgtacagggtcag

SEQ ID NO: 382462 - DNA, 25 bp, Rattus norvegicus
gcagatctcatcagccgggaacaga

SEQ ID NO: 382463 - DNA, 25 bp, Rattus norvegicus
gcagatctcatctgccgggaacaga

SEQ ID NO: 382464 - DNA, 25 bp, Rattus norvegicus
gcagatctctaactacttctccgag

SEQ ID NO: 382465 - DNA, 25 bp, Rattus norvegicus
gcagatctctaagtacttctccgag

SEQ ID NO: 382466 - DNA, 25 bp, Rattus norvegicus
gcagatctctctaagtttgaaacca

SEQ ID NO: 382467 - DNA, 25 bp, Rattus norvegicus
gcagatctctcttagtttgaaacca

SEQ ID NO: 382468 - DNA, 25 bp, Rattus norvegicus
gcagatctgaggcagtttccccctc

SEQ ID NO: 382469 - DNA, 25 bp, Rattus norvegicus
gcagatctgagggagtttccccctc

SEQ ID NO: 382470 - DNA, 25 bp, Rattus norvegicus
gcagatctgcctaatatgttttttg

SEQ ID NO: 382471 - DNA, 25 bp, Rattus norvegicus
gcagatctgcctctggtttagaaat

SEQ ID NO: 382472 - DNA, 25 bp, Rattus norvegicus
gcagatctgcctgtggtttagaaat

SEQ ID NO: 382473 - DNA, 25 bp, Rattus norvegicus
gcagatctgccttatatgttttttg

SEQ ID NO: 382474 - DNA, 25 bp, Rattus norvegicus
gcagatctgggcaccaagacactga

SEQ ID NO: 382475 - DNA, 25 bp, Rattus norvegicus
gcagatctgggctccaagacactga

SEQ ID NO: 382476 - DNA, 25 bp, Rattus norvegicus
gcagatctgttaatggctcaccaac

SEQ ID NO: 382477 - DNA, 25 bp, Rattus norvegicus
gcagatctgttattggctcaccaac

SEQ ID NO: 382478 - DNA, 25 bp, Rattus norvegicus
gcagatcttagtccagagtttatat

SEQ ID NO: 382479 - DNA, 25 bp, Rattus norvegicus
gcagatcttagtgcagagtttatat

SEQ ID NO: 382480 - DNA, 25 bp, Rattus norvegicus
gcagatctttctaatgctctcatat

SEQ ID NO: 382481 - DNA, 25 bp, Rattus norvegicus
gcagatctttcttatgctctcatat

SEQ ID NO: 382482 - DNA, 25 bp, Rattus norvegicus
gcagatcttttaagtgaggcaccac

SEQ ID NO: 382483 - DNA, 25 bp, Rattus norvegicus
gcagatcttttatgtgaggcaccac

SEQ ID NO: 382484 - DNA, 25 bp, Rattus norvegicus
gcagatgaagtgatcgggagctttt

SEQ ID NO: 382485 - DNA, 25 bp, Rattus norvegicus
gcagatgaagtgttcgggagctttt

SEQ ID NO: 382486 - DNA, 25 bp, Rattus norvegicus
gcagatgaatctccttcacccaggc

SEQ ID NO: 382487 - DNA, 25 bp, Rattus norvegicus
gcagatgaatctgcttcacccaggc

SEQ ID NO: 382488 - DNA, 25 bp, Rattus norvegicus
gcagatgactctcacgatagccagt

SEQ ID NO: 382489 - DNA, 25 bp, Rattus norvegicus
gcagatgactctgacgatagccagt

SEQ ID NO: 382490 - DNA, 25 bp, Rattus norvegicus
gcagatgagatgacccagccaggta

SEQ ID NO: 382491 - DNA, 25 bp, Rattus norvegicus
gcagatgagatgtcccagccaggta

SEQ ID NO: 382492 - DNA, 25 bp, Rattus norvegicus
gcagatgagcctaatcagccagact

SEQ ID NO: 382493 - DNA, 25 bp, Rattus norvegicus
gcagatgagccttatcagccagact

SEQ ID NO: 382494 - DNA, 25 bp, Rattus norvegicus
gcagatgagcggcttcggatcaatt

SEQ ID NO: 382495 - DNA, 25 bp, Rattus norvegicus
gcagatgagcgggttcggatcaatt

SEQ ID NO: 382496 - DNA, 25 bp, Rattus norvegicus
gcagatgcaagtcctcacctcctgg

SEQ ID NO: 382497 - DNA, 25 bp, Rattus norvegicus
gcagatgcaagtgctcacctcctgg

SEQ ID NO: 382498 - DNA, 25 bp, Rattus norvegicus
gcagatgcaattcatgtttccagga

SEQ ID NO: 382499 - DNA, 25 bp, Rattus norvegicus
gcagatgcaattgatgtttccagga

SEQ ID NO: 382500 - DNA, 25 bp, Rattus norvegicus
gcagatgcaggacggtcgcttcaac

SEQ ID NO: 382501 - DNA, 25 bp, Rattus norvegicus
gcagatgcaggagggtcgcttcaac

SEQ ID NO: 382502 - DNA, 25 bp, Rattus norvegicus
gcagatgccacacgaatgtgactta

SEQ ID NO: 382503 - DNA, 25 bp, Rattus norvegicus
gcagatgccacaggaatgtgactta

SEQ ID NO: 382504 - DNA, 25 bp, Rattus norvegicus
gcagatgccaccagagtgcacttta

SEQ ID NO: 382505 - DNA, 25 bp, Rattus norvegicus
gcagatgccacctgagtgcacttta

SEQ ID NO: 382506 - DNA, 25 bp, Rattus norvegicus
gcagatgccgttcaaaaggtcgatt

SEQ ID NO: 382507 - DNA, 25 bp, Rattus norvegicus
gcagatgccgttgaaaaggtcgatt

SEQ ID NO: 382508 - DNA, 25 bp, Rattus norvegicus
gcagatgcctgccagatggaaccag

SEQ ID NO: 382509 - DNA, 25 bp, Rattus norvegicus
gcagatgcctgcgagatggaaccag

SEQ ID NO: 382510 - DNA, 25 bp, Rattus norvegicus
gcagatgcctggactctctataaga

SEQ ID NO: 382511 - DNA, 25 bp, Rattus norvegicus
gcagatgcctggtctctctataaga

SEQ ID NO: 382512 - DNA, 25 bp, Rattus norvegicus
gcagatgcggcacctcaagagcttt

SEQ ID NO: 382513 - DNA, 25 bp, Rattus norvegicus
gcagatgcggcagctcaagagcttt

SEQ ID NO: 382514 - DNA, 25 bp, Rattus norvegicus
gcagatgcgggaatgccacgagttt

SEQ ID NO: 382515 - DNA, 25 bp, Rattus norvegicus
gcagatgcgggattgccacgagttt

SEQ ID NO: 382516 - DNA, 25 bp, Rattus norvegicus
gcagatgctaatcctaccaccatga

SEQ ID NO: 382517 - DNA, 25 bp, Rattus norvegicus
gcagatgctaatcgacgctggcctc

SEQ ID NO: 382518 - DNA, 25 bp, Rattus norvegicus
gcagatgctaatgctaccaccatga

SEQ ID NO: 382519 - DNA, 25 bp, Rattus norvegicus
gcagatgctaatggacgctggcctc

SEQ ID NO: 382520 - DNA, 25 bp, Rattus norvegicus
gcagatgctcacagccaatcattgg

SEQ ID NO: 382521 - DNA, 25 bp, Rattus norvegicus
gcagatgctcacatgcaagttatta

SEQ ID NO: 382522 - DNA, 25 bp, Rattus norvegicus
gcagatgctcactgccaatcattgg

SEQ ID NO: 382523 - DNA, 25 bp, Rattus norvegicus
gcagatgctcacttgcaagttatta

SEQ ID NO: 382524 - DNA, 25 bp, Rattus norvegicus
gcagatgctctgataggctccaaag

SEQ ID NO: 382525 - DNA, 25 bp, Rattus norvegicus
gcagatgctctgttaggctccaaag

SEQ ID NO: 382526 - DNA, 25 bp, Rattus norvegicus
gcagatgctgccaacatgacaccat

SEQ ID NO: 382527 - DNA, 25 bp, Rattus norvegicus
gcagatgctgcctacatgacaccat

SEQ ID NO: 382528 - DNA, 25 bp, Rattus norvegicus
gcagatgcttagactgcattaaata

SEQ ID NO: 382529 - DNA, 25 bp, Rattus norvegicus
gcagatgcttagtctgcattaaata

SEQ ID NO: 382530 - DNA, 25 bp, Rattus norvegicus
gcagatggaggaccgcatcacctgc

SEQ ID NO: 382531 - DNA, 25 bp, Rattus norvegicus
gcagatggaggagcgcatcacctgc

SEQ ID NO: 382532 - DNA, 25 bp, Rattus norvegicus
gcagatggcaaacgtcctgtggatc

SEQ ID NO: 382533 - DNA, 25 bp, Rattus norvegicus
gcagatggcaaaggtcctgtggatc

SEQ ID NO: 382534 - DNA, 25 bp, Rattus norvegicus
gcagatggcattctccctgaaacat

SEQ ID NO: 382535 - DNA, 25 bp, Rattus norvegicus
gcagatggcattgtccctgaaacat

SEQ ID NO: 382536 - DNA, 25 bp, Rattus norvegicus
gcagatggccacacagaaactatca

SEQ ID NO: 382537 - DNA, 25 bp, Rattus norvegicus
gcagatggccactcagaaactatca

SEQ ID NO: 382538 - DNA, 25 bp, Rattus norvegicus
gcagatggctcaagattctgggtat

SEQ ID NO: 382539 - DNA, 25 bp, Rattus norvegicus
gcagatggctcatgattctgggtat

SEQ ID NO: 382540 - DNA, 25 bp, Rattus norvegicus
gcagatggctcgaggttccaggtat

SEQ ID NO: 382541 - DNA, 25 bp, Rattus norvegicus
gcagatggctcgtggttccaggtat

SEQ ID NO: 382542 - DNA, 25 bp, Rattus norvegicus
gcagatggctggcatgaacttctac

SEQ ID NO: 382543 - DNA, 25 bp, Rattus norvegicus
gcagatggctgggatgaacttctac

SEQ ID NO: 382544 - DNA, 25 bp, Rattus norvegicus
gcagatggctttcgtgtgttccctt

SEQ ID NO: 382545 - DNA, 25 bp, Rattus norvegicus
gcagatggctttggtgtgttccctt

SEQ ID NO: 382546 - DNA, 25 bp, Rattus norvegicus
gcagatgggccaagctgtatcacac

SEQ ID NO: 382547 - DNA, 25 bp, Rattus norvegicus
gcagatgggccatgctgtatcacac

SEQ ID NO: 382548 - DNA, 25 bp, Rattus norvegicus
gcagatgggctgaaccttatctact

SEQ ID NO: 382549 - DNA, 25 bp, Rattus norvegicus
gcagatgggctgtaccttatctact

SEQ ID NO: 382550 - DNA, 25 bp, Rattus norvegicus
gcagatggtagcaagtagtcccgag

SEQ ID NO: 382551 - DNA, 25 bp, Rattus norvegicus
gcagatggtagctagtagtcccgag

SEQ ID NO: 382552 - DNA, 25 bp, Rattus norvegicus
gcagatggtatcagttgttcattca

SEQ ID NO: 382553 - DNA, 25 bp, Rattus norvegicus
gcagatggtatctgttgttcattca

SEQ ID NO: 382554 - DNA, 25 bp, Rattus norvegicus
gcagatggtgatccattgtccctca

SEQ ID NO: 382555 - DNA, 25 bp, Rattus norvegicus
gcagatggtgatgcattgtccctca

SEQ ID NO: 382556 - DNA, 25 bp, Rattus norvegicus
gcagatggttttacgctttcttttg

SEQ ID NO: 382557 - DNA, 25 bp, Rattus norvegicus
gcagatggtttttcgctttcttttg

SEQ ID NO: 382558 - DNA, 25 bp, Rattus norvegicus
gcagatgtaccccaagaatgaatta

SEQ ID NO: 382559 - DNA, 25 bp, Rattus norvegicus
gcagatgtaccccttgttgtagagt

SEQ ID NO: 382560 - DNA, 25 bp, Rattus norvegicus
gcagatgtacccgaagaatgaatta

SEQ ID NO: 382561 - DNA, 25 bp, Rattus norvegicus
gcagatgtacccgttgttgtagagt

SEQ ID NO: 382562 - DNA, 25 bp, Rattus norvegicus
gcagatgtagcacccctagattcca

SEQ ID NO: 382563 - DNA, 25 bp, Rattus norvegicus
gcagatgtagcagccctagattcca

SEQ ID NO: 382564 - DNA, 25 bp, Rattus norvegicus
gcagatgtcagcactttttgttttg

SEQ ID NO: 382565 - DNA, 25 bp, Rattus norvegicus
gcagatgtcagctctttttgttttg

SEQ ID NO: 382566 - DNA, 25 bp, Rattus norvegicus
gcagatgtctccagatgcaccatgt

SEQ ID NO: 382567 - DNA, 25 bp, Rattus norvegicus
gcagatgtctcctgatgcaccatgt

SEQ ID NO: 382568 - DNA, 25 bp, Rattus norvegicus
gcagatgtgctcactttctaggaga

SEQ ID NO: 382569 - DNA, 25 bp, Rattus norvegicus
gcagatgtgctctctttctaggaga

SEQ ID NO: 382570 - DNA, 25 bp, Rattus norvegicus
gcagatgtgcttaggtacttttttg

SEQ ID NO: 382571 - DNA, 25 bp, Rattus norvegicus
gcagatgtgctttggtacttttttg

SEQ ID NO: 382572 - DNA, 25 bp, Rattus norvegicus
gcagatgtgtgtcctctggtgtttc

SEQ ID NO: 382573 - DNA, 25 bp, Rattus norvegicus
gcagatgtgtgtgctctggtgtttc

SEQ ID NO: 382574 - DNA, 25 bp, Rattus norvegicus
gcagatgtgtttcttcttactagaa

SEQ ID NO: 382575 - DNA, 25 bp, Rattus norvegicus
gcagatgtgtttgttcttactagaa

SEQ ID NO: 382576 - DNA, 25 bp, Rattus norvegicus
gcagatgttgcacgaccttgtttaa

SEQ ID NO: 382577 - DNA, 25 bp, Rattus norvegicus
gcagatgttgcaggaccttgtttaa

SEQ ID NO: 382578 - DNA, 25 bp, Rattus norvegicus
gcagatgtttgcactgttccacaga

SEQ ID NO: 382579 - DNA, 25 bp, Rattus norvegicus
gcagatgtttgctctgttccacaga

SEQ ID NO: 382580 - DNA, 25 bp, Rattus norvegicus
gcagatgtttttcctcagatcggtt

SEQ ID NO: 382581 - DNA, 25 bp, Rattus norvegicus
gcagatgtttttgctcagatcggtt

SEQ ID NO: 382582 - DNA, 25 bp, Rattus norvegicus
gcagattaaaacacgacctaggaaa

SEQ ID NO: 382583 - DNA, 25 bp, Rattus norvegicus
gcagattaaaactcgacctaggaaa

SEQ ID NO: 382584 - DNA, 25 bp, Rattus norvegicus
gcagattaaatgctcctccagaagg

SEQ ID NO: 382585 - DNA, 25 bp, Rattus norvegicus
gcagattaaatggtcctccagaagg

SEQ ID NO: 382586 - DNA, 25 bp, Rattus norvegicus
gcagattaagtccttcacccaccat

SEQ ID NO: 382587 - DNA, 25 bp, Rattus norvegicus
gcagattaagtcgttcacccaccat

SEQ ID NO: 382588 - DNA, 25 bp, Rattus norvegicus
gcagattagactcggtggcgtataa

SEQ ID NO: 382589 - DNA, 25 bp, Rattus norvegicus
gcagattagactgggtggcgtataa

SEQ ID NO: 382590 - DNA, 25 bp, Rattus norvegicus
gcagattatagcacaggctgatttt

SEQ ID NO: 382591 - DNA, 25 bp, Rattus norvegicus
gcagattatagctcaggctgatttt

SEQ ID NO: 382592 - DNA, 25 bp, Rattus norvegicus
gcagattatcccagtggcaaacgcc

SEQ ID NO: 382593 - DNA, 25 bp, Rattus norvegicus
gcagattatccctgtggcaaacgcc

SEQ ID NO: 382594 - DNA, 25 bp, Rattus norvegicus
gcagattatggcacagctgcctctc

SEQ ID NO: 382595 - DNA, 25 bp, Rattus norvegicus
gcagattatggccttacctcaaaat

SEQ ID NO: 382596 - DNA, 25 bp, Rattus norvegicus
gcagattatggcgttacctcaaaat

SEQ ID NO: 382597 - DNA, 25 bp, Rattus norvegicus
gcagattatggctcagctgcctctc

SEQ ID NO: 382598 - DNA, 25 bp, Rattus norvegicus
gcagattatgtcagcaccatgtgat

SEQ ID NO: 382599 - DNA, 25 bp, Rattus norvegicus
gcagattatgtctgcaccatgtgat

SEQ ID NO: 382600 - DNA, 25 bp, Rattus norvegicus
gcagattcagacctttcatgcatga

SEQ ID NO: 382601 - DNA, 25 bp, Rattus norvegicus
gcagattcagacgtttcatgcatga

SEQ ID NO: 382602 - DNA, 25 bp, Rattus norvegicus
gcagattcagctctattagcccttt

SEQ ID NO: 382603 - DNA, 25 bp, Rattus norvegicus
gcagattcagctgtattagcccttt

SEQ ID NO: 382604 - DNA, 25 bp, Rattus norvegicus
gcagattcaggccttttaaaccatt

SEQ ID NO: 382605 - DNA, 25 bp, Rattus norvegicus
gcagattcaggcgttttaaaccatt

SEQ ID NO: 382606 - DNA, 25 bp, Rattus norvegicus
gcagattcagggagtcagcagcctc

SEQ ID NO: 382607 - DNA, 25 bp, Rattus norvegicus
gcagattcagggtgtcagcagcctc

SEQ ID NO: 382608 - DNA, 25 bp, Rattus norvegicus
gcagattcatttcttcctgtaacaa

SEQ ID NO: 382609 - DNA, 25 bp, Rattus norvegicus
gcagattcatttgttcctgtaacaa

SEQ ID NO: 382610 - DNA, 25 bp, Rattus norvegicus
gcagattccaatattagccaagtac

SEQ ID NO: 382611 - DNA, 25 bp, Rattus norvegicus
gcagattccaattttagccaagtac

SEQ ID NO: 382612 - DNA, 25 bp, Rattus norvegicus
gcagattccatacgcagggcgaact

SEQ ID NO: 382613 - DNA, 25 bp, Rattus norvegicus
gcagattccataggcagggcgaact

SEQ ID NO: 382614 - DNA, 25 bp, Rattus norvegicus
gcagattccatgcttatttctgtcc

SEQ ID NO: 382615 - DNA, 25 bp, Rattus norvegicus
gcagattccatggttatttctgtcc

SEQ ID NO: 382616 - DNA, 25 bp, Rattus norvegicus
gcagattcccaaagcaccttatttt

SEQ ID NO: 382617 - DNA, 25 bp, Rattus norvegicus
gcagattcccaatgcaccttatttt

SEQ ID NO: 382618 - DNA, 25 bp, Rattus norvegicus
gcagattccgggaagccctgtagtg

SEQ ID NO: 382619 - DNA, 25 bp, Rattus norvegicus
gcagattccgggtagccctgtagtg

SEQ ID NO: 382620 - DNA, 25 bp, Rattus norvegicus
gcagattcctggcttgtttgtactc

SEQ ID NO: 382621 - DNA, 25 bp, Rattus norvegicus
gcagattcctgggttgtttgtactc

SEQ ID NO: 382622 - DNA, 25 bp, Rattus norvegicus
gcagattcgtcaaatgctaagggaa

SEQ ID NO: 382623 - DNA, 25 bp, Rattus norvegicus
gcagattcgtcaaggcttccacggg

SEQ ID NO: 382624 - DNA, 25 bp, Rattus norvegicus
gcagattcgtcatatgctaagggaa

SEQ ID NO: 382625 - DNA, 25 bp, Rattus norvegicus
gcagattcgtcatggcttccacggg

SEQ ID NO: 382626 - DNA, 25 bp, Rattus norvegicus
gcagattcgttaatggtgggcctca

SEQ ID NO: 382627 - DNA, 25 bp, Rattus norvegicus
gcagattcgttattggtgggcctca

SEQ ID NO: 382628 - DNA, 25 bp, Rattus norvegicus
gcagattcgttgctttctctggaga

SEQ ID NO: 382629 - DNA, 25 bp, Rattus norvegicus
gcagattcgttggtttctctggaga

SEQ ID NO: 382630 - DNA, 25 bp, Rattus norvegicus
gcagattctgagaaccaggcccgaa

SEQ ID NO: 382631 - DNA, 25 bp, Rattus norvegicus
gcagattctgagctggagctctctc

SEQ ID NO: 382632 - DNA, 25 bp, Rattus norvegicus
gcagattctgaggtggagctctctc

SEQ ID NO: 382633 - DNA, 25 bp, Rattus norvegicus
gcagattctgagtaccaggcccgaa

SEQ ID NO: 382634 - DNA, 25 bp, Rattus norvegicus
gcagattctgcacaggctcagcctt

SEQ ID NO: 382635 - DNA, 25 bp, Rattus norvegicus
gcagattctgcactaaaattgtctt

SEQ ID NO: 382636 - DNA, 25 bp, Rattus norvegicus
gcagattctgcagaggctcagcctt

SEQ ID NO: 382637 - DNA, 25 bp, Rattus norvegicus
gcagattctgcagtaaaattgtctt

SEQ ID NO: 382638 - DNA, 25 bp, Rattus norvegicus
gcagattctgccagtctttttcttt

SEQ ID NO: 382639 - DNA, 25 bp, Rattus norvegicus
gcagattctgcctgtctttttcttt

SEQ ID NO: 382640 - DNA, 25 bp, Rattus norvegicus
gcagattctggcctgttgtgactaa

SEQ ID NO: 382641 - DNA, 25 bp, Rattus norvegicus
gcagattctggcgtgttgtgactaa

SEQ ID NO: 382642 - DNA, 25 bp, Rattus norvegicus
gcagattcttgaccaggttaattta

SEQ ID NO: 382643 - DNA, 25 bp, Rattus norvegicus
gcagattcttgagcaggttaattta

SEQ ID NO: 382644 - DNA, 25 bp, Rattus norvegicus
gcagattcttgcatatttacacaca

SEQ ID NO: 382645 - DNA, 25 bp, Rattus norvegicus
gcagattcttgcttatttacacaca

SEQ ID NO: 382646 - DNA, 25 bp, Rattus norvegicus
gcagattgcaatagactatgaggct

SEQ ID NO: 382647 - DNA, 25 bp, Rattus norvegicus
gcagattgcaattgactatgaggct

SEQ ID NO: 382648 - DNA, 25 bp, Rattus norvegicus
gcagattgccaacattgatcgtatt

SEQ ID NO: 382649 - DNA, 25 bp, Rattus norvegicus
gcagattgccaagattgatcgtatt

SEQ ID NO: 382650 - DNA, 25 bp, Rattus norvegicus
gcagattgctagacagccatttttt

SEQ ID NO: 382651 - DNA, 25 bp, Rattus norvegicus
gcagattgctagtcagccatttttt

SEQ ID NO: 382652 - DNA, 25 bp, Rattus norvegicus
gcagattggccgaaggtatcctgga

SEQ ID NO: 382653 - DNA, 25 bp, Rattus norvegicus
gcagattggccgtaggtatcctgga

SEQ ID NO: 382654 - DNA, 25 bp, Rattus norvegicus
gcagattgtcagaagtgtcccagca

SEQ ID NO: 382655 - DNA, 25 bp, Rattus norvegicus
gcagattgtcagtagtgtcccagca

SEQ ID NO: 382656 - DNA, 25 bp, Rattus norvegicus
gcagattgtgctaagggatatatac

SEQ ID NO: 382657 - DNA, 25 bp, Rattus norvegicus
gcagattgtgcttagggatatatac

SEQ ID NO: 382658 - DNA, 25 bp, Rattus norvegicus
gcagattgttgtaaggtgcgtatca

SEQ ID NO: 382659 - DNA, 25 bp, Rattus norvegicus
gcagattgttgttaggtgcgtatca

SEQ ID NO: 382660 - DNA, 25 bp, Rattus norvegicus
gcagatttataaccatttgccagct

SEQ ID NO: 382661 - DNA, 25 bp, Rattus norvegicus
gcagatttataagcatttgccagct

SEQ ID NO: 382662 - DNA, 25 bp, Rattus norvegicus
gcagatttcgagcagggctagctat

SEQ ID NO: 382663 - DNA, 25 bp, Rattus norvegicus
gcagatttcgaggagggctagctat

SEQ ID NO: 382664 - DNA, 25 bp, Rattus norvegicus
gcagatttctgaccgtttgaagcca

SEQ ID NO: 382665 - DNA, 25 bp, Rattus norvegicus
gcagatttctgactcaccttattag

SEQ ID NO: 382666 - DNA, 25 bp, Rattus norvegicus
gcagatttctgagcgtttgaagcca

SEQ ID NO: 382667 - DNA, 25 bp, Rattus norvegicus
gcagatttctgagtcaccttattag

SEQ ID NO: 382668 - DNA, 25 bp, Rattus norvegicus
gcagatttcttgagtggtttgtcct

SEQ ID NO: 382669 - DNA, 25 bp, Rattus norvegicus
gcagatttcttgtgtggtttgtcct

SEQ ID NO: 382670 - DNA, 25 bp, Rattus norvegicus
gcagatttgaccctttaggagttac

SEQ ID NO: 382671 - DNA, 25 bp, Rattus norvegicus
gcagatttgaccgtttaggagttac

SEQ ID NO: 382672 - DNA, 25 bp, Rattus norvegicus
gcagatttgggaagcagaggcctcc

SEQ ID NO: 382673 - DNA, 25 bp, Rattus norvegicus
gcagatttgggatgcagaggcctcc

SEQ ID NO: 382674 - DNA, 25 bp, Rattus norvegicus
gcagatttgtagatttgacttcaca

SEQ ID NO: 382675 - DNA, 25 bp, Rattus norvegicus
gcagatttgtagttttgacttcaca

SEQ ID NO: 382676 - DNA, 25 bp, Rattus norvegicus
gcagatttgtctctcttcacattat

SEQ ID NO: 382677 - DNA, 25 bp, Rattus norvegicus
gcagatttgtctgtcttcacattat

SEQ ID NO: 382678 - DNA, 25 bp, Rattus norvegicus
gcagattttaccagttgcagcaaat

SEQ ID NO: 382679 - DNA, 25 bp, Rattus norvegicus
gcagattttacctgttgcagcaaat

SEQ ID NO: 382680 - DNA, 25 bp, Rattus norvegicus
gcagattttagtatctctattatca

SEQ ID NO: 382681 - DNA, 25 bp, Rattus norvegicus
gcagattttagtttctctattatca

SEQ ID NO: 382682 - DNA, 25 bp, Rattus norvegicus
gcagatttttacagatcggtggcct

SEQ ID NO: 382683 - DNA, 25 bp, Rattus norvegicus
gcagatttttactgatcggtggcct

SEQ ID NO: 382684 - DNA, 25 bp, Rattus norvegicus
gcagatttttctagcttaacaccag

SEQ ID NO: 382685 - DNA, 25 bp, Rattus norvegicus
gcagatttttcttgcttaacaccag

SEQ ID NO: 382686 - DNA, 25 bp, Rattus norvegicus
gcagcaaaacttctactattttgtt

SEQ ID NO: 382687 - DNA, 25 bp, Rattus norvegicus
gcagcaaaacttgtactattttgtt

SEQ ID NO: 382688 - DNA, 25 bp, Rattus norvegicus
gcagcaaacaaccttctccaggaga

SEQ ID NO: 382689 - DNA, 25 bp, Rattus norvegicus
gcagcaaacaacgttctccaggaga

SEQ ID NO: 382690 - DNA, 25 bp, Rattus norvegicus
gcagcaaacaccagtatcccttgag

SEQ ID NO: 382691 - DNA, 25 bp, Rattus norvegicus
gcagcaaacacctgtatcccttgag

SEQ ID NO: 382692 - DNA, 25 bp, Rattus norvegicus
gcagcaaacctgacctttaaccttt

SEQ ID NO: 382693 - DNA, 25 bp, Rattus norvegicus
gcagcaaacctgaggacgttttctt

SEQ ID NO: 382694 - DNA, 25 bp, Rattus norvegicus
gcagcaaacctgtcctttaaccttt

SEQ ID NO: 382695 - DNA, 25 bp, Rattus norvegicus
gcagcaaacctgtggacgttttctt

SEQ ID NO: 382696 - DNA, 25 bp, Rattus norvegicus
gcagcaaactgaatttctaaaacca

SEQ ID NO: 382697 - DNA, 25 bp, Rattus norvegicus
gcagcaaactgattttctaaaacca

SEQ ID NO: 382698 - DNA, 25 bp, Rattus norvegicus
gcagcaaagaaacccgggtcctgct

SEQ ID NO: 382699 - DNA, 25 bp, Rattus norvegicus
gcagcaaagaaagccgggtcctgct

SEQ ID NO: 382700 - DNA, 25 bp, Rattus norvegicus
gcagcaaagatcagcctttctcttc

SEQ ID NO: 382701 - DNA, 25 bp, Rattus norvegicus
gcagcaaagatctgcctttctcttc

SEQ ID NO: 382702 - DNA, 25 bp, Rattus norvegicus
gcagcaaatatccagttgtgtttta

SEQ ID NO: 382703 - DNA, 25 bp, Rattus norvegicus
gcagcaaatatcgagttgtgtttta

SEQ ID NO: 382704 - DNA, 25 bp, Rattus norvegicus
gcagcaaatctaccacaccaaactt

SEQ ID NO: 382705 - DNA, 25 bp, Rattus norvegicus
gcagcaaatctagcacaccaaactt

SEQ ID NO: 382706 - DNA, 25 bp, Rattus norvegicus
gcagcaaatgtcaccctttcactga

SEQ ID NO: 382707 - DNA, 25 bp, Rattus norvegicus
gcagcaaatgtctccctttcactga

SEQ ID NO: 382708 - DNA, 25 bp, Rattus norvegicus
gcagcaaattgacactttaaaacct

SEQ ID NO: 382709 - DNA, 25 bp, Rattus norvegicus
gcagcaaattgagactttaaaacct

SEQ ID NO: 382710 - DNA, 25 bp, Rattus norvegicus
gcagcaacaaacagtcatcctgtaa

SEQ ID NO: 382711 - DNA, 25 bp, Rattus norvegicus
gcagcaacaaactgtcatcctgtaa

SEQ ID NO: 382712 - DNA, 25 bp, Rattus norvegicus
gcagcaacaagaacattttccggtt

SEQ ID NO: 382713 - DNA, 25 bp, Rattus norvegicus
gcagcaacaagaccaagcccaagga

SEQ ID NO: 382714 - DNA, 25 bp, Rattus norvegicus
gcagcaacaagagcaagcccaagga

SEQ ID NO: 382715 - DNA, 25 bp, Rattus norvegicus
gcagcaacaagatcattttccggtt

SEQ ID NO: 382716 - DNA, 25 bp, Rattus norvegicus
gcagcaacattacctacaagtgtct

SEQ ID NO: 382717 - DNA, 25 bp, Rattus norvegicus
gcagcaacattagctacaagtgtct

SEQ ID NO: 382718 - DNA, 25 bp, Rattus norvegicus
gcagcaaccacacttctgtgttcac

SEQ ID NO: 382719 - DNA, 25 bp, Rattus norvegicus
gcagcaaccacagttctgtgttcac

SEQ ID NO: 382720 - DNA, 25 bp, Rattus norvegicus
gcagcaaccactcccagtagagaat

SEQ ID NO: 382721 - DNA, 25 bp, Rattus norvegicus
gcagcaaccactgccagtagagaat

SEQ ID NO: 382722 - DNA, 25 bp, Rattus norvegicus
gcagcaacccttagtattcacataa

SEQ ID NO: 382723 - DNA, 25 bp, Rattus norvegicus
gcagcaaccctttgtattcacataa

SEQ ID NO: 382724 - DNA, 25 bp, Rattus norvegicus
gcagcaacgactaataaactcttct

SEQ ID NO: 382725 - DNA, 25 bp, Rattus norvegicus
gcagcaacgacttataaactcttct

SEQ ID NO: 382726 - DNA, 25 bp, Rattus norvegicus
gcagcaacggtcatggtgaggtcca

SEQ ID NO: 382727 - DNA, 25 bp, Rattus norvegicus
gcagcaacggtcttggtgaggtcca

SEQ ID NO: 382728 - DNA, 25 bp, Rattus norvegicus
gcagcaactccaagaccatgacaga

SEQ ID NO: 382729 - DNA, 25 bp, Rattus norvegicus
gcagcaactccatgaccatgacaga

SEQ ID NO: 382730 - DNA, 25 bp, Rattus norvegicus
gcagcaactgcgaggcgagtgttaa

SEQ ID NO: 382731 - DNA, 25 bp, Rattus norvegicus
gcagcaactgcgtggcgagtgttaa

SEQ ID NO: 382732 - DNA, 25 bp, Rattus norvegicus
gcagcaacttataagtgaccttcta

SEQ ID NO: 382733 - DNA, 25 bp, Rattus norvegicus
gcagcaacttatcccgagcgtcctt

SEQ ID NO: 382734 - DNA, 25 bp, Rattus norvegicus
gcagcaacttatgccgagcgtcctt

SEQ ID NO: 382735 - DNA, 25 bp, Rattus norvegicus
gcagcaacttattagtgaccttcta

SEQ ID NO: 382736 - DNA, 25 bp, Rattus norvegicus
gcagcaagaagcaggcagccacata

SEQ ID NO: 382737 - DNA, 25 bp, Rattus norvegicus
gcagcaagaagctggcagccacata

SEQ ID NO: 382738 - DNA, 25 bp, Rattus norvegicus
gcagcaagacacatcctttgacagg

SEQ ID NO: 382739 - DNA, 25 bp, Rattus norvegicus
gcagcaagacacttcctttgacagg

SEQ ID NO: 382740 - DNA, 25 bp, Rattus norvegicus
gcagcaagacctccgcctgtgcgtg

SEQ ID NO: 382741 - DNA, 25 bp, Rattus norvegicus
gcagcaagacctgcgcctgtgcgtg

SEQ ID NO: 382742 - DNA, 25 bp, Rattus norvegicus
gcagcaagagcacagactgcccttg

SEQ ID NO: 382743 - DNA, 25 bp, Rattus norvegicus
gcagcaagagcagagactgcccttg

SEQ ID NO: 382744 - DNA, 25 bp, Rattus norvegicus
gcagcaagagctaattccggtctgt

SEQ ID NO: 382745 - DNA, 25 bp, Rattus norvegicus
gcagcaagagcttattccggtctgt

SEQ ID NO: 382746 - DNA, 25 bp, Rattus norvegicus
gcagcaagaggaatagctttctaaa

SEQ ID NO: 382747 - DNA, 25 bp, Rattus norvegicus
gcagcaagaggattagctttctaaa

SEQ ID NO: 382748 - DNA, 25 bp, Rattus norvegicus
gcagcaagagtaattcagccgacct

SEQ ID NO: 382749 - DNA, 25 bp, Rattus norvegicus
gcagcaagagtatttcagccgacct

SEQ ID NO: 382750 - DNA, 25 bp, Rattus norvegicus
gcagcaagatagagccctcagcctt

SEQ ID NO: 382751 - DNA, 25 bp, Rattus norvegicus
gcagcaagatagtgccctcagcctt

SEQ ID NO: 382752 - DNA, 25 bp, Rattus norvegicus
gcagcaagatccctgtgcgtacaat

SEQ ID NO: 382753 - DNA, 25 bp, Rattus norvegicus
gcagcaagatccgtgtgcgtacaat

SEQ ID NO: 382754 - DNA, 25 bp, Rattus norvegicus
gcagcaagctccattactgtcagag

SEQ ID NO: 382755 - DNA, 25 bp, Rattus norvegicus
gcagcaagctcctttactgtcagag

SEQ ID NO: 382756 - DNA, 25 bp, Rattus norvegicus
gcagcaaggccacagaagttcgaca

SEQ ID NO: 382757 - DNA, 25 bp, Rattus norvegicus
gcagcaaggccagagaagttcgaca

SEQ ID NO: 382758 - DNA, 25 bp, Rattus norvegicus
gcagcaagggcaaccgaggcaagaa

SEQ ID NO: 382759 - DNA, 25 bp, Rattus norvegicus
gcagcaagggcatccgaggcaagaa

SEQ ID NO: 382760 - DNA, 25 bp, Rattus norvegicus
gcagcaaggtggaaggaccccagaa

SEQ ID NO: 382761 - DNA, 25 bp, Rattus norvegicus
gcagcaaggtggtaggaccccagaa

SEQ ID NO: 382762 - DNA, 25 bp, Rattus norvegicus
gcagcaagtcatccctgtggtgaaa

SEQ ID NO: 382763 - DNA, 25 bp, Rattus norvegicus
gcagcaagtcatgcctgtggtgaaa

SEQ ID NO: 382764 - DNA, 25 bp, Rattus norvegicus
gcagcaagtctgaactgggctaaca

SEQ ID NO: 382765 - DNA, 25 bp, Rattus norvegicus
gcagcaagtctgcattaatcttaca

SEQ ID NO: 382766 - DNA, 25 bp, Rattus norvegicus
gcagcaagtctggattaatcttaca

SEQ ID NO: 382767 - DNA, 25 bp, Rattus norvegicus
gcagcaagtctgtactgggctaaca

SEQ ID NO: 382768 - DNA, 25 bp, Rattus norvegicus
gcagcaagttgccatctatacccaa

SEQ ID NO: 382769 - DNA, 25 bp, Rattus norvegicus
gcagcaagttgcgatctatacccaa

SEQ ID NO: 382770 - DNA, 25 bp, Rattus norvegicus
gcagcaagttttacctctcgaatcc

SEQ ID NO: 382771 - DNA, 25 bp, Rattus norvegicus
gcagcaagtttttcctctcgaatcc

SEQ ID NO: 382772 - DNA, 25 bp, Rattus norvegicus
gcagcaatcggacgtgacagcgcca

SEQ ID NO: 382773 - DNA, 25 bp, Rattus norvegicus
gcagcaatcggaggtgacagcgcca

SEQ ID NO: 382774 - DNA, 25 bp, Rattus norvegicus
gcagcaattgaacttgcctcaggcc

SEQ ID NO: 382775 - DNA, 25 bp, Rattus norvegicus
gcagcaattgaagttgcctcaggcc

SEQ ID NO: 382776 - DNA, 25 bp, Rattus norvegicus
gcagcaatttctatgcaacatggat

SEQ ID NO: 382777 - DNA, 25 bp, Rattus norvegicus
gcagcaatttctttgcaacatggat

SEQ ID NO: 382778 - DNA, 25 bp, Rattus norvegicus
gcagcacaagcgagggtggcccggt

SEQ ID NO: 382779 - DNA, 25 bp, Rattus norvegicus
gcagcacaagcgtgggtggcccggt

SEQ ID NO: 382780 - DNA, 25 bp, Rattus norvegicus
gcagcacaagggagctgagcccagc

SEQ ID NO: 382781 - DNA, 25 bp, Rattus norvegicus
gcagcacaagggtgctgagcccagc

SEQ ID NO: 382782 - DNA, 25 bp, Rattus norvegicus
gcagcacaatgcatgcaagtcaggg

SEQ ID NO: 382783 - DNA, 25 bp, Rattus norvegicus
gcagcacaatgcttgcaagtcaggg

SEQ ID NO: 382784 - DNA, 25 bp, Rattus norvegicus
gcagcacacatcagtggcttggtgg

SEQ ID NO: 382785 - DNA, 25 bp, Rattus norvegicus
gcagcacacatctgtggcttggtgg

SEQ ID NO: 382786 - DNA, 25 bp, Rattus norvegicus
gcagcacacattacgtactggaatg

SEQ ID NO: 382787 - DNA, 25 bp, Rattus norvegicus
gcagcacacatttcgtactggaatg

SEQ ID NO: 382788 - DNA, 25 bp, Rattus norvegicus
gcagcacaccatctagcaatctaga

SEQ ID NO: 382789 - DNA, 25 bp, Rattus norvegicus
gcagcacaccatgtagcaatctaga

SEQ ID NO: 382790 - DNA, 25 bp, Rattus norvegicus
gcagcacactgaattcctcaagtag

SEQ ID NO: 382791 - DNA, 25 bp, Rattus norvegicus
gcagcacactgatttcctcaagtag

SEQ ID NO: 382792 - DNA, 25 bp, Rattus norvegicus
gcagcacactttatgacatctgtcc

SEQ ID NO: 382793 - DNA, 25 bp, Rattus norvegicus
gcagcacactttttgacatctgtcc

SEQ ID NO: 382794 - DNA, 25 bp, Rattus norvegicus
gcagcacagatcactctaaacaagt

SEQ ID NO: 382795 - DNA, 25 bp, Rattus norvegicus
gcagcacagatctctctaaacaagt

SEQ ID NO: 382796 - DNA, 25 bp, Rattus norvegicus
gcagcacagcctcaagttccagagg

SEQ ID NO: 382797 - DNA, 25 bp, Rattus norvegicus
gcagcacagcctgaagttccagagg

SEQ ID NO: 382798 - DNA, 25 bp, Rattus norvegicus
gcagcacagctaatgtcctgacagg

SEQ ID NO: 382799 - DNA, 25 bp, Rattus norvegicus
gcagcacagctattgtcctgacagg

SEQ ID NO: 382800 - DNA, 25 bp, Rattus norvegicus
gcagcacagttcctaggcactgttc

SEQ ID NO: 382801 - DNA, 25 bp, Rattus norvegicus
gcagcacagttcgtaggcactgttc

SEQ ID NO: 382802 - DNA, 25 bp, Rattus norvegicus
gcagcacatcgtaactcaattttag

SEQ ID NO: 382803 - DNA, 25 bp, Rattus norvegicus
gcagcacatcgttactcaattttag

SEQ ID NO: 382804 - DNA, 25 bp, Rattus norvegicus
gcagcacattgaagatgccctgttg

SEQ ID NO: 382805 - DNA, 25 bp, Rattus norvegicus
gcagcacattgatgatgccctgttg

SEQ ID NO: 382806 - DNA, 25 bp, Rattus norvegicus
gcagcacattgtcgttattgccaat

SEQ ID NO: 382807 - DNA, 25 bp, Rattus norvegicus
gcagcacattgtggttattgccaat

SEQ ID NO: 382808 - DNA, 25 bp, Rattus norvegicus
gcagcaccacctcctcgtatgtgtt

SEQ ID NO: 382809 - DNA, 25 bp, Rattus norvegicus
gcagcaccacctgctcgtatgtgtt

SEQ ID NO: 382810 - DNA, 25 bp, Rattus norvegicus
gcagcaccaggactctcaggagtca

SEQ ID NO: 382811 - DNA, 25 bp, Rattus norvegicus
gcagcaccaggagtctcaggagtca

SEQ ID NO: 382812 - DNA, 25 bp, Rattus norvegicus
gcagcacccttaagccataggtaga

SEQ ID NO: 382813 - DNA, 25 bp, Rattus norvegicus
gcagcacccttatgccataggtaga

SEQ ID NO: 382814 - DNA, 25 bp, Rattus norvegicus
gcagcaccggagagttggccaagta

SEQ ID NO: 382815 - DNA, 25 bp, Rattus norvegicus
gcagcaccggagtgttggccaagta

SEQ ID NO: 382816 - DNA, 25 bp, Rattus norvegicus
gcagcaccgtggctaacgacgtaat

SEQ ID NO: 382817 - DNA, 25 bp, Rattus norvegicus
gcagcaccgtgggtaacgacgtaat

SEQ ID NO: 382818 - DNA, 25 bp, Rattus norvegicus
gcagcacctccgaattctttggttt

SEQ ID NO: 382819 - DNA, 25 bp, Rattus norvegicus
gcagcacctccgtattctttggttt

SEQ ID NO: 382820 - DNA, 25 bp, Rattus norvegicus
gcagcacctggaatctgtactagat

SEQ ID NO: 382821 - DNA, 25 bp, Rattus norvegicus
gcagcacctggattctgtactagat

SEQ ID NO: 382822 - DNA, 25 bp, Rattus norvegicus
gcagcaccttgaactgaacagaaac

SEQ ID NO: 382823 - DNA, 25 bp, Rattus norvegicus
gcagcaccttgatctgaacagaaac

SEQ ID NO: 382824 - DNA, 25 bp, Rattus norvegicus
gcagcacgacgactcttttggtata

SEQ ID NO: 382825 - DNA, 25 bp, Rattus norvegicus
gcagcacgacgagtcttttggtata

SEQ ID NO: 382826 - DNA, 25 bp, Rattus norvegicus
gcagcacgcagaaagattaccagga

SEQ ID NO: 382827 - DNA, 25 bp, Rattus norvegicus
gcagcacgcagatagattaccagga

SEQ ID NO: 382828 - DNA, 25 bp, Rattus norvegicus
gcagcacgctttcaaactcttcgta

SEQ ID NO: 382829 - DNA, 25 bp, Rattus norvegicus
gcagcacgctttgaaactcttcgta

SEQ ID NO: 382830 - DNA, 25 bp, Rattus norvegicus
gcagcacgtgggactgatcctgtca

SEQ ID NO: 382831 - DNA, 25 bp, Rattus norvegicus
gcagcacgtgggtctgatcctgtca

SEQ ID NO: 382832 - DNA, 25 bp, Rattus norvegicus
gcagcactaagaatggagcaccctc

SEQ ID NO: 382833 - DNA, 25 bp, Rattus norvegicus
gcagcactaagattggagcaccctc

SEQ ID NO: 382834 - DNA, 25 bp, Rattus norvegicus
gcagcactaatcagcatgtcctagg

SEQ ID NO: 382835 - DNA, 25 bp, Rattus norvegicus
gcagcactaatctgcatgtcctagg

SEQ ID NO: 382836 - DNA, 25 bp, Rattus norvegicus
gcagcactgattccacgaacagcaa

SEQ ID NO: 382837 - DNA, 25 bp, Rattus norvegicus
gcagcactgattgcacgaacagcaa

SEQ ID NO: 382838 - DNA, 25 bp, Rattus norvegicus
gcagcactggatatagactgtgttc

SEQ ID NO: 382839 - DNA, 25 bp, Rattus norvegicus
gcagcactggatttagactgtgttc

SEQ ID NO: 382840 - DNA, 25 bp, Rattus norvegicus
gcagcacttgagaccactgtacttt

SEQ ID NO: 382841 - DNA, 25 bp, Rattus norvegicus
gcagcacttgagtccactgtacttt

SEQ ID NO: 382842 - DNA, 25 bp, Rattus norvegicus
gcagcacttgtaaaggaaaccattt

SEQ ID NO: 382843 - DNA, 25 bp, Rattus norvegicus
gcagcacttgtataggaaaccattt

SEQ ID NO: 382844 - DNA, 25 bp, Rattus norvegicus
gcagcacttgtcaacagacactgaa

SEQ ID NO: 382845 - DNA, 25 bp, Rattus norvegicus
gcagcacttgtctacagacactgaa

SEQ ID NO: 382846 - DNA, 25 bp, Rattus norvegicus
gcagcacttgtgaatagccagtcca

SEQ ID NO: 382847 - DNA, 25 bp, Rattus norvegicus
gcagcacttgtgtatagccagtcca

SEQ ID NO: 382848 - DNA, 25 bp, Rattus norvegicus
gcagcactttaaagccacgtgacat

SEQ ID NO: 382849 - DNA, 25 bp, Rattus norvegicus
gcagcactttaatgccacgtgacat

SEQ ID NO: 382850 - DNA, 25 bp, Rattus norvegicus
gcagcacttttgactgttactcagt

SEQ ID NO: 382851 - DNA, 25 bp, Rattus norvegicus
gcagcacttttgtctgttactcagt

SEQ ID NO: 382852 - DNA, 25 bp, Rattus norvegicus
gcagcagaacaacccatgccttctt

SEQ ID NO: 382853 - DNA, 25 bp, Rattus norvegicus
gcagcagaacaagccatgccttctt

SEQ ID NO: 382854 - DNA, 25 bp, Rattus norvegicus
gcagcagaacagcagccgagttatg

SEQ ID NO: 382855 - DNA, 25 bp, Rattus norvegicus
gcagcagaacaggagccgagttatg

SEQ ID NO: 382856 - DNA, 25 bp, Rattus norvegicus
gcagcagaacccacagcagcaagag

SEQ ID NO: 382857 - DNA, 25 bp, Rattus norvegicus
gcagcagaaccccaacttagcagat

SEQ ID NO: 382858 - DNA, 25 bp, Rattus norvegicus
gcagcagaacccgaacttagcagat

SEQ ID NO: 382859 - DNA, 25 bp, Rattus norvegicus
gcagcagaaccctcagcagcaagag

SEQ ID NO: 382860 - DNA, 25 bp, Rattus norvegicus
gcagcagaagcacctcggtcctcat

SEQ ID NO: 382861 - DNA, 25 bp, Rattus norvegicus
gcagcagaagcagctcggtcctcat

SEQ ID NO: 382862 - DNA, 25 bp, Rattus norvegicus
gcagcagaaggcagctgccagacgc

SEQ ID NO: 382863 - DNA, 25 bp, Rattus norvegicus
gcagcagaaggctgctgccagacgc

SEQ ID NO: 382864 - DNA, 25 bp, Rattus norvegicus
gcagcagaagggaatcagccaaata

SEQ ID NO: 382865 - DNA, 25 bp, Rattus norvegicus
gcagcagaagggtatcagccaaata

SEQ ID NO: 382866 - DNA, 25 bp, Rattus norvegicus
gcagcagaatcaactagaacagcaa

SEQ ID NO: 382867 - DNA, 25 bp, Rattus norvegicus
gcagcagaatcatctagaacagcaa

SEQ ID NO: 382868 - DNA, 25 bp, Rattus norvegicus
gcagcagaatctaattttagcccta

SEQ ID NO: 382869 - DNA, 25 bp, Rattus norvegicus
gcagcagaatcttattttagcccta

SEQ ID NO: 382870 - DNA, 25 bp, Rattus norvegicus
gcagcagacaaacgccactacaaat

SEQ ID NO: 382871 - DNA, 25 bp, Rattus norvegicus
gcagcagacaaaggccactacaaat

SEQ ID NO: 382872 - DNA, 25 bp, Rattus norvegicus
gcagcagacaacagtttcagccgaa

SEQ ID NO: 382873 - DNA, 25 bp, Rattus norvegicus
gcagcagacaactgtttcagccgaa

SEQ ID NO: 382874 - DNA, 25 bp, Rattus norvegicus
gcagcagacactctgtacagttttt

SEQ ID NO: 382875 - DNA, 25 bp, Rattus norvegicus
gcagcagacactgtgtacagttttt

SEQ ID NO: 382876 - DNA, 25 bp, Rattus norvegicus
gcagcagaccaacgtataccacaag

SEQ ID NO: 382877 - DNA, 25 bp, Rattus norvegicus
gcagcagaccaaggtataccacaag

SEQ ID NO: 382878 - DNA, 25 bp, Rattus norvegicus
gcagcagactctcgccgagaggttc

SEQ ID NO: 382879 - DNA, 25 bp, Rattus norvegicus
gcagcagactctggccgagaggttc

SEQ ID NO: 382880 - DNA, 25 bp, Rattus norvegicus
gcagcagactgtcttctgattcaga

SEQ ID NO: 382881 - DNA, 25 bp, Rattus norvegicus
gcagcagactgtgttctgattcaga

SEQ ID NO: 382882 - DNA, 25 bp, Rattus norvegicus
gcagcagagacaaagtccgttccta

SEQ ID NO: 382883 - DNA, 25 bp, Rattus norvegicus
gcagcagagacatagtccgttccta

SEQ ID NO: 382884 - DNA, 25 bp, Rattus norvegicus
gcagcagaggccacgcagtattata

SEQ ID NO: 382885 - DNA, 25 bp, Rattus norvegicus
gcagcagaggcctcgcagtattata

SEQ ID NO: 382886 - DNA, 25 bp, Rattus norvegicus
gcagcagaggctccccaggacacag

SEQ ID NO: 382887 - DNA, 25 bp, Rattus norvegicus
gcagcagaggctgcccaggacacag

SEQ ID NO: 382888 - DNA, 25 bp, Rattus norvegicus
gcagcagaggttctttctccagttt

SEQ ID NO: 382889 - DNA, 25 bp, Rattus norvegicus
gcagcagaggttgtttctccagttt

SEQ ID NO: 382890 - DNA, 25 bp, Rattus norvegicus
gcagcagagtctcggcatgtcctca

SEQ ID NO: 382891 - DNA, 25 bp, Rattus norvegicus
gcagcagagtctgggcatgtcctca

SEQ ID NO: 382892 - DNA, 25 bp, Rattus norvegicus
gcagcagagtgaaaccaagtaacca

SEQ ID NO: 382893 - DNA, 25 bp, Rattus norvegicus
gcagcagagtgataccaagtaacca

SEQ ID NO: 382894 - DNA, 25 bp, Rattus norvegicus
gcagcagataacatttttgagtcat

SEQ ID NO: 382895 - DNA, 25 bp, Rattus norvegicus
gcagcagataacttttttgagtcat

SEQ ID NO: 382896 - DNA, 25 bp, Rattus norvegicus
gcagcagatattagtctctttggga

SEQ ID NO: 382897 - DNA, 25 bp, Rattus norvegicus
gcagcagatatttgtctctttggga

SEQ ID NO: 382898 - DNA, 25 bp, Rattus norvegicus
gcagcagatcataaccaacacagga

SEQ ID NO: 382899 - DNA, 25 bp, Rattus norvegicus
gcagcagatcattaccaacacagga

SEQ ID NO: 382900 - DNA, 25 bp, Rattus norvegicus
gcagcagattctcagttctgccagt

SEQ ID NO: 382901 - DNA, 25 bp, Rattus norvegicus
gcagcagattctgagttctgccagt

SEQ ID NO: 382902 - DNA, 25 bp, Rattus norvegicus
gcagcagcacaacatgtcctggatt

SEQ ID NO: 382903 - DNA, 25 bp, Rattus norvegicus
gcagcagcacaagatgtcctggatt

SEQ ID NO: 382904 - DNA, 25 bp, Rattus norvegicus
gcagcagcacatagtgtattgctca

SEQ ID NO: 382905 - DNA, 25 bp, Rattus norvegicus
gcagcagcacattgtgtattgctca

SEQ ID NO: 382906 - DNA, 25 bp, Rattus norvegicus
gcagcagcaccaagaagcgatgacg

SEQ ID NO: 382907 - DNA, 25 bp, Rattus norvegicus
gcagcagcaccatgaagcgatgacg

SEQ ID NO: 382908 - DNA, 25 bp, Rattus norvegicus
gcagcagcaggaacccacacaggca

SEQ ID NO: 382909 - DNA, 25 bp, Rattus norvegicus
gcagcagcaggaatccacacaggca

SEQ ID NO: 382910 - DNA, 25 bp, Rattus norvegicus
gcagcagcaggatcccacacaggca

SEQ ID NO: 382911 - DNA, 25 bp, Rattus norvegicus
gcagcagcaggattccacacaggca

SEQ ID NO: 382912 - DNA, 25 bp, Rattus norvegicus
gcagcagcagtcatatccaaaccat

SEQ ID NO: 382913 - DNA, 25 bp, Rattus norvegicus
gcagcagcagtcttatccaaaccat

SEQ ID NO: 382914 - DNA, 25 bp, Rattus norvegicus
gcagcagcataaactcagagatgaa

SEQ ID NO: 382915 - DNA, 25 bp, Rattus norvegicus
gcagcagcataatctcagagatgaa

SEQ ID NO: 382916 - DNA, 25 bp, Rattus norvegicus
gcagcagcatttactgccataagtg

SEQ ID NO: 382917 - DNA, 25 bp, Rattus norvegicus
gcagcagcattttctgccataagtg

SEQ ID NO: 382918 - DNA, 25 bp, Rattus norvegicus
gcagcagccaggagccatatatctt

SEQ ID NO: 382919 - DNA, 25 bp, Rattus norvegicus
gcagcagccaggtgccatatatctt

SEQ ID NO: 382920 - DNA, 25 bp, Rattus norvegicus
gcagcagccatgcttcaggctgact

SEQ ID NO: 382921 - DNA, 25 bp, Rattus norvegicus
gcagcagccatggttcaggctgact

SEQ ID NO: 382922 - DNA, 25 bp, Rattus norvegicus
gcagcagccgaccttatcggtgtaa

SEQ ID NO: 382923 - DNA, 25 bp, Rattus norvegicus
gcagcagccgacgttatcggtgtaa

SEQ ID NO: 382924 - DNA, 25 bp, Rattus norvegicus
gcagcagccgccacactgaaaggag

SEQ ID NO: 382925 - DNA, 25 bp, Rattus norvegicus
gcagcagccgcctcactgaaaggag

SEQ ID NO: 382926 - DNA, 25 bp, Rattus norvegicus
gcagcagccgggatgaagtcagcat

SEQ ID NO: 382927 - DNA, 25 bp, Rattus norvegicus
gcagcagccgggttgaagtcagcat

SEQ ID NO: 382928 - DNA, 25 bp, Rattus norvegicus
gcagcagccgtcacagctccaatgg

SEQ ID NO: 382929 - DNA, 25 bp, Rattus norvegicus
gcagcagccgtctcagctccaatgg

SEQ ID NO: 382930 - DNA, 25 bp, Rattus norvegicus
gcagcagccgttacgcattggagca

SEQ ID NO: 382931 - DNA, 25 bp, Rattus norvegicus
gcagcagccgtttcgcattggagca

SEQ ID NO: 382932 - DNA, 25 bp, Rattus norvegicus
gcagcagcctatacctatgttttga

SEQ ID NO: 382933 - DNA, 25 bp, Rattus norvegicus
gcagcagcctattcctatgttttga

SEQ ID NO: 382934 - DNA, 25 bp, Rattus norvegicus
gcagcagcctgcatgtgtggactat

SEQ ID NO: 382935 - DNA, 25 bp, Rattus norvegicus
gcagcagcctgcttgtgtggactat

SEQ ID NO: 382936 - DNA, 25 bp, Rattus norvegicus
gcagcagccttcatgtttttaatta

SEQ ID NO: 382937 - DNA, 25 bp, Rattus norvegicus
gcagcagccttcttgtttttaatta

SEQ ID NO: 382938 - DNA, 25 bp, Rattus norvegicus
gcagcagcgagtctggaccaagcct

SEQ ID NO: 382939 - DNA, 25 bp, Rattus norvegicus
gcagcagcgagtgtggaccaagcct

SEQ ID NO: 382940 - DNA, 25 bp, Rattus norvegicus
gcagcagcggcccattgaaagcaag

SEQ ID NO: 382941 - DNA, 25 bp, Rattus norvegicus
gcagcagcggccgattgaaagcaag

SEQ ID NO: 382942 - DNA, 25 bp, Rattus norvegicus
gcagcagcgtgtcgttctgcaccag

SEQ ID NO: 382943 - DNA, 25 bp, Rattus norvegicus
gcagcagcgtgtggttctgcaccag

SEQ ID NO: 382944 - DNA, 25 bp, Rattus norvegicus
gcagcagctaatatcacacgccgaa

SEQ ID NO: 382945 - DNA, 25 bp, Rattus norvegicus
gcagcagctaatttcacacgccgaa

SEQ ID NO: 382946 - DNA, 25 bp, Rattus norvegicus
gcagcagctacgacgaagccatgca

SEQ ID NO: 382947 - DNA, 25 bp, Rattus norvegicus
gcagcagctacgtcgaagccatgca

SEQ ID NO: 382948 - DNA, 25 bp, Rattus norvegicus
gcagcagctcaccttactgtcagat

SEQ ID NO: 382949 - DNA, 25 bp, Rattus norvegicus
gcagcagctcacgttactgtcagat

SEQ ID NO: 382950 - DNA, 25 bp, Rattus norvegicus
gcagcagctgacaaacaccgaagtt

SEQ ID NO: 382951 - DNA, 25 bp, Rattus norvegicus
gcagcagctgactaacaccgaagtt

SEQ ID NO: 382952 - DNA, 25 bp, Rattus norvegicus
gcagcagctgagagcgctcttcgaa

SEQ ID NO: 382953 - DNA, 25 bp, Rattus norvegicus
gcagcagctgagtgcgctcttcgaa

SEQ ID NO: 382954 - DNA, 25 bp, Rattus norvegicus
gcagcagctgcaagagagtgcccag

SEQ ID NO: 382955 - DNA, 25 bp, Rattus norvegicus
gcagcagctgcacgaaggtacgtta

SEQ ID NO: 382956 - DNA, 25 bp, Rattus norvegicus
gcagcagctgcaggaaggtacgtta

SEQ ID NO: 382957 - DNA, 25 bp, Rattus norvegicus
gcagcagctgcatgagagtgcccag

SEQ ID NO: 382958 - DNA, 25 bp, Rattus norvegicus
gcagcagctgccacaacatcagcta

SEQ ID NO: 382959 - DNA, 25 bp, Rattus norvegicus
gcagcagctgcctcaacatcagcta

SEQ ID NO: 382960 - DNA, 25 bp, Rattus norvegicus
gcagcagctgctcgacgagcacgat

SEQ ID NO: 382961 - DNA, 25 bp, Rattus norvegicus
gcagcagctgctggacgagcacgat

SEQ ID NO: 382962 - DNA, 25 bp, Rattus norvegicus
gcagcagcttcaaaaccgcaagaga

SEQ ID NO: 382963 - DNA, 25 bp, Rattus norvegicus
gcagcagcttcacctggctttgtgg

SEQ ID NO: 382964 - DNA, 25 bp, Rattus norvegicus
gcagcagcttcagctggctttgtgg

SEQ ID NO: 382965 - DNA, 25 bp, Rattus norvegicus
gcagcagcttcataaccgcaagaga

SEQ ID NO: 382966 - DNA, 25 bp, Rattus norvegicus
gcagcaggaaaacaactccgcgcct

SEQ ID NO: 382967 - DNA, 25 bp, Rattus norvegicus
gcagcaggaaaagaactccgcgcct

SEQ ID NO: 382968 - DNA, 25 bp, Rattus norvegicus
gcagcaggcaacactctgaggtcct

SEQ ID NO: 382969 - DNA, 25 bp, Rattus norvegicus
gcagcaggcaactctctgaggtcct

SEQ ID NO: 382970 - DNA, 25 bp, Rattus norvegicus
gcagcaggcacccaaacaggattat

SEQ ID NO: 382971 - DNA, 25 bp, Rattus norvegicus
gcagcaggcaccgaaacaggattat

SEQ ID NO: 382972 - DNA, 25 bp, Rattus norvegicus
gcagcaggcactatacagcaaatgt

SEQ ID NO: 382973 - DNA, 25 bp, Rattus norvegicus
gcagcaggcactttacagcaaatgt

SEQ ID NO: 382974 - DNA, 25 bp, Rattus norvegicus
gcagcaggcaggatggcttatacca

SEQ ID NO: 382975 - DNA, 25 bp, Rattus norvegicus
gcagcaggcaggttggcttatacca

SEQ ID NO: 382976 - DNA, 25 bp, Rattus norvegicus
gcagcaggccacaagtgagagtttc

SEQ ID NO: 382977 - DNA, 25 bp, Rattus norvegicus
gcagcaggccactagtgagagtttc

SEQ ID NO: 382978 - DNA, 25 bp, Rattus norvegicus
gcagcaggcccaagtcgagaaagaa

SEQ ID NO: 382979 - DNA, 25 bp, Rattus norvegicus
gcagcaggcccatgtcgagaaagaa

SEQ ID NO: 382980 - DNA, 25 bp, Rattus norvegicus
gcagcaggctaccggacggcaggtt

SEQ ID NO: 382981 - DNA, 25 bp, Rattus norvegicus
gcagcaggctacgggacggcaggtt

SEQ ID NO: 382982 - DNA, 25 bp, Rattus norvegicus
gcagcaggctagcagcagttattct

SEQ ID NO: 382983 - DNA, 25 bp, Rattus norvegicus
gcagcaggctaggagcagttattct

SEQ ID NO: 382984 - DNA, 25 bp, Rattus norvegicus
gcagcagggctcaaagggtttcatc

SEQ ID NO: 382985 - DNA, 25 bp, Rattus norvegicus
gcagcagggctctaagggtttcatc

SEQ ID NO: 382986 - DNA, 25 bp, Rattus norvegicus
gcagcagggtgccaatgacctttat

SEQ ID NO: 382987 - DNA, 25 bp, Rattus norvegicus
gcagcagggtgcgaatgacctttat

SEQ ID NO: 382988 - DNA, 25 bp, Rattus norvegicus
gcagcaggtcagaacatcgcacaca

SEQ ID NO: 382989 - DNA, 25 bp, Rattus norvegicus
gcagcaggtcagtacatcgcacaca

SEQ ID NO: 382990 - DNA, 25 bp, Rattus norvegicus
gcagcaggtcctcgaattagagaaa

SEQ ID NO: 382991 - DNA, 25 bp, Rattus norvegicus
gcagcaggtcctggaattagagaaa

SEQ ID NO: 382992 - DNA, 25 bp, Rattus norvegicus
gcagcagtacccctgtcgtcagaga

SEQ ID NO: 382993 - DNA, 25 bp, Rattus norvegicus
gcagcagtacccgtgtcgtcagaga

SEQ ID NO: 382994 - DNA, 25 bp, Rattus norvegicus
gcagcagtacgccaaggacttcagc

SEQ ID NO: 382995 - DNA, 25 bp, Rattus norvegicus
gcagcagtacgcgaaggacttcagc

SEQ ID NO: 382996 - DNA, 25 bp, Rattus norvegicus
gcagcagtactccaacaggcagcga

SEQ ID NO: 382997 - DNA, 25 bp, Rattus norvegicus
gcagcagtactcgaacaggcagcga

SEQ ID NO: 382998 - DNA, 25 bp, Rattus norvegicus
gcagcagtacttcctacggagccaa

SEQ ID NO: 382999 - DNA, 25 bp, Rattus norvegicus
gcagcagtacttgctacggagccaa

SEQ ID NO: 383000 - DNA, 25 bp, Rattus norvegicus
gcagcagtagcactgttgaggaagg

SEQ ID NO: 383001 - DNA, 25 bp, Rattus norvegicus
gcagcagtagcagtgttgaggaagg

SEQ ID NO: 383002 - DNA, 25 bp, Rattus norvegicus
gcagcagtatgcacttcttggtagc

SEQ ID NO: 383003 - DNA, 25 bp, Rattus norvegicus
gcagcagtatgctcttcttggtagc

SEQ ID NO: 383004 - DNA, 25 bp, Rattus norvegicus
gcagcagtcatactatccacagcag

SEQ ID NO: 383005 - DNA, 25 bp, Rattus norvegicus
gcagcagtcatagtatccacagcag

SEQ ID NO: 383006 - DNA, 25 bp, Rattus norvegicus
gcagcagtcccgaagccgggcctga

SEQ ID NO: 383007 - DNA, 25 bp, Rattus norvegicus
gcagcagtcccgtagccgggcctga

SEQ ID NO: 383008 - DNA, 25 bp, Rattus norvegicus
gcagcagtccgcctgagaatatctc

SEQ ID NO: 383009 - DNA, 25 bp, Rattus norvegicus
gcagcagtccgcgtgagaatatctc

SEQ ID NO: 383010 - DNA, 25 bp, Rattus norvegicus
gcagcagtcctgaatggtgtttcat

SEQ ID NO: 383011 - DNA, 25 bp, Rattus norvegicus
gcagcagtcctgtatggtgtttcat

SEQ ID NO: 383012 - DNA, 25 bp, Rattus norvegicus
gcagcagtcgtcatcatttagtggt

SEQ ID NO: 383013 - DNA, 25 bp, Rattus norvegicus
gcagcagtcgtcttcatttagtggt

SEQ ID NO: 383014 - DNA, 25 bp, Rattus norvegicus
gcagcagtgccaacctgaaacggaa

SEQ ID NO: 383015 - DNA, 25 bp, Rattus norvegicus
gcagcagtgccatcctgaaacggaa

SEQ ID NO: 383016 - DNA, 25 bp, Rattus norvegicus
gcagcagtgctgcatatgccccaga

SEQ ID NO: 383017 - DNA, 25 bp, Rattus norvegicus
gcagcagtgctggatatgccccaga

SEQ ID NO: 383018 - DNA, 25 bp, Rattus norvegicus
gcagcagtgggcagcatcaggctct

SEQ ID NO: 383019 - DNA, 25 bp, Rattus norvegicus
gcagcagtgggctgcatcaggctct

SEQ ID NO: 383020 - DNA, 25 bp, Rattus norvegicus
gcagcagtggtactgactctcccca

SEQ ID NO: 383021 - DNA, 25 bp, Rattus norvegicus
gcagcagtggtagtgactctcccca

SEQ ID NO: 383022 - DNA, 25 bp, Rattus norvegicus
gcagcagtggtgatttctgacacta

SEQ ID NO: 383023 - DNA, 25 bp, Rattus norvegicus
gcagcagtggtgttttctgacacta

SEQ ID NO: 383024 - DNA, 25 bp, Rattus norvegicus
gcagcagtgtgtacttgacagcgtt

SEQ ID NO: 383025 - DNA, 25 bp, Rattus norvegicus
gcagcagtgtgttcttgacagcgtt

SEQ ID NO: 383026 - DNA, 25 bp, Rattus norvegicus
gcagcagttactcctgatgggctca

SEQ ID NO: 383027 - DNA, 25 bp, Rattus norvegicus
gcagcagttactgctgatgggctca

SEQ ID NO: 383028 - DNA, 25 bp, Rattus norvegicus
gcagcagttccgctttatctattac

SEQ ID NO: 383029 - DNA, 25 bp, Rattus norvegicus
gcagcagttccggtttatctattac

SEQ ID NO: 383030 - DNA, 25 bp, Rattus norvegicus
gcagcagttcctctaggtccatggg

SEQ ID NO: 383031 - DNA, 25 bp, Rattus norvegicus
gcagcagttcctgtaggtccatggg

SEQ ID NO: 383032 - DNA, 25 bp, Rattus norvegicus
gcagcataatgtctagagtcacact

SEQ ID NO: 383033 - DNA, 25 bp, Rattus norvegicus
gcagcataatgtgtagagtcacact

SEQ ID NO: 383034 - DNA, 25 bp, Rattus norvegicus
gcagcatacactcaagcactacttg

SEQ ID NO: 383035 - DNA, 25 bp, Rattus norvegicus
gcagcatacactgaagcactacttg

SEQ ID NO: 383036 - DNA, 25 bp, Rattus norvegicus
gcagcatactgtacacagggttttt

SEQ ID NO: 383037 - DNA, 25 bp, Rattus norvegicus
gcagcatactgttcacagggttttt

SEQ ID NO: 383038 - DNA, 25 bp, Rattus norvegicus
gcagcataggttaggcagccatttt

SEQ ID NO: 383039 - DNA, 25 bp, Rattus norvegicus
gcagcataggtttggcagccatttt

SEQ ID NO: 383040 - DNA, 25 bp, Rattus norvegicus
gcagcatattgtcagcgacgaggtc

SEQ ID NO: 383041 - DNA, 25 bp, Rattus norvegicus
gcagcatattgtgagcgacgaggtc

SEQ ID NO: 383042 - DNA, 25 bp, Rattus norvegicus
gcagcatcaaatcgctatggcagca

SEQ ID NO: 383043 - DNA, 25 bp, Rattus norvegicus
gcagcatcaaatggctatggcagca

SEQ ID NO: 383044 - DNA, 25 bp, Rattus norvegicus
gcagcatcaagaaacctttctgtca

SEQ ID NO: 383045 - DNA, 25 bp, Rattus norvegicus
gcagcatcaagatacctttctgtca

SEQ ID NO: 383046 - DNA, 25 bp, Rattus norvegicus
gcagcatcaaggagctccatgacat

SEQ ID NO: 383047 - DNA, 25 bp, Rattus norvegicus
gcagcatcaaggtgctccatgacat

SEQ ID NO: 383048 - DNA, 25 bp, Rattus norvegicus
gcagcatcacacctgacggattgga

SEQ ID NO: 383049 - DNA, 25 bp, Rattus norvegicus
gcagcatcacacgtgacggattgga

SEQ ID NO: 383050 - DNA, 25 bp, Rattus norvegicus
gcagcatcactgctactttcaaatt

SEQ ID NO: 383051 - DNA, 25 bp, Rattus norvegicus
gcagcatcactggtactttcaaatt

SEQ ID NO: 383052 - DNA, 25 bp, Rattus norvegicus
gcagcatcagtcaccggatccaaag

SEQ ID NO: 383053 - DNA, 25 bp, Rattus norvegicus
gcagcatcagtctccggatccaaag

SEQ ID NO: 383054 - DNA, 25 bp, Rattus norvegicus
gcagcatccagtccatccacgtggg

SEQ ID NO: 383055 - DNA, 25 bp, Rattus norvegicus
gcagcatccagtgcatccacgtggg

SEQ ID NO: 383056 - DNA, 25 bp, Rattus norvegicus
gcagcatccatgcaccaagtgaaaa

SEQ ID NO: 383057 - DNA, 25 bp, Rattus norvegicus
gcagcatccatggaccaagtgaaaa

SEQ ID NO: 383058 - DNA, 25 bp, Rattus norvegicus
gcagcatcccaaaggtgccacatga

SEQ ID NO: 383059 - DNA, 25 bp, Rattus norvegicus
gcagcatcccaatggtgccacatga

SEQ ID NO: 383060 - DNA, 25 bp, Rattus norvegicus
gcagcatccgctacgagaatatgaa

SEQ ID NO: 383061 - DNA, 25 bp, Rattus norvegicus
gcagcatccgcttcgagaatatgaa

SEQ ID NO: 383062 - DNA, 25 bp, Rattus norvegicus
gcagcatccgggatccagttcggaa

SEQ ID NO: 383063 - DNA, 25 bp, Rattus norvegicus
gcagcatccgggttccagttcggaa

SEQ ID NO: 383064 - DNA, 25 bp, Rattus norvegicus
gcagcatcgcccaagctcgaaggga

SEQ ID NO: 383065 - DNA, 25 bp, Rattus norvegicus
gcagcatcgccctagctcgaaggga

SEQ ID NO: 383066 - DNA, 25 bp, Rattus norvegicus
gcagcatcggtcaatcctgctaact

SEQ ID NO: 383067 - DNA, 25 bp, Rattus norvegicus
gcagcatcggtctatcctgctaact

SEQ ID NO: 383068 - DNA, 25 bp, Rattus norvegicus
gcagcatctggtctctgtggttttt

SEQ ID NO: 383069 - DNA, 25 bp, Rattus norvegicus
gcagcatctggtgtctgtggttttt

SEQ ID NO: 383070 - DNA, 25 bp, Rattus norvegicus
gcagcatcttcaaggcggctagcag

SEQ ID NO: 383071 - DNA, 25 bp, Rattus norvegicus
gcagcatcttcacaacttgtcctgg

SEQ ID NO: 383072 - DNA, 25 bp, Rattus norvegicus
gcagcatcttcagaacttgtcctgg

SEQ ID NO: 383073 - DNA, 25 bp, Rattus norvegicus
gcagcatcttcatggcggctagcag

SEQ ID NO: 383074 - DNA, 25 bp, Rattus norvegicus
gcagcatcttctccagcagcaacag

SEQ ID NO: 383075 - DNA, 25 bp, Rattus norvegicus
gcagcatcttctgcagcagcaacag

SEQ ID NO: 383076 - DNA, 25 bp, Rattus norvegicus
gcagcatctttgaccagagccggaa

SEQ ID NO: 383077 - DNA, 25 bp, Rattus norvegicus
gcagcatctttgtccagagccggaa

SEQ ID NO: 383078 - DNA, 25 bp, Rattus norvegicus
gcagcatcttttaacagccatgttt

SEQ ID NO: 383079 - DNA, 25 bp, Rattus norvegicus
gcagcatctttttacagccatgttt

SEQ ID NO: 383080 - DNA, 25 bp, Rattus norvegicus
gcagcatgaagcagtccccgagagg

SEQ ID NO: 383081 - DNA, 25 bp, Rattus norvegicus
gcagcatgaagctgtccccgagagg

SEQ ID NO: 383082 - DNA, 25 bp, Rattus norvegicus
gcagcatgatctccggctgggacaa

SEQ ID NO: 383083 - DNA, 25 bp, Rattus norvegicus
gcagcatgatctgcggctgggacaa

SEQ ID NO: 383084 - DNA, 25 bp, Rattus norvegicus
gcagcatgatgcaggacgcgaccag

SEQ ID NO: 383085 - DNA, 25 bp, Rattus norvegicus
gcagcatgatgctggacgcgaccag

SEQ ID NO: 383086 - DNA, 25 bp, Rattus norvegicus
gcagcatgatttctgttggcttcct

SEQ ID NO: 383087 - DNA, 25 bp, Rattus norvegicus
gcagcatgatttgtgttggcttcct

SEQ ID NO: 383088 - DNA, 25 bp, Rattus norvegicus
gcagcatgccgtacattgtagagaa

SEQ ID NO: 383089 - DNA, 25 bp, Rattus norvegicus
gcagcatgccgttcattgtagagaa

SEQ ID NO: 383090 - DNA, 25 bp, Rattus norvegicus
gcagcatgcctcataaggctggtga

SEQ ID NO: 383091 - DNA, 25 bp, Rattus norvegicus
gcagcatgcctcttaaggctggtga

SEQ ID NO: 383092 - DNA, 25 bp, Rattus norvegicus
gcagcatgcgctagtagtttctctt

SEQ ID NO: 383093 - DNA, 25 bp, Rattus norvegicus
gcagcatgcgcttgtagtttctctt

SEQ ID NO: 383094 - DNA, 25 bp, Rattus norvegicus
gcagcatgctgcaatgtacggtttt

SEQ ID NO: 383095 - DNA, 25 bp, Rattus norvegicus
gcagcatgctgctatgtacggtttt

SEQ ID NO: 383096 - DNA, 25 bp, Rattus norvegicus
gcagcatgctggaacttttgcggca

SEQ ID NO: 383097 - DNA, 25 bp, Rattus norvegicus
gcagcatgctggatccatgttttga

SEQ ID NO: 383098 - DNA, 25 bp, Rattus norvegicus
gcagcatgctggtacttttgcggca

SEQ ID NO: 383099 - DNA, 25 bp, Rattus norvegicus
gcagcatgctggttccatgttttga

SEQ ID NO: 383100 - DNA, 25 bp, Rattus norvegicus
gcagcatggcttattacatctgtaa

SEQ ID NO: 383101 - DNA, 25 bp, Rattus norvegicus
gcagcatggctttttacatctgtaa

SEQ ID NO: 383102 - DNA, 25 bp, Rattus norvegicus
gcagcatgtcttccactgatctaag

SEQ ID NO: 383103 - DNA, 25 bp, Rattus norvegicus
gcagcatgtcttgcactgatctaag

SEQ ID NO: 383104 - DNA, 25 bp, Rattus norvegicus
gcagcatgtgacaggttgttctccc

SEQ ID NO: 383105 - DNA, 25 bp, Rattus norvegicus
gcagcatgtgactggttgttctccc

SEQ ID NO: 383106 - DNA, 25 bp, Rattus norvegicus
gcagcatgtgcacgaggcctctatc

SEQ ID NO: 383107 - DNA, 25 bp, Rattus norvegicus
gcagcatgtgcaggaggcctctatc

SEQ ID NO: 383108 - DNA, 25 bp, Rattus norvegicus
gcagcatgtgccctttgatatccac

SEQ ID NO: 383109 - DNA, 25 bp, Rattus norvegicus
gcagcatgtgccgtttgatatccac

SEQ ID NO: 383110 - DNA, 25 bp, Rattus norvegicus
gcagcatgtttcagaggctttccag

SEQ ID NO: 383111 - DNA, 25 bp, Rattus norvegicus
gcagcatgtttccagagcaagtcat

SEQ ID NO: 383112 - DNA, 25 bp, Rattus norvegicus
gcagcatgtttcgagagcaagtcat

SEQ ID NO: 383113 - DNA, 25 bp, Rattus norvegicus
gcagcatgtttctgaggctttccag

SEQ ID NO: 383114 - DNA, 25 bp, Rattus norvegicus
gcagcattaatgatcttcggcattt

SEQ ID NO: 383115 - DNA, 25 bp, Rattus norvegicus
gcagcattaatgttcttcggcattt

SEQ ID NO: 383116 - DNA, 25 bp, Rattus norvegicus
gcagcattacataacactctgtgta

SEQ ID NO: 383117 - DNA, 25 bp, Rattus norvegicus
gcagcattacattacactctgtgta

SEQ ID NO: 383118 - DNA, 25 bp, Rattus norvegicus
gcagcattagcaaaggtgggcatcc

SEQ ID NO: 383119 - DNA, 25 bp, Rattus norvegicus
gcagcattagcataggtgggcatcc

SEQ ID NO: 383120 - DNA, 25 bp, Rattus norvegicus
gcagcattcctgctctcaatgaaca

SEQ ID NO: 383121 - DNA, 25 bp, Rattus norvegicus
gcagcattcctggtctcaatgaaca

SEQ ID NO: 383122 - DNA, 25 bp, Rattus norvegicus
gcagcattgcctcgcgtttggccgt

SEQ ID NO: 383123 - DNA, 25 bp, Rattus norvegicus
gcagcattgcctggcgtttggccgt

SEQ ID NO: 383124 - DNA, 25 bp, Rattus norvegicus
gcagcattggtgatatggcagtact

SEQ ID NO: 383125 - DNA, 25 bp, Rattus norvegicus
gcagcattggtgttatggcagtact

SEQ ID NO: 383126 - DNA, 25 bp, Rattus norvegicus
gcagcattgtcacgcagggttagtt

SEQ ID NO: 383127 - DNA, 25 bp, Rattus norvegicus
gcagcattgtcaggcagggttagtt

SEQ ID NO: 383128 - DNA, 25 bp, Rattus norvegicus
gcagcattgtgtattgtacttgcaa

SEQ ID NO: 383129 - DNA, 25 bp, Rattus norvegicus
gcagcattgtgttttgtacttgcaa

SEQ ID NO: 383130 - DNA, 25 bp, Rattus norvegicus
gcagcattgttgctattgacagtca

SEQ ID NO: 383131 - DNA, 25 bp, Rattus norvegicus
gcagcattgttggtattgacagtca

SEQ ID NO: 383132 - DNA, 25 bp, Rattus norvegicus
gcagcatttagcatttcatttcttc

SEQ ID NO: 383133 - DNA, 25 bp, Rattus norvegicus
gcagcatttagcttttcatttcttc

SEQ ID NO: 383134 - DNA, 25 bp, Rattus norvegicus
gcagcatttgcacaagggaatctct

SEQ ID NO: 383135 - DNA, 25 bp, Rattus norvegicus
gcagcatttgcagaagggaatctct

SEQ ID NO: 383136 - DNA, 25 bp, Rattus norvegicus
gcagcatttggaactcgtgggttac

SEQ ID NO: 383137 - DNA, 25 bp, Rattus norvegicus
gcagcatttggatctcgtgggttac

SEQ ID NO: 383138 - DNA, 25 bp, Rattus norvegicus
gcagcatttgtaagatcctatctgg

SEQ ID NO: 383139 - DNA, 25 bp, Rattus norvegicus
gcagcatttgtactgaaaccctcac

SEQ ID NO: 383140 - DNA, 25 bp, Rattus norvegicus
gcagcatttgtagtgaaaccctcac

SEQ ID NO: 383141 - DNA, 25 bp, Rattus norvegicus
gcagcatttgtatgatcctatctgg

SEQ ID NO: 383142 - DNA, 25 bp, Rattus norvegicus
gcagcatttgttatgtgtgtgagaa

SEQ ID NO: 383143 - DNA, 25 bp, Rattus norvegicus
gcagcatttgttttgtgtgtgagaa

SEQ ID NO: 383144 - DNA, 25 bp, Rattus norvegicus
gcagcattttgaccacacttgtatg

SEQ ID NO: 383145 - DNA, 25 bp, Rattus norvegicus
gcagcattttgaccagcctgcttag

SEQ ID NO: 383146 - DNA, 25 bp, Rattus norvegicus
gcagcattttgagcacacttgtatg

SEQ ID NO: 383147 - DNA, 25 bp, Rattus norvegicus
gcagcattttgagcagcctgcttag

SEQ ID NO: 383148 - DNA, 25 bp, Rattus norvegicus
gcagcattttggagagtgggccctt

SEQ ID NO: 383149 - DNA, 25 bp, Rattus norvegicus
gcagcattttggtgagtgggccctt

SEQ ID NO: 383150 - DNA, 25 bp, Rattus norvegicus
gcagcatttttcaagtttccattca

SEQ ID NO: 383151 - DNA, 25 bp, Rattus norvegicus
gcagcatttttctagtttccattca

SEQ ID NO: 383152 - DNA, 25 bp, Rattus norvegicus
gcagcattttttcattgcacataaa

SEQ ID NO: 383153 - DNA, 25 bp, Rattus norvegicus
gcagcattttttgattgcacataaa

SEQ ID NO: 383154 - DNA, 25 bp, Rattus norvegicus
gcagccaaatgtctcgctttattaa

SEQ ID NO: 383155 - DNA, 25 bp, Rattus norvegicus
gcagccaaatgtgtcgctttattaa

SEQ ID NO: 383156 - DNA, 25 bp, Rattus norvegicus
gcagccaacggcaagtggttcgaca

SEQ ID NO: 383157 - DNA, 25 bp, Rattus norvegicus
gcagccaacggctagtggttcgaca

SEQ ID NO: 383158 - DNA, 25 bp, Rattus norvegicus
gcagccaactttcccattaaaactc

SEQ ID NO: 383159 - DNA, 25 bp, Rattus norvegicus
gcagccaactttgccattaaaactc

SEQ ID NO: 383160 - DNA, 25 bp, Rattus norvegicus
gcagccaagcctcattgtcaaagtt

SEQ ID NO: 383161 - DNA, 25 bp, Rattus norvegicus
gcagccaagcctgattgtcaaagtt

SEQ ID NO: 383162 - DNA, 25 bp, Rattus norvegicus
gcagccaagtgcactttactgagga

SEQ ID NO: 383163 - DNA, 25 bp, Rattus norvegicus
gcagccaagtgctctttactgagga

SEQ ID NO: 383164 - DNA, 25 bp, Rattus norvegicus
gcagccaataaactcggtgaaaagc

SEQ ID NO: 383165 - DNA, 25 bp, Rattus norvegicus
gcagccaataaagtcggtgaaaagc

SEQ ID NO: 383166 - DNA, 25 bp, Rattus norvegicus
gcagccaataggattgctcttatat

SEQ ID NO: 383167 - DNA, 25 bp, Rattus norvegicus
gcagccaataggtttgctcttatat

SEQ ID NO: 383168 - DNA, 25 bp, Rattus norvegicus
gcagccacaactatgccttagatgt

SEQ ID NO: 383169 - DNA, 25 bp, Rattus norvegicus
gcagccacaactttgccttagatgt

SEQ ID NO: 383170 - DNA, 25 bp, Rattus norvegicus
gcagccacacgcactgagatgttag

SEQ ID NO: 383171 - DNA, 25 bp, Rattus norvegicus
gcagccacacgctctgagatgttag

SEQ ID NO: 383172 - DNA, 25 bp, Rattus norvegicus
gcagccacagagacagtatattttt

SEQ ID NO: 383173 - DNA, 25 bp, Rattus norvegicus
gcagccacagagtcagtatattttt

SEQ ID NO: 383174 - DNA, 25 bp, Rattus norvegicus
gcagccacaggcacatttcttgatt

SEQ ID NO: 383175 - DNA, 25 bp, Rattus norvegicus
gcagccacaggctcatttcttgatt

SEQ ID NO: 383176 - DNA, 25 bp, Rattus norvegicus
gcagccacagtgcttctcacaaggg

SEQ ID NO: 383177 - DNA, 25 bp, Rattus norvegicus
gcagccacagtggttctcacaaggg

SEQ ID NO: 383178 - DNA, 25 bp, Rattus norvegicus
gcagccacagttactatgagttcat

SEQ ID NO: 383179 - DNA, 25 bp, Rattus norvegicus
gcagccacagtttctatgagttcat

SEQ ID NO: 383180 - DNA, 25 bp, Rattus norvegicus
gcagccacataacgttgttcccttg

SEQ ID NO: 383181 - DNA, 25 bp, Rattus norvegicus
gcagccacataaggttgttcccttg

SEQ ID NO: 383182 - DNA, 25 bp, Rattus norvegicus
gcagccacatatccaccagcagtaa

SEQ ID NO: 383183 - DNA, 25 bp, Rattus norvegicus
gcagccacatatgcaccagcagtaa

SEQ ID NO: 383184 - DNA, 25 bp, Rattus norvegicus
gcagccacatgacaccttcagagga

SEQ ID NO: 383185 - DNA, 25 bp, Rattus norvegicus
gcagccacatgagaccttcagagga

SEQ ID NO: 383186 - DNA, 25 bp, Rattus norvegicus
gcagccaccatgcttccaatagcta

SEQ ID NO: 383187 - DNA, 25 bp, Rattus norvegicus
gcagccaccatggttccaatagcta

SEQ ID NO: 383188 - DNA, 25 bp, Rattus norvegicus
gcagccaccccacagagaaatcaaa

SEQ ID NO: 383189 - DNA, 25 bp, Rattus norvegicus
gcagccaccccagagagaaatcaaa

SEQ ID NO: 383190 - DNA, 25 bp, Rattus norvegicus
gcagccacccctctgggatagtaat

SEQ ID NO: 383191 - DNA, 25 bp, Rattus norvegicus
gcagccacccctgtgggatagtaat

SEQ ID NO: 383192 - DNA, 25 bp, Rattus norvegicus
gcagccacctgcaagccagatgaat

SEQ ID NO: 383193 - DNA, 25 bp, Rattus norvegicus
gcagccacctgctagccagatgaat

SEQ ID NO: 383194 - DNA, 25 bp, Rattus norvegicus
gcagccactctgaaggttgtttctt

SEQ ID NO: 383195 - DNA, 25 bp, Rattus norvegicus
gcagccactctgtaggttgtttctt

SEQ ID NO: 383196 - DNA, 25 bp, Rattus norvegicus
gcagccactgtcaacaaggccaagg

SEQ ID NO: 383197 - DNA, 25 bp, Rattus norvegicus
gcagccactgtctacaaggccaagg

SEQ ID NO: 383198 - DNA, 25 bp, Rattus norvegicus
gcagccacttgtccaggaccaggtg

SEQ ID NO: 383199 - DNA, 25 bp, Rattus norvegicus
gcagccacttgtgcaggaccaggtg

SEQ ID NO: 383200 - DNA, 25 bp, Rattus norvegicus
gcagccagaagtcaatgtcagcctc

SEQ ID NO: 383201 - DNA, 25 bp, Rattus norvegicus
gcagccagaagtgaatgtcagcctc

SEQ ID NO: 383202 - DNA, 25 bp, Rattus norvegicus
gcagccagaattcctattgagatct

SEQ ID NO: 383203 - DNA, 25 bp, Rattus norvegicus
gcagccagaattgctattgagatct

SEQ ID NO: 383204 - DNA, 25 bp, Rattus norvegicus
gcagccagccacagtgtgttatggt

SEQ ID NO: 383205 - DNA, 25 bp, Rattus norvegicus
gcagccagccacatgggacaatttt

SEQ ID NO: 383206 - DNA, 25 bp, Rattus norvegicus
gcagccagccactgtgtgttatggt

SEQ ID NO: 383207 - DNA, 25 bp, Rattus norvegicus
gcagccagccacttgggacaatttt

SEQ ID NO: 383208 - DNA, 25 bp, Rattus norvegicus
gcagccaggaaaagtgcttctgttt

SEQ ID NO: 383209 - DNA, 25 bp, Rattus norvegicus
gcagccaggaaatgtgcttctgttt

SEQ ID NO: 383210 - DNA, 25 bp, Rattus norvegicus
gcagccaggcggaaccaagtattct

SEQ ID NO: 383211 - DNA, 25 bp, Rattus norvegicus
gcagccaggcggtaccaagtattct

SEQ ID NO: 383212 - DNA, 25 bp, Rattus norvegicus
gcagccagggcacatgcatgtacta

SEQ ID NO: 383213 - DNA, 25 bp, Rattus norvegicus
gcagccagggcagatgcatgtacta

SEQ ID NO: 383214 - DNA, 25 bp, Rattus norvegicus
gcagccagggtgagagagatttcat

SEQ ID NO: 383215 - DNA, 25 bp, Rattus norvegicus
gcagccagggtgtgagagatttcat

SEQ ID NO: 383216 - DNA, 25 bp, Rattus norvegicus
gcagccaggtcacaacacgacattg

SEQ ID NO: 383217 - DNA, 25 bp, Rattus norvegicus
gcagccaggtcagaacacgacattg

SEQ ID NO: 383218 - DNA, 25 bp, Rattus norvegicus
gcagccagtacgcaaggcccagatg

SEQ ID NO: 383219 - DNA, 25 bp, Rattus norvegicus
gcagccagtacggaaggcccagatg

SEQ ID NO: 383220 - DNA, 25 bp, Rattus norvegicus
gcagccagtggccactccagcaagg

SEQ ID NO: 383221 - DNA, 25 bp, Rattus norvegicus
gcagccagtggcgactccagcaagg

SEQ ID NO: 383222 - DNA, 25 bp, Rattus norvegicus
gcagccagtgtcagtctctagacca

SEQ ID NO: 383223 - DNA, 25 bp, Rattus norvegicus
gcagccagtgtctgtctctagacca

SEQ ID NO: 383224 - DNA, 25 bp, Rattus norvegicus
gcagccagttcccttaggaatgaca

SEQ ID NO: 383225 - DNA, 25 bp, Rattus norvegicus
gcagccagttccgttaggaatgaca

SEQ ID NO: 383226 - DNA, 25 bp, Rattus norvegicus
gcagccagttttactcagtactcta

SEQ ID NO: 383227 - DNA, 25 bp, Rattus norvegicus
gcagccagtttttctcagtactcta

SEQ ID NO: 383228 - DNA, 25 bp, Rattus norvegicus
gcagccataattctctttgtctccg

SEQ ID NO: 383229 - DNA, 25 bp, Rattus norvegicus
gcagccataattgtctttgtctccg

SEQ ID NO: 383230 - DNA, 25 bp, Rattus norvegicus
gcagccataccgattcctaaattgt

SEQ ID NO: 383231 - DNA, 25 bp, Rattus norvegicus
gcagccataccgtttcctaaattgt

SEQ ID NO: 383232 - DNA, 25 bp, Rattus norvegicus
gcagccatactgagttttgtgtcaa

SEQ ID NO: 383233 - DNA, 25 bp, Rattus norvegicus
gcagccatactgtgttttgtgtcaa

SEQ ID NO: 383234 - DNA, 25 bp, Rattus norvegicus
gcagccatctacatcctaatgattc

SEQ ID NO: 383235 - DNA, 25 bp, Rattus norvegicus
gcagccatctacttcctaatgattc

SEQ ID NO: 383236 - DNA, 25 bp, Rattus norvegicus
gcagccatcttcagcgaagtggcaa

SEQ ID NO: 383237 - DNA, 25 bp, Rattus norvegicus
gcagccatcttctgcgaagtggcaa

SEQ ID NO: 383238 - DNA, 25 bp, Rattus norvegicus
gcagccatcttgcatcagtcgggat

SEQ ID NO: 383239 - DNA, 25 bp, Rattus norvegicus
gcagccatcttggatcagtcgggat

SEQ ID NO: 383240 - DNA, 25 bp, Rattus norvegicus
gcagccatgatgaccagtgcagact

SEQ ID NO: 383241 - DNA, 25 bp, Rattus norvegicus
gcagccatgatgtccagtgcagact

SEQ ID NO: 383242 - DNA, 25 bp, Rattus norvegicus
gcagccatgcaccacttgttgggat

SEQ ID NO: 383243 - DNA, 25 bp, Rattus norvegicus
gcagccatgcacgacttgttgggat

SEQ ID NO: 383244 - DNA, 25 bp, Rattus norvegicus
gcagccatgctgagccttaggtcaa

SEQ ID NO: 383245 - DNA, 25 bp, Rattus norvegicus
gcagccatgctgcagaccattgatg

SEQ ID NO: 383246 - DNA, 25 bp, Rattus norvegicus
gcagccatgctggagaccattgatg

SEQ ID NO: 383247 - DNA, 25 bp, Rattus norvegicus
gcagccatgctgtgccttaggtcaa

SEQ ID NO: 383248 - DNA, 25 bp, Rattus norvegicus
gcagccatggaaattggtgtctcat

SEQ ID NO: 383249 - DNA, 25 bp, Rattus norvegicus
gcagccatggaatttggtgtctcat

SEQ ID NO: 383250 - DNA, 25 bp, Rattus norvegicus
gcagccatgtaaaatgccacctacg

SEQ ID NO: 383251 - DNA, 25 bp, Rattus norvegicus
gcagccatgtaatatgccacctacg

SEQ ID NO: 383252 - DNA, 25 bp, Rattus norvegicus
gcagccatgtttaatccacggttca

SEQ ID NO: 383253 - DNA, 25 bp, Rattus norvegicus
gcagccatgttttatccacggttca

SEQ ID NO: 383254 - DNA, 25 bp, Rattus norvegicus
gcagccattaaaattttctctggat

SEQ ID NO: 383255 - DNA, 25 bp, Rattus norvegicus
gcagccattaaatttttctctggat

SEQ ID NO: 383256 - DNA, 25 bp, Rattus norvegicus
gcagccattagacagcagcaagcca

SEQ ID NO: 383257 - DNA, 25 bp, Rattus norvegicus
gcagccattagagagcagcaagcca

SEQ ID NO: 383258 - DNA, 25 bp, Rattus norvegicus
gcagccattcatcaggaagtcttat

SEQ ID NO: 383259 - DNA, 25 bp, Rattus norvegicus
gcagccattcatgaggaagtcttat

SEQ ID NO: 383260 - DNA, 25 bp, Rattus norvegicus
gcagccattgctagtaattctttaa

SEQ ID NO: 383261 - DNA, 25 bp, Rattus norvegicus
gcagccattgcttgtaattctttaa

SEQ ID NO: 383262 - DNA, 25 bp, Rattus norvegicus
gcagccattggccactttggagtaa

SEQ ID NO: 383263 - DNA, 25 bp, Rattus norvegicus
gcagccattggcgactttggagtaa

SEQ ID NO: 383264 - DNA, 25 bp, Rattus norvegicus
gcagccattgttaagtaaagagcct

SEQ ID NO: 383265 - DNA, 25 bp, Rattus norvegicus
gcagccattgttctagtctcttgag

SEQ ID NO: 383266 - DNA, 25 bp, Rattus norvegicus
gcagccattgttcttcatagttgtt

SEQ ID NO: 383267 - DNA, 25 bp, Rattus norvegicus
gcagccattgttgtagtctcttgag

SEQ ID NO: 383268 - DNA, 25 bp, Rattus norvegicus
gcagccattgttgttcatagttgtt

SEQ ID NO: 383269 - DNA, 25 bp, Rattus norvegicus
gcagccattgtttagtaaagagcct

SEQ ID NO: 383270 - DNA, 25 bp, Rattus norvegicus
gcagccatttaaacagttgcagatt

SEQ ID NO: 383271 - DNA, 25 bp, Rattus norvegicus
gcagccatttaatcagttgcagatt

SEQ ID NO: 383272 - DNA, 25 bp, Rattus norvegicus
gcagccattttcagcttttccagtt

SEQ ID NO: 383273 - DNA, 25 bp, Rattus norvegicus
gcagccattttctgcttttccagtt

SEQ ID NO: 383274 - DNA, 25 bp, Rattus norvegicus
gcagccattttgagatctggtcagt

SEQ ID NO: 383275 - DNA, 25 bp, Rattus norvegicus
gcagccattttgtgatctggtcagt

SEQ ID NO: 383276 - DNA, 25 bp, Rattus norvegicus
gcagcccaacggagcggacaaagat

SEQ ID NO: 383277 - DNA, 25 bp, Rattus norvegicus
gcagcccaacggtgcggacaaagat

SEQ ID NO: 383278 - DNA, 25 bp, Rattus norvegicus
gcagcccaagctagtctgtgtacaa

SEQ ID NO: 383279 - DNA, 25 bp, Rattus norvegicus
gcagcccaagcttgtctgtgtacaa

SEQ ID NO: 383280 - DNA, 25 bp, Rattus norvegicus
gcagcccaataaatcggtgtcacat

SEQ ID NO: 383281 - DNA, 25 bp, Rattus norvegicus
gcagcccaataattcggtgtcacat

SEQ ID NO: 383282 - DNA, 25 bp, Rattus norvegicus
gcagcccactacatcagggaaacat

SEQ ID NO: 383283 - DNA, 25 bp, Rattus norvegicus
gcagcccactacttcagggaaacat

SEQ ID NO: 383284 - DNA, 25 bp, Rattus norvegicus
gcagcccagctgcaggatcctatga

SEQ ID NO: 383285 - DNA, 25 bp, Rattus norvegicus
gcagcccagctggaggatcctatga

SEQ ID NO: 383286 - DNA, 25 bp, Rattus norvegicus
gcagcccaggacagaccacagattt

SEQ ID NO: 383287 - DNA, 25 bp, Rattus norvegicus
gcagcccaggactgaccacagattt

SEQ ID NO: 383288 - DNA, 25 bp, Rattus norvegicus
gcagcccaggctagggctctaggaa

SEQ ID NO: 383289 - DNA, 25 bp, Rattus norvegicus
gcagcccaggcttgggctctaggaa

SEQ ID NO: 383290 - DNA, 25 bp, Rattus norvegicus
gcagcccagggaatacttttatttt

SEQ ID NO: 383291 - DNA, 25 bp, Rattus norvegicus
gcagcccagggattacttttatttt

SEQ ID NO: 383292 - DNA, 25 bp, Rattus norvegicus
gcagcccagtaaccagggacgaccg

SEQ ID NO: 383293 - DNA, 25 bp, Rattus norvegicus
gcagcccagtaagcagggacgaccg

SEQ ID NO: 383294 - DNA, 25 bp, Rattus norvegicus
gcagcccatgggaacagccttcgag

SEQ ID NO: 383295 - DNA, 25 bp, Rattus norvegicus
gcagcccatgggtacagccttcgag

SEQ ID NO: 383296 - DNA, 25 bp, Rattus norvegicus
gcagcccattgtccactatatgatg

SEQ ID NO: 383297 - DNA, 25 bp, Rattus norvegicus
gcagcccattgtgcactatatgatg

SEQ ID NO: 383298 - DNA, 25 bp, Rattus norvegicus
gcagcccattttcaagactcacttc

SEQ ID NO: 383299 - DNA, 25 bp, Rattus norvegicus
gcagcccattttgaagactcacttc

SEQ ID NO: 383300 - DNA, 25 bp, Rattus norvegicus
gcagccccacctcggtttacaaact

SEQ ID NO: 383301 - DNA, 25 bp, Rattus norvegicus
gcagccccacctgggtttacaaact

SEQ ID NO: 383302 - DNA, 25 bp, Rattus norvegicus
gcagccccactgagcaaacgtaaag

SEQ ID NO: 383303 - DNA, 25 bp, Rattus norvegicus
gcagccccactgtgcaaacgtaaag

SEQ ID NO: 383304 - DNA, 25 bp, Rattus norvegicus
gcagccccacttaattggtagagtc

SEQ ID NO: 383305 - DNA, 25 bp, Rattus norvegicus
gcagccccactttattggtagagtc

SEQ ID NO: 383306 - DNA, 25 bp, Rattus norvegicus
gcagccccagaaacctaagtctttg

SEQ ID NO: 383307 - DNA, 25 bp, Rattus norvegicus
gcagccccagaatcctaagtctttg

SEQ ID NO: 383308 - DNA, 25 bp, Rattus norvegicus
gcagccccagagagtaaggtcctga

SEQ ID NO: 383309 - DNA, 25 bp, Rattus norvegicus
gcagccccagagcacataatcagag

SEQ ID NO: 383310 - DNA, 25 bp, Rattus norvegicus
gcagccccagaggacataatcagag

SEQ ID NO: 383311 - DNA, 25 bp, Rattus norvegicus
gcagccccagagtgtaaggtcctga

SEQ ID NO: 383312 - DNA, 25 bp, Rattus norvegicus
gcagccccagatatgctcagtaatg

SEQ ID NO: 383313 - DNA, 25 bp, Rattus norvegicus
gcagccccagatttgctcagtaatg

SEQ ID NO: 383314 - DNA, 25 bp, Rattus norvegicus
gcagcccctattaggcctaggtcaa

SEQ ID NO: 383315 - DNA, 25 bp, Rattus norvegicus
gcagcccctatttggcctaggtcaa

SEQ ID NO: 383316 - DNA, 25 bp, Rattus norvegicus
gcagcccctgctcaagaaaaagcat

SEQ ID NO: 383317 - DNA, 25 bp, Rattus norvegicus
gcagcccctgctgaagaaaaagcat

SEQ ID NO: 383318 - DNA, 25 bp, Rattus norvegicus
gcagcccctgttcgtttccctgttg

SEQ ID NO: 383319 - DNA, 25 bp, Rattus norvegicus
gcagcccctgttggtttccctgttg

SEQ ID NO: 383320 - DNA, 25 bp, Rattus norvegicus
gcagcccgagggaggcgcggcccag

SEQ ID NO: 383321 - DNA, 25 bp, Rattus norvegicus
gcagcccgagggtggcgcggcccag

SEQ ID NO: 383322 - DNA, 25 bp, Rattus norvegicus
gcagcccgcataataggcgcagata

SEQ ID NO: 383323 - DNA, 25 bp, Rattus norvegicus
gcagcccgcatattaggcgcagata

SEQ ID NO: 383324 - DNA, 25 bp, Rattus norvegicus
gcagcccggctcattcctgggtaaa

SEQ ID NO: 383325 - DNA, 25 bp, Rattus norvegicus
gcagcccggctctttcctgggtaaa

SEQ ID NO: 383326 - DNA, 25 bp, Rattus norvegicus
gcagcccgggccaataggatgaacc

SEQ ID NO: 383327 - DNA, 25 bp, Rattus norvegicus
gcagcccgggcctataggatgaacc

SEQ ID NO: 383328 - DNA, 25 bp, Rattus norvegicus
gcagcccgtttaactgtttgtacag

SEQ ID NO: 383329 - DNA, 25 bp, Rattus norvegicus
gcagcccgtttatctgtttgtacag

SEQ ID NO: 383330 - DNA, 25 bp, Rattus norvegicus
gcagccctagtaacctatgaagctc

SEQ ID NO: 383331 - DNA, 25 bp, Rattus norvegicus
gcagccctagtatcctatgaagctc

SEQ ID NO: 383332 - DNA, 25 bp, Rattus norvegicus
gcagccctcatcactgaggtactgt

SEQ ID NO: 383333 - DNA, 25 bp, Rattus norvegicus
gcagccctcatcagtttaaggcaca

SEQ ID NO: 383334 - DNA, 25 bp, Rattus norvegicus
gcagccctcatctctgaggtactgt

SEQ ID NO: 383335 - DNA, 25 bp, Rattus norvegicus
gcagccctcatctgtttaaggcaca

SEQ ID NO: 383336 - DNA, 25 bp, Rattus norvegicus
gcagccctcgatataggatgacaca

SEQ ID NO: 383337 - DNA, 25 bp, Rattus norvegicus
gcagccctcgatttaggatgacaca

SEQ ID NO: 383338 - DNA, 25 bp, Rattus norvegicus
gcagccctctgacttggctaaggaa

SEQ ID NO: 383339 - DNA, 25 bp, Rattus norvegicus
gcagccctctgagttggctaaggaa

SEQ ID NO: 383340 - DNA, 25 bp, Rattus norvegicus
gcagccctctggaacatggcactgt

SEQ ID NO: 383341 - DNA, 25 bp, Rattus norvegicus
gcagccctctggtacatggcactgt

SEQ ID NO: 383342 - DNA, 25 bp, Rattus norvegicus
gcagccctgattctgttttttgtat

SEQ ID NO: 383343 - DNA, 25 bp, Rattus norvegicus
gcagccctgattgtgttttttgtat

SEQ ID NO: 383344 - DNA, 25 bp, Rattus norvegicus
gcagccctgcttaatacagaccttg

SEQ ID NO: 383345 - DNA, 25 bp, Rattus norvegicus
gcagccctgcttcgaaaactcttag

SEQ ID NO: 383346 - DNA, 25 bp, Rattus norvegicus
gcagccctgcttggaaaactcttag

SEQ ID NO: 383347 - DNA, 25 bp, Rattus norvegicus
gcagccctgctttatacagaccttg

SEQ ID NO: 383348 - DNA, 25 bp, Rattus norvegicus
gcagccctggccaaagtgacaagaa

SEQ ID NO: 383349 - DNA, 25 bp, Rattus norvegicus
gcagccctggcctaagtgacaagaa

SEQ ID NO: 383350 - DNA, 25 bp, Rattus norvegicus
gcagccctggtcattgtaatttgtc

SEQ ID NO: 383351 - DNA, 25 bp, Rattus norvegicus
gcagccctggtctttgtaatttgtc

SEQ ID NO: 383352 - DNA, 25 bp, Rattus norvegicus
gcagccctgtagagcacttgtggag

SEQ ID NO: 383353 - DNA, 25 bp, Rattus norvegicus
gcagccctgtagtgcacttgtggag

SEQ ID NO: 383354 - DNA, 25 bp, Rattus norvegicus
gcagccctgtgcaatgtcagctaag

SEQ ID NO: 383355 - DNA, 25 bp, Rattus norvegicus
gcagccctgtgctatgtcagctaag

SEQ ID NO: 383356 - DNA, 25 bp, Rattus norvegicus
gcagccctgtgtcgagtgagtgagt

SEQ ID NO: 383357 - DNA, 25 bp, Rattus norvegicus
gcagccctgtgtggagtgagtgagt

SEQ ID NO: 383358 - DNA, 25 bp, Rattus norvegicus
gcagcccttcccattgtgaaatgga

SEQ ID NO: 383359 - DNA, 25 bp, Rattus norvegicus
gcagcccttccctttgtgaaatgga

SEQ ID NO: 383360 - DNA, 25 bp, Rattus norvegicus
gcagcccttgctcgaggcatgtgac

SEQ ID NO: 383361 - DNA, 25 bp, Rattus norvegicus
gcagcccttgctggaggcatgtgac

SEQ ID NO: 383362 - DNA, 25 bp, Rattus norvegicus
gcagcccttggaaatcacttcacaa

SEQ ID NO: 383363 - DNA, 25 bp, Rattus norvegicus
gcagcccttggatatcacttcacaa

SEQ ID NO: 383364 - DNA, 25 bp, Rattus norvegicus
gcagccgagcctagtaagtcctgtg

SEQ ID NO: 383365 - DNA, 25 bp, Rattus norvegicus
gcagccgagccttgtaagtcctgtg

SEQ ID NO: 383366 - DNA, 25 bp, Rattus norvegicus
gcagccgagttaagcttttgatgta

SEQ ID NO: 383367 - DNA, 25 bp, Rattus norvegicus
gcagccgagttatgcttttgatgta

SEQ ID NO: 383368 - DNA, 25 bp, Rattus norvegicus
gcagccgcagccaccagggcctagt

SEQ ID NO: 383369 - DNA, 25 bp, Rattus norvegicus
gcagccgcagcctccagggcctagt

SEQ ID NO: 383370 - DNA, 25 bp, Rattus norvegicus
gcagccgcccttatggatttctttt

SEQ ID NO: 383371 - DNA, 25 bp, Rattus norvegicus
gcagccgcccttttggatttctttt

SEQ ID NO: 383372 - DNA, 25 bp, Rattus norvegicus
gcagccgccgatagcagttactgaa

SEQ ID NO: 383373 - DNA, 25 bp, Rattus norvegicus
gcagccgccgattgcagttactgaa

SEQ ID NO: 383374 - DNA, 25 bp, Rattus norvegicus
gcagccgcgcacctgggtgtaataa

SEQ ID NO: 383375 - DNA, 25 bp, Rattus norvegicus
gcagccgcgcacgtgggtgtaataa

SEQ ID NO: 383376 - DNA, 25 bp, Rattus norvegicus
gcagccgctacgacgtggtccaggc

SEQ ID NO: 383377 - DNA, 25 bp, Rattus norvegicus
gcagccgctacgtcgtggtccaggc

SEQ ID NO: 383378 - DNA, 25 bp, Rattus norvegicus
gcagccgctctacggagggtaccat

SEQ ID NO: 383379 - DNA, 25 bp, Rattus norvegicus
gcagccgctctagggagggtaccat

SEQ ID NO: 383380 - DNA, 25 bp, Rattus norvegicus
gcagccggcagaagctcctggaata

SEQ ID NO: 383381 - DNA, 25 bp, Rattus norvegicus
gcagccggcagatgctcctggaata

SEQ ID NO: 383382 - DNA, 25 bp, Rattus norvegicus
gcagccgggcccagttctaaaatga

SEQ ID NO: 383383 - DNA, 25 bp, Rattus norvegicus
gcagccgggccctgttctaaaatga

SEQ ID NO: 383384 - DNA, 25 bp, Rattus norvegicus
gcagccggttctacagggacaagtt

SEQ ID NO: 383385 - DNA, 25 bp, Rattus norvegicus
gcagccggttcttcagggacaagtt

SEQ ID NO: 383386 - DNA, 25 bp, Rattus norvegicus
gcagccgtatgcaagctacacagag

SEQ ID NO: 383387 - DNA, 25 bp, Rattus norvegicus
gcagccgtatgctagctacacagag

SEQ ID NO: 383388 - DNA, 25 bp, Rattus norvegicus
gcagccgtgaacatggcgactcgct

SEQ ID NO: 383389 - DNA, 25 bp, Rattus norvegicus
gcagccgtgaacttggcgactcgct

SEQ ID NO: 383390 - DNA, 25 bp, Rattus norvegicus
gcagccgttggcagagaattgatca

SEQ ID NO: 383391 - DNA, 25 bp, Rattus norvegicus
gcagccgttggctgagaattgatca

SEQ ID NO: 383392 - DNA, 25 bp, Rattus norvegicus
gcagcctacagaccacactggaaga

SEQ ID NO: 383393 - DNA, 25 bp, Rattus norvegicus
gcagcctacagagcacactggaaga

SEQ ID NO: 383394 - DNA, 25 bp, Rattus norvegicus
gcagcctacatgattgtccgcaaga

SEQ ID NO: 383395 - DNA, 25 bp, Rattus norvegicus
gcagcctacatgtttgtccgcaaga

SEQ ID NO: 383396 - DNA, 25 bp, Rattus norvegicus
gcagcctactgtacttggtctaaag

SEQ ID NO: 383397 - DNA, 25 bp, Rattus norvegicus
gcagcctactgttcttggtctaaag

SEQ ID NO: 383398 - DNA, 25 bp, Rattus norvegicus
gcagcctagggcattgtaaatcgtt

SEQ ID NO: 383399 - DNA, 25 bp, Rattus norvegicus
gcagcctagggccttactcatgtta

SEQ ID NO: 383400 - DNA, 25 bp, Rattus norvegicus
gcagcctagggcgttactcatgtta

SEQ ID NO: 383401 - DNA, 25 bp, Rattus norvegicus
gcagcctagggctttgtaaatcgtt

SEQ ID NO: 383402 - DNA, 25 bp, Rattus norvegicus
gcagcctatgatagcttcttttgta

SEQ ID NO: 383403 - DNA, 25 bp, Rattus norvegicus
gcagcctatgattgcttcttttgta

SEQ ID NO: 383404 - DNA, 25 bp, Rattus norvegicus
gcagcctcaaacacccgagagcagg

SEQ ID NO: 383405 - DNA, 25 bp, Rattus norvegicus
gcagcctcaaactcccgagagcagg

SEQ ID NO: 383406 - DNA, 25 bp, Rattus norvegicus
gcagcctcaaagctcctatggtaat

SEQ ID NO: 383407 - DNA, 25 bp, Rattus norvegicus
gcagcctcaaaggtcctatggtaat

SEQ ID NO: 383408 - DNA, 25 bp, Rattus norvegicus
gcagcctcaattatctttgtgcttg

SEQ ID NO: 383409 - DNA, 25 bp, Rattus norvegicus
gcagcctcaattttctttgtgcttg

SEQ ID NO: 383410 - DNA, 25 bp, Rattus norvegicus
gcagcctcactcagtggtaacaaca

SEQ ID NO: 383411 - DNA, 25 bp, Rattus norvegicus
gcagcctcactcctaaacacagtga

SEQ ID NO: 383412 - DNA, 25 bp, Rattus norvegicus
gcagcctcactcgtaaacacagtga

SEQ ID NO: 383413 - DNA, 25 bp, Rattus norvegicus
gcagcctcactctgtggtaacaaca

SEQ ID NO: 383414 - DNA, 25 bp, Rattus norvegicus
gcagcctcactgcacacagactgga

SEQ ID NO: 383415 - DNA, 25 bp, Rattus norvegicus
gcagcctcactggacacagactgga

SEQ ID NO: 383416 - DNA, 25 bp, Rattus norvegicus
gcagcctcagatcgaaactggagtt

SEQ ID NO: 383417 - DNA, 25 bp, Rattus norvegicus
gcagcctcagatggaaactggagtt

SEQ ID NO: 383418 - DNA, 25 bp, Rattus norvegicus
gcagcctcaggcattaaacatctgg

SEQ ID NO: 383419 - DNA, 25 bp, Rattus norvegicus
gcagcctcaggctttaaacatctgg

SEQ ID NO: 383420 - DNA, 25 bp, Rattus norvegicus
gcagcctccactcttactagtgaaa

SEQ ID NO: 383421 - DNA, 25 bp, Rattus norvegicus
gcagcctccactgttactagtgaaa

SEQ ID NO: 383422 - DNA, 25 bp, Rattus norvegicus
gcagcctccagacttatgggcggga

SEQ ID NO: 383423 - DNA, 25 bp, Rattus norvegicus
gcagcctccagagttatgggcggga

SEQ ID NO: 383424 - DNA, 25 bp, Rattus norvegicus
gcagcctccgacaagctcagaaata

SEQ ID NO: 383425 - DNA, 25 bp, Rattus norvegicus
gcagcctccgactagctcagaaata

SEQ ID NO: 383426 - DNA, 25 bp, Rattus norvegicus
gcagcctccgggaatgctcgtcgaa

SEQ ID NO: 383427 - DNA, 25 bp, Rattus norvegicus
gcagcctccgggtatgctcgtcgaa

SEQ ID NO: 383428 - DNA, 25 bp, Rattus norvegicus
gcagcctccgtgagcccagagaaat

SEQ ID NO: 383429 - DNA, 25 bp, Rattus norvegicus
gcagcctccgtgtgcccagagaaat

SEQ ID NO: 383430 - DNA, 25 bp, Rattus norvegicus
gcagcctcggccaagaagaagaaag

SEQ ID NO: 383431 - DNA, 25 bp, Rattus norvegicus
gcagcctcggcctagaagaagaaag

SEQ ID NO: 383432 - DNA, 25 bp, Rattus norvegicus
gcagcctctggaacgctctggagaa

SEQ ID NO: 383433 - DNA, 25 bp, Rattus norvegicus
gcagcctctggatcgctctggagaa

SEQ ID NO: 383434 - DNA, 25 bp, Rattus norvegicus
gcagcctcttaaagattactctgga

SEQ ID NO: 383435 - DNA, 25 bp, Rattus norvegicus
gcagcctcttaatgattactctgga

SEQ ID NO: 383436 - DNA, 25 bp, Rattus norvegicus
gcagcctgaatgatttatgtacctt

SEQ ID NO: 383437 - DNA, 25 bp, Rattus norvegicus
gcagcctgaatgttttatgtacctt

SEQ ID NO: 383438 - DNA, 25 bp, Rattus norvegicus
gcagcctgagctacaaatgattcct

SEQ ID NO: 383439 - DNA, 25 bp, Rattus norvegicus
gcagcctgagcttcaaatgattcct

SEQ ID NO: 383440 - DNA, 25 bp, Rattus norvegicus
gcagcctgatatcaaatagcaccca

SEQ ID NO: 383441 - DNA, 25 bp, Rattus norvegicus
gcagcctgatatgaaatagcaccca

SEQ ID NO: 383442 - DNA, 25 bp, Rattus norvegicus
gcagcctgcaagcaccaggtatgaa

SEQ ID NO: 383443 - DNA, 25 bp, Rattus norvegicus
gcagcctgcaaggaccaggtatgaa

SEQ ID NO: 383444 - DNA, 25 bp, Rattus norvegicus
gcagcctgcacaccatcggcaagat

SEQ ID NO: 383445 - DNA, 25 bp, Rattus norvegicus
gcagcctgcacagcatcggcaagat

SEQ ID NO: 383446 - DNA, 25 bp, Rattus norvegicus
gcagcctgcagccaggtttttattt

SEQ ID NO: 383447 - DNA, 25 bp, Rattus norvegicus
gcagcctgcagcgaggtttttattt

SEQ ID NO: 383448 - DNA, 25 bp, Rattus norvegicus
gcagcctgcagtcagtcttgggaat

SEQ ID NO: 383449 - DNA, 25 bp, Rattus norvegicus
gcagcctgcagtgagtcttgggaat

SEQ ID NO: 383450 - DNA, 25 bp, Rattus norvegicus
gcagcctgcatacctggttttatga

SEQ ID NO: 383451 - DNA, 25 bp, Rattus norvegicus
gcagcctgcatagctggttttatga

SEQ ID NO: 383452 - DNA, 25 bp, Rattus norvegicus
gcagcctgccatagtgaaagtgtat

SEQ ID NO: 383453 - DNA, 25 bp, Rattus norvegicus
gcagcctgccattgtgaaagtgtat

SEQ ID NO: 383454 - DNA, 25 bp, Rattus norvegicus
gcagcctgctttagaggtgtgccgc

SEQ ID NO: 383455 - DNA, 25 bp, Rattus norvegicus
gcagcctgcttttgaggtgtgccgc

SEQ ID NO: 383456 - DNA, 25 bp, Rattus norvegicus
gcagcctggagcatgctacatggac

SEQ ID NO: 383457 - DNA, 25 bp, Rattus norvegicus
gcagcctggagcttgctacatggac

SEQ ID NO: 383458 - DNA, 25 bp, Rattus norvegicus
gcagcctggcaactggattttctcc

SEQ ID NO: 383459 - DNA, 25 bp, Rattus norvegicus
gcagcctggcaagtggattttctcc

SEQ ID NO: 383460 - DNA, 25 bp, Rattus norvegicus
gcagcctggccgacctggaatgtgt

SEQ ID NO: 383461 - DNA, 25 bp, Rattus norvegicus
gcagcctggccgtcctggaatgtgt

SEQ ID NO: 383462 - DNA, 25 bp, Rattus norvegicus
gcagcctggctaagaggccttactt

SEQ ID NO: 383463 - DNA, 25 bp, Rattus norvegicus
gcagcctggctatgaggccttactt

SEQ ID NO: 383464 - DNA, 25 bp, Rattus norvegicus
gcagcctggctgagtacattgacat

SEQ ID NO: 383465 - DNA, 25 bp, Rattus norvegicus
gcagcctggctgtgtacattgacat

SEQ ID NO: 383466 - DNA, 25 bp, Rattus norvegicus
gcagcctgggcaacgggtacacaga

SEQ ID NO: 383467 - DNA, 25 bp, Rattus norvegicus
gcagcctgggcatcgggtacacaga

SEQ ID NO: 383468 - DNA, 25 bp, Rattus norvegicus
gcagcctggtacctcgcactagcag

SEQ ID NO: 383469 - DNA, 25 bp, Rattus norvegicus
gcagcctggtacgtcgcactagcag

SEQ ID NO: 383470 - DNA, 25 bp, Rattus norvegicus
gcagcctggttaaaccacacagact

SEQ ID NO: 383471 - DNA, 25 bp, Rattus norvegicus
gcagcctggttataccacacagact

SEQ ID NO: 383472 - DNA, 25 bp, Rattus norvegicus
gcagcctggtttatatctatttcca

SEQ ID NO: 383473 - DNA, 25 bp, Rattus norvegicus
gcagcctggtttttatctatttcca

SEQ ID NO: 383474 - DNA, 25 bp, Rattus norvegicus
gcagcctgtactaaatagatttctt

SEQ ID NO: 383475 - DNA, 25 bp, Rattus norvegicus
gcagcctgtacttaatagatttctt

SEQ ID NO: 383476 - DNA, 25 bp, Rattus norvegicus
gcagcctgtggactgcagcgcctac

SEQ ID NO: 383477 - DNA, 25 bp, Rattus norvegicus
gcagcctgtggagtgcagcgcctac

SEQ ID NO: 383478 - DNA, 25 bp, Rattus norvegicus
gcagcctgttgacgcgtctggccac

SEQ ID NO: 383479 - DNA, 25 bp, Rattus norvegicus
gcagcctgttgaggcgtctggccac

SEQ ID NO: 383480 - DNA, 25 bp, Rattus norvegicus
gcagcctgtttcaagagctctggaa

SEQ ID NO: 383481 - DNA, 25 bp, Rattus norvegicus
gcagcctgtttcattgccacggccg

SEQ ID NO: 383482 - DNA, 25 bp, Rattus norvegicus
gcagcctgtttctagagctctggaa

SEQ ID NO: 383483 - DNA, 25 bp, Rattus norvegicus
gcagcctgtttctttgccacggccg

SEQ ID NO: 383484 - DNA, 25 bp, Rattus norvegicus
gcagcctgtttgctgagcattatcg

SEQ ID NO: 383485 - DNA, 25 bp, Rattus norvegicus
gcagcctgtttggtgagcattatcg

SEQ ID NO: 383486 - DNA, 25 bp, Rattus norvegicus
gcagccttaaggatgtgaccttcct

SEQ ID NO: 383487 - DNA, 25 bp, Rattus norvegicus
gcagccttaaggttgtgaccttcct

SEQ ID NO: 383488 - DNA, 25 bp, Rattus norvegicus
gcagccttacaacaatgccgctcga

SEQ ID NO: 383489 - DNA, 25 bp, Rattus norvegicus
gcagccttacaagaatgccgctcga

SEQ ID NO: 383490 - DNA, 25 bp, Rattus norvegicus
gcagccttatgtcctttgtgattgt

SEQ ID NO: 383491 - DNA, 25 bp, Rattus norvegicus
gcagccttatgtgctttgtgattgt

SEQ ID NO: 383492 - DNA, 25 bp, Rattus norvegicus
gcagccttcaagcattccattacgc

SEQ ID NO: 383493 - DNA, 25 bp, Rattus norvegicus
gcagccttcaaggattccattacgc

SEQ ID NO: 383494 - DNA, 25 bp, Rattus norvegicus
gcagccttcatcatcacggagagaa

SEQ ID NO: 383495 - DNA, 25 bp, Rattus norvegicus
gcagccttcatcttcacggagagaa

SEQ ID NO: 383496 - DNA, 25 bp, Rattus norvegicus
gcagccttccagaaatgtagccact

SEQ ID NO: 383497 - DNA, 25 bp, Rattus norvegicus
gcagccttccagtaatgtagccact

SEQ ID NO: 383498 - DNA, 25 bp, Rattus norvegicus
gcagccttccggagtgtgaagaacc

SEQ ID NO: 383499 - DNA, 25 bp, Rattus norvegicus
gcagccttccggtgtgtgaagaacc

SEQ ID NO: 383500 - DNA, 25 bp, Rattus norvegicus
gcagccttctgaatattcaaatggc

SEQ ID NO: 383501 - DNA, 25 bp, Rattus norvegicus
gcagccttctgattattcaaatggc

SEQ ID NO: 383502 - DNA, 25 bp, Rattus norvegicus
gcagccttctgcagattacttagac

SEQ ID NO: 383503 - DNA, 25 bp, Rattus norvegicus
gcagccttctgctgattacttagac

SEQ ID NO: 383504 - DNA, 25 bp, Rattus norvegicus
gcagccttgagaacagcgcctatag

SEQ ID NO: 383505 - DNA, 25 bp, Rattus norvegicus
gcagccttgagatcagcgcctatag

SEQ ID NO: 383506 - DNA, 25 bp, Rattus norvegicus
gcagccttgataatcagggtggatt

SEQ ID NO: 383507 - DNA, 25 bp, Rattus norvegicus
gcagccttgatattcagggtggatt

SEQ ID NO: 383508 - DNA, 25 bp, Rattus norvegicus
gcagccttgctgcagatcatacaga

SEQ ID NO: 383509 - DNA, 25 bp, Rattus norvegicus
gcagccttgctggagatcatacaga

SEQ ID NO: 383510 - DNA, 25 bp, Rattus norvegicus
gcagccttggccagtgaactagaca

SEQ ID NO: 383511 - DNA, 25 bp, Rattus norvegicus
gcagccttggcctgtgaactagaca

SEQ ID NO: 383512 - DNA, 25 bp, Rattus norvegicus
gcagccttgggcatcaagggtccaa

SEQ ID NO: 383513 - DNA, 25 bp, Rattus norvegicus
gcagccttgggcttcaagggtccaa

SEQ ID NO: 383514 - DNA, 25 bp, Rattus norvegicus
gcagcctttagtaggtggcacacta

SEQ ID NO: 383515 - DNA, 25 bp, Rattus norvegicus
gcagcctttagttggtggcacacta

SEQ ID NO: 383516 - DNA, 25 bp, Rattus norvegicus
gcagcctttcaacctcatgacagag

SEQ ID NO: 383517 - DNA, 25 bp, Rattus norvegicus
gcagcctttcaagctcatgacagag

SEQ ID NO: 383518 - DNA, 25 bp, Rattus norvegicus
gcagcctttcatacacttctataga

SEQ ID NO: 383519 - DNA, 25 bp, Rattus norvegicus
gcagcctttcattcacttctataga

SEQ ID NO: 383520 - DNA, 25 bp, Rattus norvegicus
gcagcctttccacctagtaagtaaa

SEQ ID NO: 383521 - DNA, 25 bp, Rattus norvegicus
gcagcctttccagctagtaagtaaa

SEQ ID NO: 383522 - DNA, 25 bp, Rattus norvegicus
gcagcctttgccatgcctgtaagtg

SEQ ID NO: 383523 - DNA, 25 bp, Rattus norvegicus
gcagcctttgccttgcctgtaagtg

SEQ ID NO: 383524 - DNA, 25 bp, Rattus norvegicus
gcagcctttgctaactttgatcctt

SEQ ID NO: 383525 - DNA, 25 bp, Rattus norvegicus
gcagcctttgcttactttgatcctt

SEQ ID NO: 383526 - DNA, 25 bp, Rattus norvegicus
gcagcctttgtgatttccataattt

SEQ ID NO: 383527 - DNA, 25 bp, Rattus norvegicus
gcagcctttgtgttttccataattt

SEQ ID NO: 383528 - DNA, 25 bp, Rattus norvegicus
gcagccttttaacatagtttctcat

SEQ ID NO: 383529 - DNA, 25 bp, Rattus norvegicus
gcagccttttaagatagtttctcat

SEQ ID NO: 383530 - DNA, 25 bp, Rattus norvegicus
gcagccttttgtcgatcccagcaca

SEQ ID NO: 383531 - DNA, 25 bp, Rattus norvegicus
gcagccttttgtggatcccagcaca

SEQ ID NO: 383532 - DNA, 25 bp, Rattus norvegicus
gcagcgaaccgaagccttcttgcac

SEQ ID NO: 383533 - DNA, 25 bp, Rattus norvegicus
gcagcgaaccgatgccttcttgcac

SEQ ID NO: 383534 - DNA, 25 bp, Rattus norvegicus
gcagcgaacctgagcacatgttcac

SEQ ID NO: 383535 - DNA, 25 bp, Rattus norvegicus
gcagcgaacctgtgcacatgttcac

SEQ ID NO: 383536 - DNA, 25 bp, Rattus norvegicus
gcagcgaactctaattaaactctta

SEQ ID NO: 383537 - DNA, 25 bp, Rattus norvegicus
gcagcgaactcttattaaactctta

SEQ ID NO: 383538 - DNA, 25 bp, Rattus norvegicus
gcagcgaagtccatgtgagcactct

SEQ ID NO: 383539 - DNA, 25 bp, Rattus norvegicus
gcagcgaagtccttgtgagcactct

SEQ ID NO: 383540 - DNA, 25 bp, Rattus norvegicus
gcagcgaccgctaccaatgtgaaag

SEQ ID NO: 383541 - DNA, 25 bp, Rattus norvegicus
gcagcgaccgcttccaatgtgaaag

SEQ ID NO: 383542 - DNA, 25 bp, Rattus norvegicus
gcagcgactgcaaaggtaaggtcat

SEQ ID NO: 383543 - DNA, 25 bp, Rattus norvegicus
gcagcgactgcataggtaaggtcat

SEQ ID NO: 383544 - DNA, 25 bp, Rattus norvegicus
gcagcgactgctactaagtaccatt

SEQ ID NO: 383545 - DNA, 25 bp, Rattus norvegicus
gcagcgactgcttctaagtaccatt

SEQ ID NO: 383546 - DNA, 25 bp, Rattus norvegicus
gcagcgagcacacctacagcgaatc

SEQ ID NO: 383547 - DNA, 25 bp, Rattus norvegicus
gcagcgagcacagctacagcgaatc

SEQ ID NO: 383548 - DNA, 25 bp, Rattus norvegicus
gcagcgagtaatatcggcatctcaa

SEQ ID NO: 383549 - DNA, 25 bp, Rattus norvegicus
gcagcgagtaatttcggcatctcaa

SEQ ID NO: 383550 - DNA, 25 bp, Rattus norvegicus
gcagcgagtcctacattacggagaa

SEQ ID NO: 383551 - DNA, 25 bp, Rattus norvegicus
gcagcgagtccttcattacggagaa

SEQ ID NO: 383552 - DNA, 25 bp, Rattus norvegicus
gcagcgatgctgagcctgtagctaa

SEQ ID NO: 383553 - DNA, 25 bp, Rattus norvegicus
gcagcgatgctgtgcctgtagctaa

SEQ ID NO: 383554 - DNA, 25 bp, Rattus norvegicus
gcagcgatggtcatgcggatctcgt

SEQ ID NO: 383555 - DNA, 25 bp, Rattus norvegicus
gcagcgatggtcttgcggatctcgt

SEQ ID NO: 383556 - DNA, 25 bp, Rattus norvegicus
gcagcgattcacagacatcctggca

SEQ ID NO: 383557 - DNA, 25 bp, Rattus norvegicus
gcagcgattcactgacatcctggca

SEQ ID NO: 383558 - DNA, 25 bp, Rattus norvegicus
gcagcgattcggcatctacagattc

SEQ ID NO: 383559 - DNA, 25 bp, Rattus norvegicus
gcagcgattcgggatctacagattc

SEQ ID NO: 383560 - DNA, 25 bp, Rattus norvegicus
gcagcgcacatgcttggcttctatc

SEQ ID NO: 383561 - DNA, 25 bp, Rattus norvegicus
gcagcgcacatggttggcttctatc

SEQ ID NO: 383562 - DNA, 25 bp, Rattus norvegicus
gcagcgcacgtacccgtaaggacgt

SEQ ID NO: 383563 - DNA, 25 bp, Rattus norvegicus
gcagcgcacgtagccgtaaggacgt

SEQ ID NO: 383564 - DNA, 25 bp, Rattus norvegicus
gcagcgcacgtgagtgtctttgctc

SEQ ID NO: 383565 - DNA, 25 bp, Rattus norvegicus
gcagcgcacgtgtgtgtctttgctc

SEQ ID NO: 383566 - DNA, 25 bp, Rattus norvegicus
gcagcgcagcgcacatcgagatgga

SEQ ID NO: 383567 - DNA, 25 bp, Rattus norvegicus
gcagcgcagcgctcatcgagatgga

SEQ ID NO: 383568 - DNA, 25 bp, Rattus norvegicus
gcagcgccacgacacaatttttgta

SEQ ID NO: 383569 - DNA, 25 bp, Rattus norvegicus
gcagcgccacgagacaatttttgta

SEQ ID NO: 383570 - DNA, 25 bp, Rattus norvegicus
gcagcgccacggcttcatagagctg

SEQ ID NO: 383571 - DNA, 25 bp, Rattus norvegicus
gcagcgccacgggttcatagagctg

SEQ ID NO: 383572 - DNA, 25 bp, Rattus norvegicus
gcagcgcgagacaaactccttggag

SEQ ID NO: 383573 - DNA, 25 bp, Rattus norvegicus
gcagcgcgagactaactccttggag

SEQ ID NO: 383574 - DNA, 25 bp, Rattus norvegicus
gcagcgctacatcgagcgtcgcttc

SEQ ID NO: 383575 - DNA, 25 bp, Rattus norvegicus
gcagcgctacatggagcgtcgcttc

SEQ ID NO: 383576 - DNA, 25 bp, Rattus norvegicus
gcagcgctccagatgctgattggct

SEQ ID NO: 383577 - DNA, 25 bp, Rattus norvegicus
gcagcgctccagttgctgattggct

SEQ ID NO: 383578 - DNA, 25 bp, Rattus norvegicus
gcagcgctcctccaaggtgggcaac

SEQ ID NO: 383579 - DNA, 25 bp, Rattus norvegicus
gcagcgctcctcgaaggtgggcaac

SEQ ID NO: 383580 - DNA, 25 bp, Rattus norvegicus
gcagcgctccttattggatgcatat

SEQ ID NO: 383581 - DNA, 25 bp, Rattus norvegicus
gcagcgctcctttttggatgcatat

SEQ ID NO: 383582 - DNA, 25 bp, Rattus norvegicus
gcagcgctgcccaggatgaatgtga

SEQ ID NO: 383583 - DNA, 25 bp, Rattus norvegicus
gcagcgctgccctggatgaatgtga

SEQ ID NO: 383584 - DNA, 25 bp, Rattus norvegicus
gcagcgctggttagagcctgtccca

SEQ ID NO: 383585 - DNA, 25 bp, Rattus norvegicus
gcagcgctggtttgagcctgtccca

SEQ ID NO: 383586 - DNA, 25 bp, Rattus norvegicus
gcagcgcttctgaaccgtgataatc

SEQ ID NO: 383587 - DNA, 25 bp, Rattus norvegicus
gcagcgcttctgtaccgtgataatc

SEQ ID NO: 383588 - DNA, 25 bp, Rattus norvegicus
gcagcggaacttaaggtcagccaca

SEQ ID NO: 383589 - DNA, 25 bp, Rattus norvegicus
gcagcggaactttaggtcagccaca

SEQ ID NO: 383590 - DNA, 25 bp, Rattus norvegicus
gcagcggatggcattctttagctta

SEQ ID NO: 383591 - DNA, 25 bp, Rattus norvegicus
gcagcggatggctttctttagctta

SEQ ID NO: 383592 - DNA, 25 bp, Rattus norvegicus
gcagcggcagccaggtgtccatgca

SEQ ID NO: 383593 - DNA, 25 bp, Rattus norvegicus
gcagcggcagcctggtgtccatgca

SEQ ID NO: 383594 - DNA, 25 bp, Rattus norvegicus
gcagcggccatccagggagacctta

SEQ ID NO: 383595 - DNA, 25 bp, Rattus norvegicus
gcagcggccatcgagggagacctta

SEQ ID NO: 383596 - DNA, 25 bp, Rattus norvegicus
gcagcggccgtcctgggaaacttaa

SEQ ID NO: 383597 - DNA, 25 bp, Rattus norvegicus
gcagcggccgtcgtgggaaacttaa

SEQ ID NO: 383598 - DNA, 25 bp, Rattus norvegicus
gcagcggcgcacagagttcaagtca

SEQ ID NO: 383599 - DNA, 25 bp, Rattus norvegicus
gcagcggcgcactgagttcaagtca

SEQ ID NO: 383600 - DNA, 25 bp, Rattus norvegicus
gcagcgggaagtcggcccctggctg

SEQ ID NO: 383601 - DNA, 25 bp, Rattus norvegicus
gcagcgggaagtgggcccctggctg

SEQ ID NO: 383602 - DNA, 25 bp, Rattus norvegicus
gcagcgggcatcacggtgcaacatg

SEQ ID NO: 383603 - DNA, 25 bp, Rattus norvegicus
gcagcgggcatctcggtgcaacatg

SEQ ID NO: 383604 - DNA, 25 bp, Rattus norvegicus
gcagcgggtcctatagttatgtgta

SEQ ID NO: 383605 - DNA, 25 bp, Rattus norvegicus
gcagcgggtcctttagttatgtgta

SEQ ID NO: 383606 - DNA, 25 bp, Rattus norvegicus
gcagcgggtctcacctgaatgacaa

SEQ ID NO: 383607 - DNA, 25 bp, Rattus norvegicus
gcagcgggtctctcctgaatgacaa

SEQ ID NO: 383608 - DNA, 25 bp, Rattus norvegicus
gcagcggtaaaccttacaagagcaa

SEQ ID NO: 383609 - DNA, 25 bp, Rattus norvegicus
gcagcggtaaacgttacaagagcaa

SEQ ID NO: 383610 - DNA, 25 bp, Rattus norvegicus
gcagcggtggccaagtcctctgtcc

SEQ ID NO: 383611 - DNA, 25 bp, Rattus norvegicus
gcagcggtggcctagtcctctgtcc

SEQ ID NO: 383612 - DNA, 25 bp, Rattus norvegicus
gcagcggtgttactatccagatcat

SEQ ID NO: 383613 - DNA, 25 bp, Rattus norvegicus
gcagcggtgttagtatccagatcat

SEQ ID NO: 383614 - DNA, 25 bp, Rattus norvegicus
gcagcggttgcactactggtagcta

SEQ ID NO: 383615 - DNA, 25 bp, Rattus norvegicus
gcagcggttgcagtactggtagcta

SEQ ID NO: 383616 - DNA, 25 bp, Rattus norvegicus
gcagcgtaaaccacagatcttagag

SEQ ID NO: 383617 - DNA, 25 bp, Rattus norvegicus
gcagcgtaaacctcagatcttagag

SEQ ID NO: 383618 - DNA, 25 bp, Rattus norvegicus
gcagcgtaaagcattgaacacacac

SEQ ID NO: 383619 - DNA, 25 bp, Rattus norvegicus
gcagcgtaaagctttgaacacacac

SEQ ID NO: 383620 - DNA, 25 bp, Rattus norvegicus
gcagcgtaaatcaatctcgtgtgga

SEQ ID NO: 383621 - DNA, 25 bp, Rattus norvegicus
gcagcgtaaatctatctcgtgtgga

SEQ ID NO: 383622 - DNA, 25 bp, Rattus norvegicus
gcagcgtacacgagtaatcagtcac

SEQ ID NO: 383623 - DNA, 25 bp, Rattus norvegicus
gcagcgtacacgtgtaatcagtcac

SEQ ID NO: 383624 - DNA, 25 bp, Rattus norvegicus
gcagcgtaggtgatgctgtacatca

SEQ ID NO: 383625 - DNA, 25 bp, Rattus norvegicus
gcagcgtaggtgttgctgtacatca

SEQ ID NO: 383626 - DNA, 25 bp, Rattus norvegicus
gcagcgtattcaccattcttgaagt

SEQ ID NO: 383627 - DNA, 25 bp, Rattus norvegicus
gcagcgtattcagcattcttgaagt

SEQ ID NO: 383628 - DNA, 25 bp, Rattus norvegicus
gcagcgtcacttcccagtgtggata

SEQ ID NO: 383629 - DNA, 25 bp, Rattus norvegicus
gcagcgtcacttgccagtgtggata

SEQ ID NO: 383630 - DNA, 25 bp, Rattus norvegicus
gcagcgtcagatccctttgagtaca

SEQ ID NO: 383631 - DNA, 25 bp, Rattus norvegicus
gcagcgtcagatgcctttgagtaca

SEQ ID NO: 383632 - DNA, 25 bp, Rattus norvegicus
gcagcgtccccaaggatagaatctt

SEQ ID NO: 383633 - DNA, 25 bp, Rattus norvegicus
gcagcgtccccatggatagaatctt

SEQ ID NO: 383634 - DNA, 25 bp, Rattus norvegicus
gcagcgtctctgattctgagtggaa

SEQ ID NO: 383635 - DNA, 25 bp, Rattus norvegicus
gcagcgtctctgtttctgagtggaa

SEQ ID NO: 383636 - DNA, 25 bp, Rattus norvegicus
gcagcgtgcgtcattattttacatt

SEQ ID NO: 383637 - DNA, 25 bp, Rattus norvegicus
gcagcgtgcgtctttattttacatt

SEQ ID NO: 383638 - DNA, 25 bp, Rattus norvegicus
gcagcgtggatgacactttttgtaa

SEQ ID NO: 383639 - DNA, 25 bp, Rattus norvegicus
gcagcgtggatgtcactttttgtaa

SEQ ID NO: 383640 - DNA, 25 bp, Rattus norvegicus
gcagcgtgtagcatctgttggtgat

SEQ ID NO: 383641 - DNA, 25 bp, Rattus norvegicus
gcagcgtgtagcttctgttggtgat

SEQ ID NO: 383642 - DNA, 25 bp, Rattus norvegicus
gcagcgtgtgctacctcacagggaa

SEQ ID NO: 383643 - DNA, 25 bp, Rattus norvegicus
gcagcgtgtgctcggctaggtgcga

SEQ ID NO: 383644 - DNA, 25 bp, Rattus norvegicus
gcagcgtgtgctgggctaggtgcga

SEQ ID NO: 383645 - DNA, 25 bp, Rattus norvegicus
gcagcgtgtgcttcctcacagggaa

SEQ ID NO: 383646 - DNA, 25 bp, Rattus norvegicus
gcagcgtgtgttaccagatggctat

SEQ ID NO: 383647 - DNA, 25 bp, Rattus norvegicus
gcagcgtgtgtttccagatggctat

SEQ ID NO: 383648 - DNA, 25 bp, Rattus norvegicus
gcagcgttcgataaccttaactgtt

SEQ ID NO: 383649 - DNA, 25 bp, Rattus norvegicus
gcagcgttcgattaccttaactgtt

SEQ ID NO: 383650 - DNA, 25 bp, Rattus norvegicus
gcagcgttcttacgccagtggacta

SEQ ID NO: 383651 - DNA, 25 bp, Rattus norvegicus
gcagcgttcttaggccagtggacta

SEQ ID NO: 383652 - DNA, 25 bp, Rattus norvegicus
gcagcgtttcaaatgggcttttagc

SEQ ID NO: 383653 - DNA, 25 bp, Rattus norvegicus
gcagcgtttcaattgggcttttagc

SEQ ID NO: 383654 - DNA, 25 bp, Rattus norvegicus
gcagcgttttcactataggcgcaaa

SEQ ID NO: 383655 - DNA, 25 bp, Rattus norvegicus
gcagcgttttcagtataggcgcaaa

SEQ ID NO: 383656 - DNA, 25 bp, Rattus norvegicus
gcagcgtttttgagcgtaacgggat

SEQ ID NO: 383657 - DNA, 25 bp, Rattus norvegicus
gcagcgtttttgtgcgtaacgggat

SEQ ID NO: 383658 - DNA, 25 bp, Rattus norvegicus
gcagctaaattcaccagttccatat

SEQ ID NO: 383659 - DNA, 25 bp, Rattus norvegicus
gcagctaaattctccagttccatat

SEQ ID NO: 383660 - DNA, 25 bp, Rattus norvegicus
gcagctaatgaacgagccctccatt

SEQ ID NO: 383661 - DNA, 25 bp, Rattus norvegicus
gcagctaatgaaggagccctccatt

SEQ ID NO: 383662 - DNA, 25 bp, Rattus norvegicus
gcagctaattggacgggcattctgt

SEQ ID NO: 383663 - DNA, 25 bp, Rattus norvegicus
gcagctaattggtcgggcattctgt

SEQ ID NO: 383664 - DNA, 25 bp, Rattus norvegicus
gcagctacaaaacgagtttccagac

SEQ ID NO: 383665 - DNA, 25 bp, Rattus norvegicus
gcagctacaaaaggagtttccagac

SEQ ID NO: 383666 - DNA, 25 bp, Rattus norvegicus
gcagctacagagaaggccaaggacc

SEQ ID NO: 383667 - DNA, 25 bp, Rattus norvegicus
gcagctacagagtaggccaaggacc

SEQ ID NO: 383668 - DNA, 25 bp, Rattus norvegicus
gcagctacagcaaatgggattcccc

SEQ ID NO: 383669 - DNA, 25 bp, Rattus norvegicus
gcagctacagcatatgggattcccc

SEQ ID NO: 383670 - DNA, 25 bp, Rattus norvegicus
gcagctacagcgcacttcagggaac

SEQ ID NO: 383671 - DNA, 25 bp, Rattus norvegicus
gcagctacagcggacttcagggaac

SEQ ID NO: 383672 - DNA, 25 bp, Rattus norvegicus
gcagctacagctatggcccaatggt

SEQ ID NO: 383673 - DNA, 25 bp, Rattus norvegicus
gcagctacagctttggcccaatggt

SEQ ID NO: 383674 - DNA, 25 bp, Rattus norvegicus
gcagctacatgcagtgagaccctat

SEQ ID NO: 383675 - DNA, 25 bp, Rattus norvegicus
gcagctacatgctgtgagaccctat

SEQ ID NO: 383676 - DNA, 25 bp, Rattus norvegicus
gcagctacctataacggttatgcgt

SEQ ID NO: 383677 - DNA, 25 bp, Rattus norvegicus
gcagctacctattacggttatgcgt

SEQ ID NO: 383678 - DNA, 25 bp, Rattus norvegicus
gcagctactctgagcgcgtgggcgc

SEQ ID NO: 383679 - DNA, 25 bp, Rattus norvegicus
gcagctactctgtgcgcgtgggcgc

SEQ ID NO: 383680 - DNA, 25 bp, Rattus norvegicus
gcagctagaacaccttttttaacgt

SEQ ID NO: 383681 - DNA, 25 bp, Rattus norvegicus
gcagctagaacagcttttttaacgt

SEQ ID NO: 383682 - DNA, 25 bp, Rattus norvegicus
gcagctagaccaatgtgaaatgatt

SEQ ID NO: 383683 - DNA, 25 bp, Rattus norvegicus
gcagctagaccattgtgaaatgatt

SEQ ID NO: 383684 - DNA, 25 bp, Rattus norvegicus
gcagctagagacacagggccaccat

SEQ ID NO: 383685 - DNA, 25 bp, Rattus norvegicus
gcagctagagactcagggccaccat

SEQ ID NO: 383686 - DNA, 25 bp, Rattus norvegicus
gcagctagcctcaagatttagacta

SEQ ID NO: 383687 - DNA, 25 bp, Rattus norvegicus
gcagctagcctctagatttagacta

SEQ ID NO: 383688 - DNA, 25 bp, Rattus norvegicus
gcagctagcttaaaagggtctcata

SEQ ID NO: 383689 - DNA, 25 bp, Rattus norvegicus
gcagctagcttataagggtctcata

SEQ ID NO: 383690 - DNA, 25 bp, Rattus norvegicus
gcagctaggagcagagtcaagactt

SEQ ID NO: 383691 - DNA, 25 bp, Rattus norvegicus
gcagctaggagctgagtcaagactt

SEQ ID NO: 383692 - DNA, 25 bp, Rattus norvegicus
gcagctagtgatacttctgtcatac

SEQ ID NO: 383693 - DNA, 25 bp, Rattus norvegicus
gcagctagtgattcttctgtcatac

SEQ ID NO: 383694 - DNA, 25 bp, Rattus norvegicus
gcagctagtggcaggcgatcgatca

SEQ ID NO: 383695 - DNA, 25 bp, Rattus norvegicus
gcagctagtggctggcgatcgatca

SEQ ID NO: 383696 - DNA, 25 bp, Rattus norvegicus
gcagctatcagtatacaagttccct

SEQ ID NO: 383697 - DNA, 25 bp, Rattus norvegicus
gcagctatcagtttacaagttccct

SEQ ID NO: 383698 - DNA, 25 bp, Rattus norvegicus
gcagctatgcagaatccttgtatgt

SEQ ID NO: 383699 - DNA, 25 bp, Rattus norvegicus
gcagctatgcagtatccttgtatgt

SEQ ID NO: 383700 - DNA, 25 bp, Rattus norvegicus
gcagctatgccacacaacactgttt

SEQ ID NO: 383701 - DNA, 25 bp, Rattus norvegicus
gcagctatgccagacaacactgttt

SEQ ID NO: 383702 - DNA, 25 bp, Rattus norvegicus
gcagctatgggtcttggccgcaaat

SEQ ID NO: 383703 - DNA, 25 bp, Rattus norvegicus
gcagctatgggtgttggccgcaaat

SEQ ID NO: 383704 - DNA, 25 bp, Rattus norvegicus
gcagctatggtgctgtgtctcagat

SEQ ID NO: 383705 - DNA, 25 bp, Rattus norvegicus
gcagctatggtggtgtgtctcagat

SEQ ID NO: 383706 - DNA, 25 bp, Rattus norvegicus
gcagctattttcctaacctcagttt

SEQ ID NO: 383707 - DNA, 25 bp, Rattus norvegicus
gcagctattttcgtaacctcagttt

SEQ ID NO: 383708 - DNA, 25 bp, Rattus norvegicus
gcagctcaaaatattctgggttttt

SEQ ID NO: 383709 - DNA, 25 bp, Rattus norvegicus
gcagctcaaaattttctgggttttt

SEQ ID NO: 383710 - DNA, 25 bp, Rattus norvegicus
gcagctcaaccaacttcttattttt

SEQ ID NO: 383711 - DNA, 25 bp, Rattus norvegicus
gcagctcaaccatcttcttattttt

SEQ ID NO: 383712 - DNA, 25 bp, Rattus norvegicus
gcagctcaactgattggaacgccaa

SEQ ID NO: 383713 - DNA, 25 bp, Rattus norvegicus
gcagctcaactgtttggaacgccaa

SEQ ID NO: 383714 - DNA, 25 bp, Rattus norvegicus
gcagctcacaaacgcctttttctgc

SEQ ID NO: 383715 - DNA, 25 bp, Rattus norvegicus
gcagctcacaaaggcctttttctgc

SEQ ID NO: 383716 - DNA, 25 bp, Rattus norvegicus
gcagctcacaatcatttgttcaagg

SEQ ID NO: 383717 - DNA, 25 bp, Rattus norvegicus
gcagctcacaatgatttgttcaagg

SEQ ID NO: 383718 - DNA, 25 bp, Rattus norvegicus
gcagctcacattacggttcgtcaag

SEQ ID NO: 383719 - DNA, 25 bp, Rattus norvegicus
gcagctcacatttcggttcgtcaag

SEQ ID NO: 383720 - DNA, 25 bp, Rattus norvegicus
gcagctcaccaaacatgggcgtatt

SEQ ID NO: 383721 - DNA, 25 bp, Rattus norvegicus
gcagctcaccaatcatgggcgtatt

SEQ ID NO: 383722 - DNA, 25 bp, Rattus norvegicus
gcagctcacggaccctgtttacaaa

SEQ ID NO: 383723 - DNA, 25 bp, Rattus norvegicus
gcagctcacggagcctgtttacaaa

SEQ ID NO: 383724 - DNA, 25 bp, Rattus norvegicus
gcagctcactcaattggtggcccaa

SEQ ID NO: 383725 - DNA, 25 bp, Rattus norvegicus
gcagctcactcatttggtggcccaa

SEQ ID NO: 383726 - DNA, 25 bp, Rattus norvegicus
gcagctcagactcccagaaacaagg

SEQ ID NO: 383727 - DNA, 25 bp, Rattus norvegicus
gcagctcagactgccagaaacaagg

SEQ ID NO: 383728 - DNA, 25 bp, Rattus norvegicus
gcagctcaggtaccagggacgacct

SEQ ID NO: 383729 - DNA, 25 bp, Rattus norvegicus
gcagctcaggtagcagggacgacct

SEQ ID NO: 383730 - DNA, 25 bp, Rattus norvegicus
gcagctcagtttagtgtagcgcctc

SEQ ID NO: 383731 - DNA, 25 bp, Rattus norvegicus
gcagctcagttttgtgtagcgcctc

SEQ ID NO: 383732 - DNA, 25 bp, Rattus norvegicus
gcagctcatcagcaatggccaggtt

SEQ ID NO: 383733 - DNA, 25 bp, Rattus norvegicus
gcagctcatcaggaatggccaggtt

SEQ ID NO: 383734 - DNA, 25 bp, Rattus norvegicus
gcagctcatgacaccctcataaaga

SEQ ID NO: 383735 - DNA, 25 bp, Rattus norvegicus
gcagctcatgactccctcataaaga

SEQ ID NO: 383736 - DNA, 25 bp, Rattus norvegicus
gcagctcatgcactctttatcacgt

SEQ ID NO: 383737 - DNA, 25 bp, Rattus norvegicus
gcagctcatgcagtctttatcacgt

SEQ ID NO: 383738 - DNA, 25 bp, Rattus norvegicus
gcagctcattatagaagatccctat

SEQ ID NO: 383739 - DNA, 25 bp, Rattus norvegicus
gcagctcattattgaagatccctat

SEQ ID NO: 383740 - DNA, 25 bp, Rattus norvegicus
gcagctcattgcaagcattcagtag

SEQ ID NO: 383741 - DNA, 25 bp, Rattus norvegicus
gcagctcattgctagcattcagtag

SEQ ID NO: 383742 - DNA, 25 bp, Rattus norvegicus
gcagctccagaaatagttgtcacat

SEQ ID NO: 383743 - DNA, 25 bp, Rattus norvegicus
gcagctccagaattagttgtcacat

SEQ ID NO: 383744 - DNA, 25 bp, Rattus norvegicus
gcagctccagcgactcagaggcaga

SEQ ID NO: 383745 - DNA, 25 bp, Rattus norvegicus
gcagctccagcgtctcagaggcaga

SEQ ID NO: 383746 - DNA, 25 bp, Rattus norvegicus
gcagctccagtgacaaatttgtctc

SEQ ID NO: 383747 - DNA, 25 bp, Rattus norvegicus
gcagctccagtgtcaaatttgtctc

SEQ ID NO: 383748 - DNA, 25 bp, Rattus norvegicus
gcagctcccctgacacaggataaag

SEQ ID NO: 383749 - DNA, 25 bp, Rattus norvegicus
gcagctcccctgtcacaggataaag

SEQ ID NO: 383750 - DNA, 25 bp, Rattus norvegicus
gcagctcccggtaggtgaaatctca

SEQ ID NO: 383751 - DNA, 25 bp, Rattus norvegicus
gcagctcccggttggtgaaatctca

SEQ ID NO: 383752 - DNA, 25 bp, Rattus norvegicus
gcagctccctgacagcgggtctgat

SEQ ID NO: 383753 - DNA, 25 bp, Rattus norvegicus
gcagctccctgagagcgggtctgat

SEQ ID NO: 383754 - DNA, 25 bp, Rattus norvegicus
gcagctccctttccgaggagatgaa

SEQ ID NO: 383755 - DNA, 25 bp, Rattus norvegicus
gcagctccctttgcgaggagatgaa

SEQ ID NO: 383756 - DNA, 25 bp, Rattus norvegicus
gcagctccgggaacttcagaggcat

SEQ ID NO: 383757 - DNA, 25 bp, Rattus norvegicus
gcagctccgggatcttcagaggcat

SEQ ID NO: 383758 - DNA, 25 bp, Rattus norvegicus
gcagctcctaatatattcatcctta

SEQ ID NO: 383759 - DNA, 25 bp, Rattus norvegicus
gcagctcctaatttattcatcctta

SEQ ID NO: 383760 - DNA, 25 bp, Rattus norvegicus
gcagctcctgagacagttactggga

SEQ ID NO: 383761 - DNA, 25 bp, Rattus norvegicus
gcagctcctgagtcagttactggga

SEQ ID NO: 383762 - DNA, 25 bp, Rattus norvegicus
gcagctcctgcacaggacctgaaat

SEQ ID NO: 383763 - DNA, 25 bp, Rattus norvegicus
gcagctcctgcagaggacctgaaat

SEQ ID NO: 383764 - DNA, 25 bp, Rattus norvegicus
gcagctcctggaaaattgcttgatt

SEQ ID NO: 383765 - DNA, 25 bp, Rattus norvegicus
gcagctcctggaagtgccccagtga

SEQ ID NO: 383766 - DNA, 25 bp, Rattus norvegicus
gcagctcctggataattgcttgatt

SEQ ID NO: 383767 - DNA, 25 bp, Rattus norvegicus
gcagctcctggatgtgccccagtga

SEQ ID NO: 383768 - DNA, 25 bp, Rattus norvegicus
gcagctcctgggagttcttctcagg

SEQ ID NO: 383769 - DNA, 25 bp, Rattus norvegicus
gcagctcctgggtgttcttctcagg

SEQ ID NO: 383770 - DNA, 25 bp, Rattus norvegicus
gcagctcctggtcactggcatcgag

SEQ ID NO: 383771 - DNA, 25 bp, Rattus norvegicus
gcagctcctggtcatggtgatattt

SEQ ID NO: 383772 - DNA, 25 bp, Rattus norvegicus
gcagctcctggtgactggcatcgag

SEQ ID NO: 383773 - DNA, 25 bp, Rattus norvegicus
gcagctcctggtgatggtgatattt

SEQ ID NO: 383774 - DNA, 25 bp, Rattus norvegicus
gcagctcctttcaaatatacatttc

SEQ ID NO: 383775 - DNA, 25 bp, Rattus norvegicus
gcagctcctttctaatatacatttc

SEQ ID NO: 383776 - DNA, 25 bp, Rattus norvegicus
gcagctcgagaactgctggcgataa

SEQ ID NO: 383777 - DNA, 25 bp, Rattus norvegicus
gcagctcgagaagtgctggcgataa

SEQ ID NO: 383778 - DNA, 25 bp, Rattus norvegicus
gcagctcgatcaatgatgctccttc

SEQ ID NO: 383779 - DNA, 25 bp, Rattus norvegicus
gcagctcgatcattgatgctccttc

SEQ ID NO: 383780 - DNA, 25 bp, Rattus norvegicus
gcagctcggagactgtgcttttatt

SEQ ID NO: 383781 - DNA, 25 bp, Rattus norvegicus
gcagctcggagagtgtgcttttatt

SEQ ID NO: 383782 - DNA, 25 bp, Rattus norvegicus
gcagctctaagtagcccacgaggta

SEQ ID NO: 383783 - DNA, 25 bp, Rattus norvegicus
gcagctctaagttgcccacgaggta

SEQ ID NO: 383784 - DNA, 25 bp, Rattus norvegicus
gcagctctactgaggtatttctaca

SEQ ID NO: 383785 - DNA, 25 bp, Rattus norvegicus
gcagctctactgtggtatttctaca

SEQ ID NO: 383786 - DNA, 25 bp, Rattus norvegicus
gcagctctcagaaatcatggaacgg

SEQ ID NO: 383787 - DNA, 25 bp, Rattus norvegicus
gcagctctcagatatcatggaacgg

SEQ ID NO: 383788 - DNA, 25 bp, Rattus norvegicus
gcagctctccttagttctgggatat

SEQ ID NO: 383789 - DNA, 25 bp, Rattus norvegicus
gcagctctcctttgttctgggatat

SEQ ID NO: 383790 - DNA, 25 bp, Rattus norvegicus
gcagctctcgtgatgttatctatta

SEQ ID NO: 383791 - DNA, 25 bp, Rattus norvegicus
gcagctctcgtgttgttatctatta

SEQ ID NO: 383792 - DNA, 25 bp, Rattus norvegicus
gcagctctcgttcctcttaagtgaa

SEQ ID NO: 383793 - DNA, 25 bp, Rattus norvegicus
gcagctctcgttgctcttaagtgaa

SEQ ID NO: 383794 - DNA, 25 bp, Rattus norvegicus
gcagctctctctcgccaagttgtaa

SEQ ID NO: 383795 - DNA, 25 bp, Rattus norvegicus
gcagctctctctggccaagttgtaa

SEQ ID NO: 383796 - DNA, 25 bp, Rattus norvegicus
gcagctctgaagacttactttcttt

SEQ ID NO: 383797 - DNA, 25 bp, Rattus norvegicus
gcagctctgaagtcttactttcttt

SEQ ID NO: 383798 - DNA, 25 bp, Rattus norvegicus
gcagctctgagaacacttgtttgtt

SEQ ID NO: 383799 - DNA, 25 bp, Rattus norvegicus
gcagctctgagatcacttgtttgtt

SEQ ID NO: 383800 - DNA, 25 bp, Rattus norvegicus
gcagctctgcatcctgggaactgga

SEQ ID NO: 383801 - DNA, 25 bp, Rattus norvegicus
gcagctctgcatgctgggaactgga

SEQ ID NO: 383802 - DNA, 25 bp, Rattus norvegicus
gcagctctggaaatgccacgtctga

SEQ ID NO: 383803 - DNA, 25 bp, Rattus norvegicus
gcagctctggaattgccacgtctga

SEQ ID NO: 383804 - DNA, 25 bp, Rattus norvegicus
gcagctcttagaaactctgaggcca

SEQ ID NO: 383805 - DNA, 25 bp, Rattus norvegicus
gcagctcttagatactctgaggcca

SEQ ID NO: 383806 - DNA, 25 bp, Rattus norvegicus
gcagctcttatgaactcttgtgtgg

SEQ ID NO: 383807 - DNA, 25 bp, Rattus norvegicus
gcagctcttatgtactcttgtgtgg

SEQ ID NO: 383808 - DNA, 25 bp, Rattus norvegicus
gcagctcttgctactaaatacagtc

SEQ ID NO: 383809 - DNA, 25 bp, Rattus norvegicus
gcagctcttgcttctaaatacagtc

SEQ ID NO: 383810 - DNA, 25 bp, Rattus norvegicus
gcagctgaagacaggttttctgata

SEQ ID NO: 383811 - DNA, 25 bp, Rattus norvegicus
gcagctgaagactggttttctgata

SEQ ID NO: 383812 - DNA, 25 bp, Rattus norvegicus
gcagctgaaggtacacggattctaa

SEQ ID NO: 383813 - DNA, 25 bp, Rattus norvegicus
gcagctgaaggttcacggattctaa

SEQ ID NO: 383814 - DNA, 25 bp, Rattus norvegicus
gcagctgaatatagcgggtccccag

SEQ ID NO: 383815 - DNA, 25 bp, Rattus norvegicus
gcagctgaatattgcgggtccccag

SEQ ID NO: 383816 - DNA, 25 bp, Rattus norvegicus
gcagctgaatgcaccatttccaaaa

SEQ ID NO: 383817 - DNA, 25 bp, Rattus norvegicus
gcagctgaatgctccatttccaaaa

SEQ ID NO: 383818 - DNA, 25 bp, Rattus norvegicus
gcagctgacaggattataagtgtaa

SEQ ID NO: 383819 - DNA, 25 bp, Rattus norvegicus
gcagctgacaggtttataagtgtaa

SEQ ID NO: 383820 - DNA, 25 bp, Rattus norvegicus
gcagctgacatgagaaaacggcaac

SEQ ID NO: 383821 - DNA, 25 bp, Rattus norvegicus
gcagctgacatgtgaaaacggcaac

SEQ ID NO: 383822 - DNA, 25 bp, Rattus norvegicus
gcagctgagaccaggtgagtgatct

SEQ ID NO: 383823 - DNA, 25 bp, Rattus norvegicus
gcagctgagacctggtgagtgatct

SEQ ID NO: 383824 - DNA, 25 bp, Rattus norvegicus
gcagctgagatgacttctaccttta

SEQ ID NO: 383825 - DNA, 25 bp, Rattus norvegicus
gcagctgagatgtcttctaccttta

SEQ ID NO: 383826 - DNA, 25 bp, Rattus norvegicus
gcagctgagcaacatggatgtccat

SEQ ID NO: 383827 - DNA, 25 bp, Rattus norvegicus
gcagctgagcaagatggatgtccat

SEQ ID NO: 383828 - DNA, 25 bp, Rattus norvegicus
gcagctgagcccaggcactgagaga

SEQ ID NO: 383829 - DNA, 25 bp, Rattus norvegicus
gcagctgagccctggcactgagaga

SEQ ID NO: 383830 - DNA, 25 bp, Rattus norvegicus
gcagctgaggcaatcggacaaacta

SEQ ID NO: 383831 - DNA, 25 bp, Rattus norvegicus
gcagctgaggcattcggacaaacta

SEQ ID NO: 383832 - DNA, 25 bp, Rattus norvegicus
gcagctgaggtgctaggaacactta

SEQ ID NO: 383833 - DNA, 25 bp, Rattus norvegicus
gcagctgaggtggtaggaacactta

SEQ ID NO: 383834 - DNA, 25 bp, Rattus norvegicus
gcagctgagtgcactaatggccata

SEQ ID NO: 383835 - DNA, 25 bp, Rattus norvegicus
gcagctgagtgctctaatggccata

SEQ ID NO: 383836 - DNA, 25 bp, Rattus norvegicus
gcagctgatcacagcagatccggaa

SEQ ID NO: 383837 - DNA, 25 bp, Rattus norvegicus
gcagctgatcactgcagatccggaa

SEQ ID NO: 383838 - DNA, 25 bp, Rattus norvegicus
gcagctgatctcaggctctttagat

SEQ ID NO: 383839 - DNA, 25 bp, Rattus norvegicus
gcagctgatctctggctctttagat

SEQ ID NO: 383840 - DNA, 25 bp, Rattus norvegicus
gcagctgatgcccaaagttttccag

SEQ ID NO: 383841 - DNA, 25 bp, Rattus norvegicus
gcagctgatgccgaaagttttccag

SEQ ID NO: 383842 - DNA, 25 bp, Rattus norvegicus
gcagctgatgctcttctatcacaga

SEQ ID NO: 383843 - DNA, 25 bp, Rattus norvegicus
gcagctgatgctgttctatcacaga

SEQ ID NO: 383844 - DNA, 25 bp, Rattus norvegicus
gcagctgatgggaatctgtgaattt

SEQ ID NO: 383845 - DNA, 25 bp, Rattus norvegicus
gcagctgatgggtatctgtgaattt

SEQ ID NO: 383846 - DNA, 25 bp, Rattus norvegicus
gcagctgatttgctacaatgccaga

SEQ ID NO: 383847 - DNA, 25 bp, Rattus norvegicus
gcagctgatttggtacaatgccaga

SEQ ID NO: 383848 - DNA, 25 bp, Rattus norvegicus
gcagctgcaaaacacaagtcttcct

SEQ ID NO: 383849 - DNA, 25 bp, Rattus norvegicus
gcagctgcaaaagacaagtcttcct

SEQ ID NO: 383850 - DNA, 25 bp, Rattus norvegicus
gcagctgcaacaaccagtgctcctg

SEQ ID NO: 383851 - DNA, 25 bp, Rattus norvegicus
gcagctgcaacatccagtgctcctg

SEQ ID NO: 383852 - DNA, 25 bp, Rattus norvegicus
gcagctgcacctagaatacctcagg

SEQ ID NO: 383853 - DNA, 25 bp, Rattus norvegicus
gcagctgcaccttgaatacctcagg

SEQ ID NO: 383854 - DNA, 25 bp, Rattus norvegicus
gcagctgcagaaccacacaggactt

SEQ ID NO: 383855 - DNA, 25 bp, Rattus norvegicus
gcagctgcagaagcacacaggactt

SEQ ID NO: 383856 - DNA, 25 bp, Rattus norvegicus
gcagctgcagatcttgcacagacag

SEQ ID NO: 383857 - DNA, 25 bp, Rattus norvegicus
gcagctgcagatgttgcacagacag

SEQ ID NO: 383858 - DNA, 25 bp, Rattus norvegicus
gcagctgcagcaccgaccacagcgg

SEQ ID NO: 383859 - DNA, 25 bp, Rattus norvegicus
gcagctgcagcagcgaccacagcgg

SEQ ID NO: 383860 - DNA, 25 bp, Rattus norvegicus
gcagctgcagccacaaaatttttaa

SEQ ID NO: 383861 - DNA, 25 bp, Rattus norvegicus
gcagctgcagcctcaaaatttttaa

SEQ ID NO: 383862 - DNA, 25 bp, Rattus norvegicus
gcagctgcaggactaagtctgccaa

SEQ ID NO: 383863 - DNA, 25 bp, Rattus norvegicus
gcagctgcaggagtaagtctgccaa

SEQ ID NO: 383864 - DNA, 25 bp, Rattus norvegicus
gcagctgcatggattttagtgccta

SEQ ID NO: 383865 - DNA, 25 bp, Rattus norvegicus
gcagctgcatggtttttagtgccta

SEQ ID NO: 383866 - DNA, 25 bp, Rattus norvegicus
gcagctgccaaacgtgcctatgtgc

SEQ ID NO: 383867 - DNA, 25 bp, Rattus norvegicus
gcagctgccaaaggtgcctatgtgc

SEQ ID NO: 383868 - DNA, 25 bp, Rattus norvegicus
gcagctgccattacatggacactga

SEQ ID NO: 383869 - DNA, 25 bp, Rattus norvegicus
gcagctgccatttcatggacactga

SEQ ID NO: 383870 - DNA, 25 bp, Rattus norvegicus
gcagctgccgacagtggccacacgg

SEQ ID NO: 383871 - DNA, 25 bp, Rattus norvegicus
gcagctgccgactgtggccacacgg

SEQ ID NO: 383872 - DNA, 25 bp, Rattus norvegicus
gcagctgccgcaacgaatgcatatt

SEQ ID NO: 383873 - DNA, 25 bp, Rattus norvegicus
gcagctgccgcatcgaatgcatatt

SEQ ID NO: 383874 - DNA, 25 bp, Rattus norvegicus
gcagctgcctgtcgtatcacaagaa

SEQ ID NO: 383875 - DNA, 25 bp, Rattus norvegicus
gcagctgcctgtggtatcacaagaa

SEQ ID NO: 383876 - DNA, 25 bp, Rattus norvegicus
gcagctgccttgcacttgaatccat

SEQ ID NO: 383877 - DNA, 25 bp, Rattus norvegicus
gcagctgccttggacttgaatccat

SEQ ID NO: 383878 - DNA, 25 bp, Rattus norvegicus
gcagctgcgaatactgtatctcgat

SEQ ID NO: 383879 - DNA, 25 bp, Rattus norvegicus
gcagctgcgaattctgtatctcgat

SEQ ID NO: 383880 - DNA, 25 bp, Rattus norvegicus
gcagctgcgcatctctataaactca

SEQ ID NO: 383881 - DNA, 25 bp, Rattus norvegicus
gcagctgcgcatgtctataaactca

SEQ ID NO: 383882 - DNA, 25 bp, Rattus norvegicus
gcagctgcggtcacagatgaccagg

SEQ ID NO: 383883 - DNA, 25 bp, Rattus norvegicus
gcagctgcggtctcagatgaccagg

SEQ ID NO: 383884 - DNA, 25 bp, Rattus norvegicus
gcagctgctacacccgcacggtggg

SEQ ID NO: 383885 - DNA, 25 bp, Rattus norvegicus
gcagctgctacagccgcacggtggg

SEQ ID NO: 383886 - DNA, 25 bp, Rattus norvegicus
gcagctgctacccttatgggtgtga

SEQ ID NO: 383887 - DNA, 25 bp, Rattus norvegicus
gcagctgctaccgttatgggtgtga

SEQ ID NO: 383888 - DNA, 25 bp, Rattus norvegicus
gcagctgctacgcactggcagaaaa

SEQ ID NO: 383889 - DNA, 25 bp, Rattus norvegicus
gcagctgctacggactggcagaaaa

SEQ ID NO: 383890 - DNA, 25 bp, Rattus norvegicus
gcagctgctagcacagcgcgctgga

SEQ ID NO: 383891 - DNA, 25 bp, Rattus norvegicus
gcagctgctagctcagcgcgctgga

SEQ ID NO: 383892 - DNA, 25 bp, Rattus norvegicus
gcagctgctaggacagaggcttctt

SEQ ID NO: 383893 - DNA, 25 bp, Rattus norvegicus
gcagctgctaggtcagaggcttctt

SEQ ID NO: 383894 - DNA, 25 bp, Rattus norvegicus
gcagctgctcacagcaggagaggtt

SEQ ID NO: 383895 - DNA, 25 bp, Rattus norvegicus
gcagctgctcactgcaggagaggtt

SEQ ID NO: 383896 - DNA, 25 bp, Rattus norvegicus
gcagctgctcagaaccacacaggtt

SEQ ID NO: 383897 - DNA, 25 bp, Rattus norvegicus
gcagctgctcagtaccacacaggtt

SEQ ID NO: 383898 - DNA, 25 bp, Rattus norvegicus
gcagctgctgaaacacgattggaaa

SEQ ID NO: 383899 - DNA, 25 bp, Rattus norvegicus
gcagctgctgaatcacgattggaaa

SEQ ID NO: 383900 - DNA, 25 bp, Rattus norvegicus
gcagctgctggactgtctagtaatc

SEQ ID NO: 383901 - DNA, 25 bp, Rattus norvegicus
gcagctgctggagtgtctagtaatc

SEQ ID NO: 383902 - DNA, 25 bp, Rattus norvegicus
gcagctgctgtaagctgcttggttg

SEQ ID NO: 383903 - DNA, 25 bp, Rattus norvegicus
gcagctgctgtatgctgcttggttg

SEQ ID NO: 383904 - DNA, 25 bp, Rattus norvegicus
gcagctgctgtcacctattgctggc

SEQ ID NO: 383905 - DNA, 25 bp, Rattus norvegicus
gcagctgctgtctcctattgctggc

SEQ ID NO: 383906 - DNA, 25 bp, Rattus norvegicus
gcagctggacaccaagctcatccgt

SEQ ID NO: 383907 - DNA, 25 bp, Rattus norvegicus
gcagctggacacgaagctcatccgt

SEQ ID NO: 383908 - DNA, 25 bp, Rattus norvegicus
gcagctggacagcagagcccgactt

SEQ ID NO: 383909 - DNA, 25 bp, Rattus norvegicus
gcagctggacaggagagcccgactt

SEQ ID NO: 383910 - DNA, 25 bp, Rattus norvegicus
gcagctggacccacgtaaattgttg

SEQ ID NO: 383911 - DNA, 25 bp, Rattus norvegicus
gcagctggaccctcgtaaattgttg

SEQ ID NO: 383912 - DNA, 25 bp, Rattus norvegicus
gcagctggagctcaactctgagtct

SEQ ID NO: 383913 - DNA, 25 bp, Rattus norvegicus
gcagctggagctgaactctgagtct

SEQ ID NO: 383914 - DNA, 25 bp, Rattus norvegicus
gcagctggaggcatcttctatggga

SEQ ID NO: 383915 - DNA, 25 bp, Rattus norvegicus
gcagctggaggcttcttctatggga

SEQ ID NO: 383916 - DNA, 25 bp, Rattus norvegicus
gcagctggatgcacaggacacggca

SEQ ID NO: 383917 - DNA, 25 bp, Rattus norvegicus
gcagctggatgctcaggacacggca

SEQ ID NO: 383918 - DNA, 25 bp, Rattus norvegicus
gcagctggcaagatacctggcagaa

SEQ ID NO: 383919 - DNA, 25 bp, Rattus norvegicus
gcagctggcaagttacctggcagaa

SEQ ID NO: 383920 - DNA, 25 bp, Rattus norvegicus
gcagctggccatactggacacgtta

SEQ ID NO: 383921 - DNA, 25 bp, Rattus norvegicus
gcagctggccattctggacacgtta

SEQ ID NO: 383922 - DNA, 25 bp, Rattus norvegicus
gcagctggcctgacccttgtagatg

SEQ ID NO: 383923 - DNA, 25 bp, Rattus norvegicus
gcagctggcctgtcccttgtagatg

SEQ ID NO: 383924 - DNA, 25 bp, Rattus norvegicus
gcagctggcgttcgtacagacacca

SEQ ID NO: 383925 - DNA, 25 bp, Rattus norvegicus
gcagctggcgttggtacagacacca

SEQ ID NO: 383926 - DNA, 25 bp, Rattus norvegicus
gcagctggctagcatttctcaggaa

SEQ ID NO: 383927 - DNA, 25 bp, Rattus norvegicus
gcagctggctaggatttctcaggaa

SEQ ID NO: 383928 - DNA, 25 bp, Rattus norvegicus
gcagctggctccagaaggaaaagag

SEQ ID NO: 383929 - DNA, 25 bp, Rattus norvegicus
gcagctggctcctgaaggaaaagag

SEQ ID NO: 383930 - DNA, 25 bp, Rattus norvegicus
gcagctggctcgactgtgcacgaag

SEQ ID NO: 383931 - DNA, 25 bp, Rattus norvegicus
gcagctggctcgtctgtgcacgaag

SEQ ID NO: 383932 - DNA, 25 bp, Rattus norvegicus
gcagctggctctagaaggaacatag

SEQ ID NO: 383933 - DNA, 25 bp, Rattus norvegicus
gcagctggctcttgaaggaacatag

SEQ ID NO: 383934 - DNA, 25 bp, Rattus norvegicus
gcagctggctttcggcttatgcagt

SEQ ID NO: 383935 - DNA, 25 bp, Rattus norvegicus
gcagctggctttgggcttatgcagt

SEQ ID NO: 383936 - DNA, 25 bp, Rattus norvegicus
gcagctgggtttctcctggatgtat

SEQ ID NO: 383937 - DNA, 25 bp, Rattus norvegicus
gcagctgggtttgtcctggatgtat

SEQ ID NO: 383938 - DNA, 25 bp, Rattus norvegicus
gcagctggtacaacgaggaacctct

SEQ ID NO: 383939 - DNA, 25 bp, Rattus norvegicus
gcagctggtacatcgaggaacctct

SEQ ID NO: 383940 - DNA, 25 bp, Rattus norvegicus
gcagctggtgcaaagcgtcttttca

SEQ ID NO: 383941 - DNA, 25 bp, Rattus norvegicus
gcagctggtgcatagcgtcttttca

SEQ ID NO: 383942 - DNA, 25 bp, Rattus norvegicus
gcagctggtgtgaagttcagagttc

SEQ ID NO: 383943 - DNA, 25 bp, Rattus norvegicus
gcagctggtgtgtagttcagagttc

SEQ ID NO: 383944 - DNA, 25 bp, Rattus norvegicus
gcagctggttaaatcctctaactgt

SEQ ID NO: 383945 - DNA, 25 bp, Rattus norvegicus
gcagctggttaattcctctaactgt

SEQ ID NO: 383946 - DNA, 25 bp, Rattus norvegicus
gcagctgtacccaagctggtgggca

SEQ ID NO: 383947 - DNA, 25 bp, Rattus norvegicus
gcagctgtaccctagctggtgggca

SEQ ID NO: 383948 - DNA, 25 bp, Rattus norvegicus
gcagctgtagatactcactgtgcct

SEQ ID NO: 383949 - DNA, 25 bp, Rattus norvegicus
gcagctgtagattctcactgtgcct

SEQ ID NO: 383950 - DNA, 25 bp, Rattus norvegicus
gcagctgtatttcaacgaatccatt

SEQ ID NO: 383951 - DNA, 25 bp, Rattus norvegicus
gcagctgtatttgaacgaatccatt

SEQ ID NO: 383952 - DNA, 25 bp, Rattus norvegicus
gcagctgtcacactacataacttaa

SEQ ID NO: 383953 - DNA, 25 bp, Rattus norvegicus
gcagctgtcacagtacataacttaa

SEQ ID NO: 383954 - DNA, 25 bp, Rattus norvegicus
gcagctgtcagcatcttcagaggaa

SEQ ID NO: 383955 - DNA, 25 bp, Rattus norvegicus
gcagctgtcagcttcttcagaggaa

SEQ ID NO: 383956 - DNA, 25 bp, Rattus norvegicus
gcagctgtcccacgatattcatgca

SEQ ID NO: 383957 - DNA, 25 bp, Rattus norvegicus
gcagctgtcccaggatattcatgca

SEQ ID NO: 383958 - DNA, 25 bp, Rattus norvegicus
gcagctgtcgacattgtaatttagg

SEQ ID NO: 383959 - DNA, 25 bp, Rattus norvegicus
gcagctgtcgactttgtaatttagg

SEQ ID NO: 383960 - DNA, 25 bp, Rattus norvegicus
gcagctgtctccagcactgaaggca

SEQ ID NO: 383961 - DNA, 25 bp, Rattus norvegicus
gcagctgtctcctgcactgaaggca

SEQ ID NO: 383962 - DNA, 25 bp, Rattus norvegicus
gcagctgtctgtataccttcaacta

SEQ ID NO: 383963 - DNA, 25 bp, Rattus norvegicus
gcagctgtctgtatgtccacatcat

SEQ ID NO: 383964 - DNA, 25 bp, Rattus norvegicus
gcagctgtctgtttaccttcaacta

SEQ ID NO: 383965 - DNA, 25 bp, Rattus norvegicus
gcagctgtctgtttgtccacatcat

SEQ ID NO: 383966 - DNA, 25 bp, Rattus norvegicus
gcagctgtggaacttggtctctcat

SEQ ID NO: 383967 - DNA, 25 bp, Rattus norvegicus
gcagctgtggaagttggtctctcat

SEQ ID NO: 383968 - DNA, 25 bp, Rattus norvegicus
gcagctgtggagacgagctcgccct

SEQ ID NO: 383969 - DNA, 25 bp, Rattus norvegicus
gcagctgtggagtcgagctcgccct

SEQ ID NO: 383970 - DNA, 25 bp, Rattus norvegicus
gcagctgtggctaatgggatcccta

SEQ ID NO: 383971 - DNA, 25 bp, Rattus norvegicus
gcagctgtggcttatgggatcccta

SEQ ID NO: 383972 - DNA, 25 bp, Rattus norvegicus
gcagctgtgggaatagggctacctc

SEQ ID NO: 383973 - DNA, 25 bp, Rattus norvegicus
gcagctgtgggattagggctacctc

SEQ ID NO: 383974 - DNA, 25 bp, Rattus norvegicus
gcagctgtgggcacatgttgtcatg

SEQ ID NO: 383975 - DNA, 25 bp, Rattus norvegicus
gcagctgtgggctcatgttgtcatg

SEQ ID NO: 383976 - DNA, 25 bp, Rattus norvegicus
gcagctgtgggtaagactttccgaa

SEQ ID NO: 383977 - DNA, 25 bp, Rattus norvegicus
gcagctgtgggttagactttccgaa

SEQ ID NO: 383978 - DNA, 25 bp, Rattus norvegicus
gcagctgtggtgcaacttctgtagc

SEQ ID NO: 383979 - DNA, 25 bp, Rattus norvegicus
gcagctgtggtggaacttctgtagc

SEQ ID NO: 383980 - DNA, 25 bp, Rattus norvegicus
gcagctgtgtcaagggtttgcagtc

SEQ ID NO: 383981 - DNA, 25 bp, Rattus norvegicus
gcagctgtgtcatgggtttgcagtc

SEQ ID NO: 383982 - DNA, 25 bp, Rattus norvegicus
gcagctgtgtgtactggattcacta

SEQ ID NO: 383983 - DNA, 25 bp, Rattus norvegicus
gcagctgtgtgttctggattcacta

SEQ ID NO: 383984 - DNA, 25 bp, Rattus norvegicus
gcagctgttacacacgaccatgtac

SEQ ID NO: 383985 - DNA, 25 bp, Rattus norvegicus
gcagctgttacagacgaccatgtac

SEQ ID NO: 383986 - DNA, 25 bp, Rattus norvegicus
gcagctgttcgacaagatggtgagc

SEQ ID NO: 383987 - DNA, 25 bp, Rattus norvegicus
gcagctgttcgagaagatggtgagc

SEQ ID NO: 383988 - DNA, 25 bp, Rattus norvegicus
gcagctgttctcagtcggcattaga

SEQ ID NO: 383989 - DNA, 25 bp, Rattus norvegicus
gcagctgttctccaatagtcaaatt

SEQ ID NO: 383990 - DNA, 25 bp, Rattus norvegicus
gcagctgttctcgaatagtcaaatt

SEQ ID NO: 383991 - DNA, 25 bp, Rattus norvegicus
gcagctgttctctgtcggcattaga

SEQ ID NO: 383992 - DNA, 25 bp, Rattus norvegicus
gcagctgtttggaaactggttccac

SEQ ID NO: 383993 - DNA, 25 bp, Rattus norvegicus
gcagctgtttggaggccagtttaat

SEQ ID NO: 383994 - DNA, 25 bp, Rattus norvegicus
gcagctgtttggtaactggttccac

SEQ ID NO: 383995 - DNA, 25 bp, Rattus norvegicus
gcagctgtttggtggccagtttaat

SEQ ID NO: 383996 - DNA, 25 bp, Rattus norvegicus
gcagctgttttcagcataaaactaa

SEQ ID NO: 383997 - DNA, 25 bp, Rattus norvegicus
gcagctgttttctgcataaaactaa

SEQ ID NO: 383998 - DNA, 25 bp, Rattus norvegicus
gcagcttaaaacactggcttccagt

SEQ ID NO: 383999 - DNA, 25 bp, Rattus norvegicus
gcagcttaaaactctggcttccagt

SEQ ID NO: 384000 - DNA, 25 bp, Rattus norvegicus
gcagcttaaggtctaaacgagtatc

SEQ ID NO: 384001 - DNA, 25 bp, Rattus norvegicus
gcagcttaaggtgtaaacgagtatc

SEQ ID NO: 384002 - DNA, 25 bp, Rattus norvegicus
gcagcttacttgatcctggttagaa

SEQ ID NO: 384003 - DNA, 25 bp, Rattus norvegicus
gcagcttacttgttcctggttagaa

SEQ ID NO: 384004 - DNA, 25 bp, Rattus norvegicus
gcagcttagagcaggacacggagct

SEQ ID NO: 384005 - DNA, 25 bp, Rattus norvegicus
gcagcttagagctggacacggagct

SEQ ID NO: 384006 - DNA, 25 bp, Rattus norvegicus
gcagcttagccaatctgtgtttgta

SEQ ID NO: 384007 - DNA, 25 bp, Rattus norvegicus
gcagcttagccattctgtgtttgta

SEQ ID NO: 384008 - DNA, 25 bp, Rattus norvegicus
gcagcttatagtatctgtcgggtac

SEQ ID NO: 384009 - DNA, 25 bp, Rattus norvegicus
gcagcttatagtttctgtcgggtac

SEQ ID NO: 384010 - DNA, 25 bp, Rattus norvegicus
gcagcttatgaccagctcatcatag

SEQ ID NO: 384011 - DNA, 25 bp, Rattus norvegicus
gcagcttatgacgagctcatcatag

SEQ ID NO: 384012 - DNA, 25 bp, Rattus norvegicus
gcagcttatgagcatctggaccctg

SEQ ID NO: 384013 - DNA, 25 bp, Rattus norvegicus
gcagcttatgaggatctggaccctg

SEQ ID NO: 384014 - DNA, 25 bp, Rattus norvegicus
gcagcttatttaaaacaaggcctga

SEQ ID NO: 384015 - DNA, 25 bp, Rattus norvegicus
gcagcttatttataacaaggcctga

SEQ ID NO: 384016 - DNA, 25 bp, Rattus norvegicus
gcagcttcacgcacgtgtggacaaa

SEQ ID NO: 384017 - DNA, 25 bp, Rattus norvegicus
gcagcttcacgctcgtgtggacaaa

SEQ ID NO: 384018 - DNA, 25 bp, Rattus norvegicus
gcagcttcactgcctttgccaacag

SEQ ID NO: 384019 - DNA, 25 bp, Rattus norvegicus
gcagcttcactggctttgccaacag

SEQ ID NO: 384020 - DNA, 25 bp, Rattus norvegicus
gcagcttcagatacccttcagggaa

SEQ ID NO: 384021 - DNA, 25 bp, Rattus norvegicus
gcagcttcagattcccttcagggaa

SEQ ID NO: 384022 - DNA, 25 bp, Rattus norvegicus
gcagcttcagccacggagacctgag

SEQ ID NO: 384023 - DNA, 25 bp, Rattus norvegicus
gcagcttcagccctaaagatcctgg

SEQ ID NO: 384024 - DNA, 25 bp, Rattus norvegicus
gcagcttcagccgtaaagatcctgg

SEQ ID NO: 384025 - DNA, 25 bp, Rattus norvegicus
gcagcttcagcctcggagacctgag

SEQ ID NO: 384026 - DNA, 25 bp, Rattus norvegicus
gcagcttcagcgaggagccctagaa

SEQ ID NO: 384027 - DNA, 25 bp, Rattus norvegicus
gcagcttcagcgtggagccctagaa

SEQ ID NO: 384028 - DNA, 25 bp, Rattus norvegicus
gcagcttccactcccaaaggctaat

SEQ ID NO: 384029 - DNA, 25 bp, Rattus norvegicus
gcagcttccactgccaaaggctaat

SEQ ID NO: 384030 - DNA, 25 bp, Rattus norvegicus
gcagcttccatgaaatctccgaata

SEQ ID NO: 384031 - DNA, 25 bp, Rattus norvegicus
gcagcttccatgtaatctccgaata

SEQ ID NO: 384032 - DNA, 25 bp, Rattus norvegicus
gcagcttcccagaggatcagagaag

SEQ ID NO: 384033 - DNA, 25 bp, Rattus norvegicus
gcagcttcccagtggatcagagaag

SEQ ID NO: 384034 - DNA, 25 bp, Rattus norvegicus
gcagcttcctgcataatagaaacca

SEQ ID NO: 384035 - DNA, 25 bp, Rattus norvegicus
gcagcttcctgcttaatagaaacca

SEQ ID NO: 384036 - DNA, 25 bp, Rattus norvegicus
gcagcttcctgtcgacagaattcat

SEQ ID NO: 384037 - DNA, 25 bp, Rattus norvegicus
gcagcttcctgtggacagaattcat

SEQ ID NO: 384038 - DNA, 25 bp, Rattus norvegicus
gcagcttcctttcagcccagagtga

SEQ ID NO: 384039 - DNA, 25 bp, Rattus norvegicus
gcagcttcctttgagcccagagtga

SEQ ID NO: 384040 - DNA, 25 bp, Rattus norvegicus
gcagcttcgaatctactggacaaag

SEQ ID NO: 384041 - DNA, 25 bp, Rattus norvegicus
gcagcttcgaatgtactggacaaag

SEQ ID NO: 384042 - DNA, 25 bp, Rattus norvegicus
gcagcttcgccaaggctcccacggt

SEQ ID NO: 384043 - DNA, 25 bp, Rattus norvegicus
gcagcttcgccatggctcccacggt

SEQ ID NO: 384044 - DNA, 25 bp, Rattus norvegicus
gcagcttcgcgcatcacggctggat

SEQ ID NO: 384045 - DNA, 25 bp, Rattus norvegicus
gcagcttcgcgcttcacggctggat

SEQ ID NO: 384046 - DNA, 25 bp, Rattus norvegicus
gcagcttcggtcagggatggtcttc

SEQ ID NO: 384047 - DNA, 25 bp, Rattus norvegicus
gcagcttcggtctgggatggtcttc

SEQ ID NO: 384048 - DNA, 25 bp, Rattus norvegicus
gcagcttctcccctggaatgagggt

SEQ ID NO: 384049 - DNA, 25 bp, Rattus norvegicus
gcagcttctcccgtggaatgagggt

SEQ ID NO: 384050 - DNA, 25 bp, Rattus norvegicus
gcagcttctcgacttagacccagaa

SEQ ID NO: 384051 - DNA, 25 bp, Rattus norvegicus
gcagcttctcgagttagacccagaa

SEQ ID NO: 384052 - DNA, 25 bp, Rattus norvegicus
gcagcttctctacatgttcttcaag

SEQ ID NO: 384053 - DNA, 25 bp, Rattus norvegicus
gcagcttctctagatgttcttcaag

SEQ ID NO: 384054 - DNA, 25 bp, Rattus norvegicus
gcagcttctctgcatcaactgtatg

SEQ ID NO: 384055 - DNA, 25 bp, Rattus norvegicus
gcagcttctctggatcaactgtatg

SEQ ID NO: 384056 - DNA, 25 bp, Rattus norvegicus
gcagcttctgaaagaatgctttcat

SEQ ID NO: 384057 - DNA, 25 bp, Rattus norvegicus
gcagcttctgaatgaatgctttcat

SEQ ID NO: 384058 - DNA, 25 bp, Rattus norvegicus
gcagcttctgagatcattcacctaa

SEQ ID NO: 384059 - DNA, 25 bp, Rattus norvegicus
gcagcttctgagttcattcacctaa

SEQ ID NO: 384060 - DNA, 25 bp, Rattus norvegicus
gcagcttctgtcacgattttcatag

SEQ ID NO: 384061 - DNA, 25 bp, Rattus norvegicus
gcagcttctgtctcgattttcatag

SEQ ID NO: 384062 - DNA, 25 bp, Rattus norvegicus
gcagcttcttaaatctttctccaac

SEQ ID NO: 384063 - DNA, 25 bp, Rattus norvegicus
gcagcttcttaattctttctccaac

SEQ ID NO: 384064 - DNA, 25 bp, Rattus norvegicus
gcagcttcttacctttgacagcaga

SEQ ID NO: 384065 - DNA, 25 bp, Rattus norvegicus
gcagcttcttacgtttgacagcaga

SEQ ID NO: 384066 - DNA, 25 bp, Rattus norvegicus
gcagcttctttactattgtatttcc

SEQ ID NO: 384067 - DNA, 25 bp, Rattus norvegicus
gcagcttctttagtattgtatttcc

SEQ ID NO: 384068 - DNA, 25 bp, Rattus norvegicus
gcagcttctttcagtcagagagctt

SEQ ID NO: 384069 - DNA, 25 bp, Rattus norvegicus
gcagcttctttctgtcagagagctt

SEQ ID NO: 384070 - DNA, 25 bp, Rattus norvegicus
gcagcttgaacgactaaagcagaaa

SEQ ID NO: 384071 - DNA, 25 bp, Rattus norvegicus
gcagcttgaacgtctaaagcagaaa

SEQ ID NO: 384072 - DNA, 25 bp, Rattus norvegicus
gcagcttgacctatatgtgggtcct

SEQ ID NO: 384073 - DNA, 25 bp, Rattus norvegicus
gcagcttgacctttatgtgggtcct

SEQ ID NO: 384074 - DNA, 25 bp, Rattus norvegicus
gcagcttgactcatcataactccaa

SEQ ID NO: 384075 - DNA, 25 bp, Rattus norvegicus
gcagcttgactcttcataactccaa

SEQ ID NO: 384076 - DNA, 25 bp, Rattus norvegicus
gcagcttgacttaatgttagtgtat

SEQ ID NO: 384077 - DNA, 25 bp, Rattus norvegicus
gcagcttgactttatgttagtgtat

SEQ ID NO: 384078 - DNA, 25 bp, Rattus norvegicus
gcagcttgcatcatacctgtttaaa

SEQ ID NO: 384079 - DNA, 25 bp, Rattus norvegicus
gcagcttgcatcttacctgtttaaa

SEQ ID NO: 384080 - DNA, 25 bp, Rattus norvegicus
gcagcttgcctgctagtgtacttag

SEQ ID NO: 384081 - DNA, 25 bp, Rattus norvegicus
gcagcttgcctggtagtgtacttag

SEQ ID NO: 384082 - DNA, 25 bp, Rattus norvegicus
gcagcttgcggacagcagccactga

SEQ ID NO: 384083 - DNA, 25 bp, Rattus norvegicus
gcagcttgcggagagcagccactga

SEQ ID NO: 384084 - DNA, 25 bp, Rattus norvegicus
gcagcttggcagatggacgcattat

SEQ ID NO: 384085 - DNA, 25 bp, Rattus norvegicus
gcagcttggcagttggacgcattat

SEQ ID NO: 384086 - DNA, 25 bp, Rattus norvegicus
gcagcttggcccaggagagctagat

SEQ ID NO: 384087 - DNA, 25 bp, Rattus norvegicus
gcagcttggccctggagagctagat

SEQ ID NO: 384088 - DNA, 25 bp, Rattus norvegicus
gcagcttggctaacatgggagtttc

SEQ ID NO: 384089 - DNA, 25 bp, Rattus norvegicus
gcagcttggctatcatgggagtttc

SEQ ID NO: 384090 - DNA, 25 bp, Rattus norvegicus
gcagcttggcttcactgggcagtca

SEQ ID NO: 384091 - DNA, 25 bp, Rattus norvegicus
gcagcttggcttgactgggcagtca

SEQ ID NO: 384092 - DNA, 25 bp, Rattus norvegicus
gcagcttgggatatagaatttctta

SEQ ID NO: 384093 - DNA, 25 bp, Rattus norvegicus
gcagcttgggatttagaatttctta

SEQ ID NO: 384094 - DNA, 25 bp, Rattus norvegicus
gcagcttggtgaaatcttgtccata

SEQ ID NO: 384095 - DNA, 25 bp, Rattus norvegicus
gcagcttggtgatatcttgtccata

SEQ ID NO: 384096 - DNA, 25 bp, Rattus norvegicus
gcagcttgtcaacatcttctggatt

SEQ ID NO: 384097 - DNA, 25 bp, Rattus norvegicus
gcagcttgtcaagatcttctggatt

SEQ ID NO: 384098 - DNA, 25 bp, Rattus norvegicus
gcagcttgtcagcacagtcggcgct

SEQ ID NO: 384099 - DNA, 25 bp, Rattus norvegicus
gcagcttgtcaggacagtcggcgct

SEQ ID NO: 384100 - DNA, 25 bp, Rattus norvegicus
gcagcttgtcctctatgacatttac

SEQ ID NO: 384101 - DNA, 25 bp, Rattus norvegicus
gcagcttgtcctgtatgacatttac

SEQ ID NO: 384102 - DNA, 25 bp, Rattus norvegicus
gcagcttgtgaacttaattccccaa

SEQ ID NO: 384103 - DNA, 25 bp, Rattus norvegicus
gcagcttgtgaagttaattccccaa

SEQ ID NO: 384104 - DNA, 25 bp, Rattus norvegicus
gcagcttgtggtagttgtggttcct

SEQ ID NO: 384105 - DNA, 25 bp, Rattus norvegicus
gcagcttgtggttgttgtggttcct

SEQ ID NO: 384106 - DNA, 25 bp, Rattus norvegicus
gcagctttaacgaggcagtggcaat

SEQ ID NO: 384107 - DNA, 25 bp, Rattus norvegicus
gcagctttaacgtggcagtggcaat

SEQ ID NO: 384108 - DNA, 25 bp, Rattus norvegicus
gcagctttagctaccatgaacgttg

SEQ ID NO: 384109 - DNA, 25 bp, Rattus norvegicus
gcagctttagcttccatgaacgttg

SEQ ID NO: 384110 - DNA, 25 bp, Rattus norvegicus
gcagctttccaactcaggtgtattt

SEQ ID NO: 384111 - DNA, 25 bp, Rattus norvegicus
gcagctttccaagtcaggtgtattt

SEQ ID NO: 384112 - DNA, 25 bp, Rattus norvegicus
gcagctttctgcagaggagttggac

SEQ ID NO: 384113 - DNA, 25 bp, Rattus norvegicus
gcagctttctgctgaggagttggac

SEQ ID NO: 384114 - DNA, 25 bp, Rattus norvegicus
gcagctttgaacacagcgcctcagg

SEQ ID NO: 384115 - DNA, 25 bp, Rattus norvegicus
gcagctttgaactcagcgcctcagg

SEQ ID NO: 384116 - DNA, 25 bp, Rattus norvegicus
gcagctttgaagagtgtttttgatc

SEQ ID NO: 384117 - DNA, 25 bp, Rattus norvegicus
gcagctttgaagtgtgtttttgatc

SEQ ID NO: 384118 - DNA, 25 bp, Rattus norvegicus
gcagctttgcccacagtagtagtga

SEQ ID NO: 384119 - DNA, 25 bp, Rattus norvegicus
gcagctttgccctcagtagtagtga

SEQ ID NO: 384120 - DNA, 25 bp, Rattus norvegicus
gcagctttgctcatatttcccatga

SEQ ID NO: 384121 - DNA, 25 bp, Rattus norvegicus
gcagctttgctcttatttcccatga

SEQ ID NO: 384122 - DNA, 25 bp, Rattus norvegicus
gcagctttggccaggagactcacag

SEQ ID NO: 384123 - DNA, 25 bp, Rattus norvegicus
gcagctttggcctggagactcacag

SEQ ID NO: 384124 - DNA, 25 bp, Rattus norvegicus
gcagctttgtacacctcagaggatc

SEQ ID NO: 384125 - DNA, 25 bp, Rattus norvegicus
gcagctttgtactcctcagaggatc

SEQ ID NO: 384126 - DNA, 25 bp, Rattus norvegicus
gcagctttgtatctcaccttattta

SEQ ID NO: 384127 - DNA, 25 bp, Rattus norvegicus
gcagctttgtatgtcaccttattta

SEQ ID NO: 384128 - DNA, 25 bp, Rattus norvegicus
gcagcttttattagtacgtagcaag

SEQ ID NO: 384129 - DNA, 25 bp, Rattus norvegicus
gcagcttttatttgtacgtagcaag

SEQ ID NO: 384130 - DNA, 25 bp, Rattus norvegicus
gcagcttttcacagtttatttgcat

SEQ ID NO: 384131 - DNA, 25 bp, Rattus norvegicus
gcagcttttcacattaaggagggaa

SEQ ID NO: 384132 - DNA, 25 bp, Rattus norvegicus
gcagcttttcactgtttatttgcat

SEQ ID NO: 384133 - DNA, 25 bp, Rattus norvegicus
gcagcttttcactttaaggagggaa

SEQ ID NO: 384134 - DNA, 25 bp, Rattus norvegicus
gcagcttttcatagacctgcaaaat

SEQ ID NO: 384135 - DNA, 25 bp, Rattus norvegicus
gcagcttttcattgacctgcaaaat

SEQ ID NO: 384136 - DNA, 25 bp, Rattus norvegicus
gcagcttttcttattcgcccttttg

SEQ ID NO: 384137 - DNA, 25 bp, Rattus norvegicus
gcagcttttctttttcgcccttttg

SEQ ID NO: 384138 - DNA, 25 bp, Rattus norvegicus
gcagcttttgaacttagttggtccc

SEQ ID NO: 384139 - DNA, 25 bp, Rattus norvegicus
gcagcttttgaagttagttggtccc

SEQ ID NO: 384140 - DNA, 25 bp, Rattus norvegicus
gcagctttttatcgccattttgtaa

SEQ ID NO: 384141 - DNA, 25 bp, Rattus norvegicus
gcagctttttatggccattttgtaa

SEQ ID NO: 384142 - DNA, 25 bp, Rattus norvegicus
gcagctttttggcaccaaccgggaa

SEQ ID NO: 384143 - DNA, 25 bp, Rattus norvegicus
gcagctttttgggaccaaccgggaa

SEQ ID NO: 384144 - DNA, 25 bp, Rattus norvegicus
gcaggaaaagcaatactgtagcaca

SEQ ID NO: 384145 - DNA, 25 bp, Rattus norvegicus
gcaggaaaagcattactgtagcaca

SEQ ID NO: 384146 - DNA, 25 bp, Rattus norvegicus
gcaggaaaatgcacttaaacccaaa

SEQ ID NO: 384147 - DNA, 25 bp, Rattus norvegicus
gcaggaaaatgccaggacctattgg

SEQ ID NO: 384148 - DNA, 25 bp, Rattus norvegicus
gcaggaaaatgcgaggacctattgg

SEQ ID NO: 384149 - DNA, 25 bp, Rattus norvegicus
gcaggaaaatgctcttaaacccaaa

SEQ ID NO: 384150 - DNA, 25 bp, Rattus norvegicus
gcaggaaacacactggaactcctgg

SEQ ID NO: 384151 - DNA, 25 bp, Rattus norvegicus
gcaggaaacacagtggaactcctgg

SEQ ID NO: 384152 - DNA, 25 bp, Rattus norvegicus
gcaggaaacctactcaagattctgt

SEQ ID NO: 384153 - DNA, 25 bp, Rattus norvegicus
gcaggaaacctagtcaagattctgt

SEQ ID NO: 384154 - DNA, 25 bp, Rattus norvegicus
gcaggaaactcccatcttgactatc

SEQ ID NO: 384155 - DNA, 25 bp, Rattus norvegicus
gcaggaaactccgatcttgactatc

SEQ ID NO: 384156 - DNA, 25 bp, Rattus norvegicus
gcaggaaagcccacaccctttgctg

SEQ ID NO: 384157 - DNA, 25 bp, Rattus norvegicus
gcaggaaagccctcaccctttgctg

SEQ ID NO: 384158 - DNA, 25 bp, Rattus norvegicus
gcaggaaaggtcctcttttcgttat

SEQ ID NO: 384159 - DNA, 25 bp, Rattus norvegicus
gcaggaaaggtcgtcttttcgttat

SEQ ID NO: 384160 - DNA, 25 bp, Rattus norvegicus
gcaggaaagtttccttccccaatat

SEQ ID NO: 384161 - DNA, 25 bp, Rattus norvegicus
gcaggaaagtttgcttccccaatat

SEQ ID NO: 384162 - DNA, 25 bp, Rattus norvegicus
gcaggaaatagaacgctacgccagt

SEQ ID NO: 384163 - DNA, 25 bp, Rattus norvegicus
gcaggaaatagatcgctacgccagt

SEQ ID NO: 384164 - DNA, 25 bp, Rattus norvegicus
gcaggaaatgttctcgctcgggtta

SEQ ID NO: 384165 - DNA, 25 bp, Rattus norvegicus
gcaggaaatgttgtcgctcgggtta

SEQ ID NO: 384166 - DNA, 25 bp, Rattus norvegicus
gcaggaacacacattataaccaggg

SEQ ID NO: 384167 - DNA, 25 bp, Rattus norvegicus
gcaggaacacactttataaccaggg

SEQ ID NO: 384168 - DNA, 25 bp, Rattus norvegicus
gcaggaacagacatttggcgacgag

SEQ ID NO: 384169 - DNA, 25 bp, Rattus norvegicus
gcaggaacagacttttggcgacgag

SEQ ID NO: 384170 - DNA, 25 bp, Rattus norvegicus
gcaggaaccatcaagggaggccaaa

SEQ ID NO: 384171 - DNA, 25 bp, Rattus norvegicus
gcaggaaccatctagggaggccaaa

SEQ ID NO: 384172 - DNA, 25 bp, Rattus norvegicus
gcaggaaccatgcacaaaccgccat

SEQ ID NO: 384173 - DNA, 25 bp, Rattus norvegicus
gcaggaaccatggacaaaccgccat

SEQ ID NO: 384174 - DNA, 25 bp, Rattus norvegicus
gcaggaacccacacaggcagagaat

SEQ ID NO: 384175 - DNA, 25 bp, Rattus norvegicus
gcaggaacccactcaggcagagaat

SEQ ID NO: 384176 - DNA, 25 bp, Rattus norvegicus
gcaggaacctgaccaatgagccatc

SEQ ID NO: 384177 - DNA, 25 bp, Rattus norvegicus
gcaggaacctgagcaatgagccatc

SEQ ID NO: 384178 - DNA, 25 bp, Rattus norvegicus
gcaggaacgactacttggccttttc

SEQ ID NO: 384179 - DNA, 25 bp, Rattus norvegicus
gcaggaacgacttcttggccttttc

SEQ ID NO: 384180 - DNA, 25 bp, Rattus norvegicus
gcaggaacgttcatagccaaggtct

SEQ ID NO: 384181 - DNA, 25 bp, Rattus norvegicus
gcaggaacgttcttagccaaggtct

SEQ ID NO: 384182 - DNA, 25 bp, Rattus norvegicus
gcaggaactctcatcagactgtttt

SEQ ID NO: 384183 - DNA, 25 bp, Rattus norvegicus
gcaggaactctcttcagactgtttt

SEQ ID NO: 384184 - DNA, 25 bp, Rattus norvegicus
gcaggaactctgacccatttgatgg

SEQ ID NO: 384185 - DNA, 25 bp, Rattus norvegicus
gcaggaactctgtcccatttgatgg

SEQ ID NO: 384186 - DNA, 25 bp, Rattus norvegicus
gcaggaactgaaagcttgagccttc

SEQ ID NO: 384187 - DNA, 25 bp, Rattus norvegicus
gcaggaactgaatgcttgagccttc

SEQ ID NO: 384188 - DNA, 25 bp, Rattus norvegicus
gcaggaagaaacctcgcgggtcctt

SEQ ID NO: 384189 - DNA, 25 bp, Rattus norvegicus
gcaggaagaaacgtcgcgggtcctt

SEQ ID NO: 384190 - DNA, 25 bp, Rattus norvegicus
gcaggaagaaagacgtgcacgtgct

SEQ ID NO: 384191 - DNA, 25 bp, Rattus norvegicus
gcaggaagaaagtcgtgcacgtgct

SEQ ID NO: 384192 - DNA, 25 bp, Rattus norvegicus
gcaggaagagaaacacacatctgtt

SEQ ID NO: 384193 - DNA, 25 bp, Rattus norvegicus
gcaggaagagaatcacacatctgtt

SEQ ID NO: 384194 - DNA, 25 bp, Rattus norvegicus
gcaggaagagcaacgccagacagga

SEQ ID NO: 384195 - DNA, 25 bp, Rattus norvegicus
gcaggaagagcatcgccagacagga

SEQ ID NO: 384196 - DNA, 25 bp, Rattus norvegicus
gcaggaagcagccagtgaagactaa

SEQ ID NO: 384197 - DNA, 25 bp, Rattus norvegicus
gcaggaagcagcgagtgaagactaa

SEQ ID NO: 384198 - DNA, 25 bp, Rattus norvegicus
gcaggaagcagtctcctggctgtca

SEQ ID NO: 384199 - DNA, 25 bp, Rattus norvegicus
gcaggaagcagtgtcctggctgtca

SEQ ID NO: 384200 - DNA, 25 bp, Rattus norvegicus
gcaggaagccccagaaaactagatt

SEQ ID NO: 384201 - DNA, 25 bp, Rattus norvegicus
gcaggaagcccctgaaaactagatt

SEQ ID NO: 384202 - DNA, 25 bp, Rattus norvegicus
gcaggaagcttcctggatcggttta

SEQ ID NO: 384203 - DNA, 25 bp, Rattus norvegicus
gcaggaagcttcgtggatcggttta

SEQ ID NO: 384204 - DNA, 25 bp, Rattus norvegicus
gcaggaagtcctctaccatacttag

SEQ ID NO: 384205 - DNA, 25 bp, Rattus norvegicus
gcaggaagtcctgtaccatacttag

SEQ ID NO: 384206 - DNA, 25 bp, Rattus norvegicus
gcaggaagtcgtcttttatgcaaca

SEQ ID NO: 384207 - DNA, 25 bp, Rattus norvegicus
gcaggaagtcgtgttttatgcaaca

SEQ ID NO: 384208 - DNA, 25 bp, Rattus norvegicus
gcaggaagttgtccttgtacctctt

SEQ ID NO: 384209 - DNA, 25 bp, Rattus norvegicus
gcaggaagttgtgcttgtacctctt

SEQ ID NO: 384210 - DNA, 25 bp, Rattus norvegicus
gcaggaatacccagaggcctttatg

SEQ ID NO: 384211 - DNA, 25 bp, Rattus norvegicus
gcaggaataccctgaggcctttatg

SEQ ID NO: 384212 - DNA, 25 bp, Rattus norvegicus
gcaggaatccacactgagctgtcag

SEQ ID NO: 384213 - DNA, 25 bp, Rattus norvegicus
gcaggaatccactctgagctgtcag

SEQ ID NO: 384214 - DNA, 25 bp, Rattus norvegicus
gcaggaatctcgatgcagacattaa

SEQ ID NO: 384215 - DNA, 25 bp, Rattus norvegicus
gcaggaatctcgttgcagacattaa

SEQ ID NO: 384216 - DNA, 25 bp, Rattus norvegicus
gcaggaatgtagacccagcccgagg

SEQ ID NO: 384217 - DNA, 25 bp, Rattus norvegicus
gcaggaatgtagtcccagcccgagg

SEQ ID NO: 384218 - DNA, 25 bp, Rattus norvegicus
gcaggaatgtttcctgccaagggaa

SEQ ID NO: 384219 - DNA, 25 bp, Rattus norvegicus
gcaggaatgtttgctgccaagggaa

SEQ ID NO: 384220 - DNA, 25 bp, Rattus norvegicus
gcaggacaactaaactgggtgcttg

SEQ ID NO: 384221 - DNA, 25 bp, Rattus norvegicus
gcaggacaactatactgggtgcttg

SEQ ID NO: 384222 - DNA, 25 bp, Rattus norvegicus
gcaggacacattccttcactttggg

SEQ ID NO: 384223 - DNA, 25 bp, Rattus norvegicus
gcaggacacattgcttcactttggg

SEQ ID NO: 384224 - DNA, 25 bp, Rattus norvegicus
gcaggacacttacactagcattgat

SEQ ID NO: 384225 - DNA, 25 bp, Rattus norvegicus
gcaggacacttagactagcattgat

SEQ ID NO: 384226 - DNA, 25 bp, Rattus norvegicus
gcaggacaggctctttaggtcttgt

SEQ ID NO: 384227 - DNA, 25 bp, Rattus norvegicus
gcaggacaggctgtttaggtcttgt

SEQ ID NO: 384228 - DNA, 25 bp, Rattus norvegicus
gcaggacagggaacttggcccgata

SEQ ID NO: 384229 - DNA, 25 bp, Rattus norvegicus
gcaggacagggatcttggcccgata

SEQ ID NO: 384230 - DNA, 25 bp, Rattus norvegicus
gcaggacagttgcatcatttcccat

SEQ ID NO: 384231 - DNA, 25 bp, Rattus norvegicus
gcaggacagttggatcatttcccat

SEQ ID NO: 384232 - DNA, 25 bp, Rattus norvegicus
gcaggacatccccaaataactttat

SEQ ID NO: 384233 - DNA, 25 bp, Rattus norvegicus
gcaggacatcccgaaataactttat

SEQ ID NO: 384234 - DNA, 25 bp, Rattus norvegicus
gcaggacatgtaatccaattaaata

SEQ ID NO: 384235 - DNA, 25 bp, Rattus norvegicus
gcaggacatgtattccaattaaata

SEQ ID NO: 384236 - DNA, 25 bp, Rattus norvegicus
gcaggaccaaacatccggttaactt

SEQ ID NO: 384237 - DNA, 25 bp, Rattus norvegicus
gcaggaccaaacttccggttaactt

SEQ ID NO: 384238 - DNA, 25 bp, Rattus norvegicus
gcaggaccagatctctgccttcatc

SEQ ID NO: 384239 - DNA, 25 bp, Rattus norvegicus
gcaggaccagatgtctgccttcatc

SEQ ID NO: 384240 - DNA, 25 bp, Rattus norvegicus
gcaggaccatcccaactacaagtac

SEQ ID NO: 384241 - DNA, 25 bp, Rattus norvegicus
gcaggaccatccgaactacaagtac

SEQ ID NO: 384242 - DNA, 25 bp, Rattus norvegicus
gcaggaccatggctatttagcaacc

SEQ ID NO: 384243 - DNA, 25 bp, Rattus norvegicus
gcaggaccatgggtatttagcaacc

SEQ ID NO: 384244 - DNA, 25 bp, Rattus norvegicus
gcaggacccaggaggcattgtgttc

SEQ ID NO: 384245 - DNA, 25 bp, Rattus norvegicus
gcaggacccaggtggcattgtgttc

SEQ ID NO: 384246 - DNA, 25 bp, Rattus norvegicus
gcaggaccccacagagtgactggaa

SEQ ID NO: 384247 - DNA, 25 bp, Rattus norvegicus
gcaggaccccactgagtgactggaa

SEQ ID NO: 384248 - DNA, 25 bp, Rattus norvegicus
gcaggaccccgaataaccctacaat

SEQ ID NO: 384249 - DNA, 25 bp, Rattus norvegicus
gcaggaccccgattaaccctacaat

SEQ ID NO: 384250 - DNA, 25 bp, Rattus norvegicus
gcaggacccggaaggctcatgccag

SEQ ID NO: 384251 - DNA, 25 bp, Rattus norvegicus
gcaggacccggatggctcatgccag

SEQ ID NO: 384252 - DNA, 25 bp, Rattus norvegicus
gcaggaccggcacggactttccact

SEQ ID NO: 384253 - DNA, 25 bp, Rattus norvegicus
gcaggaccggcagggactttccact

SEQ ID NO: 384254 - DNA, 25 bp, Rattus norvegicus
gcaggacctctcattggtgattgta

SEQ ID NO: 384255 - DNA, 25 bp, Rattus norvegicus
gcaggacctctctttggtgattgta

SEQ ID NO: 384256 - DNA, 25 bp, Rattus norvegicus
gcaggacctgcaccataaccagaaa

SEQ ID NO: 384257 - DNA, 25 bp, Rattus norvegicus
gcaggacctgcagcataaccagaaa

SEQ ID NO: 384258 - DNA, 25 bp, Rattus norvegicus
gcaggacctgttcgccgtaaccatg

SEQ ID NO: 384259 - DNA, 25 bp, Rattus norvegicus
gcaggacctgttggccgtaaccatg

SEQ ID NO: 384260 - DNA, 25 bp, Rattus norvegicus
gcaggaccttagctatcctaaagga

SEQ ID NO: 384261 - DNA, 25 bp, Rattus norvegicus
gcaggaccttaggtatcctaaagga

SEQ ID NO: 384262 - DNA, 25 bp, Rattus norvegicus
gcaggaccttggaactgaacagtca

SEQ ID NO: 384263 - DNA, 25 bp, Rattus norvegicus
gcaggaccttggtactgaacagtca

SEQ ID NO: 384264 - DNA, 25 bp, Rattus norvegicus
gcaggacgagcgagcagctcgcacc

SEQ ID NO: 384265 - DNA, 25 bp, Rattus norvegicus
gcaggacgagcgtgcagctcgcacc

SEQ ID NO: 384266 - DNA, 25 bp, Rattus norvegicus
gcaggacgcggaccatcttggaact

SEQ ID NO: 384267 - DNA, 25 bp, Rattus norvegicus
gcaggacgcggagcatcttggaact

SEQ ID NO: 384268 - DNA, 25 bp, Rattus norvegicus
gcaggacggaagcttgtctgtactt

SEQ ID NO: 384269 - DNA, 25 bp, Rattus norvegicus
gcaggacggaaggttgtctgtactt

SEQ ID NO: 384270 - DNA, 25 bp, Rattus norvegicus
gcaggacggctactgtcacatgact

SEQ ID NO: 384271 - DNA, 25 bp, Rattus norvegicus
gcaggacggctagtgtcacatgact

SEQ ID NO: 384272 - DNA, 25 bp, Rattus norvegicus
gcaggactaccaccaggctttggaa

SEQ ID NO: 384273 - DNA, 25 bp, Rattus norvegicus
gcaggactaccagcaggctttggaa

SEQ ID NO: 384274 - DNA, 25 bp, Rattus norvegicus
gcaggactaggcagactgcttctga

SEQ ID NO: 384275 - DNA, 25 bp, Rattus norvegicus
gcaggactaggctgactgcttctga

SEQ ID NO: 384276 - DNA, 25 bp, Rattus norvegicus
gcaggactatccacgcaagccgata

SEQ ID NO: 384277 - DNA, 25 bp, Rattus norvegicus
gcaggactatcctcgcaagccgata

SEQ ID NO: 384278 - DNA, 25 bp, Rattus norvegicus
gcaggactatgtcagcacacagagt

SEQ ID NO: 384279 - DNA, 25 bp, Rattus norvegicus
gcaggactatgtgagcacacagagt

SEQ ID NO: 384280 - DNA, 25 bp, Rattus norvegicus
gcaggactattcattagctctaaga

SEQ ID NO: 384281 - DNA, 25 bp, Rattus norvegicus
gcaggactattctttagctctaaga

SEQ ID NO: 384282 - DNA, 25 bp, Rattus norvegicus
gcaggactcagcaagaacttgatct

SEQ ID NO: 384283 - DNA, 25 bp, Rattus norvegicus
gcaggactcagctagaacttgatct

SEQ ID NO: 384284 - DNA, 25 bp, Rattus norvegicus
gcaggactcctcaaagatggtgaac

SEQ ID NO: 384285 - DNA, 25 bp, Rattus norvegicus
gcaggactcctctaagatggtgaac

SEQ ID NO: 384286 - DNA, 25 bp, Rattus norvegicus
gcaggactctccagtgacaggcttt

SEQ ID NO: 384287 - DNA, 25 bp, Rattus norvegicus
gcaggactctcctgtgacaggcttt

SEQ ID NO: 384288 - DNA, 25 bp, Rattus norvegicus
gcaggactctctaggtatcatggaa

SEQ ID NO: 384289 - DNA, 25 bp, Rattus norvegicus
gcaggactctcttggtatcatggaa

SEQ ID NO: 384290 - DNA, 25 bp, Rattus norvegicus
gcaggactctggacatcagtgacag

SEQ ID NO: 384291 - DNA, 25 bp, Rattus norvegicus
gcaggactctggtcatcagtgacag

SEQ ID NO: 384292 - DNA, 25 bp, Rattus norvegicus
gcaggactgaagacccgttccaata

SEQ ID NO: 384293 - DNA, 25 bp, Rattus norvegicus
gcaggactgaagtcccgttccaata

SEQ ID NO: 384294 - DNA, 25 bp, Rattus norvegicus
gcaggactgaataactacttcatta

SEQ ID NO: 384295 - DNA, 25 bp, Rattus norvegicus
gcaggactgaattactacttcatta

SEQ ID NO: 384296 - DNA, 25 bp, Rattus norvegicus
gcaggactgcccctatatatttata

SEQ ID NO: 384297 - DNA, 25 bp, Rattus norvegicus
gcaggactgcccgtatatatttata

SEQ ID NO: 384298 - DNA, 25 bp, Rattus norvegicus
gcaggactggtccactcagatcaaa

SEQ ID NO: 384299 - DNA, 25 bp, Rattus norvegicus
gcaggactggtcgactcagatcaaa

SEQ ID NO: 384300 - DNA, 25 bp, Rattus norvegicus
gcaggacttactactccctggacag

SEQ ID NO: 384301 - DNA, 25 bp, Rattus norvegicus
gcaggacttacttctccctggacag

SEQ ID NO: 384302 - DNA, 25 bp, Rattus norvegicus
gcaggacttcctcatgcaacatatc

SEQ ID NO: 384303 - DNA, 25 bp, Rattus norvegicus
gcaggacttcctgatgcaacatatc

SEQ ID NO: 384304 - DNA, 25 bp, Rattus norvegicus
gcaggacttcttcattgtttggcat

SEQ ID NO: 384305 - DNA, 25 bp, Rattus norvegicus
gcaggacttcttgattgtttggcat

SEQ ID NO: 384306 - DNA, 25 bp, Rattus norvegicus
gcaggactttttctctaactttcat

SEQ ID NO: 384307 - DNA, 25 bp, Rattus norvegicus
gcaggactttttgtctaactttcat

SEQ ID NO: 384308 - DNA, 25 bp, Rattus norvegicus
gcaggagaattccagtcttcaccgt

SEQ ID NO: 384309 - DNA, 25 bp, Rattus norvegicus
gcaggagaattcgagtcttcaccgt

SEQ ID NO: 384310 - DNA, 25 bp, Rattus norvegicus
gcaggagacccaaacgcacaggtat

SEQ ID NO: 384311 - DNA, 25 bp, Rattus norvegicus
gcaggagacccatacgcacaggtat

SEQ ID NO: 384312 - DNA, 25 bp, Rattus norvegicus
gcaggagaccccagtgacatgaagc

SEQ ID NO: 384313 - DNA, 25 bp, Rattus norvegicus
gcaggagacccctgtgacatgaagc

SEQ ID NO: 384314 - DNA, 25 bp, Rattus norvegicus
gcaggagaccctcggctcagcctga

SEQ ID NO: 384315 - DNA, 25 bp, Rattus norvegicus
gcaggagaccctgggctcagcctga

SEQ ID NO: 384316 - DNA, 25 bp, Rattus norvegicus
gcaggagacgccacactgagagaac

SEQ ID NO: 384317 - DNA, 25 bp, Rattus norvegicus
gcaggagacgcctcactgagagaac

SEQ ID NO: 384318 - DNA, 25 bp, Rattus norvegicus
gcaggagactctcgcagccaaggaa

SEQ ID NO: 384319 - DNA, 25 bp, Rattus norvegicus
gcaggagactctggcagccaaggaa

SEQ ID NO: 384320 - DNA, 25 bp, Rattus norvegicus
gcaggagactggcttcattcttaga

SEQ ID NO: 384321 - DNA, 25 bp, Rattus norvegicus
gcaggagactgggttcattcttaga

SEQ ID NO: 384322 - DNA, 25 bp, Rattus norvegicus
gcaggagagcccaggacagtgcaca

SEQ ID NO: 384323 - DNA, 25 bp, Rattus norvegicus
gcaggagagccctggacagtgcaca

SEQ ID NO: 384324 - DNA, 25 bp, Rattus norvegicus
gcaggagagggaccgccctcatcta

SEQ ID NO: 384325 - DNA, 25 bp, Rattus norvegicus
gcaggagagggagcgccctcatcta

SEQ ID NO: 384326 - DNA, 25 bp, Rattus norvegicus
gcaggagagtgcagcttctctgcac

SEQ ID NO: 384327 - DNA, 25 bp, Rattus norvegicus
gcaggagagtgctgcttctctgcac

SEQ ID NO: 384328 - DNA, 25 bp, Rattus norvegicus
gcaggagatagtcctaatcttttaa

SEQ ID NO: 384329 - DNA, 25 bp, Rattus norvegicus
gcaggagatagtgctaatcttttaa

SEQ ID NO: 384330 - DNA, 25 bp, Rattus norvegicus
gcaggagatcagcacttaccggaac

SEQ ID NO: 384331 - DNA, 25 bp, Rattus norvegicus
gcaggagatcaggacttaccggaac

SEQ ID NO: 384332 - DNA, 25 bp, Rattus norvegicus
gcaggagattcacgtcatcccacat

SEQ ID NO: 384333 - DNA, 25 bp, Rattus norvegicus
gcaggagattcaggtcatcccacat

SEQ ID NO: 384334 - DNA, 25 bp, Rattus norvegicus
gcaggagatttgaagccttaactgt

SEQ ID NO: 384335 - DNA, 25 bp, Rattus norvegicus
gcaggagatttgtagccttaactgt

SEQ ID NO: 384336 - DNA, 25 bp, Rattus norvegicus
gcaggagcagtaacatgaagcccga

SEQ ID NO: 384337 - DNA, 25 bp, Rattus norvegicus
gcaggagcagtatcatgaagcccga

SEQ ID NO: 384338 - DNA, 25 bp, Rattus norvegicus
gcaggagccctactggccagcagct

SEQ ID NO: 384339 - DNA, 25 bp, Rattus norvegicus
gcaggagccctagtggccagcagct

SEQ ID NO: 384340 - DNA, 25 bp, Rattus norvegicus
gcaggagccgcactcacagtcagag

SEQ ID NO: 384341 - DNA, 25 bp, Rattus norvegicus
gcaggagccgcagtcacagtcagag

SEQ ID NO: 384342 - DNA, 25 bp, Rattus norvegicus
gcaggagcgacaccacaggcagtat

SEQ ID NO: 384343 - DNA, 25 bp, Rattus norvegicus
gcaggagcgacagcacaggcagtat

SEQ ID NO: 384344 - DNA, 25 bp, Rattus norvegicus
gcaggagcgcaaccaggcactgtat

SEQ ID NO: 384345 - DNA, 25 bp, Rattus norvegicus
gcaggagcgcaagcaggcactgtat

SEQ ID NO: 384346 - DNA, 25 bp, Rattus norvegicus
gcaggagctaagcatgtccagtcct

SEQ ID NO: 384347 - DNA, 25 bp, Rattus norvegicus
gcaggagctaaggatgtccagtcct

SEQ ID NO: 384348 - DNA, 25 bp, Rattus norvegicus
gcaggagctcctagattgggacgct

SEQ ID NO: 384349 - DNA, 25 bp, Rattus norvegicus
gcaggagctccttgattgggacgct

SEQ ID NO: 384350 - DNA, 25 bp, Rattus norvegicus
gcaggagctcttacgtaacttcaga

SEQ ID NO: 384351 - DNA, 25 bp, Rattus norvegicus
gcaggagctctttcgtaacttcaga

SEQ ID NO: 384352 - DNA, 25 bp, Rattus norvegicus
gcaggagctgctaaatttcacagta

SEQ ID NO: 384353 - DNA, 25 bp, Rattus norvegicus
gcaggagctgcttaatttcacagta

SEQ ID NO: 384354 - DNA, 25 bp, Rattus norvegicus
gcaggagcttgtaaacatccttcta

SEQ ID NO: 384355 - DNA, 25 bp, Rattus norvegicus
gcaggagcttgttaacatccttcta

SEQ ID NO: 384356 - DNA, 25 bp, Rattus norvegicus
gcaggaggaaaaacccttctgggaa

SEQ ID NO: 384357 - DNA, 25 bp, Rattus norvegicus
gcaggaggaaaatcccttctgggaa

SEQ ID NO: 384358 - DNA, 25 bp, Rattus norvegicus
gcaggaggacagagacgcgccacca

SEQ ID NO: 384359 - DNA, 25 bp, Rattus norvegicus
gcaggaggacagtgacgcgccacca

SEQ ID NO: 384360 - DNA, 25 bp, Rattus norvegicus
gcaggaggacctattgcattctctt

SEQ ID NO: 384361 - DNA, 25 bp, Rattus norvegicus
gcaggaggaccttttgcattctctt

SEQ ID NO: 384362 - DNA, 25 bp, Rattus norvegicus
gcaggaggaggcataactccattgc

SEQ ID NO: 384363 - DNA, 25 bp, Rattus norvegicus
gcaggaggaggcttaactccattgc

SEQ ID NO: 384364 - DNA, 25 bp, Rattus norvegicus
gcaggaggatgccactaactcaaag

SEQ ID NO: 384365 - DNA, 25 bp, Rattus norvegicus
gcaggaggatgcgactaactcaaag

SEQ ID NO: 384366 - DNA, 25 bp, Rattus norvegicus
gcaggaggccagcttgttccagaaa

SEQ ID NO: 384367 - DNA, 25 bp, Rattus norvegicus
gcaggaggccaggttgttccagaaa

SEQ ID NO: 384368 - DNA, 25 bp, Rattus norvegicus
gcaggaggcttgcaatgtatgcaca

SEQ ID NO: 384369 - DNA, 25 bp, Rattus norvegicus
gcaggaggcttggaatgtatgcaca

SEQ ID NO: 384370 - DNA, 25 bp, Rattus norvegicus
gcaggagggagcagctcgcacccct

SEQ ID NO: 384371 - DNA, 25 bp, Rattus norvegicus
gcaggagggagctgctcgcacccct

SEQ ID NO: 384372 - DNA, 25 bp, Rattus norvegicus
gcaggagggaggctttctctcccaa

SEQ ID NO: 384373 - DNA, 25 bp, Rattus norvegicus
gcaggagggagggtttctctcccaa

SEQ ID NO: 384374 - DNA, 25 bp, Rattus norvegicus
gcaggagggcctatttcttgttagt

SEQ ID NO: 384375 - DNA, 25 bp, Rattus norvegicus
gcaggagggcctttttcttgttagt

SEQ ID NO: 384376 - DNA, 25 bp, Rattus norvegicus
gcaggaggtatcatttatttcactt

SEQ ID NO: 384377 - DNA, 25 bp, Rattus norvegicus
gcaggaggtatcttttatttcactt

SEQ ID NO: 384378 - DNA, 25 bp, Rattus norvegicus
gcaggagtagatcgatctctgagtt

SEQ ID NO: 384379 - DNA, 25 bp, Rattus norvegicus
gcaggagtagatggatctctgagtt

SEQ ID NO: 384380 - DNA, 25 bp, Rattus norvegicus
gcaggagtccaaactgtctctgaat

SEQ ID NO: 384381 - DNA, 25 bp, Rattus norvegicus
gcaggagtccaaagacccatggtga

SEQ ID NO: 384382 - DNA, 25 bp, Rattus norvegicus
gcaggagtccaatctgtctctgaat

SEQ ID NO: 384383 - DNA, 25 bp, Rattus norvegicus
gcaggagtccaatgacccatggtga

SEQ ID NO: 384384 - DNA, 25 bp, Rattus norvegicus
gcaggagtctcacacatgtctcaca

SEQ ID NO: 384385 - DNA, 25 bp, Rattus norvegicus
gcaggagtctcagacatgtctcaca

SEQ ID NO: 384386 - DNA, 25 bp, Rattus norvegicus
gcaggagtctgcaaacaaccaaatt

SEQ ID NO: 384387 - DNA, 25 bp, Rattus norvegicus
gcaggagtctgcatcggttagcacc

SEQ ID NO: 384388 - DNA, 25 bp, Rattus norvegicus
gcaggagtctgctaacaaccaaatt

SEQ ID NO: 384389 - DNA, 25 bp, Rattus norvegicus
gcaggagtctgcttcggttagcacc

SEQ ID NO: 384390 - DNA, 25 bp, Rattus norvegicus
gcaggagtgctaccatcatcagatg

SEQ ID NO: 384391 - DNA, 25 bp, Rattus norvegicus
gcaggagtgctagcatcatcagatg

SEQ ID NO: 384392 - DNA, 25 bp, Rattus norvegicus
gcaggagtggtaactgttcagttca

SEQ ID NO: 384393 - DNA, 25 bp, Rattus norvegicus
gcaggagtggtatctgttcagttca

SEQ ID NO: 384394 - DNA, 25 bp, Rattus norvegicus
gcaggagtgtctacaactacagcta

SEQ ID NO: 384395 - DNA, 25 bp, Rattus norvegicus
gcaggagtgtcttcaactacagcta

SEQ ID NO: 384396 - DNA, 25 bp, Rattus norvegicus
gcaggagtgttcattatctgggact

SEQ ID NO: 384397 - DNA, 25 bp, Rattus norvegicus
gcaggagtgttctttatctgggact

SEQ ID NO: 384398 - DNA, 25 bp, Rattus norvegicus
gcaggagtgtttaagtctctgatct

SEQ ID NO: 384399 - DNA, 25 bp, Rattus norvegicus
gcaggagtgttttagtctctgatct

SEQ ID NO: 384400 - DNA, 25 bp, Rattus norvegicus
gcaggagttagccttgcctccggaa

SEQ ID NO: 384401 - DNA, 25 bp, Rattus norvegicus
gcaggagttagcgttgcctccggaa

SEQ ID NO: 384402 - DNA, 25 bp, Rattus norvegicus
gcaggagttcacagagcatttcaca

SEQ ID NO: 384403 - DNA, 25 bp, Rattus norvegicus
gcaggagttcactgagcatttcaca

SEQ ID NO: 384404 - DNA, 25 bp, Rattus norvegicus
gcaggagttcgtcaaggccttctac

SEQ ID NO: 384405 - DNA, 25 bp, Rattus norvegicus
gcaggagttcgtgaaggccttctac

SEQ ID NO: 384406 - DNA, 25 bp, Rattus norvegicus
gcaggagttgctaagccagaggaca

SEQ ID NO: 384407 - DNA, 25 bp, Rattus norvegicus
gcaggagttgcttagccagaggaca

SEQ ID NO: 384408 - DNA, 25 bp, Rattus norvegicus
gcaggagtttgtctactcttgggaa

SEQ ID NO: 384409 - DNA, 25 bp, Rattus norvegicus
gcaggagtttgtgtactcttgggaa

SEQ ID NO: 384410 - DNA, 25 bp, Rattus norvegicus
gcaggatacttcatgtaggacataa

SEQ ID NO: 384411 - DNA, 25 bp, Rattus norvegicus
gcaggatacttcttgtaggacataa

SEQ ID NO: 384412 - DNA, 25 bp, Rattus norvegicus
gcaggatccaaaaataccattctta

SEQ ID NO: 384413 - DNA, 25 bp, Rattus norvegicus
gcaggatccaaatataccattctta

SEQ ID NO: 384414 - DNA, 25 bp, Rattus norvegicus
gcaggatccaagatatcggtacact

SEQ ID NO: 384415 - DNA, 25 bp, Rattus norvegicus
gcaggatccaagttatcggtacact

SEQ ID NO: 384416 - DNA, 25 bp, Rattus norvegicus
gcaggatcccaaaagacagagcagt

SEQ ID NO: 384417 - DNA, 25 bp, Rattus norvegicus
gcaggatcccaatagacagagcagt

SEQ ID NO: 384418 - DNA, 25 bp, Rattus norvegicus
gcaggatctccactgtcttataacc

SEQ ID NO: 384419 - DNA, 25 bp, Rattus norvegicus
gcaggatctccagtgtcttataacc

SEQ ID NO: 384420 - DNA, 25 bp, Rattus norvegicus
gcaggatctggtcgataaacttcaa

SEQ ID NO: 384421 - DNA, 25 bp, Rattus norvegicus
gcaggatctggtggataaacttcaa

SEQ ID NO: 384422 - DNA, 25 bp, Rattus norvegicus
gcaggatcttctactcgaagtctgt

SEQ ID NO: 384423 - DNA, 25 bp, Rattus norvegicus
gcaggatcttcttctcgaagtctgt

SEQ ID NO: 384424 - DNA, 25 bp, Rattus norvegicus
gcaggatgacaacgctggttcacaa

SEQ ID NO: 384425 - DNA, 25 bp, Rattus norvegicus
gcaggatgacaaggctggttcacaa

SEQ ID NO: 384426 - DNA, 25 bp, Rattus norvegicus
gcaggatgacggcttttctgacatg

SEQ ID NO: 384427 - DNA, 25 bp, Rattus norvegicus
gcaggatgacgggttttctgacatg

SEQ ID NO: 384428 - DNA, 25 bp, Rattus norvegicus
gcaggatgatctaggactcctcact

SEQ ID NO: 384429 - DNA, 25 bp, Rattus norvegicus
gcaggatgatcttggactcctcact

SEQ ID NO: 384430 - DNA, 25 bp, Rattus norvegicus
gcaggatgatttcccacttgcttgg

SEQ ID NO: 384431 - DNA, 25 bp, Rattus norvegicus
gcaggatgatttgccacttgcttgg

SEQ ID NO: 384432 - DNA, 25 bp, Rattus norvegicus
gcaggatgcctactttgcatgcaca

SEQ ID NO: 384433 - DNA, 25 bp, Rattus norvegicus
gcaggatgcctagtttgcatgcaca

SEQ ID NO: 384434 - DNA, 25 bp, Rattus norvegicus
gcaggatgctacctctcagcttggt

SEQ ID NO: 384435 - DNA, 25 bp, Rattus norvegicus
gcaggatgctacgtctcagcttggt

SEQ ID NO: 384436 - DNA, 25 bp, Rattus norvegicus
gcaggatggctgactagaaatatac

SEQ ID NO: 384437 - DNA, 25 bp, Rattus norvegicus
gcaggatggctgtctagaaatatac

SEQ ID NO: 384438 - DNA, 25 bp, Rattus norvegicus
gcaggatggtgacttcctgtccaac

SEQ ID NO: 384439 - DNA, 25 bp, Rattus norvegicus
gcaggatggtgagttcctgtccaac

SEQ ID NO: 384440 - DNA, 25 bp, Rattus norvegicus
gcaggatgtatacccagtggtcata

SEQ ID NO: 384441 - DNA, 25 bp, Rattus norvegicus
gcaggatgtatagccagtggtcata

SEQ ID NO: 384442 - DNA, 25 bp, Rattus norvegicus
gcaggatgtctacgctcacttggta

SEQ ID NO: 384443 - DNA, 25 bp, Rattus norvegicus
gcaggatgtctaggctcacttggta

SEQ ID NO: 384444 - DNA, 25 bp, Rattus norvegicus
gcaggatgtctgagtgactacctca

SEQ ID NO: 384445 - DNA, 25 bp, Rattus norvegicus
gcaggatgtctgagttggactctaa

SEQ ID NO: 384446 - DNA, 25 bp, Rattus norvegicus
gcaggatgtctgtgtgactacctca

SEQ ID NO: 384447 - DNA, 25 bp, Rattus norvegicus
gcaggatgtctgtgttggactctaa

SEQ ID NO: 384448 - DNA, 25 bp, Rattus norvegicus
gcaggatgtgtgactacaatgtcaa

SEQ ID NO: 384449 - DNA, 25 bp, Rattus norvegicus
gcaggatgtgtgtctacaatgtcaa

SEQ ID NO: 384450 - DNA, 25 bp, Rattus norvegicus
gcaggattacctactgtaggtttcg

SEQ ID NO: 384451 - DNA, 25 bp, Rattus norvegicus
gcaggattaccttctgtaggtttcg

SEQ ID NO: 384452 - DNA, 25 bp, Rattus norvegicus
gcaggattccacaatgcaggtttat

SEQ ID NO: 384453 - DNA, 25 bp, Rattus norvegicus
gcaggattccactatgcaggtttat

SEQ ID NO: 384454 - DNA, 25 bp, Rattus norvegicus
gcaggattcttcaactggctcctat

SEQ ID NO: 384455 - DNA, 25 bp, Rattus norvegicus
gcaggattcttctactggctcctat

SEQ ID NO: 384456 - DNA, 25 bp, Rattus norvegicus
gcaggattgctaacattggcagaga

SEQ ID NO: 384457 - DNA, 25 bp, Rattus norvegicus
gcaggattgctatcattggcagaga

SEQ ID NO: 384458 - DNA, 25 bp, Rattus norvegicus
gcaggatttattctgacttctcaga

SEQ ID NO: 384459 - DNA, 25 bp, Rattus norvegicus
gcaggatttattgtgacttctcaga

SEQ ID NO: 384460 - DNA, 25 bp, Rattus norvegicus
gcaggatttcacatcggactccata

SEQ ID NO: 384461 - DNA, 25 bp, Rattus norvegicus
gcaggatttcacttcggactccata

SEQ ID NO: 384462 - DNA, 25 bp, Rattus norvegicus
gcaggatttctccatatagctcatc

SEQ ID NO: 384463 - DNA, 25 bp, Rattus norvegicus
gcaggatttctcgatatagctcatc

SEQ ID NO: 384464 - DNA, 25 bp, Rattus norvegicus
gcaggatttcttcccggagacccaa

SEQ ID NO: 384465 - DNA, 25 bp, Rattus norvegicus
gcaggatttcttgccggagacccaa

SEQ ID NO: 384466 - DNA, 25 bp, Rattus norvegicus
gcaggatttgccctctgtagcctcc

SEQ ID NO: 384467 - DNA, 25 bp, Rattus norvegicus
gcaggatttgccgtctgtagcctcc

SEQ ID NO: 384468 - DNA, 25 bp, Rattus norvegicus
gcaggattttagatcgaccgcggtg

SEQ ID NO: 384469 - DNA, 25 bp, Rattus norvegicus
gcaggattttagttcgaccgcggtg

SEQ ID NO: 384470 - DNA, 25 bp, Rattus norvegicus
gcaggcaaaaagcattcatacatgt

SEQ ID NO: 384471 - DNA, 25 bp, Rattus norvegicus
gcaggcaaaaaggattcatacatgt

SEQ ID NO: 384472 - DNA, 25 bp, Rattus norvegicus
gcaggcaaaaatatccatacgtgta

SEQ ID NO: 384473 - DNA, 25 bp, Rattus norvegicus
gcaggcaaaaatttccatacgtgta

SEQ ID NO: 384474 - DNA, 25 bp, Rattus norvegicus
gcaggcaagaagattttcattcaga

SEQ ID NO: 384475 - DNA, 25 bp, Rattus norvegicus
gcaggcaagaagtttttcattcaga

SEQ ID NO: 384476 - DNA, 25 bp, Rattus norvegicus
gcaggcaagcccacagcacttgaaa

SEQ ID NO: 384477 - DNA, 25 bp, Rattus norvegicus
gcaggcaagccctcagcacttgaaa

SEQ ID NO: 384478 - DNA, 25 bp, Rattus norvegicus
gcaggcaagtgcaccaagacctctt

SEQ ID NO: 384479 - DNA, 25 bp, Rattus norvegicus
gcaggcaagtgctccaagacctctt

SEQ ID NO: 384480 - DNA, 25 bp, Rattus norvegicus
gcaggcacaacccattcctgggtag

SEQ ID NO: 384481 - DNA, 25 bp, Rattus norvegicus
gcaggcacaaccgattcctgggtag

SEQ ID NO: 384482 - DNA, 25 bp, Rattus norvegicus
gcaggcacagctccagtttaaattc

SEQ ID NO: 384483 - DNA, 25 bp, Rattus norvegicus
gcaggcacagctgcagtttaaattc

SEQ ID NO: 384484 - DNA, 25 bp, Rattus norvegicus
gcaggcaccaaaagctttattatag

SEQ ID NO: 384485 - DNA, 25 bp, Rattus norvegicus
gcaggcaccaaatgctttattatag

SEQ ID NO: 384486 - DNA, 25 bp, Rattus norvegicus
gcaggcaccagcaagaatccgactt

SEQ ID NO: 384487 - DNA, 25 bp, Rattus norvegicus
gcaggcaccagctagaatccgactt

SEQ ID NO: 384488 - DNA, 25 bp, Rattus norvegicus
gcaggcacccctcaagtggagtgaa

SEQ ID NO: 384489 - DNA, 25 bp, Rattus norvegicus
gcaggcacccctgaagtggagtgaa

SEQ ID NO: 384490 - DNA, 25 bp, Rattus norvegicus
gcaggcaccttcatattgaatcttt

SEQ ID NO: 384491 - DNA, 25 bp, Rattus norvegicus
gcaggcaccttcttattgaatcttt

SEQ ID NO: 384492 - DNA, 25 bp, Rattus norvegicus
gcaggcacgccacaacaacaggttc

SEQ ID NO: 384493 - DNA, 25 bp, Rattus norvegicus
gcaggcacgccagaacaacaggttc

SEQ ID NO: 384494 - DNA, 25 bp, Rattus norvegicus
gcaggcacgttaccacctatgttta

SEQ ID NO: 384495 - DNA, 25 bp, Rattus norvegicus
gcaggcacgttagcacctatgttta

SEQ ID NO: 384496 - DNA, 25 bp, Rattus norvegicus
gcaggcactgggactaagcaaagct

SEQ ID NO: 384497 - DNA, 25 bp, Rattus norvegicus
gcaggcactgggtctaagcaaagct

SEQ ID NO: 384498 - DNA, 25 bp, Rattus norvegicus
gcaggcactgtgcatgaggactctt

SEQ ID NO: 384499 - DNA, 25 bp, Rattus norvegicus
gcaggcactgtggatgaggactctt

SEQ ID NO: 384500 - DNA, 25 bp, Rattus norvegicus
gcaggcacttcgagcacatggtgca

SEQ ID NO: 384501 - DNA, 25 bp, Rattus norvegicus
gcaggcacttcgtgcacatggtgca

SEQ ID NO: 384502 - DNA, 25 bp, Rattus norvegicus
gcaggcagacctaaactgatcctaa

SEQ ID NO: 384503 - DNA, 25 bp, Rattus norvegicus
gcaggcagaccttaactgatcctaa

SEQ ID NO: 384504 - DNA, 25 bp, Rattus norvegicus
gcaggcagactgagaaacttaggat

SEQ ID NO: 384505 - DNA, 25 bp, Rattus norvegicus
gcaggcagactgtgaaacttaggat

SEQ ID NO: 384506 - DNA, 25 bp, Rattus norvegicus
gcaggcagatggacaagaaagacgt

SEQ ID NO: 384507 - DNA, 25 bp, Rattus norvegicus
gcaggcagatggctgaccctagcaa

SEQ ID NO: 384508 - DNA, 25 bp, Rattus norvegicus
gcaggcagatgggtgaccctagcaa

SEQ ID NO: 384509 - DNA, 25 bp, Rattus norvegicus
gcaggcagatggtcaagaaagacgt

SEQ ID NO: 384510 - DNA, 25 bp, Rattus norvegicus
gcaggcagcagtatggtggacatac

SEQ ID NO: 384511 - DNA, 25 bp, Rattus norvegicus
gcaggcagcagtttggtggacatac

SEQ ID NO: 384512 - DNA, 25 bp, Rattus norvegicus
gcaggcagccttagtgttctttgtg

SEQ ID NO: 384513 - DNA, 25 bp, Rattus norvegicus
gcaggcagccttccaggcaatataa

SEQ ID NO: 384514 - DNA, 25 bp, Rattus norvegicus
gcaggcagccttgcaggcaatataa

SEQ ID NO: 384515 - DNA, 25 bp, Rattus norvegicus
gcaggcagcctttgtgttctttgtg

SEQ ID NO: 384516 - DNA, 25 bp, Rattus norvegicus
gcaggcagctctcttgaattcatgg

SEQ ID NO: 384517 - DNA, 25 bp, Rattus norvegicus
gcaggcagctctgttgaattcatgg

SEQ ID NO: 384518 - DNA, 25 bp, Rattus norvegicus
gcaggcagctgcacacgatacgcgt

SEQ ID NO: 384519 - DNA, 25 bp, Rattus norvegicus
gcaggcagctgctcacgatacgcgt

SEQ ID NO: 384520 - DNA, 25 bp, Rattus norvegicus
gcaggcagcttaatgtaccgacttt

SEQ ID NO: 384521 - DNA, 25 bp, Rattus norvegicus
gcaggcagcttattgtaccgacttt

SEQ ID NO: 384522 - DNA, 25 bp, Rattus norvegicus
gcaggcaggcacagtgttcatcaac

SEQ ID NO: 384523 - DNA, 25 bp, Rattus norvegicus
gcaggcaggcactgtgttcatcaac

SEQ ID NO: 384524 - DNA, 25 bp, Rattus norvegicus
gcaggcaggcctatgtaacagttta

SEQ ID NO: 384525 - DNA, 25 bp, Rattus norvegicus
gcaggcaggcctttgtaacagttta

SEQ ID NO: 384526 - DNA, 25 bp, Rattus norvegicus
gcaggcaggtcacgccagcttcagt

SEQ ID NO: 384527 - DNA, 25 bp, Rattus norvegicus
gcaggcaggtcaggccagcttcagt

SEQ ID NO: 384528 - DNA, 25 bp, Rattus norvegicus
gcaggcagtgacactactgtgctaa

SEQ ID NO: 384529 - DNA, 25 bp, Rattus norvegicus
gcaggcagtgactctactgtgctaa

SEQ ID NO: 384530 - DNA, 25 bp, Rattus norvegicus
gcaggcagtgagaacgtccagtatt

SEQ ID NO: 384531 - DNA, 25 bp, Rattus norvegicus
gcaggcagtgagtacgtccagtatt

SEQ ID NO: 384532 - DNA, 25 bp, Rattus norvegicus
gcaggcagttgtcagatcctccttc

SEQ ID NO: 384533 - DNA, 25 bp, Rattus norvegicus
gcaggcagttgtgagatcctccttc

SEQ ID NO: 384534 - DNA, 25 bp, Rattus norvegicus
gcaggcatagctctgaattcagggc

SEQ ID NO: 384535 - DNA, 25 bp, Rattus norvegicus
gcaggcatagctgtgaattcagggc

SEQ ID NO: 384536 - DNA, 25 bp, Rattus norvegicus
gcaggcatcgacacagacactcaga

SEQ ID NO: 384537 - DNA, 25 bp, Rattus norvegicus
gcaggcatcgactcagacactcaga

SEQ ID NO: 384538 - DNA, 25 bp, Rattus norvegicus
gcaggcatctttatgttgcttttaa

SEQ ID NO: 384539 - DNA, 25 bp, Rattus norvegicus
gcaggcatctttttgttgcttttaa

SEQ ID NO: 384540 - DNA, 25 bp, Rattus norvegicus
gcaggcatgatcacgcatgctcgta

SEQ ID NO: 384541 - DNA, 25 bp, Rattus norvegicus
gcaggcatgatctcgcatgctcgta

SEQ ID NO: 384542 - DNA, 25 bp, Rattus norvegicus
gcaggcatgcctagctttaagtaaa

SEQ ID NO: 384543 - DNA, 25 bp, Rattus norvegicus
gcaggcatgccttgctttaagtaaa

SEQ ID NO: 384544 - DNA, 25 bp, Rattus norvegicus
gcaggcatgcgaccgtcagcattta

SEQ ID NO: 384545 - DNA, 25 bp, Rattus norvegicus
gcaggcatgcgagcgtcagcattta

SEQ ID NO: 384546 - DNA, 25 bp, Rattus norvegicus
gcaggcatggagatctctttaccgg

SEQ ID NO: 384547 - DNA, 25 bp, Rattus norvegicus
gcaggcatggagttctctttaccgg

SEQ ID NO: 384548 - DNA, 25 bp, Rattus norvegicus
gcaggcatggcgcttctagctgaac

SEQ ID NO: 384549 - DNA, 25 bp, Rattus norvegicus
gcaggcatggcggttctagctgaac

SEQ ID NO: 384550 - DNA, 25 bp, Rattus norvegicus
gcaggcattcctcgtacagatcaca

SEQ ID NO: 384551 - DNA, 25 bp, Rattus norvegicus
gcaggcattcctggtacagatcaca

SEQ ID NO: 384552 - DNA, 25 bp, Rattus norvegicus
gcaggcattggcatagttctcagat

SEQ ID NO: 384553 - DNA, 25 bp, Rattus norvegicus
gcaggcattggcttagttctcagat

SEQ ID NO: 384554 - DNA, 25 bp, Rattus norvegicus
gcaggcattgtcacctacgggaaaa

SEQ ID NO: 384555 - DNA, 25 bp, Rattus norvegicus
gcaggcattgtctcctacgggaaaa

SEQ ID NO: 384556 - DNA, 25 bp, Rattus norvegicus
gcaggcatttgcagtgctgtaccgt

SEQ ID NO: 384557 - DNA, 25 bp, Rattus norvegicus
gcaggcatttgctgtgctgtaccgt

SEQ ID NO: 384558 - DNA, 25 bp, Rattus norvegicus
gcaggccaacttatagctctaggtc

SEQ ID NO: 384559 - DNA, 25 bp, Rattus norvegicus
gcaggccaacttttagctctaggtc

SEQ ID NO: 384560 - DNA, 25 bp, Rattus norvegicus
gcaggccaaggactatctgtaccat

SEQ ID NO: 384561 - DNA, 25 bp, Rattus norvegicus
gcaggccaaggagtatctgtaccat

SEQ ID NO: 384562 - DNA, 25 bp, Rattus norvegicus
gcaggccacaatccttgggaagctt

SEQ ID NO: 384563 - DNA, 25 bp, Rattus norvegicus
gcaggccacaatgcttgggaagctt

SEQ ID NO: 384564 - DNA, 25 bp, Rattus norvegicus
gcaggccacactagtacagcattaa

SEQ ID NO: 384565 - DNA, 25 bp, Rattus norvegicus
gcaggccacacttgtacagcattaa

SEQ ID NO: 384566 - DNA, 25 bp, Rattus norvegicus
gcaggccacattcatgccatctgta

SEQ ID NO: 384567 - DNA, 25 bp, Rattus norvegicus
gcaggccacattgatgccatctgta

SEQ ID NO: 384568 - DNA, 25 bp, Rattus norvegicus
gcaggccaccagctcgagagaaatt

SEQ ID NO: 384569 - DNA, 25 bp, Rattus norvegicus
gcaggccaccaggtcgagagaaatt

SEQ ID NO: 384570 - DNA, 25 bp, Rattus norvegicus
gcaggccacctgattagaagagagc

SEQ ID NO: 384571 - DNA, 25 bp, Rattus norvegicus
gcaggccacctgtttagaagagagc

SEQ ID NO: 384572 - DNA, 25 bp, Rattus norvegicus
gcaggccactcgagccttaatgatt

SEQ ID NO: 384573 - DNA, 25 bp, Rattus norvegicus
gcaggccactcgtgccttaatgatt

SEQ ID NO: 384574 - DNA, 25 bp, Rattus norvegicus
gcaggccactggacttcgggaatat

SEQ ID NO: 384575 - DNA, 25 bp, Rattus norvegicus
gcaggccactggtcttcgggaatat

SEQ ID NO: 384576 - DNA, 25 bp, Rattus norvegicus
gcaggccagacaccaaacccaagat

SEQ ID NO: 384577 - DNA, 25 bp, Rattus norvegicus
gcaggccagacagcaaacccaagat

SEQ ID NO: 384578 - DNA, 25 bp, Rattus norvegicus
gcaggccagcataagcagaacacat

SEQ ID NO: 384579 - DNA, 25 bp, Rattus norvegicus
gcaggccagcattagcagaacacat

SEQ ID NO: 384580 - DNA, 25 bp, Rattus norvegicus
gcaggccagcctcggaaatggacat

SEQ ID NO: 384581 - DNA, 25 bp, Rattus norvegicus
gcaggccagcctgggaaatggacat

SEQ ID NO: 384582 - DNA, 25 bp, Rattus norvegicus
gcaggccagcgtagtgagacagacc

SEQ ID NO: 384583 - DNA, 25 bp, Rattus norvegicus
gcaggccagcgttgtgagacagacc

SEQ ID NO: 384584 - DNA, 25 bp, Rattus norvegicus
gcaggccaggttctatactacagtc

SEQ ID NO: 384585 - DNA, 25 bp, Rattus norvegicus
gcaggccaggttgtatactacagtc

SEQ ID NO: 384586 - DNA, 25 bp, Rattus norvegicus
gcaggccagttgctctgaattcaaa

SEQ ID NO: 384587 - DNA, 25 bp, Rattus norvegicus
gcaggccagttggtctgaattcaaa

SEQ ID NO: 384588 - DNA, 25 bp, Rattus norvegicus
gcaggccatcagacccaagcagagt

SEQ ID NO: 384589 - DNA, 25 bp, Rattus norvegicus
gcaggccatcagtcccaagcagagt

SEQ ID NO: 384590 - DNA, 25 bp, Rattus norvegicus
gcaggccatgagacagggccacagt

SEQ ID NO: 384591 - DNA, 25 bp, Rattus norvegicus
gcaggccatgagtcagggccacagt

SEQ ID NO: 384592 - DNA, 25 bp, Rattus norvegicus
gcaggccatgtgagggaagacactc

SEQ ID NO: 384593 - DNA, 25 bp, Rattus norvegicus
gcaggccatgtgtgggaagacactc

SEQ ID NO: 384594 - DNA, 25 bp, Rattus norvegicus
gcaggcccacagagtatgggttcaa

SEQ ID NO: 384595 - DNA, 25 bp, Rattus norvegicus
gcaggcccacagtgtatgggttcaa

SEQ ID NO: 384596 - DNA, 25 bp, Rattus norvegicus
gcaggcccggctccgttttgaagta

SEQ ID NO: 384597 - DNA, 25 bp, Rattus norvegicus
gcaggcccggctgcgttttgaagta

SEQ ID NO: 384598 - DNA, 25 bp, Rattus norvegicus
gcaggccctggcaaccgctgaggaa

SEQ ID NO: 384599 - DNA, 25 bp, Rattus norvegicus
gcaggccctggctaccgctgaggaa

SEQ ID NO: 384600 - DNA, 25 bp, Rattus norvegicus
gcaggccctttcattttgtacatat

SEQ ID NO: 384601 - DNA, 25 bp, Rattus norvegicus
gcaggccctttctttttgtacatat

SEQ ID NO: 384602 - DNA, 25 bp, Rattus norvegicus
gcaggccgaggaaaggcgtgctctc

SEQ ID NO: 384603 - DNA, 25 bp, Rattus norvegicus
gcaggccgaggataggcgtgctctc

SEQ ID NO: 384604 - DNA, 25 bp, Rattus norvegicus
gcaggccgatctacctgggttccgt

SEQ ID NO: 384605 - DNA, 25 bp, Rattus norvegicus
gcaggccgatcttcctgggttccgt

SEQ ID NO: 384606 - DNA, 25 bp, Rattus norvegicus
gcaggccggccaacaagctctacag

SEQ ID NO: 384607 - DNA, 25 bp, Rattus norvegicus
gcaggccggccatcaagctctacag

SEQ ID NO: 384608 - DNA, 25 bp, Rattus norvegicus
gcaggcctagacacatgtggcatag

SEQ ID NO: 384609 - DNA, 25 bp, Rattus norvegicus
gcaggcctagactcatgtggcatag

SEQ ID NO: 384610 - DNA, 25 bp, Rattus norvegicus
gcaggcctatgacttcatgtgtttg

SEQ ID NO: 384611 - DNA, 25 bp, Rattus norvegicus
gcaggcctatgagttcatgtgtttg

SEQ ID NO: 384612 - DNA, 25 bp, Rattus norvegicus
gcaggcctcagcagagttcttgtct

SEQ ID NO: 384613 - DNA, 25 bp, Rattus norvegicus
gcaggcctcagctgagttcttgtct

SEQ ID NO: 384614 - DNA, 25 bp, Rattus norvegicus
gcaggcctcatgagaatgtgttcag

SEQ ID NO: 384615 - DNA, 25 bp, Rattus norvegicus
gcaggcctcatgtgaatgtgttcag

SEQ ID NO: 384616 - DNA, 25 bp, Rattus norvegicus
gcaggcctccatagaactgttgtaa

SEQ ID NO: 384617 - DNA, 25 bp, Rattus norvegicus
gcaggcctccattgaactgttgtaa

SEQ ID NO: 384618 - DNA, 25 bp, Rattus norvegicus
gcaggcctctaaactctaaagaggt

SEQ ID NO: 384619 - DNA, 25 bp, Rattus norvegicus
gcaggcctctaatctctaaagaggt

SEQ ID NO: 384620 - DNA, 25 bp, Rattus norvegicus
gcaggcctctctctaactgttaata

SEQ ID NO: 384621 - DNA, 25 bp, Rattus norvegicus
gcaggcctctctgtaactgttaata

SEQ ID NO: 384622 - DNA, 25 bp, Rattus norvegicus
gcaggcctgtaccacgtagttaaat

SEQ ID NO: 384623 - DNA, 25 bp, Rattus norvegicus
gcaggcctgtacgacgtagttaaat

SEQ ID NO: 384624 - DNA, 25 bp, Rattus norvegicus
gcaggccttcaactccaagtgcaag

SEQ ID NO: 384625 - DNA, 25 bp, Rattus norvegicus
gcaggccttcaagtccaagtgcaag

SEQ ID NO: 384626 - DNA, 25 bp, Rattus norvegicus
gcaggccttctgcattgaattcagc

SEQ ID NO: 384627 - DNA, 25 bp, Rattus norvegicus
gcaggccttctggattgaattcagc

SEQ ID NO: 384628 - DNA, 25 bp, Rattus norvegicus
gcaggccttggcaaagacactacta

SEQ ID NO: 384629 - DNA, 25 bp, Rattus norvegicus
gcaggccttggctaagacactacta

SEQ ID NO: 384630 - DNA, 25 bp, Rattus norvegicus
gcaggccttgtacgcaccgtggtca

SEQ ID NO: 384631 - DNA, 25 bp, Rattus norvegicus
gcaggccttgtaggcaccgtggtca

SEQ ID NO: 384632 - DNA, 25 bp, Rattus norvegicus
gcaggcgacacaagaagcggatcca

SEQ ID NO: 384633 - DNA, 25 bp, Rattus norvegicus
gcaggcgacacatgaagcggatcca

SEQ ID NO: 384634 - DNA, 25 bp, Rattus norvegicus
gcaggcgcactcaggtagcacgggc

SEQ ID NO: 384635 - DNA, 25 bp, Rattus norvegicus
gcaggcgcactctggtagcacgggc

SEQ ID NO: 384636 - DNA, 25 bp, Rattus norvegicus
gcaggcgcacttcctacacggagtg

SEQ ID NO: 384637 - DNA, 25 bp, Rattus norvegicus
gcaggcgcacttgctacacggagtg

SEQ ID NO: 384638 - DNA, 25 bp, Rattus norvegicus
gcaggcgccatgaacatcctgggaa

SEQ ID NO: 384639 - DNA, 25 bp, Rattus norvegicus
gcaggcgccatgtacatcctgggaa

SEQ ID NO: 384640 - DNA, 25 bp, Rattus norvegicus
gcaggcgccttcagtccgtctttaa

SEQ ID NO: 384641 - DNA, 25 bp, Rattus norvegicus
gcaggcgccttctgtccgtctttaa

SEQ ID NO: 384642 - DNA, 25 bp, Rattus norvegicus
gcaggcgcggctcatctaccatggc

SEQ ID NO: 384643 - DNA, 25 bp, Rattus norvegicus
gcaggcgcggctgatctaccatggc

SEQ ID NO: 384644 - DNA, 25 bp, Rattus norvegicus
gcaggcgctgcacacagtattcagg

SEQ ID NO: 384645 - DNA, 25 bp, Rattus norvegicus
gcaggcgctgcagacagtattcagg

SEQ ID NO: 384646 - DNA, 25 bp, Rattus norvegicus
gcaggcgctgccaagaagcccaaga

SEQ ID NO: 384647 - DNA, 25 bp, Rattus norvegicus
gcaggcgctgcctagaagcccaaga

SEQ ID NO: 384648 - DNA, 25 bp, Rattus norvegicus
gcaggcgtagccactgttactcagt

SEQ ID NO: 384649 - DNA, 25 bp, Rattus norvegicus
gcaggcgtagcctctgttactcagt

SEQ ID NO: 384650 - DNA, 25 bp, Rattus norvegicus
gcaggcgtggctccccggccggatt

SEQ ID NO: 384651 - DNA, 25 bp, Rattus norvegicus
gcaggcgtggctgcccggccggatt

SEQ ID NO: 384652 - DNA, 25 bp, Rattus norvegicus
gcaggcgttggcattgagacctact

SEQ ID NO: 384653 - DNA, 25 bp, Rattus norvegicus
gcaggcgttggctttgagacctact

SEQ ID NO: 384654 - DNA, 25 bp, Rattus norvegicus
gcaggcgtttatatctgcagggctg

SEQ ID NO: 384655 - DNA, 25 bp, Rattus norvegicus
gcaggcgtttatttctgcagggctg

SEQ ID NO: 384656 - DNA, 25 bp, Rattus norvegicus
gcaggctaacagcagatctcttcag

SEQ ID NO: 384657 - DNA, 25 bp, Rattus norvegicus
gcaggctaacaggagatctcttcag

SEQ ID NO: 384658 - DNA, 25 bp, Rattus norvegicus
gcaggctaacggagtttgccgccca

SEQ ID NO: 384659 - DNA, 25 bp, Rattus norvegicus
gcaggctaacggtgtttgccgccca

SEQ ID NO: 384660 - DNA, 25 bp, Rattus norvegicus
gcaggctacatgagacaaatcccat

SEQ ID NO: 384661 - DNA, 25 bp, Rattus norvegicus
gcaggctacatgtgacaaatcccat

SEQ ID NO: 384662 - DNA, 25 bp, Rattus norvegicus
gcaggctagaacagaggcactactt

SEQ ID NO: 384663 - DNA, 25 bp, Rattus norvegicus
gcaggctagaactgaggcactactt

SEQ ID NO: 384664 - DNA, 25 bp, Rattus norvegicus
gcaggctagcatccaggagtgcctc

SEQ ID NO: 384665 - DNA, 25 bp, Rattus norvegicus
gcaggctagcatgcaggagtgcctc

SEQ ID NO: 384666 - DNA, 25 bp, Rattus norvegicus
gcaggctagccaaaaccattctgtg

SEQ ID NO: 384667 - DNA, 25 bp, Rattus norvegicus
gcaggctagccataaccattctgtg

SEQ ID NO: 384668 - DNA, 25 bp, Rattus norvegicus
gcaggctcaaaaaggagtccgcttt

SEQ ID NO: 384669 - DNA, 25 bp, Rattus norvegicus
gcaggctcaaaatggagtccgcttt

SEQ ID NO: 384670 - DNA, 25 bp, Rattus norvegicus
gcaggctcaagcaaaggatgccata

SEQ ID NO: 384671 - DNA, 25 bp, Rattus norvegicus
gcaggctcaagctaaggatgccata

SEQ ID NO: 384672 - DNA, 25 bp, Rattus norvegicus
gcaggctcaagtcgctccagcagga

SEQ ID NO: 384673 - DNA, 25 bp, Rattus norvegicus
gcaggctcaagtggctccagcagga

SEQ ID NO: 384674 - DNA, 25 bp, Rattus norvegicus
gcaggctcaccaaggctatgccagc

SEQ ID NO: 384675 - DNA, 25 bp, Rattus norvegicus
gcaggctcaccatggctatgccagc

SEQ ID NO: 384676 - DNA, 25 bp, Rattus norvegicus
gcaggctcactcactgtgtcatgag

SEQ ID NO: 384677 - DNA, 25 bp, Rattus norvegicus
gcaggctcactctctgtgtcatgag

SEQ ID NO: 384678 - DNA, 25 bp, Rattus norvegicus
gcaggctcaggtcccaatcgcaatg

SEQ ID NO: 384679 - DNA, 25 bp, Rattus norvegicus
gcaggctcaggtgccaatcgcaatg

SEQ ID NO: 384680 - DNA, 25 bp, Rattus norvegicus
gcaggctcatcccaatgctgtaggc

SEQ ID NO: 384681 - DNA, 25 bp, Rattus norvegicus
gcaggctcatccgaatgctgtaggc

SEQ ID NO: 384682 - DNA, 25 bp, Rattus norvegicus
gcaggctccagaatcaggagaactt

SEQ ID NO: 384683 - DNA, 25 bp, Rattus norvegicus
gcaggctccagattcaggagaactt

SEQ ID NO: 384684 - DNA, 25 bp, Rattus norvegicus
gcaggctccaggacagacttctaaa

SEQ ID NO: 384685 - DNA, 25 bp, Rattus norvegicus
gcaggctccaggtcagacttctaaa

SEQ ID NO: 384686 - DNA, 25 bp, Rattus norvegicus
gcaggctccagtccattttgaaatt

SEQ ID NO: 384687 - DNA, 25 bp, Rattus norvegicus
gcaggctccagtgcattttgaaatt

SEQ ID NO: 384688 - DNA, 25 bp, Rattus norvegicus
gcaggctccctgataggatctggaa

SEQ ID NO: 384689 - DNA, 25 bp, Rattus norvegicus
gcaggctccctgttaggatctggaa

SEQ ID NO: 384690 - DNA, 25 bp, Rattus norvegicus
gcaggctcctgaagatcagcacgat

SEQ ID NO: 384691 - DNA, 25 bp, Rattus norvegicus
gcaggctcctgatgatcagcacgat

SEQ ID NO: 384692 - DNA, 25 bp, Rattus norvegicus
gcaggctctccgatgagtgcaagtt

SEQ ID NO: 384693 - DNA, 25 bp, Rattus norvegicus
gcaggctctccgttgagtgcaagtt

SEQ ID NO: 384694 - DNA, 25 bp, Rattus norvegicus
gcaggctctcgtctatatcgtcatc

SEQ ID NO: 384695 - DNA, 25 bp, Rattus norvegicus
gcaggctctcgtgtatatcgtcatc

SEQ ID NO: 384696 - DNA, 25 bp, Rattus norvegicus
gcaggctctgttctggtggtaataa

SEQ ID NO: 384697 - DNA, 25 bp, Rattus norvegicus
gcaggctctgttcttctcatggtga

SEQ ID NO: 384698 - DNA, 25 bp, Rattus norvegicus
gcaggctctgttgtggtggtaataa

SEQ ID NO: 384699 - DNA, 25 bp, Rattus norvegicus
gcaggctctgttgttctcatggtga

SEQ ID NO: 384700 - DNA, 25 bp, Rattus norvegicus
gcaggctgaagaaactggaaaccct

SEQ ID NO: 384701 - DNA, 25 bp, Rattus norvegicus
gcaggctgaagacctccatgtttag

SEQ ID NO: 384702 - DNA, 25 bp, Rattus norvegicus
gcaggctgaagagctccatgtttag

SEQ ID NO: 384703 - DNA, 25 bp, Rattus norvegicus
gcaggctgaagatactggaaaccct

SEQ ID NO: 384704 - DNA, 25 bp, Rattus norvegicus
gcaggctgaatcaattcccatgtgt

SEQ ID NO: 384705 - DNA, 25 bp, Rattus norvegicus
gcaggctgaatctattcccatgtgt

SEQ ID NO: 384706 - DNA, 25 bp, Rattus norvegicus
gcaggctgactcctttcctttggtc

SEQ ID NO: 384707 - DNA, 25 bp, Rattus norvegicus
gcaggctgactcgtttcctttggtc

SEQ ID NO: 384708 - DNA, 25 bp, Rattus norvegicus
gcaggctgagcaaagctcactggtt

SEQ ID NO: 384709 - DNA, 25 bp, Rattus norvegicus
gcaggctgagcatagctcactggtt

SEQ ID NO: 384710 - DNA, 25 bp, Rattus norvegicus
gcaggctgaggaccagcagtcacca

SEQ ID NO: 384711 - DNA, 25 bp, Rattus norvegicus
gcaggctgaggagcagcagtcacca

SEQ ID NO: 384712 - DNA, 25 bp, Rattus norvegicus
gcaggctgatttctgagtttcaagc

SEQ ID NO: 384713 - DNA, 25 bp, Rattus norvegicus
gcaggctgatttgtgagtttcaagc

SEQ ID NO: 384714 - DNA, 25 bp, Rattus norvegicus
gcaggctgcagaaatgctgccttct

SEQ ID NO: 384715 - DNA, 25 bp, Rattus norvegicus
gcaggctgcagatatgctgccttct

SEQ ID NO: 384716 - DNA, 25 bp, Rattus norvegicus
gcaggctgccttcttcagttaagtt

SEQ ID NO: 384717 - DNA, 25 bp, Rattus norvegicus
gcaggctgccttgttcagttaagtt

SEQ ID NO: 384718 - DNA, 25 bp, Rattus norvegicus
gcaggctgcggcagcctcgcctggg

SEQ ID NO: 384719 - DNA, 25 bp, Rattus norvegicus
gcaggctgcggctgcctcgcctggg

SEQ ID NO: 384720 - DNA, 25 bp, Rattus norvegicus
gcaggctggcataaggctagccaat

SEQ ID NO: 384721 - DNA, 25 bp, Rattus norvegicus
gcaggctggcattaggctagccaat

SEQ ID NO: 384722 - DNA, 25 bp, Rattus norvegicus
gcaggctggctaagctggtttcttt

SEQ ID NO: 384723 - DNA, 25 bp, Rattus norvegicus
gcaggctggctatgctggtttcttt

SEQ ID NO: 384724 - DNA, 25 bp, Rattus norvegicus
gcaggctgggagactgctgccctcc

SEQ ID NO: 384725 - DNA, 25 bp, Rattus norvegicus
gcaggctgggagtctgctgccctcc

SEQ ID NO: 384726 - DNA, 25 bp, Rattus norvegicus
gcaggctggtgcagatatctctatg

SEQ ID NO: 384727 - DNA, 25 bp, Rattus norvegicus
gcaggctggtgctgatatctctatg

SEQ ID NO: 384728 - DNA, 25 bp, Rattus norvegicus
gcaggctgtagacaacggcattctt

SEQ ID NO: 384729 - DNA, 25 bp, Rattus norvegicus
gcaggctgtagagaacggcattctt

SEQ ID NO: 384730 - DNA, 25 bp, Rattus norvegicus
gcaggctgtcctccaatggattgca

SEQ ID NO: 384731 - DNA, 25 bp, Rattus norvegicus
gcaggctgtcctgcaatggattgca

SEQ ID NO: 384732 - DNA, 25 bp, Rattus norvegicus
gcaggctgtgacaaggcccttgcac

SEQ ID NO: 384733 - DNA, 25 bp, Rattus norvegicus
gcaggctgtgactaggcccttgcac

SEQ ID NO: 384734 - DNA, 25 bp, Rattus norvegicus
gcaggctgtggtaagctccatgcca

SEQ ID NO: 384735 - DNA, 25 bp, Rattus norvegicus
gcaggctgtggttagctccatgcca

SEQ ID NO: 384736 - DNA, 25 bp, Rattus norvegicus
gcaggctgttatctgctaagccctg

SEQ ID NO: 384737 - DNA, 25 bp, Rattus norvegicus
gcaggctgttatgtgctaagccctg

SEQ ID NO: 384738 - DNA, 25 bp, Rattus norvegicus
gcaggctgttttaagccgggcaaaa

SEQ ID NO: 384739 - DNA, 25 bp, Rattus norvegicus
gcaggctgtttttagccgggcaaaa

SEQ ID NO: 384740 - DNA, 25 bp, Rattus norvegicus
gcaggcttagctatcagtgggctta

SEQ ID NO: 384741 - DNA, 25 bp, Rattus norvegicus
gcaggcttagctttcagtgggctta

SEQ ID NO: 384742 - DNA, 25 bp, Rattus norvegicus
gcaggcttagtcagtggctactgtt

SEQ ID NO: 384743 - DNA, 25 bp, Rattus norvegicus
gcaggcttagtctgtggctactgtt

SEQ ID NO: 384744 - DNA, 25 bp, Rattus norvegicus
gcaggcttatatatacttcaggaac

SEQ ID NO: 384745 - DNA, 25 bp, Rattus norvegicus
gcaggcttatatttacttcaggaac

SEQ ID NO: 384746 - DNA, 25 bp, Rattus norvegicus
gcaggcttattaccttgctctgtag

SEQ ID NO: 384747 - DNA, 25 bp, Rattus norvegicus
gcaggcttattagcttgctctgtag

SEQ ID NO: 384748 - DNA, 25 bp, Rattus norvegicus
gcaggcttcaatatacagttgggtt

SEQ ID NO: 384749 - DNA, 25 bp, Rattus norvegicus
gcaggcttcaatttacagttgggtt

SEQ ID NO: 384750 - DNA, 25 bp, Rattus norvegicus
gcaggcttcagaccgcccgggcaaa

SEQ ID NO: 384751 - DNA, 25 bp, Rattus norvegicus
gcaggcttcagagcgcccgggcaaa

SEQ ID NO: 384752 - DNA, 25 bp, Rattus norvegicus
gcaggcttcatcatgctcatcgaag

SEQ ID NO: 384753 - DNA, 25 bp, Rattus norvegicus
gcaggcttcatcttgctcatcgaag

SEQ ID NO: 384754 - DNA, 25 bp, Rattus norvegicus
gcaggcttccatatttgctgtagcc

SEQ ID NO: 384755 - DNA, 25 bp, Rattus norvegicus
gcaggcttccatttttgctgtagcc

SEQ ID NO: 384756 - DNA, 25 bp, Rattus norvegicus
gcaggcttcgttctaagtttattga

SEQ ID NO: 384757 - DNA, 25 bp, Rattus norvegicus
gcaggcttcgttgtaagtttattga

SEQ ID NO: 384758 - DNA, 25 bp, Rattus norvegicus
gcaggcttgaccactagggacacac

SEQ ID NO: 384759 - DNA, 25 bp, Rattus norvegicus
gcaggcttgacctctagggacacac

SEQ ID NO: 384760 - DNA, 25 bp, Rattus norvegicus
gcaggcttgcagatgtctgatgaca

SEQ ID NO: 384761 - DNA, 25 bp, Rattus norvegicus
gcaggcttgcagttgtctgatgaca

SEQ ID NO: 384762 - DNA, 25 bp, Rattus norvegicus
gcaggcttggaaatggctgccctgt

SEQ ID NO: 384763 - DNA, 25 bp, Rattus norvegicus
gcaggcttggaattggctgccctgt

SEQ ID NO: 384764 - DNA, 25 bp, Rattus norvegicus
gcaggctttagacaatctacagcaa

SEQ ID NO: 384765 - DNA, 25 bp, Rattus norvegicus
gcaggctttagagaatctacagcaa

SEQ ID NO: 384766 - DNA, 25 bp, Rattus norvegicus
gcaggctttcacacatatacactca

SEQ ID NO: 384767 - DNA, 25 bp, Rattus norvegicus
gcaggctttcactcatatacactca

SEQ ID NO: 384768 - DNA, 25 bp, Rattus norvegicus
gcaggctttgtgagagaggacctcc

SEQ ID NO: 384769 - DNA, 25 bp, Rattus norvegicus
gcaggctttgtgtgagaggacctcc

SEQ ID NO: 384770 - DNA, 25 bp, Rattus norvegicus
gcaggcttttggcataatctattct

SEQ ID NO: 384771 - DNA, 25 bp, Rattus norvegicus
gcaggcttttgggataatctattct

SEQ ID NO: 384772 - DNA, 25 bp, Rattus norvegicus
gcagggaaatccaacagcagttcca

SEQ ID NO: 384773 - DNA, 25 bp, Rattus norvegicus
gcagggaaatccaacttggcctttg

SEQ ID NO: 384774 - DNA, 25 bp, Rattus norvegicus
gcagggaaatcctacagcagttcca

SEQ ID NO: 384775 - DNA, 25 bp, Rattus norvegicus
gcagggaaatcctacttggcctttg

SEQ ID NO: 384776 - DNA, 25 bp, Rattus norvegicus
gcagggaactctactcacagtgttt

SEQ ID NO: 384777 - DNA, 25 bp, Rattus norvegicus
gcagggaactcttctcacagtgttt

SEQ ID NO: 384778 - DNA, 25 bp, Rattus norvegicus
gcagggaagacgctacctccgcaca

SEQ ID NO: 384779 - DNA, 25 bp, Rattus norvegicus
gcagggaagacggtacctccgcaca

SEQ ID NO: 384780 - DNA, 25 bp, Rattus norvegicus
gcagggaagccaagagaagttctcc

SEQ ID NO: 384781 - DNA, 25 bp, Rattus norvegicus
gcagggaagccatgagaagttctcc

SEQ ID NO: 384782 - DNA, 25 bp, Rattus norvegicus
gcagggaagctgcatctggacctcc

SEQ ID NO: 384783 - DNA, 25 bp, Rattus norvegicus
gcagggaagctggatctggacctcc

SEQ ID NO: 384784 - DNA, 25 bp, Rattus norvegicus
gcagggaatcaacgatgacccagat

SEQ ID NO: 384785 - DNA, 25 bp, Rattus norvegicus
gcagggaatcaaggatgacccagat

SEQ ID NO: 384786 - DNA, 25 bp, Rattus norvegicus
gcagggacagcaaggagccgcttct

SEQ ID NO: 384787 - DNA, 25 bp, Rattus norvegicus
gcagggacagcatggagccgcttct

SEQ ID NO: 384788 - DNA, 25 bp, Rattus norvegicus
gcagggacctctcatcctagctctg

SEQ ID NO: 384789 - DNA, 25 bp, Rattus norvegicus
gcagggacctctgatcctagctctg

SEQ ID NO: 384790 - DNA, 25 bp, Rattus norvegicus
gcagggacgctgaatttacctcaca

SEQ ID NO: 384791 - DNA, 25 bp, Rattus norvegicus
gcagggacgctgtatttacctcaca

SEQ ID NO: 384792 - DNA, 25 bp, Rattus norvegicus
gcagggacggacagactcactatga

SEQ ID NO: 384793 - DNA, 25 bp, Rattus norvegicus
gcagggacggactgactcactatga

SEQ ID NO: 384794 - DNA, 25 bp, Rattus norvegicus
gcagggacggtacagccacttttaa

SEQ ID NO: 384795 - DNA, 25 bp, Rattus norvegicus
gcagggacggtagagccacttttaa

SEQ ID NO: 384796 - DNA, 25 bp, Rattus norvegicus
gcagggactagcatgttcagaaatc

SEQ ID NO: 384797 - DNA, 25 bp, Rattus norvegicus
gcagggactagcttgttcagaaatc

SEQ ID NO: 384798 - DNA, 25 bp, Rattus norvegicus
gcagggactcaacccagtgttccaa

SEQ ID NO: 384799 - DNA, 25 bp, Rattus norvegicus
gcagggactcaagccagtgttccaa

SEQ ID NO: 384800 - DNA, 25 bp, Rattus norvegicus
gcagggacttggctaactcctttca

SEQ ID NO: 384801 - DNA, 25 bp, Rattus norvegicus
gcagggacttgggtaactcctttca

SEQ ID NO: 384802 - DNA, 25 bp, Rattus norvegicus
gcagggagaacacaggtgtccacat

SEQ ID NO: 384803 - DNA, 25 bp, Rattus norvegicus
gcagggagaacagaggtgtccacat

SEQ ID NO: 384804 - DNA, 25 bp, Rattus norvegicus
gcagggagacttcacccgagtatct

SEQ ID NO: 384805 - DNA, 25 bp, Rattus norvegicus
gcagggagacttgacccgagtatct

SEQ ID NO: 384806 - DNA, 25 bp, Rattus norvegicus
gcagggagagccattccttggatta

SEQ ID NO: 384807 - DNA, 25 bp, Rattus norvegicus
gcagggagagcctttccttggatta

SEQ ID NO: 384808 - DNA, 25 bp, Rattus norvegicus
gcagggagctccagaaatttcaggt

SEQ ID NO: 384809 - DNA, 25 bp, Rattus norvegicus
gcagggagctcctgaaatttcaggt

SEQ ID NO: 384810 - DNA, 25 bp, Rattus norvegicus
gcagggagctggactccctcaggaa

SEQ ID NO: 384811 - DNA, 25 bp, Rattus norvegicus
gcagggagctggtctccctcaggaa

SEQ ID NO: 384812 - DNA, 25 bp, Rattus norvegicus
gcagggagtcatactgtgcagtcac

SEQ ID NO: 384813 - DNA, 25 bp, Rattus norvegicus
gcagggagtcattctgtgcagtcac

SEQ ID NO: 384814 - DNA, 25 bp, Rattus norvegicus
gcagggagttgtccttaggacccct

SEQ ID NO: 384815 - DNA, 25 bp, Rattus norvegicus
gcagggagttgtgcttaggacccct

SEQ ID NO: 384816 - DNA, 25 bp, Rattus norvegicus
gcagggagttttccttttcggctct

SEQ ID NO: 384817 - DNA, 25 bp, Rattus norvegicus
gcagggagttttgcttttcggctct

SEQ ID NO: 384818 - DNA, 25 bp, Rattus norvegicus
gcagggataggaactctcttggtct

SEQ ID NO: 384819 - DNA, 25 bp, Rattus norvegicus
gcagggataggatctctcttggtct

SEQ ID NO: 384820 - DNA, 25 bp, Rattus norvegicus
gcagggatattcctcagaccccaga

SEQ ID NO: 384821 - DNA, 25 bp, Rattus norvegicus
gcagggatattcgtcagaccccaga

SEQ ID NO: 384822 - DNA, 25 bp, Rattus norvegicus
gcagggatcaccaatcatcctgagg

SEQ ID NO: 384823 - DNA, 25 bp, Rattus norvegicus
gcagggatcacctatcatcctgagg

SEQ ID NO: 384824 - DNA, 25 bp, Rattus norvegicus
gcagggatcatcacagtgcttggat

SEQ ID NO: 384825 - DNA, 25 bp, Rattus norvegicus
gcagggatcatctcagtgcttggat

SEQ ID NO: 384826 - DNA, 25 bp, Rattus norvegicus
gcagggatctcaccccaatggattt

SEQ ID NO: 384827 - DNA, 25 bp, Rattus norvegicus
gcagggatctcagcccaatggattt

SEQ ID NO: 384828 - DNA, 25 bp, Rattus norvegicus
gcagggatctccaaaggactaactt

SEQ ID NO: 384829 - DNA, 25 bp, Rattus norvegicus
gcagggatctcctaaggactaactt

SEQ ID NO: 384830 - DNA, 25 bp, Rattus norvegicus
gcagggatctgcatttgtatgagga

SEQ ID NO: 384831 - DNA, 25 bp, Rattus norvegicus
gcagggatctgcttttgtatgagga

SEQ ID NO: 384832 - DNA, 25 bp, Rattus norvegicus
gcagggatgcccatttacaagagca

SEQ ID NO: 384833 - DNA, 25 bp, Rattus norvegicus
gcagggatgcccttttacaagagca

SEQ ID NO: 384834 - DNA, 25 bp, Rattus norvegicus
gcagggatgttaactcctctgaggt

SEQ ID NO: 384835 - DNA, 25 bp, Rattus norvegicus
gcagggatgttatctcctctgaggt

SEQ ID NO: 384836 - DNA, 25 bp, Rattus norvegicus
gcagggattaaacctgtgaattctg

SEQ ID NO: 384837 - DNA, 25 bp, Rattus norvegicus
gcagggattaaagctgtgaattctg

SEQ ID NO: 384838 - DNA, 25 bp, Rattus norvegicus
gcagggatttctcctctctgctgaa

SEQ ID NO: 384839 - DNA, 25 bp, Rattus norvegicus
gcagggatttctgctctctgctgaa

SEQ ID NO: 384840 - DNA, 25 bp, Rattus norvegicus
gcagggcaaagaagtccaccattac

SEQ ID NO: 384841 - DNA, 25 bp, Rattus norvegicus
gcagggcaaagatgtccaccattac

SEQ ID NO: 384842 - DNA, 25 bp, Rattus norvegicus
gcagggcaataccaaacagcgcatt

SEQ ID NO: 384843 - DNA, 25 bp, Rattus norvegicus
gcagggcaatacgaaacagcgcatt

SEQ ID NO: 384844 - DNA, 25 bp, Rattus norvegicus
gcagggcacgatcactttatattta

SEQ ID NO: 384845 - DNA, 25 bp, Rattus norvegicus
gcagggcacgatgactttatattta

SEQ ID NO: 384846 - DNA, 25 bp, Rattus norvegicus
gcagggcacgttcttcagctgccaa

SEQ ID NO: 384847 - DNA, 25 bp, Rattus norvegicus
gcagggcacgttgttcagctgccaa

SEQ ID NO: 384848 - DNA, 25 bp, Rattus norvegicus
gcagggcactgcctacagtttgaag

SEQ ID NO: 384849 - DNA, 25 bp, Rattus norvegicus
gcagggcactgcgtacagtttgaag

SEQ ID NO: 384850 - DNA, 25 bp, Rattus norvegicus
gcagggcacttgaggagactttggg

SEQ ID NO: 384851 - DNA, 25 bp, Rattus norvegicus
gcagggcacttgtggagactttggg

SEQ ID NO: 384852 - DNA, 25 bp, Rattus norvegicus
gcagggcaggcaagcaggaacctaa

SEQ ID NO: 384853 - DNA, 25 bp, Rattus norvegicus
gcagggcaggcaccatgagccgcga

SEQ ID NO: 384854 - DNA, 25 bp, Rattus norvegicus
gcagggcaggcagcatgagccgcga

SEQ ID NO: 384855 - DNA, 25 bp, Rattus norvegicus
gcagggcaggcatgcaggaacctaa

SEQ ID NO: 384856 - DNA, 25 bp, Rattus norvegicus
gcagggcagtccactctgctataaa

SEQ ID NO: 384857 - DNA, 25 bp, Rattus norvegicus
gcagggcagtcctctctgctataaa

SEQ ID NO: 384858 - DNA, 25 bp, Rattus norvegicus
gcagggcataatccaacaagtcata

SEQ ID NO: 384859 - DNA, 25 bp, Rattus norvegicus
gcagggcataatgcaacaagtcata

SEQ ID NO: 384860 - DNA, 25 bp, Rattus norvegicus
gcagggcatcccaaaatttgaggct

SEQ ID NO: 384861 - DNA, 25 bp, Rattus norvegicus
gcagggcatccctaaatttgaggct

SEQ ID NO: 384862 - DNA, 25 bp, Rattus norvegicus
gcagggcattgcatagcccaaaggt

SEQ ID NO: 384863 - DNA, 25 bp, Rattus norvegicus
gcagggcattgcttagcccaaaggt

SEQ ID NO: 384864 - DNA, 25 bp, Rattus norvegicus
gcagggccacagctacacaatgaag

SEQ ID NO: 384865 - DNA, 25 bp, Rattus norvegicus
gcagggccacaggtacacaatgaag

SEQ ID NO: 384866 - DNA, 25 bp, Rattus norvegicus
gcagggccactgcaggaatcattat

SEQ ID NO: 384867 - DNA, 25 bp, Rattus norvegicus
gcagggccactggaggaatcattat

SEQ ID NO: 384868 - DNA, 25 bp, Rattus norvegicus
gcagggccatcgacaggacttcaaa

SEQ ID NO: 384869 - DNA, 25 bp, Rattus norvegicus
gcagggccatcgtcaggacttcaaa

SEQ ID NO: 384870 - DNA, 25 bp, Rattus norvegicus
gcagggcccaaacagccccggccca

SEQ ID NO: 384871 - DNA, 25 bp, Rattus norvegicus
gcagggcccaaagagccccggccca

SEQ ID NO: 384872 - DNA, 25 bp, Rattus norvegicus
gcagggccctggagaatattgagct

SEQ ID NO: 384873 - DNA, 25 bp, Rattus norvegicus
gcagggccctggtgaatattgagct

SEQ ID NO: 384874 - DNA, 25 bp, Rattus norvegicus
gcagggcccttacaaccacaggctg

SEQ ID NO: 384875 - DNA, 25 bp, Rattus norvegicus
gcagggcccttagaaccacaggctg

SEQ ID NO: 384876 - DNA, 25 bp, Rattus norvegicus
gcagggccgcttatcagggacgcca

SEQ ID NO: 384877 - DNA, 25 bp, Rattus norvegicus
gcagggccgcttttcagggacgcca

SEQ ID NO: 384878 - DNA, 25 bp, Rattus norvegicus
gcagggcctcccaattttggctgtt

SEQ ID NO: 384879 - DNA, 25 bp, Rattus norvegicus
gcagggcctccctattttggctgtt

SEQ ID NO: 384880 - DNA, 25 bp, Rattus norvegicus
gcagggccttccatcgaagtagtga

SEQ ID NO: 384881 - DNA, 25 bp, Rattus norvegicus
gcagggccttccttcgaagtagtga

SEQ ID NO: 384882 - DNA, 25 bp, Rattus norvegicus
gcagggcgccatctgacaagctcat

SEQ ID NO: 384883 - DNA, 25 bp, Rattus norvegicus
gcagggcgccatgtgacaagctcat

SEQ ID NO: 384884 - DNA, 25 bp, Rattus norvegicus
gcagggcgctgacaataccacacca

SEQ ID NO: 384885 - DNA, 25 bp, Rattus norvegicus
gcagggcgctgagaataccacacca

SEQ ID NO: 384886 - DNA, 25 bp, Rattus norvegicus
gcagggctaaaactcatttccatat

SEQ ID NO: 384887 - DNA, 25 bp, Rattus norvegicus
gcagggctaaaagtcatttccatat

SEQ ID NO: 384888 - DNA, 25 bp, Rattus norvegicus
gcagggctagggaacaagtcccagc

SEQ ID NO: 384889 - DNA, 25 bp, Rattus norvegicus
gcagggctagggtacaagtcccagc

SEQ ID NO: 384890 - DNA, 25 bp, Rattus norvegicus
gcagggctagttcccgttgctaaat

SEQ ID NO: 384891 - DNA, 25 bp, Rattus norvegicus
gcagggctagttgccgttgctaaat

SEQ ID NO: 384892 - DNA, 25 bp, Rattus norvegicus
gcagggctcagcatgttcagatcta

SEQ ID NO: 384893 - DNA, 25 bp, Rattus norvegicus
gcagggctcagcttgttcagatcta

SEQ ID NO: 384894 - DNA, 25 bp, Rattus norvegicus
gcagggctcagtccataatgatttc

SEQ ID NO: 384895 - DNA, 25 bp, Rattus norvegicus
gcagggctcagtgcataatgatttc

SEQ ID NO: 384896 - DNA, 25 bp, Rattus norvegicus
gcagggctcatcaaggacattgaat

SEQ ID NO: 384897 - DNA, 25 bp, Rattus norvegicus
gcagggctcatctaggacattgaat

SEQ ID NO: 384898 - DNA, 25 bp, Rattus norvegicus
gcagggctctaccattgtttacaat

SEQ ID NO: 384899 - DNA, 25 bp, Rattus norvegicus
gcagggctctacgattgtttacaat

SEQ ID NO: 384900 - DNA, 25 bp, Rattus norvegicus
gcagggctctgaatttaaatcttac

SEQ ID NO: 384901 - DNA, 25 bp, Rattus norvegicus
gcagggctctgattttaaatcttac

SEQ ID NO: 384902 - DNA, 25 bp, Rattus norvegicus
gcagggctgctcatgtgtaagactc

SEQ ID NO: 384903 - DNA, 25 bp, Rattus norvegicus
gcagggctgctcttgtgtaagactc

SEQ ID NO: 384904 - DNA, 25 bp, Rattus norvegicus
gcagggctgctgctgcacttaatga

SEQ ID NO: 384905 - DNA, 25 bp, Rattus norvegicus
gcagggctgctggtgcacttaatga

SEQ ID NO: 384906 - DNA, 25 bp, Rattus norvegicus
gcagggctggagaatcaatctagag

SEQ ID NO: 384907 - DNA, 25 bp, Rattus norvegicus
gcagggctggagtatcaatctagag

SEQ ID NO: 384908 - DNA, 25 bp, Rattus norvegicus
gcagggctggctccttaaatgctag

SEQ ID NO: 384909 - DNA, 25 bp, Rattus norvegicus
gcagggctggctgcttaaatgctag

SEQ ID NO: 384910 - DNA, 25 bp, Rattus norvegicus
gcagggctgtagagcatcctagtgc

SEQ ID NO: 384911 - DNA, 25 bp, Rattus norvegicus
gcagggctgtagatggctttgtcat

SEQ ID NO: 384912 - DNA, 25 bp, Rattus norvegicus
gcagggctgtagtgcatcctagtgc

SEQ ID NO: 384913 - DNA, 25 bp, Rattus norvegicus
gcagggctgtagttggctttgtcat

SEQ ID NO: 384914 - DNA, 25 bp, Rattus norvegicus
gcagggctgtgcatcgaaaatccaa

SEQ ID NO: 384915 - DNA, 25 bp, Rattus norvegicus
gcagggctgtgcttcgaaaatccaa

SEQ ID NO: 384916 - DNA, 25 bp, Rattus norvegicus
gcagggcttcctccaaattgtattg

SEQ ID NO: 384917 - DNA, 25 bp, Rattus norvegicus
gcagggcttcctgcaaattgtattg

SEQ ID NO: 384918 - DNA, 25 bp, Rattus norvegicus
gcagggctttataggttgtgactac

SEQ ID NO: 384919 - DNA, 25 bp, Rattus norvegicus
gcagggctttattggttgtgactac

SEQ ID NO: 384920 - DNA, 25 bp, Rattus norvegicus
gcagggtaggatactgtcaacacca

SEQ ID NO: 384921 - DNA, 25 bp, Rattus norvegicus
gcagggtaggattctgtcaacacca

SEQ ID NO: 384922 - DNA, 25 bp, Rattus norvegicus
gcagggtagtccatagggatcttcc

SEQ ID NO: 384923 - DNA, 25 bp, Rattus norvegicus
gcagggtagtccttagggatcttcc

SEQ ID NO: 384924 - DNA, 25 bp, Rattus norvegicus
gcagggtatttgacgcaactcacta

SEQ ID NO: 384925 - DNA, 25 bp, Rattus norvegicus
gcagggtatttgtcgcaactcacta

SEQ ID NO: 384926 - DNA, 25 bp, Rattus norvegicus
gcagggtcacgtaccaaatgtgcca

SEQ ID NO: 384927 - DNA, 25 bp, Rattus norvegicus
gcagggtcacgttccaaatgtgcca

SEQ ID NO: 384928 - DNA, 25 bp, Rattus norvegicus
gcagggtcatttaagctggaggctt

SEQ ID NO: 384929 - DNA, 25 bp, Rattus norvegicus
gcagggtcattttagctggaggctt

SEQ ID NO: 384930 - DNA, 25 bp, Rattus norvegicus
gcagggtcccatcatgttctgtgga

SEQ ID NO: 384931 - DNA, 25 bp, Rattus norvegicus
gcagggtcccatgatgttctgtgga

SEQ ID NO: 384932 - DNA, 25 bp, Rattus norvegicus
gcagggtccctgcacatgtgagact

SEQ ID NO: 384933 - DNA, 25 bp, Rattus norvegicus
gcagggtccctggacatgtgagact

SEQ ID NO: 384934 - DNA, 25 bp, Rattus norvegicus
gcagggtcctttaatgtgcctcctg

SEQ ID NO: 384935 - DNA, 25 bp, Rattus norvegicus
gcagggtccttttatgtgcctcctg

SEQ ID NO: 384936 - DNA, 25 bp, Rattus norvegicus
gcagggtcgagtaagcctttttcct

SEQ ID NO: 384937 - DNA, 25 bp, Rattus norvegicus
gcagggtcgagttagcctttttcct

SEQ ID NO: 384938 - DNA, 25 bp, Rattus norvegicus
gcagggtcgggcacagacaagtcaa

SEQ ID NO: 384939 - DNA, 25 bp, Rattus norvegicus
gcagggtcgggctcagacaagtcaa

SEQ ID NO: 384940 - DNA, 25 bp, Rattus norvegicus
gcagggtcgtgaagtgtccgtctaa

SEQ ID NO: 384941 - DNA, 25 bp, Rattus norvegicus
gcagggtcgtgatgtgtccgtctaa

SEQ ID NO: 384942 - DNA, 25 bp, Rattus norvegicus
gcagggtctcacataggctaagcaa

SEQ ID NO: 384943 - DNA, 25 bp, Rattus norvegicus
gcagggtctcacttaggctaagcaa

SEQ ID NO: 384944 - DNA, 25 bp, Rattus norvegicus
gcagggtctcgcctcagtaaaaaga

SEQ ID NO: 384945 - DNA, 25 bp, Rattus norvegicus
gcagggtctcgcgtcagtaaaaaga

SEQ ID NO: 384946 - DNA, 25 bp, Rattus norvegicus
gcagggtctgcaactaggtctgcag

SEQ ID NO: 384947 - DNA, 25 bp, Rattus norvegicus
gcagggtctgcaactgtggcaagca

SEQ ID NO: 384948 - DNA, 25 bp, Rattus norvegicus
gcagggtctgcatctaggtctgcag

SEQ ID NO: 384949 - DNA, 25 bp, Rattus norvegicus
gcagggtctgcatctgtggcaagca

SEQ ID NO: 384950 - DNA, 25 bp, Rattus norvegicus
gcagggtctttcaggaagctccagc

SEQ ID NO: 384951 - DNA, 25 bp, Rattus norvegicus
gcagggtctttctggaagctccagc

SEQ ID NO: 384952 - DNA, 25 bp, Rattus norvegicus
gcagggtgatctccagtttgaagcc

SEQ ID NO: 384953 - DNA, 25 bp, Rattus norvegicus
gcagggtgatctgcagtttgaagcc

SEQ ID NO: 384954 - DNA, 25 bp, Rattus norvegicus
gcagggtgccttcgacttcaacaaa

SEQ ID NO: 384955 - DNA, 25 bp, Rattus norvegicus
gcagggtgccttggacttcaacaaa

SEQ ID NO: 384956 - DNA, 25 bp, Rattus norvegicus
gcagggtgctgcaggcaatatgaaa

SEQ ID NO: 384957 - DNA, 25 bp, Rattus norvegicus
gcagggtgctgctggcaatatgaaa

SEQ ID NO: 384958 - DNA, 25 bp, Rattus norvegicus
gcagggtggatcatttgtgagacaa

SEQ ID NO: 384959 - DNA, 25 bp, Rattus norvegicus
gcagggtggatcttttgtgagacaa

SEQ ID NO: 384960 - DNA, 25 bp, Rattus norvegicus
gcagggtggctacgctactactata

SEQ ID NO: 384961 - DNA, 25 bp, Rattus norvegicus
gcagggtggctaggctactactata

SEQ ID NO: 384962 - DNA, 25 bp, Rattus norvegicus
gcagggtgggttaccaaatttgcat

SEQ ID NO: 384963 - DNA, 25 bp, Rattus norvegicus
gcagggtgggtttccaaatttgcat

SEQ ID NO: 384964 - DNA, 25 bp, Rattus norvegicus
gcagggtgtcatagcacacagtttt

SEQ ID NO: 384965 - DNA, 25 bp, Rattus norvegicus
gcagggtgtcattgcacacagtttt

SEQ ID NO: 384966 - DNA, 25 bp, Rattus norvegicus
gcagggttaactcttatctgtcaac

SEQ ID NO: 384967 - DNA, 25 bp, Rattus norvegicus
gcagggttaactgttatctgtcaac

SEQ ID NO: 384968 - DNA, 25 bp, Rattus norvegicus
gcagggttccctctctgaatagacg

SEQ ID NO: 384969 - DNA, 25 bp, Rattus norvegicus
gcagggttccctgtctgaatagacg

SEQ ID NO: 384970 - DNA, 25 bp, Rattus norvegicus
gcagggttgcccacacaaactgcag

SEQ ID NO: 384971 - DNA, 25 bp, Rattus norvegicus
gcagggttgccctcacaaactgcag

SEQ ID NO: 384972 - DNA, 25 bp, Rattus norvegicus
gcagggttgggtagctatctcagat

SEQ ID NO: 384973 - DNA, 25 bp, Rattus norvegicus
gcagggttgggttgctatctcagat

SEQ ID NO: 384974 - DNA, 25 bp, Rattus norvegicus
gcagggtttgggacgttttcacaat

SEQ ID NO: 384975 - DNA, 25 bp, Rattus norvegicus
gcagggtttgggtcgttttcacaat

SEQ ID NO: 384976 - DNA, 25 bp, Rattus norvegicus
gcagggttttacagtgaggtgaatt

SEQ ID NO: 384977 - DNA, 25 bp, Rattus norvegicus
gcagggttttaccatgttcacctaa

SEQ ID NO: 384978 - DNA, 25 bp, Rattus norvegicus
gcagggttttacgatgttcacctaa

SEQ ID NO: 384979 - DNA, 25 bp, Rattus norvegicus
gcagggttttactgtgaggtgaatt

SEQ ID NO: 384980 - DNA, 25 bp, Rattus norvegicus
gcagggttttgcatatagctacaac

SEQ ID NO: 384981 - DNA, 25 bp, Rattus norvegicus
gcagggttttgcttatagctacaac

SEQ ID NO: 384982 - DNA, 25 bp, Rattus norvegicus
gcagggtttttcagagttggcatcc

SEQ ID NO: 384983 - DNA, 25 bp, Rattus norvegicus
gcagggtttttctgagttggcatcc

SEQ ID NO: 384984 - DNA, 25 bp, Rattus norvegicus
gcaggtaaaacaaccattctcataa

SEQ ID NO: 384985 - DNA, 25 bp, Rattus norvegicus
gcaggtaaaacatccattctcataa

SEQ ID NO: 384986 - DNA, 25 bp, Rattus norvegicus
gcaggtaaatctccttcttgaagtg

SEQ ID NO: 384987 - DNA, 25 bp, Rattus norvegicus
gcaggtaaatctgcttcttgaagtg

SEQ ID NO: 384988 - DNA, 25 bp, Rattus norvegicus
gcaggtaacactacagctaaggtga

SEQ ID NO: 384989 - DNA, 25 bp, Rattus norvegicus
gcaggtaacacttcagctaaggtga

SEQ ID NO: 384990 - DNA, 25 bp, Rattus norvegicus
gcaggtaacattacccaattagggt

SEQ ID NO: 384991 - DNA, 25 bp, Rattus norvegicus
gcaggtaacatttcccaattagggt

SEQ ID NO: 384992 - DNA, 25 bp, Rattus norvegicus
gcaggtaaccatatactgttcccca

SEQ ID NO: 384993 - DNA, 25 bp, Rattus norvegicus
gcaggtaaccatttactgttcccca

SEQ ID NO: 384994 - DNA, 25 bp, Rattus norvegicus
gcaggtaacttcaactctctgttca

SEQ ID NO: 384995 - DNA, 25 bp, Rattus norvegicus
gcaggtaacttcatgtgccattgtt

SEQ ID NO: 384996 - DNA, 25 bp, Rattus norvegicus
gcaggtaacttctactctctgttca

SEQ ID NO: 384997 - DNA, 25 bp, Rattus norvegicus
gcaggtaacttcttgtgccattgtt

SEQ ID NO: 384998 - DNA, 25 bp, Rattus norvegicus
gcaggtaaggcacgccgggcagcat

SEQ ID NO: 384999 - DNA, 25 bp, Rattus norvegicus
gcaggtaaggcaggccgggcagcat

SEQ ID NO: 385000 - DNA, 25 bp, Rattus norvegicus
gcaggtaatcagcaggtttgtctcc

SEQ ID NO: 385001 - DNA, 25 bp, Rattus norvegicus
gcaggtaatcaggaggtttgtctcc

SEQ ID NO: 385002 - DNA, 25 bp, Rattus norvegicus
gcaggtaatctgaccaagttataat

SEQ ID NO: 385003 - DNA, 25 bp, Rattus norvegicus
gcaggtaatctgtccaagttataat

SEQ ID NO: 385004 - DNA, 25 bp, Rattus norvegicus
gcaggtacaactagccaatcataat

SEQ ID NO: 385005 - DNA, 25 bp, Rattus norvegicus
gcaggtacaacttgccaatcataat

SEQ ID NO: 385006 - DNA, 25 bp, Rattus norvegicus
gcaggtacacgaacaccaggttggc

SEQ ID NO: 385007 - DNA, 25 bp, Rattus norvegicus
gcaggtacacgatcaccaggttggc

SEQ ID NO: 385008 - DNA, 25 bp, Rattus norvegicus
gcaggtacatgcagatcatctcgcg

SEQ ID NO: 385009 - DNA, 25 bp, Rattus norvegicus
gcaggtacatgctgatcatctcgcg

SEQ ID NO: 385010 - DNA, 25 bp, Rattus norvegicus
gcaggtaccactctggccataataa

SEQ ID NO: 385011 - DNA, 25 bp, Rattus norvegicus
gcaggtaccactgtggccataataa

SEQ ID NO: 385012 - DNA, 25 bp, Rattus norvegicus
gcaggtaccagcatcaaccctggaa

SEQ ID NO: 385013 - DNA, 25 bp, Rattus norvegicus
gcaggtaccagcttcaaccctggaa

SEQ ID NO: 385014 - DNA, 25 bp, Rattus norvegicus
gcaggtactgagcacagtccagcct

SEQ ID NO: 385015 - DNA, 25 bp, Rattus norvegicus
gcaggtactgaggacagtccagcct

SEQ ID NO: 385016 - DNA, 25 bp, Rattus norvegicus
gcaggtactgcgagagattcgcatt

SEQ ID NO: 385017 - DNA, 25 bp, Rattus norvegicus
gcaggtactgcgtgagattcgcatt

SEQ ID NO: 385018 - DNA, 25 bp, Rattus norvegicus
gcaggtacttatccttggtgtcttc

SEQ ID NO: 385019 - DNA, 25 bp, Rattus norvegicus
gcaggtacttatgcttggtgtcttc

SEQ ID NO: 385020 - DNA, 25 bp, Rattus norvegicus
gcaggtacttttcgtcatagccatc

SEQ ID NO: 385021 - DNA, 25 bp, Rattus norvegicus
gcaggtacttttggtcatagccatc

SEQ ID NO: 385022 - DNA, 25 bp, Rattus norvegicus
gcaggtagcacaacccagtgagggt

SEQ ID NO: 385023 - DNA, 25 bp, Rattus norvegicus
gcaggtagcacatcccagtgagggt

SEQ ID NO: 385024 - DNA, 25 bp, Rattus norvegicus
gcaggtagcaccaggagagatccca

SEQ ID NO: 385025 - DNA, 25 bp, Rattus norvegicus
gcaggtagcacctggagagatccca

SEQ ID NO: 385026 - DNA, 25 bp, Rattus norvegicus
gcaggtagcagccatggtcacagat

SEQ ID NO: 385027 - DNA, 25 bp, Rattus norvegicus
gcaggtagcagcgatggtcacagat

SEQ ID NO: 385028 - DNA, 25 bp, Rattus norvegicus
gcaggtagcttgagttgtatgagaa

SEQ ID NO: 385029 - DNA, 25 bp, Rattus norvegicus
gcaggtagcttgtgttgtatgagaa

SEQ ID NO: 385030 - DNA, 25 bp, Rattus norvegicus
gcaggtatacataggaggaccctca

SEQ ID NO: 385031 - DNA, 25 bp, Rattus norvegicus
gcaggtatacattggaggaccctca

SEQ ID NO: 385032 - DNA, 25 bp, Rattus norvegicus
gcaggtatatgcattttactactag

SEQ ID NO: 385033 - DNA, 25 bp, Rattus norvegicus
gcaggtatatgctttttactactag

SEQ ID NO: 385034 - DNA, 25 bp, Rattus norvegicus
gcaggtatctgccattatggtcttg

SEQ ID NO: 385035 - DNA, 25 bp, Rattus norvegicus
gcaggtatctgcgattatggtcttg

SEQ ID NO: 385036 - DNA, 25 bp, Rattus norvegicus
gcaggtattttgcatctatgttaac

SEQ ID NO: 385037 - DNA, 25 bp, Rattus norvegicus
gcaggtattttggatctatgttaac

SEQ ID NO: 385038 - DNA, 25 bp, Rattus norvegicus
gcaggtcaagccagctattgcagaa

SEQ ID NO: 385039 - DNA, 25 bp, Rattus norvegicus
gcaggtcaagcctgctattgcagaa

SEQ ID NO: 385040 - DNA, 25 bp, Rattus norvegicus
gcaggtcaaggtaatcatcagctac

SEQ ID NO: 385041 - DNA, 25 bp, Rattus norvegicus
gcaggtcaaggttatcatcagctac

SEQ ID NO: 385042 - DNA, 25 bp, Rattus norvegicus
gcaggtcacagtcctccaagctaaa

SEQ ID NO: 385043 - DNA, 25 bp, Rattus norvegicus
gcaggtcacagtgctccaagctaaa

SEQ ID NO: 385044 - DNA, 25 bp, Rattus norvegicus
gcaggtcaccagcatctgagagagt

SEQ ID NO: 385045 - DNA, 25 bp, Rattus norvegicus
gcaggtcaccaggatctgagagagt

SEQ ID NO: 385046 - DNA, 25 bp, Rattus norvegicus
gcaggtcagaccaagaaatcccatt

SEQ ID NO: 385047 - DNA, 25 bp, Rattus norvegicus
gcaggtcagacctagaaatcccatt

SEQ ID NO: 385048 - DNA, 25 bp, Rattus norvegicus
gcaggtcagcaccttgctgtcgatt

SEQ ID NO: 385049 - DNA, 25 bp, Rattus norvegicus
gcaggtcagcacgttgctgtcgatt

SEQ ID NO: 385050 - DNA, 25 bp, Rattus norvegicus
gcaggtcatcaactcaggctcagat

SEQ ID NO: 385051 - DNA, 25 bp, Rattus norvegicus
gcaggtcatcaagtcaggctcagat

SEQ ID NO: 385052 - DNA, 25 bp, Rattus norvegicus
gcaggtcatgaacaacgtggtctcg

SEQ ID NO: 385053 - DNA, 25 bp, Rattus norvegicus
gcaggtcatgaagaacgtggtctcg

SEQ ID NO: 385054 - DNA, 25 bp, Rattus norvegicus
gcaggtcccaagatcggcaagcgta

SEQ ID NO: 385055 - DNA, 25 bp, Rattus norvegicus
gcaggtcccaagttcggcaagcgta

SEQ ID NO: 385056 - DNA, 25 bp, Rattus norvegicus
gcaggtcccgttcctttacaagcag

SEQ ID NO: 385057 - DNA, 25 bp, Rattus norvegicus
gcaggtcccgttgctttacaagcag

SEQ ID NO: 385058 - DNA, 25 bp, Rattus norvegicus
gcaggtccgaacacggtactgttaa

SEQ ID NO: 385059 - DNA, 25 bp, Rattus norvegicus
gcaggtccgaactcggtactgttaa

SEQ ID NO: 385060 - DNA, 25 bp, Rattus norvegicus
gcaggtcctaaaccagcagctgtcg

SEQ ID NO: 385061 - DNA, 25 bp, Rattus norvegicus
gcaggtcctaaagcagcagctgtcg

SEQ ID NO: 385062 - DNA, 25 bp, Rattus norvegicus
gcaggtcctccaccagctagtggaa

SEQ ID NO: 385063 - DNA, 25 bp, Rattus norvegicus
gcaggtcctccagcagctagtggaa

SEQ ID NO: 385064 - DNA, 25 bp, Rattus norvegicus
gcaggtcctctgatttcagattcag

SEQ ID NO: 385065 - DNA, 25 bp, Rattus norvegicus
gcaggtcctctgttttcagattcag

SEQ ID NO: 385066 - DNA, 25 bp, Rattus norvegicus
gcaggtcctgccaaatggtgttcta

SEQ ID NO: 385067 - DNA, 25 bp, Rattus norvegicus
gcaggtcctgcctaatggtgttcta

SEQ ID NO: 385068 - DNA, 25 bp, Rattus norvegicus
gcaggtcctgggagacagatactct

SEQ ID NO: 385069 - DNA, 25 bp, Rattus norvegicus
gcaggtcctgggtgacagatactct

SEQ ID NO: 385070 - DNA, 25 bp, Rattus norvegicus
gcaggtcctgtaaagttgatctgaa

SEQ ID NO: 385071 - DNA, 25 bp, Rattus norvegicus
gcaggtcctgtatagttgatctgaa

SEQ ID NO: 385072 - DNA, 25 bp, Rattus norvegicus
gcaggtcctgtcactacttggaaca

SEQ ID NO: 385073 - DNA, 25 bp, Rattus norvegicus
gcaggtcctgtctctacttggaaca

SEQ ID NO: 385074 - DNA, 25 bp, Rattus norvegicus
gcaggtccttcccagccaagtgtag

SEQ ID NO: 385075 - DNA, 25 bp, Rattus norvegicus
gcaggtccttccgagccaagtgtag

SEQ ID NO: 385076 - DNA, 25 bp, Rattus norvegicus
gcaggtcctttgctactagatgagt

SEQ ID NO: 385077 - DNA, 25 bp, Rattus norvegicus
gcaggtcctttggtactagatgagt

SEQ ID NO: 385078 - DNA, 25 bp, Rattus norvegicus
gcaggtcgtctgaaggaattcctaa

SEQ ID NO: 385079 - DNA, 25 bp, Rattus norvegicus
gcaggtcgtctgtaggaattcctaa

SEQ ID NO: 385080 - DNA, 25 bp, Rattus norvegicus
gcaggtcgtgcacatggccattcat

SEQ ID NO: 385081 - DNA, 25 bp, Rattus norvegicus
gcaggtcgtgcagatggccattcat

SEQ ID NO: 385082 - DNA, 25 bp, Rattus norvegicus
gcaggtctctggaagtcatttgtag

SEQ ID NO: 385083 - DNA, 25 bp, Rattus norvegicus
gcaggtctctggattgtgaacatac

SEQ ID NO: 385084 - DNA, 25 bp, Rattus norvegicus
gcaggtctctggtagtcatttgtag

SEQ ID NO: 385085 - DNA, 25 bp, Rattus norvegicus
gcaggtctctggtttgtgaacatac

SEQ ID NO: 385086 - DNA, 25 bp, Rattus norvegicus
gcaggtctggacatacataagacaa

SEQ ID NO: 385087 - DNA, 25 bp, Rattus norvegicus
gcaggtctggacttacataagacaa

SEQ ID NO: 385088 - DNA, 25 bp, Rattus norvegicus
gcaggtctggtgacttgccgagctt

SEQ ID NO: 385089 - DNA, 25 bp, Rattus norvegicus
gcaggtctggtgtcttgccgagctt

SEQ ID NO: 385090 - DNA, 25 bp, Rattus norvegicus
gcaggtcttgaccatgatggctcag

SEQ ID NO: 385091 - DNA, 25 bp, Rattus norvegicus
gcaggtcttgacgatgatggctcag

SEQ ID NO: 385092 - DNA, 25 bp, Rattus norvegicus
gcaggtcttgcaaccaagtctgatg

SEQ ID NO: 385093 - DNA, 25 bp, Rattus norvegicus
gcaggtcttgcatccaagtctgatg

SEQ ID NO: 385094 - DNA, 25 bp, Rattus norvegicus
gcaggtcttgctcctttggtagcat

SEQ ID NO: 385095 - DNA, 25 bp, Rattus norvegicus
gcaggtcttgctgctttggtagcat

SEQ ID NO: 385096 - DNA, 25 bp, Rattus norvegicus
gcaggtctttctctaagagctacaa

SEQ ID NO: 385097 - DNA, 25 bp, Rattus norvegicus
gcaggtctttctgtaagagctacaa

SEQ ID NO: 385098 - DNA, 25 bp, Rattus norvegicus
gcaggtctttgaattccagttggct

SEQ ID NO: 385099 - DNA, 25 bp, Rattus norvegicus
gcaggtctttgatttccagttggct

SEQ ID NO: 385100 - DNA, 25 bp, Rattus norvegicus
gcaggtgaacatctgggcagactcc

SEQ ID NO: 385101 - DNA, 25 bp, Rattus norvegicus
gcaggtgaacatgtgggcagactcc

SEQ ID NO: 385102 - DNA, 25 bp, Rattus norvegicus
gcaggtgaacctcattcgactggaa

SEQ ID NO: 385103 - DNA, 25 bp, Rattus norvegicus
gcaggtgaacctgattcgactggaa

SEQ ID NO: 385104 - DNA, 25 bp, Rattus norvegicus
gcaggtgaagccattggccgcttct

SEQ ID NO: 385105 - DNA, 25 bp, Rattus norvegicus
gcaggtgaagcctttggccgcttct

SEQ ID NO: 385106 - DNA, 25 bp, Rattus norvegicus
gcaggtgacacccaattggtcctca

SEQ ID NO: 385107 - DNA, 25 bp, Rattus norvegicus
gcaggtgacaccgaattggtcctca

SEQ ID NO: 385108 - DNA, 25 bp, Rattus norvegicus
gcaggtgacattaagattccatgct

SEQ ID NO: 385109 - DNA, 25 bp, Rattus norvegicus
gcaggtgacatttagattccatgct

SEQ ID NO: 385110 - DNA, 25 bp, Rattus norvegicus
gcaggtgaccagactgtatgttact

SEQ ID NO: 385111 - DNA, 25 bp, Rattus norvegicus
gcaggtgaccagtctgtatgttact

SEQ ID NO: 385112 - DNA, 25 bp, Rattus norvegicus
gcaggtgaccttcactacagcacgg

SEQ ID NO: 385113 - DNA, 25 bp, Rattus norvegicus
gcaggtgaccttgactacagcacgg

SEQ ID NO: 385114 - DNA, 25 bp, Rattus norvegicus
gcaggtgactcacactgggacagcc

SEQ ID NO: 385115 - DNA, 25 bp, Rattus norvegicus
gcaggtgactcagactgggacagcc

SEQ ID NO: 385116 - DNA, 25 bp, Rattus norvegicus
gcaggtgactctcaagatctcttaa

SEQ ID NO: 385117 - DNA, 25 bp, Rattus norvegicus
gcaggtgactctgaagatctcttaa

SEQ ID NO: 385118 - DNA, 25 bp, Rattus norvegicus
gcaggtgaggatacttcctcggctt

SEQ ID NO: 385119 - DNA, 25 bp, Rattus norvegicus
gcaggtgaggattcttcctcggctt

SEQ ID NO: 385120 - DNA, 25 bp, Rattus norvegicus
gcaggtgatcatcctgagatgccca

SEQ ID NO: 385121 - DNA, 25 bp, Rattus norvegicus
gcaggtgatcatgctgagatgccca

SEQ ID NO: 385122 - DNA, 25 bp, Rattus norvegicus
gcaggtgcagaacgctgatgaattc

SEQ ID NO: 385123 - DNA, 25 bp, Rattus norvegicus
gcaggtgcagaaggctgatgaattc

SEQ ID NO: 385124 - DNA, 25 bp, Rattus norvegicus
gcaggtgcatcgccagcatttcgat

SEQ ID NO: 385125 - DNA, 25 bp, Rattus norvegicus
gcaggtgcatcggcagcatttcgat

SEQ ID NO: 385126 - DNA, 25 bp, Rattus norvegicus
gcaggtgccattatcataataaact

SEQ ID NO: 385127 - DNA, 25 bp, Rattus norvegicus
gcaggtgccattttcataataaact

SEQ ID NO: 385128 - DNA, 25 bp, Rattus norvegicus
gcaggtgcccaacagcatcagtgct

SEQ ID NO: 385129 - DNA, 25 bp, Rattus norvegicus
gcaggtgcccaagagcatcagtgct

SEQ ID NO: 385130 - DNA, 25 bp, Rattus norvegicus
gcaggtgccccgaaacccgagtcat

SEQ ID NO: 385131 - DNA, 25 bp, Rattus norvegicus
gcaggtgccccgtaacccgagtcat

SEQ ID NO: 385132 - DNA, 25 bp, Rattus norvegicus
gcaggtgccgagctattgcaacatt

SEQ ID NO: 385133 - DNA, 25 bp, Rattus norvegicus
gcaggtgccgaggtattgcaacatt

SEQ ID NO: 385134 - DNA, 25 bp, Rattus norvegicus
gcaggtgccttaatgcatctgtctt

SEQ ID NO: 385135 - DNA, 25 bp, Rattus norvegicus
gcaggtgccttacttcgtggataaa

SEQ ID NO: 385136 - DNA, 25 bp, Rattus norvegicus
gcaggtgccttagttcgtggataaa

SEQ ID NO: 385137 - DNA, 25 bp, Rattus norvegicus
gcaggtgccttattgcatctgtctt

SEQ ID NO: 385138 - DNA, 25 bp, Rattus norvegicus
gcaggtgctattagtacatggtaca

SEQ ID NO: 385139 - DNA, 25 bp, Rattus norvegicus
gcaggtgctatttgtacatggtaca

SEQ ID NO: 385140 - DNA, 25 bp, Rattus norvegicus
gcaggtgctgctaaaaatctcaaaa

SEQ ID NO: 385141 - DNA, 25 bp, Rattus norvegicus
gcaggtgctgctaacacatgtgctg

SEQ ID NO: 385142 - DNA, 25 bp, Rattus norvegicus
gcaggtgctgcttaaaatctcaaaa

SEQ ID NO: 385143 - DNA, 25 bp, Rattus norvegicus
gcaggtgctgcttacacatgtgctg

SEQ ID NO: 385144 - DNA, 25 bp, Rattus norvegicus
gcaggtgctgtccaaacttggctga

SEQ ID NO: 385145 - DNA, 25 bp, Rattus norvegicus
gcaggtgctgtcgaaacttggctga

SEQ ID NO: 385146 - DNA, 25 bp, Rattus norvegicus
gcaggtgctgttcatggatctccca

SEQ ID NO: 385147 - DNA, 25 bp, Rattus norvegicus
gcaggtgctgttgatggatctccca

SEQ ID NO: 385148 - DNA, 25 bp, Rattus norvegicus
gcaggtgcttacactgtatacagta

SEQ ID NO: 385149 - DNA, 25 bp, Rattus norvegicus
gcaggtgcttactctgtatacagta

SEQ ID NO: 385150 - DNA, 25 bp, Rattus norvegicus
gcaggtgcttgaccgctgtgcccca

SEQ ID NO: 385151 - DNA, 25 bp, Rattus norvegicus
gcaggtgcttgagcgctgtgcccca

SEQ ID NO: 385152 - DNA, 25 bp, Rattus norvegicus
gcaggtggacctcgaacagctcatt

SEQ ID NO: 385153 - DNA, 25 bp, Rattus norvegicus
gcaggtggacctggaacagctcatt

SEQ ID NO: 385154 - DNA, 25 bp, Rattus norvegicus
gcaggtggcaaaagctaggatccaa

SEQ ID NO: 385155 - DNA, 25 bp, Rattus norvegicus
gcaggtggcaaatgctaggatccaa

SEQ ID NO: 385156 - DNA, 25 bp, Rattus norvegicus
gcaggtggcaggaggactaacatat

SEQ ID NO: 385157 - DNA, 25 bp, Rattus norvegicus
gcaggtggcaggctaactctagaca

SEQ ID NO: 385158 - DNA, 25 bp, Rattus norvegicus
gcaggtggcagggtaactctagaca

SEQ ID NO: 385159 - DNA, 25 bp, Rattus norvegicus
gcaggtggcaggtggactaacatat

SEQ ID NO: 385160 - DNA, 25 bp, Rattus norvegicus
gcaggtggcgcacctcaaacagaaa

SEQ ID NO: 385161 - DNA, 25 bp, Rattus norvegicus
gcaggtggcgcagctcaaacagaaa

SEQ ID NO: 385162 - DNA, 25 bp, Rattus norvegicus
gcaggtggtaccatctgtgtgctga

SEQ ID NO: 385163 - DNA, 25 bp, Rattus norvegicus
gcaggtggtaccttctgtgtgctga

SEQ ID NO: 385164 - DNA, 25 bp, Rattus norvegicus
gcaggtggtattcgccacagccatc

SEQ ID NO: 385165 - DNA, 25 bp, Rattus norvegicus
gcaggtggtattggccacagccatc

SEQ ID NO: 385166 - DNA, 25 bp, Rattus norvegicus
gcaggtggtcacatgcttgactcga

SEQ ID NO: 385167 - DNA, 25 bp, Rattus norvegicus
gcaggtggtcacttgcttgactcga

SEQ ID NO: 385168 - DNA, 25 bp, Rattus norvegicus
gcaggtgtaattcgcgctaagaaac

SEQ ID NO: 385169 - DNA, 25 bp, Rattus norvegicus
gcaggtgtaattggcgctaagaaac

SEQ ID NO: 385170 - DNA, 25 bp, Rattus norvegicus
gcaggtgtactcagttcccatggga

SEQ ID NO: 385171 - DNA, 25 bp, Rattus norvegicus
gcaggtgtactctgttcccatggga

SEQ ID NO: 385172 - DNA, 25 bp, Rattus norvegicus
gcaggtgtcgccagccttgggattc

SEQ ID NO: 385173 - DNA, 25 bp, Rattus norvegicus
gcaggtgtcgcctgccttgggattc

SEQ ID NO: 385174 - DNA, 25 bp, Rattus norvegicus
gcaggtgtctctcttgtgagtttaa

SEQ ID NO: 385175 - DNA, 25 bp, Rattus norvegicus
gcaggtgtctctgttgtgagtttaa

SEQ ID NO: 385176 - DNA, 25 bp, Rattus norvegicus
gcaggtgtctttcacttacatcaag

SEQ ID NO: 385177 - DNA, 25 bp, Rattus norvegicus
gcaggtgtctttgacttacatcaag

SEQ ID NO: 385178 - DNA, 25 bp, Rattus norvegicus
gcaggtgtgtccaagctgagtgttt

SEQ ID NO: 385179 - DNA, 25 bp, Rattus norvegicus
gcaggtgtgtcctagctgagtgttt

SEQ ID NO: 385180 - DNA, 25 bp, Rattus norvegicus
gcaggtgttctgagggcgtaacttc

SEQ ID NO: 385181 - DNA, 25 bp, Rattus norvegicus
gcaggtgttctgtgggcgtaacttc

SEQ ID NO: 385182 - DNA, 25 bp, Rattus norvegicus
gcaggtgtttgacaatggcagcatc

SEQ ID NO: 385183 - DNA, 25 bp, Rattus norvegicus
gcaggtgtttgagaatggcagcatc

SEQ ID NO: 385184 - DNA, 25 bp, Rattus norvegicus
gcaggttaagaccttagcgcctgtt

SEQ ID NO: 385185 - DNA, 25 bp, Rattus norvegicus
gcaggttaagacgttagcgcctgtt

SEQ ID NO: 385186 - DNA, 25 bp, Rattus norvegicus
gcaggttaatggatccttggctata

SEQ ID NO: 385187 - DNA, 25 bp, Rattus norvegicus
gcaggttaatggttccttggctata

SEQ ID NO: 385188 - DNA, 25 bp, Rattus norvegicus
gcaggttacatacccggagtctttt

SEQ ID NO: 385189 - DNA, 25 bp, Rattus norvegicus
gcaggttacatagccggagtctttt

SEQ ID NO: 385190 - DNA, 25 bp, Rattus norvegicus
gcaggttacggcaaaagcttttctt

SEQ ID NO: 385191 - DNA, 25 bp, Rattus norvegicus
gcaggttacggctaaagcttttctt

SEQ ID NO: 385192 - DNA, 25 bp, Rattus norvegicus
gcaggttacgtaattggcctcagta

SEQ ID NO: 385193 - DNA, 25 bp, Rattus norvegicus
gcaggttacgtatttggcctcagta

SEQ ID NO: 385194 - DNA, 25 bp, Rattus norvegicus
gcaggttagaacactacatttcggg

SEQ ID NO: 385195 - DNA, 25 bp, Rattus norvegicus
gcaggttagaactctacatttcggg

SEQ ID NO: 385196 - DNA, 25 bp, Rattus norvegicus
gcaggttaggttatagctccctttg

SEQ ID NO: 385197 - DNA, 25 bp, Rattus norvegicus
gcaggttaggttcctcattttcttt

SEQ ID NO: 385198 - DNA, 25 bp, Rattus norvegicus
gcaggttaggttgctcattttcttt

SEQ ID NO: 385199 - DNA, 25 bp, Rattus norvegicus
gcaggttaggttttagctccctttg

SEQ ID NO: 385200 - DNA, 25 bp, Rattus norvegicus
gcaggttatcttatcagtcttgttt

SEQ ID NO: 385201 - DNA, 25 bp, Rattus norvegicus
gcaggttatcttttcagtcttgttt

SEQ ID NO: 385202 - DNA, 25 bp, Rattus norvegicus
gcaggttcaggaccaaagggctccc

SEQ ID NO: 385203 - DNA, 25 bp, Rattus norvegicus
gcaggttcaggagcaaagggctccc

SEQ ID NO: 385204 - DNA, 25 bp, Rattus norvegicus
gcaggttcatgtactgggccaggta

SEQ ID NO: 385205 - DNA, 25 bp, Rattus norvegicus
gcaggttcatgttctgggccaggta

SEQ ID NO: 385206 - DNA, 25 bp, Rattus norvegicus
gcaggttccactagggttttagcgt

SEQ ID NO: 385207 - DNA, 25 bp, Rattus norvegicus
gcaggttccacttgggttttagcgt

SEQ ID NO: 385208 - DNA, 25 bp, Rattus norvegicus
gcaggttcggcaccaaggacttctg

SEQ ID NO: 385209 - DNA, 25 bp, Rattus norvegicus
gcaggttcggcagcaaggacttctg

SEQ ID NO: 385210 - DNA, 25 bp, Rattus norvegicus
gcaggttctacaaggtcagctatta

SEQ ID NO: 385211 - DNA, 25 bp, Rattus norvegicus
gcaggttctacatggtcagctatta

SEQ ID NO: 385212 - DNA, 25 bp, Rattus norvegicus
gcaggttctactaagcagatattaa

SEQ ID NO: 385213 - DNA, 25 bp, Rattus norvegicus
gcaggttctacttagcagatattaa

SEQ ID NO: 385214 - DNA, 25 bp, Rattus norvegicus
gcaggttctcaaaattgaagctacg

SEQ ID NO: 385215 - DNA, 25 bp, Rattus norvegicus
gcaggttctcaatattgaagctacg

SEQ ID NO: 385216 - DNA, 25 bp, Rattus norvegicus
gcaggttcttgaaaggcgtgccttc

SEQ ID NO: 385217 - DNA, 25 bp, Rattus norvegicus
gcaggttcttgataggcgtgccttc

SEQ ID NO: 385218 - DNA, 25 bp, Rattus norvegicus
gcaggttgaaacaccaatgctaact

SEQ ID NO: 385219 - DNA, 25 bp, Rattus norvegicus
gcaggttgaaactccaatgctaact

SEQ ID NO: 385220 - DNA, 25 bp, Rattus norvegicus
gcaggttgaacactctagcattttt

SEQ ID NO: 385221 - DNA, 25 bp, Rattus norvegicus
gcaggttgaacagtctagcattttt

SEQ ID NO: 385222 - DNA, 25 bp, Rattus norvegicus
gcaggttgacgcacagccagatcta

SEQ ID NO: 385223 - DNA, 25 bp, Rattus norvegicus
gcaggttgacgctcagccagatcta

SEQ ID NO: 385224 - DNA, 25 bp, Rattus norvegicus
gcaggttgactgacctccatgcaga

SEQ ID NO: 385225 - DNA, 25 bp, Rattus norvegicus
gcaggttgactgtcctccatgcaga

SEQ ID NO: 385226 - DNA, 25 bp, Rattus norvegicus
gcaggttgatgcagtcctcataaca

SEQ ID NO: 385227 - DNA, 25 bp, Rattus norvegicus
gcaggttgatgctgtcctcataaca

SEQ ID NO: 385228 - DNA, 25 bp, Rattus norvegicus
gcaggttgcctgctctgttctggtt

SEQ ID NO: 385229 - DNA, 25 bp, Rattus norvegicus
gcaggttgcctggtctgttctggtt

SEQ ID NO: 385230 - DNA, 25 bp, Rattus norvegicus
gcaggttgccttagtctgagatttt

SEQ ID NO: 385231 - DNA, 25 bp, Rattus norvegicus
gcaggttgcctttgtctgagatttt

SEQ ID NO: 385232 - DNA, 25 bp, Rattus norvegicus
gcaggttgctcccacaaattcagga

SEQ ID NO: 385233 - DNA, 25 bp, Rattus norvegicus
gcaggttgctccgacaaattcagga

SEQ ID NO: 385234 - DNA, 25 bp, Rattus norvegicus
gcaggttgctggcactaattatttt

SEQ ID NO: 385235 - DNA, 25 bp, Rattus norvegicus
gcaggttgctgggactaattatttt

SEQ ID NO: 385236 - DNA, 25 bp, Rattus norvegicus
gcaggttgtaatcgcacgtttcact

SEQ ID NO: 385237 - DNA, 25 bp, Rattus norvegicus
gcaggttgtaatggcacgtttcact

SEQ ID NO: 385238 - DNA, 25 bp, Rattus norvegicus
gcaggttgtactatagaccgtctgt

SEQ ID NO: 385239 - DNA, 25 bp, Rattus norvegicus
gcaggttgtactttagaccgtctgt

SEQ ID NO: 385240 - DNA, 25 bp, Rattus norvegicus
gcaggttgtggtaagtagccccttc

SEQ ID NO: 385241 - DNA, 25 bp, Rattus norvegicus
gcaggttgtggttagtagccccttc

SEQ ID NO: 385242 - DNA, 25 bp, Rattus norvegicus
gcaggtttatttatcatgttatctt

SEQ ID NO: 385243 - DNA, 25 bp, Rattus norvegicus
gcaggtttatttttcatgttatctt

SEQ ID NO: 385244 - DNA, 25 bp, Rattus norvegicus
gcaggtttcaccatcaaccaatttt

SEQ ID NO: 385245 - DNA, 25 bp, Rattus norvegicus
gcaggtttcaccttcaaccaatttt

SEQ ID NO: 385246 - DNA, 25 bp, Rattus norvegicus
gcaggtttcactagccatttaactt

SEQ ID NO: 385247 - DNA, 25 bp, Rattus norvegicus
gcaggtttcacttgccatttaactt

SEQ ID NO: 385248 - DNA, 25 bp, Rattus norvegicus
gcaggtttccatcgaagctcccaga

SEQ ID NO: 385249 - DNA, 25 bp, Rattus norvegicus
gcaggtttccatggaagctcccaga

SEQ ID NO: 385250 - DNA, 25 bp, Rattus norvegicus
gcaggtttcccacagcaactgacaa

SEQ ID NO: 385251 - DNA, 25 bp, Rattus norvegicus
gcaggtttcccagagcaactgacaa

SEQ ID NO: 385252 - DNA, 25 bp, Rattus norvegicus
gcaggtttccccattatgcatatag

SEQ ID NO: 385253 - DNA, 25 bp, Rattus norvegicus
gcaggtttcccctttatgcatatag

SEQ ID NO: 385254 - DNA, 25 bp, Rattus norvegicus
gcaggtttccggagttttagcacag

SEQ ID NO: 385255 - DNA, 25 bp, Rattus norvegicus
gcaggtttccggtgttttagcacag

SEQ ID NO: 385256 - DNA, 25 bp, Rattus norvegicus
gcaggtttctcaatcctgaaattga

SEQ ID NO: 385257 - DNA, 25 bp, Rattus norvegicus
gcaggtttctcattcctgaaattga

SEQ ID NO: 385258 - DNA, 25 bp, Rattus norvegicus
gcaggtttctctagattgttcttac

SEQ ID NO: 385259 - DNA, 25 bp, Rattus norvegicus
gcaggtttctcttgattgttcttac

SEQ ID NO: 385260 - DNA, 25 bp, Rattus norvegicus
gcaggtttctgtattcttatcattg

SEQ ID NO: 385261 - DNA, 25 bp, Rattus norvegicus
gcaggtttctgttttcttatcattg

SEQ ID NO: 385262 - DNA, 25 bp, Rattus norvegicus
gcaggtttgcaaagttccccaagag

SEQ ID NO: 385263 - DNA, 25 bp, Rattus norvegicus
gcaggtttgcaatgttccccaagag

SEQ ID NO: 385264 - DNA, 25 bp, Rattus norvegicus
gcaggtttgggcacatgttgctgaa

SEQ ID NO: 385265 - DNA, 25 bp, Rattus norvegicus
gcaggtttgggcaccccattcagca

SEQ ID NO: 385266 - DNA, 25 bp, Rattus norvegicus
gcaggtttgggctcatgttgctgaa

SEQ ID NO: 385267 - DNA, 25 bp, Rattus norvegicus
gcaggtttgggctccccattcagca

SEQ ID NO: 385268 - DNA, 25 bp, Rattus norvegicus
gcaggtttgttaagcaaaggttcat

SEQ ID NO: 385269 - DNA, 25 bp, Rattus norvegicus
gcaggtttgttatgcaaaggttcat

SEQ ID NO: 385270 - DNA, 25 bp, Rattus norvegicus
gcaggttttaaacaccagctctcca

SEQ ID NO: 385271 - DNA, 25 bp, Rattus norvegicus
gcaggttttaaagaccagctctcca

SEQ ID NO: 385272 - DNA, 25 bp, Rattus norvegicus
gcaggtttttctatgtgggagccac

SEQ ID NO: 385273 - DNA, 25 bp, Rattus norvegicus
gcaggtttttctttgtgggagccac

SEQ ID NO: 385274 - DNA, 25 bp, Rattus norvegicus
gcagtaaaacagcacctcttggagt

SEQ ID NO: 385275 - DNA, 25 bp, Rattus norvegicus
gcagtaaaacaggacctcttggagt

SEQ ID NO: 385276 - DNA, 25 bp, Rattus norvegicus
gcagtaaacacacttgggaccttcc

SEQ ID NO: 385277 - DNA, 25 bp, Rattus norvegicus
gcagtaaacacagttgggaccttcc

SEQ ID NO: 385278 - DNA, 25 bp, Rattus norvegicus
gcagtaaacatccttgctctggaaa

SEQ ID NO: 385279 - DNA, 25 bp, Rattus norvegicus
gcagtaaacatcgttgctctggaaa

SEQ ID NO: 385280 - DNA, 25 bp, Rattus norvegicus
gcagtaaaggcgcactccgatgtga

SEQ ID NO: 385281 - DNA, 25 bp, Rattus norvegicus
gcagtaaaggcggactccgatgtga

SEQ ID NO: 385282 - DNA, 25 bp, Rattus norvegicus
gcagtaaatcaaataggttctttca

SEQ ID NO: 385283 - DNA, 25 bp, Rattus norvegicus
gcagtaaatcaactcttcactccag

SEQ ID NO: 385284 - DNA, 25 bp, Rattus norvegicus
gcagtaaatcaagtcttcactccag

SEQ ID NO: 385285 - DNA, 25 bp, Rattus norvegicus
gcagtaaatcaattaggttctttca

SEQ ID NO: 385286 - DNA, 25 bp, Rattus norvegicus
gcagtaaatgttcattgccctaact

SEQ ID NO: 385287 - DNA, 25 bp, Rattus norvegicus
gcagtaaatgttgattgccctaact

SEQ ID NO: 385288 - DNA, 25 bp, Rattus norvegicus
gcagtaacaactcgttctcttcagt

SEQ ID NO: 385289 - DNA, 25 bp, Rattus norvegicus
gcagtaacaactggttctcttcagt

SEQ ID NO: 385290 - DNA, 25 bp, Rattus norvegicus
gcagtaacctgaagactctcctaga

SEQ ID NO: 385291 - DNA, 25 bp, Rattus norvegicus
gcagtaacctgatgactctcctaga

SEQ ID NO: 385292 - DNA, 25 bp, Rattus norvegicus
gcagtaacctggagctgcatgccag

SEQ ID NO: 385293 - DNA, 25 bp, Rattus norvegicus
gcagtaacctggtgctgcatgccag

SEQ ID NO: 385294 - DNA, 25 bp, Rattus norvegicus
gcagtaactcttcctgttctattta

SEQ ID NO: 385295 - DNA, 25 bp, Rattus norvegicus
gcagtaactcttgctgttctattta

SEQ ID NO: 385296 - DNA, 25 bp, Rattus norvegicus
gcagtaactgttcaagctctctttt

SEQ ID NO: 385297 - DNA, 25 bp, Rattus norvegicus
gcagtaactgttgaagctctctttt

SEQ ID NO: 385298 - DNA, 25 bp, Rattus norvegicus
gcagtaacttttactcaaaggcttt

SEQ ID NO: 385299 - DNA, 25 bp, Rattus norvegicus
gcagtaactttttctcaaaggcttt

SEQ ID NO: 385300 - DNA, 25 bp, Rattus norvegicus
gcagtaagattgaacctcagcaggt

SEQ ID NO: 385301 - DNA, 25 bp, Rattus norvegicus
gcagtaagattgtacctcagcaggt

SEQ ID NO: 385302 - DNA, 25 bp, Rattus norvegicus
gcagtaagccttagagatgacacat

SEQ ID NO: 385303 - DNA, 25 bp, Rattus norvegicus
gcagtaagcctttgagatgacacat

SEQ ID NO: 385304 - DNA, 25 bp, Rattus norvegicus
gcagtaagctgccttcactctgtgg

SEQ ID NO: 385305 - DNA, 25 bp, Rattus norvegicus
gcagtaagctgcgttcactctgtgg

SEQ ID NO: 385306 - DNA, 25 bp, Rattus norvegicus
gcagtaagctgtactgactttcagg

SEQ ID NO: 385307 - DNA, 25 bp, Rattus norvegicus
gcagtaagctgttctgactttcagg

SEQ ID NO: 385308 - DNA, 25 bp, Rattus norvegicus
gcagtaagctttcgccaggacaagt

SEQ ID NO: 385309 - DNA, 25 bp, Rattus norvegicus
gcagtaagctttggccaggacaagt

SEQ ID NO: 385310 - DNA, 25 bp, Rattus norvegicus
gcagtaaggactagcagggctgtca

SEQ ID NO: 385311 - DNA, 25 bp, Rattus norvegicus
gcagtaaggacttgcagggctgtca

SEQ ID NO: 385312 - DNA, 25 bp, Rattus norvegicus
gcagtaatgctgctgacatgctgta

SEQ ID NO: 385313 - DNA, 25 bp, Rattus norvegicus
gcagtaatgctggtgacatgctgta

SEQ ID NO: 385314 - DNA, 25 bp, Rattus norvegicus
gcagtaatggagcagatccctgaaa

SEQ ID NO: 385315 - DNA, 25 bp, Rattus norvegicus
gcagtaatggaggagatccctgaaa

SEQ ID NO: 385316 - DNA, 25 bp, Rattus norvegicus
gcagtaatgggtacaatggattcac

SEQ ID NO: 385317 - DNA, 25 bp, Rattus norvegicus
gcagtaatgggttcaatggattcac

SEQ ID NO: 385318 - DNA, 25 bp, Rattus norvegicus
gcagtaatgtgcacccagaaatatt

SEQ ID NO: 385319 - DNA, 25 bp, Rattus norvegicus
gcagtaatgtgctcccagaaatatt

SEQ ID NO: 385320 - DNA, 25 bp, Rattus norvegicus
gcagtaattcttccttatgtgtgtg

SEQ ID NO: 385321 - DNA, 25 bp, Rattus norvegicus
gcagtaattcttgcttatgtgtgtg

SEQ ID NO: 385322 - DNA, 25 bp, Rattus norvegicus
gcagtacaagttaatcttccgagaa

SEQ ID NO: 385323 - DNA, 25 bp, Rattus norvegicus
gcagtacaagtttatcttccgagaa

SEQ ID NO: 385324 - DNA, 25 bp, Rattus norvegicus
gcagtacacaggcacaggcacattt

SEQ ID NO: 385325 - DNA, 25 bp, Rattus norvegicus
gcagtacacagggacaggcacattt

SEQ ID NO: 385326 - DNA, 25 bp, Rattus norvegicus
gcagtacactgtaattgggacctaa

SEQ ID NO: 385327 - DNA, 25 bp, Rattus norvegicus
gcagtacactgttattgggacctaa

SEQ ID NO: 385328 - DNA, 25 bp, Rattus norvegicus
gcagtacaggttctcaagttagtca

SEQ ID NO: 385329 - DNA, 25 bp, Rattus norvegicus
gcagtacaggttgtcaagttagtca

SEQ ID NO: 385330 - DNA, 25 bp, Rattus norvegicus
gcagtacattcccttcagtgtctaa

SEQ ID NO: 385331 - DNA, 25 bp, Rattus norvegicus
gcagtacattccgttcagtgtctaa

SEQ ID NO: 385332 - DNA, 25 bp, Rattus norvegicus
gcagtacattttacatggtggcaga

SEQ ID NO: 385333 - DNA, 25 bp, Rattus norvegicus
gcagtacatttttcatggtggcaga

SEQ ID NO: 385334 - DNA, 25 bp, Rattus norvegicus
gcagtacccgcccataaaaagcatg

SEQ ID NO: 385335 - DNA, 25 bp, Rattus norvegicus
gcagtacccgccgataaaaagcatg

SEQ ID NO: 385336 - DNA, 25 bp, Rattus norvegicus
gcagtacctgcccaagtcagaagag

SEQ ID NO: 385337 - DNA, 25 bp, Rattus norvegicus
gcagtacctgccgaagtcagaagag

SEQ ID NO: 385338 - DNA, 25 bp, Rattus norvegicus
gcagtacgagctcgttcggttgtta

SEQ ID NO: 385339 - DNA, 25 bp, Rattus norvegicus
gcagtacgagctggttcggttgtta

SEQ ID NO: 385340 - DNA, 25 bp, Rattus norvegicus
gcagtactaatcatgccggagcttt

SEQ ID NO: 385341 - DNA, 25 bp, Rattus norvegicus
gcagtactaatcttgccggagcttt

SEQ ID NO: 385342 - DNA, 25 bp, Rattus norvegicus
gcagtactatccctactacggcaaa

SEQ ID NO: 385343 - DNA, 25 bp, Rattus norvegicus
gcagtactatccgtactacggcaaa

SEQ ID NO: 385344 - DNA, 25 bp, Rattus norvegicus
gcagtactgaggagcctgagataag

SEQ ID NO: 385345 - DNA, 25 bp, Rattus norvegicus
gcagtactgaggtgcctgagataag

SEQ ID NO: 385346 - DNA, 25 bp, Rattus norvegicus
gcagtactgatcactccttagtatt

SEQ ID NO: 385347 - DNA, 25 bp, Rattus norvegicus
gcagtactgatctctccttagtatt

SEQ ID NO: 385348 - DNA, 25 bp, Rattus norvegicus
gcagtactgtaaagtttacgattct

SEQ ID NO: 385349 - DNA, 25 bp, Rattus norvegicus
gcagtactgtaatgtttacgattct

SEQ ID NO: 385350 - DNA, 25 bp, Rattus norvegicus
gcagtacttactcaccgacggaagt

SEQ ID NO: 385351 - DNA, 25 bp, Rattus norvegicus
gcagtacttactgaccgacggaagt

SEQ ID NO: 385352 - DNA, 25 bp, Rattus norvegicus
gcagtacttttaaatcggtgtggaa

SEQ ID NO: 385353 - DNA, 25 bp, Rattus norvegicus
gcagtacttttatatcggtgtggaa

SEQ ID NO: 385354 - DNA, 25 bp, Rattus norvegicus
gcagtagaagacaccagcattttgg

SEQ ID NO: 385355 - DNA, 25 bp, Rattus norvegicus
gcagtagaagactccagcattttgg

SEQ ID NO: 385356 - DNA, 25 bp, Rattus norvegicus
gcagtagacacacgctttgcgcagt

SEQ ID NO: 385357 - DNA, 25 bp, Rattus norvegicus
gcagtagacacaggctttgcgcagt

SEQ ID NO: 385358 - DNA, 25 bp, Rattus norvegicus
gcagtagacttaccttcctgatgaa

SEQ ID NO: 385359 - DNA, 25 bp, Rattus norvegicus
gcagtagacttagcttcctgatgaa

SEQ ID NO: 385360 - DNA, 25 bp, Rattus norvegicus
gcagtagagtatattaaccctccag

SEQ ID NO: 385361 - DNA, 25 bp, Rattus norvegicus
gcagtagagtattttaaccctccag

SEQ ID NO: 385362 - DNA, 25 bp, Rattus norvegicus
gcagtagcaactcagtttgattccc

SEQ ID NO: 385363 - DNA, 25 bp, Rattus norvegicus
gcagtagcaactgagtttgattccc

SEQ ID NO: 385364 - DNA, 25 bp, Rattus norvegicus
gcagtagcaagtccttcacagttca

SEQ ID NO: 385365 - DNA, 25 bp, Rattus norvegicus
gcagtagcaagtgcttcacagttca

SEQ ID NO: 385366 - DNA, 25 bp, Rattus norvegicus
gcagtagccaatccagaataccagg

SEQ ID NO: 385367 - DNA, 25 bp, Rattus norvegicus
gcagtagccaatgcagaataccagg

SEQ ID NO: 385368 - DNA, 25 bp, Rattus norvegicus
gcagtagctaggatgcttctgtccc

SEQ ID NO: 385369 - DNA, 25 bp, Rattus norvegicus
gcagtagctaggttgcttctgtccc

SEQ ID NO: 385370 - DNA, 25 bp, Rattus norvegicus
gcagtagctctgaatgtgttaccca

SEQ ID NO: 385371 - DNA, 25 bp, Rattus norvegicus
gcagtagctctgtatgtgttaccca

SEQ ID NO: 385372 - DNA, 25 bp, Rattus norvegicus
gcagtagctgcaccagacaagcact

SEQ ID NO: 385373 - DNA, 25 bp, Rattus norvegicus
gcagtagctgcagcagacaagcact

SEQ ID NO: 385374 - DNA, 25 bp, Rattus norvegicus
gcagtagctgccctcatcagagtgc

SEQ ID NO: 385375 - DNA, 25 bp, Rattus norvegicus
gcagtagctgccctgtacccagtga

SEQ ID NO: 385376 - DNA, 25 bp, Rattus norvegicus
gcagtagctgccgtcatcagagtgc

SEQ ID NO: 385377 - DNA, 25 bp, Rattus norvegicus
gcagtagctgccgtgtacccagtga

SEQ ID NO: 385378 - DNA, 25 bp, Rattus norvegicus
gcagtagcttgcattggaattcact

SEQ ID NO: 385379 - DNA, 25 bp, Rattus norvegicus
gcagtagcttgctttggaattcact

SEQ ID NO: 385380 - DNA, 25 bp, Rattus norvegicus
gcagtaggcagtatcttatgtcttt

SEQ ID NO: 385381 - DNA, 25 bp, Rattus norvegicus
gcagtaggcagtttcttatgtcttt

SEQ ID NO: 385382 - DNA, 25 bp, Rattus norvegicus
gcagtagggcggacacattgtctgt

SEQ ID NO: 385383 - DNA, 25 bp, Rattus norvegicus
gcagtagggcggtcacattgtctgt

SEQ ID NO: 385384 - DNA, 25 bp, Rattus norvegicus
gcagtagggctaacagtcttctgtt

SEQ ID NO: 385385 - DNA, 25 bp, Rattus norvegicus
gcagtagggctatcagtcttctgtt

SEQ ID NO: 385386 - DNA, 25 bp, Rattus norvegicus
gcagtagggtggacaccatgccact

SEQ ID NO: 385387 - DNA, 25 bp, Rattus norvegicus
gcagtagggtggtcaccatgccact

SEQ ID NO: 385388 - DNA, 25 bp, Rattus norvegicus
gcagtagtagatagcataagaccca

SEQ ID NO: 385389 - DNA, 25 bp, Rattus norvegicus
gcagtagtagattgcataagaccca

SEQ ID NO: 385390 - DNA, 25 bp, Rattus norvegicus
gcagtagtccggcaattcgaaatgt

SEQ ID NO: 385391 - DNA, 25 bp, Rattus norvegicus
gcagtagtccgggaattcgaaatgt

SEQ ID NO: 385392 - DNA, 25 bp, Rattus norvegicus
gcagtagtgcagatcctggctttaa

SEQ ID NO: 385393 - DNA, 25 bp, Rattus norvegicus
gcagtagtgcagttcctggctttaa

SEQ ID NO: 385394 - DNA, 25 bp, Rattus norvegicus
gcagtagttatcaacccaaagcccc

SEQ ID NO: 385395 - DNA, 25 bp, Rattus norvegicus
gcagtagttatctacccaaagcccc

SEQ ID NO: 385396 - DNA, 25 bp, Rattus norvegicus
gcagtagttctgatctttgggcgaa

SEQ ID NO: 385397 - DNA, 25 bp, Rattus norvegicus
gcagtagttctgttctttgggcgaa

SEQ ID NO: 385398 - DNA, 25 bp, Rattus norvegicus
gcagtagttgccctgagtgacccag

SEQ ID NO: 385399 - DNA, 25 bp, Rattus norvegicus
gcagtagttgccgtgagtgacccag

SEQ ID NO: 385400 - DNA, 25 bp, Rattus norvegicus
gcagtagtttacaccccattttagt

SEQ ID NO: 385401 - DNA, 25 bp, Rattus norvegicus
gcagtagtttactccccattttagt

SEQ ID NO: 385402 - DNA, 25 bp, Rattus norvegicus
gcagtagtttttcccatgatggttc

SEQ ID NO: 385403 - DNA, 25 bp, Rattus norvegicus
gcagtagtttttgccatgatggttc

SEQ ID NO: 385404 - DNA, 25 bp, Rattus norvegicus
gcagtataagaacacagccagcaat

SEQ ID NO: 385405 - DNA, 25 bp, Rattus norvegicus
gcagtataagaagacagccagcaat

SEQ ID NO: 385406 - DNA, 25 bp, Rattus norvegicus
gcagtatactggatcagcccgagtt

SEQ ID NO: 385407 - DNA, 25 bp, Rattus norvegicus
gcagtatactggttcagcccgagtt

SEQ ID NO: 385408 - DNA, 25 bp, Rattus norvegicus
gcagtatcattcatgtagagctcaa

SEQ ID NO: 385409 - DNA, 25 bp, Rattus norvegicus
gcagtatcattcttgtagagctcaa

SEQ ID NO: 385410 - DNA, 25 bp, Rattus norvegicus
gcagtatccagaatcagttgtccgt

SEQ ID NO: 385411 - DNA, 25 bp, Rattus norvegicus
gcagtatccagattcagttgtccgt

SEQ ID NO: 385412 - DNA, 25 bp, Rattus norvegicus
gcagtatcctagaaagccataaaca

SEQ ID NO: 385413 - DNA, 25 bp, Rattus norvegicus
gcagtatcctagtaagccataaaca

SEQ ID NO: 385414 - DNA, 25 bp, Rattus norvegicus
gcagtatctgagctttggcgacttt

SEQ ID NO: 385415 - DNA, 25 bp, Rattus norvegicus
gcagtatctgaggtttggcgacttt

SEQ ID NO: 385416 - DNA, 25 bp, Rattus norvegicus
gcagtatctgcaaaatccctggaaa

SEQ ID NO: 385417 - DNA, 25 bp, Rattus norvegicus
gcagtatctgcataatccctggaaa

SEQ ID NO: 385418 - DNA, 25 bp, Rattus norvegicus
gcagtatctgtgaccttgatctata

SEQ ID NO: 385419 - DNA, 25 bp, Rattus norvegicus
gcagtatctgtgtccttgatctata

SEQ ID NO: 385420 - DNA, 25 bp, Rattus norvegicus
gcagtatgaacaagcctccattcac

SEQ ID NO: 385421 - DNA, 25 bp, Rattus norvegicus
gcagtatgaacatgcctccattcac

SEQ ID NO: 385422 - DNA, 25 bp, Rattus norvegicus
gcagtatgttcaaaaatgtctcctt

SEQ ID NO: 385423 - DNA, 25 bp, Rattus norvegicus
gcagtatgttcataaatgtctcctt

SEQ ID NO: 385424 - DNA, 25 bp, Rattus norvegicus
gcagtatgttccatttgtcctttta

SEQ ID NO: 385425 - DNA, 25 bp, Rattus norvegicus
gcagtatgttccttttgtcctttta

SEQ ID NO: 385426 - DNA, 25 bp, Rattus norvegicus
gcagtattaccccattgtttaggga

SEQ ID NO: 385427 - DNA, 25 bp, Rattus norvegicus
gcagtattacccgattgtttaggga

SEQ ID NO: 385428 - DNA, 25 bp, Rattus norvegicus
gcagtattctaaatccttgggcttt

SEQ ID NO: 385429 - DNA, 25 bp, Rattus norvegicus
gcagtattctaattccttgggcttt

SEQ ID NO: 385430 - DNA, 25 bp, Rattus norvegicus
gcagtattctctctggccagtatga

SEQ ID NO: 385431 - DNA, 25 bp, Rattus norvegicus
gcagtattctctgtggccagtatga

SEQ ID NO: 385432 - DNA, 25 bp, Rattus norvegicus
gcagtattctgacgttctaactcca

SEQ ID NO: 385433 - DNA, 25 bp, Rattus norvegicus
gcagtattctgactaccagtccata

SEQ ID NO: 385434 - DNA, 25 bp, Rattus norvegicus
gcagtattctgaggttctaactcca

SEQ ID NO: 385435 - DNA, 25 bp, Rattus norvegicus
gcagtattctgagtaccagtccata

SEQ ID NO: 385436 - DNA, 25 bp, Rattus norvegicus
gcagtattgcagacaggaccatcca

SEQ ID NO: 385437 - DNA, 25 bp, Rattus norvegicus
gcagtattgcagtcaggaccatcca

SEQ ID NO: 385438 - DNA, 25 bp, Rattus norvegicus
gcagtattgctaacaggccctgttt

SEQ ID NO: 385439 - DNA, 25 bp, Rattus norvegicus
gcagtattgctatcaggccctgttt

SEQ ID NO: 385440 - DNA, 25 bp, Rattus norvegicus
gcagtattgttgattttatttgtaa

SEQ ID NO: 385441 - DNA, 25 bp, Rattus norvegicus
gcagtattgttgtttttatttgtaa

SEQ ID NO: 385442 - DNA, 25 bp, Rattus norvegicus
gcagtatttcagatattaagagaca

SEQ ID NO: 385443 - DNA, 25 bp, Rattus norvegicus
gcagtatttcagttattaagagaca

SEQ ID NO: 385444 - DNA, 25 bp, Rattus norvegicus
gcagtatttctcactatatttttac

SEQ ID NO: 385445 - DNA, 25 bp, Rattus norvegicus
gcagtatttctccaacttcatcaga

SEQ ID NO: 385446 - DNA, 25 bp, Rattus norvegicus
gcagtatttctcgaacttcatcaga

SEQ ID NO: 385447 - DNA, 25 bp, Rattus norvegicus
gcagtatttctctctatatttttac

SEQ ID NO: 385448 - DNA, 25 bp, Rattus norvegicus
gcagtattttctagcttttgttgga

SEQ ID NO: 385449 - DNA, 25 bp, Rattus norvegicus
gcagtattttcttgcttttgttgga

SEQ ID NO: 385450 - DNA, 25 bp, Rattus norvegicus
gcagtatttttcagtgagacttcat

SEQ ID NO: 385451 - DNA, 25 bp, Rattus norvegicus
gcagtatttttctgtgagacttcat

SEQ ID NO: 385452 - DNA, 25 bp, Rattus norvegicus
gcagtcaagtccagctgaagtccga

SEQ ID NO: 385453 - DNA, 25 bp, Rattus norvegicus
gcagtcaagtcctgctgaagtccga

SEQ ID NO: 385454 - DNA, 25 bp, Rattus norvegicus
gcagtcacacggattacccatgaag

SEQ ID NO: 385455 - DNA, 25 bp, Rattus norvegicus
gcagtcacacggtttacccatgaag

SEQ ID NO: 385456 - DNA, 25 bp, Rattus norvegicus
gcagtcacatgcagccacagatata

SEQ ID NO: 385457 - DNA, 25 bp, Rattus norvegicus
gcagtcacatgctgccacagatata

SEQ ID NO: 385458 - DNA, 25 bp, Rattus norvegicus
gcagtcacattccttgcaactagta

SEQ ID NO: 385459 - DNA, 25 bp, Rattus norvegicus
gcagtcacattcgttgcaactagta

SEQ ID NO: 385460 - DNA, 25 bp, Rattus norvegicus
gcagtcacattgatgcctaaacctt

SEQ ID NO: 385461 - DNA, 25 bp, Rattus norvegicus
gcagtcacattgttgcctaaacctt

SEQ ID NO: 385462 - DNA, 25 bp, Rattus norvegicus
gcagtcacccatcttcattaaatag

SEQ ID NO: 385463 - DNA, 25 bp, Rattus norvegicus
gcagtcacccatgttcattaaatag

SEQ ID NO: 385464 - DNA, 25 bp, Rattus norvegicus
gcagtcaccttcatcggaaacagca

SEQ ID NO: 385465 - DNA, 25 bp, Rattus norvegicus
gcagtcaccttcttcggaaacagca

SEQ ID NO: 385466 - DNA, 25 bp, Rattus norvegicus
gcagtcacgagcatgatgttctaca

SEQ ID NO: 385467 - DNA, 25 bp, Rattus norvegicus
gcagtcacgagcttgatgttctaca

SEQ ID NO: 385468 - DNA, 25 bp, Rattus norvegicus
gcagtcactgaacatttaacaggta

SEQ ID NO: 385469 - DNA, 25 bp, Rattus norvegicus
gcagtcactgaagatttaacaggta

SEQ ID NO: 385470 - DNA, 25 bp, Rattus norvegicus
gcagtcactgcacagttttaaggct

SEQ ID NO: 385471 - DNA, 25 bp, Rattus norvegicus
gcagtcactgcagagttttaaggct

SEQ ID NO: 385472 - DNA, 25 bp, Rattus norvegicus
gcagtcactgtacccttttacctag

SEQ ID NO: 385473 - DNA, 25 bp, Rattus norvegicus
gcagtcactgtagccttttacctag

SEQ ID NO: 385474 - DNA, 25 bp, Rattus norvegicus
gcagtcagcattcatctcctatgga

SEQ ID NO: 385475 - DNA, 25 bp, Rattus norvegicus
gcagtcagcattgatctcctatgga

SEQ ID NO: 385476 - DNA, 25 bp, Rattus norvegicus
gcagtcagccccattgtggaagaag

SEQ ID NO: 385477 - DNA, 25 bp, Rattus norvegicus
gcagtcagcccctttgtggaagaag

SEQ ID NO: 385478 - DNA, 25 bp, Rattus norvegicus
gcagtcagcctcctttttgtaaaga

SEQ ID NO: 385479 - DNA, 25 bp, Rattus norvegicus
gcagtcagcctcgtttttgtaaaga

SEQ ID NO: 385480 - DNA, 25 bp, Rattus norvegicus
gcagtcagctacacttgggttacta

SEQ ID NO: 385481 - DNA, 25 bp, Rattus norvegicus
gcagtcagctactcttgggttacta

SEQ ID NO: 385482 - DNA, 25 bp, Rattus norvegicus
gcagtcagctccaatcagaacacag

SEQ ID NO: 385483 - DNA, 25 bp, Rattus norvegicus
gcagtcagctcctatcagaacacag

SEQ ID NO: 385484 - DNA, 25 bp, Rattus norvegicus
gcagtcagctgccatatccaagaag

SEQ ID NO: 385485 - DNA, 25 bp, Rattus norvegicus
gcagtcagctgcgatatccaagaag

SEQ ID NO: 385486 - DNA, 25 bp, Rattus norvegicus
gcagtcagcttcataccgtttttaa

SEQ ID NO: 385487 - DNA, 25 bp, Rattus norvegicus
gcagtcagcttcttaccgtttttaa

SEQ ID NO: 385488 - DNA, 25 bp, Rattus norvegicus
gcagtcaggagccagtcagaccttg

SEQ ID NO: 385489 - DNA, 25 bp, Rattus norvegicus
gcagtcaggagcgagtcagaccttg

SEQ ID NO: 385490 - DNA, 25 bp, Rattus norvegicus
gcagtcaggctcagccttaaagcaa

SEQ ID NO: 385491 - DNA, 25 bp, Rattus norvegicus
gcagtcaggctctgccttaaagcaa

SEQ ID NO: 385492 - DNA, 25 bp, Rattus norvegicus
gcagtcaggtttatcccagaagaac

SEQ ID NO: 385493 - DNA, 25 bp, Rattus norvegicus
gcagtcaggtttttcccagaagaac

SEQ ID NO: 385494 - DNA, 25 bp, Rattus norvegicus
gcagtcagtgttcaagtgtgtgtct

SEQ ID NO: 385495 - DNA, 25 bp, Rattus norvegicus
gcagtcagtgttgaagtgtgtgtct

SEQ ID NO: 385496 - DNA, 25 bp, Rattus norvegicus
gcagtcagttaaatactcctctaga

SEQ ID NO: 385497 - DNA, 25 bp, Rattus norvegicus
gcagtcagttaattactcctctaga

SEQ ID NO: 385498 - DNA, 25 bp, Rattus norvegicus
gcagtcagttgacccatagtgtgga

SEQ ID NO: 385499 - DNA, 25 bp, Rattus norvegicus
gcagtcagttgagccatagtgtgga

SEQ ID NO: 385500 - DNA, 25 bp, Rattus norvegicus
gcagtcatcagtactacctgggtga

SEQ ID NO: 385501 - DNA, 25 bp, Rattus norvegicus
gcagtcatcagttctacctgggtga

SEQ ID NO: 385502 - DNA, 25 bp, Rattus norvegicus
gcagtcatctgaagaagacactcat

SEQ ID NO: 385503 - DNA, 25 bp, Rattus norvegicus
gcagtcatctgatgaagacactcat

SEQ ID NO: 385504 - DNA, 25 bp, Rattus norvegicus
gcagtcatctgccttcggaattgga

SEQ ID NO: 385505 - DNA, 25 bp, Rattus norvegicus
gcagtcatctgcgttcggaattgga

SEQ ID NO: 385506 - DNA, 25 bp, Rattus norvegicus
gcagtcatgcaaaaaccttcacgtg

SEQ ID NO: 385507 - DNA, 25 bp, Rattus norvegicus
gcagtcatgcaataaccttcacgtg

SEQ ID NO: 385508 - DNA, 25 bp, Rattus norvegicus
gcagtcatgtccactattcgggaga

SEQ ID NO: 385509 - DNA, 25 bp, Rattus norvegicus
gcagtcatgtcctctattcgggaga

SEQ ID NO: 385510 - DNA, 25 bp, Rattus norvegicus
gcagtcatgtttagtcctcccaaac

SEQ ID NO: 385511 - DNA, 25 bp, Rattus norvegicus
gcagtcatgttttgtcctcccaaac

SEQ ID NO: 385512 - DNA, 25 bp, Rattus norvegicus
gcagtcattggccagtcccgggagt

SEQ ID NO: 385513 - DNA, 25 bp, Rattus norvegicus
gcagtcattggcgagtcccgggagt

SEQ ID NO: 385514 - DNA, 25 bp, Rattus norvegicus
gcagtccaccggctgtacttaaagg

SEQ ID NO: 385515 - DNA, 25 bp, Rattus norvegicus
gcagtccaccgggtgtacttaaagg

SEQ ID NO: 385516 - DNA, 25 bp, Rattus norvegicus
gcagtccacctgattgtaacttttt

SEQ ID NO: 385517 - DNA, 25 bp, Rattus norvegicus
gcagtccacctgtttgtaacttttt

SEQ ID NO: 385518 - DNA, 25 bp, Rattus norvegicus
gcagtccacgcaattatagggtttc

SEQ ID NO: 385519 - DNA, 25 bp, Rattus norvegicus
gcagtccacgcatttatagggtttc

SEQ ID NO: 385520 - DNA, 25 bp, Rattus norvegicus
gcagtccacgggaatatcacaagtt

SEQ ID NO: 385521 - DNA, 25 bp, Rattus norvegicus
gcagtccacgggtatatcacaagtt

SEQ ID NO: 385522 - DNA, 25 bp, Rattus norvegicus
gcagtccactatcttaagcacaact

SEQ ID NO: 385523 - DNA, 25 bp, Rattus norvegicus
gcagtccactatgttaagcacaact

SEQ ID NO: 385524 - DNA, 25 bp, Rattus norvegicus
gcagtccactgccaagcatgtagag

SEQ ID NO: 385525 - DNA, 25 bp, Rattus norvegicus
gcagtccactgcgaagcatgtagag

SEQ ID NO: 385526 - DNA, 25 bp, Rattus norvegicus
gcagtccactgtcaagcttgtacac

SEQ ID NO: 385527 - DNA, 25 bp, Rattus norvegicus
gcagtccactgtgaagcttgtacac

SEQ ID NO: 385528 - DNA, 25 bp, Rattus norvegicus
gcagtccagaataagtgctgttttc

SEQ ID NO: 385529 - DNA, 25 bp, Rattus norvegicus
gcagtccagaattagtgctgttttc

SEQ ID NO: 385530 - DNA, 25 bp, Rattus norvegicus
gcagtccagatacggcttacagtgt

SEQ ID NO: 385531 - DNA, 25 bp, Rattus norvegicus
gcagtccagatagggcttacagtgt

SEQ ID NO: 385532 - DNA, 25 bp, Rattus norvegicus
gcagtccaggagcttctaccaagat

SEQ ID NO: 385533 - DNA, 25 bp, Rattus norvegicus
gcagtccaggaggttctaccaagat

SEQ ID NO: 385534 - DNA, 25 bp, Rattus norvegicus
gcagtccatcatacctgcctgataa

SEQ ID NO: 385535 - DNA, 25 bp, Rattus norvegicus
gcagtccatcattcctgcctgataa

SEQ ID NO: 385536 - DNA, 25 bp, Rattus norvegicus
gcagtcccacagcttgaaggtaaca

SEQ ID NO: 385537 - DNA, 25 bp, Rattus norvegicus
gcagtcccacaggttgaaggtaaca

SEQ ID NO: 385538 - DNA, 25 bp, Rattus norvegicus
gcagtcccagccctagagaggtaaa

SEQ ID NO: 385539 - DNA, 25 bp, Rattus norvegicus
gcagtcccagccgtagagaggtaaa

SEQ ID NO: 385540 - DNA, 25 bp, Rattus norvegicus
gcagtcccatggctgtgagcagcat

SEQ ID NO: 385541 - DNA, 25 bp, Rattus norvegicus
gcagtcccatgggtgtgagcagcat

SEQ ID NO: 385542 - DNA, 25 bp, Rattus norvegicus
gcagtccccagacatgtggaagatg

SEQ ID NO: 385543 - DNA, 25 bp, Rattus norvegicus
gcagtccccagagatgtggaagatg

SEQ ID NO: 385544 - DNA, 25 bp, Rattus norvegicus
gcagtccctttcattacttgatgag

SEQ ID NO: 385545 - DNA, 25 bp, Rattus norvegicus
gcagtccctttctttacttgatgag

SEQ ID NO: 385546 - DNA, 25 bp, Rattus norvegicus
gcagtccgagacaactctggcgaga

SEQ ID NO: 385547 - DNA, 25 bp, Rattus norvegicus
gcagtccgagactactctggcgaga

SEQ ID NO: 385548 - DNA, 25 bp, Rattus norvegicus
gcagtccgcctgacggaactgctga

SEQ ID NO: 385549 - DNA, 25 bp, Rattus norvegicus
gcagtccgcctgtcggaactgctga

SEQ ID NO: 385550 - DNA, 25 bp, Rattus norvegicus
gcagtccgtgtgaccgtcctctgtg

SEQ ID NO: 385551 - DNA, 25 bp, Rattus norvegicus
gcagtccgtgtgtccgtcctctgtg

SEQ ID NO: 385552 - DNA, 25 bp, Rattus norvegicus
gcagtcctacacaagtggttcctga

SEQ ID NO: 385553 - DNA, 25 bp, Rattus norvegicus
gcagtcctacactagtggttcctga

SEQ ID NO: 385554 - DNA, 25 bp, Rattus norvegicus
gcagtcctacttccctgtagaagta

SEQ ID NO: 385555 - DNA, 25 bp, Rattus norvegicus
gcagtcctacttgcctgtagaagta

SEQ ID NO: 385556 - DNA, 25 bp, Rattus norvegicus
gcagtcctcagtcggaggtcctgaa

SEQ ID NO: 385557 - DNA, 25 bp, Rattus norvegicus
gcagtcctcagtgggaggtcctgaa

SEQ ID NO: 385558 - DNA, 25 bp, Rattus norvegicus
gcagtcctcataacttagtctggga

SEQ ID NO: 385559 - DNA, 25 bp, Rattus norvegicus
gcagtcctcatatcttagtctggga

SEQ ID NO: 385560 - DNA, 25 bp, Rattus norvegicus
gcagtcctccggattgctctctcga

SEQ ID NO: 385561 - DNA, 25 bp, Rattus norvegicus
gcagtcctccggtttgctctctcga

SEQ ID NO: 385562 - DNA, 25 bp, Rattus norvegicus
gcagtcctcgttcgtctttaagtta

SEQ ID NO: 385563 - DNA, 25 bp, Rattus norvegicus
gcagtcctcgttggtctttaagtta

SEQ ID NO: 385564 - DNA, 25 bp, Rattus norvegicus
gcagtcctcttactattagtttaga

SEQ ID NO: 385565 - DNA, 25 bp, Rattus norvegicus
gcagtcctcttagtattagtttaga

SEQ ID NO: 385566 - DNA, 25 bp, Rattus norvegicus
gcagtcctcttgactgtcagagtag

SEQ ID NO: 385567 - DNA, 25 bp, Rattus norvegicus
gcagtcctcttgtctgtcagagtag

SEQ ID NO: 385568 - DNA, 25 bp, Rattus norvegicus
gcagtcctgatcacttctaggtgtt

SEQ ID NO: 385569 - DNA, 25 bp, Rattus norvegicus
gcagtcctgatctcttctaggtgtt

SEQ ID NO: 385570 - DNA, 25 bp, Rattus norvegicus
gcagtcctgccacgcggagattgaa

SEQ ID NO: 385571 - DNA, 25 bp, Rattus norvegicus
gcagtcctgccaggcggagattgaa

SEQ ID NO: 385572 - DNA, 25 bp, Rattus norvegicus
gcagtcctggaaagacagtcccata

SEQ ID NO: 385573 - DNA, 25 bp, Rattus norvegicus
gcagtcctggaatgacagtcccata

SEQ ID NO: 385574 - DNA, 25 bp, Rattus norvegicus
gcagtcctgtttacagattcctaca

SEQ ID NO: 385575 - DNA, 25 bp, Rattus norvegicus
gcagtcctgttttcagattcctaca

SEQ ID NO: 385576 - DNA, 25 bp, Rattus norvegicus
gcagtccttaacagtaacacaccta

SEQ ID NO: 385577 - DNA, 25 bp, Rattus norvegicus
gcagtccttaaccagtacctttaat

SEQ ID NO: 385578 - DNA, 25 bp, Rattus norvegicus
gcagtccttaacgagtacctttaat

SEQ ID NO: 385579 - DNA, 25 bp, Rattus norvegicus
gcagtccttaactgtaacacaccta

SEQ ID NO: 385580 - DNA, 25 bp, Rattus norvegicus
gcagtccttccaccattaatataat

SEQ ID NO: 385581 - DNA, 25 bp, Rattus norvegicus
gcagtccttccagcattaatataat

SEQ ID NO: 385582 - DNA, 25 bp, Rattus norvegicus
gcagtccttctaaaactaccattag

SEQ ID NO: 385583 - DNA, 25 bp, Rattus norvegicus
gcagtccttctataactaccattag

SEQ ID NO: 385584 - DNA, 25 bp, Rattus norvegicus
gcagtcctttgtattttgtggtagt

SEQ ID NO: 385585 - DNA, 25 bp, Rattus norvegicus
gcagtcctttgtccatttaggctga

SEQ ID NO: 385586 - DNA, 25 bp, Rattus norvegicus
gcagtcctttgtgcatttaggctga

SEQ ID NO: 385587 - DNA, 25 bp, Rattus norvegicus
gcagtcctttgttttttgtggtagt

SEQ ID NO: 385588 - DNA, 25 bp, Rattus norvegicus
gcagtcgaaacaccttttctggtaa

SEQ ID NO: 385589 - DNA, 25 bp, Rattus norvegicus
gcagtcgaaacagcttttctggtaa

SEQ ID NO: 385590 - DNA, 25 bp, Rattus norvegicus
gcagtcgaagcacccttagctcaga

SEQ ID NO: 385591 - DNA, 25 bp, Rattus norvegicus
gcagtcgaagcagccttagctcaga

SEQ ID NO: 385592 - DNA, 25 bp, Rattus norvegicus
gcagtcgaagggatggccaatctaa

SEQ ID NO: 385593 - DNA, 25 bp, Rattus norvegicus
gcagtcgaagggttggccaatctaa

SEQ ID NO: 385594 - DNA, 25 bp, Rattus norvegicus
gcagtcgatgtgcatggtcctcttc

SEQ ID NO: 385595 - DNA, 25 bp, Rattus norvegicus
gcagtcgatgtggatggtcctcttc

SEQ ID NO: 385596 - DNA, 25 bp, Rattus norvegicus
gcagtcgatttacaccagatcctga

SEQ ID NO: 385597 - DNA, 25 bp, Rattus norvegicus
gcagtcgatttagaccagatcctga

SEQ ID NO: 385598 - DNA, 25 bp, Rattus norvegicus
gcagtcgcacacaaggtgcctggag

SEQ ID NO: 385599 - DNA, 25 bp, Rattus norvegicus
gcagtcgcacactaggtgcctggag

SEQ ID NO: 385600 - DNA, 25 bp, Rattus norvegicus
gcagtcgcagctcacgttggatatg

SEQ ID NO: 385601 - DNA, 25 bp, Rattus norvegicus
gcagtcgcagctgacgttggatatg

SEQ ID NO: 385602 - DNA, 25 bp, Rattus norvegicus
gcagtcggactcattcctcaaagaa

SEQ ID NO: 385603 - DNA, 25 bp, Rattus norvegicus
gcagtcggactctttcctcaaagaa

SEQ ID NO: 385604 - DNA, 25 bp, Rattus norvegicus
gcagtcggtagtagtttaccttggt

SEQ ID NO: 385605 - DNA, 25 bp, Rattus norvegicus
gcagtcggtagttgtttaccttggt

SEQ ID NO: 385606 - DNA, 25 bp, Rattus norvegicus
gcagtcggtcacacagcggtgagca

SEQ ID NO: 385607 - DNA, 25 bp, Rattus norvegicus
gcagtcggtcactcagcggtgagca

SEQ ID NO: 385608 - DNA, 25 bp, Rattus norvegicus
gcagtcggtgaacaggcagttccta

SEQ ID NO: 385609 - DNA, 25 bp, Rattus norvegicus
gcagtcggtgaagaggcagttccta

SEQ ID NO: 385610 - DNA, 25 bp, Rattus norvegicus
gcagtcgtctttctcactcgaagga

SEQ ID NO: 385611 - DNA, 25 bp, Rattus norvegicus
gcagtcgtctttgtcactcgaagga

SEQ ID NO: 385612 - DNA, 25 bp, Rattus norvegicus
gcagtcgtttgcagtgtgagacctc

SEQ ID NO: 385613 - DNA, 25 bp, Rattus norvegicus
gcagtcgtttgctgtgtgagacctc

SEQ ID NO: 385614 - DNA, 25 bp, Rattus norvegicus
gcagtctacctgcttaggaaaggtt

SEQ ID NO: 385615 - DNA, 25 bp, Rattus norvegicus
gcagtctacctggttaggaaaggtt

SEQ ID NO: 385616 - DNA, 25 bp, Rattus norvegicus
gcagtctagatgactttttctggaa

SEQ ID NO: 385617 - DNA, 25 bp, Rattus norvegicus
gcagtctagatgtctttttctggaa

SEQ ID NO: 385618 - DNA, 25 bp, Rattus norvegicus
gcagtctagcacagaacagttcccc

SEQ ID NO: 385619 - DNA, 25 bp, Rattus norvegicus
gcagtctagcactgaacagttcccc

SEQ ID NO: 385620 - DNA, 25 bp, Rattus norvegicus
gcagtctagcttagttattttccac

SEQ ID NO: 385621 - DNA, 25 bp, Rattus norvegicus
gcagtctagctttgttattttccac

SEQ ID NO: 385622 - DNA, 25 bp, Rattus norvegicus
gcagtctaggaacggccgcagcaaa

SEQ ID NO: 385623 - DNA, 25 bp, Rattus norvegicus
gcagtctaggaagggccgcagcaaa

SEQ ID NO: 385624 - DNA, 25 bp, Rattus norvegicus
gcagtctataggaagatgctcccct

SEQ ID NO: 385625 - DNA, 25 bp, Rattus norvegicus
gcagtctataggtagatgctcccct

SEQ ID NO: 385626 - DNA, 25 bp, Rattus norvegicus
gcagtctatgatcggagcagcgcta

SEQ ID NO: 385627 - DNA, 25 bp, Rattus norvegicus
gcagtctatgatgggagcagcgcta

SEQ ID NO: 385628 - DNA, 25 bp, Rattus norvegicus
gcagtctcaccaccagtcagtatag

SEQ ID NO: 385629 - DNA, 25 bp, Rattus norvegicus
gcagtctcaccagcagtcagtatag

SEQ ID NO: 385630 - DNA, 25 bp, Rattus norvegicus
gcagtctcactgatagttttgggcc

SEQ ID NO: 385631 - DNA, 25 bp, Rattus norvegicus
gcagtctcactgttagttttgggcc

SEQ ID NO: 385632 - DNA, 25 bp, Rattus norvegicus
gcagtctcatggagtttattccgtt

SEQ ID NO: 385633 - DNA, 25 bp, Rattus norvegicus
gcagtctcatggtgtttattccgtt

SEQ ID NO: 385634 - DNA, 25 bp, Rattus norvegicus
gcagtctcattgagtaaccagccta

SEQ ID NO: 385635 - DNA, 25 bp, Rattus norvegicus
gcagtctcattgtgtaaccagccta

SEQ ID NO: 385636 - DNA, 25 bp, Rattus norvegicus
gcagtctcctctctagggacaggaa

SEQ ID NO: 385637 - DNA, 25 bp, Rattus norvegicus
gcagtctcctctgtagggacaggaa

SEQ ID NO: 385638 - DNA, 25 bp, Rattus norvegicus
gcagtctctctgagccaataggcta

SEQ ID NO: 385639 - DNA, 25 bp, Rattus norvegicus
gcagtctctctgtgccaataggcta

SEQ ID NO: 385640 - DNA, 25 bp, Rattus norvegicus
gcagtctctgtaaaatgcctactaa

SEQ ID NO: 385641 - DNA, 25 bp, Rattus norvegicus
gcagtctctgtataatgcctactaa

SEQ ID NO: 385642 - DNA, 25 bp, Rattus norvegicus
gcagtctctgttaatacccatgtgt

SEQ ID NO: 385643 - DNA, 25 bp, Rattus norvegicus
gcagtctctgtttatacccatgtgt

SEQ ID NO: 385644 - DNA, 25 bp, Rattus norvegicus
gcagtctgaataaatccttctgtca

SEQ ID NO: 385645 - DNA, 25 bp, Rattus norvegicus
gcagtctgaatatatccttctgtca

SEQ ID NO: 385646 - DNA, 25 bp, Rattus norvegicus
gcagtctgactccagaggagcagat

SEQ ID NO: 385647 - DNA, 25 bp, Rattus norvegicus
gcagtctgactcgagaggagcagat

SEQ ID NO: 385648 - DNA, 25 bp, Rattus norvegicus
gcagtctgacttcggccatttggca

SEQ ID NO: 385649 - DNA, 25 bp, Rattus norvegicus
gcagtctgacttgggccatttggca

SEQ ID NO: 385650 - DNA, 25 bp, Rattus norvegicus
gcagtctgcaaacaccttagtcata

SEQ ID NO: 385651 - DNA, 25 bp, Rattus norvegicus
gcagtctgcaaagaccttagtcata

SEQ ID NO: 385652 - DNA, 25 bp, Rattus norvegicus
gcagtctgcctcataagccatagcg

SEQ ID NO: 385653 - DNA, 25 bp, Rattus norvegicus
gcagtctgcctcttaagccatagcg

SEQ ID NO: 385654 - DNA, 25 bp, Rattus norvegicus
gcagtctgccttctcaagttgtgta

SEQ ID NO: 385655 - DNA, 25 bp, Rattus norvegicus
gcagtctgccttgtcaagttgtgta

SEQ ID NO: 385656 - DNA, 25 bp, Rattus norvegicus
gcagtctggaaaatgctttgcacaa

SEQ ID NO: 385657 - DNA, 25 bp, Rattus norvegicus
gcagtctggaaattgctttgcacaa

SEQ ID NO: 385658 - DNA, 25 bp, Rattus norvegicus
gcagtctggaagaagcccggatacc

SEQ ID NO: 385659 - DNA, 25 bp, Rattus norvegicus
gcagtctggaagtagcccggatacc

SEQ ID NO: 385660 - DNA, 25 bp, Rattus norvegicus
gcagtctggcgacctgatcctcaag

SEQ ID NO: 385661 - DNA, 25 bp, Rattus norvegicus
gcagtctggcgagctgatcctcaag

SEQ ID NO: 385662 - DNA, 25 bp, Rattus norvegicus
gcagtctgggcaaatcaaacatata

SEQ ID NO: 385663 - DNA, 25 bp, Rattus norvegicus
gcagtctgggcatatcaaacatata

SEQ ID NO: 385664 - DNA, 25 bp, Rattus norvegicus
gcagtctgtgtcaaggtggtctcct

SEQ ID NO: 385665 - DNA, 25 bp, Rattus norvegicus
gcagtctgtgtctaggtggtctcct

SEQ ID NO: 385666 - DNA, 25 bp, Rattus norvegicus
gcagtctgtttcaattgctgtagac

SEQ ID NO: 385667 - DNA, 25 bp, Rattus norvegicus
gcagtctgtttctattgctgtagac

SEQ ID NO: 385668 - DNA, 25 bp, Rattus norvegicus
gcagtcttacctatagcatccagct

SEQ ID NO: 385669 - DNA, 25 bp, Rattus norvegicus
gcagtcttacctttagcatccagct

SEQ ID NO: 385670 - DNA, 25 bp, Rattus norvegicus
gcagtcttcaagcatcgtccatgta

SEQ ID NO: 385671 - DNA, 25 bp, Rattus norvegicus
gcagtcttcaaggatcgtccatgta

SEQ ID NO: 385672 - DNA, 25 bp, Rattus norvegicus
gcagtcttcacccagttgtgttgtg

SEQ ID NO: 385673 - DNA, 25 bp, Rattus norvegicus
gcagtcttcaccgagttgtgttgtg

SEQ ID NO: 385674 - DNA, 25 bp, Rattus norvegicus
gcagtcttcgttatgctccagaatt

SEQ ID NO: 385675 - DNA, 25 bp, Rattus norvegicus
gcagtcttcgttttgctccagaatt

SEQ ID NO: 385676 - DNA, 25 bp, Rattus norvegicus
gcagtcttctccagtgttgtatttt

SEQ ID NO: 385677 - DNA, 25 bp, Rattus norvegicus
gcagtcttctcctgtgttgtatttt

SEQ ID NO: 385678 - DNA, 25 bp, Rattus norvegicus
gcagtcttctgcaagtcttactact

SEQ ID NO: 385679 - DNA, 25 bp, Rattus norvegicus
gcagtcttctgctagtcttactact

SEQ ID NO: 385680 - DNA, 25 bp, Rattus norvegicus
gcagtcttgagaattggcaggccat

SEQ ID NO: 385681 - DNA, 25 bp, Rattus norvegicus
gcagtcttgagatttggcaggccat

SEQ ID NO: 385682 - DNA, 25 bp, Rattus norvegicus
gcagtcttgcatccctatcatggaa

SEQ ID NO: 385683 - DNA, 25 bp, Rattus norvegicus
gcagtcttgcatgcctatcatggaa

SEQ ID NO: 385684 - DNA, 25 bp, Rattus norvegicus
gcagtcttggaaccgtctttttctt

SEQ ID NO: 385685 - DNA, 25 bp, Rattus norvegicus
gcagtcttggaagcgtctttttctt

SEQ ID NO: 385686 - DNA, 25 bp, Rattus norvegicus
gcagtctttcttcagagcagctgtg

SEQ ID NO: 385687 - DNA, 25 bp, Rattus norvegicus
gcagtctttcttgagagcagctgtg

SEQ ID NO: 385688 - DNA, 25 bp, Rattus norvegicus
gcagtctttgcaatagttcacctat

SEQ ID NO: 385689 - DNA, 25 bp, Rattus norvegicus
gcagtctttgcattagttcacctat

SEQ ID NO: 385690 - DNA, 25 bp, Rattus norvegicus
gcagtctttggaagttggagctcac

SEQ ID NO: 385691 - DNA, 25 bp, Rattus norvegicus
gcagtctttggacaccaatctctac

SEQ ID NO: 385692 - DNA, 25 bp, Rattus norvegicus
gcagtctttggagaccaatctctac

SEQ ID NO: 385693 - DNA, 25 bp, Rattus norvegicus
gcagtctttggatgttggagctcac

SEQ ID NO: 385694 - DNA, 25 bp, Rattus norvegicus
gcagtctttgtgctttctgatcata

SEQ ID NO: 385695 - DNA, 25 bp, Rattus norvegicus
gcagtctttgtggtttctgatcata

SEQ ID NO: 385696 - DNA, 25 bp, Rattus norvegicus
gcagtcttttcaaagcctttcgcat

SEQ ID NO: 385697 - DNA, 25 bp, Rattus norvegicus
gcagtcttttcatagcctttcgcat

SEQ ID NO: 385698 - DNA, 25 bp, Rattus norvegicus
gcagtgaaagttccagccgtttctt

SEQ ID NO: 385699 - DNA, 25 bp, Rattus norvegicus
gcagtgaaagttgcagccgtttctt

SEQ ID NO: 385700 - DNA, 25 bp, Rattus norvegicus
gcagtgaaatttattcctggcttaa

SEQ ID NO: 385701 - DNA, 25 bp, Rattus norvegicus
gcagtgaaattttttcctggcttaa

SEQ ID NO: 385702 - DNA, 25 bp, Rattus norvegicus
gcagtgaacatcagggccaggccaa

SEQ ID NO: 385703 - DNA, 25 bp, Rattus norvegicus
gcagtgaacatctgggccaggccaa

SEQ ID NO: 385704 - DNA, 25 bp, Rattus norvegicus
gcagtgaacattataagaccctagt

SEQ ID NO: 385705 - DNA, 25 bp, Rattus norvegicus
gcagtgaacattttaagaccctagt

SEQ ID NO: 385706 - DNA, 25 bp, Rattus norvegicus
gcagtgaactgccagaaggtaacca

SEQ ID NO: 385707 - DNA, 25 bp, Rattus norvegicus
gcagtgaactgcgagaaggtaacca

SEQ ID NO: 385708 - DNA, 25 bp, Rattus norvegicus
gcagtgaacttacctgtgtgacctt

SEQ ID NO: 385709 - DNA, 25 bp, Rattus norvegicus
gcagtgaacttagctgtgtgacctt

SEQ ID NO: 385710 - DNA, 25 bp, Rattus norvegicus
gcagtgaagtgcaccttgctggttt

SEQ ID NO: 385711 - DNA, 25 bp, Rattus norvegicus
gcagtgaagtgctccttgctggttt

SEQ ID NO: 385712 - DNA, 25 bp, Rattus norvegicus
gcagtgaagttgctgcttctcccag

SEQ ID NO: 385713 - DNA, 25 bp, Rattus norvegicus
gcagtgaagttggtgcttctcccag

SEQ ID NO: 385714 - DNA, 25 bp, Rattus norvegicus
gcagtgaatacaacttctgtgctga

SEQ ID NO: 385715 - DNA, 25 bp, Rattus norvegicus
gcagtgaatacatcttctgtgctga

SEQ ID NO: 385716 - DNA, 25 bp, Rattus norvegicus
gcagtgaatcagcagcaaacatgta

SEQ ID NO: 385717 - DNA, 25 bp, Rattus norvegicus
gcagtgaatcaggagcaaacatgta

SEQ ID NO: 385718 - DNA, 25 bp, Rattus norvegicus
gcagtgacaagcagggtctctccta

SEQ ID NO: 385719 - DNA, 25 bp, Rattus norvegicus
gcagtgacaagctgggtctctccta

SEQ ID NO: 385720 - DNA, 25 bp, Rattus norvegicus
gcagtgacaccaacaaacccaatgt

SEQ ID NO: 385721 - DNA, 25 bp, Rattus norvegicus
gcagtgacaccatcaaacccaatgt

SEQ ID NO: 385722 - DNA, 25 bp, Rattus norvegicus
gcagtgacaggtactgtgtacacct

SEQ ID NO: 385723 - DNA, 25 bp, Rattus norvegicus
gcagtgacaggttctgtgtacacct

SEQ ID NO: 385724 - DNA, 25 bp, Rattus norvegicus
gcagtgacatcaaacattcctccct

SEQ ID NO: 385725 - DNA, 25 bp, Rattus norvegicus
gcagtgacatcatacattcctccct

SEQ ID NO: 385726 - DNA, 25 bp, Rattus norvegicus
gcagtgaccagtccggaagcagcat

SEQ ID NO: 385727 - DNA, 25 bp, Rattus norvegicus
gcagtgaccagtgcggaagcagcat

SEQ ID NO: 385728 - DNA, 25 bp, Rattus norvegicus
gcagtgacctacatcctcgagagga

SEQ ID NO: 385729 - DNA, 25 bp, Rattus norvegicus
gcagtgacctacttcctcgagagga

SEQ ID NO: 385730 - DNA, 25 bp, Rattus norvegicus
gcagtgactccaatcattgggctga

SEQ ID NO: 385731 - DNA, 25 bp, Rattus norvegicus
gcagtgactccattcattgggctga

SEQ ID NO: 385732 - DNA, 25 bp, Rattus norvegicus
gcagtgactctcattgtatctgtct

SEQ ID NO: 385733 - DNA, 25 bp, Rattus norvegicus
gcagtgactctctttgtatctgtct

SEQ ID NO: 385734 - DNA, 25 bp, Rattus norvegicus
gcagtgactgcaccagctttgtggc

SEQ ID NO: 385735 - DNA, 25 bp, Rattus norvegicus
gcagtgactgcagcagctttgtggc

SEQ ID NO: 385736 - DNA, 25 bp, Rattus norvegicus
gcagtgactgttctacattgaggct

SEQ ID NO: 385737 - DNA, 25 bp, Rattus norvegicus
gcagtgactgttgtacattgaggct

SEQ ID NO: 385738 - DNA, 25 bp, Rattus norvegicus
gcagtgacttctcatctctacacat

SEQ ID NO: 385739 - DNA, 25 bp, Rattus norvegicus
gcagtgacttctgatctctacacat

SEQ ID NO: 385740 - DNA, 25 bp, Rattus norvegicus
gcagtgacttttaaaatcaccaaag

SEQ ID NO: 385741 - DNA, 25 bp, Rattus norvegicus
gcagtgactttttaaatcaccaaag

SEQ ID NO: 385742 - DNA, 25 bp, Rattus norvegicus
gcagtgagactcatctatgtgtaag

SEQ ID NO: 385743 - DNA, 25 bp, Rattus norvegicus
gcagtgagactcttctatgtgtaag

SEQ ID NO: 385744 - DNA, 25 bp, Rattus norvegicus
gcagtgagacttagactctggcaca

SEQ ID NO: 385745 - DNA, 25 bp, Rattus norvegicus
gcagtgagactttgactctggcaca

SEQ ID NO: 385746 - DNA, 25 bp, Rattus norvegicus
gcagtgagcgcactgcttcagagca

SEQ ID NO: 385747 - DNA, 25 bp, Rattus norvegicus
gcagtgagcgcagtgcttcagagca

SEQ ID NO: 385748 - DNA, 25 bp, Rattus norvegicus
gcagtgagctcaagctgttcacatt

SEQ ID NO: 385749 - DNA, 25 bp, Rattus norvegicus
gcagtgagctcatgctgttcacatt

SEQ ID NO: 385750 - DNA, 25 bp, Rattus norvegicus
gcagtgagctccaaaggccttcttc

SEQ ID NO: 385751 - DNA, 25 bp, Rattus norvegicus
gcagtgagctccatatttggtggaa

SEQ ID NO: 385752 - DNA, 25 bp, Rattus norvegicus
gcagtgagctcctaaggccttcttc

SEQ ID NO: 385753 - DNA, 25 bp, Rattus norvegicus
gcagtgagctccttatttggtggaa

SEQ ID NO: 385754 - DNA, 25 bp, Rattus norvegicus
gcagtgagctctcccaaagcatcac

SEQ ID NO: 385755 - DNA, 25 bp, Rattus norvegicus
gcagtgagctctgccaaagcatcac

SEQ ID NO: 385756 - DNA, 25 bp, Rattus norvegicus
gcagtgaggagcaccgtccctctgt

SEQ ID NO: 385757 - DNA, 25 bp, Rattus norvegicus
gcagtgaggagctccgtccctctgt

SEQ ID NO: 385758 - DNA, 25 bp, Rattus norvegicus
gcagtgagtaaactgtcccacttcc

SEQ ID NO: 385759 - DNA, 25 bp, Rattus norvegicus
gcagtgagtaaagtgtcccacttcc

SEQ ID NO: 385760 - DNA, 25 bp, Rattus norvegicus
gcagtgagtcttagctctcaagcga

SEQ ID NO: 385761 - DNA, 25 bp, Rattus norvegicus
gcagtgagtctttgctctcaagcga

SEQ ID NO: 385762 - DNA, 25 bp, Rattus norvegicus
gcagtgatcctgcaaacagcattca

SEQ ID NO: 385763 - DNA, 25 bp, Rattus norvegicus
gcagtgatcctggaaacagcattca

SEQ ID NO: 385764 - DNA, 25 bp, Rattus norvegicus
gcagtgatcggtaggtgttcaccat

SEQ ID NO: 385765 - DNA, 25 bp, Rattus norvegicus
gcagtgatcggttggtgttcaccat

SEQ ID NO: 385766 - DNA, 25 bp, Rattus norvegicus
gcagtgatgctaagaggtgttctta

SEQ ID NO: 385767 - DNA, 25 bp, Rattus norvegicus
gcagtgatgctatgaggtgttctta

SEQ ID NO: 385768 - DNA, 25 bp, Rattus norvegicus
gcagtgatggtccatcagttctgtt

SEQ ID NO: 385769 - DNA, 25 bp, Rattus norvegicus
gcagtgatggtcgatcagttctgtt

SEQ ID NO: 385770 - DNA, 25 bp, Rattus norvegicus
gcagtgattccgaagcagctgactc

SEQ ID NO: 385771 - DNA, 25 bp, Rattus norvegicus
gcagtgattccgtagcagctgactc

SEQ ID NO: 385772 - DNA, 25 bp, Rattus norvegicus
gcagtgattggcacttggtgtcata

SEQ ID NO: 385773 - DNA, 25 bp, Rattus norvegicus
gcagtgattggctcttggtgtcata

SEQ ID NO: 385774 - DNA, 25 bp, Rattus norvegicus
gcagtgattttaaaacctcaagttt

SEQ ID NO: 385775 - DNA, 25 bp, Rattus norvegicus
gcagtgattttataacctcaagttt

SEQ ID NO: 385776 - DNA, 25 bp, Rattus norvegicus
gcagtgcaacggcaggctcgcctct

SEQ ID NO: 385777 - DNA, 25 bp, Rattus norvegicus
gcagtgcaacgggaggctcgcctct

SEQ ID NO: 385778 - DNA, 25 bp, Rattus norvegicus
gcagtgcaaggccaacatgttttac

SEQ ID NO: 385779 - DNA, 25 bp, Rattus norvegicus
gcagtgcaaggcgaacatgttttac

SEQ ID NO: 385780 - DNA, 25 bp, Rattus norvegicus
gcagtgcaagggagacctcatccag

SEQ ID NO: 385781 - DNA, 25 bp, Rattus norvegicus
gcagtgcaagggtgacctcatccag

SEQ ID NO: 385782 - DNA, 25 bp, Rattus norvegicus
gcagtgcagatgatggtcaaaccca

SEQ ID NO: 385783 - DNA, 25 bp, Rattus norvegicus
gcagtgcagatgttggtcaaaccca

SEQ ID NO: 385784 - DNA, 25 bp, Rattus norvegicus
gcagtgcagcctacgtcttcagtgg

SEQ ID NO: 385785 - DNA, 25 bp, Rattus norvegicus
gcagtgcagccttcgtcttcagtgg

SEQ ID NO: 385786 - DNA, 25 bp, Rattus norvegicus
gcagtgcagtaaagcgttgttggat

SEQ ID NO: 385787 - DNA, 25 bp, Rattus norvegicus
gcagtgcagtaatgcgttgttggat

SEQ ID NO: 385788 - DNA, 25 bp, Rattus norvegicus
gcagtgcagtatcattatgttggct

SEQ ID NO: 385789 - DNA, 25 bp, Rattus norvegicus
gcagtgcagtatgattatgttggct

SEQ ID NO: 385790 - DNA, 25 bp, Rattus norvegicus
gcagtgcagtgcacaatccttttag

SEQ ID NO: 385791 - DNA, 25 bp, Rattus norvegicus
gcagtgcagtgctcaatccttttag

SEQ ID NO: 385792 - DNA, 25 bp, Rattus norvegicus
gcagtgcatcaccaacataggcatt

SEQ ID NO: 385793 - DNA, 25 bp, Rattus norvegicus
gcagtgcatcacgaacataggcatt

SEQ ID NO: 385794 - DNA, 25 bp, Rattus norvegicus
gcagtgcatcataaacgttttcctt

SEQ ID NO: 385795 - DNA, 25 bp, Rattus norvegicus
gcagtgcatcattaacgttttcctt

SEQ ID NO: 385796 - DNA, 25 bp, Rattus norvegicus
gcagtgcatgcccatctggctggaa

SEQ ID NO: 385797 - DNA, 25 bp, Rattus norvegicus
gcagtgcatgccgatctggctggaa

SEQ ID NO: 385798 - DNA, 25 bp, Rattus norvegicus
gcagtgccaaagactacacgcagct

SEQ ID NO: 385799 - DNA, 25 bp, Rattus norvegicus
gcagtgccaaagtctacacgcagct

SEQ ID NO: 385800 - DNA, 25 bp, Rattus norvegicus
gcagtgccaactacacagtgctgat

SEQ ID NO: 385801 - DNA, 25 bp, Rattus norvegicus
gcagtgccaacttcacagtgctgat

SEQ ID NO: 385802 - DNA, 25 bp, Rattus norvegicus
gcagtgccatttctcgatcacgagt

SEQ ID NO: 385803 - DNA, 25 bp, Rattus norvegicus
gcagtgccatttgtcgatcacgagt

SEQ ID NO: 385804 - DNA, 25 bp, Rattus norvegicus
gcagtgcccacacacaaggaagcct

SEQ ID NO: 385805 - DNA, 25 bp, Rattus norvegicus
gcagtgcccacagacaaggaagcct

SEQ ID NO: 385806 - DNA, 25 bp, Rattus norvegicus
gcagtgcccagtatgcaggagcatt

SEQ ID NO: 385807 - DNA, 25 bp, Rattus norvegicus
gcagtgcccagtttgcaggagcatt

SEQ ID NO: 385808 - DNA, 25 bp, Rattus norvegicus
gcagtgccctgcctctgttgctatg

SEQ ID NO: 385809 - DNA, 25 bp, Rattus norvegicus
gcagtgccctgcgtctgttgctatg

SEQ ID NO: 385810 - DNA, 25 bp, Rattus norvegicus
gcagtgcctctgatcataattctaa

SEQ ID NO: 385811 - DNA, 25 bp, Rattus norvegicus
gcagtgcctctgttcataattctaa

SEQ ID NO: 385812 - DNA, 25 bp, Rattus norvegicus
gcagtgcctgataattgcctctctc

SEQ ID NO: 385813 - DNA, 25 bp, Rattus norvegicus
gcagtgcctgattattgcctctctc

SEQ ID NO: 385814 - DNA, 25 bp, Rattus norvegicus
gcagtgcctgtgcactcactgggca

SEQ ID NO: 385815 - DNA, 25 bp, Rattus norvegicus
gcagtgcctgtggactcactgggca

SEQ ID NO: 385816 - DNA, 25 bp, Rattus norvegicus
gcagtgccttttagcattggtacaa

SEQ ID NO: 385817 - DNA, 25 bp, Rattus norvegicus
gcagtgcctttttgcattggtacaa

SEQ ID NO: 385818 - DNA, 25 bp, Rattus norvegicus
gcagtgcgctgccaatggtaatcta

SEQ ID NO: 385819 - DNA, 25 bp, Rattus norvegicus
gcagtgcgctgcgaatggtaatcta

SEQ ID NO: 385820 - DNA, 25 bp, Rattus norvegicus
gcagtgcggctgattaggcaagatc

SEQ ID NO: 385821 - DNA, 25 bp, Rattus norvegicus
gcagtgcggctgtttaggcaagatc

SEQ ID NO: 385822 - DNA, 25 bp, Rattus norvegicus
gcagtgcgtgcaacttgtatttcat

SEQ ID NO: 385823 - DNA, 25 bp, Rattus norvegicus
gcagtgcgtgcatcttgtatttcat

SEQ ID NO: 385824 - DNA, 25 bp, Rattus norvegicus
gcagtgctactccaatattttcaat

SEQ ID NO: 385825 - DNA, 25 bp, Rattus norvegicus
gcagtgctactcgaatattttcaat

SEQ ID NO: 385826 - DNA, 25 bp, Rattus norvegicus
gcagtgctaggcagttctctgtata

SEQ ID NO: 385827 - DNA, 25 bp, Rattus norvegicus
gcagtgctaggctgttctctgtata

SEQ ID NO: 385828 - DNA, 25 bp, Rattus norvegicus
gcagtgctcatcacatccgaatgaa

SEQ ID NO: 385829 - DNA, 25 bp, Rattus norvegicus
gcagtgctcatctcatccgaatgaa

SEQ ID NO: 385830 - DNA, 25 bp, Rattus norvegicus
gcagtgctcgacacatggtcatgca

SEQ ID NO: 385831 - DNA, 25 bp, Rattus norvegicus
gcagtgctcgactcatggtcatgca

SEQ ID NO: 385832 - DNA, 25 bp, Rattus norvegicus
gcagtgctctgtcgcctagcatcac

SEQ ID NO: 385833 - DNA, 25 bp, Rattus norvegicus
gcagtgctctgtggcctagcatcac

SEQ ID NO: 385834 - DNA, 25 bp, Rattus norvegicus
gcagtgctgacaacggttccttaat

SEQ ID NO: 385835 - DNA, 25 bp, Rattus norvegicus
gcagtgctgacatcggttccttaat

SEQ ID NO: 385836 - DNA, 25 bp, Rattus norvegicus
gcagtgctgagcaatctgtaacagt

SEQ ID NO: 385837 - DNA, 25 bp, Rattus norvegicus
gcagtgctgagctatctgtaacagt

SEQ ID NO: 385838 - DNA, 25 bp, Rattus norvegicus
gcagtgctgccccaagagaatgaag

SEQ ID NO: 385839 - DNA, 25 bp, Rattus norvegicus
gcagtgctgcccgaagagaatgaag

SEQ ID NO: 385840 - DNA, 25 bp, Rattus norvegicus
gcagtgctgcttcgtaacccaggaa

SEQ ID NO: 385841 - DNA, 25 bp, Rattus norvegicus
gcagtgctgcttggtaacccaggaa

SEQ ID NO: 385842 - DNA, 25 bp, Rattus norvegicus
gcagtgctggcgctgttctggaaga

SEQ ID NO: 385843 - DNA, 25 bp, Rattus norvegicus
gcagtgctggcggtgttctggaaga

SEQ ID NO: 385844 - DNA, 25 bp, Rattus norvegicus
gcagtgctgggcattcaaacctcca

SEQ ID NO: 385845 - DNA, 25 bp, Rattus norvegicus
gcagtgctgggctttcaaacctcca

SEQ ID NO: 385846 - DNA, 25 bp, Rattus norvegicus
gcagtgctggtactgcatcctgata

SEQ ID NO: 385847 - DNA, 25 bp, Rattus norvegicus
gcagtgctggtagtgcatcctgata

SEQ ID NO: 385848 - DNA, 25 bp, Rattus norvegicus
gcagtgctgtgactcatctgtgagc

SEQ ID NO: 385849 - DNA, 25 bp, Rattus norvegicus
gcagtgctgtgagtcatctgtgagc

SEQ ID NO: 385850 - DNA, 25 bp, Rattus norvegicus
gcagtgctgtggacctctgagaagc

SEQ ID NO: 385851 - DNA, 25 bp, Rattus norvegicus
gcagtgctgtggtcctctgagaagc

SEQ ID NO: 385852 - DNA, 25 bp, Rattus norvegicus
gcagtgcttcaactttgcgcagcat

SEQ ID NO: 385853 - DNA, 25 bp, Rattus norvegicus
gcagtgcttcaagtttgcgcagcat

SEQ ID NO: 385854 - DNA, 25 bp, Rattus norvegicus
gcagtgcttgaacaggccattaaaa

SEQ ID NO: 385855 - DNA, 25 bp, Rattus norvegicus
gcagtgcttgaagaggccattaaaa

SEQ ID NO: 385856 - DNA, 25 bp, Rattus norvegicus
gcagtgcttgcacccgtttgctcag

SEQ ID NO: 385857 - DNA, 25 bp, Rattus norvegicus
gcagtgcttgcagccgtttgctcag

SEQ ID NO: 385858 - DNA, 25 bp, Rattus norvegicus
gcagtgcttgcccaaaggatgacaa

SEQ ID NO: 385859 - DNA, 25 bp, Rattus norvegicus
gcagtgcttgccgaaaggatgacaa

SEQ ID NO: 385860 - DNA, 25 bp, Rattus norvegicus
gcagtgcttggaagagagacccctt

SEQ ID NO: 385861 - DNA, 25 bp, Rattus norvegicus
gcagtgcttggatgagagacccctt

SEQ ID NO: 385862 - DNA, 25 bp, Rattus norvegicus
gcagtggacaggcacacaggacata

SEQ ID NO: 385863 - DNA, 25 bp, Rattus norvegicus
gcagtggacagggacacaggacata

SEQ ID NO: 385864 - DNA, 25 bp, Rattus norvegicus
gcagtggacgttcagcttggttacc

SEQ ID NO: 385865 - DNA, 25 bp, Rattus norvegicus
gcagtggacgttgagcttggttacc

SEQ ID NO: 385866 - DNA, 25 bp, Rattus norvegicus
gcagtggagagacctatttgtttgt

SEQ ID NO: 385867 - DNA, 25 bp, Rattus norvegicus
gcagtggagagagctatttgtttgt

SEQ ID NO: 385868 - DNA, 25 bp, Rattus norvegicus
gcagtggagccgagaactaccgtgt

SEQ ID NO: 385869 - DNA, 25 bp, Rattus norvegicus
gcagtggagccgtgaactaccgtgt

SEQ ID NO: 385870 - DNA, 25 bp, Rattus norvegicus
gcagtggatgttcacctgggcctcc

SEQ ID NO: 385871 - DNA, 25 bp, Rattus norvegicus
gcagtggatgttcgccagatctacg

SEQ ID NO: 385872 - DNA, 25 bp, Rattus norvegicus
gcagtggatgttgacctgggcctcc

SEQ ID NO: 385873 - DNA, 25 bp, Rattus norvegicus
gcagtggatgttggccagatctacg

SEQ ID NO: 385874 - DNA, 25 bp, Rattus norvegicus
gcagtggatttcatggaaacctcaa

SEQ ID NO: 385875 - DNA, 25 bp, Rattus norvegicus
gcagtggatttcttggaaacctcaa

SEQ ID NO: 385876 - DNA, 25 bp, Rattus norvegicus
gcagtggcaattatctaaggataac

SEQ ID NO: 385877 - DNA, 25 bp, Rattus norvegicus
gcagtggcaattttctaaggataac

SEQ ID NO: 385878 - DNA, 25 bp, Rattus norvegicus
gcagtggcacagaggacttcgacga

SEQ ID NO: 385879 - DNA, 25 bp, Rattus norvegicus
gcagtggcacagtggacttcgacga

SEQ ID NO: 385880 - DNA, 25 bp, Rattus norvegicus
gcagtggcagcaattcagcaggact

SEQ ID NO: 385881 - DNA, 25 bp, Rattus norvegicus
gcagtggcagcacatctcaacaatg

SEQ ID NO: 385882 - DNA, 25 bp, Rattus norvegicus
gcagtggcagcagatctcaacaatg

SEQ ID NO: 385883 - DNA, 25 bp, Rattus norvegicus
gcagtggcagcatttcagcaggact

SEQ ID NO: 385884 - DNA, 25 bp, Rattus norvegicus
gcagtggcagctctttgccctaaaa

SEQ ID NO: 385885 - DNA, 25 bp, Rattus norvegicus
gcagtggcagctgtttgccctaaaa

SEQ ID NO: 385886 - DNA, 25 bp, Rattus norvegicus
gcagtggccgctatgtgaacaggat

SEQ ID NO: 385887 - DNA, 25 bp, Rattus norvegicus
gcagtggccgctttgtgaacaggat

SEQ ID NO: 385888 - DNA, 25 bp, Rattus norvegicus
gcagtggccggtcatttgagctaac

SEQ ID NO: 385889 - DNA, 25 bp, Rattus norvegicus
gcagtggccggtgatttgagctaac

SEQ ID NO: 385890 - DNA, 25 bp, Rattus norvegicus
gcagtggcctagaatgattagttta

SEQ ID NO: 385891 - DNA, 25 bp, Rattus norvegicus
gcagtggcctagtatgattagttta

SEQ ID NO: 385892 - DNA, 25 bp, Rattus norvegicus
gcagtggcgccaacccgctgggatc

SEQ ID NO: 385893 - DNA, 25 bp, Rattus norvegicus
gcagtggcgccatcccgctgggatc

SEQ ID NO: 385894 - DNA, 25 bp, Rattus norvegicus
gcagtggcggctacaaataacttat

SEQ ID NO: 385895 - DNA, 25 bp, Rattus norvegicus
gcagtggcggcttcaaataacttat

SEQ ID NO: 385896 - DNA, 25 bp, Rattus norvegicus
gcagtggctccacaaggttcagtcc

SEQ ID NO: 385897 - DNA, 25 bp, Rattus norvegicus
gcagtggctccagaaggttcagtcc

SEQ ID NO: 385898 - DNA, 25 bp, Rattus norvegicus
gcagtggctgacatcctgaggagaa

SEQ ID NO: 385899 - DNA, 25 bp, Rattus norvegicus
gcagtggctgacttcctgaggagaa

SEQ ID NO: 385900 - DNA, 25 bp, Rattus norvegicus
gcagtggctgttctcttatgctgta

SEQ ID NO: 385901 - DNA, 25 bp, Rattus norvegicus
gcagtggctgttgtcttatgctgta

SEQ ID NO: 385902 - DNA, 25 bp, Rattus norvegicus
gcagtggcttcaaagagtcttggtt

SEQ ID NO: 385903 - DNA, 25 bp, Rattus norvegicus
gcagtggcttcatagagtcttggtt

SEQ ID NO: 385904 - DNA, 25 bp, Rattus norvegicus
gcagtggcttggcaggccctaacta

SEQ ID NO: 385905 - DNA, 25 bp, Rattus norvegicus
gcagtggcttgggaggccctaacta

SEQ ID NO: 385906 - DNA, 25 bp, Rattus norvegicus
gcagtggcttttccacctacaaaaa

SEQ ID NO: 385907 - DNA, 25 bp, Rattus norvegicus
gcagtggcttttgcacctacaaaaa

SEQ ID NO: 385908 - DNA, 25 bp, Rattus norvegicus
gcagtgggaccacagaacttctgac

SEQ ID NO: 385909 - DNA, 25 bp, Rattus norvegicus
gcagtgggaccagagaacttctgac

SEQ ID NO: 385910 - DNA, 25 bp, Rattus norvegicus
gcagtgggaggcacgtctatctatg

SEQ ID NO: 385911 - DNA, 25 bp, Rattus norvegicus
gcagtgggaggctcgtctatctatg

SEQ ID NO: 385912 - DNA, 25 bp, Rattus norvegicus
gcagtgggcacgaggctctgaccta

SEQ ID NO: 385913 - DNA, 25 bp, Rattus norvegicus
gcagtgggcacgtggctctgaccta

SEQ ID NO: 385914 - DNA, 25 bp, Rattus norvegicus
gcagtgggccacattgattagcaga

SEQ ID NO: 385915 - DNA, 25 bp, Rattus norvegicus
gcagtgggccactttgattagcaga

SEQ ID NO: 385916 - DNA, 25 bp, Rattus norvegicus
gcagtgggtccactattgtctaaat

SEQ ID NO: 385917 - DNA, 25 bp, Rattus norvegicus
gcagtgggtccagtattgtctaaat

SEQ ID NO: 385918 - DNA, 25 bp, Rattus norvegicus
gcagtgggtctgactaagtagttgt

SEQ ID NO: 385919 - DNA, 25 bp, Rattus norvegicus
gcagtgggtctgagtcttaatgcac

SEQ ID NO: 385920 - DNA, 25 bp, Rattus norvegicus
gcagtgggtctgtctaagtagttgt

SEQ ID NO: 385921 - DNA, 25 bp, Rattus norvegicus
gcagtgggtctgtgtcttaatgcac

SEQ ID NO: 385922 - DNA, 25 bp, Rattus norvegicus
gcagtggtaatcataattctccttt

SEQ ID NO: 385923 - DNA, 25 bp, Rattus norvegicus
gcagtggtaatcttaattctccttt

SEQ ID NO: 385924 - DNA, 25 bp, Rattus norvegicus
gcagtggtaccacctacctagtcaa

SEQ ID NO: 385925 - DNA, 25 bp, Rattus norvegicus
gcagtggtaccagctacctagtcaa

SEQ ID NO: 385926 - DNA, 25 bp, Rattus norvegicus
gcagtggtactgatgctgggctctc

SEQ ID NO: 385927 - DNA, 25 bp, Rattus norvegicus
gcagtggtactgttgctgggctctc

SEQ ID NO: 385928 - DNA, 25 bp, Rattus norvegicus
gcagtggtcacaccttctcagggat

SEQ ID NO: 385929 - DNA, 25 bp, Rattus norvegicus
gcagtggtcacagcttctcagggat

SEQ ID NO: 385930 - DNA, 25 bp, Rattus norvegicus
gcagtggtcagtatcctcagattat

SEQ ID NO: 385931 - DNA, 25 bp, Rattus norvegicus
gcagtggtcagtttcctcagattat

SEQ ID NO: 385932 - DNA, 25 bp, Rattus norvegicus
gcagtggtcatgagatcacaggctt

SEQ ID NO: 385933 - DNA, 25 bp, Rattus norvegicus
gcagtggtcatgtgatcacaggctt

SEQ ID NO: 385934 - DNA, 25 bp, Rattus norvegicus
gcagtggtccagcaagggtccttta

SEQ ID NO: 385935 - DNA, 25 bp, Rattus norvegicus
gcagtggtccaggaagggtccttta

SEQ ID NO: 385936 - DNA, 25 bp, Rattus norvegicus
gcagtggtctgactctctcgggaat

SEQ ID NO: 385937 - DNA, 25 bp, Rattus norvegicus
gcagtggtctgagtctctcgggaat

SEQ ID NO: 385938 - DNA, 25 bp, Rattus norvegicus
gcagtggtgcccatctcaggaaacc

SEQ ID NO: 385939 - DNA, 25 bp, Rattus norvegicus
gcagtggtgcccttctcaggaaacc

SEQ ID NO: 385940 - DNA, 25 bp, Rattus norvegicus
gcagtggtgctaaggctgtcgttca

SEQ ID NO: 385941 - DNA, 25 bp, Rattus norvegicus
gcagtggtgctatggctgtcgttca

SEQ ID NO: 385942 - DNA, 25 bp, Rattus norvegicus
gcagtggtggtgagcacaacttgca

SEQ ID NO: 385943 - DNA, 25 bp, Rattus norvegicus
gcagtggtggtgtgcacaacttgca

SEQ ID NO: 385944 - DNA, 25 bp, Rattus norvegicus
gcagtggtggttatgaacccgcttt

SEQ ID NO: 385945 - DNA, 25 bp, Rattus norvegicus
gcagtggtggttttgaacccgcttt

SEQ ID NO: 385946 - DNA, 25 bp, Rattus norvegicus
gcagtggtgtctacgggattagctc

SEQ ID NO: 385947 - DNA, 25 bp, Rattus norvegicus
gcagtggtgtcttcgggattagctc

SEQ ID NO: 385948 - DNA, 25 bp, Rattus norvegicus
gcagtggtgttgcttgtcttgttaa

SEQ ID NO: 385949 - DNA, 25 bp, Rattus norvegicus
gcagtggtgttggttgtcttgttaa

SEQ ID NO: 385950 - DNA, 25 bp, Rattus norvegicus
gcagtggttactcgacagtcctcgt

SEQ ID NO: 385951 - DNA, 25 bp, Rattus norvegicus
gcagtggttactggacagtcctcgt

SEQ ID NO: 385952 - DNA, 25 bp, Rattus norvegicus
gcagtggttgtgcatcccattcaga

SEQ ID NO: 385953 - DNA, 25 bp, Rattus norvegicus
gcagtggttgtggatcccattcaga

SEQ ID NO: 385954 - DNA, 25 bp, Rattus norvegicus
gcagtgtaactgagaagggaccttc

SEQ ID NO: 385955 - DNA, 25 bp, Rattus norvegicus
gcagtgtaactgtgaagggaccttc

SEQ ID NO: 385956 - DNA, 25 bp, Rattus norvegicus
gcagtgtaagacacggcacaggttt

SEQ ID NO: 385957 - DNA, 25 bp, Rattus norvegicus
gcagtgtaagactcggcacaggttt

SEQ ID NO: 385958 - DNA, 25 bp, Rattus norvegicus
gcagtgtaagctctttcctggatta

SEQ ID NO: 385959 - DNA, 25 bp, Rattus norvegicus
gcagtgtaagctgtttcctggatta

SEQ ID NO: 385960 - DNA, 25 bp, Rattus norvegicus
gcagtgtaatatcagctgaggcaca

SEQ ID NO: 385961 - DNA, 25 bp, Rattus norvegicus
gcagtgtaatatgagctgaggcaca

SEQ ID NO: 385962 - DNA, 25 bp, Rattus norvegicus
gcagtgtacactcaaccctttgtat

SEQ ID NO: 385963 - DNA, 25 bp, Rattus norvegicus
gcagtgtacactgaaccctttgtat

SEQ ID NO: 385964 - DNA, 25 bp, Rattus norvegicus
gcagtgtagtcacggtcaggctcat

SEQ ID NO: 385965 - DNA, 25 bp, Rattus norvegicus
gcagtgtagtcagggtcaggctcat

SEQ ID NO: 385966 - DNA, 25 bp, Rattus norvegicus
gcagtgtatataatttcttgatcta

SEQ ID NO: 385967 - DNA, 25 bp, Rattus norvegicus
gcagtgtatatattttcttgatcta

SEQ ID NO: 385968 - DNA, 25 bp, Rattus norvegicus
gcagtgtatgccatactacagagta

SEQ ID NO: 385969 - DNA, 25 bp, Rattus norvegicus
gcagtgtatgccttactacagagta

SEQ ID NO: 385970 - DNA, 25 bp, Rattus norvegicus
gcagtgtcagcactggctgcagctc

SEQ ID NO: 385971 - DNA, 25 bp, Rattus norvegicus
gcagtgtcagcagtggctgcagctc

SEQ ID NO: 385972 - DNA, 25 bp, Rattus norvegicus
gcagtgtcagttcaatcaattacaa

SEQ ID NO: 385973 - DNA, 25 bp, Rattus norvegicus
gcagtgtcagttgaatcaattacaa

SEQ ID NO: 385974 - DNA, 25 bp, Rattus norvegicus
gcagtgtcatgcattgagccactta

SEQ ID NO: 385975 - DNA, 25 bp, Rattus norvegicus
gcagtgtcatgctttgagccactta

SEQ ID NO: 385976 - DNA, 25 bp, Rattus norvegicus
gcagtgtccagcacaggaagacttt

SEQ ID NO: 385977 - DNA, 25 bp, Rattus norvegicus
gcagtgtccagctcaggaagacttt

SEQ ID NO: 385978 - DNA, 25 bp, Rattus norvegicus
gcagtgtcctgtaaagcttgtaatg

SEQ ID NO: 385979 - DNA, 25 bp, Rattus norvegicus
gcagtgtcctgttaagcttgtaatg

SEQ ID NO: 385980 - DNA, 25 bp, Rattus norvegicus
gcagtgtcgggaaaaatccctccct

SEQ ID NO: 385981 - DNA, 25 bp, Rattus norvegicus
gcagtgtcgggataaatccctccct

SEQ ID NO: 385982 - DNA, 25 bp, Rattus norvegicus
gcagtgtctaaaccacaggcttaat

SEQ ID NO: 385983 - DNA, 25 bp, Rattus norvegicus
gcagtgtctaaagcacaggcttaat

SEQ ID NO: 385984 - DNA, 25 bp, Rattus norvegicus
gcagtgtctaagaacattgaacctt

SEQ ID NO: 385985 - DNA, 25 bp, Rattus norvegicus
gcagtgtctaagtacattgaacctt

SEQ ID NO: 385986 - DNA, 25 bp, Rattus norvegicus
gcagtgtctgcaattatttcccatg

SEQ ID NO: 385987 - DNA, 25 bp, Rattus norvegicus
gcagtgtctgcatttatttcccatg

SEQ ID NO: 385988 - DNA, 25 bp, Rattus norvegicus
gcagtgtctgcgctatacctaatag

SEQ ID NO: 385989 - DNA, 25 bp, Rattus norvegicus
gcagtgtctgcggtatacctaatag

SEQ ID NO: 385990 - DNA, 25 bp, Rattus norvegicus
gcagtgtctgtgatcatccccagaa

SEQ ID NO: 385991 - DNA, 25 bp, Rattus norvegicus
gcagtgtctgtgttcatccccagaa

SEQ ID NO: 385992 - DNA, 25 bp, Rattus norvegicus
gcagtgtctgttcatttgctcaaga

SEQ ID NO: 385993 - DNA, 25 bp, Rattus norvegicus
gcagtgtctgttgatttgctcaaga

SEQ ID NO: 385994 - DNA, 25 bp, Rattus norvegicus
gcagtgtcttctctcattataggtt

SEQ ID NO: 385995 - DNA, 25 bp, Rattus norvegicus
gcagtgtcttctgtcattataggtt

SEQ ID NO: 385996 - DNA, 25 bp, Rattus norvegicus
gcagtgtgaaccacccaatgctttg

SEQ ID NO: 385997 - DNA, 25 bp, Rattus norvegicus
gcagtgtgaacctcccaatgctttg

SEQ ID NO: 385998 - DNA, 25 bp, Rattus norvegicus
gcagtgtgaccacggctctagtgca

SEQ ID NO: 385999 - DNA, 25 bp, Rattus norvegicus
gcagtgtgaccagggctctagtgca

SEQ ID NO: 386000 - DNA, 25 bp, Rattus norvegicus
gcagtgtgactgacgtgtcccagta

SEQ ID NO: 386001 - DNA, 25 bp, Rattus norvegicus
gcagtgtgactgtcgtgtcccagta

SEQ ID NO: 386002 - DNA, 25 bp, Rattus norvegicus
gcagtgtgatgaacccacctggaat

SEQ ID NO: 386003 - DNA, 25 bp, Rattus norvegicus
gcagtgtgatgatcccacctggaat

SEQ ID NO: 386004 - DNA, 25 bp, Rattus norvegicus
gcagtgtgcactatggatccatgtt

SEQ ID NO: 386005 - DNA, 25 bp, Rattus norvegicus
gcagtgtgcactttggatccatgtt

SEQ ID NO: 386006 - DNA, 25 bp, Rattus norvegicus
gcagtgtgcatcactgagcccagag

SEQ ID NO: 386007 - DNA, 25 bp, Rattus norvegicus
gcagtgtgcatctctgagcccagag

SEQ ID NO: 386008 - DNA, 25 bp, Rattus norvegicus
gcagtgtgcgctctgcacattgata

SEQ ID NO: 386009 - DNA, 25 bp, Rattus norvegicus
gcagtgtgcgctgtgcacattgata

SEQ ID NO: 386010 - DNA, 25 bp, Rattus norvegicus
gcagtgtggtacacatgctgtgaaa

SEQ ID NO: 386011 - DNA, 25 bp, Rattus norvegicus
gcagtgtggtactcatgctgtgaaa

SEQ ID NO: 386012 - DNA, 25 bp, Rattus norvegicus
gcagtgtggtttaggtagtcctttc

SEQ ID NO: 386013 - DNA, 25 bp, Rattus norvegicus
gcagtgtggttttggtagtcctttc

SEQ ID NO: 386014 - DNA, 25 bp, Rattus norvegicus
gcagtgtgtacacgcacttgctgcc

SEQ ID NO: 386015 - DNA, 25 bp, Rattus norvegicus
gcagtgtgtacaggcacttgctgcc

SEQ ID NO: 386016 - DNA, 25 bp, Rattus norvegicus
gcagtgtgttgcaagttccagcttt

SEQ ID NO: 386017 - DNA, 25 bp, Rattus norvegicus
gcagtgtgttgctagttccagcttt

SEQ ID NO: 386018 - DNA, 25 bp, Rattus norvegicus
gcagtgttaactcttccaggccttg

SEQ ID NO: 386019 - DNA, 25 bp, Rattus norvegicus
gcagtgttaactgttccaggccttg

SEQ ID NO: 386020 - DNA, 25 bp, Rattus norvegicus
gcagtgttacttattggcctgtgca

SEQ ID NO: 386021 - DNA, 25 bp, Rattus norvegicus
gcagtgttactttttggcctgtgca

SEQ ID NO: 386022 - DNA, 25 bp, Rattus norvegicus
gcagtgttagacactggtgatgtga

SEQ ID NO: 386023 - DNA, 25 bp, Rattus norvegicus
gcagtgttagactctggtgatgtga

SEQ ID NO: 386024 - DNA, 25 bp, Rattus norvegicus
gcagtgttcagtcctagtttttctt

SEQ ID NO: 386025 - DNA, 25 bp, Rattus norvegicus
gcagtgttcagtgctagtttttctt

SEQ ID NO: 386026 - DNA, 25 bp, Rattus norvegicus
gcagtgttccagacatctgtgacaa

SEQ ID NO: 386027 - DNA, 25 bp, Rattus norvegicus
gcagtgttccagtcatctgtgacaa

SEQ ID NO: 386028 - DNA, 25 bp, Rattus norvegicus
gcagtgttccataaaaagacatcaa

SEQ ID NO: 386029 - DNA, 25 bp, Rattus norvegicus
gcagtgttccattaaaagacatcaa

SEQ ID NO: 386030 - DNA, 25 bp, Rattus norvegicus
gcagtgttcctgctggctcctttaa

SEQ ID NO: 386031 - DNA, 25 bp, Rattus norvegicus
gcagtgttcctggtggctcctttaa

SEQ ID NO: 386032 - DNA, 25 bp, Rattus norvegicus
gcagtgttccttaccctagaaggga

SEQ ID NO: 386033 - DNA, 25 bp, Rattus norvegicus
gcagtgttcctttccctagaaggga

SEQ ID NO: 386034 - DNA, 25 bp, Rattus norvegicus
gcagtgttgcatctttttaagttct

SEQ ID NO: 386035 - DNA, 25 bp, Rattus norvegicus
gcagtgttgcatgtttttaagttct

SEQ ID NO: 386036 - DNA, 25 bp, Rattus norvegicus
gcagtgttgggcagtcaaggacaat

SEQ ID NO: 386037 - DNA, 25 bp, Rattus norvegicus
gcagtgttgggctgtcaaggacaat

SEQ ID NO: 386038 - DNA, 25 bp, Rattus norvegicus
gcagtgtttctactcggatgtccat

SEQ ID NO: 386039 - DNA, 25 bp, Rattus norvegicus
gcagtgtttctagtcggatgtccat

SEQ ID NO: 386040 - DNA, 25 bp, Rattus norvegicus
gcagtgtttgacctcagctgaagcc

SEQ ID NO: 386041 - DNA, 25 bp, Rattus norvegicus
gcagtgtttgacgtcagctgaagcc

SEQ ID NO: 386042 - DNA, 25 bp, Rattus norvegicus
gcagtgtttttaatccttagttagg

SEQ ID NO: 386043 - DNA, 25 bp, Rattus norvegicus
gcagtgtttttattccttagttagg

SEQ ID NO: 386044 - DNA, 25 bp, Rattus norvegicus
gcagttaaaaatctgttgtctcccc

SEQ ID NO: 386045 - DNA, 25 bp, Rattus norvegicus
gcagttaaaaatgtgttgtctcccc

SEQ ID NO: 386046 - DNA, 25 bp, Rattus norvegicus
gcagttaaaatcagctgccctccaa

SEQ ID NO: 386047 - DNA, 25 bp, Rattus norvegicus
gcagttaaaatctgctgccctccaa

SEQ ID NO: 386048 - DNA, 25 bp, Rattus norvegicus
gcagttaagagcatccaactactct

SEQ ID NO: 386049 - DNA, 25 bp, Rattus norvegicus
gcagttaagagcttccaactactct

SEQ ID NO: 386050 - DNA, 25 bp, Rattus norvegicus
gcagttaagtccatgggaagcccat

SEQ ID NO: 386051 - DNA, 25 bp, Rattus norvegicus
gcagttaagtccttgggaagcccat

SEQ ID NO: 386052 - DNA, 25 bp, Rattus norvegicus
gcagttaagtcgcaggcagcgcctc

SEQ ID NO: 386053 - DNA, 25 bp, Rattus norvegicus
gcagttaagtcggaggcagcgcctc

SEQ ID NO: 386054 - DNA, 25 bp, Rattus norvegicus
gcagttacaccaatctgtggagttt

SEQ ID NO: 386055 - DNA, 25 bp, Rattus norvegicus
gcagttacaccattctgtggagttt

SEQ ID NO: 386056 - DNA, 25 bp, Rattus norvegicus
gcagttacatgcagttctgtccgaa

SEQ ID NO: 386057 - DNA, 25 bp, Rattus norvegicus
gcagttacatgctgttctgtccgaa

SEQ ID NO: 386058 - DNA, 25 bp, Rattus norvegicus
gcagttacctctcctctcagaagtg

SEQ ID NO: 386059 - DNA, 25 bp, Rattus norvegicus
gcagttacctctgctctcagaagtg

SEQ ID NO: 386060 - DNA, 25 bp, Rattus norvegicus
gcagttacgacaaattttcctccag

SEQ ID NO: 386061 - DNA, 25 bp, Rattus norvegicus
gcagttacgacatattttcctccag

SEQ ID NO: 386062 - DNA, 25 bp, Rattus norvegicus
gcagttacgctgagatatccatatt

SEQ ID NO: 386063 - DNA, 25 bp, Rattus norvegicus
gcagttacgctgtgatatccatatt

SEQ ID NO: 386064 - DNA, 25 bp, Rattus norvegicus
gcagttactgtgagacgtttcgaag

SEQ ID NO: 386065 - DNA, 25 bp, Rattus norvegicus
gcagttactgtgtgacgtttcgaag

SEQ ID NO: 386066 - DNA, 25 bp, Rattus norvegicus
gcagttacttcaagggtattgatca

SEQ ID NO: 386067 - DNA, 25 bp, Rattus norvegicus
gcagttacttcatgggtattgatca

SEQ ID NO: 386068 - DNA, 25 bp, Rattus norvegicus
gcagttagacctaggagctctttag

SEQ ID NO: 386069 - DNA, 25 bp, Rattus norvegicus
gcagttagaccttggagctctttag

SEQ ID NO: 386070 - DNA, 25 bp, Rattus norvegicus
gcagttagcataagccatccttcag

SEQ ID NO: 386071 - DNA, 25 bp, Rattus norvegicus
gcagttagcatatgccatccttcag

SEQ ID NO: 386072 - DNA, 25 bp, Rattus norvegicus
gcagttagtcttaacacctgtcttg

SEQ ID NO: 386073 - DNA, 25 bp, Rattus norvegicus
gcagttagtctttacacctgtcttg

SEQ ID NO: 386074 - DNA, 25 bp, Rattus norvegicus
gcagttagtttgaggataggcatat

SEQ ID NO: 386075 - DNA, 25 bp, Rattus norvegicus
gcagttagtttgtggataggcatat

SEQ ID NO: 386076 - DNA, 25 bp, Rattus norvegicus
gcagttataggtcacagcagtgaca

SEQ ID NO: 386077 - DNA, 25 bp, Rattus norvegicus
gcagttataggtgacagcagtgaca

SEQ ID NO: 386078 - DNA, 25 bp, Rattus norvegicus
gcagttatccatcaacacaaggaca

SEQ ID NO: 386079 - DNA, 25 bp, Rattus norvegicus
gcagttatccatgaacacaaggaca

SEQ ID NO: 386080 - DNA, 25 bp, Rattus norvegicus
gcagttatctacctgcacaacctga

SEQ ID NO: 386081 - DNA, 25 bp, Rattus norvegicus
gcagttatctacgtgcacaacctga

SEQ ID NO: 386082 - DNA, 25 bp, Rattus norvegicus
gcagttatctccacacgtggacaga

SEQ ID NO: 386083 - DNA, 25 bp, Rattus norvegicus
gcagttatctcctcacgtggacaga

SEQ ID NO: 386084 - DNA, 25 bp, Rattus norvegicus
gcagttatctctacagtgcctagaa

SEQ ID NO: 386085 - DNA, 25 bp, Rattus norvegicus
gcagttatctcttcagtgcctagaa

SEQ ID NO: 386086 - DNA, 25 bp, Rattus norvegicus
gcagttatgctcataatgcttaaaa

SEQ ID NO: 386087 - DNA, 25 bp, Rattus norvegicus
gcagttatgctcttaatgcttaaaa

SEQ ID NO: 386088 - DNA, 25 bp, Rattus norvegicus
gcagttatgctgagccattaggaca

SEQ ID NO: 386089 - DNA, 25 bp, Rattus norvegicus
gcagttatgctgtgccattaggaca

SEQ ID NO: 386090 - DNA, 25 bp, Rattus norvegicus
gcagttattcgtatcttgcgggaac

SEQ ID NO: 386091 - DNA, 25 bp, Rattus norvegicus
gcagttattcgtttcttgcgggaac

SEQ ID NO: 386092 - DNA, 25 bp, Rattus norvegicus
gcagttcaaactctagacctcctca

SEQ ID NO: 386093 - DNA, 25 bp, Rattus norvegicus
gcagttcaaactgtagacctcctca

SEQ ID NO: 386094 - DNA, 25 bp, Rattus norvegicus
gcagttcaacgacatcctgcagaac

SEQ ID NO: 386095 - DNA, 25 bp, Rattus norvegicus
gcagttcaacgagatcctgcagaac

SEQ ID NO: 386096 - DNA, 25 bp, Rattus norvegicus
gcagttcaagctcactatcactagt

SEQ ID NO: 386097 - DNA, 25 bp, Rattus norvegicus
gcagttcaagctgactatcactagt

SEQ ID NO: 386098 - DNA, 25 bp, Rattus norvegicus
gcagttcaatgccaaaatcctggaa

SEQ ID NO: 386099 - DNA, 25 bp, Rattus norvegicus
gcagttcaatgccagggattccagg

SEQ ID NO: 386100 - DNA, 25 bp, Rattus norvegicus
gcagttcaatgcgaaaatcctggaa

SEQ ID NO: 386101 - DNA, 25 bp, Rattus norvegicus
gcagttcaatgcgagggattccagg

SEQ ID NO: 386102 - DNA, 25 bp, Rattus norvegicus
gcagttcacactctgtactttgtac

SEQ ID NO: 386103 - DNA, 25 bp, Rattus norvegicus
gcagttcacactgtgtactttgtac

SEQ ID NO: 386104 - DNA, 25 bp, Rattus norvegicus
gcagttcaccccagtgatgatggca

SEQ ID NO: 386105 - DNA, 25 bp, Rattus norvegicus
gcagttcacccctgtgatgatggca

SEQ ID NO: 386106 - DNA, 25 bp, Rattus norvegicus
gcagttcagaatcctagttccataa

SEQ ID NO: 386107 - DNA, 25 bp, Rattus norvegicus
gcagttcagaatgctagttccataa

SEQ ID NO: 386108 - DNA, 25 bp, Rattus norvegicus
gcagttcagattacttatttcttaa

SEQ ID NO: 386109 - DNA, 25 bp, Rattus norvegicus
gcagttcagatttcttatttcttaa

SEQ ID NO: 386110 - DNA, 25 bp, Rattus norvegicus
gcagttcataatcccaggagcagcc

SEQ ID NO: 386111 - DNA, 25 bp, Rattus norvegicus
gcagttcataatgccaggagcagcc

SEQ ID NO: 386112 - DNA, 25 bp, Rattus norvegicus
gcagttcatcatctctattgtctaa

SEQ ID NO: 386113 - DNA, 25 bp, Rattus norvegicus
gcagttcatcatgtctattgtctaa

SEQ ID NO: 386114 - DNA, 25 bp, Rattus norvegicus
gcagttcatctgacgtggagcaaat

SEQ ID NO: 386115 - DNA, 25 bp, Rattus norvegicus
gcagttcatctgtcgtggagcaaat

SEQ ID NO: 386116 - DNA, 25 bp, Rattus norvegicus
gcagttcatgaaacgtcttccctaa

SEQ ID NO: 386117 - DNA, 25 bp, Rattus norvegicus
gcagttcatgaatcgtcttccctaa

SEQ ID NO: 386118 - DNA, 25 bp, Rattus norvegicus
gcagttcatgtgactaatgcttggt

SEQ ID NO: 386119 - DNA, 25 bp, Rattus norvegicus
gcagttcatgtgtctaatgcttggt

SEQ ID NO: 386120 - DNA, 25 bp, Rattus norvegicus
gcagttccagagagacctctgagtt

SEQ ID NO: 386121 - DNA, 25 bp, Rattus norvegicus
gcagttccagagtgacctctgagtt

SEQ ID NO: 386122 - DNA, 25 bp, Rattus norvegicus
gcagttccaggaagccactttcata

SEQ ID NO: 386123 - DNA, 25 bp, Rattus norvegicus
gcagttccaggatgccactttcata

SEQ ID NO: 386124 - DNA, 25 bp, Rattus norvegicus
gcagttcccaaaccagacctagatt

SEQ ID NO: 386125 - DNA, 25 bp, Rattus norvegicus
gcagttcccaaagcagacctagatt

SEQ ID NO: 386126 - DNA, 25 bp, Rattus norvegicus
gcagttcccaccagatcgcgtgcag

SEQ ID NO: 386127 - DNA, 25 bp, Rattus norvegicus
gcagttcccacctgatcgcgtgcag

SEQ ID NO: 386128 - DNA, 25 bp, Rattus norvegicus
gcagttccccggagcagggttccca

SEQ ID NO: 386129 - DNA, 25 bp, Rattus norvegicus
gcagttccccggtgcagggttccca

SEQ ID NO: 386130 - DNA, 25 bp, Rattus norvegicus
gcagttccggttaggtgtgccttcc

SEQ ID NO: 386131 - DNA, 25 bp, Rattus norvegicus
gcagttccggtttggtgtgccttcc

SEQ ID NO: 386132 - DNA, 25 bp, Rattus norvegicus
gcagttcctacaatcacgttattta

SEQ ID NO: 386133 - DNA, 25 bp, Rattus norvegicus
gcagttcctacattcacgttattta

SEQ ID NO: 386134 - DNA, 25 bp, Rattus norvegicus
gcagttcctgccagaattgatttgg

SEQ ID NO: 386135 - DNA, 25 bp, Rattus norvegicus
gcagttcctgcctgaattgatttgg

SEQ ID NO: 386136 - DNA, 25 bp, Rattus norvegicus
gcagttcctgcgaagtgtgtccgcc

SEQ ID NO: 386137 - DNA, 25 bp, Rattus norvegicus
gcagttcctgcgtagtgtgtccgcc

SEQ ID NO: 386138 - DNA, 25 bp, Rattus norvegicus
gcagttccttaacgagtgacccgtt

SEQ ID NO: 386139 - DNA, 25 bp, Rattus norvegicus
gcagttccttaaggagtgacccgtt

SEQ ID NO: 386140 - DNA, 25 bp, Rattus norvegicus
gcagttcgctgaatggattgacatt

SEQ ID NO: 386141 - DNA, 25 bp, Rattus norvegicus
gcagttcgctgattggattgacatt

SEQ ID NO: 386142 - DNA, 25 bp, Rattus norvegicus
gcagttcgtcatagttttttattcg

SEQ ID NO: 386143 - DNA, 25 bp, Rattus norvegicus
gcagttcgtcattgttttttattcg

SEQ ID NO: 386144 - DNA, 25 bp, Rattus norvegicus
gcagttcgttttcaagtttgggctt

SEQ ID NO: 386145 - DNA, 25 bp, Rattus norvegicus
gcagttcgttttgaagtttgggctt

SEQ ID NO: 386146 - DNA, 25 bp, Rattus norvegicus
gcagttctacacctgtgctagacaa

SEQ ID NO: 386147 - DNA, 25 bp, Rattus norvegicus
gcagttctacacgtgtgctagacaa

SEQ ID NO: 386148 - DNA, 25 bp, Rattus norvegicus
gcagttctaccgaatacttggacca

SEQ ID NO: 386149 - DNA, 25 bp, Rattus norvegicus
gcagttctaccgtatacttggacca

SEQ ID NO: 386150 - DNA, 25 bp, Rattus norvegicus
gcagttctaggactctaagcatcca

SEQ ID NO: 386151 - DNA, 25 bp, Rattus norvegicus
gcagttctaggagtctaagcatcca

SEQ ID NO: 386152 - DNA, 25 bp, Rattus norvegicus
gcagttctaggtccacagtagcagg

SEQ ID NO: 386153 - DNA, 25 bp, Rattus norvegicus
gcagttctaggtgcacagtagcagg

SEQ ID NO: 386154 - DNA, 25 bp, Rattus norvegicus
gcagttctagtccaggcgttttata

SEQ ID NO: 386155 - DNA, 25 bp, Rattus norvegicus
gcagttctagtcgaggcgttttata

SEQ ID NO: 386156 - DNA, 25 bp, Rattus norvegicus
gcagttctatctagcaagtgctaca

SEQ ID NO: 386157 - DNA, 25 bp, Rattus norvegicus
gcagttctatcttgcaagtgctaca

SEQ ID NO: 386158 - DNA, 25 bp, Rattus norvegicus
gcagttctcatgagcacctttagaa

SEQ ID NO: 386159 - DNA, 25 bp, Rattus norvegicus
gcagttctcatgtgcacctttagaa

SEQ ID NO: 386160 - DNA, 25 bp, Rattus norvegicus
gcagttctcattacacaagtgcatt

SEQ ID NO: 386161 - DNA, 25 bp, Rattus norvegicus
gcagttctcatttcacaagtgcatt

SEQ ID NO: 386162 - DNA, 25 bp, Rattus norvegicus
gcagttctcggcagtcttgcctgct

SEQ ID NO: 386163 - DNA, 25 bp, Rattus norvegicus
gcagttctcggctgtcttgcctgct

SEQ ID NO: 386164 - DNA, 25 bp, Rattus norvegicus
gcagttctctgacttcgagatctct

SEQ ID NO: 386165 - DNA, 25 bp, Rattus norvegicus
gcagttctctgagttcgagatctct

SEQ ID NO: 386166 - DNA, 25 bp, Rattus norvegicus
gcagttctctgtcgctcaggtttac

SEQ ID NO: 386167 - DNA, 25 bp, Rattus norvegicus
gcagttctctgtggctcaggtttac

SEQ ID NO: 386168 - DNA, 25 bp, Rattus norvegicus
gcagttctgattatgactggactaa

SEQ ID NO: 386169 - DNA, 25 bp, Rattus norvegicus
gcagttctgattttgactggactaa

SEQ ID NO: 386170 - DNA, 25 bp, Rattus norvegicus
gcagttctgcaccacaggcatggac

SEQ ID NO: 386171 - DNA, 25 bp, Rattus norvegicus
gcagttctgcacgacaggcatggac

SEQ ID NO: 386172 - DNA, 25 bp, Rattus norvegicus
gcagttctgccaaggtcatacattt

SEQ ID NO: 386173 - DNA, 25 bp, Rattus norvegicus
gcagttctgccatggtcatacattt

SEQ ID NO: 386174 - DNA, 25 bp, Rattus norvegicus
gcagttctgggcattctacactggc

SEQ ID NO: 386175 - DNA, 25 bp, Rattus norvegicus
gcagttctgggctttctacactggc

SEQ ID NO: 386176 - DNA, 25 bp, Rattus norvegicus
gcagttctgttcatgtgtatgactt

SEQ ID NO: 386177 - DNA, 25 bp, Rattus norvegicus
gcagttctgttcttgtgtatgactt

SEQ ID NO: 386178 - DNA, 25 bp, Rattus norvegicus
gcagttcttaggatttggctcagat

SEQ ID NO: 386179 - DNA, 25 bp, Rattus norvegicus
gcagttcttaggttttggctcagat

SEQ ID NO: 386180 - DNA, 25 bp, Rattus norvegicus
gcagttcttgctaccatgcaaggtg

SEQ ID NO: 386181 - DNA, 25 bp, Rattus norvegicus
gcagttcttgcttccatgcaaggtg

SEQ ID NO: 386182 - DNA, 25 bp, Rattus norvegicus
gcagttcttggtcttttgtactcgt

SEQ ID NO: 386183 - DNA, 25 bp, Rattus norvegicus
gcagttcttggtgttttgtactcgt

SEQ ID NO: 386184 - DNA, 25 bp, Rattus norvegicus
gcagttctttgactatgcctcatat

SEQ ID NO: 386185 - DNA, 25 bp, Rattus norvegicus
gcagttctttgagtatgcctcatat

SEQ ID NO: 386186 - DNA, 25 bp, Rattus norvegicus
gcagttcttttcatgtcagctttct

SEQ ID NO: 386187 - DNA, 25 bp, Rattus norvegicus
gcagttcttttcttgtcagctttct

SEQ ID NO: 386188 - DNA, 25 bp, Rattus norvegicus
gcagttgaaatgacgactcccactc

SEQ ID NO: 386189 - DNA, 25 bp, Rattus norvegicus
gcagttgaaatgtcgactcccactc

SEQ ID NO: 386190 - DNA, 25 bp, Rattus norvegicus
gcagttgaactgactccttgtatct

SEQ ID NO: 386191 - DNA, 25 bp, Rattus norvegicus
gcagttgaactgtctccttgtatct

SEQ ID NO: 386192 - DNA, 25 bp, Rattus norvegicus
gcagttgactacaaatgctttttca

SEQ ID NO: 386193 - DNA, 25 bp, Rattus norvegicus
gcagttgactactaatgctttttca

SEQ ID NO: 386194 - DNA, 25 bp, Rattus norvegicus
gcagttgagacccatgtgctatcag

SEQ ID NO: 386195 - DNA, 25 bp, Rattus norvegicus
gcagttgagaccgatgtgctatcag

SEQ ID NO: 386196 - DNA, 25 bp, Rattus norvegicus
gcagttgagctaaaaagccatgttt

SEQ ID NO: 386197 - DNA, 25 bp, Rattus norvegicus
gcagttgagctataaagccatgttt

SEQ ID NO: 386198 - DNA, 25 bp, Rattus norvegicus
gcagttgatgtgaattgcctcccac

SEQ ID NO: 386199 - DNA, 25 bp, Rattus norvegicus
gcagttgatgtgtattgcctcccac

SEQ ID NO: 386200 - DNA, 25 bp, Rattus norvegicus
gcagttgcaaaaaacagcgctccct

SEQ ID NO: 386201 - DNA, 25 bp, Rattus norvegicus
gcagttgcaaaatacagcgctccct

SEQ ID NO: 386202 - DNA, 25 bp, Rattus norvegicus
gcagttgcagtcatgatgctgccat

SEQ ID NO: 386203 - DNA, 25 bp, Rattus norvegicus
gcagttgcagtcttgatgctgccat

SEQ ID NO: 386204 - DNA, 25 bp, Rattus norvegicus
gcagttgccacaaaattatcacatt

SEQ ID NO: 386205 - DNA, 25 bp, Rattus norvegicus
gcagttgccacataattatcacatt

SEQ ID NO: 386206 - DNA, 25 bp, Rattus norvegicus
gcagttgcctttaaagatccccatt

SEQ ID NO: 386207 - DNA, 25 bp, Rattus norvegicus
gcagttgccttttaagatccccatt

SEQ ID NO: 386208 - DNA, 25 bp, Rattus norvegicus
gcagttgcgactctctctttcagat

SEQ ID NO: 386209 - DNA, 25 bp, Rattus norvegicus
gcagttgcgactgtctctttcagat

SEQ ID NO: 386210 - DNA, 25 bp, Rattus norvegicus
gcagttgctaggaactaacatccca

SEQ ID NO: 386211 - DNA, 25 bp, Rattus norvegicus
gcagttgctaggtactaacatccca

SEQ ID NO: 386212 - DNA, 25 bp, Rattus norvegicus
gcagttgctctgatctaatctcagt

SEQ ID NO: 386213 - DNA, 25 bp, Rattus norvegicus
gcagttgctctgttctaatctcagt

SEQ ID NO: 386214 - DNA, 25 bp, Rattus norvegicus
gcagttgctgcgcagcatcatttga

SEQ ID NO: 386215 - DNA, 25 bp, Rattus norvegicus
gcagttgctgcggagcatcatttga

SEQ ID NO: 386216 - DNA, 25 bp, Rattus norvegicus
gcagttgctgctccgtacagaggtt

SEQ ID NO: 386217 - DNA, 25 bp, Rattus norvegicus
gcagttgctgctgcgtacagaggtt

SEQ ID NO: 386218 - DNA, 25 bp, Rattus norvegicus
gcagttgctggaacatcttttcatc

SEQ ID NO: 386219 - DNA, 25 bp, Rattus norvegicus
gcagttgctggatcatcttttcatc

SEQ ID NO: 386220 - DNA, 25 bp, Rattus norvegicus
gcagttgcttgtacacttgtgtgat

SEQ ID NO: 386221 - DNA, 25 bp, Rattus norvegicus
gcagttgcttgttcacttgtgtgat

SEQ ID NO: 386222 - DNA, 25 bp, Rattus norvegicus
gcagttggagaaaacttcgcttcat

SEQ ID NO: 386223 - DNA, 25 bp, Rattus norvegicus
gcagttggagaatacttcgcttcat

SEQ ID NO: 386224 - DNA, 25 bp, Rattus norvegicus
gcagttggcaggcagttcccatgaa

SEQ ID NO: 386225 - DNA, 25 bp, Rattus norvegicus
gcagttggcagggagttcccatgaa

SEQ ID NO: 386226 - DNA, 25 bp, Rattus norvegicus
gcagttggctttacgtacctgactt

SEQ ID NO: 386227 - DNA, 25 bp, Rattus norvegicus
gcagttggcttttcgtacctgactt

SEQ ID NO: 386228 - DNA, 25 bp, Rattus norvegicus
gcagttgggctcctatgatccacta

SEQ ID NO: 386229 - DNA, 25 bp, Rattus norvegicus
gcagttgggctcgtatgatccacta

SEQ ID NO: 386230 - DNA, 25 bp, Rattus norvegicus
gcagttgggtttaatcatggcggcc

SEQ ID NO: 386231 - DNA, 25 bp, Rattus norvegicus
gcagttgggttttatcatggcggcc

SEQ ID NO: 386232 - DNA, 25 bp, Rattus norvegicus
gcagttggttgaagtctgggatttc

SEQ ID NO: 386233 - DNA, 25 bp, Rattus norvegicus
gcagttggttgatgtctgggatttc

SEQ ID NO: 386234 - DNA, 25 bp, Rattus norvegicus
gcagttgtacaacgaatgcaccctt

SEQ ID NO: 386235 - DNA, 25 bp, Rattus norvegicus
gcagttgtacaaggaatgcaccctt

SEQ ID NO: 386236 - DNA, 25 bp, Rattus norvegicus
gcagttgtactgagtcttgtaggaa

SEQ ID NO: 386237 - DNA, 25 bp, Rattus norvegicus
gcagttgtactgtgtcttgtaggaa

SEQ ID NO: 386238 - DNA, 25 bp, Rattus norvegicus
gcagttgtagctagggttgctttta

SEQ ID NO: 386239 - DNA, 25 bp, Rattus norvegicus
gcagttgtagcttgggttgctttta

SEQ ID NO: 386240 - DNA, 25 bp, Rattus norvegicus
gcagttgtaggtcacatcttgggcc

SEQ ID NO: 386241 - DNA, 25 bp, Rattus norvegicus
gcagttgtaggtgacatcttgggcc

SEQ ID NO: 386242 - DNA, 25 bp, Rattus norvegicus
gcagttgtcactagggaacccacat

SEQ ID NO: 386243 - DNA, 25 bp, Rattus norvegicus
gcagttgtcacttgggaacccacat

SEQ ID NO: 386244 - DNA, 25 bp, Rattus norvegicus
gcagttgtcagcctttctgtttcag

SEQ ID NO: 386245 - DNA, 25 bp, Rattus norvegicus
gcagttgtcagcgtttctgtttcag

SEQ ID NO: 386246 - DNA, 25 bp, Rattus norvegicus
gcagttgtccagaactgtcaggctt

SEQ ID NO: 386247 - DNA, 25 bp, Rattus norvegicus
gcagttgtccagtactgtcaggctt

SEQ ID NO: 386248 - DNA, 25 bp, Rattus norvegicus
gcagttgtgctcaatttcccttaga

SEQ ID NO: 386249 - DNA, 25 bp, Rattus norvegicus
gcagttgtgctctatttcccttaga

SEQ ID NO: 386250 - DNA, 25 bp, Rattus norvegicus
gcagttgtgtctctgaatttcactt

SEQ ID NO: 386251 - DNA, 25 bp, Rattus norvegicus
gcagttgtgtctgtgaatttcactt

SEQ ID NO: 386252 - DNA, 25 bp, Rattus norvegicus
gcagttgtgttaagcctgcacacca

SEQ ID NO: 386253 - DNA, 25 bp, Rattus norvegicus
gcagttgtgttatgcctgcacacca

SEQ ID NO: 386254 - DNA, 25 bp, Rattus norvegicus
gcagttgtgtttctcgctcttggaa

SEQ ID NO: 386255 - DNA, 25 bp, Rattus norvegicus
gcagttgtgtttgtcgctcttggaa

SEQ ID NO: 386256 - DNA, 25 bp, Rattus norvegicus
gcagttgttccaacctgtggtaaca

SEQ ID NO: 386257 - DNA, 25 bp, Rattus norvegicus
gcagttgttccatcctgtggtaaca

SEQ ID NO: 386258 - DNA, 25 bp, Rattus norvegicus
gcagttgttgccatctttaaatata

SEQ ID NO: 386259 - DNA, 25 bp, Rattus norvegicus
gcagttgttgccttctttaaatata

SEQ ID NO: 386260 - DNA, 25 bp, Rattus norvegicus
gcagttgtttcgagcttatggttaa

SEQ ID NO: 386261 - DNA, 25 bp, Rattus norvegicus
gcagttgtttcgtgcttatggttaa

SEQ ID NO: 386262 - DNA, 25 bp, Rattus norvegicus
gcagttgttttaagaaattcatcct

SEQ ID NO: 386263 - DNA, 25 bp, Rattus norvegicus
gcagttgttttatgaaattcatcct

SEQ ID NO: 386264 - DNA, 25 bp, Rattus norvegicus
gcagtttaactcaagggcttggcct

SEQ ID NO: 386265 - DNA, 25 bp, Rattus norvegicus
gcagtttaactctagggcttggcct

SEQ ID NO: 386266 - DNA, 25 bp, Rattus norvegicus
gcagtttaacttagactttgatcag

SEQ ID NO: 386267 - DNA, 25 bp, Rattus norvegicus
gcagtttaactttgactttgatcag

SEQ ID NO: 386268 - DNA, 25 bp, Rattus norvegicus
gcagtttacaacaggcacagacaga

SEQ ID NO: 386269 - DNA, 25 bp, Rattus norvegicus
gcagtttacaactggcacagacaga

SEQ ID NO: 386270 - DNA, 25 bp, Rattus norvegicus
gcagtttacgtaccgaacggacgcc

SEQ ID NO: 386271 - DNA, 25 bp, Rattus norvegicus
gcagtttacgtagcgaacggacgcc

SEQ ID NO: 386272 - DNA, 25 bp, Rattus norvegicus
gcagtttacgtgcttagaaaattat

SEQ ID NO: 386273 - DNA, 25 bp, Rattus norvegicus
gcagtttacgtggttagaaaattat

SEQ ID NO: 386274 - DNA, 25 bp, Rattus norvegicus
gcagtttactaaaatccttcttcag

SEQ ID NO: 386275 - DNA, 25 bp, Rattus norvegicus
gcagtttactaatatccttcttcag

SEQ ID NO: 386276 - DNA, 25 bp, Rattus norvegicus
gcagtttactggaagttgccataaa

SEQ ID NO: 386277 - DNA, 25 bp, Rattus norvegicus
gcagtttactggtagttgccataaa

SEQ ID NO: 386278 - DNA, 25 bp, Rattus norvegicus
gcagtttagacaagagtcctggtca

SEQ ID NO: 386279 - DNA, 25 bp, Rattus norvegicus
gcagtttagacatgagtcctggtca

SEQ ID NO: 386280 - DNA, 25 bp, Rattus norvegicus
gcagtttagctcacttgacttttac

SEQ ID NO: 386281 - DNA, 25 bp, Rattus norvegicus
gcagtttagctctcttgacttttac

SEQ ID NO: 386282 - DNA, 25 bp, Rattus norvegicus
gcagtttaggctagaggttcttgag

SEQ ID NO: 386283 - DNA, 25 bp, Rattus norvegicus
gcagtttaggcttgaggttcttgag

SEQ ID NO: 386284 - DNA, 25 bp, Rattus norvegicus
gcagtttagttgatcatacctagtt

SEQ ID NO: 386285 - DNA, 25 bp, Rattus norvegicus
gcagtttagttgttcatacctagtt

SEQ ID NO: 386286 - DNA, 25 bp, Rattus norvegicus
gcagtttatactctacttcccatat

SEQ ID NO: 386287 - DNA, 25 bp, Rattus norvegicus
gcagtttatactgtacttcccatat

SEQ ID NO: 386288 - DNA, 25 bp, Rattus norvegicus
gcagtttatccgagagagctaccca

SEQ ID NO: 386289 - DNA, 25 bp, Rattus norvegicus
gcagtttatccgtgagagctaccca

SEQ ID NO: 386290 - DNA, 25 bp, Rattus norvegicus
gcagtttattaaagacgcacatttt

SEQ ID NO: 386291 - DNA, 25 bp, Rattus norvegicus
gcagtttattaatgacgcacatttt

SEQ ID NO: 386292 - DNA, 25 bp, Rattus norvegicus
gcagtttattttcataccctgtata

SEQ ID NO: 386293 - DNA, 25 bp, Rattus norvegicus
gcagtttattttgataccctgtata

SEQ ID NO: 386294 - DNA, 25 bp, Rattus norvegicus
gcagtttcaagacttcagcttttgt

SEQ ID NO: 386295 - DNA, 25 bp, Rattus norvegicus
gcagtttcaagagttcagcttttgt

SEQ ID NO: 386296 - DNA, 25 bp, Rattus norvegicus
gcagtttccaaaccgagcagtcgaa

SEQ ID NO: 386297 - DNA, 25 bp, Rattus norvegicus
gcagtttccaaagcgagcagtcgaa

SEQ ID NO: 386298 - DNA, 25 bp, Rattus norvegicus
gcagtttccagtcgttttattgcct

SEQ ID NO: 386299 - DNA, 25 bp, Rattus norvegicus
gcagtttccagtggttttattgcct

SEQ ID NO: 386300 - DNA, 25 bp, Rattus norvegicus
gcagtttcccaaagaagccctgttg

SEQ ID NO: 386301 - DNA, 25 bp, Rattus norvegicus
gcagtttcccaatgaagccctgttg

SEQ ID NO: 386302 - DNA, 25 bp, Rattus norvegicus
gcagtttcccgtctcagaagtattg

SEQ ID NO: 386303 - DNA, 25 bp, Rattus norvegicus
gcagtttcccgtgtcagaagtattg

SEQ ID NO: 386304 - DNA, 25 bp, Rattus norvegicus
gcagtttctagaattaatcttagta

SEQ ID NO: 386305 - DNA, 25 bp, Rattus norvegicus
gcagtttctagatttaatcttagta

SEQ ID NO: 386306 - DNA, 25 bp, Rattus norvegicus
gcagtttctccaccagagcagtgaa

SEQ ID NO: 386307 - DNA, 25 bp, Rattus norvegicus
gcagtttctccagcagagcagtgaa

SEQ ID NO: 386308 - DNA, 25 bp, Rattus norvegicus
gcagtttctgtaacttttcccattt

SEQ ID NO: 386309 - DNA, 25 bp, Rattus norvegicus
gcagtttctgtatcttttcccattt

SEQ ID NO: 386310 - DNA, 25 bp, Rattus norvegicus
gcagtttctgtcagtgttccgtctg

SEQ ID NO: 386311 - DNA, 25 bp, Rattus norvegicus
gcagtttctgtctgtgttccgtctg

SEQ ID NO: 386312 - DNA, 25 bp, Rattus norvegicus
gcagtttcttcaaatttcctacgta

SEQ ID NO: 386313 - DNA, 25 bp, Rattus norvegicus
gcagtttcttcatatttcctacgta

SEQ ID NO: 386314 - DNA, 25 bp, Rattus norvegicus
gcagtttgaaagcttgagacttcat

SEQ ID NO: 386315 - DNA, 25 bp, Rattus norvegicus
gcagtttgaaaggttgagacttcat

SEQ ID NO: 386316 - DNA, 25 bp, Rattus norvegicus
gcagtttgacccatgtcaccaggga

SEQ ID NO: 386317 - DNA, 25 bp, Rattus norvegicus
gcagtttgacccttgtcaccaggga

SEQ ID NO: 386318 - DNA, 25 bp, Rattus norvegicus
gcagtttgaggtacacaggcagcaa

SEQ ID NO: 386319 - DNA, 25 bp, Rattus norvegicus
gcagtttgaggttcacaggcagcaa

SEQ ID NO: 386320 - DNA, 25 bp, Rattus norvegicus
gcagtttgcaggcttttgatttgtt

SEQ ID NO: 386321 - DNA, 25 bp, Rattus norvegicus
gcagtttgcagggttttgatttgtt

SEQ ID NO: 386322 - DNA, 25 bp, Rattus norvegicus
gcagtttgctaaatacaaccaccat

SEQ ID NO: 386323 - DNA, 25 bp, Rattus norvegicus
gcagtttgctaattacaaccaccat

SEQ ID NO: 386324 - DNA, 25 bp, Rattus norvegicus
gcagtttgctgccatttgtattcag

SEQ ID NO: 386325 - DNA, 25 bp, Rattus norvegicus
gcagtttgctgcgatttgtattcag

SEQ ID NO: 386326 - DNA, 25 bp, Rattus norvegicus
gcagtttgcttaacattacagaggt

SEQ ID NO: 386327 - DNA, 25 bp, Rattus norvegicus
gcagtttgcttatcattacagaggt

SEQ ID NO: 386328 - DNA, 25 bp, Rattus norvegicus
gcagtttggtgcattcagatgtttg

SEQ ID NO: 386329 - DNA, 25 bp, Rattus norvegicus
gcagtttggtgctttcagatgtttg

SEQ ID NO: 386330 - DNA, 25 bp, Rattus norvegicus
gcagtttgtcatatttggtcagttt

SEQ ID NO: 386331 - DNA, 25 bp, Rattus norvegicus
gcagtttgtcatttttggtcagttt

SEQ ID NO: 386332 - DNA, 25 bp, Rattus norvegicus
gcagttttccttagagaatgttcca

SEQ ID NO: 386333 - DNA, 25 bp, Rattus norvegicus
gcagttttcctttgagaatgttcca

SEQ ID NO: 386334 - DNA, 25 bp, Rattus norvegicus
gcagttttctaaactttttcttcct

SEQ ID NO: 386335 - DNA, 25 bp, Rattus norvegicus
gcagttttctaatctttttcttcct

SEQ ID NO: 386336 - DNA, 25 bp, Rattus norvegicus
gcagttttctttagtgaccttgggt

SEQ ID NO: 386337 - DNA, 25 bp, Rattus norvegicus
gcagttttcttttgtgaccttgggt

SEQ ID NO: 386338 - DNA, 25 bp, Rattus norvegicus
gcagttttgaggatttattcccaca

SEQ ID NO: 386339 - DNA, 25 bp, Rattus norvegicus
gcagttttgaggttttattcccaca

SEQ ID NO: 386340 - DNA, 25 bp, Rattus norvegicus
gcagttttggttatattcatgtcac

SEQ ID NO: 386341 - DNA, 25 bp, Rattus norvegicus
gcagttttggttttattcatgtcac

SEQ ID NO: 386342 - DNA, 25 bp, Rattus norvegicus
gcagttttgttaaatccagcagccg

SEQ ID NO: 386343 - DNA, 25 bp, Rattus norvegicus
gcagttttgttatatccagcagccg

SEQ ID NO: 386344 - DNA, 25 bp, Rattus norvegicus
gcagtttttcatactaagtttaaga

SEQ ID NO: 386345 - DNA, 25 bp, Rattus norvegicus
gcagtttttcattctaagtttaaga

SEQ ID NO: 386346 - DNA, 25 bp, Rattus norvegicus
gcagtttttgttagcgtgtatcact

SEQ ID NO: 386347 - DNA, 25 bp, Rattus norvegicus
gcagtttttgtttgcgtgtatcact

SEQ ID NO: 386348 - DNA, 25 bp, Rattus norvegicus
gcagttttttgcaattccctttcct

SEQ ID NO: 386349 - DNA, 25 bp, Rattus norvegicus
gcagttttttgctattccctttcct

SEQ ID NO: 386350 - DNA, 25 bp, Rattus norvegicus
gcataaaaaggcaccctgtgtcctt

SEQ ID NO: 386351 - DNA, 25 bp, Rattus norvegicus
gcataaaaaggctccctgtgtcctt

SEQ ID NO: 386352 - DNA, 25 bp, Rattus norvegicus
gcataaacgcaaaaactcgcctctc

SEQ ID NO: 386353 - DNA, 25 bp, Rattus norvegicus
gcataaacgcaataactcgcctctc

SEQ ID NO: 386354 - DNA, 25 bp, Rattus norvegicus
gcataaagatgacagccaggctccc

SEQ ID NO: 386355 - DNA, 25 bp, Rattus norvegicus
gcataaagatgagagccaggctccc

SEQ ID NO: 386356 - DNA, 25 bp, Rattus norvegicus
gcataaaggcttccatctcaatcct

SEQ ID NO: 386357 - DNA, 25 bp, Rattus norvegicus
gcataaaggcttgcatctcaatcct

SEQ ID NO: 386358 - DNA, 25 bp, Rattus norvegicus
gcataaatagaaccccccagctgct

SEQ ID NO: 386359 - DNA, 25 bp, Rattus norvegicus
gcataaatagaagcccccagctgct

SEQ ID NO: 386360 - DNA, 25 bp, Rattus norvegicus
gcataaatccctaaactcagtcagc

SEQ ID NO: 386361 - DNA, 25 bp, Rattus norvegicus
gcataaatcccttaactcagtcagc

SEQ ID NO: 386362 - DNA, 25 bp, Rattus norvegicus
gcataaatctctacccaaagccgat

SEQ ID NO: 386363 - DNA, 25 bp, Rattus norvegicus
gcataaatctcttcccaaagccgat

SEQ ID NO: 386364 - DNA, 25 bp, Rattus norvegicus
gcataacaacgacgcaggcagactg

SEQ ID NO: 386365 - DNA, 25 bp, Rattus norvegicus
gcataacaacgaggcaggcagactg

SEQ ID NO: 386366 - DNA, 25 bp, Rattus norvegicus
gcataacacactcctattattggtc

SEQ ID NO: 386367 - DNA, 25 bp, Rattus norvegicus
gcataacacactgctattattggtc

SEQ ID NO: 386368 - DNA, 25 bp, Rattus norvegicus
gcataacacgcgatagttctcacca

SEQ ID NO: 386369 - DNA, 25 bp, Rattus norvegicus
gcataacacgcgttagttctcacca

SEQ ID NO: 386370 - DNA, 25 bp, Rattus norvegicus
gcataacatgtccaatgctgtttaa

SEQ ID NO: 386371 - DNA, 25 bp, Rattus norvegicus
gcataacatgtcgaatgctgtttaa

SEQ ID NO: 386372 - DNA, 25 bp, Rattus norvegicus
gcataacatttaagtccctgggtat

SEQ ID NO: 386373 - DNA, 25 bp, Rattus norvegicus
gcataacatttatgtccctgggtat

SEQ ID NO: 386374 - DNA, 25 bp, Rattus norvegicus
gcataaccatctcgtttctgagcag

SEQ ID NO: 386375 - DNA, 25 bp, Rattus norvegicus
gcataaccatctggtttctgagcag

SEQ ID NO: 386376 - DNA, 25 bp, Rattus norvegicus
gcataacccaagaactgatccagat

SEQ ID NO: 386377 - DNA, 25 bp, Rattus norvegicus
gcataacccaagtactgatccagat

SEQ ID NO: 386378 - DNA, 25 bp, Rattus norvegicus
gcataacctagcctgtgaggaacct

SEQ ID NO: 386379 - DNA, 25 bp, Rattus norvegicus
gcataacctagcgtgtgaggaacct

SEQ ID NO: 386380 - DNA, 25 bp, Rattus norvegicus
gcataacgtaaactgcgaagtcttt

SEQ ID NO: 386381 - DNA, 25 bp, Rattus norvegicus
gcataacgtaaagtgcgaagtcttt

SEQ ID NO: 386382 - DNA, 25 bp, Rattus norvegicus
gcataactggacatggttcctcctg

SEQ ID NO: 386383 - DNA, 25 bp, Rattus norvegicus
gcataactggacttggttcctcctg

SEQ ID NO: 386384 - DNA, 25 bp, Rattus norvegicus
gcataacttgaaatttacttgtata

SEQ ID NO: 386385 - DNA, 25 bp, Rattus norvegicus
gcataacttgaattttacttgtata

SEQ ID NO: 386386 - DNA, 25 bp, Rattus norvegicus
gcataagctatgagttggcaaaagt

SEQ ID NO: 386387 - DNA, 25 bp, Rattus norvegicus
gcataagctatgtgttggcaaaagt

SEQ ID NO: 386388 - DNA, 25 bp, Rattus norvegicus
gcataaggaattcagtttctaccct

SEQ ID NO: 386389 - DNA, 25 bp, Rattus norvegicus
gcataaggaattgagtttctaccct

SEQ ID NO: 386390 - DNA, 25 bp, Rattus norvegicus
gcataagggctcagtagtttctgaa

SEQ ID NO: 386391 - DNA, 25 bp, Rattus norvegicus
gcataagggctctgtagtttctgaa

SEQ ID NO: 386392 - DNA, 25 bp, Rattus norvegicus
gcataaggtctccgagtccagcacc

SEQ ID NO: 386393 - DNA, 25 bp, Rattus norvegicus
gcataaggtctcggagtccagcacc

SEQ ID NO: 386394 - DNA, 25 bp, Rattus norvegicus
gcataagtcgtcaccgctgagagct

SEQ ID NO: 386395 - DNA, 25 bp, Rattus norvegicus
gcataagtcgtctccgctgagagct

SEQ ID NO: 386396 - DNA, 25 bp, Rattus norvegicus
gcataagtgcatagtcacagagcaa

SEQ ID NO: 386397 - DNA, 25 bp, Rattus norvegicus
gcataagtgcattgtcacagagcaa

SEQ ID NO: 386398 - DNA, 25 bp, Rattus norvegicus
gcataagttagtccgcttttcttct

SEQ ID NO: 386399 - DNA, 25 bp, Rattus norvegicus
gcataagttagtgcgcttttcttct

SEQ ID NO: 386400 - DNA, 25 bp, Rattus norvegicus
gcataagttcaactgcttatctaga

SEQ ID NO: 386401 - DNA, 25 bp, Rattus norvegicus
gcataagttcaagtgcttatctaga

SEQ ID NO: 386402 - DNA, 25 bp, Rattus norvegicus
gcataataatacatcccaaggcaat

SEQ ID NO: 386403 - DNA, 25 bp, Rattus norvegicus
gcataataatacttcccaaggcaat

SEQ ID NO: 386404 - DNA, 25 bp, Rattus norvegicus
gcataatacattacgcctgtgatat

SEQ ID NO: 386405 - DNA, 25 bp, Rattus norvegicus
gcataatacatttcgcctgtgatat

SEQ ID NO: 386406 - DNA, 25 bp, Rattus norvegicus
gcataatatctacgtccaggccatt

SEQ ID NO: 386407 - DNA, 25 bp, Rattus norvegicus
gcataatatctaggtccaggccatt

SEQ ID NO: 386408 - DNA, 25 bp, Rattus norvegicus
gcataatcagcaacgttttttccaa

SEQ ID NO: 386409 - DNA, 25 bp, Rattus norvegicus
gcataatcagcatcgttttttccaa

SEQ ID NO: 386410 - DNA, 25 bp, Rattus norvegicus
gcataatggtgacagtccctgccag

SEQ ID NO: 386411 - DNA, 25 bp, Rattus norvegicus
gcataatggtgagagtccctgccag

SEQ ID NO: 386412 - DNA, 25 bp, Rattus norvegicus
gcataattactgcagaacaagtcac

SEQ ID NO: 386413 - DNA, 25 bp, Rattus norvegicus
gcataattactggagaacaagtcac

SEQ ID NO: 386414 - DNA, 25 bp, Rattus norvegicus
gcataattaggcattctgccctcca

SEQ ID NO: 386415 - DNA, 25 bp, Rattus norvegicus
gcataattaggctttctgccctcca

SEQ ID NO: 386416 - DNA, 25 bp, Rattus norvegicus
gcataattattccaaaaagttcttt

SEQ ID NO: 386417 - DNA, 25 bp, Rattus norvegicus
gcataattattcgaaaaagttcttt

SEQ ID NO: 386418 - DNA, 25 bp, Rattus norvegicus
gcataatttggacctattcaggaat

SEQ ID NO: 386419 - DNA, 25 bp, Rattus norvegicus
gcataatttggagctattcaggaat

SEQ ID NO: 386420 - DNA, 25 bp, Rattus norvegicus
gcataattttctagtcactgtgcca

SEQ ID NO: 386421 - DNA, 25 bp, Rattus norvegicus
gcataattttcttgtcactgtgcca

SEQ ID NO: 386422 - DNA, 25 bp, Rattus norvegicus
gcatacaaagcaactacacctggat

SEQ ID NO: 386423 - DNA, 25 bp, Rattus norvegicus
gcatacaaagcatctacacctggat

SEQ ID NO: 386424 - DNA, 25 bp, Rattus norvegicus
gcatacacagcacaatcacggaaca

SEQ ID NO: 386425 - DNA, 25 bp, Rattus norvegicus
gcatacacagcagaatcacggaaca

SEQ ID NO: 386426 - DNA, 25 bp, Rattus norvegicus
gcatacacccatctgtagacacata

SEQ ID NO: 386427 - DNA, 25 bp, Rattus norvegicus
gcatacacccatgtgtagacacata

SEQ ID NO: 386428 - DNA, 25 bp, Rattus norvegicus
gcatacacgtgtcaacaaaagccat

SEQ ID NO: 386429 - DNA, 25 bp, Rattus norvegicus
gcatacacgtgtgaacaaaagccat

SEQ ID NO: 386430 - DNA, 25 bp, Rattus norvegicus
gcatacagaagcacacacacacaag

SEQ ID NO: 386431 - DNA, 25 bp, Rattus norvegicus
gcatacagaagctcacacacacaag

SEQ ID NO: 386432 - DNA, 25 bp, Rattus norvegicus
gcatacagactgactcttccagagc

SEQ ID NO: 386433 - DNA, 25 bp, Rattus norvegicus
gcatacagactgtctcttccagagc

SEQ ID NO: 386434 - DNA, 25 bp, Rattus norvegicus
gcatacagtaggcacattcaaggtg

SEQ ID NO: 386435 - DNA, 25 bp, Rattus norvegicus
gcatacagtagggacattcaaggtg

SEQ ID NO: 386436 - DNA, 25 bp, Rattus norvegicus
gcatacagtgagcacatctagctga

SEQ ID NO: 386437 - DNA, 25 bp, Rattus norvegicus
gcatacagtgaggacatctagctga

SEQ ID NO: 386438 - DNA, 25 bp, Rattus norvegicus
gcatacatagctacagagaaaacag

SEQ ID NO: 386439 - DNA, 25 bp, Rattus norvegicus
gcatacatagctattcaccgagact

SEQ ID NO: 386440 - DNA, 25 bp, Rattus norvegicus
gcatacatagcttcagagaaaacag

SEQ ID NO: 386441 - DNA, 25 bp, Rattus norvegicus
gcatacatagcttttcaccgagact

SEQ ID NO: 386442 - DNA, 25 bp, Rattus norvegicus
gcatacatcataaggtccaggccaa

SEQ ID NO: 386443 - DNA, 25 bp, Rattus norvegicus
gcatacatcatatggtccaggccaa

SEQ ID NO: 386444 - DNA, 25 bp, Rattus norvegicus
gcatacatcctaaccacacataagt

SEQ ID NO: 386445 - DNA, 25 bp, Rattus norvegicus
gcatacatcctatccacacataagt

SEQ ID NO: 386446 - DNA, 25 bp, Rattus norvegicus
gcatacatctctcttttttcttaat

SEQ ID NO: 386447 - DNA, 25 bp, Rattus norvegicus
gcatacatctctgttttttcttaat

SEQ ID NO: 386448 - DNA, 25 bp, Rattus norvegicus
gcatacatgcatatgtgtcttccaa

SEQ ID NO: 386449 - DNA, 25 bp, Rattus norvegicus
gcatacatgcatttgtgtcttccaa

SEQ ID NO: 386450 - DNA, 25 bp, Rattus norvegicus
gcatacatgcggagttcgagtgtca

SEQ ID NO: 386451 - DNA, 25 bp, Rattus norvegicus
gcatacatgcggtgttcgagtgtca

SEQ ID NO: 386452 - DNA, 25 bp, Rattus norvegicus
gcatacatggagcttttctgccaat

SEQ ID NO: 386453 - DNA, 25 bp, Rattus norvegicus
gcatacatggaggttttctgccaat

SEQ ID NO: 386454 - DNA, 25 bp, Rattus norvegicus
gcatacatggttatcatgcctagtg

SEQ ID NO: 386455 - DNA, 25 bp, Rattus norvegicus
gcatacatggttttcatgcctagtg

SEQ ID NO: 386456 - DNA, 25 bp, Rattus norvegicus
gcatacatgtgaaggccagaggaca

SEQ ID NO: 386457 - DNA, 25 bp, Rattus norvegicus
gcatacatgtgatggccagaggaca

SEQ ID NO: 386458 - DNA, 25 bp, Rattus norvegicus
gcatacatgttcaactgtttgccat

SEQ ID NO: 386459 - DNA, 25 bp, Rattus norvegicus
gcatacatgttctactgtttgccat

SEQ ID NO: 386460 - DNA, 25 bp, Rattus norvegicus
gcatacattcacaagggcacatacg

SEQ ID NO: 386461 - DNA, 25 bp, Rattus norvegicus
gcatacattcactagggcacatacg

SEQ ID NO: 386462 - DNA, 25 bp, Rattus norvegicus
gcatacattttaactgggctaacag

SEQ ID NO: 386463 - DNA, 25 bp, Rattus norvegicus
gcatacattttatctgggctaacag

SEQ ID NO: 386464 - DNA, 25 bp, Rattus norvegicus
gcataccaagtaagtttttctggga

SEQ ID NO: 386465 - DNA, 25 bp, Rattus norvegicus
gcataccaagtatgtttttctggga

SEQ ID NO: 386466 - DNA, 25 bp, Rattus norvegicus
gcataccagaggagcctgggttaca

SEQ ID NO: 386467 - DNA, 25 bp, Rattus norvegicus
gcataccagaggtgcctgggttaca

SEQ ID NO: 386468 - DNA, 25 bp, Rattus norvegicus
gcataccagcaacaggagtcttcta

SEQ ID NO: 386469 - DNA, 25 bp, Rattus norvegicus
gcataccagcaagaggagtcttcta

SEQ ID NO: 386470 - DNA, 25 bp, Rattus norvegicus
gcatacccttggcacttatactaaa

SEQ ID NO: 386471 - DNA, 25 bp, Rattus norvegicus
gcatacccttgggacttatactaaa

SEQ ID NO: 386472 - DNA, 25 bp, Rattus norvegicus
gcataccgacgtcctcaaaggttca

SEQ ID NO: 386473 - DNA, 25 bp, Rattus norvegicus
gcataccgacgtgctcaaaggttca

SEQ ID NO: 386474 - DNA, 25 bp, Rattus norvegicus
gcatacctacctctgcatcctgaga

SEQ ID NO: 386475 - DNA, 25 bp, Rattus norvegicus
gcatacctacctgtgcatcctgaga

SEQ ID NO: 386476 - DNA, 25 bp, Rattus norvegicus
gcatacctgcaaacttggtcgctta

SEQ ID NO: 386477 - DNA, 25 bp, Rattus norvegicus
gcatacctgcaatcttggtcgctta

SEQ ID NO: 386478 - DNA, 25 bp, Rattus norvegicus
gcatacctgtcaaccatttcattag

SEQ ID NO: 386479 - DNA, 25 bp, Rattus norvegicus
gcatacctgtcatccatttcattag

SEQ ID NO: 386480 - DNA, 25 bp, Rattus norvegicus
gcatacgcacgcacactaaatattt

SEQ ID NO: 386481 - DNA, 25 bp, Rattus norvegicus
gcatacgcacgctcactaaatattt

SEQ ID NO: 386482 - DNA, 25 bp, Rattus norvegicus
gcatacgcgaagctgccaaagcctt

SEQ ID NO: 386483 - DNA, 25 bp, Rattus norvegicus
gcatacgcgaaggtgccaaagcctt

SEQ ID NO: 386484 - DNA, 25 bp, Rattus norvegicus
gcatacgtatgccagagcacacctg

SEQ ID NO: 386485 - DNA, 25 bp, Rattus norvegicus
gcatacgtatgcgagagcacacctg

SEQ ID NO: 386486 - DNA, 25 bp, Rattus norvegicus
gcatacgtgctgatactcaaccaga

SEQ ID NO: 386487 - DNA, 25 bp, Rattus norvegicus
gcatacgtgctgattgttggagcaa

SEQ ID NO: 386488 - DNA, 25 bp, Rattus norvegicus
gcatacgtgctgttactcaaccaga

SEQ ID NO: 386489 - DNA, 25 bp, Rattus norvegicus
gcatacgtgctgtttgttggagcaa

SEQ ID NO: 386490 - DNA, 25 bp, Rattus norvegicus
gcatactaaccgatccagggttcta

SEQ ID NO: 386491 - DNA, 25 bp, Rattus norvegicus
gcatactaaccgttccagggttcta

SEQ ID NO: 386492 - DNA, 25 bp, Rattus norvegicus
gcatactcatttagtttgagtccac

SEQ ID NO: 386493 - DNA, 25 bp, Rattus norvegicus
gcatactcattttgtttgagtccac

SEQ ID NO: 386494 - DNA, 25 bp, Rattus norvegicus
gcatactccactcataaccatatat

SEQ ID NO: 386495 - DNA, 25 bp, Rattus norvegicus
gcatactccactgataaccatatat

SEQ ID NO: 386496 - DNA, 25 bp, Rattus norvegicus
gcatactcccttcactgtaggaatt

SEQ ID NO: 386497 - DNA, 25 bp, Rattus norvegicus
gcatactcccttgactgtaggaatt

SEQ ID NO: 386498 - DNA, 25 bp, Rattus norvegicus
gcatactccttcacagaacagtgga

SEQ ID NO: 386499 - DNA, 25 bp, Rattus norvegicus
gcatactccttctcagaacagtgga

SEQ ID NO: 386500 - DNA, 25 bp, Rattus norvegicus
gcatactctgctccttaatttaaaa

SEQ ID NO: 386501 - DNA, 25 bp, Rattus norvegicus
gcatactctgctgcttaatttaaaa

SEQ ID NO: 386502 - DNA, 25 bp, Rattus norvegicus
gcatactctgggacgtttgagtgtg

SEQ ID NO: 386503 - DNA, 25 bp, Rattus norvegicus
gcatactctgggtcgtttgagtgtg

SEQ ID NO: 386504 - DNA, 25 bp, Rattus norvegicus
gcatactgcactacaagccttgtaa

SEQ ID NO: 386505 - DNA, 25 bp, Rattus norvegicus
gcatactgcacttcaagccttgtaa

SEQ ID NO: 386506 - DNA, 25 bp, Rattus norvegicus
gcatactgcattctattctggatac

SEQ ID NO: 386507 - DNA, 25 bp, Rattus norvegicus
gcatactgcattgtattctggatac

SEQ ID NO: 386508 - DNA, 25 bp, Rattus norvegicus
gcatactgcttgatccaatgtcttt

SEQ ID NO: 386509 - DNA, 25 bp, Rattus norvegicus
gcatactgcttgttccaatgtcttt

SEQ ID NO: 386510 - DNA, 25 bp, Rattus norvegicus
gcatactgtacaaagatctccgttc

SEQ ID NO: 386511 - DNA, 25 bp, Rattus norvegicus
gcatactgtacatagatctccgttc

SEQ ID NO: 386512 - DNA, 25 bp, Rattus norvegicus
gcatactgtgtgctcacaatatcat

SEQ ID NO: 386513 - DNA, 25 bp, Rattus norvegicus
gcatactgtgtggtcacaatatcat

SEQ ID NO: 386514 - DNA, 25 bp, Rattus norvegicus
gcatactgtgttatccctatagaga

SEQ ID NO: 386515 - DNA, 25 bp, Rattus norvegicus
gcatactgtgttttccctatagaga

SEQ ID NO: 386516 - DNA, 25 bp, Rattus norvegicus
gcatactgttgcatagggtgatcct

SEQ ID NO: 386517 - DNA, 25 bp, Rattus norvegicus
gcatactgttgcttagggtgatcct

SEQ ID NO: 386518 - DNA, 25 bp, Rattus norvegicus
gcatacttcagcagctccatgtgga

SEQ ID NO: 386519 - DNA, 25 bp, Rattus norvegicus
gcatacttcagctgctccatgtgga

SEQ ID NO: 386520 - DNA, 25 bp, Rattus norvegicus
gcatacttgacacttacgctttaac

SEQ ID NO: 386521 - DNA, 25 bp, Rattus norvegicus
gcatacttgacagttacgctttaac

SEQ ID NO: 386522 - DNA, 25 bp, Rattus norvegicus
gcatacttgtggcacacacacatat

SEQ ID NO: 386523 - DNA, 25 bp, Rattus norvegicus
gcatacttgtgggacacacacatat

SEQ ID NO: 386524 - DNA, 25 bp, Rattus norvegicus
gcatacttgttcatgtgtttctgga

SEQ ID NO: 386525 - DNA, 25 bp, Rattus norvegicus
gcatacttgttcttgtgtttctgga

SEQ ID NO: 386526 - DNA, 25 bp, Rattus norvegicus
gcatagaaaggcaggacttggccca

SEQ ID NO: 386527 - DNA, 25 bp, Rattus norvegicus
gcatagaaaggctggacttggccca

SEQ ID NO: 386528 - DNA, 25 bp, Rattus norvegicus
gcatagaagcctacgtgacactcaa

SEQ ID NO: 386529 - DNA, 25 bp, Rattus norvegicus
gcatagaagccttcgtgacactcaa

SEQ ID NO: 386530 - DNA, 25 bp, Rattus norvegicus
gcatagaagtgtaaagcctacatca

SEQ ID NO: 386531 - DNA, 25 bp, Rattus norvegicus
gcatagaagtgttaagcctacatca

SEQ ID NO: 386532 - DNA, 25 bp, Rattus norvegicus
gcatagacacacagggctgggtttt

SEQ ID NO: 386533 - DNA, 25 bp, Rattus norvegicus
gcatagacacactgggctgggtttt

SEQ ID NO: 386534 - DNA, 25 bp, Rattus norvegicus
gcatagacagagctagccacaccaa

SEQ ID NO: 386535 - DNA, 25 bp, Rattus norvegicus
gcatagacagaggtagccacaccaa

SEQ ID NO: 386536 - DNA, 25 bp, Rattus norvegicus
gcatagactagtcctacataatggt

SEQ ID NO: 386537 - DNA, 25 bp, Rattus norvegicus
gcatagactagtgctacataatggt

SEQ ID NO: 386538 - DNA, 25 bp, Rattus norvegicus
gcatagactgcaccaacggttgcgt

SEQ ID NO: 386539 - DNA, 25 bp, Rattus norvegicus
gcatagactgcagcaacggttgcgt

SEQ ID NO: 386540 - DNA, 25 bp, Rattus norvegicus
gcatagactgggacctgcttgaaaa

SEQ ID NO: 386541 - DNA, 25 bp, Rattus norvegicus
gcatagactgggtcctgcttgaaaa

SEQ ID NO: 386542 - DNA, 25 bp, Rattus norvegicus
gcatagactgttaaaattctcccga

SEQ ID NO: 386543 - DNA, 25 bp, Rattus norvegicus
gcatagactgtttaaattctcccga

SEQ ID NO: 386544 - DNA, 25 bp, Rattus norvegicus
gcatagagcctgagcttatcactaa

SEQ ID NO: 386545 - DNA, 25 bp, Rattus norvegicus
gcatagagcctgtgcttatcactaa

SEQ ID NO: 386546 - DNA, 25 bp, Rattus norvegicus
gcatagagtcctaaaagcggcacaa

SEQ ID NO: 386547 - DNA, 25 bp, Rattus norvegicus
gcatagagtccttaaagcggcacaa

SEQ ID NO: 386548 - DNA, 25 bp, Rattus norvegicus
gcatagagtctgagcctcaagtccc

SEQ ID NO: 386549 - DNA, 25 bp, Rattus norvegicus
gcatagagtctgcaggacctgcctg

SEQ ID NO: 386550 - DNA, 25 bp, Rattus norvegicus
gcatagagtctggaggacctgcctg

SEQ ID NO: 386551 - DNA, 25 bp, Rattus norvegicus
gcatagagtctgtgcctcaagtccc

SEQ ID NO: 386552 - DNA, 25 bp, Rattus norvegicus
gcatagatgttcatgtttcgctcac

SEQ ID NO: 386553 - DNA, 25 bp, Rattus norvegicus
gcatagatgttcttgtttcgctcac

SEQ ID NO: 386554 - DNA, 25 bp, Rattus norvegicus
gcatagattgctcagctttacactg

SEQ ID NO: 386555 - DNA, 25 bp, Rattus norvegicus
gcatagattgctgagctttacactg

SEQ ID NO: 386556 - DNA, 25 bp, Rattus norvegicus
gcatagcacagtacatcaaccataa

SEQ ID NO: 386557 - DNA, 25 bp, Rattus norvegicus
gcatagcacagttcatcaaccataa

SEQ ID NO: 386558 - DNA, 25 bp, Rattus norvegicus
gcatagcagagtcgccgttgctcat

SEQ ID NO: 386559 - DNA, 25 bp, Rattus norvegicus
gcatagcagagtggccgttgctcat

SEQ ID NO: 386560 - DNA, 25 bp, Rattus norvegicus
gcatagcagataatactccccagac

SEQ ID NO: 386561 - DNA, 25 bp, Rattus norvegicus
gcatagcagatattactccccagac

SEQ ID NO: 386562 - DNA, 25 bp, Rattus norvegicus
gcatagcagcctatttcagagagta

SEQ ID NO: 386563 - DNA, 25 bp, Rattus norvegicus
gcatagcagcctttttcagagagta

SEQ ID NO: 386564 - DNA, 25 bp, Rattus norvegicus
gcatagcagtcacaggctggccact

SEQ ID NO: 386565 - DNA, 25 bp, Rattus norvegicus
gcatagcagtcagaggctggccact

SEQ ID NO: 386566 - DNA, 25 bp, Rattus norvegicus
gcatagcataggaatgtcacaggac

SEQ ID NO: 386567 - DNA, 25 bp, Rattus norvegicus
gcatagcataggtatgtcacaggac

SEQ ID NO: 386568 - DNA, 25 bp, Rattus norvegicus
gcatagcatataaactgcacctgga

SEQ ID NO: 386569 - DNA, 25 bp, Rattus norvegicus
gcatagcatatatactgcacctgga

SEQ ID NO: 386570 - DNA, 25 bp, Rattus norvegicus
gcatagcatccactttatccactta

SEQ ID NO: 386571 - DNA, 25 bp, Rattus norvegicus
gcatagcatccagtttatccactta

SEQ ID NO: 386572 - DNA, 25 bp, Rattus norvegicus
gcatagccatccaaagtcttgtaga

SEQ ID NO: 386573 - DNA, 25 bp, Rattus norvegicus
gcatagccatcctaagtcttgtaga

SEQ ID NO: 386574 - DNA, 25 bp, Rattus norvegicus
gcatagcccaccaaccaagtaatat

SEQ ID NO: 386575 - DNA, 25 bp, Rattus norvegicus
gcatagcccacctaccaagtaatat

SEQ ID NO: 386576 - DNA, 25 bp, Rattus norvegicus
gcatagccctttccttcatgttaat

SEQ ID NO: 386577 - DNA, 25 bp, Rattus norvegicus
gcatagccctttgcttcatgttaat

SEQ ID NO: 386578 - DNA, 25 bp, Rattus norvegicus
gcatagcctataacttgacattctt

SEQ ID NO: 386579 - DNA, 25 bp, Rattus norvegicus
gcatagcctatatcttgacattctt

SEQ ID NO: 386580 - DNA, 25 bp, Rattus norvegicus
gcatagcctcaaacttaccacataa

SEQ ID NO: 386581 - DNA, 25 bp, Rattus norvegicus
gcatagcctcaatcttaccacataa

SEQ ID NO: 386582 - DNA, 25 bp, Rattus norvegicus
gcatagcgcgcgacggattcctgtc

SEQ ID NO: 386583 - DNA, 25 bp, Rattus norvegicus
gcatagcgcgcgtcggattcctgtc

SEQ ID NO: 386584 - DNA, 25 bp, Rattus norvegicus
gcatagcggccaacggccagcaggc

SEQ ID NO: 386585 - DNA, 25 bp, Rattus norvegicus
gcatagcggccatcggccagcaggc

SEQ ID NO: 386586 - DNA, 25 bp, Rattus norvegicus
gcatagctcagacaaatacaccttc

SEQ ID NO: 386587 - DNA, 25 bp, Rattus norvegicus
gcatagctcagagaaatacaccttc

SEQ ID NO: 386588 - DNA, 25 bp, Rattus norvegicus
gcatagctctgtaagttaggcgcca

SEQ ID NO: 386589 - DNA, 25 bp, Rattus norvegicus
gcatagctctgttagttaggcgcca

SEQ ID NO: 386590 - DNA, 25 bp, Rattus norvegicus
gcatagcttacacctggtaggacca

SEQ ID NO: 386591 - DNA, 25 bp, Rattus norvegicus
gcatagcttacagctggtaggacca

SEQ ID NO: 386592 - DNA, 25 bp, Rattus norvegicus
gcatagcttaggcaccagtaatatt

SEQ ID NO: 386593 - DNA, 25 bp, Rattus norvegicus
gcatagcttagggaccagtaatatt

SEQ ID NO: 386594 - DNA, 25 bp, Rattus norvegicus
gcatagcttcttagtaattttgtac

SEQ ID NO: 386595 - DNA, 25 bp, Rattus norvegicus
gcatagcttctttgtaattttgtac

SEQ ID NO: 386596 - DNA, 25 bp, Rattus norvegicus
gcatagcttgacctgtcacctttaa

SEQ ID NO: 386597 - DNA, 25 bp, Rattus norvegicus
gcatagcttgacgtgtcacctttaa

SEQ ID NO: 386598 - DNA, 25 bp, Rattus norvegicus
gcatagctttgcattctggataaaa

SEQ ID NO: 386599 - DNA, 25 bp, Rattus norvegicus
gcatagctttgctttctggataaaa

SEQ ID NO: 386600 - DNA, 25 bp, Rattus norvegicus
gcataggaatccacgtcttcatctt

SEQ ID NO: 386601 - DNA, 25 bp, Rattus norvegicus
gcataggaatcctcgtcttcatctt

SEQ ID NO: 386602 - DNA, 25 bp, Rattus norvegicus
gcataggagaccacaaagcctgtcc

SEQ ID NO: 386603 - DNA, 25 bp, Rattus norvegicus
gcataggagacctcaaagcctgtcc

SEQ ID NO: 386604 - DNA, 25 bp, Rattus norvegicus
gcataggatacgatgtgcacatgta

SEQ ID NO: 386605 - DNA, 25 bp, Rattus norvegicus
gcataggatacgttgtgcacatgta

SEQ ID NO: 386606 - DNA, 25 bp, Rattus norvegicus
gcataggattcaatcttagtgtata

SEQ ID NO: 386607 - DNA, 25 bp, Rattus norvegicus
gcataggattcattcttagtgtata

SEQ ID NO: 386608 - DNA, 25 bp, Rattus norvegicus
gcataggctatgacgttcggattta

SEQ ID NO: 386609 - DNA, 25 bp, Rattus norvegicus
gcataggctatgtcgttcggattta

SEQ ID NO: 386610 - DNA, 25 bp, Rattus norvegicus
gcataggctgctcatcagttacaca

SEQ ID NO: 386611 - DNA, 25 bp, Rattus norvegicus
gcataggctgctgatcagttacaca

SEQ ID NO: 386612 - DNA, 25 bp, Rattus norvegicus
gcatagggaaaccaagccacaccgc

SEQ ID NO: 386613 - DNA, 25 bp, Rattus norvegicus
gcatagggaaacgaagccacaccgc

SEQ ID NO: 386614 - DNA, 25 bp, Rattus norvegicus
gcatagggatatctgcgtattcacc

SEQ ID NO: 386615 - DNA, 25 bp, Rattus norvegicus
gcatagggatatgtgcgtattcacc

SEQ ID NO: 386616 - DNA, 25 bp, Rattus norvegicus
gcataggggtccagcccagagcgaa

SEQ ID NO: 386617 - DNA, 25 bp, Rattus norvegicus
gcataggggtcctgcccagagcgaa

SEQ ID NO: 386618 - DNA, 25 bp, Rattus norvegicus
gcatagggtcctagttcttctaaac

SEQ ID NO: 386619 - DNA, 25 bp, Rattus norvegicus
gcatagggtccttgttcttctaaac

SEQ ID NO: 386620 - DNA, 25 bp, Rattus norvegicus
gcataggtgtcactgttcacttgcc

SEQ ID NO: 386621 - DNA, 25 bp, Rattus norvegicus
gcataggtgtcagtgttcacttgcc

SEQ ID NO: 386622 - DNA, 25 bp, Rattus norvegicus
gcataggtttaaccccagggccctg

SEQ ID NO: 386623 - DNA, 25 bp, Rattus norvegicus
gcataggtttaagcccagggccctg

SEQ ID NO: 386624 - DNA, 25 bp, Rattus norvegicus
gcatagtatatcaaggagctaccca

SEQ ID NO: 386625 - DNA, 25 bp, Rattus norvegicus
gcatagtatatctaggagctaccca

SEQ ID NO: 386626 - DNA, 25 bp, Rattus norvegicus
gcatagtcccttatatctcttggaa

SEQ ID NO: 386627 - DNA, 25 bp, Rattus norvegicus
gcatagtcccttttatctcttggaa

SEQ ID NO: 386628 - DNA, 25 bp, Rattus norvegicus
gcatagtcctaaacgtgccgacgga

SEQ ID NO: 386629 - DNA, 25 bp, Rattus norvegicus
gcatagtcctaatcgtgccgacgga

SEQ ID NO: 386630 - DNA, 25 bp, Rattus norvegicus
gcatagtctacaaacaagtctctga

SEQ ID NO: 386631 - DNA, 25 bp, Rattus norvegicus
gcatagtctacatacaagtctctga

SEQ ID NO: 386632 - DNA, 25 bp, Rattus norvegicus
gcatagtctcaaagtgtctctagca

SEQ ID NO: 386633 - DNA, 25 bp, Rattus norvegicus
gcatagtctcaatgtgtctctagca

SEQ ID NO: 386634 - DNA, 25 bp, Rattus norvegicus
gcatagtctgggagctgttagcaac

SEQ ID NO: 386635 - DNA, 25 bp, Rattus norvegicus
gcatagtctgggtgctgttagcaac

SEQ ID NO: 386636 - DNA, 25 bp, Rattus norvegicus
gcatagtgccatcaatatttaccaa

SEQ ID NO: 386637 - DNA, 25 bp, Rattus norvegicus
gcatagtgccatgaatatttaccaa

SEQ ID NO: 386638 - DNA, 25 bp, Rattus norvegicus
gcatagtggtggctctttagtctga

SEQ ID NO: 386639 - DNA, 25 bp, Rattus norvegicus
gcatagtggtgggtctttagtctga

SEQ ID NO: 386640 - DNA, 25 bp, Rattus norvegicus
gcatagtggtttactgctcttaaaa

SEQ ID NO: 386641 - DNA, 25 bp, Rattus norvegicus
gcatagtggttttctgctcttaaaa

SEQ ID NO: 386642 - DNA, 25 bp, Rattus norvegicus
gcatagtgttgcatttccaagtaca

SEQ ID NO: 386643 - DNA, 25 bp, Rattus norvegicus
gcatagtgttgcttttccaagtaca

SEQ ID NO: 386644 - DNA, 25 bp, Rattus norvegicus
gcatagttcagcagggagatacgtt

SEQ ID NO: 386645 - DNA, 25 bp, Rattus norvegicus
gcatagttcagctgggagatacgtt

SEQ ID NO: 386646 - DNA, 25 bp, Rattus norvegicus
gcatagtttattcttctgcttatac

SEQ ID NO: 386647 - DNA, 25 bp, Rattus norvegicus
gcatagtttattgttctgcttatac

SEQ ID NO: 386648 - DNA, 25 bp, Rattus norvegicus
gcatagttttttccagaccttactg

SEQ ID NO: 386649 - DNA, 25 bp, Rattus norvegicus
gcatagttttttgcagaccttactg

SEQ ID NO: 386650 - DNA, 25 bp, Rattus norvegicus
gcatatacaaaccactacaatggtg

SEQ ID NO: 386651 - DNA, 25 bp, Rattus norvegicus
gcatatacaaacgactacaatggtg

SEQ ID NO: 386652 - DNA, 25 bp, Rattus norvegicus
gcatatacatgtctgccttagcaca

SEQ ID NO: 386653 - DNA, 25 bp, Rattus norvegicus
gcatatacatgtgtgccttagcaca

SEQ ID NO: 386654 - DNA, 25 bp, Rattus norvegicus
gcatataccgcactgctctgagctg

SEQ ID NO: 386655 - DNA, 25 bp, Rattus norvegicus
gcatataccgcagtgctctgagctg

SEQ ID NO: 386656 - DNA, 25 bp, Rattus norvegicus
gcatatacgtgtctttgtcggacaa

SEQ ID NO: 386657 - DNA, 25 bp, Rattus norvegicus
gcatatacgtgtgtttgtcggacaa

SEQ ID NO: 386658 - DNA, 25 bp, Rattus norvegicus
gcatatactgctatgttggcctcac

SEQ ID NO: 386659 - DNA, 25 bp, Rattus norvegicus
gcatatactgctttgttggcctcac

SEQ ID NO: 386660 - DNA, 25 bp, Rattus norvegicus
gcatatactttaatcttggctggca

SEQ ID NO: 386661 - DNA, 25 bp, Rattus norvegicus
gcatatactttattcttggctggca

SEQ ID NO: 386662 - DNA, 25 bp, Rattus norvegicus
gcatatagcgttctcatcttctgat

SEQ ID NO: 386663 - DNA, 25 bp, Rattus norvegicus
gcatatagcgttgtcatcttctgat

SEQ ID NO: 386664 - DNA, 25 bp, Rattus norvegicus
gcatatagctttatgatttctggag

SEQ ID NO: 386665 - DNA, 25 bp, Rattus norvegicus
gcatatagctttttgatttctggag

SEQ ID NO: 386666 - DNA, 25 bp, Rattus norvegicus
gcatatatactaatgtgctgccata

SEQ ID NO: 386667 - DNA, 25 bp, Rattus norvegicus
gcatatatactattgtgctgccata

SEQ ID NO: 386668 - DNA, 25 bp, Rattus norvegicus
gcatatatatccacggctgtgctgt

SEQ ID NO: 386669 - DNA, 25 bp, Rattus norvegicus
gcatatatatcctcggctgtgctgt

SEQ ID NO: 386670 - DNA, 25 bp, Rattus norvegicus
gcatatatatgcacgctaaagccaa

SEQ ID NO: 386671 - DNA, 25 bp, Rattus norvegicus
gcatatatatgctcgctaaagccaa

SEQ ID NO: 386672 - DNA, 25 bp, Rattus norvegicus
gcatatatgggtcttacattgcaaa

SEQ ID NO: 386673 - DNA, 25 bp, Rattus norvegicus
gcatatatgggtgttacattgcaaa

SEQ ID NO: 386674 - DNA, 25 bp, Rattus norvegicus
gcatatcaaaatcacccatgagggc

SEQ ID NO: 386675 - DNA, 25 bp, Rattus norvegicus
gcatatcaaaatgacccatgagggc

SEQ ID NO: 386676 - DNA, 25 bp, Rattus norvegicus
gcatatcagtgcatagcctgctagg

SEQ ID NO: 386677 - DNA, 25 bp, Rattus norvegicus
gcatatcagtgcttagcctgctagg

SEQ ID NO: 386678 - DNA, 25 bp, Rattus norvegicus
gcatatcattgaatcccagcacttg

SEQ ID NO: 386679 - DNA, 25 bp, Rattus norvegicus
gcatatcattgattcccagcacttg

SEQ ID NO: 386680 - DNA, 25 bp, Rattus norvegicus
gcatatccccaactgtgacaagcat

SEQ ID NO: 386681 - DNA, 25 bp, Rattus norvegicus
gcatatccccaagtgtgacaagcat

SEQ ID NO: 386682 - DNA, 25 bp, Rattus norvegicus
gcatatccctttcagtcttaactaa

SEQ ID NO: 386683 - DNA, 25 bp, Rattus norvegicus
gcatatccctttgagtcttaactaa

SEQ ID NO: 386684 - DNA, 25 bp, Rattus norvegicus
gcatatccgcaaagccaccaagtat

SEQ ID NO: 386685 - DNA, 25 bp, Rattus norvegicus
gcatatccgcaatgccaccaagtat

SEQ ID NO: 386686 - DNA, 25 bp, Rattus norvegicus
gcatatcctctgcactgtcggatca

SEQ ID NO: 386687 - DNA, 25 bp, Rattus norvegicus
gcatatcctctggactgtcggatca

SEQ ID NO: 386688 - DNA, 25 bp, Rattus norvegicus
gcatatccttggaagacatttctca

SEQ ID NO: 386689 - DNA, 25 bp, Rattus norvegicus
gcatatccttggtagacatttctca

SEQ ID NO: 386690 - DNA, 25 bp, Rattus norvegicus
gcatatcctttgaagccaacaactt

SEQ ID NO: 386691 - DNA, 25 bp, Rattus norvegicus
gcatatcctttgtagccaacaactt

SEQ ID NO: 386692 - DNA, 25 bp, Rattus norvegicus
gcatatcgtaggaacccaatgatgg

SEQ ID NO: 386693 - DNA, 25 bp, Rattus norvegicus
gcatatcgtaggtacccaatgatgg

SEQ ID NO: 386694 - DNA, 25 bp, Rattus norvegicus
gcatatcgtgtactctgcggatttt

SEQ ID NO: 386695 - DNA, 25 bp, Rattus norvegicus
gcatatcgtgtagtctgcggatttt

SEQ ID NO: 386696 - DNA, 25 bp, Rattus norvegicus
gcatatctggataactggtctggta

SEQ ID NO: 386697 - DNA, 25 bp, Rattus norvegicus
gcatatctggattactggtctggta

SEQ ID NO: 386698 - DNA, 25 bp, Rattus norvegicus
gcatatctggccattcattgttact

SEQ ID NO: 386699 - DNA, 25 bp, Rattus norvegicus
gcatatctggcctttcattgttact

SEQ ID NO: 386700 - DNA, 25 bp, Rattus norvegicus
gcatatctgtttagcctcagtcctg

SEQ ID NO: 386701 - DNA, 25 bp, Rattus norvegicus
gcatatctgttttgcctcagtcctg

SEQ ID NO: 386702 - DNA, 25 bp, Rattus norvegicus
gcatatcttcaacagctttgcattt

SEQ ID NO: 386703 - DNA, 25 bp, Rattus norvegicus
gcatatcttcaagagctttgcattt

SEQ ID NO: 386704 - DNA, 25 bp, Rattus norvegicus
gcatatcttggcaggcgttgtggaa

SEQ ID NO: 386705 - DNA, 25 bp, Rattus norvegicus
gcatatcttggctggcgttgtggaa

SEQ ID NO: 386706 - DNA, 25 bp, Rattus norvegicus
gcatatcttgttacttggcaatcct

SEQ ID NO: 386707 - DNA, 25 bp, Rattus norvegicus
gcatatcttgtttcttggcaatcct

SEQ ID NO: 386708 - DNA, 25 bp, Rattus norvegicus
gcatatgaagttatattcactctga

SEQ ID NO: 386709 - DNA, 25 bp, Rattus norvegicus
gcatatgaagttttattcactctga

SEQ ID NO: 386710 - DNA, 25 bp, Rattus norvegicus
gcatatgatcatagcacctacggta

SEQ ID NO: 386711 - DNA, 25 bp, Rattus norvegicus
gcatatgatcattgcacctacggta

SEQ ID NO: 386712 - DNA, 25 bp, Rattus norvegicus
gcatatgattccataagggccacct

SEQ ID NO: 386713 - DNA, 25 bp, Rattus norvegicus
gcatatgattccttaagggccacct

SEQ ID NO: 386714 - DNA, 25 bp, Rattus norvegicus
gcatatgcaataattacgtccttaa

SEQ ID NO: 386715 - DNA, 25 bp, Rattus norvegicus
gcatatgcaatatttacgtccttaa

SEQ ID NO: 386716 - DNA, 25 bp, Rattus norvegicus
gcatatgcacagctggccttgggca

SEQ ID NO: 386717 - DNA, 25 bp, Rattus norvegicus
gcatatgcacaggtggccttgggca

SEQ ID NO: 386718 - DNA, 25 bp, Rattus norvegicus
gcatatgcacttcgaattaaatctc

SEQ ID NO: 386719 - DNA, 25 bp, Rattus norvegicus
gcatatgcacttggaattaaatctc

SEQ ID NO: 386720 - DNA, 25 bp, Rattus norvegicus
gcatatgcagccacgtgcaagttta

SEQ ID NO: 386721 - DNA, 25 bp, Rattus norvegicus
gcatatgcagcccgtgctaacatga

SEQ ID NO: 386722 - DNA, 25 bp, Rattus norvegicus
gcatatgcagccggtgctaacatga

SEQ ID NO: 386723 - DNA, 25 bp, Rattus norvegicus
gcatatgcagcctcgtgcaagttta

SEQ ID NO: 386724 - DNA, 25 bp, Rattus norvegicus
gcatatgcagtgaatatcccctgtc

SEQ ID NO: 386725 - DNA, 25 bp, Rattus norvegicus
gcatatgcagtgtatatcccctgtc

SEQ ID NO: 386726 - DNA, 25 bp, Rattus norvegicus
gcatatgcctacagtattcgagggt

SEQ ID NO: 386727 - DNA, 25 bp, Rattus norvegicus
gcatatgcctactgtattcgagggt

SEQ ID NO: 386728 - DNA, 25 bp, Rattus norvegicus
gcatatgctcttagacatttttctt

SEQ ID NO: 386729 - DNA, 25 bp, Rattus norvegicus
gcatatgctctttgacatttttctt

SEQ ID NO: 386730 - DNA, 25 bp, Rattus norvegicus
gcatatgctgacaacatcggcttta

SEQ ID NO: 386731 - DNA, 25 bp, Rattus norvegicus
gcatatgctgactacatcggcttta

SEQ ID NO: 386732 - DNA, 25 bp, Rattus norvegicus
gcatatgctgttcacgatgactgga

SEQ ID NO: 386733 - DNA, 25 bp, Rattus norvegicus
gcatatgctgttgacgatgactgga

SEQ ID NO: 386734 - DNA, 25 bp, Rattus norvegicus
gcatatggaattcagctcttggctt

SEQ ID NO: 386735 - DNA, 25 bp, Rattus norvegicus
gcatatggaattgagctcttggctt

SEQ ID NO: 386736 - DNA, 25 bp, Rattus norvegicus
gcatatggatctctggacctactaa

SEQ ID NO: 386737 - DNA, 25 bp, Rattus norvegicus
gcatatggatctgtggacctactaa

SEQ ID NO: 386738 - DNA, 25 bp, Rattus norvegicus
gcatatgggacaaagacctcctgtc

SEQ ID NO: 386739 - DNA, 25 bp, Rattus norvegicus
gcatatgggacatagacctcctgtc

SEQ ID NO: 386740 - DNA, 25 bp, Rattus norvegicus
gcatatgggcaaactggatccggaa

SEQ ID NO: 386741 - DNA, 25 bp, Rattus norvegicus
gcatatgggcaatctggatccggaa

SEQ ID NO: 386742 - DNA, 25 bp, Rattus norvegicus
gcatatgtgcggacatcaacaacat

SEQ ID NO: 386743 - DNA, 25 bp, Rattus norvegicus
gcatatgtgcggtcatcaacaacat

SEQ ID NO: 386744 - DNA, 25 bp, Rattus norvegicus
gcatatgtggaccttgatagccgaa

SEQ ID NO: 386745 - DNA, 25 bp, Rattus norvegicus
gcatatgtggacgttgatagccgaa

SEQ ID NO: 386746 - DNA, 25 bp, Rattus norvegicus
gcatatgtgggaagaaatcctgtcc

SEQ ID NO: 386747 - DNA, 25 bp, Rattus norvegicus
gcatatgtgggatgaaatcctgtcc

SEQ ID NO: 386748 - DNA, 25 bp, Rattus norvegicus
gcatatgttcttatacacaccactg

SEQ ID NO: 386749 - DNA, 25 bp, Rattus norvegicus
gcatatgttcttttacacaccactg

SEQ ID NO: 386750 - DNA, 25 bp, Rattus norvegicus
gcatatgttgcgacccacagaatag

SEQ ID NO: 386751 - DNA, 25 bp, Rattus norvegicus
gcatatgttgcgtcccacagaatag

SEQ ID NO: 386752 - DNA, 25 bp, Rattus norvegicus
gcatatgtttctcccaatgtaccaa

SEQ ID NO: 386753 - DNA, 25 bp, Rattus norvegicus
gcatatgtttctgccaatgtaccaa

SEQ ID NO: 386754 - DNA, 25 bp, Rattus norvegicus
gcatattagtaaaggtcgtccttgt

SEQ ID NO: 386755 - DNA, 25 bp, Rattus norvegicus
gcatattagtaatggtcgtccttgt

SEQ ID NO: 386756 - DNA, 25 bp, Rattus norvegicus
gcatattatgtgaagcaggtacccc

SEQ ID NO: 386757 - DNA, 25 bp, Rattus norvegicus
gcatattatgtgtagcaggtacccc

SEQ ID NO: 386758 - DNA, 25 bp, Rattus norvegicus
gcatattattttagcctcatcaggg

SEQ ID NO: 386759 - DNA, 25 bp, Rattus norvegicus
gcatattatttttgcctcatcaggg

SEQ ID NO: 386760 - DNA, 25 bp, Rattus norvegicus
gcatattcagtacagatgtttccag

SEQ ID NO: 386761 - DNA, 25 bp, Rattus norvegicus
gcatattcagtagagatgtttccag

SEQ ID NO: 386762 - DNA, 25 bp, Rattus norvegicus
gcatattcataacccatttttcgtc

SEQ ID NO: 386763 - DNA, 25 bp, Rattus norvegicus
gcatattcataagccatttttcgtc

SEQ ID NO: 386764 - DNA, 25 bp, Rattus norvegicus
gcatattcctcaactgaagcacaag

SEQ ID NO: 386765 - DNA, 25 bp, Rattus norvegicus
gcatattcctcatctgaagcacaag

SEQ ID NO: 386766 - DNA, 25 bp, Rattus norvegicus
gcatattcttcaagtcactttctgt

SEQ ID NO: 386767 - DNA, 25 bp, Rattus norvegicus
gcatattcttcatgtcactttctgt

SEQ ID NO: 386768 - DNA, 25 bp, Rattus norvegicus
gcatattgctgtcaagtggactgtt

SEQ ID NO: 386769 - DNA, 25 bp, Rattus norvegicus
gcatattgctgtgaagtggactgtt

SEQ ID NO: 386770 - DNA, 25 bp, Rattus norvegicus
gcatattgtcaaaccttgtctggaa

SEQ ID NO: 386771 - DNA, 25 bp, Rattus norvegicus
gcatattgtcaatccttgtctggaa

SEQ ID NO: 386772 - DNA, 25 bp, Rattus norvegicus
gcatattgtgtcactgaactgttta

SEQ ID NO: 386773 - DNA, 25 bp, Rattus norvegicus
gcatattgtgtctctgaactgttta

SEQ ID NO: 386774 - DNA, 25 bp, Rattus norvegicus
gcatatttaacaagaccagttttta

SEQ ID NO: 386775 - DNA, 25 bp, Rattus norvegicus
gcatatttaacactggcccattcta

SEQ ID NO: 386776 - DNA, 25 bp, Rattus norvegicus
gcatatttaacagtggcccattcta

SEQ ID NO: 386777 - DNA, 25 bp, Rattus norvegicus
gcatatttaacatgaccagttttta

SEQ ID NO: 386778 - DNA, 25 bp, Rattus norvegicus
gcatatttacatacaggctttcagc

SEQ ID NO: 386779 - DNA, 25 bp, Rattus norvegicus
gcatatttacattcaggctttcagc

SEQ ID NO: 386780 - DNA, 25 bp, Rattus norvegicus
gcatatttacccagttaagcagtta

SEQ ID NO: 386781 - DNA, 25 bp, Rattus norvegicus
gcatatttaccctgttaagcagtta

SEQ ID NO: 386782 - DNA, 25 bp, Rattus norvegicus
gcatatttattgctttcctcaggaa

SEQ ID NO: 386783 - DNA, 25 bp, Rattus norvegicus
gcatatttattggtttcctcaggaa

SEQ ID NO: 386784 - DNA, 25 bp, Rattus norvegicus
gcatatttcaggagtggtcggcgac

SEQ ID NO: 386785 - DNA, 25 bp, Rattus norvegicus
gcatatttcaggtgtggtcggcgac

SEQ ID NO: 386786 - DNA, 25 bp, Rattus norvegicus
gcatatttcctccagtttgttttat

SEQ ID NO: 386787 - DNA, 25 bp, Rattus norvegicus
gcatatttcctcgagtttgttttat

SEQ ID NO: 386788 - DNA, 25 bp, Rattus norvegicus
gcatatttgactagtcctagctgta

SEQ ID NO: 386789 - DNA, 25 bp, Rattus norvegicus
gcatatttgacttgtcctagctgta

SEQ ID NO: 386790 - DNA, 25 bp, Rattus norvegicus
gcatatttggtcctgaaaagggtgt

SEQ ID NO: 386791 - DNA, 25 bp, Rattus norvegicus
gcatatttggtcgtgaaaagggtgt

SEQ ID NO: 386792 - DNA, 25 bp, Rattus norvegicus
gcatatttgtacatttcagtggaac

SEQ ID NO: 386793 - DNA, 25 bp, Rattus norvegicus
gcatatttgtacttttcagtggaac

SEQ ID NO: 386794 - DNA, 25 bp, Rattus norvegicus
gcatattttgcgagttagcccttta

SEQ ID NO: 386795 - DNA, 25 bp, Rattus norvegicus
gcatattttgcgtgttagcccttta

SEQ ID NO: 386796 - DNA, 25 bp, Rattus norvegicus
gcatattttgtgatgtgttgttcta

SEQ ID NO: 386797 - DNA, 25 bp, Rattus norvegicus
gcatattttgtgttgtgttgttcta

SEQ ID NO: 386798 - DNA, 25 bp, Rattus norvegicus
gcatcaaaattactacagccaggag

SEQ ID NO: 386799 - DNA, 25 bp, Rattus norvegicus
gcatcaaaattagtacagccaggag

SEQ ID NO: 386800 - DNA, 25 bp, Rattus norvegicus
gcatcaaccccgaggtgtgtttcct

SEQ ID NO: 386801 - DNA, 25 bp, Rattus norvegicus
gcatcaaccccgtggtgtgtttcct

SEQ ID NO: 386802 - DNA, 25 bp, Rattus norvegicus
gcatcaaccctcacagaatagcttg

SEQ ID NO: 386803 - DNA, 25 bp, Rattus norvegicus
gcatcaaccctctcagaatagcttg

SEQ ID NO: 386804 - DNA, 25 bp, Rattus norvegicus
gcatcaacctgcaggagcgcgtggt

SEQ ID NO: 386805 - DNA, 25 bp, Rattus norvegicus
gcatcaacctgctggagcgcgtggt

SEQ ID NO: 386806 - DNA, 25 bp, Rattus norvegicus
gcatcaactcatcgtcttgttttta

SEQ ID NO: 386807 - DNA, 25 bp, Rattus norvegicus
gcatcaactcatggtcttgttttta

SEQ ID NO: 386808 - DNA, 25 bp, Rattus norvegicus
gcatcaactgcacctgttgtaccac

SEQ ID NO: 386809 - DNA, 25 bp, Rattus norvegicus
gcatcaactgcagctgttgtaccac

SEQ ID NO: 386810 - DNA, 25 bp, Rattus norvegicus
gcatcaactgggaagacaaatctta

SEQ ID NO: 386811 - DNA, 25 bp, Rattus norvegicus
gcatcaactgggtagacaaatctta

SEQ ID NO: 386812 - DNA, 25 bp, Rattus norvegicus
gcatcaagaaaactgcggcctataa

SEQ ID NO: 386813 - DNA, 25 bp, Rattus norvegicus
gcatcaagaaaagtgcggcctataa

SEQ ID NO: 386814 - DNA, 25 bp, Rattus norvegicus
gcatcaagaatgagctgacagtcca

SEQ ID NO: 386815 - DNA, 25 bp, Rattus norvegicus
gcatcaagaatgtgctgacagtcca

SEQ ID NO: 386816 - DNA, 25 bp, Rattus norvegicus
gcatcaagacacacaaccaggacga

SEQ ID NO: 386817 - DNA, 25 bp, Rattus norvegicus
gcatcaagacactcaaccaggacga

SEQ ID NO: 386818 - DNA, 25 bp, Rattus norvegicus
gcatcaagtgaaaaacatttaaccc

SEQ ID NO: 386819 - DNA, 25 bp, Rattus norvegicus
gcatcaagtgaataacatttaaccc

SEQ ID NO: 386820 - DNA, 25 bp, Rattus norvegicus
gcatcaagtgccacatcaacgtgta

SEQ ID NO: 386821 - DNA, 25 bp, Rattus norvegicus
gcatcaagtgcctcatcaacgtgta

SEQ ID NO: 386822 - DNA, 25 bp, Rattus norvegicus
gcatcaagtgctctgtcccagtgaa

SEQ ID NO: 386823 - DNA, 25 bp, Rattus norvegicus
gcatcaagtgctgtgtcccagtgaa

SEQ ID NO: 386824 - DNA, 25 bp, Rattus norvegicus
gcatcaatcgcaaactggctttgaa

SEQ ID NO: 386825 - DNA, 25 bp, Rattus norvegicus
gcatcaatcgcatactggctttgaa

SEQ ID NO: 386826 - DNA, 25 bp, Rattus norvegicus
gcatcaatgccaccttctgagagtt

SEQ ID NO: 386827 - DNA, 25 bp, Rattus norvegicus
gcatcaatgccagcttctgagagtt

SEQ ID NO: 386828 - DNA, 25 bp, Rattus norvegicus
gcatcaatgggcaccaggccaagtt

SEQ ID NO: 386829 - DNA, 25 bp, Rattus norvegicus
gcatcaatgggctccaggccaagtt

SEQ ID NO: 386830 - DNA, 25 bp, Rattus norvegicus
gcatcaatttctctatttgtgtgaa

SEQ ID NO: 386831 - DNA, 25 bp, Rattus norvegicus
gcatcaatttctgtatttgtgtgaa

SEQ ID NO: 386832 - DNA, 25 bp, Rattus norvegicus
gcatcacacaaaagccagaggctgg

SEQ ID NO: 386833 - DNA, 25 bp, Rattus norvegicus
gcatcacacaaatgccagaggctgg

SEQ ID NO: 386834 - DNA, 25 bp, Rattus norvegicus
gcatcacacctgacggattggaatt

SEQ ID NO: 386835 - DNA, 25 bp, Rattus norvegicus
gcatcacacctgtcggattggaatt

SEQ ID NO: 386836 - DNA, 25 bp, Rattus norvegicus
gcatcacaggacatagtagctgaga

SEQ ID NO: 386837 - DNA, 25 bp, Rattus norvegicus
gcatcacaggacttagtagctgaga

SEQ ID NO: 386838 - DNA, 25 bp, Rattus norvegicus
gcatcacagtctctctgcaaatgac

SEQ ID NO: 386839 - DNA, 25 bp, Rattus norvegicus
gcatcacagtctgtctgcaaatgac

SEQ ID NO: 386840 - DNA, 25 bp, Rattus norvegicus
gcatcacatcgaaaacagcacttat

SEQ ID NO: 386841 - DNA, 25 bp, Rattus norvegicus
gcatcacatcgataacagcacttat

SEQ ID NO: 386842 - DNA, 25 bp, Rattus norvegicus
gcatcaccactcagtgcgcgggcgg

SEQ ID NO: 386843 - DNA, 25 bp, Rattus norvegicus
gcatcaccactctgtgcgcgggcgg

SEQ ID NO: 386844 - DNA, 25 bp, Rattus norvegicus
gcatcaccagctatctgagggacga

SEQ ID NO: 386845 - DNA, 25 bp, Rattus norvegicus
gcatcaccagctttctgagggacga

SEQ ID NO: 386846 - DNA, 25 bp, Rattus norvegicus
gcatcacccactcgatatgcgtgga

SEQ ID NO: 386847 - DNA, 25 bp, Rattus norvegicus
gcatcacccactggatatgcgtgga

SEQ ID NO: 386848 - DNA, 25 bp, Rattus norvegicus
gcatcacccaggagcttcagcagag

SEQ ID NO: 386849 - DNA, 25 bp, Rattus norvegicus
gcatcacccaggtgcttcagcagag

SEQ ID NO: 386850 - DNA, 25 bp, Rattus norvegicus
gcatcacgcccgaggaggccaagta

SEQ ID NO: 386851 - DNA, 25 bp, Rattus norvegicus
gcatcacgcccgtggaggccaagta

SEQ ID NO: 386852 - DNA, 25 bp, Rattus norvegicus
gcatcacgctgactttacactggag

SEQ ID NO: 386853 - DNA, 25 bp, Rattus norvegicus
gcatcacgctgagtttacactggag

SEQ ID NO: 386854 - DNA, 25 bp, Rattus norvegicus
gcatcacggcctctgtcggagcaga

SEQ ID NO: 386855 - DNA, 25 bp, Rattus norvegicus
gcatcacggcctgtgtcggagcaga

SEQ ID NO: 386856 - DNA, 25 bp, Rattus norvegicus
gcatcacgggagcatctagccttgt

SEQ ID NO: 386857 - DNA, 25 bp, Rattus norvegicus
gcatcacgggaggatctagccttgt

SEQ ID NO: 386858 - DNA, 25 bp, Rattus norvegicus
gcatcacgggtcatcttggagtcag

SEQ ID NO: 386859 - DNA, 25 bp, Rattus norvegicus
gcatcacgggtcttcttggagtcag

SEQ ID NO: 386860 - DNA, 25 bp, Rattus norvegicus
gcatcactagccatggactggtcta

SEQ ID NO: 386861 - DNA, 25 bp, Rattus norvegicus
gcatcactagccttggactggtcta

SEQ ID NO: 386862 - DNA, 25 bp, Rattus norvegicus
gcatcactcagcaggacactccagg

SEQ ID NO: 386863 - DNA, 25 bp, Rattus norvegicus
gcatcactcagctggacactccagg

SEQ ID NO: 386864 - DNA, 25 bp, Rattus norvegicus
gcatcactccagagctgctcacgag

SEQ ID NO: 386865 - DNA, 25 bp, Rattus norvegicus
gcatcactccagtgctgctcacgag

SEQ ID NO: 386866 - DNA, 25 bp, Rattus norvegicus
gcatcactctgtcagtctacagttt

SEQ ID NO: 386867 - DNA, 25 bp, Rattus norvegicus
gcatcactctgtgagtctacagttt

SEQ ID NO: 386868 - DNA, 25 bp, Rattus norvegicus
gcatcactgtgacttgcttgctctg

SEQ ID NO: 386869 - DNA, 25 bp, Rattus norvegicus
gcatcactgtgagttgcttgctctg

SEQ ID NO: 386870 - DNA, 25 bp, Rattus norvegicus
gcatcactgttacaggagggtccca

SEQ ID NO: 386871 - DNA, 25 bp, Rattus norvegicus
gcatcactgttagaggagggtccca

SEQ ID NO: 386872 - DNA, 25 bp, Rattus norvegicus
gcatcacttacaacagtctgactga

SEQ ID NO: 386873 - DNA, 25 bp, Rattus norvegicus
gcatcacttacatcagtctgactga

SEQ ID NO: 386874 - DNA, 25 bp, Rattus norvegicus
gcatcacttatgctgctgatatcca

SEQ ID NO: 386875 - DNA, 25 bp, Rattus norvegicus
gcatcacttatggtgctgatatcca

SEQ ID NO: 386876 - DNA, 25 bp, Rattus norvegicus
gcatcacttcacactggtttgtgta

SEQ ID NO: 386877 - DNA, 25 bp, Rattus norvegicus
gcatcacttcactctggtttgtgta

SEQ ID NO: 386878 - DNA, 25 bp, Rattus norvegicus
gcatcacttgtgacatccgagcaaa

SEQ ID NO: 386879 - DNA, 25 bp, Rattus norvegicus
gcatcacttgtgtcatccgagcaaa

SEQ ID NO: 386880 - DNA, 25 bp, Rattus norvegicus
gcatcactttcgatgtattacacat

SEQ ID NO: 386881 - DNA, 25 bp, Rattus norvegicus
gcatcactttcgttgtattacacat

SEQ ID NO: 386882 - DNA, 25 bp, Rattus norvegicus
gcatcagaaaccatctgccagtgag

SEQ ID NO: 386883 - DNA, 25 bp, Rattus norvegicus
gcatcagaaaccttctgccagtgag

SEQ ID NO: 386884 - DNA, 25 bp, Rattus norvegicus
gcatcagaagccacaggtttcctgt

SEQ ID NO: 386885 - DNA, 25 bp, Rattus norvegicus
gcatcagaagcctcaggtttcctgt

SEQ ID NO: 386886 - DNA, 25 bp, Rattus norvegicus
gcatcagaagtgaacctgcccacag

SEQ ID NO: 386887 - DNA, 25 bp, Rattus norvegicus
gcatcagaagtgtacctgcccacag

SEQ ID NO: 386888 - DNA, 25 bp, Rattus norvegicus
gcatcagaatgaaccaccaagcttt

SEQ ID NO: 386889 - DNA, 25 bp, Rattus norvegicus
gcatcagaatgatccaccaagcttt

SEQ ID NO: 386890 - DNA, 25 bp, Rattus norvegicus
gcatcagaatgtcaaggttaccctt

SEQ ID NO: 386891 - DNA, 25 bp, Rattus norvegicus
gcatcagaatgtgaaggttaccctt

SEQ ID NO: 386892 - DNA, 25 bp, Rattus norvegicus
gcatcagacctaagagggacagttt

SEQ ID NO: 386893 - DNA, 25 bp, Rattus norvegicus
gcatcagacctatgagggacagttt

SEQ ID NO: 386894 - DNA, 25 bp, Rattus norvegicus
gcatcagagactaactttccctgta

SEQ ID NO: 386895 - DNA, 25 bp, Rattus norvegicus
gcatcagagacttactttccctgta

SEQ ID NO: 386896 - DNA, 25 bp, Rattus norvegicus
gcatcagagccaacacagggtgtga

SEQ ID NO: 386897 - DNA, 25 bp, Rattus norvegicus
gcatcagagccatcacagggtgtga

SEQ ID NO: 386898 - DNA, 25 bp, Rattus norvegicus
gcatcagagcgcagtgacctgctta

SEQ ID NO: 386899 - DNA, 25 bp, Rattus norvegicus
gcatcagagcgctgtgacctgctta

SEQ ID NO: 386900 - DNA, 25 bp, Rattus norvegicus
gcatcagatctacagctgcagtgat

SEQ ID NO: 386901 - DNA, 25 bp, Rattus norvegicus
gcatcagatctagagctgcagtgat

SEQ ID NO: 386902 - DNA, 25 bp, Rattus norvegicus
gcatcagatctgcaacgggagctac

SEQ ID NO: 386903 - DNA, 25 bp, Rattus norvegicus
gcatcagatctggaacgggagctac

SEQ ID NO: 386904 - DNA, 25 bp, Rattus norvegicus
gcatcagatggcaactcctacgaga

SEQ ID NO: 386905 - DNA, 25 bp, Rattus norvegicus
gcatcagatggctactcctacgaga

SEQ ID NO: 386906 - DNA, 25 bp, Rattus norvegicus
gcatcagattctagcctagcaccaa

SEQ ID NO: 386907 - DNA, 25 bp, Rattus norvegicus
gcatcagattcttgcctagcaccaa

SEQ ID NO: 386908 - DNA, 25 bp, Rattus norvegicus
gcatcagcaatcatactttttagga

SEQ ID NO: 386909 - DNA, 25 bp, Rattus norvegicus
gcatcagcaatcttactttttagga

SEQ ID NO: 386910 - DNA, 25 bp, Rattus norvegicus
gcatcagcacaaagccctactgcag

SEQ ID NO: 386911 - DNA, 25 bp, Rattus norvegicus
gcatcagcacaatgccctactgcag

SEQ ID NO: 386912 - DNA, 25 bp, Rattus norvegicus
gcatcagcaccacctggaagcatat

SEQ ID NO: 386913 - DNA, 25 bp, Rattus norvegicus
gcatcagcaccagctggaagcatat

SEQ ID NO: 386914 - DNA, 25 bp, Rattus norvegicus
gcatcagcagccattcgggaagaaa

SEQ ID NO: 386915 - DNA, 25 bp, Rattus norvegicus
gcatcagcagcctttcgggaagaaa

SEQ ID NO: 386916 - DNA, 25 bp, Rattus norvegicus
gcatcagcaggtcgtgagccgcatc

SEQ ID NO: 386917 - DNA, 25 bp, Rattus norvegicus
gcatcagcaggtggtgagccgcatc

SEQ ID NO: 386918 - DNA, 25 bp, Rattus norvegicus
gcatcagccctcataggccgggttt

SEQ ID NO: 386919 - DNA, 25 bp, Rattus norvegicus
gcatcagccctcttaggccgggttt

SEQ ID NO: 386920 - DNA, 25 bp, Rattus norvegicus
gcatcagcctgactggaggagccta

SEQ ID NO: 386921 - DNA, 25 bp, Rattus norvegicus
gcatcagcctgagtggaggagccta

SEQ ID NO: 386922 - DNA, 25 bp, Rattus norvegicus
gcatcagcgaacaatctacgtggaa

SEQ ID NO: 386923 - DNA, 25 bp, Rattus norvegicus
gcatcagcgaactatctacgtggaa

SEQ ID NO: 386924 - DNA, 25 bp, Rattus norvegicus
gcatcagcgatcactacaaggacct

SEQ ID NO: 386925 - DNA, 25 bp, Rattus norvegicus
gcatcagcgatctctacaaggacct

SEQ ID NO: 386926 - DNA, 25 bp, Rattus norvegicus
gcatcagcgctacctgctatagcag

SEQ ID NO: 386927 - DNA, 25 bp, Rattus norvegicus
gcatcagcgctagctgctatagcag

SEQ ID NO: 386928 - DNA, 25 bp, Rattus norvegicus
gcatcagctaagagggctccagcag

SEQ ID NO: 386929 - DNA, 25 bp, Rattus norvegicus
gcatcagctaagtgggctccagcag

SEQ ID NO: 386930 - DNA, 25 bp, Rattus norvegicus
gcatcagctccacaaagactttttc

SEQ ID NO: 386931 - DNA, 25 bp, Rattus norvegicus
gcatcagctccagaaagactttttc

SEQ ID NO: 386932 - DNA, 25 bp, Rattus norvegicus
gcatcagctgtccatcttccagagg

SEQ ID NO: 386933 - DNA, 25 bp, Rattus norvegicus
gcatcagctgtcgatcttccagagg

SEQ ID NO: 386934 - DNA, 25 bp, Rattus norvegicus
gcatcagctgttataatgcagagtt

SEQ ID NO: 386935 - DNA, 25 bp, Rattus norvegicus
gcatcagctgttattagtttgggac

SEQ ID NO: 386936 - DNA, 25 bp, Rattus norvegicus
gcatcagctgttttaatgcagagtt

SEQ ID NO: 386937 - DNA, 25 bp, Rattus norvegicus
gcatcagctgtttttagtttgggac

SEQ ID NO: 386938 - DNA, 25 bp, Rattus norvegicus
gcatcagcttttcccctttgagaag

SEQ ID NO: 386939 - DNA, 25 bp, Rattus norvegicus
gcatcagcttttgccctttgagaag

SEQ ID NO: 386940 - DNA, 25 bp, Rattus norvegicus
gcatcaggcatgaggtttctaaata

SEQ ID NO: 386941 - DNA, 25 bp, Rattus norvegicus
gcatcaggcatgtggtttctaaata

SEQ ID NO: 386942 - DNA, 25 bp, Rattus norvegicus
gcatcaggcctgagtagcagctcct

SEQ ID NO: 386943 - DNA, 25 bp, Rattus norvegicus
gcatcaggcctgtgtagcagctcct

SEQ ID NO: 386944 - DNA, 25 bp, Rattus norvegicus
gcatcagggatccagtgcaaaggaa

SEQ ID NO: 386945 - DNA, 25 bp, Rattus norvegicus
gcatcagggatcgagtgcaaaggaa

SEQ ID NO: 386946 - DNA, 25 bp, Rattus norvegicus
gcatcagggtcacagtcgaacagtt

SEQ ID NO: 386947 - DNA, 25 bp, Rattus norvegicus
gcatcagggtcagagtcgaacagtt

SEQ ID NO: 386948 - DNA, 25 bp, Rattus norvegicus
gcatcagtatttacacgtggttcca

SEQ ID NO: 386949 - DNA, 25 bp, Rattus norvegicus
gcatcagtattttcacgtggttcca

SEQ ID NO: 386950 - DNA, 25 bp, Rattus norvegicus
gcatcagtcacacactatgatcagg

SEQ ID NO: 386951 - DNA, 25 bp, Rattus norvegicus
gcatcagtcacagactatgatcagg

SEQ ID NO: 386952 - DNA, 25 bp, Rattus norvegicus
gcatcagtcatgaacagagttcaag

SEQ ID NO: 386953 - DNA, 25 bp, Rattus norvegicus
gcatcagtcatgtacagagttcaag

SEQ ID NO: 386954 - DNA, 25 bp, Rattus norvegicus
gcatcagtgcagaacttgactagaa

SEQ ID NO: 386955 - DNA, 25 bp, Rattus norvegicus
gcatcagtgcagtacttgactagaa

SEQ ID NO: 386956 - DNA, 25 bp, Rattus norvegicus
gcatcagtgcctctcatggcgtcgc

SEQ ID NO: 386957 - DNA, 25 bp, Rattus norvegicus
gcatcagtgcctgtcatggcgtcgc

SEQ ID NO: 386958 - DNA, 25 bp, Rattus norvegicus
gcatcagtggaacacaccttaggtc

SEQ ID NO: 386959 - DNA, 25 bp, Rattus norvegicus
gcatcagtggaagacaccttaggtc

SEQ ID NO: 386960 - DNA, 25 bp, Rattus norvegicus
gcatcagtggacatatcttgccaat

SEQ ID NO: 386961 - DNA, 25 bp, Rattus norvegicus
gcatcagtggacttatcttgccaat

SEQ ID NO: 386962 - DNA, 25 bp, Rattus norvegicus
gcatcagtgtttacctgcaagggtt

SEQ ID NO: 386963 - DNA, 25 bp, Rattus norvegicus
gcatcagtgttttcctgcaagggtt

SEQ ID NO: 386964 - DNA, 25 bp, Rattus norvegicus
gcatcagttcggctactccccaggg

SEQ ID NO: 386965 - DNA, 25 bp, Rattus norvegicus
gcatcagttcgggtactccccaggg

SEQ ID NO: 386966 - DNA, 25 bp, Rattus norvegicus
gcatcagttctgcagtagtctttga

SEQ ID NO: 386967 - DNA, 25 bp, Rattus norvegicus
gcatcagttctggagtagtctttga

SEQ ID NO: 386968 - DNA, 25 bp, Rattus norvegicus
gcatcagtttgaactttcgaaggga

SEQ ID NO: 386969 - DNA, 25 bp, Rattus norvegicus
gcatcagtttgatctttcgaaggga

SEQ ID NO: 386970 - DNA, 25 bp, Rattus norvegicus
gcatcataaattacacaaacctgtt

SEQ ID NO: 386971 - DNA, 25 bp, Rattus norvegicus
gcatcataaattctgctgcagctga

SEQ ID NO: 386972 - DNA, 25 bp, Rattus norvegicus
gcatcataaattgtgctgcagctga

SEQ ID NO: 386973 - DNA, 25 bp, Rattus norvegicus
gcatcataaatttcacaaacctgtt

SEQ ID NO: 386974 - DNA, 25 bp, Rattus norvegicus
gcatcatattgcaccagggacagtc

SEQ ID NO: 386975 - DNA, 25 bp, Rattus norvegicus
gcatcatattgctccagggacagtc

SEQ ID NO: 386976 - DNA, 25 bp, Rattus norvegicus
gcatcatcaccacgtctttcagatg

SEQ ID NO: 386977 - DNA, 25 bp, Rattus norvegicus
gcatcatcaccaggtctttcagatg

SEQ ID NO: 386978 - DNA, 25 bp, Rattus norvegicus
gcatcatcaccgacttgctctgaga

SEQ ID NO: 386979 - DNA, 25 bp, Rattus norvegicus
gcatcatcaccgtcttgctctgaga

SEQ ID NO: 386980 - DNA, 25 bp, Rattus norvegicus
gcatcatcagcaacggaggcgccaa

SEQ ID NO: 386981 - DNA, 25 bp, Rattus norvegicus
gcatcatcagcatcggaggcgccaa

SEQ ID NO: 386982 - DNA, 25 bp, Rattus norvegicus
gcatcatcatctaagccatttttta

SEQ ID NO: 386983 - DNA, 25 bp, Rattus norvegicus
gcatcatcatctacagagctgccta

SEQ ID NO: 386984 - DNA, 25 bp, Rattus norvegicus
gcatcatcatcttagccatttttta

SEQ ID NO: 386985 - DNA, 25 bp, Rattus norvegicus
gcatcatcatcttcagagctgccta

SEQ ID NO: 386986 - DNA, 25 bp, Rattus norvegicus
gcatcatcgtctattggttcgtgaa

SEQ ID NO: 386987 - DNA, 25 bp, Rattus norvegicus
gcatcatcgtcttttggttcgtgaa

SEQ ID NO: 386988 - DNA, 25 bp, Rattus norvegicus
gcatcatctaccacagatactctga

SEQ ID NO: 386989 - DNA, 25 bp, Rattus norvegicus
gcatcatctacctcagatactctga

SEQ ID NO: 386990 - DNA, 25 bp, Rattus norvegicus
gcatcatctgacatcttgtgggcac

SEQ ID NO: 386991 - DNA, 25 bp, Rattus norvegicus
gcatcatctgacttcttgtgggcac

SEQ ID NO: 386992 - DNA, 25 bp, Rattus norvegicus
gcatcatctgttagcctgaaagtca

SEQ ID NO: 386993 - DNA, 25 bp, Rattus norvegicus
gcatcatctgttcctaatctagtta

SEQ ID NO: 386994 - DNA, 25 bp, Rattus norvegicus
gcatcatctgttgctaatctagtta

SEQ ID NO: 386995 - DNA, 25 bp, Rattus norvegicus
gcatcatctgtttgcctgaaagtca

SEQ ID NO: 386996 - DNA, 25 bp, Rattus norvegicus
gcatcatgaccacagcaagggccct

SEQ ID NO: 386997 - DNA, 25 bp, Rattus norvegicus
gcatcatgaccagagcaagggccct

SEQ ID NO: 386998 - DNA, 25 bp, Rattus norvegicus
gcatcatgagtgactgttctgtcct

SEQ ID NO: 386999 - DNA, 25 bp, Rattus norvegicus
gcatcatgagtgtctgttctgtcct

SEQ ID NO: 387000 - DNA, 25 bp, Rattus norvegicus
gcatcatgcatgactcaggtgccct

SEQ ID NO: 387001 - DNA, 25 bp, Rattus norvegicus
gcatcatgcatgtctcaggtgccct

SEQ ID NO: 387002 - DNA, 25 bp, Rattus norvegicus
gcatcatggaccagaagctcctgaa

SEQ ID NO: 387003 - DNA, 25 bp, Rattus norvegicus
gcatcatggacctgaagctcctgaa

SEQ ID NO: 387004 - DNA, 25 bp, Rattus norvegicus
gcatcatggagtcaatggatctgtt

SEQ ID NO: 387005 - DNA, 25 bp, Rattus norvegicus
gcatcatggagtgaatggatctgtt

SEQ ID NO: 387006 - DNA, 25 bp, Rattus norvegicus
gcatcatgggttcaggtcatcctgc

SEQ ID NO: 387007 - DNA, 25 bp, Rattus norvegicus
gcatcatgggttgaggtcatcctgc

SEQ ID NO: 387008 - DNA, 25 bp, Rattus norvegicus
gcatcatgtagactagcagggcttc

SEQ ID NO: 387009 - DNA, 25 bp, Rattus norvegicus
gcatcatgtagagtagcagggcttc

SEQ ID NO: 387010 - DNA, 25 bp, Rattus norvegicus
gcatcatgtattagtttttgttctc

SEQ ID NO: 387011 - DNA, 25 bp, Rattus norvegicus
gcatcatgtatttgtttttgttctc

SEQ ID NO: 387012 - DNA, 25 bp, Rattus norvegicus
gcatcatgtcttagagtgtcctttt

SEQ ID NO: 387013 - DNA, 25 bp, Rattus norvegicus
gcatcatgtctttgagtgtcctttt

SEQ ID NO: 387014 - DNA, 25 bp, Rattus norvegicus
gcatcatgttgaccagtactggcgt

SEQ ID NO: 387015 - DNA, 25 bp, Rattus norvegicus
gcatcatgttgagcagtactggcgt

SEQ ID NO: 387016 - DNA, 25 bp, Rattus norvegicus
gcatcattaccaatgtctgtgccat

SEQ ID NO: 387017 - DNA, 25 bp, Rattus norvegicus
gcatcattaccattgtctgtgccat

SEQ ID NO: 387018 - DNA, 25 bp, Rattus norvegicus
gcatcattagtaccgggtggttctc

SEQ ID NO: 387019 - DNA, 25 bp, Rattus norvegicus
gcatcattagtagcgggtggttctc

SEQ ID NO: 387020 - DNA, 25 bp, Rattus norvegicus
gcatcattagtgagtgctcccacag

SEQ ID NO: 387021 - DNA, 25 bp, Rattus norvegicus
gcatcattagtgtgtgctcccacag

SEQ ID NO: 387022 - DNA, 25 bp, Rattus norvegicus
gcatcattatttaaaccgctggttt

SEQ ID NO: 387023 - DNA, 25 bp, Rattus norvegicus
gcatcattattttaaccgctggttt

SEQ ID NO: 387024 - DNA, 25 bp, Rattus norvegicus
gcatcattcaccattctgggagatt

SEQ ID NO: 387025 - DNA, 25 bp, Rattus norvegicus
gcatcattcacctttctgggagatt

SEQ ID NO: 387026 - DNA, 25 bp, Rattus norvegicus
gcatcattcagtatggccttttttg

SEQ ID NO: 387027 - DNA, 25 bp, Rattus norvegicus
gcatcattcagtttggccttttttg

SEQ ID NO: 387028 - DNA, 25 bp, Rattus norvegicus
gcatcattgatgacctcattgccac

SEQ ID NO: 387029 - DNA, 25 bp, Rattus norvegicus
gcatcattgatgtcctcattgccac

SEQ ID NO: 387030 - DNA, 25 bp, Rattus norvegicus
gcatcattgtacagtgtttccttca

SEQ ID NO: 387031 - DNA, 25 bp, Rattus norvegicus
gcatcattgtactgtgtttccttca

SEQ ID NO: 387032 - DNA, 25 bp, Rattus norvegicus
gcatcattttgtaaccttttttctt

SEQ ID NO: 387033 - DNA, 25 bp, Rattus norvegicus
gcatcattttgttaccttttttctt

SEQ ID NO: 387034 - DNA, 25 bp, Rattus norvegicus
gcatccaaacagctttatctgctta

SEQ ID NO: 387035 - DNA, 25 bp, Rattus norvegicus
gcatccaaacaggtttatctgctta

SEQ ID NO: 387036 - DNA, 25 bp, Rattus norvegicus
gcatccaaatgaaatgtgtgccttt

SEQ ID NO: 387037 - DNA, 25 bp, Rattus norvegicus
gcatccaaatgatatgtgtgccttt

SEQ ID NO: 387038 - DNA, 25 bp, Rattus norvegicus
gcatccaagagacacaggccaggca

SEQ ID NO: 387039 - DNA, 25 bp, Rattus norvegicus
gcatccaagagagacaggccaggca

SEQ ID NO: 387040 - DNA, 25 bp, Rattus norvegicus
gcatccaaggaaattcccctaactt

SEQ ID NO: 387041 - DNA, 25 bp, Rattus norvegicus
gcatccaaggaatttcccctaactt

SEQ ID NO: 387042 - DNA, 25 bp, Rattus norvegicus
gcatccaaggagattgctgccatgg

SEQ ID NO: 387043 - DNA, 25 bp, Rattus norvegicus
gcatccaaggagtttgctgccatgg

SEQ ID NO: 387044 - DNA, 25 bp, Rattus norvegicus
gcatccaaggtaacggcgccacggg

SEQ ID NO: 387045 - DNA, 25 bp, Rattus norvegicus
gcatccaaggtatcggcgccacggg

SEQ ID NO: 387046 - DNA, 25 bp, Rattus norvegicus
gcatccaagtgaatgctgagggaga

SEQ ID NO: 387047 - DNA, 25 bp, Rattus norvegicus
gcatccaagtgattgctgagggaga

SEQ ID NO: 387048 - DNA, 25 bp, Rattus norvegicus
gcatccacaactccaatttctgtag

SEQ ID NO: 387049 - DNA, 25 bp, Rattus norvegicus
gcatccacaactgcaatttctgtag

SEQ ID NO: 387050 - DNA, 25 bp, Rattus norvegicus
gcatccacaagaatactgtttgcat

SEQ ID NO: 387051 - DNA, 25 bp, Rattus norvegicus
gcatccacaagattactgtttgcat

SEQ ID NO: 387052 - DNA, 25 bp, Rattus norvegicus
gcatccacacatagtagagctgttg

SEQ ID NO: 387053 - DNA, 25 bp, Rattus norvegicus
gcatccacacattgtagagctgttg

SEQ ID NO: 387054 - DNA, 25 bp, Rattus norvegicus
gcatccacatctcattggtcactta

SEQ ID NO: 387055 - DNA, 25 bp, Rattus norvegicus
gcatccacatctgattggtcactta

SEQ ID NO: 387056 - DNA, 25 bp, Rattus norvegicus
gcatccacatggctttatctgtata

SEQ ID NO: 387057 - DNA, 25 bp, Rattus norvegicus
gcatccacatgggtttatctgtata

SEQ ID NO: 387058 - DNA, 25 bp, Rattus norvegicus
gcatccaccagccaaaagtgcttgt

SEQ ID NO: 387059 - DNA, 25 bp, Rattus norvegicus
gcatccaccagcgaaaagtgcttgt

SEQ ID NO: 387060 - DNA, 25 bp, Rattus norvegicus
gcatccacccctaataatgctgtta

SEQ ID NO: 387061 - DNA, 25 bp, Rattus norvegicus
gcatccaccccttataatgctgtta

SEQ ID NO: 387062 - DNA, 25 bp, Rattus norvegicus
gcatccacgtttatcgcctggataa

SEQ ID NO: 387063 - DNA, 25 bp, Rattus norvegicus
gcatccacgtttttcgcctggataa

SEQ ID NO: 387064 - DNA, 25 bp, Rattus norvegicus
gcatccactcagcacggcagtagaa

SEQ ID NO: 387065 - DNA, 25 bp, Rattus norvegicus
gcatccactcaggacggcagtagaa

SEQ ID NO: 387066 - DNA, 25 bp, Rattus norvegicus
gcatccactgttaatcatggcctag

SEQ ID NO: 387067 - DNA, 25 bp, Rattus norvegicus
gcatccactgtttatcatggcctag

SEQ ID NO: 387068 - DNA, 25 bp, Rattus norvegicus
gcatccagacaaagaggtcccagct

SEQ ID NO: 387069 - DNA, 25 bp, Rattus norvegicus
gcatccagacaatgaggtcccagct

SEQ ID NO: 387070 - DNA, 25 bp, Rattus norvegicus
gcatccagatccaagagctgttctt

SEQ ID NO: 387071 - DNA, 25 bp, Rattus norvegicus
gcatccagatcctagagctgttctt

SEQ ID NO: 387072 - DNA, 25 bp, Rattus norvegicus
gcatccagatctagggatacagaat

SEQ ID NO: 387073 - DNA, 25 bp, Rattus norvegicus
gcatccagatcttgggatacagaat

SEQ ID NO: 387074 - DNA, 25 bp, Rattus norvegicus
gcatccagatgtatgacgtcgtgta

SEQ ID NO: 387075 - DNA, 25 bp, Rattus norvegicus
gcatccagatgtttgacgtcgtgta

SEQ ID NO: 387076 - DNA, 25 bp, Rattus norvegicus
gcatccagcacacactctcaaggag

SEQ ID NO: 387077 - DNA, 25 bp, Rattus norvegicus
gcatccagcacagactctcaaggag

SEQ ID NO: 387078 - DNA, 25 bp, Rattus norvegicus
gcatccagccacatcttgaggtgaa

SEQ ID NO: 387079 - DNA, 25 bp, Rattus norvegicus
gcatccagccacttcttgaggtgaa

SEQ ID NO: 387080 - DNA, 25 bp, Rattus norvegicus
gcatccagcgtaatcccagaagatt

SEQ ID NO: 387081 - DNA, 25 bp, Rattus norvegicus
gcatccagcgtattcccagaagatt

SEQ ID NO: 387082 - DNA, 25 bp, Rattus norvegicus
gcatccagctgacaaaaaactcttt

SEQ ID NO: 387083 - DNA, 25 bp, Rattus norvegicus
gcatccagctgagaaaaaactcttt

SEQ ID NO: 387084 - DNA, 25 bp, Rattus norvegicus
gcatccaggagtaagagaccttttc

SEQ ID NO: 387085 - DNA, 25 bp, Rattus norvegicus
gcatccaggagtaagctgacccaat

SEQ ID NO: 387086 - DNA, 25 bp, Rattus norvegicus
gcatccaggagttagagaccttttc

SEQ ID NO: 387087 - DNA, 25 bp, Rattus norvegicus
gcatccaggagttagctgacccaat

SEQ ID NO: 387088 - DNA, 25 bp, Rattus norvegicus
gcatccaggatgctagcctagattg

SEQ ID NO: 387089 - DNA, 25 bp, Rattus norvegicus
gcatccaggatggtagcctagattg

SEQ ID NO: 387090 - DNA, 25 bp, Rattus norvegicus
gcatccagggcacgaccgcagtaga

SEQ ID NO: 387091 - DNA, 25 bp, Rattus norvegicus
gcatccagggcaggaccgcagtaga

SEQ ID NO: 387092 - DNA, 25 bp, Rattus norvegicus
gcatccagggccattacaattcttg

SEQ ID NO: 387093 - DNA, 25 bp, Rattus norvegicus
gcatccagggcctttacaattcttg

SEQ ID NO: 387094 - DNA, 25 bp, Rattus norvegicus
gcatccagggtcatcagtttcccat

SEQ ID NO: 387095 - DNA, 25 bp, Rattus norvegicus
gcatccagggtcttcagtttcccat

SEQ ID NO: 387096 - DNA, 25 bp, Rattus norvegicus
gcatccaggtgccattcatcagaaa

SEQ ID NO: 387097 - DNA, 25 bp, Rattus norvegicus
gcatccaggtgcgattcatcagaaa

SEQ ID NO: 387098 - DNA, 25 bp, Rattus norvegicus
gcatccagtactattcagatttcta

SEQ ID NO: 387099 - DNA, 25 bp, Rattus norvegicus
gcatccagtacttttcagatttcta

SEQ ID NO: 387100 - DNA, 25 bp, Rattus norvegicus
gcatccagtaggaatttgcccagat

SEQ ID NO: 387101 - DNA, 25 bp, Rattus norvegicus
gcatccagtaggtatttgcccagat

SEQ ID NO: 387102 - DNA, 25 bp, Rattus norvegicus
gcatccagtattatcaagtgtctca

SEQ ID NO: 387103 - DNA, 25 bp, Rattus norvegicus
gcatccagtattttcaagtgtctca

SEQ ID NO: 387104 - DNA, 25 bp, Rattus norvegicus
gcatccagtcccatttttacgacat

SEQ ID NO: 387105 - DNA, 25 bp, Rattus norvegicus
gcatccagtcccttttttacgacat

SEQ ID NO: 387106 - DNA, 25 bp, Rattus norvegicus
gcatccagtcctcttttctttagaa

SEQ ID NO: 387107 - DNA, 25 bp, Rattus norvegicus
gcatccagtcctgttttctttagaa

SEQ ID NO: 387108 - DNA, 25 bp, Rattus norvegicus
gcatccagtgaaccgagagttaaca

SEQ ID NO: 387109 - DNA, 25 bp, Rattus norvegicus
gcatccagtgaagcgagagttaaca

SEQ ID NO: 387110 - DNA, 25 bp, Rattus norvegicus
gcatccatagtgattgactgagcca

SEQ ID NO: 387111 - DNA, 25 bp, Rattus norvegicus
gcatccatagtgtttgactgagcca

SEQ ID NO: 387112 - DNA, 25 bp, Rattus norvegicus
gcatccatctggagctaatcttgag

SEQ ID NO: 387113 - DNA, 25 bp, Rattus norvegicus
gcatccatctggtgctaatcttgag

SEQ ID NO: 387114 - DNA, 25 bp, Rattus norvegicus
gcatccatctttcgcatcataccag

SEQ ID NO: 387115 - DNA, 25 bp, Rattus norvegicus
gcatccatctttggcatcataccag

SEQ ID NO: 387116 - DNA, 25 bp, Rattus norvegicus
gcatccatggacagtgacgtaggca

SEQ ID NO: 387117 - DNA, 25 bp, Rattus norvegicus
gcatccatggactgtgacgtaggca

SEQ ID NO: 387118 - DNA, 25 bp, Rattus norvegicus
gcatccatggtcaactgcaccatat

SEQ ID NO: 387119 - DNA, 25 bp, Rattus norvegicus
gcatccatggtctactgcaccatat

SEQ ID NO: 387120 - DNA, 25 bp, Rattus norvegicus
gcatccattactcaagccaaacctt

SEQ ID NO: 387121 - DNA, 25 bp, Rattus norvegicus
gcatccattactgaagccaaacctt

SEQ ID NO: 387122 - DNA, 25 bp, Rattus norvegicus
gcatccattcaaccactcagcaagt

SEQ ID NO: 387123 - DNA, 25 bp, Rattus norvegicus
gcatccattcaagcactcagcaagt

SEQ ID NO: 387124 - DNA, 25 bp, Rattus norvegicus
gcatccattcggagatcctcaagaa

SEQ ID NO: 387125 - DNA, 25 bp, Rattus norvegicus
gcatccattcggtgatcctcaagaa

SEQ ID NO: 387126 - DNA, 25 bp, Rattus norvegicus
gcatcccaaatgacaaggcttcttt

SEQ ID NO: 387127 - DNA, 25 bp, Rattus norvegicus
gcatcccaaatgtcaaggcttcttt

SEQ ID NO: 387128 - DNA, 25 bp, Rattus norvegicus
gcatcccaaggccaataaatatttt

SEQ ID NO: 387129 - DNA, 25 bp, Rattus norvegicus
gcatcccaaggcgaataaatatttt

SEQ ID NO: 387130 - DNA, 25 bp, Rattus norvegicus
gcatcccacccgatgaatgggcgag

SEQ ID NO: 387131 - DNA, 25 bp, Rattus norvegicus
gcatcccacccgttgaatgggcgag

SEQ ID NO: 387132 - DNA, 25 bp, Rattus norvegicus
gcatcccacgcgaagacagagcatt

SEQ ID NO: 387133 - DNA, 25 bp, Rattus norvegicus
gcatcccacgcgtagacagagcatt

SEQ ID NO: 387134 - DNA, 25 bp, Rattus norvegicus
gcatcccactacactttatcaaaga

SEQ ID NO: 387135 - DNA, 25 bp, Rattus norvegicus
gcatcccactactctttatcaaaga

SEQ ID NO: 387136 - DNA, 25 bp, Rattus norvegicus
gcatcccactatattcggcctgaga

SEQ ID NO: 387137 - DNA, 25 bp, Rattus norvegicus
gcatcccactattttcggcctgaga

SEQ ID NO: 387138 - DNA, 25 bp, Rattus norvegicus
gcatcccaggatcgccgtatgacag

SEQ ID NO: 387139 - DNA, 25 bp, Rattus norvegicus
gcatcccaggatggccgtatgacag

SEQ ID NO: 387140 - DNA, 25 bp, Rattus norvegicus
gcatcccatcagcatgaacaccatg

SEQ ID NO: 387141 - DNA, 25 bp, Rattus norvegicus
gcatcccatcaggatgaacaccatg

SEQ ID NO: 387142 - DNA, 25 bp, Rattus norvegicus
gcatcccatgagctctgactggaca

SEQ ID NO: 387143 - DNA, 25 bp, Rattus norvegicus
gcatcccatgaggtctgactggaca

SEQ ID NO: 387144 - DNA, 25 bp, Rattus norvegicus
gcatcccattgaccaagtattaagt

SEQ ID NO: 387145 - DNA, 25 bp, Rattus norvegicus
gcatcccattgagcaagtattaagt

SEQ ID NO: 387146 - DNA, 25 bp, Rattus norvegicus
gcatcccgacagatacgtggtacaa

SEQ ID NO: 387147 - DNA, 25 bp, Rattus norvegicus
gcatcccgacagttacgtggtacaa

SEQ ID NO: 387148 - DNA, 25 bp, Rattus norvegicus
gcatcccggaggacgacgagtacga

SEQ ID NO: 387149 - DNA, 25 bp, Rattus norvegicus
gcatcccggaggtcgacgagtacga

SEQ ID NO: 387150 - DNA, 25 bp, Rattus norvegicus
gcatcccggcacacaaagaaaacaa

SEQ ID NO: 387151 - DNA, 25 bp, Rattus norvegicus
gcatcccggcactcaaagaaaacaa

SEQ ID NO: 387152 - DNA, 25 bp, Rattus norvegicus
gcatccctaggtcatgttcctgatt

SEQ ID NO: 387153 - DNA, 25 bp, Rattus norvegicus
gcatccctaggtgatgttcctgatt

SEQ ID NO: 387154 - DNA, 25 bp, Rattus norvegicus
gcatccctcaggcattgctgttagt

SEQ ID NO: 387155 - DNA, 25 bp, Rattus norvegicus
gcatccctcagggattgctgttagt

SEQ ID NO: 387156 - DNA, 25 bp, Rattus norvegicus
gcatccctgcaacttttcatagacc

SEQ ID NO: 387157 - DNA, 25 bp, Rattus norvegicus
gcatccctgcaagttttcatagacc

SEQ ID NO: 387158 - DNA, 25 bp, Rattus norvegicus
gcatccctgtctagttaaggtacac

SEQ ID NO: 387159 - DNA, 25 bp, Rattus norvegicus
gcatccctgtctatgggtgccacaa

SEQ ID NO: 387160 - DNA, 25 bp, Rattus norvegicus
gcatccctgtcttgttaaggtacac

SEQ ID NO: 387161 - DNA, 25 bp, Rattus norvegicus
gcatccctgtctttgggtgccacaa

SEQ ID NO: 387162 - DNA, 25 bp, Rattus norvegicus
gcatcccttgacatctgacaataca

SEQ ID NO: 387163 - DNA, 25 bp, Rattus norvegicus
gcatcccttgacttctgacaataca

SEQ ID NO: 387164 - DNA, 25 bp, Rattus norvegicus
gcatcccttgccatcagtaatgatg

SEQ ID NO: 387165 - DNA, 25 bp, Rattus norvegicus
gcatcccttgccttcagtaatgatg

SEQ ID NO: 387166 - DNA, 25 bp, Rattus norvegicus
gcatcccttgggaatggcagtcaag

SEQ ID NO: 387167 - DNA, 25 bp, Rattus norvegicus
gcatcccttgggtatggcagtcaag

SEQ ID NO: 387168 - DNA, 25 bp, Rattus norvegicus
gcatccgaagctaaggtctgccaaa

SEQ ID NO: 387169 - DNA, 25 bp, Rattus norvegicus
gcatccgaagcttaggtctgccaaa

SEQ ID NO: 387170 - DNA, 25 bp, Rattus norvegicus
gcatccgagtacctttgtccagaaa

SEQ ID NO: 387171 - DNA, 25 bp, Rattus norvegicus
gcatccgagtacgtttgtccagaaa

SEQ ID NO: 387172 - DNA, 25 bp, Rattus norvegicus
gcatccgagtgtctgaggccttcaa

SEQ ID NO: 387173 - DNA, 25 bp, Rattus norvegicus
gcatccgagtgtgtgaggccttcaa

SEQ ID NO: 387174 - DNA, 25 bp, Rattus norvegicus
gcatccgcaagcagcaatgctagtt

SEQ ID NO: 387175 - DNA, 25 bp, Rattus norvegicus
gcatccgcaagctgcaatgctagtt

SEQ ID NO: 387176 - DNA, 25 bp, Rattus norvegicus
gcatccgcagccaggagaacttact

SEQ ID NO: 387177 - DNA, 25 bp, Rattus norvegicus
gcatccgcagcctggagaacttact

SEQ ID NO: 387178 - DNA, 25 bp, Rattus norvegicus
gcatccgcaggacagtcaagttctt

SEQ ID NO: 387179 - DNA, 25 bp, Rattus norvegicus
gcatccgcaggagagtcaagttctt

SEQ ID NO: 387180 - DNA, 25 bp, Rattus norvegicus
gcatccgcatttcgtatcttttaca

SEQ ID NO: 387181 - DNA, 25 bp, Rattus norvegicus
gcatccgcatttggtatcttttaca

SEQ ID NO: 387182 - DNA, 25 bp, Rattus norvegicus
gcatccgccgtgaaataccaacttt

SEQ ID NO: 387183 - DNA, 25 bp, Rattus norvegicus
gcatccgccgtgtaataccaacttt

SEQ ID NO: 387184 - DNA, 25 bp, Rattus norvegicus
gcatccgctaccagggcgaaagaag

SEQ ID NO: 387185 - DNA, 25 bp, Rattus norvegicus
gcatccgctacctgggcgaaagaag

SEQ ID NO: 387186 - DNA, 25 bp, Rattus norvegicus
gcatccgctggcagggctagtagaa

SEQ ID NO: 387187 - DNA, 25 bp, Rattus norvegicus
gcatccgctggctgggctagtagaa

SEQ ID NO: 387188 - DNA, 25 bp, Rattus norvegicus
gcatccggagatatttgactgtgtt

SEQ ID NO: 387189 - DNA, 25 bp, Rattus norvegicus
gcatccggagatttttgactgtgtt

SEQ ID NO: 387190 - DNA, 25 bp, Rattus norvegicus
gcatccgggagcatttattcattct

SEQ ID NO: 387191 - DNA, 25 bp, Rattus norvegicus
gcatccgggagcttttattcattct

SEQ ID NO: 387192 - DNA, 25 bp, Rattus norvegicus
gcatccgtccatctgctgtatatgt

SEQ ID NO: 387193 - DNA, 25 bp, Rattus norvegicus
gcatccgtccatgtgctgtatatgt

SEQ ID NO: 387194 - DNA, 25 bp, Rattus norvegicus
gcatccgtgaatactgcatgtggca

SEQ ID NO: 387195 - DNA, 25 bp, Rattus norvegicus
gcatccgtgaattctgcatgtggca

SEQ ID NO: 387196 - DNA, 25 bp, Rattus norvegicus
gcatccgtgagcatgtttatgtaat

SEQ ID NO: 387197 - DNA, 25 bp, Rattus norvegicus
gcatccgtgagcttgtttatgtaat

SEQ ID NO: 387198 - DNA, 25 bp, Rattus norvegicus
gcatccgtgtgtatcactggaggac

SEQ ID NO: 387199 - DNA, 25 bp, Rattus norvegicus
gcatccgtgtgtttcactggaggac

SEQ ID NO: 387200 - DNA, 25 bp, Rattus norvegicus
gcatcctaccgtacaacagagctat

SEQ ID NO: 387201 - DNA, 25 bp, Rattus norvegicus
gcatcctaccgttcaacagagctat

SEQ ID NO: 387202 - DNA, 25 bp, Rattus norvegicus
gcatcctaggccaatggtttactac

SEQ ID NO: 387203 - DNA, 25 bp, Rattus norvegicus
gcatcctaggcctatggtttactac

SEQ ID NO: 387204 - DNA, 25 bp, Rattus norvegicus
gcatcctaggtcactatttgtcact

SEQ ID NO: 387205 - DNA, 25 bp, Rattus norvegicus
gcatcctaggtctctatttgtcact

SEQ ID NO: 387206 - DNA, 25 bp, Rattus norvegicus
gcatcctatgcaattgtccatctgg

SEQ ID NO: 387207 - DNA, 25 bp, Rattus norvegicus
gcatcctatgcatttgtccatctgg

SEQ ID NO: 387208 - DNA, 25 bp, Rattus norvegicus
gcatcctcaagtacacagcatcaga

SEQ ID NO: 387209 - DNA, 25 bp, Rattus norvegicus
gcatcctcaagtcttcttatccata

SEQ ID NO: 387210 - DNA, 25 bp, Rattus norvegicus
gcatcctcaagtgttcttatccata

SEQ ID NO: 387211 - DNA, 25 bp, Rattus norvegicus
gcatcctcaagttcacagcatcaga

SEQ ID NO: 387212 - DNA, 25 bp, Rattus norvegicus
gcatcctcaatgattctgctgtaga

SEQ ID NO: 387213 - DNA, 25 bp, Rattus norvegicus
gcatcctcaatgtttctgctgtaga

SEQ ID NO: 387214 - DNA, 25 bp, Rattus norvegicus
gcatcctcagcaagcttgactggaa

SEQ ID NO: 387215 - DNA, 25 bp, Rattus norvegicus
gcatcctcagcatgcttgactggaa

SEQ ID NO: 387216 - DNA, 25 bp, Rattus norvegicus
gcatcctcagtgaaacagtgtcctt

SEQ ID NO: 387217 - DNA, 25 bp, Rattus norvegicus
gcatcctcagtgtaacagtgtcctt

SEQ ID NO: 387218 - DNA, 25 bp, Rattus norvegicus
gcatcctcatcgacatgatcatcat

SEQ ID NO: 387219 - DNA, 25 bp, Rattus norvegicus
gcatcctcatcgtcatgatcatcat

SEQ ID NO: 387220 - DNA, 25 bp, Rattus norvegicus
gcatcctccaaacctgtgagcatca

SEQ ID NO: 387221 - DNA, 25 bp, Rattus norvegicus
gcatcctccaaagctgtgagcatca

SEQ ID NO: 387222 - DNA, 25 bp, Rattus norvegicus
gcatcctccaagcagagtagcagca

SEQ ID NO: 387223 - DNA, 25 bp, Rattus norvegicus
gcatcctccaaggagagtagcagca

SEQ ID NO: 387224 - DNA, 25 bp, Rattus norvegicus
gcatcctccactacattctgaagat

SEQ ID NO: 387225 - DNA, 25 bp, Rattus norvegicus
gcatcctccacttcattctgaagat

SEQ ID NO: 387226 - DNA, 25 bp, Rattus norvegicus
gcatcctctactcgctgggcaatgg

SEQ ID NO: 387227 - DNA, 25 bp, Rattus norvegicus
gcatcctctactggctgggcaatgg

SEQ ID NO: 387228 - DNA, 25 bp, Rattus norvegicus
gcatcctctcataatgggctctgaa

SEQ ID NO: 387229 - DNA, 25 bp, Rattus norvegicus
gcatcctctcattatgggctctgaa

SEQ ID NO: 387230 - DNA, 25 bp, Rattus norvegicus
gcatcctcttcaaacagtagctttg

SEQ ID NO: 387231 - DNA, 25 bp, Rattus norvegicus
gcatcctcttcatacagtagctttg

SEQ ID NO: 387232 - DNA, 25 bp, Rattus norvegicus
gcatcctgaagcacctagacgggta

SEQ ID NO: 387233 - DNA, 25 bp, Rattus norvegicus
gcatcctgaagctcctagacgggta

SEQ ID NO: 387234 - DNA, 25 bp, Rattus norvegicus
gcatcctgaattatcaaatgtcctt

SEQ ID NO: 387235 - DNA, 25 bp, Rattus norvegicus
gcatcctgaattttcaaatgtcctt

SEQ ID NO: 387236 - DNA, 25 bp, Rattus norvegicus
gcatcctgacagacttgtagccatg

SEQ ID NO: 387237 - DNA, 25 bp, Rattus norvegicus
gcatcctgacagtcttgtagccatg

SEQ ID NO: 387238 - DNA, 25 bp, Rattus norvegicus
gcatcctgacttacaaatctgaaac

SEQ ID NO: 387239 - DNA, 25 bp, Rattus norvegicus
gcatcctgactttcaaatctgaaac

SEQ ID NO: 387240 - DNA, 25 bp, Rattus norvegicus
gcatcctgagtgaattcttggtgag

SEQ ID NO: 387241 - DNA, 25 bp, Rattus norvegicus
gcatcctgagtgtattcttggtgag

SEQ ID NO: 387242 - DNA, 25 bp, Rattus norvegicus
gcatcctggagacagtagcagcact

SEQ ID NO: 387243 - DNA, 25 bp, Rattus norvegicus
gcatcctggagacccttcagagaaa

SEQ ID NO: 387244 - DNA, 25 bp, Rattus norvegicus
gcatcctggagagagtagcagcact

SEQ ID NO: 387245 - DNA, 25 bp, Rattus norvegicus
gcatcctggagagccttcagagaaa

SEQ ID NO: 387246 - DNA, 25 bp, Rattus norvegicus
gcatcctggatgaggtcaccgttga

SEQ ID NO: 387247 - DNA, 25 bp, Rattus norvegicus
gcatcctggatgtggtcaccgttga

SEQ ID NO: 387248 - DNA, 25 bp, Rattus norvegicus
gcatcctgtacaatgtttgggtctc

SEQ ID NO: 387249 - DNA, 25 bp, Rattus norvegicus
gcatcctgtacacggtttgctccca

SEQ ID NO: 387250 - DNA, 25 bp, Rattus norvegicus
gcatcctgtacagggtttgctccca

SEQ ID NO: 387251 - DNA, 25 bp, Rattus norvegicus
gcatcctgtacattgtttgggtctc

SEQ ID NO: 387252 - DNA, 25 bp, Rattus norvegicus
gcatcctgtaggaggtggctgccca

SEQ ID NO: 387253 - DNA, 25 bp, Rattus norvegicus
gcatcctgtaggtggtggctgccca

SEQ ID NO: 387254 - DNA, 25 bp, Rattus norvegicus
gcatcctgtgtaactcttgacaata

SEQ ID NO: 387255 - DNA, 25 bp, Rattus norvegicus
gcatcctgtgtatctcttgacaata

SEQ ID NO: 387256 - DNA, 25 bp, Rattus norvegicus
gcatcctgtgtgacagcctggagga

SEQ ID NO: 387257 - DNA, 25 bp, Rattus norvegicus
gcatcctgtgtgagatactgtgtat

SEQ ID NO: 387258 - DNA, 25 bp, Rattus norvegicus
gcatcctgtgtgtcagcctggagga

SEQ ID NO: 387259 - DNA, 25 bp, Rattus norvegicus
gcatcctgtgtgtgatactgtgtat

SEQ ID NO: 387260 - DNA, 25 bp, Rattus norvegicus
gcatcctgtgttctcacgttgttat

SEQ ID NO: 387261 - DNA, 25 bp, Rattus norvegicus
gcatcctgtgttgtcacgttgttat

SEQ ID NO: 387262 - DNA, 25 bp, Rattus norvegicus
gcatcctgttgacgtggtcacactg

SEQ ID NO: 387263 - DNA, 25 bp, Rattus norvegicus
gcatcctgttgaggtggtcacactg

SEQ ID NO: 387264 - DNA, 25 bp, Rattus norvegicus
gcatccttatgtccctcttaaatta

SEQ ID NO: 387265 - DNA, 25 bp, Rattus norvegicus
gcatccttatgtgcctcttaaatta

SEQ ID NO: 387266 - DNA, 25 bp, Rattus norvegicus
gcatccttcaatcatacctttgtcc

SEQ ID NO: 387267 - DNA, 25 bp, Rattus norvegicus
gcatccttcaatgatacctttgtcc

SEQ ID NO: 387268 - DNA, 25 bp, Rattus norvegicus
gcatccttccaaactacagaatctc

SEQ ID NO: 387269 - DNA, 25 bp, Rattus norvegicus
gcatccttccaatctacagaatctc

SEQ ID NO: 387270 - DNA, 25 bp, Rattus norvegicus
gcatccttccagcaagcttcaggtt

SEQ ID NO: 387271 - DNA, 25 bp, Rattus norvegicus
gcatccttccaggaagcttcaggtt

SEQ ID NO: 387272 - DNA, 25 bp, Rattus norvegicus
gcatccttccctagaaatttttgtg

SEQ ID NO: 387273 - DNA, 25 bp, Rattus norvegicus
gcatccttcccttgaaatttttgtg

SEQ ID NO: 387274 - DNA, 25 bp, Rattus norvegicus
gcatccttctgcatatgtgtgtaga

SEQ ID NO: 387275 - DNA, 25 bp, Rattus norvegicus
gcatccttctgcttatgtgtgtaga

SEQ ID NO: 387276 - DNA, 25 bp, Rattus norvegicus
gcatccttgacaagagtccttttac

SEQ ID NO: 387277 - DNA, 25 bp, Rattus norvegicus
gcatccttgacatgagtccttttac

SEQ ID NO: 387278 - DNA, 25 bp, Rattus norvegicus
gcatccttgccacaagcttcatttg

SEQ ID NO: 387279 - DNA, 25 bp, Rattus norvegicus
gcatccttgccagaagcttcatttg

SEQ ID NO: 387280 - DNA, 25 bp, Rattus norvegicus
gcatccttgcctatcggtggttgga

SEQ ID NO: 387281 - DNA, 25 bp, Rattus norvegicus
gcatccttgcctcaaatgtgaatgt

SEQ ID NO: 387282 - DNA, 25 bp, Rattus norvegicus
gcatccttgcctgaaatgtgaatgt

SEQ ID NO: 387283 - DNA, 25 bp, Rattus norvegicus
gcatccttgcctttcggtggttgga

SEQ ID NO: 387284 - DNA, 25 bp, Rattus norvegicus
gcatccttggctccagtcaataaaa

SEQ ID NO: 387285 - DNA, 25 bp, Rattus norvegicus
gcatccttggctgcagtcaataaaa

SEQ ID NO: 387286 - DNA, 25 bp, Rattus norvegicus
gcatcctttcttccaggagtacgtg

SEQ ID NO: 387287 - DNA, 25 bp, Rattus norvegicus
gcatcctttcttgcaggagtacgtg

SEQ ID NO: 387288 - DNA, 25 bp, Rattus norvegicus
gcatcgaaccatccaagaccttaga

SEQ ID NO: 387289 - DNA, 25 bp, Rattus norvegicus
gcatcgaaccatgcaagaccttaga

SEQ ID NO: 387290 - DNA, 25 bp, Rattus norvegicus
gcatcgaagcctacagatggaaggt

SEQ ID NO: 387291 - DNA, 25 bp, Rattus norvegicus
gcatcgaagcctacgaacagaaggt

SEQ ID NO: 387292 - DNA, 25 bp, Rattus norvegicus
gcatcgaagccttcagatggaaggt

SEQ ID NO: 387293 - DNA, 25 bp, Rattus norvegicus
gcatcgaagccttcgaacagaaggt

SEQ ID NO: 387294 - DNA, 25 bp, Rattus norvegicus
gcatcgaaggcaacagccggctgat

SEQ ID NO: 387295 - DNA, 25 bp, Rattus norvegicus
gcatcgaaggcatcagccggctgat

SEQ ID NO: 387296 - DNA, 25 bp, Rattus norvegicus
gcatcgacagttcccagggcgacag

SEQ ID NO: 387297 - DNA, 25 bp, Rattus norvegicus
gcatcgacagttgccagggcgacag

SEQ ID NO: 387298 - DNA, 25 bp, Rattus norvegicus
gcatcgaccgctcgttgtcagagaa

SEQ ID NO: 387299 - DNA, 25 bp, Rattus norvegicus
gcatcgaccgctggttgtcagagaa

SEQ ID NO: 387300 - DNA, 25 bp, Rattus norvegicus
gcatcgactacacagagctgctgca

SEQ ID NO: 387301 - DNA, 25 bp, Rattus norvegicus
gcatcgactacagagagctgctgca

SEQ ID NO: 387302 - DNA, 25 bp, Rattus norvegicus
gcatcgactcgtcaatgggctatta

SEQ ID NO: 387303 - DNA, 25 bp, Rattus norvegicus
gcatcgactcgtgaatgggctatta

SEQ ID NO: 387304 - DNA, 25 bp, Rattus norvegicus
gcatcgacttctcttgatcttgtca

SEQ ID NO: 387305 - DNA, 25 bp, Rattus norvegicus
gcatcgacttctgttgatcttgtca

SEQ ID NO: 387306 - DNA, 25 bp, Rattus norvegicus
gcatcgaggagaacggctacaacac

SEQ ID NO: 387307 - DNA, 25 bp, Rattus norvegicus
gcatcgaggagatcggctacaacac

SEQ ID NO: 387308 - DNA, 25 bp, Rattus norvegicus
gcatcgagtagtccagaccctgcat

SEQ ID NO: 387309 - DNA, 25 bp, Rattus norvegicus
gcatcgagtagtgcagaccctgcat

SEQ ID NO: 387310 - DNA, 25 bp, Rattus norvegicus
gcatcgataaacagcacttgcttaa

SEQ ID NO: 387311 - DNA, 25 bp, Rattus norvegicus
gcatcgataaactgcacttgcttaa

SEQ ID NO: 387312 - DNA, 25 bp, Rattus norvegicus
gcatcgatccagacgacaggcgagt

SEQ ID NO: 387313 - DNA, 25 bp, Rattus norvegicus
gcatcgatccagtcgacaggcgagt

SEQ ID NO: 387314 - DNA, 25 bp, Rattus norvegicus
gcatcgatgctgatctgtccagtgc

SEQ ID NO: 387315 - DNA, 25 bp, Rattus norvegicus
gcatcgatgctgttctgtccagtgc

SEQ ID NO: 387316 - DNA, 25 bp, Rattus norvegicus
gcatcgcatcccaacgtcaaaaagt

SEQ ID NO: 387317 - DNA, 25 bp, Rattus norvegicus
gcatcgcatccctacgtcaaaaagt

SEQ ID NO: 387318 - DNA, 25 bp, Rattus norvegicus
gcatcgccagcaattcgatcctcgt

SEQ ID NO: 387319 - DNA, 25 bp, Rattus norvegicus
gcatcgccagcatttcgatcctcgt

SEQ ID NO: 387320 - DNA, 25 bp, Rattus norvegicus
gcatcgccagcgagttttatgagca

SEQ ID NO: 387321 - DNA, 25 bp, Rattus norvegicus
gcatcgccagcgtgttttatgagca

SEQ ID NO: 387322 - DNA, 25 bp, Rattus norvegicus
gcatcgccatatctgtagctgcagt

SEQ ID NO: 387323 - DNA, 25 bp, Rattus norvegicus
gcatcgccatatgtgtagctgcagt

SEQ ID NO: 387324 - DNA, 25 bp, Rattus norvegicus
gcatcgccatgtccatggaccggta

SEQ ID NO: 387325 - DNA, 25 bp, Rattus norvegicus
gcatcgccatgtgcatggaccggta

SEQ ID NO: 387326 - DNA, 25 bp, Rattus norvegicus
gcatcgcctactacatgtactcggg

SEQ ID NO: 387327 - DNA, 25 bp, Rattus norvegicus
gcatcgcctacttcatgtactcggg

SEQ ID NO: 387328 - DNA, 25 bp, Rattus norvegicus
gcatcgcctgcaaatactggatttc

SEQ ID NO: 387329 - DNA, 25 bp, Rattus norvegicus
gcatcgcctgcatatactggatttc

SEQ ID NO: 387330 - DNA, 25 bp, Rattus norvegicus
gcatcgcggtggcattctacggcaa

SEQ ID NO: 387331 - DNA, 25 bp, Rattus norvegicus
gcatcgcggtgggattctacggcaa

SEQ ID NO: 387332 - DNA, 25 bp, Rattus norvegicus
gcatcgctacggatcaacgagacaa

SEQ ID NO: 387333 - DNA, 25 bp, Rattus norvegicus
gcatcgctacggttcaacgagacaa

SEQ ID NO: 387334 - DNA, 25 bp, Rattus norvegicus
gcatcgctcagtctcaagtgtttga

SEQ ID NO: 387335 - DNA, 25 bp, Rattus norvegicus
gcatcgctcagtgtcaagtgtttga

SEQ ID NO: 387336 - DNA, 25 bp, Rattus norvegicus
gcatcgctgtttccactttgggctg

SEQ ID NO: 387337 - DNA, 25 bp, Rattus norvegicus
gcatcgctgtttgcactttgggctg

SEQ ID NO: 387338 - DNA, 25 bp, Rattus norvegicus
gcatcggcacagacagcagcgtaaa

SEQ ID NO: 387339 - DNA, 25 bp, Rattus norvegicus
gcatcggcacagtcagcagcgtaaa

SEQ ID NO: 387340 - DNA, 25 bp, Rattus norvegicus
gcatcggcacatccgtgtggagcaa

SEQ ID NO: 387341 - DNA, 25 bp, Rattus norvegicus
gcatcggcacatgcgtgtggagcaa

SEQ ID NO: 387342 - DNA, 25 bp, Rattus norvegicus
gcatcggccacacgagcatggtgaa

SEQ ID NO: 387343 - DNA, 25 bp, Rattus norvegicus
gcatcggccacaggagcatggtgaa

SEQ ID NO: 387344 - DNA, 25 bp, Rattus norvegicus
gcatcggccctgaaagagcatttac

SEQ ID NO: 387345 - DNA, 25 bp, Rattus norvegicus
gcatcggccctgtaagagcatttac

SEQ ID NO: 387346 - DNA, 25 bp, Rattus norvegicus
gcatcggctgcaatgtggtggataa

SEQ ID NO: 387347 - DNA, 25 bp, Rattus norvegicus
gcatcggctgcattgtggtggataa

SEQ ID NO: 387348 - DNA, 25 bp, Rattus norvegicus
gcatcggcttcaagtgtctttgaaa

SEQ ID NO: 387349 - DNA, 25 bp, Rattus norvegicus
gcatcggcttcatgtgtctttgaaa

SEQ ID NO: 387350 - DNA, 25 bp, Rattus norvegicus
gcatcgggaagacccgggacgcgcc

SEQ ID NO: 387351 - DNA, 25 bp, Rattus norvegicus
gcatcgggaagagccgggacgcgcc

SEQ ID NO: 387352 - DNA, 25 bp, Rattus norvegicus
gcatcgggactcatgccttaaggag

SEQ ID NO: 387353 - DNA, 25 bp, Rattus norvegicus
gcatcgggactcttgccttaaggag

SEQ ID NO: 387354 - DNA, 25 bp, Rattus norvegicus
gcatcgggattcatctactacgttc

SEQ ID NO: 387355 - DNA, 25 bp, Rattus norvegicus
gcatcgggattcttctactacgttc

SEQ ID NO: 387356 - DNA, 25 bp, Rattus norvegicus
gcatcgggtcctaaacgtcctggta

SEQ ID NO: 387357 - DNA, 25 bp, Rattus norvegicus
gcatcgggtcctaccagtggcgctg

SEQ ID NO: 387358 - DNA, 25 bp, Rattus norvegicus
gcatcgggtccttaacgtcctggta

SEQ ID NO: 387359 - DNA, 25 bp, Rattus norvegicus
gcatcgggtccttccagtggcgctg

SEQ ID NO: 387360 - DNA, 25 bp, Rattus norvegicus
gcatcggtaagcaggtaaatcctta

SEQ ID NO: 387361 - DNA, 25 bp, Rattus norvegicus
gcatcggtaagctggtaaatcctta

SEQ ID NO: 387362 - DNA, 25 bp, Rattus norvegicus
gcatcggtacttcagcaacgcttac

SEQ ID NO: 387363 - DNA, 25 bp, Rattus norvegicus
gcatcggtacttgagcaacgcttac

SEQ ID NO: 387364 - DNA, 25 bp, Rattus norvegicus
gcatcggtcaaacctggcctttgag

SEQ ID NO: 387365 - DNA, 25 bp, Rattus norvegicus
gcatcggtcaaagctggcctttgag

SEQ ID NO: 387366 - DNA, 25 bp, Rattus norvegicus
gcatcggtgtctacgtataaagctc

SEQ ID NO: 387367 - DNA, 25 bp, Rattus norvegicus
gcatcggtgtcttcgtataaagctc

SEQ ID NO: 387368 - DNA, 25 bp, Rattus norvegicus
gcatcggttgctagaactcacaagt

SEQ ID NO: 387369 - DNA, 25 bp, Rattus norvegicus
gcatcggttgcttgaactcacaagt

SEQ ID NO: 387370 - DNA, 25 bp, Rattus norvegicus
gcatcggttgtgatctggtcaggct

SEQ ID NO: 387371 - DNA, 25 bp, Rattus norvegicus
gcatcggttgtgttctggtcaggct

SEQ ID NO: 387372 - DNA, 25 bp, Rattus norvegicus
gcatcgtagtgcattgagagaggaa

SEQ ID NO: 387373 - DNA, 25 bp, Rattus norvegicus
gcatcgtagtgctttgagagaggaa

SEQ ID NO: 387374 - DNA, 25 bp, Rattus norvegicus
gcatcgtcctttaccatgtaacacg

SEQ ID NO: 387375 - DNA, 25 bp, Rattus norvegicus
gcatcgtccttttccatgtaacacg

SEQ ID NO: 387376 - DNA, 25 bp, Rattus norvegicus
gcatcgtctgatatgctgctactga

SEQ ID NO: 387377 - DNA, 25 bp, Rattus norvegicus
gcatcgtctgatttgctgctactga

SEQ ID NO: 387378 - DNA, 25 bp, Rattus norvegicus
gcatcgtgagctacggttccagtag

SEQ ID NO: 387379 - DNA, 25 bp, Rattus norvegicus
gcatcgtgagcttcggttccagtag

SEQ ID NO: 387380 - DNA, 25 bp, Rattus norvegicus
gcatcgtgagttcaagtgcagcctg

SEQ ID NO: 387381 - DNA, 25 bp, Rattus norvegicus
gcatcgtgagttgaagtgcagcctg

SEQ ID NO: 387382 - DNA, 25 bp, Rattus norvegicus
gcatcgtgatacatctgcattccag

SEQ ID NO: 387383 - DNA, 25 bp, Rattus norvegicus
gcatcgtgatacttctgcattccag

SEQ ID NO: 387384 - DNA, 25 bp, Rattus norvegicus
gcatcgtgcaacatgatctgaactt

SEQ ID NO: 387385 - DNA, 25 bp, Rattus norvegicus
gcatcgtgcaacttgatctgaactt

SEQ ID NO: 387386 - DNA, 25 bp, Rattus norvegicus
gcatcgtgcccacctgcggaagaaa

SEQ ID NO: 387387 - DNA, 25 bp, Rattus norvegicus
gcatcgtgcccagctgcggaagaaa

SEQ ID NO: 387388 - DNA, 25 bp, Rattus norvegicus
gcatcgtggagcacttggtgacttt

SEQ ID NO: 387389 - DNA, 25 bp, Rattus norvegicus
gcatcgtggagctcttggtgacttt

SEQ ID NO: 387390 - DNA, 25 bp, Rattus norvegicus
gcatcgtggccaactgacagcggtt

SEQ ID NO: 387391 - DNA, 25 bp, Rattus norvegicus
gcatcgtggccatctgacagcggtt

SEQ ID NO: 387392 - DNA, 25 bp, Rattus norvegicus
gcatcgtgtaggagtcccaggtgat

SEQ ID NO: 387393 - DNA, 25 bp, Rattus norvegicus
gcatcgtgtaggtgtcccaggtgat

SEQ ID NO: 387394 - DNA, 25 bp, Rattus norvegicus
gcatcgtttattctatgtcccatag

SEQ ID NO: 387395 - DNA, 25 bp, Rattus norvegicus
gcatcgtttattgtatgtcccatag

SEQ ID NO: 387396 - DNA, 25 bp, Rattus norvegicus
gcatcgtttcttaggttttctgtat

SEQ ID NO: 387397 - DNA, 25 bp, Rattus norvegicus
gcatcgtttctttggttttctgtat

SEQ ID NO: 387398 - DNA, 25 bp, Rattus norvegicus
gcatctaaagaacgcttgtttctgt

SEQ ID NO: 387399 - DNA, 25 bp, Rattus norvegicus
gcatctaaagaaggcttgtttctgt

SEQ ID NO: 387400 - DNA, 25 bp, Rattus norvegicus
gcatctaaatcccttgtctgtgtgt

SEQ ID NO: 387401 - DNA, 25 bp, Rattus norvegicus
gcatctaaatccgttgtctgtgtgt

SEQ ID NO: 387402 - DNA, 25 bp, Rattus norvegicus
gcatctaactagcatcgtatactta

SEQ ID NO: 387403 - DNA, 25 bp, Rattus norvegicus
gcatctaactaggatcgtatactta

SEQ ID NO: 387404 - DNA, 25 bp, Rattus norvegicus
gcatctaagaggattccccagtgga

SEQ ID NO: 387405 - DNA, 25 bp, Rattus norvegicus
gcatctaagaggtttccccagtgga

SEQ ID NO: 387406 - DNA, 25 bp, Rattus norvegicus
gcatctaatgtgagccggctgatat

SEQ ID NO: 387407 - DNA, 25 bp, Rattus norvegicus
gcatctaatgtgcaatttatcatcc

SEQ ID NO: 387408 - DNA, 25 bp, Rattus norvegicus
gcatctaatgtggaatttatcatcc

SEQ ID NO: 387409 - DNA, 25 bp, Rattus norvegicus
gcatctaatgtgtgccggctgatat

SEQ ID NO: 387410 - DNA, 25 bp, Rattus norvegicus
gcatctacaagcacaggactctcaa

SEQ ID NO: 387411 - DNA, 25 bp, Rattus norvegicus
gcatctacaagctcaggactctcaa

SEQ ID NO: 387412 - DNA, 25 bp, Rattus norvegicus
gcatctacagatccgctttgtacag

SEQ ID NO: 387413 - DNA, 25 bp, Rattus norvegicus
gcatctacagatgcgctttgtacag

SEQ ID NO: 387414 - DNA, 25 bp, Rattus norvegicus
gcatctacagctatttaagtcctct

SEQ ID NO: 387415 - DNA, 25 bp, Rattus norvegicus
gcatctacagctttttaagtcctct

SEQ ID NO: 387416 - DNA, 25 bp, Rattus norvegicus
gcatctacctggattttagtcccac

SEQ ID NO: 387417 - DNA, 25 bp, Rattus norvegicus
gcatctacctggtttttagtcccac

SEQ ID NO: 387418 - DNA, 25 bp, Rattus norvegicus
gcatctactgaaatcttggagtttc

SEQ ID NO: 387419 - DNA, 25 bp, Rattus norvegicus
gcatctactgaattcttggagtttc

SEQ ID NO: 387420 - DNA, 25 bp, Rattus norvegicus
gcatctactttgatctggacccgag

SEQ ID NO: 387421 - DNA, 25 bp, Rattus norvegicus
gcatctactttgttctggacccgag

SEQ ID NO: 387422 - DNA, 25 bp, Rattus norvegicus
gcatctagcccgaggttttgttttt

SEQ ID NO: 387423 - DNA, 25 bp, Rattus norvegicus
gcatctagcccgtggttttgttttt

SEQ ID NO: 387424 - DNA, 25 bp, Rattus norvegicus
gcatctagcttcacaagggacctaa

SEQ ID NO: 387425 - DNA, 25 bp, Rattus norvegicus
gcatctagcttctcaagggacctaa

SEQ ID NO: 387426 - DNA, 25 bp, Rattus norvegicus
gcatctagtgttatctccctgtgaa

SEQ ID NO: 387427 - DNA, 25 bp, Rattus norvegicus
gcatctagtgttttctccctgtgaa

SEQ ID NO: 387428 - DNA, 25 bp, Rattus norvegicus
gcatctatcaaacatcagagcattc

SEQ ID NO: 387429 - DNA, 25 bp, Rattus norvegicus
gcatctatcaaagatcagagcattc

SEQ ID NO: 387430 - DNA, 25 bp, Rattus norvegicus
gcatctatcatcctgatcttacaca

SEQ ID NO: 387431 - DNA, 25 bp, Rattus norvegicus
gcatctatcatcgtgatcttacaca

SEQ ID NO: 387432 - DNA, 25 bp, Rattus norvegicus
gcatctatctatctgcatgttggaa

SEQ ID NO: 387433 - DNA, 25 bp, Rattus norvegicus
gcatctatctatgtgcatgttggaa

SEQ ID NO: 387434 - DNA, 25 bp, Rattus norvegicus
gcatctatgagtctgctgcacagct

SEQ ID NO: 387435 - DNA, 25 bp, Rattus norvegicus
gcatctatgagtgtgctgcacagct

SEQ ID NO: 387436 - DNA, 25 bp, Rattus norvegicus
gcatctatgcctagaggtgccacgg

SEQ ID NO: 387437 - DNA, 25 bp, Rattus norvegicus
gcatctatgccttgaggtgccacgg

SEQ ID NO: 387438 - DNA, 25 bp, Rattus norvegicus
gcatctatgtgcaggccatcaacta

SEQ ID NO: 387439 - DNA, 25 bp, Rattus norvegicus
gcatctatgtgctggccatcaacta

SEQ ID NO: 387440 - DNA, 25 bp, Rattus norvegicus
gcatctattaaaacaagcagtcggt

SEQ ID NO: 387441 - DNA, 25 bp, Rattus norvegicus
gcatctattaaatcaagcagtcggt

SEQ ID NO: 387442 - DNA, 25 bp, Rattus norvegicus
gcatctattacccattgtctgtgtt

SEQ ID NO: 387443 - DNA, 25 bp, Rattus norvegicus
gcatctattaccgattgtctgtgtt

SEQ ID NO: 387444 - DNA, 25 bp, Rattus norvegicus
gcatctattagcacagtcaactccg

SEQ ID NO: 387445 - DNA, 25 bp, Rattus norvegicus
gcatctattagctcagtcaactccg

SEQ ID NO: 387446 - DNA, 25 bp, Rattus norvegicus
gcatctattatgagccacagtgtaa

SEQ ID NO: 387447 - DNA, 25 bp, Rattus norvegicus
gcatctattatgtgccacagtgtaa

SEQ ID NO: 387448 - DNA, 25 bp, Rattus norvegicus
gcatctattcagctcaagtattgtt

SEQ ID NO: 387449 - DNA, 25 bp, Rattus norvegicus
gcatctattcaggtcaagtattgtt

SEQ ID NO: 387450 - DNA, 25 bp, Rattus norvegicus
gcatctattgagaatgtcctgtaat

SEQ ID NO: 387451 - DNA, 25 bp, Rattus norvegicus
gcatctattgagtatgtcctgtaat

SEQ ID NO: 387452 - DNA, 25 bp, Rattus norvegicus
gcatctcaaaagagcatagctttct

SEQ ID NO: 387453 - DNA, 25 bp, Rattus norvegicus
gcatctcaaaagtgcatagctttct

SEQ ID NO: 387454 - DNA, 25 bp, Rattus norvegicus
gcatctcagagtaccagagccttga

SEQ ID NO: 387455 - DNA, 25 bp, Rattus norvegicus
gcatctcagagttccagagccttga

SEQ ID NO: 387456 - DNA, 25 bp, Rattus norvegicus
gcatctcagcatagtttaaactgta

SEQ ID NO: 387457 - DNA, 25 bp, Rattus norvegicus
gcatctcagcattgtttaaactgta

SEQ ID NO: 387458 - DNA, 25 bp, Rattus norvegicus
gcatctcaggaaaggtggctgccac

SEQ ID NO: 387459 - DNA, 25 bp, Rattus norvegicus
gcatctcaggaatggtggctgccac

SEQ ID NO: 387460 - DNA, 25 bp, Rattus norvegicus
gcatctcaggctcgcagtagaactt

SEQ ID NO: 387461 - DNA, 25 bp, Rattus norvegicus
gcatctcaggctggcagtagaactt

SEQ ID NO: 387462 - DNA, 25 bp, Rattus norvegicus
gcatctcagtggagcttagcatcta

SEQ ID NO: 387463 - DNA, 25 bp, Rattus norvegicus
gcatctcagtggtgcttagcatcta

SEQ ID NO: 387464 - DNA, 25 bp, Rattus norvegicus
gcatctcatatcatagtctctgtct

SEQ ID NO: 387465 - DNA, 25 bp, Rattus norvegicus
gcatctcatatcttagtctctgtct

SEQ ID NO: 387466 - DNA, 25 bp, Rattus norvegicus
gcatctcatgctaagtgttctggtg

SEQ ID NO: 387467 - DNA, 25 bp, Rattus norvegicus
gcatctcatgcttagtgttctggtg

SEQ ID NO: 387468 - DNA, 25 bp, Rattus norvegicus
gcatctcattctctcagaccaggta

SEQ ID NO: 387469 - DNA, 25 bp, Rattus norvegicus
gcatctcattctgtcagaccaggta

SEQ ID NO: 387470 - DNA, 25 bp, Rattus norvegicus
gcatctccaccaagacacagtgtag

SEQ ID NO: 387471 - DNA, 25 bp, Rattus norvegicus
gcatctccaccatgacacagtgtag

SEQ ID NO: 387472 - DNA, 25 bp, Rattus norvegicus
gcatctccagctatgtgtccaaaag

SEQ ID NO: 387473 - DNA, 25 bp, Rattus norvegicus
gcatctccagctttgtgtccaaaag

SEQ ID NO: 387474 - DNA, 25 bp, Rattus norvegicus
gcatctccaggacccgcatagtaga

SEQ ID NO: 387475 - DNA, 25 bp, Rattus norvegicus
gcatctccaggagccgcatagtaga

SEQ ID NO: 387476 - DNA, 25 bp, Rattus norvegicus
gcatctccagtcatttcaagtctac

SEQ ID NO: 387477 - DNA, 25 bp, Rattus norvegicus
gcatctccagtcttttcaagtctac

SEQ ID NO: 387478 - DNA, 25 bp, Rattus norvegicus
gcatctccagttacttcttgcaaaa

SEQ ID NO: 387479 - DNA, 25 bp, Rattus norvegicus
gcatctccagtttcttcttgcaaaa

SEQ ID NO: 387480 - DNA, 25 bp, Rattus norvegicus
gcatctccatgacactttctatgta

SEQ ID NO: 387481 - DNA, 25 bp, Rattus norvegicus
gcatctccatgagactttctatgta

SEQ ID NO: 387482 - DNA, 25 bp, Rattus norvegicus
gcatctcccaagaaggcaggagtgc

SEQ ID NO: 387483 - DNA, 25 bp, Rattus norvegicus
gcatctcccaagtaggcaggagtgc

SEQ ID NO: 387484 - DNA, 25 bp, Rattus norvegicus
gcatctcccattagatcacatggta

SEQ ID NO: 387485 - DNA, 25 bp, Rattus norvegicus
gcatctcccatttgatcacatggta

SEQ ID NO: 387486 - DNA, 25 bp, Rattus norvegicus
gcatctcctgtaagcctaatccaag

SEQ ID NO: 387487 - DNA, 25 bp, Rattus norvegicus
gcatctcctgtatgcctaatccaag

SEQ ID NO: 387488 - DNA, 25 bp, Rattus norvegicus
gcatctcctttacacttcttgagca

SEQ ID NO: 387489 - DNA, 25 bp, Rattus norvegicus
gcatctcctttagacttcttgagca

SEQ ID NO: 387490 - DNA, 25 bp, Rattus norvegicus
gcatctcgaacccatgggcactaga

SEQ ID NO: 387491 - DNA, 25 bp, Rattus norvegicus
gcatctcgaaccgatgggcactaga

SEQ ID NO: 387492 - DNA, 25 bp, Rattus norvegicus
gcatctcggagcagggtatttttgg

SEQ ID NO: 387493 - DNA, 25 bp, Rattus norvegicus
gcatctcggagctgggtatttttgg

SEQ ID NO: 387494 - DNA, 25 bp, Rattus norvegicus
gcatctcgtttgaggtagacatcat

SEQ ID NO: 387495 - DNA, 25 bp, Rattus norvegicus
gcatctcgtttgtggtagacatcat

SEQ ID NO: 387496 - DNA, 25 bp, Rattus norvegicus
gcatctctaagacctgtgacccagg

SEQ ID NO: 387497 - DNA, 25 bp, Rattus norvegicus
gcatctctaagagctgtgacccagg

SEQ ID NO: 387498 - DNA, 25 bp, Rattus norvegicus
gcatctctcacaacacatggatgat

SEQ ID NO: 387499 - DNA, 25 bp, Rattus norvegicus
gcatctctcacatcacatggatgat

SEQ ID NO: 387500 - DNA, 25 bp, Rattus norvegicus
gcatctctcagaacactggtctgtg

SEQ ID NO: 387501 - DNA, 25 bp, Rattus norvegicus
gcatctctcagatcactggtctgtg

SEQ ID NO: 387502 - DNA, 25 bp, Rattus norvegicus
gcatctctcctgataatcgcatgta

SEQ ID NO: 387503 - DNA, 25 bp, Rattus norvegicus
gcatctctcctgttaatcgcatgta

SEQ ID NO: 387504 - DNA, 25 bp, Rattus norvegicus
gcatctctcgtcacatgggcgacta

SEQ ID NO: 387505 - DNA, 25 bp, Rattus norvegicus
gcatctctcgtctcatgggcgacta

SEQ ID NO: 387506 - DNA, 25 bp, Rattus norvegicus
gcatctctctagactttactctcga

SEQ ID NO: 387507 - DNA, 25 bp, Rattus norvegicus
gcatctctctagtctttactctcga

SEQ ID NO: 387508 - DNA, 25 bp, Rattus norvegicus
gcatctctctctctaagggaaactc

SEQ ID NO: 387509 - DNA, 25 bp, Rattus norvegicus
gcatctctctctgtaagggaaactc

SEQ ID NO: 387510 - DNA, 25 bp, Rattus norvegicus
gcatctctctgacaccaagatacgt

SEQ ID NO: 387511 - DNA, 25 bp, Rattus norvegicus
gcatctctctgagaccaagatacgt

SEQ ID NO: 387512 - DNA, 25 bp, Rattus norvegicus
gcatctctgagaccgaaagcgacct

SEQ ID NO: 387513 - DNA, 25 bp, Rattus norvegicus
gcatctctgagagcgaaagcgacct

SEQ ID NO: 387514 - DNA, 25 bp, Rattus norvegicus
gcatctctgagcagcaagttcttaa

SEQ ID NO: 387515 - DNA, 25 bp, Rattus norvegicus
gcatctctgagcagcctctaatgaa

SEQ ID NO: 387516 - DNA, 25 bp, Rattus norvegicus
gcatctctgagctgcaagttcttaa

SEQ ID NO: 387517 - DNA, 25 bp, Rattus norvegicus
gcatctctgagctgcctctaatgaa

SEQ ID NO: 387518 - DNA, 25 bp, Rattus norvegicus
gcatctctgcgaacgattttcattt

SEQ ID NO: 387519 - DNA, 25 bp, Rattus norvegicus
gcatctctgcgatcgattttcattt

SEQ ID NO: 387520 - DNA, 25 bp, Rattus norvegicus
gcatctctgcggaggagctctgaca

SEQ ID NO: 387521 - DNA, 25 bp, Rattus norvegicus
gcatctctgcggtggagctctgaca

SEQ ID NO: 387522 - DNA, 25 bp, Rattus norvegicus
gcatctctggttagttcattcttaa

SEQ ID NO: 387523 - DNA, 25 bp, Rattus norvegicus
gcatctctggtttgttcattcttaa

SEQ ID NO: 387524 - DNA, 25 bp, Rattus norvegicus
gcatctctgttcagccaattacatg

SEQ ID NO: 387525 - DNA, 25 bp, Rattus norvegicus
gcatctctgttctgccaattacatg

SEQ ID NO: 387526 - DNA, 25 bp, Rattus norvegicus
gcatctcttcctactgaaatttttt

SEQ ID NO: 387527 - DNA, 25 bp, Rattus norvegicus
gcatctcttccttctgaaatttttt

SEQ ID NO: 387528 - DNA, 25 bp, Rattus norvegicus
gcatctcttgaaaaggtacactgaa

SEQ ID NO: 387529 - DNA, 25 bp, Rattus norvegicus
gcatctcttgaacctcttcatttgg

SEQ ID NO: 387530 - DNA, 25 bp, Rattus norvegicus
gcatctcttgaagctcttcatttgg

SEQ ID NO: 387531 - DNA, 25 bp, Rattus norvegicus
gcatctcttgaataggtacactgaa

SEQ ID NO: 387532 - DNA, 25 bp, Rattus norvegicus
gcatctcttgagaccccatttgaag

SEQ ID NO: 387533 - DNA, 25 bp, Rattus norvegicus
gcatctcttgagtccccatttgaag

SEQ ID NO: 387534 - DNA, 25 bp, Rattus norvegicus
gcatctcttgggattttgttgtcat

SEQ ID NO: 387535 - DNA, 25 bp, Rattus norvegicus
gcatctcttgggtttttgttgtcat

SEQ ID NO: 387536 - DNA, 25 bp, Rattus norvegicus
gcatctcttggtctagttttacagt

SEQ ID NO: 387537 - DNA, 25 bp, Rattus norvegicus
gcatctcttggtgtagttttacagt

SEQ ID NO: 387538 - DNA, 25 bp, Rattus norvegicus
gcatctgaaccaagactgattctca

SEQ ID NO: 387539 - DNA, 25 bp, Rattus norvegicus
gcatctgaaccatgactgattctca

SEQ ID NO: 387540 - DNA, 25 bp, Rattus norvegicus
gcatctgacttcaaagttcgcctta

SEQ ID NO: 387541 - DNA, 25 bp, Rattus norvegicus
gcatctgacttctaagttcgcctta

SEQ ID NO: 387542 - DNA, 25 bp, Rattus norvegicus
gcatctgagagtccttcaagccagt

SEQ ID NO: 387543 - DNA, 25 bp, Rattus norvegicus
gcatctgagagtgcttcaagccagt

SEQ ID NO: 387544 - DNA, 25 bp, Rattus norvegicus
gcatctgaggtcatctataagagcc

SEQ ID NO: 387545 - DNA, 25 bp, Rattus norvegicus
gcatctgaggtcttctataagagcc

SEQ ID NO: 387546 - DNA, 25 bp, Rattus norvegicus
gcatctgagtatctgccagaagcct

SEQ ID NO: 387547 - DNA, 25 bp, Rattus norvegicus
gcatctgagtatgtgccagaagcct

SEQ ID NO: 387548 - DNA, 25 bp, Rattus norvegicus
gcatctgatatgaactcttctgttt

SEQ ID NO: 387549 - DNA, 25 bp, Rattus norvegicus
gcatctgatatgtactcttctgttt

SEQ ID NO: 387550 - DNA, 25 bp, Rattus norvegicus
gcatctgattcccatgttctgaaat

SEQ ID NO: 387551 - DNA, 25 bp, Rattus norvegicus
gcatctgattccgatgttctgaaat

SEQ ID NO: 387552 - DNA, 25 bp, Rattus norvegicus
gcatctgattttcgtcctggtgcca

SEQ ID NO: 387553 - DNA, 25 bp, Rattus norvegicus
gcatctgattttggtcctggtgcca

SEQ ID NO: 387554 - DNA, 25 bp, Rattus norvegicus
gcatctgcaattatctgagctatta

SEQ ID NO: 387555 - DNA, 25 bp, Rattus norvegicus
gcatctgcaattttctgagctatta

SEQ ID NO: 387556 - DNA, 25 bp, Rattus norvegicus
gcatctgcagtaaaggctggccagc

SEQ ID NO: 387557 - DNA, 25 bp, Rattus norvegicus
gcatctgcagtataggctggccagc

SEQ ID NO: 387558 - DNA, 25 bp, Rattus norvegicus
gcatctgcatgcatatgtgacagta

SEQ ID NO: 387559 - DNA, 25 bp, Rattus norvegicus
gcatctgcatgcttatgtgacagta

SEQ ID NO: 387560 - DNA, 25 bp, Rattus norvegicus
gcatctgcatggactctggaggctt

SEQ ID NO: 387561 - DNA, 25 bp, Rattus norvegicus
gcatctgcatggaggacactggtgt

SEQ ID NO: 387562 - DNA, 25 bp, Rattus norvegicus
gcatctgcatggtctctggaggctt

SEQ ID NO: 387563 - DNA, 25 bp, Rattus norvegicus
gcatctgcatggtggacactggtgt

SEQ ID NO: 387564 - DNA, 25 bp, Rattus norvegicus
gcatctgcattcacagtgctgggaa

SEQ ID NO: 387565 - DNA, 25 bp, Rattus norvegicus
gcatctgcattctcagtgctgggaa

SEQ ID NO: 387566 - DNA, 25 bp, Rattus norvegicus
gcatctgcattgacattatcgtcat

SEQ ID NO: 387567 - DNA, 25 bp, Rattus norvegicus
gcatctgcattgtcattatcgtcat

SEQ ID NO: 387568 - DNA, 25 bp, Rattus norvegicus
gcatctgcatttattgctaaggcaa

SEQ ID NO: 387569 - DNA, 25 bp, Rattus norvegicus
gcatctgcatttcagctttgtatct

SEQ ID NO: 387570 - DNA, 25 bp, Rattus norvegicus
gcatctgcatttgagctttgtatct

SEQ ID NO: 387571 - DNA, 25 bp, Rattus norvegicus
gcatctgcattttttgctaaggcaa

SEQ ID NO: 387572 - DNA, 25 bp, Rattus norvegicus
gcatctgccacaaaaatgttcactt

SEQ ID NO: 387573 - DNA, 25 bp, Rattus norvegicus
gcatctgccacataaatgttcactt

SEQ ID NO: 387574 - DNA, 25 bp, Rattus norvegicus
gcatctgccaggaaagctgcttcgt

SEQ ID NO: 387575 - DNA, 25 bp, Rattus norvegicus
gcatctgccaggtaagctgcttcgt

SEQ ID NO: 387576 - DNA, 25 bp, Rattus norvegicus
gcatctgcccacatagtgctcttta

SEQ ID NO: 387577 - DNA, 25 bp, Rattus norvegicus
gcatctgcccacttagtgctcttta

SEQ ID NO: 387578 - DNA, 25 bp, Rattus norvegicus
gcatctgccgcacaccttcgatttg

SEQ ID NO: 387579 - DNA, 25 bp, Rattus norvegicus
gcatctgccgcagaccttcgatttg

SEQ ID NO: 387580 - DNA, 25 bp, Rattus norvegicus
gcatctgctcctactagactactag

SEQ ID NO: 387581 - DNA, 25 bp, Rattus norvegicus
gcatctgctccttctagactactag

SEQ ID NO: 387582 - DNA, 25 bp, Rattus norvegicus
gcatctgctctcactaccaactgga

SEQ ID NO: 387583 - DNA, 25 bp, Rattus norvegicus
gcatctgctctctctaccaactgga

SEQ ID NO: 387584 - DNA, 25 bp, Rattus norvegicus
gcatctgctgagctcggcttgagat

SEQ ID NO: 387585 - DNA, 25 bp, Rattus norvegicus
gcatctgctgaggtcggcttgagat

SEQ ID NO: 387586 - DNA, 25 bp, Rattus norvegicus
gcatctgcttgtcaggtgtggccaa

SEQ ID NO: 387587 - DNA, 25 bp, Rattus norvegicus
gcatctgcttgtgaggtgtggccaa

SEQ ID NO: 387588 - DNA, 25 bp, Rattus norvegicus
gcatctggacacagtgcctctagtc

SEQ ID NO: 387589 - DNA, 25 bp, Rattus norvegicus
gcatctggacactgtgcctctagtc

SEQ ID NO: 387590 - DNA, 25 bp, Rattus norvegicus
gcatctggagaccaggcctgcatcc

SEQ ID NO: 387591 - DNA, 25 bp, Rattus norvegicus
gcatctggagacgaggcctgcatcc

SEQ ID NO: 387592 - DNA, 25 bp, Rattus norvegicus
gcatctggagtaagcacttttctgg

SEQ ID NO: 387593 - DNA, 25 bp, Rattus norvegicus
gcatctggagtatgcacttttctgg

SEQ ID NO: 387594 - DNA, 25 bp, Rattus norvegicus
gcatctggagtcaggttgccacctt

SEQ ID NO: 387595 - DNA, 25 bp, Rattus norvegicus
gcatctggagtctggttgccacctt

SEQ ID NO: 387596 - DNA, 25 bp, Rattus norvegicus
gcatctggctggaggcatcgacagt

SEQ ID NO: 387597 - DNA, 25 bp, Rattus norvegicus
gcatctggctggtggcatcgacagt

SEQ ID NO: 387598 - DNA, 25 bp, Rattus norvegicus
gcatctgggcagagtagaccacaaa

SEQ ID NO: 387599 - DNA, 25 bp, Rattus norvegicus
gcatctgggcagtgtagaccacaaa

SEQ ID NO: 387600 - DNA, 25 bp, Rattus norvegicus
gcatctggtagaactagcttttcat

SEQ ID NO: 387601 - DNA, 25 bp, Rattus norvegicus
gcatctggtagatctagcttttcat

SEQ ID NO: 387602 - DNA, 25 bp, Rattus norvegicus
gcatctggtgaaagatcctgacctt

SEQ ID NO: 387603 - DNA, 25 bp, Rattus norvegicus
gcatctggtgaatgatcctgacctt

SEQ ID NO: 387604 - DNA, 25 bp, Rattus norvegicus
gcatctggtgatcgcagggaatcca

SEQ ID NO: 387605 - DNA, 25 bp, Rattus norvegicus
gcatctggtgatggcagggaatcca

SEQ ID NO: 387606 - DNA, 25 bp, Rattus norvegicus
gcatctggttctcaagctcggtgaa

SEQ ID NO: 387607 - DNA, 25 bp, Rattus norvegicus
gcatctggttctgaagctcggtgaa

SEQ ID NO: 387608 - DNA, 25 bp, Rattus norvegicus
gcatctggttggagtgcgcgcacat

SEQ ID NO: 387609 - DNA, 25 bp, Rattus norvegicus
gcatctggttggtgtgcgcgcacat

SEQ ID NO: 387610 - DNA, 25 bp, Rattus norvegicus
gcatctgtaactacttttccaggtt

SEQ ID NO: 387611 - DNA, 25 bp, Rattus norvegicus
gcatctgtaacttcttttccaggtt

SEQ ID NO: 387612 - DNA, 25 bp, Rattus norvegicus
gcatctgtagagcagctggatcgaa

SEQ ID NO: 387613 - DNA, 25 bp, Rattus norvegicus
gcatctgtagaggagctggatcgaa

SEQ ID NO: 387614 - DNA, 25 bp, Rattus norvegicus
gcatctgtatgacccctgagtccta

SEQ ID NO: 387615 - DNA, 25 bp, Rattus norvegicus
gcatctgtatgagccctgagtccta

SEQ ID NO: 387616 - DNA, 25 bp, Rattus norvegicus
gcatctgtcactcctgattgcattt

SEQ ID NO: 387617 - DNA, 25 bp, Rattus norvegicus
gcatctgtcactctagcacttggga

SEQ ID NO: 387618 - DNA, 25 bp, Rattus norvegicus
gcatctgtcactgctgattgcattt

SEQ ID NO: 387619 - DNA, 25 bp, Rattus norvegicus
gcatctgtcactgtagcacttggga

SEQ ID NO: 387620 - DNA, 25 bp, Rattus norvegicus
gcatctgtccagatgttcagtatct

SEQ ID NO: 387621 - DNA, 25 bp, Rattus norvegicus
gcatctgtccagttgttcagtatct

SEQ ID NO: 387622 - DNA, 25 bp, Rattus norvegicus
gcatctgtctagagttgtcttcatc

SEQ ID NO: 387623 - DNA, 25 bp, Rattus norvegicus
gcatctgtctagtgttgtcttcatc

SEQ ID NO: 387624 - DNA, 25 bp, Rattus norvegicus
gcatctgtgatgactaagcctttga

SEQ ID NO: 387625 - DNA, 25 bp, Rattus norvegicus
gcatctgtgatgtctaagcctttga

SEQ ID NO: 387626 - DNA, 25 bp, Rattus norvegicus
gcatctgtgccgacagccgttagca

SEQ ID NO: 387627 - DNA, 25 bp, Rattus norvegicus
gcatctgtgccgtcagccgttagca

SEQ ID NO: 387628 - DNA, 25 bp, Rattus norvegicus
gcatctgtgctaagtcaatgtagaa

SEQ ID NO: 387629 - DNA, 25 bp, Rattus norvegicus
gcatctgtgctatgtcaatgtagaa

SEQ ID NO: 387630 - DNA, 25 bp, Rattus norvegicus
gcatctgtgcttacctgagcaagag

SEQ ID NO: 387631 - DNA, 25 bp, Rattus norvegicus
gcatctgtgctttcctgagcaagag

SEQ ID NO: 387632 - DNA, 25 bp, Rattus norvegicus
gcatctgtggatagtatatggcata

SEQ ID NO: 387633 - DNA, 25 bp, Rattus norvegicus
gcatctgtggattgtatatggcata

SEQ ID NO: 387634 - DNA, 25 bp, Rattus norvegicus
gcatctgtgtacatgctaccatgaa

SEQ ID NO: 387635 - DNA, 25 bp, Rattus norvegicus
gcatctgtgtacttgctaccatgaa

SEQ ID NO: 387636 - DNA, 25 bp, Rattus norvegicus
gcatctgtgtccaccagcggaaagg

SEQ ID NO: 387637 - DNA, 25 bp, Rattus norvegicus
gcatctgtgtcctccagcggaaagg

SEQ ID NO: 387638 - DNA, 25 bp, Rattus norvegicus
gcatctgttggtacttccagttaac

SEQ ID NO: 387639 - DNA, 25 bp, Rattus norvegicus
gcatctgttggttcttccagttaac

SEQ ID NO: 387640 - DNA, 25 bp, Rattus norvegicus
gcatctgttttaatcctgtggcttt

SEQ ID NO: 387641 - DNA, 25 bp, Rattus norvegicus
gcatctgttttattcctgtggcttt

SEQ ID NO: 387642 - DNA, 25 bp, Rattus norvegicus
gcatcttaactgcaagacccgatgg

SEQ ID NO: 387643 - DNA, 25 bp, Rattus norvegicus
gcatcttaactggaagacccgatgg

SEQ ID NO: 387644 - DNA, 25 bp, Rattus norvegicus
gcatcttactgacccgatattctaa

SEQ ID NO: 387645 - DNA, 25 bp, Rattus norvegicus
gcatcttactgagccgatattctaa

SEQ ID NO: 387646 - DNA, 25 bp, Rattus norvegicus
gcatcttagacacactcccagtggg

SEQ ID NO: 387647 - DNA, 25 bp, Rattus norvegicus
gcatcttagacagactcccagtggg

SEQ ID NO: 387648 - DNA, 25 bp, Rattus norvegicus
gcatcttagattacattctcagcga

SEQ ID NO: 387649 - DNA, 25 bp, Rattus norvegicus
gcatcttagatttcattctcagcga

SEQ ID NO: 387650 - DNA, 25 bp, Rattus norvegicus
gcatcttattgtacatccaggcctt

SEQ ID NO: 387651 - DNA, 25 bp, Rattus norvegicus
gcatcttattgttcatccaggcctt

SEQ ID NO: 387652 - DNA, 25 bp, Rattus norvegicus
gcatcttcactcctgtttcatggat

SEQ ID NO: 387653 - DNA, 25 bp, Rattus norvegicus
gcatcttcactcgtgtttcatggat

SEQ ID NO: 387654 - DNA, 25 bp, Rattus norvegicus
gcatcttcagacaattacctaccag

SEQ ID NO: 387655 - DNA, 25 bp, Rattus norvegicus
gcatcttcagactattacctaccag

SEQ ID NO: 387656 - DNA, 25 bp, Rattus norvegicus
gcatcttcatgtaaccaagaccatt

SEQ ID NO: 387657 - DNA, 25 bp, Rattus norvegicus
gcatcttcatgttaccaagaccatt

SEQ ID NO: 387658 - DNA, 25 bp, Rattus norvegicus
gcatcttcctctcttcaagacttta

SEQ ID NO: 387659 - DNA, 25 bp, Rattus norvegicus
gcatcttcctctgttcaagacttta

SEQ ID NO: 387660 - DNA, 25 bp, Rattus norvegicus
gcatcttcgaatattctccttgaga

SEQ ID NO: 387661 - DNA, 25 bp, Rattus norvegicus
gcatcttcgaattttctccttgaga

SEQ ID NO: 387662 - DNA, 25 bp, Rattus norvegicus
gcatcttcgcttcagggacgagcag

SEQ ID NO: 387663 - DNA, 25 bp, Rattus norvegicus
gcatcttcgcttgagggacgagcag

SEQ ID NO: 387664 - DNA, 25 bp, Rattus norvegicus
gcatcttcgggcatgggtatctctg

SEQ ID NO: 387665 - DNA, 25 bp, Rattus norvegicus
gcatcttcgggcttgggtatctctg

SEQ ID NO: 387666 - DNA, 25 bp, Rattus norvegicus
gcatcttctaagactgtcagtggtg

SEQ ID NO: 387667 - DNA, 25 bp, Rattus norvegicus
gcatcttctaagtctgtcagtggtg

SEQ ID NO: 387668 - DNA, 25 bp, Rattus norvegicus
gcatcttctcttcagggagcaattt

SEQ ID NO: 387669 - DNA, 25 bp, Rattus norvegicus
gcatcttctcttgagggagcaattt

SEQ ID NO: 387670 - DNA, 25 bp, Rattus norvegicus
gcatcttctggtacacttgttagca

SEQ ID NO: 387671 - DNA, 25 bp, Rattus norvegicus
gcatcttctggttcacttgttagca

SEQ ID NO: 387672 - DNA, 25 bp, Rattus norvegicus
gcatcttctgtcagttcattcctac

SEQ ID NO: 387673 - DNA, 25 bp, Rattus norvegicus
gcatcttctgtctgttcattcctac

SEQ ID NO: 387674 - DNA, 25 bp, Rattus norvegicus
gcatcttctgtgaactttttaggtc

SEQ ID NO: 387675 - DNA, 25 bp, Rattus norvegicus
gcatcttctgtgacatcccaaggac

SEQ ID NO: 387676 - DNA, 25 bp, Rattus norvegicus
gcatcttctgtgtactttttaggtc

SEQ ID NO: 387677 - DNA, 25 bp, Rattus norvegicus
gcatcttctgtgtcatcccaaggac

SEQ ID NO: 387678 - DNA, 25 bp, Rattus norvegicus
gcatcttctgttccagttcattttt

SEQ ID NO: 387679 - DNA, 25 bp, Rattus norvegicus
gcatcttctgttgcagttcattttt

SEQ ID NO: 387680 - DNA, 25 bp, Rattus norvegicus
gcatcttcttcgaggacgccgagcg

SEQ ID NO: 387681 - DNA, 25 bp, Rattus norvegicus
gcatcttcttcgtggacgccgagcg

SEQ ID NO: 387682 - DNA, 25 bp, Rattus norvegicus
gcatcttgagatctattcttcatac

SEQ ID NO: 387683 - DNA, 25 bp, Rattus norvegicus
gcatcttgagatgtattcttcatac

SEQ ID NO: 387684 - DNA, 25 bp, Rattus norvegicus
gcatcttgagttagtggctagccaa

SEQ ID NO: 387685 - DNA, 25 bp, Rattus norvegicus
gcatcttgagtttgtggctagccaa

SEQ ID NO: 387686 - DNA, 25 bp, Rattus norvegicus
gcatcttgataacactatgcccagc

SEQ ID NO: 387687 - DNA, 25 bp, Rattus norvegicus
gcatcttgataagactatgcccagc

SEQ ID NO: 387688 - DNA, 25 bp, Rattus norvegicus
gcatcttgcaatattctttttcgaa

SEQ ID NO: 387689 - DNA, 25 bp, Rattus norvegicus
gcatcttgcaattttctttttcgaa

SEQ ID NO: 387690 - DNA, 25 bp, Rattus norvegicus
gcatcttgccaccttgtttacaaaa

SEQ ID NO: 387691 - DNA, 25 bp, Rattus norvegicus
gcatcttgccacgttgtttacaaaa

SEQ ID NO: 387692 - DNA, 25 bp, Rattus norvegicus
gcatcttgcctaacactggagttca

SEQ ID NO: 387693 - DNA, 25 bp, Rattus norvegicus
gcatcttgcctatcactggagttca

SEQ ID NO: 387694 - DNA, 25 bp, Rattus norvegicus
gcatcttgctcaaccctgtaagata

SEQ ID NO: 387695 - DNA, 25 bp, Rattus norvegicus
gcatcttgctcatccctgtaagata

SEQ ID NO: 387696 - DNA, 25 bp, Rattus norvegicus
gcatcttgcttaatttctgtgttct

SEQ ID NO: 387697 - DNA, 25 bp, Rattus norvegicus
gcatcttgcttattttctgtgttct

SEQ ID NO: 387698 - DNA, 25 bp, Rattus norvegicus
gcatcttggaacacgacttgaacat

SEQ ID NO: 387699 - DNA, 25 bp, Rattus norvegicus
gcatcttggaactcgacttgaacat

SEQ ID NO: 387700 - DNA, 25 bp, Rattus norvegicus
gcatcttggactatggaccttgggc

SEQ ID NO: 387701 - DNA, 25 bp, Rattus norvegicus
gcatcttggactttggaccttgggc

SEQ ID NO: 387702 - DNA, 25 bp, Rattus norvegicus
gcatcttgggccaacagaacagctc

SEQ ID NO: 387703 - DNA, 25 bp, Rattus norvegicus
gcatcttgggcctacagaacagctc

SEQ ID NO: 387704 - DNA, 25 bp, Rattus norvegicus
gcatcttggtgtccagcccgaggtt

SEQ ID NO: 387705 - DNA, 25 bp, Rattus norvegicus
gcatcttggtgtgcagcccgaggtt

SEQ ID NO: 387706 - DNA, 25 bp, Rattus norvegicus
gcatcttgtccaagctggagttggc

SEQ ID NO: 387707 - DNA, 25 bp, Rattus norvegicus
gcatcttgtccatgctggagttggc

SEQ ID NO: 387708 - DNA, 25 bp, Rattus norvegicus
gcatcttgtcccctctgggtcggag

SEQ ID NO: 387709 - DNA, 25 bp, Rattus norvegicus
gcatcttgtcccgtctgggtcggag

SEQ ID NO: 387710 - DNA, 25 bp, Rattus norvegicus
gcatcttgtttacgcctgggaactt

SEQ ID NO: 387711 - DNA, 25 bp, Rattus norvegicus
gcatcttgtttaggcctgggaactt

SEQ ID NO: 387712 - DNA, 25 bp, Rattus norvegicus
gcatctttaagaatttgagccaact

SEQ ID NO: 387713 - DNA, 25 bp, Rattus norvegicus
gcatctttaagattttgagccaact

SEQ ID NO: 387714 - DNA, 25 bp, Rattus norvegicus
gcatctttacacacttgcacaaaaa

SEQ ID NO: 387715 - DNA, 25 bp, Rattus norvegicus
gcatctttacactcttgcacaaaaa

SEQ ID NO: 387716 - DNA, 25 bp, Rattus norvegicus
gcatctttatgaattggtgctacct

SEQ ID NO: 387717 - DNA, 25 bp, Rattus norvegicus
gcatctttatgatttggtgctacct

SEQ ID NO: 387718 - DNA, 25 bp, Rattus norvegicus
gcatctttcattacttcttcactaa

SEQ ID NO: 387719 - DNA, 25 bp, Rattus norvegicus
gcatctttcatttcttcttcactaa

SEQ ID NO: 387720 - DNA, 25 bp, Rattus norvegicus
gcatctttctgtcctgagaagtaaa

SEQ ID NO: 387721 - DNA, 25 bp, Rattus norvegicus
gcatctttctgtgctgagaagtaaa

SEQ ID NO: 387722 - DNA, 25 bp, Rattus norvegicus
gcatctttctttaaccatgtttcag

SEQ ID NO: 387723 - DNA, 25 bp, Rattus norvegicus
gcatctttcttttaccatgtttcag

SEQ ID NO: 387724 - DNA, 25 bp, Rattus norvegicus
gcatctttgcaaatactgaggtggg

SEQ ID NO: 387725 - DNA, 25 bp, Rattus norvegicus
gcatctttgcaattactgaggtggg

SEQ ID NO: 387726 - DNA, 25 bp, Rattus norvegicus
gcatctttgggtacctttcaacaga

SEQ ID NO: 387727 - DNA, 25 bp, Rattus norvegicus
gcatctttgggttcctttcaacaga

SEQ ID NO: 387728 - DNA, 25 bp, Rattus norvegicus
gcatctttgtctctgttggtgtaaa

SEQ ID NO: 387729 - DNA, 25 bp, Rattus norvegicus
gcatctttgtctgtgttggtgtaaa

SEQ ID NO: 387730 - DNA, 25 bp, Rattus norvegicus
gcatcttttactctacaccggagtt

SEQ ID NO: 387731 - DNA, 25 bp, Rattus norvegicus
gcatcttttactgtacaccggagtt

SEQ ID NO: 387732 - DNA, 25 bp, Rattus norvegicus
gcatcttttataactacctggtgaa

SEQ ID NO: 387733 - DNA, 25 bp, Rattus norvegicus
gcatcttttatatctacctggtgaa

SEQ ID NO: 387734 - DNA, 25 bp, Rattus norvegicus
gcatcttttgcaaagtgcggttcag

SEQ ID NO: 387735 - DNA, 25 bp, Rattus norvegicus
gcatcttttgcatagtgcggttcag

SEQ ID NO: 387736 - DNA, 25 bp, Rattus norvegicus
gcatcttttgcccatggactgtggt

SEQ ID NO: 387737 - DNA, 25 bp, Rattus norvegicus
gcatcttttgccgatggactgtggt

SEQ ID NO: 387738 - DNA, 25 bp, Rattus norvegicus
gcatctttttctccatgtccttcta

SEQ ID NO: 387739 - DNA, 25 bp, Rattus norvegicus
gcatctttttctgcatgtccttcta

SEQ ID NO: 387740 - DNA, 25 bp, Rattus norvegicus
gcatgaaaagctatgtcgcagacaa

SEQ ID NO: 387741 - DNA, 25 bp, Rattus norvegicus
gcatgaaaagctttgtcgcagacaa

SEQ ID NO: 387742 - DNA, 25 bp, Rattus norvegicus
gcatgaaaccgtctctcattccaaa

SEQ ID NO: 387743 - DNA, 25 bp, Rattus norvegicus
gcatgaaaccgtgtctcattccaaa

SEQ ID NO: 387744 - DNA, 25 bp, Rattus norvegicus
gcatgaaatgggatcctgcatcact

SEQ ID NO: 387745 - DNA, 25 bp, Rattus norvegicus
gcatgaaatgggttcctgcatcact

SEQ ID NO: 387746 - DNA, 25 bp, Rattus norvegicus
gcatgaaattacatttgaactccat

SEQ ID NO: 387747 - DNA, 25 bp, Rattus norvegicus
gcatgaaattacttttgaactccat

SEQ ID NO: 387748 - DNA, 25 bp, Rattus norvegicus
gcatgaaccaggatgggctcacgcc

SEQ ID NO: 387749 - DNA, 25 bp, Rattus norvegicus
gcatgaaccaggttgggctcacgcc

SEQ ID NO: 387750 - DNA, 25 bp, Rattus norvegicus
gcatgaacccacagaattagaccta

SEQ ID NO: 387751 - DNA, 25 bp, Rattus norvegicus
gcatgaacccactgaattagaccta

SEQ ID NO: 387752 - DNA, 25 bp, Rattus norvegicus
gcatgaacccctcagtgaactagtg

SEQ ID NO: 387753 - DNA, 25 bp, Rattus norvegicus
gcatgaacccctgagtgaactagtg

SEQ ID NO: 387754 - DNA, 25 bp, Rattus norvegicus
gcatgaacccggagcgctcgtggat

SEQ ID NO: 387755 - DNA, 25 bp, Rattus norvegicus
gcatgaacccggtgcgctcgtggat

SEQ ID NO: 387756 - DNA, 25 bp, Rattus norvegicus
gcatgaaccctacgtggaccttgta

SEQ ID NO: 387757 - DNA, 25 bp, Rattus norvegicus
gcatgaaccctaggtggaccttgta

SEQ ID NO: 387758 - DNA, 25 bp, Rattus norvegicus
gcatgaaccttgcaagacctttcta

SEQ ID NO: 387759 - DNA, 25 bp, Rattus norvegicus
gcatgaaccttggaagacctttcta

SEQ ID NO: 387760 - DNA, 25 bp, Rattus norvegicus
gcatgaacttgtcaggaggacccag

SEQ ID NO: 387761 - DNA, 25 bp, Rattus norvegicus
gcatgaacttgtgaggaggacccag

SEQ ID NO: 387762 - DNA, 25 bp, Rattus norvegicus
gcatgaagactaatccactctgagt

SEQ ID NO: 387763 - DNA, 25 bp, Rattus norvegicus
gcatgaagactattccactctgagt

SEQ ID NO: 387764 - DNA, 25 bp, Rattus norvegicus
gcatgaagagaaacccagagctggt

SEQ ID NO: 387765 - DNA, 25 bp, Rattus norvegicus
gcatgaagagaatcccagagctggt

SEQ ID NO: 387766 - DNA, 25 bp, Rattus norvegicus
gcatgaagcatgcattccttccttt

SEQ ID NO: 387767 - DNA, 25 bp, Rattus norvegicus
gcatgaagcatggattccttccttt

SEQ ID NO: 387768 - DNA, 25 bp, Rattus norvegicus
gcatgaagccctcaactttattcct

SEQ ID NO: 387769 - DNA, 25 bp, Rattus norvegicus
gcatgaagccctgaactttattcct

SEQ ID NO: 387770 - DNA, 25 bp, Rattus norvegicus
gcatgaagggcaaccagctgtggaa

SEQ ID NO: 387771 - DNA, 25 bp, Rattus norvegicus
gcatgaagggcatccagctgtggaa

SEQ ID NO: 387772 - DNA, 25 bp, Rattus norvegicus
gcatgaaggtttagcagtcagtccc

SEQ ID NO: 387773 - DNA, 25 bp, Rattus norvegicus
gcatgaaggttttgcagtcagtccc

SEQ ID NO: 387774 - DNA, 25 bp, Rattus norvegicus
gcatgaagtcatcctaaagcacaca

SEQ ID NO: 387775 - DNA, 25 bp, Rattus norvegicus
gcatgaagtcatgctaaagcacaca

SEQ ID NO: 387776 - DNA, 25 bp, Rattus norvegicus
gcatgaagttgacatcctgtagtat

SEQ ID NO: 387777 - DNA, 25 bp, Rattus norvegicus
gcatgaagttgagatcctgtagtat

SEQ ID NO: 387778 - DNA, 25 bp, Rattus norvegicus
gcatgaataaccacagactgcccct

SEQ ID NO: 387779 - DNA, 25 bp, Rattus norvegicus
gcatgaataacctcagactgcccct

SEQ ID NO: 387780 - DNA, 25 bp, Rattus norvegicus
gcatgaatcaagacagccatagtta

SEQ ID NO: 387781 - DNA, 25 bp, Rattus norvegicus
gcatgaatcaagtcagccatagtta

SEQ ID NO: 387782 - DNA, 25 bp, Rattus norvegicus
gcatgaatcggaagcgatgcctcca

SEQ ID NO: 387783 - DNA, 25 bp, Rattus norvegicus
gcatgaatcggatgcgatgcctcca

SEQ ID NO: 387784 - DNA, 25 bp, Rattus norvegicus
gcatgaatcttcatgtgtctccgaa

SEQ ID NO: 387785 - DNA, 25 bp, Rattus norvegicus
gcatgaatcttcttgtgtctccgaa

SEQ ID NO: 387786 - DNA, 25 bp, Rattus norvegicus
gcatgaatgcagatgtgacttgtca

SEQ ID NO: 387787 - DNA, 25 bp, Rattus norvegicus
gcatgaatgcagttgtgacttgtca

SEQ ID NO: 387788 - DNA, 25 bp, Rattus norvegicus
gcatgaatgccaccctgcttcaggg

SEQ ID NO: 387789 - DNA, 25 bp, Rattus norvegicus
gcatgaatgccagcctgcttcaggg

SEQ ID NO: 387790 - DNA, 25 bp, Rattus norvegicus
gcatgaatgctgcactaaataacta

SEQ ID NO: 387791 - DNA, 25 bp, Rattus norvegicus
gcatgaatgctggactaaataacta

SEQ ID NO: 387792 - DNA, 25 bp, Rattus norvegicus
gcatgaatttcacacctaacctttt

SEQ ID NO: 387793 - DNA, 25 bp, Rattus norvegicus
gcatgaatttcagacctaacctttt

SEQ ID NO: 387794 - DNA, 25 bp, Rattus norvegicus
gcatgaatttgaatagctcccacta

SEQ ID NO: 387795 - DNA, 25 bp, Rattus norvegicus
gcatgaatttgattagctcccacta

SEQ ID NO: 387796 - DNA, 25 bp, Rattus norvegicus
gcatgacaaaagaggccactctgct

SEQ ID NO: 387797 - DNA, 25 bp, Rattus norvegicus
gcatgacaaaagtggccactctgct

SEQ ID NO: 387798 - DNA, 25 bp, Rattus norvegicus
gcatgacagcctcggatgccaaaat

SEQ ID NO: 387799 - DNA, 25 bp, Rattus norvegicus
gcatgacagcctgggatgccaaaat

SEQ ID NO: 387800 - DNA, 25 bp, Rattus norvegicus
gcatgacaggatcccttcttttgag

SEQ ID NO: 387801 - DNA, 25 bp, Rattus norvegicus
gcatgacaggatgccttcttttgag

SEQ ID NO: 387802 - DNA, 25 bp, Rattus norvegicus
gcatgacattgccatctgtgcttcc

SEQ ID NO: 387803 - DNA, 25 bp, Rattus norvegicus
gcatgacattgcgatctgtgcttcc

SEQ ID NO: 387804 - DNA, 25 bp, Rattus norvegicus
gcatgaccaggcactgcattatgag

SEQ ID NO: 387805 - DNA, 25 bp, Rattus norvegicus
gcatgaccaggctctgcattatgag

SEQ ID NO: 387806 - DNA, 25 bp, Rattus norvegicus
gcatgaccagtaacagctctgcaga

SEQ ID NO: 387807 - DNA, 25 bp, Rattus norvegicus
gcatgaccagtatcagctctgcaga

SEQ ID NO: 387808 - DNA, 25 bp, Rattus norvegicus
gcatgaccattaacacaactgactt

SEQ ID NO: 387809 - DNA, 25 bp, Rattus norvegicus
gcatgaccattatcacaactgactt

SEQ ID NO: 387810 - DNA, 25 bp, Rattus norvegicus
gcatgacccacgaggcttgctggga

SEQ ID NO: 387811 - DNA, 25 bp, Rattus norvegicus
gcatgacccacgtggcttgctggga

SEQ ID NO: 387812 - DNA, 25 bp, Rattus norvegicus
gcatgacccggccagacagataaga

SEQ ID NO: 387813 - DNA, 25 bp, Rattus norvegicus
gcatgacccggcgagacagataaga

SEQ ID NO: 387814 - DNA, 25 bp, Rattus norvegicus
gcatgacctacactcttcagtcctg

SEQ ID NO: 387815 - DNA, 25 bp, Rattus norvegicus
gcatgacctacagtcttcagtcctg

SEQ ID NO: 387816 - DNA, 25 bp, Rattus norvegicus
gcatgaccttgaaggacacttcttg

SEQ ID NO: 387817 - DNA, 25 bp, Rattus norvegicus
gcatgaccttgatggacacttcttg

SEQ ID NO: 387818 - DNA, 25 bp, Rattus norvegicus
gcatgacggatcagcttgactgtct

SEQ ID NO: 387819 - DNA, 25 bp, Rattus norvegicus
gcatgacggatctgcttgactgtct

SEQ ID NO: 387820 - DNA, 25 bp, Rattus norvegicus
gcatgacgtgtgagaacttgcacaa

SEQ ID NO: 387821 - DNA, 25 bp, Rattus norvegicus
gcatgacgtgtgtgaacttgcacaa

SEQ ID NO: 387822 - DNA, 25 bp, Rattus norvegicus
gcatgactagtacacacctctgtgt

SEQ ID NO: 387823 - DNA, 25 bp, Rattus norvegicus
gcatgactagtagacacctctgtgt

SEQ ID NO: 387824 - DNA, 25 bp, Rattus norvegicus
gcatgactccacagacaagcttaaa

SEQ ID NO: 387825 - DNA, 25 bp, Rattus norvegicus
gcatgactccactgacaagcttaaa

SEQ ID NO: 387826 - DNA, 25 bp, Rattus norvegicus
gcatgactccagaacaactctttgt

SEQ ID NO: 387827 - DNA, 25 bp, Rattus norvegicus
gcatgactccagtacaactctttgt

SEQ ID NO: 387828 - DNA, 25 bp, Rattus norvegicus
gcatgactcctgacctcttcaataa

SEQ ID NO: 387829 - DNA, 25 bp, Rattus norvegicus
gcatgactcctgtcctcttcaataa

SEQ ID NO: 387830 - DNA, 25 bp, Rattus norvegicus
gcatgactgacaattccctcaagga

SEQ ID NO: 387831 - DNA, 25 bp, Rattus norvegicus
gcatgactgacatttccctcaagga

SEQ ID NO: 387832 - DNA, 25 bp, Rattus norvegicus
gcatgactgagccttgactgaagtt

SEQ ID NO: 387833 - DNA, 25 bp, Rattus norvegicus
gcatgactgagcgttgactgaagtt

SEQ ID NO: 387834 - DNA, 25 bp, Rattus norvegicus
gcatgactgaggatcctgtctctac

SEQ ID NO: 387835 - DNA, 25 bp, Rattus norvegicus
gcatgactgaggttcctgtctctac

SEQ ID NO: 387836 - DNA, 25 bp, Rattus norvegicus
gcatgactgatgcttgtctgcctct

SEQ ID NO: 387837 - DNA, 25 bp, Rattus norvegicus
gcatgactgatggttgtctgcctct

SEQ ID NO: 387838 - DNA, 25 bp, Rattus norvegicus
gcatgactgcatactattaaccaat

SEQ ID NO: 387839 - DNA, 25 bp, Rattus norvegicus
gcatgactgcattctattaaccaat

SEQ ID NO: 387840 - DNA, 25 bp, Rattus norvegicus
gcatgactgcggcacagagtagaaa

SEQ ID NO: 387841 - DNA, 25 bp, Rattus norvegicus
gcatgactgcgggacagagtagaaa

SEQ ID NO: 387842 - DNA, 25 bp, Rattus norvegicus
gcatgacttgtcagctaagccattt

SEQ ID NO: 387843 - DNA, 25 bp, Rattus norvegicus
gcatgacttgtctgctaagccattt

SEQ ID NO: 387844 - DNA, 25 bp, Rattus norvegicus
gcatgagaatacacccttcgtggta

SEQ ID NO: 387845 - DNA, 25 bp, Rattus norvegicus
gcatgagaatactcccttcgtggta

SEQ ID NO: 387846 - DNA, 25 bp, Rattus norvegicus
gcatgagaatttcctagctgcatcc

SEQ ID NO: 387847 - DNA, 25 bp, Rattus norvegicus
gcatgagaatttgctagctgcatcc

SEQ ID NO: 387848 - DNA, 25 bp, Rattus norvegicus
gcatgagacacactagaacccttct

SEQ ID NO: 387849 - DNA, 25 bp, Rattus norvegicus
gcatgagacacagtagaacccttct

SEQ ID NO: 387850 - DNA, 25 bp, Rattus norvegicus
gcatgagacagcagtccattgacaa

SEQ ID NO: 387851 - DNA, 25 bp, Rattus norvegicus
gcatgagacagctgtccattgacaa

SEQ ID NO: 387852 - DNA, 25 bp, Rattus norvegicus
gcatgagagcgcagggatttaagat

SEQ ID NO: 387853 - DNA, 25 bp, Rattus norvegicus
gcatgagagcgctgggatttaagat

SEQ ID NO: 387854 - DNA, 25 bp, Rattus norvegicus
gcatgagagctgaggccagtgcacc

SEQ ID NO: 387855 - DNA, 25 bp, Rattus norvegicus
gcatgagagctgtggccagtgcacc

SEQ ID NO: 387856 - DNA, 25 bp, Rattus norvegicus
gcatgagattgcaccctgtgaggta

SEQ ID NO: 387857 - DNA, 25 bp, Rattus norvegicus
gcatgagattgctccctgtgaggta

SEQ ID NO: 387858 - DNA, 25 bp, Rattus norvegicus
gcatgagcaccaatgtggctgcaaa

SEQ ID NO: 387859 - DNA, 25 bp, Rattus norvegicus
gcatgagcaccattgtggctgcaaa

SEQ ID NO: 387860 - DNA, 25 bp, Rattus norvegicus
gcatgagcagagctttggctcccaa

SEQ ID NO: 387861 - DNA, 25 bp, Rattus norvegicus
gcatgagcagaggtttggctcccaa

SEQ ID NO: 387862 - DNA, 25 bp, Rattus norvegicus
gcatgagcagtgaacagcgatgtta

SEQ ID NO: 387863 - DNA, 25 bp, Rattus norvegicus
gcatgagcagtgtacagcgatgtta

SEQ ID NO: 387864 - DNA, 25 bp, Rattus norvegicus
gcatgagcataacggcccggcttaa

SEQ ID NO: 387865 - DNA, 25 bp, Rattus norvegicus
gcatgagcataagggcccggcttaa

SEQ ID NO: 387866 - DNA, 25 bp, Rattus norvegicus
gcatgagccaccatattcagcttaa

SEQ ID NO: 387867 - DNA, 25 bp, Rattus norvegicus
gcatgagccaccttattcagcttaa

SEQ ID NO: 387868 - DNA, 25 bp, Rattus norvegicus
gcatgagccgcgaggagaagcgttc

SEQ ID NO: 387869 - DNA, 25 bp, Rattus norvegicus
gcatgagccgcgtggagaagcgttc

SEQ ID NO: 387870 - DNA, 25 bp, Rattus norvegicus
gcatgagccggaatctctacgctgg

SEQ ID NO: 387871 - DNA, 25 bp, Rattus norvegicus
gcatgagccggattctctacgctgg

SEQ ID NO: 387872 - DNA, 25 bp, Rattus norvegicus
gcatgagctcaaatagtcccaggtc

SEQ ID NO: 387873 - DNA, 25 bp, Rattus norvegicus
gcatgagctcaattagtcccaggtc

SEQ ID NO: 387874 - DNA, 25 bp, Rattus norvegicus
gcatgagctgcactggttgaacgtt

SEQ ID NO: 387875 - DNA, 25 bp, Rattus norvegicus
gcatgagctgcagtggttgaacgtt

SEQ ID NO: 387876 - DNA, 25 bp, Rattus norvegicus
gcatgagctggaccagtgacatctc

SEQ ID NO: 387877 - DNA, 25 bp, Rattus norvegicus
gcatgagctggagcagtgacatctc

SEQ ID NO: 387878 - DNA, 25 bp, Rattus norvegicus
gcatgaggacctctacaaacgctat

SEQ ID NO: 387879 - DNA, 25 bp, Rattus norvegicus
gcatgaggacctgtacaaacgctat

SEQ ID NO: 387880 - DNA, 25 bp, Rattus norvegicus
gcatgaggctctatttgccacatct

SEQ ID NO: 387881 - DNA, 25 bp, Rattus norvegicus
gcatgaggctctttttgccacatct

SEQ ID NO: 387882 - DNA, 25 bp, Rattus norvegicus
gcatgagggcctcgaatgagacatt

SEQ ID NO: 387883 - DNA, 25 bp, Rattus norvegicus
gcatgagggcctggaatgagacatt

SEQ ID NO: 387884 - DNA, 25 bp, Rattus norvegicus
gcatgagggtttcgcctttgtacat

SEQ ID NO: 387885 - DNA, 25 bp, Rattus norvegicus
gcatgagggtttggcctttgtacat

SEQ ID NO: 387886 - DNA, 25 bp, Rattus norvegicus
gcatgaggtactactatgctccgac

SEQ ID NO: 387887 - DNA, 25 bp, Rattus norvegicus
gcatgaggtacttctatgctccgac

SEQ ID NO: 387888 - DNA, 25 bp, Rattus norvegicus
gcatgaggtcatattcccgtaagta

SEQ ID NO: 387889 - DNA, 25 bp, Rattus norvegicus
gcatgaggtcattttcccgtaagta

SEQ ID NO: 387890 - DNA, 25 bp, Rattus norvegicus
gcatgagtcatgaaccctggcatgt

SEQ ID NO: 387891 - DNA, 25 bp, Rattus norvegicus
gcatgagtcatgtaccctggcatgt

SEQ ID NO: 387892 - DNA, 25 bp, Rattus norvegicus
gcatgagtctgcaaccttcaacagg

SEQ ID NO: 387893 - DNA, 25 bp, Rattus norvegicus
gcatgagtctgctaccttcaacagg

SEQ ID NO: 387894 - DNA, 25 bp, Rattus norvegicus
gcatgagtgaccagctggacttcgg

SEQ ID NO: 387895 - DNA, 25 bp, Rattus norvegicus
gcatgagtgacctgctggacttcgg

SEQ ID NO: 387896 - DNA, 25 bp, Rattus norvegicus
gcatgagtgtgcacacaagtgtgag

SEQ ID NO: 387897 - DNA, 25 bp, Rattus norvegicus
gcatgagtgtgctcacaagtgtgag

SEQ ID NO: 387898 - DNA, 25 bp, Rattus norvegicus
gcatgagttataattccctgggtac

SEQ ID NO: 387899 - DNA, 25 bp, Rattus norvegicus
gcatgagttatatttccctgggtac

SEQ ID NO: 387900 - DNA, 25 bp, Rattus norvegicus
gcatgagttcaaacctgtcgttcct

SEQ ID NO: 387901 - DNA, 25 bp, Rattus norvegicus
gcatgagttcaatcctgtcgttcct

SEQ ID NO: 387902 - DNA, 25 bp, Rattus norvegicus
gcatgagtttccactgcactttagt

SEQ ID NO: 387903 - DNA, 25 bp, Rattus norvegicus
gcatgagtttcctctgcactttagt

SEQ ID NO: 387904 - DNA, 25 bp, Rattus norvegicus
gcatgataaactctccattcagtgt

SEQ ID NO: 387905 - DNA, 25 bp, Rattus norvegicus
gcatgataaactgtccattcagtgt

SEQ ID NO: 387906 - DNA, 25 bp, Rattus norvegicus
gcatgatacaggctgctgggccact

SEQ ID NO: 387907 - DNA, 25 bp, Rattus norvegicus
gcatgatacagggtgctgggccact

SEQ ID NO: 387908 - DNA, 25 bp, Rattus norvegicus
gcatgatagactccctggtgcgcat

SEQ ID NO: 387909 - DNA, 25 bp, Rattus norvegicus
gcatgatagactgcctggtgcgcat

SEQ ID NO: 387910 - DNA, 25 bp, Rattus norvegicus
gcatgataggatagctttttgtctc

SEQ ID NO: 387911 - DNA, 25 bp, Rattus norvegicus
gcatgataggattgctttttgtctc

SEQ ID NO: 387912 - DNA, 25 bp, Rattus norvegicus
gcatgatatagcactgaattttgaa

SEQ ID NO: 387913 - DNA, 25 bp, Rattus norvegicus
gcatgatatagctctgaattttgaa

SEQ ID NO: 387914 - DNA, 25 bp, Rattus norvegicus
gcatgatatgtaatgcgctcagatg

SEQ ID NO: 387915 - DNA, 25 bp, Rattus norvegicus
gcatgatatgtattgcgctcagatg

SEQ ID NO: 387916 - DNA, 25 bp, Rattus norvegicus
gcatgatcaacgagtttccctccaa

SEQ ID NO: 387917 - DNA, 25 bp, Rattus norvegicus
gcatgatcaacgtgtttccctccaa

SEQ ID NO: 387918 - DNA, 25 bp, Rattus norvegicus
gcatgatcctctcgtggaatggagt

SEQ ID NO: 387919 - DNA, 25 bp, Rattus norvegicus
gcatgatcctctggtggaatggagt

SEQ ID NO: 387920 - DNA, 25 bp, Rattus norvegicus
gcatgatcgggcagggctttgctca

SEQ ID NO: 387921 - DNA, 25 bp, Rattus norvegicus
gcatgatcgggctgggctttgctca

SEQ ID NO: 387922 - DNA, 25 bp, Rattus norvegicus
gcatgatctagaactctgtgcccca

SEQ ID NO: 387923 - DNA, 25 bp, Rattus norvegicus
gcatgatctagatctctgtgcccca

SEQ ID NO: 387924 - DNA, 25 bp, Rattus norvegicus
gcatgatctcatatatacgcagact

SEQ ID NO: 387925 - DNA, 25 bp, Rattus norvegicus
gcatgatctcatttatacgcagact

SEQ ID NO: 387926 - DNA, 25 bp, Rattus norvegicus
gcatgatctcctatgcacataatgt

SEQ ID NO: 387927 - DNA, 25 bp, Rattus norvegicus
gcatgatctcctttgcacataatgt

SEQ ID NO: 387928 - DNA, 25 bp, Rattus norvegicus
gcatgatctgtcaacatagcagctt

SEQ ID NO: 387929 - DNA, 25 bp, Rattus norvegicus
gcatgatctgtctacatagcagctt

SEQ ID NO: 387930 - DNA, 25 bp, Rattus norvegicus
gcatgatgcctgcagcccacagatg

SEQ ID NO: 387931 - DNA, 25 bp, Rattus norvegicus
gcatgatgcctggagcccacagatg

SEQ ID NO: 387932 - DNA, 25 bp, Rattus norvegicus
gcatgatgctttactgttttcaaga

SEQ ID NO: 387933 - DNA, 25 bp, Rattus norvegicus
gcatgatgcttttctgttttcaaga

SEQ ID NO: 387934 - DNA, 25 bp, Rattus norvegicus
gcatgatggatgatcacctaccctt

SEQ ID NO: 387935 - DNA, 25 bp, Rattus norvegicus
gcatgatggatgttcacctaccctt

SEQ ID NO: 387936 - DNA, 25 bp, Rattus norvegicus
gcatgatggcagctctcgtctgtgt

SEQ ID NO: 387937 - DNA, 25 bp, Rattus norvegicus
gcatgatggcaggtctcgtctgtgt

SEQ ID NO: 387938 - DNA, 25 bp, Rattus norvegicus
gcatgatggctgcatttactttaac

SEQ ID NO: 387939 - DNA, 25 bp, Rattus norvegicus
gcatgatggctggatttactttaac

SEQ ID NO: 387940 - DNA, 25 bp, Rattus norvegicus
gcatgatgggtgaactcggcactcc

SEQ ID NO: 387941 - DNA, 25 bp, Rattus norvegicus
gcatgatgggtgtactcggcactcc

SEQ ID NO: 387942 - DNA, 25 bp, Rattus norvegicus
gcatgatggttcacgcctggaagtc

SEQ ID NO: 387943 - DNA, 25 bp, Rattus norvegicus
gcatgatggttctcgcctggaagtc

SEQ ID NO: 387944 - DNA, 25 bp, Rattus norvegicus
gcatgatgtcgtctacttgagtttg

SEQ ID NO: 387945 - DNA, 25 bp, Rattus norvegicus
gcatgatgtcgtgtacttgagtttg

SEQ ID NO: 387946 - DNA, 25 bp, Rattus norvegicus
gcatgattcaagatcgacctggcca

SEQ ID NO: 387947 - DNA, 25 bp, Rattus norvegicus
gcatgattcaagttcgacctggcca

SEQ ID NO: 387948 - DNA, 25 bp, Rattus norvegicus
gcatgattcacaactgctccttgat

SEQ ID NO: 387949 - DNA, 25 bp, Rattus norvegicus
gcatgattcacatctgctccttgat

SEQ ID NO: 387950 - DNA, 25 bp, Rattus norvegicus
gcatgattgaatcttcctacttctg

SEQ ID NO: 387951 - DNA, 25 bp, Rattus norvegicus
gcatgattgaatgttcctacttctg

SEQ ID NO: 387952 - DNA, 25 bp, Rattus norvegicus
gcatgattgcctcgtcccgtgattg

SEQ ID NO: 387953 - DNA, 25 bp, Rattus norvegicus
gcatgattgcctggtcccgtgattg

SEQ ID NO: 387954 - DNA, 25 bp, Rattus norvegicus
gcatgattggttcatttctctcgac

SEQ ID NO: 387955 - DNA, 25 bp, Rattus norvegicus
gcatgattggttgatttctctcgac

SEQ ID NO: 387956 - DNA, 25 bp, Rattus norvegicus
gcatgatttccaatgttaccagatg

SEQ ID NO: 387957 - DNA, 25 bp, Rattus norvegicus
gcatgatttccattgttaccagatg

SEQ ID NO: 387958 - DNA, 25 bp, Rattus norvegicus
gcatgatttgggatgtggaaaccaa

SEQ ID NO: 387959 - DNA, 25 bp, Rattus norvegicus
gcatgatttgggttgtggaaaccaa

SEQ ID NO: 387960 - DNA, 25 bp, Rattus norvegicus
gcatgcaaaatcacttccccacatt

SEQ ID NO: 387961 - DNA, 25 bp, Rattus norvegicus
gcatgcaaaatctcttccccacatt

SEQ ID NO: 387962 - DNA, 25 bp, Rattus norvegicus
gcatgcaaagtcagtatccacccat

SEQ ID NO: 387963 - DNA, 25 bp, Rattus norvegicus
gcatgcaaagtctgtatccacccat

SEQ ID NO: 387964 - DNA, 25 bp, Rattus norvegicus
gcatgcaaatgcaggccgcaccaag

SEQ ID NO: 387965 - DNA, 25 bp, Rattus norvegicus
gcatgcaaatgctggccgcaccaag

SEQ ID NO: 387966 - DNA, 25 bp, Rattus norvegicus
gcatgcaacttcatgctcagagctt

SEQ ID NO: 387967 - DNA, 25 bp, Rattus norvegicus
gcatgcaacttcttgctcagagctt

SEQ ID NO: 387968 - DNA, 25 bp, Rattus norvegicus
gcatgcaagcatcgaaggaccaata

SEQ ID NO: 387969 - DNA, 25 bp, Rattus norvegicus
gcatgcaagcatggaaggaccaata

SEQ ID NO: 387970 - DNA, 25 bp, Rattus norvegicus
gcatgcaataccagggcagcagctc

SEQ ID NO: 387971 - DNA, 25 bp, Rattus norvegicus
gcatgcaatacctgggcagcagctc

SEQ ID NO: 387972 - DNA, 25 bp, Rattus norvegicus
gcatgcaatctcatgtaaccctgga

SEQ ID NO: 387973 - DNA, 25 bp, Rattus norvegicus
gcatgcaatctcttgtaaccctgga

SEQ ID NO: 387974 - DNA, 25 bp, Rattus norvegicus
gcatgcaatgtccacaagctattgt

SEQ ID NO: 387975 - DNA, 25 bp, Rattus norvegicus
gcatgcaatgtcgacaagctattgt

SEQ ID NO: 387976 - DNA, 25 bp, Rattus norvegicus
gcatgcaatgttagtgagcacccaa

SEQ ID NO: 387977 - DNA, 25 bp, Rattus norvegicus
gcatgcaatgttcttgacctggctt

SEQ ID NO: 387978 - DNA, 25 bp, Rattus norvegicus
gcatgcaatgttgttgacctggctt

SEQ ID NO: 387979 - DNA, 25 bp, Rattus norvegicus
gcatgcaatgtttgtgagcacccaa

SEQ ID NO: 387980 - DNA, 25 bp, Rattus norvegicus
gcatgcacacagacggaagaaggtc

SEQ ID NO: 387981 - DNA, 25 bp, Rattus norvegicus
gcatgcacacagtcggaagaaggtc

SEQ ID NO: 387982 - DNA, 25 bp, Rattus norvegicus
gcatgcacatgcaaatctgtacctg

SEQ ID NO: 387983 - DNA, 25 bp, Rattus norvegicus
gcatgcacatgctaatctgtacctg

SEQ ID NO: 387984 - DNA, 25 bp, Rattus norvegicus
gcatgcacatgtactcattcacaca

SEQ ID NO: 387985 - DNA, 25 bp, Rattus norvegicus
gcatgcacatgttctcattcacaca

SEQ ID NO: 387986 - DNA, 25 bp, Rattus norvegicus
gcatgcaccgatacagcttattagt

SEQ ID NO: 387987 - DNA, 25 bp, Rattus norvegicus
gcatgcaccgattcagcttattagt

SEQ ID NO: 387988 - DNA, 25 bp, Rattus norvegicus
gcatgcactcatagtgcacacatac

SEQ ID NO: 387989 - DNA, 25 bp, Rattus norvegicus
gcatgcactcattgtgcacacatac

SEQ ID NO: 387990 - DNA, 25 bp, Rattus norvegicus
gcatgcactcgccagacggtgagaa

SEQ ID NO: 387991 - DNA, 25 bp, Rattus norvegicus
gcatgcactcgcgagacggtgagaa

SEQ ID NO: 387992 - DNA, 25 bp, Rattus norvegicus
gcatgcactggactgtcatatgccc

SEQ ID NO: 387993 - DNA, 25 bp, Rattus norvegicus
gcatgcactggagtgtcatatgccc

SEQ ID NO: 387994 - DNA, 25 bp, Rattus norvegicus
gcatgcactgtgatttgtccaaggc

SEQ ID NO: 387995 - DNA, 25 bp, Rattus norvegicus
gcatgcactgtgttttgtccaaggc

SEQ ID NO: 387996 - DNA, 25 bp, Rattus norvegicus
gcatgcagaaagactacaggaccaa

SEQ ID NO: 387997 - DNA, 25 bp, Rattus norvegicus
gcatgcagaaagtctacaggaccaa

SEQ ID NO: 387998 - DNA, 25 bp, Rattus norvegicus
gcatgcagccacacaagtgcatttt

SEQ ID NO: 387999 - DNA, 25 bp, Rattus norvegicus
gcatgcagccactcaagtgcatttt

SEQ ID NO: 388000 - DNA, 25 bp, Rattus norvegicus
gcatgcagcctaattcagtggaatt

SEQ ID NO: 388001 - DNA, 25 bp, Rattus norvegicus
gcatgcagcctatttcagtggaatt

SEQ ID NO: 388002 - DNA, 25 bp, Rattus norvegicus
gcatgcaggaacacggagatctcct

SEQ ID NO: 388003 - DNA, 25 bp, Rattus norvegicus
gcatgcaggaacctaacctctgcag

SEQ ID NO: 388004 - DNA, 25 bp, Rattus norvegicus
gcatgcaggaacgtaacctctgcag

SEQ ID NO: 388005 - DNA, 25 bp, Rattus norvegicus
gcatgcaggaactcggagatctcct

SEQ ID NO: 388006 - DNA, 25 bp, Rattus norvegicus
gcatgcaggtttattacacttttgg

SEQ ID NO: 388007 - DNA, 25 bp, Rattus norvegicus
gcatgcaggttttttacacttttgg

SEQ ID NO: 388008 - DNA, 25 bp, Rattus norvegicus
gcatgcagtaccaagacagagcgga

SEQ ID NO: 388009 - DNA, 25 bp, Rattus norvegicus
gcatgcagtacctagacagagcgga

SEQ ID NO: 388010 - DNA, 25 bp, Rattus norvegicus
gcatgcagtttgcttagccagtgta

SEQ ID NO: 388011 - DNA, 25 bp, Rattus norvegicus
gcatgcagtttggttagccagtgta

SEQ ID NO: 388012 - DNA, 25 bp, Rattus norvegicus
gcatgcatacggagcacggacacat

SEQ ID NO: 388013 - DNA, 25 bp, Rattus norvegicus
gcatgcatacggtgcacggacacat

SEQ ID NO: 388014 - DNA, 25 bp, Rattus norvegicus
gcatgcatactcactgctggattgg

SEQ ID NO: 388015 - DNA, 25 bp, Rattus norvegicus
gcatgcatactctctgctggattgg

SEQ ID NO: 388016 - DNA, 25 bp, Rattus norvegicus
gcatgcatattcatctgcttctaag

SEQ ID NO: 388017 - DNA, 25 bp, Rattus norvegicus
gcatgcatattcttctgcttctaag

SEQ ID NO: 388018 - DNA, 25 bp, Rattus norvegicus
gcatgcatcaccacaggatcaactt

SEQ ID NO: 388019 - DNA, 25 bp, Rattus norvegicus
gcatgcatcacctcaggatcaactt

SEQ ID NO: 388020 - DNA, 25 bp, Rattus norvegicus
gcatgcatgacacttcacacaggtt

SEQ ID NO: 388021 - DNA, 25 bp, Rattus norvegicus
gcatgcatgacagttcacacaggtt

SEQ ID NO: 388022 - DNA, 25 bp, Rattus norvegicus
gcatgcatgagtaacctggagccag

SEQ ID NO: 388023 - DNA, 25 bp, Rattus norvegicus
gcatgcatgagttacctggagccag

SEQ ID NO: 388024 - DNA, 25 bp, Rattus norvegicus
gcatgcatgcacactctgcaaacaa

SEQ ID NO: 388025 - DNA, 25 bp, Rattus norvegicus
gcatgcatgcactctctgcaaacaa

SEQ ID NO: 388026 - DNA, 25 bp, Rattus norvegicus
gcatgcatgcagaccacagcagtat

SEQ ID NO: 388027 - DNA, 25 bp, Rattus norvegicus
gcatgcatgcagtccacagcagtat

SEQ ID NO: 388028 - DNA, 25 bp, Rattus norvegicus
gcatgcatgcgcacacagggttcta

SEQ ID NO: 388029 - DNA, 25 bp, Rattus norvegicus
gcatgcatgcgctcacagggttcta

SEQ ID NO: 388030 - DNA, 25 bp, Rattus norvegicus
gcatgcatggcaaacaggaatccgt

SEQ ID NO: 388031 - DNA, 25 bp, Rattus norvegicus
gcatgcatggcatacaggaatccgt

SEQ ID NO: 388032 - DNA, 25 bp, Rattus norvegicus
gcatgcatggctcatttgcggttgt

SEQ ID NO: 388033 - DNA, 25 bp, Rattus norvegicus
gcatgcatggctgatttgcggttgt

SEQ ID NO: 388034 - DNA, 25 bp, Rattus norvegicus
gcatgcatgtccagttttgtggtta

SEQ ID NO: 388035 - DNA, 25 bp, Rattus norvegicus
gcatgcatgtcctgttttgtggtta

SEQ ID NO: 388036 - DNA, 25 bp, Rattus norvegicus
gcatgcatgttcctgcgactagtca

SEQ ID NO: 388037 - DNA, 25 bp, Rattus norvegicus
gcatgcatgttcgtgcgactagtca

SEQ ID NO: 388038 - DNA, 25 bp, Rattus norvegicus
gcatgcattctcatactttgctttt

SEQ ID NO: 388039 - DNA, 25 bp, Rattus norvegicus
gcatgcattctcttactttgctttt

SEQ ID NO: 388040 - DNA, 25 bp, Rattus norvegicus
gcatgcatttcaatacagtaattag

SEQ ID NO: 388041 - DNA, 25 bp, Rattus norvegicus
gcatgcatttcattacagtaattag

SEQ ID NO: 388042 - DNA, 25 bp, Rattus norvegicus
gcatgcatttttcatatcagagtca

SEQ ID NO: 388043 - DNA, 25 bp, Rattus norvegicus
gcatgcatttttctggtgattttga

SEQ ID NO: 388044 - DNA, 25 bp, Rattus norvegicus
gcatgcatttttgatatcagagtca

SEQ ID NO: 388045 - DNA, 25 bp, Rattus norvegicus
gcatgcatttttgtggtgattttga

SEQ ID NO: 388046 - DNA, 25 bp, Rattus norvegicus
gcatgccaaccacatttgtctttat

SEQ ID NO: 388047 - DNA, 25 bp, Rattus norvegicus
gcatgccaaccagatttgtctttat

SEQ ID NO: 388048 - DNA, 25 bp, Rattus norvegicus
gcatgccaagagagcccatgtctaa

SEQ ID NO: 388049 - DNA, 25 bp, Rattus norvegicus
gcatgccaagagtgcccatgtctaa

SEQ ID NO: 388050 - DNA, 25 bp, Rattus norvegicus
gcatgccactagctttccaatttgt

SEQ ID NO: 388051 - DNA, 25 bp, Rattus norvegicus
gcatgccactaggtttccaatttgt

SEQ ID NO: 388052 - DNA, 25 bp, Rattus norvegicus
gcatgccaggtacacagatctcaat

SEQ ID NO: 388053 - DNA, 25 bp, Rattus norvegicus
gcatgccaggtagacagatctcaat

SEQ ID NO: 388054 - DNA, 25 bp, Rattus norvegicus
gcatgccatactcggtgttgcacga

SEQ ID NO: 388055 - DNA, 25 bp, Rattus norvegicus
gcatgccatactgggtgttgcacga

SEQ ID NO: 388056 - DNA, 25 bp, Rattus norvegicus
gcatgccatgaaacaagccgtcgtg

SEQ ID NO: 388057 - DNA, 25 bp, Rattus norvegicus
gcatgccatgaatcaagccgtcgtg

SEQ ID NO: 388058 - DNA, 25 bp, Rattus norvegicus
gcatgcccacgtatgatgtgttcca

SEQ ID NO: 388059 - DNA, 25 bp, Rattus norvegicus
gcatgcccacgtttgatgtgttcca

SEQ ID NO: 388060 - DNA, 25 bp, Rattus norvegicus
gcatgcccagcacatccagatgtta

SEQ ID NO: 388061 - DNA, 25 bp, Rattus norvegicus
gcatgcccagcagatccagatgtta

SEQ ID NO: 388062 - DNA, 25 bp, Rattus norvegicus
gcatgcccagttatcagtggttgca

SEQ ID NO: 388063 - DNA, 25 bp, Rattus norvegicus
gcatgcccagttttcagtggttgca

SEQ ID NO: 388064 - DNA, 25 bp, Rattus norvegicus
gcatgcccccaaacttcttttgtat

SEQ ID NO: 388065 - DNA, 25 bp, Rattus norvegicus
gcatgcccccaatcttcttttgtat

SEQ ID NO: 388066 - DNA, 25 bp, Rattus norvegicus
gcatgccccgaaagcctttgtgaaa

SEQ ID NO: 388067 - DNA, 25 bp, Rattus norvegicus
gcatgccccgaatgcctttgtgaaa

SEQ ID NO: 388068 - DNA, 25 bp, Rattus norvegicus
gcatgcccctctctctggagttggg

SEQ ID NO: 388069 - DNA, 25 bp, Rattus norvegicus
gcatgcccctctgtctggagttggg

SEQ ID NO: 388070 - DNA, 25 bp, Rattus norvegicus
gcatgccctcttctacatgggagga

SEQ ID NO: 388071 - DNA, 25 bp, Rattus norvegicus
gcatgccctcttgtacatgggagga

SEQ ID NO: 388072 - DNA, 25 bp, Rattus norvegicus
gcatgccctgtaattaatcatccgg

SEQ ID NO: 388073 - DNA, 25 bp, Rattus norvegicus
gcatgccctgtatttaatcatccgg

SEQ ID NO: 388074 - DNA, 25 bp, Rattus norvegicus
gcatgcccttggagtgcacagcaat

SEQ ID NO: 388075 - DNA, 25 bp, Rattus norvegicus
gcatgcccttggtgtgcacagcaat

SEQ ID NO: 388076 - DNA, 25 bp, Rattus norvegicus
gcatgccgaggacgaggctccatct

SEQ ID NO: 388077 - DNA, 25 bp, Rattus norvegicus
gcatgccgaggaggaggctccatct

SEQ ID NO: 388078 - DNA, 25 bp, Rattus norvegicus
gcatgccgccgacaaggaaccgcga

SEQ ID NO: 388079 - DNA, 25 bp, Rattus norvegicus
gcatgccgccgagaaggaaccgcga

SEQ ID NO: 388080 - DNA, 25 bp, Rattus norvegicus
gcatgccgtgaacaaccgagttaca

SEQ ID NO: 388081 - DNA, 25 bp, Rattus norvegicus
gcatgccgtgaagaaccgagttaca

SEQ ID NO: 388082 - DNA, 25 bp, Rattus norvegicus
gcatgcctaccaacttggaactttg

SEQ ID NO: 388083 - DNA, 25 bp, Rattus norvegicus
gcatgcctaccaagacactgagaat

SEQ ID NO: 388084 - DNA, 25 bp, Rattus norvegicus
gcatgcctaccatcttggaactttg

SEQ ID NO: 388085 - DNA, 25 bp, Rattus norvegicus
gcatgcctaccatgacactgagaat

SEQ ID NO: 388086 - DNA, 25 bp, Rattus norvegicus
gcatgcctcctaagcagaaactggt

SEQ ID NO: 388087 - DNA, 25 bp, Rattus norvegicus
gcatgcctcctatgcagaaactggt

SEQ ID NO: 388088 - DNA, 25 bp, Rattus norvegicus
gcatgcctcctgacatcaaagtgga

SEQ ID NO: 388089 - DNA, 25 bp, Rattus norvegicus
gcatgcctcctgtcatcaaagtgga

SEQ ID NO: 388090 - DNA, 25 bp, Rattus norvegicus
gcatgcctgcccaactagacaaagt

SEQ ID NO: 388091 - DNA, 25 bp, Rattus norvegicus
gcatgcctgccctactagacaaagt

SEQ ID NO: 388092 - DNA, 25 bp, Rattus norvegicus
gcatgcctgggaagaggtcctcagt

SEQ ID NO: 388093 - DNA, 25 bp, Rattus norvegicus
gcatgcctgggatgaggtcctcagt

SEQ ID NO: 388094 - DNA, 25 bp, Rattus norvegicus
gcatgcctgtgaaacccgtgagcca

SEQ ID NO: 388095 - DNA, 25 bp, Rattus norvegicus
gcatgcctgtgatacccgtgagcca

SEQ ID NO: 388096 - DNA, 25 bp, Rattus norvegicus
gcatgccttagcaacagtgaaaccg

SEQ ID NO: 388097 - DNA, 25 bp, Rattus norvegicus
gcatgccttagctacagtgaaaccg

SEQ ID NO: 388098 - DNA, 25 bp, Rattus norvegicus
gcatgccttcagatgtaagtggcca

SEQ ID NO: 388099 - DNA, 25 bp, Rattus norvegicus
gcatgccttcagttgtaagtggcca

SEQ ID NO: 388100 - DNA, 25 bp, Rattus norvegicus
gcatgccttggtatctcgatagtac

SEQ ID NO: 388101 - DNA, 25 bp, Rattus norvegicus
gcatgccttggtttctcgatagtac

SEQ ID NO: 388102 - DNA, 25 bp, Rattus norvegicus
gcatgcctttgacatcatccacctg

SEQ ID NO: 388103 - DNA, 25 bp, Rattus norvegicus
gcatgcctttgagatcatccacctg

SEQ ID NO: 388104 - DNA, 25 bp, Rattus norvegicus
gcatgcctttgtactaagacgtggc

SEQ ID NO: 388105 - DNA, 25 bp, Rattus norvegicus
gcatgcctttgttctaagacgtggc

SEQ ID NO: 388106 - DNA, 25 bp, Rattus norvegicus
gcatgcgagccgcaatggaccacaa

SEQ ID NO: 388107 - DNA, 25 bp, Rattus norvegicus
gcatgcgagccggaatggaccacaa

SEQ ID NO: 388108 - DNA, 25 bp, Rattus norvegicus
gcatgcgagtgcagtactaccgaga

SEQ ID NO: 388109 - DNA, 25 bp, Rattus norvegicus
gcatgcgagtgctgtactaccgaga

SEQ ID NO: 388110 - DNA, 25 bp, Rattus norvegicus
gcatgcgatgtgcttttgccaaata

SEQ ID NO: 388111 - DNA, 25 bp, Rattus norvegicus
gcatgcgatgtggttttgccaaata

SEQ ID NO: 388112 - DNA, 25 bp, Rattus norvegicus
gcatgcgcaataaagcagcacgtgt

SEQ ID NO: 388113 - DNA, 25 bp, Rattus norvegicus
gcatgcgcaatatagcagcacgtgt

SEQ ID NO: 388114 - DNA, 25 bp, Rattus norvegicus
gcatgcgcaccaaaacacagcagat

SEQ ID NO: 388115 - DNA, 25 bp, Rattus norvegicus
gcatgcgcaccataacacagcagat

SEQ ID NO: 388116 - DNA, 25 bp, Rattus norvegicus
gcatgcgcagaaacgtgcttttccc

SEQ ID NO: 388117 - DNA, 25 bp, Rattus norvegicus
gcatgcgcagaatcgtgcttttccc

SEQ ID NO: 388118 - DNA, 25 bp, Rattus norvegicus
gcatgcgcgctgaaagcaattgtta

SEQ ID NO: 388119 - DNA, 25 bp, Rattus norvegicus
gcatgcgcgctgtaagcaattgtta

SEQ ID NO: 388120 - DNA, 25 bp, Rattus norvegicus
gcatgcgctggacaggctgaaacct

SEQ ID NO: 388121 - DNA, 25 bp, Rattus norvegicus
gcatgcgctggagaggctgaaacct

SEQ ID NO: 388122 - DNA, 25 bp, Rattus norvegicus
gcatgcggacaacatcagaggtcgt

SEQ ID NO: 388123 - DNA, 25 bp, Rattus norvegicus
gcatgcggacaagatcagaggtcgt

SEQ ID NO: 388124 - DNA, 25 bp, Rattus norvegicus
gcatgcggagacattcgtccctggg

SEQ ID NO: 388125 - DNA, 25 bp, Rattus norvegicus
gcatgcggagactttcgtccctggg

SEQ ID NO: 388126 - DNA, 25 bp, Rattus norvegicus
gcatgcgtatccagaggatgcggaa

SEQ ID NO: 388127 - DNA, 25 bp, Rattus norvegicus
gcatgcgtatcctgaggatgcggaa

SEQ ID NO: 388128 - DNA, 25 bp, Rattus norvegicus
gcatgctaatcgcttcagtcctgtc

SEQ ID NO: 388129 - DNA, 25 bp, Rattus norvegicus
gcatgctaatcggttcagtcctgtc

SEQ ID NO: 388130 - DNA, 25 bp, Rattus norvegicus
gcatgctacctccatttcggattag

SEQ ID NO: 388131 - DNA, 25 bp, Rattus norvegicus
gcatgctacctcgatttcggattag

SEQ ID NO: 388132 - DNA, 25 bp, Rattus norvegicus
gcatgctacttgcaattcttgtttt

SEQ ID NO: 388133 - DNA, 25 bp, Rattus norvegicus
gcatgctacttggaattcttgtttt

SEQ ID NO: 388134 - DNA, 25 bp, Rattus norvegicus
gcatgctaggcacgttctgtactta

SEQ ID NO: 388135 - DNA, 25 bp, Rattus norvegicus
gcatgctaggcaggttctgtactta

SEQ ID NO: 388136 - DNA, 25 bp, Rattus norvegicus
gcatgctagtgtatgttgtggccat

SEQ ID NO: 388137 - DNA, 25 bp, Rattus norvegicus
gcatgctagtgtttgttgtggccat

SEQ ID NO: 388138 - DNA, 25 bp, Rattus norvegicus
gcatgctcaagcaggtgaccggcaa

SEQ ID NO: 388139 - DNA, 25 bp, Rattus norvegicus
gcatgctcaagctggtgaccggcaa

SEQ ID NO: 388140 - DNA, 25 bp, Rattus norvegicus
gcatgctcatgcaaatgatctccaa

SEQ ID NO: 388141 - DNA, 25 bp, Rattus norvegicus
gcatgctcatgctaatgatctccaa

SEQ ID NO: 388142 - DNA, 25 bp, Rattus norvegicus
gcatgctcattgacatcgtggtcct

SEQ ID NO: 388143 - DNA, 25 bp, Rattus norvegicus
gcatgctcattgtcatcgtggtcct

SEQ ID NO: 388144 - DNA, 25 bp, Rattus norvegicus
gcatgctccagtcggatctgctcaa

SEQ ID NO: 388145 - DNA, 25 bp, Rattus norvegicus
gcatgctccagtgggatctgctcaa

SEQ ID NO: 388146 - DNA, 25 bp, Rattus norvegicus
gcatgctccttcctaaggacatgta

SEQ ID NO: 388147 - DNA, 25 bp, Rattus norvegicus
gcatgctccttcgtaaggacatgta

SEQ ID NO: 388148 - DNA, 25 bp, Rattus norvegicus
gcatgctctattcagacaccattct

SEQ ID NO: 388149 - DNA, 25 bp, Rattus norvegicus
gcatgctctattgagacaccattct

SEQ ID NO: 388150 - DNA, 25 bp, Rattus norvegicus
gcatgctctgagaagctgtcaccag

SEQ ID NO: 388151 - DNA, 25 bp, Rattus norvegicus
gcatgctctgagtagctgtcaccag

SEQ ID NO: 388152 - DNA, 25 bp, Rattus norvegicus
gcatgctctgctacatcgtgcacag

SEQ ID NO: 388153 - DNA, 25 bp, Rattus norvegicus
gcatgctctgcttcatcgtgcacag

SEQ ID NO: 388154 - DNA, 25 bp, Rattus norvegicus
gcatgctctggcaaaaatctgtgga

SEQ ID NO: 388155 - DNA, 25 bp, Rattus norvegicus
gcatgctctggctaaaatctgtgga

SEQ ID NO: 388156 - DNA, 25 bp, Rattus norvegicus
gcatgctctgtaatttgcctatttt

SEQ ID NO: 388157 - DNA, 25 bp, Rattus norvegicus
gcatgctctgtattttgcctatttt

SEQ ID NO: 388158 - DNA, 25 bp, Rattus norvegicus
gcatgctgacacacatccataggtg

SEQ ID NO: 388159 - DNA, 25 bp, Rattus norvegicus
gcatgctgacactcatccataggtg

SEQ ID NO: 388160 - DNA, 25 bp, Rattus norvegicus
gcatgctgacagagagtatctcatt

SEQ ID NO: 388161 - DNA, 25 bp, Rattus norvegicus
gcatgctgacagtgagtatctcatt

SEQ ID NO: 388162 - DNA, 25 bp, Rattus norvegicus
gcatgctgacgccacattgttggtc

SEQ ID NO: 388163 - DNA, 25 bp, Rattus norvegicus
gcatgctgacgcgacattgttggtc

SEQ ID NO: 388164 - DNA, 25 bp, Rattus norvegicus
gcatgctgaggtcctcaacatccgg

SEQ ID NO: 388165 - DNA, 25 bp, Rattus norvegicus
gcatgctgaggtgctcaacatccgg

SEQ ID NO: 388166 - DNA, 25 bp, Rattus norvegicus
gcatgctgcagtaggtgcttcccgt

SEQ ID NO: 388167 - DNA, 25 bp, Rattus norvegicus
gcatgctgcagttggtgcttcccgt

SEQ ID NO: 388168 - DNA, 25 bp, Rattus norvegicus
gcatgctgctaaattagagcctcca

SEQ ID NO: 388169 - DNA, 25 bp, Rattus norvegicus
gcatgctgctaatttagagcctcca

SEQ ID NO: 388170 - DNA, 25 bp, Rattus norvegicus
gcatgctgctataggtctagggact

SEQ ID NO: 388171 - DNA, 25 bp, Rattus norvegicus
gcatgctgctattggtctagggact

SEQ ID NO: 388172 - DNA, 25 bp, Rattus norvegicus
gcatgctgcttaaatactcaccgat

SEQ ID NO: 388173 - DNA, 25 bp, Rattus norvegicus
gcatgctgcttatatactcaccgat

SEQ ID NO: 388174 - DNA, 25 bp, Rattus norvegicus
gcatgctggctaatcttgaggttca

SEQ ID NO: 388175 - DNA, 25 bp, Rattus norvegicus
gcatgctggctattcttgaggttca

SEQ ID NO: 388176 - DNA, 25 bp, Rattus norvegicus
gcatgctgggaaatagacacgcttt

SEQ ID NO: 388177 - DNA, 25 bp, Rattus norvegicus
gcatgctgggaattagacacgcttt

SEQ ID NO: 388178 - DNA, 25 bp, Rattus norvegicus
gcatgctgggcacgtacacacaaga

SEQ ID NO: 388179 - DNA, 25 bp, Rattus norvegicus
gcatgctgggcaggtacacacaaga

SEQ ID NO: 388180 - DNA, 25 bp, Rattus norvegicus
gcatgctgtcagacatagggacatc

SEQ ID NO: 388181 - DNA, 25 bp, Rattus norvegicus
gcatgctgtcagtcatagggacatc

SEQ ID NO: 388182 - DNA, 25 bp, Rattus norvegicus
gcatgctgtcctcaaatttggcttt

SEQ ID NO: 388183 - DNA, 25 bp, Rattus norvegicus
gcatgctgtcctgaaatttggcttt

SEQ ID NO: 388184 - DNA, 25 bp, Rattus norvegicus
gcatgctgtgctagtacaacggact

SEQ ID NO: 388185 - DNA, 25 bp, Rattus norvegicus
gcatgctgtgcttgtacaacggact

SEQ ID NO: 388186 - DNA, 25 bp, Rattus norvegicus
gcatgctgttagctgggtatcccac

SEQ ID NO: 388187 - DNA, 25 bp, Rattus norvegicus
gcatgctgttaggtgggtatcccac

SEQ ID NO: 388188 - DNA, 25 bp, Rattus norvegicus
gcatgctgttctaggtggctgagct

SEQ ID NO: 388189 - DNA, 25 bp, Rattus norvegicus
gcatgctgttcttggtggctgagct

SEQ ID NO: 388190 - DNA, 25 bp, Rattus norvegicus
gcatgcttaaggacctggcaccaga

SEQ ID NO: 388191 - DNA, 25 bp, Rattus norvegicus
gcatgcttaaggatcccaaacaact

SEQ ID NO: 388192 - DNA, 25 bp, Rattus norvegicus
gcatgcttaaggtcctggcaccaga

SEQ ID NO: 388193 - DNA, 25 bp, Rattus norvegicus
gcatgcttaaggttcccaaacaact

SEQ ID NO: 388194 - DNA, 25 bp, Rattus norvegicus
gcatgcttacaacaggctgggccca

SEQ ID NO: 388195 - DNA, 25 bp, Rattus norvegicus
gcatgcttacaagaggctgggccca

SEQ ID NO: 388196 - DNA, 25 bp, Rattus norvegicus
gcatgcttatttcttgccttaattt

SEQ ID NO: 388197 - DNA, 25 bp, Rattus norvegicus
gcatgcttatttgttgccttaattt

SEQ ID NO: 388198 - DNA, 25 bp, Rattus norvegicus
gcatgcttcacacctcagtagtata

SEQ ID NO: 388199 - DNA, 25 bp, Rattus norvegicus
gcatgcttcacagctcagtagtata

SEQ ID NO: 388200 - DNA, 25 bp, Rattus norvegicus
gcatgcttcatgcaatgctagcaca

SEQ ID NO: 388201 - DNA, 25 bp, Rattus norvegicus
gcatgcttcatggaatgctagcaca

SEQ ID NO: 388202 - DNA, 25 bp, Rattus norvegicus
gcatgcttcccacagtaaactgtca

SEQ ID NO: 388203 - DNA, 25 bp, Rattus norvegicus
gcatgcttcccagagtaaactgtca

SEQ ID NO: 388204 - DNA, 25 bp, Rattus norvegicus
gcatgcttctatccaccttcttctg

SEQ ID NO: 388205 - DNA, 25 bp, Rattus norvegicus
gcatgcttctatgcaccttcttctg

SEQ ID NO: 388206 - DNA, 25 bp, Rattus norvegicus
gcatgcttctgaactactaccgcaa

SEQ ID NO: 388207 - DNA, 25 bp, Rattus norvegicus
gcatgcttctgaatttgcttcagtc

SEQ ID NO: 388208 - DNA, 25 bp, Rattus norvegicus
gcatgcttctgaccagtgtttgtac

SEQ ID NO: 388209 - DNA, 25 bp, Rattus norvegicus
gcatgcttctgagcagtgtttgtac

SEQ ID NO: 388210 - DNA, 25 bp, Rattus norvegicus
gcatgcttctgatctactaccgcaa

SEQ ID NO: 388211 - DNA, 25 bp, Rattus norvegicus
gcatgcttctgattttgcttcagtc

SEQ ID NO: 388212 - DNA, 25 bp, Rattus norvegicus
gcatgcttgcttaatttgctggatt

SEQ ID NO: 388213 - DNA, 25 bp, Rattus norvegicus
gcatgcttgctttatttgctggatt

SEQ ID NO: 388214 - DNA, 25 bp, Rattus norvegicus
gcatgcttggcaaacactggtcagc

SEQ ID NO: 388215 - DNA, 25 bp, Rattus norvegicus
gcatgcttggcatacactggtcagc

SEQ ID NO: 388216 - DNA, 25 bp, Rattus norvegicus
gcatgctttaggactatggcttcca

SEQ ID NO: 388217 - DNA, 25 bp, Rattus norvegicus
gcatgctttaggtctatggcttcca

SEQ ID NO: 388218 - DNA, 25 bp, Rattus norvegicus
gcatgctttatacaatccacaatac

SEQ ID NO: 388219 - DNA, 25 bp, Rattus norvegicus
gcatgctttatacagaaccagcccg

SEQ ID NO: 388220 - DNA, 25 bp, Rattus norvegicus
gcatgctttatagaatccacaatac

SEQ ID NO: 388221 - DNA, 25 bp, Rattus norvegicus
gcatgctttatagagaaccagcccg

SEQ ID NO: 388222 - DNA, 25 bp, Rattus norvegicus
gcatgctttcacagttttgcttgta

SEQ ID NO: 388223 - DNA, 25 bp, Rattus norvegicus
gcatgctttcactgttttgcttgta

SEQ ID NO: 388224 - DNA, 25 bp, Rattus norvegicus
gcatgctttgaaatctaccacctaa

SEQ ID NO: 388225 - DNA, 25 bp, Rattus norvegicus
gcatgctttgaattctaccacctaa

SEQ ID NO: 388226 - DNA, 25 bp, Rattus norvegicus
gcatgctttgtgattgtcctgattc

SEQ ID NO: 388227 - DNA, 25 bp, Rattus norvegicus
gcatgctttgtgtttgtcctgattc

SEQ ID NO: 388228 - DNA, 25 bp, Rattus norvegicus
gcatgcttttacatctaagactgtc

SEQ ID NO: 388229 - DNA, 25 bp, Rattus norvegicus
gcatgcttttacttctaagactgtc

SEQ ID NO: 388230 - DNA, 25 bp, Rattus norvegicus
gcatggaaaactcggctttgcacac

SEQ ID NO: 388231 - DNA, 25 bp, Rattus norvegicus
gcatggaaaactgggctttgcacac

SEQ ID NO: 388232 - DNA, 25 bp, Rattus norvegicus
gcatggaacagaacgtctctcacaa

SEQ ID NO: 388233 - DNA, 25 bp, Rattus norvegicus
gcatggaacagatcgtctctcacaa

SEQ ID NO: 388234 - DNA, 25 bp, Rattus norvegicus
gcatggaacagcagtttgtacccaa

SEQ ID NO: 388235 - DNA, 25 bp, Rattus norvegicus
gcatggaacagctgtttgtacccaa

SEQ ID NO: 388236 - DNA, 25 bp, Rattus norvegicus
gcatggaagtctctgctgaagccca

SEQ ID NO: 388237 - DNA, 25 bp, Rattus norvegicus
gcatggaagtctgtgctgaagccca

SEQ ID NO: 388238 - DNA, 25 bp, Rattus norvegicus
gcatggacacctagagactttatag

SEQ ID NO: 388239 - DNA, 25 bp, Rattus norvegicus
gcatggacaccttgagactttatag

SEQ ID NO: 388240 - DNA, 25 bp, Rattus norvegicus
gcatggacacttccttcaaaatcaa

SEQ ID NO: 388241 - DNA, 25 bp, Rattus norvegicus
gcatggacacttgcttcaaaatcaa

SEQ ID NO: 388242 - DNA, 25 bp, Rattus norvegicus
gcatggacagcgagagcctcttcaa

SEQ ID NO: 388243 - DNA, 25 bp, Rattus norvegicus
gcatggacagcgtgagcctcttcaa

SEQ ID NO: 388244 - DNA, 25 bp, Rattus norvegicus
gcatggacatggcttttccctagaa

SEQ ID NO: 388245 - DNA, 25 bp, Rattus norvegicus
gcatggacatgggttttccctagaa

SEQ ID NO: 388246 - DNA, 25 bp, Rattus norvegicus
gcatggacgcgaactgctcggtgcc

SEQ ID NO: 388247 - DNA, 25 bp, Rattus norvegicus
gcatggacgcgatctgctcggtgcc

SEQ ID NO: 388248 - DNA, 25 bp, Rattus norvegicus
gcatggactcggagctgaaggcata

SEQ ID NO: 388249 - DNA, 25 bp, Rattus norvegicus
gcatggactcggtgctgaaggcata

SEQ ID NO: 388250 - DNA, 25 bp, Rattus norvegicus
gcatggactgaacatgctttcatct

SEQ ID NO: 388251 - DNA, 25 bp, Rattus norvegicus
gcatggactgaagatgctttcatct

SEQ ID NO: 388252 - DNA, 25 bp, Rattus norvegicus
gcatggactgtaccactaagccaca

SEQ ID NO: 388253 - DNA, 25 bp, Rattus norvegicus
gcatggactgtagcactaagccaca

SEQ ID NO: 388254 - DNA, 25 bp, Rattus norvegicus
gcatggacttccagttgagtgctaa

SEQ ID NO: 388255 - DNA, 25 bp, Rattus norvegicus
gcatggacttcctgttgagtgctaa

SEQ ID NO: 388256 - DNA, 25 bp, Rattus norvegicus
gcatggactttactgtttcttccct

SEQ ID NO: 388257 - DNA, 25 bp, Rattus norvegicus
gcatggactttagtgtttcttccct

SEQ ID NO: 388258 - DNA, 25 bp, Rattus norvegicus
gcatggagaactaccctagagtgta

SEQ ID NO: 388259 - DNA, 25 bp, Rattus norvegicus
gcatggagaacttccctagagtgta

SEQ ID NO: 388260 - DNA, 25 bp, Rattus norvegicus
gcatggagaccaaattgccctctta

SEQ ID NO: 388261 - DNA, 25 bp, Rattus norvegicus
gcatggagaccatattgccctctta

SEQ ID NO: 388262 - DNA, 25 bp, Rattus norvegicus
gcatggagagcaattccgcatagac

SEQ ID NO: 388263 - DNA, 25 bp, Rattus norvegicus
gcatggagagcatttccgcatagac

SEQ ID NO: 388264 - DNA, 25 bp, Rattus norvegicus
gcatggagatatccgcctgcttttt

SEQ ID NO: 388265 - DNA, 25 bp, Rattus norvegicus
gcatggagatatgcgcctgcttttt

SEQ ID NO: 388266 - DNA, 25 bp, Rattus norvegicus
gcatggagcaatctcgcagtgcagt

SEQ ID NO: 388267 - DNA, 25 bp, Rattus norvegicus
gcatggagcaatgtcgcagtgcagt

SEQ ID NO: 388268 - DNA, 25 bp, Rattus norvegicus
gcatggagcaccaacagcaaagcag

SEQ ID NO: 388269 - DNA, 25 bp, Rattus norvegicus
gcatggagcacctacagcaaagcag

SEQ ID NO: 388270 - DNA, 25 bp, Rattus norvegicus
gcatggagccagaagcccattggat

SEQ ID NO: 388271 - DNA, 25 bp, Rattus norvegicus
gcatggagccagtagcccattggat

SEQ ID NO: 388272 - DNA, 25 bp, Rattus norvegicus
gcatggagctgcaggtagaacacca

SEQ ID NO: 388273 - DNA, 25 bp, Rattus norvegicus
gcatggagctgctggtagaacacca

SEQ ID NO: 388274 - DNA, 25 bp, Rattus norvegicus
gcatggaggaacagccacgtggcat

SEQ ID NO: 388275 - DNA, 25 bp, Rattus norvegicus
gcatggaggaactgccacgtggcat

SEQ ID NO: 388276 - DNA, 25 bp, Rattus norvegicus
gcatggaggaccctttcctgctgac

SEQ ID NO: 388277 - DNA, 25 bp, Rattus norvegicus
gcatggaggaccgtttcctgctgac

SEQ ID NO: 388278 - DNA, 25 bp, Rattus norvegicus
gcatggagtacaccctggacttgct

SEQ ID NO: 388279 - DNA, 25 bp, Rattus norvegicus
gcatggagtacagcctggacttgct

SEQ ID NO: 388280 - DNA, 25 bp, Rattus norvegicus
gcatggagtcctactgtgttcgagc

SEQ ID NO: 388281 - DNA, 25 bp, Rattus norvegicus
gcatggagtccttctgtgttcgagc

SEQ ID NO: 388282 - DNA, 25 bp, Rattus norvegicus
gcatggatacagcaacatagcatct

SEQ ID NO: 388283 - DNA, 25 bp, Rattus norvegicus
gcatggatacaggaacatagcatct

SEQ ID NO: 388284 - DNA, 25 bp, Rattus norvegicus
gcatggatagcaattctgcctactc

SEQ ID NO: 388285 - DNA, 25 bp, Rattus norvegicus
gcatggatagcatttctgcctactc

SEQ ID NO: 388286 - DNA, 25 bp, Rattus norvegicus
gcatggatgttgatatttgtgcata

SEQ ID NO: 388287 - DNA, 25 bp, Rattus norvegicus
gcatggatgttgttatttgtgcata

SEQ ID NO: 388288 - DNA, 25 bp, Rattus norvegicus
gcatggattcctattctccagagaa

SEQ ID NO: 388289 - DNA, 25 bp, Rattus norvegicus
gcatggattccttttctccagagaa

SEQ ID NO: 388290 - DNA, 25 bp, Rattus norvegicus
gcatggattttactcttcttctgaa

SEQ ID NO: 388291 - DNA, 25 bp, Rattus norvegicus
gcatggattttactgcctactgaat

SEQ ID NO: 388292 - DNA, 25 bp, Rattus norvegicus
gcatggattttagtcttcttctgaa

SEQ ID NO: 388293 - DNA, 25 bp, Rattus norvegicus
gcatggattttagtgcctactgaat

SEQ ID NO: 388294 - DNA, 25 bp, Rattus norvegicus
gcatggcaagtacatggcctgctgc

SEQ ID NO: 388295 - DNA, 25 bp, Rattus norvegicus
gcatggcaagtagatggcctgctgc

SEQ ID NO: 388296 - DNA, 25 bp, Rattus norvegicus
gcatggcacaatagacagctgtcag

SEQ ID NO: 388297 - DNA, 25 bp, Rattus norvegicus
gcatggcacaattgacagctgtcag

SEQ ID NO: 388298 - DNA, 25 bp, Rattus norvegicus
gcatggcacgcacaaggctttgagt

SEQ ID NO: 388299 - DNA, 25 bp, Rattus norvegicus
gcatggcacgcagaaggctttgagt

SEQ ID NO: 388300 - DNA, 25 bp, Rattus norvegicus
gcatggcagcctcccagggtcactg

SEQ ID NO: 388301 - DNA, 25 bp, Rattus norvegicus
gcatggcagcctgccagggtcactg

SEQ ID NO: 388302 - DNA, 25 bp, Rattus norvegicus
gcatggcagctgagaggaacctcct

SEQ ID NO: 388303 - DNA, 25 bp, Rattus norvegicus
gcatggcagctgatttactggagag

SEQ ID NO: 388304 - DNA, 25 bp, Rattus norvegicus
gcatggcagctgtgaggaacctcct

SEQ ID NO: 388305 - DNA, 25 bp, Rattus norvegicus
gcatggcagctgttttactggagag

SEQ ID NO: 388306 - DNA, 25 bp, Rattus norvegicus
gcatggcatctcaccaagtgaagac

SEQ ID NO: 388307 - DNA, 25 bp, Rattus norvegicus
gcatggcatctctccaagtgaagac

SEQ ID NO: 388308 - DNA, 25 bp, Rattus norvegicus
gcatggcatgagacaactaatttaa

SEQ ID NO: 388309 - DNA, 25 bp, Rattus norvegicus
gcatggcatgagtcaactaatttaa

SEQ ID NO: 388310 - DNA, 25 bp, Rattus norvegicus
gcatggcatggaagggtatttctct

SEQ ID NO: 388311 - DNA, 25 bp, Rattus norvegicus
gcatggcatggatgggtatttctct

SEQ ID NO: 388312 - DNA, 25 bp, Rattus norvegicus
gcatggcattgcacatacctagaaa

SEQ ID NO: 388313 - DNA, 25 bp, Rattus norvegicus
gcatggcattgcactaacaatacca

SEQ ID NO: 388314 - DNA, 25 bp, Rattus norvegicus
gcatggcattgctcatacctagaaa

SEQ ID NO: 388315 - DNA, 25 bp, Rattus norvegicus
gcatggcattgctctaacaatacca

SEQ ID NO: 388316 - DNA, 25 bp, Rattus norvegicus
gcatggccaaaacacacttgtcttt

SEQ ID NO: 388317 - DNA, 25 bp, Rattus norvegicus
gcatggccaaaagacacttgtcttt

SEQ ID NO: 388318 - DNA, 25 bp, Rattus norvegicus
gcatggccactcacagtgaagaaga

SEQ ID NO: 388319 - DNA, 25 bp, Rattus norvegicus
gcatggccactctcagtgaagaaga

SEQ ID NO: 388320 - DNA, 25 bp, Rattus norvegicus
gcatggccagcgcatccaaaggaga

SEQ ID NO: 388321 - DNA, 25 bp, Rattus norvegicus
gcatggccagcggatccaaaggaga

SEQ ID NO: 388322 - DNA, 25 bp, Rattus norvegicus
gcatggcccgaacaagcaagcgcag

SEQ ID NO: 388323 - DNA, 25 bp, Rattus norvegicus
gcatggcccgaagaagcaagcgcag

SEQ ID NO: 388324 - DNA, 25 bp, Rattus norvegicus
gcatggccctctagtggttggaaaa

SEQ ID NO: 388325 - DNA, 25 bp, Rattus norvegicus
gcatggccctcttgtggttggaaaa

SEQ ID NO: 388326 - DNA, 25 bp, Rattus norvegicus
gcatggcctctgagagctgggccct

SEQ ID NO: 388327 - DNA, 25 bp, Rattus norvegicus
gcatggcctctgtgagctgggccct

SEQ ID NO: 388328 - DNA, 25 bp, Rattus norvegicus
gcatggcctgcaccggaggaaccaa

SEQ ID NO: 388329 - DNA, 25 bp, Rattus norvegicus
gcatggcctgcagcggaggaaccaa

SEQ ID NO: 388330 - DNA, 25 bp, Rattus norvegicus
gcatggccttagcatccatcttcaa

SEQ ID NO: 388331 - DNA, 25 bp, Rattus norvegicus
gcatggccttaggatccatcttcaa

SEQ ID NO: 388332 - DNA, 25 bp, Rattus norvegicus
gcatggcctttcattgattcctttt

SEQ ID NO: 388333 - DNA, 25 bp, Rattus norvegicus
gcatggcctttctttgattcctttt

SEQ ID NO: 388334 - DNA, 25 bp, Rattus norvegicus
gcatggcctttgattctgactcatc

SEQ ID NO: 388335 - DNA, 25 bp, Rattus norvegicus
gcatggcctttgtttctgactcatc

SEQ ID NO: 388336 - DNA, 25 bp, Rattus norvegicus
gcatggcgactaaccctgaggcaat

SEQ ID NO: 388337 - DNA, 25 bp, Rattus norvegicus
gcatggcgactatccctgaggcaat

SEQ ID NO: 388338 - DNA, 25 bp, Rattus norvegicus
gcatggctacataggtgaattcgag

SEQ ID NO: 388339 - DNA, 25 bp, Rattus norvegicus
gcatggctacattggtgaattcgag

SEQ ID NO: 388340 - DNA, 25 bp, Rattus norvegicus
gcatggctaggaagttgggcttccc

SEQ ID NO: 388341 - DNA, 25 bp, Rattus norvegicus
gcatggctaggatgttgggcttccc

SEQ ID NO: 388342 - DNA, 25 bp, Rattus norvegicus
gcatggctatggagtcttaggtgca

SEQ ID NO: 388343 - DNA, 25 bp, Rattus norvegicus
gcatggctatggtgtcttaggtgca

SEQ ID NO: 388344 - DNA, 25 bp, Rattus norvegicus
gcatggctcccacggtggtagcact

SEQ ID NO: 388345 - DNA, 25 bp, Rattus norvegicus
gcatggctcccagggtggtagcact

SEQ ID NO: 388346 - DNA, 25 bp, Rattus norvegicus
gcatggctcctaaaagactttccag

SEQ ID NO: 388347 - DNA, 25 bp, Rattus norvegicus
gcatggctcctataagactttccag

SEQ ID NO: 388348 - DNA, 25 bp, Rattus norvegicus
gcatggctgacaattttgctaaata

SEQ ID NO: 388349 - DNA, 25 bp, Rattus norvegicus
gcatggctgacatttttgctaaata

SEQ ID NO: 388350 - DNA, 25 bp, Rattus norvegicus
gcatggctggttacttgattcttta

SEQ ID NO: 388351 - DNA, 25 bp, Rattus norvegicus
gcatggctggtttcttgattcttta

SEQ ID NO: 388352 - DNA, 25 bp, Rattus norvegicus
gcatggctgtgcaaaactcttttcc

SEQ ID NO: 388353 - DNA, 25 bp, Rattus norvegicus
gcatggctgtgctaaactcttttcc

SEQ ID NO: 388354 - DNA, 25 bp, Rattus norvegicus
gcatggcttacactggctttgaatt

SEQ ID NO: 388355 - DNA, 25 bp, Rattus norvegicus
gcatggcttacagtggctttgaatt

SEQ ID NO: 388356 - DNA, 25 bp, Rattus norvegicus
gcatggcttcacctttcagattaat

SEQ ID NO: 388357 - DNA, 25 bp, Rattus norvegicus
gcatggcttcacgtttcagattaat

SEQ ID NO: 388358 - DNA, 25 bp, Rattus norvegicus
gcatggcttgaacacccacacagaa

SEQ ID NO: 388359 - DNA, 25 bp, Rattus norvegicus
gcatggcttgaagacccacacagaa

SEQ ID NO: 388360 - DNA, 25 bp, Rattus norvegicus
gcatggctttatatttctgctccag

SEQ ID NO: 388361 - DNA, 25 bp, Rattus norvegicus
gcatggctttatttttctgctccag

SEQ ID NO: 388362 - DNA, 25 bp, Rattus norvegicus
gcatggctttctcaactgaacaccc

SEQ ID NO: 388363 - DNA, 25 bp, Rattus norvegicus
gcatggctttctgaactgaacaccc

SEQ ID NO: 388364 - DNA, 25 bp, Rattus norvegicus
gcatgggacgacatagcttctgtac

SEQ ID NO: 388365 - DNA, 25 bp, Rattus norvegicus
gcatgggacgacttagcttctgtac

SEQ ID NO: 388366 - DNA, 25 bp, Rattus norvegicus
gcatgggactgcacattgcctaatg

SEQ ID NO: 388367 - DNA, 25 bp, Rattus norvegicus
gcatgggactgctcattgcctaatg

SEQ ID NO: 388368 - DNA, 25 bp, Rattus norvegicus
gcatgggacttaaactctggagcct

SEQ ID NO: 388369 - DNA, 25 bp, Rattus norvegicus
gcatgggacttatactctggagcct

SEQ ID NO: 388370 - DNA, 25 bp, Rattus norvegicus
gcatgggagattccttcctttatct

SEQ ID NO: 388371 - DNA, 25 bp, Rattus norvegicus
gcatgggagattgcttcctttatct

SEQ ID NO: 388372 - DNA, 25 bp, Rattus norvegicus
gcatgggagcccagactatggaaag

SEQ ID NO: 388373 - DNA, 25 bp, Rattus norvegicus
gcatgggagccctgactatggaaag

SEQ ID NO: 388374 - DNA, 25 bp, Rattus norvegicus
gcatgggagctaactgtcttttgac

SEQ ID NO: 388375 - DNA, 25 bp, Rattus norvegicus
gcatgggagctatctgtcttttgac

SEQ ID NO: 388376 - DNA, 25 bp, Rattus norvegicus
gcatgggatccaacgacagtaagta

SEQ ID NO: 388377 - DNA, 25 bp, Rattus norvegicus
gcatgggatccatcgacagtaagta

SEQ ID NO: 388378 - DNA, 25 bp, Rattus norvegicus
gcatgggatcttattgcccttgcac

SEQ ID NO: 388379 - DNA, 25 bp, Rattus norvegicus
gcatgggatctttttgcccttgcac

SEQ ID NO: 388380 - DNA, 25 bp, Rattus norvegicus
gcatgggatgcacagccacagcctg

SEQ ID NO: 388381 - DNA, 25 bp, Rattus norvegicus
gcatgggatgcagagccacagcctg

SEQ ID NO: 388382 - DNA, 25 bp, Rattus norvegicus
gcatgggcacagcagtaagttcctt

SEQ ID NO: 388383 - DNA, 25 bp, Rattus norvegicus
gcatgggcacaggagtaagttcctt

SEQ ID NO: 388384 - DNA, 25 bp, Rattus norvegicus
gcatgggcaccacatctcttaagtg

SEQ ID NO: 388385 - DNA, 25 bp, Rattus norvegicus
gcatgggcaccagatctcttaagtg

SEQ ID NO: 388386 - DNA, 25 bp, Rattus norvegicus
gcatgggcactcacaaaaagcacat

SEQ ID NO: 388387 - DNA, 25 bp, Rattus norvegicus
gcatgggcactctcaaaaagcacat

SEQ ID NO: 388388 - DNA, 25 bp, Rattus norvegicus
gcatgggcagacacatgttgcctct

SEQ ID NO: 388389 - DNA, 25 bp, Rattus norvegicus
gcatgggcagactcatgttgcctct

SEQ ID NO: 388390 - DNA, 25 bp, Rattus norvegicus
gcatgggcagataggttttattttc

SEQ ID NO: 388391 - DNA, 25 bp, Rattus norvegicus
gcatgggcagattggttttattttc

SEQ ID NO: 388392 - DNA, 25 bp, Rattus norvegicus
gcatgggcaggcagtaagcagcacc

SEQ ID NO: 388393 - DNA, 25 bp, Rattus norvegicus
gcatgggcaggctgtaagcagcacc

SEQ ID NO: 388394 - DNA, 25 bp, Rattus norvegicus
gcatgggcatccacaaaaggctctc

SEQ ID NO: 388395 - DNA, 25 bp, Rattus norvegicus
gcatgggcatcctcaaaaggctctc

SEQ ID NO: 388396 - DNA, 25 bp, Rattus norvegicus
gcatgggccctgagagaaaattgtc

SEQ ID NO: 388397 - DNA, 25 bp, Rattus norvegicus
gcatgggccctgtgagaaaattgtc

SEQ ID NO: 388398 - DNA, 25 bp, Rattus norvegicus
gcatgggccggcagcacatcctcga

SEQ ID NO: 388399 - DNA, 25 bp, Rattus norvegicus
gcatgggccggctgcacatcctcga

SEQ ID NO: 388400 - DNA, 25 bp, Rattus norvegicus
gcatgggctcccaagaactatattg

SEQ ID NO: 388401 - DNA, 25 bp, Rattus norvegicus
gcatgggctccctagaactatattg

SEQ ID NO: 388402 - DNA, 25 bp, Rattus norvegicus
gcatgggctctcactgaatccagag

SEQ ID NO: 388403 - DNA, 25 bp, Rattus norvegicus
gcatgggctctctctgaatccagag

SEQ ID NO: 388404 - DNA, 25 bp, Rattus norvegicus
gcatgggctgcaatatctacagcat

SEQ ID NO: 388405 - DNA, 25 bp, Rattus norvegicus
gcatgggctgcattatctacagcat

SEQ ID NO: 388406 - DNA, 25 bp, Rattus norvegicus
gcatgggctgtcacttattgatctt

SEQ ID NO: 388407 - DNA, 25 bp, Rattus norvegicus
gcatgggctgtctcttattgatctt

SEQ ID NO: 388408 - DNA, 25 bp, Rattus norvegicus
gcatgggcttgcatgatcactccaa

SEQ ID NO: 388409 - DNA, 25 bp, Rattus norvegicus
gcatgggcttgcttgatcactccaa

SEQ ID NO: 388410 - DNA, 25 bp, Rattus norvegicus
gcatgggcttggatcacttcaacaa

SEQ ID NO: 388411 - DNA, 25 bp, Rattus norvegicus
gcatgggcttggttcacttcaacaa

SEQ ID NO: 388412 - DNA, 25 bp, Rattus norvegicus
gcatgggctttaccctgacatggac

SEQ ID NO: 388413 - DNA, 25 bp, Rattus norvegicus
gcatgggctttagcctgacatggac

SEQ ID NO: 388414 - DNA, 25 bp, Rattus norvegicus
gcatgggctttgcagatcttacttc

SEQ ID NO: 388415 - DNA, 25 bp, Rattus norvegicus
gcatgggctttggagatcttacttc

SEQ ID NO: 388416 - DNA, 25 bp, Rattus norvegicus
gcatgggtacctctttgtactcaga

SEQ ID NO: 388417 - DNA, 25 bp, Rattus norvegicus
gcatgggtacctgtttgtactcaga

SEQ ID NO: 388418 - DNA, 25 bp, Rattus norvegicus
gcatgggtccttatgcagttgccaa

SEQ ID NO: 388419 - DNA, 25 bp, Rattus norvegicus
gcatgggtccttttgcagttgccaa

SEQ ID NO: 388420 - DNA, 25 bp, Rattus norvegicus
gcatgggtgggtacagctacttatt

SEQ ID NO: 388421 - DNA, 25 bp, Rattus norvegicus
gcatgggtgggttcagctacttatt

SEQ ID NO: 388422 - DNA, 25 bp, Rattus norvegicus
gcatgggtgtcaccctgttgcacag

SEQ ID NO: 388423 - DNA, 25 bp, Rattus norvegicus
gcatgggtgtcagcctgttgcacag

SEQ ID NO: 388424 - DNA, 25 bp, Rattus norvegicus
gcatgggtgttgcattgactttaat

SEQ ID NO: 388425 - DNA, 25 bp, Rattus norvegicus
gcatgggtgttggattgactttaat

SEQ ID NO: 388426 - DNA, 25 bp, Rattus norvegicus
gcatgggttaacatttcctttgttg

SEQ ID NO: 388427 - DNA, 25 bp, Rattus norvegicus
gcatgggttaacttttcctttgttg

SEQ ID NO: 388428 - DNA, 25 bp, Rattus norvegicus
gcatgggttccaagtccatcaatat

SEQ ID NO: 388429 - DNA, 25 bp, Rattus norvegicus
gcatgggttccatgtccatcaatat

SEQ ID NO: 388430 - DNA, 25 bp, Rattus norvegicus
gcatgggttggaccaccttcaggaa

SEQ ID NO: 388431 - DNA, 25 bp, Rattus norvegicus
gcatgggttggagcaccttcaggaa

SEQ ID NO: 388432 - DNA, 25 bp, Rattus norvegicus
gcatggtaaccgatgatgtcataac

SEQ ID NO: 388433 - DNA, 25 bp, Rattus norvegicus
gcatggtaaccgttgatgtcataac

SEQ ID NO: 388434 - DNA, 25 bp, Rattus norvegicus
gcatggtacagcaccacctgaagag

SEQ ID NO: 388435 - DNA, 25 bp, Rattus norvegicus
gcatggtacagctccacctgaagag

SEQ ID NO: 388436 - DNA, 25 bp, Rattus norvegicus
gcatggtaccaacagctcaattttt

SEQ ID NO: 388437 - DNA, 25 bp, Rattus norvegicus
gcatggtaccaagagctcaattttt

SEQ ID NO: 388438 - DNA, 25 bp, Rattus norvegicus
gcatggtagcacacaaggaggcatt

SEQ ID NO: 388439 - DNA, 25 bp, Rattus norvegicus
gcatggtagcactcaaggaggcatt

SEQ ID NO: 388440 - DNA, 25 bp, Rattus norvegicus
gcatggtagctactctcaaggtcac

SEQ ID NO: 388441 - DNA, 25 bp, Rattus norvegicus
gcatggtagctagtctcaaggtcac

SEQ ID NO: 388442 - DNA, 25 bp, Rattus norvegicus
gcatggtagctcacatcccagcatt

SEQ ID NO: 388443 - DNA, 25 bp, Rattus norvegicus
gcatggtagctctcatcccagcatt

SEQ ID NO: 388444 - DNA, 25 bp, Rattus norvegicus
gcatggtagggcacaactgcttatg

SEQ ID NO: 388445 - DNA, 25 bp, Rattus norvegicus
gcatggtagggctcaactgcttatg

SEQ ID NO: 388446 - DNA, 25 bp, Rattus norvegicus
gcatggtatcgcacattttctaagt

SEQ ID NO: 388447 - DNA, 25 bp, Rattus norvegicus
gcatggtatcgctcattttctaagt

SEQ ID NO: 388448 - DNA, 25 bp, Rattus norvegicus
gcatggtatgccactggaatcagct

SEQ ID NO: 388449 - DNA, 25 bp, Rattus norvegicus
gcatggtatgcctctggaatcagct

SEQ ID NO: 388450 - DNA, 25 bp, Rattus norvegicus
gcatggtcaggcctggcttagcaaa

SEQ ID NO: 388451 - DNA, 25 bp, Rattus norvegicus
gcatggtcaggcgtggcttagcaaa

SEQ ID NO: 388452 - DNA, 25 bp, Rattus norvegicus
gcatggtccatgcttatgagttcag

SEQ ID NO: 388453 - DNA, 25 bp, Rattus norvegicus
gcatggtccatggttatgagttcag

SEQ ID NO: 388454 - DNA, 25 bp, Rattus norvegicus
gcatggtcctggagatcagctccca

SEQ ID NO: 388455 - DNA, 25 bp, Rattus norvegicus
gcatggtcctggtgatcagctccca

SEQ ID NO: 388456 - DNA, 25 bp, Rattus norvegicus
gcatggtctggcctcatatagtaac

SEQ ID NO: 388457 - DNA, 25 bp, Rattus norvegicus
gcatggtctggcgtcatatagtaac

SEQ ID NO: 388458 - DNA, 25 bp, Rattus norvegicus
gcatggtgaaatactcccttttgtt

SEQ ID NO: 388459 - DNA, 25 bp, Rattus norvegicus
gcatggtgaaattctcccttttgtt

SEQ ID NO: 388460 - DNA, 25 bp, Rattus norvegicus
gcatggtgaaggaatgaacttcatt

SEQ ID NO: 388461 - DNA, 25 bp, Rattus norvegicus
gcatggtgaaggtatgaacttcatt

SEQ ID NO: 388462 - DNA, 25 bp, Rattus norvegicus
gcatggtgacatcgaactgtaattc

SEQ ID NO: 388463 - DNA, 25 bp, Rattus norvegicus
gcatggtgacatggaactgtaattc

SEQ ID NO: 388464 - DNA, 25 bp, Rattus norvegicus
gcatggtgagctataaagtctgttt

SEQ ID NO: 388465 - DNA, 25 bp, Rattus norvegicus
gcatggtgagctttaaagtctgttt

SEQ ID NO: 388466 - DNA, 25 bp, Rattus norvegicus
gcatggtgcaaaaccggatctcaga

SEQ ID NO: 388467 - DNA, 25 bp, Rattus norvegicus
gcatggtgcaaatccggatctcaga

SEQ ID NO: 388468 - DNA, 25 bp, Rattus norvegicus
gcatggtgcattcactttttactag

SEQ ID NO: 388469 - DNA, 25 bp, Rattus norvegicus
gcatggtgcattgactttttactag

SEQ ID NO: 388470 - DNA, 25 bp, Rattus norvegicus
gcatggtggaccagccgcagctatt

SEQ ID NO: 388471 - DNA, 25 bp, Rattus norvegicus
gcatggtggacctgccgcagctatt

SEQ ID NO: 388472 - DNA, 25 bp, Rattus norvegicus
gcatggtgggcccagccttttcttt

SEQ ID NO: 388473 - DNA, 25 bp, Rattus norvegicus
gcatggtgggccgagccttttcttt

SEQ ID NO: 388474 - DNA, 25 bp, Rattus norvegicus
gcatggtggtttacacctctaatcc

SEQ ID NO: 388475 - DNA, 25 bp, Rattus norvegicus
gcatggtggttttcacctctaatcc

SEQ ID NO: 388476 - DNA, 25 bp, Rattus norvegicus
gcatggtgtccaattaatgtgcaaa

SEQ ID NO: 388477 - DNA, 25 bp, Rattus norvegicus
gcatggtgtccatttaatgtgcaaa

SEQ ID NO: 388478 - DNA, 25 bp, Rattus norvegicus
gcatggtgtcctcattcataaagtt

SEQ ID NO: 388479 - DNA, 25 bp, Rattus norvegicus
gcatggtgtcctgattcataaagtt

SEQ ID NO: 388480 - DNA, 25 bp, Rattus norvegicus
gcatggttaccacgttttctttgga

SEQ ID NO: 388481 - DNA, 25 bp, Rattus norvegicus
gcatggttaccaggttttctttgga

SEQ ID NO: 388482 - DNA, 25 bp, Rattus norvegicus
gcatggttatcaccacctttgtgaa

SEQ ID NO: 388483 - DNA, 25 bp, Rattus norvegicus
gcatggttatcagcacctttgtgaa

SEQ ID NO: 388484 - DNA, 25 bp, Rattus norvegicus
gcatggttctgactgctgtgtgaca

SEQ ID NO: 388485 - DNA, 25 bp, Rattus norvegicus
gcatggttctgagtgctgtgtgaca

SEQ ID NO: 388486 - DNA, 25 bp, Rattus norvegicus
gcatggttgcacaggcctttaaccc

SEQ ID NO: 388487 - DNA, 25 bp, Rattus norvegicus
gcatggttgcactggcctttaaccc

SEQ ID NO: 388488 - DNA, 25 bp, Rattus norvegicus
gcatgtaacagcagaaccatctctg

SEQ ID NO: 388489 - DNA, 25 bp, Rattus norvegicus
gcatgtaacagctgaaccatctctg

SEQ ID NO: 388490 - DNA, 25 bp, Rattus norvegicus
gcatgtaacccaattgtcctggagg

SEQ ID NO: 388491 - DNA, 25 bp, Rattus norvegicus
gcatgtaacccatttgtcctggagg

SEQ ID NO: 388492 - DNA, 25 bp, Rattus norvegicus
gcatgtaacgtcctcgtacttttcg

SEQ ID NO: 388493 - DNA, 25 bp, Rattus norvegicus
gcatgtaacgtcgtcgtacttttcg

SEQ ID NO: 388494 - DNA, 25 bp, Rattus norvegicus
gcatgtaaggttaccagtgccactg

SEQ ID NO: 388495 - DNA, 25 bp, Rattus norvegicus
gcatgtaaggtttccagtgccactg

SEQ ID NO: 388496 - DNA, 25 bp, Rattus norvegicus
gcatgtaatctcacttgtctgtcaa

SEQ ID NO: 388497 - DNA, 25 bp, Rattus norvegicus
gcatgtaatctctcttgtctgtcaa

SEQ ID NO: 388498 - DNA, 25 bp, Rattus norvegicus
gcatgtaattttatcgcaagtatcg

SEQ ID NO: 388499 - DNA, 25 bp, Rattus norvegicus
gcatgtaattttttcgcaagtatcg

SEQ ID NO: 388500 - DNA, 25 bp, Rattus norvegicus
gcatgtacagatcgtgtgcatcaga

SEQ ID NO: 388501 - DNA, 25 bp, Rattus norvegicus
gcatgtacagatggtgtgcatcaga

SEQ ID NO: 388502 - DNA, 25 bp, Rattus norvegicus
gcatgtaccccgaaggaaagacatt

SEQ ID NO: 388503 - DNA, 25 bp, Rattus norvegicus
gcatgtaccccgtaggaaagacatt

SEQ ID NO: 388504 - DNA, 25 bp, Rattus norvegicus
gcatgtaccctcacaaactggtgtt

SEQ ID NO: 388505 - DNA, 25 bp, Rattus norvegicus
gcatgtaccctctcaaactggtgtt

SEQ ID NO: 388506 - DNA, 25 bp, Rattus norvegicus
gcatgtacctgtatccaagacaacg

SEQ ID NO: 388507 - DNA, 25 bp, Rattus norvegicus
gcatgtacctgtttccaagacaacg

SEQ ID NO: 388508 - DNA, 25 bp, Rattus norvegicus
gcatgtacctttaccccgatttatt

SEQ ID NO: 388509 - DNA, 25 bp, Rattus norvegicus
gcatgtaccttttccccgatttatt

SEQ ID NO: 388510 - DNA, 25 bp, Rattus norvegicus
gcatgtacgtcaaaaccctgcagta

SEQ ID NO: 388511 - DNA, 25 bp, Rattus norvegicus
gcatgtacgtcataaccctgcagta

SEQ ID NO: 388512 - DNA, 25 bp, Rattus norvegicus
gcatgtactagcatctgcattcctc

SEQ ID NO: 388513 - DNA, 25 bp, Rattus norvegicus
gcatgtactagcttctgcattcctc

SEQ ID NO: 388514 - DNA, 25 bp, Rattus norvegicus
gcatgtacttttcgcctgactggaa

SEQ ID NO: 388515 - DNA, 25 bp, Rattus norvegicus
gcatgtacttttggcctgactggaa

SEQ ID NO: 388516 - DNA, 25 bp, Rattus norvegicus
gcatgtatacacagcattttgtcca

SEQ ID NO: 388517 - DNA, 25 bp, Rattus norvegicus
gcatgtatacactgcattttgtcca

SEQ ID NO: 388518 - DNA, 25 bp, Rattus norvegicus
gcatgtatacatcatctacgtgtga

SEQ ID NO: 388519 - DNA, 25 bp, Rattus norvegicus
gcatgtatacatgatctacgtgtga

SEQ ID NO: 388520 - DNA, 25 bp, Rattus norvegicus
gcatgtatatccatgtatatctgta

SEQ ID NO: 388521 - DNA, 25 bp, Rattus norvegicus
gcatgtatatccttgtatatctgta

SEQ ID NO: 388522 - DNA, 25 bp, Rattus norvegicus
gcatgtatcagtcccgaggagcaaa

SEQ ID NO: 388523 - DNA, 25 bp, Rattus norvegicus
gcatgtatcagtgccgaggagcaaa

SEQ ID NO: 388524 - DNA, 25 bp, Rattus norvegicus
gcatgtatcgttaaggaagcagcca

SEQ ID NO: 388525 - DNA, 25 bp, Rattus norvegicus
gcatgtatcgtttaggaagcagcca

SEQ ID NO: 388526 - DNA, 25 bp, Rattus norvegicus
gcatgtatcttcagggccgcggcaa

SEQ ID NO: 388527 - DNA, 25 bp, Rattus norvegicus
gcatgtatcttctgggccgcggcaa

SEQ ID NO: 388528 - DNA, 25 bp, Rattus norvegicus
gcatgtatgagacccattcttcctt

SEQ ID NO: 388529 - DNA, 25 bp, Rattus norvegicus
gcatgtatgagagccattcttcctt

SEQ ID NO: 388530 - DNA, 25 bp, Rattus norvegicus
gcatgtatgccaatcctttttgata

SEQ ID NO: 388531 - DNA, 25 bp, Rattus norvegicus
gcatgtatgccattcctttttgata

SEQ ID NO: 388532 - DNA, 25 bp, Rattus norvegicus
gcatgtatgctgaaaagagagttct

SEQ ID NO: 388533 - DNA, 25 bp, Rattus norvegicus
gcatgtatgctgtaaagagagttct

SEQ ID NO: 388534 - DNA, 25 bp, Rattus norvegicus
gcatgtatgtataatacccggtgct

SEQ ID NO: 388535 - DNA, 25 bp, Rattus norvegicus
gcatgtatgtattatacccggtgct

SEQ ID NO: 388536 - DNA, 25 bp, Rattus norvegicus
gcatgtattcccacttgcagggtaa

SEQ ID NO: 388537 - DNA, 25 bp, Rattus norvegicus
gcatgtattccctcttgcagggtaa

SEQ ID NO: 388538 - DNA, 25 bp, Rattus norvegicus
gcatgtattctgagcagatacccca

SEQ ID NO: 388539 - DNA, 25 bp, Rattus norvegicus
gcatgtattctgtgcagatacccca

SEQ ID NO: 388540 - DNA, 25 bp, Rattus norvegicus
gcatgtatttcaaagcttctcttcg

SEQ ID NO: 388541 - DNA, 25 bp, Rattus norvegicus
gcatgtatttcacaccaggcaagga

SEQ ID NO: 388542 - DNA, 25 bp, Rattus norvegicus
gcatgtatttcagaccaggcaagga

SEQ ID NO: 388543 - DNA, 25 bp, Rattus norvegicus
gcatgtatttcatagcttctcttcg

SEQ ID NO: 388544 - DNA, 25 bp, Rattus norvegicus
gcatgtcaactcaaggtggttcctg

SEQ ID NO: 388545 - DNA, 25 bp, Rattus norvegicus
gcatgtcaactctaggtggttcctg

SEQ ID NO: 388546 - DNA, 25 bp, Rattus norvegicus
gcatgtcaatgcaaaggttccggtg

SEQ ID NO: 388547 - DNA, 25 bp, Rattus norvegicus
gcatgtcaatgctaaggttccggtg

SEQ ID NO: 388548 - DNA, 25 bp, Rattus norvegicus
gcatgtcacataaactcctgaacag

SEQ ID NO: 388549 - DNA, 25 bp, Rattus norvegicus
gcatgtcacatatactcctgaacag

SEQ ID NO: 388550 - DNA, 25 bp, Rattus norvegicus
gcatgtcaccgtcgagcacgtcggt

SEQ ID NO: 388551 - DNA, 25 bp, Rattus norvegicus
gcatgtcaccgtggagcacgtcggt

SEQ ID NO: 388552 - DNA, 25 bp, Rattus norvegicus
gcatgtcaccttaaacagctgttga

SEQ ID NO: 388553 - DNA, 25 bp, Rattus norvegicus
gcatgtcacctttaacagctgttga

SEQ ID NO: 388554 - DNA, 25 bp, Rattus norvegicus
gcatgtcacggactactgtgttctt

SEQ ID NO: 388555 - DNA, 25 bp, Rattus norvegicus
gcatgtcacggagtactgtgttctt

SEQ ID NO: 388556 - DNA, 25 bp, Rattus norvegicus
gcatgtcagtacaggcctcagggat

SEQ ID NO: 388557 - DNA, 25 bp, Rattus norvegicus
gcatgtcagtactggcctcagggat

SEQ ID NO: 388558 - DNA, 25 bp, Rattus norvegicus
gcatgtcatgggatactgttcctgt

SEQ ID NO: 388559 - DNA, 25 bp, Rattus norvegicus
gcatgtcatgggttactgttcctgt

SEQ ID NO: 388560 - DNA, 25 bp, Rattus norvegicus
gcatgtcatggtctaggagtctttc

SEQ ID NO: 388561 - DNA, 25 bp, Rattus norvegicus
gcatgtcatggtgtaggagtctttc

SEQ ID NO: 388562 - DNA, 25 bp, Rattus norvegicus
gcatgtccaaatatgccagctaatt

SEQ ID NO: 388563 - DNA, 25 bp, Rattus norvegicus
gcatgtccaaatttgccagctaatt

SEQ ID NO: 388564 - DNA, 25 bp, Rattus norvegicus
gcatgtccacatcatagccgtattt

SEQ ID NO: 388565 - DNA, 25 bp, Rattus norvegicus
gcatgtccacatgatagccgtattt

SEQ ID NO: 388566 - DNA, 25 bp, Rattus norvegicus
gcatgtccagatcagcaatgagtca

SEQ ID NO: 388567 - DNA, 25 bp, Rattus norvegicus
gcatgtccagatgagcaatgagtca

SEQ ID NO: 388568 - DNA, 25 bp, Rattus norvegicus
gcatgtcccagaacatttctgtgtt

SEQ ID NO: 388569 - DNA, 25 bp, Rattus norvegicus
gcatgtcccagatcatttctgtgtt

SEQ ID NO: 388570 - DNA, 25 bp, Rattus norvegicus
gcatgtcccggcagttttgtaaaaa

SEQ ID NO: 388571 - DNA, 25 bp, Rattus norvegicus
gcatgtcccggctgttttgtaaaaa

SEQ ID NO: 388572 - DNA, 25 bp, Rattus norvegicus
gcatgtccctcaagtcatcgatatt

SEQ ID NO: 388573 - DNA, 25 bp, Rattus norvegicus
gcatgtccctcatgtcatcgatatt

SEQ ID NO: 388574 - DNA, 25 bp, Rattus norvegicus
gcatgtccctttaatcagaataatc

SEQ ID NO: 388575 - DNA, 25 bp, Rattus norvegicus
gcatgtcccttttatcagaataatc

SEQ ID NO: 388576 - DNA, 25 bp, Rattus norvegicus
gcatgtcctcagaagtgtctcgaaa

SEQ ID NO: 388577 - DNA, 25 bp, Rattus norvegicus
gcatgtcctcagtagtgtctcgaaa

SEQ ID NO: 388578 - DNA, 25 bp, Rattus norvegicus
gcatgtcgcagaaggactcgcacaa

SEQ ID NO: 388579 - DNA, 25 bp, Rattus norvegicus
gcatgtcgcagatggactcgcacaa

SEQ ID NO: 388580 - DNA, 25 bp, Rattus norvegicus
gcatgtcgccatcacttaaagtaag

SEQ ID NO: 388581 - DNA, 25 bp, Rattus norvegicus
gcatgtcgccatgacttaaagtaag

SEQ ID NO: 388582 - DNA, 25 bp, Rattus norvegicus
gcatgtcggcatatcttctttatag

SEQ ID NO: 388583 - DNA, 25 bp, Rattus norvegicus
gcatgtcggcatttcttctttatag

SEQ ID NO: 388584 - DNA, 25 bp, Rattus norvegicus
gcatgtctaatactgaccttcctgg

SEQ ID NO: 388585 - DNA, 25 bp, Rattus norvegicus
gcatgtctaatagtgaccttcctgg

SEQ ID NO: 388586 - DNA, 25 bp, Rattus norvegicus
gcatgtctactgaacgtcgtcatta

SEQ ID NO: 388587 - DNA, 25 bp, Rattus norvegicus
gcatgtctactgtacgtcgtcatta

SEQ ID NO: 388588 - DNA, 25 bp, Rattus norvegicus
gcatgtctagagagctctgggctta

SEQ ID NO: 388589 - DNA, 25 bp, Rattus norvegicus
gcatgtctagagtgctctgggctta

SEQ ID NO: 388590 - DNA, 25 bp, Rattus norvegicus
gcatgtctatctatatagagctaca

SEQ ID NO: 388591 - DNA, 25 bp, Rattus norvegicus
gcatgtctatctttatagagctaca

SEQ ID NO: 388592 - DNA, 25 bp, Rattus norvegicus
gcatgtctcagaacacctttgtaat

SEQ ID NO: 388593 - DNA, 25 bp, Rattus norvegicus
gcatgtctcagatcacctttgtaat

SEQ ID NO: 388594 - DNA, 25 bp, Rattus norvegicus
gcatgtctcaggattttgccatgaa

SEQ ID NO: 388595 - DNA, 25 bp, Rattus norvegicus
gcatgtctcaggtttttgccatgaa

SEQ ID NO: 388596 - DNA, 25 bp, Rattus norvegicus
gcatgtctcagtcaggtccttagga

SEQ ID NO: 388597 - DNA, 25 bp, Rattus norvegicus
gcatgtctcagtgaggtccttagga

SEQ ID NO: 388598 - DNA, 25 bp, Rattus norvegicus
gcatgtctcattcgaggagccttct

SEQ ID NO: 388599 - DNA, 25 bp, Rattus norvegicus
gcatgtctcattggaggagccttct

SEQ ID NO: 388600 - DNA, 25 bp, Rattus norvegicus
gcatgtctctctcccaacttaaatg

SEQ ID NO: 388601 - DNA, 25 bp, Rattus norvegicus
gcatgtctctctgccaacttaaatg

SEQ ID NO: 388602 - DNA, 25 bp, Rattus norvegicus
gcatgtctgagaacctagccttcat

SEQ ID NO: 388603 - DNA, 25 bp, Rattus norvegicus
gcatgtctgagatcctagccttcat

SEQ ID NO: 388604 - DNA, 25 bp, Rattus norvegicus
gcatgtctgcctcatcgaggacaag

SEQ ID NO: 388605 - DNA, 25 bp, Rattus norvegicus
gcatgtctgcctgatcgaggacaag

SEQ ID NO: 388606 - DNA, 25 bp, Rattus norvegicus
gcatgtcttagacatctggctcctg

SEQ ID NO: 388607 - DNA, 25 bp, Rattus norvegicus
gcatgtcttagagatctggctcctg

SEQ ID NO: 388608 - DNA, 25 bp, Rattus norvegicus
gcatgtcttctaaagaccttccaaa

SEQ ID NO: 388609 - DNA, 25 bp, Rattus norvegicus
gcatgtcttctatagaccttccaaa

SEQ ID NO: 388610 - DNA, 25 bp, Rattus norvegicus
gcatgtcttgaaatggccggcactg

SEQ ID NO: 388611 - DNA, 25 bp, Rattus norvegicus
gcatgtcttgaattggccggcactg

SEQ ID NO: 388612 - DNA, 25 bp, Rattus norvegicus
gcatgtctttagacccagtattggg

SEQ ID NO: 388613 - DNA, 25 bp, Rattus norvegicus
gcatgtctttagtcccagtattggg

SEQ ID NO: 388614 - DNA, 25 bp, Rattus norvegicus
gcatgtctttgtatatactctgtag

SEQ ID NO: 388615 - DNA, 25 bp, Rattus norvegicus
gcatgtctttgtttatactctgtag

SEQ ID NO: 388616 - DNA, 25 bp, Rattus norvegicus
gcatgtgaattaaatacctcagtgc

SEQ ID NO: 388617 - DNA, 25 bp, Rattus norvegicus
gcatgtgaattatatacctcagtgc

SEQ ID NO: 388618 - DNA, 25 bp, Rattus norvegicus
gcatgtgacaacagaaagccttcag

SEQ ID NO: 388619 - DNA, 25 bp, Rattus norvegicus
gcatgtgacaactgaaagccttcag

SEQ ID NO: 388620 - DNA, 25 bp, Rattus norvegicus
gcatgtgaccaactgttcaagcttt

SEQ ID NO: 388621 - DNA, 25 bp, Rattus norvegicus
gcatgtgaccaagtgttcaagcttt

SEQ ID NO: 388622 - DNA, 25 bp, Rattus norvegicus
gcatgtgacccaactacgactgaag

SEQ ID NO: 388623 - DNA, 25 bp, Rattus norvegicus
gcatgtgacccatctacgactgaag

SEQ ID NO: 388624 - DNA, 25 bp, Rattus norvegicus
gcatgtgaccggaggctgttccaga

SEQ ID NO: 388625 - DNA, 25 bp, Rattus norvegicus
gcatgtgaccggtggctgttccaga

SEQ ID NO: 388626 - DNA, 25 bp, Rattus norvegicus
gcatgtgactgcaagttttggcttt

SEQ ID NO: 388627 - DNA, 25 bp, Rattus norvegicus
gcatgtgactgctagttttggcttt

SEQ ID NO: 388628 - DNA, 25 bp, Rattus norvegicus
gcatgtgagcacaacctgaggagcg

SEQ ID NO: 388629 - DNA, 25 bp, Rattus norvegicus
gcatgtgagcactacctgaggagcg

SEQ ID NO: 388630 - DNA, 25 bp, Rattus norvegicus
gcatgtgatctgatgctcatccaaa

SEQ ID NO: 388631 - DNA, 25 bp, Rattus norvegicus
gcatgtgatctgttgctcatccaaa

SEQ ID NO: 388632 - DNA, 25 bp, Rattus norvegicus
gcatgtgcaaggacctaggcttcct

SEQ ID NO: 388633 - DNA, 25 bp, Rattus norvegicus
gcatgtgcaaggtcctaggcttcct

SEQ ID NO: 388634 - DNA, 25 bp, Rattus norvegicus
gcatgtgcacccctatgcatacata

SEQ ID NO: 388635 - DNA, 25 bp, Rattus norvegicus
gcatgtgcacccgtatgcatacata

SEQ ID NO: 388636 - DNA, 25 bp, Rattus norvegicus
gcatgtgcacctctctgctaagact

SEQ ID NO: 388637 - DNA, 25 bp, Rattus norvegicus
gcatgtgcacctgtctgctaagact

SEQ ID NO: 388638 - DNA, 25 bp, Rattus norvegicus
gcatgtgcacgaataacacctaggt

SEQ ID NO: 388639 - DNA, 25 bp, Rattus norvegicus
gcatgtgcacgattaacacctaggt

SEQ ID NO: 388640 - DNA, 25 bp, Rattus norvegicus
gcatgtgcatgtatacctcactcat

SEQ ID NO: 388641 - DNA, 25 bp, Rattus norvegicus
gcatgtgcatgtttacctcactcat

SEQ ID NO: 388642 - DNA, 25 bp, Rattus norvegicus
gcatgtgccataatgtttctttcca

SEQ ID NO: 388643 - DNA, 25 bp, Rattus norvegicus
gcatgtgccatattgtttctttcca

SEQ ID NO: 388644 - DNA, 25 bp, Rattus norvegicus
gcatgtgccgccagtcactctgaac

SEQ ID NO: 388645 - DNA, 25 bp, Rattus norvegicus
gcatgtgccgcctgtcactctgaac

SEQ ID NO: 388646 - DNA, 25 bp, Rattus norvegicus
gcatgtgcgatccagagtttatatt

SEQ ID NO: 388647 - DNA, 25 bp, Rattus norvegicus
gcatgtgcgatcgagagtttatatt

SEQ ID NO: 388648 - DNA, 25 bp, Rattus norvegicus
gcatgtgcgatgcttctgcttgcaa

SEQ ID NO: 388649 - DNA, 25 bp, Rattus norvegicus
gcatgtgcgatggttctgcttgcaa

SEQ ID NO: 388650 - DNA, 25 bp, Rattus norvegicus
gcatgtgcgcggacaagttcggctt

SEQ ID NO: 388651 - DNA, 25 bp, Rattus norvegicus
gcatgtgcgcggtcaagttcggctt

SEQ ID NO: 388652 - DNA, 25 bp, Rattus norvegicus
gcatgtgctaacaactcagctactg

SEQ ID NO: 388653 - DNA, 25 bp, Rattus norvegicus
gcatgtgctaactactcagctactg

SEQ ID NO: 388654 - DNA, 25 bp, Rattus norvegicus
gcatgtgctaagattgccatctggt

SEQ ID NO: 388655 - DNA, 25 bp, Rattus norvegicus
gcatgtgctaagtttgccatctggt

SEQ ID NO: 388656 - DNA, 25 bp, Rattus norvegicus
gcatgtgctactacacaggttagta

SEQ ID NO: 388657 - DNA, 25 bp, Rattus norvegicus
gcatgtgctacttcacaggttagta

SEQ ID NO: 388658 - DNA, 25 bp, Rattus norvegicus
gcatgtgctatgatctgtgtggtcg

SEQ ID NO: 388659 - DNA, 25 bp, Rattus norvegicus
gcatgtgctatgttctgtgtggtcg

SEQ ID NO: 388660 - DNA, 25 bp, Rattus norvegicus
gcatgtgctctaaccctcaataaaa

SEQ ID NO: 388661 - DNA, 25 bp, Rattus norvegicus
gcatgtgctctactgacattaattc

SEQ ID NO: 388662 - DNA, 25 bp, Rattus norvegicus
gcatgtgctctagtgacattaattc

SEQ ID NO: 388663 - DNA, 25 bp, Rattus norvegicus
gcatgtgctctatccctcaataaaa

SEQ ID NO: 388664 - DNA, 25 bp, Rattus norvegicus
gcatgtgctgacagttagcctacgt

SEQ ID NO: 388665 - DNA, 25 bp, Rattus norvegicus
gcatgtgctgactgttagcctacgt

SEQ ID NO: 388666 - DNA, 25 bp, Rattus norvegicus
gcatgtggacagacgcgagcgttta

SEQ ID NO: 388667 - DNA, 25 bp, Rattus norvegicus
gcatgtggacagtcgcgagcgttta

SEQ ID NO: 388668 - DNA, 25 bp, Rattus norvegicus
gcatgtggagacacagccctgtcaa

SEQ ID NO: 388669 - DNA, 25 bp, Rattus norvegicus
gcatgtggagactcagccctgtcaa

SEQ ID NO: 388670 - DNA, 25 bp, Rattus norvegicus
gcatgtggagcgcatcgttcgccaa

SEQ ID NO: 388671 - DNA, 25 bp, Rattus norvegicus
gcatgtggagcggatcgttcgccaa

SEQ ID NO: 388672 - DNA, 25 bp, Rattus norvegicus
gcatgtggccgtcaatgaggaaata

SEQ ID NO: 388673 - DNA, 25 bp, Rattus norvegicus
gcatgtggccgtgaatgaggaaata

SEQ ID NO: 388674 - DNA, 25 bp, Rattus norvegicus
gcatgtggctataccgctggcaaaa

SEQ ID NO: 388675 - DNA, 25 bp, Rattus norvegicus
gcatgtggctattccgctggcaaaa

SEQ ID NO: 388676 - DNA, 25 bp, Rattus norvegicus
gcatgtgggatgcacctagtattaa

SEQ ID NO: 388677 - DNA, 25 bp, Rattus norvegicus
gcatgtgggatggacctagtattaa

SEQ ID NO: 388678 - DNA, 25 bp, Rattus norvegicus
gcatgtggtctgagtgctgactaga

SEQ ID NO: 388679 - DNA, 25 bp, Rattus norvegicus
gcatgtggtctgtgtgctgactaga

SEQ ID NO: 388680 - DNA, 25 bp, Rattus norvegicus
gcatgtggttctcgcgttgaagtca

SEQ ID NO: 388681 - DNA, 25 bp, Rattus norvegicus
gcatgtggttctggcgttgaagtca

SEQ ID NO: 388682 - DNA, 25 bp, Rattus norvegicus
gcatgtgtaacaaccagaggcgagc

SEQ ID NO: 388683 - DNA, 25 bp, Rattus norvegicus
gcatgtgtaacatccagaggcgagc

SEQ ID NO: 388684 - DNA, 25 bp, Rattus norvegicus
gcatgtgtaagacgtaatggttcca

SEQ ID NO: 388685 - DNA, 25 bp, Rattus norvegicus
gcatgtgtaagaggtaatggttcca

SEQ ID NO: 388686 - DNA, 25 bp, Rattus norvegicus
gcatgtgtaagtagcccagcgggaa

SEQ ID NO: 388687 - DNA, 25 bp, Rattus norvegicus
gcatgtgtaagttgcccagcgggaa

SEQ ID NO: 388688 - DNA, 25 bp, Rattus norvegicus
gcatgtgtacatctccatggtgttt

SEQ ID NO: 388689 - DNA, 25 bp, Rattus norvegicus
gcatgtgtacatgtccatggtgttt

SEQ ID NO: 388690 - DNA, 25 bp, Rattus norvegicus
gcatgtgtacctccacatgcacata

SEQ ID NO: 388691 - DNA, 25 bp, Rattus norvegicus
gcatgtgtacctccagtgcaatgat

SEQ ID NO: 388692 - DNA, 25 bp, Rattus norvegicus
gcatgtgtacctgcacatgcacata

SEQ ID NO: 388693 - DNA, 25 bp, Rattus norvegicus
gcatgtgtacctgcagtgcaatgat

SEQ ID NO: 388694 - DNA, 25 bp, Rattus norvegicus
gcatgtgtcactctacctgttttat

SEQ ID NO: 388695 - DNA, 25 bp, Rattus norvegicus
gcatgtgtcactgtacctgttttat

SEQ ID NO: 388696 - DNA, 25 bp, Rattus norvegicus
gcatgtgtcagacctcccgtgataa

SEQ ID NO: 388697 - DNA, 25 bp, Rattus norvegicus
gcatgtgtcagagctcccgtgataa

SEQ ID NO: 388698 - DNA, 25 bp, Rattus norvegicus
gcatgtgtcaggctgcctggctcaa

SEQ ID NO: 388699 - DNA, 25 bp, Rattus norvegicus
gcatgtgtcagggtgcctggctcaa

SEQ ID NO: 388700 - DNA, 25 bp, Rattus norvegicus
gcatgtgtccacagtgctaaaggca

SEQ ID NO: 388701 - DNA, 25 bp, Rattus norvegicus
gcatgtgtccactgtgctaaaggca

SEQ ID NO: 388702 - DNA, 25 bp, Rattus norvegicus
gcatgtgtccctaatgccgcatggg

SEQ ID NO: 388703 - DNA, 25 bp, Rattus norvegicus
gcatgtgtcccttatgccgcatggg

SEQ ID NO: 388704 - DNA, 25 bp, Rattus norvegicus
gcatgtgtccgtcgcatgtatgcac

SEQ ID NO: 388705 - DNA, 25 bp, Rattus norvegicus
gcatgtgtccgtggcatgtatgcac

SEQ ID NO: 388706 - DNA, 25 bp, Rattus norvegicus
gcatgtgtctgtccattctgattac

SEQ ID NO: 388707 - DNA, 25 bp, Rattus norvegicus
gcatgtgtctgtgcattctgattac

SEQ ID NO: 388708 - DNA, 25 bp, Rattus norvegicus
gcatgtgtcttcactttgtggccat

SEQ ID NO: 388709 - DNA, 25 bp, Rattus norvegicus
gcatgtgtcttcattctgcagcaga

SEQ ID NO: 388710 - DNA, 25 bp, Rattus norvegicus
gcatgtgtcttctctttgtggccat

SEQ ID NO: 388711 - DNA, 25 bp, Rattus norvegicus
gcatgtgtcttctttctgcagcaga

SEQ ID NO: 388712 - DNA, 25 bp, Rattus norvegicus
gcatgtgtgagcacggcagcaccgt

SEQ ID NO: 388713 - DNA, 25 bp, Rattus norvegicus
gcatgtgtgagctcggcagcaccgt

SEQ ID NO: 388714 - DNA, 25 bp, Rattus norvegicus
gcatgtgtgattactggctcttgtc

SEQ ID NO: 388715 - DNA, 25 bp, Rattus norvegicus
gcatgtgtgattctctgagtgccag

SEQ ID NO: 388716 - DNA, 25 bp, Rattus norvegicus
gcatgtgtgattgtctgagtgccag

SEQ ID NO: 388717 - DNA, 25 bp, Rattus norvegicus
gcatgtgtgatttctggctcttgtc

SEQ ID NO: 388718 - DNA, 25 bp, Rattus norvegicus
gcatgtgtgcagaggctgtttcatt

SEQ ID NO: 388719 - DNA, 25 bp, Rattus norvegicus
gcatgtgtgcagtggctgtttcatt

SEQ ID NO: 388720 - DNA, 25 bp, Rattus norvegicus
gcatgtgtgcgccagaggataacct

SEQ ID NO: 388721 - DNA, 25 bp, Rattus norvegicus
gcatgtgtgcgcgagaggataacct

SEQ ID NO: 388722 - DNA, 25 bp, Rattus norvegicus
gcatgtgtgctcagatgtagaacta

SEQ ID NO: 388723 - DNA, 25 bp, Rattus norvegicus
gcatgtgtgctctgatgtagaacta

SEQ ID NO: 388724 - DNA, 25 bp, Rattus norvegicus
gcatgtgtgcttcgtagatactttc

SEQ ID NO: 388725 - DNA, 25 bp, Rattus norvegicus
gcatgtgtgcttctccagaagcctg

SEQ ID NO: 388726 - DNA, 25 bp, Rattus norvegicus
gcatgtgtgcttggtagatactttc

SEQ ID NO: 388727 - DNA, 25 bp, Rattus norvegicus
gcatgtgtgcttgtccagaagcctg

SEQ ID NO: 388728 - DNA, 25 bp, Rattus norvegicus
gcatgtgtgtatcgcagctggcaca

SEQ ID NO: 388729 - DNA, 25 bp, Rattus norvegicus
gcatgtgtgtatggcagctggcaca

SEQ ID NO: 388730 - DNA, 25 bp, Rattus norvegicus
gcatgtgtgtcactttccttgaaaa

SEQ ID NO: 388731 - DNA, 25 bp, Rattus norvegicus
gcatgtgtgtcagtttccttgaaaa

SEQ ID NO: 388732 - DNA, 25 bp, Rattus norvegicus
gcatgtgtgtctaaaattatatcaa

SEQ ID NO: 388733 - DNA, 25 bp, Rattus norvegicus
gcatgtgtgtcttaaattatatcaa

SEQ ID NO: 388734 - DNA, 25 bp, Rattus norvegicus
gcatgtgtgtttcctcgctcacttg

SEQ ID NO: 388735 - DNA, 25 bp, Rattus norvegicus
gcatgtgtgtttctcctctcttagt

SEQ ID NO: 388736 - DNA, 25 bp, Rattus norvegicus
gcatgtgtgtttgctcgctcacttg

SEQ ID NO: 388737 - DNA, 25 bp, Rattus norvegicus
gcatgtgtgtttgtcctctcttagt

SEQ ID NO: 388738 - DNA, 25 bp, Rattus norvegicus
gcatgtgttcaacattcctggtctc

SEQ ID NO: 388739 - DNA, 25 bp, Rattus norvegicus
gcatgtgttcaagattcctggtctc

SEQ ID NO: 388740 - DNA, 25 bp, Rattus norvegicus
gcatgtgtttcaaaatctgggtgat

SEQ ID NO: 388741 - DNA, 25 bp, Rattus norvegicus
gcatgtgtttcataatctgggtgat

SEQ ID NO: 388742 - DNA, 25 bp, Rattus norvegicus
gcatgttaaacactgggactctttt

SEQ ID NO: 388743 - DNA, 25 bp, Rattus norvegicus
gcatgttaaacagtgggactctttt

SEQ ID NO: 388744 - DNA, 25 bp, Rattus norvegicus
gcatgttaacttaccgtgccataaa

SEQ ID NO: 388745 - DNA, 25 bp, Rattus norvegicus
gcatgttaactttccgtgccataaa

SEQ ID NO: 388746 - DNA, 25 bp, Rattus norvegicus
gcatgttaatatctttcgttatggg

SEQ ID NO: 388747 - DNA, 25 bp, Rattus norvegicus
gcatgttaatatgtttcgttatggg

SEQ ID NO: 388748 - DNA, 25 bp, Rattus norvegicus
gcatgttacaatcgttttcccttaa

SEQ ID NO: 388749 - DNA, 25 bp, Rattus norvegicus
gcatgttacaatggttttcccttaa

SEQ ID NO: 388750 - DNA, 25 bp, Rattus norvegicus
gcatgttacactcttcttcaaagga

SEQ ID NO: 388751 - DNA, 25 bp, Rattus norvegicus
gcatgttacactgttcttcaaagga

SEQ ID NO: 388752 - DNA, 25 bp, Rattus norvegicus
gcatgttacagtattctgggtttta

SEQ ID NO: 388753 - DNA, 25 bp, Rattus norvegicus
gcatgttacagttttctgggtttta

SEQ ID NO: 388754 - DNA, 25 bp, Rattus norvegicus
gcatgttacccacttgaccattgta

SEQ ID NO: 388755 - DNA, 25 bp, Rattus norvegicus
gcatgttacccagttgaccattgta

SEQ ID NO: 388756 - DNA, 25 bp, Rattus norvegicus
gcatgttcactcagagctctgagga

SEQ ID NO: 388757 - DNA, 25 bp, Rattus norvegicus
gcatgttcactctgagctctgagga

SEQ ID NO: 388758 - DNA, 25 bp, Rattus norvegicus
gcatgttcagaaacaggtggacgaa

SEQ ID NO: 388759 - DNA, 25 bp, Rattus norvegicus
gcatgttcagaatcaggtggacgaa

SEQ ID NO: 388760 - DNA, 25 bp, Rattus norvegicus
gcatgttcaggcaagctccgaagtt

SEQ ID NO: 388761 - DNA, 25 bp, Rattus norvegicus
gcatgttcaggctagctccgaagtt

SEQ ID NO: 388762 - DNA, 25 bp, Rattus norvegicus
gcatgttcatgcctggtgcccatgg

SEQ ID NO: 388763 - DNA, 25 bp, Rattus norvegicus
gcatgttcatgcgtggtgcccatgg

SEQ ID NO: 388764 - DNA, 25 bp, Rattus norvegicus
gcatgttcctagacttgtggtcaga

SEQ ID NO: 388765 - DNA, 25 bp, Rattus norvegicus
gcatgttcctagtcttgtggtcaga

SEQ ID NO: 388766 - DNA, 25 bp, Rattus norvegicus
gcatgttcctcgactcaacaaatgc

SEQ ID NO: 388767 - DNA, 25 bp, Rattus norvegicus
gcatgttcctcgtctcaacaaatgc

SEQ ID NO: 388768 - DNA, 25 bp, Rattus norvegicus
gcatgttccttcaccgggactgtgg

SEQ ID NO: 388769 - DNA, 25 bp, Rattus norvegicus
gcatgttccttcagtatgatactca

SEQ ID NO: 388770 - DNA, 25 bp, Rattus norvegicus
gcatgttccttctccgggactgtgg

SEQ ID NO: 388771 - DNA, 25 bp, Rattus norvegicus
gcatgttccttctgtatgatactca

SEQ ID NO: 388772 - DNA, 25 bp, Rattus norvegicus
gcatgttctgctcttcttattctat

SEQ ID NO: 388773 - DNA, 25 bp, Rattus norvegicus
gcatgttctgctgttcttattctat

SEQ ID NO: 388774 - DNA, 25 bp, Rattus norvegicus
gcatgttgatatactaggcggtttc

SEQ ID NO: 388775 - DNA, 25 bp, Rattus norvegicus
gcatgttgatattctaggcggtttc

SEQ ID NO: 388776 - DNA, 25 bp, Rattus norvegicus
gcatgttgctggatttgatagtcac

SEQ ID NO: 388777 - DNA, 25 bp, Rattus norvegicus
gcatgttgctggttttgatagtcac

SEQ ID NO: 388778 - DNA, 25 bp, Rattus norvegicus
gcatgttgggccacaagatcaccta

SEQ ID NO: 388779 - DNA, 25 bp, Rattus norvegicus
gcatgttgggcctcaagatcaccta

SEQ ID NO: 388780 - DNA, 25 bp, Rattus norvegicus
gcatgttgtagcaactggtggccag

SEQ ID NO: 388781 - DNA, 25 bp, Rattus norvegicus
gcatgttgtagctactggtggccag

SEQ ID NO: 388782 - DNA, 25 bp, Rattus norvegicus
gcatgttgtttgagacatccctctc

SEQ ID NO: 388783 - DNA, 25 bp, Rattus norvegicus
gcatgttgtttgtgacatccctctc

SEQ ID NO: 388784 - DNA, 25 bp, Rattus norvegicus
gcatgtttaagccatatttttatat

SEQ ID NO: 388785 - DNA, 25 bp, Rattus norvegicus
gcatgtttaagcgatatttttatat

SEQ ID NO: 388786 - DNA, 25 bp, Rattus norvegicus
gcatgtttacagaggctggactcat

SEQ ID NO: 388787 - DNA, 25 bp, Rattus norvegicus
gcatgtttacagtggctggactcat

SEQ ID NO: 388788 - DNA, 25 bp, Rattus norvegicus
gcatgtttatgcaatgttcactata

SEQ ID NO: 388789 - DNA, 25 bp, Rattus norvegicus
gcatgtttatgctatgttcactata

SEQ ID NO: 388790 - DNA, 25 bp, Rattus norvegicus
gcatgtttcagacgttttgccacac

SEQ ID NO: 388791 - DNA, 25 bp, Rattus norvegicus
gcatgtttcagaggttttgccacac

SEQ ID NO: 388792 - DNA, 25 bp, Rattus norvegicus
gcatgtttccatcgtgattctgagt

SEQ ID NO: 388793 - DNA, 25 bp, Rattus norvegicus
gcatgtttccatggtgattctgagt

SEQ ID NO: 388794 - DNA, 25 bp, Rattus norvegicus
gcatgtttcgtcatatttctagcta

SEQ ID NO: 388795 - DNA, 25 bp, Rattus norvegicus
gcatgtttcgtcttatttctagcta

SEQ ID NO: 388796 - DNA, 25 bp, Rattus norvegicus
gcatgtttctccaagatcaccaaga

SEQ ID NO: 388797 - DNA, 25 bp, Rattus norvegicus
gcatgtttctcctagatcaccaaga

SEQ ID NO: 388798 - DNA, 25 bp, Rattus norvegicus
gcatgtttctctaaaggctacctgt

SEQ ID NO: 388799 - DNA, 25 bp, Rattus norvegicus
gcatgtttctctccactatggattt

SEQ ID NO: 388800 - DNA, 25 bp, Rattus norvegicus
gcatgtttctctgcactatggattt

SEQ ID NO: 388801 - DNA, 25 bp, Rattus norvegicus
gcatgtttctcttaaggctacctgt

SEQ ID NO: 388802 - DNA, 25 bp, Rattus norvegicus
gcatgtttgcaacacacacttacat

SEQ ID NO: 388803 - DNA, 25 bp, Rattus norvegicus
gcatgtttgcaagacacacttacat

SEQ ID NO: 388804 - DNA, 25 bp, Rattus norvegicus
gcatgtttgcgtctgtttcctcctt

SEQ ID NO: 388805 - DNA, 25 bp, Rattus norvegicus
gcatgtttgcgtgtgtttcctcctt

SEQ ID NO: 388806 - DNA, 25 bp, Rattus norvegicus
gcatgtttgctgaatataactcttt

SEQ ID NO: 388807 - DNA, 25 bp, Rattus norvegicus
gcatgtttgctgtatataactcttt

SEQ ID NO: 388808 - DNA, 25 bp, Rattus norvegicus
gcatgtttgtgcactacagtatgta

SEQ ID NO: 388809 - DNA, 25 bp, Rattus norvegicus
gcatgtttgtgctctacagtatgta

SEQ ID NO: 388810 - DNA, 25 bp, Rattus norvegicus
gcatgttttcatcctgttagcctta

SEQ ID NO: 388811 - DNA, 25 bp, Rattus norvegicus
gcatgttttcatgctgttagcctta

SEQ ID NO: 388812 - DNA, 25 bp, Rattus norvegicus
gcatgttttgttaggtgctacagtg

SEQ ID NO: 388813 - DNA, 25 bp, Rattus norvegicus
gcatgttttgtttggtgctacagtg

SEQ ID NO: 388814 - DNA, 25 bp, Rattus norvegicus
gcatgttttttacttccttgagtca

SEQ ID NO: 388815 - DNA, 25 bp, Rattus norvegicus
gcatgttttttagttccttgagtca

SEQ ID NO: 388816 - DNA, 25 bp, Rattus norvegicus
gcattaaaactcacttcccaaactt

SEQ ID NO: 388817 - DNA, 25 bp, Rattus norvegicus
gcattaaaactctcttcccaaactt

SEQ ID NO: 388818 - DNA, 25 bp, Rattus norvegicus
gcattaaaacttcggcactgccaga

SEQ ID NO: 388819 - DNA, 25 bp, Rattus norvegicus
gcattaaaacttgggcactgccaga

SEQ ID NO: 388820 - DNA, 25 bp, Rattus norvegicus
gcattaaaccttcttcgtacgcctt

SEQ ID NO: 388821 - DNA, 25 bp, Rattus norvegicus
gcattaaaccttgttcgtacgcctt

SEQ ID NO: 388822 - DNA, 25 bp, Rattus norvegicus
gcattaaactgcatataccgtggag

SEQ ID NO: 388823 - DNA, 25 bp, Rattus norvegicus
gcattaaactgcttataccgtggag

SEQ ID NO: 388824 - DNA, 25 bp, Rattus norvegicus
gcattaaacttactgtgaacttaca

SEQ ID NO: 388825 - DNA, 25 bp, Rattus norvegicus
gcattaaacttagtgtgaacttaca

SEQ ID NO: 388826 - DNA, 25 bp, Rattus norvegicus
gcattaaagattatcccgccatacg

SEQ ID NO: 388827 - DNA, 25 bp, Rattus norvegicus
gcattaaagattttcccgccatacg

SEQ ID NO: 388828 - DNA, 25 bp, Rattus norvegicus
gcattaaagcagctgattcctcccc

SEQ ID NO: 388829 - DNA, 25 bp, Rattus norvegicus
gcattaaagcaggtgattcctcccc

SEQ ID NO: 388830 - DNA, 25 bp, Rattus norvegicus
gcattaaataaacttgccttccctg

SEQ ID NO: 388831 - DNA, 25 bp, Rattus norvegicus
gcattaaataaagttgccttccctg

SEQ ID NO: 388832 - DNA, 25 bp, Rattus norvegicus
gcattaacacctccagattccgggt

SEQ ID NO: 388833 - DNA, 25 bp, Rattus norvegicus
gcattaacacctgcagattccgggt

SEQ ID NO: 388834 - DNA, 25 bp, Rattus norvegicus
gcattaacagagcatgggaccgact

SEQ ID NO: 388835 - DNA, 25 bp, Rattus norvegicus
gcattaacagaggatgggaccgact

SEQ ID NO: 388836 - DNA, 25 bp, Rattus norvegicus
gcattaacttctcggcactttttcc

SEQ ID NO: 388837 - DNA, 25 bp, Rattus norvegicus
gcattaacttctgggcactttttcc

SEQ ID NO: 388838 - DNA, 25 bp, Rattus norvegicus
gcattaagattcctgtagcgccacc

SEQ ID NO: 388839 - DNA, 25 bp, Rattus norvegicus
gcattaagattcgtgtagcgccacc

SEQ ID NO: 388840 - DNA, 25 bp, Rattus norvegicus
gcattaagcgacagcggagactcta

SEQ ID NO: 388841 - DNA, 25 bp, Rattus norvegicus
gcattaagcgactgcggagactcta

SEQ ID NO: 388842 - DNA, 25 bp, Rattus norvegicus
gcattaaggttaagaatcgccgaag

SEQ ID NO: 388843 - DNA, 25 bp, Rattus norvegicus
gcattaaggttatgaatcgccgaag

SEQ ID NO: 388844 - DNA, 25 bp, Rattus norvegicus
gcattaaggttgattactctgaagt

SEQ ID NO: 388845 - DNA, 25 bp, Rattus norvegicus
gcattaaggttgtttactctgaagt

SEQ ID NO: 388846 - DNA, 25 bp, Rattus norvegicus
gcattaagtcagagaacacgcacat

SEQ ID NO: 388847 - DNA, 25 bp, Rattus norvegicus
gcattaagtcagtgaacacgcacat

SEQ ID NO: 388848 - DNA, 25 bp, Rattus norvegicus
gcattacagaagaccggtgccttcc

SEQ ID NO: 388849 - DNA, 25 bp, Rattus norvegicus
gcattacagaagtccggtgccttcc

SEQ ID NO: 388850 - DNA, 25 bp, Rattus norvegicus
gcattacatggaactggtgtcatct

SEQ ID NO: 388851 - DNA, 25 bp, Rattus norvegicus
gcattacatggatctggtgtcatct

SEQ ID NO: 388852 - DNA, 25 bp, Rattus norvegicus
gcattacatttgactgtctgcgtgt

SEQ ID NO: 388853 - DNA, 25 bp, Rattus norvegicus
gcattacatttgtctgtctgcgtgt

SEQ ID NO: 388854 - DNA, 25 bp, Rattus norvegicus
gcattaccaaagacctccagggaaa

SEQ ID NO: 388855 - DNA, 25 bp, Rattus norvegicus
gcattaccaaagtcctccagggaaa

SEQ ID NO: 388856 - DNA, 25 bp, Rattus norvegicus
gcattaccctaaattttcgagcaca

SEQ ID NO: 388857 - DNA, 25 bp, Rattus norvegicus
gcattaccctaatttttcgagcaca

SEQ ID NO: 388858 - DNA, 25 bp, Rattus norvegicus
gcattacctcagattatgtcccagc

SEQ ID NO: 388859 - DNA, 25 bp, Rattus norvegicus
gcattacctcagtttatgtcccagc

SEQ ID NO: 388860 - DNA, 25 bp, Rattus norvegicus
gcattaccttgtattgccccaaatt

SEQ ID NO: 388861 - DNA, 25 bp, Rattus norvegicus
gcattaccttgttttgccccaaatt

SEQ ID NO: 388862 - DNA, 25 bp, Rattus norvegicus
gcattacgtaccatcctagaactta

SEQ ID NO: 388863 - DNA, 25 bp, Rattus norvegicus
gcattacgtaccttcctagaactta

SEQ ID NO: 388864 - DNA, 25 bp, Rattus norvegicus
gcattactcattattgcacctaaaa

SEQ ID NO: 388865 - DNA, 25 bp, Rattus norvegicus
gcattactcatttttgcacctaaaa

SEQ ID NO: 388866 - DNA, 25 bp, Rattus norvegicus
gcattactcgtgcagaaagctcaat

SEQ ID NO: 388867 - DNA, 25 bp, Rattus norvegicus
gcattactcgtggagaaagctcaat

SEQ ID NO: 388868 - DNA, 25 bp, Rattus norvegicus
gcattactgctgcagattttgaaac

SEQ ID NO: 388869 - DNA, 25 bp, Rattus norvegicus
gcattactgctggagattttgaaac

SEQ ID NO: 388870 - DNA, 25 bp, Rattus norvegicus
gcattagaatgtcgattgggcccta

SEQ ID NO: 388871 - DNA, 25 bp, Rattus norvegicus
gcattagaatgtggattgggcccta

SEQ ID NO: 388872 - DNA, 25 bp, Rattus norvegicus
gcattagaattcactgttgtcaaca

SEQ ID NO: 388873 - DNA, 25 bp, Rattus norvegicus
gcattagaattctctgttgtcaaca

SEQ ID NO: 388874 - DNA, 25 bp, Rattus norvegicus
gcattagactttattagctgcccta

SEQ ID NO: 388875 - DNA, 25 bp, Rattus norvegicus
gcattagacttttttagctgcccta

SEQ ID NO: 388876 - DNA, 25 bp, Rattus norvegicus
gcattagagagtcctgtgccttcag

SEQ ID NO: 388877 - DNA, 25 bp, Rattus norvegicus
gcattagagagtgctgtgccttcag

SEQ ID NO: 388878 - DNA, 25 bp, Rattus norvegicus
gcattagaggccaacctgggccatc

SEQ ID NO: 388879 - DNA, 25 bp, Rattus norvegicus
gcattagaggcctacctgggccatc

SEQ ID NO: 388880 - DNA, 25 bp, Rattus norvegicus
gcattagcaggacacagacccaggt

SEQ ID NO: 388881 - DNA, 25 bp, Rattus norvegicus
gcattagcaggagacagacccaggt

SEQ ID NO: 388882 - DNA, 25 bp, Rattus norvegicus
gcattagccactaaacagcagcagt

SEQ ID NO: 388883 - DNA, 25 bp, Rattus norvegicus
gcattagccacttaacagcagcagt

SEQ ID NO: 388884 - DNA, 25 bp, Rattus norvegicus
gcattagccggtacaccaatgtttt

SEQ ID NO: 388885 - DNA, 25 bp, Rattus norvegicus
gcattagccggttcaccaatgtttt

SEQ ID NO: 388886 - DNA, 25 bp, Rattus norvegicus
gcattagctagaaagaccctccaga

SEQ ID NO: 388887 - DNA, 25 bp, Rattus norvegicus
gcattagctagatagaccctccaga

SEQ ID NO: 388888 - DNA, 25 bp, Rattus norvegicus
gcattagctctactattcggtcaca

SEQ ID NO: 388889 - DNA, 25 bp, Rattus norvegicus
gcattagctctagtattcggtcaca

SEQ ID NO: 388890 - DNA, 25 bp, Rattus norvegicus
gcattagctggacttctgtttacaa

SEQ ID NO: 388891 - DNA, 25 bp, Rattus norvegicus
gcattagctggagttctgtttacaa

SEQ ID NO: 388892 - DNA, 25 bp, Rattus norvegicus
gcattaggaatgactcagctcagga

SEQ ID NO: 388893 - DNA, 25 bp, Rattus norvegicus
gcattaggaatgtctcagctcagga

SEQ ID NO: 388894 - DNA, 25 bp, Rattus norvegicus
gcattagtcacaagaactgctatgt

SEQ ID NO: 388895 - DNA, 25 bp, Rattus norvegicus
gcattagtcacatgaactgctatgt

SEQ ID NO: 388896 - DNA, 25 bp, Rattus norvegicus
gcattagtggctatggtctgtacaa

SEQ ID NO: 388897 - DNA, 25 bp, Rattus norvegicus
gcattagtggctttggtctgtacaa

SEQ ID NO: 388898 - DNA, 25 bp, Rattus norvegicus
gcattagtgttactctttggacttt

SEQ ID NO: 388899 - DNA, 25 bp, Rattus norvegicus
gcattagtgttagtctttggacttt

SEQ ID NO: 388900 - DNA, 25 bp, Rattus norvegicus
gcattagtttggcatacgtttcaca

SEQ ID NO: 388901 - DNA, 25 bp, Rattus norvegicus
gcattagtttgggatacgtttcaca

SEQ ID NO: 388902 - DNA, 25 bp, Rattus norvegicus
gcattataagttatgctttcagtaa

SEQ ID NO: 388903 - DNA, 25 bp, Rattus norvegicus
gcattataagttttgctttcagtaa

SEQ ID NO: 388904 - DNA, 25 bp, Rattus norvegicus
gcattatacacacatggcctcattg

SEQ ID NO: 388905 - DNA, 25 bp, Rattus norvegicus
gcattatacacagatggcctcattg

SEQ ID NO: 388906 - DNA, 25 bp, Rattus norvegicus
gcattatacagcatcttggtttcaa

SEQ ID NO: 388907 - DNA, 25 bp, Rattus norvegicus
gcattatacagcttcttggtttcaa

SEQ ID NO: 388908 - DNA, 25 bp, Rattus norvegicus
gcattatattgtcccaaccagtagt

SEQ ID NO: 388909 - DNA, 25 bp, Rattus norvegicus
gcattatattgtgccaaccagtagt

SEQ ID NO: 388910 - DNA, 25 bp, Rattus norvegicus
gcattatccagcagctcacagagac

SEQ ID NO: 388911 - DNA, 25 bp, Rattus norvegicus
gcattatccagctgctcacagagac

SEQ ID NO: 388912 - DNA, 25 bp, Rattus norvegicus
gcattatcctgtcgcaaacaacctg

SEQ ID NO: 388913 - DNA, 25 bp, Rattus norvegicus
gcattatcctgtggcaaacaacctg

SEQ ID NO: 388914 - DNA, 25 bp, Rattus norvegicus
gcattatctatcatacctgtggagt

SEQ ID NO: 388915 - DNA, 25 bp, Rattus norvegicus
gcattatctatcttacctgtggagt

SEQ ID NO: 388916 - DNA, 25 bp, Rattus norvegicus
gcattatgacgtagtagcccagccc

SEQ ID NO: 388917 - DNA, 25 bp, Rattus norvegicus
gcattatgacgttgtagcccagccc

SEQ ID NO: 388918 - DNA, 25 bp, Rattus norvegicus
gcattatgaggcctctttggtccca

SEQ ID NO: 388919 - DNA, 25 bp, Rattus norvegicus
gcattatgaggcgtctttggtccca

SEQ ID NO: 388920 - DNA, 25 bp, Rattus norvegicus
gcattatgatttctcttttcccaag

SEQ ID NO: 388921 - DNA, 25 bp, Rattus norvegicus
gcattatgatttgtcttttcccaag

SEQ ID NO: 388922 - DNA, 25 bp, Rattus norvegicus
gcattatgccatcgactatagcggt

SEQ ID NO: 388923 - DNA, 25 bp, Rattus norvegicus
gcattatgccatggactatagcggt

SEQ ID NO: 388924 - DNA, 25 bp, Rattus norvegicus
gcattatggactcctgcacgtggga

SEQ ID NO: 388925 - DNA, 25 bp, Rattus norvegicus
gcattatggactgctgcacgtggga

SEQ ID NO: 388926 - DNA, 25 bp, Rattus norvegicus
gcattatggcagacccaggttgcaa

SEQ ID NO: 388927 - DNA, 25 bp, Rattus norvegicus
gcattatggcagtcccaggttgcaa

SEQ ID NO: 388928 - DNA, 25 bp, Rattus norvegicus
gcattatggtgcagggctgaactct

SEQ ID NO: 388929 - DNA, 25 bp, Rattus norvegicus
gcattatggtgctgggctgaactct

SEQ ID NO: 388930 - DNA, 25 bp, Rattus norvegicus
gcattatgtcagaagctccgaagag

SEQ ID NO: 388931 - DNA, 25 bp, Rattus norvegicus
gcattatgtcagtagctccgaagag

SEQ ID NO: 388932 - DNA, 25 bp, Rattus norvegicus
gcattatgtctgaccccaaacactg

SEQ ID NO: 388933 - DNA, 25 bp, Rattus norvegicus
gcattatgtctgtccccaaacactg

SEQ ID NO: 388934 - DNA, 25 bp, Rattus norvegicus
gcattatgtgggacaccgtagctta

SEQ ID NO: 388935 - DNA, 25 bp, Rattus norvegicus
gcattatgtgggtcaccgtagctta

SEQ ID NO: 388936 - DNA, 25 bp, Rattus norvegicus
gcattattctacattgacagcagtt

SEQ ID NO: 388937 - DNA, 25 bp, Rattus norvegicus
gcattattctactttgacagcagtt

SEQ ID NO: 388938 - DNA, 25 bp, Rattus norvegicus
gcattattgtgcaacctcaaaggta

SEQ ID NO: 388939 - DNA, 25 bp, Rattus norvegicus
gcattattgtgctacctcaaaggta

SEQ ID NO: 388940 - DNA, 25 bp, Rattus norvegicus
gcattatttactactactgtggcta

SEQ ID NO: 388941 - DNA, 25 bp, Rattus norvegicus
gcattatttacttctactgtggcta

SEQ ID NO: 388942 - DNA, 25 bp, Rattus norvegicus
gcattatttattatggccccagtta

SEQ ID NO: 388943 - DNA, 25 bp, Rattus norvegicus
gcattatttattttggccccagtta

SEQ ID NO: 388944 - DNA, 25 bp, Rattus norvegicus
gcattattttggattgtggctacta

SEQ ID NO: 388945 - DNA, 25 bp, Rattus norvegicus
gcattattttggtttgtggctacta

SEQ ID NO: 388946 - DNA, 25 bp, Rattus norvegicus
gcattcaaactgattcccaagcttc

SEQ ID NO: 388947 - DNA, 25 bp, Rattus norvegicus
gcattcaaactgtttcccaagcttc

SEQ ID NO: 388948 - DNA, 25 bp, Rattus norvegicus
gcattcaaagtcatgtctgtactac

SEQ ID NO: 388949 - DNA, 25 bp, Rattus norvegicus
gcattcaaagtcttgtctgtactac

SEQ ID NO: 388950 - DNA, 25 bp, Rattus norvegicus
gcattcaagaagaagaggccatcct

SEQ ID NO: 388951 - DNA, 25 bp, Rattus norvegicus
gcattcaagaagtagaggccatcct

SEQ ID NO: 388952 - DNA, 25 bp, Rattus norvegicus
gcattcaagatacctaactccttcg

SEQ ID NO: 388953 - DNA, 25 bp, Rattus norvegicus
gcattcaagatagctaactccttcg

SEQ ID NO: 388954 - DNA, 25 bp, Rattus norvegicus
gcattcaatggtcctgtaaacgaaa

SEQ ID NO: 388955 - DNA, 25 bp, Rattus norvegicus
gcattcaatggtgctgtaaacgaaa

SEQ ID NO: 388956 - DNA, 25 bp, Rattus norvegicus
gcattcaatttgaagtcctgatttg

SEQ ID NO: 388957 - DNA, 25 bp, Rattus norvegicus
gcattcaatttgtagtcctgatttg

SEQ ID NO: 388958 - DNA, 25 bp, Rattus norvegicus
gcattcacaaggacccgggtttagt

SEQ ID NO: 388959 - DNA, 25 bp, Rattus norvegicus
gcattcacaaggtcccgggtttagt

SEQ ID NO: 388960 - DNA, 25 bp, Rattus norvegicus
gcattcacacatattcctcttaaga

SEQ ID NO: 388961 - DNA, 25 bp, Rattus norvegicus
gcattcacacattttcctcttaaga

SEQ ID NO: 388962 - DNA, 25 bp, Rattus norvegicus
gcattcacagtgagctcctgatagt

SEQ ID NO: 388963 - DNA, 25 bp, Rattus norvegicus
gcattcacagtgattccaggatcct

SEQ ID NO: 388964 - DNA, 25 bp, Rattus norvegicus
gcattcacagtgtgctcctgatagt

SEQ ID NO: 388965 - DNA, 25 bp, Rattus norvegicus
gcattcacagtgtttccaggatcct

SEQ ID NO: 388966 - DNA, 25 bp, Rattus norvegicus
gcattcaccgagaggaatacatcca

SEQ ID NO: 388967 - DNA, 25 bp, Rattus norvegicus
gcattcaccgagtggaatacatcca

SEQ ID NO: 388968 - DNA, 25 bp, Rattus norvegicus
gcattcacgggtattgttcccctaa

SEQ ID NO: 388969 - DNA, 25 bp, Rattus norvegicus
gcattcacgggttttgttcccctaa

SEQ ID NO: 388970 - DNA, 25 bp, Rattus norvegicus
gcattcactacaagctgcagctact

SEQ ID NO: 388971 - DNA, 25 bp, Rattus norvegicus
gcattcactacatgctgcagctact

SEQ ID NO: 388972 - DNA, 25 bp, Rattus norvegicus
gcattcactggacgcttctttagaa

SEQ ID NO: 388973 - DNA, 25 bp, Rattus norvegicus
gcattcactggaggcttctttagaa

SEQ ID NO: 388974 - DNA, 25 bp, Rattus norvegicus
gcattcacttggcttccttcaaata

SEQ ID NO: 388975 - DNA, 25 bp, Rattus norvegicus
gcattcacttgggttccttcaaata

SEQ ID NO: 388976 - DNA, 25 bp, Rattus norvegicus
gcattcagaacacgccggcacagca

SEQ ID NO: 388977 - DNA, 25 bp, Rattus norvegicus
gcattcagaacaggccggcacagca

SEQ ID NO: 388978 - DNA, 25 bp, Rattus norvegicus
gcattcagaatgcagcgcaagccat

SEQ ID NO: 388979 - DNA, 25 bp, Rattus norvegicus
gcattcagaatgcttgcctaccgaa

SEQ ID NO: 388980 - DNA, 25 bp, Rattus norvegicus
gcattcagaatggagcgcaagccat

SEQ ID NO: 388981 - DNA, 25 bp, Rattus norvegicus
gcattcagaatggttgcctaccgaa

SEQ ID NO: 388982 - DNA, 25 bp, Rattus norvegicus
gcattcagacctcctgggcgaggaa

SEQ ID NO: 388983 - DNA, 25 bp, Rattus norvegicus
gcattcagacctgctgggcgaggaa

SEQ ID NO: 388984 - DNA, 25 bp, Rattus norvegicus
gcattcagcaatagtgactatacct

SEQ ID NO: 388985 - DNA, 25 bp, Rattus norvegicus
gcattcagcaattgtgactatacct

SEQ ID NO: 388986 - DNA, 25 bp, Rattus norvegicus
gcattcagcagtctccttgggtaga

SEQ ID NO: 388987 - DNA, 25 bp, Rattus norvegicus
gcattcagcagtgtccttgggtaga

SEQ ID NO: 388988 - DNA, 25 bp, Rattus norvegicus
gcattcagcctgcttttaacggact

SEQ ID NO: 388989 - DNA, 25 bp, Rattus norvegicus
gcattcagcctggttttaacggact

SEQ ID NO: 388990 - DNA, 25 bp, Rattus norvegicus
gcattcaggtcacagctgcagcttt

SEQ ID NO: 388991 - DNA, 25 bp, Rattus norvegicus
gcattcaggtcagagctgcagcttt

SEQ ID NO: 388992 - DNA, 25 bp, Rattus norvegicus
gcattcagtatgaaccagtttcagg

SEQ ID NO: 388993 - DNA, 25 bp, Rattus norvegicus
gcattcagtatgtaccagtttcagg

SEQ ID NO: 388994 - DNA, 25 bp, Rattus norvegicus
gcattcagtattctacccacaggag

SEQ ID NO: 388995 - DNA, 25 bp, Rattus norvegicus
gcattcagtattgtacccacaggag

SEQ ID NO: 388996 - DNA, 25 bp, Rattus norvegicus
gcattcagtgcaactttgggaacct

SEQ ID NO: 388997 - DNA, 25 bp, Rattus norvegicus
gcattcagtgcatctttgggaacct

SEQ ID NO: 388998 - DNA, 25 bp, Rattus norvegicus
gcattcatacaacgcacagagggct

SEQ ID NO: 388999 - DNA, 25 bp, Rattus norvegicus
gcattcatacaaggcacagagggct

SEQ ID NO: 389000 - DNA, 25 bp, Rattus norvegicus
gcattcatagcaaaactgcagttga

SEQ ID NO: 389001 - DNA, 25 bp, Rattus norvegicus
gcattcatagcataactgcagttga

SEQ ID NO: 389002 - DNA, 25 bp, Rattus norvegicus
gcattcatatctcgctagtcttggg

SEQ ID NO: 389003 - DNA, 25 bp, Rattus norvegicus
gcattcatatctggctagtcttggg

SEQ ID NO: 389004 - DNA, 25 bp, Rattus norvegicus
gcattcatgacaatggctgcagaga

SEQ ID NO: 389005 - DNA, 25 bp, Rattus norvegicus
gcattcatgacattggctgcagaga

SEQ ID NO: 389006 - DNA, 25 bp, Rattus norvegicus
gcattcatgagcatcgccaagttcg

SEQ ID NO: 389007 - DNA, 25 bp, Rattus norvegicus
gcattcatgagcttcgccaagttcg

SEQ ID NO: 389008 - DNA, 25 bp, Rattus norvegicus
gcattcatgcaaatcggtcttggct

SEQ ID NO: 389009 - DNA, 25 bp, Rattus norvegicus
gcattcatgcaattcggtcttggct

SEQ ID NO: 389010 - DNA, 25 bp, Rattus norvegicus
gcattcatgttgatacatcttccaa

SEQ ID NO: 389011 - DNA, 25 bp, Rattus norvegicus
gcattcatgttgttacatcttccaa

SEQ ID NO: 389012 - DNA, 25 bp, Rattus norvegicus
gcattcattatgctcctggcaacaa

SEQ ID NO: 389013 - DNA, 25 bp, Rattus norvegicus
gcattcattatggtcctggcaacaa

SEQ ID NO: 389014 - DNA, 25 bp, Rattus norvegicus
gcattcattcataacctgtatggag

SEQ ID NO: 389015 - DNA, 25 bp, Rattus norvegicus
gcattcattcattacctgtatggag

SEQ ID NO: 389016 - DNA, 25 bp, Rattus norvegicus
gcattcattctgattgcttcatggt

SEQ ID NO: 389017 - DNA, 25 bp, Rattus norvegicus
gcattcattctgtttgcttcatggt

SEQ ID NO: 389018 - DNA, 25 bp, Rattus norvegicus
gcattcatttgaaaccacttggaag

SEQ ID NO: 389019 - DNA, 25 bp, Rattus norvegicus
gcattcatttgataccacttggaag

SEQ ID NO: 389020 - DNA, 25 bp, Rattus norvegicus
gcattcattttacagagcaccaact

SEQ ID NO: 389021 - DNA, 25 bp, Rattus norvegicus
gcattcattttagagagcaccaact

SEQ ID NO: 389022 - DNA, 25 bp, Rattus norvegicus
gcattcattttccacactcgatcat

SEQ ID NO: 389023 - DNA, 25 bp, Rattus norvegicus
gcattcattttcgacactcgatcat

SEQ ID NO: 389024 - DNA, 25 bp, Rattus norvegicus
gcattcatttttcactcttaataca

SEQ ID NO: 389025 - DNA, 25 bp, Rattus norvegicus
gcattcatttttgactcttaataca

SEQ ID NO: 389026 - DNA, 25 bp, Rattus norvegicus
gcattccaaatcagtgagggcccaa

SEQ ID NO: 389027 - DNA, 25 bp, Rattus norvegicus
gcattccaaatctgtgagggcccaa

SEQ ID NO: 389028 - DNA, 25 bp, Rattus norvegicus
gcattccaacgaagggttttactgt

SEQ ID NO: 389029 - DNA, 25 bp, Rattus norvegicus
gcattccaacgatgggttttactgt

SEQ ID NO: 389030 - DNA, 25 bp, Rattus norvegicus
gcattccaagtgatgcccctgacat

SEQ ID NO: 389031 - DNA, 25 bp, Rattus norvegicus
gcattccaagtgttgcccctgacat

SEQ ID NO: 389032 - DNA, 25 bp, Rattus norvegicus
gcattccaatagacactggctctga

SEQ ID NO: 389033 - DNA, 25 bp, Rattus norvegicus
gcattccaatagtcactggctctga

SEQ ID NO: 389034 - DNA, 25 bp, Rattus norvegicus
gcattccaatggacttgtgcatagc

SEQ ID NO: 389035 - DNA, 25 bp, Rattus norvegicus
gcattccaatggtcttgtgcatagc

SEQ ID NO: 389036 - DNA, 25 bp, Rattus norvegicus
gcattccagatgcagtttcctgact

SEQ ID NO: 389037 - DNA, 25 bp, Rattus norvegicus
gcattccagatggagtttcctgact

SEQ ID NO: 389038 - DNA, 25 bp, Rattus norvegicus
gcattccagggaatacactccatca

SEQ ID NO: 389039 - DNA, 25 bp, Rattus norvegicus
gcattccagggattacactccatca

SEQ ID NO: 389040 - DNA, 25 bp, Rattus norvegicus
gcattccagtatctctcaaaggcgt

SEQ ID NO: 389041 - DNA, 25 bp, Rattus norvegicus
gcattccagtatgtctcaaaggcgt

SEQ ID NO: 389042 - DNA, 25 bp, Rattus norvegicus
gcattccagttcacaggtacggctt

SEQ ID NO: 389043 - DNA, 25 bp, Rattus norvegicus
gcattccagttctcaggtacggctt

SEQ ID NO: 389044 - DNA, 25 bp, Rattus norvegicus
gcattccatgagatttccttcactg

SEQ ID NO: 389045 - DNA, 25 bp, Rattus norvegicus
gcattccatgagttttccttcactg

SEQ ID NO: 389046 - DNA, 25 bp, Rattus norvegicus
gcattccatttaacttctccataac

SEQ ID NO: 389047 - DNA, 25 bp, Rattus norvegicus
gcattccatttatcttctccataac

SEQ ID NO: 389048 - DNA, 25 bp, Rattus norvegicus
gcattcccatttctagatacccaat

SEQ ID NO: 389049 - DNA, 25 bp, Rattus norvegicus
gcattcccatttgtagatacccaat

SEQ ID NO: 389050 - DNA, 25 bp, Rattus norvegicus
gcattccctaacagagccttgtgtg

SEQ ID NO: 389051 - DNA, 25 bp, Rattus norvegicus
gcattccctaactgagccttgtgtg

SEQ ID NO: 389052 - DNA, 25 bp, Rattus norvegicus
gcattccctaatctgtgttttacaa

SEQ ID NO: 389053 - DNA, 25 bp, Rattus norvegicus
gcattccctaatgtgtgttttacaa

SEQ ID NO: 389054 - DNA, 25 bp, Rattus norvegicus
gcattccctcagctctaagatgtat

SEQ ID NO: 389055 - DNA, 25 bp, Rattus norvegicus
gcattccctcaggtctaagatgtat

SEQ ID NO: 389056 - DNA, 25 bp, Rattus norvegicus
gcattccctggccatgtgacatggt

SEQ ID NO: 389057 - DNA, 25 bp, Rattus norvegicus
gcattccctggcgatgtgacatggt

SEQ ID NO: 389058 - DNA, 25 bp, Rattus norvegicus
gcattccctgttctagttctttgga

SEQ ID NO: 389059 - DNA, 25 bp, Rattus norvegicus
gcattccctgttgtagttctttgga

SEQ ID NO: 389060 - DNA, 25 bp, Rattus norvegicus
gcattccctttgaaacttaggttga

SEQ ID NO: 389061 - DNA, 25 bp, Rattus norvegicus
gcattccctttgtaacttaggttga

SEQ ID NO: 389062 - DNA, 25 bp, Rattus norvegicus
gcattcccttttagacctagatctg

SEQ ID NO: 389063 - DNA, 25 bp, Rattus norvegicus
gcattccctttttgacctagatctg

SEQ ID NO: 389064 - DNA, 25 bp, Rattus norvegicus
gcattccgccttaagagagctactt

SEQ ID NO: 389065 - DNA, 25 bp, Rattus norvegicus
gcattccgcctttagagagctactt

SEQ ID NO: 389066 - DNA, 25 bp, Rattus norvegicus
gcattccgctttcgctgctggagca

SEQ ID NO: 389067 - DNA, 25 bp, Rattus norvegicus
gcattccgctttggctgctggagca

SEQ ID NO: 389068 - DNA, 25 bp, Rattus norvegicus
gcattccggcgcaaggagcacctgc

SEQ ID NO: 389069 - DNA, 25 bp, Rattus norvegicus
gcattccggcgctaggagcacctgc

SEQ ID NO: 389070 - DNA, 25 bp, Rattus norvegicus
gcattccgtcagaccttcataagaa

SEQ ID NO: 389071 - DNA, 25 bp, Rattus norvegicus
gcattccgtcagtccttcataagaa

SEQ ID NO: 389072 - DNA, 25 bp, Rattus norvegicus
gcattcctaatgctacgacctttta

SEQ ID NO: 389073 - DNA, 25 bp, Rattus norvegicus
gcattcctaatggtacgacctttta

SEQ ID NO: 389074 - DNA, 25 bp, Rattus norvegicus
gcattcctacgaatgcctgcattag

SEQ ID NO: 389075 - DNA, 25 bp, Rattus norvegicus
gcattcctacgattgcctgcattag

SEQ ID NO: 389076 - DNA, 25 bp, Rattus norvegicus
gcattcctatatctccacctgataa

SEQ ID NO: 389077 - DNA, 25 bp, Rattus norvegicus
gcattcctatatgtccacctgataa

SEQ ID NO: 389078 - DNA, 25 bp, Rattus norvegicus
gcattcctcagtctttgtcatagac

SEQ ID NO: 389079 - DNA, 25 bp, Rattus norvegicus
gcattcctcagtgtttgtcatagac

SEQ ID NO: 389080 - DNA, 25 bp, Rattus norvegicus
gcattcctcattatggatttagggc

SEQ ID NO: 389081 - DNA, 25 bp, Rattus norvegicus
gcattcctcattttggatttagggc

SEQ ID NO: 389082 - DNA, 25 bp, Rattus norvegicus
gcattcctccataatatctgcttct

SEQ ID NO: 389083 - DNA, 25 bp, Rattus norvegicus
gcattcctccattatatctgcttct

SEQ ID NO: 389084 - DNA, 25 bp, Rattus norvegicus
gcattcctgcacagggtgttagtgt

SEQ ID NO: 389085 - DNA, 25 bp, Rattus norvegicus
gcattcctgcactgggtgttagtgt

SEQ ID NO: 389086 - DNA, 25 bp, Rattus norvegicus
gcattcctggaacttatctgacctt

SEQ ID NO: 389087 - DNA, 25 bp, Rattus norvegicus
gcattcctggaagttatctgacctt

SEQ ID NO: 389088 - DNA, 25 bp, Rattus norvegicus
gcattcctggctctcttgtgaatgt

SEQ ID NO: 389089 - DNA, 25 bp, Rattus norvegicus
gcattcctggctgtcttgtgaatgt

SEQ ID NO: 389090 - DNA, 25 bp, Rattus norvegicus
gcattcctgtatcatatctacctca

SEQ ID NO: 389091 - DNA, 25 bp, Rattus norvegicus
gcattcctgtatgatatctacctca

SEQ ID NO: 389092 - DNA, 25 bp, Rattus norvegicus
gcattcctgtgactcacacacctaa

SEQ ID NO: 389093 - DNA, 25 bp, Rattus norvegicus
gcattcctgtgagtcacacacctaa

SEQ ID NO: 389094 - DNA, 25 bp, Rattus norvegicus
gcattccttcagatggcctttagaa

SEQ ID NO: 389095 - DNA, 25 bp, Rattus norvegicus
gcattccttcagttggcctttagaa

SEQ ID NO: 389096 - DNA, 25 bp, Rattus norvegicus
gcattcctttgaagtttgagctaag

SEQ ID NO: 389097 - DNA, 25 bp, Rattus norvegicus
gcattcctttgatgtttgagctaag

SEQ ID NO: 389098 - DNA, 25 bp, Rattus norvegicus
gcattcctttggaccattggactat

SEQ ID NO: 389099 - DNA, 25 bp, Rattus norvegicus
gcattcctttggtccattggactat

SEQ ID NO: 389100 - DNA, 25 bp, Rattus norvegicus
gcattccttttaaataccaggtcgt

SEQ ID NO: 389101 - DNA, 25 bp, Rattus norvegicus
gcattccttttatataccaggtcgt

SEQ ID NO: 389102 - DNA, 25 bp, Rattus norvegicus
gcattcgctggactcccactacagg

SEQ ID NO: 389103 - DNA, 25 bp, Rattus norvegicus
gcattcgctggagtcccactacagg

SEQ ID NO: 389104 - DNA, 25 bp, Rattus norvegicus
gcattcggacttatgacgccaacac

SEQ ID NO: 389105 - DNA, 25 bp, Rattus norvegicus
gcattcggacttttgacgccaacac

SEQ ID NO: 389106 - DNA, 25 bp, Rattus norvegicus
gcattcggagaacgcagcgctgact

SEQ ID NO: 389107 - DNA, 25 bp, Rattus norvegicus
gcattcggagaaggcagcgctgact

SEQ ID NO: 389108 - DNA, 25 bp, Rattus norvegicus
gcattcggagccacaggattctcag

SEQ ID NO: 389109 - DNA, 25 bp, Rattus norvegicus
gcattcggagcctcaggattctcag

SEQ ID NO: 389110 - DNA, 25 bp, Rattus norvegicus
gcattcggcacacctgggtccagac

SEQ ID NO: 389111 - DNA, 25 bp, Rattus norvegicus
gcattcggcacagctgggtccagac

SEQ ID NO: 389112 - DNA, 25 bp, Rattus norvegicus
gcattcggttaccactaaactcgtg

SEQ ID NO: 389113 - DNA, 25 bp, Rattus norvegicus
gcattcggttacgactaaactcgtg

SEQ ID NO: 389114 - DNA, 25 bp, Rattus norvegicus
gcattcgtagctctctcttagaaat

SEQ ID NO: 389115 - DNA, 25 bp, Rattus norvegicus
gcattcgtagctgtctcttagaaat

SEQ ID NO: 389116 - DNA, 25 bp, Rattus norvegicus
gcattcgtcggccatgtgtgactgt

SEQ ID NO: 389117 - DNA, 25 bp, Rattus norvegicus
gcattcgtcggcgatgtgtgactgt

SEQ ID NO: 389118 - DNA, 25 bp, Rattus norvegicus
gcattcgtgagacttgcccttgtaa

SEQ ID NO: 389119 - DNA, 25 bp, Rattus norvegicus
gcattcgtgagagttgcccttgtaa

SEQ ID NO: 389120 - DNA, 25 bp, Rattus norvegicus
gcattcgtgattagcctgattccac

SEQ ID NO: 389121 - DNA, 25 bp, Rattus norvegicus
gcattcgtgatttgcctgattccac

SEQ ID NO: 389122 - DNA, 25 bp, Rattus norvegicus
gcattcgtggtacacctgatataca

SEQ ID NO: 389123 - DNA, 25 bp, Rattus norvegicus
gcattcgtggtagacctgatataca

SEQ ID NO: 389124 - DNA, 25 bp, Rattus norvegicus
gcattcgttttacctgctgcaaaag

SEQ ID NO: 389125 - DNA, 25 bp, Rattus norvegicus
gcattcgttttagctgctgcaaaag

SEQ ID NO: 389126 - DNA, 25 bp, Rattus norvegicus
gcattctaaaagcttcagggactct

SEQ ID NO: 389127 - DNA, 25 bp, Rattus norvegicus
gcattctaaaaggttcagggactct

SEQ ID NO: 389128 - DNA, 25 bp, Rattus norvegicus
gcattctaccatatgggaggctgaa

SEQ ID NO: 389129 - DNA, 25 bp, Rattus norvegicus
gcattctaccatttgggaggctgaa

SEQ ID NO: 389130 - DNA, 25 bp, Rattus norvegicus
gcattctaggagctctgccagccag

SEQ ID NO: 389131 - DNA, 25 bp, Rattus norvegicus
gcattctaggaggtctgccagccag

SEQ ID NO: 389132 - DNA, 25 bp, Rattus norvegicus
gcattctagtagctgcactgcagga

SEQ ID NO: 389133 - DNA, 25 bp, Rattus norvegicus
gcattctagtaggtgcactgcagga

SEQ ID NO: 389134 - DNA, 25 bp, Rattus norvegicus
gcattctattgccttctttgaagaa

SEQ ID NO: 389135 - DNA, 25 bp, Rattus norvegicus
gcattctattgcgttctttgaagaa

SEQ ID NO: 389136 - DNA, 25 bp, Rattus norvegicus
gcattctcaagactcatcttggcct

SEQ ID NO: 389137 - DNA, 25 bp, Rattus norvegicus
gcattctcaagagtcatcttggcct

SEQ ID NO: 389138 - DNA, 25 bp, Rattus norvegicus
gcattctcagcgaatgcagatgagt

SEQ ID NO: 389139 - DNA, 25 bp, Rattus norvegicus
gcattctcagcgtatgcagatgagt

SEQ ID NO: 389140 - DNA, 25 bp, Rattus norvegicus
gcattctcagggatgttctttaata

SEQ ID NO: 389141 - DNA, 25 bp, Rattus norvegicus
gcattctcagggttgttctttaata

SEQ ID NO: 389142 - DNA, 25 bp, Rattus norvegicus
gcattctcagttcctgtcacagagt

SEQ ID NO: 389143 - DNA, 25 bp, Rattus norvegicus
gcattctcagttgctgtcacagagt

SEQ ID NO: 389144 - DNA, 25 bp, Rattus norvegicus
gcattctccaggcatccaaacagtt

SEQ ID NO: 389145 - DNA, 25 bp, Rattus norvegicus
gcattctccagggatccaaacagtt

SEQ ID NO: 389146 - DNA, 25 bp, Rattus norvegicus
gcattctcccataggctaaaagccg

SEQ ID NO: 389147 - DNA, 25 bp, Rattus norvegicus
gcattctcccattggctaaaagccg

SEQ ID NO: 389148 - DNA, 25 bp, Rattus norvegicus
gcattctcgggtcatcagaacgcta

SEQ ID NO: 389149 - DNA, 25 bp, Rattus norvegicus
gcattctcgggtgatcagaacgcta

SEQ ID NO: 389150 - DNA, 25 bp, Rattus norvegicus
gcattctctttaaagctgtgtgtgt

SEQ ID NO: 389151 - DNA, 25 bp, Rattus norvegicus
gcattctctttatagctgtgtgtgt

SEQ ID NO: 389152 - DNA, 25 bp, Rattus norvegicus
gcattctctttcatccttgaggtga

SEQ ID NO: 389153 - DNA, 25 bp, Rattus norvegicus
gcattctctttcttccttgaggtga

SEQ ID NO: 389154 - DNA, 25 bp, Rattus norvegicus
gcattctgaaagctcaccctgctag

SEQ ID NO: 389155 - DNA, 25 bp, Rattus norvegicus
gcattctgaaaggtcaccctgctag

SEQ ID NO: 389156 - DNA, 25 bp, Rattus norvegicus
gcattctgaagcagtatgactccta

SEQ ID NO: 389157 - DNA, 25 bp, Rattus norvegicus
gcattctgaagctgtatgactccta

SEQ ID NO: 389158 - DNA, 25 bp, Rattus norvegicus
gcattctgatgtccaggtcactgag

SEQ ID NO: 389159 - DNA, 25 bp, Rattus norvegicus
gcattctgatgtgcaggtcactgag

SEQ ID NO: 389160 - DNA, 25 bp, Rattus norvegicus
gcattctgcctcaagagctcattga

SEQ ID NO: 389161 - DNA, 25 bp, Rattus norvegicus
gcattctgcctctagagctcattga

SEQ ID NO: 389162 - DNA, 25 bp, Rattus norvegicus
gcattctggactaagagctgagcaa

SEQ ID NO: 389163 - DNA, 25 bp, Rattus norvegicus
gcattctggacttagagctgagcaa

SEQ ID NO: 389164 - DNA, 25 bp, Rattus norvegicus
gcattctggcttctgtatgtagtat

SEQ ID NO: 389165 - DNA, 25 bp, Rattus norvegicus
gcattctggcttgtgtatgtagtat

SEQ ID NO: 389166 - DNA, 25 bp, Rattus norvegicus
gcattctgggtgattgactgacggt

SEQ ID NO: 389167 - DNA, 25 bp, Rattus norvegicus
gcattctgggtgtttgactgacggt

SEQ ID NO: 389168 - DNA, 25 bp, Rattus norvegicus
gcattctgtaagatccgtgggcctt

SEQ ID NO: 389169 - DNA, 25 bp, Rattus norvegicus
gcattctgtaagttccgtgggcctt

SEQ ID NO: 389170 - DNA, 25 bp, Rattus norvegicus
gcattcttcccaatatccaagtggt

SEQ ID NO: 389171 - DNA, 25 bp, Rattus norvegicus
gcattcttcccattatccaagtggt

SEQ ID NO: 389172 - DNA, 25 bp, Rattus norvegicus
gcattcttcctgctgggctagatga

SEQ ID NO: 389173 - DNA, 25 bp, Rattus norvegicus
gcattcttcctggtgggctagatga

SEQ ID NO: 389174 - DNA, 25 bp, Rattus norvegicus
gcattcttcgggatcctctttggag

SEQ ID NO: 389175 - DNA, 25 bp, Rattus norvegicus
gcattcttcgggttcctctttggag

SEQ ID NO: 389176 - DNA, 25 bp, Rattus norvegicus
gcattcttggtactgcagcttacat

SEQ ID NO: 389177 - DNA, 25 bp, Rattus norvegicus
gcattcttggtagtgcagcttacat

SEQ ID NO: 389178 - DNA, 25 bp, Rattus norvegicus
gcattctttactcgtgcgtggcact

SEQ ID NO: 389179 - DNA, 25 bp, Rattus norvegicus
gcattctttactggtgcgtggcact

SEQ ID NO: 389180 - DNA, 25 bp, Rattus norvegicus
gcattctttggaacctgcataagca

SEQ ID NO: 389181 - DNA, 25 bp, Rattus norvegicus
gcattctttggatcctgcataagca

SEQ ID NO: 389182 - DNA, 25 bp, Rattus norvegicus
gcattcttttcaatgtgggcctaag

SEQ ID NO: 389183 - DNA, 25 bp, Rattus norvegicus
gcattcttttcattgtgggcctaag

SEQ ID NO: 389184 - DNA, 25 bp, Rattus norvegicus
gcattgaactacactttggttattt

SEQ ID NO: 389185 - DNA, 25 bp, Rattus norvegicus
gcattgaactactctttggttattt

SEQ ID NO: 389186 - DNA, 25 bp, Rattus norvegicus
gcattgaccaacctgcagcagtggg

SEQ ID NO: 389187 - DNA, 25 bp, Rattus norvegicus
gcattgaccaacgtgcagcagtggg

SEQ ID NO: 389188 - DNA, 25 bp, Rattus norvegicus
gcattgaccataactaacccgttga

SEQ ID NO: 389189 - DNA, 25 bp, Rattus norvegicus
gcattgaccatatctaacccgttga

SEQ ID NO: 389190 - DNA, 25 bp, Rattus norvegicus
gcattgacctgcatgctttggtaca

SEQ ID NO: 389191 - DNA, 25 bp, Rattus norvegicus
gcattgacctgcttgctttggtaca

SEQ ID NO: 389192 - DNA, 25 bp, Rattus norvegicus
gcattgactatcaactgctgcagat

SEQ ID NO: 389193 - DNA, 25 bp, Rattus norvegicus
gcattgactatctactgctgcagat

SEQ ID NO: 389194 - DNA, 25 bp, Rattus norvegicus
gcattgactctcaagtttgccactg

SEQ ID NO: 389195 - DNA, 25 bp, Rattus norvegicus
gcattgactctctagtttgccactg

SEQ ID NO: 389196 - DNA, 25 bp, Rattus norvegicus
gcattgactttgctctctagtggat

SEQ ID NO: 389197 - DNA, 25 bp, Rattus norvegicus
gcattgactttggtctctagtggat

SEQ ID NO: 389198 - DNA, 25 bp, Rattus norvegicus
gcattgagaagaaagagtcccgcta

SEQ ID NO: 389199 - DNA, 25 bp, Rattus norvegicus
gcattgagaagatagagtcccgcta

SEQ ID NO: 389200 - DNA, 25 bp, Rattus norvegicus
gcattgagaccgattgtcctttgat

SEQ ID NO: 389201 - DNA, 25 bp, Rattus norvegicus
gcattgagaccgtttgtcctttgat

SEQ ID NO: 389202 - DNA, 25 bp, Rattus norvegicus
gcattgagagctaagggacagtcca

SEQ ID NO: 389203 - DNA, 25 bp, Rattus norvegicus
gcattgagagcttagggacagtcca

SEQ ID NO: 389204 - DNA, 25 bp, Rattus norvegicus
gcattgagatctatccatttcagca

SEQ ID NO: 389205 - DNA, 25 bp, Rattus norvegicus
gcattgagatctttccatttcagca

SEQ ID NO: 389206 - DNA, 25 bp, Rattus norvegicus
gcattgagggatatcaggacacctg

SEQ ID NO: 389207 - DNA, 25 bp, Rattus norvegicus
gcattgagggatttcaggacacctg

SEQ ID NO: 389208 - DNA, 25 bp, Rattus norvegicus
gcattgagggccagctacaacaacc

SEQ ID NO: 389209 - DNA, 25 bp, Rattus norvegicus
gcattgagggcctgctacaacaacc

SEQ ID NO: 389210 - DNA, 25 bp, Rattus norvegicus
gcattgagtatgctttcaaaaccat

SEQ ID NO: 389211 - DNA, 25 bp, Rattus norvegicus
gcattgagtatggtttcaaaaccat

SEQ ID NO: 389212 - DNA, 25 bp, Rattus norvegicus
gcattgagtgccagcctgtgtagat

SEQ ID NO: 389213 - DNA, 25 bp, Rattus norvegicus
gcattgagtgcctgcctgtgtagat

SEQ ID NO: 389214 - DNA, 25 bp, Rattus norvegicus
gcattgagttccaggcacaggccag

SEQ ID NO: 389215 - DNA, 25 bp, Rattus norvegicus
gcattgagttcctggcacaggccag

SEQ ID NO: 389216 - DNA, 25 bp, Rattus norvegicus
gcattgatgaacagcagccggtgca

SEQ ID NO: 389217 - DNA, 25 bp, Rattus norvegicus
gcattgatgaactgcagccggtgca

SEQ ID NO: 389218 - DNA, 25 bp, Rattus norvegicus
gcattgatgtgacccatagctttcc

SEQ ID NO: 389219 - DNA, 25 bp, Rattus norvegicus
gcattgatgtgagccatagctttcc

SEQ ID NO: 389220 - DNA, 25 bp, Rattus norvegicus
gcattgattacacaagatgctcaca

SEQ ID NO: 389221 - DNA, 25 bp, Rattus norvegicus
gcattgattacagaagatgctcaca

SEQ ID NO: 389222 - DNA, 25 bp, Rattus norvegicus
gcattgattacccaggatctgccct

SEQ ID NO: 389223 - DNA, 25 bp, Rattus norvegicus
gcattgattaccgaggatctgccct

SEQ ID NO: 389224 - DNA, 25 bp, Rattus norvegicus
gcattgatttatacacctctacagg

SEQ ID NO: 389225 - DNA, 25 bp, Rattus norvegicus
gcattgatttattcacctctacagg

SEQ ID NO: 389226 - DNA, 25 bp, Rattus norvegicus
gcattgcaaaacctgaacccttagt

SEQ ID NO: 389227 - DNA, 25 bp, Rattus norvegicus
gcattgcaaaacgtgaacccttagt

SEQ ID NO: 389228 - DNA, 25 bp, Rattus norvegicus
gcattgcaagggactgccccaagta

SEQ ID NO: 389229 - DNA, 25 bp, Rattus norvegicus
gcattgcaagggtctgccccaagta

SEQ ID NO: 389230 - DNA, 25 bp, Rattus norvegicus
gcattgcacaatcccgccgtactgt

SEQ ID NO: 389231 - DNA, 25 bp, Rattus norvegicus
gcattgcacaatgccgccgtactgt

SEQ ID NO: 389232 - DNA, 25 bp, Rattus norvegicus
gcattgcacagactctgacctgcag

SEQ ID NO: 389233 - DNA, 25 bp, Rattus norvegicus
gcattgcacagagtctgacctgcag

SEQ ID NO: 389234 - DNA, 25 bp, Rattus norvegicus
gcattgcacaggacatctggccgaa

SEQ ID NO: 389235 - DNA, 25 bp, Rattus norvegicus
gcattgcacaggtcatctggccgaa

SEQ ID NO: 389236 - DNA, 25 bp, Rattus norvegicus
gcattgcacattactgaggttactg

SEQ ID NO: 389237 - DNA, 25 bp, Rattus norvegicus
gcattgcacatttctgaggttactg

SEQ ID NO: 389238 - DNA, 25 bp, Rattus norvegicus
gcattgcacgttctccttaggattg

SEQ ID NO: 389239 - DNA, 25 bp, Rattus norvegicus
gcattgcacgttgtccttaggattg

SEQ ID NO: 389240 - DNA, 25 bp, Rattus norvegicus
gcattgcactgcagttgttggaagg

SEQ ID NO: 389241 - DNA, 25 bp, Rattus norvegicus
gcattgcactgctgttgttggaagg

SEQ ID NO: 389242 - DNA, 25 bp, Rattus norvegicus
gcattgcagcaaagcattgctctga

SEQ ID NO: 389243 - DNA, 25 bp, Rattus norvegicus
gcattgcagcaatgcattgctctga

SEQ ID NO: 389244 - DNA, 25 bp, Rattus norvegicus
gcattgcagctcacataggaggtta

SEQ ID NO: 389245 - DNA, 25 bp, Rattus norvegicus
gcattgcagctctcataggaggtta

SEQ ID NO: 389246 - DNA, 25 bp, Rattus norvegicus
gcattgcagggcagagcaccgtgta

SEQ ID NO: 389247 - DNA, 25 bp, Rattus norvegicus
gcattgcagggctgagcaccgtgta

SEQ ID NO: 389248 - DNA, 25 bp, Rattus norvegicus
gcattgcatcaaccagctgctgact

SEQ ID NO: 389249 - DNA, 25 bp, Rattus norvegicus
gcattgcatcaagcagctgctgact

SEQ ID NO: 389250 - DNA, 25 bp, Rattus norvegicus
gcattgcatccacgtggtacacatg

SEQ ID NO: 389251 - DNA, 25 bp, Rattus norvegicus
gcattgcatccaggtggtacacatg

SEQ ID NO: 389252 - DNA, 25 bp, Rattus norvegicus
gcattgcatggcactatctccatat

SEQ ID NO: 389253 - DNA, 25 bp, Rattus norvegicus
gcattgcatggctctatctccatat

SEQ ID NO: 389254 - DNA, 25 bp, Rattus norvegicus
gcattgcattggagggttattctag

SEQ ID NO: 389255 - DNA, 25 bp, Rattus norvegicus
gcattgcattggtgggttattctag

SEQ ID NO: 389256 - DNA, 25 bp, Rattus norvegicus
gcattgccactaagctatatcctca

SEQ ID NO: 389257 - DNA, 25 bp, Rattus norvegicus
gcattgccactatgctatatcctca

SEQ ID NO: 389258 - DNA, 25 bp, Rattus norvegicus
gcattgccagcacagtacaagtcga

SEQ ID NO: 389259 - DNA, 25 bp, Rattus norvegicus
gcattgccagcagagtacaagtcga

SEQ ID NO: 389260 - DNA, 25 bp, Rattus norvegicus
gcattgccatgcctttttgaagggt

SEQ ID NO: 389261 - DNA, 25 bp, Rattus norvegicus
gcattgccatgcgtttttgaagggt

SEQ ID NO: 389262 - DNA, 25 bp, Rattus norvegicus
gcattgccccggctttccataatta

SEQ ID NO: 389263 - DNA, 25 bp, Rattus norvegicus
gcattgccccgggtttccataatta

SEQ ID NO: 389264 - DNA, 25 bp, Rattus norvegicus
gcattgccctttcttgtttgtttaa

SEQ ID NO: 389265 - DNA, 25 bp, Rattus norvegicus
gcattgccctttgttgtttgtttaa

SEQ ID NO: 389266 - DNA, 25 bp, Rattus norvegicus
gcattgcctatgatggaacgtagcc

SEQ ID NO: 389267 - DNA, 25 bp, Rattus norvegicus
gcattgcctatgttggaacgtagcc

SEQ ID NO: 389268 - DNA, 25 bp, Rattus norvegicus
gcattgcctattaaagctgtccttt

SEQ ID NO: 389269 - DNA, 25 bp, Rattus norvegicus
gcattgcctatttaagctgtccttt

SEQ ID NO: 389270 - DNA, 25 bp, Rattus norvegicus
gcattgcctcttattgtacagaact

SEQ ID NO: 389271 - DNA, 25 bp, Rattus norvegicus
gcattgcctctttttgtacagaact

SEQ ID NO: 389272 - DNA, 25 bp, Rattus norvegicus
gcattgcctttcattggtacaggta

SEQ ID NO: 389273 - DNA, 25 bp, Rattus norvegicus
gcattgcctttctttggtacaggta

SEQ ID NO: 389274 - DNA, 25 bp, Rattus norvegicus
gcattgcggcttagcacaagggtaa

SEQ ID NO: 389275 - DNA, 25 bp, Rattus norvegicus
gcattgcggctttgcacaagggtaa

SEQ ID NO: 389276 - DNA, 25 bp, Rattus norvegicus
gcattgcgtgttactgttgagttta

SEQ ID NO: 389277 - DNA, 25 bp, Rattus norvegicus
gcattgcgtgtttctgttgagttta

SEQ ID NO: 389278 - DNA, 25 bp, Rattus norvegicus
gcattgctaccaacgcgagcagtga

SEQ ID NO: 389279 - DNA, 25 bp, Rattus norvegicus
gcattgctaccatcgcgagcagtga

SEQ ID NO: 389280 - DNA, 25 bp, Rattus norvegicus
gcattgctagttctgttctcaccgt

SEQ ID NO: 389281 - DNA, 25 bp, Rattus norvegicus
gcattgctagttgtgttctcaccgt

SEQ ID NO: 389282 - DNA, 25 bp, Rattus norvegicus
gcattgctccatcctggcagaagat

SEQ ID NO: 389283 - DNA, 25 bp, Rattus norvegicus
gcattgctccatgctggcagaagat

SEQ ID NO: 389284 - DNA, 25 bp, Rattus norvegicus
gcattgctgaaaaacctccataggg

SEQ ID NO: 389285 - DNA, 25 bp, Rattus norvegicus
gcattgctgaaatacctccataggg

SEQ ID NO: 389286 - DNA, 25 bp, Rattus norvegicus
gcattgctggttcgacatggtgaat

SEQ ID NO: 389287 - DNA, 25 bp, Rattus norvegicus
gcattgctggttggacatggtgaat

SEQ ID NO: 389288 - DNA, 25 bp, Rattus norvegicus
gcattgctgttcagcctgatgctaa

SEQ ID NO: 389289 - DNA, 25 bp, Rattus norvegicus
gcattgctgttctgcctgatgctaa

SEQ ID NO: 389290 - DNA, 25 bp, Rattus norvegicus
gcattgcttcagagtgtgctagtgc

SEQ ID NO: 389291 - DNA, 25 bp, Rattus norvegicus
gcattgcttcagtgtgtgctagtgc

SEQ ID NO: 389292 - DNA, 25 bp, Rattus norvegicus
gcattgcttctaaaaatcattactg

SEQ ID NO: 389293 - DNA, 25 bp, Rattus norvegicus
gcattgcttctataaatcattactg

SEQ ID NO: 389294 - DNA, 25 bp, Rattus norvegicus
gcattgcttctcagtctgtttcatt

SEQ ID NO: 389295 - DNA, 25 bp, Rattus norvegicus
gcattgcttctctgtctgtttcatt

SEQ ID NO: 389296 - DNA, 25 bp, Rattus norvegicus
gcattgctttcccatgcactgggaa

SEQ ID NO: 389297 - DNA, 25 bp, Rattus norvegicus
gcattgctttccgatgcactgggaa

SEQ ID NO: 389298 - DNA, 25 bp, Rattus norvegicus
gcattggaacaactcctgagggcaa

SEQ ID NO: 389299 - DNA, 25 bp, Rattus norvegicus
gcattggaacaagtcctgagggcaa

SEQ ID NO: 389300 - DNA, 25 bp, Rattus norvegicus
gcattggaaggcatcagacagcaca

SEQ ID NO: 389301 - DNA, 25 bp, Rattus norvegicus
gcattggaaggcttcagacagcaca

SEQ ID NO: 389302 - DNA, 25 bp, Rattus norvegicus
gcattggaagtcctggatctgccat

SEQ ID NO: 389303 - DNA, 25 bp, Rattus norvegicus
gcattggaagtcgtggatctgccat

SEQ ID NO: 389304 - DNA, 25 bp, Rattus norvegicus
gcattggactgcacactagacttca

SEQ ID NO: 389305 - DNA, 25 bp, Rattus norvegicus
gcattggactgctcactagacttca

SEQ ID NO: 389306 - DNA, 25 bp, Rattus norvegicus
gcattggagaaaagttgtttccctg

SEQ ID NO: 389307 - DNA, 25 bp, Rattus norvegicus
gcattggagaaatgttgtttccctg

SEQ ID NO: 389308 - DNA, 25 bp, Rattus norvegicus
gcattggagatcacccttcatatat

SEQ ID NO: 389309 - DNA, 25 bp, Rattus norvegicus
gcattggagatctcccttcatatat

SEQ ID NO: 389310 - DNA, 25 bp, Rattus norvegicus
gcattggagttgactctccccacca

SEQ ID NO: 389311 - DNA, 25 bp, Rattus norvegicus
gcattggagttgtctctccccacca

SEQ ID NO: 389312 - DNA, 25 bp, Rattus norvegicus
gcattggatcaacgatctcctcaga

SEQ ID NO: 389313 - DNA, 25 bp, Rattus norvegicus
gcattggatcaaggatctcctcaga

SEQ ID NO: 389314 - DNA, 25 bp, Rattus norvegicus
gcattggattctactaagtgtctca

SEQ ID NO: 389315 - DNA, 25 bp, Rattus norvegicus
gcattggattcttctaagtgtctca

SEQ ID NO: 389316 - DNA, 25 bp, Rattus norvegicus
gcattggattgccagactttggact

SEQ ID NO: 389317 - DNA, 25 bp, Rattus norvegicus
gcattggattgcgagactttggact

SEQ ID NO: 389318 - DNA, 25 bp, Rattus norvegicus
gcattggcaatactgtctgtgtaca

SEQ ID NO: 389319 - DNA, 25 bp, Rattus norvegicus
gcattggcaatagtgtctgtgtaca

SEQ ID NO: 389320 - DNA, 25 bp, Rattus norvegicus
gcattggcagcacgacatcttgtca

SEQ ID NO: 389321 - DNA, 25 bp, Rattus norvegicus
gcattggcagcaggacatcttgtca

SEQ ID NO: 389322 - DNA, 25 bp, Rattus norvegicus
gcattggccagtcgcagaaggtcat

SEQ ID NO: 389323 - DNA, 25 bp, Rattus norvegicus
gcattggccagtggcagaaggtcat

SEQ ID NO: 389324 - DNA, 25 bp, Rattus norvegicus
gcattggcggttatgcctcagatat

SEQ ID NO: 389325 - DNA, 25 bp, Rattus norvegicus
gcattggcggttttgcctcagatat

SEQ ID NO: 389326 - DNA, 25 bp, Rattus norvegicus
gcattggctgtgaatagcgcaacat

SEQ ID NO: 389327 - DNA, 25 bp, Rattus norvegicus
gcattggctgtgtatagcgcaacat

SEQ ID NO: 389328 - DNA, 25 bp, Rattus norvegicus
gcattggctttaacctctttagagt

SEQ ID NO: 389329 - DNA, 25 bp, Rattus norvegicus
gcattggctttatcctctttagagt

SEQ ID NO: 389330 - DNA, 25 bp, Rattus norvegicus
gcattgggacctcacagggacacga

SEQ ID NO: 389331 - DNA, 25 bp, Rattus norvegicus
gcattgggacctgacagggacacga

SEQ ID NO: 389332 - DNA, 25 bp, Rattus norvegicus
gcattgggttatcatgtcacaacat

SEQ ID NO: 389333 - DNA, 25 bp, Rattus norvegicus
gcattgggttatgatgtcacaacat

SEQ ID NO: 389334 - DNA, 25 bp, Rattus norvegicus
gcattgggttgcaaactatttttaa

SEQ ID NO: 389335 - DNA, 25 bp, Rattus norvegicus
gcattgggttgctaactatttttaa

SEQ ID NO: 389336 - DNA, 25 bp, Rattus norvegicus
gcattgggttttaggctcttcacag

SEQ ID NO: 389337 - DNA, 25 bp, Rattus norvegicus
gcattgggtttttggctcttcacag

SEQ ID NO: 389338 - DNA, 25 bp, Rattus norvegicus
gcattggtactgagcctgcctggct

SEQ ID NO: 389339 - DNA, 25 bp, Rattus norvegicus
gcattggtactgtgcctgcctggct

SEQ ID NO: 389340 - DNA, 25 bp, Rattus norvegicus
gcattggtcatactgagtggttctt

SEQ ID NO: 389341 - DNA, 25 bp, Rattus norvegicus
gcattggtcatagtgagtggttctt

SEQ ID NO: 389342 - DNA, 25 bp, Rattus norvegicus
gcattggtctagagagcatccttcc

SEQ ID NO: 389343 - DNA, 25 bp, Rattus norvegicus
gcattggtctagtgagcatccttcc

SEQ ID NO: 389344 - DNA, 25 bp, Rattus norvegicus
gcattggtgtttaatacgcttatag

SEQ ID NO: 389345 - DNA, 25 bp, Rattus norvegicus
gcattggtgttttatacgcttatag

SEQ ID NO: 389346 - DNA, 25 bp, Rattus norvegicus
gcattgtatgtcagaagcactactt

SEQ ID NO: 389347 - DNA, 25 bp, Rattus norvegicus
gcattgtatgtctgaagcactactt

SEQ ID NO: 389348 - DNA, 25 bp, Rattus norvegicus
gcattgtcagttatcgcttgtgtac

SEQ ID NO: 389349 - DNA, 25 bp, Rattus norvegicus
gcattgtcagttttcgcttgtgtac

SEQ ID NO: 389350 - DNA, 25 bp, Rattus norvegicus
gcattgtcatgacccctgggccgta

SEQ ID NO: 389351 - DNA, 25 bp, Rattus norvegicus
gcattgtcatgagccctgggccgta

SEQ ID NO: 389352 - DNA, 25 bp, Rattus norvegicus
gcattgtccgtgagctgagctctgg

SEQ ID NO: 389353 - DNA, 25 bp, Rattus norvegicus
gcattgtccgtgtgctgagctctgg

SEQ ID NO: 389354 - DNA, 25 bp, Rattus norvegicus
gcattgtctattcctcatggtccat

SEQ ID NO: 389355 - DNA, 25 bp, Rattus norvegicus
gcattgtctattgctcatggtccat

SEQ ID NO: 389356 - DNA, 25 bp, Rattus norvegicus
gcattgtctgcacctcaagaactat

SEQ ID NO: 389357 - DNA, 25 bp, Rattus norvegicus
gcattgtctgcagctcaagaactat

SEQ ID NO: 389358 - DNA, 25 bp, Rattus norvegicus
gcattgtctgtccttgtctggctaa

SEQ ID NO: 389359 - DNA, 25 bp, Rattus norvegicus
gcattgtctgtcgttgtctggctaa

SEQ ID NO: 389360 - DNA, 25 bp, Rattus norvegicus
gcattgtctgttatccttgtagtta

SEQ ID NO: 389361 - DNA, 25 bp, Rattus norvegicus
gcattgtctgttttccttgtagtta

SEQ ID NO: 389362 - DNA, 25 bp, Rattus norvegicus
gcattgtctttcacgtgttgtttaa

SEQ ID NO: 389363 - DNA, 25 bp, Rattus norvegicus
gcattgtctttctcgtgttgtttaa

SEQ ID NO: 389364 - DNA, 25 bp, Rattus norvegicus
gcattgtgatgaactgtgtaccttt

SEQ ID NO: 389365 - DNA, 25 bp, Rattus norvegicus
gcattgtgatgatctgtgtaccttt

SEQ ID NO: 389366 - DNA, 25 bp, Rattus norvegicus
gcattgtgcacaatttcatactttg

SEQ ID NO: 389367 - DNA, 25 bp, Rattus norvegicus
gcattgtgcacattttcatactttg

SEQ ID NO: 389368 - DNA, 25 bp, Rattus norvegicus
gcattgtgccagagccgcagaaaga

SEQ ID NO: 389369 - DNA, 25 bp, Rattus norvegicus
gcattgtgccagtgccgcagaaaga

SEQ ID NO: 389370 - DNA, 25 bp, Rattus norvegicus
gcattgtgctataaagaggaagtct

SEQ ID NO: 389371 - DNA, 25 bp, Rattus norvegicus
gcattgtgctattaagaggaagtct

SEQ ID NO: 389372 - DNA, 25 bp, Rattus norvegicus
gcattgtgcttgaacttgtgctcac

SEQ ID NO: 389373 - DNA, 25 bp, Rattus norvegicus
gcattgtgcttgtacttgtgctcac

SEQ ID NO: 389374 - DNA, 25 bp, Rattus norvegicus
gcattgtgggctaaggcgaaacggt

SEQ ID NO: 389375 - DNA, 25 bp, Rattus norvegicus
gcattgtgggcttaggcgaaacggt

SEQ ID NO: 389376 - DNA, 25 bp, Rattus norvegicus
gcattgtgtacaatatcgctgcacc

SEQ ID NO: 389377 - DNA, 25 bp, Rattus norvegicus
gcattgtgtacattatcgctgcacc

SEQ ID NO: 389378 - DNA, 25 bp, Rattus norvegicus
gcattgtgtgaactcctggagccct

SEQ ID NO: 389379 - DNA, 25 bp, Rattus norvegicus
gcattgtgtgaagtcctggagccct

SEQ ID NO: 389380 - DNA, 25 bp, Rattus norvegicus
gcattgtgtgcaacagctgtgccat

SEQ ID NO: 389381 - DNA, 25 bp, Rattus norvegicus
gcattgtgtgcatcagctgtgccat

SEQ ID NO: 389382 - DNA, 25 bp, Rattus norvegicus
gcattgtgtgtcatgtacatctctt

SEQ ID NO: 389383 - DNA, 25 bp, Rattus norvegicus
gcattgtgtgtcttgtacatctctt

SEQ ID NO: 389384 - DNA, 25 bp, Rattus norvegicus
gcattgtgttagagaagagttcatt

SEQ ID NO: 389385 - DNA, 25 bp, Rattus norvegicus
gcattgtgttagtgaagagttcatt

SEQ ID NO: 389386 - DNA, 25 bp, Rattus norvegicus
gcattgtgttttccaaatcctcttg

SEQ ID NO: 389387 - DNA, 25 bp, Rattus norvegicus
gcattgtgttttgcaaatcctcttg

SEQ ID NO: 389388 - DNA, 25 bp, Rattus norvegicus
gcattgttaatgatccagtgcattg

SEQ ID NO: 389389 - DNA, 25 bp, Rattus norvegicus
gcattgttaatgttccagtgcattg

SEQ ID NO: 389390 - DNA, 25 bp, Rattus norvegicus
gcattgttcagactcagctctgttt

SEQ ID NO: 389391 - DNA, 25 bp, Rattus norvegicus
gcattgttcagagtcagctctgttt

SEQ ID NO: 389392 - DNA, 25 bp, Rattus norvegicus
gcattgttcctcatcgttatgttaa

SEQ ID NO: 389393 - DNA, 25 bp, Rattus norvegicus
gcattgttcctcttcgttatgttaa

SEQ ID NO: 389394 - DNA, 25 bp, Rattus norvegicus
gcattgttcgagctacgtggctttt

SEQ ID NO: 389395 - DNA, 25 bp, Rattus norvegicus
gcattgttcgaggtacgtggctttt

SEQ ID NO: 389396 - DNA, 25 bp, Rattus norvegicus
gcattgttctaaaggctgagcttca

SEQ ID NO: 389397 - DNA, 25 bp, Rattus norvegicus
gcattgttctaatggctgagcttca

SEQ ID NO: 389398 - DNA, 25 bp, Rattus norvegicus
gcattgttgaccattgttgattgtt

SEQ ID NO: 389399 - DNA, 25 bp, Rattus norvegicus
gcattgttgacctttgttgattgtt

SEQ ID NO: 389400 - DNA, 25 bp, Rattus norvegicus
gcattgttggcacgtctcgttctga

SEQ ID NO: 389401 - DNA, 25 bp, Rattus norvegicus
gcattgttggcaggtctcgttctga

SEQ ID NO: 389402 - DNA, 25 bp, Rattus norvegicus
gcattgtttcttaggagtctgtgta

SEQ ID NO: 389403 - DNA, 25 bp, Rattus norvegicus
gcattgtttctttggagtctgtgta

SEQ ID NO: 389404 - DNA, 25 bp, Rattus norvegicus
gcattgtttgcaactatgaaactct

SEQ ID NO: 389405 - DNA, 25 bp, Rattus norvegicus
gcattgtttgcatctatgaaactct

SEQ ID NO: 389406 - DNA, 25 bp, Rattus norvegicus
gcattgtttggtatatgattctgac

SEQ ID NO: 389407 - DNA, 25 bp, Rattus norvegicus
gcattgtttggtttatgattctgac

SEQ ID NO: 389408 - DNA, 25 bp, Rattus norvegicus
gcattgttttgtctatctatcatct

SEQ ID NO: 389409 - DNA, 25 bp, Rattus norvegicus
gcattgttttgtgtatctatcatct

SEQ ID NO: 389410 - DNA, 25 bp, Rattus norvegicus
gcatttaaatgcacggaacgggaaa

SEQ ID NO: 389411 - DNA, 25 bp, Rattus norvegicus
gcatttaaatgccacttcgagttta

SEQ ID NO: 389412 - DNA, 25 bp, Rattus norvegicus
gcatttaaatgcgacttcgagttta

SEQ ID NO: 389413 - DNA, 25 bp, Rattus norvegicus
gcatttaaatgctcggaacgggaaa

SEQ ID NO: 389414 - DNA, 25 bp, Rattus norvegicus
gcatttaaccttaactctactccag

SEQ ID NO: 389415 - DNA, 25 bp, Rattus norvegicus
gcatttaacctttactctactccag

SEQ ID NO: 389416 - DNA, 25 bp, Rattus norvegicus
gcatttaagaggatggcaggtccca

SEQ ID NO: 389417 - DNA, 25 bp, Rattus norvegicus
gcatttaagaggttggcaggtccca

SEQ ID NO: 389418 - DNA, 25 bp, Rattus norvegicus
gcatttaagcagagttcttgggtct

SEQ ID NO: 389419 - DNA, 25 bp, Rattus norvegicus
gcatttaagcagtgttcttgggtct

SEQ ID NO: 389420 - DNA, 25 bp, Rattus norvegicus
gcatttacaaaaatctggtctggat

SEQ ID NO: 389421 - DNA, 25 bp, Rattus norvegicus
gcatttacaaaattctggtctggat

SEQ ID NO: 389422 - DNA, 25 bp, Rattus norvegicus
gcatttacacctcgctgttccaaga

SEQ ID NO: 389423 - DNA, 25 bp, Rattus norvegicus
gcatttacacctggctgttccaaga

SEQ ID NO: 389424 - DNA, 25 bp, Rattus norvegicus
gcatttacagtcatcttcaaaggaa

SEQ ID NO: 389425 - DNA, 25 bp, Rattus norvegicus
gcatttacagtcttcttcaaaggaa

SEQ ID NO: 389426 - DNA, 25 bp, Rattus norvegicus
gcatttacatctcggtcctaactaa

SEQ ID NO: 389427 - DNA, 25 bp, Rattus norvegicus
gcatttacatctgggtcctaactaa

SEQ ID NO: 389428 - DNA, 25 bp, Rattus norvegicus
gcatttacctgtctgtccaagctgc

SEQ ID NO: 389429 - DNA, 25 bp, Rattus norvegicus
gcatttacctgtgtgtccaagctgc

SEQ ID NO: 389430 - DNA, 25 bp, Rattus norvegicus
gcatttaccttaccacagttctctt

SEQ ID NO: 389431 - DNA, 25 bp, Rattus norvegicus
gcatttaccttagcacagttctctt

SEQ ID NO: 389432 - DNA, 25 bp, Rattus norvegicus
gcatttactaaaaattccagctggt

SEQ ID NO: 389433 - DNA, 25 bp, Rattus norvegicus
gcatttactaaatattccagctggt

SEQ ID NO: 389434 - DNA, 25 bp, Rattus norvegicus
gcatttactgctacttgacctctaa

SEQ ID NO: 389435 - DNA, 25 bp, Rattus norvegicus
gcatttactgcttcttgacctctaa

SEQ ID NO: 389436 - DNA, 25 bp, Rattus norvegicus
gcatttagatggaggcttgcctctc

SEQ ID NO: 389437 - DNA, 25 bp, Rattus norvegicus
gcatttagatggtggcttgcctctc

SEQ ID NO: 389438 - DNA, 25 bp, Rattus norvegicus
gcatttagcatgaagtcctcagccc

SEQ ID NO: 389439 - DNA, 25 bp, Rattus norvegicus
gcatttagcatgtagtcctcagccc

SEQ ID NO: 389440 - DNA, 25 bp, Rattus norvegicus
gcatttagtcccacttggatgtttt

SEQ ID NO: 389441 - DNA, 25 bp, Rattus norvegicus
gcatttagtccctcttggatgtttt

SEQ ID NO: 389442 - DNA, 25 bp, Rattus norvegicus
gcatttatactccacagacttccag

SEQ ID NO: 389443 - DNA, 25 bp, Rattus norvegicus
gcatttatactcgacagacttccag

SEQ ID NO: 389444 - DNA, 25 bp, Rattus norvegicus
gcatttatacttagcccagatcaat

SEQ ID NO: 389445 - DNA, 25 bp, Rattus norvegicus
gcatttatactttgcccagatcaat

SEQ ID NO: 389446 - DNA, 25 bp, Rattus norvegicus
gcatttatcattatgattagtgtca

SEQ ID NO: 389447 - DNA, 25 bp, Rattus norvegicus
gcatttatcattttgattagtgtca

SEQ ID NO: 389448 - DNA, 25 bp, Rattus norvegicus
gcatttatctcgaggttggtcttat

SEQ ID NO: 389449 - DNA, 25 bp, Rattus norvegicus
gcatttatctcgtggttggtcttat

SEQ ID NO: 389450 - DNA, 25 bp, Rattus norvegicus
gcatttatgaagctacccggatgtg

SEQ ID NO: 389451 - DNA, 25 bp, Rattus norvegicus
gcatttatgaaggtacccggatgtg

SEQ ID NO: 389452 - DNA, 25 bp, Rattus norvegicus
gcatttattaagagcctgctggatg

SEQ ID NO: 389453 - DNA, 25 bp, Rattus norvegicus
gcatttattaagtgcctgctggatg

SEQ ID NO: 389454 - DNA, 25 bp, Rattus norvegicus
gcatttattattacctcttttcaag

SEQ ID NO: 389455 - DNA, 25 bp, Rattus norvegicus
gcatttattatttcctcttttcaag

SEQ ID NO: 389456 - DNA, 25 bp, Rattus norvegicus
gcatttcaaactagagctcctcatc

SEQ ID NO: 389457 - DNA, 25 bp, Rattus norvegicus
gcatttcaaacttgagctcctcatc

SEQ ID NO: 389458 - DNA, 25 bp, Rattus norvegicus
gcatttcaacttctcctggattggt

SEQ ID NO: 389459 - DNA, 25 bp, Rattus norvegicus
gcatttcaacttgtcctggattggt

SEQ ID NO: 389460 - DNA, 25 bp, Rattus norvegicus
gcatttcaagctcggcatgtttgca

SEQ ID NO: 389461 - DNA, 25 bp, Rattus norvegicus
gcatttcaagctgggcatgtttgca

SEQ ID NO: 389462 - DNA, 25 bp, Rattus norvegicus
gcatttcaaggtcctgagttgtata

SEQ ID NO: 389463 - DNA, 25 bp, Rattus norvegicus
gcatttcaaggtgctgagttgtata

SEQ ID NO: 389464 - DNA, 25 bp, Rattus norvegicus
gcatttcaatgcagctggatccacc

SEQ ID NO: 389465 - DNA, 25 bp, Rattus norvegicus
gcatttcaatgctgctggatccacc

SEQ ID NO: 389466 - DNA, 25 bp, Rattus norvegicus
gcatttcacaaaaggccaggcacaa

SEQ ID NO: 389467 - DNA, 25 bp, Rattus norvegicus
gcatttcacaaatggccaggcacaa

SEQ ID NO: 389468 - DNA, 25 bp, Rattus norvegicus
gcatttcacagcaattgtccaggga

SEQ ID NO: 389469 - DNA, 25 bp, Rattus norvegicus
gcatttcacagcagagtgtcgcttt

SEQ ID NO: 389470 - DNA, 25 bp, Rattus norvegicus
gcatttcacagctattgtccaggga

SEQ ID NO: 389471 - DNA, 25 bp, Rattus norvegicus
gcatttcacagctgagtgtcgcttt

SEQ ID NO: 389472 - DNA, 25 bp, Rattus norvegicus
gcatttcactgtatgttttaatgtc

SEQ ID NO: 389473 - DNA, 25 bp, Rattus norvegicus
gcatttcactgtttgttttaatgtc

SEQ ID NO: 389474 - DNA, 25 bp, Rattus norvegicus
gcatttcacttcactgggatttaaa

SEQ ID NO: 389475 - DNA, 25 bp, Rattus norvegicus
gcatttcacttctctgggatttaaa

SEQ ID NO: 389476 - DNA, 25 bp, Rattus norvegicus
gcatttcagacaccttttctttttg

SEQ ID NO: 389477 - DNA, 25 bp, Rattus norvegicus
gcatttcagacagcttttctttttg

SEQ ID NO: 389478 - DNA, 25 bp, Rattus norvegicus
gcatttcaggacatctaaaagctac

SEQ ID NO: 389479 - DNA, 25 bp, Rattus norvegicus
gcatttcaggacttctaaaagctac

SEQ ID NO: 389480 - DNA, 25 bp, Rattus norvegicus
gcatttcagtttctgcataatttag

SEQ ID NO: 389481 - DNA, 25 bp, Rattus norvegicus
gcatttcagtttgtgcataatttag

SEQ ID NO: 389482 - DNA, 25 bp, Rattus norvegicus
gcatttcatccaaaggttacagcag

SEQ ID NO: 389483 - DNA, 25 bp, Rattus norvegicus
gcatttcatccataggttacagcag

SEQ ID NO: 389484 - DNA, 25 bp, Rattus norvegicus
gcatttcatgatccttgctaacgat

SEQ ID NO: 389485 - DNA, 25 bp, Rattus norvegicus
gcatttcatgatgcttgctaacgat

SEQ ID NO: 389486 - DNA, 25 bp, Rattus norvegicus
gcatttcatgtgagtggatcccctt

SEQ ID NO: 389487 - DNA, 25 bp, Rattus norvegicus
gcatttcatgtgtgtggatcccctt

SEQ ID NO: 389488 - DNA, 25 bp, Rattus norvegicus
gcatttccacatacatttagaagcg

SEQ ID NO: 389489 - DNA, 25 bp, Rattus norvegicus
gcatttccacattcatttagaagcg

SEQ ID NO: 389490 - DNA, 25 bp, Rattus norvegicus
gcatttccagacacttatccctgag

SEQ ID NO: 389491 - DNA, 25 bp, Rattus norvegicus
gcatttccagactcttatccctgag

SEQ ID NO: 389492 - DNA, 25 bp, Rattus norvegicus
gcatttccagataagatggtgccat

SEQ ID NO: 389493 - DNA, 25 bp, Rattus norvegicus
gcatttccagattagatggtgccat

SEQ ID NO: 389494 - DNA, 25 bp, Rattus norvegicus
gcatttccagtaattctccctgatt

SEQ ID NO: 389495 - DNA, 25 bp, Rattus norvegicus
gcatttccagtatttctccctgatt

SEQ ID NO: 389496 - DNA, 25 bp, Rattus norvegicus
gcatttccattgctgggtcttatat

SEQ ID NO: 389497 - DNA, 25 bp, Rattus norvegicus
gcatttccattggtgggtcttatat

SEQ ID NO: 389498 - DNA, 25 bp, Rattus norvegicus
gcatttccctagctcctgaaaagat

SEQ ID NO: 389499 - DNA, 25 bp, Rattus norvegicus
gcatttccctaggtcctgaaaagat

SEQ ID NO: 389500 - DNA, 25 bp, Rattus norvegicus
gcatttccctatattggctattagc

SEQ ID NO: 389501 - DNA, 25 bp, Rattus norvegicus
gcatttccctattttggctattagc

SEQ ID NO: 389502 - DNA, 25 bp, Rattus norvegicus
gcatttccctgaacgtttctcgtga

SEQ ID NO: 389503 - DNA, 25 bp, Rattus norvegicus
gcatttccctgatcgtttctcgtga

SEQ ID NO: 389504 - DNA, 25 bp, Rattus norvegicus
gcatttcctcttaaaacgggtgtgg

SEQ ID NO: 389505 - DNA, 25 bp, Rattus norvegicus
gcatttcctctttaaacgggtgtgg

SEQ ID NO: 389506 - DNA, 25 bp, Rattus norvegicus
gcatttccttggcatctatcttaca

SEQ ID NO: 389507 - DNA, 25 bp, Rattus norvegicus
gcatttccttgggatctatcttaca

SEQ ID NO: 389508 - DNA, 25 bp, Rattus norvegicus
gcatttccttgtcttttatcttcat

SEQ ID NO: 389509 - DNA, 25 bp, Rattus norvegicus
gcatttccttgtgttttatcttcat

SEQ ID NO: 389510 - DNA, 25 bp, Rattus norvegicus
gcatttcgaggcagtcaccaggaca

SEQ ID NO: 389511 - DNA, 25 bp, Rattus norvegicus
gcatttcgaggctgtcaccaggaca

SEQ ID NO: 389512 - DNA, 25 bp, Rattus norvegicus
gcatttcgatccacgtcaggtgcag

SEQ ID NO: 389513 - DNA, 25 bp, Rattus norvegicus
gcatttcgatcctcgtcaggtgcag

SEQ ID NO: 389514 - DNA, 25 bp, Rattus norvegicus
gcatttcgcctcaactataattctg

SEQ ID NO: 389515 - DNA, 25 bp, Rattus norvegicus
gcatttcgcctctactataattctg

SEQ ID NO: 389516 - DNA, 25 bp, Rattus norvegicus
gcatttcggagtaggtcggtgtttt

SEQ ID NO: 389517 - DNA, 25 bp, Rattus norvegicus
gcatttcggagttggtcggtgtttt

SEQ ID NO: 389518 - DNA, 25 bp, Rattus norvegicus
gcatttcgtaggactttccatacaa

SEQ ID NO: 389519 - DNA, 25 bp, Rattus norvegicus
gcatttcgtaggtctttccatacaa

SEQ ID NO: 389520 - DNA, 25 bp, Rattus norvegicus
gcatttctatccctggatggtgcta

SEQ ID NO: 389521 - DNA, 25 bp, Rattus norvegicus
gcatttctatccgtggatggtgcta

SEQ ID NO: 389522 - DNA, 25 bp, Rattus norvegicus
gcatttctattcatcatgaacctgg

SEQ ID NO: 389523 - DNA, 25 bp, Rattus norvegicus
gcatttctattcttcatgaacctgg

SEQ ID NO: 389524 - DNA, 25 bp, Rattus norvegicus
gcatttctattgcttttgtatggaa

SEQ ID NO: 389525 - DNA, 25 bp, Rattus norvegicus
gcatttctattggttttgtatggaa

SEQ ID NO: 389526 - DNA, 25 bp, Rattus norvegicus
gcatttctcaaacatacccgcagta

SEQ ID NO: 389527 - DNA, 25 bp, Rattus norvegicus
gcatttctcaaagatacccgcagta

SEQ ID NO: 389528 - DNA, 25 bp, Rattus norvegicus
gcatttctcaagcacccaatgaaaa

SEQ ID NO: 389529 - DNA, 25 bp, Rattus norvegicus
gcatttctcaaggacccaatgaaaa

SEQ ID NO: 389530 - DNA, 25 bp, Rattus norvegicus
gcatttctcagcaacaaaccaatcg

SEQ ID NO: 389531 - DNA, 25 bp, Rattus norvegicus
gcatttctcagctacaaaccaatcg

SEQ ID NO: 389532 - DNA, 25 bp, Rattus norvegicus
gcatttctcctcagccattaagaat

SEQ ID NO: 389533 - DNA, 25 bp, Rattus norvegicus
gcatttctcctctgccattaagaat

SEQ ID NO: 389534 - DNA, 25 bp, Rattus norvegicus
gcatttctctttagtgcgtccttca

SEQ ID NO: 389535 - DNA, 25 bp, Rattus norvegicus
gcatttctcttttgtgcgtccttca

SEQ ID NO: 389536 - DNA, 25 bp, Rattus norvegicus
gcatttctgcacataatccatattt

SEQ ID NO: 389537 - DNA, 25 bp, Rattus norvegicus
gcatttctgcacttaatccatattt

SEQ ID NO: 389538 - DNA, 25 bp, Rattus norvegicus
gcatttctgcctagggagagctttt

SEQ ID NO: 389539 - DNA, 25 bp, Rattus norvegicus
gcatttctgccttgggagagctttt

SEQ ID NO: 389540 - DNA, 25 bp, Rattus norvegicus
gcatttctggctaggatttcgtaaa

SEQ ID NO: 389541 - DNA, 25 bp, Rattus norvegicus
gcatttctggcttggatttcgtaaa

SEQ ID NO: 389542 - DNA, 25 bp, Rattus norvegicus
gcatttctgtataaattagccttga

SEQ ID NO: 389543 - DNA, 25 bp, Rattus norvegicus
gcatttctgtattaattagccttga

SEQ ID NO: 389544 - DNA, 25 bp, Rattus norvegicus
gcatttctgtcccaaacctagtaag

SEQ ID NO: 389545 - DNA, 25 bp, Rattus norvegicus
gcatttctgtccgaaacctagtaag

SEQ ID NO: 389546 - DNA, 25 bp, Rattus norvegicus
gcatttctgtgcctatcgattttca

SEQ ID NO: 389547 - DNA, 25 bp, Rattus norvegicus
gcatttctgtgcgtatcgattttca

SEQ ID NO: 389548 - DNA, 25 bp, Rattus norvegicus
gcatttcttgaaagggtctcctcag

SEQ ID NO: 389549 - DNA, 25 bp, Rattus norvegicus
gcatttcttgaatgggtctcctcag

SEQ ID NO: 389550 - DNA, 25 bp, Rattus norvegicus
gcatttcttggcagcatgaactttg

SEQ ID NO: 389551 - DNA, 25 bp, Rattus norvegicus
gcatttcttggctgcatgaactttg

SEQ ID NO: 389552 - DNA, 25 bp, Rattus norvegicus
gcatttctttagcactccatacacg

SEQ ID NO: 389553 - DNA, 25 bp, Rattus norvegicus
gcatttctttaggactccatacacg

SEQ ID NO: 389554 - DNA, 25 bp, Rattus norvegicus
gcatttgaaagactctgcctgctta

SEQ ID NO: 389555 - DNA, 25 bp, Rattus norvegicus
gcatttgaaagagtctgcctgctta

SEQ ID NO: 389556 - DNA, 25 bp, Rattus norvegicus
gcatttgaagagacccacagcagag

SEQ ID NO: 389557 - DNA, 25 bp, Rattus norvegicus
gcatttgaagagtcccacagcagag

SEQ ID NO: 389558 - DNA, 25 bp, Rattus norvegicus
gcatttgaaggaatttcttcccctt

SEQ ID NO: 389559 - DNA, 25 bp, Rattus norvegicus
gcatttgaaggattttcttcccctt

SEQ ID NO: 389560 - DNA, 25 bp, Rattus norvegicus
gcatttgaatcgaacctttcatcac

SEQ ID NO: 389561 - DNA, 25 bp, Rattus norvegicus
gcatttgaatcgtacctttcatcac

SEQ ID NO: 389562 - DNA, 25 bp, Rattus norvegicus
gcatttgaatgtaaaccccacggga

SEQ ID NO: 389563 - DNA, 25 bp, Rattus norvegicus
gcatttgaatgtctgcttacctgtg

SEQ ID NO: 389564 - DNA, 25 bp, Rattus norvegicus
gcatttgaatgtgtgcttacctgtg

SEQ ID NO: 389565 - DNA, 25 bp, Rattus norvegicus
gcatttgaatgttaaccccacggga

SEQ ID NO: 389566 - DNA, 25 bp, Rattus norvegicus
gcatttgacattaccagccattttt

SEQ ID NO: 389567 - DNA, 25 bp, Rattus norvegicus
gcatttgacatttccagccattttt

SEQ ID NO: 389568 - DNA, 25 bp, Rattus norvegicus
gcatttgaccagaaggagacccttt

SEQ ID NO: 389569 - DNA, 25 bp, Rattus norvegicus
gcatttgaccagtaggagacccttt

SEQ ID NO: 389570 - DNA, 25 bp, Rattus norvegicus
gcatttgaccttcaccatttggaaa

SEQ ID NO: 389571 - DNA, 25 bp, Rattus norvegicus
gcatttgaccttgaccatttggaaa

SEQ ID NO: 389572 - DNA, 25 bp, Rattus norvegicus
gcatttgagaatcggcctgctcctc

SEQ ID NO: 389573 - DNA, 25 bp, Rattus norvegicus
gcatttgagaatgggcctgctcctc

SEQ ID NO: 389574 - DNA, 25 bp, Rattus norvegicus
gcatttgagcatccacctgtataga

SEQ ID NO: 389575 - DNA, 25 bp, Rattus norvegicus
gcatttgagcatgcacctgtataga

SEQ ID NO: 389576 - DNA, 25 bp, Rattus norvegicus
gcatttgagccactagccttttaaa

SEQ ID NO: 389577 - DNA, 25 bp, Rattus norvegicus
gcatttgagccagtagccttttaaa

SEQ ID NO: 389578 - DNA, 25 bp, Rattus norvegicus
gcatttgagtgtattttccgacttc

SEQ ID NO: 389579 - DNA, 25 bp, Rattus norvegicus
gcatttgagtgtcgccatagcaact

SEQ ID NO: 389580 - DNA, 25 bp, Rattus norvegicus
gcatttgagtgtggccatagcaact

SEQ ID NO: 389581 - DNA, 25 bp, Rattus norvegicus
gcatttgagtgttttttccgacttc

SEQ ID NO: 389582 - DNA, 25 bp, Rattus norvegicus
gcatttgatccactgctctgacaaa

SEQ ID NO: 389583 - DNA, 25 bp, Rattus norvegicus
gcatttgatccagtgctctgacaaa

SEQ ID NO: 389584 - DNA, 25 bp, Rattus norvegicus
gcatttgatgaactgctggccagca

SEQ ID NO: 389585 - DNA, 25 bp, Rattus norvegicus
gcatttgatgaagtgctggccagca

SEQ ID NO: 389586 - DNA, 25 bp, Rattus norvegicus
gcatttgcaaacaccatgactgtga

SEQ ID NO: 389587 - DNA, 25 bp, Rattus norvegicus
gcatttgcaaactccatgactgtga

SEQ ID NO: 389588 - DNA, 25 bp, Rattus norvegicus
gcatttgcaaagacgtcgttgcttt

SEQ ID NO: 389589 - DNA, 25 bp, Rattus norvegicus
gcatttgcaaagtcgtcgttgcttt

SEQ ID NO: 389590 - DNA, 25 bp, Rattus norvegicus
gcatttgcacggattgggttatttc

SEQ ID NO: 389591 - DNA, 25 bp, Rattus norvegicus
gcatttgcacggtttgggttatttc

SEQ ID NO: 389592 - DNA, 25 bp, Rattus norvegicus
gcatttgcagcaactacagcatttc

SEQ ID NO: 389593 - DNA, 25 bp, Rattus norvegicus
gcatttgcagcacccttacttgtga

SEQ ID NO: 389594 - DNA, 25 bp, Rattus norvegicus
gcatttgcagcagccttacttgtga

SEQ ID NO: 389595 - DNA, 25 bp, Rattus norvegicus
gcatttgcagcatctacagcatttc

SEQ ID NO: 389596 - DNA, 25 bp, Rattus norvegicus
gcatttgcaggaatttcagccaaga

SEQ ID NO: 389597 - DNA, 25 bp, Rattus norvegicus
gcatttgcaggattttcagccaaga

SEQ ID NO: 389598 - DNA, 25 bp, Rattus norvegicus
gcatttgcagttcgtgtatgaattt

SEQ ID NO: 389599 - DNA, 25 bp, Rattus norvegicus
gcatttgcagttggtgtatgaattt

SEQ ID NO: 389600 - DNA, 25 bp, Rattus norvegicus
gcatttgcatacatggacacccatt

SEQ ID NO: 389601 - DNA, 25 bp, Rattus norvegicus
gcatttgcatacttggacacccatt

SEQ ID NO: 389602 - DNA, 25 bp, Rattus norvegicus
gcatttgcgagtactccagcatgat

SEQ ID NO: 389603 - DNA, 25 bp, Rattus norvegicus
gcatttgcgagttctccagcatgat

SEQ ID NO: 389604 - DNA, 25 bp, Rattus norvegicus
gcatttgcgcttagtgtgttttgtt

SEQ ID NO: 389605 - DNA, 25 bp, Rattus norvegicus
gcatttgcgctttgtgtgttttgtt

SEQ ID NO: 389606 - DNA, 25 bp, Rattus norvegicus
gcatttgctaatatcattaccatta

SEQ ID NO: 389607 - DNA, 25 bp, Rattus norvegicus
gcatttgctaatttcattaccatta

SEQ ID NO: 389608 - DNA, 25 bp, Rattus norvegicus
gcatttgctattcctggtgacagtc

SEQ ID NO: 389609 - DNA, 25 bp, Rattus norvegicus
gcatttgctattgctggtgacagtc

SEQ ID NO: 389610 - DNA, 25 bp, Rattus norvegicus
gcatttgctgcacatattgttagga

SEQ ID NO: 389611 - DNA, 25 bp, Rattus norvegicus
gcatttgctgcagatattgttagga

SEQ ID NO: 389612 - DNA, 25 bp, Rattus norvegicus
gcatttgctgtcctgtgtcctgaca

SEQ ID NO: 389613 - DNA, 25 bp, Rattus norvegicus
gcatttgctgtcgtgtgtcctgaca

SEQ ID NO: 389614 - DNA, 25 bp, Rattus norvegicus
gcatttgctgtgagtttataactca

SEQ ID NO: 389615 - DNA, 25 bp, Rattus norvegicus
gcatttgctgtgtgtttataactca

SEQ ID NO: 389616 - DNA, 25 bp, Rattus norvegicus
gcatttgcttgtcgccccattcctg

SEQ ID NO: 389617 - DNA, 25 bp, Rattus norvegicus
gcatttgcttgtggccccattcctg

SEQ ID NO: 389618 - DNA, 25 bp, Rattus norvegicus
gcatttggatgaattcttacaacta

SEQ ID NO: 389619 - DNA, 25 bp, Rattus norvegicus
gcatttggatgatttcttacaacta

SEQ ID NO: 389620 - DNA, 25 bp, Rattus norvegicus
gcatttgggaaaacatgaccttcta

SEQ ID NO: 389621 - DNA, 25 bp, Rattus norvegicus
gcatttgggaaatcatgaccttcta

SEQ ID NO: 389622 - DNA, 25 bp, Rattus norvegicus
gcatttgggaggacaggagcatctt

SEQ ID NO: 389623 - DNA, 25 bp, Rattus norvegicus
gcatttgggaggtcaggagcatctt

SEQ ID NO: 389624 - DNA, 25 bp, Rattus norvegicus
gcatttgggattactgcttgggaga

SEQ ID NO: 389625 - DNA, 25 bp, Rattus norvegicus
gcatttgggatttctgcttgggaga

SEQ ID NO: 389626 - DNA, 25 bp, Rattus norvegicus
gcatttggtcagagtttacccacag

SEQ ID NO: 389627 - DNA, 25 bp, Rattus norvegicus
gcatttggtcagtgtttacccacag

SEQ ID NO: 389628 - DNA, 25 bp, Rattus norvegicus
gcatttgtaactctggaagggtcct

SEQ ID NO: 389629 - DNA, 25 bp, Rattus norvegicus
gcatttgtaactgtggaagggtcct

SEQ ID NO: 389630 - DNA, 25 bp, Rattus norvegicus
gcatttgtaatgcaagttttccatg

SEQ ID NO: 389631 - DNA, 25 bp, Rattus norvegicus
gcatttgtaatggaagttttccatg

SEQ ID NO: 389632 - DNA, 25 bp, Rattus norvegicus
gcatttgtaattcagtcgcatttat

SEQ ID NO: 389633 - DNA, 25 bp, Rattus norvegicus
gcatttgtaattgagtcgcatttat

SEQ ID NO: 389634 - DNA, 25 bp, Rattus norvegicus
gcatttgtatctcctgtgtactatt

SEQ ID NO: 389635 - DNA, 25 bp, Rattus norvegicus
gcatttgtatctgctgtgtactatt

SEQ ID NO: 389636 - DNA, 25 bp, Rattus norvegicus
gcatttgtatttccatttcttgcaa

SEQ ID NO: 389637 - DNA, 25 bp, Rattus norvegicus
gcatttgtatttgcatttcttgcaa

SEQ ID NO: 389638 - DNA, 25 bp, Rattus norvegicus
gcatttgtcatgagcaagctcagag

SEQ ID NO: 389639 - DNA, 25 bp, Rattus norvegicus
gcatttgtcatgctctaggtcactt

SEQ ID NO: 389640 - DNA, 25 bp, Rattus norvegicus
gcatttgtcatggtctaggtcactt

SEQ ID NO: 389641 - DNA, 25 bp, Rattus norvegicus
gcatttgtcatgtgcaagctcagag

SEQ ID NO: 389642 - DNA, 25 bp, Rattus norvegicus
gcatttgtccatcttaagagtctaa

SEQ ID NO: 389643 - DNA, 25 bp, Rattus norvegicus
gcatttgtccatgttaagagtctaa

SEQ ID NO: 389644 - DNA, 25 bp, Rattus norvegicus
gcatttgtgtaaatgacctgggacc

SEQ ID NO: 389645 - DNA, 25 bp, Rattus norvegicus
gcatttgtgtaattgacctgggacc

SEQ ID NO: 389646 - DNA, 25 bp, Rattus norvegicus
gcatttgtgtcgctgttgactgcgt

SEQ ID NO: 389647 - DNA, 25 bp, Rattus norvegicus
gcatttgtgtcggtgttgactgcgt

SEQ ID NO: 389648 - DNA, 25 bp, Rattus norvegicus
gcatttgttaacagtgcatccccag

SEQ ID NO: 389649 - DNA, 25 bp, Rattus norvegicus
gcatttgttaactgtgcatccccag

SEQ ID NO: 389650 - DNA, 25 bp, Rattus norvegicus
gcatttgttaagaccagttagcatt

SEQ ID NO: 389651 - DNA, 25 bp, Rattus norvegicus
gcatttgttaagtccagttagcatt

SEQ ID NO: 389652 - DNA, 25 bp, Rattus norvegicus
gcatttgttaatatatttagcttcc

SEQ ID NO: 389653 - DNA, 25 bp, Rattus norvegicus
gcatttgttaatttatttagcttcc

SEQ ID NO: 389654 - DNA, 25 bp, Rattus norvegicus
gcatttgtttcccattgagacttgt

SEQ ID NO: 389655 - DNA, 25 bp, Rattus norvegicus
gcatttgtttccgattgagacttgt

SEQ ID NO: 389656 - DNA, 25 bp, Rattus norvegicus
gcatttgtttcgacttttaggtctc

SEQ ID NO: 389657 - DNA, 25 bp, Rattus norvegicus
gcatttgtttcgtcttttaggtctc

SEQ ID NO: 389658 - DNA, 25 bp, Rattus norvegicus
gcattttaaaaccactcagcacaca

SEQ ID NO: 389659 - DNA, 25 bp, Rattus norvegicus
gcattttaaaacgactcagcacaca

SEQ ID NO: 389660 - DNA, 25 bp, Rattus norvegicus
gcattttaactgacacctcagggat

SEQ ID NO: 389661 - DNA, 25 bp, Rattus norvegicus
gcattttaactgtcacctcagggat

SEQ ID NO: 389662 - DNA, 25 bp, Rattus norvegicus
gcattttaagttaagctgcctgaag

SEQ ID NO: 389663 - DNA, 25 bp, Rattus norvegicus
gcattttaagtttagctgcctgaag

SEQ ID NO: 389664 - DNA, 25 bp, Rattus norvegicus
gcattttaatgacctcttggctcac

SEQ ID NO: 389665 - DNA, 25 bp, Rattus norvegicus
gcattttaatgagctcttggctcac

SEQ ID NO: 389666 - DNA, 25 bp, Rattus norvegicus
gcattttagccacacagactctcac

SEQ ID NO: 389667 - DNA, 25 bp, Rattus norvegicus
gcattttagccagacagactctcac

SEQ ID NO: 389668 - DNA, 25 bp, Rattus norvegicus
gcattttagcctctggtcttgccag

SEQ ID NO: 389669 - DNA, 25 bp, Rattus norvegicus
gcattttagcctgtggtcttgccag

SEQ ID NO: 389670 - DNA, 25 bp, Rattus norvegicus
gcattttagctgagaatttccgagg

SEQ ID NO: 389671 - DNA, 25 bp, Rattus norvegicus
gcattttagctgtgaatttccgagg

SEQ ID NO: 389672 - DNA, 25 bp, Rattus norvegicus
gcattttagtttcgccatcttctcc

SEQ ID NO: 389673 - DNA, 25 bp, Rattus norvegicus
gcattttagtttggccatcttctcc

SEQ ID NO: 389674 - DNA, 25 bp, Rattus norvegicus
gcattttatcttagctcaattgtta

SEQ ID NO: 389675 - DNA, 25 bp, Rattus norvegicus
gcattttatctttgctcaattgtta

SEQ ID NO: 389676 - DNA, 25 bp, Rattus norvegicus
gcattttatgacactaaccccttga

SEQ ID NO: 389677 - DNA, 25 bp, Rattus norvegicus
gcattttatgacctgttaagctttc

SEQ ID NO: 389678 - DNA, 25 bp, Rattus norvegicus
gcattttatgacgtgttaagctttc

SEQ ID NO: 389679 - DNA, 25 bp, Rattus norvegicus
gcattttatgactctaaccccttga

SEQ ID NO: 389680 - DNA, 25 bp, Rattus norvegicus
gcattttattggaacaagactgttt

SEQ ID NO: 389681 - DNA, 25 bp, Rattus norvegicus
gcattttattggtacaagactgttt

SEQ ID NO: 389682 - DNA, 25 bp, Rattus norvegicus
gcattttattttctcccaggttgga

SEQ ID NO: 389683 - DNA, 25 bp, Rattus norvegicus
gcattttattttgtcccaggttgga

SEQ ID NO: 389684 - DNA, 25 bp, Rattus norvegicus
gcattttcaaggctctctacagaca

SEQ ID NO: 389685 - DNA, 25 bp, Rattus norvegicus
gcattttcaagggtctctacagaca

SEQ ID NO: 389686 - DNA, 25 bp, Rattus norvegicus
gcattttcagtacacagggtcctag

SEQ ID NO: 389687 - DNA, 25 bp, Rattus norvegicus
gcattttcagtagacagggtcctag

SEQ ID NO: 389688 - DNA, 25 bp, Rattus norvegicus
gcattttcatttactacagctgttc

SEQ ID NO: 389689 - DNA, 25 bp, Rattus norvegicus
gcattttcattttctacagctgttc

SEQ ID NO: 389690 - DNA, 25 bp, Rattus norvegicus
gcattttccagaatgctgtgtagca

SEQ ID NO: 389691 - DNA, 25 bp, Rattus norvegicus
gcattttccagattgctgtgtagca

SEQ ID NO: 389692 - DNA, 25 bp, Rattus norvegicus
gcattttcctgcaaagacctttgcc

SEQ ID NO: 389693 - DNA, 25 bp, Rattus norvegicus
gcattttcctgctaagacctttgcc

SEQ ID NO: 389694 - DNA, 25 bp, Rattus norvegicus
gcattttccttgaagttttgttcta

SEQ ID NO: 389695 - DNA, 25 bp, Rattus norvegicus
gcattttccttgtagttttgttcta

SEQ ID NO: 389696 - DNA, 25 bp, Rattus norvegicus
gcattttcctttagctgttggtcat

SEQ ID NO: 389697 - DNA, 25 bp, Rattus norvegicus
gcattttccttttgctgttggtcat

SEQ ID NO: 389698 - DNA, 25 bp, Rattus norvegicus
gcattttctacaattactgagctgt

SEQ ID NO: 389699 - DNA, 25 bp, Rattus norvegicus
gcattttctacatttactgagctgt

SEQ ID NO: 389700 - DNA, 25 bp, Rattus norvegicus
gcattttctagacgttagttttctg

SEQ ID NO: 389701 - DNA, 25 bp, Rattus norvegicus
gcattttctagaggttagttttctg

SEQ ID NO: 389702 - DNA, 25 bp, Rattus norvegicus
gcattttctcagacaaggttctgtc

SEQ ID NO: 389703 - DNA, 25 bp, Rattus norvegicus
gcattttctcagtcaaggttctgtc

SEQ ID NO: 389704 - DNA, 25 bp, Rattus norvegicus
gcattttctcatccttttggtgccg

SEQ ID NO: 389705 - DNA, 25 bp, Rattus norvegicus
gcattttctcatgcttttggtgccg

SEQ ID NO: 389706 - DNA, 25 bp, Rattus norvegicus
gcattttctcttaattttgacactg

SEQ ID NO: 389707 - DNA, 25 bp, Rattus norvegicus
gcattttctctttattttgacactg

SEQ ID NO: 389708 - DNA, 25 bp, Rattus norvegicus
gcattttctgctctaagttttggtg

SEQ ID NO: 389709 - DNA, 25 bp, Rattus norvegicus
gcattttctgctgtaagttttggtg

SEQ ID NO: 389710 - DNA, 25 bp, Rattus norvegicus
gcattttctgttcatttgtttcact

SEQ ID NO: 389711 - DNA, 25 bp, Rattus norvegicus
gcattttctgttgatttgtttcact

SEQ ID NO: 389712 - DNA, 25 bp, Rattus norvegicus
gcattttcttaacttgtggccagca

SEQ ID NO: 389713 - DNA, 25 bp, Rattus norvegicus
gcattttcttaagttgtggccagca

SEQ ID NO: 389714 - DNA, 25 bp, Rattus norvegicus
gcattttcttatcccattatttgca

SEQ ID NO: 389715 - DNA, 25 bp, Rattus norvegicus
gcattttcttatgccattatttgca

SEQ ID NO: 389716 - DNA, 25 bp, Rattus norvegicus
gcattttcttctattgttaacgttg

SEQ ID NO: 389717 - DNA, 25 bp, Rattus norvegicus
gcattttcttcttttgttaacgttg

SEQ ID NO: 389718 - DNA, 25 bp, Rattus norvegicus
gcattttgaatcatagcctcaggtg

SEQ ID NO: 389719 - DNA, 25 bp, Rattus norvegicus
gcattttgaatcttagcctcaggtg

SEQ ID NO: 389720 - DNA, 25 bp, Rattus norvegicus
gcattttgacaacatccacagggca

SEQ ID NO: 389721 - DNA, 25 bp, Rattus norvegicus
gcattttgacaagatccacagggca

SEQ ID NO: 389722 - DNA, 25 bp, Rattus norvegicus
gcattttgacagactgagtccctgc

SEQ ID NO: 389723 - DNA, 25 bp, Rattus norvegicus
gcattttgacagtctgagtccctgc

SEQ ID NO: 389724 - DNA, 25 bp, Rattus norvegicus
gcattttgagttcttcacgcccaac

SEQ ID NO: 389725 - DNA, 25 bp, Rattus norvegicus
gcattttgagttgttcacgcccaac

SEQ ID NO: 389726 - DNA, 25 bp, Rattus norvegicus
gcattttgcaatcaactggcattta

SEQ ID NO: 389727 - DNA, 25 bp, Rattus norvegicus
gcattttgcaatgaactggcattta

SEQ ID NO: 389728 - DNA, 25 bp, Rattus norvegicus
gcattttgcacactcagtttgccga

SEQ ID NO: 389729 - DNA, 25 bp, Rattus norvegicus
gcattttgcacagtcagtttgccga

SEQ ID NO: 389730 - DNA, 25 bp, Rattus norvegicus
gcattttgcctcctgtacaaattat

SEQ ID NO: 389731 - DNA, 25 bp, Rattus norvegicus
gcattttgcctcgtgtacaaattat

SEQ ID NO: 389732 - DNA, 25 bp, Rattus norvegicus
gcattttgcgttcttcatgtgtaat

SEQ ID NO: 389733 - DNA, 25 bp, Rattus norvegicus
gcattttgcgttgttcatgtgtaat

SEQ ID NO: 389734 - DNA, 25 bp, Rattus norvegicus
gcattttgcttgacatggttcaatc

SEQ ID NO: 389735 - DNA, 25 bp, Rattus norvegicus
gcattttgcttgatcgtttgctccg

SEQ ID NO: 389736 - DNA, 25 bp, Rattus norvegicus
gcattttgcttgtcatggttcaatc

SEQ ID NO: 389737 - DNA, 25 bp, Rattus norvegicus
gcattttgcttgttcgtttgctccg

SEQ ID NO: 389738 - DNA, 25 bp, Rattus norvegicus
gcattttggacacattgctgtacaa

SEQ ID NO: 389739 - DNA, 25 bp, Rattus norvegicus
gcattttggacagattgctgtacaa

SEQ ID NO: 389740 - DNA, 25 bp, Rattus norvegicus
gcattttggatgatcattagcctgt

SEQ ID NO: 389741 - DNA, 25 bp, Rattus norvegicus
gcattttggatgttcattagcctgt

SEQ ID NO: 389742 - DNA, 25 bp, Rattus norvegicus
gcattttggcgcactaagttgattt

SEQ ID NO: 389743 - DNA, 25 bp, Rattus norvegicus
gcattttggcgctctaagttgattt

SEQ ID NO: 389744 - DNA, 25 bp, Rattus norvegicus
gcattttgggaacaaattttctttg

SEQ ID NO: 389745 - DNA, 25 bp, Rattus norvegicus
gcattttgggaagaaattttctttg

SEQ ID NO: 389746 - DNA, 25 bp, Rattus norvegicus
gcattttggtggacatcagccctag

SEQ ID NO: 389747 - DNA, 25 bp, Rattus norvegicus
gcattttggtggtcatcagccctag

SEQ ID NO: 389748 - DNA, 25 bp, Rattus norvegicus
gcattttgtaaacctcacttgtcac

SEQ ID NO: 389749 - DNA, 25 bp, Rattus norvegicus
gcattttgtaaagctcacttgtcac

SEQ ID NO: 389750 - DNA, 25 bp, Rattus norvegicus
gcattttgtaccacagtgtttctaa

SEQ ID NO: 389751 - DNA, 25 bp, Rattus norvegicus
gcattttgtacctcagtgtttctaa

SEQ ID NO: 389752 - DNA, 25 bp, Rattus norvegicus
gcattttgtacgaaattctggctac

SEQ ID NO: 389753 - DNA, 25 bp, Rattus norvegicus
gcattttgtacgtaattctggctac

SEQ ID NO: 389754 - DNA, 25 bp, Rattus norvegicus
gcattttgtagcctaaagtctctag

SEQ ID NO: 389755 - DNA, 25 bp, Rattus norvegicus
gcattttgtagcgtaaagtctctag

SEQ ID NO: 389756 - DNA, 25 bp, Rattus norvegicus
gcattttgtcctatccacaaacttg

SEQ ID NO: 389757 - DNA, 25 bp, Rattus norvegicus
gcattttgtcctcatgggccataaa

SEQ ID NO: 389758 - DNA, 25 bp, Rattus norvegicus
gcattttgtcctgatgggccataaa

SEQ ID NO: 389759 - DNA, 25 bp, Rattus norvegicus
gcattttgtcctttccacaaacttg

SEQ ID NO: 389760 - DNA, 25 bp, Rattus norvegicus
gcatttttaagcacttgccttccat

SEQ ID NO: 389761 - DNA, 25 bp, Rattus norvegicus
gcatttttaagctcttgccttccat

SEQ ID NO: 389762 - DNA, 25 bp, Rattus norvegicus
gcatttttatgcatcttttctgtca

SEQ ID NO: 389763 - DNA, 25 bp, Rattus norvegicus
gcatttttatgcttcttttctgtca

SEQ ID NO: 389764 - DNA, 25 bp, Rattus norvegicus
gcatttttctagcactctgtgcacc

SEQ ID NO: 389765 - DNA, 25 bp, Rattus norvegicus
gcatttttctaggactctgtgcacc

SEQ ID NO: 389766 - DNA, 25 bp, Rattus norvegicus
gcatttttctttcaatattttctgt

SEQ ID NO: 389767 - DNA, 25 bp, Rattus norvegicus
gcatttttctttgaatattttctgt

SEQ ID NO: 389768 - DNA, 25 bp, Rattus norvegicus
gcatttttgtatcagagagctgatt

SEQ ID NO: 389769 - DNA, 25 bp, Rattus norvegicus
gcatttttgtatgagagagctgatt

SEQ ID NO: 389770 - DNA, 25 bp, Rattus norvegicus
gcatttttgtctcttcaacctgtag

SEQ ID NO: 389771 - DNA, 25 bp, Rattus norvegicus
gcatttttgtctgttcaacctgtag

SEQ ID NO: 389772 - DNA, 25 bp, Rattus norvegicus
gcattttttaatcttcttgagccag

SEQ ID NO: 389773 - DNA, 25 bp, Rattus norvegicus
gcattttttaatgttcttgagccag

SEQ ID NO: 389774 - DNA, 25 bp, Rattus norvegicus
gcattttttcctcctgtgttttgat

SEQ ID NO: 389775 - DNA, 25 bp, Rattus norvegicus
gcattttttcctgctgtgttttgat

SEQ ID NO: 389776 - DNA, 25 bp, Rattus norvegicus
gcattttttgctaatcacttgttta

SEQ ID NO: 389777 - DNA, 25 bp, Rattus norvegicus
gcattttttgcttatcacttgttta

SEQ ID NO: 389778 - DNA, 25 bp, Rattus norvegicus
gcattttttttcataaggagtctga

SEQ ID NO: 389779 - DNA, 25 bp, Rattus norvegicus
gcattttttttcttaaggagtctga

SEQ ID NO: 389780 - DNA, 25 bp, Rattus norvegicus
gccaaaaagcaccagtttctgacaa

SEQ ID NO: 389781 - DNA, 25 bp, Rattus norvegicus
gccaaaaagcacgagtttctgacaa

SEQ ID NO: 389782 - DNA, 25 bp, Rattus norvegicus
gccaaaaatacaaactgacttccta

SEQ ID NO: 389783 - DNA, 25 bp, Rattus norvegicus
gccaaaaatacatactgacttccta

SEQ ID NO: 389784 - DNA, 25 bp, Rattus norvegicus
gccaaaacccgaaatgttgatgcga

SEQ ID NO: 389785 - DNA, 25 bp, Rattus norvegicus
gccaaaacccgatatgttgatgcga

SEQ ID NO: 389786 - DNA, 25 bp, Rattus norvegicus
gccaaaacctggaagctgtgtgcaa

SEQ ID NO: 389787 - DNA, 25 bp, Rattus norvegicus
gccaaaacctggtagctgtgtgcaa

SEQ ID NO: 389788 - DNA, 25 bp, Rattus norvegicus
gccaaaactggcctataaccctaag

SEQ ID NO: 389789 - DNA, 25 bp, Rattus norvegicus
gccaaaactggcgtataaccctaag

SEQ ID NO: 389790 - DNA, 25 bp, Rattus norvegicus
gccaaaagtttgattcatcccaagc

SEQ ID NO: 389791 - DNA, 25 bp, Rattus norvegicus
gccaaaagtttgtttcatcccaagc

SEQ ID NO: 389792 - DNA, 25 bp, Rattus norvegicus
gccaaaatgaatatcctgtcagctt

SEQ ID NO: 389793 - DNA, 25 bp, Rattus norvegicus
gccaaaatgaatttcctgtcagctt

SEQ ID NO: 389794 - DNA, 25 bp, Rattus norvegicus
gccaaaatgggaagctcatgtggat

SEQ ID NO: 389795 - DNA, 25 bp, Rattus norvegicus
gccaaaatgggatgctcatgtggat

SEQ ID NO: 389796 - DNA, 25 bp, Rattus norvegicus
gccaaacaatatccgatgagctaga

SEQ ID NO: 389797 - DNA, 25 bp, Rattus norvegicus
gccaaacaatatgcgatgagctaga

SEQ ID NO: 389798 - DNA, 25 bp, Rattus norvegicus
gccaaacacctacgttaactcggtg

SEQ ID NO: 389799 - DNA, 25 bp, Rattus norvegicus
gccaaacacctaggttaactcggtg

SEQ ID NO: 389800 - DNA, 25 bp, Rattus norvegicus
gccaaacatgttactgtgtcgcaca

SEQ ID NO: 389801 - DNA, 25 bp, Rattus norvegicus
gccaaacatgtttctgtgtcgcaca

SEQ ID NO: 389802 - DNA, 25 bp, Rattus norvegicus
gccaaacccaaacaagcagttctga

SEQ ID NO: 389803 - DNA, 25 bp, Rattus norvegicus
gccaaacccaaagaagcagttctga

SEQ ID NO: 389804 - DNA, 25 bp, Rattus norvegicus
gccaaacccttaactgtggtctgga

SEQ ID NO: 389805 - DNA, 25 bp, Rattus norvegicus
gccaaacccttatctgtggtctgga

SEQ ID NO: 389806 - DNA, 25 bp, Rattus norvegicus
gccaaacctgaaagcatcgagtaaa

SEQ ID NO: 389807 - DNA, 25 bp, Rattus norvegicus
gccaaacctgaatgcatcgagtaaa

SEQ ID NO: 389808 - DNA, 25 bp, Rattus norvegicus
gccaaacctgatcactccagttcaa

SEQ ID NO: 389809 - DNA, 25 bp, Rattus norvegicus
gccaaacctgatgactccagttcaa

SEQ ID NO: 389810 - DNA, 25 bp, Rattus norvegicus
gccaaacctggtaactctgttcatt

SEQ ID NO: 389811 - DNA, 25 bp, Rattus norvegicus
gccaaacctggttactctgttcatt

SEQ ID NO: 389812 - DNA, 25 bp, Rattus norvegicus
gccaaaccttctctttatggacttt

SEQ ID NO: 389813 - DNA, 25 bp, Rattus norvegicus
gccaaaccttctgtttatggacttt

SEQ ID NO: 389814 - DNA, 25 bp, Rattus norvegicus
gccaaacgctttactgtgaaccaga

SEQ ID NO: 389815 - DNA, 25 bp, Rattus norvegicus
gccaaacgcttttctgtgaaccaga

SEQ ID NO: 389816 - DNA, 25 bp, Rattus norvegicus
gccaaacgggcacactactagatgt

SEQ ID NO: 389817 - DNA, 25 bp, Rattus norvegicus
gccaaacgggcagactactagatgt

SEQ ID NO: 389818 - DNA, 25 bp, Rattus norvegicus
gccaaacgttctagtgagtccattt

SEQ ID NO: 389819 - DNA, 25 bp, Rattus norvegicus
gccaaacgttcttgtgagtccattt

SEQ ID NO: 389820 - DNA, 25 bp, Rattus norvegicus
gccaaactattccacactggtgact

SEQ ID NO: 389821 - DNA, 25 bp, Rattus norvegicus
gccaaactattcgacactggtgact

SEQ ID NO: 389822 - DNA, 25 bp, Rattus norvegicus
gccaaactcctgacacgggattgta

SEQ ID NO: 389823 - DNA, 25 bp, Rattus norvegicus
gccaaactcctgtcacgggattgta

SEQ ID NO: 389824 - DNA, 25 bp, Rattus norvegicus
gccaaactgaatcatgccaggtggt

SEQ ID NO: 389825 - DNA, 25 bp, Rattus norvegicus
gccaaactgaatgatgccaggtggt

SEQ ID NO: 389826 - DNA, 25 bp, Rattus norvegicus
gccaaactgactcaggaggcagtct

SEQ ID NO: 389827 - DNA, 25 bp, Rattus norvegicus
gccaaactgactgaggaggcagtct

SEQ ID NO: 389828 - DNA, 25 bp, Rattus norvegicus
gccaaacttcaaactaagccggatt

SEQ ID NO: 389829 - DNA, 25 bp, Rattus norvegicus
gccaaacttcaatctaagccggatt

SEQ ID NO: 389830 - DNA, 25 bp, Rattus norvegicus
gccaaacttgcaactccagaatgta

SEQ ID NO: 389831 - DNA, 25 bp, Rattus norvegicus
gccaaacttgcatctccagaatgta

SEQ ID NO: 389832 - DNA, 25 bp, Rattus norvegicus
gccaaacttgtcactcaaaagcaca

SEQ ID NO: 389833 - DNA, 25 bp, Rattus norvegicus
gccaaacttgtctctcaaaagcaca

SEQ ID NO: 389834 - DNA, 25 bp, Rattus norvegicus
gccaaacttgtgattcttgtcagta

SEQ ID NO: 389835 - DNA, 25 bp, Rattus norvegicus
gccaaacttgtgtttcttgtcagta

SEQ ID NO: 389836 - DNA, 25 bp, Rattus norvegicus
gccaaagaaccaagaaccaaagcca

SEQ ID NO: 389837 - DNA, 25 bp, Rattus norvegicus
gccaaagaaccatgaaccaaagcca

SEQ ID NO: 389838 - DNA, 25 bp, Rattus norvegicus
gccaaagaatagatcccgcgacatt

SEQ ID NO: 389839 - DNA, 25 bp, Rattus norvegicus
gccaaagaatagttcccgcgacatt

SEQ ID NO: 389840 - DNA, 25 bp, Rattus norvegicus
gccaaagacagaagcattttcctct

SEQ ID NO: 389841 - DNA, 25 bp, Rattus norvegicus
gccaaagacagatgcattttcctct

SEQ ID NO: 389842 - DNA, 25 bp, Rattus norvegicus
gccaaagcaaccattgcagcagcag

SEQ ID NO: 389843 - DNA, 25 bp, Rattus norvegicus
gccaaagcaacctttgcagcagcag

SEQ ID NO: 389844 - DNA, 25 bp, Rattus norvegicus
gccaaagcaagtctgttctcgccgc

SEQ ID NO: 389845 - DNA, 25 bp, Rattus norvegicus
gccaaagcaagtgtgttctcgccgc

SEQ ID NO: 389846 - DNA, 25 bp, Rattus norvegicus
gccaaagcagggactttcttcagct

SEQ ID NO: 389847 - DNA, 25 bp, Rattus norvegicus
gccaaagcagggtctttcttcagct

SEQ ID NO: 389848 - DNA, 25 bp, Rattus norvegicus
gccaaagcatctatcaataagaagg

SEQ ID NO: 389849 - DNA, 25 bp, Rattus norvegicus
gccaaagcatctttcaataagaagg

SEQ ID NO: 389850 - DNA, 25 bp, Rattus norvegicus
gccaaagccaggaccctaggtggaa

SEQ ID NO: 389851 - DNA, 25 bp, Rattus norvegicus
gccaaagccaggtccctaggtggaa

SEQ ID NO: 389852 - DNA, 25 bp, Rattus norvegicus
gccaaagccattccctagcgttatc

SEQ ID NO: 389853 - DNA, 25 bp, Rattus norvegicus
gccaaagccattgcctagcgttatc

SEQ ID NO: 389854 - DNA, 25 bp, Rattus norvegicus
gccaaagccccaacaggtactatga

SEQ ID NO: 389855 - DNA, 25 bp, Rattus norvegicus
gccaaagccccatcaggtactatga

SEQ ID NO: 389856 - DNA, 25 bp, Rattus norvegicus
gccaaagcccttattcttcatgaaa

SEQ ID NO: 389857 - DNA, 25 bp, Rattus norvegicus
gccaaagccctttttcttcatgaaa

SEQ ID NO: 389858 - DNA, 25 bp, Rattus norvegicus
gccaaagccttgctactgtagctca

SEQ ID NO: 389859 - DNA, 25 bp, Rattus norvegicus
gccaaagccttggtactgtagctca

SEQ ID NO: 389860 - DNA, 25 bp, Rattus norvegicus
gccaaagcgctcatcctggaaacag

SEQ ID NO: 389861 - DNA, 25 bp, Rattus norvegicus
gccaaagcgctcttcctggaaacag

SEQ ID NO: 389862 - DNA, 25 bp, Rattus norvegicus
gccaaagctgagatgtgcccggtgt

SEQ ID NO: 389863 - DNA, 25 bp, Rattus norvegicus
gccaaagctgagttgtgcccggtgt

SEQ ID NO: 389864 - DNA, 25 bp, Rattus norvegicus
gccaaagctggcactgggtttccgt

SEQ ID NO: 389865 - DNA, 25 bp, Rattus norvegicus
gccaaagctggctctgggtttccgt

SEQ ID NO: 389866 - DNA, 25 bp, Rattus norvegicus
gccaaagctgtgaagtccacgacaa

SEQ ID NO: 389867 - DNA, 25 bp, Rattus norvegicus
gccaaagctgtgtagtccacgacaa

SEQ ID NO: 389868 - DNA, 25 bp, Rattus norvegicus
gccaaaggactaaatgttgtcacat

SEQ ID NO: 389869 - DNA, 25 bp, Rattus norvegicus
gccaaaggactatatgttgtcacat

SEQ ID NO: 389870 - DNA, 25 bp, Rattus norvegicus
gccaaaggctctaactactctgaag

SEQ ID NO: 389871 - DNA, 25 bp, Rattus norvegicus
gccaaaggctcttactactctgaag

SEQ ID NO: 389872 - DNA, 25 bp, Rattus norvegicus
gccaaagggcagaaccatcaaccaa

SEQ ID NO: 389873 - DNA, 25 bp, Rattus norvegicus
gccaaagggcagtaccatcaaccaa

SEQ ID NO: 389874 - DNA, 25 bp, Rattus norvegicus
gccaaagtacctaagacctctgtag

SEQ ID NO: 389875 - DNA, 25 bp, Rattus norvegicus
gccaaagtaccttagacctctgtag

SEQ ID NO: 389876 - DNA, 25 bp, Rattus norvegicus
gccaaagtagaaccccactgctgtg

SEQ ID NO: 389877 - DNA, 25 bp, Rattus norvegicus
gccaaagtagaagcccactgctgtg

SEQ ID NO: 389878 - DNA, 25 bp, Rattus norvegicus
gccaaagtagttctctgtgttttct

SEQ ID NO: 389879 - DNA, 25 bp, Rattus norvegicus
gccaaagtagttgtctgtgttttct

SEQ ID NO: 389880 - DNA, 25 bp, Rattus norvegicus
gccaaagtcatccttgtccttttac

SEQ ID NO: 389881 - DNA, 25 bp, Rattus norvegicus
gccaaagtcatcgttgtccttttac

SEQ ID NO: 389882 - DNA, 25 bp, Rattus norvegicus
gccaaagtgcgtatttcttgtttct

SEQ ID NO: 389883 - DNA, 25 bp, Rattus norvegicus
gccaaagtgcgtttttcttgtttct

SEQ ID NO: 389884 - DNA, 25 bp, Rattus norvegicus
gccaaagtgtcacggcttttacttt

SEQ ID NO: 389885 - DNA, 25 bp, Rattus norvegicus
gccaaagtgtcagggcttttacttt

SEQ ID NO: 389886 - DNA, 25 bp, Rattus norvegicus
gccaaagttctgatgcctgtcaaga

SEQ ID NO: 389887 - DNA, 25 bp, Rattus norvegicus
gccaaagttctgttgcctgtcaaga

SEQ ID NO: 389888 - DNA, 25 bp, Rattus norvegicus
gccaaataaacgctacctaaatcac

SEQ ID NO: 389889 - DNA, 25 bp, Rattus norvegicus
gccaaataaacggtacctaaatcac

SEQ ID NO: 389890 - DNA, 25 bp, Rattus norvegicus
gccaaatatactctctgtgtttcag

SEQ ID NO: 389891 - DNA, 25 bp, Rattus norvegicus
gccaaatatactgtctgtgtttcag

SEQ ID NO: 389892 - DNA, 25 bp, Rattus norvegicus
gccaaatcctgactgaaagtgtcct

SEQ ID NO: 389893 - DNA, 25 bp, Rattus norvegicus
gccaaatcctgagtgaaagtgtcct

SEQ ID NO: 389894 - DNA, 25 bp, Rattus norvegicus
gccaaatctatgacagggtgcccct

SEQ ID NO: 389895 - DNA, 25 bp, Rattus norvegicus
gccaaatctatgtcagggtgcccct

SEQ ID NO: 389896 - DNA, 25 bp, Rattus norvegicus
gccaaatgccttaatgaacttaatt

SEQ ID NO: 389897 - DNA, 25 bp, Rattus norvegicus
gccaaatgcctttatgaacttaatt

SEQ ID NO: 389898 - DNA, 25 bp, Rattus norvegicus
gccaaatgctccagtggcatgagaa

SEQ ID NO: 389899 - DNA, 25 bp, Rattus norvegicus
gccaaatgctcctgtggcatgagaa

SEQ ID NO: 389900 - DNA, 25 bp, Rattus norvegicus
gccaaatggccgaagtcagactgca

SEQ ID NO: 389901 - DNA, 25 bp, Rattus norvegicus
gccaaatggccgtagtcagactgca

SEQ ID NO: 389902 - DNA, 25 bp, Rattus norvegicus
gccaaatgtccgacgatgtcactaa

SEQ ID NO: 389903 - DNA, 25 bp, Rattus norvegicus
gccaaatgtccgtcgatgtcactaa

SEQ ID NO: 389904 - DNA, 25 bp, Rattus norvegicus
gccaaatgtcggctctagctgcaat

SEQ ID NO: 389905 - DNA, 25 bp, Rattus norvegicus
gccaaatgtcgggtctagctgcaat

SEQ ID NO: 389906 - DNA, 25 bp, Rattus norvegicus
gccaaatgtgttcttgacgttgttc

SEQ ID NO: 389907 - DNA, 25 bp, Rattus norvegicus
gccaaatgtgttgttgacgttgttc

SEQ ID NO: 389908 - DNA, 25 bp, Rattus norvegicus
gccaaattcagccttcagtactata

SEQ ID NO: 389909 - DNA, 25 bp, Rattus norvegicus
gccaaattcagcgttcagtactata

SEQ ID NO: 389910 - DNA, 25 bp, Rattus norvegicus
gccaaattctggcttgttcctggaa

SEQ ID NO: 389911 - DNA, 25 bp, Rattus norvegicus
gccaaattctgggttgttcctggaa

SEQ ID NO: 389912 - DNA, 25 bp, Rattus norvegicus
gccaaattgtaaccgtctgacttct

SEQ ID NO: 389913 - DNA, 25 bp, Rattus norvegicus
gccaaattgtaagcgtctgacttct

SEQ ID NO: 389914 - DNA, 25 bp, Rattus norvegicus
gccaaatttgtgaagcagctagacc

SEQ ID NO: 389915 - DNA, 25 bp, Rattus norvegicus
gccaaatttgtgtagcagctagacc

SEQ ID NO: 389916 - DNA, 25 bp, Rattus norvegicus
gccaaattttccacaaggcttgatt

SEQ ID NO: 389917 - DNA, 25 bp, Rattus norvegicus
gccaaattttcctcaaggcttgatt

SEQ ID NO: 389918 - DNA, 25 bp, Rattus norvegicus
gccaacaaccggctggacttcgcgg

SEQ ID NO: 389919 - DNA, 25 bp, Rattus norvegicus
gccaacaaccgggtggacttcgcgg

SEQ ID NO: 389920 - DNA, 25 bp, Rattus norvegicus
gccaacaactgtccagctttgagga

SEQ ID NO: 389921 - DNA, 25 bp, Rattus norvegicus
gccaacaactgtgcagctttgagga

SEQ ID NO: 389922 - DNA, 25 bp, Rattus norvegicus
gccaacaagcgcattgtctttcata

SEQ ID NO: 389923 - DNA, 25 bp, Rattus norvegicus
gccaacaagcgctttgtctttcata

SEQ ID NO: 389924 - DNA, 25 bp, Rattus norvegicus
gccaacacaaaaagaaacccaaggt

SEQ ID NO: 389925 - DNA, 25 bp, Rattus norvegicus
gccaacacaaaatgaaacccaaggt

SEQ ID NO: 389926 - DNA, 25 bp, Rattus norvegicus
gccaacacatcactcatgctgtagg

SEQ ID NO: 389927 - DNA, 25 bp, Rattus norvegicus
gccaacacatcagtcatgctgtagg

SEQ ID NO: 389928 - DNA, 25 bp, Rattus norvegicus
gccaacaccttgcttcttagaggag

SEQ ID NO: 389929 - DNA, 25 bp, Rattus norvegicus
gccaacaccttggttcttagaggag

SEQ ID NO: 389930 - DNA, 25 bp, Rattus norvegicus
gccaacacggtgaccaaggagctgt

SEQ ID NO: 389931 - DNA, 25 bp, Rattus norvegicus
gccaacacggtgtccaaggagctgt

SEQ ID NO: 389932 - DNA, 25 bp, Rattus norvegicus
gccaacagaagaagtaaatagctct

SEQ ID NO: 389933 - DNA, 25 bp, Rattus norvegicus
gccaacagaagatgtaaatagctct

SEQ ID NO: 389934 - DNA, 25 bp, Rattus norvegicus
gccaacagaggaaccagccagtgta

SEQ ID NO: 389935 - DNA, 25 bp, Rattus norvegicus
gccaacagaggatccagccagtgta

SEQ ID NO: 389936 - DNA, 25 bp, Rattus norvegicus
gccaacagagtgcttctaagagact

SEQ ID NO: 389937 - DNA, 25 bp, Rattus norvegicus
gccaacagagtggttctaagagact

SEQ ID NO: 389938 - DNA, 25 bp, Rattus norvegicus
gccaacagcagccaacagcagcgag

SEQ ID NO: 389939 - DNA, 25 bp, Rattus norvegicus
gccaacagcagcgaacagcagcgag

SEQ ID NO: 389940 - DNA, 25 bp, Rattus norvegicus
gccaacagcattcccaacctgagat

SEQ ID NO: 389941 - DNA, 25 bp, Rattus norvegicus
gccaacagcattgccaacctgagat

SEQ ID NO: 389942 - DNA, 25 bp, Rattus norvegicus
gccaacagccccagaagtgtctgaa

SEQ ID NO: 389943 - DNA, 25 bp, Rattus norvegicus
gccaacagcccctgaagtgtctgaa

SEQ ID NO: 389944 - DNA, 25 bp, Rattus norvegicus
gccaacaggtccattccaggtgatg

SEQ ID NO: 389945 - DNA, 25 bp, Rattus norvegicus
gccaacaggtcctttccaggtgatg

SEQ ID NO: 389946 - DNA, 25 bp, Rattus norvegicus
gccaacaggttaaggcagtagtttt

SEQ ID NO: 389947 - DNA, 25 bp, Rattus norvegicus
gccaacaggttatggcagtagtttt

SEQ ID NO: 389948 - DNA, 25 bp, Rattus norvegicus
gccaacagtggccttttaataaata

SEQ ID NO: 389949 - DNA, 25 bp, Rattus norvegicus
gccaacagtggcgttttaataaata

SEQ ID NO: 389950 - DNA, 25 bp, Rattus norvegicus
gccaacatgcgaaagctgcagagat

SEQ ID NO: 389951 - DNA, 25 bp, Rattus norvegicus
gccaacatgcgatagctgcagagat

SEQ ID NO: 389952 - DNA, 25 bp, Rattus norvegicus
gccaacatgtcgcagcaatctgtat

SEQ ID NO: 389953 - DNA, 25 bp, Rattus norvegicus
gccaacatgtcggagcaatctgtat

SEQ ID NO: 389954 - DNA, 25 bp, Rattus norvegicus
gccaacatgttcattagcagctagg

SEQ ID NO: 389955 - DNA, 25 bp, Rattus norvegicus
gccaacatgttctttagcagctagg

SEQ ID NO: 389956 - DNA, 25 bp, Rattus norvegicus
gccaaccagaggctttgtgcttcag

SEQ ID NO: 389957 - DNA, 25 bp, Rattus norvegicus
gccaaccagagggtttgtgcttcag

SEQ ID NO: 389958 - DNA, 25 bp, Rattus norvegicus
gccaaccagtccctttgtgtaaaat

SEQ ID NO: 389959 - DNA, 25 bp, Rattus norvegicus
gccaaccagtccgtttgtgtaaaat

SEQ ID NO: 389960 - DNA, 25 bp, Rattus norvegicus
gccaaccatgtcatcaggaaggatc

SEQ ID NO: 389961 - DNA, 25 bp, Rattus norvegicus
gccaaccatgtcttcaggaaggatc

SEQ ID NO: 389962 - DNA, 25 bp, Rattus norvegicus
gccaacccatagctctttgcaagag

SEQ ID NO: 389963 - DNA, 25 bp, Rattus norvegicus
gccaacccataggtctttgcaagag

SEQ ID NO: 389964 - DNA, 25 bp, Rattus norvegicus
gccaacccatgaactaatagctgaa

SEQ ID NO: 389965 - DNA, 25 bp, Rattus norvegicus
gccaacccatgatctaatagctgaa

SEQ ID NO: 389966 - DNA, 25 bp, Rattus norvegicus
gccaaccccagcattttatgcactt

SEQ ID NO: 389967 - DNA, 25 bp, Rattus norvegicus
gccaaccccagctttttatgcactt

SEQ ID NO: 389968 - DNA, 25 bp, Rattus norvegicus
gccaaccctgggaattacatacttc

SEQ ID NO: 389969 - DNA, 25 bp, Rattus norvegicus
gccaaccctgggtattacatacttc

SEQ ID NO: 389970 - DNA, 25 bp, Rattus norvegicus
gccaacctagaaaatccatctactt

SEQ ID NO: 389971 - DNA, 25 bp, Rattus norvegicus
gccaacctagaatatccatctactt

SEQ ID NO: 389972 - DNA, 25 bp, Rattus norvegicus
gccaacctagttatcatccgtgaac

SEQ ID NO: 389973 - DNA, 25 bp, Rattus norvegicus
gccaacctagttttcatccgtgaac

SEQ ID NO: 389974 - DNA, 25 bp, Rattus norvegicus
gccaacctctgacaaggtacccagt

SEQ ID NO: 389975 - DNA, 25 bp, Rattus norvegicus
gccaacctctgagaaggtacccagt

SEQ ID NO: 389976 - DNA, 25 bp, Rattus norvegicus
gccaacctgagcagtttcgcgggtg

SEQ ID NO: 389977 - DNA, 25 bp, Rattus norvegicus
gccaacctgagctgtttcgcgggtg

SEQ ID NO: 389978 - DNA, 25 bp, Rattus norvegicus
gccaacctgatgatgacctggattt

SEQ ID NO: 389979 - DNA, 25 bp, Rattus norvegicus
gccaacctgatgttgacctggattt

SEQ ID NO: 389980 - DNA, 25 bp, Rattus norvegicus
gccaacctgcagctgctggtttgga

SEQ ID NO: 389981 - DNA, 25 bp, Rattus norvegicus
gccaacctgcaggtgctggtttgga

SEQ ID NO: 389982 - DNA, 25 bp, Rattus norvegicus
gccaacctgccacatctgtacaaag

SEQ ID NO: 389983 - DNA, 25 bp, Rattus norvegicus
gccaacctgccagatctgtacaaag

SEQ ID NO: 389984 - DNA, 25 bp, Rattus norvegicus
gccaacctggatcagctcagctaca

SEQ ID NO: 389985 - DNA, 25 bp, Rattus norvegicus
gccaacctggatgagctcagctaca

SEQ ID NO: 389986 - DNA, 25 bp, Rattus norvegicus
gccaaccttcctataactctaagat

SEQ ID NO: 389987 - DNA, 25 bp, Rattus norvegicus
gccaaccttcctttaactctaagat

SEQ ID NO: 389988 - DNA, 25 bp, Rattus norvegicus
gccaaccttggcattcagtgagctt

SEQ ID NO: 389989 - DNA, 25 bp, Rattus norvegicus
gccaaccttggctttcagtgagctt

SEQ ID NO: 389990 - DNA, 25 bp, Rattus norvegicus
gccaacctttgtaatgagccacact

SEQ ID NO: 389991 - DNA, 25 bp, Rattus norvegicus
gccaacctttgttatgagccacact

SEQ ID NO: 389992 - DNA, 25 bp, Rattus norvegicus
gccaacgactagagcgggaagccaa

SEQ ID NO: 389993 - DNA, 25 bp, Rattus norvegicus
gccaacgactagtgcgggaagccaa

SEQ ID NO: 389994 - DNA, 25 bp, Rattus norvegicus
gccaacgcacagaattcctaagatg

SEQ ID NO: 389995 - DNA, 25 bp, Rattus norvegicus
gccaacgcacagtattcctaagatg

SEQ ID NO: 389996 - DNA, 25 bp, Rattus norvegicus
gccaacggactgaagactctttcta

SEQ ID NO: 389997 - DNA, 25 bp, Rattus norvegicus
gccaacggactgtagactctttcta

SEQ ID NO: 389998 - DNA, 25 bp, Rattus norvegicus
gccaacggcaagagggaagtgctca

SEQ ID NO: 389999 - DNA, 25 bp, Rattus norvegicus
gccaacggcaagtgggaagtgctca

SEQ ID NO: 390000 - DNA, 25 bp, Rattus norvegicus
gccaacggtggtctgatgtaaagct

SEQ ID NO: 390001 - DNA, 25 bp, Rattus norvegicus
gccaacggtggtgtgatgtaaagct

SEQ ID NO: 390002 - DNA, 25 bp, Rattus norvegicus
gccaacgtcagcagtcttttaatcg

SEQ ID NO: 390003 - DNA, 25 bp, Rattus norvegicus
gccaacgtcagctgtcttttaatcg

SEQ ID NO: 390004 - DNA, 25 bp, Rattus norvegicus
gccaactagctgagaatcctgactt

SEQ ID NO: 390005 - DNA, 25 bp, Rattus norvegicus
gccaactagctgtgaatcctgactt

SEQ ID NO: 390006 - DNA, 25 bp, Rattus norvegicus
gccaactcacttcggatacctgtac

SEQ ID NO: 390007 - DNA, 25 bp, Rattus norvegicus
gccaactcacttgggatacctgtac

SEQ ID NO: 390008 - DNA, 25 bp, Rattus norvegicus
gccaactcagttccattcattgaac

SEQ ID NO: 390009 - DNA, 25 bp, Rattus norvegicus
gccaactcagttgcattcattgaac

SEQ ID NO: 390010 - DNA, 25 bp, Rattus norvegicus
gccaactcccttagactttaccata

SEQ ID NO: 390011 - DNA, 25 bp, Rattus norvegicus
gccaactccctttgactttaccata

SEQ ID NO: 390012 - DNA, 25 bp, Rattus norvegicus
gccaactcgcccattaaaatgcaat

SEQ ID NO: 390013 - DNA, 25 bp, Rattus norvegicus
gccaactcgccctttaaaatgcaat

SEQ ID NO: 390014 - DNA, 25 bp, Rattus norvegicus
gccaactctggcagcaagaagggtt

SEQ ID NO: 390015 - DNA, 25 bp, Rattus norvegicus
gccaactctggctgcaagaagggtt

SEQ ID NO: 390016 - DNA, 25 bp, Rattus norvegicus
gccaactgagaactctggacaccag

SEQ ID NO: 390017 - DNA, 25 bp, Rattus norvegicus
gccaactgagaagtctggacaccag

SEQ ID NO: 390018 - DNA, 25 bp, Rattus norvegicus
gccaactgcagtctcatttatttca

SEQ ID NO: 390019 - DNA, 25 bp, Rattus norvegicus
gccaactgcagtgtcatttatttca

SEQ ID NO: 390020 - DNA, 25 bp, Rattus norvegicus
gccaactggttgacacttcttagta

SEQ ID NO: 390021 - DNA, 25 bp, Rattus norvegicus
gccaactggttgtcacttcttagta

SEQ ID NO: 390022 - DNA, 25 bp, Rattus norvegicus
gccaacttcggcatcaccgggtaca

SEQ ID NO: 390023 - DNA, 25 bp, Rattus norvegicus
gccaacttcggcttcaccgggtaca

SEQ ID NO: 390024 - DNA, 25 bp, Rattus norvegicus
gccaacttggctactactcataaaa

SEQ ID NO: 390025 - DNA, 25 bp, Rattus norvegicus
gccaacttggcttctactcataaaa

SEQ ID NO: 390026 - DNA, 25 bp, Rattus norvegicus
gccaacttgtttagaagtgccacat

SEQ ID NO: 390027 - DNA, 25 bp, Rattus norvegicus
gccaacttgttttgaagtgccacat

SEQ ID NO: 390028 - DNA, 25 bp, Rattus norvegicus
gccaactttgttctcatttgtatag

SEQ ID NO: 390029 - DNA, 25 bp, Rattus norvegicus
gccaactttgttgtcatttgtatag

SEQ ID NO: 390030 - DNA, 25 bp, Rattus norvegicus
gccaacttttaaacacaacccaggt

SEQ ID NO: 390031 - DNA, 25 bp, Rattus norvegicus
gccaacttttaatcacaacccaggt

SEQ ID NO: 390032 - DNA, 25 bp, Rattus norvegicus
gccaagaaactcaatctgctcaaga

SEQ ID NO: 390033 - DNA, 25 bp, Rattus norvegicus
gccaagaaactctatctgctcaaga

SEQ ID NO: 390034 - DNA, 25 bp, Rattus norvegicus
gccaagaacattaacctgcggctct

SEQ ID NO: 390035 - DNA, 25 bp, Rattus norvegicus
gccaagaacatttacctgcggctct

SEQ ID NO: 390036 - DNA, 25 bp, Rattus norvegicus
gccaagaaccgtctctttatattgc

SEQ ID NO: 390037 - DNA, 25 bp, Rattus norvegicus
gccaagaaccgtgtctttatattgc

SEQ ID NO: 390038 - DNA, 25 bp, Rattus norvegicus
gccaagaacggtatcatagcctagc

SEQ ID NO: 390039 - DNA, 25 bp, Rattus norvegicus
gccaagaacggtttcatagcctagc

SEQ ID NO: 390040 - DNA, 25 bp, Rattus norvegicus
gccaagaactcacatgtgctccaat

SEQ ID NO: 390041 - DNA, 25 bp, Rattus norvegicus
gccaagaactcagatgtgctccaat

SEQ ID NO: 390042 - DNA, 25 bp, Rattus norvegicus
gccaagaagctgctggagtccctgc

SEQ ID NO: 390043 - DNA, 25 bp, Rattus norvegicus
gccaagaagctggtggagtccctgc

SEQ ID NO: 390044 - DNA, 25 bp, Rattus norvegicus
gccaagaagcttattctcccaggaa

SEQ ID NO: 390045 - DNA, 25 bp, Rattus norvegicus
gccaagaagctttttctcccaggaa

SEQ ID NO: 390046 - DNA, 25 bp, Rattus norvegicus
gccaagaagtgtatcctgacaggaa

SEQ ID NO: 390047 - DNA, 25 bp, Rattus norvegicus
gccaagaagtgtttcctgacaggaa

SEQ ID NO: 390048 - DNA, 25 bp, Rattus norvegicus
gccaagacagcaagcggacctacaa

SEQ ID NO: 390049 - DNA, 25 bp, Rattus norvegicus
gccaagacagcatgcggacctacaa

SEQ ID NO: 390050 - DNA, 25 bp, Rattus norvegicus
gccaagaccatccaggtctggccga

SEQ ID NO: 390051 - DNA, 25 bp, Rattus norvegicus
gccaagaccatcgaggtctggccga

SEQ ID NO: 390052 - DNA, 25 bp, Rattus norvegicus
gccaagaccgcgagtctaattctca

SEQ ID NO: 390053 - DNA, 25 bp, Rattus norvegicus
gccaagaccgcgtgtctaattctca

SEQ ID NO: 390054 - DNA, 25 bp, Rattus norvegicus
gccaagacggttatattatctacta

SEQ ID NO: 390055 - DNA, 25 bp, Rattus norvegicus
gccaagacggttttattatctacta

SEQ ID NO: 390056 - DNA, 25 bp, Rattus norvegicus
gccaagactatgagctttaaagcca

SEQ ID NO: 390057 - DNA, 25 bp, Rattus norvegicus
gccaagactatgtgctttaaagcca

SEQ ID NO: 390058 - DNA, 25 bp, Rattus norvegicus
gccaagagcagacaagccacggtct

SEQ ID NO: 390059 - DNA, 25 bp, Rattus norvegicus
gccaagagcagagaagccacggtct

SEQ ID NO: 390060 - DNA, 25 bp, Rattus norvegicus
gccaagagcctgaaattcatccatc

SEQ ID NO: 390061 - DNA, 25 bp, Rattus norvegicus
gccaagagcctgtaattcatccatc

SEQ ID NO: 390062 - DNA, 25 bp, Rattus norvegicus
gccaagagctacatattgtgattac

SEQ ID NO: 390063 - DNA, 25 bp, Rattus norvegicus
gccaagagctacttattgtgattac

SEQ ID NO: 390064 - DNA, 25 bp, Rattus norvegicus
gccaagaggactagagctgtgaaga

SEQ ID NO: 390065 - DNA, 25 bp, Rattus norvegicus
gccaagaggactatggatctctcct

SEQ ID NO: 390066 - DNA, 25 bp, Rattus norvegicus
gccaagaggacttgagctgtgaaga

SEQ ID NO: 390067 - DNA, 25 bp, Rattus norvegicus
gccaagaggactttggatctctcct

SEQ ID NO: 390068 - DNA, 25 bp, Rattus norvegicus
gccaagatccacctcaagcaaaagg

SEQ ID NO: 390069 - DNA, 25 bp, Rattus norvegicus
gccaagatccacgtcaagcaaaagg

SEQ ID NO: 390070 - DNA, 25 bp, Rattus norvegicus
gccaagatgggcctactctgttaca

SEQ ID NO: 390071 - DNA, 25 bp, Rattus norvegicus
gccaagatgggcgtactctgttaca

SEQ ID NO: 390072 - DNA, 25 bp, Rattus norvegicus
gccaagattctcaaggacccaactt

SEQ ID NO: 390073 - DNA, 25 bp, Rattus norvegicus
gccaagattctctaggacccaactt

SEQ ID NO: 390074 - DNA, 25 bp, Rattus norvegicus
gccaagatttaacaacagctcctta

SEQ ID NO: 390075 - DNA, 25 bp, Rattus norvegicus
gccaagatttaagaacagctcctta

SEQ ID NO: 390076 - DNA, 25 bp, Rattus norvegicus
gccaagcaaggcagtgagttattaa

SEQ ID NO: 390077 - DNA, 25 bp, Rattus norvegicus
gccaagcaaggctgtgagttattaa

SEQ ID NO: 390078 - DNA, 25 bp, Rattus norvegicus
gccaagcaccttcgagaaacttcta

SEQ ID NO: 390079 - DNA, 25 bp, Rattus norvegicus
gccaagcaccttggagaaacttcta

SEQ ID NO: 390080 - DNA, 25 bp, Rattus norvegicus
gccaagcaggccatcaagagacatt

SEQ ID NO: 390081 - DNA, 25 bp, Rattus norvegicus
gccaagcaggccttcaagagacatt

SEQ ID NO: 390082 - DNA, 25 bp, Rattus norvegicus
gccaagcatagaaacacaaagacca

SEQ ID NO: 390083 - DNA, 25 bp, Rattus norvegicus
gccaagcatagatacacaaagacca

SEQ ID NO: 390084 - DNA, 25 bp, Rattus norvegicus
gccaagcattgcactggtaactcat

SEQ ID NO: 390085 - DNA, 25 bp, Rattus norvegicus
gccaagcattgctctggtaactcat

SEQ ID NO: 390086 - DNA, 25 bp, Rattus norvegicus
gccaagcatttactacttcagtgtt

SEQ ID NO: 390087 - DNA, 25 bp, Rattus norvegicus
gccaagcatttagtacttcagtgtt

SEQ ID NO: 390088 - DNA, 25 bp, Rattus norvegicus
gccaagccagtgactttgcaagtgt

SEQ ID NO: 390089 - DNA, 25 bp, Rattus norvegicus
gccaagccagtgagcctgcagggaa

SEQ ID NO: 390090 - DNA, 25 bp, Rattus norvegicus
gccaagccagtgtctttgcaagtgt

SEQ ID NO: 390091 - DNA, 25 bp, Rattus norvegicus
gccaagccagtgtgcctgcagggaa

SEQ ID NO: 390092 - DNA, 25 bp, Rattus norvegicus
gccaagccatacaacatctttcagt

SEQ ID NO: 390093 - DNA, 25 bp, Rattus norvegicus
gccaagccatactacatctttcagt

SEQ ID NO: 390094 - DNA, 25 bp, Rattus norvegicus
gccaagccattgcacacgtaaacat

SEQ ID NO: 390095 - DNA, 25 bp, Rattus norvegicus
gccaagccattggacacgtaaacat

SEQ ID NO: 390096 - DNA, 25 bp, Rattus norvegicus
gccaagcccggaccagatcataatg

SEQ ID NO: 390097 - DNA, 25 bp, Rattus norvegicus
gccaagcccggagcagatcataatg

SEQ ID NO: 390098 - DNA, 25 bp, Rattus norvegicus
gccaagccctgaagactaagtacta

SEQ ID NO: 390099 - DNA, 25 bp, Rattus norvegicus
gccaagccctgatgactaagtacta

SEQ ID NO: 390100 - DNA, 25 bp, Rattus norvegicus
gccaagcccttcaaagtcatctgta

SEQ ID NO: 390101 - DNA, 25 bp, Rattus norvegicus
gccaagcccttctaagtcatctgta

SEQ ID NO: 390102 - DNA, 25 bp, Rattus norvegicus
gccaagccgatgctgcaaatagcta

SEQ ID NO: 390103 - DNA, 25 bp, Rattus norvegicus
gccaagccgatggtgcaaatagcta

SEQ ID NO: 390104 - DNA, 25 bp, Rattus norvegicus
gccaagcctcccaatagcaagatgg

SEQ ID NO: 390105 - DNA, 25 bp, Rattus norvegicus
gccaagcctccctatagcaagatgg

SEQ ID NO: 390106 - DNA, 25 bp, Rattus norvegicus
gccaagcctgaacatctgatcacca

SEQ ID NO: 390107 - DNA, 25 bp, Rattus norvegicus
gccaagcctgaagatctgatcacca

SEQ ID NO: 390108 - DNA, 25 bp, Rattus norvegicus
gccaagccttggcacctgaattcta

SEQ ID NO: 390109 - DNA, 25 bp, Rattus norvegicus
gccaagccttgggacctgaattcta

SEQ ID NO: 390110 - DNA, 25 bp, Rattus norvegicus
gccaagcgagacagaggactccgat

SEQ ID NO: 390111 - DNA, 25 bp, Rattus norvegicus
gccaagcgagactgaggactccgat

SEQ ID NO: 390112 - DNA, 25 bp, Rattus norvegicus
gccaagcgctacagttacttaaaac

SEQ ID NO: 390113 - DNA, 25 bp, Rattus norvegicus
gccaagcgctactgttacttaaaac

SEQ ID NO: 390114 - DNA, 25 bp, Rattus norvegicus
gccaagcgggctacccttattagga

SEQ ID NO: 390115 - DNA, 25 bp, Rattus norvegicus
gccaagcgggcttcccttattagga

SEQ ID NO: 390116 - DNA, 25 bp, Rattus norvegicus
gccaagcgtaaacgagtgcactgca

SEQ ID NO: 390117 - DNA, 25 bp, Rattus norvegicus
gccaagcgtaaaggagtgcactgca

SEQ ID NO: 390118 - DNA, 25 bp, Rattus norvegicus
gccaagctcctgatcatacgattga

SEQ ID NO: 390119 - DNA, 25 bp, Rattus norvegicus
gccaagctcctgttcatacgattga

SEQ ID NO: 390120 - DNA, 25 bp, Rattus norvegicus
gccaagctcttgctcaggacatggt

SEQ ID NO: 390121 - DNA, 25 bp, Rattus norvegicus
gccaagctcttggtcaggacatggt

SEQ ID NO: 390122 - DNA, 25 bp, Rattus norvegicus
gccaagctggctcagtgtcaagacc

SEQ ID NO: 390123 - DNA, 25 bp, Rattus norvegicus
gccaagctggctgagtgtcaagacc

SEQ ID NO: 390124 - DNA, 25 bp, Rattus norvegicus
gccaaggaaagtagcagctccgggt

SEQ ID NO: 390125 - DNA, 25 bp, Rattus norvegicus
gccaaggaaagttgcagctccgggt

SEQ ID NO: 390126 - DNA, 25 bp, Rattus norvegicus
gccaaggaagcaaaacctcccagga

SEQ ID NO: 390127 - DNA, 25 bp, Rattus norvegicus
gccaaggaagcataacctcccagga

SEQ ID NO: 390128 - DNA, 25 bp, Rattus norvegicus
gccaaggaagttaccaggacagccg

SEQ ID NO: 390129 - DNA, 25 bp, Rattus norvegicus
gccaaggaagtttccaggacagccg

SEQ ID NO: 390130 - DNA, 25 bp, Rattus norvegicus
gccaaggaccaaagtgatgatgacc

SEQ ID NO: 390131 - DNA, 25 bp, Rattus norvegicus
gccaaggaccaatgtgatgatgacc

SEQ ID NO: 390132 - DNA, 25 bp, Rattus norvegicus
gccaaggactgtacacccattgagt

SEQ ID NO: 390133 - DNA, 25 bp, Rattus norvegicus
gccaaggactgttcacccattgagt

SEQ ID NO: 390134 - DNA, 25 bp, Rattus norvegicus
gccaaggagcgacaccaggatgatc

SEQ ID NO: 390135 - DNA, 25 bp, Rattus norvegicus
gccaaggagcgagaccaggatgatc

SEQ ID NO: 390136 - DNA, 25 bp, Rattus norvegicus
gccaaggaggaacgagcttgattcc

SEQ ID NO: 390137 - DNA, 25 bp, Rattus norvegicus
gccaaggaggaaggagcttgattcc

SEQ ID NO: 390138 - DNA, 25 bp, Rattus norvegicus
gccaaggatccaagacaagcagctc

SEQ ID NO: 390139 - DNA, 25 bp, Rattus norvegicus
gccaaggatccatgacaagcagctc

SEQ ID NO: 390140 - DNA, 25 bp, Rattus norvegicus
gccaaggattatagtttgctttaac

SEQ ID NO: 390141 - DNA, 25 bp, Rattus norvegicus
gccaaggattattgtttgctttaac

SEQ ID NO: 390142 - DNA, 25 bp, Rattus norvegicus
gccaaggcaaccatactatgtgcat

SEQ ID NO: 390143 - DNA, 25 bp, Rattus norvegicus
gccaaggcaaccttactatgtgcat

SEQ ID NO: 390144 - DNA, 25 bp, Rattus norvegicus
gccaaggcacgtagcatgactgcaa

SEQ ID NO: 390145 - DNA, 25 bp, Rattus norvegicus
gccaaggcacgttgcatgactgcaa

SEQ ID NO: 390146 - DNA, 25 bp, Rattus norvegicus
gccaaggcccagcagtactggcagc

SEQ ID NO: 390147 - DNA, 25 bp, Rattus norvegicus
gccaaggcccaggagtactggcagc

SEQ ID NO: 390148 - DNA, 25 bp, Rattus norvegicus
gccaaggccgatcacctgaatttga

SEQ ID NO: 390149 - DNA, 25 bp, Rattus norvegicus
gccaaggccgatgacctgaatttga

SEQ ID NO: 390150 - DNA, 25 bp, Rattus norvegicus
gccaaggcctacattgacgttaaag

SEQ ID NO: 390151 - DNA, 25 bp, Rattus norvegicus
gccaaggcctactttgacgttaaag

SEQ ID NO: 390152 - DNA, 25 bp, Rattus norvegicus
gccaaggcgccaacatcaatgagat

SEQ ID NO: 390153 - DNA, 25 bp, Rattus norvegicus
gccaaggcgccatcatcaatgagat

SEQ ID NO: 390154 - DNA, 25 bp, Rattus norvegicus
gccaaggctaacattcaactcacag

SEQ ID NO: 390155 - DNA, 25 bp, Rattus norvegicus
gccaaggctaactttcaactcacag

SEQ ID NO: 390156 - DNA, 25 bp, Rattus norvegicus
gccaaggctgtcatagtgactgcta

SEQ ID NO: 390157 - DNA, 25 bp, Rattus norvegicus
gccaaggctgtcttagtgactgcta

SEQ ID NO: 390158 - DNA, 25 bp, Rattus norvegicus
gccaaggcttacattcagaatgcac

SEQ ID NO: 390159 - DNA, 25 bp, Rattus norvegicus
gccaaggcttactttcagaatgcac

SEQ ID NO: 390160 - DNA, 25 bp, Rattus norvegicus
gccaaggcttcaaacacttactgga

SEQ ID NO: 390161 - DNA, 25 bp, Rattus norvegicus
gccaaggcttcatacacttactgga

SEQ ID NO: 390162 - DNA, 25 bp, Rattus norvegicus
gccaaggcttgcacacttgagtttt

SEQ ID NO: 390163 - DNA, 25 bp, Rattus norvegicus
gccaaggcttgctcacttgagtttt

SEQ ID NO: 390164 - DNA, 25 bp, Rattus norvegicus
gccaagggaagccacgcagatacag

SEQ ID NO: 390165 - DNA, 25 bp, Rattus norvegicus
gccaagggaagcgacgcagatacag

SEQ ID NO: 390166 - DNA, 25 bp, Rattus norvegicus
gccaagggcaaacctacctggtcca

SEQ ID NO: 390167 - DNA, 25 bp, Rattus norvegicus
gccaagggcaaagctacctggtcca

SEQ ID NO: 390168 - DNA, 25 bp, Rattus norvegicus
gccaagggcatgcttctgatttcct

SEQ ID NO: 390169 - DNA, 25 bp, Rattus norvegicus
gccaagggcatggttctgatttcct

SEQ ID NO: 390170 - DNA, 25 bp, Rattus norvegicus
gccaagggtagcagttgtacctgaa

SEQ ID NO: 390171 - DNA, 25 bp, Rattus norvegicus
gccaagggtagctgttgtacctgaa

SEQ ID NO: 390172 - DNA, 25 bp, Rattus norvegicus
gccaagggtcccagatagcagatga

SEQ ID NO: 390173 - DNA, 25 bp, Rattus norvegicus
gccaagggtccctgatagcagatga

SEQ ID NO: 390174 - DNA, 25 bp, Rattus norvegicus
gccaagggtcctcagcacaatttga

SEQ ID NO: 390175 - DNA, 25 bp, Rattus norvegicus
gccaagggtcctgagcacaatttga

SEQ ID NO: 390176 - DNA, 25 bp, Rattus norvegicus
gccaaggtagatcaggtcctgcaca

SEQ ID NO: 390177 - DNA, 25 bp, Rattus norvegicus
gccaaggtagatgaggtcctgcaca

SEQ ID NO: 390178 - DNA, 25 bp, Rattus norvegicus
gccaaggtcttccatgttcagtgct

SEQ ID NO: 390179 - DNA, 25 bp, Rattus norvegicus
gccaaggtcttcgatgttcagtgct

SEQ ID NO: 390180 - DNA, 25 bp, Rattus norvegicus
gccaaggtcttgagttctaggataa

SEQ ID NO: 390181 - DNA, 25 bp, Rattus norvegicus
gccaaggtcttgtgttctaggataa

SEQ ID NO: 390182 - DNA, 25 bp, Rattus norvegicus
gccaaggtgattaacttgggccgga

SEQ ID NO: 390183 - DNA, 25 bp, Rattus norvegicus
gccaaggtgatttacttgggccgga

SEQ ID NO: 390184 - DNA, 25 bp, Rattus norvegicus
gccaaggttcttattctaattctag

SEQ ID NO: 390185 - DNA, 25 bp, Rattus norvegicus
gccaaggttctttttctaattctag

SEQ ID NO: 390186 - DNA, 25 bp, Rattus norvegicus
gccaagtacctgatttttctttgca

SEQ ID NO: 390187 - DNA, 25 bp, Rattus norvegicus
gccaagtacctgttttttctttgca

SEQ ID NO: 390188 - DNA, 25 bp, Rattus norvegicus
gccaagtactttagtctacctgagg

SEQ ID NO: 390189 - DNA, 25 bp, Rattus norvegicus
gccaagtacttttgtctacctgagg

SEQ ID NO: 390190 - DNA, 25 bp, Rattus norvegicus
gccaagtagagcctcagcctgactc

SEQ ID NO: 390191 - DNA, 25 bp, Rattus norvegicus
gccaagtagagcgtcagcctgactc

SEQ ID NO: 390192 - DNA, 25 bp, Rattus norvegicus
gccaagtagcatacttagccttcat

SEQ ID NO: 390193 - DNA, 25 bp, Rattus norvegicus
gccaagtagcattcttagccttcat

SEQ ID NO: 390194 - DNA, 25 bp, Rattus norvegicus
gccaagtatcacatgcagcgttgca

SEQ ID NO: 390195 - DNA, 25 bp, Rattus norvegicus
gccaagtatcacttgcagcgttgca

SEQ ID NO: 390196 - DNA, 25 bp, Rattus norvegicus
gccaagtcagccattatgttccagg

SEQ ID NO: 390197 - DNA, 25 bp, Rattus norvegicus
gccaagtcagcctttatgttccagg

SEQ ID NO: 390198 - DNA, 25 bp, Rattus norvegicus
gccaagtccatgatgtgtgctcaga

SEQ ID NO: 390199 - DNA, 25 bp, Rattus norvegicus
gccaagtccatgttgtgtgctcaga

SEQ ID NO: 390200 - DNA, 25 bp, Rattus norvegicus
gccaagtccttgagtgtatctgttc

SEQ ID NO: 390201 - DNA, 25 bp, Rattus norvegicus
gccaagtccttgtgtgtatctgttc

SEQ ID NO: 390202 - DNA, 25 bp, Rattus norvegicus
gccaagtctgcccagcacagcaaat

SEQ ID NO: 390203 - DNA, 25 bp, Rattus norvegicus
gccaagtctgccgagcacagcaaat

SEQ ID NO: 390204 - DNA, 25 bp, Rattus norvegicus
gccaagtcttccattagaggtctga

SEQ ID NO: 390205 - DNA, 25 bp, Rattus norvegicus
gccaagtcttcctttagaggtctga

SEQ ID NO: 390206 - DNA, 25 bp, Rattus norvegicus
gccaagtcttgtatagcccaggaga

SEQ ID NO: 390207 - DNA, 25 bp, Rattus norvegicus
gccaagtcttgtttagcccaggaga

SEQ ID NO: 390208 - DNA, 25 bp, Rattus norvegicus
gccaagtgattgctttgctcagctg

SEQ ID NO: 390209 - DNA, 25 bp, Rattus norvegicus
gccaagtgattggtttgctcagctg

SEQ ID NO: 390210 - DNA, 25 bp, Rattus norvegicus
gccaagtgcaacagcgccgtctaga

SEQ ID NO: 390211 - DNA, 25 bp, Rattus norvegicus
gccaagtgcaactgcgccgtctaga

SEQ ID NO: 390212 - DNA, 25 bp, Rattus norvegicus
gccaagtggtatatgtcttctccaa

SEQ ID NO: 390213 - DNA, 25 bp, Rattus norvegicus
gccaagtggtatttgtcttctccaa

SEQ ID NO: 390214 - DNA, 25 bp, Rattus norvegicus
gccaagtgtcctcatatatgccttt

SEQ ID NO: 390215 - DNA, 25 bp, Rattus norvegicus
gccaagtgtcctgatatatgccttt

SEQ ID NO: 390216 - DNA, 25 bp, Rattus norvegicus
gccaagtgtgcacaggaattgtcct

SEQ ID NO: 390217 - DNA, 25 bp, Rattus norvegicus
gccaagtgtgcagaggaattgtcct

SEQ ID NO: 390218 - DNA, 25 bp, Rattus norvegicus
gccaagttataaagctcttaactat

SEQ ID NO: 390219 - DNA, 25 bp, Rattus norvegicus
gccaagttataatgctcttaactat

SEQ ID NO: 390220 - DNA, 25 bp, Rattus norvegicus
gccaagttcaccaaactaggccttt

SEQ ID NO: 390221 - DNA, 25 bp, Rattus norvegicus
gccaagttcacctaactaggccttt

SEQ ID NO: 390222 - DNA, 25 bp, Rattus norvegicus
gccaagttctagcaacggagtccat

SEQ ID NO: 390223 - DNA, 25 bp, Rattus norvegicus
gccaagttctaggaacggagtccat

SEQ ID NO: 390224 - DNA, 25 bp, Rattus norvegicus
gccaagttctttccctgcatcaaga

SEQ ID NO: 390225 - DNA, 25 bp, Rattus norvegicus
gccaagttctttgcctgcatcaaga

SEQ ID NO: 390226 - DNA, 25 bp, Rattus norvegicus
gccaagttggctccagttctgtgac

SEQ ID NO: 390227 - DNA, 25 bp, Rattus norvegicus
gccaagttggctgcagttctgtgac

SEQ ID NO: 390228 - DNA, 25 bp, Rattus norvegicus
gccaagttgtagctgagacccgcaa

SEQ ID NO: 390229 - DNA, 25 bp, Rattus norvegicus
gccaagttgtaggtgagacccgcaa

SEQ ID NO: 390230 - DNA, 25 bp, Rattus norvegicus
gccaagtttcccagatgttcagcat

SEQ ID NO: 390231 - DNA, 25 bp, Rattus norvegicus
gccaagtttccctgatgttcagcat

SEQ ID NO: 390232 - DNA, 25 bp, Rattus norvegicus
gccaataaggacagttcgtatctac

SEQ ID NO: 390233 - DNA, 25 bp, Rattus norvegicus
gccaataaggactgttcgtatctac

SEQ ID NO: 390234 - DNA, 25 bp, Rattus norvegicus
gccaatacgttgcatctgtacggaa

SEQ ID NO: 390235 - DNA, 25 bp, Rattus norvegicus
gccaatacgttggatctgtacggaa

SEQ ID NO: 390236 - DNA, 25 bp, Rattus norvegicus
gccaatagactaattgcccttctga

SEQ ID NO: 390237 - DNA, 25 bp, Rattus norvegicus
gccaatagactatttgcccttctga

SEQ ID NO: 390238 - DNA, 25 bp, Rattus norvegicus
gccaatagatgcctagtacgctgac

SEQ ID NO: 390239 - DNA, 25 bp, Rattus norvegicus
gccaatagatgcgtagtacgctgac

SEQ ID NO: 390240 - DNA, 25 bp, Rattus norvegicus
gccaataggactccacccttaggag

SEQ ID NO: 390241 - DNA, 25 bp, Rattus norvegicus
gccaataggactgcacccttaggag

SEQ ID NO: 390242 - DNA, 25 bp, Rattus norvegicus
gccaatatgcacagtacattccacg

SEQ ID NO: 390243 - DNA, 25 bp, Rattus norvegicus
gccaatatgcactgtacattccacg

SEQ ID NO: 390244 - DNA, 25 bp, Rattus norvegicus
gccaatatgttgagaacttccggat

SEQ ID NO: 390245 - DNA, 25 bp, Rattus norvegicus
gccaatatgttgtgaacttccggat

SEQ ID NO: 390246 - DNA, 25 bp, Rattus norvegicus
gccaatcatgtgcaagccagttttt

SEQ ID NO: 390247 - DNA, 25 bp, Rattus norvegicus
gccaatcatgtggaagccagttttt

SEQ ID NO: 390248 - DNA, 25 bp, Rattus norvegicus
gccaatcattctaagctgatgtaaa

SEQ ID NO: 390249 - DNA, 25 bp, Rattus norvegicus
gccaatcattcttagctgatgtaaa

SEQ ID NO: 390250 - DNA, 25 bp, Rattus norvegicus
gccaatccaaccacgtagagatgat

SEQ ID NO: 390251 - DNA, 25 bp, Rattus norvegicus
gccaatccaacctcgtagagatgat

SEQ ID NO: 390252 - DNA, 25 bp, Rattus norvegicus
gccaatccattcaccttcaaagagt

SEQ ID NO: 390253 - DNA, 25 bp, Rattus norvegicus
gccaatccattctccttcaaagagt

SEQ ID NO: 390254 - DNA, 25 bp, Rattus norvegicus
gccaatccatttaatgccacatgca

SEQ ID NO: 390255 - DNA, 25 bp, Rattus norvegicus
gccaatccattttatgccacatgca

SEQ ID NO: 390256 - DNA, 25 bp, Rattus norvegicus
gccaatcctcttaagtattcctgtc

SEQ ID NO: 390257 - DNA, 25 bp, Rattus norvegicus
gccaatcctctttagtattcctgtc

SEQ ID NO: 390258 - DNA, 25 bp, Rattus norvegicus
gccaatcctgtaatttcttactaaa

SEQ ID NO: 390259 - DNA, 25 bp, Rattus norvegicus
gccaatcctgtattttcttactaaa

SEQ ID NO: 390260 - DNA, 25 bp, Rattus norvegicus
gccaatcgattcatgtgagacggtc

SEQ ID NO: 390261 - DNA, 25 bp, Rattus norvegicus
gccaatcgattcttgtgagacggtc

SEQ ID NO: 390262 - DNA, 25 bp, Rattus norvegicus
gccaatcggcaaaaacactatcact

SEQ ID NO: 390263 - DNA, 25 bp, Rattus norvegicus
gccaatcggcaataacactatcact

SEQ ID NO: 390264 - DNA, 25 bp, Rattus norvegicus
gccaatctaacaccccttcagaagt

SEQ ID NO: 390265 - DNA, 25 bp, Rattus norvegicus
gccaatctaacagcccttcagaagt

SEQ ID NO: 390266 - DNA, 25 bp, Rattus norvegicus
gccaatctgccaatcatggtgttat

SEQ ID NO: 390267 - DNA, 25 bp, Rattus norvegicus
gccaatctgccattcatggtgttat

SEQ ID NO: 390268 - DNA, 25 bp, Rattus norvegicus
gccaatcttcatatctttattctaa

SEQ ID NO: 390269 - DNA, 25 bp, Rattus norvegicus
gccaatcttcatttctttattctaa

SEQ ID NO: 390270 - DNA, 25 bp, Rattus norvegicus
gccaatgaatgcattctatgctttg

SEQ ID NO: 390271 - DNA, 25 bp, Rattus norvegicus
gccaatgaatgctttctatgctttg

SEQ ID NO: 390272 - DNA, 25 bp, Rattus norvegicus
gccaatgagacaacaatccctgaga

SEQ ID NO: 390273 - DNA, 25 bp, Rattus norvegicus
gccaatgagacatcaatccctgaga

SEQ ID NO: 390274 - DNA, 25 bp, Rattus norvegicus
gccaatgagatcaccaaacgcttgc

SEQ ID NO: 390275 - DNA, 25 bp, Rattus norvegicus
gccaatgagatctccaaacgcttgc

SEQ ID NO: 390276 - DNA, 25 bp, Rattus norvegicus
gccaatgagggcactggaggctcac

SEQ ID NO: 390277 - DNA, 25 bp, Rattus norvegicus
gccaatgagggctctggaggctcac

SEQ ID NO: 390278 - DNA, 25 bp, Rattus norvegicus
gccaatgagtgcagctggatccacg

SEQ ID NO: 390279 - DNA, 25 bp, Rattus norvegicus
gccaatgagtgctgctggatccacg

SEQ ID NO: 390280 - DNA, 25 bp, Rattus norvegicus
gccaatgatatgccagcttctacat

SEQ ID NO: 390281 - DNA, 25 bp, Rattus norvegicus
gccaatgatatggcagcttctacat

SEQ ID NO: 390282 - DNA, 25 bp, Rattus norvegicus
gccaatgatgtactatgccttctat

SEQ ID NO: 390283 - DNA, 25 bp, Rattus norvegicus
gccaatgatgtagtatgccttctat

SEQ ID NO: 390284 - DNA, 25 bp, Rattus norvegicus
gccaatgcgcttatgtgtgtatttc

SEQ ID NO: 390285 - DNA, 25 bp, Rattus norvegicus
gccaatgcgcttttgtgtgtatttc

SEQ ID NO: 390286 - DNA, 25 bp, Rattus norvegicus
gccaatgcggctcatgtctatttta

SEQ ID NO: 390287 - DNA, 25 bp, Rattus norvegicus
gccaatgcggctgatgtctatttta

SEQ ID NO: 390288 - DNA, 25 bp, Rattus norvegicus
gccaatgctaacctcatgcggaatg

SEQ ID NO: 390289 - DNA, 25 bp, Rattus norvegicus
gccaatgctaacgtcatgcggaatg

SEQ ID NO: 390290 - DNA, 25 bp, Rattus norvegicus
gccaatgctaggctttgatgactgc

SEQ ID NO: 390291 - DNA, 25 bp, Rattus norvegicus
gccaatgctagggtttgatgactgc

SEQ ID NO: 390292 - DNA, 25 bp, Rattus norvegicus
gccaatgctgccatggttattccaa

SEQ ID NO: 390293 - DNA, 25 bp, Rattus norvegicus
gccaatgctgccttggttattccaa

SEQ ID NO: 390294 - DNA, 25 bp, Rattus norvegicus
gccaatgctttcagttcatgtgttc

SEQ ID NO: 390295 - DNA, 25 bp, Rattus norvegicus
gccaatgctttctgttcatgtgttc

SEQ ID NO: 390296 - DNA, 25 bp, Rattus norvegicus
gccaatggacatcttactaactgaa

SEQ ID NO: 390297 - DNA, 25 bp, Rattus norvegicus
gccaatggacatgttactaactgaa

SEQ ID NO: 390298 - DNA, 25 bp, Rattus norvegicus
gccaatggacggacattttaatgtc

SEQ ID NO: 390299 - DNA, 25 bp, Rattus norvegicus
gccaatggacggtcattttaatgtc

SEQ ID NO: 390300 - DNA, 25 bp, Rattus norvegicus
gccaatggcaaaaacggtgaaattt

SEQ ID NO: 390301 - DNA, 25 bp, Rattus norvegicus
gccaatggcaaatacggtgaaattt

SEQ ID NO: 390302 - DNA, 25 bp, Rattus norvegicus
gccaatggccttaatcctcaggtta

SEQ ID NO: 390303 - DNA, 25 bp, Rattus norvegicus
gccaatggcctttatcctcaggtta

SEQ ID NO: 390304 - DNA, 25 bp, Rattus norvegicus
gccaatgggcaaatagtctaagctt

SEQ ID NO: 390305 - DNA, 25 bp, Rattus norvegicus
gccaatgggcaattagtctaagctt

SEQ ID NO: 390306 - DNA, 25 bp, Rattus norvegicus
gccaatgtcctaacaatggttcaga

SEQ ID NO: 390307 - DNA, 25 bp, Rattus norvegicus
gccaatgtcctatcaatggttcaga

SEQ ID NO: 390308 - DNA, 25 bp, Rattus norvegicus
gccaatgtggctatttgttctaatt

SEQ ID NO: 390309 - DNA, 25 bp, Rattus norvegicus
gccaatgtggctttttgttctaatt

SEQ ID NO: 390310 - DNA, 25 bp, Rattus norvegicus
gccaatgtgttcattctttctgtat

SEQ ID NO: 390311 - DNA, 25 bp, Rattus norvegicus
gccaatgtgttctttctttctgtat

SEQ ID NO: 390312 - DNA, 25 bp, Rattus norvegicus
gccaatgttctaactgcggcggcat

SEQ ID NO: 390313 - DNA, 25 bp, Rattus norvegicus
gccaatgttctatctgcggcggcat

SEQ ID NO: 390314 - DNA, 25 bp, Rattus norvegicus
gccaatgtttttctggtgtcaacac

SEQ ID NO: 390315 - DNA, 25 bp, Rattus norvegicus
gccaatgtttttgtggtgtcaacac

SEQ ID NO: 390316 - DNA, 25 bp, Rattus norvegicus
gccaattactatactcagtttccat

SEQ ID NO: 390317 - DNA, 25 bp, Rattus norvegicus
gccaattactattctcagtttccat

SEQ ID NO: 390318 - DNA, 25 bp, Rattus norvegicus
gccaattccaggcaactctttattg

SEQ ID NO: 390319 - DNA, 25 bp, Rattus norvegicus
gccaattccagggaactctttattg

SEQ ID NO: 390320 - DNA, 25 bp, Rattus norvegicus
gccaattccgccattttatgtatta

SEQ ID NO: 390321 - DNA, 25 bp, Rattus norvegicus
gccaattccgcctttttatgtatta

SEQ ID NO: 390322 - DNA, 25 bp, Rattus norvegicus
gccaattcgtgcagaagaagctgtt

SEQ ID NO: 390323 - DNA, 25 bp, Rattus norvegicus
gccaattcgtgctgaagaagctgtt

SEQ ID NO: 390324 - DNA, 25 bp, Rattus norvegicus
gccaattctcaaactgtggttttag

SEQ ID NO: 390325 - DNA, 25 bp, Rattus norvegicus
gccaattctcaatctgtggttttag

SEQ ID NO: 390326 - DNA, 25 bp, Rattus norvegicus
gccaattctcagatttgctttgcca

SEQ ID NO: 390327 - DNA, 25 bp, Rattus norvegicus
gccaattctcagttttgctttgcca

SEQ ID NO: 390328 - DNA, 25 bp, Rattus norvegicus
gccaattgatggatctttcaggtat

SEQ ID NO: 390329 - DNA, 25 bp, Rattus norvegicus
gccaattgatggttctttcaggtat

SEQ ID NO: 390330 - DNA, 25 bp, Rattus norvegicus
gccaattggcacatatcaatgacat

SEQ ID NO: 390331 - DNA, 25 bp, Rattus norvegicus
gccaattggcacttatcaatgacat

SEQ ID NO: 390332 - DNA, 25 bp, Rattus norvegicus
gccaatttgactaacaacttctcac

SEQ ID NO: 390333 - DNA, 25 bp, Rattus norvegicus
gccaatttgacttacaacttctcac

SEQ ID NO: 390334 - DNA, 25 bp, Rattus norvegicus
gccacaaaatttcgatactgcattt

SEQ ID NO: 390335 - DNA, 25 bp, Rattus norvegicus
gccacaaaatttggatactgcattt

SEQ ID NO: 390336 - DNA, 25 bp, Rattus norvegicus
gccacaaaccatatcatccaaatca

SEQ ID NO: 390337 - DNA, 25 bp, Rattus norvegicus
gccacaaaccatttcatccaaatca

SEQ ID NO: 390338 - DNA, 25 bp, Rattus norvegicus
gccacaaatctcaacaagtgcctgt

SEQ ID NO: 390339 - DNA, 25 bp, Rattus norvegicus
gccacaaatctctacaagtgcctgt

SEQ ID NO: 390340 - DNA, 25 bp, Rattus norvegicus
gccacaaatgttcctgttttcctaa

SEQ ID NO: 390341 - DNA, 25 bp, Rattus norvegicus
gccacaaatgttgctgttttcctaa

SEQ ID NO: 390342 - DNA, 25 bp, Rattus norvegicus
gccacaacatgcaacacgaggtctc

SEQ ID NO: 390343 - DNA, 25 bp, Rattus norvegicus
gccacaacatgctacacgaggtctc

SEQ ID NO: 390344 - DNA, 25 bp, Rattus norvegicus
gccacaacctgccttgtataaacat

SEQ ID NO: 390345 - DNA, 25 bp, Rattus norvegicus
gccacaacctgcgttgtataaacat

SEQ ID NO: 390346 - DNA, 25 bp, Rattus norvegicus
gccacaacttcaaccttttcagaaa

SEQ ID NO: 390347 - DNA, 25 bp, Rattus norvegicus
gccacaacttcatccttttcagaaa

SEQ ID NO: 390348 - DNA, 25 bp, Rattus norvegicus
gccacaagaaacacaagctaactaa

SEQ ID NO: 390349 - DNA, 25 bp, Rattus norvegicus
gccacaagaaactcaagctaactaa

SEQ ID NO: 390350 - DNA, 25 bp, Rattus norvegicus
gccacaaggcttaatttttcgtttg

SEQ ID NO: 390351 - DNA, 25 bp, Rattus norvegicus
gccacaaggctttatttttcgtttg

SEQ ID NO: 390352 - DNA, 25 bp, Rattus norvegicus
gccacaaggtctcatgttcattgct

SEQ ID NO: 390353 - DNA, 25 bp, Rattus norvegicus
gccacaaggtctgatgttcattgct

SEQ ID NO: 390354 - DNA, 25 bp, Rattus norvegicus
gccacaagtgctaagaggaggatct

SEQ ID NO: 390355 - DNA, 25 bp, Rattus norvegicus
gccacaagtgcttagaggaggatct

SEQ ID NO: 390356 - DNA, 25 bp, Rattus norvegicus
gccacaataaaaacacattgcatgt

SEQ ID NO: 390357 - DNA, 25 bp, Rattus norvegicus
gccacaataaaatcacattgcatgt

SEQ ID NO: 390358 - DNA, 25 bp, Rattus norvegicus
gccacaatcttacctttattctgaa

SEQ ID NO: 390359 - DNA, 25 bp, Rattus norvegicus
gccacaatcttagctttattctgaa

SEQ ID NO: 390360 - DNA, 25 bp, Rattus norvegicus
gccacaatgcaaaaactcatgttga

SEQ ID NO: 390361 - DNA, 25 bp, Rattus norvegicus
gccacaatgcaataactcatgttga

SEQ ID NO: 390362 - DNA, 25 bp, Rattus norvegicus
gccacaatgcataatcaaccacttc

SEQ ID NO: 390363 - DNA, 25 bp, Rattus norvegicus
gccacaatgcattatcaaccacttc

SEQ ID NO: 390364 - DNA, 25 bp, Rattus norvegicus
gccacaatttgaaaacaccaactgt

SEQ ID NO: 390365 - DNA, 25 bp, Rattus norvegicus
gccacaatttgataacaccaactgt

SEQ ID NO: 390366 - DNA, 25 bp, Rattus norvegicus
gccacacaagcgattatttttagta

SEQ ID NO: 390367 - DNA, 25 bp, Rattus norvegicus
gccacacaagcgtttatttttagta

SEQ ID NO: 390368 - DNA, 25 bp, Rattus norvegicus
gccacacaccttcgagaattaccat

SEQ ID NO: 390369 - DNA, 25 bp, Rattus norvegicus
gccacacaccttggagaattaccat

SEQ ID NO: 390370 - DNA, 25 bp, Rattus norvegicus
gccacacagattattgcctcagaac

SEQ ID NO: 390371 - DNA, 25 bp, Rattus norvegicus
gccacacagatttttgcctcagaac

SEQ ID NO: 390372 - DNA, 25 bp, Rattus norvegicus
gccacacagcctacttgtaagattt

SEQ ID NO: 390373 - DNA, 25 bp, Rattus norvegicus
gccacacagccttcttgtaagattt

SEQ ID NO: 390374 - DNA, 25 bp, Rattus norvegicus
gccacacaggagagcctaggatgca

SEQ ID NO: 390375 - DNA, 25 bp, Rattus norvegicus
gccacacaggagtgcctaggatgca

SEQ ID NO: 390376 - DNA, 25 bp, Rattus norvegicus
gccacacagtgcattgtttttctat

SEQ ID NO: 390377 - DNA, 25 bp, Rattus norvegicus
gccacacagtgctttgtttttctat

SEQ ID NO: 390378 - DNA, 25 bp, Rattus norvegicus
gccacacatattagcatgtgcatgt

SEQ ID NO: 390379 - DNA, 25 bp, Rattus norvegicus
gccacacatatttgcatgtgcatgt

SEQ ID NO: 390380 - DNA, 25 bp, Rattus norvegicus
gccacaccagctctacaatgctaag

SEQ ID NO: 390381 - DNA, 25 bp, Rattus norvegicus
gccacaccagctgtacaatgctaag

SEQ ID NO: 390382 - DNA, 25 bp, Rattus norvegicus
gccacacccagacatgactgtagac

SEQ ID NO: 390383 - DNA, 25 bp, Rattus norvegicus
gccacacccagagatgactgtagac

SEQ ID NO: 390384 - DNA, 25 bp, Rattus norvegicus
gccacacccatacccatttgttttt

SEQ ID NO: 390385 - DNA, 25 bp, Rattus norvegicus
gccacacccatagccatttgttttt

SEQ ID NO: 390386 - DNA, 25 bp, Rattus norvegicus
gccacacccctacgaactggagtta

SEQ ID NO: 390387 - DNA, 25 bp, Rattus norvegicus
gccacacccctaggaactggagtta

SEQ ID NO: 390388 - DNA, 25 bp, Rattus norvegicus
gccacaccgtttcattagcacgaag

SEQ ID NO: 390389 - DNA, 25 bp, Rattus norvegicus
gccacaccgtttgattagcacgaag

SEQ ID NO: 390390 - DNA, 25 bp, Rattus norvegicus
gccacacctaagattcaggaaccat

SEQ ID NO: 390391 - DNA, 25 bp, Rattus norvegicus
gccacacctaagtttcaggaaccat

SEQ ID NO: 390392 - DNA, 25 bp, Rattus norvegicus
gccacacctactataattcactttg

SEQ ID NO: 390393 - DNA, 25 bp, Rattus norvegicus
gccacacctactttaattcactttg

SEQ ID NO: 390394 - DNA, 25 bp, Rattus norvegicus
gccacacctctacatgtcattaaat

SEQ ID NO: 390395 - DNA, 25 bp, Rattus norvegicus
gccacacctctagatgtcattaaat

SEQ ID NO: 390396 - DNA, 25 bp, Rattus norvegicus
gccacacgaaatcaccaacttctaa

SEQ ID NO: 390397 - DNA, 25 bp, Rattus norvegicus
gccacacgaaatgaccaacttctaa

SEQ ID NO: 390398 - DNA, 25 bp, Rattus norvegicus
gccacacgcaataccaagacagaca

SEQ ID NO: 390399 - DNA, 25 bp, Rattus norvegicus
gccacacgcaattccaagacagaca

SEQ ID NO: 390400 - DNA, 25 bp, Rattus norvegicus
gccacacggataagcctacaggtct

SEQ ID NO: 390401 - DNA, 25 bp, Rattus norvegicus
gccacacggatatgcctacaggtct

SEQ ID NO: 390402 - DNA, 25 bp, Rattus norvegicus
gccacacggcagacaaggctgtcaa

SEQ ID NO: 390403 - DNA, 25 bp, Rattus norvegicus
gccacacggcagtcaaggctgtcaa

SEQ ID NO: 390404 - DNA, 25 bp, Rattus norvegicus
gccacacgtcctcacaggaagaatg

SEQ ID NO: 390405 - DNA, 25 bp, Rattus norvegicus
gccacacgtcctgacaggaagaatg

SEQ ID NO: 390406 - DNA, 25 bp, Rattus norvegicus
gccacacgtgttaatttatatgcta

SEQ ID NO: 390407 - DNA, 25 bp, Rattus norvegicus
gccacacgtgtttatttatatgcta

SEQ ID NO: 390408 - DNA, 25 bp, Rattus norvegicus
gccacactaaccacaggtgaagaga

SEQ ID NO: 390409 - DNA, 25 bp, Rattus norvegicus
gccacactaacctcaggtgaagaga

SEQ ID NO: 390410 - DNA, 25 bp, Rattus norvegicus
gccacactcaagatccaggctggaa

SEQ ID NO: 390411 - DNA, 25 bp, Rattus norvegicus
gccacactcaagttccaggctggaa

SEQ ID NO: 390412 - DNA, 25 bp, Rattus norvegicus
gccacactcattcaatcgatgctag

SEQ ID NO: 390413 - DNA, 25 bp, Rattus norvegicus
gccacactcattgaatcgatgctag

SEQ ID NO: 390414 - DNA, 25 bp, Rattus norvegicus
gccacactctacagcagtactagga

SEQ ID NO: 390415 - DNA, 25 bp, Rattus norvegicus
gccacactctactgcagtactagga

SEQ ID NO: 390416 - DNA, 25 bp, Rattus norvegicus
gccacactcttgatttttcctttgt

SEQ ID NO: 390417 - DNA, 25 bp, Rattus norvegicus
gccacactcttgttttttcctttgt

SEQ ID NO: 390418 - DNA, 25 bp, Rattus norvegicus
gccacactgagaagggccaggctgt

SEQ ID NO: 390419 - DNA, 25 bp, Rattus norvegicus
gccacactgagatgggccaggctgt

SEQ ID NO: 390420 - DNA, 25 bp, Rattus norvegicus
gccacactgcacctttgttctgaaa

SEQ ID NO: 390421 - DNA, 25 bp, Rattus norvegicus
gccacactgcacgtttgttctgaaa

SEQ ID NO: 390422 - DNA, 25 bp, Rattus norvegicus
gccacactggctcgagctacagcta

SEQ ID NO: 390423 - DNA, 25 bp, Rattus norvegicus
gccacactggctggagctacagcta

SEQ ID NO: 390424 - DNA, 25 bp, Rattus norvegicus
gccacactggtgcagctttggtcag

SEQ ID NO: 390425 - DNA, 25 bp, Rattus norvegicus
gccacactggtggagctttggtcag

SEQ ID NO: 390426 - DNA, 25 bp, Rattus norvegicus
gccacactgtaaaatctctttctat

SEQ ID NO: 390427 - DNA, 25 bp, Rattus norvegicus
gccacactgtaatatctctttctat

SEQ ID NO: 390428 - DNA, 25 bp, Rattus norvegicus
gccacacttagactctttccaaaga

SEQ ID NO: 390429 - DNA, 25 bp, Rattus norvegicus
gccacacttagagtctttccaaaga

SEQ ID NO: 390430 - DNA, 25 bp, Rattus norvegicus
gccacacttatacgcctttctatca

SEQ ID NO: 390431 - DNA, 25 bp, Rattus norvegicus
gccacacttataggcctttctatca

SEQ ID NO: 390432 - DNA, 25 bp, Rattus norvegicus
gccacacttcaacaggaggcctgtt

SEQ ID NO: 390433 - DNA, 25 bp, Rattus norvegicus
gccacacttcaagaggaggcctgtt

SEQ ID NO: 390434 - DNA, 25 bp, Rattus norvegicus
gccacacttcatcaccacgtgaagt

SEQ ID NO: 390435 - DNA, 25 bp, Rattus norvegicus
gccacacttcatgaccacgtgaagt

SEQ ID NO: 390436 - DNA, 25 bp, Rattus norvegicus
gccacagaaaccacttccagaagac

SEQ ID NO: 390437 - DNA, 25 bp, Rattus norvegicus
gccacagaaacctcttccagaagac

SEQ ID NO: 390438 - DNA, 25 bp, Rattus norvegicus
gccacagacaccattgatcgaacat

SEQ ID NO: 390439 - DNA, 25 bp, Rattus norvegicus
gccacagacacctttgatcgaacat

SEQ ID NO: 390440 - DNA, 25 bp, Rattus norvegicus
gccacagacgacaaccactatgaga

SEQ ID NO: 390441 - DNA, 25 bp, Rattus norvegicus
gccacagacgactaccactatgaga

SEQ ID NO: 390442 - DNA, 25 bp, Rattus norvegicus
gccacagacgtgatctccttttact

SEQ ID NO: 390443 - DNA, 25 bp, Rattus norvegicus
gccacagacgtgttctccttttact

SEQ ID NO: 390444 - DNA, 25 bp, Rattus norvegicus
gccacagactgactttcaagcatca

SEQ ID NO: 390445 - DNA, 25 bp, Rattus norvegicus
gccacagactgagtttcaagcatca

SEQ ID NO: 390446 - DNA, 25 bp, Rattus norvegicus
gccacagagaagagcccagctggaa

SEQ ID NO: 390447 - DNA, 25 bp, Rattus norvegicus
gccacagagaagtgcccagctggaa

SEQ ID NO: 390448 - DNA, 25 bp, Rattus norvegicus
gccacagagcagcagcggcagatct

SEQ ID NO: 390449 - DNA, 25 bp, Rattus norvegicus
gccacagagcaggagcggcagatct

SEQ ID NO: 390450 - DNA, 25 bp, Rattus norvegicus
gccacagaggccaggcgcttagctg

SEQ ID NO: 390451 - DNA, 25 bp, Rattus norvegicus
gccacagaggcctggcgcttagctg

SEQ ID NO: 390452 - DNA, 25 bp, Rattus norvegicus
gccacagagggcatacccctggaaa

SEQ ID NO: 390453 - DNA, 25 bp, Rattus norvegicus
gccacagagggcttacccctggaaa

SEQ ID NO: 390454 - DNA, 25 bp, Rattus norvegicus
gccacagaggtgatctccaggacaa

SEQ ID NO: 390455 - DNA, 25 bp, Rattus norvegicus
gccacagaggtgttctccaggacaa

SEQ ID NO: 390456 - DNA, 25 bp, Rattus norvegicus
gccacagagtggattgttatcatcg

SEQ ID NO: 390457 - DNA, 25 bp, Rattus norvegicus
gccacagagtggtttgttatcatcg

SEQ ID NO: 390458 - DNA, 25 bp, Rattus norvegicus
gccacagatcttagggctgcctgga

SEQ ID NO: 390459 - DNA, 25 bp, Rattus norvegicus
gccacagatctttgggctgcctgga

SEQ ID NO: 390460 - DNA, 25 bp, Rattus norvegicus
gccacagatggcatttaatctctta

SEQ ID NO: 390461 - DNA, 25 bp, Rattus norvegicus
gccacagatggcttttaatctctta

SEQ ID NO: 390462 - DNA, 25 bp, Rattus norvegicus
gccacagcacctagttttgcggtta

SEQ ID NO: 390463 - DNA, 25 bp, Rattus norvegicus
gccacagcaccttgttttgcggtta

SEQ ID NO: 390464 - DNA, 25 bp, Rattus norvegicus
gccacagcacggctcatgatgaaat

SEQ ID NO: 390465 - DNA, 25 bp, Rattus norvegicus
gccacagcacgggtcatgatgaaat

SEQ ID NO: 390466 - DNA, 25 bp, Rattus norvegicus
gccacagcactaaagaggtcgtcct

SEQ ID NO: 390467 - DNA, 25 bp, Rattus norvegicus
gccacagcactatagaggtcgtcct

SEQ ID NO: 390468 - DNA, 25 bp, Rattus norvegicus
gccacagcaggtcaggatacataga

SEQ ID NO: 390469 - DNA, 25 bp, Rattus norvegicus
gccacagcaggtgaggatacataga

SEQ ID NO: 390470 - DNA, 25 bp, Rattus norvegicus
gccacagcatcaccaaactagcaga

SEQ ID NO: 390471 - DNA, 25 bp, Rattus norvegicus
gccacagcatcagcaaactagcaga

SEQ ID NO: 390472 - DNA, 25 bp, Rattus norvegicus
gccacagccccacatttgtttttga

SEQ ID NO: 390473 - DNA, 25 bp, Rattus norvegicus
gccacagccccagatttgtttttga

SEQ ID NO: 390474 - DNA, 25 bp, Rattus norvegicus
gccacagcccgccagtctgcgtatg

SEQ ID NO: 390475 - DNA, 25 bp, Rattus norvegicus
gccacagcccgcgagtctgcgtatg

SEQ ID NO: 390476 - DNA, 25 bp, Rattus norvegicus
gccacagccctccatagaattttgg

SEQ ID NO: 390477 - DNA, 25 bp, Rattus norvegicus
gccacagccctcgatagaattttgg

SEQ ID NO: 390478 - DNA, 25 bp, Rattus norvegicus
gccacagccgaaatatatttattat

SEQ ID NO: 390479 - DNA, 25 bp, Rattus norvegicus
gccacagccgaattatatttattat

SEQ ID NO: 390480 - DNA, 25 bp, Rattus norvegicus
gccacagccttgaagccagagcaga

SEQ ID NO: 390481 - DNA, 25 bp, Rattus norvegicus
gccacagccttgtagccagagcaga

SEQ ID NO: 390482 - DNA, 25 bp, Rattus norvegicus
gccacagcgaatcttgatgctacaa

SEQ ID NO: 390483 - DNA, 25 bp, Rattus norvegicus
gccacagcgaatgttgatgctacaa

SEQ ID NO: 390484 - DNA, 25 bp, Rattus norvegicus
gccacagcgcgtcgcactgagattt

SEQ ID NO: 390485 - DNA, 25 bp, Rattus norvegicus
gccacagcgcgtggcactgagattt

SEQ ID NO: 390486 - DNA, 25 bp, Rattus norvegicus
gccacagctccaacttgattatatc

SEQ ID NO: 390487 - DNA, 25 bp, Rattus norvegicus
gccacagctccatcttgattatatc

SEQ ID NO: 390488 - DNA, 25 bp, Rattus norvegicus
gccacagctctgacgggatagcatg

SEQ ID NO: 390489 - DNA, 25 bp, Rattus norvegicus
gccacagctctgtcgggatagcatg

SEQ ID NO: 390490 - DNA, 25 bp, Rattus norvegicus
gccacagctgtgactagtctatttt

SEQ ID NO: 390491 - DNA, 25 bp, Rattus norvegicus
gccacagctgtgatcagggcttatg

SEQ ID NO: 390492 - DNA, 25 bp, Rattus norvegicus
gccacagctgtgcactggtttacag

SEQ ID NO: 390493 - DNA, 25 bp, Rattus norvegicus
gccacagctgtggactggtttacag

SEQ ID NO: 390494 - DNA, 25 bp, Rattus norvegicus
gccacagctgtgtctagtctatttt

SEQ ID NO: 390495 - DNA, 25 bp, Rattus norvegicus
gccacagctgtgttcagggcttatg

SEQ ID NO: 390496 - DNA, 25 bp, Rattus norvegicus
gccacagcttccaacttgggatgat

SEQ ID NO: 390497 - DNA, 25 bp, Rattus norvegicus
gccacagcttcctacttgggatgat

SEQ ID NO: 390498 - DNA, 25 bp, Rattus norvegicus
gccacaggcactaactactgcagag

SEQ ID NO: 390499 - DNA, 25 bp, Rattus norvegicus
gccacaggcacttactactgcagag

SEQ ID NO: 390500 - DNA, 25 bp, Rattus norvegicus
gccacaggccgcagttcggaccaac

SEQ ID NO: 390501 - DNA, 25 bp, Rattus norvegicus
gccacaggccgctgttcggaccaac

SEQ ID NO: 390502 - DNA, 25 bp, Rattus norvegicus
gccacaggcttcatttaatttcagt

SEQ ID NO: 390503 - DNA, 25 bp, Rattus norvegicus
gccacaggcttcttttaatttcagt

SEQ ID NO: 390504 - DNA, 25 bp, Rattus norvegicus
gccacaggctttctttcggccggga

SEQ ID NO: 390505 - DNA, 25 bp, Rattus norvegicus
gccacaggctttgtttcggccggga

SEQ ID NO: 390506 - DNA, 25 bp, Rattus norvegicus
gccacagggcagatccactttggaa

SEQ ID NO: 390507 - DNA, 25 bp, Rattus norvegicus
gccacagggcagttccactttggaa

SEQ ID NO: 390508 - DNA, 25 bp, Rattus norvegicus
gccacaggtagcaatgaatatcata

SEQ ID NO: 390509 - DNA, 25 bp, Rattus norvegicus
gccacaggtagctatgaatatcata

SEQ ID NO: 390510 - DNA, 25 bp, Rattus norvegicus
gccacaggtgagctgtattgcccca

SEQ ID NO: 390511 - DNA, 25 bp, Rattus norvegicus
gccacaggtgaggtgtattgcccca

SEQ ID NO: 390512 - DNA, 25 bp, Rattus norvegicus
gccacagtaaaactcatgggattgt

SEQ ID NO: 390513 - DNA, 25 bp, Rattus norvegicus
gccacagtaaaagtcatgggattgt

SEQ ID NO: 390514 - DNA, 25 bp, Rattus norvegicus
gccacagtaaggagcacacttcttt

SEQ ID NO: 390515 - DNA, 25 bp, Rattus norvegicus
gccacagtaaggtgcacacttcttt

SEQ ID NO: 390516 - DNA, 25 bp, Rattus norvegicus
gccacagtaggccagtgtcacatgg

SEQ ID NO: 390517 - DNA, 25 bp, Rattus norvegicus
gccacagtaggcgagtgtcacatgg

SEQ ID NO: 390518 - DNA, 25 bp, Rattus norvegicus
gccacagtatttctcccaagcctgg

SEQ ID NO: 390519 - DNA, 25 bp, Rattus norvegicus
gccacagtatttgtcccaagcctgg

SEQ ID NO: 390520 - DNA, 25 bp, Rattus norvegicus
gccacagtcctcatttctttaaata

SEQ ID NO: 390521 - DNA, 25 bp, Rattus norvegicus
gccacagtcctcttttctttaaata

SEQ ID NO: 390522 - DNA, 25 bp, Rattus norvegicus
gccacagtggcaaattgttcttaat

SEQ ID NO: 390523 - DNA, 25 bp, Rattus norvegicus
gccacagtggcatattgttcttaat

SEQ ID NO: 390524 - DNA, 25 bp, Rattus norvegicus
gccacagtgtaaatgctaactagcc

SEQ ID NO: 390525 - DNA, 25 bp, Rattus norvegicus
gccacagtgtaattgctaactagcc

SEQ ID NO: 390526 - DNA, 25 bp, Rattus norvegicus
gccacagtgtggatcaagatatcag

SEQ ID NO: 390527 - DNA, 25 bp, Rattus norvegicus
gccacagtgtggttcaagatatcag

SEQ ID NO: 390528 - DNA, 25 bp, Rattus norvegicus
gccacagtgtgtcctcacagtagag

SEQ ID NO: 390529 - DNA, 25 bp, Rattus norvegicus
gccacagtgtgtgctcacagtagag

SEQ ID NO: 390530 - DNA, 25 bp, Rattus norvegicus
gccacagtgttgattccagctacat

SEQ ID NO: 390531 - DNA, 25 bp, Rattus norvegicus
gccacagtgttgtttccagctacat

SEQ ID NO: 390532 - DNA, 25 bp, Rattus norvegicus
gccacagttagaatagactcatcag

SEQ ID NO: 390533 - DNA, 25 bp, Rattus norvegicus
gccacagttagattagactcatcag

SEQ ID NO: 390534 - DNA, 25 bp, Rattus norvegicus
gccacagttctgagccccagagaag

SEQ ID NO: 390535 - DNA, 25 bp, Rattus norvegicus
gccacagttctgtgccccagagaag

SEQ ID NO: 390536 - DNA, 25 bp, Rattus norvegicus
gccacagttgacatagtcctctgga

SEQ ID NO: 390537 - DNA, 25 bp, Rattus norvegicus
gccacagttgacttagtcctctgga

SEQ ID NO: 390538 - DNA, 25 bp, Rattus norvegicus
gccacagttgatcttcacttctaga

SEQ ID NO: 390539 - DNA, 25 bp, Rattus norvegicus
gccacagttgatgttcacttctaga

SEQ ID NO: 390540 - DNA, 25 bp, Rattus norvegicus
gccacagtttacaagcagaagcgaa

SEQ ID NO: 390541 - DNA, 25 bp, Rattus norvegicus
gccacagtttactagcagaagcgaa

SEQ ID NO: 390542 - DNA, 25 bp, Rattus norvegicus
gccacataaacgcactttgctgcaa

SEQ ID NO: 390543 - DNA, 25 bp, Rattus norvegicus
gccacataaacggactttgctgcaa

SEQ ID NO: 390544 - DNA, 25 bp, Rattus norvegicus
gccacataccccagtgctataaaag

SEQ ID NO: 390545 - DNA, 25 bp, Rattus norvegicus
gccacatacccctgtgctataaaag

SEQ ID NO: 390546 - DNA, 25 bp, Rattus norvegicus
gccacatagctcagggccacatttg

SEQ ID NO: 390547 - DNA, 25 bp, Rattus norvegicus
gccacatagctctgggccacatttg

SEQ ID NO: 390548 - DNA, 25 bp, Rattus norvegicus
gccacatatggccatttcagagtta

SEQ ID NO: 390549 - DNA, 25 bp, Rattus norvegicus
gccacatatggcgatttcagagtta

SEQ ID NO: 390550 - DNA, 25 bp, Rattus norvegicus
gccacatcactaagcgcatgcgcaa

SEQ ID NO: 390551 - DNA, 25 bp, Rattus norvegicus
gccacatcactatgcgcatgcgcaa

SEQ ID NO: 390552 - DNA, 25 bp, Rattus norvegicus
gccacatcaggtcccttttcaagaa

SEQ ID NO: 390553 - DNA, 25 bp, Rattus norvegicus
gccacatcaggtgccttttcaagaa

SEQ ID NO: 390554 - DNA, 25 bp, Rattus norvegicus
gccacatcctgactactgcagtata

SEQ ID NO: 390555 - DNA, 25 bp, Rattus norvegicus
gccacatcctgagtactgcagtata

SEQ ID NO: 390556 - DNA, 25 bp, Rattus norvegicus
gccacatcctgccaaggaagtctta

SEQ ID NO: 390557 - DNA, 25 bp, Rattus norvegicus
gccacatcctgcgaaggaagtctta

SEQ ID NO: 390558 - DNA, 25 bp, Rattus norvegicus
gccacatccttgatgggtttgttca

SEQ ID NO: 390559 - DNA, 25 bp, Rattus norvegicus
gccacatccttgttgggtttgttca

SEQ ID NO: 390560 - DNA, 25 bp, Rattus norvegicus
gccacatctgatcaccttactagag

SEQ ID NO: 390561 - DNA, 25 bp, Rattus norvegicus
gccacatctgatgaccttactagag

SEQ ID NO: 390562 - DNA, 25 bp, Rattus norvegicus
gccacatctgcactcctagaaagat

SEQ ID NO: 390563 - DNA, 25 bp, Rattus norvegicus
gccacatctgcagtcctagaaagat

SEQ ID NO: 390564 - DNA, 25 bp, Rattus norvegicus
gccacatctgtgcaagctttctgtt

SEQ ID NO: 390565 - DNA, 25 bp, Rattus norvegicus
gccacatctgtggaagctttctgtt

SEQ ID NO: 390566 - DNA, 25 bp, Rattus norvegicus
gccacatgaggaaggcttcttctga

SEQ ID NO: 390567 - DNA, 25 bp, Rattus norvegicus
gccacatgaggatggcttcttctga

SEQ ID NO: 390568 - DNA, 25 bp, Rattus norvegicus
gccacatgcgctacatgctggacat

SEQ ID NO: 390569 - DNA, 25 bp, Rattus norvegicus
gccacatgcgcttcatgctggacat

SEQ ID NO: 390570 - DNA, 25 bp, Rattus norvegicus
gccacatggcacaatgggacacctt

SEQ ID NO: 390571 - DNA, 25 bp, Rattus norvegicus
gccacatggcactatgggacacctt

SEQ ID NO: 390572 - DNA, 25 bp, Rattus norvegicus
gccacattaaggagtgagtcttctt

SEQ ID NO: 390573 - DNA, 25 bp, Rattus norvegicus
gccacattaaggtgtgagtcttctt

SEQ ID NO: 390574 - DNA, 25 bp, Rattus norvegicus
gccacattgagacccctgcatggag

SEQ ID NO: 390575 - DNA, 25 bp, Rattus norvegicus
gccacattgagagccctgcatggag

SEQ ID NO: 390576 - DNA, 25 bp, Rattus norvegicus
gccacattgggaatgctgttcctga

SEQ ID NO: 390577 - DNA, 25 bp, Rattus norvegicus
gccacattgggattgctgttcctga

SEQ ID NO: 390578 - DNA, 25 bp, Rattus norvegicus
gccacattggttaagtgccatcaat

SEQ ID NO: 390579 - DNA, 25 bp, Rattus norvegicus
gccacattggtttagtgccatcaat

SEQ ID NO: 390580 - DNA, 25 bp, Rattus norvegicus
gccacattgtctcgttgtcattcaa

SEQ ID NO: 390581 - DNA, 25 bp, Rattus norvegicus
gccacattgtctggttgtcattcaa

SEQ ID NO: 390582 - DNA, 25 bp, Rattus norvegicus
gccacatttataatttgccccacag

SEQ ID NO: 390583 - DNA, 25 bp, Rattus norvegicus
gccacatttatattttgccccacag

SEQ ID NO: 390584 - DNA, 25 bp, Rattus norvegicus
gccacatttcataactgtttttaat

SEQ ID NO: 390585 - DNA, 25 bp, Rattus norvegicus
gccacatttcattactgtttttaat

SEQ ID NO: 390586 - DNA, 25 bp, Rattus norvegicus
gccacatttgttagtcaactgcagt

SEQ ID NO: 390587 - DNA, 25 bp, Rattus norvegicus
gccacatttgtttgtcaactgcagt

SEQ ID NO: 390588 - DNA, 25 bp, Rattus norvegicus
gccacattttgtatttctcctctga

SEQ ID NO: 390589 - DNA, 25 bp, Rattus norvegicus
gccacattttgtttttctcctctga

SEQ ID NO: 390590 - DNA, 25 bp, Rattus norvegicus
gccaccaaccagaccacaaatgaat

SEQ ID NO: 390591 - DNA, 25 bp, Rattus norvegicus
gccaccaaccagctagtgtcagatt

SEQ ID NO: 390592 - DNA, 25 bp, Rattus norvegicus
gccaccaaccaggtagtgtcagatt

SEQ ID NO: 390593 - DNA, 25 bp, Rattus norvegicus
gccaccaaccagtccacaaatgaat

SEQ ID NO: 390594 - DNA, 25 bp, Rattus norvegicus
gccaccaacctgagtatccctgaga

SEQ ID NO: 390595 - DNA, 25 bp, Rattus norvegicus
gccaccaacctgtgtatccctgaga

SEQ ID NO: 390596 - DNA, 25 bp, Rattus norvegicus
gccaccaagcagatgctgggacttg

SEQ ID NO: 390597 - DNA, 25 bp, Rattus norvegicus
gccaccaagcagttgctgggacttg

SEQ ID NO: 390598 - DNA, 25 bp, Rattus norvegicus
gccaccaaggatccagccagcgaag

SEQ ID NO: 390599 - DNA, 25 bp, Rattus norvegicus
gccaccaaggatgcagccagcgaag

SEQ ID NO: 390600 - DNA, 25 bp, Rattus norvegicus
gccaccaatgcccactattttaaga

SEQ ID NO: 390601 - DNA, 25 bp, Rattus norvegicus
gccaccaatgccgactattttaaga

SEQ ID NO: 390602 - DNA, 25 bp, Rattus norvegicus
gccaccaatggtaacttcctgtgat

SEQ ID NO: 390603 - DNA, 25 bp, Rattus norvegicus
gccaccaatggttacttcctgtgat

SEQ ID NO: 390604 - DNA, 25 bp, Rattus norvegicus
gccaccaatgttcaacaggcattca

SEQ ID NO: 390605 - DNA, 25 bp, Rattus norvegicus
gccaccaatgttgaacaggcattca

SEQ ID NO: 390606 - DNA, 25 bp, Rattus norvegicus
gccaccaattttacgtgcttttttg

SEQ ID NO: 390607 - DNA, 25 bp, Rattus norvegicus
gccaccaatttttcgtgcttttttg

SEQ ID NO: 390608 - DNA, 25 bp, Rattus norvegicus
gccaccacaaccacttacaagtatg

SEQ ID NO: 390609 - DNA, 25 bp, Rattus norvegicus
gccaccacaacctcttacaagtatg

SEQ ID NO: 390610 - DNA, 25 bp, Rattus norvegicus
gccaccaccacgagaaaccaagtgt

SEQ ID NO: 390611 - DNA, 25 bp, Rattus norvegicus
gccaccaccacgtgaaaccaagtgt

SEQ ID NO: 390612 - DNA, 25 bp, Rattus norvegicus
gccaccaccttcaagttttctaagt

SEQ ID NO: 390613 - DNA, 25 bp, Rattus norvegicus
gccaccaccttctagttttctaagt

SEQ ID NO: 390614 - DNA, 25 bp, Rattus norvegicus
gccaccacgggcagaaactttgatg

SEQ ID NO: 390615 - DNA, 25 bp, Rattus norvegicus
gccaccacgggctgaaactttgatg

SEQ ID NO: 390616 - DNA, 25 bp, Rattus norvegicus
gccaccacggtgacagtactgcagg

SEQ ID NO: 390617 - DNA, 25 bp, Rattus norvegicus
gccaccacggtgtcagtactgcagg

SEQ ID NO: 390618 - DNA, 25 bp, Rattus norvegicus
gccaccacgttcaagagagcagcaa

SEQ ID NO: 390619 - DNA, 25 bp, Rattus norvegicus
gccaccacgttctagagagcagcaa

SEQ ID NO: 390620 - DNA, 25 bp, Rattus norvegicus
gccaccactggcagagaacatacta

SEQ ID NO: 390621 - DNA, 25 bp, Rattus norvegicus
gccaccactggctgagaacatacta

SEQ ID NO: 390622 - DNA, 25 bp, Rattus norvegicus
gccaccagatgacgcaccgcggtga

SEQ ID NO: 390623 - DNA, 25 bp, Rattus norvegicus
gccaccagatgaggcaccgcggtga

SEQ ID NO: 390624 - DNA, 25 bp, Rattus norvegicus
gccaccagcaccatttctgttaagg

SEQ ID NO: 390625 - DNA, 25 bp, Rattus norvegicus
gccaccagcaccttttctgttaagg

SEQ ID NO: 390626 - DNA, 25 bp, Rattus norvegicus
gccaccagcctaacatgagacgttg

SEQ ID NO: 390627 - DNA, 25 bp, Rattus norvegicus
gccaccagcctatcatgagacgttg

SEQ ID NO: 390628 - DNA, 25 bp, Rattus norvegicus
gccaccagcctcagtgctctgtgtg

SEQ ID NO: 390629 - DNA, 25 bp, Rattus norvegicus
gccaccagcctctgtgctctgtgtg

SEQ ID NO: 390630 - DNA, 25 bp, Rattus norvegicus
gccaccagcgcaagtaccggcgata

SEQ ID NO: 390631 - DNA, 25 bp, Rattus norvegicus
gccaccagcgcatgtaccggcgata

SEQ ID NO: 390632 - DNA, 25 bp, Rattus norvegicus
gccaccagcgtcaggacacatgtaa

SEQ ID NO: 390633 - DNA, 25 bp, Rattus norvegicus
gccaccagcgtcatcacaatagtaa

SEQ ID NO: 390634 - DNA, 25 bp, Rattus norvegicus
gccaccagcgtctggacacatgtaa

SEQ ID NO: 390635 - DNA, 25 bp, Rattus norvegicus
gccaccagcgtcttcacaatagtaa

SEQ ID NO: 390636 - DNA, 25 bp, Rattus norvegicus
gccaccagtcgaatttacccgaagg

SEQ ID NO: 390637 - DNA, 25 bp, Rattus norvegicus
gccaccagtcgattttacccgaagg

SEQ ID NO: 390638 - DNA, 25 bp, Rattus norvegicus
gccaccatacacatcatcaatctga

SEQ ID NO: 390639 - DNA, 25 bp, Rattus norvegicus
gccaccatacacttcatcaatctga

SEQ ID NO: 390640 - DNA, 25 bp, Rattus norvegicus
gccaccatacccagtcatgttttat

SEQ ID NO: 390641 - DNA, 25 bp, Rattus norvegicus
gccaccataccctgtcatgttttat

SEQ ID NO: 390642 - DNA, 25 bp, Rattus norvegicus
gccaccatatggctcctgagaattg

SEQ ID NO: 390643 - DNA, 25 bp, Rattus norvegicus
gccaccatatgggtcctgagaattg

SEQ ID NO: 390644 - DNA, 25 bp, Rattus norvegicus
gccaccatcaccacaaacagtatgt

SEQ ID NO: 390645 - DNA, 25 bp, Rattus norvegicus
gccaccatcacctcaaacagtatgt

SEQ ID NO: 390646 - DNA, 25 bp, Rattus norvegicus
gccaccatcctgatttgtctgattt

SEQ ID NO: 390647 - DNA, 25 bp, Rattus norvegicus
gccaccatcctgttttgtctgattt

SEQ ID NO: 390648 - DNA, 25 bp, Rattus norvegicus
gccaccatccttaatgagatcctga

SEQ ID NO: 390649 - DNA, 25 bp, Rattus norvegicus
gccaccatcctttatgagatcctga

SEQ ID NO: 390650 - DNA, 25 bp, Rattus norvegicus
gccaccatggtgacaggatctttgt

SEQ ID NO: 390651 - DNA, 25 bp, Rattus norvegicus
gccaccatggtgtcaggatctttgt

SEQ ID NO: 390652 - DNA, 25 bp, Rattus norvegicus
gccaccatgtgaactctgttactga

SEQ ID NO: 390653 - DNA, 25 bp, Rattus norvegicus
gccaccatgtgatctctgttactga

SEQ ID NO: 390654 - DNA, 25 bp, Rattus norvegicus
gccaccattaccatctgttaagttc

SEQ ID NO: 390655 - DNA, 25 bp, Rattus norvegicus
gccaccattaccttctgttaagttc

SEQ ID NO: 390656 - DNA, 25 bp, Rattus norvegicus
gccaccattctcagctagaactagt

SEQ ID NO: 390657 - DNA, 25 bp, Rattus norvegicus
gccaccattctctgctagaactagt

SEQ ID NO: 390658 - DNA, 25 bp, Rattus norvegicus
gccaccattgcaatgaggaagatca

SEQ ID NO: 390659 - DNA, 25 bp, Rattus norvegicus
gccaccattgcattgaggaagatca

SEQ ID NO: 390660 - DNA, 25 bp, Rattus norvegicus
gccaccatttctataggcagctctg

SEQ ID NO: 390661 - DNA, 25 bp, Rattus norvegicus
gccaccatttctttaggcagctctg

SEQ ID NO: 390662 - DNA, 25 bp, Rattus norvegicus
gccaccatttttacttcagcgataa

SEQ ID NO: 390663 - DNA, 25 bp, Rattus norvegicus
gccaccattttttcttcagcgataa

SEQ ID NO: 390664 - DNA, 25 bp, Rattus norvegicus
gccacccacattcttacttgatgaa

SEQ ID NO: 390665 - DNA, 25 bp, Rattus norvegicus
gccacccacattgttacttgatgaa

SEQ ID NO: 390666 - DNA, 25 bp, Rattus norvegicus
gccacccagaaacccaaagattcaa

SEQ ID NO: 390667 - DNA, 25 bp, Rattus norvegicus
gccacccagaaacctgttggagctt

SEQ ID NO: 390668 - DNA, 25 bp, Rattus norvegicus
gccacccagaaagccaaagattcaa

SEQ ID NO: 390669 - DNA, 25 bp, Rattus norvegicus
gccacccagaaagctgttggagctt

SEQ ID NO: 390670 - DNA, 25 bp, Rattus norvegicus
gccacccagctaccagttttaataa

SEQ ID NO: 390671 - DNA, 25 bp, Rattus norvegicus
gccacccagctagcagttttaataa

SEQ ID NO: 390672 - DNA, 25 bp, Rattus norvegicus
gccacccaggtactttcaaatgatg

SEQ ID NO: 390673 - DNA, 25 bp, Rattus norvegicus
gccacccaggtagtttcaaatgatg

SEQ ID NO: 390674 - DNA, 25 bp, Rattus norvegicus
gccacccaggtgctcagagacagaa

SEQ ID NO: 390675 - DNA, 25 bp, Rattus norvegicus
gccacccaggtggtcagagacagaa

SEQ ID NO: 390676 - DNA, 25 bp, Rattus norvegicus
gccacccatattacctgtgtgaatt

SEQ ID NO: 390677 - DNA, 25 bp, Rattus norvegicus
gccacccatatttcctgtgtgaatt

SEQ ID NO: 390678 - DNA, 25 bp, Rattus norvegicus
gccacccatctgctgaatggcattt

SEQ ID NO: 390679 - DNA, 25 bp, Rattus norvegicus
gccacccatctggtgaatggcattt

SEQ ID NO: 390680 - DNA, 25 bp, Rattus norvegicus
gccacccatcttaagaattccagga

SEQ ID NO: 390681 - DNA, 25 bp, Rattus norvegicus
gccacccatctttagaattccagga

SEQ ID NO: 390682 - DNA, 25 bp, Rattus norvegicus
gccaccccagggatacaaaacagtt

SEQ ID NO: 390683 - DNA, 25 bp, Rattus norvegicus
gccaccccagggttacaaaacagtt

SEQ ID NO: 390684 - DNA, 25 bp, Rattus norvegicus
gccaccccgtaaaaggtcactaaca

SEQ ID NO: 390685 - DNA, 25 bp, Rattus norvegicus
gccaccccgtaataggtcactaaca

SEQ ID NO: 390686 - DNA, 25 bp, Rattus norvegicus
gccacccctgagaaaatctgatttc

SEQ ID NO: 390687 - DNA, 25 bp, Rattus norvegicus
gccacccctgagtaaatctgatttc

SEQ ID NO: 390688 - DNA, 25 bp, Rattus norvegicus
gccacccgaggcagaagttgacgtt

SEQ ID NO: 390689 - DNA, 25 bp, Rattus norvegicus
gccacccgaggctgaagttgacgtt

SEQ ID NO: 390690 - DNA, 25 bp, Rattus norvegicus
gccaccctacccagcaagaatattt

SEQ ID NO: 390691 - DNA, 25 bp, Rattus norvegicus
gccaccctaccctgcaagaatattt

SEQ ID NO: 390692 - DNA, 25 bp, Rattus norvegicus
gccaccctcacgcaatcatgattat

SEQ ID NO: 390693 - DNA, 25 bp, Rattus norvegicus
gccaccctcacggaatcatgattat

SEQ ID NO: 390694 - DNA, 25 bp, Rattus norvegicus
gccaccctgctaaatgatcttttgt

SEQ ID NO: 390695 - DNA, 25 bp, Rattus norvegicus
gccaccctgctatatgatcttttgt

SEQ ID NO: 390696 - DNA, 25 bp, Rattus norvegicus
gccaccctggccaagagagataata

SEQ ID NO: 390697 - DNA, 25 bp, Rattus norvegicus
gccaccctggcctagagagataata

SEQ ID NO: 390698 - DNA, 25 bp, Rattus norvegicus
gccacccttactatctcagagagta

SEQ ID NO: 390699 - DNA, 25 bp, Rattus norvegicus
gccacccttactttctcagagagta

SEQ ID NO: 390700 - DNA, 25 bp, Rattus norvegicus
gccacccttctgatgtaaacgctag

SEQ ID NO: 390701 - DNA, 25 bp, Rattus norvegicus
gccacccttctgttgtaaacgctag

SEQ ID NO: 390702 - DNA, 25 bp, Rattus norvegicus
gccaccctttcaatccctattgaaa

SEQ ID NO: 390703 - DNA, 25 bp, Rattus norvegicus
gccaccctttcattccctattgaaa

SEQ ID NO: 390704 - DNA, 25 bp, Rattus norvegicus
gccaccgagaatccagtctctttaa

SEQ ID NO: 390705 - DNA, 25 bp, Rattus norvegicus
gccaccgagaatgcagtctctttaa

SEQ ID NO: 390706 - DNA, 25 bp, Rattus norvegicus
gccaccgatgttcccgctgaggatg

SEQ ID NO: 390707 - DNA, 25 bp, Rattus norvegicus
gccaccgatgttgccgctgaggatg

SEQ ID NO: 390708 - DNA, 25 bp, Rattus norvegicus
gccaccgccactcagaaattacaaa

SEQ ID NO: 390709 - DNA, 25 bp, Rattus norvegicus
gccaccgccactgagaaattacaaa

SEQ ID NO: 390710 - DNA, 25 bp, Rattus norvegicus
gccaccggccttcctgagaagtatt

SEQ ID NO: 390711 - DNA, 25 bp, Rattus norvegicus
gccaccggccttgctgagaagtatt

SEQ ID NO: 390712 - DNA, 25 bp, Rattus norvegicus
gccaccgggaaacccaccagtaagg

SEQ ID NO: 390713 - DNA, 25 bp, Rattus norvegicus
gccaccgggaaagccaccagtaagg

SEQ ID NO: 390714 - DNA, 25 bp, Rattus norvegicus
gccaccgtatttccaagtgaggact

SEQ ID NO: 390715 - DNA, 25 bp, Rattus norvegicus
gccaccgtatttgcaagtgaggact

SEQ ID NO: 390716 - DNA, 25 bp, Rattus norvegicus
gccaccgtcattataattccattct

SEQ ID NO: 390717 - DNA, 25 bp, Rattus norvegicus
gccaccgtcattttaattccattct

SEQ ID NO: 390718 - DNA, 25 bp, Rattus norvegicus
gccacctaatgaacaggccctgtaa

SEQ ID NO: 390719 - DNA, 25 bp, Rattus norvegicus
gccacctaatgatcaggccctgtaa

SEQ ID NO: 390720 - DNA, 25 bp, Rattus norvegicus
gccacctacaacacggacagggata

SEQ ID NO: 390721 - DNA, 25 bp, Rattus norvegicus
gccacctacaactcggacagggata

SEQ ID NO: 390722 - DNA, 25 bp, Rattus norvegicus
gccacctacctgaggacttgatgta

SEQ ID NO: 390723 - DNA, 25 bp, Rattus norvegicus
gccacctacctgtggacttgatgta

SEQ ID NO: 390724 - DNA, 25 bp, Rattus norvegicus
gccacctactggctgcatatggaat

SEQ ID NO: 390725 - DNA, 25 bp, Rattus norvegicus
gccacctactgggtgcatatggaat

SEQ ID NO: 390726 - DNA, 25 bp, Rattus norvegicus
gccacctagtggctctatgtattaa

SEQ ID NO: 390727 - DNA, 25 bp, Rattus norvegicus
gccacctagtgggtctatgtattaa

SEQ ID NO: 390728 - DNA, 25 bp, Rattus norvegicus
gccacctatggccttttgtacaatt

SEQ ID NO: 390729 - DNA, 25 bp, Rattus norvegicus
gccacctatggcgttttgtacaatt

SEQ ID NO: 390730 - DNA, 25 bp, Rattus norvegicus
gccacctcaccgcattgtatattaa

SEQ ID NO: 390731 - DNA, 25 bp, Rattus norvegicus
gccacctcaccggattgtatattaa

SEQ ID NO: 390732 - DNA, 25 bp, Rattus norvegicus
gccacctcagacactttgtgacaag

SEQ ID NO: 390733 - DNA, 25 bp, Rattus norvegicus
gccacctcagactctttgtgacaag

SEQ ID NO: 390734 - DNA, 25 bp, Rattus norvegicus
gccacctcaggtcacacagtgtatt

SEQ ID NO: 390735 - DNA, 25 bp, Rattus norvegicus
gccacctcaggtgacacagtgtatt

SEQ ID NO: 390736 - DNA, 25 bp, Rattus norvegicus
gccacctcggcgactggaagagcaa

SEQ ID NO: 390737 - DNA, 25 bp, Rattus norvegicus
gccacctcggcgtctggaagagcaa

SEQ ID NO: 390738 - DNA, 25 bp, Rattus norvegicus
gccacctctccactgtgatgtatgt

SEQ ID NO: 390739 - DNA, 25 bp, Rattus norvegicus
gccacctctccagtgtgatgtatgt

SEQ ID NO: 390740 - DNA, 25 bp, Rattus norvegicus
gccacctctgacaccattataaaat

SEQ ID NO: 390741 - DNA, 25 bp, Rattus norvegicus
gccacctctgactccattataaaat

SEQ ID NO: 390742 - DNA, 25 bp, Rattus norvegicus
gccacctctgcactgtgtattagta

SEQ ID NO: 390743 - DNA, 25 bp, Rattus norvegicus
gccacctctgcagtgtgtattagta

SEQ ID NO: 390744 - DNA, 25 bp, Rattus norvegicus
gccacctctgggagtgaagaggaac

SEQ ID NO: 390745 - DNA, 25 bp, Rattus norvegicus
gccacctctgggtgtgaagaggaac

SEQ ID NO: 390746 - DNA, 25 bp, Rattus norvegicus
gccacctctgtgaagacctgagttc

SEQ ID NO: 390747 - DNA, 25 bp, Rattus norvegicus
gccacctctgtgtagacctgagttc

SEQ ID NO: 390748 - DNA, 25 bp, Rattus norvegicus
gccacctgacatcctaaacatttat

SEQ ID NO: 390749 - DNA, 25 bp, Rattus norvegicus
gccacctgacatgctaaacatttat

SEQ ID NO: 390750 - DNA, 25 bp, Rattus norvegicus
gccacctgacgactactgctttgat

SEQ ID NO: 390751 - DNA, 25 bp, Rattus norvegicus
gccacctgacgagtactgctttgat

SEQ ID NO: 390752 - DNA, 25 bp, Rattus norvegicus
gccacctgacttaaatcaacttctg

SEQ ID NO: 390753 - DNA, 25 bp, Rattus norvegicus
gccacctgacttatagctactttta

SEQ ID NO: 390754 - DNA, 25 bp, Rattus norvegicus
gccacctgacttcgtctctgataat

SEQ ID NO: 390755 - DNA, 25 bp, Rattus norvegicus
gccacctgacttggtctctgataat

SEQ ID NO: 390756 - DNA, 25 bp, Rattus norvegicus
gccacctgactttaatcaacttctg

SEQ ID NO: 390757 - DNA, 25 bp, Rattus norvegicus
gccacctgacttttagctactttta

SEQ ID NO: 390758 - DNA, 25 bp, Rattus norvegicus
gccacctgagccaacgtagtactat

SEQ ID NO: 390759 - DNA, 25 bp, Rattus norvegicus
gccacctgagcctacgtagtactat

SEQ ID NO: 390760 - DNA, 25 bp, Rattus norvegicus
gccacctgcagccttgttgataaat

SEQ ID NO: 390761 - DNA, 25 bp, Rattus norvegicus
gccacctgcagcgttgttgataaat

SEQ ID NO: 390762 - DNA, 25 bp, Rattus norvegicus
gccacctgcaggcatagaaataaca

SEQ ID NO: 390763 - DNA, 25 bp, Rattus norvegicus
gccacctgcagggatagaaataaca

SEQ ID NO: 390764 - DNA, 25 bp, Rattus norvegicus
gccacctgcatcactgagtcaaatg

SEQ ID NO: 390765 - DNA, 25 bp, Rattus norvegicus
gccacctgcatctctgagtcaaatg

SEQ ID NO: 390766 - DNA, 25 bp, Rattus norvegicus
gccacctgctcaagtatcttatttg

SEQ ID NO: 390767 - DNA, 25 bp, Rattus norvegicus
gccacctgctcatgtatcttatttg

SEQ ID NO: 390768 - DNA, 25 bp, Rattus norvegicus
gccacctggagcagattctgaacaa

SEQ ID NO: 390769 - DNA, 25 bp, Rattus norvegicus
gccacctggagctgattctgaacaa

SEQ ID NO: 390770 - DNA, 25 bp, Rattus norvegicus
gccacctggcttaaatggttttcca

SEQ ID NO: 390771 - DNA, 25 bp, Rattus norvegicus
gccacctggctttaatggttttcca

SEQ ID NO: 390772 - DNA, 25 bp, Rattus norvegicus
gccacctgggtcaatgttgagctga

SEQ ID NO: 390773 - DNA, 25 bp, Rattus norvegicus
gccacctgggtctatgttgagctga

SEQ ID NO: 390774 - DNA, 25 bp, Rattus norvegicus
gccacctggtgtccttagctgggaa

SEQ ID NO: 390775 - DNA, 25 bp, Rattus norvegicus
gccacctggtgtgcttagctgggaa

SEQ ID NO: 390776 - DNA, 25 bp, Rattus norvegicus
gccacctgtggaatgattcacatcc

SEQ ID NO: 390777 - DNA, 25 bp, Rattus norvegicus
gccacctgtggattgattcacatcc

SEQ ID NO: 390778 - DNA, 25 bp, Rattus norvegicus
gccacctgttgcatgtagaggctgg

SEQ ID NO: 390779 - DNA, 25 bp, Rattus norvegicus
gccacctgttgcttgtagaggctgg

SEQ ID NO: 390780 - DNA, 25 bp, Rattus norvegicus
gccaccttctataattttcatcact

SEQ ID NO: 390781 - DNA, 25 bp, Rattus norvegicus
gccaccttctattattttcatcact

SEQ ID NO: 390782 - DNA, 25 bp, Rattus norvegicus
gccaccttctctcttgtgagcaagg

SEQ ID NO: 390783 - DNA, 25 bp, Rattus norvegicus
gccaccttctctgttgtgagcaagg

SEQ ID NO: 390784 - DNA, 25 bp, Rattus norvegicus
gccaccttgatgacattcggcagga

SEQ ID NO: 390785 - DNA, 25 bp, Rattus norvegicus
gccaccttgatgtcattcggcagga

SEQ ID NO: 390786 - DNA, 25 bp, Rattus norvegicus
gccaccttgcctcagaaacagttga

SEQ ID NO: 390787 - DNA, 25 bp, Rattus norvegicus
gccaccttgcctgagaaacagttga

SEQ ID NO: 390788 - DNA, 25 bp, Rattus norvegicus
gccaccttgggaagccatccttgag

SEQ ID NO: 390789 - DNA, 25 bp, Rattus norvegicus
gccaccttgggatgccatccttgag

SEQ ID NO: 390790 - DNA, 25 bp, Rattus norvegicus
gccaccttgggcagcagagtttaca

SEQ ID NO: 390791 - DNA, 25 bp, Rattus norvegicus
gccaccttgggctgcagagtttaca

SEQ ID NO: 390792 - DNA, 25 bp, Rattus norvegicus
gccaccttgtataaaccctgatgta

SEQ ID NO: 390793 - DNA, 25 bp, Rattus norvegicus
gccaccttgtattaaccctgatgta

SEQ ID NO: 390794 - DNA, 25 bp, Rattus norvegicus
gccacctttatgaacagctgcggga

SEQ ID NO: 390795 - DNA, 25 bp, Rattus norvegicus
gccacctttatgtacagctgcggga

SEQ ID NO: 390796 - DNA, 25 bp, Rattus norvegicus
gccacctttgtgatggatgtttaca

SEQ ID NO: 390797 - DNA, 25 bp, Rattus norvegicus
gccacctttgtgttggatgtttaca

SEQ ID NO: 390798 - DNA, 25 bp, Rattus norvegicus
gccaccttttacacttactatcaaa

SEQ ID NO: 390799 - DNA, 25 bp, Rattus norvegicus
gccaccttttactcttactatcaaa

SEQ ID NO: 390800 - DNA, 25 bp, Rattus norvegicus
gccacgaagctccactggcgagcta

SEQ ID NO: 390801 - DNA, 25 bp, Rattus norvegicus
gccacgaagctcgactggcgagcta

SEQ ID NO: 390802 - DNA, 25 bp, Rattus norvegicus
gccacgacagccagtgtgttcctga

SEQ ID NO: 390803 - DNA, 25 bp, Rattus norvegicus
gccacgacagcctgtgtgttcctga

SEQ ID NO: 390804 - DNA, 25 bp, Rattus norvegicus
gccacgacccggactggaaaacatt

SEQ ID NO: 390805 - DNA, 25 bp, Rattus norvegicus
gccacgacccggtctggaaaacatt

SEQ ID NO: 390806 - DNA, 25 bp, Rattus norvegicus
gccacgagaaatacaagcggacctt

SEQ ID NO: 390807 - DNA, 25 bp, Rattus norvegicus
gccacgagaaattcaagcggacctt

SEQ ID NO: 390808 - DNA, 25 bp, Rattus norvegicus
gccacgagaagtacattccttgttt

SEQ ID NO: 390809 - DNA, 25 bp, Rattus norvegicus
gccacgagaagttcattccttgttt

SEQ ID NO: 390810 - DNA, 25 bp, Rattus norvegicus
gccacgagtcctccatgaagaaact

SEQ ID NO: 390811 - DNA, 25 bp, Rattus norvegicus
gccacgagtcctgcatgaagaaact

SEQ ID NO: 390812 - DNA, 25 bp, Rattus norvegicus
gccacgagtttcagagcagctggac

SEQ ID NO: 390813 - DNA, 25 bp, Rattus norvegicus
gccacgagtttctgagcagctggac

SEQ ID NO: 390814 - DNA, 25 bp, Rattus norvegicus
gccacgagttttccttcagagcaag

SEQ ID NO: 390815 - DNA, 25 bp, Rattus norvegicus
gccacgagttttgcttcagagcaag

SEQ ID NO: 390816 - DNA, 25 bp, Rattus norvegicus
gccacgattcgacttgttgaggttg

SEQ ID NO: 390817 - DNA, 25 bp, Rattus norvegicus
gccacgattcgagttgttgaggttg

SEQ ID NO: 390818 - DNA, 25 bp, Rattus norvegicus
gccacgcagctaacaggacctgtga

SEQ ID NO: 390819 - DNA, 25 bp, Rattus norvegicus
gccacgcagctatcaggacctgtga

SEQ ID NO: 390820 - DNA, 25 bp, Rattus norvegicus
gccacgcattgaatcgcactgaaat

SEQ ID NO: 390821 - DNA, 25 bp, Rattus norvegicus
gccacgcattgattcgcactgaaat

SEQ ID NO: 390822 - DNA, 25 bp, Rattus norvegicus
gccacgcgctctatgaaatcagcaa

SEQ ID NO: 390823 - DNA, 25 bp, Rattus norvegicus
gccacgcgctctttgaaatcagcaa

SEQ ID NO: 390824 - DNA, 25 bp, Rattus norvegicus
gccacgctggctacttaagtactag

SEQ ID NO: 390825 - DNA, 25 bp, Rattus norvegicus
gccacgctggcttcttaagtactag

SEQ ID NO: 390826 - DNA, 25 bp, Rattus norvegicus
gccacgctttgcacggagctggcga

SEQ ID NO: 390827 - DNA, 25 bp, Rattus norvegicus
gccacgctttgctcggagctggcga

SEQ ID NO: 390828 - DNA, 25 bp, Rattus norvegicus
gccacggacaacagaccagttgctt

SEQ ID NO: 390829 - DNA, 25 bp, Rattus norvegicus
gccacggacaactgaccagttgctt

SEQ ID NO: 390830 - DNA, 25 bp, Rattus norvegicus
gccacggcatgtacgagcataagcc

SEQ ID NO: 390831 - DNA, 25 bp, Rattus norvegicus
gccacggcatgttcgagcataagcc

SEQ ID NO: 390832 - DNA, 25 bp, Rattus norvegicus
gccacggcttggcaaataagaactt

SEQ ID NO: 390833 - DNA, 25 bp, Rattus norvegicus
gccacggcttgggaaataagaactt

SEQ ID NO: 390834 - DNA, 25 bp, Rattus norvegicus
gccacgggaatgagccactgcagta

SEQ ID NO: 390835 - DNA, 25 bp, Rattus norvegicus
gccacgggaatgtgccactgcagta

SEQ ID NO: 390836 - DNA, 25 bp, Rattus norvegicus
gccacgggactcatgacggatctgt

SEQ ID NO: 390837 - DNA, 25 bp, Rattus norvegicus
gccacgggactcttgacggatctgt

SEQ ID NO: 390838 - DNA, 25 bp, Rattus norvegicus
gccacgggagtgatgacggactatc

SEQ ID NO: 390839 - DNA, 25 bp, Rattus norvegicus
gccacgggagtgttgacggactatc

SEQ ID NO: 390840 - DNA, 25 bp, Rattus norvegicus
gccacgggcgtgaaaccaacggagt

SEQ ID NO: 390841 - DNA, 25 bp, Rattus norvegicus
gccacgggcgtgtaaccaacggagt

SEQ ID NO: 390842 - DNA, 25 bp, Rattus norvegicus
gccacgggtccaatagttatcaaat

SEQ ID NO: 390843 - DNA, 25 bp, Rattus norvegicus
gccacgggtccattagttatcaaat

SEQ ID NO: 390844 - DNA, 25 bp, Rattus norvegicus
gccacgggttccagctgatcttcag

SEQ ID NO: 390845 - DNA, 25 bp, Rattus norvegicus
gccacgggttcctgctgatcttcag

SEQ ID NO: 390846 - DNA, 25 bp, Rattus norvegicus
gccacggtcgctcttcctggaaaga

SEQ ID NO: 390847 - DNA, 25 bp, Rattus norvegicus
gccacggtcgctgttcctggaaaga

SEQ ID NO: 390848 - DNA, 25 bp, Rattus norvegicus
gccacggtggtgcaggaactcttca

SEQ ID NO: 390849 - DNA, 25 bp, Rattus norvegicus
gccacggtggtggaggaactcttca

SEQ ID NO: 390850 - DNA, 25 bp, Rattus norvegicus
gccacggttgctccggtcatcttga

SEQ ID NO: 390851 - DNA, 25 bp, Rattus norvegicus
gccacggttgctgcggtcatcttga

SEQ ID NO: 390852 - DNA, 25 bp, Rattus norvegicus
gccacggtttctcttaaacacgtca

SEQ ID NO: 390853 - DNA, 25 bp, Rattus norvegicus
gccacggtttctgttaaacacgtca

SEQ ID NO: 390854 - DNA, 25 bp, Rattus norvegicus
gccacgtacctccaacaatgcaaag

SEQ ID NO: 390855 - DNA, 25 bp, Rattus norvegicus
gccacgtacctcgaacaatgcaaag

SEQ ID NO: 390856 - DNA, 25 bp, Rattus norvegicus
gccacgtgcaaacagtgtgccaggt

SEQ ID NO: 390857 - DNA, 25 bp, Rattus norvegicus
gccacgtgcaaagagtgtgccaggt

SEQ ID NO: 390858 - DNA, 25 bp, Rattus norvegicus
gccacgtgtggcatctctccaagga

SEQ ID NO: 390859 - DNA, 25 bp, Rattus norvegicus
gccacgtgtggcttctctccaagga

SEQ ID NO: 390860 - DNA, 25 bp, Rattus norvegicus
gccacgttcgctcctttattaaagt

SEQ ID NO: 390861 - DNA, 25 bp, Rattus norvegicus
gccacgttcgctgctttattaaagt

SEQ ID NO: 390862 - DNA, 25 bp, Rattus norvegicus
gccacgttggtcacgtaatcacaca

SEQ ID NO: 390863 - DNA, 25 bp, Rattus norvegicus
gccacgttggtcatggtgttaagtg

SEQ ID NO: 390864 - DNA, 25 bp, Rattus norvegicus
gccacgttggtctcgtaatcacaca

SEQ ID NO: 390865 - DNA, 25 bp, Rattus norvegicus
gccacgttggtcttggtgttaagtg

SEQ ID NO: 390866 - DNA, 25 bp, Rattus norvegicus
gccacgttttgcctgttcgggactc

SEQ ID NO: 390867 - DNA, 25 bp, Rattus norvegicus
gccacgttttgcgtgttcgggactc

SEQ ID NO: 390868 - DNA, 25 bp, Rattus norvegicus
gccactaagtctatttattctgtga

SEQ ID NO: 390869 - DNA, 25 bp, Rattus norvegicus
gccactaagtctttttattctgtga

SEQ ID NO: 390870 - DNA, 25 bp, Rattus norvegicus
gccactacatggcaggttaggatta

SEQ ID NO: 390871 - DNA, 25 bp, Rattus norvegicus
gccactacatgggaggttaggatta

SEQ ID NO: 390872 - DNA, 25 bp, Rattus norvegicus
gccactacctctacgatgttcagag

SEQ ID NO: 390873 - DNA, 25 bp, Rattus norvegicus
gccactacctcttcgatgttcagag

SEQ ID NO: 390874 - DNA, 25 bp, Rattus norvegicus
gccactactgtcagcgcgggatgga

SEQ ID NO: 390875 - DNA, 25 bp, Rattus norvegicus
gccactactgtctgcgcgggatgga

SEQ ID NO: 390876 - DNA, 25 bp, Rattus norvegicus
gccactatcatgatcgtgctgggca

SEQ ID NO: 390877 - DNA, 25 bp, Rattus norvegicus
gccactatcatgttcgtgctgggca

SEQ ID NO: 390878 - DNA, 25 bp, Rattus norvegicus
gccactcaacttcaggcaggaatgt

SEQ ID NO: 390879 - DNA, 25 bp, Rattus norvegicus
gccactcaacttgaggcaggaatgt

SEQ ID NO: 390880 - DNA, 25 bp, Rattus norvegicus
gccactcaagcaaacaattcacata

SEQ ID NO: 390881 - DNA, 25 bp, Rattus norvegicus
gccactcaagcatacaattcacata

SEQ ID NO: 390882 - DNA, 25 bp, Rattus norvegicus
gccactcacatcaatgatcctaaca

SEQ ID NO: 390883 - DNA, 25 bp, Rattus norvegicus
gccactcacatctatgatcctaaca

SEQ ID NO: 390884 - DNA, 25 bp, Rattus norvegicus
gccactcacctgctgaataacattt

SEQ ID NO: 390885 - DNA, 25 bp, Rattus norvegicus
gccactcacctggtgaataacattt

SEQ ID NO: 390886 - DNA, 25 bp, Rattus norvegicus
gccactcagattatagacctgcgag

SEQ ID NO: 390887 - DNA, 25 bp, Rattus norvegicus
gccactcagattttagacctgcgag

SEQ ID NO: 390888 - DNA, 25 bp, Rattus norvegicus
gccactccacccatagggagcaaat

SEQ ID NO: 390889 - DNA, 25 bp, Rattus norvegicus
gccactccacccttagggagcaaat

SEQ ID NO: 390890 - DNA, 25 bp, Rattus norvegicus
gccactcccttaactcctagagaaa

SEQ ID NO: 390891 - DNA, 25 bp, Rattus norvegicus
gccactcccttatctcctagagaaa

SEQ ID NO: 390892 - DNA, 25 bp, Rattus norvegicus
gccactcctaccatgagttgagttc

SEQ ID NO: 390893 - DNA, 25 bp, Rattus norvegicus
gccactcctaccttgagttgagttc

SEQ ID NO: 390894 - DNA, 25 bp, Rattus norvegicus
gccactcctcggaaaggatctcgta

SEQ ID NO: 390895 - DNA, 25 bp, Rattus norvegicus
gccactcctcggtaaggatctcgta

SEQ ID NO: 390896 - DNA, 25 bp, Rattus norvegicus
gccactcctggccattggacataag

SEQ ID NO: 390897 - DNA, 25 bp, Rattus norvegicus
gccactcctggcgattggacataag

SEQ ID NO: 390898 - DNA, 25 bp, Rattus norvegicus
gccactcggaagatctgaggttgga

SEQ ID NO: 390899 - DNA, 25 bp, Rattus norvegicus
gccactcggaagttctgaggttgga

SEQ ID NO: 390900 - DNA, 25 bp, Rattus norvegicus
gccactctaattaacttcttatgtt

SEQ ID NO: 390901 - DNA, 25 bp, Rattus norvegicus
gccactctaatttacttcttatgtt

SEQ ID NO: 390902 - DNA, 25 bp, Rattus norvegicus
gccactctagagacctattatcttt

SEQ ID NO: 390903 - DNA, 25 bp, Rattus norvegicus
gccactctagagtcctattatcttt

SEQ ID NO: 390904 - DNA, 25 bp, Rattus norvegicus
gccactctcccaagaggatttgtga

SEQ ID NO: 390905 - DNA, 25 bp, Rattus norvegicus
gccactctcccatgaggatttgtga

SEQ ID NO: 390906 - DNA, 25 bp, Rattus norvegicus
gccactctcgaaacacgttaacttt

SEQ ID NO: 390907 - DNA, 25 bp, Rattus norvegicus
gccactctcgaatcacgttaacttt

SEQ ID NO: 390908 - DNA, 25 bp, Rattus norvegicus
gccactctgctgatgaaacaagcct

SEQ ID NO: 390909 - DNA, 25 bp, Rattus norvegicus
gccactctgctgttgaaacaagcct

SEQ ID NO: 390910 - DNA, 25 bp, Rattus norvegicus
gccactctgtaccaggattgccgaa

SEQ ID NO: 390911 - DNA, 25 bp, Rattus norvegicus
gccactctgtacgaggattgccgaa

SEQ ID NO: 390912 - DNA, 25 bp, Rattus norvegicus
gccactcttaacaaatcttaatgta

SEQ ID NO: 390913 - DNA, 25 bp, Rattus norvegicus
gccactcttaactaatcttaatgta

SEQ ID NO: 390914 - DNA, 25 bp, Rattus norvegicus
gccactcttgtgcaggctgcactat

SEQ ID NO: 390915 - DNA, 25 bp, Rattus norvegicus
gccactcttgtggaggctgcactat

SEQ ID NO: 390916 - DNA, 25 bp, Rattus norvegicus
gccactgaagatcaggacaaccttc

SEQ ID NO: 390917 - DNA, 25 bp, Rattus norvegicus
gccactgaagatgaggacaaccttc

SEQ ID NO: 390918 - DNA, 25 bp, Rattus norvegicus
gccactgaagccaggacattcttta

SEQ ID NO: 390919 - DNA, 25 bp, Rattus norvegicus
gccactgaagcctggacattcttta

SEQ ID NO: 390920 - DNA, 25 bp, Rattus norvegicus
gccactgaagctcactgagatgaga

SEQ ID NO: 390921 - DNA, 25 bp, Rattus norvegicus
gccactgaagctgactgagatgaga

SEQ ID NO: 390922 - DNA, 25 bp, Rattus norvegicus
gccactgaatggaacgctgaccttg

SEQ ID NO: 390923 - DNA, 25 bp, Rattus norvegicus
gccactgaatggtacgctgaccttg

SEQ ID NO: 390924 - DNA, 25 bp, Rattus norvegicus
gccactgaattgaacccttcaaaaa

SEQ ID NO: 390925 - DNA, 25 bp, Rattus norvegicus
gccactgaattgtacccttcaaaaa

SEQ ID NO: 390926 - DNA, 25 bp, Rattus norvegicus
gccactgacttcctttgatcatttt

SEQ ID NO: 390927 - DNA, 25 bp, Rattus norvegicus
gccactgacttcgtttgatcatttt

SEQ ID NO: 390928 - DNA, 25 bp, Rattus norvegicus
gccactgagaacaaggattagacta

SEQ ID NO: 390929 - DNA, 25 bp, Rattus norvegicus
gccactgagaactaggattagacta

SEQ ID NO: 390930 - DNA, 25 bp, Rattus norvegicus
gccactgagacgcagcagaccttgt

SEQ ID NO: 390931 - DNA, 25 bp, Rattus norvegicus
gccactgagacggagcagaccttgt

SEQ ID NO: 390932 - DNA, 25 bp, Rattus norvegicus
gccactgagagccaccatggaggaa

SEQ ID NO: 390933 - DNA, 25 bp, Rattus norvegicus
gccactgagagcgaccatggaggaa

SEQ ID NO: 390934 - DNA, 25 bp, Rattus norvegicus
gccactgagagtatgaccattccta

SEQ ID NO: 390935 - DNA, 25 bp, Rattus norvegicus
gccactgagagtttgaccattccta

SEQ ID NO: 390936 - DNA, 25 bp, Rattus norvegicus
gccactgagctgacttcttttggaa

SEQ ID NO: 390937 - DNA, 25 bp, Rattus norvegicus
gccactgagctgtcttcttttggaa

SEQ ID NO: 390938 - DNA, 25 bp, Rattus norvegicus
gccactgagcttctgtgcttattat

SEQ ID NO: 390939 - DNA, 25 bp, Rattus norvegicus
gccactgagcttgtgtgcttattat

SEQ ID NO: 390940 - DNA, 25 bp, Rattus norvegicus
gccactgagggcaaaggagtcctta

SEQ ID NO: 390941 - DNA, 25 bp, Rattus norvegicus
gccactgagggctaaggagtcctta

SEQ ID NO: 390942 - DNA, 25 bp, Rattus norvegicus
gccactgagtggattcggttattat

SEQ ID NO: 390943 - DNA, 25 bp, Rattus norvegicus
gccactgagtggcttggagccacca

SEQ ID NO: 390944 - DNA, 25 bp, Rattus norvegicus
gccactgagtgggttggagccacca

SEQ ID NO: 390945 - DNA, 25 bp, Rattus norvegicus
gccactgagtggtttcggttattat

SEQ ID NO: 390946 - DNA, 25 bp, Rattus norvegicus
gccactgagtttcaagagccccgag

SEQ ID NO: 390947 - DNA, 25 bp, Rattus norvegicus
gccactgagtttgaagagccccgag

SEQ ID NO: 390948 - DNA, 25 bp, Rattus norvegicus
gccactgatccgattttagttctga

SEQ ID NO: 390949 - DNA, 25 bp, Rattus norvegicus
gccactgatccgtttttagttctga

SEQ ID NO: 390950 - DNA, 25 bp, Rattus norvegicus
gccactgccaccaggtttatattat

SEQ ID NO: 390951 - DNA, 25 bp, Rattus norvegicus
gccactgccacctggtttatattat

SEQ ID NO: 390952 - DNA, 25 bp, Rattus norvegicus
gccactgccagcctgactaggagag

SEQ ID NO: 390953 - DNA, 25 bp, Rattus norvegicus
gccactgccagcgtgactaggagag

SEQ ID NO: 390954 - DNA, 25 bp, Rattus norvegicus
gccactgccatacctaggaacactt

SEQ ID NO: 390955 - DNA, 25 bp, Rattus norvegicus
gccactgccatagctaggaacactt

SEQ ID NO: 390956 - DNA, 25 bp, Rattus norvegicus
gccactgcccacagaaagggatctt

SEQ ID NO: 390957 - DNA, 25 bp, Rattus norvegicus
gccactgcccactgaaagggatctt

SEQ ID NO: 390958 - DNA, 25 bp, Rattus norvegicus
gccactgcgggcatgtttagcatga

SEQ ID NO: 390959 - DNA, 25 bp, Rattus norvegicus
gccactgcgggcattttgggaaata

SEQ ID NO: 390960 - DNA, 25 bp, Rattus norvegicus
gccactgcgggcttgtttagcatga

SEQ ID NO: 390961 - DNA, 25 bp, Rattus norvegicus
gccactgcgggctttttgggaaata

SEQ ID NO: 390962 - DNA, 25 bp, Rattus norvegicus
gccactgctaataccaagtttccat

SEQ ID NO: 390963 - DNA, 25 bp, Rattus norvegicus
gccactgctaattccaagtttccat

SEQ ID NO: 390964 - DNA, 25 bp, Rattus norvegicus
gccactgctctgacaattgctttat

SEQ ID NO: 390965 - DNA, 25 bp, Rattus norvegicus
gccactgctctgtcaattgctttat

SEQ ID NO: 390966 - DNA, 25 bp, Rattus norvegicus
gccactgctcttcagaattacagaa

SEQ ID NO: 390967 - DNA, 25 bp, Rattus norvegicus
gccactgctcttgagaattacagaa

SEQ ID NO: 390968 - DNA, 25 bp, Rattus norvegicus
gccactgctggaaaggttccccact

SEQ ID NO: 390969 - DNA, 25 bp, Rattus norvegicus
gccactgctggataggttccccact

SEQ ID NO: 390970 - DNA, 25 bp, Rattus norvegicus
gccactggaagtcaccatggattga

SEQ ID NO: 390971 - DNA, 25 bp, Rattus norvegicus
gccactggaagtgaccatggattga

SEQ ID NO: 390972 - DNA, 25 bp, Rattus norvegicus
gccactggcactaagagctggttgg

SEQ ID NO: 390973 - DNA, 25 bp, Rattus norvegicus
gccactggcacttagagctggttgg

SEQ ID NO: 390974 - DNA, 25 bp, Rattus norvegicus
gccactggcataatcagtcttttgt

SEQ ID NO: 390975 - DNA, 25 bp, Rattus norvegicus
gccactggcatattcagtcttttgt

SEQ ID NO: 390976 - DNA, 25 bp, Rattus norvegicus
gccactgggaacagggattggacta

SEQ ID NO: 390977 - DNA, 25 bp, Rattus norvegicus
gccactgggaactgggattggacta

SEQ ID NO: 390978 - DNA, 25 bp, Rattus norvegicus
gccactgggagaccgtatttacaaa

SEQ ID NO: 390979 - DNA, 25 bp, Rattus norvegicus
gccactgggagagcgtatttacaaa

SEQ ID NO: 390980 - DNA, 25 bp, Rattus norvegicus
gccactggtattacctaccaacatg

SEQ ID NO: 390981 - DNA, 25 bp, Rattus norvegicus
gccactggtatttcctaccaacatg

SEQ ID NO: 390982 - DNA, 25 bp, Rattus norvegicus
gccactggtcacatttctactaaat

SEQ ID NO: 390983 - DNA, 25 bp, Rattus norvegicus
gccactggtcacctggaaatgcaaa

SEQ ID NO: 390984 - DNA, 25 bp, Rattus norvegicus
gccactggtcacgtggaaatgcaaa

SEQ ID NO: 390985 - DNA, 25 bp, Rattus norvegicus
gccactggtcacttttctactaaat

SEQ ID NO: 390986 - DNA, 25 bp, Rattus norvegicus
gccactggtcttattgagtccacta

SEQ ID NO: 390987 - DNA, 25 bp, Rattus norvegicus
gccactggtctttttgagtccacta

SEQ ID NO: 390988 - DNA, 25 bp, Rattus norvegicus
gccactggtgttccaactgtctaaa

SEQ ID NO: 390989 - DNA, 25 bp, Rattus norvegicus
gccactggtgttgcaactgtctaaa

SEQ ID NO: 390990 - DNA, 25 bp, Rattus norvegicus
gccactgtaaggaccaaggctacaa

SEQ ID NO: 390991 - DNA, 25 bp, Rattus norvegicus
gccactgtaaggtccaaggctacaa

SEQ ID NO: 390992 - DNA, 25 bp, Rattus norvegicus
gccactgtacatacagatattattt

SEQ ID NO: 390993 - DNA, 25 bp, Rattus norvegicus
gccactgtacattcagatattattt

SEQ ID NO: 390994 - DNA, 25 bp, Rattus norvegicus
gccactgtcaacagcaattgccgaa

SEQ ID NO: 390995 - DNA, 25 bp, Rattus norvegicus
gccactgtcaactgcaattgccgaa

SEQ ID NO: 390996 - DNA, 25 bp, Rattus norvegicus
gccactgtcagcacttgggtcaaat

SEQ ID NO: 390997 - DNA, 25 bp, Rattus norvegicus
gccactgtcagctcttgggtcaaat

SEQ ID NO: 390998 - DNA, 25 bp, Rattus norvegicus
gccactgtccaaagatctccataga

SEQ ID NO: 390999 - DNA, 25 bp, Rattus norvegicus
gccactgtccaatgatctccataga

SEQ ID NO: 391000 - DNA, 25 bp, Rattus norvegicus
gccactgtccaccttagagcaggaa

SEQ ID NO: 391001 - DNA, 25 bp, Rattus norvegicus
gccactgtccacgttagagcaggaa

SEQ ID NO: 391002 - DNA, 25 bp, Rattus norvegicus
gccactgtccagagagtctgtgaga

SEQ ID NO: 391003 - DNA, 25 bp, Rattus norvegicus
gccactgtccagtgagtctgtgaga

SEQ ID NO: 391004 - DNA, 25 bp, Rattus norvegicus
gccactgtcccaattaccaaattat

SEQ ID NO: 391005 - DNA, 25 bp, Rattus norvegicus
gccactgtcccatttaccaaattat

SEQ ID NO: 391006 - DNA, 25 bp, Rattus norvegicus
gccactgtctgaaattctgggccaa

SEQ ID NO: 391007 - DNA, 25 bp, Rattus norvegicus
gccactgtctgatattctgggccaa

SEQ ID NO: 391008 - DNA, 25 bp, Rattus norvegicus
gccactgtgattcttgttctgtttc

SEQ ID NO: 391009 - DNA, 25 bp, Rattus norvegicus
gccactgtgattgttgttctgtttc

SEQ ID NO: 391010 - DNA, 25 bp, Rattus norvegicus
gccactgtggcaaatgtttatctga

SEQ ID NO: 391011 - DNA, 25 bp, Rattus norvegicus
gccactgtggcatatgtttatctga

SEQ ID NO: 391012 - DNA, 25 bp, Rattus norvegicus
gccactgtgtcaacgatgagcggac

SEQ ID NO: 391013 - DNA, 25 bp, Rattus norvegicus
gccactgtgtcatcgatgagcggac

SEQ ID NO: 391014 - DNA, 25 bp, Rattus norvegicus
gccactgtgtttccaggatacgctg

SEQ ID NO: 391015 - DNA, 25 bp, Rattus norvegicus
gccactgtgtttgcaggatacgctg

SEQ ID NO: 391016 - DNA, 25 bp, Rattus norvegicus
gccactgttaccacacgaggttcgg

SEQ ID NO: 391017 - DNA, 25 bp, Rattus norvegicus
gccactgttacctcacgaggttcgg

SEQ ID NO: 391018 - DNA, 25 bp, Rattus norvegicus
gccactgttgaccatctatttgtat

SEQ ID NO: 391019 - DNA, 25 bp, Rattus norvegicus
gccactgttgacgatctatttgtat

SEQ ID NO: 391020 - DNA, 25 bp, Rattus norvegicus
gccactgttgcaagttttagatgtt

SEQ ID NO: 391021 - DNA, 25 bp, Rattus norvegicus
gccactgttgcatgttttagatgtt

SEQ ID NO: 391022 - DNA, 25 bp, Rattus norvegicus
gccactgttggcatcaacggacact

SEQ ID NO: 391023 - DNA, 25 bp, Rattus norvegicus
gccactgttggcttcaacggacact

SEQ ID NO: 391024 - DNA, 25 bp, Rattus norvegicus
gccactgttgttcgctgtgtgacag

SEQ ID NO: 391025 - DNA, 25 bp, Rattus norvegicus
gccactgttgttggctgtgtgacag

SEQ ID NO: 391026 - DNA, 25 bp, Rattus norvegicus
gccactgtttatcctgaaccccaaa

SEQ ID NO: 391027 - DNA, 25 bp, Rattus norvegicus
gccactgtttatgctgaaccccaaa

SEQ ID NO: 391028 - DNA, 25 bp, Rattus norvegicus
gccacttaaacaagccatctatcca

SEQ ID NO: 391029 - DNA, 25 bp, Rattus norvegicus
gccacttaaacatgccatctatcca

SEQ ID NO: 391030 - DNA, 25 bp, Rattus norvegicus
gccacttaatttactctgttgttcc

SEQ ID NO: 391031 - DNA, 25 bp, Rattus norvegicus
gccacttaattttctctgttgttcc

SEQ ID NO: 391032 - DNA, 25 bp, Rattus norvegicus
gccacttacttcatatcctttttta

SEQ ID NO: 391033 - DNA, 25 bp, Rattus norvegicus
gccacttacttcttatcctttttta

SEQ ID NO: 391034 - DNA, 25 bp, Rattus norvegicus
gccacttacttgaccaatgagctta

SEQ ID NO: 391035 - DNA, 25 bp, Rattus norvegicus
gccacttacttgtccaatgagctta

SEQ ID NO: 391036 - DNA, 25 bp, Rattus norvegicus
gccacttataatactgtcagcagga

SEQ ID NO: 391037 - DNA, 25 bp, Rattus norvegicus
gccacttataattctgtcagcagga

SEQ ID NO: 391038 - DNA, 25 bp, Rattus norvegicus
gccacttatttcattatcttctcca

SEQ ID NO: 391039 - DNA, 25 bp, Rattus norvegicus
gccacttatttctttatcttctcca

SEQ ID NO: 391040 - DNA, 25 bp, Rattus norvegicus
gccacttcaggcaagtaagctgctt

SEQ ID NO: 391041 - DNA, 25 bp, Rattus norvegicus
gccacttcaggctagtaagctgctt

SEQ ID NO: 391042 - DNA, 25 bp, Rattus norvegicus
gccacttcagttaagttcatttgaa

SEQ ID NO: 391043 - DNA, 25 bp, Rattus norvegicus
gccacttcagttcttttaattttgc

SEQ ID NO: 391044 - DNA, 25 bp, Rattus norvegicus
gccacttcagttgttttaattttgc

SEQ ID NO: 391045 - DNA, 25 bp, Rattus norvegicus
gccacttcagtttagttcatttgaa

SEQ ID NO: 391046 - DNA, 25 bp, Rattus norvegicus
gccacttcatgaaggactgtcccat

SEQ ID NO: 391047 - DNA, 25 bp, Rattus norvegicus
gccacttcatgatggactgtcccat

SEQ ID NO: 391048 - DNA, 25 bp, Rattus norvegicus
gccacttcccataggcttggagttg

SEQ ID NO: 391049 - DNA, 25 bp, Rattus norvegicus
gccacttcccattggcttggagttg

SEQ ID NO: 391050 - DNA, 25 bp, Rattus norvegicus
gccacttcctgcatagtgagatagt

SEQ ID NO: 391051 - DNA, 25 bp, Rattus norvegicus
gccacttcctgcttagtgagatagt

SEQ ID NO: 391052 - DNA, 25 bp, Rattus norvegicus
gccacttcgcggatcagcacctgag

SEQ ID NO: 391053 - DNA, 25 bp, Rattus norvegicus
gccacttcgcggttcagcacctgag

SEQ ID NO: 391054 - DNA, 25 bp, Rattus norvegicus
gccacttcgtgcctcggttctggaa

SEQ ID NO: 391055 - DNA, 25 bp, Rattus norvegicus
gccacttcgtgcgtcggttctggaa

SEQ ID NO: 391056 - DNA, 25 bp, Rattus norvegicus
gccacttctggcaaacttggaaaat

SEQ ID NO: 391057 - DNA, 25 bp, Rattus norvegicus
gccacttctggctaacttggaaaat

SEQ ID NO: 391058 - DNA, 25 bp, Rattus norvegicus
gccacttgaagacctaactacactt

SEQ ID NO: 391059 - DNA, 25 bp, Rattus norvegicus
gccacttgaagagctaactacactt

SEQ ID NO: 391060 - DNA, 25 bp, Rattus norvegicus
gccacttgaattcgtcttgccagca

SEQ ID NO: 391061 - DNA, 25 bp, Rattus norvegicus
gccacttgaattggtcttgccagca

SEQ ID NO: 391062 - DNA, 25 bp, Rattus norvegicus
gccacttgcacacaggcagcattta

SEQ ID NO: 391063 - DNA, 25 bp, Rattus norvegicus
gccacttgcacagaggcagcattta

SEQ ID NO: 391064 - DNA, 25 bp, Rattus norvegicus
gccacttgctgtcccaaatggaaca

SEQ ID NO: 391065 - DNA, 25 bp, Rattus norvegicus
gccacttgctgtgccaaatggaaca

SEQ ID NO: 391066 - DNA, 25 bp, Rattus norvegicus
gccacttggtccaccgattttggaa

SEQ ID NO: 391067 - DNA, 25 bp, Rattus norvegicus
gccacttggtcctccgattttggaa

SEQ ID NO: 391068 - DNA, 25 bp, Rattus norvegicus
gccacttgtgtaacatcaatcttaa

SEQ ID NO: 391069 - DNA, 25 bp, Rattus norvegicus
gccacttgtgtatcatcaatcttaa

SEQ ID NO: 391070 - DNA, 25 bp, Rattus norvegicus
gccacttgtgtgatgttgggcgaca

SEQ ID NO: 391071 - DNA, 25 bp, Rattus norvegicus
gccacttgtgtgttgttgggcgaca

SEQ ID NO: 391072 - DNA, 25 bp, Rattus norvegicus
gccacttgttggcattcaagttaaa

SEQ ID NO: 391073 - DNA, 25 bp, Rattus norvegicus
gccacttgttgggattcaagttaaa

SEQ ID NO: 391074 - DNA, 25 bp, Rattus norvegicus
gccacttgtttaccgttggataact

SEQ ID NO: 391075 - DNA, 25 bp, Rattus norvegicus
gccacttgtttagcgttggataact

SEQ ID NO: 391076 - DNA, 25 bp, Rattus norvegicus
gccactttactgattaagaatctat

SEQ ID NO: 391077 - DNA, 25 bp, Rattus norvegicus
gccactttactgtttaagaatctat

SEQ ID NO: 391078 - DNA, 25 bp, Rattus norvegicus
gccactttgaagaatcaggctcctg

SEQ ID NO: 391079 - DNA, 25 bp, Rattus norvegicus
gccactttgaagtatcaggctcctg

SEQ ID NO: 391080 - DNA, 25 bp, Rattus norvegicus
gccactttgacccttgaaggagcct

SEQ ID NO: 391081 - DNA, 25 bp, Rattus norvegicus
gccactttgaccgttgaaggagcct

SEQ ID NO: 391082 - DNA, 25 bp, Rattus norvegicus
gccactttgagaacttaggtcctgt

SEQ ID NO: 391083 - DNA, 25 bp, Rattus norvegicus
gccactttgagatcttaggtcctgt

SEQ ID NO: 391084 - DNA, 25 bp, Rattus norvegicus
gccactttgtgactgcatagctcaa

SEQ ID NO: 391085 - DNA, 25 bp, Rattus norvegicus
gccactttgtgagtgcatagctcaa

SEQ ID NO: 391086 - DNA, 25 bp, Rattus norvegicus
gccactttgttgaagcatccacttg

SEQ ID NO: 391087 - DNA, 25 bp, Rattus norvegicus
gccactttgttgtagcatccacttg

SEQ ID NO: 391088 - DNA, 25 bp, Rattus norvegicus
gccacttttaacaacaaccaccaat

SEQ ID NO: 391089 - DNA, 25 bp, Rattus norvegicus
gccacttttaactacaaccaccaat

SEQ ID NO: 391090 - DNA, 25 bp, Rattus norvegicus
gccacttttagcactagttccagga

SEQ ID NO: 391091 - DNA, 25 bp, Rattus norvegicus
gccacttttagctctagttccagga

SEQ ID NO: 391092 - DNA, 25 bp, Rattus norvegicus
gccagaaaaagtcttccagagatgg

SEQ ID NO: 391093 - DNA, 25 bp, Rattus norvegicus
gccagaaaaagtgttccagagatgg

SEQ ID NO: 391094 - DNA, 25 bp, Rattus norvegicus
gccagaaacccaagcctgggctgag

SEQ ID NO: 391095 - DNA, 25 bp, Rattus norvegicus
gccagaaacccatgcctgggctgag

SEQ ID NO: 391096 - DNA, 25 bp, Rattus norvegicus
gccagaaataaacctcatagacctc

SEQ ID NO: 391097 - DNA, 25 bp, Rattus norvegicus
gccagaaataaagctcatagacctc

SEQ ID NO: 391098 - DNA, 25 bp, Rattus norvegicus
gccagaaccacacgtctgctgttaa

SEQ ID NO: 391099 - DNA, 25 bp, Rattus norvegicus
gccagaaccacaggtctgctgttaa

SEQ ID NO: 391100 - DNA, 25 bp, Rattus norvegicus
gccagaacctgccagctaggagctg

SEQ ID NO: 391101 - DNA, 25 bp, Rattus norvegicus
gccagaacctgcgagctaggagctg

SEQ ID NO: 391102 - DNA, 25 bp, Rattus norvegicus
gccagaacctggacaacgtgtacca

SEQ ID NO: 391103 - DNA, 25 bp, Rattus norvegicus
gccagaacctggtcaacgtgtacca

SEQ ID NO: 391104 - DNA, 25 bp, Rattus norvegicus
gccagaaccttgcaggagccttaag

SEQ ID NO: 391105 - DNA, 25 bp, Rattus norvegicus
gccagaaccttggaggagccttaag

SEQ ID NO: 391106 - DNA, 25 bp, Rattus norvegicus
gccagaactcggctggtggctttca

SEQ ID NO: 391107 - DNA, 25 bp, Rattus norvegicus
gccagaactcgggtggtggctttca

SEQ ID NO: 391108 - DNA, 25 bp, Rattus norvegicus
gccagaactgcactctttcgatgat

SEQ ID NO: 391109 - DNA, 25 bp, Rattus norvegicus
gccagaactgcagtctttcgatgat

SEQ ID NO: 391110 - DNA, 25 bp, Rattus norvegicus
gccagaactgctcgtacagcctgca

SEQ ID NO: 391111 - DNA, 25 bp, Rattus norvegicus
gccagaactgctggtacagcctgca

SEQ ID NO: 391112 - DNA, 25 bp, Rattus norvegicus
gccagaacttatatctcctgtggtt

SEQ ID NO: 391113 - DNA, 25 bp, Rattus norvegicus
gccagaacttatttctcctgtggtt

SEQ ID NO: 391114 - DNA, 25 bp, Rattus norvegicus
gccagaagaattcagcacccttgct

SEQ ID NO: 391115 - DNA, 25 bp, Rattus norvegicus
gccagaagaattgagcacccttgct

SEQ ID NO: 391116 - DNA, 25 bp, Rattus norvegicus
gccagaagacccctacaggtgctgg

SEQ ID NO: 391117 - DNA, 25 bp, Rattus norvegicus
gccagaagacccgtacaggtgctgg

SEQ ID NO: 391118 - DNA, 25 bp, Rattus norvegicus
gccagaagagccaagtagcccatct

SEQ ID NO: 391119 - DNA, 25 bp, Rattus norvegicus
gccagaagagcctagtagcccatct

SEQ ID NO: 391120 - DNA, 25 bp, Rattus norvegicus
gccagaagctggctttgtcgcaaaa

SEQ ID NO: 391121 - DNA, 25 bp, Rattus norvegicus
gccagaagctgggtttgtcgcaaaa

SEQ ID NO: 391122 - DNA, 25 bp, Rattus norvegicus
gccagaaggactaggtcatcgccaa

SEQ ID NO: 391123 - DNA, 25 bp, Rattus norvegicus
gccagaaggacttggtcatcgccaa

SEQ ID NO: 391124 - DNA, 25 bp, Rattus norvegicus
gccagaaggtaccacttacgggtat

SEQ ID NO: 391125 - DNA, 25 bp, Rattus norvegicus
gccagaaggtacgacttacgggtat

SEQ ID NO: 391126 - DNA, 25 bp, Rattus norvegicus
gccagaaggtgaagagcaagtgaac

SEQ ID NO: 391127 - DNA, 25 bp, Rattus norvegicus
gccagaaggtgatgagcaagtgaac

SEQ ID NO: 391128 - DNA, 25 bp, Rattus norvegicus
gccagaagtgagctcatgccagtag

SEQ ID NO: 391129 - DNA, 25 bp, Rattus norvegicus
gccagaagtgaggtcatgccagtag

SEQ ID NO: 391130 - DNA, 25 bp, Rattus norvegicus
gccagaagtgccaagacatgtccga

SEQ ID NO: 391131 - DNA, 25 bp, Rattus norvegicus
gccagaagtgcctagacatgtccga

SEQ ID NO: 391132 - DNA, 25 bp, Rattus norvegicus
gccagaataggcacgtagggtttaa

SEQ ID NO: 391133 - DNA, 25 bp, Rattus norvegicus
gccagaataggctcgtagggtttaa

SEQ ID NO: 391134 - DNA, 25 bp, Rattus norvegicus
gccagaatcctgaacgaacgaaact

SEQ ID NO: 391135 - DNA, 25 bp, Rattus norvegicus
gccagaatcctgtacgaacgaaact

SEQ ID NO: 391136 - DNA, 25 bp, Rattus norvegicus
gccagaatctcaatactgcttcatt

SEQ ID NO: 391137 - DNA, 25 bp, Rattus norvegicus
gccagaatctcattactgcttcatt

SEQ ID NO: 391138 - DNA, 25 bp, Rattus norvegicus
gccagaatgagtagaccaggaagaa

SEQ ID NO: 391139 - DNA, 25 bp, Rattus norvegicus
gccagaatgagttgaccaggaagaa

SEQ ID NO: 391140 - DNA, 25 bp, Rattus norvegicus
gccagaatgctaatgctatgcgact

SEQ ID NO: 391141 - DNA, 25 bp, Rattus norvegicus
gccagaatgctattgctatgcgact

SEQ ID NO: 391142 - DNA, 25 bp, Rattus norvegicus
gccagaatgtggcacagtgctacag

SEQ ID NO: 391143 - DNA, 25 bp, Rattus norvegicus
gccagaatgtgggacagtgctacag

SEQ ID NO: 391144 - DNA, 25 bp, Rattus norvegicus
gccagaatttcaaccaggcggccgg

SEQ ID NO: 391145 - DNA, 25 bp, Rattus norvegicus
gccagaatttcatccaggcggccgg

SEQ ID NO: 391146 - DNA, 25 bp, Rattus norvegicus
gccagaattttacttgctccttaat

SEQ ID NO: 391147 - DNA, 25 bp, Rattus norvegicus
gccagaattttagttgctccttaat

SEQ ID NO: 391148 - DNA, 25 bp, Rattus norvegicus
gccagaattttgaatctcctttgat

SEQ ID NO: 391149 - DNA, 25 bp, Rattus norvegicus
gccagaattttgtatctcctttgat

SEQ ID NO: 391150 - DNA, 25 bp, Rattus norvegicus
gccagacaaagaagattccccttct

SEQ ID NO: 391151 - DNA, 25 bp, Rattus norvegicus
gccagacaaagatgattccccttct

SEQ ID NO: 391152 - DNA, 25 bp, Rattus norvegicus
gccagacaacctcctatgataacaa

SEQ ID NO: 391153 - DNA, 25 bp, Rattus norvegicus
gccagacaacctgctatgataacaa

SEQ ID NO: 391154 - DNA, 25 bp, Rattus norvegicus
gccagacacagcaagcactttggag

SEQ ID NO: 391155 - DNA, 25 bp, Rattus norvegicus
gccagacacagctagcactttggag

SEQ ID NO: 391156 - DNA, 25 bp, Rattus norvegicus
gccagacactttatgactacattta

SEQ ID NO: 391157 - DNA, 25 bp, Rattus norvegicus
gccagacactttttgactacattta

SEQ ID NO: 391158 - DNA, 25 bp, Rattus norvegicus
gccagacagctaaacagggatgcta

SEQ ID NO: 391159 - DNA, 25 bp, Rattus norvegicus
gccagacagctatacagggatgcta

SEQ ID NO: 391160 - DNA, 25 bp, Rattus norvegicus
gccagacatctgctttcgttgaaat

SEQ ID NO: 391161 - DNA, 25 bp, Rattus norvegicus
gccagacatctggtttcgttgaaat

SEQ ID NO: 391162 - DNA, 25 bp, Rattus norvegicus
gccagaccacgtatccaagtagtaa

SEQ ID NO: 391163 - DNA, 25 bp, Rattus norvegicus
gccagaccacgtttccaagtagtaa

SEQ ID NO: 391164 - DNA, 25 bp, Rattus norvegicus
gccagaccaggtaacttatgtattc

SEQ ID NO: 391165 - DNA, 25 bp, Rattus norvegicus
gccagaccaggttacttatgtattc

SEQ ID NO: 391166 - DNA, 25 bp, Rattus norvegicus
gccagaccctgaaggaccatgtaca

SEQ ID NO: 391167 - DNA, 25 bp, Rattus norvegicus
gccagaccctgatggaccatgtaca

SEQ ID NO: 391168 - DNA, 25 bp, Rattus norvegicus
gccagaccgaaaacggcgatcgcgt

SEQ ID NO: 391169 - DNA, 25 bp, Rattus norvegicus
gccagaccgaaatcggcgatcgcgt

SEQ ID NO: 391170 - DNA, 25 bp, Rattus norvegicus
gccagacctgctccatttcaaggag

SEQ ID NO: 391171 - DNA, 25 bp, Rattus norvegicus
gccagacctgctgcatttcaaggag

SEQ ID NO: 391172 - DNA, 25 bp, Rattus norvegicus
gccagaccttctcctgttagacgaa

SEQ ID NO: 391173 - DNA, 25 bp, Rattus norvegicus
gccagaccttctgctgttagacgaa

SEQ ID NO: 391174 - DNA, 25 bp, Rattus norvegicus
gccagacgggcaagaattcaaattc

SEQ ID NO: 391175 - DNA, 25 bp, Rattus norvegicus
gccagacgggcatgaattcaaattc

SEQ ID NO: 391176 - DNA, 25 bp, Rattus norvegicus
gccagacgtaaacagctccgaatta

SEQ ID NO: 391177 - DNA, 25 bp, Rattus norvegicus
gccagacgtaaagagctccgaatta

SEQ ID NO: 391178 - DNA, 25 bp, Rattus norvegicus
gccagacgtgctagcccaattagga

SEQ ID NO: 391179 - DNA, 25 bp, Rattus norvegicus
gccagacgtgcttgcccaattagga

SEQ ID NO: 391180 - DNA, 25 bp, Rattus norvegicus
gccagactactgcacttggaggatc

SEQ ID NO: 391181 - DNA, 25 bp, Rattus norvegicus
gccagactactggacttggaggatc

SEQ ID NO: 391182 - DNA, 25 bp, Rattus norvegicus
gccagactataccttgtgtagcttc

SEQ ID NO: 391183 - DNA, 25 bp, Rattus norvegicus
gccagactatacgttgtgtagcttc

SEQ ID NO: 391184 - DNA, 25 bp, Rattus norvegicus
gccagactcaagctttgttgggctg

SEQ ID NO: 391185 - DNA, 25 bp, Rattus norvegicus
gccagactcaaggtttgttgggctg

SEQ ID NO: 391186 - DNA, 25 bp, Rattus norvegicus
gccagactctaaaacagccagcgat

SEQ ID NO: 391187 - DNA, 25 bp, Rattus norvegicus
gccagactctaatacagccagcgat

SEQ ID NO: 391188 - DNA, 25 bp, Rattus norvegicus
gccagactgatcactgcagatgaat

SEQ ID NO: 391189 - DNA, 25 bp, Rattus norvegicus
gccagactgatctctgcagatgaat

SEQ ID NO: 391190 - DNA, 25 bp, Rattus norvegicus
gccagacttcctatttgttgtgata

SEQ ID NO: 391191 - DNA, 25 bp, Rattus norvegicus
gccagacttcctttttgttgtgata

SEQ ID NO: 391192 - DNA, 25 bp, Rattus norvegicus
gccagacttgtcattatacaccaga

SEQ ID NO: 391193 - DNA, 25 bp, Rattus norvegicus
gccagacttgtctttatacaccaga

SEQ ID NO: 391194 - DNA, 25 bp, Rattus norvegicus
gccagactttaaccaggaggcgtat

SEQ ID NO: 391195 - DNA, 25 bp, Rattus norvegicus
gccagactttaagcaggaggcgtat

SEQ ID NO: 391196 - DNA, 25 bp, Rattus norvegicus
gccagagaaaccaaatgttccaagg

SEQ ID NO: 391197 - DNA, 25 bp, Rattus norvegicus
gccagagaaacctaatgttccaagg

SEQ ID NO: 391198 - DNA, 25 bp, Rattus norvegicus
gccagagaagatcctgaaccggatt

SEQ ID NO: 391199 - DNA, 25 bp, Rattus norvegicus
gccagagaagatgctgaaccggatt

SEQ ID NO: 391200 - DNA, 25 bp, Rattus norvegicus
gccagagagcctcccaggatgcagt

SEQ ID NO: 391201 - DNA, 25 bp, Rattus norvegicus
gccagagagcctgccaggatgcagt

SEQ ID NO: 391202 - DNA, 25 bp, Rattus norvegicus
gccagagagtgacgctatagaatct

SEQ ID NO: 391203 - DNA, 25 bp, Rattus norvegicus
gccagagagtgaggctatagaatct

SEQ ID NO: 391204 - DNA, 25 bp, Rattus norvegicus
gccagagatgctcttggagatctgt

SEQ ID NO: 391205 - DNA, 25 bp, Rattus norvegicus
gccagagatgctgttggagatctgt

SEQ ID NO: 391206 - DNA, 25 bp, Rattus norvegicus
gccagagcaactatgatcaccatca

SEQ ID NO: 391207 - DNA, 25 bp, Rattus norvegicus
gccagagcaactttgatcaccatca

SEQ ID NO: 391208 - DNA, 25 bp, Rattus norvegicus
gccagagcagcgcaagccacagagc

SEQ ID NO: 391209 - DNA, 25 bp, Rattus norvegicus
gccagagcagcggaagccacagagc

SEQ ID NO: 391210 - DNA, 25 bp, Rattus norvegicus
gccagagcatggacacgccttagaa

SEQ ID NO: 391211 - DNA, 25 bp, Rattus norvegicus
gccagagcatggtcacgccttagaa

SEQ ID NO: 391212 - DNA, 25 bp, Rattus norvegicus
gccagagcatttacagttcttatat

SEQ ID NO: 391213 - DNA, 25 bp, Rattus norvegicus
gccagagcattttcagttcttatat

SEQ ID NO: 391214 - DNA, 25 bp, Rattus norvegicus
gccagagcccaaatcacaaggtcag

SEQ ID NO: 391215 - DNA, 25 bp, Rattus norvegicus
gccagagcccaattcacaaggtcag

SEQ ID NO: 391216 - DNA, 25 bp, Rattus norvegicus
gccagagcctcgcattcattcaggc

SEQ ID NO: 391217 - DNA, 25 bp, Rattus norvegicus
gccagagcctcggattcattcaggc

SEQ ID NO: 391218 - DNA, 25 bp, Rattus norvegicus
gccagagcctgcctatttgagagag

SEQ ID NO: 391219 - DNA, 25 bp, Rattus norvegicus
gccagagcctgcgtatttgagagag

SEQ ID NO: 391220 - DNA, 25 bp, Rattus norvegicus
gccagagctaccaatgggcagcaca

SEQ ID NO: 391221 - DNA, 25 bp, Rattus norvegicus
gccagagctacctatgggcagcaca

SEQ ID NO: 391222 - DNA, 25 bp, Rattus norvegicus
gccagagctcctcaagcaatagcat

SEQ ID NO: 391223 - DNA, 25 bp, Rattus norvegicus
gccagagctcctgaagcaatagcat

SEQ ID NO: 391224 - DNA, 25 bp, Rattus norvegicus
gccagagcttgcacagctgagagtc

SEQ ID NO: 391225 - DNA, 25 bp, Rattus norvegicus
gccagagcttgctcagctgagagtc

SEQ ID NO: 391226 - DNA, 25 bp, Rattus norvegicus
gccagaggaccaagcttttgaagat

SEQ ID NO: 391227 - DNA, 25 bp, Rattus norvegicus
gccagaggaccatgcttttgaagat

SEQ ID NO: 391228 - DNA, 25 bp, Rattus norvegicus
gccagaggactcatctttagtggga

SEQ ID NO: 391229 - DNA, 25 bp, Rattus norvegicus
gccagaggactcttctttagtggga

SEQ ID NO: 391230 - DNA, 25 bp, Rattus norvegicus
gccagaggcaagcactagccagact

SEQ ID NO: 391231 - DNA, 25 bp, Rattus norvegicus
gccagaggcaaggactagccagact

SEQ ID NO: 391232 - DNA, 25 bp, Rattus norvegicus
gccagaggcaggaaaggacagactt

SEQ ID NO: 391233 - DNA, 25 bp, Rattus norvegicus
gccagaggcaggtaaggacagactt

SEQ ID NO: 391234 - DNA, 25 bp, Rattus norvegicus
gccagaggcctgagagaatgtgcta

SEQ ID NO: 391235 - DNA, 25 bp, Rattus norvegicus
gccagaggcctgtgagaatgtgcta

SEQ ID NO: 391236 - DNA, 25 bp, Rattus norvegicus
gccagaggctgtctttatccatgaa

SEQ ID NO: 391237 - DNA, 25 bp, Rattus norvegicus
gccagaggctgtgtttatccatgaa

SEQ ID NO: 391238 - DNA, 25 bp, Rattus norvegicus
gccagagggtggaactttgtttcct

SEQ ID NO: 391239 - DNA, 25 bp, Rattus norvegicus
gccagagggtggtactttgtttcct

SEQ ID NO: 391240 - DNA, 25 bp, Rattus norvegicus
gccagaggtctgaggttattcgaac

SEQ ID NO: 391241 - DNA, 25 bp, Rattus norvegicus
gccagaggtctgtggttattcgaac

SEQ ID NO: 391242 - DNA, 25 bp, Rattus norvegicus
gccagaggtgaacacaattcccaga

SEQ ID NO: 391243 - DNA, 25 bp, Rattus norvegicus
gccagaggtgaagacaattcccaga

SEQ ID NO: 391244 - DNA, 25 bp, Rattus norvegicus
gccagaggtggcaccggacgaaaaa

SEQ ID NO: 391245 - DNA, 25 bp, Rattus norvegicus
gccagaggtggctccggacgaaaaa

SEQ ID NO: 391246 - DNA, 25 bp, Rattus norvegicus
gccagagtacagattgggtcttcac

SEQ ID NO: 391247 - DNA, 25 bp, Rattus norvegicus
gccagagtacagtttgggtcttcac

SEQ ID NO: 391248 - DNA, 25 bp, Rattus norvegicus
gccagagtaggaagagcaggctcac

SEQ ID NO: 391249 - DNA, 25 bp, Rattus norvegicus
gccagagtaggatgagcaggctcac

SEQ ID NO: 391250 - DNA, 25 bp, Rattus norvegicus
gccagagtatcactgtttgttgctc

SEQ ID NO: 391251 - DNA, 25 bp, Rattus norvegicus
gccagagtatcagtgtttgttgctc

SEQ ID NO: 391252 - DNA, 25 bp, Rattus norvegicus
gccagagtcagtaccacacctagat

SEQ ID NO: 391253 - DNA, 25 bp, Rattus norvegicus
gccagagtcagttccacacctagat

SEQ ID NO: 391254 - DNA, 25 bp, Rattus norvegicus
gccagagtctacatctacactacag

SEQ ID NO: 391255 - DNA, 25 bp, Rattus norvegicus
gccagagtctacttctacactacag

SEQ ID NO: 391256 - DNA, 25 bp, Rattus norvegicus
gccagagtcttgagctgctcttgat

SEQ ID NO: 391257 - DNA, 25 bp, Rattus norvegicus
gccagagtcttgtgctgctcttgat

SEQ ID NO: 391258 - DNA, 25 bp, Rattus norvegicus
gccagagtggagagttccatctcat

SEQ ID NO: 391259 - DNA, 25 bp, Rattus norvegicus
gccagagtggagtgttccatctcat

SEQ ID NO: 391260 - DNA, 25 bp, Rattus norvegicus
gccagagtggatcccgagaacttct

SEQ ID NO: 391261 - DNA, 25 bp, Rattus norvegicus
gccagagtggatgccgagaacttct

SEQ ID NO: 391262 - DNA, 25 bp, Rattus norvegicus
gccagagtgtggacgagctcttcca

SEQ ID NO: 391263 - DNA, 25 bp, Rattus norvegicus
gccagagtgtggtcgagctcttcca

SEQ ID NO: 391264 - DNA, 25 bp, Rattus norvegicus
gccagagttgcaaggtgagaaccta

SEQ ID NO: 391265 - DNA, 25 bp, Rattus norvegicus
gccagagttgcatggtgagaaccta

SEQ ID NO: 391266 - DNA, 25 bp, Rattus norvegicus
gccagagtttggagctgctgcaact

SEQ ID NO: 391267 - DNA, 25 bp, Rattus norvegicus
gccagagtttggtgctgctgcaact

SEQ ID NO: 391268 - DNA, 25 bp, Rattus norvegicus
gccagagttttcaactttagttcta

SEQ ID NO: 391269 - DNA, 25 bp, Rattus norvegicus
gccagagttttctactttagttcta

SEQ ID NO: 391270 - DNA, 25 bp, Rattus norvegicus
gccagataaagccatcgcacagtta

SEQ ID NO: 391271 - DNA, 25 bp, Rattus norvegicus
gccagataaagcgatcgcacagtta

SEQ ID NO: 391272 - DNA, 25 bp, Rattus norvegicus
gccagatacccaacctgaagtacgg

SEQ ID NO: 391273 - DNA, 25 bp, Rattus norvegicus
gccagatacccatcctgaagtacgg

SEQ ID NO: 391274 - DNA, 25 bp, Rattus norvegicus
gccagataggccaaacagcagatat

SEQ ID NO: 391275 - DNA, 25 bp, Rattus norvegicus
gccagataggcctaacagcagatat

SEQ ID NO: 391276 - DNA, 25 bp, Rattus norvegicus
gccagatattccactgagtcttcag

SEQ ID NO: 391277 - DNA, 25 bp, Rattus norvegicus
gccagatattcctctgagtcttcag

SEQ ID NO: 391278 - DNA, 25 bp, Rattus norvegicus
gccagatatttccattgcaaccaga

SEQ ID NO: 391279 - DNA, 25 bp, Rattus norvegicus
gccagatatttcgattgcaaccaga

SEQ ID NO: 391280 - DNA, 25 bp, Rattus norvegicus
gccagatcaaagcaagtttcagcca

SEQ ID NO: 391281 - DNA, 25 bp, Rattus norvegicus
gccagatcaaaggaagtttcagcca

SEQ ID NO: 391282 - DNA, 25 bp, Rattus norvegicus
gccagatcaactatcttgccgagaa

SEQ ID NO: 391283 - DNA, 25 bp, Rattus norvegicus
gccagatcaactttcttgccgagaa

SEQ ID NO: 391284 - DNA, 25 bp, Rattus norvegicus
gccagatcctcacccatttaagtta

SEQ ID NO: 391285 - DNA, 25 bp, Rattus norvegicus
gccagatcctcagccatttaagtta

SEQ ID NO: 391286 - DNA, 25 bp, Rattus norvegicus
gccagatcggcccagccaagagagt

SEQ ID NO: 391287 - DNA, 25 bp, Rattus norvegicus
gccagatcggccgagccaagagagt

SEQ ID NO: 391288 - DNA, 25 bp, Rattus norvegicus
gccagatctgtgaacttgttgctca

SEQ ID NO: 391289 - DNA, 25 bp, Rattus norvegicus
gccagatctgtgtacttgttgctca

SEQ ID NO: 391290 - DNA, 25 bp, Rattus norvegicus
gccagatgacgacagtatttgccaa

SEQ ID NO: 391291 - DNA, 25 bp, Rattus norvegicus
gccagatgacgagagtatttgccaa

SEQ ID NO: 391292 - DNA, 25 bp, Rattus norvegicus
gccagatgatctacagtgcagccaa

SEQ ID NO: 391293 - DNA, 25 bp, Rattus norvegicus
gccagatgatcttcagtgcagccaa

SEQ ID NO: 391294 - DNA, 25 bp, Rattus norvegicus
gccagatgcaccagtgaccctggct

SEQ ID NO: 391295 - DNA, 25 bp, Rattus norvegicus
gccagatgcacctgtgaccctggct

SEQ ID NO: 391296 - DNA, 25 bp, Rattus norvegicus
gccagatgccagagccgtcggccga

SEQ ID NO: 391297 - DNA, 25 bp, Rattus norvegicus
gccagatgccagtgccgtcggccga

SEQ ID NO: 391298 - DNA, 25 bp, Rattus norvegicus
gccagattaagcagccacatgtgta

SEQ ID NO: 391299 - DNA, 25 bp, Rattus norvegicus
gccagattaagctgccacatgtgta

SEQ ID NO: 391300 - DNA, 25 bp, Rattus norvegicus
gccagattaggaacagcgagcactt

SEQ ID NO: 391301 - DNA, 25 bp, Rattus norvegicus
gccagattaggatcagcgagcactt

SEQ ID NO: 391302 - DNA, 25 bp, Rattus norvegicus
gccagattatcacacatgtgaacct

SEQ ID NO: 391303 - DNA, 25 bp, Rattus norvegicus
gccagattatcagacatgtgaacct

SEQ ID NO: 391304 - DNA, 25 bp, Rattus norvegicus
gccagattcagacgtgggctactca

SEQ ID NO: 391305 - DNA, 25 bp, Rattus norvegicus
gccagattcagaggtgggctactca

SEQ ID NO: 391306 - DNA, 25 bp, Rattus norvegicus
gccagatttattcccatcaggtccg

SEQ ID NO: 391307 - DNA, 25 bp, Rattus norvegicus
gccagatttattgccatcaggtccg

SEQ ID NO: 391308 - DNA, 25 bp, Rattus norvegicus
gccagatttcatactgtgttcccga

SEQ ID NO: 391309 - DNA, 25 bp, Rattus norvegicus
gccagatttcattctgtgttcccga

SEQ ID NO: 391310 - DNA, 25 bp, Rattus norvegicus
gccagattttcaccagccaaggaca

SEQ ID NO: 391311 - DNA, 25 bp, Rattus norvegicus
gccagattttcagcagccaaggaca

SEQ ID NO: 391312 - DNA, 25 bp, Rattus norvegicus
gccagattttgtaagctgcaggaaa

SEQ ID NO: 391313 - DNA, 25 bp, Rattus norvegicus
gccagattttgttagctgcaggaaa

SEQ ID NO: 391314 - DNA, 25 bp, Rattus norvegicus
gccagatttttaagacagttgccga

SEQ ID NO: 391315 - DNA, 25 bp, Rattus norvegicus
gccagatttttatgacagttgccga

SEQ ID NO: 391316 - DNA, 25 bp, Rattus norvegicus
gccagcaaacagaactccttgtggt

SEQ ID NO: 391317 - DNA, 25 bp, Rattus norvegicus
gccagcaaacagtactccttgtggt

SEQ ID NO: 391318 - DNA, 25 bp, Rattus norvegicus
gccagcaaacgtatcttcatctgca

SEQ ID NO: 391319 - DNA, 25 bp, Rattus norvegicus
gccagcaaacgtttcttcatctgca

SEQ ID NO: 391320 - DNA, 25 bp, Rattus norvegicus
gccagcaacacaaaaagcccagggt

SEQ ID NO: 391321 - DNA, 25 bp, Rattus norvegicus
gccagcaacacataaagcccagggt

SEQ ID NO: 391322 - DNA, 25 bp, Rattus norvegicus
gccagcaactccaagctatttcgga

SEQ ID NO: 391323 - DNA, 25 bp, Rattus norvegicus
gccagcaactcctagctatttcgga

SEQ ID NO: 391324 - DNA, 25 bp, Rattus norvegicus
gccagcaagcagattaaccccaaga

SEQ ID NO: 391325 - DNA, 25 bp, Rattus norvegicus
gccagcaagcagtttaaccccaaga

SEQ ID NO: 391326 - DNA, 25 bp, Rattus norvegicus
gccagcaagggactttatttaaggt

SEQ ID NO: 391327 - DNA, 25 bp, Rattus norvegicus
gccagcaagggagtttatttaaggt

SEQ ID NO: 391328 - DNA, 25 bp, Rattus norvegicus
gccagcaatggacaacccttagaaa

SEQ ID NO: 391329 - DNA, 25 bp, Rattus norvegicus
gccagcaatggagaacccttagaaa

SEQ ID NO: 391330 - DNA, 25 bp, Rattus norvegicus
gccagcacaacaaggactgggacct

SEQ ID NO: 391331 - DNA, 25 bp, Rattus norvegicus
gccagcacaacatggactgggacct

SEQ ID NO: 391332 - DNA, 25 bp, Rattus norvegicus
gccagcacatctaaaagtagcctca

SEQ ID NO: 391333 - DNA, 25 bp, Rattus norvegicus
gccagcacatcttaaagtagcctca

SEQ ID NO: 391334 - DNA, 25 bp, Rattus norvegicus
gccagcacatttaaccttgaaggat

SEQ ID NO: 391335 - DNA, 25 bp, Rattus norvegicus
gccagcacattttaccttgaaggat

SEQ ID NO: 391336 - DNA, 25 bp, Rattus norvegicus
gccagcacctcacggccaataataa

SEQ ID NO: 391337 - DNA, 25 bp, Rattus norvegicus
gccagcacctcagggccaataataa

SEQ ID NO: 391338 - DNA, 25 bp, Rattus norvegicus
gccagcactcgtcattttattcata

SEQ ID NO: 391339 - DNA, 25 bp, Rattus norvegicus
gccagcactcgtgattttattcata

SEQ ID NO: 391340 - DNA, 25 bp, Rattus norvegicus
gccagcactgcacttaagctactaa

SEQ ID NO: 391341 - DNA, 25 bp, Rattus norvegicus
gccagcactgcagttaagctactaa

SEQ ID NO: 391342 - DNA, 25 bp, Rattus norvegicus
gccagcactgctctggaaccagaga

SEQ ID NO: 391343 - DNA, 25 bp, Rattus norvegicus
gccagcactgctgtggaaccagaga

SEQ ID NO: 391344 - DNA, 25 bp, Rattus norvegicus
gccagcactgtgaggtgcagatttc

SEQ ID NO: 391345 - DNA, 25 bp, Rattus norvegicus
gccagcactgtgtggtgcagatttc

SEQ ID NO: 391346 - DNA, 25 bp, Rattus norvegicus
gccagcagaggaaataggaagcccc

SEQ ID NO: 391347 - DNA, 25 bp, Rattus norvegicus
gccagcagaggatataggaagcccc

SEQ ID NO: 391348 - DNA, 25 bp, Rattus norvegicus
gccagcagagtaaggtgtccaggaa

SEQ ID NO: 391349 - DNA, 25 bp, Rattus norvegicus
gccagcagagtatggtgtccaggaa

SEQ ID NO: 391350 - DNA, 25 bp, Rattus norvegicus
gccagcagagtcagtccaggattat

SEQ ID NO: 391351 - DNA, 25 bp, Rattus norvegicus
gccagcagagtctgtccaggattat

SEQ ID NO: 391352 - DNA, 25 bp, Rattus norvegicus
gccagcagatcccttgtacacattt

SEQ ID NO: 391353 - DNA, 25 bp, Rattus norvegicus
gccagcagatccgttgtacacattt

SEQ ID NO: 391354 - DNA, 25 bp, Rattus norvegicus
gccagcagcatgaatatgttactga

SEQ ID NO: 391355 - DNA, 25 bp, Rattus norvegicus
gccagcagcatgtatatgttactga

SEQ ID NO: 391356 - DNA, 25 bp, Rattus norvegicus
gccagcagccttactcatttggaaa

SEQ ID NO: 391357 - DNA, 25 bp, Rattus norvegicus
gccagcagcctttctcatttggaaa

SEQ ID NO: 391358 - DNA, 25 bp, Rattus norvegicus
gccagcagctccctagaagaaattt

SEQ ID NO: 391359 - DNA, 25 bp, Rattus norvegicus
gccagcagctccgtagaagaaattt

SEQ ID NO: 391360 - DNA, 25 bp, Rattus norvegicus
gccagcagctgacggctaagctcat

SEQ ID NO: 391361 - DNA, 25 bp, Rattus norvegicus
gccagcagctgagggctaagctcat

SEQ ID NO: 391362 - DNA, 25 bp, Rattus norvegicus
gccagcagctgcatttaaagggtca

SEQ ID NO: 391363 - DNA, 25 bp, Rattus norvegicus
gccagcagctgcttttaaagggtca

SEQ ID NO: 391364 - DNA, 25 bp, Rattus norvegicus
gccagcaggaataggaagcctcttt

SEQ ID NO: 391365 - DNA, 25 bp, Rattus norvegicus
gccagcaggaattggaagcctcttt

SEQ ID NO: 391366 - DNA, 25 bp, Rattus norvegicus
gccagcagtggcaggtgatccaaaa

SEQ ID NO: 391367 - DNA, 25 bp, Rattus norvegicus
gccagcagtggctggtgatccaaaa

SEQ ID NO: 391368 - DNA, 25 bp, Rattus norvegicus
gccagcagtgggacattttatctct

SEQ ID NO: 391369 - DNA, 25 bp, Rattus norvegicus
gccagcagtgggtcattttatctct

SEQ ID NO: 391370 - DNA, 25 bp, Rattus norvegicus
gccagcagttgtagaggcagttact

SEQ ID NO: 391371 - DNA, 25 bp, Rattus norvegicus
gccagcagttgttgaggcagttact

SEQ ID NO: 391372 - DNA, 25 bp, Rattus norvegicus
gccagcagtttgcttcttgaacgat

SEQ ID NO: 391373 - DNA, 25 bp, Rattus norvegicus
gccagcagtttggttcttgaacgat

SEQ ID NO: 391374 - DNA, 25 bp, Rattus norvegicus
gccagcatacccatgagaccataat

SEQ ID NO: 391375 - DNA, 25 bp, Rattus norvegicus
gccagcatacccttgagaccataat

SEQ ID NO: 391376 - DNA, 25 bp, Rattus norvegicus
gccagcatcttcatgcatctaatga

SEQ ID NO: 391377 - DNA, 25 bp, Rattus norvegicus
gccagcatcttcttgcatctaatga

SEQ ID NO: 391378 - DNA, 25 bp, Rattus norvegicus
gccagcattcagctaaacctttctc

SEQ ID NO: 391379 - DNA, 25 bp, Rattus norvegicus
gccagcattcaggtaaacctttctc

SEQ ID NO: 391380 - DNA, 25 bp, Rattus norvegicus
gccagcattcatcattttgtttgta

SEQ ID NO: 391381 - DNA, 25 bp, Rattus norvegicus
gccagcattcatgattttgtttgta

SEQ ID NO: 391382 - DNA, 25 bp, Rattus norvegicus
gccagcattctcatccatagacaag

SEQ ID NO: 391383 - DNA, 25 bp, Rattus norvegicus
gccagcattctcttccatagacaag

SEQ ID NO: 391384 - DNA, 25 bp, Rattus norvegicus
gccagccacagacattgctgaagaa

SEQ ID NO: 391385 - DNA, 25 bp, Rattus norvegicus
gccagccacagagattgctgaagaa

SEQ ID NO: 391386 - DNA, 25 bp, Rattus norvegicus
gccagccactgacgattggtcagca

SEQ ID NO: 391387 - DNA, 25 bp, Rattus norvegicus
gccagccactgaggattggtcagca

SEQ ID NO: 391388 - DNA, 25 bp, Rattus norvegicus
gccagccactgtagtcttaaatgga

SEQ ID NO: 391389 - DNA, 25 bp, Rattus norvegicus
gccagccactgttgtcttaaatgga

SEQ ID NO: 391390 - DNA, 25 bp, Rattus norvegicus
gccagccacttacttgaccaatgag

SEQ ID NO: 391391 - DNA, 25 bp, Rattus norvegicus
gccagccacttagttgaccaatgag

SEQ ID NO: 391392 - DNA, 25 bp, Rattus norvegicus
gccagccagcaccatgatgtaacaa

SEQ ID NO: 391393 - DNA, 25 bp, Rattus norvegicus
gccagccagcacgatgatgtaacaa

SEQ ID NO: 391394 - DNA, 25 bp, Rattus norvegicus
gccagccagcagcacagtgtacaga

SEQ ID NO: 391395 - DNA, 25 bp, Rattus norvegicus
gccagccagcaggacagtgtacaga

SEQ ID NO: 391396 - DNA, 25 bp, Rattus norvegicus
gccagccaggaacacctttttactt

SEQ ID NO: 391397 - DNA, 25 bp, Rattus norvegicus
gccagccaggaagacctttttactt

SEQ ID NO: 391398 - DNA, 25 bp, Rattus norvegicus
gccagccagtgcaggagatcttcga

SEQ ID NO: 391399 - DNA, 25 bp, Rattus norvegicus
gccagccagtgctggagatcttcga

SEQ ID NO: 391400 - DNA, 25 bp, Rattus norvegicus
gccagccagtgtaccagaagcccag

SEQ ID NO: 391401 - DNA, 25 bp, Rattus norvegicus
gccagccagtgtagctttcttgtca

SEQ ID NO: 391402 - DNA, 25 bp, Rattus norvegicus
gccagccagtgtctcttgtgcagtg

SEQ ID NO: 391403 - DNA, 25 bp, Rattus norvegicus
gccagccagtgtgtcttgtgcagtg

SEQ ID NO: 391404 - DNA, 25 bp, Rattus norvegicus
gccagccagtgttccagaagcccag

SEQ ID NO: 391405 - DNA, 25 bp, Rattus norvegicus
gccagccagtgttgctttcttgtca

SEQ ID NO: 391406 - DNA, 25 bp, Rattus norvegicus
gccagccagtttagcctagggaatt

SEQ ID NO: 391407 - DNA, 25 bp, Rattus norvegicus
gccagccagttttgcctagggaatt

SEQ ID NO: 391408 - DNA, 25 bp, Rattus norvegicus
gccagccatcacagctctgaattag

SEQ ID NO: 391409 - DNA, 25 bp, Rattus norvegicus
gccagccatcactgctctgaattag

SEQ ID NO: 391410 - DNA, 25 bp, Rattus norvegicus
gccagccatctacagcgcagaaggt

SEQ ID NO: 391411 - DNA, 25 bp, Rattus norvegicus
gccagccatctagagcgcagaaggt

SEQ ID NO: 391412 - DNA, 25 bp, Rattus norvegicus
gccagccatggacctgtaaatttga

SEQ ID NO: 391413 - DNA, 25 bp, Rattus norvegicus
gccagccatggagctgtaaatttga

SEQ ID NO: 391414 - DNA, 25 bp, Rattus norvegicus
gccagccattggaagtgttgacaga

SEQ ID NO: 391415 - DNA, 25 bp, Rattus norvegicus
gccagccattggtagtgttgacaga

SEQ ID NO: 391416 - DNA, 25 bp, Rattus norvegicus
gccagcccaaatatccttggtgtta

SEQ ID NO: 391417 - DNA, 25 bp, Rattus norvegicus
gccagcccaaatatttacatgcagt

SEQ ID NO: 391418 - DNA, 25 bp, Rattus norvegicus
gccagcccaaatttccttggtgtta

SEQ ID NO: 391419 - DNA, 25 bp, Rattus norvegicus
gccagcccaaatttttacatgcagt

SEQ ID NO: 391420 - DNA, 25 bp, Rattus norvegicus
gccagcccagcaacaagagacattt

SEQ ID NO: 391421 - DNA, 25 bp, Rattus norvegicus
gccagcccagcatcaagagacattt

SEQ ID NO: 391422 - DNA, 25 bp, Rattus norvegicus
gccagccccaaaagccatgagtgct

SEQ ID NO: 391423 - DNA, 25 bp, Rattus norvegicus
gccagccccaaatgccatgagtgct

SEQ ID NO: 391424 - DNA, 25 bp, Rattus norvegicus
gccagccctacacatttgatatcaa

SEQ ID NO: 391425 - DNA, 25 bp, Rattus norvegicus
gccagccctacagatttgatatcaa

SEQ ID NO: 391426 - DNA, 25 bp, Rattus norvegicus
gccagccctgttattagccagaaag

SEQ ID NO: 391427 - DNA, 25 bp, Rattus norvegicus
gccagccctgttctccagagaagta

SEQ ID NO: 391428 - DNA, 25 bp, Rattus norvegicus
gccagccctgttgtccagagaagta

SEQ ID NO: 391429 - DNA, 25 bp, Rattus norvegicus
gccagccctgtttttagccagaaag

SEQ ID NO: 391430 - DNA, 25 bp, Rattus norvegicus
gccagccgagttcagtactttctaa

SEQ ID NO: 391431 - DNA, 25 bp, Rattus norvegicus
gccagccgagttgagtactttctaa

SEQ ID NO: 391432 - DNA, 25 bp, Rattus norvegicus
gccagccgggcactcaggatgcata

SEQ ID NO: 391433 - DNA, 25 bp, Rattus norvegicus
gccagccgggcagtcaggatgcata

SEQ ID NO: 391434 - DNA, 25 bp, Rattus norvegicus
gccagccgggttaaaaaatctggtg

SEQ ID NO: 391435 - DNA, 25 bp, Rattus norvegicus
gccagccgggtttaaaaatctggtg

SEQ ID NO: 391436 - DNA, 25 bp, Rattus norvegicus
gccagccgtccaagttggctaaaca

SEQ ID NO: 391437 - DNA, 25 bp, Rattus norvegicus
gccagccgtccatgttggctaaaca

SEQ ID NO: 391438 - DNA, 25 bp, Rattus norvegicus
gccagcctacaaccagactatgtca

SEQ ID NO: 391439 - DNA, 25 bp, Rattus norvegicus
gccagcctacaagcagactatgtca

SEQ ID NO: 391440 - DNA, 25 bp, Rattus norvegicus
gccagcctacctcctgtcagaatag

SEQ ID NO: 391441 - DNA, 25 bp, Rattus norvegicus
gccagcctacctgctgtcagaatag

SEQ ID NO: 391442 - DNA, 25 bp, Rattus norvegicus
gccagcctagggacataagcattca

SEQ ID NO: 391443 - DNA, 25 bp, Rattus norvegicus
gccagcctagggtcataagcattca

SEQ ID NO: 391444 - DNA, 25 bp, Rattus norvegicus
gccagcctaggtaacgtagcaagat

SEQ ID NO: 391445 - DNA, 25 bp, Rattus norvegicus
gccagcctaggttacgtagcaagat

SEQ ID NO: 391446 - DNA, 25 bp, Rattus norvegicus
gccagcctagttacaaagcaggact

SEQ ID NO: 391447 - DNA, 25 bp, Rattus norvegicus
gccagcctagtttcaaagcaggact

SEQ ID NO: 391448 - DNA, 25 bp, Rattus norvegicus
gccagcctcaaaattgttgtgttgc

SEQ ID NO: 391449 - DNA, 25 bp, Rattus norvegicus
gccagcctcaaatttgttgtgttgc

SEQ ID NO: 391450 - DNA, 25 bp, Rattus norvegicus
gccagcctcaggagtgaggacctct

SEQ ID NO: 391451 - DNA, 25 bp, Rattus norvegicus
gccagcctcaggtgtgaggacctct

SEQ ID NO: 391452 - DNA, 25 bp, Rattus norvegicus
gccagcctcatgatgtactgaggag

SEQ ID NO: 391453 - DNA, 25 bp, Rattus norvegicus
gccagcctcatgttgtactgaggag

SEQ ID NO: 391454 - DNA, 25 bp, Rattus norvegicus
gccagcctctacatatagagttcaa

SEQ ID NO: 391455 - DNA, 25 bp, Rattus norvegicus
gccagcctctacctgtttggagaga

SEQ ID NO: 391456 - DNA, 25 bp, Rattus norvegicus
gccagcctctacgtgtttggagaga

SEQ ID NO: 391457 - DNA, 25 bp, Rattus norvegicus
gccagcctctacttatagagttcaa

SEQ ID NO: 391458 - DNA, 25 bp, Rattus norvegicus
gccagcctctatacccagtaaagga

SEQ ID NO: 391459 - DNA, 25 bp, Rattus norvegicus
gccagcctctattcccagtaaagga

SEQ ID NO: 391460 - DNA, 25 bp, Rattus norvegicus
gccagcctctgaatttgcacatttt

SEQ ID NO: 391461 - DNA, 25 bp, Rattus norvegicus
gccagcctctgattttgcacatttt

SEQ ID NO: 391462 - DNA, 25 bp, Rattus norvegicus
gccagcctcttgcatgtgatcccag

SEQ ID NO: 391463 - DNA, 25 bp, Rattus norvegicus
gccagcctcttggatgtgatcccag

SEQ ID NO: 391464 - DNA, 25 bp, Rattus norvegicus
gccagcctgaacagatgaacgagac

SEQ ID NO: 391465 - DNA, 25 bp, Rattus norvegicus
gccagcctgaactgatgaacgagac

SEQ ID NO: 391466 - DNA, 25 bp, Rattus norvegicus
gccagcctgaagagcaatcacctag

SEQ ID NO: 391467 - DNA, 25 bp, Rattus norvegicus
gccagcctgaagtgcaatcacctag

SEQ ID NO: 391468 - DNA, 25 bp, Rattus norvegicus
gccagcctgaatctctgcgataaaa

SEQ ID NO: 391469 - DNA, 25 bp, Rattus norvegicus
gccagcctgaatgtctgcgataaaa

SEQ ID NO: 391470 - DNA, 25 bp, Rattus norvegicus
gccagcctgcagatctgggagattg

SEQ ID NO: 391471 - DNA, 25 bp, Rattus norvegicus
gccagcctgcagttctgggagattg

SEQ ID NO: 391472 - DNA, 25 bp, Rattus norvegicus
gccagcctgctaacatttcaagatt

SEQ ID NO: 391473 - DNA, 25 bp, Rattus norvegicus
gccagcctgctatcatttcaagatt

SEQ ID NO: 391474 - DNA, 25 bp, Rattus norvegicus
gccagcctgctccagaggtatacaa

SEQ ID NO: 391475 - DNA, 25 bp, Rattus norvegicus
gccagcctgctcgagaggtatacaa

SEQ ID NO: 391476 - DNA, 25 bp, Rattus norvegicus
gccagcctgcttatctacagttaaa

SEQ ID NO: 391477 - DNA, 25 bp, Rattus norvegicus
gccagcctgcttttctacagttaaa

SEQ ID NO: 391478 - DNA, 25 bp, Rattus norvegicus
gccagcctggagaatgtgataacct

SEQ ID NO: 391479 - DNA, 25 bp, Rattus norvegicus
gccagcctggagtatgtgataacct

SEQ ID NO: 391480 - DNA, 25 bp, Rattus norvegicus
gccagcctggcccacatggactagg

SEQ ID NO: 391481 - DNA, 25 bp, Rattus norvegicus
gccagcctggccgacatggactagg

SEQ ID NO: 391482 - DNA, 25 bp, Rattus norvegicus
gccagcctggctaatagaactagtt

SEQ ID NO: 391483 - DNA, 25 bp, Rattus norvegicus
gccagcctggcttatagaactagtt

SEQ ID NO: 391484 - DNA, 25 bp, Rattus norvegicus
gccagcctggtcacagggacagaac

SEQ ID NO: 391485 - DNA, 25 bp, Rattus norvegicus
gccagcctggtctcagggacagaac

SEQ ID NO: 391486 - DNA, 25 bp, Rattus norvegicus
gccagcctggtgaatgtgccaagtt

SEQ ID NO: 391487 - DNA, 25 bp, Rattus norvegicus
gccagcctggtgagccggaaacgaa

SEQ ID NO: 391488 - DNA, 25 bp, Rattus norvegicus
gccagcctggtgtatgtgccaagtt

SEQ ID NO: 391489 - DNA, 25 bp, Rattus norvegicus
gccagcctggtgtgccggaaacgaa

SEQ ID NO: 391490 - DNA, 25 bp, Rattus norvegicus
gccagcctgtagacatggacaatgt

SEQ ID NO: 391491 - DNA, 25 bp, Rattus norvegicus
gccagcctgtagtcatggacaatgt

SEQ ID NO: 391492 - DNA, 25 bp, Rattus norvegicus
gccagccttagaaaatagcgagaat

SEQ ID NO: 391493 - DNA, 25 bp, Rattus norvegicus
gccagccttagataatagcgagaat

SEQ ID NO: 391494 - DNA, 25 bp, Rattus norvegicus
gccagccttcgacagtttctagaaa

SEQ ID NO: 391495 - DNA, 25 bp, Rattus norvegicus
gccagccttcgagagtttctagaaa

SEQ ID NO: 391496 - DNA, 25 bp, Rattus norvegicus
gccagccttcgtctttcagttgaat

SEQ ID NO: 391497 - DNA, 25 bp, Rattus norvegicus
gccagccttcgtgtttcagttgaat

SEQ ID NO: 391498 - DNA, 25 bp, Rattus norvegicus
gccagcctttttcccatagttgact

SEQ ID NO: 391499 - DNA, 25 bp, Rattus norvegicus
gccagcctttttgccatagttgact

SEQ ID NO: 391500 - DNA, 25 bp, Rattus norvegicus
gccagcgaccaacactcagggctga

SEQ ID NO: 391501 - DNA, 25 bp, Rattus norvegicus
gccagcgaccaagactcagggctga

SEQ ID NO: 391502 - DNA, 25 bp, Rattus norvegicus
gccagcgaccacactggattgttat

SEQ ID NO: 391503 - DNA, 25 bp, Rattus norvegicus
gccagcgaccactctggattgttat

SEQ ID NO: 391504 - DNA, 25 bp, Rattus norvegicus
gccagcgactcccaggagcccttgg

SEQ ID NO: 391505 - DNA, 25 bp, Rattus norvegicus
gccagcgactccgaggagcccttgg

SEQ ID NO: 391506 - DNA, 25 bp, Rattus norvegicus
gccagcgagtacatgtccttcttga

SEQ ID NO: 391507 - DNA, 25 bp, Rattus norvegicus
gccagcgagtacttgtccttcttga

SEQ ID NO: 391508 - DNA, 25 bp, Rattus norvegicus
gccagcgcacctagaagtttcagaa

SEQ ID NO: 391509 - DNA, 25 bp, Rattus norvegicus
gccagcgcaccttgaagtttcagaa

SEQ ID NO: 391510 - DNA, 25 bp, Rattus norvegicus
gccagcgccaaccttggtcaagggt

SEQ ID NO: 391511 - DNA, 25 bp, Rattus norvegicus
gccagcgccaacgttggtcaagggt

SEQ ID NO: 391512 - DNA, 25 bp, Rattus norvegicus
gccagcgccaggcttttgtatcaaa

SEQ ID NO: 391513 - DNA, 25 bp, Rattus norvegicus
gccagcgccagggttttgtatcaaa

SEQ ID NO: 391514 - DNA, 25 bp, Rattus norvegicus
gccagcgccgagaccagaaagattg

SEQ ID NO: 391515 - DNA, 25 bp, Rattus norvegicus
gccagcgccgagtccagaaagattg

SEQ ID NO: 391516 - DNA, 25 bp, Rattus norvegicus
gccagcgcctttcagaatatgtctt

SEQ ID NO: 391517 - DNA, 25 bp, Rattus norvegicus
gccagcgcctttgagaatatgtctt

SEQ ID NO: 391518 - DNA, 25 bp, Rattus norvegicus
gccagcgctaatccctctgtttggg

SEQ ID NO: 391519 - DNA, 25 bp, Rattus norvegicus
gccagcgctaatgcctctgtttggg

SEQ ID NO: 391520 - DNA, 25 bp, Rattus norvegicus
gccagcgctcccaaagtattttata

SEQ ID NO: 391521 - DNA, 25 bp, Rattus norvegicus
gccagcgctccctaagtattttata

SEQ ID NO: 391522 - DNA, 25 bp, Rattus norvegicus
gccagcgggaagcaaatatctattt

SEQ ID NO: 391523 - DNA, 25 bp, Rattus norvegicus
gccagcgggaaggaaatatctattt

SEQ ID NO: 391524 - DNA, 25 bp, Rattus norvegicus
gccagcgtggccagaacacacagga

SEQ ID NO: 391525 - DNA, 25 bp, Rattus norvegicus
gccagcgtggcctgaacacacagga

SEQ ID NO: 391526 - DNA, 25 bp, Rattus norvegicus
gccagctacccacctataagacgtg

SEQ ID NO: 391527 - DNA, 25 bp, Rattus norvegicus
gccagctacccagctataagacgtg

SEQ ID NO: 391528 - DNA, 25 bp, Rattus norvegicus
gccagctactctaaagggtcactat

SEQ ID NO: 391529 - DNA, 25 bp, Rattus norvegicus
gccagctactcttaagggtcactat

SEQ ID NO: 391530 - DNA, 25 bp, Rattus norvegicus
gccagctactggagggcagtcatct

SEQ ID NO: 391531 - DNA, 25 bp, Rattus norvegicus
gccagctactggtgggcagtcatct

SEQ ID NO: 391532 - DNA, 25 bp, Rattus norvegicus
gccagctaggacaacagactaacta

SEQ ID NO: 391533 - DNA, 25 bp, Rattus norvegicus
gccagctaggactacagactaacta

SEQ ID NO: 391534 - DNA, 25 bp, Rattus norvegicus
gccagctcaaaaccctcaattcatt

SEQ ID NO: 391535 - DNA, 25 bp, Rattus norvegicus
gccagctcaaaagcctcaattcatt

SEQ ID NO: 391536 - DNA, 25 bp, Rattus norvegicus
gccagctcaagtattggtcatttcc

SEQ ID NO: 391537 - DNA, 25 bp, Rattus norvegicus
gccagctcaagttttggtcatttcc

SEQ ID NO: 391538 - DNA, 25 bp, Rattus norvegicus
gccagctcactgaagtatcttaaga

SEQ ID NO: 391539 - DNA, 25 bp, Rattus norvegicus
gccagctcactgtagtatcttaaga

SEQ ID NO: 391540 - DNA, 25 bp, Rattus norvegicus
gccagctcagcgcatgcacataaac

SEQ ID NO: 391541 - DNA, 25 bp, Rattus norvegicus
gccagctcagcggatgcacataaac

SEQ ID NO: 391542 - DNA, 25 bp, Rattus norvegicus
gccagctcagtgcacgtgcgcatga

SEQ ID NO: 391543 - DNA, 25 bp, Rattus norvegicus
gccagctcagtggacgtgcgcatga

SEQ ID NO: 391544 - DNA, 25 bp, Rattus norvegicus
gccagctcatcccagagacatgaaa

SEQ ID NO: 391545 - DNA, 25 bp, Rattus norvegicus
gccagctcatccgagagacatgaaa

SEQ ID NO: 391546 - DNA, 25 bp, Rattus norvegicus
gccagctccactactgaatcttaat

SEQ ID NO: 391547 - DNA, 25 bp, Rattus norvegicus
gccagctccacttctgaatcttaat

SEQ ID NO: 391548 - DNA, 25 bp, Rattus norvegicus
gccagctcctagagaatatgccttt

SEQ ID NO: 391549 - DNA, 25 bp, Rattus norvegicus
gccagctcctagtgaatatgccttt

SEQ ID NO: 391550 - DNA, 25 bp, Rattus norvegicus
gccagctcgcacacgttgtcgatgc

SEQ ID NO: 391551 - DNA, 25 bp, Rattus norvegicus
gccagctcgcacatggagatgccgt

SEQ ID NO: 391552 - DNA, 25 bp, Rattus norvegicus
gccagctcgcactcgttgtcgatgc

SEQ ID NO: 391553 - DNA, 25 bp, Rattus norvegicus
gccagctcgcacttggagatgccgt

SEQ ID NO: 391554 - DNA, 25 bp, Rattus norvegicus
gccagctctgatcgcttctggagct

SEQ ID NO: 391555 - DNA, 25 bp, Rattus norvegicus
gccagctctgatggcttctggagct

SEQ ID NO: 391556 - DNA, 25 bp, Rattus norvegicus
gccagctcttagaacagtggcagct

SEQ ID NO: 391557 - DNA, 25 bp, Rattus norvegicus
gccagctcttagtacagtggcagct

SEQ ID NO: 391558 - DNA, 25 bp, Rattus norvegicus
gccagctcttcactgtcatctttaa

SEQ ID NO: 391559 - DNA, 25 bp, Rattus norvegicus
gccagctcttcagtgtcatctttaa

SEQ ID NO: 391560 - DNA, 25 bp, Rattus norvegicus
gccagctctttccttgaagatctat

SEQ ID NO: 391561 - DNA, 25 bp, Rattus norvegicus
gccagctctttcgttgaagatctat

SEQ ID NO: 391562 - DNA, 25 bp, Rattus norvegicus
gccagctgaaaaatgcctatcctta

SEQ ID NO: 391563 - DNA, 25 bp, Rattus norvegicus
gccagctgaaaattgcctatcctta

SEQ ID NO: 391564 - DNA, 25 bp, Rattus norvegicus
gccagctgagaaacccaacacagat

SEQ ID NO: 391565 - DNA, 25 bp, Rattus norvegicus
gccagctgagaatcccaacacagat

SEQ ID NO: 391566 - DNA, 25 bp, Rattus norvegicus
gccagctgctgcaaagggcaaagac

SEQ ID NO: 391567 - DNA, 25 bp, Rattus norvegicus
gccagctgctgctaagggcaaagac

SEQ ID NO: 391568 - DNA, 25 bp, Rattus norvegicus
gccagctgctgtccgcatgaagagt

SEQ ID NO: 391569 - DNA, 25 bp, Rattus norvegicus
gccagctgctgtgcgcatgaagagt

SEQ ID NO: 391570 - DNA, 25 bp, Rattus norvegicus
gccagctgggagacgacgacctgaa

SEQ ID NO: 391571 - DNA, 25 bp, Rattus norvegicus
gccagctgggagtcgacgacctgaa

SEQ ID NO: 391572 - DNA, 25 bp, Rattus norvegicus
gccagctggtaacgtttggcactta

SEQ ID NO: 391573 - DNA, 25 bp, Rattus norvegicus
gccagctggtaaggtttggcactta

SEQ ID NO: 391574 - DNA, 25 bp, Rattus norvegicus
gccagctgtataagtgcccactaat

SEQ ID NO: 391575 - DNA, 25 bp, Rattus norvegicus
gccagctgtatatgtgcccactaat

SEQ ID NO: 391576 - DNA, 25 bp, Rattus norvegicus
gccagctgtgagagccgaggccctc

SEQ ID NO: 391577 - DNA, 25 bp, Rattus norvegicus
gccagctgtgagtgccgaggccctc

SEQ ID NO: 391578 - DNA, 25 bp, Rattus norvegicus
gccagctgtgtcatgttttcgaatt

SEQ ID NO: 391579 - DNA, 25 bp, Rattus norvegicus
gccagctgtgtcttgttttcgaatt

SEQ ID NO: 391580 - DNA, 25 bp, Rattus norvegicus
gccagctgttaaaccatcactttga

SEQ ID NO: 391581 - DNA, 25 bp, Rattus norvegicus
gccagctgttaatccatcactttga

SEQ ID NO: 391582 - DNA, 25 bp, Rattus norvegicus
gccagctgttcccttttagtagatt

SEQ ID NO: 391583 - DNA, 25 bp, Rattus norvegicus
gccagctgttccgttttagtagatt

SEQ ID NO: 391584 - DNA, 25 bp, Rattus norvegicus
gccagcttaacccacgtggtgagtt

SEQ ID NO: 391585 - DNA, 25 bp, Rattus norvegicus
gccagcttaaccgacgtggtgagtt

SEQ ID NO: 391586 - DNA, 25 bp, Rattus norvegicus
gccagcttaccccataactgtatat

SEQ ID NO: 391587 - DNA, 25 bp, Rattus norvegicus
gccagcttacccgataactgtatat

SEQ ID NO: 391588 - DNA, 25 bp, Rattus norvegicus
gccagcttagccaccagaatgagtt

SEQ ID NO: 391589 - DNA, 25 bp, Rattus norvegicus
gccagcttagcctccagaatgagtt

SEQ ID NO: 391590 - DNA, 25 bp, Rattus norvegicus
gccagcttcacaccgggcatcgtgg

SEQ ID NO: 391591 - DNA, 25 bp, Rattus norvegicus
gccagcttcacagcgggcatcgtgg

SEQ ID NO: 391592 - DNA, 25 bp, Rattus norvegicus
gccagcttcactaccagattgagga

SEQ ID NO: 391593 - DNA, 25 bp, Rattus norvegicus
gccagcttcacttccagattgagga

SEQ ID NO: 391594 - DNA, 25 bp, Rattus norvegicus
gccagcttcccaccgagaatgatga

SEQ ID NO: 391595 - DNA, 25 bp, Rattus norvegicus
gccagcttcccactgttgtaacaaa

SEQ ID NO: 391596 - DNA, 25 bp, Rattus norvegicus
gccagcttcccagcgagaatgatga

SEQ ID NO: 391597 - DNA, 25 bp, Rattus norvegicus
gccagcttcccagtgttgtaacaaa

SEQ ID NO: 391598 - DNA, 25 bp, Rattus norvegicus
gccagcttccggaatacaacttcaa

SEQ ID NO: 391599 - DNA, 25 bp, Rattus norvegicus
gccagcttccggtatacaacttcaa

SEQ ID NO: 391600 - DNA, 25 bp, Rattus norvegicus
gccagcttcgggagtcagtcctgat

SEQ ID NO: 391601 - DNA, 25 bp, Rattus norvegicus
gccagcttcgggtgtcagtcctgat

SEQ ID NO: 391602 - DNA, 25 bp, Rattus norvegicus
gccagcttctccagatgtttacatg

SEQ ID NO: 391603 - DNA, 25 bp, Rattus norvegicus
gccagcttctcctgatgtttacatg

SEQ ID NO: 391604 - DNA, 25 bp, Rattus norvegicus
gccagcttctgtcatggtctgaaga

SEQ ID NO: 391605 - DNA, 25 bp, Rattus norvegicus
gccagcttctgtgatggtctgaaga

SEQ ID NO: 391606 - DNA, 25 bp, Rattus norvegicus
gccagcttcttaccttgggtgaata

SEQ ID NO: 391607 - DNA, 25 bp, Rattus norvegicus
gccagcttcttagcttgggtgaata

SEQ ID NO: 391608 - DNA, 25 bp, Rattus norvegicus
gccagcttgctgctgtcggtgacca

SEQ ID NO: 391609 - DNA, 25 bp, Rattus norvegicus
gccagcttgctggtgtcggtgacca

SEQ ID NO: 391610 - DNA, 25 bp, Rattus norvegicus
gccagcttggcactcagtgtgcaga

SEQ ID NO: 391611 - DNA, 25 bp, Rattus norvegicus
gccagcttggcagtcagtgtgcaga

SEQ ID NO: 391612 - DNA, 25 bp, Rattus norvegicus
gccagcttggtcaactgatcgagtt

SEQ ID NO: 391613 - DNA, 25 bp, Rattus norvegicus
gccagcttggtctactgatcgagtt

SEQ ID NO: 391614 - DNA, 25 bp, Rattus norvegicus
gccagcttttgaatgggcatttgca

SEQ ID NO: 391615 - DNA, 25 bp, Rattus norvegicus
gccagcttttgattgggcatttgca

SEQ ID NO: 391616 - DNA, 25 bp, Rattus norvegicus
gccagctttttaacattgactcttg

SEQ ID NO: 391617 - DNA, 25 bp, Rattus norvegicus
gccagctttttatcattgactcttg

SEQ ID NO: 391618 - DNA, 25 bp, Rattus norvegicus
gccaggaaacacagcgcattcattt

SEQ ID NO: 391619 - DNA, 25 bp, Rattus norvegicus
gccaggaaacactgcgcattcattt

SEQ ID NO: 391620 - DNA, 25 bp, Rattus norvegicus
gccaggaaagctctcagggtcatcg

SEQ ID NO: 391621 - DNA, 25 bp, Rattus norvegicus
gccaggaaagctgtcagggtcatcg

SEQ ID NO: 391622 - DNA, 25 bp, Rattus norvegicus
gccaggaaatccaaaccataaattt

SEQ ID NO: 391623 - DNA, 25 bp, Rattus norvegicus
gccaggaaatcctaaccataaattt

SEQ ID NO: 391624 - DNA, 25 bp, Rattus norvegicus
gccaggaacagcagcaaaatttctt

SEQ ID NO: 391625 - DNA, 25 bp, Rattus norvegicus
gccaggaacagctgcaaaatttctt

SEQ ID NO: 391626 - DNA, 25 bp, Rattus norvegicus
gccaggaacctcattacatgctcaa

SEQ ID NO: 391627 - DNA, 25 bp, Rattus norvegicus
gccaggaacctctttacatgctcaa

SEQ ID NO: 391628 - DNA, 25 bp, Rattus norvegicus
gccaggaacgggaaacaacctagat

SEQ ID NO: 391629 - DNA, 25 bp, Rattus norvegicus
gccaggaacgggtaacaacctagat

SEQ ID NO: 391630 - DNA, 25 bp, Rattus norvegicus
gccaggaagcagattttgcccattt

SEQ ID NO: 391631 - DNA, 25 bp, Rattus norvegicus
gccaggaagcagtttttgcccattt

SEQ ID NO: 391632 - DNA, 25 bp, Rattus norvegicus
gccaggaagcgaagtgtgtgtcata

SEQ ID NO: 391633 - DNA, 25 bp, Rattus norvegicus
gccaggaagcgatgtgtgtgtcata

SEQ ID NO: 391634 - DNA, 25 bp, Rattus norvegicus
gccaggaagctgatatcttgacagt

SEQ ID NO: 391635 - DNA, 25 bp, Rattus norvegicus
gccaggaagctgttatcttgacagt

SEQ ID NO: 391636 - DNA, 25 bp, Rattus norvegicus
gccaggaaggaacacttagcattgt

SEQ ID NO: 391637 - DNA, 25 bp, Rattus norvegicus
gccaggaaggaagacttagcattgt

SEQ ID NO: 391638 - DNA, 25 bp, Rattus norvegicus
gccaggaatgcacttactatatgtc

SEQ ID NO: 391639 - DNA, 25 bp, Rattus norvegicus
gccaggaatgcagttactatatgtc

SEQ ID NO: 391640 - DNA, 25 bp, Rattus norvegicus
gccaggaatgtgctcttaacatctt

SEQ ID NO: 391641 - DNA, 25 bp, Rattus norvegicus
gccaggaatgtggtcttaacatctt

SEQ ID NO: 391642 - DNA, 25 bp, Rattus norvegicus
gccaggacagtaaaccttcaccagt

SEQ ID NO: 391643 - DNA, 25 bp, Rattus norvegicus
gccaggacagtataccttcaccagt

SEQ ID NO: 391644 - DNA, 25 bp, Rattus norvegicus
gccaggacatgtatctgtttgtgct

SEQ ID NO: 391645 - DNA, 25 bp, Rattus norvegicus
gccaggacatgtttctgtttgtgct

SEQ ID NO: 391646 - DNA, 25 bp, Rattus norvegicus
gccaggaccaacatgtgacccagaa

SEQ ID NO: 391647 - DNA, 25 bp, Rattus norvegicus
gccaggaccaacttgtgacccagaa

SEQ ID NO: 391648 - DNA, 25 bp, Rattus norvegicus
gccaggaccaagaaggcctcgtgca

SEQ ID NO: 391649 - DNA, 25 bp, Rattus norvegicus
gccaggaccaagtaggcctcgtgca

SEQ ID NO: 391650 - DNA, 25 bp, Rattus norvegicus
gccaggacctgacgaggctgctaca

SEQ ID NO: 391651 - DNA, 25 bp, Rattus norvegicus
gccaggacctgaggaggctgctaca

SEQ ID NO: 391652 - DNA, 25 bp, Rattus norvegicus
gccaggacctgtatcagtttctgaa

SEQ ID NO: 391653 - DNA, 25 bp, Rattus norvegicus
gccaggacctgtttcagtttctgaa

SEQ ID NO: 391654 - DNA, 25 bp, Rattus norvegicus
gccaggactggcaagccataaagat

SEQ ID NO: 391655 - DNA, 25 bp, Rattus norvegicus
gccaggactggctagccataaagat

SEQ ID NO: 391656 - DNA, 25 bp, Rattus norvegicus
gccaggacttctccgaggcacaaga

SEQ ID NO: 391657 - DNA, 25 bp, Rattus norvegicus
gccaggacttctgcgaggcacaaga

SEQ ID NO: 391658 - DNA, 25 bp, Rattus norvegicus
gccaggagagccagtgttgtcccag

SEQ ID NO: 391659 - DNA, 25 bp, Rattus norvegicus
gccaggagagcctgtgttgtcccag

SEQ ID NO: 391660 - DNA, 25 bp, Rattus norvegicus
gccaggagcggaacaagcgtttcta

SEQ ID NO: 391661 - DNA, 25 bp, Rattus norvegicus
gccaggagcggatcaagcgtttcta

SEQ ID NO: 391662 - DNA, 25 bp, Rattus norvegicus
gccaggagcgtacaatgccatttct

SEQ ID NO: 391663 - DNA, 25 bp, Rattus norvegicus
gccaggagcgtagaatgccatttct

SEQ ID NO: 391664 - DNA, 25 bp, Rattus norvegicus
gccaggaggcccacctgctggagta

SEQ ID NO: 391665 - DNA, 25 bp, Rattus norvegicus
gccaggaggccctcctgctggagta

SEQ ID NO: 391666 - DNA, 25 bp, Rattus norvegicus
gccaggaggtaccaggactaagcct

SEQ ID NO: 391667 - DNA, 25 bp, Rattus norvegicus
gccaggaggtacgaggactaagcct

SEQ ID NO: 391668 - DNA, 25 bp, Rattus norvegicus
gccaggaggtcaagcacaagttcat

SEQ ID NO: 391669 - DNA, 25 bp, Rattus norvegicus
gccaggaggtcatgcacaagttcat

SEQ ID NO: 391670 - DNA, 25 bp, Rattus norvegicus
gccaggagtggtatgcccggtactt

SEQ ID NO: 391671 - DNA, 25 bp, Rattus norvegicus
gccaggagtggtttgcccggtactt

SEQ ID NO: 391672 - DNA, 25 bp, Rattus norvegicus
gccaggatagaaaatacagccgtcg

SEQ ID NO: 391673 - DNA, 25 bp, Rattus norvegicus
gccaggatagaatatacagccgtcg

SEQ ID NO: 391674 - DNA, 25 bp, Rattus norvegicus
gccaggatctcgatgagtacgcaca

SEQ ID NO: 391675 - DNA, 25 bp, Rattus norvegicus
gccaggatctcgttgagtacgcaca

SEQ ID NO: 391676 - DNA, 25 bp, Rattus norvegicus
gccaggatctggcacagcaagttct

SEQ ID NO: 391677 - DNA, 25 bp, Rattus norvegicus
gccaggatctgggacagcaagttct

SEQ ID NO: 391678 - DNA, 25 bp, Rattus norvegicus
gccaggatggctcatgcattattaa

SEQ ID NO: 391679 - DNA, 25 bp, Rattus norvegicus
gccaggatggctgatgcattattaa

SEQ ID NO: 391680 - DNA, 25 bp, Rattus norvegicus
gccaggatgtccacagcaacaaaat

SEQ ID NO: 391681 - DNA, 25 bp, Rattus norvegicus
gccaggatgtcctcagcaacaaaat

SEQ ID NO: 391682 - DNA, 25 bp, Rattus norvegicus
gccaggattctcagagtgcggtcac

SEQ ID NO: 391683 - DNA, 25 bp, Rattus norvegicus
gccaggattctctgagtgcggtcac

SEQ ID NO: 391684 - DNA, 25 bp, Rattus norvegicus
gccaggatttttaggtgcagtgtta

SEQ ID NO: 391685 - DNA, 25 bp, Rattus norvegicus
gccaggattttttggtgcagtgtta

SEQ ID NO: 391686 - DNA, 25 bp, Rattus norvegicus
gccaggcaaggaattgtgtggcctt

SEQ ID NO: 391687 - DNA, 25 bp, Rattus norvegicus
gccaggcaaggatttgtgtggcctt

SEQ ID NO: 391688 - DNA, 25 bp, Rattus norvegicus
gccaggcaccagctagatatgaaag

SEQ ID NO: 391689 - DNA, 25 bp, Rattus norvegicus
gccaggcaccaggtagatatgaaag

SEQ ID NO: 391690 - DNA, 25 bp, Rattus norvegicus
gccaggcactgtctgttgacctttc

SEQ ID NO: 391691 - DNA, 25 bp, Rattus norvegicus
gccaggcactgtgtgttgacctttc

SEQ ID NO: 391692 - DNA, 25 bp, Rattus norvegicus
gccaggcacttacccattgtaattt

SEQ ID NO: 391693 - DNA, 25 bp, Rattus norvegicus
gccaggcacttagccattgtaattt

SEQ ID NO: 391694 - DNA, 25 bp, Rattus norvegicus
gccaggcagaggacaaactttcttt

SEQ ID NO: 391695 - DNA, 25 bp, Rattus norvegicus
gccaggcagaggcagcccaatcttt

SEQ ID NO: 391696 - DNA, 25 bp, Rattus norvegicus
gccaggcagagggagcccaatcttt

SEQ ID NO: 391697 - DNA, 25 bp, Rattus norvegicus
gccaggcagaggtcaaactttcttt

SEQ ID NO: 391698 - DNA, 25 bp, Rattus norvegicus
gccaggcagctgagatcatgtgcaa

SEQ ID NO: 391699 - DNA, 25 bp, Rattus norvegicus
gccaggcagctgtgatcatgtgcaa

SEQ ID NO: 391700 - DNA, 25 bp, Rattus norvegicus
gccaggcaggacatgctgccgagat

SEQ ID NO: 391701 - DNA, 25 bp, Rattus norvegicus
gccaggcaggacttgctgccgagat

SEQ ID NO: 391702 - DNA, 25 bp, Rattus norvegicus
gccaggcagtgaagtggtcaccact

SEQ ID NO: 391703 - DNA, 25 bp, Rattus norvegicus
gccaggcagtgatgtggtcaccact

SEQ ID NO: 391704 - DNA, 25 bp, Rattus norvegicus
gccaggcatccacctaatgagtatt

SEQ ID NO: 391705 - DNA, 25 bp, Rattus norvegicus
gccaggcatccagctaatgagtatt

SEQ ID NO: 391706 - DNA, 25 bp, Rattus norvegicus
gccaggcatcgtctctgactttgca

SEQ ID NO: 391707 - DNA, 25 bp, Rattus norvegicus
gccaggcatcgtgtctgactttgca

SEQ ID NO: 391708 - DNA, 25 bp, Rattus norvegicus
gccaggcatgagctgaaggacttca

SEQ ID NO: 391709 - DNA, 25 bp, Rattus norvegicus
gccaggcatgaggtgaaggacttca

SEQ ID NO: 391710 - DNA, 25 bp, Rattus norvegicus
gccaggccacagacggtttttctaa

SEQ ID NO: 391711 - DNA, 25 bp, Rattus norvegicus
gccaggccacagtcggtttttctaa

SEQ ID NO: 391712 - DNA, 25 bp, Rattus norvegicus
gccaggccactcaagatgcatggtt

SEQ ID NO: 391713 - DNA, 25 bp, Rattus norvegicus
gccaggccactctagatgcatggtt

SEQ ID NO: 391714 - DNA, 25 bp, Rattus norvegicus
gccaggccagtgcattacttaacaa

SEQ ID NO: 391715 - DNA, 25 bp, Rattus norvegicus
gccaggccagtggattacttaacaa

SEQ ID NO: 391716 - DNA, 25 bp, Rattus norvegicus
gccaggccccttatgtcatgagaga

SEQ ID NO: 391717 - DNA, 25 bp, Rattus norvegicus
gccaggccccttttgtcatgagaga

SEQ ID NO: 391718 - DNA, 25 bp, Rattus norvegicus
gccaggccctaccactttgagaaaa

SEQ ID NO: 391719 - DNA, 25 bp, Rattus norvegicus
gccaggccctacgactttgagaaaa

SEQ ID NO: 391720 - DNA, 25 bp, Rattus norvegicus
gccaggccctgtcctgcagaaaaaa

SEQ ID NO: 391721 - DNA, 25 bp, Rattus norvegicus
gccaggccctgtgctgcagaaaaaa

SEQ ID NO: 391722 - DNA, 25 bp, Rattus norvegicus
gccaggcctcttctttggtgggaaa

SEQ ID NO: 391723 - DNA, 25 bp, Rattus norvegicus
gccaggcctcttgtttggtgggaaa

SEQ ID NO: 391724 - DNA, 25 bp, Rattus norvegicus
gccaggcctgacagactgtttcatt

SEQ ID NO: 391725 - DNA, 25 bp, Rattus norvegicus
gccaggcctgactgactgtttcatt

SEQ ID NO: 391726 - DNA, 25 bp, Rattus norvegicus
gccaggcgttttctgagcatacctg

SEQ ID NO: 391727 - DNA, 25 bp, Rattus norvegicus
gccaggcgttttgtgagcatacctg

SEQ ID NO: 391728 - DNA, 25 bp, Rattus norvegicus
gccaggctaacaatttagacggact

SEQ ID NO: 391729 - DNA, 25 bp, Rattus norvegicus
gccaggctaacattttagacggact

SEQ ID NO: 391730 - DNA, 25 bp, Rattus norvegicus
gccaggctagaactcttgaattcag

SEQ ID NO: 391731 - DNA, 25 bp, Rattus norvegicus
gccaggctagaagtcttgaattcag

SEQ ID NO: 391732 - DNA, 25 bp, Rattus norvegicus
gccaggctagttactaatccttctg

SEQ ID NO: 391733 - DNA, 25 bp, Rattus norvegicus
gccaggctagtttctaatccttctg

SEQ ID NO: 391734 - DNA, 25 bp, Rattus norvegicus
gccaggctatgcagtgggatctcaa

SEQ ID NO: 391735 - DNA, 25 bp, Rattus norvegicus
gccaggctatgctgtgggatctcaa

SEQ ID NO: 391736 - DNA, 25 bp, Rattus norvegicus
gccaggctcaagagactgagtcacc

SEQ ID NO: 391737 - DNA, 25 bp, Rattus norvegicus
gccaggctcaagtgactgagtcacc

SEQ ID NO: 391738 - DNA, 25 bp, Rattus norvegicus
gccaggctccagatgtcctaaatat

SEQ ID NO: 391739 - DNA, 25 bp, Rattus norvegicus
gccaggctccagttgtcctaaatat

SEQ ID NO: 391740 - DNA, 25 bp, Rattus norvegicus
gccaggctcctgactcagtaatgta

SEQ ID NO: 391741 - DNA, 25 bp, Rattus norvegicus
gccaggctcctgtctcagtaatgta

SEQ ID NO: 391742 - DNA, 25 bp, Rattus norvegicus
gccaggctgtgaccaccacagggca

SEQ ID NO: 391743 - DNA, 25 bp, Rattus norvegicus
gccaggctgtgagcaccacagggca

SEQ ID NO: 391744 - DNA, 25 bp, Rattus norvegicus
gccaggctgtgtccttgagtactaa

SEQ ID NO: 391745 - DNA, 25 bp, Rattus norvegicus
gccaggctgtgtgcttgagtactaa

SEQ ID NO: 391746 - DNA, 25 bp, Rattus norvegicus
gccaggctgtttactttccaacgat

SEQ ID NO: 391747 - DNA, 25 bp, Rattus norvegicus
gccaggctgttttctttccaacgat

SEQ ID NO: 391748 - DNA, 25 bp, Rattus norvegicus
gccaggcttgtcagttgcgggacaa

SEQ ID NO: 391749 - DNA, 25 bp, Rattus norvegicus
gccaggcttgtctgttgcgggacaa

SEQ ID NO: 391750 - DNA, 25 bp, Rattus norvegicus
gccaggctttcccactttgtgagag

SEQ ID NO: 391751 - DNA, 25 bp, Rattus norvegicus
gccaggctttccgactttgtgagag

SEQ ID NO: 391752 - DNA, 25 bp, Rattus norvegicus
gccaggctttcgagctgatcttaaa

SEQ ID NO: 391753 - DNA, 25 bp, Rattus norvegicus
gccaggctttcgtgctgatcttaaa

SEQ ID NO: 391754 - DNA, 25 bp, Rattus norvegicus
gccaggcttttcacaggagcttcaa

SEQ ID NO: 391755 - DNA, 25 bp, Rattus norvegicus
gccaggcttttctcaggagcttcaa

SEQ ID NO: 391756 - DNA, 25 bp, Rattus norvegicus
gccaggctttttcaccatattacaa

SEQ ID NO: 391757 - DNA, 25 bp, Rattus norvegicus
gccaggctttttgaccatattacaa

SEQ ID NO: 391758 - DNA, 25 bp, Rattus norvegicus
gccagggaagctatctgccaggcta

SEQ ID NO: 391759 - DNA, 25 bp, Rattus norvegicus
gccagggaagctttctgccaggcta

SEQ ID NO: 391760 - DNA, 25 bp, Rattus norvegicus
gccagggaattgaatggccgccctt

SEQ ID NO: 391761 - DNA, 25 bp, Rattus norvegicus
gccagggaattgtatggccgccctt

SEQ ID NO: 391762 - DNA, 25 bp, Rattus norvegicus
gccagggagcacctagagatataaa

SEQ ID NO: 391763 - DNA, 25 bp, Rattus norvegicus
gccagggagcacgtagagatataaa

SEQ ID NO: 391764 - DNA, 25 bp, Rattus norvegicus
gccagggatcagacagcgtgtagtc

SEQ ID NO: 391765 - DNA, 25 bp, Rattus norvegicus
gccagggatcagtcagcgtgtagtc

SEQ ID NO: 391766 - DNA, 25 bp, Rattus norvegicus
gccagggatgcacgctggaagccaa

SEQ ID NO: 391767 - DNA, 25 bp, Rattus norvegicus
gccagggatgcaggctggaagccaa

SEQ ID NO: 391768 - DNA, 25 bp, Rattus norvegicus
gccagggatgggattcaagtactct

SEQ ID NO: 391769 - DNA, 25 bp, Rattus norvegicus
gccagggatgggtttcaagtactct

SEQ ID NO: 391770 - DNA, 25 bp, Rattus norvegicus
gccagggccactagcagagacttat

SEQ ID NO: 391771 - DNA, 25 bp, Rattus norvegicus
gccagggccacttgcagagacttat

SEQ ID NO: 391772 - DNA, 25 bp, Rattus norvegicus
gccagggcctgaattagactttgta

SEQ ID NO: 391773 - DNA, 25 bp, Rattus norvegicus
gccagggcctgatttagactttgta

SEQ ID NO: 391774 - DNA, 25 bp, Rattus norvegicus
gccagggcctggaaatcattgattc

SEQ ID NO: 391775 - DNA, 25 bp, Rattus norvegicus
gccagggcctggtaatcattgattc

SEQ ID NO: 391776 - DNA, 25 bp, Rattus norvegicus
gccagggctacaaagacattgctat

SEQ ID NO: 391777 - DNA, 25 bp, Rattus norvegicus
gccagggctacatagacattgctat

SEQ ID NO: 391778 - DNA, 25 bp, Rattus norvegicus
gccagggctagtaagtgttttctca

SEQ ID NO: 391779 - DNA, 25 bp, Rattus norvegicus
gccagggctagttagtgttttctca

SEQ ID NO: 391780 - DNA, 25 bp, Rattus norvegicus
gccagggctataaaatgagactttg

SEQ ID NO: 391781 - DNA, 25 bp, Rattus norvegicus
gccagggctatataatgagactttg

SEQ ID NO: 391782 - DNA, 25 bp, Rattus norvegicus
gccagggctgcgcatcttcaggaaa

SEQ ID NO: 391783 - DNA, 25 bp, Rattus norvegicus
gccagggctgcggatcttcaggaaa

SEQ ID NO: 391784 - DNA, 25 bp, Rattus norvegicus
gccagggctggtacctaacacagaa

SEQ ID NO: 391785 - DNA, 25 bp, Rattus norvegicus
gccagggctggttcctaacacagaa

SEQ ID NO: 391786 - DNA, 25 bp, Rattus norvegicus
gccagggcttagagtaggttcacat

SEQ ID NO: 391787 - DNA, 25 bp, Rattus norvegicus
gccagggcttagtgtaggttcacat

SEQ ID NO: 391788 - DNA, 25 bp, Rattus norvegicus
gccagggcttgacctgcatgtcagt

SEQ ID NO: 391789 - DNA, 25 bp, Rattus norvegicus
gccagggcttgagctgcatgtcagt

SEQ ID NO: 391790 - DNA, 25 bp, Rattus norvegicus
gccagggctttcaatcattgccaat

SEQ ID NO: 391791 - DNA, 25 bp, Rattus norvegicus
gccagggctttctatcattgccaat

SEQ ID NO: 391792 - DNA, 25 bp, Rattus norvegicus
gccagggtaactccgctgctcagaa

SEQ ID NO: 391793 - DNA, 25 bp, Rattus norvegicus
gccagggtaactgcgctgctcagaa

SEQ ID NO: 391794 - DNA, 25 bp, Rattus norvegicus
gccagggtagacaagctcaaccagc

SEQ ID NO: 391795 - DNA, 25 bp, Rattus norvegicus
gccagggtagactagctcaaccagc

SEQ ID NO: 391796 - DNA, 25 bp, Rattus norvegicus
gccagggtctgaattgggccccatt

SEQ ID NO: 391797 - DNA, 25 bp, Rattus norvegicus
gccagggtctgatttgggccccatt

SEQ ID NO: 391798 - DNA, 25 bp, Rattus norvegicus
gccagggttacaccatccgcattct

SEQ ID NO: 391799 - DNA, 25 bp, Rattus norvegicus
gccagggttacagcatccgcattct

SEQ ID NO: 391800 - DNA, 25 bp, Rattus norvegicus
gccagggttcccacatgtatattaa

SEQ ID NO: 391801 - DNA, 25 bp, Rattus norvegicus
gccagggttccctcatgtatattaa

SEQ ID NO: 391802 - DNA, 25 bp, Rattus norvegicus
gccagggttgagactgtttctacac

SEQ ID NO: 391803 - DNA, 25 bp, Rattus norvegicus
gccagggttgagtctgtttctacac

SEQ ID NO: 391804 - DNA, 25 bp, Rattus norvegicus
gccaggtaatacacattcttgccaa

SEQ ID NO: 391805 - DNA, 25 bp, Rattus norvegicus
gccaggtaatactcattcttgccaa

SEQ ID NO: 391806 - DNA, 25 bp, Rattus norvegicus
gccaggtaatatctgtaggactcca

SEQ ID NO: 391807 - DNA, 25 bp, Rattus norvegicus
gccaggtaatatgtgtaggactcca

SEQ ID NO: 391808 - DNA, 25 bp, Rattus norvegicus
gccaggtaatgcattatgctttcca

SEQ ID NO: 391809 - DNA, 25 bp, Rattus norvegicus
gccaggtaatgctttatgctttcca

SEQ ID NO: 391810 - DNA, 25 bp, Rattus norvegicus
gccaggtacctgagctccaagtgaa

SEQ ID NO: 391811 - DNA, 25 bp, Rattus norvegicus
gccaggtacctgtgctccaagtgaa

SEQ ID NO: 391812 - DNA, 25 bp, Rattus norvegicus
gccaggtataagagcctacccttgt

SEQ ID NO: 391813 - DNA, 25 bp, Rattus norvegicus
gccaggtataagtgcctacccttgt

SEQ ID NO: 391814 - DNA, 25 bp, Rattus norvegicus
gccaggtatcaactccttacaacaa

SEQ ID NO: 391815 - DNA, 25 bp, Rattus norvegicus
gccaggtatcaagtccttacaacaa

SEQ ID NO: 391816 - DNA, 25 bp, Rattus norvegicus
gccaggtatggacgcttcaggatac

SEQ ID NO: 391817 - DNA, 25 bp, Rattus norvegicus
gccaggtatggaggcttcaggatac

SEQ ID NO: 391818 - DNA, 25 bp, Rattus norvegicus
gccaggtccaggctgagttcatcat

SEQ ID NO: 391819 - DNA, 25 bp, Rattus norvegicus
gccaggtccagggtgagttcatcat

SEQ ID NO: 391820 - DNA, 25 bp, Rattus norvegicus
gccaggtctacacgacaaggactac

SEQ ID NO: 391821 - DNA, 25 bp, Rattus norvegicus
gccaggtctacaggacaaggactac

SEQ ID NO: 391822 - DNA, 25 bp, Rattus norvegicus
gccaggtctctgctatacttcatca

SEQ ID NO: 391823 - DNA, 25 bp, Rattus norvegicus
gccaggtctctggtatacttcatca

SEQ ID NO: 391824 - DNA, 25 bp, Rattus norvegicus
gccaggtctgcgaacagtcagagaa

SEQ ID NO: 391825 - DNA, 25 bp, Rattus norvegicus
gccaggtctgcgtacagtcagagaa

SEQ ID NO: 391826 - DNA, 25 bp, Rattus norvegicus
gccaggtcttctatagtttttctca

SEQ ID NO: 391827 - DNA, 25 bp, Rattus norvegicus
gccaggtcttctttagtttttctca

SEQ ID NO: 391828 - DNA, 25 bp, Rattus norvegicus
gccaggtgagatcgctaagtacatg

SEQ ID NO: 391829 - DNA, 25 bp, Rattus norvegicus
gccaggtgagatggctaagtacatg

SEQ ID NO: 391830 - DNA, 25 bp, Rattus norvegicus
gccaggtgattgagtttgccatttg

SEQ ID NO: 391831 - DNA, 25 bp, Rattus norvegicus
gccaggtgattgtgtttgccatttg

SEQ ID NO: 391832 - DNA, 25 bp, Rattus norvegicus
gccaggtgccacatagtattgattt

SEQ ID NO: 391833 - DNA, 25 bp, Rattus norvegicus
gccaggtgccacttagtattgattt

SEQ ID NO: 391834 - DNA, 25 bp, Rattus norvegicus
gccaggtgccccatttcacctgtta

SEQ ID NO: 391835 - DNA, 25 bp, Rattus norvegicus
gccaggtgccccttttcacctgtta

SEQ ID NO: 391836 - DNA, 25 bp, Rattus norvegicus
gccaggtggagtagagaccgctgtt

SEQ ID NO: 391837 - DNA, 25 bp, Rattus norvegicus
gccaggtggagttgagaccgctgtt

SEQ ID NO: 391838 - DNA, 25 bp, Rattus norvegicus
gccaggtgtgctaatgagcgcccaa

SEQ ID NO: 391839 - DNA, 25 bp, Rattus norvegicus
gccaggtgtgcttatgagcgcccaa

SEQ ID NO: 391840 - DNA, 25 bp, Rattus norvegicus
gccaggtgttgtagcacatgatttt

SEQ ID NO: 391841 - DNA, 25 bp, Rattus norvegicus
gccaggtgttgttgcacatgatttt

SEQ ID NO: 391842 - DNA, 25 bp, Rattus norvegicus
gccaggttatctagtactaatgtaa

SEQ ID NO: 391843 - DNA, 25 bp, Rattus norvegicus
gccaggttatcttgtactaatgtaa

SEQ ID NO: 391844 - DNA, 25 bp, Rattus norvegicus
gccaggttatgcactctagaggtca

SEQ ID NO: 391845 - DNA, 25 bp, Rattus norvegicus
gccaggttatgctctctagaggtca

SEQ ID NO: 391846 - DNA, 25 bp, Rattus norvegicus
gccaggttcaacaacacagcgattt

SEQ ID NO: 391847 - DNA, 25 bp, Rattus norvegicus
gccaggttcaactacacagcgattt

SEQ ID NO: 391848 - DNA, 25 bp, Rattus norvegicus
gccaggttcatcctctgagagttca

SEQ ID NO: 391849 - DNA, 25 bp, Rattus norvegicus
gccaggttcatcgtctgagagttca

SEQ ID NO: 391850 - DNA, 25 bp, Rattus norvegicus
gccaggttcccactataaatcagcc

SEQ ID NO: 391851 - DNA, 25 bp, Rattus norvegicus
gccaggttcccagtataaatcagcc

SEQ ID NO: 391852 - DNA, 25 bp, Rattus norvegicus
gccaggttgtggattcagcatcgac

SEQ ID NO: 391853 - DNA, 25 bp, Rattus norvegicus
gccaggttgtggtttcagcatcgac

SEQ ID NO: 391854 - DNA, 25 bp, Rattus norvegicus
gccaggtttccaatgattcattcta

SEQ ID NO: 391855 - DNA, 25 bp, Rattus norvegicus
gccaggtttccattgattcattcta

SEQ ID NO: 391856 - DNA, 25 bp, Rattus norvegicus
gccaggtttggcaatccatattcag

SEQ ID NO: 391857 - DNA, 25 bp, Rattus norvegicus
gccaggtttggctatccatattcag

SEQ ID NO: 391858 - DNA, 25 bp, Rattus norvegicus
gccagtaaccatcacgacggccgtt

SEQ ID NO: 391859 - DNA, 25 bp, Rattus norvegicus
gccagtaaccatgacgacggccgtt

SEQ ID NO: 391860 - DNA, 25 bp, Rattus norvegicus
gccagtaactgtccttgtagctatg

SEQ ID NO: 391861 - DNA, 25 bp, Rattus norvegicus
gccagtaactgtgcttgtagctatg

SEQ ID NO: 391862 - DNA, 25 bp, Rattus norvegicus
gccagtaagcagcatgtcactttta

SEQ ID NO: 391863 - DNA, 25 bp, Rattus norvegicus
gccagtaagcaggatgtcactttta

SEQ ID NO: 391864 - DNA, 25 bp, Rattus norvegicus
gccagtaaggagcattcctccataa

SEQ ID NO: 391865 - DNA, 25 bp, Rattus norvegicus
gccagtaaggaggattcctccataa

SEQ ID NO: 391866 - DNA, 25 bp, Rattus norvegicus
gccagtacagccagaggaaacagcc

SEQ ID NO: 391867 - DNA, 25 bp, Rattus norvegicus
gccagtacagcctgaggaaacagcc

SEQ ID NO: 391868 - DNA, 25 bp, Rattus norvegicus
gccagtacagggactgatccgacat

SEQ ID NO: 391869 - DNA, 25 bp, Rattus norvegicus
gccagtacagggtctgatccgacat

SEQ ID NO: 391870 - DNA, 25 bp, Rattus norvegicus
gccagtacatctcagctaagtgttt

SEQ ID NO: 391871 - DNA, 25 bp, Rattus norvegicus
gccagtacatctgagctaagtgttt

SEQ ID NO: 391872 - DNA, 25 bp, Rattus norvegicus
gccagtaccctgatcatgatatctg

SEQ ID NO: 391873 - DNA, 25 bp, Rattus norvegicus
gccagtaccctgttcatgatatctg

SEQ ID NO: 391874 - DNA, 25 bp, Rattus norvegicus
gccagtacctgaaccttttaatttg

SEQ ID NO: 391875 - DNA, 25 bp, Rattus norvegicus
gccagtacctgatccttttaatttg

SEQ ID NO: 391876 - DNA, 25 bp, Rattus norvegicus
gccagtacttttccctttccttaag

SEQ ID NO: 391877 - DNA, 25 bp, Rattus norvegicus
gccagtacttttgcctttccttaag

SEQ ID NO: 391878 - DNA, 25 bp, Rattus norvegicus
gccagtagactgcttcctcacttta

SEQ ID NO: 391879 - DNA, 25 bp, Rattus norvegicus
gccagtagactggttcctcacttta

SEQ ID NO: 391880 - DNA, 25 bp, Rattus norvegicus
gccagtagatccatctaagttgccc

SEQ ID NO: 391881 - DNA, 25 bp, Rattus norvegicus
gccagtagatccttctaagttgccc

SEQ ID NO: 391882 - DNA, 25 bp, Rattus norvegicus
gccagtagcaacagtatatccagga

SEQ ID NO: 391883 - DNA, 25 bp, Rattus norvegicus
gccagtagcaactgtatatccagga

SEQ ID NO: 391884 - DNA, 25 bp, Rattus norvegicus
gccagtagccttagctcacaagaga

SEQ ID NO: 391885 - DNA, 25 bp, Rattus norvegicus
gccagtagcctttgctcacaagaga

SEQ ID NO: 391886 - DNA, 25 bp, Rattus norvegicus
gccagtagctggatccttgaggtca

SEQ ID NO: 391887 - DNA, 25 bp, Rattus norvegicus
gccagtagctggttccttgaggtca

SEQ ID NO: 391888 - DNA, 25 bp, Rattus norvegicus
gccagtaggcgtaggaagcactcat

SEQ ID NO: 391889 - DNA, 25 bp, Rattus norvegicus
gccagtaggcgttggaagcactcat

SEQ ID NO: 391890 - DNA, 25 bp, Rattus norvegicus
gccagtagtttgaaggccctataag

SEQ ID NO: 391891 - DNA, 25 bp, Rattus norvegicus
gccagtagtttgtaggccctataag

SEQ ID NO: 391892 - DNA, 25 bp, Rattus norvegicus
gccagtatgattctctttgcctttt

SEQ ID NO: 391893 - DNA, 25 bp, Rattus norvegicus
gccagtatgattgtctttgcctttt

SEQ ID NO: 391894 - DNA, 25 bp, Rattus norvegicus
gccagtattatacctcacaccttta

SEQ ID NO: 391895 - DNA, 25 bp, Rattus norvegicus
gccagtattatagctcacaccttta

SEQ ID NO: 391896 - DNA, 25 bp, Rattus norvegicus
gccagtattgtaattctgactttga

SEQ ID NO: 391897 - DNA, 25 bp, Rattus norvegicus
gccagtattgtatttctgactttga

SEQ ID NO: 391898 - DNA, 25 bp, Rattus norvegicus
gccagtattgtgagtcatgcctgta

SEQ ID NO: 391899 - DNA, 25 bp, Rattus norvegicus
gccagtattgtgtgtcatgcctgta

SEQ ID NO: 391900 - DNA, 25 bp, Rattus norvegicus
gccagtattgttactggttagggac

SEQ ID NO: 391901 - DNA, 25 bp, Rattus norvegicus
gccagtattgtttctggttagggac

SEQ ID NO: 391902 - DNA, 25 bp, Rattus norvegicus
gccagtcaacggctgaagaactttg

SEQ ID NO: 391903 - DNA, 25 bp, Rattus norvegicus
gccagtcaacgggtgaagaactttg

SEQ ID NO: 391904 - DNA, 25 bp, Rattus norvegicus
gccagtcaagatcctttcatgatat

SEQ ID NO: 391905 - DNA, 25 bp, Rattus norvegicus
gccagtcaagatgctttcatgatat

SEQ ID NO: 391906 - DNA, 25 bp, Rattus norvegicus
gccagtcaatggaggagtttgcctt

SEQ ID NO: 391907 - DNA, 25 bp, Rattus norvegicus
gccagtcaatggctgcgacttacat

SEQ ID NO: 391908 - DNA, 25 bp, Rattus norvegicus
gccagtcaatgggtgcgacttacat

SEQ ID NO: 391909 - DNA, 25 bp, Rattus norvegicus
gccagtcaatggtggagtttgcctt

SEQ ID NO: 391910 - DNA, 25 bp, Rattus norvegicus
gccagtcacacaataacactgcatg

SEQ ID NO: 391911 - DNA, 25 bp, Rattus norvegicus
gccagtcacacattaacactgcatg

SEQ ID NO: 391912 - DNA, 25 bp, Rattus norvegicus
gccagtcacccactgatagtacggc

SEQ ID NO: 391913 - DNA, 25 bp, Rattus norvegicus
gccagtcacccagtgatagtacggc

SEQ ID NO: 391914 - DNA, 25 bp, Rattus norvegicus
gccagtcacctcattcagaacatag

SEQ ID NO: 391915 - DNA, 25 bp, Rattus norvegicus
gccagtcacctctttcagaacatag

SEQ ID NO: 391916 - DNA, 25 bp, Rattus norvegicus
gccagtcaccttacagctagactga

SEQ ID NO: 391917 - DNA, 25 bp, Rattus norvegicus
gccagtcacctttcagctagactga

SEQ ID NO: 391918 - DNA, 25 bp, Rattus norvegicus
gccagtcacggtccaaacctgtaat

SEQ ID NO: 391919 - DNA, 25 bp, Rattus norvegicus
gccagtcacggtgcaaacctgtaat

SEQ ID NO: 391920 - DNA, 25 bp, Rattus norvegicus
gccagtcacgtgcttatatctgtaa

SEQ ID NO: 391921 - DNA, 25 bp, Rattus norvegicus
gccagtcacgtggttatatctgtaa

SEQ ID NO: 391922 - DNA, 25 bp, Rattus norvegicus
gccagtccaacaatggttatccacc

SEQ ID NO: 391923 - DNA, 25 bp, Rattus norvegicus
gccagtccaacattggttatccacc

SEQ ID NO: 391924 - DNA, 25 bp, Rattus norvegicus
gccagtcccaagaggctttttaatt

SEQ ID NO: 391925 - DNA, 25 bp, Rattus norvegicus
gccagtcccaagctttgtgaattct

SEQ ID NO: 391926 - DNA, 25 bp, Rattus norvegicus
gccagtcccaaggtttgtgaattct

SEQ ID NO: 391927 - DNA, 25 bp, Rattus norvegicus
gccagtcccaagtggctttttaatt

SEQ ID NO: 391928 - DNA, 25 bp, Rattus norvegicus
gccagtccctgcacaaacaaatata

SEQ ID NO: 391929 - DNA, 25 bp, Rattus norvegicus
gccagtccctgctcaaacaaatata

SEQ ID NO: 391930 - DNA, 25 bp, Rattus norvegicus
gccagtccggcaccgacagggttaa

SEQ ID NO: 391931 - DNA, 25 bp, Rattus norvegicus
gccagtccggcagcgacagggttaa

SEQ ID NO: 391932 - DNA, 25 bp, Rattus norvegicus
gccagtcctggccatccaaaggaat

SEQ ID NO: 391933 - DNA, 25 bp, Rattus norvegicus
gccagtcctggcgatccaaaggaat

SEQ ID NO: 391934 - DNA, 25 bp, Rattus norvegicus
gccagtcctgttacttgtgtgatca

SEQ ID NO: 391935 - DNA, 25 bp, Rattus norvegicus
gccagtcctgtttcttgtgtgatca

SEQ ID NO: 391936 - DNA, 25 bp, Rattus norvegicus
gccagtccttaacgcttagcttctg

SEQ ID NO: 391937 - DNA, 25 bp, Rattus norvegicus
gccagtccttaaggcttagcttctg

SEQ ID NO: 391938 - DNA, 25 bp, Rattus norvegicus
gccagtccttagatagtggaggcac

SEQ ID NO: 391939 - DNA, 25 bp, Rattus norvegicus
gccagtccttagttagtggaggcac

SEQ ID NO: 391940 - DNA, 25 bp, Rattus norvegicus
gccagtccttggcaggttttctatt

SEQ ID NO: 391941 - DNA, 25 bp, Rattus norvegicus
gccagtccttgggaggttttctatt

SEQ ID NO: 391942 - DNA, 25 bp, Rattus norvegicus
gccagtcgaggcaatgttgtaagag

SEQ ID NO: 391943 - DNA, 25 bp, Rattus norvegicus
gccagtcgaggctatgttgtaagag

SEQ ID NO: 391944 - DNA, 25 bp, Rattus norvegicus
gccagtctagccctatgtatgtatg

SEQ ID NO: 391945 - DNA, 25 bp, Rattus norvegicus
gccagtctagccgtatgtatgtatg

SEQ ID NO: 391946 - DNA, 25 bp, Rattus norvegicus
gccagtctcaacactcgggagtata

SEQ ID NO: 391947 - DNA, 25 bp, Rattus norvegicus
gccagtctcaactctcgggagtata

SEQ ID NO: 391948 - DNA, 25 bp, Rattus norvegicus
gccagtctcactcctgaagaatatc

SEQ ID NO: 391949 - DNA, 25 bp, Rattus norvegicus
gccagtctcactgctgaagaatatc

SEQ ID NO: 391950 - DNA, 25 bp, Rattus norvegicus
gccagtctcaggctttgggtgcaaa

SEQ ID NO: 391951 - DNA, 25 bp, Rattus norvegicus
gccagtctcagggtttgggtgcaaa

SEQ ID NO: 391952 - DNA, 25 bp, Rattus norvegicus
gccagtctctccaggaacagctgaa

SEQ ID NO: 391953 - DNA, 25 bp, Rattus norvegicus
gccagtctctcctggaacagctgaa

SEQ ID NO: 391954 - DNA, 25 bp, Rattus norvegicus
gccagtctctggctgagcatatata

SEQ ID NO: 391955 - DNA, 25 bp, Rattus norvegicus
gccagtctctgggtgagcatatata

SEQ ID NO: 391956 - DNA, 25 bp, Rattus norvegicus
gccagtctgatcaacagagtgagtt

SEQ ID NO: 391957 - DNA, 25 bp, Rattus norvegicus
gccagtctgatctacagagtgagtt

SEQ ID NO: 391958 - DNA, 25 bp, Rattus norvegicus
gccagtctgggcagtagcagtgaaa

SEQ ID NO: 391959 - DNA, 25 bp, Rattus norvegicus
gccagtctgggctgtagcagtgaaa

SEQ ID NO: 391960 - DNA, 25 bp, Rattus norvegicus
gccagtctgtggcactctgttacag

SEQ ID NO: 391961 - DNA, 25 bp, Rattus norvegicus
gccagtctgtgggactctgttacag

SEQ ID NO: 391962 - DNA, 25 bp, Rattus norvegicus
gccagtcttactatgatgccattgt

SEQ ID NO: 391963 - DNA, 25 bp, Rattus norvegicus
gccagtcttactttgatgccattgt

SEQ ID NO: 391964 - DNA, 25 bp, Rattus norvegicus
gccagtcttcttacagggcttgaga

SEQ ID NO: 391965 - DNA, 25 bp, Rattus norvegicus
gccagtcttctttcagggcttgaga

SEQ ID NO: 391966 - DNA, 25 bp, Rattus norvegicus
gccagtctttggcagcagactcttt

SEQ ID NO: 391967 - DNA, 25 bp, Rattus norvegicus
gccagtctttgggagcagactcttt

SEQ ID NO: 391968 - DNA, 25 bp, Rattus norvegicus
gccagtctttgtacatagctttaaa

SEQ ID NO: 391969 - DNA, 25 bp, Rattus norvegicus
gccagtctttgttcatagctttaaa

SEQ ID NO: 391970 - DNA, 25 bp, Rattus norvegicus
gccagtgaacccaaccaagagcagc

SEQ ID NO: 391971 - DNA, 25 bp, Rattus norvegicus
gccagtgaaccctaccaagagcagc

SEQ ID NO: 391972 - DNA, 25 bp, Rattus norvegicus
gccagtgaaccgcagttcagtcact

SEQ ID NO: 391973 - DNA, 25 bp, Rattus norvegicus
gccagtgaaccggagttcagtcact

SEQ ID NO: 391974 - DNA, 25 bp, Rattus norvegicus
gccagtgaatttcagggtttcccaa

SEQ ID NO: 391975 - DNA, 25 bp, Rattus norvegicus
gccagtgaatttgagggtttcccaa

SEQ ID NO: 391976 - DNA, 25 bp, Rattus norvegicus
gccagtgacagtagtttccttcaaa

SEQ ID NO: 391977 - DNA, 25 bp, Rattus norvegicus
gccagtgacagttgtttccttcaaa

SEQ ID NO: 391978 - DNA, 25 bp, Rattus norvegicus
gccagtgacataccagtgtgctata

SEQ ID NO: 391979 - DNA, 25 bp, Rattus norvegicus
gccagtgacatagcagtgtgctata

SEQ ID NO: 391980 - DNA, 25 bp, Rattus norvegicus
gccagtgaccacagtgtttaaatta

SEQ ID NO: 391981 - DNA, 25 bp, Rattus norvegicus
gccagtgaccactgtgtttaaatta

SEQ ID NO: 391982 - DNA, 25 bp, Rattus norvegicus
gccagtgacccgacgtttaaacctg

SEQ ID NO: 391983 - DNA, 25 bp, Rattus norvegicus
gccagtgacccgtcgtttaaacctg

SEQ ID NO: 391984 - DNA, 25 bp, Rattus norvegicus
gccagtgacgtgatccaggagcaca

SEQ ID NO: 391985 - DNA, 25 bp, Rattus norvegicus
gccagtgacgtgttccaggagcaca

SEQ ID NO: 391986 - DNA, 25 bp, Rattus norvegicus
gccagtgactcaccttgaagacgac

SEQ ID NO: 391987 - DNA, 25 bp, Rattus norvegicus
gccagtgactcagcttgaagacgac

SEQ ID NO: 391988 - DNA, 25 bp, Rattus norvegicus
gccagtgactttctttattcttcag

SEQ ID NO: 391989 - DNA, 25 bp, Rattus norvegicus
gccagtgactttgtttattcttcag

SEQ ID NO: 391990 - DNA, 25 bp, Rattus norvegicus
gccagtgagaaaactgctgctgcac

SEQ ID NO: 391991 - DNA, 25 bp, Rattus norvegicus
gccagtgagaaatctgctgctgcac

SEQ ID NO: 391992 - DNA, 25 bp, Rattus norvegicus
gccagtgagcaaagtcctgcttcca

SEQ ID NO: 391993 - DNA, 25 bp, Rattus norvegicus
gccagtgagcaatgtcctgcttcca

SEQ ID NO: 391994 - DNA, 25 bp, Rattus norvegicus
gccagtgaggccatattagactaat

SEQ ID NO: 391995 - DNA, 25 bp, Rattus norvegicus
gccagtgaggccttattagactaat

SEQ ID NO: 391996 - DNA, 25 bp, Rattus norvegicus
gccagtgaggttacatacgcaggtg

SEQ ID NO: 391997 - DNA, 25 bp, Rattus norvegicus
gccagtgaggtttcatacgcaggtg

SEQ ID NO: 391998 - DNA, 25 bp, Rattus norvegicus
gccagtgcaccaagccaacaaatgt

SEQ ID NO: 391999 - DNA, 25 bp, Rattus norvegicus
gccagtgcaccatgccaacaaatgt

SEQ ID NO: 392000 - DNA, 25 bp, Rattus norvegicus
gccagtgcactaatctctttggaga

SEQ ID NO: 392001 - DNA, 25 bp, Rattus norvegicus
gccagtgcactattctctttggaga

SEQ ID NO: 392002 - DNA, 25 bp, Rattus norvegicus
gccagtgcagaaccatctattatcg

SEQ ID NO: 392003 - DNA, 25 bp, Rattus norvegicus
gccagtgcagaagcatctattatcg

SEQ ID NO: 392004 - DNA, 25 bp, Rattus norvegicus
gccagtgcagagatctatgtccagt

SEQ ID NO: 392005 - DNA, 25 bp, Rattus norvegicus
gccagtgcagagttctatgtccagt

SEQ ID NO: 392006 - DNA, 25 bp, Rattus norvegicus
gccagtgcaggccagagaagcttca

SEQ ID NO: 392007 - DNA, 25 bp, Rattus norvegicus
gccagtgcaggcgagagaagcttca

SEQ ID NO: 392008 - DNA, 25 bp, Rattus norvegicus
gccagtgccaacaggaagccgacga

SEQ ID NO: 392009 - DNA, 25 bp, Rattus norvegicus
gccagtgccaactggaagccgacga

SEQ ID NO: 392010 - DNA, 25 bp, Rattus norvegicus
gccagtgccaagcacaatttcaacg

SEQ ID NO: 392011 - DNA, 25 bp, Rattus norvegicus
gccagtgccaaggacaatttcaacg

SEQ ID NO: 392012 - DNA, 25 bp, Rattus norvegicus
gccagtgccactacacacaaatggg

SEQ ID NO: 392013 - DNA, 25 bp, Rattus norvegicus
gccagtgccacttcacacaaatggg

SEQ ID NO: 392014 - DNA, 25 bp, Rattus norvegicus
gccagtgccattctggaaggcttaa

SEQ ID NO: 392015 - DNA, 25 bp, Rattus norvegicus
gccagtgccattgtggaaggcttaa

SEQ ID NO: 392016 - DNA, 25 bp, Rattus norvegicus
gccagtgccgggaagacgacaaagt

SEQ ID NO: 392017 - DNA, 25 bp, Rattus norvegicus
gccagtgccgggtagacgacaaagt

SEQ ID NO: 392018 - DNA, 25 bp, Rattus norvegicus
gccagtgccgtgactgcatgagaag

SEQ ID NO: 392019 - DNA, 25 bp, Rattus norvegicus
gccagtgccgtgtctgcatgagaag

SEQ ID NO: 392020 - DNA, 25 bp, Rattus norvegicus
gccagtgcctggacagattccaatt

SEQ ID NO: 392021 - DNA, 25 bp, Rattus norvegicus
gccagtgcctggtcagattccaatt

SEQ ID NO: 392022 - DNA, 25 bp, Rattus norvegicus
gccagtgcgctacagcaacagtgaa

SEQ ID NO: 392023 - DNA, 25 bp, Rattus norvegicus
gccagtgcgctagagcaacagtgaa

SEQ ID NO: 392024 - DNA, 25 bp, Rattus norvegicus
gccagtgcggtgaatgtctgattat

SEQ ID NO: 392025 - DNA, 25 bp, Rattus norvegicus
gccagtgcggtgtatgtctgattat

SEQ ID NO: 392026 - DNA, 25 bp, Rattus norvegicus
gccagtgctaccatttatgtgtcct

SEQ ID NO: 392027 - DNA, 25 bp, Rattus norvegicus
gccagtgctaccttttatgtgtcct

SEQ ID NO: 392028 - DNA, 25 bp, Rattus norvegicus
gccagtgctagtcttccgtgtgaaa

SEQ ID NO: 392029 - DNA, 25 bp, Rattus norvegicus
gccagtgctagtgttccgtgtgaaa

SEQ ID NO: 392030 - DNA, 25 bp, Rattus norvegicus
gccagtgctggacaccacctttaaa

SEQ ID NO: 392031 - DNA, 25 bp, Rattus norvegicus
gccagtgctggagaccacctttaaa

SEQ ID NO: 392032 - DNA, 25 bp, Rattus norvegicus
gccagtgcttcacggaacttatcta

SEQ ID NO: 392033 - DNA, 25 bp, Rattus norvegicus
gccagtgcttcagggaacttatcta

SEQ ID NO: 392034 - DNA, 25 bp, Rattus norvegicus
gccagtggcaggcatccttgtagtt

SEQ ID NO: 392035 - DNA, 25 bp, Rattus norvegicus
gccagtggcagggatccttgtagtt

SEQ ID NO: 392036 - DNA, 25 bp, Rattus norvegicus
gccagtggcattctgacgcagacct

SEQ ID NO: 392037 - DNA, 25 bp, Rattus norvegicus
gccagtggcattgtgacgcagacct

SEQ ID NO: 392038 - DNA, 25 bp, Rattus norvegicus
gccagtggctccaggctgagaaatt

SEQ ID NO: 392039 - DNA, 25 bp, Rattus norvegicus
gccagtggctcctggctgagaaatt

SEQ ID NO: 392040 - DNA, 25 bp, Rattus norvegicus
gccagtggctttaatgatctgacca

SEQ ID NO: 392041 - DNA, 25 bp, Rattus norvegicus
gccagtggcttttatgatctgacca

SEQ ID NO: 392042 - DNA, 25 bp, Rattus norvegicus
gccagtgggagcatctcaagaataa

SEQ ID NO: 392043 - DNA, 25 bp, Rattus norvegicus
gccagtgggagcttctcaagaataa

SEQ ID NO: 392044 - DNA, 25 bp, Rattus norvegicus
gccagtgggcttacatgatgggata

SEQ ID NO: 392045 - DNA, 25 bp, Rattus norvegicus
gccagtgggctttcatgatgggata

SEQ ID NO: 392046 - DNA, 25 bp, Rattus norvegicus
gccagtgggtgcatcatatgctcta

SEQ ID NO: 392047 - DNA, 25 bp, Rattus norvegicus
gccagtgggtgcttcatatgctcta

SEQ ID NO: 392048 - DNA, 25 bp, Rattus norvegicus
gccagtggtattagtgattctactt

SEQ ID NO: 392049 - DNA, 25 bp, Rattus norvegicus
gccagtggtatttgtgattctactt

SEQ ID NO: 392050 - DNA, 25 bp, Rattus norvegicus
gccagtgtagctagataatgaattt

SEQ ID NO: 392051 - DNA, 25 bp, Rattus norvegicus
gccagtgtagctatcttgtcaagtt

SEQ ID NO: 392052 - DNA, 25 bp, Rattus norvegicus
gccagtgtagcttgataatgaattt

SEQ ID NO: 392053 - DNA, 25 bp, Rattus norvegicus
gccagtgtagctttcttgtcaagtt

SEQ ID NO: 392054 - DNA, 25 bp, Rattus norvegicus
gccagtgtcctgctttcaacttaaa

SEQ ID NO: 392055 - DNA, 25 bp, Rattus norvegicus
gccagtgtcctggtttcaacttaaa

SEQ ID NO: 392056 - DNA, 25 bp, Rattus norvegicus
gccagtgtctcaaaatgtcagcatt

SEQ ID NO: 392057 - DNA, 25 bp, Rattus norvegicus
gccagtgtctcataatgtcagcatt

SEQ ID NO: 392058 - DNA, 25 bp, Rattus norvegicus
gccagtgtctctagtgcagtgtgct

SEQ ID NO: 392059 - DNA, 25 bp, Rattus norvegicus
gccagtgtctcttgtgcagtgtgct

SEQ ID NO: 392060 - DNA, 25 bp, Rattus norvegicus
gccagtgtgattagcagggtcctcc

SEQ ID NO: 392061 - DNA, 25 bp, Rattus norvegicus
gccagtgtgatttgcagggtcctcc

SEQ ID NO: 392062 - DNA, 25 bp, Rattus norvegicus
gccagtgtgccaaattcttgttgga

SEQ ID NO: 392063 - DNA, 25 bp, Rattus norvegicus
gccagtgtgccatattcttgttgga

SEQ ID NO: 392064 - DNA, 25 bp, Rattus norvegicus
gccagtgtgctgacctggttttaaa

SEQ ID NO: 392065 - DNA, 25 bp, Rattus norvegicus
gccagtgtgctgtcctggttttaaa

SEQ ID NO: 392066 - DNA, 25 bp, Rattus norvegicus
gccagtgtggaaagtgtatttgcct

SEQ ID NO: 392067 - DNA, 25 bp, Rattus norvegicus
gccagtgtggaatgtgtatttgcct

SEQ ID NO: 392068 - DNA, 25 bp, Rattus norvegicus
gccagtgtggatcggaaaatctcac

SEQ ID NO: 392069 - DNA, 25 bp, Rattus norvegicus
gccagtgtggatgggaaaatctcac

SEQ ID NO: 392070 - DNA, 25 bp, Rattus norvegicus
gccagtgtgtggctatctaccattt

SEQ ID NO: 392071 - DNA, 25 bp, Rattus norvegicus
gccagtgtgtgggtatctaccattt

SEQ ID NO: 392072 - DNA, 25 bp, Rattus norvegicus
gccagtgttataattttcagatcaa

SEQ ID NO: 392073 - DNA, 25 bp, Rattus norvegicus
gccagtgttatatttttcagatcaa

SEQ ID NO: 392074 - DNA, 25 bp, Rattus norvegicus
gccagtgttcgacctttccgataat

SEQ ID NO: 392075 - DNA, 25 bp, Rattus norvegicus
gccagtgttcgagctttccgataat

SEQ ID NO: 392076 - DNA, 25 bp, Rattus norvegicus
gccagtgttggtatgtttgtagctt

SEQ ID NO: 392077 - DNA, 25 bp, Rattus norvegicus
gccagtgttggtttgtttgtagctt

SEQ ID NO: 392078 - DNA, 25 bp, Rattus norvegicus
gccagttacccacatatgaccagaa

SEQ ID NO: 392079 - DNA, 25 bp, Rattus norvegicus
gccagttacccagatatgaccagaa

SEQ ID NO: 392080 - DNA, 25 bp, Rattus norvegicus
gccagttatggcaataggtgctaca

SEQ ID NO: 392081 - DNA, 25 bp, Rattus norvegicus
gccagttatggctataggtgctaca

SEQ ID NO: 392082 - DNA, 25 bp, Rattus norvegicus
gccagttcagggatgggacgcccac

SEQ ID NO: 392083 - DNA, 25 bp, Rattus norvegicus
gccagttcagggttgggacgcccac

SEQ ID NO: 392084 - DNA, 25 bp, Rattus norvegicus
gccagttcatctacgacgtggtgaa

SEQ ID NO: 392085 - DNA, 25 bp, Rattus norvegicus
gccagttcatcttcgacgtggtgaa

SEQ ID NO: 392086 - DNA, 25 bp, Rattus norvegicus
gccagttccacacaaataccaacgg

SEQ ID NO: 392087 - DNA, 25 bp, Rattus norvegicus
gccagttccacagaaataccaacgg

SEQ ID NO: 392088 - DNA, 25 bp, Rattus norvegicus
gccagttccaggctgctgcatgaat

SEQ ID NO: 392089 - DNA, 25 bp, Rattus norvegicus
gccagttccagggtgctgcatgaat

SEQ ID NO: 392090 - DNA, 25 bp, Rattus norvegicus
gccagttctcagcaggcctccagga

SEQ ID NO: 392091 - DNA, 25 bp, Rattus norvegicus
gccagttctcaggaggcctccagga

SEQ ID NO: 392092 - DNA, 25 bp, Rattus norvegicus
gccagttctttaacacgtgttctaa

SEQ ID NO: 392093 - DNA, 25 bp, Rattus norvegicus
gccagttctttatcacgtgttctaa

SEQ ID NO: 392094 - DNA, 25 bp, Rattus norvegicus
gccagttgaatcatcccctgggaga

SEQ ID NO: 392095 - DNA, 25 bp, Rattus norvegicus
gccagttgaatcttcccctgggaga

SEQ ID NO: 392096 - DNA, 25 bp, Rattus norvegicus
gccagttgactgattttgcttcagt

SEQ ID NO: 392097 - DNA, 25 bp, Rattus norvegicus
gccagttgactgtttttgcttcagt

SEQ ID NO: 392098 - DNA, 25 bp, Rattus norvegicus
gccagttgcaccattaacacatcag

SEQ ID NO: 392099 - DNA, 25 bp, Rattus norvegicus
gccagttgcacctttaacacatcag

SEQ ID NO: 392100 - DNA, 25 bp, Rattus norvegicus
gccagttgcacgcacaaggactcat

SEQ ID NO: 392101 - DNA, 25 bp, Rattus norvegicus
gccagttgcacggacaaggactcat

SEQ ID NO: 392102 - DNA, 25 bp, Rattus norvegicus
gccagttggaagatccagcaacaga

SEQ ID NO: 392103 - DNA, 25 bp, Rattus norvegicus
gccagttggaagttccagcaacaga

SEQ ID NO: 392104 - DNA, 25 bp, Rattus norvegicus
gccagttgtacactgctatgctctt

SEQ ID NO: 392105 - DNA, 25 bp, Rattus norvegicus
gccagttgtacagtgctatgctctt

SEQ ID NO: 392106 - DNA, 25 bp, Rattus norvegicus
gccagtttatctatgttctttagtg

SEQ ID NO: 392107 - DNA, 25 bp, Rattus norvegicus
gccagtttatctttgttctttagtg

SEQ ID NO: 392108 - DNA, 25 bp, Rattus norvegicus
gccagtttcaataacacttactaaa

SEQ ID NO: 392109 - DNA, 25 bp, Rattus norvegicus
gccagtttcaattacacttactaaa

SEQ ID NO: 392110 - DNA, 25 bp, Rattus norvegicus
gccagtttcataatagcttcttttt

SEQ ID NO: 392111 - DNA, 25 bp, Rattus norvegicus
gccagtttcatattagcttcttttt

SEQ ID NO: 392112 - DNA, 25 bp, Rattus norvegicus
gccagtttgaggattatgaagcccc

SEQ ID NO: 392113 - DNA, 25 bp, Rattus norvegicus
gccagtttgaggtttatgaagcccc

SEQ ID NO: 392114 - DNA, 25 bp, Rattus norvegicus
gccagtttgatgagagcctgtgcta

SEQ ID NO: 392115 - DNA, 25 bp, Rattus norvegicus
gccagtttgatgtgagcctgtgcta

SEQ ID NO: 392116 - DNA, 25 bp, Rattus norvegicus
gccagtttgattactttccgcattg

SEQ ID NO: 392117 - DNA, 25 bp, Rattus norvegicus
gccagtttgatttctttccgcattg

SEQ ID NO: 392118 - DNA, 25 bp, Rattus norvegicus
gccagtttgccaagggcggcgcctt

SEQ ID NO: 392119 - DNA, 25 bp, Rattus norvegicus
gccagtttgccatgggcggcgcctt

SEQ ID NO: 392120 - DNA, 25 bp, Rattus norvegicus
gccagtttgtcaaagggaacccctg

SEQ ID NO: 392121 - DNA, 25 bp, Rattus norvegicus
gccagtttgtcatagggaacccctg

SEQ ID NO: 392122 - DNA, 25 bp, Rattus norvegicus
gccagttttcacacctagaacatgt

SEQ ID NO: 392123 - DNA, 25 bp, Rattus norvegicus
gccagttttcactcctagaacatgt

SEQ ID NO: 392124 - DNA, 25 bp, Rattus norvegicus
gccagttttccgagggctgagtcct

SEQ ID NO: 392125 - DNA, 25 bp, Rattus norvegicus
gccagttttccgtgggctgagtcct

SEQ ID NO: 392126 - DNA, 25 bp, Rattus norvegicus
gccagttttctaagctttatctatt

SEQ ID NO: 392127 - DNA, 25 bp, Rattus norvegicus
gccagttttctatgctttatctatt

SEQ ID NO: 392128 - DNA, 25 bp, Rattus norvegicus
gccagttttggaatcgaacctctgc

SEQ ID NO: 392129 - DNA, 25 bp, Rattus norvegicus
gccagttttggattcgaacctctgc

SEQ ID NO: 392130 - DNA, 25 bp, Rattus norvegicus
gccagtttttgcctttgttgcattt

SEQ ID NO: 392131 - DNA, 25 bp, Rattus norvegicus
gccagtttttgcgtttgttgcattt

SEQ ID NO: 392132 - DNA, 25 bp, Rattus norvegicus
gccataaataggataactgccacaa

SEQ ID NO: 392133 - DNA, 25 bp, Rattus norvegicus
gccataaataggttaactgccacaa

SEQ ID NO: 392134 - DNA, 25 bp, Rattus norvegicus
gccataaatgtcatgcctcatctga

SEQ ID NO: 392135 - DNA, 25 bp, Rattus norvegicus
gccataaatgtcttgcctcatctga

SEQ ID NO: 392136 - DNA, 25 bp, Rattus norvegicus
gccataacctgaaaggagccggtga

SEQ ID NO: 392137 - DNA, 25 bp, Rattus norvegicus
gccataacctgataggagccggtga

SEQ ID NO: 392138 - DNA, 25 bp, Rattus norvegicus
gccataactccacaggatgcctgaa

SEQ ID NO: 392139 - DNA, 25 bp, Rattus norvegicus
gccataactccagaggatgcctgaa

SEQ ID NO: 392140 - DNA, 25 bp, Rattus norvegicus
gccatacaaataagagtgctaaact

SEQ ID NO: 392141 - DNA, 25 bp, Rattus norvegicus
gccatacaaatatgagtgctaaact

SEQ ID NO: 392142 - DNA, 25 bp, Rattus norvegicus
gccatacaaatgaagaagcagctag

SEQ ID NO: 392143 - DNA, 25 bp, Rattus norvegicus
gccatacaaatgtagaagcagctag

SEQ ID NO: 392144 - DNA, 25 bp, Rattus norvegicus
gccatacagtttagttacctcagtt

SEQ ID NO: 392145 - DNA, 25 bp, Rattus norvegicus
gccatacagttttgttacctcagtt

SEQ ID NO: 392146 - DNA, 25 bp, Rattus norvegicus
gccatacattagatctgttttctac

SEQ ID NO: 392147 - DNA, 25 bp, Rattus norvegicus
gccatacattagttctgttttctac

SEQ ID NO: 392148 - DNA, 25 bp, Rattus norvegicus
gccataccattcaactgctttcagt

SEQ ID NO: 392149 - DNA, 25 bp, Rattus norvegicus
gccataccattctactgctttcagt

SEQ ID NO: 392150 - DNA, 25 bp, Rattus norvegicus
gccataccctgcagttgtttctaat

SEQ ID NO: 392151 - DNA, 25 bp, Rattus norvegicus
gccataccctgctgttgtttctaat

SEQ ID NO: 392152 - DNA, 25 bp, Rattus norvegicus
gccatacctggcacacgtttgtttt

SEQ ID NO: 392153 - DNA, 25 bp, Rattus norvegicus
gccatacctggctcacgtttgtttt

SEQ ID NO: 392154 - DNA, 25 bp, Rattus norvegicus
gccatacctgttctgcatatttcat

SEQ ID NO: 392155 - DNA, 25 bp, Rattus norvegicus
gccatacctgttgtgcatatttcat

SEQ ID NO: 392156 - DNA, 25 bp, Rattus norvegicus
gccatacggaggctgttgctacctt

SEQ ID NO: 392157 - DNA, 25 bp, Rattus norvegicus
gccatacggagggtgttgctacctt

SEQ ID NO: 392158 - DNA, 25 bp, Rattus norvegicus
gccatacgtcttcagttctccaagg

SEQ ID NO: 392159 - DNA, 25 bp, Rattus norvegicus
gccatacgtcttgagttctccaagg

SEQ ID NO: 392160 - DNA, 25 bp, Rattus norvegicus
gccatactctggcttttgcaacatc

SEQ ID NO: 392161 - DNA, 25 bp, Rattus norvegicus
gccatactctgggttttgcaacatc

SEQ ID NO: 392162 - DNA, 25 bp, Rattus norvegicus
gccatactgttcctatcaattttcc

SEQ ID NO: 392163 - DNA, 25 bp, Rattus norvegicus
gccatactgttcgtatcaattttcc

SEQ ID NO: 392164 - DNA, 25 bp, Rattus norvegicus
gccatacttacccaggaattttatt

SEQ ID NO: 392165 - DNA, 25 bp, Rattus norvegicus
gccatacttaccgaggaattttatt

SEQ ID NO: 392166 - DNA, 25 bp, Rattus norvegicus
gccatagaactaaagccaacccact

SEQ ID NO: 392167 - DNA, 25 bp, Rattus norvegicus
gccatagaactatagccaacccact

SEQ ID NO: 392168 - DNA, 25 bp, Rattus norvegicus
gccatagaagcccttggaagcaaag

SEQ ID NO: 392169 - DNA, 25 bp, Rattus norvegicus
gccatagaagccgttggaagcaaag

SEQ ID NO: 392170 - DNA, 25 bp, Rattus norvegicus
gccatagaagttcagcaagtagcca

SEQ ID NO: 392171 - DNA, 25 bp, Rattus norvegicus
gccatagaagttgagcaagtagcca

SEQ ID NO: 392172 - DNA, 25 bp, Rattus norvegicus
gccatagagatcagcggcagccatg

SEQ ID NO: 392173 - DNA, 25 bp, Rattus norvegicus
gccatagagatctgcggcagccatg

SEQ ID NO: 392174 - DNA, 25 bp, Rattus norvegicus
gccatagagtatcagcgtcagcctt

SEQ ID NO: 392175 - DNA, 25 bp, Rattus norvegicus
gccatagagtatgagcgtcagcctt

SEQ ID NO: 392176 - DNA, 25 bp, Rattus norvegicus
gccatagataaacgtttccttcctc

SEQ ID NO: 392177 - DNA, 25 bp, Rattus norvegicus
gccatagataaaggtttccttcctc

SEQ ID NO: 392178 - DNA, 25 bp, Rattus norvegicus
gccatagcataaattgaagcctttg

SEQ ID NO: 392179 - DNA, 25 bp, Rattus norvegicus
gccatagcataatttgaagcctttg

SEQ ID NO: 392180 - DNA, 25 bp, Rattus norvegicus
gccatagcattaaccagcgactgta

SEQ ID NO: 392181 - DNA, 25 bp, Rattus norvegicus
gccatagcattatccagcgactgta

SEQ ID NO: 392182 - DNA, 25 bp, Rattus norvegicus
gccatagcccctagttgtaatttat

SEQ ID NO: 392183 - DNA, 25 bp, Rattus norvegicus
gccatagccccttgttgtaatttat

SEQ ID NO: 392184 - DNA, 25 bp, Rattus norvegicus
gccatagccttgactcatcagcgag

SEQ ID NO: 392185 - DNA, 25 bp, Rattus norvegicus
gccatagccttgtctcatcagcgag

SEQ ID NO: 392186 - DNA, 25 bp, Rattus norvegicus
gccataggccgacaagatgtggtcc

SEQ ID NO: 392187 - DNA, 25 bp, Rattus norvegicus
gccataggccgagaagatgtggtcc

SEQ ID NO: 392188 - DNA, 25 bp, Rattus norvegicus
gccatagggctcattccaaagcact

SEQ ID NO: 392189 - DNA, 25 bp, Rattus norvegicus
gccatagggctctttccaaagcact

SEQ ID NO: 392190 - DNA, 25 bp, Rattus norvegicus
gccataggtcctaattgtttaattg

SEQ ID NO: 392191 - DNA, 25 bp, Rattus norvegicus
gccataggtccttattgtttaattg

SEQ ID NO: 392192 - DNA, 25 bp, Rattus norvegicus
gccatagttggacattcattgccga

SEQ ID NO: 392193 - DNA, 25 bp, Rattus norvegicus
gccatagttggagattcattgccga

SEQ ID NO: 392194 - DNA, 25 bp, Rattus norvegicus
gccatagtttttaagcagcttgcat

SEQ ID NO: 392195 - DNA, 25 bp, Rattus norvegicus
gccatagttttttagcagcttgcat

SEQ ID NO: 392196 - DNA, 25 bp, Rattus norvegicus
gccatataaacaacttccaaccttc

SEQ ID NO: 392197 - DNA, 25 bp, Rattus norvegicus
gccatataaacatcttccaaccttc

SEQ ID NO: 392198 - DNA, 25 bp, Rattus norvegicus
gccatatacttgactgtgagttaca

SEQ ID NO: 392199 - DNA, 25 bp, Rattus norvegicus
gccatatacttgtctgtgagttaca

SEQ ID NO: 392200 - DNA, 25 bp, Rattus norvegicus
gccatatcctatcacagtactgcag

SEQ ID NO: 392201 - DNA, 25 bp, Rattus norvegicus
gccatatcctatgacagtactgcag

SEQ ID NO: 392202 - DNA, 25 bp, Rattus norvegicus
gccatatgagaccagaacaaccttg

SEQ ID NO: 392203 - DNA, 25 bp, Rattus norvegicus
gccatatgagacgagaacaaccttg

SEQ ID NO: 392204 - DNA, 25 bp, Rattus norvegicus
gccatatgagctcacagtacctgca

SEQ ID NO: 392205 - DNA, 25 bp, Rattus norvegicus
gccatatgagctgacagtacctgca

SEQ ID NO: 392206 - DNA, 25 bp, Rattus norvegicus
gccatatggcccaggactggattat

SEQ ID NO: 392207 - DNA, 25 bp, Rattus norvegicus
gccatatggccctggactggattat

SEQ ID NO: 392208 - DNA, 25 bp, Rattus norvegicus
gccatatttgatctctggctgcccc

SEQ ID NO: 392209 - DNA, 25 bp, Rattus norvegicus
gccatatttgatgtctggctgcccc

SEQ ID NO: 392210 - DNA, 25 bp, Rattus norvegicus
gccatcaaagccaacaccttgtgta

SEQ ID NO: 392211 - DNA, 25 bp, Rattus norvegicus
gccatcaaagcctacaccttgtgta

SEQ ID NO: 392212 - DNA, 25 bp, Rattus norvegicus
gccatcaagcgcctgtatatttttt

SEQ ID NO: 392213 - DNA, 25 bp, Rattus norvegicus
gccatcaagcgcgtgtatatttttt

SEQ ID NO: 392214 - DNA, 25 bp, Rattus norvegicus
gccatcaattggatcatcgtccata

SEQ ID NO: 392215 - DNA, 25 bp, Rattus norvegicus
gccatcaattggttcatcgtccata

SEQ ID NO: 392216 - DNA, 25 bp, Rattus norvegicus
gccatcacatgactcaggcaactgt

SEQ ID NO: 392217 - DNA, 25 bp, Rattus norvegicus
gccatcacatgagtcaggcaactgt

SEQ ID NO: 392218 - DNA, 25 bp, Rattus norvegicus
gccatcaccactcgaacttatgctg

SEQ ID NO: 392219 - DNA, 25 bp, Rattus norvegicus
gccatcaccactggaacttatgctg

SEQ ID NO: 392220 - DNA, 25 bp, Rattus norvegicus
gccatcaccgtcctagtgggtcaga

SEQ ID NO: 392221 - DNA, 25 bp, Rattus norvegicus
gccatcaccgtcgtagtgggtcaga

SEQ ID NO: 392222 - DNA, 25 bp, Rattus norvegicus
gccatcacttacaacatcctgggta

SEQ ID NO: 392223 - DNA, 25 bp, Rattus norvegicus
gccatcacttactacatcctgggta

SEQ ID NO: 392224 - DNA, 25 bp, Rattus norvegicus
gccatcactttgcttcaaacatcac

SEQ ID NO: 392225 - DNA, 25 bp, Rattus norvegicus
gccatcactttggttcaaacatcac

SEQ ID NO: 392226 - DNA, 25 bp, Rattus norvegicus
gccatcagactcaccttagaacaag

SEQ ID NO: 392227 - DNA, 25 bp, Rattus norvegicus
gccatcagactctccttagaacaag

SEQ ID NO: 392228 - DNA, 25 bp, Rattus norvegicus
gccatcagcatcacaattcatcaat

SEQ ID NO: 392229 - DNA, 25 bp, Rattus norvegicus
gccatcagcatctcaattcatcaat

SEQ ID NO: 392230 - DNA, 25 bp, Rattus norvegicus
gccatcatcactctgctttatcatg

SEQ ID NO: 392231 - DNA, 25 bp, Rattus norvegicus
gccatcatcactgtgctttatcatg

SEQ ID NO: 392232 - DNA, 25 bp, Rattus norvegicus
gccatcatgatcagcacttacgagt

SEQ ID NO: 392233 - DNA, 25 bp, Rattus norvegicus
gccatcatgatctgcacttacgagt

SEQ ID NO: 392234 - DNA, 25 bp, Rattus norvegicus
gccatcatgccacagccaggtcagg

SEQ ID NO: 392235 - DNA, 25 bp, Rattus norvegicus
gccatcatgccagagccaggtcagg

SEQ ID NO: 392236 - DNA, 25 bp, Rattus norvegicus
gccatcatgcgtatggatatagctg

SEQ ID NO: 392237 - DNA, 25 bp, Rattus norvegicus
gccatcatgcgtttggatatagctg

SEQ ID NO: 392238 - DNA, 25 bp, Rattus norvegicus
gccatcattagtcagctctgtataa

SEQ ID NO: 392239 - DNA, 25 bp, Rattus norvegicus
gccatcattagtgagctctgtataa

SEQ ID NO: 392240 - DNA, 25 bp, Rattus norvegicus
gccatcattcatccctacttttaag

SEQ ID NO: 392241 - DNA, 25 bp, Rattus norvegicus
gccatcattcatgcctacttttaag

SEQ ID NO: 392242 - DNA, 25 bp, Rattus norvegicus
gccatcattgccatttgtattttat

SEQ ID NO: 392243 - DNA, 25 bp, Rattus norvegicus
gccatcattgccttttgtattttat

SEQ ID NO: 392244 - DNA, 25 bp, Rattus norvegicus
gccatcattggacgcatgtttacag

SEQ ID NO: 392245 - DNA, 25 bp, Rattus norvegicus
gccatcattggaggcatgtttacag

SEQ ID NO: 392246 - DNA, 25 bp, Rattus norvegicus
gccatcattgtacttgtagccgtca

SEQ ID NO: 392247 - DNA, 25 bp, Rattus norvegicus
gccatcattgtagttgtagccgtca

SEQ ID NO: 392248 - DNA, 25 bp, Rattus norvegicus
gccatcatttgtatctacgggtaga

SEQ ID NO: 392249 - DNA, 25 bp, Rattus norvegicus
gccatcatttgtttctacgggtaga

SEQ ID NO: 392250 - DNA, 25 bp, Rattus norvegicus
gccatccaacctagcaattcatttg

SEQ ID NO: 392251 - DNA, 25 bp, Rattus norvegicus
gccatccaaccttgcaattcatttg

SEQ ID NO: 392252 - DNA, 25 bp, Rattus norvegicus
gccatccacggtccaacagtgacaa

SEQ ID NO: 392253 - DNA, 25 bp, Rattus norvegicus
gccatccacggtgcaacagtgacaa

SEQ ID NO: 392254 - DNA, 25 bp, Rattus norvegicus
gccatccaggaacgactgatacccg

SEQ ID NO: 392255 - DNA, 25 bp, Rattus norvegicus
gccatccaggaaggactgatacccg

SEQ ID NO: 392256 - DNA, 25 bp, Rattus norvegicus
gccatccataacaaggtgacgggaa

SEQ ID NO: 392257 - DNA, 25 bp, Rattus norvegicus
gccatccataactaggtgacgggaa

SEQ ID NO: 392258 - DNA, 25 bp, Rattus norvegicus
gccatccataccatcttgatgttgg

SEQ ID NO: 392259 - DNA, 25 bp, Rattus norvegicus
gccatccataccttcttgatgttgg

SEQ ID NO: 392260 - DNA, 25 bp, Rattus norvegicus
gccatccatgtaatctctctgggag

SEQ ID NO: 392261 - DNA, 25 bp, Rattus norvegicus
gccatccatgtattctctctgggag

SEQ ID NO: 392262 - DNA, 25 bp, Rattus norvegicus
gccatccatgttcagaacctcaagc

SEQ ID NO: 392263 - DNA, 25 bp, Rattus norvegicus
gccatccatgttgagaacctcaagc

SEQ ID NO: 392264 - DNA, 25 bp, Rattus norvegicus
gccatcccattcatttttctcatga

SEQ ID NO: 392265 - DNA, 25 bp, Rattus norvegicus
gccatcccattcttttttctcatga

SEQ ID NO: 392266 - DNA, 25 bp, Rattus norvegicus
gccatcccggaacttatttctaaca

SEQ ID NO: 392267 - DNA, 25 bp, Rattus norvegicus
gccatcccggaagttatttctaaca

SEQ ID NO: 392268 - DNA, 25 bp, Rattus norvegicus
gccatccctgcacacaaagaaaata

SEQ ID NO: 392269 - DNA, 25 bp, Rattus norvegicus
gccatccctgcagacaaagaaaata

SEQ ID NO: 392270 - DNA, 25 bp, Rattus norvegicus
gccatcccttgcagtgtgtatatat

SEQ ID NO: 392271 - DNA, 25 bp, Rattus norvegicus
gccatcccttgctgtgtgtatatat

SEQ ID NO: 392272 - DNA, 25 bp, Rattus norvegicus
gccatcccttggcaggtagcttgag

SEQ ID NO: 392273 - DNA, 25 bp, Rattus norvegicus
gccatcccttgggaggtagcttgag

SEQ ID NO: 392274 - DNA, 25 bp, Rattus norvegicus
gccatccgcacgcacagtgcgagga

SEQ ID NO: 392275 - DNA, 25 bp, Rattus norvegicus
gccatccgcacggacagtgcgagga

SEQ ID NO: 392276 - DNA, 25 bp, Rattus norvegicus
gccatccgccgccagaaagattatg

SEQ ID NO: 392277 - DNA, 25 bp, Rattus norvegicus
gccatccgccgcgagaaagattatg

SEQ ID NO: 392278 - DNA, 25 bp, Rattus norvegicus
gccatcctaagaaactgcttcacaa

SEQ ID NO: 392279 - DNA, 25 bp, Rattus norvegicus
gccatcctaagatactgcttcacaa

SEQ ID NO: 392280 - DNA, 25 bp, Rattus norvegicus
gccatcctaggaagaccgagtgatc

SEQ ID NO: 392281 - DNA, 25 bp, Rattus norvegicus
gccatcctaggatgaccgagtgatc

SEQ ID NO: 392282 - DNA, 25 bp, Rattus norvegicus
gccatcctatctattccatattgta

SEQ ID NO: 392283 - DNA, 25 bp, Rattus norvegicus
gccatcctatcttttccatattgta

SEQ ID NO: 392284 - DNA, 25 bp, Rattus norvegicus
gccatcctcagcaagtaatatcaga

SEQ ID NO: 392285 - DNA, 25 bp, Rattus norvegicus
gccatcctcagctagtaatatcaga

SEQ ID NO: 392286 - DNA, 25 bp, Rattus norvegicus
gccatcctcattacagcaccaattg

SEQ ID NO: 392287 - DNA, 25 bp, Rattus norvegicus
gccatcctcatttcagcaccaattg

SEQ ID NO: 392288 - DNA, 25 bp, Rattus norvegicus
gccatcctccagatctattgaaaca

SEQ ID NO: 392289 - DNA, 25 bp, Rattus norvegicus
gccatcctccagttctattgaaaca

SEQ ID NO: 392290 - DNA, 25 bp, Rattus norvegicus
gccatcctcgccaggtttgaagaaa

SEQ ID NO: 392291 - DNA, 25 bp, Rattus norvegicus
gccatcctcgcctggtttgaagaaa

SEQ ID NO: 392292 - DNA, 25 bp, Rattus norvegicus
gccatcctctgaacctacagattat

SEQ ID NO: 392293 - DNA, 25 bp, Rattus norvegicus
gccatcctctgatcctacagattat

SEQ ID NO: 392294 - DNA, 25 bp, Rattus norvegicus
gccatcctggtgagcacggtgaagt

SEQ ID NO: 392295 - DNA, 25 bp, Rattus norvegicus
gccatcctggtgtgcacggtgaagt

SEQ ID NO: 392296 - DNA, 25 bp, Rattus norvegicus
gccatcctgtttcccgtcagtaaaa

SEQ ID NO: 392297 - DNA, 25 bp, Rattus norvegicus
gccatcctgtttgccgtcagtaaaa

SEQ ID NO: 392298 - DNA, 25 bp, Rattus norvegicus
gccatccttcagcagctgggtttga

SEQ ID NO: 392299 - DNA, 25 bp, Rattus norvegicus
gccatccttcaggagctgggtttga

SEQ ID NO: 392300 - DNA, 25 bp, Rattus norvegicus
gccatccttgtcctaagaggtacgg

SEQ ID NO: 392301 - DNA, 25 bp, Rattus norvegicus
gccatccttgtcgtaagaggtacgg

SEQ ID NO: 392302 - DNA, 25 bp, Rattus norvegicus
gccatcctttggctggttttaaagc

SEQ ID NO: 392303 - DNA, 25 bp, Rattus norvegicus
gccatcctttgggtggttttaaagc

SEQ ID NO: 392304 - DNA, 25 bp, Rattus norvegicus
gccatcgaagctatgaggtaccttt

SEQ ID NO: 392305 - DNA, 25 bp, Rattus norvegicus
gccatcgaagctttgaggtaccttt

SEQ ID NO: 392306 - DNA, 25 bp, Rattus norvegicus
gccatcgagggcaatttagggatcc

SEQ ID NO: 392307 - DNA, 25 bp, Rattus norvegicus
gccatcgagggctatttagggatcc

SEQ ID NO: 392308 - DNA, 25 bp, Rattus norvegicus
gccatcgccagtcctattgctgaag

SEQ ID NO: 392309 - DNA, 25 bp, Rattus norvegicus
gccatcgccagtgctattgctgaag

SEQ ID NO: 392310 - DNA, 25 bp, Rattus norvegicus
gccatcgcccagcagatctatgtag

SEQ ID NO: 392311 - DNA, 25 bp, Rattus norvegicus
gccatcgcccaggagatctatgtag

SEQ ID NO: 392312 - DNA, 25 bp, Rattus norvegicus
gccatcgctaagcactcaacaggtt

SEQ ID NO: 392313 - DNA, 25 bp, Rattus norvegicus
gccatcgctaaggactcaacaggtt

SEQ ID NO: 392314 - DNA, 25 bp, Rattus norvegicus
gccatcggatggcaataacttgcta

SEQ ID NO: 392315 - DNA, 25 bp, Rattus norvegicus
gccatcggatgggaataacttgcta

SEQ ID NO: 392316 - DNA, 25 bp, Rattus norvegicus
gccatcggtgttctggacttactaa

SEQ ID NO: 392317 - DNA, 25 bp, Rattus norvegicus
gccatcggtgttgtggacttactaa

SEQ ID NO: 392318 - DNA, 25 bp, Rattus norvegicus
gccatcgtaggcatcttagaggaca

SEQ ID NO: 392319 - DNA, 25 bp, Rattus norvegicus
gccatcgtaggcttcttagaggaca

SEQ ID NO: 392320 - DNA, 25 bp, Rattus norvegicus
gccatcgtttctcccgggcgtgcgt

SEQ ID NO: 392321 - DNA, 25 bp, Rattus norvegicus
gccatcgtttctgccgggcgtgcgt

SEQ ID NO: 392322 - DNA, 25 bp, Rattus norvegicus
gccatcgtttttaatctgactagaa

SEQ ID NO: 392323 - DNA, 25 bp, Rattus norvegicus
gccatcgttttttatctgactagaa

SEQ ID NO: 392324 - DNA, 25 bp, Rattus norvegicus
gccatctaaggcagctaattacgca

SEQ ID NO: 392325 - DNA, 25 bp, Rattus norvegicus
gccatctaaggctgctaattacgca

SEQ ID NO: 392326 - DNA, 25 bp, Rattus norvegicus
gccatctaatgcaactcactggatt

SEQ ID NO: 392327 - DNA, 25 bp, Rattus norvegicus
gccatctaatgctactcactggatt

SEQ ID NO: 392328 - DNA, 25 bp, Rattus norvegicus
gccatctagatgacctttggtctcc

SEQ ID NO: 392329 - DNA, 25 bp, Rattus norvegicus
gccatctagatgtcctttggtctcc

SEQ ID NO: 392330 - DNA, 25 bp, Rattus norvegicus
gccatctataaaacttcagcctgaa

SEQ ID NO: 392331 - DNA, 25 bp, Rattus norvegicus
gccatctataaatcttcagcctgaa

SEQ ID NO: 392332 - DNA, 25 bp, Rattus norvegicus
gccatctatgccaacagcagcagaa

SEQ ID NO: 392333 - DNA, 25 bp, Rattus norvegicus
gccatctatgcctacagcagcagaa

SEQ ID NO: 392334 - DNA, 25 bp, Rattus norvegicus
gccatctatgtccactctgggcaaa

SEQ ID NO: 392335 - DNA, 25 bp, Rattus norvegicus
gccatctatgtcgactctgggcaaa

SEQ ID NO: 392336 - DNA, 25 bp, Rattus norvegicus
gccatctcacccacatttgtataga

SEQ ID NO: 392337 - DNA, 25 bp, Rattus norvegicus
gccatctcaccctcatttgtataga

SEQ ID NO: 392338 - DNA, 25 bp, Rattus norvegicus
gccatctcagagatctaaaagaaga

SEQ ID NO: 392339 - DNA, 25 bp, Rattus norvegicus
gccatctcagagttctaaaagaaga

SEQ ID NO: 392340 - DNA, 25 bp, Rattus norvegicus
gccatctcagtcatcagcatttgtt

SEQ ID NO: 392341 - DNA, 25 bp, Rattus norvegicus
gccatctcagtcttcagcatttgtt

SEQ ID NO: 392342 - DNA, 25 bp, Rattus norvegicus
gccatctcatggcattggattggta

SEQ ID NO: 392343 - DNA, 25 bp, Rattus norvegicus
gccatctcatgggattggattggta

SEQ ID NO: 392344 - DNA, 25 bp, Rattus norvegicus
gccatctccattccagagtatctgg

SEQ ID NO: 392345 - DNA, 25 bp, Rattus norvegicus
gccatctccattgcagagtatctgg

SEQ ID NO: 392346 - DNA, 25 bp, Rattus norvegicus
gccatctccgaacggttctgtgtca

SEQ ID NO: 392347 - DNA, 25 bp, Rattus norvegicus
gccatctccgaagggttctgtgtca

SEQ ID NO: 392348 - DNA, 25 bp, Rattus norvegicus
gccatctcctctcttcagattttga

SEQ ID NO: 392349 - DNA, 25 bp, Rattus norvegicus
gccatctcctctgttcagattttga

SEQ ID NO: 392350 - DNA, 25 bp, Rattus norvegicus
gccatctctgaacatccaacggaat

SEQ ID NO: 392351 - DNA, 25 bp, Rattus norvegicus
gccatctctgaagatccaacggaat

SEQ ID NO: 392352 - DNA, 25 bp, Rattus norvegicus
gccatctctgcaccctaggaatatt

SEQ ID NO: 392353 - DNA, 25 bp, Rattus norvegicus
gccatctctgcagcctaggaatatt

SEQ ID NO: 392354 - DNA, 25 bp, Rattus norvegicus
gccatctctggccaaatatgcactt

SEQ ID NO: 392355 - DNA, 25 bp, Rattus norvegicus
gccatctctggcgaaatatgcactt

SEQ ID NO: 392356 - DNA, 25 bp, Rattus norvegicus
gccatctctggtactacagtgctaa

SEQ ID NO: 392357 - DNA, 25 bp, Rattus norvegicus
gccatctctggttctacagtgctaa

SEQ ID NO: 392358 - DNA, 25 bp, Rattus norvegicus
gccatctctgtaccctttcagtatt

SEQ ID NO: 392359 - DNA, 25 bp, Rattus norvegicus
gccatctctgtagcctttcagtatt

SEQ ID NO: 392360 - DNA, 25 bp, Rattus norvegicus
gccatctcttcaataaacgtttctc

SEQ ID NO: 392361 - DNA, 25 bp, Rattus norvegicus
gccatctcttcattaaacgtttctc

SEQ ID NO: 392362 - DNA, 25 bp, Rattus norvegicus
gccatctctttcctgacatattcaa

SEQ ID NO: 392363 - DNA, 25 bp, Rattus norvegicus
gccatctctttcgtgacatattcaa

SEQ ID NO: 392364 - DNA, 25 bp, Rattus norvegicus
gccatctctttgagctttgtatcag

SEQ ID NO: 392365 - DNA, 25 bp, Rattus norvegicus
gccatctctttgtgctttgtatcag

SEQ ID NO: 392366 - DNA, 25 bp, Rattus norvegicus
gccatctgaagaaacattttactta

SEQ ID NO: 392367 - DNA, 25 bp, Rattus norvegicus
gccatctgaagatacattttactta

SEQ ID NO: 392368 - DNA, 25 bp, Rattus norvegicus
gccatctgccccaatttagaacaat

SEQ ID NO: 392369 - DNA, 25 bp, Rattus norvegicus
gccatctgccccaggaaagtgacag

SEQ ID NO: 392370 - DNA, 25 bp, Rattus norvegicus
gccatctgcccctatttagaacaat

SEQ ID NO: 392371 - DNA, 25 bp, Rattus norvegicus
gccatctgcccctggaaagtgacag

SEQ ID NO: 392372 - DNA, 25 bp, Rattus norvegicus
gccatctgcttgagaaggacccaaa

SEQ ID NO: 392373 - DNA, 25 bp, Rattus norvegicus
gccatctgcttgtgaaggacccaaa

SEQ ID NO: 392374 - DNA, 25 bp, Rattus norvegicus
gccatctggtggagcatttgggcac

SEQ ID NO: 392375 - DNA, 25 bp, Rattus norvegicus
gccatctggtggtgcatttgggcac

SEQ ID NO: 392376 - DNA, 25 bp, Rattus norvegicus
gccatctgtccacaaggcctgttaa

SEQ ID NO: 392377 - DNA, 25 bp, Rattus norvegicus
gccatctgtccagaaggcctgttaa

SEQ ID NO: 392378 - DNA, 25 bp, Rattus norvegicus
gccatctgtggcagtattacttgct

SEQ ID NO: 392379 - DNA, 25 bp, Rattus norvegicus
gccatctgtggctgtattacttgct

SEQ ID NO: 392380 - DNA, 25 bp, Rattus norvegicus
gccatcttaaccagaggcatcagtt

SEQ ID NO: 392381 - DNA, 25 bp, Rattus norvegicus
gccatcttaacctgaggcatcagtt

SEQ ID NO: 392382 - DNA, 25 bp, Rattus norvegicus
gccatcttagctcatttgtttgtta

SEQ ID NO: 392383 - DNA, 25 bp, Rattus norvegicus
gccatcttagctgatttgtttgtta

SEQ ID NO: 392384 - DNA, 25 bp, Rattus norvegicus
gccatcttcaaaatcttgctgagca

SEQ ID NO: 392385 - DNA, 25 bp, Rattus norvegicus
gccatcttcaaattcttgctgagca

SEQ ID NO: 392386 - DNA, 25 bp, Rattus norvegicus
gccatcttcacccacgtacagaaaa

SEQ ID NO: 392387 - DNA, 25 bp, Rattus norvegicus
gccatcttcaccgacgtacagaaaa

SEQ ID NO: 392388 - DNA, 25 bp, Rattus norvegicus
gccatcttcagcattgcttgcaaaa

SEQ ID NO: 392389 - DNA, 25 bp, Rattus norvegicus
gccatcttcagctttgcttgcaaaa

SEQ ID NO: 392390 - DNA, 25 bp, Rattus norvegicus
gccatcttccggcagaaagacttcg

SEQ ID NO: 392391 - DNA, 25 bp, Rattus norvegicus
gccatcttccgggagaaagacttcg

SEQ ID NO: 392392 - DNA, 25 bp, Rattus norvegicus
gccatcttctaaacatgacactgct

SEQ ID NO: 392393 - DNA, 25 bp, Rattus norvegicus
gccatcttctaatcatgacactgct

SEQ ID NO: 392394 - DNA, 25 bp, Rattus norvegicus
gccatcttctctccttctgagataa

SEQ ID NO: 392395 - DNA, 25 bp, Rattus norvegicus
gccatcttctctgcttctgagataa

SEQ ID NO: 392396 - DNA, 25 bp, Rattus norvegicus
gccatcttcttcacagctgactgat

SEQ ID NO: 392397 - DNA, 25 bp, Rattus norvegicus
gccatcttcttctcagctgactgat

SEQ ID NO: 392398 - DNA, 25 bp, Rattus norvegicus
gccatcttctttaccaaagcaaatt

SEQ ID NO: 392399 - DNA, 25 bp, Rattus norvegicus
gccatcttctttcttggaattctga

SEQ ID NO: 392400 - DNA, 25 bp, Rattus norvegicus
gccatcttctttgttggaattctga

SEQ ID NO: 392401 - DNA, 25 bp, Rattus norvegicus
gccatcttcttttccaaagcaaatt

SEQ ID NO: 392402 - DNA, 25 bp, Rattus norvegicus
gccatcttgaaaccagggcttcagg

SEQ ID NO: 392403 - DNA, 25 bp, Rattus norvegicus
gccatcttgaaagcagggcttcagg

SEQ ID NO: 392404 - DNA, 25 bp, Rattus norvegicus
gccatcttgcccagtagctattatt

SEQ ID NO: 392405 - DNA, 25 bp, Rattus norvegicus
gccatcttgccctgtagctattatt

SEQ ID NO: 392406 - DNA, 25 bp, Rattus norvegicus
gccatcttgcttctgatttttcatt

SEQ ID NO: 392407 - DNA, 25 bp, Rattus norvegicus
gccatcttgcttgtgatttttcatt

SEQ ID NO: 392408 - DNA, 25 bp, Rattus norvegicus
gccatcttgggcaccttgaaggcag

SEQ ID NO: 392409 - DNA, 25 bp, Rattus norvegicus
gccatcttgggctccttgaaggcag

SEQ ID NO: 392410 - DNA, 25 bp, Rattus norvegicus
gccatctttatcatttgggattttc

SEQ ID NO: 392411 - DNA, 25 bp, Rattus norvegicus
gccatctttatcttttgggattttc

SEQ ID NO: 392412 - DNA, 25 bp, Rattus norvegicus
gccatctttctcattgaggcctaaa

SEQ ID NO: 392413 - DNA, 25 bp, Rattus norvegicus
gccatctttctctttgaggcctaaa

SEQ ID NO: 392414 - DNA, 25 bp, Rattus norvegicus
gccatctttctgctaccccgtggga

SEQ ID NO: 392415 - DNA, 25 bp, Rattus norvegicus
gccatctttctggtaccccgtggga

SEQ ID NO: 392416 - DNA, 25 bp, Rattus norvegicus
gccatcttttgaaatccaagctgaa

SEQ ID NO: 392417 - DNA, 25 bp, Rattus norvegicus
gccatcttttgatatccaagctgaa

SEQ ID NO: 392418 - DNA, 25 bp, Rattus norvegicus
gccatgaaaaagctgttccgcgtgt

SEQ ID NO: 392419 - DNA, 25 bp, Rattus norvegicus
gccatgaaaaaggtgttccgcgtgt

SEQ ID NO: 392420 - DNA, 25 bp, Rattus norvegicus
gccatgaacagtcgcggcggccttc

SEQ ID NO: 392421 - DNA, 25 bp, Rattus norvegicus
gccatgaacagtggcggcggccttc

SEQ ID NO: 392422 - DNA, 25 bp, Rattus norvegicus
gccatgaagatgcacaagcctgtgt

SEQ ID NO: 392423 - DNA, 25 bp, Rattus norvegicus
gccatgaagatggacaagcctgtgt

SEQ ID NO: 392424 - DNA, 25 bp, Rattus norvegicus
gccatgaagcatctggagcctcaag

SEQ ID NO: 392425 - DNA, 25 bp, Rattus norvegicus
gccatgaagcatgtggagcctcaag

SEQ ID NO: 392426 - DNA, 25 bp, Rattus norvegicus
gccatgaataagactcttgcagctg

SEQ ID NO: 392427 - DNA, 25 bp, Rattus norvegicus
gccatgaataagtctcttgcagctg

SEQ ID NO: 392428 - DNA, 25 bp, Rattus norvegicus
gccatgaatcacatcagtgcttgtt

SEQ ID NO: 392429 - DNA, 25 bp, Rattus norvegicus
gccatgaatcacttcagtgcttgtt

SEQ ID NO: 392430 - DNA, 25 bp, Rattus norvegicus
gccatgacaacgcaatgccggagtt

SEQ ID NO: 392431 - DNA, 25 bp, Rattus norvegicus
gccatgacaacggaatgccggagtt

SEQ ID NO: 392432 - DNA, 25 bp, Rattus norvegicus
gccatgacagagacccgtgagccca

SEQ ID NO: 392433 - DNA, 25 bp, Rattus norvegicus
gccatgacagagtcccgtgagccca

SEQ ID NO: 392434 - DNA, 25 bp, Rattus norvegicus
gccatgaccacaccagcacttgtaa

SEQ ID NO: 392435 - DNA, 25 bp, Rattus norvegicus
gccatgaccacagcagcacttgtaa

SEQ ID NO: 392436 - DNA, 25 bp, Rattus norvegicus
gccatgaccgcgcagtccggagaaa

SEQ ID NO: 392437 - DNA, 25 bp, Rattus norvegicus
gccatgaccgcggagtccggagaaa

SEQ ID NO: 392438 - DNA, 25 bp, Rattus norvegicus
gccatgacctcacccatgactacag

SEQ ID NO: 392439 - DNA, 25 bp, Rattus norvegicus
gccatgacctcagccatgactacag

SEQ ID NO: 392440 - DNA, 25 bp, Rattus norvegicus
gccatgagaaaacccacgtgaccag

SEQ ID NO: 392441 - DNA, 25 bp, Rattus norvegicus
gccatgagaaaagccacgtgaccag

SEQ ID NO: 392442 - DNA, 25 bp, Rattus norvegicus
gccatgagaccgcaagagacaccta

SEQ ID NO: 392443 - DNA, 25 bp, Rattus norvegicus
gccatgagaccggaagagacaccta

SEQ ID NO: 392444 - DNA, 25 bp, Rattus norvegicus
gccatgagcatgattcttctgtaaa

SEQ ID NO: 392445 - DNA, 25 bp, Rattus norvegicus
gccatgagcatgtttcttctgtaaa

SEQ ID NO: 392446 - DNA, 25 bp, Rattus norvegicus
gccatgagccaaactgaggacactt

SEQ ID NO: 392447 - DNA, 25 bp, Rattus norvegicus
gccatgagccaatctgaggacactt

SEQ ID NO: 392448 - DNA, 25 bp, Rattus norvegicus
gccatgagctttcgtgtttgtcact

SEQ ID NO: 392449 - DNA, 25 bp, Rattus norvegicus
gccatgagctttggtgtttgtcact

SEQ ID NO: 392450 - DNA, 25 bp, Rattus norvegicus
gccatgaggacaagccactcctgtt

SEQ ID NO: 392451 - DNA, 25 bp, Rattus norvegicus
gccatgaggacatgccactcctgtt

SEQ ID NO: 392452 - DNA, 25 bp, Rattus norvegicus
gccatgaggctcatcctggagcaga

SEQ ID NO: 392453 - DNA, 25 bp, Rattus norvegicus
gccatgaggctcttcctggagcaga

SEQ ID NO: 392454 - DNA, 25 bp, Rattus norvegicus
gccatgaggttgagacaagctcccc

SEQ ID NO: 392455 - DNA, 25 bp, Rattus norvegicus
gccatgaggttgtgacaagctcccc

SEQ ID NO: 392456 - DNA, 25 bp, Rattus norvegicus
gccatgagtcaacagtcttcggaga

SEQ ID NO: 392457 - DNA, 25 bp, Rattus norvegicus
gccatgagtcaagagtcttcggaga

SEQ ID NO: 392458 - DNA, 25 bp, Rattus norvegicus
gccatgatagctatctacactgtat

SEQ ID NO: 392459 - DNA, 25 bp, Rattus norvegicus
gccatgatagctttctacactgtat

SEQ ID NO: 392460 - DNA, 25 bp, Rattus norvegicus
gccatgatcctgctggaggtgaaca

SEQ ID NO: 392461 - DNA, 25 bp, Rattus norvegicus
gccatgatcctggtggaggtgaaca

SEQ ID NO: 392462 - DNA, 25 bp, Rattus norvegicus
gccatgatgaatcagagccccttcc

SEQ ID NO: 392463 - DNA, 25 bp, Rattus norvegicus
gccatgatgaatgagagccccttcc

SEQ ID NO: 392464 - DNA, 25 bp, Rattus norvegicus
gccatgatgctaagttgttccctcg

SEQ ID NO: 392465 - DNA, 25 bp, Rattus norvegicus
gccatgatgctatgttgttccctcg

SEQ ID NO: 392466 - DNA, 25 bp, Rattus norvegicus
gccatgatggctctacgtgtactcc

SEQ ID NO: 392467 - DNA, 25 bp, Rattus norvegicus
gccatgatggctgtacgtgtactcc

SEQ ID NO: 392468 - DNA, 25 bp, Rattus norvegicus
gccatgatgtcccacaccataatag

SEQ ID NO: 392469 - DNA, 25 bp, Rattus norvegicus
gccatgatgtccgacaccataatag

SEQ ID NO: 392470 - DNA, 25 bp, Rattus norvegicus
gccatgattgcaattcagtcagagt

SEQ ID NO: 392471 - DNA, 25 bp, Rattus norvegicus
gccatgattgcatttcagtcagagt

SEQ ID NO: 392472 - DNA, 25 bp, Rattus norvegicus
gccatgcaagccatggaggtcatta

SEQ ID NO: 392473 - DNA, 25 bp, Rattus norvegicus
gccatgcaagccttggaggtcatta

SEQ ID NO: 392474 - DNA, 25 bp, Rattus norvegicus
gccatgcactagagggcaggtctgt

SEQ ID NO: 392475 - DNA, 25 bp, Rattus norvegicus
gccatgcactagtgggcaggtctgt

SEQ ID NO: 392476 - DNA, 25 bp, Rattus norvegicus
gccatgcatacacgcaaagcactca

SEQ ID NO: 392477 - DNA, 25 bp, Rattus norvegicus
gccatgcatacaggcaaagcactca

SEQ ID NO: 392478 - DNA, 25 bp, Rattus norvegicus
gccatgccaagaaactacactattt

SEQ ID NO: 392479 - DNA, 25 bp, Rattus norvegicus
gccatgccaagatactacactattt

SEQ ID NO: 392480 - DNA, 25 bp, Rattus norvegicus
gccatgcccagaagctttgagagtt

SEQ ID NO: 392481 - DNA, 25 bp, Rattus norvegicus
gccatgcccagatgctttgagagtt

SEQ ID NO: 392482 - DNA, 25 bp, Rattus norvegicus
gccatgcccagcctagaagccgtgg

SEQ ID NO: 392483 - DNA, 25 bp, Rattus norvegicus
gccatgcccagcgtagaagccgtgg

SEQ ID NO: 392484 - DNA, 25 bp, Rattus norvegicus
gccatgcccatcaatagctttcgat

SEQ ID NO: 392485 - DNA, 25 bp, Rattus norvegicus
gccatgcccatccaggtcatgatga

SEQ ID NO: 392486 - DNA, 25 bp, Rattus norvegicus
gccatgcccatcgaggtcatgatga

SEQ ID NO: 392487 - DNA, 25 bp, Rattus norvegicus
gccatgcccatctatagctttcgat

SEQ ID NO: 392488 - DNA, 25 bp, Rattus norvegicus
gccatgcccattcttttatcattta

SEQ ID NO: 392489 - DNA, 25 bp, Rattus norvegicus
gccatgcccattgttttatcattta

SEQ ID NO: 392490 - DNA, 25 bp, Rattus norvegicus
gccatgcctaccaggcgtttatgga

SEQ ID NO: 392491 - DNA, 25 bp, Rattus norvegicus
gccatgcctacctggcgtttatgga

SEQ ID NO: 392492 - DNA, 25 bp, Rattus norvegicus
gccatgcctactacagaatctgatt

SEQ ID NO: 392493 - DNA, 25 bp, Rattus norvegicus
gccatgcctacttcagaatctgatt

SEQ ID NO: 392494 - DNA, 25 bp, Rattus norvegicus
gccatgcctaggagtgattgtcacc

SEQ ID NO: 392495 - DNA, 25 bp, Rattus norvegicus
gccatgcctaggtgtgattgtcacc

SEQ ID NO: 392496 - DNA, 25 bp, Rattus norvegicus
gccatgcctatcatactgtgtcata

SEQ ID NO: 392497 - DNA, 25 bp, Rattus norvegicus
gccatgcctatcttactgtgtcata

SEQ ID NO: 392498 - DNA, 25 bp, Rattus norvegicus
gccatgcctcacagggcaccttaga

SEQ ID NO: 392499 - DNA, 25 bp, Rattus norvegicus
gccatgcctcactgggcaccttaga

SEQ ID NO: 392500 - DNA, 25 bp, Rattus norvegicus
gccatgcctggcaagtgttgagtcc

SEQ ID NO: 392501 - DNA, 25 bp, Rattus norvegicus
gccatgcctggcatttgagttgtaa

SEQ ID NO: 392502 - DNA, 25 bp, Rattus norvegicus
gccatgcctggctagtgttgagtcc

SEQ ID NO: 392503 - DNA, 25 bp, Rattus norvegicus
gccatgcctggcttttgagttgtaa

SEQ ID NO: 392504 - DNA, 25 bp, Rattus norvegicus
gccatgcgttttcgtcatctcaaaa

SEQ ID NO: 392505 - DNA, 25 bp, Rattus norvegicus
gccatgcgttttggtcatctcaaaa

SEQ ID NO: 392506 - DNA, 25 bp, Rattus norvegicus
gccatgctaagtctccattatgtct

SEQ ID NO: 392507 - DNA, 25 bp, Rattus norvegicus
gccatgctaagtgtccattatgtct

SEQ ID NO: 392508 - DNA, 25 bp, Rattus norvegicus
gccatgctattacatcctactgctg

SEQ ID NO: 392509 - DNA, 25 bp, Rattus norvegicus
gccatgctattagatcctactgctg

SEQ ID NO: 392510 - DNA, 25 bp, Rattus norvegicus
gccatgctgcctataccttttattt

SEQ ID NO: 392511 - DNA, 25 bp, Rattus norvegicus
gccatgctgcctttaccttttattt

SEQ ID NO: 392512 - DNA, 25 bp, Rattus norvegicus
gccatgctgctgcaaagctgttctt

SEQ ID NO: 392513 - DNA, 25 bp, Rattus norvegicus
gccatgctgctggaaagctgttctt

SEQ ID NO: 392514 - DNA, 25 bp, Rattus norvegicus
gccatgctggaactgtgccctagtg

SEQ ID NO: 392515 - DNA, 25 bp, Rattus norvegicus
gccatgctggaagtgtgccctagtg

SEQ ID NO: 392516 - DNA, 25 bp, Rattus norvegicus
gccatgctggctctcaagaagtaaa

SEQ ID NO: 392517 - DNA, 25 bp, Rattus norvegicus
gccatgctggctgtcaagaagtaaa

SEQ ID NO: 392518 - DNA, 25 bp, Rattus norvegicus
gccatgctgggcaccagtggtagaa

SEQ ID NO: 392519 - DNA, 25 bp, Rattus norvegicus
gccatgctgggcatcttaagcttcc

SEQ ID NO: 392520 - DNA, 25 bp, Rattus norvegicus
gccatgctgggctccagtggtagaa

SEQ ID NO: 392521 - DNA, 25 bp, Rattus norvegicus
gccatgctgggcttcttaagcttcc

SEQ ID NO: 392522 - DNA, 25 bp, Rattus norvegicus
gccatgctggttctaaggactctgt

SEQ ID NO: 392523 - DNA, 25 bp, Rattus norvegicus
gccatgctggttgtaaggactctgt

SEQ ID NO: 392524 - DNA, 25 bp, Rattus norvegicus
gccatgctgtctcttttgtacttaa

SEQ ID NO: 392525 - DNA, 25 bp, Rattus norvegicus
gccatgctgtctgttttgtacttaa

SEQ ID NO: 392526 - DNA, 25 bp, Rattus norvegicus
gccatgctgtgtaaggactgtgccc

SEQ ID NO: 392527 - DNA, 25 bp, Rattus norvegicus
gccatgctgtgttaggactgtgccc

SEQ ID NO: 392528 - DNA, 25 bp, Rattus norvegicus
gccatgcttcttagccagacaaatg

SEQ ID NO: 392529 - DNA, 25 bp, Rattus norvegicus
gccatgcttctttgccagacaaatg

SEQ ID NO: 392530 - DNA, 25 bp, Rattus norvegicus
gccatgcttgcaaaagaactttctt

SEQ ID NO: 392531 - DNA, 25 bp, Rattus norvegicus
gccatgcttgcataagaactttctt

SEQ ID NO: 392532 - DNA, 25 bp, Rattus norvegicus
gccatgcttgccaatttgctgtata

SEQ ID NO: 392533 - DNA, 25 bp, Rattus norvegicus
gccatgcttgcctatttgctgtata

SEQ ID NO: 392534 - DNA, 25 bp, Rattus norvegicus
gccatggaacatcaaaaacttacta

SEQ ID NO: 392535 - DNA, 25 bp, Rattus norvegicus
gccatggaacatgaaaaacttacta

SEQ ID NO: 392536 - DNA, 25 bp, Rattus norvegicus
gccatggacacaactgagccagtca

SEQ ID NO: 392537 - DNA, 25 bp, Rattus norvegicus
gccatggacacatctgagccagtca

SEQ ID NO: 392538 - DNA, 25 bp, Rattus norvegicus
gccatggacgccagcaagttggagc

SEQ ID NO: 392539 - DNA, 25 bp, Rattus norvegicus
gccatggacgcctgcaagttggagc

SEQ ID NO: 392540 - DNA, 25 bp, Rattus norvegicus
gccatggagaagatgtttttcacag

SEQ ID NO: 392541 - DNA, 25 bp, Rattus norvegicus
gccatggagaagttgtttttcacag

SEQ ID NO: 392542 - DNA, 25 bp, Rattus norvegicus
gccatggagcaaaacggtcacttca

SEQ ID NO: 392543 - DNA, 25 bp, Rattus norvegicus
gccatggagcaatacggtcacttca

SEQ ID NO: 392544 - DNA, 25 bp, Rattus norvegicus
gccatggataaaccatttctactta

SEQ ID NO: 392545 - DNA, 25 bp, Rattus norvegicus
gccatggataaagcatttctactta

SEQ ID NO: 392546 - DNA, 25 bp, Rattus norvegicus
gccatggatgcaaagtgagactctt

SEQ ID NO: 392547 - DNA, 25 bp, Rattus norvegicus
gccatggatgcatagtgagactctt

SEQ ID NO: 392548 - DNA, 25 bp, Rattus norvegicus
gccatggatgctctaagtcttcact

SEQ ID NO: 392549 - DNA, 25 bp, Rattus norvegicus
gccatggatgctgtaagtcttcact

SEQ ID NO: 392550 - DNA, 25 bp, Rattus norvegicus
gccatggcagcacaaagtgacacca

SEQ ID NO: 392551 - DNA, 25 bp, Rattus norvegicus
gccatggcagcagaaagtgacacca

SEQ ID NO: 392552 - DNA, 25 bp, Rattus norvegicus
gccatggcaggcaggttgagcaaac

SEQ ID NO: 392553 - DNA, 25 bp, Rattus norvegicus
gccatggcaggctggttgagcaaac

SEQ ID NO: 392554 - DNA, 25 bp, Rattus norvegicus
gccatggccagacctcctaagtagg

SEQ ID NO: 392555 - DNA, 25 bp, Rattus norvegicus
gccatggccagagctcctaagtagg

SEQ ID NO: 392556 - DNA, 25 bp, Rattus norvegicus
gccatggcggagctgcagcaacttc

SEQ ID NO: 392557 - DNA, 25 bp, Rattus norvegicus
gccatggcggaggtgcagcaacttc

SEQ ID NO: 392558 - DNA, 25 bp, Rattus norvegicus
gccatggctactactgacgtgaaac

SEQ ID NO: 392559 - DNA, 25 bp, Rattus norvegicus
gccatggctacttctgacgtgaaac

SEQ ID NO: 392560 - DNA, 25 bp, Rattus norvegicus
gccatggctgacacttcttcctttt

SEQ ID NO: 392561 - DNA, 25 bp, Rattus norvegicus
gccatggctgaccagctgaccgaag

SEQ ID NO: 392562 - DNA, 25 bp, Rattus norvegicus
gccatggctgaccttaaactgtaga

SEQ ID NO: 392563 - DNA, 25 bp, Rattus norvegicus
gccatggctgacgagctgaccgaag

SEQ ID NO: 392564 - DNA, 25 bp, Rattus norvegicus
gccatggctgacgttaaactgtaga

SEQ ID NO: 392565 - DNA, 25 bp, Rattus norvegicus
gccatggctgactcttcttcctttt

SEQ ID NO: 392566 - DNA, 25 bp, Rattus norvegicus
gccatggctgcaaagttagactttt

SEQ ID NO: 392567 - DNA, 25 bp, Rattus norvegicus
gccatggctgcacctttggtggcca

SEQ ID NO: 392568 - DNA, 25 bp, Rattus norvegicus
gccatggctgcagctttggtggcca

SEQ ID NO: 392569 - DNA, 25 bp, Rattus norvegicus
gccatggctgcatagttagactttt

SEQ ID NO: 392570 - DNA, 25 bp, Rattus norvegicus
gccatggctttcagacagactcagt

SEQ ID NO: 392571 - DNA, 25 bp, Rattus norvegicus
gccatggctttctgacagactcagt

SEQ ID NO: 392572 - DNA, 25 bp, Rattus norvegicus
gccatgggaatgattgctgtagctc

SEQ ID NO: 392573 - DNA, 25 bp, Rattus norvegicus
gccatgggaatgtttgctgtagctc

SEQ ID NO: 392574 - DNA, 25 bp, Rattus norvegicus
gccatgggccgtctcaatgtgaaga

SEQ ID NO: 392575 - DNA, 25 bp, Rattus norvegicus
gccatgggccgtgtcaatgtgaaga

SEQ ID NO: 392576 - DNA, 25 bp, Rattus norvegicus
gccatggtctatatttgtttgctca

SEQ ID NO: 392577 - DNA, 25 bp, Rattus norvegicus
gccatggtctatttttgtttgctca

SEQ ID NO: 392578 - DNA, 25 bp, Rattus norvegicus
gccatggtgacactggacctttcca

SEQ ID NO: 392579 - DNA, 25 bp, Rattus norvegicus
gccatggtgacagtggacctttcca

SEQ ID NO: 392580 - DNA, 25 bp, Rattus norvegicus
gccatggtgtccagcaggcatatga

SEQ ID NO: 392581 - DNA, 25 bp, Rattus norvegicus
gccatggtgtcctgcaggcatatga

SEQ ID NO: 392582 - DNA, 25 bp, Rattus norvegicus
gccatggttgtgattgcctataatc

SEQ ID NO: 392583 - DNA, 25 bp, Rattus norvegicus
gccatggttgtgtttgcctataatc

SEQ ID NO: 392584 - DNA, 25 bp, Rattus norvegicus
gccatgtaagcacttgtcagtctag

SEQ ID NO: 392585 - DNA, 25 bp, Rattus norvegicus
gccatgtaagcagttgtcagtctag

SEQ ID NO: 392586 - DNA, 25 bp, Rattus norvegicus
gccatgtaatttatctggtcttaaa

SEQ ID NO: 392587 - DNA, 25 bp, Rattus norvegicus
gccatgtaatttttctggtcttaaa

SEQ ID NO: 392588 - DNA, 25 bp, Rattus norvegicus
gccatgtagaatatttagctgcaca

SEQ ID NO: 392589 - DNA, 25 bp, Rattus norvegicus
gccatgtagaatttttagctgcaca

SEQ ID NO: 392590 - DNA, 25 bp, Rattus norvegicus
gccatgtatatgagtttagcacaca

SEQ ID NO: 392591 - DNA, 25 bp, Rattus norvegicus
gccatgtatatgtgtttagcacaca

SEQ ID NO: 392592 - DNA, 25 bp, Rattus norvegicus
gccatgtatgtacctggagcctgca

SEQ ID NO: 392593 - DNA, 25 bp, Rattus norvegicus
gccatgtatgtagctggagcctgca

SEQ ID NO: 392594 - DNA, 25 bp, Rattus norvegicus
gccatgtccaacagacagcatttcg

SEQ ID NO: 392595 - DNA, 25 bp, Rattus norvegicus
gccatgtccaactgacagcatttcg

SEQ ID NO: 392596 - DNA, 25 bp, Rattus norvegicus
gccatgtcgatcaagggcgatccgt

SEQ ID NO: 392597 - DNA, 25 bp, Rattus norvegicus
gccatgtcgatctagggcgatccgt

SEQ ID NO: 392598 - DNA, 25 bp, Rattus norvegicus
gccatgtcgggtacttctagcgtcg

SEQ ID NO: 392599 - DNA, 25 bp, Rattus norvegicus
gccatgtcgggttcttctagcgtcg

SEQ ID NO: 392600 - DNA, 25 bp, Rattus norvegicus
gccatgtctcacaaggtttgcaagt

SEQ ID NO: 392601 - DNA, 25 bp, Rattus norvegicus
gccatgtctcactaggtttgcaagt

SEQ ID NO: 392602 - DNA, 25 bp, Rattus norvegicus
gccatgtctgctaggttcacttaat

SEQ ID NO: 392603 - DNA, 25 bp, Rattus norvegicus
gccatgtctgcttggttcacttaat

SEQ ID NO: 392604 - DNA, 25 bp, Rattus norvegicus
gccatgtctggcacctttacaaaag

SEQ ID NO: 392605 - DNA, 25 bp, Rattus norvegicus
gccatgtctggctcctttacaaaag

SEQ ID NO: 392606 - DNA, 25 bp, Rattus norvegicus
gccatgtcttccctgaacaatcagt

SEQ ID NO: 392607 - DNA, 25 bp, Rattus norvegicus
gccatgtcttccgtgaacaatcagt

SEQ ID NO: 392608 - DNA, 25 bp, Rattus norvegicus
gccatgtcttctcaaggactgcaaa

SEQ ID NO: 392609 - DNA, 25 bp, Rattus norvegicus
gccatgtcttctgaaggactgcaaa

SEQ ID NO: 392610 - DNA, 25 bp, Rattus norvegicus
gccatgtgatgcatagagcctcttt

SEQ ID NO: 392611 - DNA, 25 bp, Rattus norvegicus
gccatgtgatgcttagagcctcttt

SEQ ID NO: 392612 - DNA, 25 bp, Rattus norvegicus
gccatgtgccttatccagtagtgta

SEQ ID NO: 392613 - DNA, 25 bp, Rattus norvegicus
gccatgtgccttttccagtagtgta

SEQ ID NO: 392614 - DNA, 25 bp, Rattus norvegicus
gccatgtgctctacgaggctgcaaa

SEQ ID NO: 392615 - DNA, 25 bp, Rattus norvegicus
gccatgtgctcttcgaggctgcaaa

SEQ ID NO: 392616 - DNA, 25 bp, Rattus norvegicus
gccatgtgtattatcctatgtacca

SEQ ID NO: 392617 - DNA, 25 bp, Rattus norvegicus
gccatgtgtattttcctatgtacca

SEQ ID NO: 392618 - DNA, 25 bp, Rattus norvegicus
gccatgtgtggcagatgtccttgaa

SEQ ID NO: 392619 - DNA, 25 bp, Rattus norvegicus
gccatgtgtggctgatgtccttgaa

SEQ ID NO: 392620 - DNA, 25 bp, Rattus norvegicus
gccatgtgtggtatcatatttagca

SEQ ID NO: 392621 - DNA, 25 bp, Rattus norvegicus
gccatgtgtggtttcatatttagca

SEQ ID NO: 392622 - DNA, 25 bp, Rattus norvegicus
gccatgttactgagccaatagtgtc

SEQ ID NO: 392623 - DNA, 25 bp, Rattus norvegicus
gccatgttactgtgccaatagtgtc

SEQ ID NO: 392624 - DNA, 25 bp, Rattus norvegicus
gccatgttcacacttgttcatgaca

SEQ ID NO: 392625 - DNA, 25 bp, Rattus norvegicus
gccatgttcacagttgttcatgaca

SEQ ID NO: 392626 - DNA, 25 bp, Rattus norvegicus
gccatgttcaggaggtttcttctca

SEQ ID NO: 392627 - DNA, 25 bp, Rattus norvegicus
gccatgttcaggtggtttcttctca

SEQ ID NO: 392628 - DNA, 25 bp, Rattus norvegicus
gccatgttcatcagtttttgcaata

SEQ ID NO: 392629 - DNA, 25 bp, Rattus norvegicus
gccatgttcatccataaccacttta

SEQ ID NO: 392630 - DNA, 25 bp, Rattus norvegicus
gccatgttcatcgataaccacttta

SEQ ID NO: 392631 - DNA, 25 bp, Rattus norvegicus
gccatgttcatctgtttttgcaata

SEQ ID NO: 392632 - DNA, 25 bp, Rattus norvegicus
gccatgttgtcccttagcagaataa

SEQ ID NO: 392633 - DNA, 25 bp, Rattus norvegicus
gccatgttgtccgttagcagaataa

SEQ ID NO: 392634 - DNA, 25 bp, Rattus norvegicus
gccatgtttactctactacagcaag

SEQ ID NO: 392635 - DNA, 25 bp, Rattus norvegicus
gccatgtttactgtactacagcaag

SEQ ID NO: 392636 - DNA, 25 bp, Rattus norvegicus
gccatgtttataaatctgtttccca

SEQ ID NO: 392637 - DNA, 25 bp, Rattus norvegicus
gccatgtttatatatctgtttccca

SEQ ID NO: 392638 - DNA, 25 bp, Rattus norvegicus
gccatgtttgagagcttcagaattt

SEQ ID NO: 392639 - DNA, 25 bp, Rattus norvegicus
gccatgtttgagtgcttcagaattt

SEQ ID NO: 392640 - DNA, 25 bp, Rattus norvegicus
gccatgtttgctctctttccagaaa

SEQ ID NO: 392641 - DNA, 25 bp, Rattus norvegicus
gccatgtttgctgtctttccagaaa

SEQ ID NO: 392642 - DNA, 25 bp, Rattus norvegicus
gccatgtttgtgaatgtgaccactg

SEQ ID NO: 392643 - DNA, 25 bp, Rattus norvegicus
gccatgtttgtgtatgtgaccactg

SEQ ID NO: 392644 - DNA, 25 bp, Rattus norvegicus
gccatgttttcactcagcactcaag

SEQ ID NO: 392645 - DNA, 25 bp, Rattus norvegicus
gccatgttttcagtcagcactcaag

SEQ ID NO: 392646 - DNA, 25 bp, Rattus norvegicus
gccattaaatttaccagaggtccct

SEQ ID NO: 392647 - DNA, 25 bp, Rattus norvegicus
gccattaaattttccagaggtccct

SEQ ID NO: 392648 - DNA, 25 bp, Rattus norvegicus
gccattaacctcactgtaactcaag

SEQ ID NO: 392649 - DNA, 25 bp, Rattus norvegicus
gccattaacctctctgtaactcaag

SEQ ID NO: 392650 - DNA, 25 bp, Rattus norvegicus
gccattaaggccattactaccattg

SEQ ID NO: 392651 - DNA, 25 bp, Rattus norvegicus
gccattaaggcctttactaccattg

SEQ ID NO: 392652 - DNA, 25 bp, Rattus norvegicus
gccattacttacaggtgttttccga

SEQ ID NO: 392653 - DNA, 25 bp, Rattus norvegicus
gccattacttactggtgttttccga

SEQ ID NO: 392654 - DNA, 25 bp, Rattus norvegicus
gccattagaccacaggctatgcatt

SEQ ID NO: 392655 - DNA, 25 bp, Rattus norvegicus
gccattagaccagaggctatgcatt

SEQ ID NO: 392656 - DNA, 25 bp, Rattus norvegicus
gccattagagtgctcagagtgtcta

SEQ ID NO: 392657 - DNA, 25 bp, Rattus norvegicus
gccattagagtggtcagagtgtcta

SEQ ID NO: 392658 - DNA, 25 bp, Rattus norvegicus
gccattagtaatattcttgccacaa

SEQ ID NO: 392659 - DNA, 25 bp, Rattus norvegicus
gccattagtaattttcttgccacaa

SEQ ID NO: 392660 - DNA, 25 bp, Rattus norvegicus
gccattcaaaagctttgctttctct

SEQ ID NO: 392661 - DNA, 25 bp, Rattus norvegicus
gccattcaaaaggtttgctttctct

SEQ ID NO: 392662 - DNA, 25 bp, Rattus norvegicus
gccattcagtacatttttaggtttc

SEQ ID NO: 392663 - DNA, 25 bp, Rattus norvegicus
gccattcagtacttttttaggtttc

SEQ ID NO: 392664 - DNA, 25 bp, Rattus norvegicus
gccattcatattacctaagagttta

SEQ ID NO: 392665 - DNA, 25 bp, Rattus norvegicus
gccattcatatttcctaagagttta

SEQ ID NO: 392666 - DNA, 25 bp, Rattus norvegicus
gccattcatgccacttgagagcggt

SEQ ID NO: 392667 - DNA, 25 bp, Rattus norvegicus
gccattcatgcctcttgagagcggt

SEQ ID NO: 392668 - DNA, 25 bp, Rattus norvegicus
gccattccaggaatgtctctacaca

SEQ ID NO: 392669 - DNA, 25 bp, Rattus norvegicus
gccattccaggattgtctctacaca

SEQ ID NO: 392670 - DNA, 25 bp, Rattus norvegicus
gccattccaggcattatagatcaca

SEQ ID NO: 392671 - DNA, 25 bp, Rattus norvegicus
gccattccaggctttatagatcaca

SEQ ID NO: 392672 - DNA, 25 bp, Rattus norvegicus
gccattcccatcaggttgtactgga

SEQ ID NO: 392673 - DNA, 25 bp, Rattus norvegicus
gccattcccatctggttgtactgga

SEQ ID NO: 392674 - DNA, 25 bp, Rattus norvegicus
gccattcccgaactgccataacagt

SEQ ID NO: 392675 - DNA, 25 bp, Rattus norvegicus
gccattcccgaagtgccataacagt

SEQ ID NO: 392676 - DNA, 25 bp, Rattus norvegicus
gccattcctaatcggtctgatgttt

SEQ ID NO: 392677 - DNA, 25 bp, Rattus norvegicus
gccattcctaatgggtctgatgttt

SEQ ID NO: 392678 - DNA, 25 bp, Rattus norvegicus
gccattcctgtgaggtattttaata

SEQ ID NO: 392679 - DNA, 25 bp, Rattus norvegicus
gccattcctgtgtggtattttaata

SEQ ID NO: 392680 - DNA, 25 bp, Rattus norvegicus
gccattctaggcattgatcctgtgt

SEQ ID NO: 392681 - DNA, 25 bp, Rattus norvegicus
gccattctaggctttgatcctgtgt

SEQ ID NO: 392682 - DNA, 25 bp, Rattus norvegicus
gccattctatacatctggcttctgt

SEQ ID NO: 392683 - DNA, 25 bp, Rattus norvegicus
gccattctatacttctggcttctgt

SEQ ID NO: 392684 - DNA, 25 bp, Rattus norvegicus
gccattctccaaactatttctgttc

SEQ ID NO: 392685 - DNA, 25 bp, Rattus norvegicus
gccattctccaatctatttctgttc

SEQ ID NO: 392686 - DNA, 25 bp, Rattus norvegicus
gccattctcctgatcaaatctggtt

SEQ ID NO: 392687 - DNA, 25 bp, Rattus norvegicus
gccattctcctgttcaaatctggtt

SEQ ID NO: 392688 - DNA, 25 bp, Rattus norvegicus
gccattctctggattcacccaaact

SEQ ID NO: 392689 - DNA, 25 bp, Rattus norvegicus
gccattctctggtttcacccaaact

SEQ ID NO: 392690 - DNA, 25 bp, Rattus norvegicus
gccattctgccaatttgagtttttg

SEQ ID NO: 392691 - DNA, 25 bp, Rattus norvegicus
gccattctgccattttgagtttttg

SEQ ID NO: 392692 - DNA, 25 bp, Rattus norvegicus
gccattctggaacaagtctcttggt

SEQ ID NO: 392693 - DNA, 25 bp, Rattus norvegicus
gccattctggaactgtccctcaatc

SEQ ID NO: 392694 - DNA, 25 bp, Rattus norvegicus
gccattctggaagaagtctcttggt

SEQ ID NO: 392695 - DNA, 25 bp, Rattus norvegicus
gccattctggaagtgtccctcaatc

SEQ ID NO: 392696 - DNA, 25 bp, Rattus norvegicus
gccattctggttaaagctttgctta

SEQ ID NO: 392697 - DNA, 25 bp, Rattus norvegicus
gccattctggtttaagctttgctta

SEQ ID NO: 392698 - DNA, 25 bp, Rattus norvegicus
gccattctgttcactgcatatatac

SEQ ID NO: 392699 - DNA, 25 bp, Rattus norvegicus
gccattctgttctctgcatatatac

SEQ ID NO: 392700 - DNA, 25 bp, Rattus norvegicus
gccattcttaagagagctcctggaa

SEQ ID NO: 392701 - DNA, 25 bp, Rattus norvegicus
gccattcttaagtgagctcctggaa

SEQ ID NO: 392702 - DNA, 25 bp, Rattus norvegicus
gccattcttctcatgtttgcactag

SEQ ID NO: 392703 - DNA, 25 bp, Rattus norvegicus
gccattcttctcttgtttgcactag

SEQ ID NO: 392704 - DNA, 25 bp, Rattus norvegicus
gccattgaaggaatgctgcaggaat

SEQ ID NO: 392705 - DNA, 25 bp, Rattus norvegicus
gccattgaaggattgctgcaggaat

SEQ ID NO: 392706 - DNA, 25 bp, Rattus norvegicus
gccattgaatgcagagggcggcttc

SEQ ID NO: 392707 - DNA, 25 bp, Rattus norvegicus
gccattgaatgctgagggcggcttc

SEQ ID NO: 392708 - DNA, 25 bp, Rattus norvegicus
gccattgaccaaactatctggagga

SEQ ID NO: 392709 - DNA, 25 bp, Rattus norvegicus
gccattgaccaatctatctggagga

SEQ ID NO: 392710 - DNA, 25 bp, Rattus norvegicus
gccattgactcaatcggctttgaga

SEQ ID NO: 392711 - DNA, 25 bp, Rattus norvegicus
gccattgactcattcggctttgaga

SEQ ID NO: 392712 - DNA, 25 bp, Rattus norvegicus
gccattgactgtcagctagcttgct

SEQ ID NO: 392713 - DNA, 25 bp, Rattus norvegicus
gccattgactgtgagctagcttgct

SEQ ID NO: 392714 - DNA, 25 bp, Rattus norvegicus
gccattgagtttctccctgggcagc

SEQ ID NO: 392715 - DNA, 25 bp, Rattus norvegicus
gccattgagtttgtccctgggcagc

SEQ ID NO: 392716 - DNA, 25 bp, Rattus norvegicus
gccattgatagtctactgtaaacct

SEQ ID NO: 392717 - DNA, 25 bp, Rattus norvegicus
gccattgatagtgtactgtaaacct

SEQ ID NO: 392718 - DNA, 25 bp, Rattus norvegicus
gccattgatctcaagcctgcagata

SEQ ID NO: 392719 - DNA, 25 bp, Rattus norvegicus
gccattgatctctagcctgcagata

SEQ ID NO: 392720 - DNA, 25 bp, Rattus norvegicus
gccattgatggtatggaacttgcta

SEQ ID NO: 392721 - DNA, 25 bp, Rattus norvegicus
gccattgatggtttggaacttgcta

SEQ ID NO: 392722 - DNA, 25 bp, Rattus norvegicus
gccattgatttaccagtttaacgtt

SEQ ID NO: 392723 - DNA, 25 bp, Rattus norvegicus
gccattgatttagcagtttaacgtt

SEQ ID NO: 392724 - DNA, 25 bp, Rattus norvegicus
gccattgcactgacttttggttaaa

SEQ ID NO: 392725 - DNA, 25 bp, Rattus norvegicus
gccattgcactgtcttttggttaaa

SEQ ID NO: 392726 - DNA, 25 bp, Rattus norvegicus
gccattgcagctacttcatagtttg

SEQ ID NO: 392727 - DNA, 25 bp, Rattus norvegicus
gccattgcagcttcttcatagtttg

SEQ ID NO: 392728 - DNA, 25 bp, Rattus norvegicus
gccattgcgcaaaccccgggtgagg

SEQ ID NO: 392729 - DNA, 25 bp, Rattus norvegicus
gccattgcgcaatccccgggtgagg

SEQ ID NO: 392730 - DNA, 25 bp, Rattus norvegicus
gccattgctaaacccgggttggaca

SEQ ID NO: 392731 - DNA, 25 bp, Rattus norvegicus
gccattgctaaagccgggttggaca

SEQ ID NO: 392732 - DNA, 25 bp, Rattus norvegicus
gccattgctccgatacttaagtgct

SEQ ID NO: 392733 - DNA, 25 bp, Rattus norvegicus
gccattgctccgttacttaagtgct

SEQ ID NO: 392734 - DNA, 25 bp, Rattus norvegicus
gccattgctgtacatttgctcggag

SEQ ID NO: 392735 - DNA, 25 bp, Rattus norvegicus
gccattgctgtagatttgctcggag

SEQ ID NO: 392736 - DNA, 25 bp, Rattus norvegicus
gccattgctgtcatgctgggttatt

SEQ ID NO: 392737 - DNA, 25 bp, Rattus norvegicus
gccattgctgtcttgctgggttatt

SEQ ID NO: 392738 - DNA, 25 bp, Rattus norvegicus
gccattggcaagagtgctgctgctt

SEQ ID NO: 392739 - DNA, 25 bp, Rattus norvegicus
gccattggcaagtgtgctgctgctt

SEQ ID NO: 392740 - DNA, 25 bp, Rattus norvegicus
gccattggccaccagtagcgataac

SEQ ID NO: 392741 - DNA, 25 bp, Rattus norvegicus
gccattggccacgagtagcgataac

SEQ ID NO: 392742 - DNA, 25 bp, Rattus norvegicus
gccattgtacagcatcaataggagg

SEQ ID NO: 392743 - DNA, 25 bp, Rattus norvegicus
gccattgtacaggatcaataggagg

SEQ ID NO: 392744 - DNA, 25 bp, Rattus norvegicus
gccattgtacgtccaaaggctttac

SEQ ID NO: 392745 - DNA, 25 bp, Rattus norvegicus
gccattgtacgtgcaaaggctttac

SEQ ID NO: 392746 - DNA, 25 bp, Rattus norvegicus
gccattgtagttctgtgcttttagc

SEQ ID NO: 392747 - DNA, 25 bp, Rattus norvegicus
gccattgtagttgtgtgcttttagc

SEQ ID NO: 392748 - DNA, 25 bp, Rattus norvegicus
gccattgtccagaagtatgctttca

SEQ ID NO: 392749 - DNA, 25 bp, Rattus norvegicus
gccattgtccagtagtatgctttca

SEQ ID NO: 392750 - DNA, 25 bp, Rattus norvegicus
gccattgtcttaattttgatctagt

SEQ ID NO: 392751 - DNA, 25 bp, Rattus norvegicus
gccattgtcttatttttgatctagt

SEQ ID NO: 392752 - DNA, 25 bp, Rattus norvegicus
gccattgtctttcggttagggtgtc

SEQ ID NO: 392753 - DNA, 25 bp, Rattus norvegicus
gccattgtctttgggttagggtgtc

SEQ ID NO: 392754 - DNA, 25 bp, Rattus norvegicus
gccattgtgtggctagcagtatatc

SEQ ID NO: 392755 - DNA, 25 bp, Rattus norvegicus
gccattgtgtgggtagcagtatatc

SEQ ID NO: 392756 - DNA, 25 bp, Rattus norvegicus
gccattgttactatgtgcctttgat

SEQ ID NO: 392757 - DNA, 25 bp, Rattus norvegicus
gccattgttactttgtgcctttgat

SEQ ID NO: 392758 - DNA, 25 bp, Rattus norvegicus
gccattgttattaatatttgcaccc

SEQ ID NO: 392759 - DNA, 25 bp, Rattus norvegicus
gccattgttatttatatttgcaccc

SEQ ID NO: 392760 - DNA, 25 bp, Rattus norvegicus
gccattgttggcacgaagcccagaa

SEQ ID NO: 392761 - DNA, 25 bp, Rattus norvegicus
gccattgttggctcgaagcccagaa

SEQ ID NO: 392762 - DNA, 25 bp, Rattus norvegicus
gccattgttggtactcatctgctaa

SEQ ID NO: 392763 - DNA, 25 bp, Rattus norvegicus
gccattgttggttctcatctgctaa

SEQ ID NO: 392764 - DNA, 25 bp, Rattus norvegicus
gccattgttgttaggtggtatccta

SEQ ID NO: 392765 - DNA, 25 bp, Rattus norvegicus
gccattgttgtttggtggtatccta

SEQ ID NO: 392766 - DNA, 25 bp, Rattus norvegicus
gccatttaaccccacaactcttaag

SEQ ID NO: 392767 - DNA, 25 bp, Rattus norvegicus
gccatttaacccgacaactcttaag

SEQ ID NO: 392768 - DNA, 25 bp, Rattus norvegicus
gccatttaccacatacctttactgt

SEQ ID NO: 392769 - DNA, 25 bp, Rattus norvegicus
gccatttaccacttacctttactgt

SEQ ID NO: 392770 - DNA, 25 bp, Rattus norvegicus
gccatttaccctcctttttatctat

SEQ ID NO: 392771 - DNA, 25 bp, Rattus norvegicus
gccatttaccctgctttttatctat

SEQ ID NO: 392772 - DNA, 25 bp, Rattus norvegicus
gccatttacggcagtgtactagaca

SEQ ID NO: 392773 - DNA, 25 bp, Rattus norvegicus
gccatttacggctgtgtactagaca

SEQ ID NO: 392774 - DNA, 25 bp, Rattus norvegicus
gccatttactaaagatccctacctg

SEQ ID NO: 392775 - DNA, 25 bp, Rattus norvegicus
gccatttactaatgatccctacctg

SEQ ID NO: 392776 - DNA, 25 bp, Rattus norvegicus
gccatttaggagaatgattgacccc

SEQ ID NO: 392777 - DNA, 25 bp, Rattus norvegicus
gccatttaggagtatgattgacccc

SEQ ID NO: 392778 - DNA, 25 bp, Rattus norvegicus
gccatttataatctgtgccgctgct

SEQ ID NO: 392779 - DNA, 25 bp, Rattus norvegicus
gccatttataatgtgtgccgctgct

SEQ ID NO: 392780 - DNA, 25 bp, Rattus norvegicus
gccatttatataccaccttcattgt

SEQ ID NO: 392781 - DNA, 25 bp, Rattus norvegicus
gccatttatatagcaccttcattgt

SEQ ID NO: 392782 - DNA, 25 bp, Rattus norvegicus
gccatttatcgaattgcgctgcaga

SEQ ID NO: 392783 - DNA, 25 bp, Rattus norvegicus
gccatttatcgatttgcgctgcaga

SEQ ID NO: 392784 - DNA, 25 bp, Rattus norvegicus
gccatttatgctactgccttttata

SEQ ID NO: 392785 - DNA, 25 bp, Rattus norvegicus
gccatttatgcttctgccttttata

SEQ ID NO: 392786 - DNA, 25 bp, Rattus norvegicus
gccatttcacatatgggctgtagaa

SEQ ID NO: 392787 - DNA, 25 bp, Rattus norvegicus
gccatttcacatttgggctgtagaa

SEQ ID NO: 392788 - DNA, 25 bp, Rattus norvegicus
gccatttcaccaattttagctgtag

SEQ ID NO: 392789 - DNA, 25 bp, Rattus norvegicus
gccatttcaccatttttagctgtag

SEQ ID NO: 392790 - DNA, 25 bp, Rattus norvegicus
gccatttcatccacagacttgtaga

SEQ ID NO: 392791 - DNA, 25 bp, Rattus norvegicus
gccatttcatcctcagacttgtaga

SEQ ID NO: 392792 - DNA, 25 bp, Rattus norvegicus
gccatttcatctcggtcttactatg

SEQ ID NO: 392793 - DNA, 25 bp, Rattus norvegicus
gccatttcatctgggtcttactatg

SEQ ID NO: 392794 - DNA, 25 bp, Rattus norvegicus
gccatttccacacaatgcaggacag

SEQ ID NO: 392795 - DNA, 25 bp, Rattus norvegicus
gccatttccacagaatgcaggacag

SEQ ID NO: 392796 - DNA, 25 bp, Rattus norvegicus
gccatttcccaacactattctttgc

SEQ ID NO: 392797 - DNA, 25 bp, Rattus norvegicus
gccatttcccaagactattctttgc

SEQ ID NO: 392798 - DNA, 25 bp, Rattus norvegicus
gccatttccccacaatttcttttat

SEQ ID NO: 392799 - DNA, 25 bp, Rattus norvegicus
gccatttccccagaatttcttttat

SEQ ID NO: 392800 - DNA, 25 bp, Rattus norvegicus
gccatttcctggagaaaggcccaac

SEQ ID NO: 392801 - DNA, 25 bp, Rattus norvegicus
gccatttcctggtgaaaggcccaac

SEQ ID NO: 392802 - DNA, 25 bp, Rattus norvegicus
gccatttcgctacaactatacattt

SEQ ID NO: 392803 - DNA, 25 bp, Rattus norvegicus
gccatttcgctagaactatacattt

SEQ ID NO: 392804 - DNA, 25 bp, Rattus norvegicus
gccatttctcacaggcgtgctcaaa

SEQ ID NO: 392805 - DNA, 25 bp, Rattus norvegicus
gccatttctcactggcgtgctcaaa

SEQ ID NO: 392806 - DNA, 25 bp, Rattus norvegicus
gccatttctcctacaacttagttta

SEQ ID NO: 392807 - DNA, 25 bp, Rattus norvegicus
gccatttctccttcaacttagttta

SEQ ID NO: 392808 - DNA, 25 bp, Rattus norvegicus
gccatttctcttcacgttgcttttc

SEQ ID NO: 392809 - DNA, 25 bp, Rattus norvegicus
gccatttctcttgacgttgcttttc

SEQ ID NO: 392810 - DNA, 25 bp, Rattus norvegicus
gccatttcttaacttttttgccttg

SEQ ID NO: 392811 - DNA, 25 bp, Rattus norvegicus
gccatttcttaagttttttgccttg

SEQ ID NO: 392812 - DNA, 25 bp, Rattus norvegicus
gccatttgacaaattatatacccaa

SEQ ID NO: 392813 - DNA, 25 bp, Rattus norvegicus
gccatttgacaactgatcttttctt

SEQ ID NO: 392814 - DNA, 25 bp, Rattus norvegicus
gccatttgacaagtgatcttttctt

SEQ ID NO: 392815 - DNA, 25 bp, Rattus norvegicus
gccatttgacaatttatatacccaa

SEQ ID NO: 392816 - DNA, 25 bp, Rattus norvegicus
gccatttgcattcttgcttagctcc

SEQ ID NO: 392817 - DNA, 25 bp, Rattus norvegicus
gccatttgcattgttgcttagctcc

SEQ ID NO: 392818 - DNA, 25 bp, Rattus norvegicus
gccatttgcctcattcttgatggaa

SEQ ID NO: 392819 - DNA, 25 bp, Rattus norvegicus
gccatttgcctctttcttgatggaa

SEQ ID NO: 392820 - DNA, 25 bp, Rattus norvegicus
gccatttgtctcacaagggctcaat

SEQ ID NO: 392821 - DNA, 25 bp, Rattus norvegicus
gccatttgtctctcaagggctcaat

SEQ ID NO: 392822 - DNA, 25 bp, Rattus norvegicus
gccatttgtgcaatgagtgttctga

SEQ ID NO: 392823 - DNA, 25 bp, Rattus norvegicus
gccatttgtgcattgagtgttctga

SEQ ID NO: 392824 - DNA, 25 bp, Rattus norvegicus
gccatttgttccctgtctaaagatg

SEQ ID NO: 392825 - DNA, 25 bp, Rattus norvegicus
gccatttgttccgtgtctaaagatg

SEQ ID NO: 392826 - DNA, 25 bp, Rattus norvegicus
gccattttagcaattacttgtagat

SEQ ID NO: 392827 - DNA, 25 bp, Rattus norvegicus
gccattttagcatttacttgtagat

SEQ ID NO: 392828 - DNA, 25 bp, Rattus norvegicus
gccattttcatgatttacacctgtt

SEQ ID NO: 392829 - DNA, 25 bp, Rattus norvegicus
gccattttcatgttttacacctgtt

SEQ ID NO: 392830 - DNA, 25 bp, Rattus norvegicus
gccattttccagctccctattagaa

SEQ ID NO: 392831 - DNA, 25 bp, Rattus norvegicus
gccattttccaggtccctattagaa

SEQ ID NO: 392832 - DNA, 25 bp, Rattus norvegicus
gccattttcgctagtctctatggaa

SEQ ID NO: 392833 - DNA, 25 bp, Rattus norvegicus
gccattttcgcttgtctctatggaa

SEQ ID NO: 392834 - DNA, 25 bp, Rattus norvegicus
gccattttcttacgacacattcttg

SEQ ID NO: 392835 - DNA, 25 bp, Rattus norvegicus
gccattttcttaggacacattcttg

SEQ ID NO: 392836 - DNA, 25 bp, Rattus norvegicus
gccattttgcccaagccggtgaaaa

SEQ ID NO: 392837 - DNA, 25 bp, Rattus norvegicus
gccattttgccctagccggtgaaaa

SEQ ID NO: 392838 - DNA, 25 bp, Rattus norvegicus
gccattttggaaagttaggccccag

SEQ ID NO: 392839 - DNA, 25 bp, Rattus norvegicus
gccattttggaatgttaggccccag

SEQ ID NO: 392840 - DNA, 25 bp, Rattus norvegicus
gccatttttaccaacatactcattc

SEQ ID NO: 392841 - DNA, 25 bp, Rattus norvegicus
gccatttttacctacatactcattc

SEQ ID NO: 392842 - DNA, 25 bp, Rattus norvegicus
gccatttttaggatctgttgtactc

SEQ ID NO: 392843 - DNA, 25 bp, Rattus norvegicus
gccatttttaggttctgttgtactc

SEQ ID NO: 392844 - DNA, 25 bp, Rattus norvegicus
gccatttttgttagccaggacatgc

SEQ ID NO: 392845 - DNA, 25 bp, Rattus norvegicus
gccatttttgtttgccaggacatgc

SEQ ID NO: 392846 - DNA, 25 bp, Rattus norvegicus
gcccaaaagccgctctgaagaggaa

SEQ ID NO: 392847 - DNA, 25 bp, Rattus norvegicus
gcccaaaagccggtctgaagaggaa

SEQ ID NO: 392848 - DNA, 25 bp, Rattus norvegicus
gcccaaaaggctaagggaagctcta

SEQ ID NO: 392849 - DNA, 25 bp, Rattus norvegicus
gcccaaaaggcttagggaagctcta

SEQ ID NO: 392850 - DNA, 25 bp, Rattus norvegicus
gcccaaacacgaacacgatttcaac

SEQ ID NO: 392851 - DNA, 25 bp, Rattus norvegicus
gcccaaacacgatcacgatttcaac

SEQ ID NO: 392852 - DNA, 25 bp, Rattus norvegicus
gcccaaacctgtagcctgattttaa

SEQ ID NO: 392853 - DNA, 25 bp, Rattus norvegicus
gcccaaacctgttgcctgattttaa

SEQ ID NO: 392854 - DNA, 25 bp, Rattus norvegicus
gcccaaacgggaagcctgaggaact

SEQ ID NO: 392855 - DNA, 25 bp, Rattus norvegicus
gcccaaacgggatgcctgaggaact

SEQ ID NO: 392856 - DNA, 25 bp, Rattus norvegicus
gcccaaactgaaactgctcttcttt

SEQ ID NO: 392857 - DNA, 25 bp, Rattus norvegicus
gcccaaactgaatctgctcttcttt

SEQ ID NO: 392858 - DNA, 25 bp, Rattus norvegicus
gcccaaagaaacaggatggtaccca

SEQ ID NO: 392859 - DNA, 25 bp, Rattus norvegicus
gcccaaagaaactggatggtaccca

SEQ ID NO: 392860 - DNA, 25 bp, Rattus norvegicus
gcccaaagcagcagttattgttcag

SEQ ID NO: 392861 - DNA, 25 bp, Rattus norvegicus
gcccaaagcagctgttattgttcag

SEQ ID NO: 392862 - DNA, 25 bp, Rattus norvegicus
gcccaaagcgtaccttccagggtga

SEQ ID NO: 392863 - DNA, 25 bp, Rattus norvegicus
gcccaaagcgtagcttccagggtga

SEQ ID NO: 392864 - DNA, 25 bp, Rattus norvegicus
gcccaaagctgtctgcaggcttgca

SEQ ID NO: 392865 - DNA, 25 bp, Rattus norvegicus
gcccaaagctgtgtgcaggcttgca

SEQ ID NO: 392866 - DNA, 25 bp, Rattus norvegicus
gcccaaaggtagaatgatcgacaag

SEQ ID NO: 392867 - DNA, 25 bp, Rattus norvegicus
gcccaaaggtagagtttgtggccac

SEQ ID NO: 392868 - DNA, 25 bp, Rattus norvegicus
gcccaaaggtagtatgatcgacaag

SEQ ID NO: 392869 - DNA, 25 bp, Rattus norvegicus
gcccaaaggtagtgtttgtggccac

SEQ ID NO: 392870 - DNA, 25 bp, Rattus norvegicus
gcccaaagtcgcaggcttcaaagaa

SEQ ID NO: 392871 - DNA, 25 bp, Rattus norvegicus
gcccaaagtcgctggcttcaaagaa

SEQ ID NO: 392872 - DNA, 25 bp, Rattus norvegicus
gcccaaatgtacatagattctctta

SEQ ID NO: 392873 - DNA, 25 bp, Rattus norvegicus
gcccaaatgtacttagattctctta

SEQ ID NO: 392874 - DNA, 25 bp, Rattus norvegicus
gcccaacacgacattgccgagagaa

SEQ ID NO: 392875 - DNA, 25 bp, Rattus norvegicus
gcccaacacgactttgccgagagaa

SEQ ID NO: 392876 - DNA, 25 bp, Rattus norvegicus
gcccaacacggtctggtccaagatt

SEQ ID NO: 392877 - DNA, 25 bp, Rattus norvegicus
gcccaacacggtgtggtccaagatt

SEQ ID NO: 392878 - DNA, 25 bp, Rattus norvegicus
gcccaacagggcactgctggaaaac

SEQ ID NO: 392879 - DNA, 25 bp, Rattus norvegicus
gcccaacagggctctgctggaaaac

SEQ ID NO: 392880 - DNA, 25 bp, Rattus norvegicus
gcccaacatggcagtaactggagat

SEQ ID NO: 392881 - DNA, 25 bp, Rattus norvegicus
gcccaacatggctgtaactggagat

SEQ ID NO: 392882 - DNA, 25 bp, Rattus norvegicus
gcccaacatttgactactgacctgt

SEQ ID NO: 392883 - DNA, 25 bp, Rattus norvegicus
gcccaacatttgtctactgacctgt

SEQ ID NO: 392884 - DNA, 25 bp, Rattus norvegicus
gcccaacctaagcaggcaagttatg

SEQ ID NO: 392885 - DNA, 25 bp, Rattus norvegicus
gcccaacctaaggaggcaagttatg

SEQ ID NO: 392886 - DNA, 25 bp, Rattus norvegicus
gcccaacctcaacgaccaggtggta

SEQ ID NO: 392887 - DNA, 25 bp, Rattus norvegicus
gcccaacctcaaggaccaggtggta

SEQ ID NO: 392888 - DNA, 25 bp, Rattus norvegicus
gcccaactgatgatcatgatgcgct

SEQ ID NO: 392889 - DNA, 25 bp, Rattus norvegicus
gcccaactgatgttcatgatgcgct

SEQ ID NO: 392890 - DNA, 25 bp, Rattus norvegicus
gcccaactggttctgcttgatccat

SEQ ID NO: 392891 - DNA, 25 bp, Rattus norvegicus
gcccaactggttgtgcttgatccat

SEQ ID NO: 392892 - DNA, 25 bp, Rattus norvegicus
gcccaagacagtcatcggagaccat

SEQ ID NO: 392893 - DNA, 25 bp, Rattus norvegicus
gcccaagacagtgatcggagaccat

SEQ ID NO: 392894 - DNA, 25 bp, Rattus norvegicus
gcccaagaccaaccagaccggaaat

SEQ ID NO: 392895 - DNA, 25 bp, Rattus norvegicus
gcccaagaccaagcagaccggaaat

SEQ ID NO: 392896 - DNA, 25 bp, Rattus norvegicus
gcccaagacctgcttatgtgcttta

SEQ ID NO: 392897 - DNA, 25 bp, Rattus norvegicus
gcccaagacctggttatgtgcttta

SEQ ID NO: 392898 - DNA, 25 bp, Rattus norvegicus
gcccaagagatacccatactgatga

SEQ ID NO: 392899 - DNA, 25 bp, Rattus norvegicus
gcccaagagatagccatactgatga

SEQ ID NO: 392900 - DNA, 25 bp, Rattus norvegicus
gcccaagagtttccagctgcagtta

SEQ ID NO: 392901 - DNA, 25 bp, Rattus norvegicus
gcccaagagtttgcagctgcagtta

SEQ ID NO: 392902 - DNA, 25 bp, Rattus norvegicus
gcccaagattttaacatgcacctgt

SEQ ID NO: 392903 - DNA, 25 bp, Rattus norvegicus
gcccaagatttttacatgcacctgt

SEQ ID NO: 392904 - DNA, 25 bp, Rattus norvegicus
gcccaagccttgaggtggaacccaa

SEQ ID NO: 392905 - DNA, 25 bp, Rattus norvegicus
gcccaagccttgtggtggaacccaa

SEQ ID NO: 392906 - DNA, 25 bp, Rattus norvegicus
gcccaagctcacagtttttatctgt

SEQ ID NO: 392907 - DNA, 25 bp, Rattus norvegicus
gcccaagctcactgtttttatctgt

SEQ ID NO: 392908 - DNA, 25 bp, Rattus norvegicus
gcccaagctgaacgtgtgtgcactg

SEQ ID NO: 392909 - DNA, 25 bp, Rattus norvegicus
gcccaagctgaaggtgtgtgcactg

SEQ ID NO: 392910 - DNA, 25 bp, Rattus norvegicus
gcccaaggacatctgcctgttcagg

SEQ ID NO: 392911 - DNA, 25 bp, Rattus norvegicus
gcccaaggacatgtgcctgttcagg

SEQ ID NO: 392912 - DNA, 25 bp, Rattus norvegicus
gcccaaggacctcatttaagggaca

SEQ ID NO: 392913 - DNA, 25 bp, Rattus norvegicus
gcccaaggacctgatttaagggaca

SEQ ID NO: 392914 - DNA, 25 bp, Rattus norvegicus
gcccaaggactcagtttcatgatct

SEQ ID NO: 392915 - DNA, 25 bp, Rattus norvegicus
gcccaaggactctgtttcatgatct

SEQ ID NO: 392916 - DNA, 25 bp, Rattus norvegicus
gcccaaggagcacgaacatttttca

SEQ ID NO: 392917 - DNA, 25 bp, Rattus norvegicus
gcccaaggagcaggaacatttttca

SEQ ID NO: 392918 - DNA, 25 bp, Rattus norvegicus
gcccaaggaggccatttcaggtctg

SEQ ID NO: 392919 - DNA, 25 bp, Rattus norvegicus
gcccaaggaggcgatttcaggtctg

SEQ ID NO: 392920 - DNA, 25 bp, Rattus norvegicus
gcccaaggcaaaaggtctccaagaa

SEQ ID NO: 392921 - DNA, 25 bp, Rattus norvegicus
gcccaaggcaaactgctgcttgtgc

SEQ ID NO: 392922 - DNA, 25 bp, Rattus norvegicus
gcccaaggcaaagtgctgcttgtgc

SEQ ID NO: 392923 - DNA, 25 bp, Rattus norvegicus
gcccaaggcaaatggtctccaagaa

SEQ ID NO: 392924 - DNA, 25 bp, Rattus norvegicus
gcccaaggccctcagatgttaaaaa

SEQ ID NO: 392925 - DNA, 25 bp, Rattus norvegicus
gcccaaggccctgagatgttaaaaa

SEQ ID NO: 392926 - DNA, 25 bp, Rattus norvegicus
gcccaaggccttcatgctacatgag

SEQ ID NO: 392927 - DNA, 25 bp, Rattus norvegicus
gcccaaggccttgatgctacatgag

SEQ ID NO: 392928 - DNA, 25 bp, Rattus norvegicus
gcccaaggctggatttgcctgagga

SEQ ID NO: 392929 - DNA, 25 bp, Rattus norvegicus
gcccaaggctggttttgcctgagga

SEQ ID NO: 392930 - DNA, 25 bp, Rattus norvegicus
gcccaaggtactaagtctcagtgag

SEQ ID NO: 392931 - DNA, 25 bp, Rattus norvegicus
gcccaaggtacttagtctcagtgag

SEQ ID NO: 392932 - DNA, 25 bp, Rattus norvegicus
gcccaaggtccactttgaaggagaa

SEQ ID NO: 392933 - DNA, 25 bp, Rattus norvegicus
gcccaaggtccagtttgaaggagaa

SEQ ID NO: 392934 - DNA, 25 bp, Rattus norvegicus
gcccaagtaactctccctttgtggt

SEQ ID NO: 392935 - DNA, 25 bp, Rattus norvegicus
gcccaagtaactgtccctttgtggt

SEQ ID NO: 392936 - DNA, 25 bp, Rattus norvegicus
gcccaagtcccgagttcaaggtggg

SEQ ID NO: 392937 - DNA, 25 bp, Rattus norvegicus
gcccaagtcccgtgttcaaggtggg

SEQ ID NO: 392938 - DNA, 25 bp, Rattus norvegicus
gcccaagtctggaagcatgtgctga

SEQ ID NO: 392939 - DNA, 25 bp, Rattus norvegicus
gcccaagtctggtagcatgtgctga

SEQ ID NO: 392940 - DNA, 25 bp, Rattus norvegicus
gcccaagttcttccatgtatactag

SEQ ID NO: 392941 - DNA, 25 bp, Rattus norvegicus
gcccaagttcttgcatgtatactag

SEQ ID NO: 392942 - DNA, 25 bp, Rattus norvegicus
gcccaagtttgcagttaatgcttaa

SEQ ID NO: 392943 - DNA, 25 bp, Rattus norvegicus
gcccaagtttgctgttaatgcttaa

SEQ ID NO: 392944 - DNA, 25 bp, Rattus norvegicus
gcccaataaatgctttctttcataa

SEQ ID NO: 392945 - DNA, 25 bp, Rattus norvegicus
gcccaataaatggtttctttcataa

SEQ ID NO: 392946 - DNA, 25 bp, Rattus norvegicus
gcccaataccgtcactgttttgata

SEQ ID NO: 392947 - DNA, 25 bp, Rattus norvegicus
gcccaataccgtgactgttttgata

SEQ ID NO: 392948 - DNA, 25 bp, Rattus norvegicus
gcccaatatgccaagctttgacagc

SEQ ID NO: 392949 - DNA, 25 bp, Rattus norvegicus
gcccaatatgcctagctttgacagc

SEQ ID NO: 392950 - DNA, 25 bp, Rattus norvegicus
gcccaatcctgtcctcaagaataag

SEQ ID NO: 392951 - DNA, 25 bp, Rattus norvegicus
gcccaatcctgtgctcaagaataag

SEQ ID NO: 392952 - DNA, 25 bp, Rattus norvegicus
gcccaatccttgagaaccagaggtt

SEQ ID NO: 392953 - DNA, 25 bp, Rattus norvegicus
gcccaatccttgtgaaccagaggtt

SEQ ID NO: 392954 - DNA, 25 bp, Rattus norvegicus
gcccaatgaatgcagtcactgcgtg

SEQ ID NO: 392955 - DNA, 25 bp, Rattus norvegicus
gcccaatgaatggagtcactgcgtg

SEQ ID NO: 392956 - DNA, 25 bp, Rattus norvegicus
gcccaatgactacgctggctttatt

SEQ ID NO: 392957 - DNA, 25 bp, Rattus norvegicus
gcccaatgactaggctggctttatt

SEQ ID NO: 392958 - DNA, 25 bp, Rattus norvegicus
gcccaatgggcaaattcccagacaa

SEQ ID NO: 392959 - DNA, 25 bp, Rattus norvegicus
gcccaatgggcatattcccagacaa

SEQ ID NO: 392960 - DNA, 25 bp, Rattus norvegicus
gcccaatgggctatacagaaaactg

SEQ ID NO: 392961 - DNA, 25 bp, Rattus norvegicus
gcccaatgggctttacagaaaactg

SEQ ID NO: 392962 - DNA, 25 bp, Rattus norvegicus
gcccaatggtgtccaaatgagacta

SEQ ID NO: 392963 - DNA, 25 bp, Rattus norvegicus
gcccaatggtgtctcacacgagtgt

SEQ ID NO: 392964 - DNA, 25 bp, Rattus norvegicus
gcccaatggtgtgcaaatgagacta

SEQ ID NO: 392965 - DNA, 25 bp, Rattus norvegicus
gcccaatggtgtgtcacacgagtgt

SEQ ID NO: 392966 - DNA, 25 bp, Rattus norvegicus
gcccaatgtcacagatgccgagagt

SEQ ID NO: 392967 - DNA, 25 bp, Rattus norvegicus
gcccaatgtcactgatgccgagagt

SEQ ID NO: 392968 - DNA, 25 bp, Rattus norvegicus
gcccaattaaccattagcatatttg

SEQ ID NO: 392969 - DNA, 25 bp, Rattus norvegicus
gcccaattaacctttagcatatttg

SEQ ID NO: 392970 - DNA, 25 bp, Rattus norvegicus
gcccaattgcttcttttttagactt

SEQ ID NO: 392971 - DNA, 25 bp, Rattus norvegicus
gcccaattgcttgttttttagactt

SEQ ID NO: 392972 - DNA, 25 bp, Rattus norvegicus
gcccaattgtctctggcattctaag

SEQ ID NO: 392973 - DNA, 25 bp, Rattus norvegicus
gcccaattgtctgtggcattctaag

SEQ ID NO: 392974 - DNA, 25 bp, Rattus norvegicus
gcccacaactttcagaggacatctt

SEQ ID NO: 392975 - DNA, 25 bp, Rattus norvegicus
gcccacaactttgagaggacatctt

SEQ ID NO: 392976 - DNA, 25 bp, Rattus norvegicus
gcccacaatgccacatactattgga

SEQ ID NO: 392977 - DNA, 25 bp, Rattus norvegicus
gcccacaatgcctcatactattgga

SEQ ID NO: 392978 - DNA, 25 bp, Rattus norvegicus
gcccacacattaatttctactttca

SEQ ID NO: 392979 - DNA, 25 bp, Rattus norvegicus
gcccacacattattttctactttca

SEQ ID NO: 392980 - DNA, 25 bp, Rattus norvegicus
gcccacaccctgaagtagaaagcgg

SEQ ID NO: 392981 - DNA, 25 bp, Rattus norvegicus
gcccacaccctgtagtagaaagcgg

SEQ ID NO: 392982 - DNA, 25 bp, Rattus norvegicus
gcccacacctgcattaatcggattg

SEQ ID NO: 392983 - DNA, 25 bp, Rattus norvegicus
gcccacacctgctttaatcggattg

SEQ ID NO: 392984 - DNA, 25 bp, Rattus norvegicus
gcccacacgcataagcaaggaaatt

SEQ ID NO: 392985 - DNA, 25 bp, Rattus norvegicus
gcccacacgcattagcaaggaaatt

SEQ ID NO: 392986 - DNA, 25 bp, Rattus norvegicus
gcccacactgggaatcaccatgtaa

SEQ ID NO: 392987 - DNA, 25 bp, Rattus norvegicus
gcccacactgggtatcaccatgtaa

SEQ ID NO: 392988 - DNA, 25 bp, Rattus norvegicus
gcccacagagaacggtgttctcaca

SEQ ID NO: 392989 - DNA, 25 bp, Rattus norvegicus
gcccacagagaagggtgttctcaca

SEQ ID NO: 392990 - DNA, 25 bp, Rattus norvegicus
gcccacagcactatgaaagtgacca

SEQ ID NO: 392991 - DNA, 25 bp, Rattus norvegicus
gcccacagcactttgaaagtgacca

SEQ ID NO: 392992 - DNA, 25 bp, Rattus norvegicus
gcccacagcctgagtcacaaagaat

SEQ ID NO: 392993 - DNA, 25 bp, Rattus norvegicus
gcccacagcctgtgtcacaaagaat

SEQ ID NO: 392994 - DNA, 25 bp, Rattus norvegicus
gcccacaggtacaagggtgcagcga

SEQ ID NO: 392995 - DNA, 25 bp, Rattus norvegicus
gcccacaggtactagggtgcagcga

SEQ ID NO: 392996 - DNA, 25 bp, Rattus norvegicus
gcccacagtcgtccagtgtttaata

SEQ ID NO: 392997 - DNA, 25 bp, Rattus norvegicus
gcccacagtcgtgcagtgtttaata

SEQ ID NO: 392998 - DNA, 25 bp, Rattus norvegicus
gcccacatcacaatgtctgtagctg

SEQ ID NO: 392999 - DNA, 25 bp, Rattus norvegicus
gcccacatcacattgtctgtagctg

SEQ ID NO: 393000 - DNA, 25 bp, Rattus norvegicus
gcccacatctgtccctttcagaagg

SEQ ID NO: 393001 - DNA, 25 bp, Rattus norvegicus
gcccacatctgtgcctttcagaagg

SEQ ID NO: 393002 - DNA, 25 bp, Rattus norvegicus
gcccacatgtggatagacactgcat

SEQ ID NO: 393003 - DNA, 25 bp, Rattus norvegicus
gcccacatgtggttagacactgcat

SEQ ID NO: 393004 - DNA, 25 bp, Rattus norvegicus
gcccacatttacctctatctaaaga

SEQ ID NO: 393005 - DNA, 25 bp, Rattus norvegicus
gcccacatttacgtctatctaaaga

SEQ ID NO: 393006 - DNA, 25 bp, Rattus norvegicus
gcccacatttttcaaggcctagaaa

SEQ ID NO: 393007 - DNA, 25 bp, Rattus norvegicus
gcccacatttttgaaggcctagaaa

SEQ ID NO: 393008 - DNA, 25 bp, Rattus norvegicus
gcccaccaacggacactgtttgaat

SEQ ID NO: 393009 - DNA, 25 bp, Rattus norvegicus
gcccaccaacggtcactgtttgaat

SEQ ID NO: 393010 - DNA, 25 bp, Rattus norvegicus
gcccaccaaggtagtcatcagctaa

SEQ ID NO: 393011 - DNA, 25 bp, Rattus norvegicus
gcccaccaaggttgtcatcagctaa

SEQ ID NO: 393012 - DNA, 25 bp, Rattus norvegicus
gcccaccactgtccgtatggaaatg

SEQ ID NO: 393013 - DNA, 25 bp, Rattus norvegicus
gcccaccactgtgcgtatggaaatg

SEQ ID NO: 393014 - DNA, 25 bp, Rattus norvegicus
gcccaccagagtaacctctgaagaa

SEQ ID NO: 393015 - DNA, 25 bp, Rattus norvegicus
gcccaccagagttacctctgaagaa

SEQ ID NO: 393016 - DNA, 25 bp, Rattus norvegicus
gcccaccagcatattatccaagaga

SEQ ID NO: 393017 - DNA, 25 bp, Rattus norvegicus
gcccaccagcattttatccaagaga

SEQ ID NO: 393018 - DNA, 25 bp, Rattus norvegicus
gcccaccagcctagtcctaataaaa

SEQ ID NO: 393019 - DNA, 25 bp, Rattus norvegicus
gcccaccagccttgtcctaataaaa

SEQ ID NO: 393020 - DNA, 25 bp, Rattus norvegicus
gcccaccaggatcctactgggttga

SEQ ID NO: 393021 - DNA, 25 bp, Rattus norvegicus
gcccaccaggatgctactgggttga

SEQ ID NO: 393022 - DNA, 25 bp, Rattus norvegicus
gcccaccattgtatgtaatctagaa

SEQ ID NO: 393023 - DNA, 25 bp, Rattus norvegicus
gcccaccattgtttgtaatctagaa

SEQ ID NO: 393024 - DNA, 25 bp, Rattus norvegicus
gcccacccagggattttgctatttg

SEQ ID NO: 393025 - DNA, 25 bp, Rattus norvegicus
gcccacccagggtttttgctatttg

SEQ ID NO: 393026 - DNA, 25 bp, Rattus norvegicus
gcccacccagtgctgatgataccag

SEQ ID NO: 393027 - DNA, 25 bp, Rattus norvegicus
gcccacccagtggtgatgataccag

SEQ ID NO: 393028 - DNA, 25 bp, Rattus norvegicus
gcccaccccgttcctgaattgtttg

SEQ ID NO: 393029 - DNA, 25 bp, Rattus norvegicus
gcccaccccgttgctgaattgtttg

SEQ ID NO: 393030 - DNA, 25 bp, Rattus norvegicus
gcccaccctgcacgtaaggttgagg

SEQ ID NO: 393031 - DNA, 25 bp, Rattus norvegicus
gcccaccctgcaggtaaggttgagg

SEQ ID NO: 393032 - DNA, 25 bp, Rattus norvegicus
gcccaccctttccttgtgaggaaga

SEQ ID NO: 393033 - DNA, 25 bp, Rattus norvegicus
gcccaccctttcgttgtgaggaaga

SEQ ID NO: 393034 - DNA, 25 bp, Rattus norvegicus
gcccaccgtgggaactgcaaagatg

SEQ ID NO: 393035 - DNA, 25 bp, Rattus norvegicus
gcccaccgtgggtactgcaaagatg

SEQ ID NO: 393036 - DNA, 25 bp, Rattus norvegicus
gcccaccgtgtgcaaatcctagagg

SEQ ID NO: 393037 - DNA, 25 bp, Rattus norvegicus
gcccaccgtgtggaaatcctagagg

SEQ ID NO: 393038 - DNA, 25 bp, Rattus norvegicus
gcccacctatggaatctactgagta

SEQ ID NO: 393039 - DNA, 25 bp, Rattus norvegicus
gcccacctatggtatctactgagta

SEQ ID NO: 393040 - DNA, 25 bp, Rattus norvegicus
gcccacctgtggaatttatgcgaat

SEQ ID NO: 393041 - DNA, 25 bp, Rattus norvegicus
gcccacctgtggtatttatgcgaat

SEQ ID NO: 393042 - DNA, 25 bp, Rattus norvegicus
gcccaccttaccacatttgattgaa

SEQ ID NO: 393043 - DNA, 25 bp, Rattus norvegicus
gcccaccttacctcatttgattgaa

SEQ ID NO: 393044 - DNA, 25 bp, Rattus norvegicus
gcccaccttggtagagctgaatcgt

SEQ ID NO: 393045 - DNA, 25 bp, Rattus norvegicus
gcccaccttggttgagctgaatcgt

SEQ ID NO: 393046 - DNA, 25 bp, Rattus norvegicus
gcccacctttatattctttccatat

SEQ ID NO: 393047 - DNA, 25 bp, Rattus norvegicus
gcccacctttattttctttccatat

SEQ ID NO: 393048 - DNA, 25 bp, Rattus norvegicus
gcccacgatgccagttgctgaaaga

SEQ ID NO: 393049 - DNA, 25 bp, Rattus norvegicus
gcccacgatgcctgttgctgaaaga

SEQ ID NO: 393050 - DNA, 25 bp, Rattus norvegicus
gcccacgcagtcattttcaggaaca

SEQ ID NO: 393051 - DNA, 25 bp, Rattus norvegicus
gcccacgcagtctttttcaggaaca

SEQ ID NO: 393052 - DNA, 25 bp, Rattus norvegicus
gcccacgcattgcttatgtgtccat

SEQ ID NO: 393053 - DNA, 25 bp, Rattus norvegicus
gcccacgcattggttatgtgtccat

SEQ ID NO: 393054 - DNA, 25 bp, Rattus norvegicus
gcccacgctatcaggatctttttag

SEQ ID NO: 393055 - DNA, 25 bp, Rattus norvegicus
gcccacgctatctggatctttttag

SEQ ID NO: 393056 - DNA, 25 bp, Rattus norvegicus
gcccacggaattctcttcactgaag

SEQ ID NO: 393057 - DNA, 25 bp, Rattus norvegicus
gcccacggaattgtcttcactgaag

SEQ ID NO: 393058 - DNA, 25 bp, Rattus norvegicus
gcccacggtgtgcatagtccgattt

SEQ ID NO: 393059 - DNA, 25 bp, Rattus norvegicus
gcccacggtgtggatagtccgattt

SEQ ID NO: 393060 - DNA, 25 bp, Rattus norvegicus
gcccacgtcaaacagaactgcctga

SEQ ID NO: 393061 - DNA, 25 bp, Rattus norvegicus
gcccacgtcaaagagaactgcctga

SEQ ID NO: 393062 - DNA, 25 bp, Rattus norvegicus
gcccacgttcagacgaaggatatct

SEQ ID NO: 393063 - DNA, 25 bp, Rattus norvegicus
gcccacgttcagtcgaaggatatct

SEQ ID NO: 393064 - DNA, 25 bp, Rattus norvegicus
gcccacgttctgacatggctagaag

SEQ ID NO: 393065 - DNA, 25 bp, Rattus norvegicus
gcccacgttctgtcatggctagaag

SEQ ID NO: 393066 - DNA, 25 bp, Rattus norvegicus
gcccactaggccatctctaaaggga

SEQ ID NO: 393067 - DNA, 25 bp, Rattus norvegicus
gcccactaggccttctctaaaggga

SEQ ID NO: 393068 - DNA, 25 bp, Rattus norvegicus
gcccactatttcctactttttgaag

SEQ ID NO: 393069 - DNA, 25 bp, Rattus norvegicus
gcccactatttcgtactttttgaag

SEQ ID NO: 393070 - DNA, 25 bp, Rattus norvegicus
gcccactcaatactgtgaagccttg

SEQ ID NO: 393071 - DNA, 25 bp, Rattus norvegicus
gcccactcaatagtgtgaagccttg

SEQ ID NO: 393072 - DNA, 25 bp, Rattus norvegicus
gcccactcagggattttgtgaagac

SEQ ID NO: 393073 - DNA, 25 bp, Rattus norvegicus
gcccactcagggtttttgtgaagac

SEQ ID NO: 393074 - DNA, 25 bp, Rattus norvegicus
gcccactcataacaggctatttctt

SEQ ID NO: 393075 - DNA, 25 bp, Rattus norvegicus
gcccactcataagaggctatttctt

SEQ ID NO: 393076 - DNA, 25 bp, Rattus norvegicus
gcccactccctaccaaaagtgtgga

SEQ ID NO: 393077 - DNA, 25 bp, Rattus norvegicus
gcccactccctagcaaaagtgtgga

SEQ ID NO: 393078 - DNA, 25 bp, Rattus norvegicus
gcccactggcggagcatctgggcct

SEQ ID NO: 393079 - DNA, 25 bp, Rattus norvegicus
gcccactggcggtgcatctgggcct

SEQ ID NO: 393080 - DNA, 25 bp, Rattus norvegicus
gcccactggctcaagaagaggtgat

SEQ ID NO: 393081 - DNA, 25 bp, Rattus norvegicus
gcccactggctctagaagaggtgat

SEQ ID NO: 393082 - DNA, 25 bp, Rattus norvegicus
gcccacttagatccttgagcatgat

SEQ ID NO: 393083 - DNA, 25 bp, Rattus norvegicus
gcccacttagatgcttgagcatgat

SEQ ID NO: 393084 - DNA, 25 bp, Rattus norvegicus
gcccacttcaagcatataaacccta

SEQ ID NO: 393085 - DNA, 25 bp, Rattus norvegicus
gcccacttcaaggatataaacccta

SEQ ID NO: 393086 - DNA, 25 bp, Rattus norvegicus
gcccacttcaatcctgactacagga

SEQ ID NO: 393087 - DNA, 25 bp, Rattus norvegicus
gcccacttcaatgctgactacagga

SEQ ID NO: 393088 - DNA, 25 bp, Rattus norvegicus
gcccacttcattaccatatacaagg

SEQ ID NO: 393089 - DNA, 25 bp, Rattus norvegicus
gcccacttcatttccatatacaagg

SEQ ID NO: 393090 - DNA, 25 bp, Rattus norvegicus
gcccacttgctaccctggatgtgaa

SEQ ID NO: 393091 - DNA, 25 bp, Rattus norvegicus
gcccacttgctagcctggatgtgaa

SEQ ID NO: 393092 - DNA, 25 bp, Rattus norvegicus
gcccactttcttcctatggcaataa

SEQ ID NO: 393093 - DNA, 25 bp, Rattus norvegicus
gcccactttcttgctatggcaataa

SEQ ID NO: 393094 - DNA, 25 bp, Rattus norvegicus
gcccactttgtgcttctgatgtgca

SEQ ID NO: 393095 - DNA, 25 bp, Rattus norvegicus
gcccactttgtggttctgatgtgca

SEQ ID NO: 393096 - DNA, 25 bp, Rattus norvegicus
gcccagaaaggcaaagaccgcagtg

SEQ ID NO: 393097 - DNA, 25 bp, Rattus norvegicus
gcccagaaaggctaagaccgcagtg

SEQ ID NO: 393098 - DNA, 25 bp, Rattus norvegicus
gcccagaaccagctggttatttgga

SEQ ID NO: 393099 - DNA, 25 bp, Rattus norvegicus
gcccagaaccaggtggttatttgga

SEQ ID NO: 393100 - DNA, 25 bp, Rattus norvegicus
gcccagaactcgcagaaatcttcct

SEQ ID NO: 393101 - DNA, 25 bp, Rattus norvegicus
gcccagaactcggagaaatcttcct

SEQ ID NO: 393102 - DNA, 25 bp, Rattus norvegicus
gcccagaagcaacttcaaagtgaag

SEQ ID NO: 393103 - DNA, 25 bp, Rattus norvegicus
gcccagaagcaagttcaaagtgaag

SEQ ID NO: 393104 - DNA, 25 bp, Rattus norvegicus
gcccagacaaagagaccaggacatt

SEQ ID NO: 393105 - DNA, 25 bp, Rattus norvegicus
gcccagacaaagtgaccaggacatt

SEQ ID NO: 393106 - DNA, 25 bp, Rattus norvegicus
gcccagacactgcatccaaatgtta

SEQ ID NO: 393107 - DNA, 25 bp, Rattus norvegicus
gcccagacactggatccaaatgtta

SEQ ID NO: 393108 - DNA, 25 bp, Rattus norvegicus
gcccagacatgtctccggctgcgga

SEQ ID NO: 393109 - DNA, 25 bp, Rattus norvegicus
gcccagacatgtgtccggctgcgga

SEQ ID NO: 393110 - DNA, 25 bp, Rattus norvegicus
gcccagacgcctctggctgaactgg

SEQ ID NO: 393111 - DNA, 25 bp, Rattus norvegicus
gcccagacgcctgtggctgaactgg

SEQ ID NO: 393112 - DNA, 25 bp, Rattus norvegicus
gcccagacgtcgaggatgccgctga

SEQ ID NO: 393113 - DNA, 25 bp, Rattus norvegicus
gcccagacgtcgtggatgccgctga

SEQ ID NO: 393114 - DNA, 25 bp, Rattus norvegicus
gcccagactagcctggagcacatga

SEQ ID NO: 393115 - DNA, 25 bp, Rattus norvegicus
gcccagactagcgtggagcacatga

SEQ ID NO: 393116 - DNA, 25 bp, Rattus norvegicus
gcccagactgaacctgtggctgata

SEQ ID NO: 393117 - DNA, 25 bp, Rattus norvegicus
gcccagactgaagctgtggctgata

SEQ ID NO: 393118 - DNA, 25 bp, Rattus norvegicus
gcccagagagacatgtcctagcagg

SEQ ID NO: 393119 - DNA, 25 bp, Rattus norvegicus
gcccagagagacttgtcctagcagg

SEQ ID NO: 393120 - DNA, 25 bp, Rattus norvegicus
gcccagagagctagcaacttgtatt

SEQ ID NO: 393121 - DNA, 25 bp, Rattus norvegicus
gcccagagagcttgcaacttgtatt

SEQ ID NO: 393122 - DNA, 25 bp, Rattus norvegicus
gcccagagcaccagtgagcgtgagt

SEQ ID NO: 393123 - DNA, 25 bp, Rattus norvegicus
gcccagagcacctgtgagcgtgagt

SEQ ID NO: 393124 - DNA, 25 bp, Rattus norvegicus
gcccagagcctacacgatacggaga

SEQ ID NO: 393125 - DNA, 25 bp, Rattus norvegicus
gcccagagcctagacgatacggaga

SEQ ID NO: 393126 - DNA, 25 bp, Rattus norvegicus
gcccagagcctgacaacttgaatga

SEQ ID NO: 393127 - DNA, 25 bp, Rattus norvegicus
gcccagagcctgtcaacttgaatga

SEQ ID NO: 393128 - DNA, 25 bp, Rattus norvegicus
gcccagagcggtatcttaccaatga

SEQ ID NO: 393129 - DNA, 25 bp, Rattus norvegicus
gcccagagcggtttcttaccaatga

SEQ ID NO: 393130 - DNA, 25 bp, Rattus norvegicus
gcccagaggtaacagaacagcttca

SEQ ID NO: 393131 - DNA, 25 bp, Rattus norvegicus
gcccagaggtaagagaacagcttca

SEQ ID NO: 393132 - DNA, 25 bp, Rattus norvegicus
gcccagaggttgctttcaggagact

SEQ ID NO: 393133 - DNA, 25 bp, Rattus norvegicus
gcccagaggttggtttcaggagact

SEQ ID NO: 393134 - DNA, 25 bp, Rattus norvegicus
gcccagagtgtacctgaagcatact

SEQ ID NO: 393135 - DNA, 25 bp, Rattus norvegicus
gcccagagtgtagctgaagcatact

SEQ ID NO: 393136 - DNA, 25 bp, Rattus norvegicus
gcccagatatctcaagctcctgctg

SEQ ID NO: 393137 - DNA, 25 bp, Rattus norvegicus
gcccagatatctgaagctcctgctg

SEQ ID NO: 393138 - DNA, 25 bp, Rattus norvegicus
gcccagatatttatgcatatttagc

SEQ ID NO: 393139 - DNA, 25 bp, Rattus norvegicus
gcccagatatttttgcatatttagc

SEQ ID NO: 393140 - DNA, 25 bp, Rattus norvegicus
gcccagatgcagatgacaagtcaga

SEQ ID NO: 393141 - DNA, 25 bp, Rattus norvegicus
gcccagatgcagttgacaagtcaga

SEQ ID NO: 393142 - DNA, 25 bp, Rattus norvegicus
gcccagatgcccattgcagaatgta

SEQ ID NO: 393143 - DNA, 25 bp, Rattus norvegicus
gcccagatgccctttgcagaatgta

SEQ ID NO: 393144 - DNA, 25 bp, Rattus norvegicus
gcccagatgcttatctcaggagtgt

SEQ ID NO: 393145 - DNA, 25 bp, Rattus norvegicus
gcccagatgcttttctcaggagtgt

SEQ ID NO: 393146 - DNA, 25 bp, Rattus norvegicus
gcccagatggctccgctggttcata

SEQ ID NO: 393147 - DNA, 25 bp, Rattus norvegicus
gcccagatggctgcgctggttcata

SEQ ID NO: 393148 - DNA, 25 bp, Rattus norvegicus
gcccagatgtttaaggaatacctgt

SEQ ID NO: 393149 - DNA, 25 bp, Rattus norvegicus
gcccagatgttttaggaatacctgt

SEQ ID NO: 393150 - DNA, 25 bp, Rattus norvegicus
gcccagattaaaccctcctctggaa

SEQ ID NO: 393151 - DNA, 25 bp, Rattus norvegicus
gcccagattaaagcctcctctggaa

SEQ ID NO: 393152 - DNA, 25 bp, Rattus norvegicus
gcccagcaacagaaaacgaactcca

SEQ ID NO: 393153 - DNA, 25 bp, Rattus norvegicus
gcccagcaacagtaaacgaactcca

SEQ ID NO: 393154 - DNA, 25 bp, Rattus norvegicus
gcccagcaagaaatccttctctgaa

SEQ ID NO: 393155 - DNA, 25 bp, Rattus norvegicus
gcccagcaagaattccttctctgaa

SEQ ID NO: 393156 - DNA, 25 bp, Rattus norvegicus
gcccagcaatgcagtttgtgacacg

SEQ ID NO: 393157 - DNA, 25 bp, Rattus norvegicus
gcccagcaatgctgtttgtgacacg

SEQ ID NO: 393158 - DNA, 25 bp, Rattus norvegicus
gcccagcacagccttacaaagttgt

SEQ ID NO: 393159 - DNA, 25 bp, Rattus norvegicus
gcccagcacagcgttacaaagttgt

SEQ ID NO: 393160 - DNA, 25 bp, Rattus norvegicus
gcccagcacctgacgatacttgtga

SEQ ID NO: 393161 - DNA, 25 bp, Rattus norvegicus
gcccagcacctgtcgatacttgtga

SEQ ID NO: 393162 - DNA, 25 bp, Rattus norvegicus
gcccagcagacccatgaattcttaa

SEQ ID NO: 393163 - DNA, 25 bp, Rattus norvegicus
gcccagcagaccgatgaattcttaa

SEQ ID NO: 393164 - DNA, 25 bp, Rattus norvegicus
gcccagcagcagagaagacccagag

SEQ ID NO: 393165 - DNA, 25 bp, Rattus norvegicus
gcccagcagcagtgaagacccagag

SEQ ID NO: 393166 - DNA, 25 bp, Rattus norvegicus
gcccagcataccaacaatctggaaa

SEQ ID NO: 393167 - DNA, 25 bp, Rattus norvegicus
gcccagcatacctacaatctggaaa

SEQ ID NO: 393168 - DNA, 25 bp, Rattus norvegicus
gcccagcatagtccacatgccttgg

SEQ ID NO: 393169 - DNA, 25 bp, Rattus norvegicus
gcccagcatagtgcacatgccttgg

SEQ ID NO: 393170 - DNA, 25 bp, Rattus norvegicus
gcccagcatctgaagtgaacctcaa

SEQ ID NO: 393171 - DNA, 25 bp, Rattus norvegicus
gcccagcatctgtagtgaacctcaa

SEQ ID NO: 393172 - DNA, 25 bp, Rattus norvegicus
gcccagcatggcctccaagagaagg

SEQ ID NO: 393173 - DNA, 25 bp, Rattus norvegicus
gcccagcatggcgtccaagagaagg

SEQ ID NO: 393174 - DNA, 25 bp, Rattus norvegicus
gcccagcattcacttgttttactca

SEQ ID NO: 393175 - DNA, 25 bp, Rattus norvegicus
gcccagcattcagttgttttactca

SEQ ID NO: 393176 - DNA, 25 bp, Rattus norvegicus
gcccagccacggactgttcagagga

SEQ ID NO: 393177 - DNA, 25 bp, Rattus norvegicus
gcccagccacggtctgttcagagga

SEQ ID NO: 393178 - DNA, 25 bp, Rattus norvegicus
gcccagccataacttggaggccatg

SEQ ID NO: 393179 - DNA, 25 bp, Rattus norvegicus
gcccagccataagttggaggccatg

SEQ ID NO: 393180 - DNA, 25 bp, Rattus norvegicus
gcccagccattaaagcattgtctct

SEQ ID NO: 393181 - DNA, 25 bp, Rattus norvegicus
gcccagccattatagcattgtctct

SEQ ID NO: 393182 - DNA, 25 bp, Rattus norvegicus
gcccagcccaagagaaggccatctt

SEQ ID NO: 393183 - DNA, 25 bp, Rattus norvegicus
gcccagcccaagtgaaggccatctt

SEQ ID NO: 393184 - DNA, 25 bp, Rattus norvegicus
gcccagcccacccaaataaagaata

SEQ ID NO: 393185 - DNA, 25 bp, Rattus norvegicus
gcccagcccaccgaaataaagaata

SEQ ID NO: 393186 - DNA, 25 bp, Rattus norvegicus
gcccagcccatacctcaaaaattga

SEQ ID NO: 393187 - DNA, 25 bp, Rattus norvegicus
gcccagcccatagctcaaaaattga

SEQ ID NO: 393188 - DNA, 25 bp, Rattus norvegicus
gcccagcccctcaaatgtgtaagaa

SEQ ID NO: 393189 - DNA, 25 bp, Rattus norvegicus
gcccagcccctctaatgtgtaagaa

SEQ ID NO: 393190 - DNA, 25 bp, Rattus norvegicus
gcccagcccgagcaagacatctgtg

SEQ ID NO: 393191 - DNA, 25 bp, Rattus norvegicus
gcccagcccgaggaagacatctgtg

SEQ ID NO: 393192 - DNA, 25 bp, Rattus norvegicus
gcccagcccgggactgataatgtga

SEQ ID NO: 393193 - DNA, 25 bp, Rattus norvegicus
gcccagcccgggtctgataatgtga

SEQ ID NO: 393194 - DNA, 25 bp, Rattus norvegicus
gcccagcctagcacaggtgtagcaa

SEQ ID NO: 393195 - DNA, 25 bp, Rattus norvegicus
gcccagcctagctcaggtgtagcaa

SEQ ID NO: 393196 - DNA, 25 bp, Rattus norvegicus
gcccagcctgggagtttcaaattct

SEQ ID NO: 393197 - DNA, 25 bp, Rattus norvegicus
gcccagcctgggtgtttcaaattct

SEQ ID NO: 393198 - DNA, 25 bp, Rattus norvegicus
gcccagccttccatctgttaaaaaa

SEQ ID NO: 393199 - DNA, 25 bp, Rattus norvegicus
gcccagccttccttctgttaaaaaa

SEQ ID NO: 393200 - DNA, 25 bp, Rattus norvegicus
gcccagcgacatattaatttctgca

SEQ ID NO: 393201 - DNA, 25 bp, Rattus norvegicus
gcccagcgacattttaatttctgca

SEQ ID NO: 393202 - DNA, 25 bp, Rattus norvegicus
gcccagcgactgcaggatgacgaca

SEQ ID NO: 393203 - DNA, 25 bp, Rattus norvegicus
gcccagcgactggaggatgacgaca

SEQ ID NO: 393204 - DNA, 25 bp, Rattus norvegicus
gcccagcgagtacgtgcagttttgt

SEQ ID NO: 393205 - DNA, 25 bp, Rattus norvegicus
gcccagcgagtaggtgcagttttgt

SEQ ID NO: 393206 - DNA, 25 bp, Rattus norvegicus
gcccagcgtgtgcacatcatcactg

SEQ ID NO: 393207 - DNA, 25 bp, Rattus norvegicus
gcccagcgtgtggacatcatcactg

SEQ ID NO: 393208 - DNA, 25 bp, Rattus norvegicus
gcccagctatgaattccgtagataa

SEQ ID NO: 393209 - DNA, 25 bp, Rattus norvegicus
gcccagctatgatttccgtagataa

SEQ ID NO: 393210 - DNA, 25 bp, Rattus norvegicus
gcccagctctggataggaatcgtgt

SEQ ID NO: 393211 - DNA, 25 bp, Rattus norvegicus
gcccagctctggttaggaatcgtgt

SEQ ID NO: 393212 - DNA, 25 bp, Rattus norvegicus
gcccagctgatgcatgtgaaaccga

SEQ ID NO: 393213 - DNA, 25 bp, Rattus norvegicus
gcccagctgatggatgtgaaaccga

SEQ ID NO: 393214 - DNA, 25 bp, Rattus norvegicus
gcccagctgctgagactaggaacgg

SEQ ID NO: 393215 - DNA, 25 bp, Rattus norvegicus
gcccagctgctgagacttagataat

SEQ ID NO: 393216 - DNA, 25 bp, Rattus norvegicus
gcccagctgctgtgactaggaacgg

SEQ ID NO: 393217 - DNA, 25 bp, Rattus norvegicus
gcccagctgctgtgacttagataat

SEQ ID NO: 393218 - DNA, 25 bp, Rattus norvegicus
gcccagctgggccatgtcaaaaggc

SEQ ID NO: 393219 - DNA, 25 bp, Rattus norvegicus
gcccagctgggcgatgtcaaaaggc

SEQ ID NO: 393220 - DNA, 25 bp, Rattus norvegicus
gcccagctgtgtcatctttttgaat

SEQ ID NO: 393221 - DNA, 25 bp, Rattus norvegicus
gcccagctgtgtgatctttttgaat

SEQ ID NO: 393222 - DNA, 25 bp, Rattus norvegicus
gcccagcttatcagtttagtcatta

SEQ ID NO: 393223 - DNA, 25 bp, Rattus norvegicus
gcccagcttatctgtttagtcatta

SEQ ID NO: 393224 - DNA, 25 bp, Rattus norvegicus
gcccagcttcagatacctacatagt

SEQ ID NO: 393225 - DNA, 25 bp, Rattus norvegicus
gcccagcttcagttacctacatagt

SEQ ID NO: 393226 - DNA, 25 bp, Rattus norvegicus
gcccagcttccacgacgaatgcaag

SEQ ID NO: 393227 - DNA, 25 bp, Rattus norvegicus
gcccagcttccaggacgaatgcaag

SEQ ID NO: 393228 - DNA, 25 bp, Rattus norvegicus
gcccagcttctgatctttgatatag

SEQ ID NO: 393229 - DNA, 25 bp, Rattus norvegicus
gcccagcttctgttctttgatatag

SEQ ID NO: 393230 - DNA, 25 bp, Rattus norvegicus
gcccagcttgcacactacagcagtg

SEQ ID NO: 393231 - DNA, 25 bp, Rattus norvegicus
gcccagcttgcagactacagcagtg

SEQ ID NO: 393232 - DNA, 25 bp, Rattus norvegicus
gcccagcttgctctatcagaagttt

SEQ ID NO: 393233 - DNA, 25 bp, Rattus norvegicus
gcccagcttgctgtatcagaagttt

SEQ ID NO: 393234 - DNA, 25 bp, Rattus norvegicus
gcccagcttggacgccttggctatg

SEQ ID NO: 393235 - DNA, 25 bp, Rattus norvegicus
gcccagcttggaggccttggctatg

SEQ ID NO: 393236 - DNA, 25 bp, Rattus norvegicus
gcccagctttaaatccaacgggaat

SEQ ID NO: 393237 - DNA, 25 bp, Rattus norvegicus
gcccagctttaattccaacgggaat

SEQ ID NO: 393238 - DNA, 25 bp, Rattus norvegicus
gcccaggaaagtaaggcatcccatg

SEQ ID NO: 393239 - DNA, 25 bp, Rattus norvegicus
gcccaggaaagttaggcatcccatg

SEQ ID NO: 393240 - DNA, 25 bp, Rattus norvegicus
gcccaggaacctctaggcgttttat

SEQ ID NO: 393241 - DNA, 25 bp, Rattus norvegicus
gcccaggaacctgtaggcgttttat

SEQ ID NO: 393242 - DNA, 25 bp, Rattus norvegicus
gcccaggaccatatcccgggttgtg

SEQ ID NO: 393243 - DNA, 25 bp, Rattus norvegicus
gcccaggaccatttcccgggttgtg

SEQ ID NO: 393244 - DNA, 25 bp, Rattus norvegicus
gcccaggaccttatgttgctttgtt

SEQ ID NO: 393245 - DNA, 25 bp, Rattus norvegicus
gcccaggaccttttgttgctttgtt

SEQ ID NO: 393246 - DNA, 25 bp, Rattus norvegicus
gcccaggagatcaacagggaggcct

SEQ ID NO: 393247 - DNA, 25 bp, Rattus norvegicus
gcccaggagatctacagggaggcct

SEQ ID NO: 393248 - DNA, 25 bp, Rattus norvegicus
gcccaggatacaagagaaagctcac

SEQ ID NO: 393249 - DNA, 25 bp, Rattus norvegicus
gcccaggatacatgagaaagctcac

SEQ ID NO: 393250 - DNA, 25 bp, Rattus norvegicus
gcccaggatggcatggacctacctt

SEQ ID NO: 393251 - DNA, 25 bp, Rattus norvegicus
gcccaggatggcttggacctacctt

SEQ ID NO: 393252 - DNA, 25 bp, Rattus norvegicus
gcccaggatggtccttccagtggaa

SEQ ID NO: 393253 - DNA, 25 bp, Rattus norvegicus
gcccaggatggtgcttccagtggaa

SEQ ID NO: 393254 - DNA, 25 bp, Rattus norvegicus
gcccaggatgtcaagtggtaccact

SEQ ID NO: 393255 - DNA, 25 bp, Rattus norvegicus
gcccaggatgtctagtggtaccact

SEQ ID NO: 393256 - DNA, 25 bp, Rattus norvegicus
gcccaggccagtatgtcaaagggaa

SEQ ID NO: 393257 - DNA, 25 bp, Rattus norvegicus
gcccaggccagtccatggtcagcta

SEQ ID NO: 393258 - DNA, 25 bp, Rattus norvegicus
gcccaggccagtgcatggtcagcta

SEQ ID NO: 393259 - DNA, 25 bp, Rattus norvegicus
gcccaggccagtttgtcaaagggaa

SEQ ID NO: 393260 - DNA, 25 bp, Rattus norvegicus
gcccaggccatcattgacggtgcaa

SEQ ID NO: 393261 - DNA, 25 bp, Rattus norvegicus
gcccaggccatctttgacggtgcaa

SEQ ID NO: 393262 - DNA, 25 bp, Rattus norvegicus
gcccaggccattctgagcggtgcca

SEQ ID NO: 393263 - DNA, 25 bp, Rattus norvegicus
gcccaggccattgtgagcggtgcca

SEQ ID NO: 393264 - DNA, 25 bp, Rattus norvegicus
gcccaggccccaccaaggttggaga

SEQ ID NO: 393265 - DNA, 25 bp, Rattus norvegicus
gcccaggccccagcaaggttggaga

SEQ ID NO: 393266 - DNA, 25 bp, Rattus norvegicus
gcccaggccctgcattgaaacaaga

SEQ ID NO: 393267 - DNA, 25 bp, Rattus norvegicus
gcccaggccctggattgaaacaaga

SEQ ID NO: 393268 - DNA, 25 bp, Rattus norvegicus
gcccaggcctgacgaccatggaatg

SEQ ID NO: 393269 - DNA, 25 bp, Rattus norvegicus
gcccaggcctgaggaccatggaatg

SEQ ID NO: 393270 - DNA, 25 bp, Rattus norvegicus
gcccaggcgctaatatcataccata

SEQ ID NO: 393271 - DNA, 25 bp, Rattus norvegicus
gcccaggcgctattatcataccata

SEQ ID NO: 393272 - DNA, 25 bp, Rattus norvegicus
gcccaggcgggcattgaaattacag

SEQ ID NO: 393273 - DNA, 25 bp, Rattus norvegicus
gcccaggcgggctttgaaattacag

SEQ ID NO: 393274 - DNA, 25 bp, Rattus norvegicus
gcccaggtaaccaggcccagaaggt

SEQ ID NO: 393275 - DNA, 25 bp, Rattus norvegicus
gcccaggtaacctggcccagaaggt

SEQ ID NO: 393276 - DNA, 25 bp, Rattus norvegicus
gcccaggtcagaaggctgcatagtt

SEQ ID NO: 393277 - DNA, 25 bp, Rattus norvegicus
gcccaggtcagatggctgcatagtt

SEQ ID NO: 393278 - DNA, 25 bp, Rattus norvegicus
gcccaggtcatgcattgctttttaa

SEQ ID NO: 393279 - DNA, 25 bp, Rattus norvegicus
gcccaggtcatggattgctttttaa

SEQ ID NO: 393280 - DNA, 25 bp, Rattus norvegicus
gcccaggtcattagactctttgctg

SEQ ID NO: 393281 - DNA, 25 bp, Rattus norvegicus
gcccaggtcatttgactctttgctg

SEQ ID NO: 393282 - DNA, 25 bp, Rattus norvegicus
gcccaggtcctaagagagcccaagt

SEQ ID NO: 393283 - DNA, 25 bp, Rattus norvegicus
gcccaggtcctatgagagcccaagt

SEQ ID NO: 393284 - DNA, 25 bp, Rattus norvegicus
gcccaggtcctgcaggtgctctgca

SEQ ID NO: 393285 - DNA, 25 bp, Rattus norvegicus
gcccaggtcctggaggtgctctgca

SEQ ID NO: 393286 - DNA, 25 bp, Rattus norvegicus
gcccaggtctgaaggtcttggccag

SEQ ID NO: 393287 - DNA, 25 bp, Rattus norvegicus
gcccaggtctgatggtcttggccag

SEQ ID NO: 393288 - DNA, 25 bp, Rattus norvegicus
gcccaggtcttcacaccaagagtta

SEQ ID NO: 393289 - DNA, 25 bp, Rattus norvegicus
gcccaggtcttctcaccaagagtta

SEQ ID NO: 393290 - DNA, 25 bp, Rattus norvegicus
gcccaggttctcacactaaatgttt

SEQ ID NO: 393291 - DNA, 25 bp, Rattus norvegicus
gcccaggttctctcactaaatgttt

SEQ ID NO: 393292 - DNA, 25 bp, Rattus norvegicus
gcccaggttggcatcagactaataa

SEQ ID NO: 393293 - DNA, 25 bp, Rattus norvegicus
gcccaggttggcatttctgatgact

SEQ ID NO: 393294 - DNA, 25 bp, Rattus norvegicus
gcccaggttggcttcagactaataa

SEQ ID NO: 393295 - DNA, 25 bp, Rattus norvegicus
gcccaggttggcttttctgatgact

SEQ ID NO: 393296 - DNA, 25 bp, Rattus norvegicus
gcccagtacactagccatgtccgaa

SEQ ID NO: 393297 - DNA, 25 bp, Rattus norvegicus
gcccagtacacttgccatgtccgaa

SEQ ID NO: 393298 - DNA, 25 bp, Rattus norvegicus
gcccagtactttcagcaccatttat

SEQ ID NO: 393299 - DNA, 25 bp, Rattus norvegicus
gcccagtactttgagcaccatttat

SEQ ID NO: 393300 - DNA, 25 bp, Rattus norvegicus
gcccagtagcctaatggcccaatgg

SEQ ID NO: 393301 - DNA, 25 bp, Rattus norvegicus
gcccagtagccttatggcccaatgg

SEQ ID NO: 393302 - DNA, 25 bp, Rattus norvegicus
gcccagtatgacattctgcatctaa

SEQ ID NO: 393303 - DNA, 25 bp, Rattus norvegicus
gcccagtatgactttctgcatctaa

SEQ ID NO: 393304 - DNA, 25 bp, Rattus norvegicus
gcccagtatggcactatgtctatgt

SEQ ID NO: 393305 - DNA, 25 bp, Rattus norvegicus
gcccagtatggcagtctgcgtttgg

SEQ ID NO: 393306 - DNA, 25 bp, Rattus norvegicus
gcccagtatggctctatgtctatgt

SEQ ID NO: 393307 - DNA, 25 bp, Rattus norvegicus
gcccagtatggctgtctgcgtttgg

SEQ ID NO: 393308 - DNA, 25 bp, Rattus norvegicus
gcccagtcagccatggtgcttttaa

SEQ ID NO: 393309 - DNA, 25 bp, Rattus norvegicus
gcccagtcagccttggtgcttttaa

SEQ ID NO: 393310 - DNA, 25 bp, Rattus norvegicus
gcccagtcagggagattccagcaga

SEQ ID NO: 393311 - DNA, 25 bp, Rattus norvegicus
gcccagtcagggtgattccagcaga

SEQ ID NO: 393312 - DNA, 25 bp, Rattus norvegicus
gcccagtcctgacagacgagcagaa

SEQ ID NO: 393313 - DNA, 25 bp, Rattus norvegicus
gcccagtcctgagagacgagcagaa

SEQ ID NO: 393314 - DNA, 25 bp, Rattus norvegicus
gcccagtcctttacagaggcacaga

SEQ ID NO: 393315 - DNA, 25 bp, Rattus norvegicus
gcccagtccttttcagaggcacaga

SEQ ID NO: 393316 - DNA, 25 bp, Rattus norvegicus
gcccagtctgtgacaactacttgat

SEQ ID NO: 393317 - DNA, 25 bp, Rattus norvegicus
gcccagtctgtgtcaactacttgat

SEQ ID NO: 393318 - DNA, 25 bp, Rattus norvegicus
gcccagtcttacatctgtgcttttt

SEQ ID NO: 393319 - DNA, 25 bp, Rattus norvegicus
gcccagtcttacttctgtgcttttt

SEQ ID NO: 393320 - DNA, 25 bp, Rattus norvegicus
gcccagtgacgtagcagagtctcag

SEQ ID NO: 393321 - DNA, 25 bp, Rattus norvegicus
gcccagtgacgttgcagagtctcag

SEQ ID NO: 393322 - DNA, 25 bp, Rattus norvegicus
gcccagtgatccataatgccgaagc

SEQ ID NO: 393323 - DNA, 25 bp, Rattus norvegicus
gcccagtgatccttaatgccgaagc

SEQ ID NO: 393324 - DNA, 25 bp, Rattus norvegicus
gcccagtgtgacatcagttgatcct

SEQ ID NO: 393325 - DNA, 25 bp, Rattus norvegicus
gcccagtgtgacttcagttgatcct

SEQ ID NO: 393326 - DNA, 25 bp, Rattus norvegicus
gcccagtgtggccatgtcattacag

SEQ ID NO: 393327 - DNA, 25 bp, Rattus norvegicus
gcccagtgtggcgatgtcattacag

SEQ ID NO: 393328 - DNA, 25 bp, Rattus norvegicus
gcccagttacagagcaacctcatga

SEQ ID NO: 393329 - DNA, 25 bp, Rattus norvegicus
gcccagttacagtgcaacctcatga

SEQ ID NO: 393330 - DNA, 25 bp, Rattus norvegicus
gcccagttcaggctgccagatgcag

SEQ ID NO: 393331 - DNA, 25 bp, Rattus norvegicus
gcccagttcagggtgccagatgcag

SEQ ID NO: 393332 - DNA, 25 bp, Rattus norvegicus
gcccagttcctgatgagtccaaagt

SEQ ID NO: 393333 - DNA, 25 bp, Rattus norvegicus
gcccagttcctgttgagtccaaagt

SEQ ID NO: 393334 - DNA, 25 bp, Rattus norvegicus
gcccagttccttacctgagaaagtc

SEQ ID NO: 393335 - DNA, 25 bp, Rattus norvegicus
gcccagttccttcaaatctaatcag

SEQ ID NO: 393336 - DNA, 25 bp, Rattus norvegicus
gcccagttccttgaaatctaatcag

SEQ ID NO: 393337 - DNA, 25 bp, Rattus norvegicus
gcccagttcctttcctgagaaagtc

SEQ ID NO: 393338 - DNA, 25 bp, Rattus norvegicus
gcccagttcgggatttcagcaagtt

SEQ ID NO: 393339 - DNA, 25 bp, Rattus norvegicus
gcccagttcgggttttcagcaagtt

SEQ ID NO: 393340 - DNA, 25 bp, Rattus norvegicus
gcccagttctggatcttcagagctt

SEQ ID NO: 393341 - DNA, 25 bp, Rattus norvegicus
gcccagttctggttcttcagagctt

SEQ ID NO: 393342 - DNA, 25 bp, Rattus norvegicus
gcccagttgccactattctgtacaa

SEQ ID NO: 393343 - DNA, 25 bp, Rattus norvegicus
gcccagttgccagtattctgtacaa

SEQ ID NO: 393344 - DNA, 25 bp, Rattus norvegicus
gcccagttgtcacagttagcagtct

SEQ ID NO: 393345 - DNA, 25 bp, Rattus norvegicus
gcccagttgtcagagttagcagtct

SEQ ID NO: 393346 - DNA, 25 bp, Rattus norvegicus
gcccagttgtgtcaacttaccctat

SEQ ID NO: 393347 - DNA, 25 bp, Rattus norvegicus
gcccagttgtgtgaacttaccctat

SEQ ID NO: 393348 - DNA, 25 bp, Rattus norvegicus
gcccagttgttcagtcacactttat

SEQ ID NO: 393349 - DNA, 25 bp, Rattus norvegicus
gcccagttgttctgtcacactttat

SEQ ID NO: 393350 - DNA, 25 bp, Rattus norvegicus
gcccagtttggccatattagaagat

SEQ ID NO: 393351 - DNA, 25 bp, Rattus norvegicus
gcccagtttggcgatattagaagat

SEQ ID NO: 393352 - DNA, 25 bp, Rattus norvegicus
gcccataatagcatcagagtgatct

SEQ ID NO: 393353 - DNA, 25 bp, Rattus norvegicus
gcccataatagcttcagagtgatct

SEQ ID NO: 393354 - DNA, 25 bp, Rattus norvegicus
gcccatacacacactcctgtgtggg

SEQ ID NO: 393355 - DNA, 25 bp, Rattus norvegicus
gcccatacacactctcctgtgtggg

SEQ ID NO: 393356 - DNA, 25 bp, Rattus norvegicus
gcccatacgacgctcagtctgactt

SEQ ID NO: 393357 - DNA, 25 bp, Rattus norvegicus
gcccatacgacggtcagtctgactt

SEQ ID NO: 393358 - DNA, 25 bp, Rattus norvegicus
gcccatacttccacctgatgaatga

SEQ ID NO: 393359 - DNA, 25 bp, Rattus norvegicus
gcccatacttcctcctgatgaatga

SEQ ID NO: 393360 - DNA, 25 bp, Rattus norvegicus
gcccatagtcatatatttgattggt

SEQ ID NO: 393361 - DNA, 25 bp, Rattus norvegicus
gcccatagtcatttatttgattggt

SEQ ID NO: 393362 - DNA, 25 bp, Rattus norvegicus
gcccatatctacatttgtgatcttt

SEQ ID NO: 393363 - DNA, 25 bp, Rattus norvegicus
gcccatatctacttttgtgatcttt

SEQ ID NO: 393364 - DNA, 25 bp, Rattus norvegicus
gcccatatctcaccctatttgtgat

SEQ ID NO: 393365 - DNA, 25 bp, Rattus norvegicus
gcccatatctcagcctatttgtgat

SEQ ID NO: 393366 - DNA, 25 bp, Rattus norvegicus
gcccatatctgcagtttttctttgg

SEQ ID NO: 393367 - DNA, 25 bp, Rattus norvegicus
gcccatatctgctgtttttctttgg

SEQ ID NO: 393368 - DNA, 25 bp, Rattus norvegicus
gcccatcaaaggctgaagactctcg

SEQ ID NO: 393369 - DNA, 25 bp, Rattus norvegicus
gcccatcaaagggtgaagactctcg

SEQ ID NO: 393370 - DNA, 25 bp, Rattus norvegicus
gcccatcaccagagctttacaaaag

SEQ ID NO: 393371 - DNA, 25 bp, Rattus norvegicus
gcccatcaccagtgctttacaaaag

SEQ ID NO: 393372 - DNA, 25 bp, Rattus norvegicus
gcccatcacccgagagtatggagta

SEQ ID NO: 393373 - DNA, 25 bp, Rattus norvegicus
gcccatcacccgtgagtatggagta

SEQ ID NO: 393374 - DNA, 25 bp, Rattus norvegicus
gcccatcagcgtagccacagcagtg

SEQ ID NO: 393375 - DNA, 25 bp, Rattus norvegicus
gcccatcagcgttgccacagcagtg

SEQ ID NO: 393376 - DNA, 25 bp, Rattus norvegicus
gcccatcattcaccactttaatatt

SEQ ID NO: 393377 - DNA, 25 bp, Rattus norvegicus
gcccatcattcagcactttaatatt

SEQ ID NO: 393378 - DNA, 25 bp, Rattus norvegicus
gcccatccctataatacacactgga

SEQ ID NO: 393379 - DNA, 25 bp, Rattus norvegicus
gcccatccctattatacacactgga

SEQ ID NO: 393380 - DNA, 25 bp, Rattus norvegicus
gcccatccctgaaactgactatgga

SEQ ID NO: 393381 - DNA, 25 bp, Rattus norvegicus
gcccatccctgatactgactatgga

SEQ ID NO: 393382 - DNA, 25 bp, Rattus norvegicus
gcccatcctcaaatacatggagttg

SEQ ID NO: 393383 - DNA, 25 bp, Rattus norvegicus
gcccatcctcaattacatggagttg

SEQ ID NO: 393384 - DNA, 25 bp, Rattus norvegicus
gcccatctctctcaggatttcatga

SEQ ID NO: 393385 - DNA, 25 bp, Rattus norvegicus
gcccatctctctgaggatttcatga

SEQ ID NO: 393386 - DNA, 25 bp, Rattus norvegicus
gcccatctgcaaacacctttattag

SEQ ID NO: 393387 - DNA, 25 bp, Rattus norvegicus
gcccatctgcaacccggacaaggga

SEQ ID NO: 393388 - DNA, 25 bp, Rattus norvegicus
gcccatctgcaagccggacaaggga

SEQ ID NO: 393389 - DNA, 25 bp, Rattus norvegicus
gcccatctgcaatcacctttattag

SEQ ID NO: 393390 - DNA, 25 bp, Rattus norvegicus
gcccatctgcacacgggagcatgtg

SEQ ID NO: 393391 - DNA, 25 bp, Rattus norvegicus
gcccatctgcactcgggagcatgtg

SEQ ID NO: 393392 - DNA, 25 bp, Rattus norvegicus
gcccatctgcccatgataagaacgt

SEQ ID NO: 393393 - DNA, 25 bp, Rattus norvegicus
gcccatctgcccttgataagaacgt

SEQ ID NO: 393394 - DNA, 25 bp, Rattus norvegicus
gcccatcttgaaagactctatggta

SEQ ID NO: 393395 - DNA, 25 bp, Rattus norvegicus
gcccatcttgaatgactctatggta

SEQ ID NO: 393396 - DNA, 25 bp, Rattus norvegicus
gcccatcttgcacctttttgaagta

SEQ ID NO: 393397 - DNA, 25 bp, Rattus norvegicus
gcccatcttgcagctttttgaagta

SEQ ID NO: 393398 - DNA, 25 bp, Rattus norvegicus
gcccatgagcttcagagccagccag

SEQ ID NO: 393399 - DNA, 25 bp, Rattus norvegicus
gcccatgagcttgagagccagccag

SEQ ID NO: 393400 - DNA, 25 bp, Rattus norvegicus
gcccatgatcaacataactgtggtg

SEQ ID NO: 393401 - DNA, 25 bp, Rattus norvegicus
gcccatgatcaagataactgtggtg

SEQ ID NO: 393402 - DNA, 25 bp, Rattus norvegicus
gcccatgatctcaattttctagagg

SEQ ID NO: 393403 - DNA, 25 bp, Rattus norvegicus
gcccatgatctctattttctagagg

SEQ ID NO: 393404 - DNA, 25 bp, Rattus norvegicus
gcccatgattaacaaagctcgcaaa

SEQ ID NO: 393405 - DNA, 25 bp, Rattus norvegicus
gcccatgattaagaaagctcgcaaa

SEQ ID NO: 393406 - DNA, 25 bp, Rattus norvegicus
gcccatgcacccatcagttagtaaa

SEQ ID NO: 393407 - DNA, 25 bp, Rattus norvegicus
gcccatgcacccttcagttagtaaa

SEQ ID NO: 393408 - DNA, 25 bp, Rattus norvegicus
gcccatgcattgagtacttgctgta

SEQ ID NO: 393409 - DNA, 25 bp, Rattus norvegicus
gcccatgcattgtgtacttgctgta

SEQ ID NO: 393410 - DNA, 25 bp, Rattus norvegicus
gcccatggaatgacctgcaactgtt

SEQ ID NO: 393411 - DNA, 25 bp, Rattus norvegicus
gcccatggaatgtcctgcaactgtt

SEQ ID NO: 393412 - DNA, 25 bp, Rattus norvegicus
gcccatggacagagacgcaaggact

SEQ ID NO: 393413 - DNA, 25 bp, Rattus norvegicus
gcccatggacagtgacgcaaggact

SEQ ID NO: 393414 - DNA, 25 bp, Rattus norvegicus
gcccatggatctcaaagtgctgttg

SEQ ID NO: 393415 - DNA, 25 bp, Rattus norvegicus
gcccatggatctgaaagtgctgttg

SEQ ID NO: 393416 - DNA, 25 bp, Rattus norvegicus
gcccatggccggctcggagcagcag

SEQ ID NO: 393417 - DNA, 25 bp, Rattus norvegicus
gcccatggccgggtcggagcagcag

SEQ ID NO: 393418 - DNA, 25 bp, Rattus norvegicus
gcccatgggcgtcatgcagttcaac

SEQ ID NO: 393419 - DNA, 25 bp, Rattus norvegicus
gcccatgggcgtgatgcagttcaac

SEQ ID NO: 393420 - DNA, 25 bp, Rattus norvegicus
gcccatggggaacctctagtaaaat

SEQ ID NO: 393421 - DNA, 25 bp, Rattus norvegicus
gcccatggggaagctctagtaaaat

SEQ ID NO: 393422 - DNA, 25 bp, Rattus norvegicus
gcccatggtctgaactactatggag

SEQ ID NO: 393423 - DNA, 25 bp, Rattus norvegicus
gcccatggtctgtactactatggag

SEQ ID NO: 393424 - DNA, 25 bp, Rattus norvegicus
gcccatgtatctaggcacatttcaa

SEQ ID NO: 393425 - DNA, 25 bp, Rattus norvegicus
gcccatgtatcttggcacatttcaa

SEQ ID NO: 393426 - DNA, 25 bp, Rattus norvegicus
gcccatgtgagaaaccacggcgttt

SEQ ID NO: 393427 - DNA, 25 bp, Rattus norvegicus
gcccatgtgagataccacggcgttt

SEQ ID NO: 393428 - DNA, 25 bp, Rattus norvegicus
gcccatgtgcagagaagacgactaa

SEQ ID NO: 393429 - DNA, 25 bp, Rattus norvegicus
gcccatgtgcagtgaagacgactaa

SEQ ID NO: 393430 - DNA, 25 bp, Rattus norvegicus
gcccatgtgcccagaagcttaagag

SEQ ID NO: 393431 - DNA, 25 bp, Rattus norvegicus
gcccatgtgccctgaagcttaagag

SEQ ID NO: 393432 - DNA, 25 bp, Rattus norvegicus
gcccatgtgctcctgtgactagaga

SEQ ID NO: 393433 - DNA, 25 bp, Rattus norvegicus
gcccatgtgctcgtgtgactagaga

SEQ ID NO: 393434 - DNA, 25 bp, Rattus norvegicus
gcccatgtgctgcttgcttatgtca

SEQ ID NO: 393435 - DNA, 25 bp, Rattus norvegicus
gcccatgtgctggttgcttatgtca

SEQ ID NO: 393436 - DNA, 25 bp, Rattus norvegicus
gcccatgtggagagtgttttctgtc

SEQ ID NO: 393437 - DNA, 25 bp, Rattus norvegicus
gcccatgtggagtgtgttttctgtc

SEQ ID NO: 393438 - DNA, 25 bp, Rattus norvegicus
gcccatgttggaatgagctgttacc

SEQ ID NO: 393439 - DNA, 25 bp, Rattus norvegicus
gcccatgttggattgagctgttacc

SEQ ID NO: 393440 - DNA, 25 bp, Rattus norvegicus
gcccatgtttctcgaggctcaggaa

SEQ ID NO: 393441 - DNA, 25 bp, Rattus norvegicus
gcccatgtttctggaggctcaggaa

SEQ ID NO: 393442 - DNA, 25 bp, Rattus norvegicus
gcccatgttttcctcaggtgatgaa

SEQ ID NO: 393443 - DNA, 25 bp, Rattus norvegicus
gcccatgttttcgtcaggtgatgaa

SEQ ID NO: 393444 - DNA, 25 bp, Rattus norvegicus
gcccattaaaatagtgtcctgcctc

SEQ ID NO: 393445 - DNA, 25 bp, Rattus norvegicus
gcccattaaaattgtgtcctgcctc

SEQ ID NO: 393446 - DNA, 25 bp, Rattus norvegicus
gcccattaaattccatccgtttctc

SEQ ID NO: 393447 - DNA, 25 bp, Rattus norvegicus
gcccattaaattgcatccgtttctc

SEQ ID NO: 393448 - DNA, 25 bp, Rattus norvegicus
gcccattaactactgtttgagagga

SEQ ID NO: 393449 - DNA, 25 bp, Rattus norvegicus
gcccattaactagtgtttgagagga

SEQ ID NO: 393450 - DNA, 25 bp, Rattus norvegicus
gcccattacctgaggcctgtggaaa

SEQ ID NO: 393451 - DNA, 25 bp, Rattus norvegicus
gcccattacctgtggcctgtggaaa

SEQ ID NO: 393452 - DNA, 25 bp, Rattus norvegicus
gcccattccatacgaattcatggcc

SEQ ID NO: 393453 - DNA, 25 bp, Rattus norvegicus
gcccattccataggaattcatggcc

SEQ ID NO: 393454 - DNA, 25 bp, Rattus norvegicus
gcccattcgtccagggggtgactat

SEQ ID NO: 393455 - DNA, 25 bp, Rattus norvegicus
gcccattcgtcctgggggtgactat

SEQ ID NO: 393456 - DNA, 25 bp, Rattus norvegicus
gcccattgaaagcaaggcagagatg

SEQ ID NO: 393457 - DNA, 25 bp, Rattus norvegicus
gcccattgaaaggaaggcagagatg

SEQ ID NO: 393458 - DNA, 25 bp, Rattus norvegicus
gcccattgcttgaccattgcttaaa

SEQ ID NO: 393459 - DNA, 25 bp, Rattus norvegicus
gcccattgcttgtccattgcttaaa

SEQ ID NO: 393460 - DNA, 25 bp, Rattus norvegicus
gcccattgtaggaggtgtcagtcct

SEQ ID NO: 393461 - DNA, 25 bp, Rattus norvegicus
gcccattgtaggtggtgtcagtcct

SEQ ID NO: 393462 - DNA, 25 bp, Rattus norvegicus
gcccattgtgtgacggccaacgagt

SEQ ID NO: 393463 - DNA, 25 bp, Rattus norvegicus
gcccattgtgtgtcggccaacgagt

SEQ ID NO: 393464 - DNA, 25 bp, Rattus norvegicus
gcccattgttttctgaccatctaaa

SEQ ID NO: 393465 - DNA, 25 bp, Rattus norvegicus
gcccattgttttgtgaccatctaaa

SEQ ID NO: 393466 - DNA, 25 bp, Rattus norvegicus
gcccatttgcacattcctttgataa

SEQ ID NO: 393467 - DNA, 25 bp, Rattus norvegicus
gcccatttgcactttcctttgataa

SEQ ID NO: 393468 - DNA, 25 bp, Rattus norvegicus
gcccatttgtttactattggctcag

SEQ ID NO: 393469 - DNA, 25 bp, Rattus norvegicus
gcccatttgttttctattggctcag

SEQ ID NO: 393470 - DNA, 25 bp, Rattus norvegicus
gcccattttaccaaatcccttatgt

SEQ ID NO: 393471 - DNA, 25 bp, Rattus norvegicus
gcccattttacctaatcccttatgt

SEQ ID NO: 393472 - DNA, 25 bp, Rattus norvegicus
gcccattttcaccaagcacgtcaga

SEQ ID NO: 393473 - DNA, 25 bp, Rattus norvegicus
gcccattttcacgaagcacgtcaga

SEQ ID NO: 393474 - DNA, 25 bp, Rattus norvegicus
gcccattttcttacagatattacta

SEQ ID NO: 393475 - DNA, 25 bp, Rattus norvegicus
gcccattttctttcagatattacta

SEQ ID NO: 393476 - DNA, 25 bp, Rattus norvegicus
gcccattttttgcaggtaaagcagg

SEQ ID NO: 393477 - DNA, 25 bp, Rattus norvegicus
gcccattttttggaggtaaagcagg

SEQ ID NO: 393478 - DNA, 25 bp, Rattus norvegicus
gccccaaaatacagatgatgtatat

SEQ ID NO: 393479 - DNA, 25 bp, Rattus norvegicus
gccccaaaatactgatgatgtatat

SEQ ID NO: 393480 - DNA, 25 bp, Rattus norvegicus
gccccaaacaggaagtcccaatcat

SEQ ID NO: 393481 - DNA, 25 bp, Rattus norvegicus
gccccaaacaggtagtcccaatcat

SEQ ID NO: 393482 - DNA, 25 bp, Rattus norvegicus
gccccaaacatcatttcagtcatat

SEQ ID NO: 393483 - DNA, 25 bp, Rattus norvegicus
gccccaaacatcttttcagtcatat

SEQ ID NO: 393484 - DNA, 25 bp, Rattus norvegicus
gccccaaagtacaccaacaagttca

SEQ ID NO: 393485 - DNA, 25 bp, Rattus norvegicus
gccccaaagtactccaacaagttca

SEQ ID NO: 393486 - DNA, 25 bp, Rattus norvegicus
gccccaaagtctctatttctctgat

SEQ ID NO: 393487 - DNA, 25 bp, Rattus norvegicus
gccccaaagtctgtatttctctgat

SEQ ID NO: 393488 - DNA, 25 bp, Rattus norvegicus
gccccaaatgaacactgctaaaagt

SEQ ID NO: 393489 - DNA, 25 bp, Rattus norvegicus
gccccaaatgaagactgctaaaagt

SEQ ID NO: 393490 - DNA, 25 bp, Rattus norvegicus
gccccaaattctagaagtctggtga

SEQ ID NO: 393491 - DNA, 25 bp, Rattus norvegicus
gccccaaattcttgaagtctggtga

SEQ ID NO: 393492 - DNA, 25 bp, Rattus norvegicus
gccccaacaagacagcagtgatgct

SEQ ID NO: 393493 - DNA, 25 bp, Rattus norvegicus
gccccaacaagagagcagtgatgct

SEQ ID NO: 393494 - DNA, 25 bp, Rattus norvegicus
gccccaacaggacagcgctagtagg

SEQ ID NO: 393495 - DNA, 25 bp, Rattus norvegicus
gccccaacaggagagcgctagtagg

SEQ ID NO: 393496 - DNA, 25 bp, Rattus norvegicus
gccccaaccccaatagaggataagt

SEQ ID NO: 393497 - DNA, 25 bp, Rattus norvegicus
gccccaaccccattagaggataagt

SEQ ID NO: 393498 - DNA, 25 bp, Rattus norvegicus
gccccaaccggtatatctagacgtt

SEQ ID NO: 393499 - DNA, 25 bp, Rattus norvegicus
gccccaaccggtttatctagacgtt

SEQ ID NO: 393500 - DNA, 25 bp, Rattus norvegicus
gccccaacttcaatgttcaacatag

SEQ ID NO: 393501 - DNA, 25 bp, Rattus norvegicus
gccccaacttcattgttcaacatag

SEQ ID NO: 393502 - DNA, 25 bp, Rattus norvegicus
gccccaacttggacgtgcaggatgt

SEQ ID NO: 393503 - DNA, 25 bp, Rattus norvegicus
gccccaacttggtcgtgcaggatgt

SEQ ID NO: 393504 - DNA, 25 bp, Rattus norvegicus
gccccaactttgagtttgcttgata

SEQ ID NO: 393505 - DNA, 25 bp, Rattus norvegicus
gccccaactttgtgtttgcttgata

SEQ ID NO: 393506 - DNA, 25 bp, Rattus norvegicus
gccccaagaccgctactgtgaggaa

SEQ ID NO: 393507 - DNA, 25 bp, Rattus norvegicus
gccccaagaccggtactgtgaggaa

SEQ ID NO: 393508 - DNA, 25 bp, Rattus norvegicus
gccccaagagtgactcggagctgga

SEQ ID NO: 393509 - DNA, 25 bp, Rattus norvegicus
gccccaagagtgtctcggagctgga

SEQ ID NO: 393510 - DNA, 25 bp, Rattus norvegicus
gccccaaggtggaagtcatagctaa

SEQ ID NO: 393511 - DNA, 25 bp, Rattus norvegicus
gccccaaggtggtagtcatagctaa

SEQ ID NO: 393512 - DNA, 25 bp, Rattus norvegicus
gccccaattatacacttttaacaat

SEQ ID NO: 393513 - DNA, 25 bp, Rattus norvegicus
gccccaattatagacttttaacaat

SEQ ID NO: 393514 - DNA, 25 bp, Rattus norvegicus
gccccacaaaacacttcagcagagt

SEQ ID NO: 393515 - DNA, 25 bp, Rattus norvegicus
gccccacaaaactcttcagcagagt

SEQ ID NO: 393516 - DNA, 25 bp, Rattus norvegicus
gccccacaagagactttgtcattca

SEQ ID NO: 393517 - DNA, 25 bp, Rattus norvegicus
gccccacaagagtctttgtcattca

SEQ ID NO: 393518 - DNA, 25 bp, Rattus norvegicus
gccccacaatgtacttcaagactgt

SEQ ID NO: 393519 - DNA, 25 bp, Rattus norvegicus
gccccacaatgttcttcaagactgt

SEQ ID NO: 393520 - DNA, 25 bp, Rattus norvegicus
gccccacacgtacactttctgtaaa

SEQ ID NO: 393521 - DNA, 25 bp, Rattus norvegicus
gccccacacgtagactttctgtaaa

SEQ ID NO: 393522 - DNA, 25 bp, Rattus norvegicus
gccccacagctactgacttcaataa

SEQ ID NO: 393523 - DNA, 25 bp, Rattus norvegicus
gccccacagctagtgacttcaataa

SEQ ID NO: 393524 - DNA, 25 bp, Rattus norvegicus
gccccacagctcatctgtatatata

SEQ ID NO: 393525 - DNA, 25 bp, Rattus norvegicus
gccccacagctcttctgtatatata

SEQ ID NO: 393526 - DNA, 25 bp, Rattus norvegicus
gccccacagctgaaagggataagga

SEQ ID NO: 393527 - DNA, 25 bp, Rattus norvegicus
gccccacagctgtaagggataagga

SEQ ID NO: 393528 - DNA, 25 bp, Rattus norvegicus
gccccacaggcaagagctggagagc

SEQ ID NO: 393529 - DNA, 25 bp, Rattus norvegicus
gccccacaggcatgagctggagagc

SEQ ID NO: 393530 - DNA, 25 bp, Rattus norvegicus
gccccacataagatccatgagaggt

SEQ ID NO: 393531 - DNA, 25 bp, Rattus norvegicus
gccccacataagttccatgagaggt

SEQ ID NO: 393532 - DNA, 25 bp, Rattus norvegicus
gccccacatgatcagtaagttctat

SEQ ID NO: 393533 - DNA, 25 bp, Rattus norvegicus
gccccacatgatgagtaagttctat

SEQ ID NO: 393534 - DNA, 25 bp, Rattus norvegicus
gccccaccagtcactgagtgggaaa

SEQ ID NO: 393535 - DNA, 25 bp, Rattus norvegicus
gccccaccagtctctgagtgggaaa

SEQ ID NO: 393536 - DNA, 25 bp, Rattus norvegicus
gccccacccagcaaatacgtagagg

SEQ ID NO: 393537 - DNA, 25 bp, Rattus norvegicus
gccccacccagctaatacgtagagg

SEQ ID NO: 393538 - DNA, 25 bp, Rattus norvegicus
gccccacccatactataatcgtgat

SEQ ID NO: 393539 - DNA, 25 bp, Rattus norvegicus
gccccacccatagtataatcgtgat

SEQ ID NO: 393540 - DNA, 25 bp, Rattus norvegicus
gccccacccttacaatgttacttag

SEQ ID NO: 393541 - DNA, 25 bp, Rattus norvegicus
gccccacccttagaatgttacttag

SEQ ID NO: 393542 - DNA, 25 bp, Rattus norvegicus
gccccaccgaagcacagggtgatgt

SEQ ID NO: 393543 - DNA, 25 bp, Rattus norvegicus
gccccaccgaaggacagggtgatgt

SEQ ID NO: 393544 - DNA, 25 bp, Rattus norvegicus
gccccaccgtgtagctggcatggct

SEQ ID NO: 393545 - DNA, 25 bp, Rattus norvegicus
gccccaccgtgttgctggcatggct

SEQ ID NO: 393546 - DNA, 25 bp, Rattus norvegicus
gccccacctccaatcagaaataaat

SEQ ID NO: 393547 - DNA, 25 bp, Rattus norvegicus
gccccacctccattcagaaataaat

SEQ ID NO: 393548 - DNA, 25 bp, Rattus norvegicus
gccccacctgatcattttcggatat

SEQ ID NO: 393549 - DNA, 25 bp, Rattus norvegicus
gccccacctgatgattttcggatat

SEQ ID NO: 393550 - DNA, 25 bp, Rattus norvegicus
gccccacctgggaaagcacgagaag

SEQ ID NO: 393551 - DNA, 25 bp, Rattus norvegicus
gccccacctgggtaagcacgagaag

SEQ ID NO: 393552 - DNA, 25 bp, Rattus norvegicus
gccccacgctttagtgactttcaaa

SEQ ID NO: 393553 - DNA, 25 bp, Rattus norvegicus
gccccacgcttttgtgactttcaaa

SEQ ID NO: 393554 - DNA, 25 bp, Rattus norvegicus
gccccacggcttcaaagacatcaaa

SEQ ID NO: 393555 - DNA, 25 bp, Rattus norvegicus
gccccacggcttgaaagacatcaaa

SEQ ID NO: 393556 - DNA, 25 bp, Rattus norvegicus
gccccacgtctcagcaaacataaat

SEQ ID NO: 393557 - DNA, 25 bp, Rattus norvegicus
gccccacgtctctgcaaacataaat

SEQ ID NO: 393558 - DNA, 25 bp, Rattus norvegicus
gccccacgtgaaagctcagttgtat

SEQ ID NO: 393559 - DNA, 25 bp, Rattus norvegicus
gccccacgtgaatgctcagttgtat

SEQ ID NO: 393560 - DNA, 25 bp, Rattus norvegicus
gccccacgtggcagctatgtaaatt

SEQ ID NO: 393561 - DNA, 25 bp, Rattus norvegicus
gccccacgtggctgctatgtaaatt

SEQ ID NO: 393562 - DNA, 25 bp, Rattus norvegicus
gccccacgtttgcatacaacatttt

SEQ ID NO: 393563 - DNA, 25 bp, Rattus norvegicus
gccccacgtttggatacaacatttt

SEQ ID NO: 393564 - DNA, 25 bp, Rattus norvegicus
gccccactgcctcaggttttttgtt

SEQ ID NO: 393565 - DNA, 25 bp, Rattus norvegicus
gccccactgcctgaggttttttgtt

SEQ ID NO: 393566 - DNA, 25 bp, Rattus norvegicus
gccccactgtctaccaaatgagagt

SEQ ID NO: 393567 - DNA, 25 bp, Rattus norvegicus
gccccactgtcttccaaatgagagt

SEQ ID NO: 393568 - DNA, 25 bp, Rattus norvegicus
gccccactgtgaatggctcttggag

SEQ ID NO: 393569 - DNA, 25 bp, Rattus norvegicus
gccccactgtgattggctcttggag

SEQ ID NO: 393570 - DNA, 25 bp, Rattus norvegicus
gccccactgtgtaatctgtttttaa

SEQ ID NO: 393571 - DNA, 25 bp, Rattus norvegicus
gccccactgtgttatctgtttttaa

SEQ ID NO: 393572 - DNA, 25 bp, Rattus norvegicus
gccccacttgagcttctgattaatt

SEQ ID NO: 393573 - DNA, 25 bp, Rattus norvegicus
gccccacttgaggttctgattaatt

SEQ ID NO: 393574 - DNA, 25 bp, Rattus norvegicus
gccccacttgggatgcttgatactt

SEQ ID NO: 393575 - DNA, 25 bp, Rattus norvegicus
gccccacttgggttgcttgatactt

SEQ ID NO: 393576 - DNA, 25 bp, Rattus norvegicus
gccccagaaattcattctaacccag

SEQ ID NO: 393577 - DNA, 25 bp, Rattus norvegicus
gccccagaaattgattctaacccag

SEQ ID NO: 393578 - DNA, 25 bp, Rattus norvegicus
gccccagaactactgcttggtgcta

SEQ ID NO: 393579 - DNA, 25 bp, Rattus norvegicus
gccccagaactagtgcttggtgcta

SEQ ID NO: 393580 - DNA, 25 bp, Rattus norvegicus
gccccagacatgcattcaaacggtg

SEQ ID NO: 393581 - DNA, 25 bp, Rattus norvegicus
gccccagacatggattcaaacggtg

SEQ ID NO: 393582 - DNA, 25 bp, Rattus norvegicus
gccccagacgcaccagtaagcattt

SEQ ID NO: 393583 - DNA, 25 bp, Rattus norvegicus
gccccagacgcagcagtaagcattt

SEQ ID NO: 393584 - DNA, 25 bp, Rattus norvegicus
gccccagagaggaagctgtcacaga

SEQ ID NO: 393585 - DNA, 25 bp, Rattus norvegicus
gccccagagaggtagctgtcacaga

SEQ ID NO: 393586 - DNA, 25 bp, Rattus norvegicus
gccccagagatgaagccattttgaa

SEQ ID NO: 393587 - DNA, 25 bp, Rattus norvegicus
gccccagagatgtagccattttgaa

SEQ ID NO: 393588 - DNA, 25 bp, Rattus norvegicus
gccccagaggagattctagctgcta

SEQ ID NO: 393589 - DNA, 25 bp, Rattus norvegicus
gccccagaggagtttctagctgcta

SEQ ID NO: 393590 - DNA, 25 bp, Rattus norvegicus
gccccagaggctccttttatcagag

SEQ ID NO: 393591 - DNA, 25 bp, Rattus norvegicus
gccccagaggctgcttttatcagag

SEQ ID NO: 393592 - DNA, 25 bp, Rattus norvegicus
gccccagatagccagcatatttgta

SEQ ID NO: 393593 - DNA, 25 bp, Rattus norvegicus
gccccagatagcgagcatatttgta

SEQ ID NO: 393594 - DNA, 25 bp, Rattus norvegicus
gccccagcatccagtataagcatgt

SEQ ID NO: 393595 - DNA, 25 bp, Rattus norvegicus
gccccagcatcctgtataagcatgt

SEQ ID NO: 393596 - DNA, 25 bp, Rattus norvegicus
gccccagcggagattaagccagaac

SEQ ID NO: 393597 - DNA, 25 bp, Rattus norvegicus
gccccagcggagtttaagccagaac

SEQ ID NO: 393598 - DNA, 25 bp, Rattus norvegicus
gccccagcggtgacgtcaacgaaga

SEQ ID NO: 393599 - DNA, 25 bp, Rattus norvegicus
gccccagcggtgtcgtcaacgaaga

SEQ ID NO: 393600 - DNA, 25 bp, Rattus norvegicus
gccccagctgccagttatgcaaata

SEQ ID NO: 393601 - DNA, 25 bp, Rattus norvegicus
gccccagctgcctgttatgcaaata

SEQ ID NO: 393602 - DNA, 25 bp, Rattus norvegicus
gccccaggactgatcataattcatg

SEQ ID NO: 393603 - DNA, 25 bp, Rattus norvegicus
gccccaggactgttcataattcatg

SEQ ID NO: 393604 - DNA, 25 bp, Rattus norvegicus
gccccaggacttctatcaacgtttt

SEQ ID NO: 393605 - DNA, 25 bp, Rattus norvegicus
gccccaggacttgtatcaacgtttt

SEQ ID NO: 393606 - DNA, 25 bp, Rattus norvegicus
gccccaggagtcatgaagccttgag

SEQ ID NO: 393607 - DNA, 25 bp, Rattus norvegicus
gccccaggagtcttgaagccttgag

SEQ ID NO: 393608 - DNA, 25 bp, Rattus norvegicus
gccccaggatgtagcagagttgtta

SEQ ID NO: 393609 - DNA, 25 bp, Rattus norvegicus
gccccaggatgttgcagagttgtta

SEQ ID NO: 393610 - DNA, 25 bp, Rattus norvegicus
gccccaggattcattgcccaacttt

SEQ ID NO: 393611 - DNA, 25 bp, Rattus norvegicus
gccccaggattctttgcccaacttt

SEQ ID NO: 393612 - DNA, 25 bp, Rattus norvegicus
gccccagggactagggacaagtagt

SEQ ID NO: 393613 - DNA, 25 bp, Rattus norvegicus
gccccagggacttgggacaagtagt

SEQ ID NO: 393614 - DNA, 25 bp, Rattus norvegicus
gccccagggatgataagtcctcatt

SEQ ID NO: 393615 - DNA, 25 bp, Rattus norvegicus
gccccagggatgttaagtcctcatt

SEQ ID NO: 393616 - DNA, 25 bp, Rattus norvegicus
gccccagggtcaaagctcagtggta

SEQ ID NO: 393617 - DNA, 25 bp, Rattus norvegicus
gccccagggtcatagctcagtggta

SEQ ID NO: 393618 - DNA, 25 bp, Rattus norvegicus
gccccaggttccctaagttagcagt

SEQ ID NO: 393619 - DNA, 25 bp, Rattus norvegicus
gccccaggttccgtaagttagcagt

SEQ ID NO: 393620 - DNA, 25 bp, Rattus norvegicus
gccccagtactgatgagcatgctta

SEQ ID NO: 393621 - DNA, 25 bp, Rattus norvegicus
gccccagtactgttgagcatgctta

SEQ ID NO: 393622 - DNA, 25 bp, Rattus norvegicus
gccccagtcagactgccatagtttt

SEQ ID NO: 393623 - DNA, 25 bp, Rattus norvegicus
gccccagtcagagtgccatagtttt

SEQ ID NO: 393624 - DNA, 25 bp, Rattus norvegicus
gccccagtccacactgttgataatt

SEQ ID NO: 393625 - DNA, 25 bp, Rattus norvegicus
gccccagtccactctgttgataatt

SEQ ID NO: 393626 - DNA, 25 bp, Rattus norvegicus
gccccagtccatctaagcaagcaaa

SEQ ID NO: 393627 - DNA, 25 bp, Rattus norvegicus
gccccagtccatgtaagcaagcaaa

SEQ ID NO: 393628 - DNA, 25 bp, Rattus norvegicus
gccccagtcctcctgtgtgtgtgat

SEQ ID NO: 393629 - DNA, 25 bp, Rattus norvegicus
gccccagtcctcgtgtgtgtgtgat

SEQ ID NO: 393630 - DNA, 25 bp, Rattus norvegicus
gccccagtctctaactactgtattt

SEQ ID NO: 393631 - DNA, 25 bp, Rattus norvegicus
gccccagtctcttactactgtattt

SEQ ID NO: 393632 - DNA, 25 bp, Rattus norvegicus
gccccagtgcacagttggtggttat

SEQ ID NO: 393633 - DNA, 25 bp, Rattus norvegicus
gccccagtgcactgttggtggttat

SEQ ID NO: 393634 - DNA, 25 bp, Rattus norvegicus
gccccagttcacaggttttggagtt

SEQ ID NO: 393635 - DNA, 25 bp, Rattus norvegicus
gccccagttcactggttttggagtt

SEQ ID NO: 393636 - DNA, 25 bp, Rattus norvegicus
gccccagttggccagaattgattct

SEQ ID NO: 393637 - DNA, 25 bp, Rattus norvegicus
gccccagttggcgagaattgattct

SEQ ID NO: 393638 - DNA, 25 bp, Rattus norvegicus
gccccagttgttagaattatgcccc

SEQ ID NO: 393639 - DNA, 25 bp, Rattus norvegicus
gccccagttgtttgaattatgcccc

SEQ ID NO: 393640 - DNA, 25 bp, Rattus norvegicus
gccccatacttgaaggatgccactg

SEQ ID NO: 393641 - DNA, 25 bp, Rattus norvegicus
gccccatacttgtaggatgccactg

SEQ ID NO: 393642 - DNA, 25 bp, Rattus norvegicus
gccccatcaactccaaggctaaaaa

SEQ ID NO: 393643 - DNA, 25 bp, Rattus norvegicus
gccccatcaactgcaaggctaaaaa

SEQ ID NO: 393644 - DNA, 25 bp, Rattus norvegicus
gccccatcaagcatcgcaaaagcat

SEQ ID NO: 393645 - DNA, 25 bp, Rattus norvegicus
gccccatcaagcttcgcaaaagcat

SEQ ID NO: 393646 - DNA, 25 bp, Rattus norvegicus
gccccatcacccctaagaagaaaag

SEQ ID NO: 393647 - DNA, 25 bp, Rattus norvegicus
gccccatcacccgtaagaagaaaag

SEQ ID NO: 393648 - DNA, 25 bp, Rattus norvegicus
gccccatcatgtatagagcttctta

SEQ ID NO: 393649 - DNA, 25 bp, Rattus norvegicus
gccccatcatgtctgtaggctgagg

SEQ ID NO: 393650 - DNA, 25 bp, Rattus norvegicus
gccccatcatgtgtgtaggctgagg

SEQ ID NO: 393651 - DNA, 25 bp, Rattus norvegicus
gccccatcatgtttagagcttctta

SEQ ID NO: 393652 - DNA, 25 bp, Rattus norvegicus
gccccatcctccatggtgtaaattt

SEQ ID NO: 393653 - DNA, 25 bp, Rattus norvegicus
gccccatcctccttggtgtaaattt

SEQ ID NO: 393654 - DNA, 25 bp, Rattus norvegicus
gccccatctaccataacagcgagga

SEQ ID NO: 393655 - DNA, 25 bp, Rattus norvegicus
gccccatctaccttaacagcgagga

SEQ ID NO: 393656 - DNA, 25 bp, Rattus norvegicus
gccccatctgggactcaggagaaaa

SEQ ID NO: 393657 - DNA, 25 bp, Rattus norvegicus
gccccatctgggtctcaggagaaaa

SEQ ID NO: 393658 - DNA, 25 bp, Rattus norvegicus
gccccatctttccattaatattcat

SEQ ID NO: 393659 - DNA, 25 bp, Rattus norvegicus
gccccatctttcgattaatattcat

SEQ ID NO: 393660 - DNA, 25 bp, Rattus norvegicus
gccccatctttgacttgtggctagt

SEQ ID NO: 393661 - DNA, 25 bp, Rattus norvegicus
gccccatctttgtcttgtggctagt

SEQ ID NO: 393662 - DNA, 25 bp, Rattus norvegicus
gccccatgacgtactcaggttaggt

SEQ ID NO: 393663 - DNA, 25 bp, Rattus norvegicus
gccccatgacgttctcaggttaggt

SEQ ID NO: 393664 - DNA, 25 bp, Rattus norvegicus
gccccatgcatgctaatgtttagtt

SEQ ID NO: 393665 - DNA, 25 bp, Rattus norvegicus
gccccatgcatggtaatgtttagtt

SEQ ID NO: 393666 - DNA, 25 bp, Rattus norvegicus
gccccatggtgtatgcctcattaag

SEQ ID NO: 393667 - DNA, 25 bp, Rattus norvegicus
gccccatggtgtttgcctcattaag

SEQ ID NO: 393668 - DNA, 25 bp, Rattus norvegicus
gccccatgtatacagagcgtcatct

SEQ ID NO: 393669 - DNA, 25 bp, Rattus norvegicus
gccccatgtatagagagcgtcatct

SEQ ID NO: 393670 - DNA, 25 bp, Rattus norvegicus
gccccatgtgagctgcatgaggttt

SEQ ID NO: 393671 - DNA, 25 bp, Rattus norvegicus
gccccatgtgaggtgcatgaggttt

SEQ ID NO: 393672 - DNA, 25 bp, Rattus norvegicus
gccccattgcctaattttgttattg

SEQ ID NO: 393673 - DNA, 25 bp, Rattus norvegicus
gccccattgccttattttgttattg

SEQ ID NO: 393674 - DNA, 25 bp, Rattus norvegicus
gccccattgctcctccaagaaaaaa

SEQ ID NO: 393675 - DNA, 25 bp, Rattus norvegicus
gccccattgctcgtccaagaaaaaa

SEQ ID NO: 393676 - DNA, 25 bp, Rattus norvegicus
gccccattgcttcagtagcagcatg

SEQ ID NO: 393677 - DNA, 25 bp, Rattus norvegicus
gccccattgcttgagtagcagcatg

SEQ ID NO: 393678 - DNA, 25 bp, Rattus norvegicus
gccccattgttgattgtgttcctat

SEQ ID NO: 393679 - DNA, 25 bp, Rattus norvegicus
gccccattgttgtttgtgttcctat

SEQ ID NO: 393680 - DNA, 25 bp, Rattus norvegicus
gccccatttctcaggtgatgtacga

SEQ ID NO: 393681 - DNA, 25 bp, Rattus norvegicus
gccccatttctctggtgatgtacga

SEQ ID NO: 393682 - DNA, 25 bp, Rattus norvegicus
gccccccccagaacaattaagatat

SEQ ID NO: 393683 - DNA, 25 bp, Rattus norvegicus
gccccccccagatcaattaagatat

SEQ ID NO: 393684 - DNA, 25 bp, Rattus norvegicus
gccccctcggaaatggcattctgag

SEQ ID NO: 393685 - DNA, 25 bp, Rattus norvegicus
gccccctcggaattggcattctgag

SEQ ID NO: 393686 - DNA, 25 bp, Rattus norvegicus
gcccccttcaagagtcttccaagta

SEQ ID NO: 393687 - DNA, 25 bp, Rattus norvegicus
gcccccttcaagtgtcttccaagta

SEQ ID NO: 393688 - DNA, 25 bp, Rattus norvegicus
gccccgaagcgaaaagcgacgcggc

SEQ ID NO: 393689 - DNA, 25 bp, Rattus norvegicus
gccccgaagcgataagcgacgcggc

SEQ ID NO: 393690 - DNA, 25 bp, Rattus norvegicus
gccccgacgtctccgatgagtataa

SEQ ID NO: 393691 - DNA, 25 bp, Rattus norvegicus
gccccgacgtctgcgatgagtataa

SEQ ID NO: 393692 - DNA, 25 bp, Rattus norvegicus
gccccgagagtgaataaggagccat

SEQ ID NO: 393693 - DNA, 25 bp, Rattus norvegicus
gccccgagagtgtataaggagccat

SEQ ID NO: 393694 - DNA, 25 bp, Rattus norvegicus
gccccgaggcaacaacatgaggact

SEQ ID NO: 393695 - DNA, 25 bp, Rattus norvegicus
gccccgaggcaagaacatgaggact

SEQ ID NO: 393696 - DNA, 25 bp, Rattus norvegicus
gccccgaggcctaggattttctgga

SEQ ID NO: 393697 - DNA, 25 bp, Rattus norvegicus
gccccgaggccttggattttctgga

SEQ ID NO: 393698 - DNA, 25 bp, Rattus norvegicus
gccccgagtatgataccactgtggt

SEQ ID NO: 393699 - DNA, 25 bp, Rattus norvegicus
gccccgagtatgttaccactgtggt

SEQ ID NO: 393700 - DNA, 25 bp, Rattus norvegicus
gccccgagtggtcgatggactatca

SEQ ID NO: 393701 - DNA, 25 bp, Rattus norvegicus
gccccgagtggtggatggactatca

SEQ ID NO: 393702 - DNA, 25 bp, Rattus norvegicus
gccccgagttcacctagtaaagtct

SEQ ID NO: 393703 - DNA, 25 bp, Rattus norvegicus
gccccgagttcagctagtaaagtct

SEQ ID NO: 393704 - DNA, 25 bp, Rattus norvegicus
gccccgatttgtactgattctcttt

SEQ ID NO: 393705 - DNA, 25 bp, Rattus norvegicus
gccccgatttgttctgattctcttt

SEQ ID NO: 393706 - DNA, 25 bp, Rattus norvegicus
gccccgcacagtagacatatcacta

SEQ ID NO: 393707 - DNA, 25 bp, Rattus norvegicus
gccccgcacagttgacatatcacta

SEQ ID NO: 393708 - DNA, 25 bp, Rattus norvegicus
gccccgcatagcattgacattgtgg

SEQ ID NO: 393709 - DNA, 25 bp, Rattus norvegicus
gccccgcatagctttgacattgtgg

SEQ ID NO: 393710 - DNA, 25 bp, Rattus norvegicus
gccccgcctgtcacaataaagttta

SEQ ID NO: 393711 - DNA, 25 bp, Rattus norvegicus
gccccgcctgtctcaataaagttta

SEQ ID NO: 393712 - DNA, 25 bp, Rattus norvegicus
gccccgcgcagcagcgacaagatgg

SEQ ID NO: 393713 - DNA, 25 bp, Rattus norvegicus
gccccgcgcagctgcgacaagatgg

SEQ ID NO: 393714 - DNA, 25 bp, Rattus norvegicus
gccccgcggcggaggcaggaacctg

SEQ ID NO: 393715 - DNA, 25 bp, Rattus norvegicus
gccccgcggcggtggcaggaacctg

SEQ ID NO: 393716 - DNA, 25 bp, Rattus norvegicus
gccccgcgggatcttttgagacttc

SEQ ID NO: 393717 - DNA, 25 bp, Rattus norvegicus
gccccgcgggatgttttgagacttc

SEQ ID NO: 393718 - DNA, 25 bp, Rattus norvegicus
gccccgcttcatacataacccggag

SEQ ID NO: 393719 - DNA, 25 bp, Rattus norvegicus
gccccgcttcattcataacccggag

SEQ ID NO: 393720 - DNA, 25 bp, Rattus norvegicus
gccccggataagacagaggtcactg

SEQ ID NO: 393721 - DNA, 25 bp, Rattus norvegicus
gccccggataagtcagaggtcactg

SEQ ID NO: 393722 - DNA, 25 bp, Rattus norvegicus
gccccggatgacagctcgaaatgag

SEQ ID NO: 393723 - DNA, 25 bp, Rattus norvegicus
gccccggatgactgctcgaaatgag

SEQ ID NO: 393724 - DNA, 25 bp, Rattus norvegicus
gccccggcgctgagcctcaaaatgc

SEQ ID NO: 393725 - DNA, 25 bp, Rattus norvegicus
gccccggcgctgtgcctcaaaatgc

SEQ ID NO: 393726 - DNA, 25 bp, Rattus norvegicus
gccccggcgtggagaatgcatgtaa

SEQ ID NO: 393727 - DNA, 25 bp, Rattus norvegicus
gccccggcgtggtgaatgcatgtaa

SEQ ID NO: 393728 - DNA, 25 bp, Rattus norvegicus
gccccggctttgattcagtcggaat

SEQ ID NO: 393729 - DNA, 25 bp, Rattus norvegicus
gccccggctttgtttcagtcggaat

SEQ ID NO: 393730 - DNA, 25 bp, Rattus norvegicus
gccccgggcatgaatgcccctggag

SEQ ID NO: 393731 - DNA, 25 bp, Rattus norvegicus
gccccgggcatgtatgcccctggag

SEQ ID NO: 393732 - DNA, 25 bp, Rattus norvegicus
gccccgggtgtgcttgcattagtta

SEQ ID NO: 393733 - DNA, 25 bp, Rattus norvegicus
gccccgggtgtggttgcattagtta

SEQ ID NO: 393734 - DNA, 25 bp, Rattus norvegicus
gccccggtcactcgtgatatcatag

SEQ ID NO: 393735 - DNA, 25 bp, Rattus norvegicus
gccccggtcactggtgatatcatag

SEQ ID NO: 393736 - DNA, 25 bp, Rattus norvegicus
gccccggtgttcagattctgcgagg

SEQ ID NO: 393737 - DNA, 25 bp, Rattus norvegicus
gccccggtgttctgattctgcgagg

SEQ ID NO: 393738 - DNA, 25 bp, Rattus norvegicus
gccccgtatgacaaggactcgacag

SEQ ID NO: 393739 - DNA, 25 bp, Rattus norvegicus
gccccgtatgactaggactcgacag

SEQ ID NO: 393740 - DNA, 25 bp, Rattus norvegicus
gccccgtcgagtccacattgagatg

SEQ ID NO: 393741 - DNA, 25 bp, Rattus norvegicus
gccccgtcgagtgcacattgagatg

SEQ ID NO: 393742 - DNA, 25 bp, Rattus norvegicus
gccccgtctcttagcgttagatgat

SEQ ID NO: 393743 - DNA, 25 bp, Rattus norvegicus
gccccgtctctttgcgttagatgat

SEQ ID NO: 393744 - DNA, 25 bp, Rattus norvegicus
gccccgtgcggaagagaactgctga

SEQ ID NO: 393745 - DNA, 25 bp, Rattus norvegicus
gccccgtgcggatgagaactgctga

SEQ ID NO: 393746 - DNA, 25 bp, Rattus norvegicus
gccccgtgttcgactttgattatga

SEQ ID NO: 393747 - DNA, 25 bp, Rattus norvegicus
gccccgtgttcgtctttgattatga

SEQ ID NO: 393748 - DNA, 25 bp, Rattus norvegicus
gccccgttctccactatgagaaata

SEQ ID NO: 393749 - DNA, 25 bp, Rattus norvegicus
gccccgttctcctctatgagaaata

SEQ ID NO: 393750 - DNA, 25 bp, Rattus norvegicus
gccccgttgaggcttcaatgttcaa

SEQ ID NO: 393751 - DNA, 25 bp, Rattus norvegicus
gccccgttgagggttcaatgttcaa

SEQ ID NO: 393752 - DNA, 25 bp, Rattus norvegicus
gcccctaagggcaacagtgtgacta

SEQ ID NO: 393753 - DNA, 25 bp, Rattus norvegicus
gcccctaagggctacagtgtgacta

SEQ ID NO: 393754 - DNA, 25 bp, Rattus norvegicus
gcccctaagtatacttctgcatttg

SEQ ID NO: 393755 - DNA, 25 bp, Rattus norvegicus
gcccctaagtattcttctgcatttg

SEQ ID NO: 393756 - DNA, 25 bp, Rattus norvegicus
gcccctactttaatatttgccatta

SEQ ID NO: 393757 - DNA, 25 bp, Rattus norvegicus
gcccctactttattatttgccatta

SEQ ID NO: 393758 - DNA, 25 bp, Rattus norvegicus
gcccctagaaccacagatgacctgt

SEQ ID NO: 393759 - DNA, 25 bp, Rattus norvegicus
gcccctagaacctcagatgacctgt

SEQ ID NO: 393760 - DNA, 25 bp, Rattus norvegicus
gcccctaggctgagcacagtagtta

SEQ ID NO: 393761 - DNA, 25 bp, Rattus norvegicus
gcccctaggctgtgcacagtagtta

SEQ ID NO: 393762 - DNA, 25 bp, Rattus norvegicus
gcccctaggtgaccacattggtgat

SEQ ID NO: 393763 - DNA, 25 bp, Rattus norvegicus
gcccctaggtgagcacattggtgat

SEQ ID NO: 393764 - DNA, 25 bp, Rattus norvegicus
gcccctatacttatggtggttggat

SEQ ID NO: 393765 - DNA, 25 bp, Rattus norvegicus
gcccctatacttttggtggttggat

SEQ ID NO: 393766 - DNA, 25 bp, Rattus norvegicus
gcccctatcatcaccatgaggttaa

SEQ ID NO: 393767 - DNA, 25 bp, Rattus norvegicus
gcccctatcatctccatgaggttaa

SEQ ID NO: 393768 - DNA, 25 bp, Rattus norvegicus
gcccctatggctactttctttagtt

SEQ ID NO: 393769 - DNA, 25 bp, Rattus norvegicus
gcccctatggcttctttctttagtt

SEQ ID NO: 393770 - DNA, 25 bp, Rattus norvegicus
gcccctcaaaggatagtgttggctt

SEQ ID NO: 393771 - DNA, 25 bp, Rattus norvegicus
gcccctcaaaggttagtgttggctt

SEQ ID NO: 393772 - DNA, 25 bp, Rattus norvegicus
gcccctcaaatacagacatctgctt

SEQ ID NO: 393773 - DNA, 25 bp, Rattus norvegicus
gcccctcaaatagagacatctgctt

SEQ ID NO: 393774 - DNA, 25 bp, Rattus norvegicus
gcccctcactacaagttctgtttta

SEQ ID NO: 393775 - DNA, 25 bp, Rattus norvegicus
gcccctcactactagttctgtttta

SEQ ID NO: 393776 - DNA, 25 bp, Rattus norvegicus
gcccctcagaaaatcaatctctgaa

SEQ ID NO: 393777 - DNA, 25 bp, Rattus norvegicus
gcccctcagaaattcaatctctgaa

SEQ ID NO: 393778 - DNA, 25 bp, Rattus norvegicus
gcccctcagcatctcttcttaaatg

SEQ ID NO: 393779 - DNA, 25 bp, Rattus norvegicus
gcccctcagcatgtcttcttaaatg

SEQ ID NO: 393780 - DNA, 25 bp, Rattus norvegicus
gcccctcatctgcttgcaatatgga

SEQ ID NO: 393781 - DNA, 25 bp, Rattus norvegicus
gcccctcatctggttgcaatatgga

SEQ ID NO: 393782 - DNA, 25 bp, Rattus norvegicus
gcccctcatgacacaacagcagatg

SEQ ID NO: 393783 - DNA, 25 bp, Rattus norvegicus
gcccctcatgactcaacagcagatg

SEQ ID NO: 393784 - DNA, 25 bp, Rattus norvegicus
gcccctccatctctgtgtaagcatt

SEQ ID NO: 393785 - DNA, 25 bp, Rattus norvegicus
gcccctccatctgtgtgtaagcatt

SEQ ID NO: 393786 - DNA, 25 bp, Rattus norvegicus
gcccctcccctgataacattttgta

SEQ ID NO: 393787 - DNA, 25 bp, Rattus norvegicus
gcccctcccctgttaacattttgta

SEQ ID NO: 393788 - DNA, 25 bp, Rattus norvegicus
gcccctccggctatatataaagcgc

SEQ ID NO: 393789 - DNA, 25 bp, Rattus norvegicus
gcccctccggctttatataaagcgc

SEQ ID NO: 393790 - DNA, 25 bp, Rattus norvegicus
gcccctcgagctctcaaatggtata

SEQ ID NO: 393791 - DNA, 25 bp, Rattus norvegicus
gcccctcgagctgtcaaatggtata

SEQ ID NO: 393792 - DNA, 25 bp, Rattus norvegicus
gcccctcggagtataagtcagtaat

SEQ ID NO: 393793 - DNA, 25 bp, Rattus norvegicus
gcccctcggagtttaagtcagtaat

SEQ ID NO: 393794 - DNA, 25 bp, Rattus norvegicus
gcccctcgtgatcgtgatgaccgag

SEQ ID NO: 393795 - DNA, 25 bp, Rattus norvegicus
gcccctcgtgatggtgatgaccgag

SEQ ID NO: 393796 - DNA, 25 bp, Rattus norvegicus
gcccctctagagcaaaatgtaggat

SEQ ID NO: 393797 - DNA, 25 bp, Rattus norvegicus
gcccctctagaggaaaatgtaggat

SEQ ID NO: 393798 - DNA, 25 bp, Rattus norvegicus
gcccctctcagaatagcagcgttaa

SEQ ID NO: 393799 - DNA, 25 bp, Rattus norvegicus
gcccctctcagattagcagcgttaa

SEQ ID NO: 393800 - DNA, 25 bp, Rattus norvegicus
gcccctctctttcacctgtttttat

SEQ ID NO: 393801 - DNA, 25 bp, Rattus norvegicus
gcccctctctttgacctgtttttat

SEQ ID NO: 393802 - DNA, 25 bp, Rattus norvegicus
gcccctctgaaacctctttgattga

SEQ ID NO: 393803 - DNA, 25 bp, Rattus norvegicus
gcccctctgaaagctctttgattga

SEQ ID NO: 393804 - DNA, 25 bp, Rattus norvegicus
gcccctctgggaaaggctctagtta

SEQ ID NO: 393805 - DNA, 25 bp, Rattus norvegicus
gcccctctgggataggctctagtta

SEQ ID NO: 393806 - DNA, 25 bp, Rattus norvegicus
gcccctctgtcaattctacaagaag

SEQ ID NO: 393807 - DNA, 25 bp, Rattus norvegicus
gcccctctgtcatttctacaagaag

SEQ ID NO: 393808 - DNA, 25 bp, Rattus norvegicus
gcccctctttcaacagagttcagaa

SEQ ID NO: 393809 - DNA, 25 bp, Rattus norvegicus
gcccctctttcatcagagttcagaa

SEQ ID NO: 393810 - DNA, 25 bp, Rattus norvegicus
gcccctgaagccaagaactgtactg

SEQ ID NO: 393811 - DNA, 25 bp, Rattus norvegicus
gcccctgaagcctagaactgtactg

SEQ ID NO: 393812 - DNA, 25 bp, Rattus norvegicus
gcccctgaatgtcatggtgatccgc

SEQ ID NO: 393813 - DNA, 25 bp, Rattus norvegicus
gcccctgaatgtgatggtgatccgc

SEQ ID NO: 393814 - DNA, 25 bp, Rattus norvegicus
gcccctgacatcagcatagcatata

SEQ ID NO: 393815 - DNA, 25 bp, Rattus norvegicus
gcccctgacatctgcatagcatata

SEQ ID NO: 393816 - DNA, 25 bp, Rattus norvegicus
gcccctgacgtgattgtgttgattt

SEQ ID NO: 393817 - DNA, 25 bp, Rattus norvegicus
gcccctgacgtgtttgtgttgattt

SEQ ID NO: 393818 - DNA, 25 bp, Rattus norvegicus
gcccctgactcccaagagtggtaga

SEQ ID NO: 393819 - DNA, 25 bp, Rattus norvegicus
gcccctgactccgaagagtggtaga

SEQ ID NO: 393820 - DNA, 25 bp, Rattus norvegicus
gcccctgacttaatttactggacat

SEQ ID NO: 393821 - DNA, 25 bp, Rattus norvegicus
gcccctgacttattttactggacat

SEQ ID NO: 393822 - DNA, 25 bp, Rattus norvegicus
gcccctgatgtccagattaatcttc

SEQ ID NO: 393823 - DNA, 25 bp, Rattus norvegicus
gcccctgatgtcgagattaatcttc

SEQ ID NO: 393824 - DNA, 25 bp, Rattus norvegicus
gcccctgatttactacctctggaga

SEQ ID NO: 393825 - DNA, 25 bp, Rattus norvegicus
gcccctgatttagtacctctggaga

SEQ ID NO: 393826 - DNA, 25 bp, Rattus norvegicus
gcccctgcacagacatggctcagat

SEQ ID NO: 393827 - DNA, 25 bp, Rattus norvegicus
gcccctgcacagtcatggctcagat

SEQ ID NO: 393828 - DNA, 25 bp, Rattus norvegicus
gcccctgcatcaagggataaggtga

SEQ ID NO: 393829 - DNA, 25 bp, Rattus norvegicus
gcccctgcatcatgggataaggtga

SEQ ID NO: 393830 - DNA, 25 bp, Rattus norvegicus
gcccctgccagtaacactaagattg

SEQ ID NO: 393831 - DNA, 25 bp, Rattus norvegicus
gcccctgccagttacactaagattg

SEQ ID NO: 393832 - DNA, 25 bp, Rattus norvegicus
gcccctgccttgacttgcaagattt

SEQ ID NO: 393833 - DNA, 25 bp, Rattus norvegicus
gcccctgccttgtcttgcaagattt

SEQ ID NO: 393834 - DNA, 25 bp, Rattus norvegicus
gcccctgctcagagctttagaggag

SEQ ID NO: 393835 - DNA, 25 bp, Rattus norvegicus
gcccctgctcagtgctttagaggag

SEQ ID NO: 393836 - DNA, 25 bp, Rattus norvegicus
gcccctgctcttaccagagaggaag

SEQ ID NO: 393837 - DNA, 25 bp, Rattus norvegicus
gcccctgctctttccagagaggaag

SEQ ID NO: 393838 - DNA, 25 bp, Rattus norvegicus
gcccctgctgcaaactagggtttgg

SEQ ID NO: 393839 - DNA, 25 bp, Rattus norvegicus
gcccctgctgcatactagggtttgg

SEQ ID NO: 393840 - DNA, 25 bp, Rattus norvegicus
gcccctgctgttcggtacagcaata

SEQ ID NO: 393841 - DNA, 25 bp, Rattus norvegicus
gcccctgctgttgggtacagcaata

SEQ ID NO: 393842 - DNA, 25 bp, Rattus norvegicus
gcccctgcttttccactgaagaagg

SEQ ID NO: 393843 - DNA, 25 bp, Rattus norvegicus
gcccctgcttttgcactgaagaagg

SEQ ID NO: 393844 - DNA, 25 bp, Rattus norvegicus
gcccctggaaaactgccactggagg

SEQ ID NO: 393845 - DNA, 25 bp, Rattus norvegicus
gcccctggaaaagtgccactggagg

SEQ ID NO: 393846 - DNA, 25 bp, Rattus norvegicus
gcccctggaaccacggaaacagcta

SEQ ID NO: 393847 - DNA, 25 bp, Rattus norvegicus
gcccctggaacctcggaaacagcta

SEQ ID NO: 393848 - DNA, 25 bp, Rattus norvegicus
gcccctggaagaagctcactgttaa

SEQ ID NO: 393849 - DNA, 25 bp, Rattus norvegicus
gcccctggaagatgctcactgttaa

SEQ ID NO: 393850 - DNA, 25 bp, Rattus norvegicus
gcccctggagtaccacatcttaaat

SEQ ID NO: 393851 - DNA, 25 bp, Rattus norvegicus
gcccctggagtagcacatcttaaat

SEQ ID NO: 393852 - DNA, 25 bp, Rattus norvegicus
gcccctggctacaccaaggtaatga

SEQ ID NO: 393853 - DNA, 25 bp, Rattus norvegicus
gcccctggctactccaaggtaatga

SEQ ID NO: 393854 - DNA, 25 bp, Rattus norvegicus
gcccctgggactcttgtatttgtaa

SEQ ID NO: 393855 - DNA, 25 bp, Rattus norvegicus
gcccctgggactgttgtatttgtaa

SEQ ID NO: 393856 - DNA, 25 bp, Rattus norvegicus
gcccctgggagcagtttgcacgaga

SEQ ID NO: 393857 - DNA, 25 bp, Rattus norvegicus
gcccctgggagctgtttgcacgaga

SEQ ID NO: 393858 - DNA, 25 bp, Rattus norvegicus
gcccctgggctgaagtatgcaaagt

SEQ ID NO: 393859 - DNA, 25 bp, Rattus norvegicus
gcccctgggctgtagtatgcaaagt

SEQ ID NO: 393860 - DNA, 25 bp, Rattus norvegicus
gcccctgggtatcacaagctagagt

SEQ ID NO: 393861 - DNA, 25 bp, Rattus norvegicus
gcccctgggtatgacaagctagagt

SEQ ID NO: 393862 - DNA, 25 bp, Rattus norvegicus
gcccctgtactgagtctgtaaacaa

SEQ ID NO: 393863 - DNA, 25 bp, Rattus norvegicus
gcccctgtactgtgtctgtaaacaa

SEQ ID NO: 393864 - DNA, 25 bp, Rattus norvegicus
gcccctgtagggagcgcattcaaat

SEQ ID NO: 393865 - DNA, 25 bp, Rattus norvegicus
gcccctgtagggtgcgcattcaaat

SEQ ID NO: 393866 - DNA, 25 bp, Rattus norvegicus
gcccctgtatgactgccatccagag

SEQ ID NO: 393867 - DNA, 25 bp, Rattus norvegicus
gcccctgtatgagtgccatccagag

SEQ ID NO: 393868 - DNA, 25 bp, Rattus norvegicus
gcccctgtatgtatccctaataaag

SEQ ID NO: 393869 - DNA, 25 bp, Rattus norvegicus
gcccctgtatgtttccctaataaag

SEQ ID NO: 393870 - DNA, 25 bp, Rattus norvegicus
gcccctgtcagaaagtgaacacgtt

SEQ ID NO: 393871 - DNA, 25 bp, Rattus norvegicus
gcccctgtcagaagtgaatgccatt

SEQ ID NO: 393872 - DNA, 25 bp, Rattus norvegicus
gcccctgtcagatagtgaacacgtt

SEQ ID NO: 393873 - DNA, 25 bp, Rattus norvegicus
gcccctgtcagatgtgaatgccatt

SEQ ID NO: 393874 - DNA, 25 bp, Rattus norvegicus
gcccctgtcagtcattttcttatat

SEQ ID NO: 393875 - DNA, 25 bp, Rattus norvegicus
gcccctgtcagtgattttcttatat

SEQ ID NO: 393876 - DNA, 25 bp, Rattus norvegicus
gcccctgtccagatactatttattt

SEQ ID NO: 393877 - DNA, 25 bp, Rattus norvegicus
gcccctgtccagttactatttattt

SEQ ID NO: 393878 - DNA, 25 bp, Rattus norvegicus
gcccctgtccatcgccagatgaatg

SEQ ID NO: 393879 - DNA, 25 bp, Rattus norvegicus
gcccctgtccatggccagatgaatg

SEQ ID NO: 393880 - DNA, 25 bp, Rattus norvegicus
gcccctgtcgtgaagtttacatgtg

SEQ ID NO: 393881 - DNA, 25 bp, Rattus norvegicus
gcccctgtcgtgtagtttacatgtg

SEQ ID NO: 393882 - DNA, 25 bp, Rattus norvegicus
gcccctgtgaaaaactcgtttgacc

SEQ ID NO: 393883 - DNA, 25 bp, Rattus norvegicus
gcccctgtgaaatactcgtttgacc

SEQ ID NO: 393884 - DNA, 25 bp, Rattus norvegicus
gcccctgtgggtctcgaagcactta

SEQ ID NO: 393885 - DNA, 25 bp, Rattus norvegicus
gcccctgtgggtgtcgaagcactta

SEQ ID NO: 393886 - DNA, 25 bp, Rattus norvegicus
gcccctgtgttcaaccaaaattgtt

SEQ ID NO: 393887 - DNA, 25 bp, Rattus norvegicus
gcccctgtgttctaccaaaattgtt

SEQ ID NO: 393888 - DNA, 25 bp, Rattus norvegicus
gcccctgttgccatacttaaaatat

SEQ ID NO: 393889 - DNA, 25 bp, Rattus norvegicus
gcccctgttgccttacttaaaatat

SEQ ID NO: 393890 - DNA, 25 bp, Rattus norvegicus
gcccctgtttgaagttatgtggaat

SEQ ID NO: 393891 - DNA, 25 bp, Rattus norvegicus
gcccctgtttgatgttatgtggaat

SEQ ID NO: 393892 - DNA, 25 bp, Rattus norvegicus
gccccttaaatacttatgcccagat

SEQ ID NO: 393893 - DNA, 25 bp, Rattus norvegicus
gccccttaaatagttatgcccagat

SEQ ID NO: 393894 - DNA, 25 bp, Rattus norvegicus
gccccttaaggacgagtgtatgtgt

SEQ ID NO: 393895 - DNA, 25 bp, Rattus norvegicus
gccccttaaggaggagtgtatgtgt

SEQ ID NO: 393896 - DNA, 25 bp, Rattus norvegicus
gccccttaccataccttgagaactg

SEQ ID NO: 393897 - DNA, 25 bp, Rattus norvegicus
gccccttaccattccttgagaactg

SEQ ID NO: 393898 - DNA, 25 bp, Rattus norvegicus
gccccttagactattcttagttcag

SEQ ID NO: 393899 - DNA, 25 bp, Rattus norvegicus
gccccttagacttttcttagttcag

SEQ ID NO: 393900 - DNA, 25 bp, Rattus norvegicus
gccccttagccacttttcatgtatg

SEQ ID NO: 393901 - DNA, 25 bp, Rattus norvegicus
gccccttagccagttttcatgtatg

SEQ ID NO: 393902 - DNA, 25 bp, Rattus norvegicus
gccccttagccccttgtatattatt

SEQ ID NO: 393903 - DNA, 25 bp, Rattus norvegicus
gccccttagcccgttgtatattatt

SEQ ID NO: 393904 - DNA, 25 bp, Rattus norvegicus
gccccttaggtgacaggccaaggat

SEQ ID NO: 393905 - DNA, 25 bp, Rattus norvegicus
gccccttaggtgtcaggccaaggat

SEQ ID NO: 393906 - DNA, 25 bp, Rattus norvegicus
gccccttattggcttgaaagctgac

SEQ ID NO: 393907 - DNA, 25 bp, Rattus norvegicus
gccccttattgggttgaaagctgac

SEQ ID NO: 393908 - DNA, 25 bp, Rattus norvegicus
gccccttcagttcttgatagtctgt

SEQ ID NO: 393909 - DNA, 25 bp, Rattus norvegicus
gccccttcagttgttgatagtctgt

SEQ ID NO: 393910 - DNA, 25 bp, Rattus norvegicus
gccccttcatcactgcaggtgatta

SEQ ID NO: 393911 - DNA, 25 bp, Rattus norvegicus
gccccttcatcagtgcaggtgatta

SEQ ID NO: 393912 - DNA, 25 bp, Rattus norvegicus
gccccttccagtactgttttgagtc

SEQ ID NO: 393913 - DNA, 25 bp, Rattus norvegicus
gccccttccagttctgttttgagtc

SEQ ID NO: 393914 - DNA, 25 bp, Rattus norvegicus
gccccttccttgacattttctggga

SEQ ID NO: 393915 - DNA, 25 bp, Rattus norvegicus
gccccttccttgtcattttctggga

SEQ ID NO: 393916 - DNA, 25 bp, Rattus norvegicus
gccccttctaccacatcagagataa

SEQ ID NO: 393917 - DNA, 25 bp, Rattus norvegicus
gccccttctacctcatcagagataa

SEQ ID NO: 393918 - DNA, 25 bp, Rattus norvegicus
gccccttctagtcgcaaatgtgcag

SEQ ID NO: 393919 - DNA, 25 bp, Rattus norvegicus
gccccttctagtggcaaatgtgcag

SEQ ID NO: 393920 - DNA, 25 bp, Rattus norvegicus
gccccttctgagacttttactctaa

SEQ ID NO: 393921 - DNA, 25 bp, Rattus norvegicus
gccccttctgagtcttttactctaa

SEQ ID NO: 393922 - DNA, 25 bp, Rattus norvegicus
gccccttggctcaaggtcaaaatta

SEQ ID NO: 393923 - DNA, 25 bp, Rattus norvegicus
gccccttggctctaggtcaaaatta

SEQ ID NO: 393924 - DNA, 25 bp, Rattus norvegicus
gccccttgggtgaaaatagattgtt

SEQ ID NO: 393925 - DNA, 25 bp, Rattus norvegicus
gccccttgggtgtaaatagattgtt

SEQ ID NO: 393926 - DNA, 25 bp, Rattus norvegicus
gccccttgtcaaccactaaagtata

SEQ ID NO: 393927 - DNA, 25 bp, Rattus norvegicus
gccccttgtcaagcactaaagtata

SEQ ID NO: 393928 - DNA, 25 bp, Rattus norvegicus
gcccctttatccaacatttcaaata

SEQ ID NO: 393929 - DNA, 25 bp, Rattus norvegicus
gcccctttatcctacatttcaaata

SEQ ID NO: 393930 - DNA, 25 bp, Rattus norvegicus
gcccctttcaagcatttcctggagg

SEQ ID NO: 393931 - DNA, 25 bp, Rattus norvegicus
gcccctttcaaggatttcctggagg

SEQ ID NO: 393932 - DNA, 25 bp, Rattus norvegicus
gcccctttctggcacgtagagattt

SEQ ID NO: 393933 - DNA, 25 bp, Rattus norvegicus
gcccctttctgggacgtagagattt

SEQ ID NO: 393934 - DNA, 25 bp, Rattus norvegicus
gcccctttgccgaatagttactgtt

SEQ ID NO: 393935 - DNA, 25 bp, Rattus norvegicus
gcccctttgccgtatagttactgtt

SEQ ID NO: 393936 - DNA, 25 bp, Rattus norvegicus
gcccctttgtatattgtgcagtgat

SEQ ID NO: 393937 - DNA, 25 bp, Rattus norvegicus
gcccctttgtattttgtgcagtgat

SEQ ID NO: 393938 - DNA, 25 bp, Rattus norvegicus
gccccttttcaaaaactggaacact

SEQ ID NO: 393939 - DNA, 25 bp, Rattus norvegicus
gccccttttcaataactggaacact

SEQ ID NO: 393940 - DNA, 25 bp, Rattus norvegicus
gccccttttgtactcagtatctgtc

SEQ ID NO: 393941 - DNA, 25 bp, Rattus norvegicus
gccccttttgtagtcagtatctgtc

SEQ ID NO: 393942 - DNA, 25 bp, Rattus norvegicus
gccccttttgttcaagagcttctgg

SEQ ID NO: 393943 - DNA, 25 bp, Rattus norvegicus
gccccttttgttgaagagcttctgg

SEQ ID NO: 393944 - DNA, 25 bp, Rattus norvegicus
gcccgaaatcccctgacctggtggt

SEQ ID NO: 393945 - DNA, 25 bp, Rattus norvegicus
gcccgaaatcccgtgacctggtggt

SEQ ID NO: 393946 - DNA, 25 bp, Rattus norvegicus
gcccgaaccaatcatagtgcacact

SEQ ID NO: 393947 - DNA, 25 bp, Rattus norvegicus
gcccgaaccaatgatagtgcacact

SEQ ID NO: 393948 - DNA, 25 bp, Rattus norvegicus
gcccgaactgctaggccgcataacg

SEQ ID NO: 393949 - DNA, 25 bp, Rattus norvegicus
gcccgaactgcttggccgcataacg

SEQ ID NO: 393950 - DNA, 25 bp, Rattus norvegicus
gcccgaagaactcgtgtcctgtgca

SEQ ID NO: 393951 - DNA, 25 bp, Rattus norvegicus
gcccgaagaactggtgtcctgtgca

SEQ ID NO: 393952 - DNA, 25 bp, Rattus norvegicus
gcccgaagcagcatttgtagcaatt

SEQ ID NO: 393953 - DNA, 25 bp, Rattus norvegicus
gcccgaagcagcttttgtagcaatt

SEQ ID NO: 393954 - DNA, 25 bp, Rattus norvegicus
gcccgaagcggccaagagtctatac

SEQ ID NO: 393955 - DNA, 25 bp, Rattus norvegicus
gcccgaagcggcgaagagtctatac

SEQ ID NO: 393956 - DNA, 25 bp, Rattus norvegicus
gcccgaatcccgaatctgaaggtgg

SEQ ID NO: 393957 - DNA, 25 bp, Rattus norvegicus
gcccgaatcccgtatctgaaggtgg

SEQ ID NO: 393958 - DNA, 25 bp, Rattus norvegicus
gcccgacagtcactcgacacgaggg

SEQ ID NO: 393959 - DNA, 25 bp, Rattus norvegicus
gcccgacagtcagtcgacacgaggg

SEQ ID NO: 393960 - DNA, 25 bp, Rattus norvegicus
gcccgacatggcagactattactat

SEQ ID NO: 393961 - DNA, 25 bp, Rattus norvegicus
gcccgacatggctgactattactat

SEQ ID NO: 393962 - DNA, 25 bp, Rattus norvegicus
gcccgactacgaaggccagttctaa

SEQ ID NO: 393963 - DNA, 25 bp, Rattus norvegicus
gcccgactacgatggccagttctaa

SEQ ID NO: 393964 - DNA, 25 bp, Rattus norvegicus
gcccgagagctgcagagccagatcc

SEQ ID NO: 393965 - DNA, 25 bp, Rattus norvegicus
gcccgagagctggagagccagatcc

SEQ ID NO: 393966 - DNA, 25 bp, Rattus norvegicus
gcccgagagtctcgatgtgtcttta

SEQ ID NO: 393967 - DNA, 25 bp, Rattus norvegicus
gcccgagagtctggatgtgtcttta

SEQ ID NO: 393968 - DNA, 25 bp, Rattus norvegicus
gcccgagccatgagagtgaggactt

SEQ ID NO: 393969 - DNA, 25 bp, Rattus norvegicus
gcccgagccatgtgagtgaggactt

SEQ ID NO: 393970 - DNA, 25 bp, Rattus norvegicus
gcccgagccttaactttgtgactga

SEQ ID NO: 393971 - DNA, 25 bp, Rattus norvegicus
gcccgagccttatctttgtgactga

SEQ ID NO: 393972 - DNA, 25 bp, Rattus norvegicus
gcccgagctgatatagcccgcaagg

SEQ ID NO: 393973 - DNA, 25 bp, Rattus norvegicus
gcccgagctgatttagcccgcaagg

SEQ ID NO: 393974 - DNA, 25 bp, Rattus norvegicus
gcccgagggaacacaggatcgtttt

SEQ ID NO: 393975 - DNA, 25 bp, Rattus norvegicus
gcccgagggaactcaggatcgtttt

SEQ ID NO: 393976 - DNA, 25 bp, Rattus norvegicus
gcccgaggtccacttaacgtgagaa

SEQ ID NO: 393977 - DNA, 25 bp, Rattus norvegicus
gcccgaggtccagttaacgtgagaa

SEQ ID NO: 393978 - DNA, 25 bp, Rattus norvegicus
gcccgagtgtagctatagactttgt

SEQ ID NO: 393979 - DNA, 25 bp, Rattus norvegicus
gcccgagtgtaggtatagactttgt

SEQ ID NO: 393980 - DNA, 25 bp, Rattus norvegicus
gcccgagttctgcttctggtgaaag

SEQ ID NO: 393981 - DNA, 25 bp, Rattus norvegicus
gcccgagttctggttctggtgaaag

SEQ ID NO: 393982 - DNA, 25 bp, Rattus norvegicus
gcccgagttttgacagctaagatga

SEQ ID NO: 393983 - DNA, 25 bp, Rattus norvegicus
gcccgagttttgtcagctaagatga

SEQ ID NO: 393984 - DNA, 25 bp, Rattus norvegicus
gcccgataggcaccaagtcttttcc

SEQ ID NO: 393985 - DNA, 25 bp, Rattus norvegicus
gcccgataggcagcaagtcttttcc

SEQ ID NO: 393986 - DNA, 25 bp, Rattus norvegicus
gcccgatatgacatctcccatgaga

SEQ ID NO: 393987 - DNA, 25 bp, Rattus norvegicus
gcccgatatgacttctcccatgaga

SEQ ID NO: 393988 - DNA, 25 bp, Rattus norvegicus
gcccgatcagttacctgtctaggta

SEQ ID NO: 393989 - DNA, 25 bp, Rattus norvegicus
gcccgatcagtttcctgtctaggta

SEQ ID NO: 393990 - DNA, 25 bp, Rattus norvegicus
gcccgatctactagcgacgcataaa

SEQ ID NO: 393991 - DNA, 25 bp, Rattus norvegicus
gcccgatctacttgcgacgcataaa

SEQ ID NO: 393992 - DNA, 25 bp, Rattus norvegicus
gcccgatctcgtctgatctcggaag

SEQ ID NO: 393993 - DNA, 25 bp, Rattus norvegicus
gcccgatctcgtgtgatctcggaag

SEQ ID NO: 393994 - DNA, 25 bp, Rattus norvegicus
gcccgatctgacaacctaaattaat

SEQ ID NO: 393995 - DNA, 25 bp, Rattus norvegicus
gcccgatctgactacctaaattaat

SEQ ID NO: 393996 - DNA, 25 bp, Rattus norvegicus
gcccgatctggccttgaattaatct

SEQ ID NO: 393997 - DNA, 25 bp, Rattus norvegicus
gcccgatctggcgttgaattaatct

SEQ ID NO: 393998 - DNA, 25 bp, Rattus norvegicus
gcccgatgcctcatttgaacctgtt

SEQ ID NO: 393999 - DNA, 25 bp, Rattus norvegicus
gcccgatgcctcttttgaacctgtt

SEQ ID NO: 394000 - DNA, 25 bp, Rattus norvegicus
gcccgatgtccacgcagacactgaa

SEQ ID NO: 394001 - DNA, 25 bp, Rattus norvegicus
gcccgatgtccaggcagacactgaa

SEQ ID NO: 394002 - DNA, 25 bp, Rattus norvegicus
gcccgatgtcgaagagtttgtctac

SEQ ID NO: 394003 - DNA, 25 bp, Rattus norvegicus
gcccgatgtcgatgagtttgtctac

SEQ ID NO: 394004 - DNA, 25 bp, Rattus norvegicus
gcccgattgtagatcccacagctgg

SEQ ID NO: 394005 - DNA, 25 bp, Rattus norvegicus
gcccgattgtagttcccacagctgg

SEQ ID NO: 394006 - DNA, 25 bp, Rattus norvegicus
gcccgcaatcttcctggcaagttta

SEQ ID NO: 394007 - DNA, 25 bp, Rattus norvegicus
gcccgcaatcttgctggcaagttta

SEQ ID NO: 394008 - DNA, 25 bp, Rattus norvegicus
gcccgcacacttagggacttttcta

SEQ ID NO: 394009 - DNA, 25 bp, Rattus norvegicus
gcccgcacactttgggacttttcta

SEQ ID NO: 394010 - DNA, 25 bp, Rattus norvegicus
gcccgcagacctagtatgagctgat

SEQ ID NO: 394011 - DNA, 25 bp, Rattus norvegicus
gcccgcagaccttgtatgagctgat

SEQ ID NO: 394012 - DNA, 25 bp, Rattus norvegicus
gcccgcaggctgcagctgtctagat

SEQ ID NO: 394013 - DNA, 25 bp, Rattus norvegicus
gcccgcaggctggagctgtctagat

SEQ ID NO: 394014 - DNA, 25 bp, Rattus norvegicus
gcccgcatcttccatggaattgcaa

SEQ ID NO: 394015 - DNA, 25 bp, Rattus norvegicus
gcccgcatcttcgatggaattgcaa

SEQ ID NO: 394016 - DNA, 25 bp, Rattus norvegicus
gcccgcatgcagatgtttctattct

SEQ ID NO: 394017 - DNA, 25 bp, Rattus norvegicus
gcccgcatgcagttgtttctattct

SEQ ID NO: 394018 - DNA, 25 bp, Rattus norvegicus
gcccgcatgggtcggaccgattaac

SEQ ID NO: 394019 - DNA, 25 bp, Rattus norvegicus
gcccgcatgggtgggaccgattaac

SEQ ID NO: 394020 - DNA, 25 bp, Rattus norvegicus
gcccgccaccttcctgggttgagga

SEQ ID NO: 394021 - DNA, 25 bp, Rattus norvegicus
gcccgccaccttgctgggttgagga

SEQ ID NO: 394022 - DNA, 25 bp, Rattus norvegicus
gcccgccagaacattgctttctgaa

SEQ ID NO: 394023 - DNA, 25 bp, Rattus norvegicus
gcccgccagaactttgctttctgaa

SEQ ID NO: 394024 - DNA, 25 bp, Rattus norvegicus
gcccgccatcacctgtatataagaa

SEQ ID NO: 394025 - DNA, 25 bp, Rattus norvegicus
gcccgccatcacgtgtatataagaa

SEQ ID NO: 394026 - DNA, 25 bp, Rattus norvegicus
gcccgccatgttagaatactgtcca

SEQ ID NO: 394027 - DNA, 25 bp, Rattus norvegicus
gcccgccatgtttgaatactgtcca

SEQ ID NO: 394028 - DNA, 25 bp, Rattus norvegicus
gcccgccctataccttgagtgtaat

SEQ ID NO: 394029 - DNA, 25 bp, Rattus norvegicus
gcccgccctatagcttgagtgtaat

SEQ ID NO: 394030 - DNA, 25 bp, Rattus norvegicus
gcccgccgcgccagaagacgtgagt

SEQ ID NO: 394031 - DNA, 25 bp, Rattus norvegicus
gcccgccgcgcctgaagacgtgagt

SEQ ID NO: 394032 - DNA, 25 bp, Rattus norvegicus
gcccgccgtcagaggaaacacattt

SEQ ID NO: 394033 - DNA, 25 bp, Rattus norvegicus
gcccgccgtcagtggaaacacattt

SEQ ID NO: 394034 - DNA, 25 bp, Rattus norvegicus
gcccgccgttgaaatgtcattctgc

SEQ ID NO: 394035 - DNA, 25 bp, Rattus norvegicus
gcccgccgttgatatgtcattctgc

SEQ ID NO: 394036 - DNA, 25 bp, Rattus norvegicus
gcccgcctcaagatcagtgatgtgg

SEQ ID NO: 394037 - DNA, 25 bp, Rattus norvegicus
gcccgcctcaagttcagtgatgtgg

SEQ ID NO: 394038 - DNA, 25 bp, Rattus norvegicus
gcccgcctcggcaactggtagagga

SEQ ID NO: 394039 - DNA, 25 bp, Rattus norvegicus
gcccgcctcggctactggtagagga

SEQ ID NO: 394040 - DNA, 25 bp, Rattus norvegicus
gcccgcctctgtagtctggaagaga

SEQ ID NO: 394041 - DNA, 25 bp, Rattus norvegicus
gcccgcctctgttgtctggaagaga

SEQ ID NO: 394042 - DNA, 25 bp, Rattus norvegicus
gcccgcgcatgccagaaaagttcgg

SEQ ID NO: 394043 - DNA, 25 bp, Rattus norvegicus
gcccgcgcatgcgagaaaagttcgg

SEQ ID NO: 394044 - DNA, 25 bp, Rattus norvegicus
gcccgcggtaggaggagacacacac

SEQ ID NO: 394045 - DNA, 25 bp, Rattus norvegicus
gcccgcggtaggtggagacacacac

SEQ ID NO: 394046 - DNA, 25 bp, Rattus norvegicus
gcccgcgtccgacaaggaacctgag

SEQ ID NO: 394047 - DNA, 25 bp, Rattus norvegicus
gcccgcgtccgagaaggaacctgag

SEQ ID NO: 394048 - DNA, 25 bp, Rattus norvegicus
gcccgctctcggattttgaaacaga

SEQ ID NO: 394049 - DNA, 25 bp, Rattus norvegicus
gcccgctctcggtttttgaaacaga

SEQ ID NO: 394050 - DNA, 25 bp, Rattus norvegicus
gcccgctctggtctgacttgtgtga

SEQ ID NO: 394051 - DNA, 25 bp, Rattus norvegicus
gcccgctctggtgtgacttgtgtga

SEQ ID NO: 394052 - DNA, 25 bp, Rattus norvegicus
gcccgctgacgcacaactgaaagag

SEQ ID NO: 394053 - DNA, 25 bp, Rattus norvegicus
gcccgctgacgctcaactgaaagag

SEQ ID NO: 394054 - DNA, 25 bp, Rattus norvegicus
gcccgcttcttgcagtaattccata

SEQ ID NO: 394055 - DNA, 25 bp, Rattus norvegicus
gcccgcttcttggagtaattccata

SEQ ID NO: 394056 - DNA, 25 bp, Rattus norvegicus
gcccggaaggctcatcagctacaga

SEQ ID NO: 394057 - DNA, 25 bp, Rattus norvegicus
gcccggaaggctgatcagctacaga

SEQ ID NO: 394058 - DNA, 25 bp, Rattus norvegicus
gcccggaatcagctatttttcagtt

SEQ ID NO: 394059 - DNA, 25 bp, Rattus norvegicus
gcccggaatcaggtatttttcagtt

SEQ ID NO: 394060 - DNA, 25 bp, Rattus norvegicus
gcccggaattgcaatctcacatgtg

SEQ ID NO: 394061 - DNA, 25 bp, Rattus norvegicus
gcccggaattgctatctcacatgtg

SEQ ID NO: 394062 - DNA, 25 bp, Rattus norvegicus
gcccggacacgcagagcgctcggat

SEQ ID NO: 394063 - DNA, 25 bp, Rattus norvegicus
gcccggacacgctgagcgctcggat

SEQ ID NO: 394064 - DNA, 25 bp, Rattus norvegicus
gcccggacgctcctgtcattagggt

SEQ ID NO: 394065 - DNA, 25 bp, Rattus norvegicus
gcccggacgctcgtgtcattagggt

SEQ ID NO: 394066 - DNA, 25 bp, Rattus norvegicus
gcccggactagcaggtggcagctca

SEQ ID NO: 394067 - DNA, 25 bp, Rattus norvegicus
gcccggactagctggtggcagctca

SEQ ID NO: 394068 - DNA, 25 bp, Rattus norvegicus
gcccggagacgaattcagcagcaaa

SEQ ID NO: 394069 - DNA, 25 bp, Rattus norvegicus
gcccggagacgatttcagcagcaaa

SEQ ID NO: 394070 - DNA, 25 bp, Rattus norvegicus
gcccggagccaaaccacttgacaag

SEQ ID NO: 394071 - DNA, 25 bp, Rattus norvegicus
gcccggagccaatccacttgacaag

SEQ ID NO: 394072 - DNA, 25 bp, Rattus norvegicus
gcccggagcgctcccgcttgtaagt

SEQ ID NO: 394073 - DNA, 25 bp, Rattus norvegicus
gcccggagcgctgccgcttgtaagt

SEQ ID NO: 394074 - DNA, 25 bp, Rattus norvegicus
gcccggaggaagaggcttccaaaca

SEQ ID NO: 394075 - DNA, 25 bp, Rattus norvegicus
gcccggaggaagtggcttccaaaca

SEQ ID NO: 394076 - DNA, 25 bp, Rattus norvegicus
gcccggaggcagacttcacaaggaa

SEQ ID NO: 394077 - DNA, 25 bp, Rattus norvegicus
gcccggaggcagtcttcacaaggaa

SEQ ID NO: 394078 - DNA, 25 bp, Rattus norvegicus
gcccggcaggcgacatggttccaga

SEQ ID NO: 394079 - DNA, 25 bp, Rattus norvegicus
gcccggcaggcgtcatggttccaga

SEQ ID NO: 394080 - DNA, 25 bp, Rattus norvegicus
gcccggcagtttctaggttcccttg

SEQ ID NO: 394081 - DNA, 25 bp, Rattus norvegicus
gcccggcagtttgtaggttcccttg

SEQ ID NO: 394082 - DNA, 25 bp, Rattus norvegicus
gcccggcattttccttcttatataa

SEQ ID NO: 394083 - DNA, 25 bp, Rattus norvegicus
gcccggcattttgcttcttatataa

SEQ ID NO: 394084 - DNA, 25 bp, Rattus norvegicus
gcccggccaaaccacattgagaagg

SEQ ID NO: 394085 - DNA, 25 bp, Rattus norvegicus
gcccggccaaacgacattgagaagg

SEQ ID NO: 394086 - DNA, 25 bp, Rattus norvegicus
gcccggctcaagattgacttccagg

SEQ ID NO: 394087 - DNA, 25 bp, Rattus norvegicus
gcccggctcaagtttgacttccagg

SEQ ID NO: 394088 - DNA, 25 bp, Rattus norvegicus
gcccggctcttgatcaagaaagtat

SEQ ID NO: 394089 - DNA, 25 bp, Rattus norvegicus
gcccggctcttgttcaagaaagtat

SEQ ID NO: 394090 - DNA, 25 bp, Rattus norvegicus
gcccggcttagcagggaaggtagaa

SEQ ID NO: 394091 - DNA, 25 bp, Rattus norvegicus
gcccggcttagctgggaaggtagaa

SEQ ID NO: 394092 - DNA, 25 bp, Rattus norvegicus
gcccggctttttcgaaggacaagca

SEQ ID NO: 394093 - DNA, 25 bp, Rattus norvegicus
gcccggctttttggaaggacaagca

SEQ ID NO: 394094 - DNA, 25 bp, Rattus norvegicus
gcccgggacccacagtatgcagaaa

SEQ ID NO: 394095 - DNA, 25 bp, Rattus norvegicus
gcccgggacccagagtatgcagaaa

SEQ ID NO: 394096 - DNA, 25 bp, Rattus norvegicus
gcccgggagtatcatgtccagtttt

SEQ ID NO: 394097 - DNA, 25 bp, Rattus norvegicus
gcccgggagtatgatgtccagtttt

SEQ ID NO: 394098 - DNA, 25 bp, Rattus norvegicus
gcccgggatgctagggtcccaaaga

SEQ ID NO: 394099 - DNA, 25 bp, Rattus norvegicus
gcccgggatgcttgggtcccaaaga

SEQ ID NO: 394100 - DNA, 25 bp, Rattus norvegicus
gcccgggcactcatgtggatggtaa

SEQ ID NO: 394101 - DNA, 25 bp, Rattus norvegicus
gcccgggcactcttgtggatggtaa

SEQ ID NO: 394102 - DNA, 25 bp, Rattus norvegicus
gcccgggccagtctcatcaagaaga

SEQ ID NO: 394103 - DNA, 25 bp, Rattus norvegicus
gcccgggccagtgtcatcaagaaga

SEQ ID NO: 394104 - DNA, 25 bp, Rattus norvegicus
gcccgggcctctactatgtagacag

SEQ ID NO: 394105 - DNA, 25 bp, Rattus norvegicus
gcccgggcctcttctatgtagacag

SEQ ID NO: 394106 - DNA, 25 bp, Rattus norvegicus
gcccgggctgctctttgagatcatg

SEQ ID NO: 394107 - DNA, 25 bp, Rattus norvegicus
gcccgggctgctgtttgagatcatg

SEQ ID NO: 394108 - DNA, 25 bp, Rattus norvegicus
gcccgggtaacgaaggagccataat

SEQ ID NO: 394109 - DNA, 25 bp, Rattus norvegicus
gcccgggtaacgtaggagccataat

SEQ ID NO: 394110 - DNA, 25 bp, Rattus norvegicus
gcccgggtcatcatcgagaagtact

SEQ ID NO: 394111 - DNA, 25 bp, Rattus norvegicus
gcccgggtcatcttcgagaagtact

SEQ ID NO: 394112 - DNA, 25 bp, Rattus norvegicus
gcccgggtgaccaacagtagcgtgt

SEQ ID NO: 394113 - DNA, 25 bp, Rattus norvegicus
gcccgggtgacctacagtagcgtgt

SEQ ID NO: 394114 - DNA, 25 bp, Rattus norvegicus
gcccgggttttgattacgagagcag

SEQ ID NO: 394115 - DNA, 25 bp, Rattus norvegicus
gcccgggttttgtttacgagagcag

SEQ ID NO: 394116 - DNA, 25 bp, Rattus norvegicus
gcccggtaaatcaccatttcagaaa

SEQ ID NO: 394117 - DNA, 25 bp, Rattus norvegicus
gcccggtaaatctccatttcagaaa

SEQ ID NO: 394118 - DNA, 25 bp, Rattus norvegicus
gcccggtactgacaaccgcctgggt

SEQ ID NO: 394119 - DNA, 25 bp, Rattus norvegicus
gcccggtactgagaaccgcctgggt

SEQ ID NO: 394120 - DNA, 25 bp, Rattus norvegicus
gcccggtacttcacgttctgaatga

SEQ ID NO: 394121 - DNA, 25 bp, Rattus norvegicus
gcccggtacttctcgttctgaatga

SEQ ID NO: 394122 - DNA, 25 bp, Rattus norvegicus
gcccggtccagtactccgctgaggt

SEQ ID NO: 394123 - DNA, 25 bp, Rattus norvegicus
gcccggtccagttctccgctgaggt

SEQ ID NO: 394124 - DNA, 25 bp, Rattus norvegicus
gcccggtgcctgagctatcaagagt

SEQ ID NO: 394125 - DNA, 25 bp, Rattus norvegicus
gcccggtgcctgtgctatcaagagt

SEQ ID NO: 394126 - DNA, 25 bp, Rattus norvegicus
gcccggtttaagcacaggtatccag

SEQ ID NO: 394127 - DNA, 25 bp, Rattus norvegicus
gcccggtttaaggacaggtatccag

SEQ ID NO: 394128 - DNA, 25 bp, Rattus norvegicus
gcccgtacagcgcagtcatgcgaat

SEQ ID NO: 394129 - DNA, 25 bp, Rattus norvegicus
gcccgtacagcggagtcatgcgaat

SEQ ID NO: 394130 - DNA, 25 bp, Rattus norvegicus
gcccgtatggacacaccgcgctggg

SEQ ID NO: 394131 - DNA, 25 bp, Rattus norvegicus
gcccgtatggactcaccgcgctggg

SEQ ID NO: 394132 - DNA, 25 bp, Rattus norvegicus
gcccgtatgggcaactatgagacag

SEQ ID NO: 394133 - DNA, 25 bp, Rattus norvegicus
gcccgtatgggctactatgagacag

SEQ ID NO: 394134 - DNA, 25 bp, Rattus norvegicus
gcccgtcaacacagctagtctataa

SEQ ID NO: 394135 - DNA, 25 bp, Rattus norvegicus
gcccgtcaacactgctagtctataa

SEQ ID NO: 394136 - DNA, 25 bp, Rattus norvegicus
gcccgtcacaaacagcttcaacagg

SEQ ID NO: 394137 - DNA, 25 bp, Rattus norvegicus
gcccgtcacaaagagcttcaacagg

SEQ ID NO: 394138 - DNA, 25 bp, Rattus norvegicus
gcccgtccctatcaaaccgttgtat

SEQ ID NO: 394139 - DNA, 25 bp, Rattus norvegicus
gcccgtccctatgaaaccgttgtat

SEQ ID NO: 394140 - DNA, 25 bp, Rattus norvegicus
gcccgtcttggcaataagtgtaaat

SEQ ID NO: 394141 - DNA, 25 bp, Rattus norvegicus
gcccgtcttggctataagtgtaaat

SEQ ID NO: 394142 - DNA, 25 bp, Rattus norvegicus
gcccgtcttgggaactatttaactg

SEQ ID NO: 394143 - DNA, 25 bp, Rattus norvegicus
gcccgtcttgggtactatttaactg

SEQ ID NO: 394144 - DNA, 25 bp, Rattus norvegicus
gcccgtgaacttcagagcatgtcat

SEQ ID NO: 394145 - DNA, 25 bp, Rattus norvegicus
gcccgtgaacttgagagcatgtcat

SEQ ID NO: 394146 - DNA, 25 bp, Rattus norvegicus
gcccgtgctgacaattttgctcaaa

SEQ ID NO: 394147 - DNA, 25 bp, Rattus norvegicus
gcccgtgctgacagctgaatgcgaa

SEQ ID NO: 394148 - DNA, 25 bp, Rattus norvegicus
gcccgtgctgactattttgctcaaa

SEQ ID NO: 394149 - DNA, 25 bp, Rattus norvegicus
gcccgtgctgactgctgaatgcgaa

SEQ ID NO: 394150 - DNA, 25 bp, Rattus norvegicus
gcccgtgctttgcaggcgctcgctt

SEQ ID NO: 394151 - DNA, 25 bp, Rattus norvegicus
gcccgtgctttggaggcgctcgctt

SEQ ID NO: 394152 - DNA, 25 bp, Rattus norvegicus
gcccgtgggcctcaaatctaactta

SEQ ID NO: 394153 - DNA, 25 bp, Rattus norvegicus
gcccgtgggcctgaaatctaactta

SEQ ID NO: 394154 - DNA, 25 bp, Rattus norvegicus
gcccgtgtcctcactgtcattaatc

SEQ ID NO: 394155 - DNA, 25 bp, Rattus norvegicus
gcccgtgtcctctctgtcattaatc

SEQ ID NO: 394156 - DNA, 25 bp, Rattus norvegicus
gcccgtgtgatgctggttaccatag

SEQ ID NO: 394157 - DNA, 25 bp, Rattus norvegicus
gcccgtgtgatggtggttaccatag

SEQ ID NO: 394158 - DNA, 25 bp, Rattus norvegicus
gcccgtttactcaagcttttctaca

SEQ ID NO: 394159 - DNA, 25 bp, Rattus norvegicus
gcccgtttactctagcttttctaca

SEQ ID NO: 394160 - DNA, 25 bp, Rattus norvegicus
gcccgtttcagtatagagcagttac

SEQ ID NO: 394161 - DNA, 25 bp, Rattus norvegicus
gcccgtttcagtttagagcagttac

SEQ ID NO: 394162 - DNA, 25 bp, Rattus norvegicus
gcccgttttcccaacataaagagat

SEQ ID NO: 394163 - DNA, 25 bp, Rattus norvegicus
gcccgttttccctacataaagagat

SEQ ID NO: 394164 - DNA, 25 bp, Rattus norvegicus
gcccgttttggtccatgttggtata

SEQ ID NO: 394165 - DNA, 25 bp, Rattus norvegicus
gcccgttttggtgcatgttggtata

SEQ ID NO: 394166 - DNA, 25 bp, Rattus norvegicus
gccctaaagctcagttttttgtgtc

SEQ ID NO: 394167 - DNA, 25 bp, Rattus norvegicus
gccctaaagctctgttttttgtgtc

SEQ ID NO: 394168 - DNA, 25 bp, Rattus norvegicus
gccctaagcttacagtgcacacctt

SEQ ID NO: 394169 - DNA, 25 bp, Rattus norvegicus
gccctaagcttagagtgcacacctt

SEQ ID NO: 394170 - DNA, 25 bp, Rattus norvegicus
gccctaagttcactgaccttcacaa

SEQ ID NO: 394171 - DNA, 25 bp, Rattus norvegicus
gccctaagttcagtgaccttcacaa

SEQ ID NO: 394172 - DNA, 25 bp, Rattus norvegicus
gccctaatagatcacgcagaccata

SEQ ID NO: 394173 - DNA, 25 bp, Rattus norvegicus
gccctaatagatgacgcagaccata

SEQ ID NO: 394174 - DNA, 25 bp, Rattus norvegicus
gccctaatgctgactcagttctgat

SEQ ID NO: 394175 - DNA, 25 bp, Rattus norvegicus
gccctaatgctgtctcagttctgat

SEQ ID NO: 394176 - DNA, 25 bp, Rattus norvegicus
gccctaatggccctaaatagagctc

SEQ ID NO: 394177 - DNA, 25 bp, Rattus norvegicus
gccctaatggccgtaaatagagctc

SEQ ID NO: 394178 - DNA, 25 bp, Rattus norvegicus
gccctacaaggcctagtctggaagt

SEQ ID NO: 394179 - DNA, 25 bp, Rattus norvegicus
gccctacaaggcgtagtctggaagt

SEQ ID NO: 394180 - DNA, 25 bp, Rattus norvegicus
gccctacaccctcaaggactatgat

SEQ ID NO: 394181 - DNA, 25 bp, Rattus norvegicus
gccctacaccctgaaggactatgat

SEQ ID NO: 394182 - DNA, 25 bp, Rattus norvegicus
gccctacagaaaaggacttcgaagt

SEQ ID NO: 394183 - DNA, 25 bp, Rattus norvegicus
gccctacagaaatggacttcgaagt

SEQ ID NO: 394184 - DNA, 25 bp, Rattus norvegicus
gccctacagaggatgttcgctgcct

SEQ ID NO: 394185 - DNA, 25 bp, Rattus norvegicus
gccctacagaggttgttcgctgcct

SEQ ID NO: 394186 - DNA, 25 bp, Rattus norvegicus
gccctacaggacactgccaggcaga

SEQ ID NO: 394187 - DNA, 25 bp, Rattus norvegicus
gccctacaggactctgccaggcaga

SEQ ID NO: 394188 - DNA, 25 bp, Rattus norvegicus
gccctacatggtctgatgctgcatt

SEQ ID NO: 394189 - DNA, 25 bp, Rattus norvegicus
gccctacatggtgtgatgctgcatt

SEQ ID NO: 394190 - DNA, 25 bp, Rattus norvegicus
gccctacctcatatacaagtcgtgg

SEQ ID NO: 394191 - DNA, 25 bp, Rattus norvegicus
gccctacctcatttacaagtcgtgg

SEQ ID NO: 394192 - DNA, 25 bp, Rattus norvegicus
gccctacctgctacgtgtgtaagaa

SEQ ID NO: 394193 - DNA, 25 bp, Rattus norvegicus
gccctacctgcttcgtgtgtaagaa

SEQ ID NO: 394194 - DNA, 25 bp, Rattus norvegicus
gccctaccttggcatttcaagcaat

SEQ ID NO: 394195 - DNA, 25 bp, Rattus norvegicus
gccctaccttgggatttcaagcaat

SEQ ID NO: 394196 - DNA, 25 bp, Rattus norvegicus
gccctacgggccataagacagacta

SEQ ID NO: 394197 - DNA, 25 bp, Rattus norvegicus
gccctacgggccttaagacagacta

SEQ ID NO: 394198 - DNA, 25 bp, Rattus norvegicus
gccctactaggtcctggtttgctaa

SEQ ID NO: 394199 - DNA, 25 bp, Rattus norvegicus
gccctactaggtgctggtttgctaa

SEQ ID NO: 394200 - DNA, 25 bp, Rattus norvegicus
gccctactctaaccgttctgaggta

SEQ ID NO: 394201 - DNA, 25 bp, Rattus norvegicus
gccctactctaagcgttctgaggta

SEQ ID NO: 394202 - DNA, 25 bp, Rattus norvegicus
gccctactcttcctcattaagtttt

SEQ ID NO: 394203 - DNA, 25 bp, Rattus norvegicus
gccctactcttcgtcattaagtttt

SEQ ID NO: 394204 - DNA, 25 bp, Rattus norvegicus
gccctactgtgtatttatgttcctg

SEQ ID NO: 394205 - DNA, 25 bp, Rattus norvegicus
gccctactgtgtttttatgttcctg

SEQ ID NO: 394206 - DNA, 25 bp, Rattus norvegicus
gccctagactcaatggccagtttta

SEQ ID NO: 394207 - DNA, 25 bp, Rattus norvegicus
gccctagactcattggccagtttta

SEQ ID NO: 394208 - DNA, 25 bp, Rattus norvegicus
gccctagagtggctggtccttagaa

SEQ ID NO: 394209 - DNA, 25 bp, Rattus norvegicus
gccctagagtgggtggtccttagaa

SEQ ID NO: 394210 - DNA, 25 bp, Rattus norvegicus
gccctagatggccaccttagtagat

SEQ ID NO: 394211 - DNA, 25 bp, Rattus norvegicus
gccctagatggcgaccttagtagat

SEQ ID NO: 394212 - DNA, 25 bp, Rattus norvegicus
gccctagccctacttcaaatggtga

SEQ ID NO: 394213 - DNA, 25 bp, Rattus norvegicus
gccctagccctagttcaaatggtga

SEQ ID NO: 394214 - DNA, 25 bp, Rattus norvegicus
gccctaggtctcctttagatcagag

SEQ ID NO: 394215 - DNA, 25 bp, Rattus norvegicus
gccctaggtctcgtttagatcagag

SEQ ID NO: 394216 - DNA, 25 bp, Rattus norvegicus
gccctaggtgggaaaagcagagata

SEQ ID NO: 394217 - DNA, 25 bp, Rattus norvegicus
gccctaggtgggtaaagcagagata

SEQ ID NO: 394218 - DNA, 25 bp, Rattus norvegicus
gccctagtccctcggcagagaacag

SEQ ID NO: 394219 - DNA, 25 bp, Rattus norvegicus
gccctagtccctgggcagagaacag

SEQ ID NO: 394220 - DNA, 25 bp, Rattus norvegicus
gccctagtcttgaggttttgtgtgt

SEQ ID NO: 394221 - DNA, 25 bp, Rattus norvegicus
gccctagtcttgtggttttgtgtgt

SEQ ID NO: 394222 - DNA, 25 bp, Rattus norvegicus
gccctataagtgctgcccagtgttt

SEQ ID NO: 394223 - DNA, 25 bp, Rattus norvegicus
gccctataagtggtgcccagtgttt

SEQ ID NO: 394224 - DNA, 25 bp, Rattus norvegicus
gccctatactttctttgcatgcttt

SEQ ID NO: 394225 - DNA, 25 bp, Rattus norvegicus
gccctatactttgtttgcatgcttt

SEQ ID NO: 394226 - DNA, 25 bp, Rattus norvegicus
gccctatatggaatctaattttgta

SEQ ID NO: 394227 - DNA, 25 bp, Rattus norvegicus
gccctatatggattctaattttgta

SEQ ID NO: 394228 - DNA, 25 bp, Rattus norvegicus
gccctatcaaagaatcgtaccctga

SEQ ID NO: 394229 - DNA, 25 bp, Rattus norvegicus
gccctatcaaagtatcgtaccctga

SEQ ID NO: 394230 - DNA, 25 bp, Rattus norvegicus
gccctatcccctcagattttgaaag

SEQ ID NO: 394231 - DNA, 25 bp, Rattus norvegicus
gccctatcccctgagattttgaaag

SEQ ID NO: 394232 - DNA, 25 bp, Rattus norvegicus
gccctatccctgacaataaaactct

SEQ ID NO: 394233 - DNA, 25 bp, Rattus norvegicus
gccctatccctgtcaataaaactct

SEQ ID NO: 394234 - DNA, 25 bp, Rattus norvegicus
gccctatccgctacctaagaagaat

SEQ ID NO: 394235 - DNA, 25 bp, Rattus norvegicus
gccctatccgcttcctaagaagaat

SEQ ID NO: 394236 - DNA, 25 bp, Rattus norvegicus
gccctatctgagacttgcaaacacg

SEQ ID NO: 394237 - DNA, 25 bp, Rattus norvegicus
gccctatctgagtcttgcaaacacg

SEQ ID NO: 394238 - DNA, 25 bp, Rattus norvegicus
gccctatgcacaattctgcttggaa

SEQ ID NO: 394239 - DNA, 25 bp, Rattus norvegicus
gccctatgcacatttctgcttggaa

SEQ ID NO: 394240 - DNA, 25 bp, Rattus norvegicus
gccctatgcactatttttccttcct

SEQ ID NO: 394241 - DNA, 25 bp, Rattus norvegicus
gccctatgcactttttttccttcct

SEQ ID NO: 394242 - DNA, 25 bp, Rattus norvegicus
gccctatgcccgatatttctaatga

SEQ ID NO: 394243 - DNA, 25 bp, Rattus norvegicus
gccctatgcccgttatttctaatga

SEQ ID NO: 394244 - DNA, 25 bp, Rattus norvegicus
gccctatggatgctgtcccaaacaa

SEQ ID NO: 394245 - DNA, 25 bp, Rattus norvegicus
gccctatggatggtgtcccaaacaa

SEQ ID NO: 394246 - DNA, 25 bp, Rattus norvegicus
gccctatgtggtagcatctgatttt

SEQ ID NO: 394247 - DNA, 25 bp, Rattus norvegicus
gccctatgtggttgcatctgatttt

SEQ ID NO: 394248 - DNA, 25 bp, Rattus norvegicus
gccctattggatacccgctgtgtga

SEQ ID NO: 394249 - DNA, 25 bp, Rattus norvegicus
gccctattggattcccgctgtgtga

SEQ ID NO: 394250 - DNA, 25 bp, Rattus norvegicus
gccctcaaacgaaacctttcttgtt

SEQ ID NO: 394251 - DNA, 25 bp, Rattus norvegicus
gccctcaaacgatacctttcttgtt

SEQ ID NO: 394252 - DNA, 25 bp, Rattus norvegicus
gccctcaacaggaagccatgctgaa

SEQ ID NO: 394253 - DNA, 25 bp, Rattus norvegicus
gccctcaacaggtagccatgctgaa

SEQ ID NO: 394254 - DNA, 25 bp, Rattus norvegicus
gccctcaacggcatctgtttataaa

SEQ ID NO: 394255 - DNA, 25 bp, Rattus norvegicus
gccctcaacggcttctgtttataaa

SEQ ID NO: 394256 - DNA, 25 bp, Rattus norvegicus
gccctcaagcacagacctgaaagta

SEQ ID NO: 394257 - DNA, 25 bp, Rattus norvegicus
gccctcaagcactgacctgaaagta

SEQ ID NO: 394258 - DNA, 25 bp, Rattus norvegicus
gccctcaagtgcctttctgattaaa

SEQ ID NO: 394259 - DNA, 25 bp, Rattus norvegicus
gccctcaagtgcgtttctgattaaa

SEQ ID NO: 394260 - DNA, 25 bp, Rattus norvegicus
gccctcacacgtacacgtttaagtt

SEQ ID NO: 394261 - DNA, 25 bp, Rattus norvegicus
gccctcacacgttcacgtttaagtt

SEQ ID NO: 394262 - DNA, 25 bp, Rattus norvegicus
gccctcacagccacaggaatctata

SEQ ID NO: 394263 - DNA, 25 bp, Rattus norvegicus
gccctcacagcctcaggaatctata

SEQ ID NO: 394264 - DNA, 25 bp, Rattus norvegicus
gccctcacattcaaggatgctgatc

SEQ ID NO: 394265 - DNA, 25 bp, Rattus norvegicus
gccctcacattctaggatgctgatc

SEQ ID NO: 394266 - DNA, 25 bp, Rattus norvegicus
gccctcacctgacttgtacattttt

SEQ ID NO: 394267 - DNA, 25 bp, Rattus norvegicus
gccctcacctgagttgtacattttt

SEQ ID NO: 394268 - DNA, 25 bp, Rattus norvegicus
gccctcacggaacagatgctgctga

SEQ ID NO: 394269 - DNA, 25 bp, Rattus norvegicus
gccctcacggaagagatgctgctga

SEQ ID NO: 394270 - DNA, 25 bp, Rattus norvegicus
gccctcactaagattcctctagaga

SEQ ID NO: 394271 - DNA, 25 bp, Rattus norvegicus
gccctcactaagtttcctctagaga

SEQ ID NO: 394272 - DNA, 25 bp, Rattus norvegicus
gccctcactctgacaagtctgggaa

SEQ ID NO: 394273 - DNA, 25 bp, Rattus norvegicus
gccctcactctgtcaagtctgggaa

SEQ ID NO: 394274 - DNA, 25 bp, Rattus norvegicus
gccctcacttccaggctgaaacaaa

SEQ ID NO: 394275 - DNA, 25 bp, Rattus norvegicus
gccctcacttcctggctgaaacaaa

SEQ ID NO: 394276 - DNA, 25 bp, Rattus norvegicus
gccctcagagggaagcacatttatg

SEQ ID NO: 394277 - DNA, 25 bp, Rattus norvegicus
gccctcagagggtagcacatttatg

SEQ ID NO: 394278 - DNA, 25 bp, Rattus norvegicus
gccctcagcaggatagaagttgcca

SEQ ID NO: 394279 - DNA, 25 bp, Rattus norvegicus
gccctcagcaggttagaagttgcca

SEQ ID NO: 394280 - DNA, 25 bp, Rattus norvegicus
gccctcagcctgcaacatgatgtga

SEQ ID NO: 394281 - DNA, 25 bp, Rattus norvegicus
gccctcagcctggaacatgatgtga

SEQ ID NO: 394282 - DNA, 25 bp, Rattus norvegicus
gccctcaggagaaaagcaaacaatc

SEQ ID NO: 394283 - DNA, 25 bp, Rattus norvegicus
gccctcaggagataagcaaacaatc

SEQ ID NO: 394284 - DNA, 25 bp, Rattus norvegicus
gccctcagggtacacgatagccaga

SEQ ID NO: 394285 - DNA, 25 bp, Rattus norvegicus
gccctcagggtagacgatagccaga

SEQ ID NO: 394286 - DNA, 25 bp, Rattus norvegicus
gccctcaggtgtaaataatttccgg

SEQ ID NO: 394287 - DNA, 25 bp, Rattus norvegicus
gccctcaggtgttaataatttccgg

SEQ ID NO: 394288 - DNA, 25 bp, Rattus norvegicus
gccctcagtgagcaatttgccttct

SEQ ID NO: 394289 - DNA, 25 bp, Rattus norvegicus
gccctcagtgaggaatttgccttct

SEQ ID NO: 394290 - DNA, 25 bp, Rattus norvegicus
gccctcatggctactttgtgtgtga

SEQ ID NO: 394291 - DNA, 25 bp, Rattus norvegicus
gccctcatggcttctttgtgtgtga

SEQ ID NO: 394292 - DNA, 25 bp, Rattus norvegicus
gccctcattaggattgctgctataa

SEQ ID NO: 394293 - DNA, 25 bp, Rattus norvegicus
gccctcattaggtttgctgctataa

SEQ ID NO: 394294 - DNA, 25 bp, Rattus norvegicus
gccctcattgtacctgtaactacta

SEQ ID NO: 394295 - DNA, 25 bp, Rattus norvegicus
gccctcattgtagctgtaactacta

SEQ ID NO: 394296 - DNA, 25 bp, Rattus norvegicus
gccctcattgtgcttggcttcgcaa

SEQ ID NO: 394297 - DNA, 25 bp, Rattus norvegicus
gccctcattgtggttggcttcgcaa

SEQ ID NO: 394298 - DNA, 25 bp, Rattus norvegicus
gccctccaagaccttgggtcagtta

SEQ ID NO: 394299 - DNA, 25 bp, Rattus norvegicus
gccctccaagacgttgggtcagtta

SEQ ID NO: 394300 - DNA, 25 bp, Rattus norvegicus
gccctccaccttatgttaggttgtg

SEQ ID NO: 394301 - DNA, 25 bp, Rattus norvegicus
gccctccaccttttgttaggttgtg

SEQ ID NO: 394302 - DNA, 25 bp, Rattus norvegicus
gccctccagattatgtagacgtttt

SEQ ID NO: 394303 - DNA, 25 bp, Rattus norvegicus
gccctccagattttgtagacgtttt

SEQ ID NO: 394304 - DNA, 25 bp, Rattus norvegicus
gccctccagcagagatgtgactttg

SEQ ID NO: 394305 - DNA, 25 bp, Rattus norvegicus
gccctccagcagtgatgtgactttg

SEQ ID NO: 394306 - DNA, 25 bp, Rattus norvegicus
gccctccagtttcaaacctgaaaag

SEQ ID NO: 394307 - DNA, 25 bp, Rattus norvegicus
gccctccagtttgaaacctgaaaag

SEQ ID NO: 394308 - DNA, 25 bp, Rattus norvegicus
gccctccatactcttactgacaaat

SEQ ID NO: 394309 - DNA, 25 bp, Rattus norvegicus
gccctccatactgttactgacaaat

SEQ ID NO: 394310 - DNA, 25 bp, Rattus norvegicus
gccctccatgccattaataaacttg

SEQ ID NO: 394311 - DNA, 25 bp, Rattus norvegicus
gccctccatgcctttaataaacttg

SEQ ID NO: 394312 - DNA, 25 bp, Rattus norvegicus
gccctcccacaaacaatcattaaaa

SEQ ID NO: 394313 - DNA, 25 bp, Rattus norvegicus
gccctcccacaatcaatcattaaaa

SEQ ID NO: 394314 - DNA, 25 bp, Rattus norvegicus
gccctcccacataaatcattagaca

SEQ ID NO: 394315 - DNA, 25 bp, Rattus norvegicus
gccctcccacattaatcattagaca

SEQ ID NO: 394316 - DNA, 25 bp, Rattus norvegicus
gccctcccagagcactgaagttcaa

SEQ ID NO: 394317 - DNA, 25 bp, Rattus norvegicus
gccctcccagaggactgaagttcaa

SEQ ID NO: 394318 - DNA, 25 bp, Rattus norvegicus
gccctccccaagatagtatcaatgg

SEQ ID NO: 394319 - DNA, 25 bp, Rattus norvegicus
gccctccccaagttagtatcaatgg

SEQ ID NO: 394320 - DNA, 25 bp, Rattus norvegicus
gccctccccttcagcaaaggaggaa

SEQ ID NO: 394321 - DNA, 25 bp, Rattus norvegicus
gccctccccttctgcaaaggaggaa

SEQ ID NO: 394322 - DNA, 25 bp, Rattus norvegicus
gccctccctgggacacttgtaagta

SEQ ID NO: 394323 - DNA, 25 bp, Rattus norvegicus
gccctccctgggtcacttgtaagta

SEQ ID NO: 394324 - DNA, 25 bp, Rattus norvegicus
gccctccgtgctctagccaatataa

SEQ ID NO: 394325 - DNA, 25 bp, Rattus norvegicus
gccctccgtgctgtagccaatataa

SEQ ID NO: 394326 - DNA, 25 bp, Rattus norvegicus
gccctcctagcaagttatattttgt

SEQ ID NO: 394327 - DNA, 25 bp, Rattus norvegicus
gccctcctagcatgttatattttgt

SEQ ID NO: 394328 - DNA, 25 bp, Rattus norvegicus
gccctcctaggacaagttcttccat

SEQ ID NO: 394329 - DNA, 25 bp, Rattus norvegicus
gccctcctaggagaagttcttccat

SEQ ID NO: 394330 - DNA, 25 bp, Rattus norvegicus
gccctcctcgtcatgtatttgttta

SEQ ID NO: 394331 - DNA, 25 bp, Rattus norvegicus
gccctcctcgtcttgtatttgttta

SEQ ID NO: 394332 - DNA, 25 bp, Rattus norvegicus
gccctcctctgaagattatccctga

SEQ ID NO: 394333 - DNA, 25 bp, Rattus norvegicus
gccctcctctgatgattatccctga

SEQ ID NO: 394334 - DNA, 25 bp, Rattus norvegicus
gccctcctgacgaatcagcctggaa

SEQ ID NO: 394335 - DNA, 25 bp, Rattus norvegicus
gccctcctgacgtatcagcctggaa

SEQ ID NO: 394336 - DNA, 25 bp, Rattus norvegicus
gccctcctgcatatgtgtattgaca

SEQ ID NO: 394337 - DNA, 25 bp, Rattus norvegicus
gccctcctgcatttgtgtattgaca

SEQ ID NO: 394338 - DNA, 25 bp, Rattus norvegicus
gccctcctggagcacaaggactagg

SEQ ID NO: 394339 - DNA, 25 bp, Rattus norvegicus
gccctcctggaggacaaggactagg

SEQ ID NO: 394340 - DNA, 25 bp, Rattus norvegicus
gccctccttggaatgcagtgttaat

SEQ ID NO: 394341 - DNA, 25 bp, Rattus norvegicus
gccctccttggattgcagtgttaat

SEQ ID NO: 394342 - DNA, 25 bp, Rattus norvegicus
gccctcgacgggaagctcaagcatg

SEQ ID NO: 394343 - DNA, 25 bp, Rattus norvegicus
gccctcgacgggtagctcaagcatg

SEQ ID NO: 394344 - DNA, 25 bp, Rattus norvegicus
gccctcgagcctcgatctcaaatgt

SEQ ID NO: 394345 - DNA, 25 bp, Rattus norvegicus
gccctcgagcctggatctcaaatgt

SEQ ID NO: 394346 - DNA, 25 bp, Rattus norvegicus
gccctcgaggctcttttggaaacca

SEQ ID NO: 394347 - DNA, 25 bp, Rattus norvegicus
gccctcgaggctgttttggaaacca

SEQ ID NO: 394348 - DNA, 25 bp, Rattus norvegicus
gccctcgcagagcacattgcttttg

SEQ ID NO: 394349 - DNA, 25 bp, Rattus norvegicus
gccctcgcagaggacattgcttttg

SEQ ID NO: 394350 - DNA, 25 bp, Rattus norvegicus
gccctcgcagcaactgtatattgga

SEQ ID NO: 394351 - DNA, 25 bp, Rattus norvegicus
gccctcgcagcatctgtatattgga

SEQ ID NO: 394352 - DNA, 25 bp, Rattus norvegicus
gccctcgcgcggacaggtggaggag

SEQ ID NO: 394353 - DNA, 25 bp, Rattus norvegicus
gccctcgcgcggtcaggtggaggag

SEQ ID NO: 394354 - DNA, 25 bp, Rattus norvegicus
gccctcgctcaaagatgagcggcgg

SEQ ID NO: 394355 - DNA, 25 bp, Rattus norvegicus
gccctcgctcaatgatgagcggcgg

SEQ ID NO: 394356 - DNA, 25 bp, Rattus norvegicus
gccctcgctttgacttcaagactaa

SEQ ID NO: 394357 - DNA, 25 bp, Rattus norvegicus
gccctcgctttgtcttcaagactaa

SEQ ID NO: 394358 - DNA, 25 bp, Rattus norvegicus
gccctcgtcatgaaagagcgctgag

SEQ ID NO: 394359 - DNA, 25 bp, Rattus norvegicus
gccctcgtcatgtaagagcgctgag

SEQ ID NO: 394360 - DNA, 25 bp, Rattus norvegicus
gccctctaaagtctgcttgtgttgt

SEQ ID NO: 394361 - DNA, 25 bp, Rattus norvegicus
gccctctaaagtgtgcttgtgttgt

SEQ ID NO: 394362 - DNA, 25 bp, Rattus norvegicus
gccctctacaggcactgcacagaaa

SEQ ID NO: 394363 - DNA, 25 bp, Rattus norvegicus
gccctctacaggcatgacttcagga

SEQ ID NO: 394364 - DNA, 25 bp, Rattus norvegicus
gccctctacagggactgcacagaaa

SEQ ID NO: 394365 - DNA, 25 bp, Rattus norvegicus
gccctctacagggatgacttcagga

SEQ ID NO: 394366 - DNA, 25 bp, Rattus norvegicus
gccctctactttcagtgcggtgtga

SEQ ID NO: 394367 - DNA, 25 bp, Rattus norvegicus
gccctctactttgagtgcggtgtga

SEQ ID NO: 394368 - DNA, 25 bp, Rattus norvegicus
gccctctatctaccgtattctagaa

SEQ ID NO: 394369 - DNA, 25 bp, Rattus norvegicus
gccctctatctagcgtattctagaa

SEQ ID NO: 394370 - DNA, 25 bp, Rattus norvegicus
gccctctcccttctttgtagaatta

SEQ ID NO: 394371 - DNA, 25 bp, Rattus norvegicus
gccctctcccttgtttgtagaatta

SEQ ID NO: 394372 - DNA, 25 bp, Rattus norvegicus
gccctctctagtcgccagtctggaa

SEQ ID NO: 394373 - DNA, 25 bp, Rattus norvegicus
gccctctctagtggccagtctggaa

SEQ ID NO: 394374 - DNA, 25 bp, Rattus norvegicus
gccctctctgcactcttagtctaag

SEQ ID NO: 394375 - DNA, 25 bp, Rattus norvegicus
gccctctctgcagtcttagtctaag

SEQ ID NO: 394376 - DNA, 25 bp, Rattus norvegicus
gccctctctggtaatttatttctct

SEQ ID NO: 394377 - DNA, 25 bp, Rattus norvegicus
gccctctctggttatttatttctct

SEQ ID NO: 394378 - DNA, 25 bp, Rattus norvegicus
gccctctgagcaataagtcttccaa

SEQ ID NO: 394379 - DNA, 25 bp, Rattus norvegicus
gccctctgagcattaagtcttccaa

SEQ ID NO: 394380 - DNA, 25 bp, Rattus norvegicus
gccctctgatggctaagcctcatag

SEQ ID NO: 394381 - DNA, 25 bp, Rattus norvegicus
gccctctgatgggtaagcctcatag

SEQ ID NO: 394382 - DNA, 25 bp, Rattus norvegicus
gccctctgatttctaggctttactg

SEQ ID NO: 394383 - DNA, 25 bp, Rattus norvegicus
gccctctgatttgtaggctttactg

SEQ ID NO: 394384 - DNA, 25 bp, Rattus norvegicus
gccctctgctgtacttctggagaag

SEQ ID NO: 394385 - DNA, 25 bp, Rattus norvegicus
gccctctgctgttcttctggagaag

SEQ ID NO: 394386 - DNA, 25 bp, Rattus norvegicus
gccctctgtaaacacaaagccctgt

SEQ ID NO: 394387 - DNA, 25 bp, Rattus norvegicus
gccctctgtaaacctctaacacgga

SEQ ID NO: 394388 - DNA, 25 bp, Rattus norvegicus
gccctctgtaaagacaaagccctgt

SEQ ID NO: 394389 - DNA, 25 bp, Rattus norvegicus
gccctctgtaaagctctaacacgga

SEQ ID NO: 394390 - DNA, 25 bp, Rattus norvegicus
gccctctgtaacaacagttccaggg

SEQ ID NO: 394391 - DNA, 25 bp, Rattus norvegicus
gccctctgtaactacagttccaggg

SEQ ID NO: 394392 - DNA, 25 bp, Rattus norvegicus
gccctctgtaggaacttcttggttt

SEQ ID NO: 394393 - DNA, 25 bp, Rattus norvegicus
gccctctgtaggtacttcttggttt

SEQ ID NO: 394394 - DNA, 25 bp, Rattus norvegicus
gccctcttaagaactgactgccaaa

SEQ ID NO: 394395 - DNA, 25 bp, Rattus norvegicus
gccctcttaagatctgactgccaaa

SEQ ID NO: 394396 - DNA, 25 bp, Rattus norvegicus
gccctcttaggtcccgatgtacaat

SEQ ID NO: 394397 - DNA, 25 bp, Rattus norvegicus
gccctcttaggtcctggttcagaga

SEQ ID NO: 394398 - DNA, 25 bp, Rattus norvegicus
gccctcttaggtgccgatgtacaat

SEQ ID NO: 394399 - DNA, 25 bp, Rattus norvegicus
gccctcttaggtgctggttcagaga

SEQ ID NO: 394400 - DNA, 25 bp, Rattus norvegicus
gccctcttctagctgcaaagcaaat

SEQ ID NO: 394401 - DNA, 25 bp, Rattus norvegicus
gccctcttctaggtgcaaagcaaat

SEQ ID NO: 394402 - DNA, 25 bp, Rattus norvegicus
gccctcttcttgagttcttgacttg

SEQ ID NO: 394403 - DNA, 25 bp, Rattus norvegicus
gccctcttcttgtgttcttgacttg

SEQ ID NO: 394404 - DNA, 25 bp, Rattus norvegicus
gccctcttgctactgtaattgtaaa

SEQ ID NO: 394405 - DNA, 25 bp, Rattus norvegicus
gccctcttgctagtgtaattgtaaa

SEQ ID NO: 394406 - DNA, 25 bp, Rattus norvegicus
gccctcttgggacagaacattgcat

SEQ ID NO: 394407 - DNA, 25 bp, Rattus norvegicus
gccctcttgggagagaacattgcat

SEQ ID NO: 394408 - DNA, 25 bp, Rattus norvegicus
gccctctttcaaacagactgctcat

SEQ ID NO: 394409 - DNA, 25 bp, Rattus norvegicus
gccctctttcaatcagactgctcat

SEQ ID NO: 394410 - DNA, 25 bp, Rattus norvegicus
gccctctttctgatacctgtagaag

SEQ ID NO: 394411 - DNA, 25 bp, Rattus norvegicus
gccctctttctgttacctgtagaag

SEQ ID NO: 394412 - DNA, 25 bp, Rattus norvegicus
gccctcttttggcagagtctggaat

SEQ ID NO: 394413 - DNA, 25 bp, Rattus norvegicus
gccctcttttgggagagtctggaat

SEQ ID NO: 394414 - DNA, 25 bp, Rattus norvegicus
gccctctttttacttctagcacgtg

SEQ ID NO: 394415 - DNA, 25 bp, Rattus norvegicus
gccctctttttagttctagcacgtg

SEQ ID NO: 394416 - DNA, 25 bp, Rattus norvegicus
gccctgaacctgctgcacaagaaga

SEQ ID NO: 394417 - DNA, 25 bp, Rattus norvegicus
gccctgaacctggtgcacaagaaga

SEQ ID NO: 394418 - DNA, 25 bp, Rattus norvegicus
gccctgaactctcaagccggaaaac

SEQ ID NO: 394419 - DNA, 25 bp, Rattus norvegicus
gccctgaactctgaagccggaaaac

SEQ ID NO: 394420 - DNA, 25 bp, Rattus norvegicus
gccctgaactttaacatccacatta

SEQ ID NO: 394421 - DNA, 25 bp, Rattus norvegicus
gccctgaacttttacatccacatta

SEQ ID NO: 394422 - DNA, 25 bp, Rattus norvegicus
gccctgaaggatctcatgcagtttc

SEQ ID NO: 394423 - DNA, 25 bp, Rattus norvegicus
gccctgaaggatgtcatgcagtttc

SEQ ID NO: 394424 - DNA, 25 bp, Rattus norvegicus
gccctgaagggacactgtattctgt

SEQ ID NO: 394425 - DNA, 25 bp, Rattus norvegicus
gccctgaagggagactgtattctgt

SEQ ID NO: 394426 - DNA, 25 bp, Rattus norvegicus
gccctgaagggcatgtacagtcgtg

SEQ ID NO: 394427 - DNA, 25 bp, Rattus norvegicus
gccctgaagggcttgtacagtcgtg

SEQ ID NO: 394428 - DNA, 25 bp, Rattus norvegicus
gccctgaaggttctttttgaaagca

SEQ ID NO: 394429 - DNA, 25 bp, Rattus norvegicus
gccctgaaggttgtttttgaaagca

SEQ ID NO: 394430 - DNA, 25 bp, Rattus norvegicus
gccctgaatgcacctcttttgatta

SEQ ID NO: 394431 - DNA, 25 bp, Rattus norvegicus
gccctgaatgcagctcttttgatta

SEQ ID NO: 394432 - DNA, 25 bp, Rattus norvegicus
gccctgaatgtcagtgtccaattat

SEQ ID NO: 394433 - DNA, 25 bp, Rattus norvegicus
gccctgaatgtctgtgtccaattat

SEQ ID NO: 394434 - DNA, 25 bp, Rattus norvegicus
gccctgacaaatatccacagatgta

SEQ ID NO: 394435 - DNA, 25 bp, Rattus norvegicus
gccctgacaaatttccacagatgta

SEQ ID NO: 394436 - DNA, 25 bp, Rattus norvegicus
gccctgacaaccctgtaaggatatg

SEQ ID NO: 394437 - DNA, 25 bp, Rattus norvegicus
gccctgacaaccgtgtaaggatatg

SEQ ID NO: 394438 - DNA, 25 bp, Rattus norvegicus
gccctgacaatgaatttcttgcaga

SEQ ID NO: 394439 - DNA, 25 bp, Rattus norvegicus
gccctgacaatgtatttcttgcaga

SEQ ID NO: 394440 - DNA, 25 bp, Rattus norvegicus
gccctgacagacaatgtattcactt

SEQ ID NO: 394441 - DNA, 25 bp, Rattus norvegicus
gccctgacagactatgtattcactt

SEQ ID NO: 394442 - DNA, 25 bp, Rattus norvegicus
gccctgaccaacctaagacgatcga

SEQ ID NO: 394443 - DNA, 25 bp, Rattus norvegicus
gccctgaccaacgtaagacgatcga

SEQ ID NO: 394444 - DNA, 25 bp, Rattus norvegicus
gccctgactgacagggtttagtctt

SEQ ID NO: 394445 - DNA, 25 bp, Rattus norvegicus
gccctgactgactgggtttagtctt

SEQ ID NO: 394446 - DNA, 25 bp, Rattus norvegicus
gccctgactggcatagagttcacta

SEQ ID NO: 394447 - DNA, 25 bp, Rattus norvegicus
gccctgactggcttagagttcacta

SEQ ID NO: 394448 - DNA, 25 bp, Rattus norvegicus
gccctgagaacactgaggtctgatt

SEQ ID NO: 394449 - DNA, 25 bp, Rattus norvegicus
gccctgagaacagtgaggtctgatt

SEQ ID NO: 394450 - DNA, 25 bp, Rattus norvegicus
gccctgagaggtatgctccctggga

SEQ ID NO: 394451 - DNA, 25 bp, Rattus norvegicus
gccctgagaggtttgctccctggga

SEQ ID NO: 394452 - DNA, 25 bp, Rattus norvegicus
gccctgagccacataaacacaaagc

SEQ ID NO: 394453 - DNA, 25 bp, Rattus norvegicus
gccctgagccacttaaacacaaagc

SEQ ID NO: 394454 - DNA, 25 bp, Rattus norvegicus
gccctgagcccgcagcgattgtttg

SEQ ID NO: 394455 - DNA, 25 bp, Rattus norvegicus
gccctgagcccggagcgattgtttg

SEQ ID NO: 394456 - DNA, 25 bp, Rattus norvegicus
gccctgagctggacctattggttga

SEQ ID NO: 394457 - DNA, 25 bp, Rattus norvegicus
gccctgagctggtcctattggttga

SEQ ID NO: 394458 - DNA, 25 bp, Rattus norvegicus
gccctgaggaagcagcagtgccact

SEQ ID NO: 394459 - DNA, 25 bp, Rattus norvegicus
gccctgaggaaggagcagtgccact

SEQ ID NO: 394460 - DNA, 25 bp, Rattus norvegicus
gccctgagtgtcctggaagctttaa

SEQ ID NO: 394461 - DNA, 25 bp, Rattus norvegicus
gccctgagtgtcgtggaagctttaa

SEQ ID NO: 394462 - DNA, 25 bp, Rattus norvegicus
gccctgagttagcttctatgattca

SEQ ID NO: 394463 - DNA, 25 bp, Rattus norvegicus
gccctgagttaggttctatgattca

SEQ ID NO: 394464 - DNA, 25 bp, Rattus norvegicus
gccctgatctgtatttgtctaactt

SEQ ID NO: 394465 - DNA, 25 bp, Rattus norvegicus
gccctgatctgtttttgtctaactt

SEQ ID NO: 394466 - DNA, 25 bp, Rattus norvegicus
gccctgatgatgataccaagcccgg

SEQ ID NO: 394467 - DNA, 25 bp, Rattus norvegicus
gccctgatgatgttaccaagcccgg

SEQ ID NO: 394468 - DNA, 25 bp, Rattus norvegicus
gccctgcaaacaattctacgctgta

SEQ ID NO: 394469 - DNA, 25 bp, Rattus norvegicus
gccctgcaaacatttctacgctgta

SEQ ID NO: 394470 - DNA, 25 bp, Rattus norvegicus
gccctgcaagcacagaagatgaatc

SEQ ID NO: 394471 - DNA, 25 bp, Rattus norvegicus
gccctgcaagcagagaagatgaatc

SEQ ID NO: 394472 - DNA, 25 bp, Rattus norvegicus
gccctgcacatccatgttgtcttta

SEQ ID NO: 394473 - DNA, 25 bp, Rattus norvegicus
gccctgcacatcgatgttgtcttta

SEQ ID NO: 394474 - DNA, 25 bp, Rattus norvegicus
gccctgcagagacgctgtactgtca

SEQ ID NO: 394475 - DNA, 25 bp, Rattus norvegicus
gccctgcagagaggctgtactgtca

SEQ ID NO: 394476 - DNA, 25 bp, Rattus norvegicus
gccctgccaaggatctaacaatcta

SEQ ID NO: 394477 - DNA, 25 bp, Rattus norvegicus
gccctgccaaggttctaacaatcta

SEQ ID NO: 394478 - DNA, 25 bp, Rattus norvegicus
gccctgccagaacggttaaaacttg

SEQ ID NO: 394479 - DNA, 25 bp, Rattus norvegicus
gccctgccagaagggttaaaacttg

SEQ ID NO: 394480 - DNA, 25 bp, Rattus norvegicus
gccctgcccctgaggaaagacagct

SEQ ID NO: 394481 - DNA, 25 bp, Rattus norvegicus
gccctgcccctgtggaaagacagct

SEQ ID NO: 394482 - DNA, 25 bp, Rattus norvegicus
gccctgccctttagatgatgtttta

SEQ ID NO: 394483 - DNA, 25 bp, Rattus norvegicus
gccctgcccttttgatgatgtttta

SEQ ID NO: 394484 - DNA, 25 bp, Rattus norvegicus
gccctgccgagcagtaaagcatctt

SEQ ID NO: 394485 - DNA, 25 bp, Rattus norvegicus
gccctgccgagctgtaaagcatctt

SEQ ID NO: 394486 - DNA, 25 bp, Rattus norvegicus
gccctgccgatgcaacgaatgcgga

SEQ ID NO: 394487 - DNA, 25 bp, Rattus norvegicus
gccctgccgatggaacgaatgcgga

SEQ ID NO: 394488 - DNA, 25 bp, Rattus norvegicus
gccctgcctatactcggtgtgaaaa

SEQ ID NO: 394489 - DNA, 25 bp, Rattus norvegicus
gccctgcctatagtcggtgtgaaaa

SEQ ID NO: 394490 - DNA, 25 bp, Rattus norvegicus
gccctgccttggcatcttctgtttc

SEQ ID NO: 394491 - DNA, 25 bp, Rattus norvegicus
gccctgccttgggatcttctgtttc

SEQ ID NO: 394492 - DNA, 25 bp, Rattus norvegicus
gccctgcgccacatgtgattttgaa

SEQ ID NO: 394493 - DNA, 25 bp, Rattus norvegicus
gccctgcgccacttgtgattttgaa

SEQ ID NO: 394494 - DNA, 25 bp, Rattus norvegicus
gccctgcgcgtgaagaagaccattt

SEQ ID NO: 394495 - DNA, 25 bp, Rattus norvegicus
gccctgcgcgtgtagaagaccattt

SEQ ID NO: 394496 - DNA, 25 bp, Rattus norvegicus
gccctgcgctggatgccgaagcctt

SEQ ID NO: 394497 - DNA, 25 bp, Rattus norvegicus
gccctgcgctggttgccgaagcctt

SEQ ID NO: 394498 - DNA, 25 bp, Rattus norvegicus
gccctgcggcataaatttggctgca

SEQ ID NO: 394499 - DNA, 25 bp, Rattus norvegicus
gccctgcggcattaatttggctgca

SEQ ID NO: 394500 - DNA, 25 bp, Rattus norvegicus
gccctgctacctattgatacatata

SEQ ID NO: 394501 - DNA, 25 bp, Rattus norvegicus
gccctgctaccttttgatacatata

SEQ ID NO: 394502 - DNA, 25 bp, Rattus norvegicus
gccctgctatcaccagtgtaggaat

SEQ ID NO: 394503 - DNA, 25 bp, Rattus norvegicus
gccctgctatcagcagtgtaggaat

SEQ ID NO: 394504 - DNA, 25 bp, Rattus norvegicus
gccctgctccagacagatgttagag

SEQ ID NO: 394505 - DNA, 25 bp, Rattus norvegicus
gccctgctccagtcagatgttagag

SEQ ID NO: 394506 - DNA, 25 bp, Rattus norvegicus
gccctgctcgtaactgggaactgta

SEQ ID NO: 394507 - DNA, 25 bp, Rattus norvegicus
gccctgctcgtatctgggaactgta

SEQ ID NO: 394508 - DNA, 25 bp, Rattus norvegicus
gccctgctgagtctcaacttctgag

SEQ ID NO: 394509 - DNA, 25 bp, Rattus norvegicus
gccctgctgagtgtcaacttctgag

SEQ ID NO: 394510 - DNA, 25 bp, Rattus norvegicus
gccctgctgtacctcatttttagga

SEQ ID NO: 394511 - DNA, 25 bp, Rattus norvegicus
gccctgctgtacgtcatttttagga

SEQ ID NO: 394512 - DNA, 25 bp, Rattus norvegicus
gccctgctgtctcttgacatcatta

SEQ ID NO: 394513 - DNA, 25 bp, Rattus norvegicus
gccctgctgtctgttgacatcatta

SEQ ID NO: 394514 - DNA, 25 bp, Rattus norvegicus
gccctgctgttgcactgctgttaca

SEQ ID NO: 394515 - DNA, 25 bp, Rattus norvegicus
gccctgctgttggactgctgttaca

SEQ ID NO: 394516 - DNA, 25 bp, Rattus norvegicus
gccctgcttttaaatgaatgctggt

SEQ ID NO: 394517 - DNA, 25 bp, Rattus norvegicus
gccctgcttttatatgaatgctggt

SEQ ID NO: 394518 - DNA, 25 bp, Rattus norvegicus
gccctgcttttgctgtaacactgaa

SEQ ID NO: 394519 - DNA, 25 bp, Rattus norvegicus
gccctgcttttggtgtaacactgaa

SEQ ID NO: 394520 - DNA, 25 bp, Rattus norvegicus
gccctggaagggactgactcacaga

SEQ ID NO: 394521 - DNA, 25 bp, Rattus norvegicus
gccctggaagggtctgactcacaga

SEQ ID NO: 394522 - DNA, 25 bp, Rattus norvegicus
gccctggaagtgatcgtgacgctgt

SEQ ID NO: 394523 - DNA, 25 bp, Rattus norvegicus
gccctggaagtgttcgtgacgctgt

SEQ ID NO: 394524 - DNA, 25 bp, Rattus norvegicus
gccctggaatacacagaggctcttg

SEQ ID NO: 394525 - DNA, 25 bp, Rattus norvegicus
gccctggaatactcagaggctcttg

SEQ ID NO: 394526 - DNA, 25 bp, Rattus norvegicus
gccctggaatcactgttgcctacag

SEQ ID NO: 394527 - DNA, 25 bp, Rattus norvegicus
gccctggaatcagtgttgcctacag

SEQ ID NO: 394528 - DNA, 25 bp, Rattus norvegicus
gccctggaccatactagactgatag

SEQ ID NO: 394529 - DNA, 25 bp, Rattus norvegicus
gccctggaccattctagactgatag

SEQ ID NO: 394530 - DNA, 25 bp, Rattus norvegicus
gccctggacttcctgagattagctt

SEQ ID NO: 394531 - DNA, 25 bp, Rattus norvegicus
gccctggacttcgtgagattagctt

SEQ ID NO: 394532 - DNA, 25 bp, Rattus norvegicus
gccctggagaagattgacctgaagt

SEQ ID NO: 394533 - DNA, 25 bp, Rattus norvegicus
gccctggagaagtttgacctgaagt

SEQ ID NO: 394534 - DNA, 25 bp, Rattus norvegicus
gccctggagaccctacagtaaataa

SEQ ID NO: 394535 - DNA, 25 bp, Rattus norvegicus
gccctggagaccgtacagtaaataa

SEQ ID NO: 394536 - DNA, 25 bp, Rattus norvegicus
gccctggagtcacccatgtgggtca

SEQ ID NO: 394537 - DNA, 25 bp, Rattus norvegicus
gccctggagtcagccatgtgggtca

SEQ ID NO: 394538 - DNA, 25 bp, Rattus norvegicus
gccctggatggaagactctgggatc

SEQ ID NO: 394539 - DNA, 25 bp, Rattus norvegicus
gccctggatggatgactctgggatc

SEQ ID NO: 394540 - DNA, 25 bp, Rattus norvegicus
gccctggcaatcatactaggttcat

SEQ ID NO: 394541 - DNA, 25 bp, Rattus norvegicus
gccctggcaatcttactaggttcat

SEQ ID NO: 394542 - DNA, 25 bp, Rattus norvegicus
gccctggcaggcatggacaacagtt

SEQ ID NO: 394543 - DNA, 25 bp, Rattus norvegicus
gccctggcaggcttggacaacagtt

SEQ ID NO: 394544 - DNA, 25 bp, Rattus norvegicus
gccctggcccacattgaggaatgga

SEQ ID NO: 394545 - DNA, 25 bp, Rattus norvegicus
gccctggcccactttgaggaatgga

SEQ ID NO: 394546 - DNA, 25 bp, Rattus norvegicus
gccctggcctctacagaaaacagta

SEQ ID NO: 394547 - DNA, 25 bp, Rattus norvegicus
gccctggcctcttcagaaaacagta

SEQ ID NO: 394548 - DNA, 25 bp, Rattus norvegicus
gccctggctggactagaactagttg

SEQ ID NO: 394549 - DNA, 25 bp, Rattus norvegicus
gccctggctggagtagaactagttg

SEQ ID NO: 394550 - DNA, 25 bp, Rattus norvegicus
gccctggcttccatcacaagtggag

SEQ ID NO: 394551 - DNA, 25 bp, Rattus norvegicus
gccctggcttccttcacaagtggag

SEQ ID NO: 394552 - DNA, 25 bp, Rattus norvegicus
gccctgggacctcctctttgtataa

SEQ ID NO: 394553 - DNA, 25 bp, Rattus norvegicus
gccctgggacctgctctttgtataa

SEQ ID NO: 394554 - DNA, 25 bp, Rattus norvegicus
gccctgggacgtctgacgtacagac

SEQ ID NO: 394555 - DNA, 25 bp, Rattus norvegicus
gccctgggacgtgtgacgtacagac

SEQ ID NO: 394556 - DNA, 25 bp, Rattus norvegicus
gccctgggagttcccatctgagagc

SEQ ID NO: 394557 - DNA, 25 bp, Rattus norvegicus
gccctgggagttgccatctgagagc

SEQ ID NO: 394558 - DNA, 25 bp, Rattus norvegicus
gccctgggcactccagcatttggaa

SEQ ID NO: 394559 - DNA, 25 bp, Rattus norvegicus
gccctgggcactgcagcatttggaa

SEQ ID NO: 394560 - DNA, 25 bp, Rattus norvegicus
gccctgggccccatgacgaggaagg

SEQ ID NO: 394561 - DNA, 25 bp, Rattus norvegicus
gccctgggccccttgacgaggaagg

SEQ ID NO: 394562 - DNA, 25 bp, Rattus norvegicus
gccctgggccctcgttctaagaagc

SEQ ID NO: 394563 - DNA, 25 bp, Rattus norvegicus
gccctgggccctggttctaagaagc

SEQ ID NO: 394564 - DNA, 25 bp, Rattus norvegicus
gccctgggccgaagacttccgacag

SEQ ID NO: 394565 - DNA, 25 bp, Rattus norvegicus
gccctgggccgatgacttccgacag

SEQ ID NO: 394566 - DNA, 25 bp, Rattus norvegicus
gccctgggcttcagtgttgtgtgca

SEQ ID NO: 394567 - DNA, 25 bp, Rattus norvegicus
gccctgggcttctgtgttgtgtgca

SEQ ID NO: 394568 - DNA, 25 bp, Rattus norvegicus
gccctgggctttaatcttcagttcc

SEQ ID NO: 394569 - DNA, 25 bp, Rattus norvegicus
gccctgggcttttatcttcagttcc

SEQ ID NO: 394570 - DNA, 25 bp, Rattus norvegicus
gccctgggtcccactctgcttttta

SEQ ID NO: 394571 - DNA, 25 bp, Rattus norvegicus
gccctgggtccctctctgcttttta

SEQ ID NO: 394572 - DNA, 25 bp, Rattus norvegicus
gccctgggtcctaaatgatagtttt

SEQ ID NO: 394573 - DNA, 25 bp, Rattus norvegicus
gccctgggtcctcgtcaacgagaaa

SEQ ID NO: 394574 - DNA, 25 bp, Rattus norvegicus
gccctgggtcctggtcaacgagaaa

SEQ ID NO: 394575 - DNA, 25 bp, Rattus norvegicus
gccctgggtccttaatgatagtttt

SEQ ID NO: 394576 - DNA, 25 bp, Rattus norvegicus
gccctgggtctcagaggaagtcata

SEQ ID NO: 394577 - DNA, 25 bp, Rattus norvegicus
gccctgggtctctgaggaagtcata

SEQ ID NO: 394578 - DNA, 25 bp, Rattus norvegicus
gccctgggtgggacagaaccgacat

SEQ ID NO: 394579 - DNA, 25 bp, Rattus norvegicus
gccctgggtgggtcagaaccgacat

SEQ ID NO: 394580 - DNA, 25 bp, Rattus norvegicus
gccctgggttggattcccacatggt

SEQ ID NO: 394581 - DNA, 25 bp, Rattus norvegicus
gccctgggttggtttcccacatggt

SEQ ID NO: 394582 - DNA, 25 bp, Rattus norvegicus
gccctgggtttgctctctaatacca

SEQ ID NO: 394583 - DNA, 25 bp, Rattus norvegicus
gccctgggtttggtctctaatacca

SEQ ID NO: 394584 - DNA, 25 bp, Rattus norvegicus
gccctggtaacaaggtgctacagta

SEQ ID NO: 394585 - DNA, 25 bp, Rattus norvegicus
gccctggtaacatggtgctacagta

SEQ ID NO: 394586 - DNA, 25 bp, Rattus norvegicus
gccctggtcatgataatggatgcac

SEQ ID NO: 394587 - DNA, 25 bp, Rattus norvegicus
gccctggtcatgttaatggatgcac

SEQ ID NO: 394588 - DNA, 25 bp, Rattus norvegicus
gccctggtccaaagtctctgagaga

SEQ ID NO: 394589 - DNA, 25 bp, Rattus norvegicus
gccctggtccaatgtctctgagaga

SEQ ID NO: 394590 - DNA, 25 bp, Rattus norvegicus
gccctggtctgtaaacatctgctgg

SEQ ID NO: 394591 - DNA, 25 bp, Rattus norvegicus
gccctggtctgttaacatctgctgg

SEQ ID NO: 394592 - DNA, 25 bp, Rattus norvegicus
gccctggtcttcagtgtcagcaata

SEQ ID NO: 394593 - DNA, 25 bp, Rattus norvegicus
gccctggtcttctgtgtcagcaata

SEQ ID NO: 394594 - DNA, 25 bp, Rattus norvegicus
gccctggtgccaaagagatggctca

SEQ ID NO: 394595 - DNA, 25 bp, Rattus norvegicus
gccctggtgccatagagatggctca

SEQ ID NO: 394596 - DNA, 25 bp, Rattus norvegicus
gccctggtgctgacacttagaacaa

SEQ ID NO: 394597 - DNA, 25 bp, Rattus norvegicus
gccctggtgctgatgctggtagact

SEQ ID NO: 394598 - DNA, 25 bp, Rattus norvegicus
gccctggtgctgtcacttagaacaa

SEQ ID NO: 394599 - DNA, 25 bp, Rattus norvegicus
gccctggtgctgttgctggtagact

SEQ ID NO: 394600 - DNA, 25 bp, Rattus norvegicus
gccctggtggagaatgcatttgccc

SEQ ID NO: 394601 - DNA, 25 bp, Rattus norvegicus
gccctggtggagtatgcatttgccc

SEQ ID NO: 394602 - DNA, 25 bp, Rattus norvegicus
gccctggtgtttctgactgtcgtga

SEQ ID NO: 394603 - DNA, 25 bp, Rattus norvegicus
gccctggtgtttgtgactgtcgtga

SEQ ID NO: 394604 - DNA, 25 bp, Rattus norvegicus
gccctggttataacaacttaagcta

SEQ ID NO: 394605 - DNA, 25 bp, Rattus norvegicus
gccctggttatatcaacttaagcta

SEQ ID NO: 394606 - DNA, 25 bp, Rattus norvegicus
gccctggttcgaatgtctgtttatt

SEQ ID NO: 394607 - DNA, 25 bp, Rattus norvegicus
gccctggttcgattgtctgtttatt

SEQ ID NO: 394608 - DNA, 25 bp, Rattus norvegicus
gccctggttgttcacgatgccgtaa

SEQ ID NO: 394609 - DNA, 25 bp, Rattus norvegicus
gccctggttgttgacgatgccgtaa

SEQ ID NO: 394610 - DNA, 25 bp, Rattus norvegicus
gccctggtttggctgtgactcacaa

SEQ ID NO: 394611 - DNA, 25 bp, Rattus norvegicus
gccctggtttgggtgtgactcacaa

SEQ ID NO: 394612 - DNA, 25 bp, Rattus norvegicus
gccctggttttcaatgaatcgctct

SEQ ID NO: 394613 - DNA, 25 bp, Rattus norvegicus
gccctggttttctatgaatcgctct

SEQ ID NO: 394614 - DNA, 25 bp, Rattus norvegicus
gccctgtaaactaggctatcctcaa

SEQ ID NO: 394615 - DNA, 25 bp, Rattus norvegicus
gccctgtaaacttggctatcctcaa

SEQ ID NO: 394616 - DNA, 25 bp, Rattus norvegicus
gccctgtacagacgaggtagtgaca

SEQ ID NO: 394617 - DNA, 25 bp, Rattus norvegicus
gccctgtacagaggaggtagtgaca

SEQ ID NO: 394618 - DNA, 25 bp, Rattus norvegicus
gccctgtaccagacaccatgtgaag

SEQ ID NO: 394619 - DNA, 25 bp, Rattus norvegicus
gccctgtaccagtcaccatgtgaag

SEQ ID NO: 394620 - DNA, 25 bp, Rattus norvegicus
gccctgtagaagattagagtccctc

SEQ ID NO: 394621 - DNA, 25 bp, Rattus norvegicus
gccctgtagaagtttagagtccctc

SEQ ID NO: 394622 - DNA, 25 bp, Rattus norvegicus
gccctgtatcccacaccaaaaggag

SEQ ID NO: 394623 - DNA, 25 bp, Rattus norvegicus
gccctgtatccctcaccaaaaggag

SEQ ID NO: 394624 - DNA, 25 bp, Rattus norvegicus
gccctgtcacctaacagacactaaa

SEQ ID NO: 394625 - DNA, 25 bp, Rattus norvegicus
gccctgtcaccttacagacactaaa

SEQ ID NO: 394626 - DNA, 25 bp, Rattus norvegicus
gccctgtcccatctcaggtaaaaaa

SEQ ID NO: 394627 - DNA, 25 bp, Rattus norvegicus
gccctgtcccatgtcaggtaaaaaa

SEQ ID NO: 394628 - DNA, 25 bp, Rattus norvegicus
gccctgtctgaactgtaactcataa

SEQ ID NO: 394629 - DNA, 25 bp, Rattus norvegicus
gccctgtctgaagtgtaactcataa

SEQ ID NO: 394630 - DNA, 25 bp, Rattus norvegicus
gccctgtctgcactgtcggatagag

SEQ ID NO: 394631 - DNA, 25 bp, Rattus norvegicus
gccctgtctgcagtgtcggatagag

SEQ ID NO: 394632 - DNA, 25 bp, Rattus norvegicus
gccctgtctgccagattgagtgaga

SEQ ID NO: 394633 - DNA, 25 bp, Rattus norvegicus
gccctgtctgcctgattgagtgaga

SEQ ID NO: 394634 - DNA, 25 bp, Rattus norvegicus
gccctgtctgtcatgatccttttat

SEQ ID NO: 394635 - DNA, 25 bp, Rattus norvegicus
gccctgtctgtcttgatccttttat

SEQ ID NO: 394636 - DNA, 25 bp, Rattus norvegicus
gccctgtctgttctagaacttctgt

SEQ ID NO: 394637 - DNA, 25 bp, Rattus norvegicus
gccctgtctgttgtagaacttctgt

SEQ ID NO: 394638 - DNA, 25 bp, Rattus norvegicus
gccctgtctttccattttttaggca

SEQ ID NO: 394639 - DNA, 25 bp, Rattus norvegicus
gccctgtctttcgattttttaggca

SEQ ID NO: 394640 - DNA, 25 bp, Rattus norvegicus
gccctgtggactcttcttccacatg

SEQ ID NO: 394641 - DNA, 25 bp, Rattus norvegicus
gccctgtggactgttcttccacatg

SEQ ID NO: 394642 - DNA, 25 bp, Rattus norvegicus
gccctgtggcagagtggtccagtaa

SEQ ID NO: 394643 - DNA, 25 bp, Rattus norvegicus
gccctgtggcagtgtggtccagtaa

SEQ ID NO: 394644 - DNA, 25 bp, Rattus norvegicus
gccctgtgggacaccgggctttcgt

SEQ ID NO: 394645 - DNA, 25 bp, Rattus norvegicus
gccctgtgggactccgggctttcgt

SEQ ID NO: 394646 - DNA, 25 bp, Rattus norvegicus
gccctgtgggtgagattcatctgga

SEQ ID NO: 394647 - DNA, 25 bp, Rattus norvegicus
gccctgtgggtgtgattcatctgga

SEQ ID NO: 394648 - DNA, 25 bp, Rattus norvegicus
gccctgtggtcaaatgctggtatgt

SEQ ID NO: 394649 - DNA, 25 bp, Rattus norvegicus
gccctgtggtcatatgctggtatgt

SEQ ID NO: 394650 - DNA, 25 bp, Rattus norvegicus
gccctgtggtcgaagcatagcatca

SEQ ID NO: 394651 - DNA, 25 bp, Rattus norvegicus
gccctgtggtcgtagcatagcatca

SEQ ID NO: 394652 - DNA, 25 bp, Rattus norvegicus
gccctgtggtttccaatggagaagt

SEQ ID NO: 394653 - DNA, 25 bp, Rattus norvegicus
gccctgtggtttgcaatggagaagt

SEQ ID NO: 394654 - DNA, 25 bp, Rattus norvegicus
gccctgtgtcccacagagatgaatg

SEQ ID NO: 394655 - DNA, 25 bp, Rattus norvegicus
gccctgtgtccctcagagatgaatg

SEQ ID NO: 394656 - DNA, 25 bp, Rattus norvegicus
gccctgtgtctcagcaataaaactt

SEQ ID NO: 394657 - DNA, 25 bp, Rattus norvegicus
gccctgtgtctctgcaataaaactt

SEQ ID NO: 394658 - DNA, 25 bp, Rattus norvegicus
gccctgtgtgtcatttgtggaaccc

SEQ ID NO: 394659 - DNA, 25 bp, Rattus norvegicus
gccctgtgtgtcttttgtggaaccc

SEQ ID NO: 394660 - DNA, 25 bp, Rattus norvegicus
gccctgttcacaaacgtgtttggta

SEQ ID NO: 394661 - DNA, 25 bp, Rattus norvegicus
gccctgttcacatacgtgtttggta

SEQ ID NO: 394662 - DNA, 25 bp, Rattus norvegicus
gccctgttcagtcaccttcaataaa

SEQ ID NO: 394663 - DNA, 25 bp, Rattus norvegicus
gccctgttcagtgaccttcaataaa

SEQ ID NO: 394664 - DNA, 25 bp, Rattus norvegicus
gccctgttcttcaaatgcactgtag

SEQ ID NO: 394665 - DNA, 25 bp, Rattus norvegicus
gccctgttcttctaatgcactgtag

SEQ ID NO: 394666 - DNA, 25 bp, Rattus norvegicus
gccctgttgcttaccagacttgtta

SEQ ID NO: 394667 - DNA, 25 bp, Rattus norvegicus
gccctgttgctttccagacttgtta

SEQ ID NO: 394668 - DNA, 25 bp, Rattus norvegicus
gccctgttgggcatcagactgcaga

SEQ ID NO: 394669 - DNA, 25 bp, Rattus norvegicus
gccctgttgggcttcagactgcaga

SEQ ID NO: 394670 - DNA, 25 bp, Rattus norvegicus
gccctgtttacactgtgactatcaa

SEQ ID NO: 394671 - DNA, 25 bp, Rattus norvegicus
gccctgtttacagtgtgactatcaa

SEQ ID NO: 394672 - DNA, 25 bp, Rattus norvegicus
gccctgttttctaattccaacacag

SEQ ID NO: 394673 - DNA, 25 bp, Rattus norvegicus
gccctgttttcttattccaacacag

SEQ ID NO: 394674 - DNA, 25 bp, Rattus norvegicus
gcccttaacttgacttccatttaga

SEQ ID NO: 394675 - DNA, 25 bp, Rattus norvegicus
gcccttaacttgtcttccatttaga

SEQ ID NO: 394676 - DNA, 25 bp, Rattus norvegicus
gcccttacaggtccatggtgtctga

SEQ ID NO: 394677 - DNA, 25 bp, Rattus norvegicus
gcccttacaggtgcatggtgtctga

SEQ ID NO: 394678 - DNA, 25 bp, Rattus norvegicus
gcccttacgggccactgaatgcttg

SEQ ID NO: 394679 - DNA, 25 bp, Rattus norvegicus
gcccttacgggcgactgaatgcttg

SEQ ID NO: 394680 - DNA, 25 bp, Rattus norvegicus
gcccttacgtctacatctataacag

SEQ ID NO: 394681 - DNA, 25 bp, Rattus norvegicus
gcccttacgtcttcatctataacag

SEQ ID NO: 394682 - DNA, 25 bp, Rattus norvegicus
gcccttagctgcatcagattctgtt

SEQ ID NO: 394683 - DNA, 25 bp, Rattus norvegicus
gcccttagctgcctgttctaaatga

SEQ ID NO: 394684 - DNA, 25 bp, Rattus norvegicus
gcccttagctgcgtgttctaaatga

SEQ ID NO: 394685 - DNA, 25 bp, Rattus norvegicus
gcccttagctgcttcagattctgtt

SEQ ID NO: 394686 - DNA, 25 bp, Rattus norvegicus
gcccttaggcccatgacattagaca

SEQ ID NO: 394687 - DNA, 25 bp, Rattus norvegicus
gcccttaggcccttgacattagaca

SEQ ID NO: 394688 - DNA, 25 bp, Rattus norvegicus
gcccttaggcttcgctacaaagtat

SEQ ID NO: 394689 - DNA, 25 bp, Rattus norvegicus
gcccttaggcttggctacaaagtat

SEQ ID NO: 394690 - DNA, 25 bp, Rattus norvegicus
gcccttattggtatcttcattagat

SEQ ID NO: 394691 - DNA, 25 bp, Rattus norvegicus
gcccttattggtttcttcattagat

SEQ ID NO: 394692 - DNA, 25 bp, Rattus norvegicus
gcccttcagaagatacctttctcat

SEQ ID NO: 394693 - DNA, 25 bp, Rattus norvegicus
gcccttcagaagttacctttctcat

SEQ ID NO: 394694 - DNA, 25 bp, Rattus norvegicus
gcccttcagcagcttgcgagtttga

SEQ ID NO: 394695 - DNA, 25 bp, Rattus norvegicus
gcccttcagcaggttgcgagtttga

SEQ ID NO: 394696 - DNA, 25 bp, Rattus norvegicus
gcccttcagctccaaggtgtgagtt

SEQ ID NO: 394697 - DNA, 25 bp, Rattus norvegicus
gcccttcagctcgaaggtgtgagtt

SEQ ID NO: 394698 - DNA, 25 bp, Rattus norvegicus
gcccttcagtttaccttgtgactta

SEQ ID NO: 394699 - DNA, 25 bp, Rattus norvegicus
gcccttcagttttccttgtgactta

SEQ ID NO: 394700 - DNA, 25 bp, Rattus norvegicus
gcccttcatctgacctgattaaata

SEQ ID NO: 394701 - DNA, 25 bp, Rattus norvegicus
gcccttcatctgtcctgattaaata

SEQ ID NO: 394702 - DNA, 25 bp, Rattus norvegicus
gcccttcattatccagcttccaaga

SEQ ID NO: 394703 - DNA, 25 bp, Rattus norvegicus
gcccttcattatgcagcttccaaga

SEQ ID NO: 394704 - DNA, 25 bp, Rattus norvegicus
gcccttcatttgcatatcctggttt

SEQ ID NO: 394705 - DNA, 25 bp, Rattus norvegicus
gcccttcatttggatatcctggttt

SEQ ID NO: 394706 - DNA, 25 bp, Rattus norvegicus
gcccttccaaaaaagtcccaagaag

SEQ ID NO: 394707 - DNA, 25 bp, Rattus norvegicus
gcccttccaaaatagtcccaagaag

SEQ ID NO: 394708 - DNA, 25 bp, Rattus norvegicus
gcccttccagaacccaagatcagat

SEQ ID NO: 394709 - DNA, 25 bp, Rattus norvegicus
gcccttccagaagccaagatcagat

SEQ ID NO: 394710 - DNA, 25 bp, Rattus norvegicus
gcccttccagacaacacagtttatt

SEQ ID NO: 394711 - DNA, 25 bp, Rattus norvegicus
gcccttccagactacacagtttatt

SEQ ID NO: 394712 - DNA, 25 bp, Rattus norvegicus
gcccttccagagctctaagggagct

SEQ ID NO: 394713 - DNA, 25 bp, Rattus norvegicus
gcccttccagaggtctaagggagct

SEQ ID NO: 394714 - DNA, 25 bp, Rattus norvegicus
gcccttcccattattcatcatgtaa

SEQ ID NO: 394715 - DNA, 25 bp, Rattus norvegicus
gcccttcccatttttcatcatgtaa

SEQ ID NO: 394716 - DNA, 25 bp, Rattus norvegicus
gcccttcccgcaattattggtgtat

SEQ ID NO: 394717 - DNA, 25 bp, Rattus norvegicus
gcccttcccgcatttattggtgtat

SEQ ID NO: 394718 - DNA, 25 bp, Rattus norvegicus
gcccttcccgtcaagtcagagtaaa

SEQ ID NO: 394719 - DNA, 25 bp, Rattus norvegicus
gcccttcccgtctagtcagagtaaa

SEQ ID NO: 394720 - DNA, 25 bp, Rattus norvegicus
gcccttcctgaactattttgtgctg

SEQ ID NO: 394721 - DNA, 25 bp, Rattus norvegicus
gcccttcctgaacttgctgtgatat

SEQ ID NO: 394722 - DNA, 25 bp, Rattus norvegicus
gcccttcctgaagtattttgtgctg

SEQ ID NO: 394723 - DNA, 25 bp, Rattus norvegicus
gcccttcctgaagttgctgtgatat

SEQ ID NO: 394724 - DNA, 25 bp, Rattus norvegicus
gcccttccttccaatggaagtggga

SEQ ID NO: 394725 - DNA, 25 bp, Rattus norvegicus
gcccttccttcctatggaagtggga

SEQ ID NO: 394726 - DNA, 25 bp, Rattus norvegicus
gcccttcctttcagttgctcagagg

SEQ ID NO: 394727 - DNA, 25 bp, Rattus norvegicus
gcccttcctttctgttgctcagagg

SEQ ID NO: 394728 - DNA, 25 bp, Rattus norvegicus
gcccttctagcccagcagtaggagg

SEQ ID NO: 394729 - DNA, 25 bp, Rattus norvegicus
gcccttctagccgagcagtaggagg

SEQ ID NO: 394730 - DNA, 25 bp, Rattus norvegicus
gcccttctagtcacacagagtacat

SEQ ID NO: 394731 - DNA, 25 bp, Rattus norvegicus
gcccttctagtctcacagagtacat

SEQ ID NO: 394732 - DNA, 25 bp, Rattus norvegicus
gcccttctcctgaggaaacggacat

SEQ ID NO: 394733 - DNA, 25 bp, Rattus norvegicus
gcccttctcctgtggaaacggacat

SEQ ID NO: 394734 - DNA, 25 bp, Rattus norvegicus
gcccttctcgggagccattggaaga

SEQ ID NO: 394735 - DNA, 25 bp, Rattus norvegicus
gcccttctcgggtgccattggaaga

SEQ ID NO: 394736 - DNA, 25 bp, Rattus norvegicus
gcccttctcttgaccatgatttcag

SEQ ID NO: 394737 - DNA, 25 bp, Rattus norvegicus
gcccttctcttgtccatgatttcag

SEQ ID NO: 394738 - DNA, 25 bp, Rattus norvegicus
gcccttgagattaatttcgcagtag

SEQ ID NO: 394739 - DNA, 25 bp, Rattus norvegicus
gcccttgagatttatttcgcagtag

SEQ ID NO: 394740 - DNA, 25 bp, Rattus norvegicus
gcccttgagggcaagtgaagctcat

SEQ ID NO: 394741 - DNA, 25 bp, Rattus norvegicus
gcccttgagggctagtgaagctcat

SEQ ID NO: 394742 - DNA, 25 bp, Rattus norvegicus
gcccttgaggtgaagcttggttcca

SEQ ID NO: 394743 - DNA, 25 bp, Rattus norvegicus
gcccttgaggtgtagcttggttcca

SEQ ID NO: 394744 - DNA, 25 bp, Rattus norvegicus
gcccttgatcccactgattttgaag

SEQ ID NO: 394745 - DNA, 25 bp, Rattus norvegicus
gcccttgatccctctgattttgaag

SEQ ID NO: 394746 - DNA, 25 bp, Rattus norvegicus
gcccttgcaattctacatcttcttt

SEQ ID NO: 394747 - DNA, 25 bp, Rattus norvegicus
gcccttgcaattgtacatcttcttt

SEQ ID NO: 394748 - DNA, 25 bp, Rattus norvegicus
gcccttgcacttcctggaggtgaaa

SEQ ID NO: 394749 - DNA, 25 bp, Rattus norvegicus
gcccttgcacttgctggaggtgaaa

SEQ ID NO: 394750 - DNA, 25 bp, Rattus norvegicus
gcccttgcattcacatgtgcactta

SEQ ID NO: 394751 - DNA, 25 bp, Rattus norvegicus
gcccttgcattctcatgtgcactta

SEQ ID NO: 394752 - DNA, 25 bp, Rattus norvegicus
gcccttgccctcaagttggctagaa

SEQ ID NO: 394753 - DNA, 25 bp, Rattus norvegicus
gcccttgccctctagttggctagaa

SEQ ID NO: 394754 - DNA, 25 bp, Rattus norvegicus
gcccttgcctccatggaaatggaaa

SEQ ID NO: 394755 - DNA, 25 bp, Rattus norvegicus
gcccttgcctccttggaaatggaaa

SEQ ID NO: 394756 - DNA, 25 bp, Rattus norvegicus
gcccttggacatcctgctgaaatag

SEQ ID NO: 394757 - DNA, 25 bp, Rattus norvegicus
gcccttggacatgctgctgaaatag

SEQ ID NO: 394758 - DNA, 25 bp, Rattus norvegicus
gcccttggcgttcagaattgccgag

SEQ ID NO: 394759 - DNA, 25 bp, Rattus norvegicus
gcccttggcgttgagaattgccgag

SEQ ID NO: 394760 - DNA, 25 bp, Rattus norvegicus
gcccttggctgtacagagactctat

SEQ ID NO: 394761 - DNA, 25 bp, Rattus norvegicus
gcccttggctgttcagagactctat

SEQ ID NO: 394762 - DNA, 25 bp, Rattus norvegicus
gcccttggcttgcttgtgtggacaa

SEQ ID NO: 394763 - DNA, 25 bp, Rattus norvegicus
gcccttggcttggttgtgtggacaa

SEQ ID NO: 394764 - DNA, 25 bp, Rattus norvegicus
gcccttgggaaacctcagaggcaca

SEQ ID NO: 394765 - DNA, 25 bp, Rattus norvegicus
gcccttgggaaagctcagaggcaca

SEQ ID NO: 394766 - DNA, 25 bp, Rattus norvegicus
gcccttgggaagagacatcgtgtcg

SEQ ID NO: 394767 - DNA, 25 bp, Rattus norvegicus
gcccttgggaagtgacatcgtgtcg

SEQ ID NO: 394768 - DNA, 25 bp, Rattus norvegicus
gcccttggtcagaatcagagaatta

SEQ ID NO: 394769 - DNA, 25 bp, Rattus norvegicus
gcccttggtcagtatcagagaatta

SEQ ID NO: 394770 - DNA, 25 bp, Rattus norvegicus
gcccttggtgtcatactctggagag

SEQ ID NO: 394771 - DNA, 25 bp, Rattus norvegicus
gcccttggtgtcttactctggagag

SEQ ID NO: 394772 - DNA, 25 bp, Rattus norvegicus
gcccttggttctaccaaggctagaa

SEQ ID NO: 394773 - DNA, 25 bp, Rattus norvegicus
gcccttggttcttccaaggctagaa

SEQ ID NO: 394774 - DNA, 25 bp, Rattus norvegicus
gcccttgtactactttgcaaaccca

SEQ ID NO: 394775 - DNA, 25 bp, Rattus norvegicus
gcccttgtactagtttgcaaaccca

SEQ ID NO: 394776 - DNA, 25 bp, Rattus norvegicus
gcccttgtcactagctgcatggatt

SEQ ID NO: 394777 - DNA, 25 bp, Rattus norvegicus
gcccttgtcacttgctgcatggatt

SEQ ID NO: 394778 - DNA, 25 bp, Rattus norvegicus
gcccttgtcattagcacaggacaca

SEQ ID NO: 394779 - DNA, 25 bp, Rattus norvegicus
gcccttgtcatttgcacaggacaca

SEQ ID NO: 394780 - DNA, 25 bp, Rattus norvegicus
gcccttgtccatccagtgtaggtga

SEQ ID NO: 394781 - DNA, 25 bp, Rattus norvegicus
gcccttgtccatgcagtgtaggtga

SEQ ID NO: 394782 - DNA, 25 bp, Rattus norvegicus
gcccttgtcggtccttatggcctct

SEQ ID NO: 394783 - DNA, 25 bp, Rattus norvegicus
gcccttgtcggtgcttatggcctct

SEQ ID NO: 394784 - DNA, 25 bp, Rattus norvegicus
gcccttgtctgtacctcgtgtgtat

SEQ ID NO: 394785 - DNA, 25 bp, Rattus norvegicus
gcccttgtctgttcctcgtgtgtat

SEQ ID NO: 394786 - DNA, 25 bp, Rattus norvegicus
gcccttgtgcaactggaggactcag

SEQ ID NO: 394787 - DNA, 25 bp, Rattus norvegicus
gcccttgtgcaagtggaggactcag

SEQ ID NO: 394788 - DNA, 25 bp, Rattus norvegicus
gcccttgtggtgacagaagcccgga

SEQ ID NO: 394789 - DNA, 25 bp, Rattus norvegicus
gcccttgtggtgtcagaagcccgga

SEQ ID NO: 394790 - DNA, 25 bp, Rattus norvegicus
gcccttgttccaagaagaacgttgg

SEQ ID NO: 394791 - DNA, 25 bp, Rattus norvegicus
gcccttgttccatgaagaacgttgg

SEQ ID NO: 394792 - DNA, 25 bp, Rattus norvegicus
gcccttgttcccactaagaaatgca

SEQ ID NO: 394793 - DNA, 25 bp, Rattus norvegicus
gcccttgttccctctaagaaatgca

SEQ ID NO: 394794 - DNA, 25 bp, Rattus norvegicus
gcccttgttctcacacatagtaagt

SEQ ID NO: 394795 - DNA, 25 bp, Rattus norvegicus
gcccttgttctctcacatagtaagt

SEQ ID NO: 394796 - DNA, 25 bp, Rattus norvegicus
gccctttacaggcttcagctagctg

SEQ ID NO: 394797 - DNA, 25 bp, Rattus norvegicus
gccctttacagggttcagctagctg

SEQ ID NO: 394798 - DNA, 25 bp, Rattus norvegicus
gccctttaccttccactgagagtat

SEQ ID NO: 394799 - DNA, 25 bp, Rattus norvegicus
gccctttaccttgcactgagagtat

SEQ ID NO: 394800 - DNA, 25 bp, Rattus norvegicus
gccctttagggcaagtacgtcagtc

SEQ ID NO: 394801 - DNA, 25 bp, Rattus norvegicus
gccctttagggctagtacgtcagtc

SEQ ID NO: 394802 - DNA, 25 bp, Rattus norvegicus
gccctttatctcactgtccaataaa

SEQ ID NO: 394803 - DNA, 25 bp, Rattus norvegicus
gccctttatctctctgtccaataaa

SEQ ID NO: 394804 - DNA, 25 bp, Rattus norvegicus
gccctttattttagcatctggttga

SEQ ID NO: 394805 - DNA, 25 bp, Rattus norvegicus
gccctttatttttgcatctggttga

SEQ ID NO: 394806 - DNA, 25 bp, Rattus norvegicus
gccctttcaggccatttgaggttct

SEQ ID NO: 394807 - DNA, 25 bp, Rattus norvegicus
gccctttcaggcgatttgaggttct

SEQ ID NO: 394808 - DNA, 25 bp, Rattus norvegicus
gccctttcagttcagaaccctagga

SEQ ID NO: 394809 - DNA, 25 bp, Rattus norvegicus
gccctttcagttgagaaccctagga

SEQ ID NO: 394810 - DNA, 25 bp, Rattus norvegicus
gccctttccgttaacttagatgaat

SEQ ID NO: 394811 - DNA, 25 bp, Rattus norvegicus
gccctttccgtttacttagatgaat

SEQ ID NO: 394812 - DNA, 25 bp, Rattus norvegicus
gccctttcggaaaacaaatgctagt

SEQ ID NO: 394813 - DNA, 25 bp, Rattus norvegicus
gccctttcggaatacaaatgctagt

SEQ ID NO: 394814 - DNA, 25 bp, Rattus norvegicus
gccctttgacctatctactatgtaa

SEQ ID NO: 394815 - DNA, 25 bp, Rattus norvegicus
gccctttgacctttctactatgtaa

SEQ ID NO: 394816 - DNA, 25 bp, Rattus norvegicus
gccctttgactacttctgagcacag

SEQ ID NO: 394817 - DNA, 25 bp, Rattus norvegicus
gccctttgactagttctgagcacag

SEQ ID NO: 394818 - DNA, 25 bp, Rattus norvegicus
gccctttggaagagtatggacatca

SEQ ID NO: 394819 - DNA, 25 bp, Rattus norvegicus
gccctttggaagtgtatggacatca

SEQ ID NO: 394820 - DNA, 25 bp, Rattus norvegicus
gccctttggaataagccacccagaa

SEQ ID NO: 394821 - DNA, 25 bp, Rattus norvegicus
gccctttggaattagccacccagaa

SEQ ID NO: 394822 - DNA, 25 bp, Rattus norvegicus
gccctttggagcaggcattgggaaa

SEQ ID NO: 394823 - DNA, 25 bp, Rattus norvegicus
gccctttggagctggcattgggaaa

SEQ ID NO: 394824 - DNA, 25 bp, Rattus norvegicus
gccctttgggagatgggttttccat

SEQ ID NO: 394825 - DNA, 25 bp, Rattus norvegicus
gccctttgggagttgggttttccat

SEQ ID NO: 394826 - DNA, 25 bp, Rattus norvegicus
gccctttggtatacaggttcgaaat

SEQ ID NO: 394827 - DNA, 25 bp, Rattus norvegicus
gccctttggtattcaggttcgaaat

SEQ ID NO: 394828 - DNA, 25 bp, Rattus norvegicus
gccctttgtattaaacacacccaag

SEQ ID NO: 394829 - DNA, 25 bp, Rattus norvegicus
gccctttgtatttaacacacccaag

SEQ ID NO: 394830 - DNA, 25 bp, Rattus norvegicus
gcccttttaaataggagctcttcaa

SEQ ID NO: 394831 - DNA, 25 bp, Rattus norvegicus
gcccttttaaattggagctcttcaa

SEQ ID NO: 394832 - DNA, 25 bp, Rattus norvegicus
gcccttttatttatccttgcatgca

SEQ ID NO: 394833 - DNA, 25 bp, Rattus norvegicus
gcccttttatttttccttgcatgca

SEQ ID NO: 394834 - DNA, 25 bp, Rattus norvegicus
gcccttttctcccagaggttggaag

SEQ ID NO: 394835 - DNA, 25 bp, Rattus norvegicus
gcccttttctccgagaggttggaag

SEQ ID NO: 394836 - DNA, 25 bp, Rattus norvegicus
gcccttttgcagctaggcctagagg

SEQ ID NO: 394837 - DNA, 25 bp, Rattus norvegicus
gcccttttgcaggtaggcctagagg

SEQ ID NO: 394838 - DNA, 25 bp, Rattus norvegicus
gcccttttggaaaacacggcagtga

SEQ ID NO: 394839 - DNA, 25 bp, Rattus norvegicus
gcccttttggaatacacggcagtga

SEQ ID NO: 394840 - DNA, 25 bp, Rattus norvegicus
gccgaaaggctgacacattccatgt

SEQ ID NO: 394841 - DNA, 25 bp, Rattus norvegicus
gccgaaaggctgtcacattccatgt

SEQ ID NO: 394842 - DNA, 25 bp, Rattus norvegicus
gccgaaatgttacgcggtctcgatt

SEQ ID NO: 394843 - DNA, 25 bp, Rattus norvegicus
gccgaaatgttaggcggtctcgatt

SEQ ID NO: 394844 - DNA, 25 bp, Rattus norvegicus
gccgaaattggccacttttgtgaca

SEQ ID NO: 394845 - DNA, 25 bp, Rattus norvegicus
gccgaaattggcgacttttgtgaca

SEQ ID NO: 394846 - DNA, 25 bp, Rattus norvegicus
gccgaacaacttaatcacaaatagg

SEQ ID NO: 394847 - DNA, 25 bp, Rattus norvegicus
gccgaacaactttatcacaaatagg

SEQ ID NO: 394848 - DNA, 25 bp, Rattus norvegicus
gccgaacagagcagtccagggtgat

SEQ ID NO: 394849 - DNA, 25 bp, Rattus norvegicus
gccgaacagagctgtccagggtgat

SEQ ID NO: 394850 - DNA, 25 bp, Rattus norvegicus
gccgaacagtcaaaatatccctcat

SEQ ID NO: 394851 - DNA, 25 bp, Rattus norvegicus
gccgaacagtcataatatccctcat

SEQ ID NO: 394852 - DNA, 25 bp, Rattus norvegicus
gccgaagactgacgcttccccagaa

SEQ ID NO: 394853 - DNA, 25 bp, Rattus norvegicus
gccgaagactgaggcttccccagaa

SEQ ID NO: 394854 - DNA, 25 bp, Rattus norvegicus
gccgaagcggtgctccattggttaa

SEQ ID NO: 394855 - DNA, 25 bp, Rattus norvegicus
gccgaagcggtggtccattggttaa

SEQ ID NO: 394856 - DNA, 25 bp, Rattus norvegicus
gccgaaggatgtatgacctccggat

SEQ ID NO: 394857 - DNA, 25 bp, Rattus norvegicus
gccgaaggatgtttgacctccggat

SEQ ID NO: 394858 - DNA, 25 bp, Rattus norvegicus
gccgaaggcgcaaaggaaacatggt

SEQ ID NO: 394859 - DNA, 25 bp, Rattus norvegicus
gccgaaggcgcataggaaacatggt

SEQ ID NO: 394860 - DNA, 25 bp, Rattus norvegicus
gccgaagggcttattcttgcttctt

SEQ ID NO: 394861 - DNA, 25 bp, Rattus norvegicus
gccgaagggctttttcttgcttctt

SEQ ID NO: 394862 - DNA, 25 bp, Rattus norvegicus
gccgaagtgtcactcagcaggttgt

SEQ ID NO: 394863 - DNA, 25 bp, Rattus norvegicus
gccgaagtgtcagtcagcaggttgt

SEQ ID NO: 394864 - DNA, 25 bp, Rattus norvegicus
gccgaatggtttcaggcaggctatt

SEQ ID NO: 394865 - DNA, 25 bp, Rattus norvegicus
gccgaatggtttgaggcaggctatt

SEQ ID NO: 394866 - DNA, 25 bp, Rattus norvegicus
gccgaatttcggcagcgtttttgag

SEQ ID NO: 394867 - DNA, 25 bp, Rattus norvegicus
gccgaatttcgggagcgtttttgag

SEQ ID NO: 394868 - DNA, 25 bp, Rattus norvegicus
gccgacaaatgcaagagatcacctg

SEQ ID NO: 394869 - DNA, 25 bp, Rattus norvegicus
gccgacaaatgctagagatcacctg

SEQ ID NO: 394870 - DNA, 25 bp, Rattus norvegicus
gccgacaagatacctctcgcatgtc

SEQ ID NO: 394871 - DNA, 25 bp, Rattus norvegicus
gccgacaagatagctctcgcatgtc

SEQ ID NO: 394872 - DNA, 25 bp, Rattus norvegicus
gccgacaaggataactgcttcgcca

SEQ ID NO: 394873 - DNA, 25 bp, Rattus norvegicus
gccgacaaggattactgcttcgcca

SEQ ID NO: 394874 - DNA, 25 bp, Rattus norvegicus
gccgacaatggcatcgttctggaag

SEQ ID NO: 394875 - DNA, 25 bp, Rattus norvegicus
gccgacaatggcttcgttctggaag

SEQ ID NO: 394876 - DNA, 25 bp, Rattus norvegicus
gccgacagacatacataggtcacga

SEQ ID NO: 394877 - DNA, 25 bp, Rattus norvegicus
gccgacagacattcataggtcacga

SEQ ID NO: 394878 - DNA, 25 bp, Rattus norvegicus
gccgacagctctcgctgctggtgta

SEQ ID NO: 394879 - DNA, 25 bp, Rattus norvegicus
gccgacagctctggctgctggtgta

SEQ ID NO: 394880 - DNA, 25 bp, Rattus norvegicus
gccgacaggcttcggattatgaaaa

SEQ ID NO: 394881 - DNA, 25 bp, Rattus norvegicus
gccgacaggcttgggattatgaaaa

SEQ ID NO: 394882 - DNA, 25 bp, Rattus norvegicus
gccgacagggtgaagaaagcccatt

SEQ ID NO: 394883 - DNA, 25 bp, Rattus norvegicus
gccgacagggtgtagaaagcccatt

SEQ ID NO: 394884 - DNA, 25 bp, Rattus norvegicus
gccgacatgattacagtgacactca

SEQ ID NO: 394885 - DNA, 25 bp, Rattus norvegicus
gccgacatgatttcagtgacactca

SEQ ID NO: 394886 - DNA, 25 bp, Rattus norvegicus
gccgacatgcttcatgaacagcgcg

SEQ ID NO: 394887 - DNA, 25 bp, Rattus norvegicus
gccgacatgcttgatgaacagcgcg

SEQ ID NO: 394888 - DNA, 25 bp, Rattus norvegicus
gccgacattggcaacaagaccttct

SEQ ID NO: 394889 - DNA, 25 bp, Rattus norvegicus
gccgacattggctacaagaccttct

SEQ ID NO: 394890 - DNA, 25 bp, Rattus norvegicus
gccgacccaatgacatcatggcaga

SEQ ID NO: 394891 - DNA, 25 bp, Rattus norvegicus
gccgacccaatgtcatcatggcaga

SEQ ID NO: 394892 - DNA, 25 bp, Rattus norvegicus
gccgaccgcagcacagcagaagtat

SEQ ID NO: 394893 - DNA, 25 bp, Rattus norvegicus
gccgaccgcagctcagcagaagtat

SEQ ID NO: 394894 - DNA, 25 bp, Rattus norvegicus
gccgacctaattacccgtattgtgg

SEQ ID NO: 394895 - DNA, 25 bp, Rattus norvegicus
gccgacctaatttcccgtattgtgg

SEQ ID NO: 394896 - DNA, 25 bp, Rattus norvegicus
gccgacctagggatccacagatgaa

SEQ ID NO: 394897 - DNA, 25 bp, Rattus norvegicus
gccgacctagggttccacagatgaa

SEQ ID NO: 394898 - DNA, 25 bp, Rattus norvegicus
gccgacctctagaggcagatctgga

SEQ ID NO: 394899 - DNA, 25 bp, Rattus norvegicus
gccgacctctagtggcagatctgga

SEQ ID NO: 394900 - DNA, 25 bp, Rattus norvegicus
gccgacgaagtgaagttacaacaga

SEQ ID NO: 394901 - DNA, 25 bp, Rattus norvegicus
gccgacgaagtgtagttacaacaga

SEQ ID NO: 394902 - DNA, 25 bp, Rattus norvegicus
gccgacgctgacaccagtgtggata

SEQ ID NO: 394903 - DNA, 25 bp, Rattus norvegicus
gccgacgctgactccagtgtggata

SEQ ID NO: 394904 - DNA, 25 bp, Rattus norvegicus
gccgacggttgccaagacctttata

SEQ ID NO: 394905 - DNA, 25 bp, Rattus norvegicus
gccgacggttgcgaagacctttata

SEQ ID NO: 394906 - DNA, 25 bp, Rattus norvegicus
gccgacgtcctacttacgtggagtt

SEQ ID NO: 394907 - DNA, 25 bp, Rattus norvegicus
gccgacgtcctagttacgtggagtt

SEQ ID NO: 394908 - DNA, 25 bp, Rattus norvegicus
gccgactacaggctgatgggaccaa

SEQ ID NO: 394909 - DNA, 25 bp, Rattus norvegicus
gccgactacagggtgatgggaccaa

SEQ ID NO: 394910 - DNA, 25 bp, Rattus norvegicus
gccgactcacttctgttcaaaatgg

SEQ ID NO: 394911 - DNA, 25 bp, Rattus norvegicus
gccgactcacttgtgttcaaaatgg

SEQ ID NO: 394912 - DNA, 25 bp, Rattus norvegicus
gccgactccggaattggcaggacag

SEQ ID NO: 394913 - DNA, 25 bp, Rattus norvegicus
gccgactccggatttggcaggacag

SEQ ID NO: 394914 - DNA, 25 bp, Rattus norvegicus
gccgacttgctccaatttgcagttt

SEQ ID NO: 394915 - DNA, 25 bp, Rattus norvegicus
gccgacttgctcgaatttgcagttt

SEQ ID NO: 394916 - DNA, 25 bp, Rattus norvegicus
gccgagaaagttccgcgcggagact

SEQ ID NO: 394917 - DNA, 25 bp, Rattus norvegicus
gccgagaaagttgcgcgcggagact

SEQ ID NO: 394918 - DNA, 25 bp, Rattus norvegicus
gccgagaacgctattttgagatgta

SEQ ID NO: 394919 - DNA, 25 bp, Rattus norvegicus
gccgagaacgcttttttgagatgta

SEQ ID NO: 394920 - DNA, 25 bp, Rattus norvegicus
gccgagaggaatacacccttcttgt

SEQ ID NO: 394921 - DNA, 25 bp, Rattus norvegicus
gccgagaggaattcacccttcttgt

SEQ ID NO: 394922 - DNA, 25 bp, Rattus norvegicus
gccgagaggaggaactctgctctgt

SEQ ID NO: 394923 - DNA, 25 bp, Rattus norvegicus
gccgagaggaggtactctgctctgt

SEQ ID NO: 394924 - DNA, 25 bp, Rattus norvegicus
gccgagaggctgaggtcctccagaa

SEQ ID NO: 394925 - DNA, 25 bp, Rattus norvegicus
gccgagaggctgtggtcctccagaa

SEQ ID NO: 394926 - DNA, 25 bp, Rattus norvegicus
gccgagaggtcaagcgtgtactcat

SEQ ID NO: 394927 - DNA, 25 bp, Rattus norvegicus
gccgagaggtcatgcgtgtactcat

SEQ ID NO: 394928 - DNA, 25 bp, Rattus norvegicus
gccgagataccacctagttatgctg

SEQ ID NO: 394929 - DNA, 25 bp, Rattus norvegicus
gccgagataccagctagttatgctg

SEQ ID NO: 394930 - DNA, 25 bp, Rattus norvegicus
gccgagatgcagaaaactccatgtt

SEQ ID NO: 394931 - DNA, 25 bp, Rattus norvegicus
gccgagatgcagtaaactccatgtt

SEQ ID NO: 394932 - DNA, 25 bp, Rattus norvegicus
gccgagatgcgtctcagaggatcaa

SEQ ID NO: 394933 - DNA, 25 bp, Rattus norvegicus
gccgagatgcgtgtcagaggatcaa

SEQ ID NO: 394934 - DNA, 25 bp, Rattus norvegicus
gccgagatttcacgtgtgcacccaa

SEQ ID NO: 394935 - DNA, 25 bp, Rattus norvegicus
gccgagatttcaggtgtgcacccaa

SEQ ID NO: 394936 - DNA, 25 bp, Rattus norvegicus
gccgagcaaacaatctagcaaaaaa

SEQ ID NO: 394937 - DNA, 25 bp, Rattus norvegicus
gccgagcaaacattctagcaaaaaa

SEQ ID NO: 394938 - DNA, 25 bp, Rattus norvegicus
gccgagcattcaaacacaggagtgt

SEQ ID NO: 394939 - DNA, 25 bp, Rattus norvegicus
gccgagcattcatacacaggagtgt

SEQ ID NO: 394940 - DNA, 25 bp, Rattus norvegicus
gccgagccaccgagtgaggagccat

SEQ ID NO: 394941 - DNA, 25 bp, Rattus norvegicus
gccgagccaccgtgtgaggagccat

SEQ ID NO: 394942 - DNA, 25 bp, Rattus norvegicus
gccgagccctgtctgtgttctgaga

SEQ ID NO: 394943 - DNA, 25 bp, Rattus norvegicus
gccgagccctgtgtgtgttctgaga

SEQ ID NO: 394944 - DNA, 25 bp, Rattus norvegicus
gccgagcgcgccagcagctggaaca

SEQ ID NO: 394945 - DNA, 25 bp, Rattus norvegicus
gccgagcgcgcctgcagctggaaca

SEQ ID NO: 394946 - DNA, 25 bp, Rattus norvegicus
gccgagctacctaccggatagagga

SEQ ID NO: 394947 - DNA, 25 bp, Rattus norvegicus
gccgagctaccttccggatagagga

SEQ ID NO: 394948 - DNA, 25 bp, Rattus norvegicus
gccgagctgcatctcctgggataaa

SEQ ID NO: 394949 - DNA, 25 bp, Rattus norvegicus
gccgagctgcatgtcctgggataaa

SEQ ID NO: 394950 - DNA, 25 bp, Rattus norvegicus
gccgagctgtctaagcaggctactg

SEQ ID NO: 394951 - DNA, 25 bp, Rattus norvegicus
gccgagctgtcttagcaggctactg

SEQ ID NO: 394952 - DNA, 25 bp, Rattus norvegicus
gccgaggaagcgcaggaacaatcca

SEQ ID NO: 394953 - DNA, 25 bp, Rattus norvegicus
gccgaggaagcggaggaacaatcca

SEQ ID NO: 394954 - DNA, 25 bp, Rattus norvegicus
gccgaggactggagatctgcgcata

SEQ ID NO: 394955 - DNA, 25 bp, Rattus norvegicus
gccgaggactggtgatctgcgcata

SEQ ID NO: 394956 - DNA, 25 bp, Rattus norvegicus
gccgaggacttgagtaagttttcca

SEQ ID NO: 394957 - DNA, 25 bp, Rattus norvegicus
gccgaggacttgtgtaagttttcca

SEQ ID NO: 394958 - DNA, 25 bp, Rattus norvegicus
gccgaggagcttacagtgcaatttc

SEQ ID NO: 394959 - DNA, 25 bp, Rattus norvegicus
gccgaggagctttcagtgcaatttc

SEQ ID NO: 394960 - DNA, 25 bp, Rattus norvegicus
gccgaggccagaactcttacttaat

SEQ ID NO: 394961 - DNA, 25 bp, Rattus norvegicus
gccgaggccagatctcttacttaat

SEQ ID NO: 394962 - DNA, 25 bp, Rattus norvegicus
gccgaggctgtacatgcaagaccct

SEQ ID NO: 394963 - DNA, 25 bp, Rattus norvegicus
gccgaggctgtagatgcaagaccct

SEQ ID NO: 394964 - DNA, 25 bp, Rattus norvegicus
gccgaggtcccgcaaggcatgggat

SEQ ID NO: 394965 - DNA, 25 bp, Rattus norvegicus
gccgaggtcccggaaggcatgggat

SEQ ID NO: 394966 - DNA, 25 bp, Rattus norvegicus
gccgaggtcgtcatgtaatttctta

SEQ ID NO: 394967 - DNA, 25 bp, Rattus norvegicus
gccgaggtcgtcttgtaatttctta

SEQ ID NO: 394968 - DNA, 25 bp, Rattus norvegicus
gccgaggtttccaaaagctgataaa

SEQ ID NO: 394969 - DNA, 25 bp, Rattus norvegicus
gccgaggtttcctaaagctgataaa

SEQ ID NO: 394970 - DNA, 25 bp, Rattus norvegicus
gccgagtacaagacatcagagtcct

SEQ ID NO: 394971 - DNA, 25 bp, Rattus norvegicus
gccgagtacaagtcatcagagtcct

SEQ ID NO: 394972 - DNA, 25 bp, Rattus norvegicus
gccgagtagggcaggtatttttata

SEQ ID NO: 394973 - DNA, 25 bp, Rattus norvegicus
gccgagtagggctggtatttttata

SEQ ID NO: 394974 - DNA, 25 bp, Rattus norvegicus
gccgagtatgacctgtctccggaga

SEQ ID NO: 394975 - DNA, 25 bp, Rattus norvegicus
gccgagtatgacgtgtctccggaga

SEQ ID NO: 394976 - DNA, 25 bp, Rattus norvegicus
gccgagtattgcacttgatccatat

SEQ ID NO: 394977 - DNA, 25 bp, Rattus norvegicus
gccgagtattgctcttgatccatat

SEQ ID NO: 394978 - DNA, 25 bp, Rattus norvegicus
gccgagtcatttaataccatggaga

SEQ ID NO: 394979 - DNA, 25 bp, Rattus norvegicus
gccgagtcattttataccatggaga

SEQ ID NO: 394980 - DNA, 25 bp, Rattus norvegicus
gccgagtggcagagctggtccccac

SEQ ID NO: 394981 - DNA, 25 bp, Rattus norvegicus
gccgagtggcagtgctggtccccac

SEQ ID NO: 394982 - DNA, 25 bp, Rattus norvegicus
gccgagtggtgccacaaagcttccg

SEQ ID NO: 394983 - DNA, 25 bp, Rattus norvegicus
gccgagtggtgcgacaaagcttccg

SEQ ID NO: 394984 - DNA, 25 bp, Rattus norvegicus
gccgagttggagactcaccttgtat

SEQ ID NO: 394985 - DNA, 25 bp, Rattus norvegicus
gccgagttggagtctcaccttgtat

SEQ ID NO: 394986 - DNA, 25 bp, Rattus norvegicus
gccgagtttgccactgaggatgaag

SEQ ID NO: 394987 - DNA, 25 bp, Rattus norvegicus
gccgagtttgcctctgaggatgaag

SEQ ID NO: 394988 - DNA, 25 bp, Rattus norvegicus
gccgatatcctgcagctgagcgtta

SEQ ID NO: 394989 - DNA, 25 bp, Rattus norvegicus
gccgatatcctggagctgagcgtta

SEQ ID NO: 394990 - DNA, 25 bp, Rattus norvegicus
gccgatatgtgaagctgacccttca

SEQ ID NO: 394991 - DNA, 25 bp, Rattus norvegicus
gccgatatgtgatgctgacccttca

SEQ ID NO: 394992 - DNA, 25 bp, Rattus norvegicus
gccgatcgtggaccgtgccagtcat

SEQ ID NO: 394993 - DNA, 25 bp, Rattus norvegicus
gccgatcgtggagcgtgccagtcat

SEQ ID NO: 394994 - DNA, 25 bp, Rattus norvegicus
gccgatgagcacagccatgtggagt

SEQ ID NO: 394995 - DNA, 25 bp, Rattus norvegicus
gccgatgagcactgccatgtggagt

SEQ ID NO: 394996 - DNA, 25 bp, Rattus norvegicus
gccgatgaggctagcttttacaaaa

SEQ ID NO: 394997 - DNA, 25 bp, Rattus norvegicus
gccgatgaggcttgcttttacaaaa

SEQ ID NO: 394998 - DNA, 25 bp, Rattus norvegicus
gccgatgccagtccccaggttagga

SEQ ID NO: 394999 - DNA, 25 bp, Rattus norvegicus
gccgatgccagtgcccaggttagga

SEQ ID NO: 395000 - DNA, 25 bp, Rattus norvegicus
gccgatgccggcatgtttggtagcc

SEQ ID NO: 395001 - DNA, 25 bp, Rattus norvegicus
gccgatgccggcttgtttggtagcc

SEQ ID NO: 395002 - DNA, 25 bp, Rattus norvegicus
gccgatggtagtctcccatgaggat

SEQ ID NO: 395003 - DNA, 25 bp, Rattus norvegicus
gccgatggtagtgtcccatgaggat

SEQ ID NO: 395004 - DNA, 25 bp, Rattus norvegicus
gccgatgtcctgcacgtatgagagt

SEQ ID NO: 395005 - DNA, 25 bp, Rattus norvegicus
gccgatgtcctggacgtatgagagt

SEQ ID NO: 395006 - DNA, 25 bp, Rattus norvegicus
gccgatgtgatgcttacagatgttc

SEQ ID NO: 395007 - DNA, 25 bp, Rattus norvegicus
gccgatgtgatggttacagatgttc

SEQ ID NO: 395008 - DNA, 25 bp, Rattus norvegicus
gccgatgttacacttctttgacctt

SEQ ID NO: 395009 - DNA, 25 bp, Rattus norvegicus
gccgatgttacagttctttgacctt

SEQ ID NO: 395010 - DNA, 25 bp, Rattus norvegicus
gccgattcatggatgggagccccta

SEQ ID NO: 395011 - DNA, 25 bp, Rattus norvegicus
gccgattcatggttgggagccccta

SEQ ID NO: 395012 - DNA, 25 bp, Rattus norvegicus
gccgattcctccctctggaaataaa

SEQ ID NO: 395013 - DNA, 25 bp, Rattus norvegicus
gccgattcctccgtctggaaataaa

SEQ ID NO: 395014 - DNA, 25 bp, Rattus norvegicus
gccgatttccggctgtgtatgtgtc

SEQ ID NO: 395015 - DNA, 25 bp, Rattus norvegicus
gccgatttccgggtgtgtatgtgtc

SEQ ID NO: 395016 - DNA, 25 bp, Rattus norvegicus
gccgatttggcgcactcatgccaat

SEQ ID NO: 395017 - DNA, 25 bp, Rattus norvegicus
gccgatttggcggactcatgccaat

SEQ ID NO: 395018 - DNA, 25 bp, Rattus norvegicus
gccgattttcagaggaggcccgcac

SEQ ID NO: 395019 - DNA, 25 bp, Rattus norvegicus
gccgattttcagtggaggcccgcac

SEQ ID NO: 395020 - DNA, 25 bp, Rattus norvegicus
gccgcaaggtccagggcctataaaa

SEQ ID NO: 395021 - DNA, 25 bp, Rattus norvegicus
gccgcaaggtcctgggcctataaaa

SEQ ID NO: 395022 - DNA, 25 bp, Rattus norvegicus
gccgcacacaacactgtcgtaatag

SEQ ID NO: 395023 - DNA, 25 bp, Rattus norvegicus
gccgcacacaactctgtcgtaatag

SEQ ID NO: 395024 - DNA, 25 bp, Rattus norvegicus
gccgcacacagtaggttatcttcaa

SEQ ID NO: 395025 - DNA, 25 bp, Rattus norvegicus
gccgcacacagttggttatcttcaa

SEQ ID NO: 395026 - DNA, 25 bp, Rattus norvegicus
gccgcacgatgcatacaaaagggag

SEQ ID NO: 395027 - DNA, 25 bp, Rattus norvegicus
gccgcacgatgcttacaaaagggag

SEQ ID NO: 395028 - DNA, 25 bp, Rattus norvegicus
gccgcacggtgaccaggacactgac

SEQ ID NO: 395029 - DNA, 25 bp, Rattus norvegicus
gccgcacggtgagcaggacactgac

SEQ ID NO: 395030 - DNA, 25 bp, Rattus norvegicus
gccgcactgtggaccattgtactta

SEQ ID NO: 395031 - DNA, 25 bp, Rattus norvegicus
gccgcactgtggtccattgtactta

SEQ ID NO: 395032 - DNA, 25 bp, Rattus norvegicus
gccgcagaaaccctctttgaatttg

SEQ ID NO: 395033 - DNA, 25 bp, Rattus norvegicus
gccgcagaaaccgtctttgaatttg

SEQ ID NO: 395034 - DNA, 25 bp, Rattus norvegicus
gccgcagaccataatctggcgggag

SEQ ID NO: 395035 - DNA, 25 bp, Rattus norvegicus
gccgcagaccattatctggcgggag

SEQ ID NO: 395036 - DNA, 25 bp, Rattus norvegicus
gccgcagaccgcacagcatgtggag

SEQ ID NO: 395037 - DNA, 25 bp, Rattus norvegicus
gccgcagaccgctcagcatgtggag

SEQ ID NO: 395038 - DNA, 25 bp, Rattus norvegicus
gccgcagagccccaaggatgatgac

SEQ ID NO: 395039 - DNA, 25 bp, Rattus norvegicus
gccgcagagcccgaaggatgatgac

SEQ ID NO: 395040 - DNA, 25 bp, Rattus norvegicus
gccgcagagtacattcgactttgga

SEQ ID NO: 395041 - DNA, 25 bp, Rattus norvegicus
gccgcagagtactttcgactttgga

SEQ ID NO: 395042 - DNA, 25 bp, Rattus norvegicus
gccgcagcaatgactatgaggtcca

SEQ ID NO: 395043 - DNA, 25 bp, Rattus norvegicus
gccgcagcaatgtctatgaggtcca

SEQ ID NO: 395044 - DNA, 25 bp, Rattus norvegicus
gccgcagcctacagtgacagttatg

SEQ ID NO: 395045 - DNA, 25 bp, Rattus norvegicus
gccgcagcctactgtgacagttatg

SEQ ID NO: 395046 - DNA, 25 bp, Rattus norvegicus
gccgcagccttcattttagacagga

SEQ ID NO: 395047 - DNA, 25 bp, Rattus norvegicus
gccgcagccttctttttagacagga

SEQ ID NO: 395048 - DNA, 25 bp, Rattus norvegicus
gccgcaggccatacatgttgcagat

SEQ ID NO: 395049 - DNA, 25 bp, Rattus norvegicus
gccgcaggccattcatgttgcagat

SEQ ID NO: 395050 - DNA, 25 bp, Rattus norvegicus
gccgcaggcctacggactaagcaag

SEQ ID NO: 395051 - DNA, 25 bp, Rattus norvegicus
gccgcaggcctagggactaagcaag

SEQ ID NO: 395052 - DNA, 25 bp, Rattus norvegicus
gccgcagggacaccgactgcctagt

SEQ ID NO: 395053 - DNA, 25 bp, Rattus norvegicus
gccgcagggacagcgactgcctagt

SEQ ID NO: 395054 - DNA, 25 bp, Rattus norvegicus
gccgcagggtcaatgatatcctaag

SEQ ID NO: 395055 - DNA, 25 bp, Rattus norvegicus
gccgcagggtcattgatatcctaag

SEQ ID NO: 395056 - DNA, 25 bp, Rattus norvegicus
gccgcagtgcaacggacagacgtaa

SEQ ID NO: 395057 - DNA, 25 bp, Rattus norvegicus
gccgcagtgcaagggacagacgtaa

SEQ ID NO: 395058 - DNA, 25 bp, Rattus norvegicus
gccgcagtgctcacatgaagagtca

SEQ ID NO: 395059 - DNA, 25 bp, Rattus norvegicus
gccgcagtgctctcatgaagagtca

SEQ ID NO: 395060 - DNA, 25 bp, Rattus norvegicus
gccgcatacatacagtccgagttcg

SEQ ID NO: 395061 - DNA, 25 bp, Rattus norvegicus
gccgcatacatagagtccgagttcg

SEQ ID NO: 395062 - DNA, 25 bp, Rattus norvegicus
gccgcatacgcgcagaacgtgctta

SEQ ID NO: 395063 - DNA, 25 bp, Rattus norvegicus
gccgcatacgcggagaacgtgctta

SEQ ID NO: 395064 - DNA, 25 bp, Rattus norvegicus
gccgcatcagcactcaggaatcttt

SEQ ID NO: 395065 - DNA, 25 bp, Rattus norvegicus
gccgcatcagcagtcaggaatcttt

SEQ ID NO: 395066 - DNA, 25 bp, Rattus norvegicus
gccgcatccacaaggacgacacggg

SEQ ID NO: 395067 - DNA, 25 bp, Rattus norvegicus
gccgcatccacatggacgacacggg

SEQ ID NO: 395068 - DNA, 25 bp, Rattus norvegicus
gccgcatgctgaagggccgcaagtc

SEQ ID NO: 395069 - DNA, 25 bp, Rattus norvegicus
gccgcatgctgatgggccgcaagtc

SEQ ID NO: 395070 - DNA, 25 bp, Rattus norvegicus
gccgcatgctggcaggtaaagttca

SEQ ID NO: 395071 - DNA, 25 bp, Rattus norvegicus
gccgcatgctgggaggtaaagttca

SEQ ID NO: 395072 - DNA, 25 bp, Rattus norvegicus
gccgcattaataattctcctgttga

SEQ ID NO: 395073 - DNA, 25 bp, Rattus norvegicus
gccgcattaatatttctcctgttga

SEQ ID NO: 395074 - DNA, 25 bp, Rattus norvegicus
gccgcattcacccttttgttgagaa

SEQ ID NO: 395075 - DNA, 25 bp, Rattus norvegicus
gccgcattcaccgttttgttgagaa

SEQ ID NO: 395076 - DNA, 25 bp, Rattus norvegicus
gccgccaaacttatgatcagaactt

SEQ ID NO: 395077 - DNA, 25 bp, Rattus norvegicus
gccgccaaacttttgatcagaactt

SEQ ID NO: 395078 - DNA, 25 bp, Rattus norvegicus
gccgccaacctaatatctacaatga

SEQ ID NO: 395079 - DNA, 25 bp, Rattus norvegicus
gccgccaacctattatctacaatga

SEQ ID NO: 395080 - DNA, 25 bp, Rattus norvegicus
gccgccaatgaacagtaacttgaga

SEQ ID NO: 395081 - DNA, 25 bp, Rattus norvegicus
gccgccaatgaagagtaacttgaga

SEQ ID NO: 395082 - DNA, 25 bp, Rattus norvegicus
gccgccaatgctagttcaggcacgc

SEQ ID NO: 395083 - DNA, 25 bp, Rattus norvegicus
gccgccaatgcttgttcaggcacgc

SEQ ID NO: 395084 - DNA, 25 bp, Rattus norvegicus
gccgccactgctcggaatgctgaag

SEQ ID NO: 395085 - DNA, 25 bp, Rattus norvegicus
gccgccactgctgggaatgctgaag

SEQ ID NO: 395086 - DNA, 25 bp, Rattus norvegicus
gccgccagccgtcgaaggagcctaa

SEQ ID NO: 395087 - DNA, 25 bp, Rattus norvegicus
gccgccagccgtggaaggagcctaa

SEQ ID NO: 395088 - DNA, 25 bp, Rattus norvegicus
gccgccatcagtctgcatgctttta

SEQ ID NO: 395089 - DNA, 25 bp, Rattus norvegicus
gccgccatcagtgtgcatgctttta

SEQ ID NO: 395090 - DNA, 25 bp, Rattus norvegicus
gccgccatggttacgtggtgacaga

SEQ ID NO: 395091 - DNA, 25 bp, Rattus norvegicus
gccgccatggtttcgtggtgacaga

SEQ ID NO: 395092 - DNA, 25 bp, Rattus norvegicus
gccgccattacgagcccttaaagag

SEQ ID NO: 395093 - DNA, 25 bp, Rattus norvegicus
gccgccattacgtgcccttaaagag

SEQ ID NO: 395094 - DNA, 25 bp, Rattus norvegicus
gccgccattgttcagatggtcccag

SEQ ID NO: 395095 - DNA, 25 bp, Rattus norvegicus
gccgccattgttgagatggtcccag

SEQ ID NO: 395096 - DNA, 25 bp, Rattus norvegicus
gccgcccactctatatgcaaatgtt

SEQ ID NO: 395097 - DNA, 25 bp, Rattus norvegicus
gccgcccactctttatgcaaatgtt

SEQ ID NO: 395098 - DNA, 25 bp, Rattus norvegicus
gccgcccagcagataacgccgaggg

SEQ ID NO: 395099 - DNA, 25 bp, Rattus norvegicus
gccgcccagcagttaacgccgaggg

SEQ ID NO: 395100 - DNA, 25 bp, Rattus norvegicus
gccgcccagtgaatcttatctaaag

SEQ ID NO: 395101 - DNA, 25 bp, Rattus norvegicus
gccgcccagtgattcttatctaaag

SEQ ID NO: 395102 - DNA, 25 bp, Rattus norvegicus
gccgcccatctacctcagattttta

SEQ ID NO: 395103 - DNA, 25 bp, Rattus norvegicus
gccgcccatctagctcagattttta

SEQ ID NO: 395104 - DNA, 25 bp, Rattus norvegicus
gccgcccgcatacttgaatgtacat

SEQ ID NO: 395105 - DNA, 25 bp, Rattus norvegicus
gccgcccgcatagttgaatgtacat

SEQ ID NO: 395106 - DNA, 25 bp, Rattus norvegicus
gccgccctaggcaccagggtgtgat

SEQ ID NO: 395107 - DNA, 25 bp, Rattus norvegicus
gccgccctaggctccagggtgtgat

SEQ ID NO: 395108 - DNA, 25 bp, Rattus norvegicus
gccgccgaattcagcttggacttaa

SEQ ID NO: 395109 - DNA, 25 bp, Rattus norvegicus
gccgccgaattctgcttggacttaa

SEQ ID NO: 395110 - DNA, 25 bp, Rattus norvegicus
gccgccgagagcactacacataaaa

SEQ ID NO: 395111 - DNA, 25 bp, Rattus norvegicus
gccgccgagagctctacacataaaa

SEQ ID NO: 395112 - DNA, 25 bp, Rattus norvegicus
gccgccgccgggactcatgagctga

SEQ ID NO: 395113 - DNA, 25 bp, Rattus norvegicus
gccgccgccgggtctcatgagctga

SEQ ID NO: 395114 - DNA, 25 bp, Rattus norvegicus
gccgccgcgaatccgagaagcagaa

SEQ ID NO: 395115 - DNA, 25 bp, Rattus norvegicus
gccgccgcgaatgcgagaagcagaa

SEQ ID NO: 395116 - DNA, 25 bp, Rattus norvegicus
gccgccgcgtggagatggctaacct

SEQ ID NO: 395117 - DNA, 25 bp, Rattus norvegicus
gccgccgcgtggtgatggctaacct

SEQ ID NO: 395118 - DNA, 25 bp, Rattus norvegicus
gccgccggagagactagacgctttc

SEQ ID NO: 395119 - DNA, 25 bp, Rattus norvegicus
gccgccggagagtctagacgctttc

SEQ ID NO: 395120 - DNA, 25 bp, Rattus norvegicus
gccgccggcacactatggacaagga

SEQ ID NO: 395121 - DNA, 25 bp, Rattus norvegicus
gccgccggcacagtatggacaagga

SEQ ID NO: 395122 - DNA, 25 bp, Rattus norvegicus
gccgcctaacgtctcgactatcggg

SEQ ID NO: 395123 - DNA, 25 bp, Rattus norvegicus
gccgcctaacgtgtcgactatcggg

SEQ ID NO: 395124 - DNA, 25 bp, Rattus norvegicus
gccgcctaagacaccagtgagacta

SEQ ID NO: 395125 - DNA, 25 bp, Rattus norvegicus
gccgcctaagactccagtgagacta

SEQ ID NO: 395126 - DNA, 25 bp, Rattus norvegicus
gccgcctctttcagaaaccaagaga

SEQ ID NO: 395127 - DNA, 25 bp, Rattus norvegicus
gccgcctctttctgaaaccaagaga

SEQ ID NO: 395128 - DNA, 25 bp, Rattus norvegicus
gccgcctcttttcagtgaagtctcg

SEQ ID NO: 395129 - DNA, 25 bp, Rattus norvegicus
gccgcctcttttgagtgaagtctcg

SEQ ID NO: 395130 - DNA, 25 bp, Rattus norvegicus
gccgcctgacttaactcgtcagaaa

SEQ ID NO: 395131 - DNA, 25 bp, Rattus norvegicus
gccgcctgactttactcgtcagaaa

SEQ ID NO: 395132 - DNA, 25 bp, Rattus norvegicus
gccgcctgcaggacgaccatatgga

SEQ ID NO: 395133 - DNA, 25 bp, Rattus norvegicus
gccgcctgcaggtcgaccatatgga

SEQ ID NO: 395134 - DNA, 25 bp, Rattus norvegicus
gccgcctggtggatgctctgaagaa

SEQ ID NO: 395135 - DNA, 25 bp, Rattus norvegicus
gccgcctggtggttgctctgaagaa

SEQ ID NO: 395136 - DNA, 25 bp, Rattus norvegicus
gccgcctggttgaaattctggcatt

SEQ ID NO: 395137 - DNA, 25 bp, Rattus norvegicus
gccgcctggttgtaattctggcatt

SEQ ID NO: 395138 - DNA, 25 bp, Rattus norvegicus
gccgcctgtggtacttgatattttc

SEQ ID NO: 395139 - DNA, 25 bp, Rattus norvegicus
gccgcctgtggttcttgatattttc

SEQ ID NO: 395140 - DNA, 25 bp, Rattus norvegicus
gccgccttatggaggatgatgtcat

SEQ ID NO: 395141 - DNA, 25 bp, Rattus norvegicus
gccgccttatggtggatgatgtcat

SEQ ID NO: 395142 - DNA, 25 bp, Rattus norvegicus
gccgcctttcttctcaaggatcaaa

SEQ ID NO: 395143 - DNA, 25 bp, Rattus norvegicus
gccgcctttcttgtcaaggatcaaa

SEQ ID NO: 395144 - DNA, 25 bp, Rattus norvegicus
gccgcgacatttcctttgttttaag

SEQ ID NO: 395145 - DNA, 25 bp, Rattus norvegicus
gccgcgacatttgctttgttttaag

SEQ ID NO: 395146 - DNA, 25 bp, Rattus norvegicus
gccgcgagcacaccctgattgaaga

SEQ ID NO: 395147 - DNA, 25 bp, Rattus norvegicus
gccgcgagcacagcctgattgaaga

SEQ ID NO: 395148 - DNA, 25 bp, Rattus norvegicus
gccgcgatgaaacgcgcagttccta

SEQ ID NO: 395149 - DNA, 25 bp, Rattus norvegicus
gccgcgatgaaaggcgcagttccta

SEQ ID NO: 395150 - DNA, 25 bp, Rattus norvegicus
gccgcgattatacccgatgactcag

SEQ ID NO: 395151 - DNA, 25 bp, Rattus norvegicus
gccgcgattatagccgatgactcag

SEQ ID NO: 395152 - DNA, 25 bp, Rattus norvegicus
gccgcgcacagaactctggaacaaa

SEQ ID NO: 395153 - DNA, 25 bp, Rattus norvegicus
gccgcgcacagatctctggaacaaa

SEQ ID NO: 395154 - DNA, 25 bp, Rattus norvegicus
gccgcggaggcccaatgatatttat

SEQ ID NO: 395155 - DNA, 25 bp, Rattus norvegicus
gccgcggaggccgaatgatatttat

SEQ ID NO: 395156 - DNA, 25 bp, Rattus norvegicus
gccgcgggtatgagcaatacgccta

SEQ ID NO: 395157 - DNA, 25 bp, Rattus norvegicus
gccgcgggtatgtgcaatacgccta

SEQ ID NO: 395158 - DNA, 25 bp, Rattus norvegicus
gccgcgtctggaagaagcaatcctt

SEQ ID NO: 395159 - DNA, 25 bp, Rattus norvegicus
gccgcgtctggatgaagcaatcctt

SEQ ID NO: 395160 - DNA, 25 bp, Rattus norvegicus
gccgcgtgaccgagcagagtgatcc

SEQ ID NO: 395161 - DNA, 25 bp, Rattus norvegicus
gccgcgtgaccgtgcagagtgatcc

SEQ ID NO: 395162 - DNA, 25 bp, Rattus norvegicus
gccgcgttcgcaccaagactgtgaa

SEQ ID NO: 395163 - DNA, 25 bp, Rattus norvegicus
gccgcgttcgcagcaagactgtgaa

SEQ ID NO: 395164 - DNA, 25 bp, Rattus norvegicus
gccgcgttctgtaccaaaaaccaag

SEQ ID NO: 395165 - DNA, 25 bp, Rattus norvegicus
gccgcgttctgttccaaaaaccaag

SEQ ID NO: 395166 - DNA, 25 bp, Rattus norvegicus
gccgcgtttggtactgcaactttaa

SEQ ID NO: 395167 - DNA, 25 bp, Rattus norvegicus
gccgcgtttggttctgcaactttaa

SEQ ID NO: 395168 - DNA, 25 bp, Rattus norvegicus
gccgctaccagtacaattacttcga

SEQ ID NO: 395169 - DNA, 25 bp, Rattus norvegicus
gccgctaccagttcaattacttcga

SEQ ID NO: 395170 - DNA, 25 bp, Rattus norvegicus
gccgctacctcactaaatgacaagg

SEQ ID NO: 395171 - DNA, 25 bp, Rattus norvegicus
gccgctacctcagtaaatgacaagg

SEQ ID NO: 395172 - DNA, 25 bp, Rattus norvegicus
gccgctacctgccttttggaaaaga

SEQ ID NO: 395173 - DNA, 25 bp, Rattus norvegicus
gccgctacctgcgttttggaaaaga

SEQ ID NO: 395174 - DNA, 25 bp, Rattus norvegicus
gccgctcattacaccaatttgcaga

SEQ ID NO: 395175 - DNA, 25 bp, Rattus norvegicus
gccgctcattactccaatttgcaga

SEQ ID NO: 395176 - DNA, 25 bp, Rattus norvegicus
gccgctccacttctcagaaagtagc

SEQ ID NO: 395177 - DNA, 25 bp, Rattus norvegicus
gccgctccacttgtcagaaagtagc

SEQ ID NO: 395178 - DNA, 25 bp, Rattus norvegicus
gccgctccgcttcggtaaataggaa

SEQ ID NO: 395179 - DNA, 25 bp, Rattus norvegicus
gccgctccgcttgggtaaataggaa

SEQ ID NO: 395180 - DNA, 25 bp, Rattus norvegicus
gccgctctggagacatcaacctaga

SEQ ID NO: 395181 - DNA, 25 bp, Rattus norvegicus
gccgctctggagtcatcaacctaga

SEQ ID NO: 395182 - DNA, 25 bp, Rattus norvegicus
gccgctcttggtcgctccagaaaga

SEQ ID NO: 395183 - DNA, 25 bp, Rattus norvegicus
gccgctcttggtggctccagaaaga

SEQ ID NO: 395184 - DNA, 25 bp, Rattus norvegicus
gccgctctttgaattctcttggaca

SEQ ID NO: 395185 - DNA, 25 bp, Rattus norvegicus
gccgctctttgatttctcttggaca

SEQ ID NO: 395186 - DNA, 25 bp, Rattus norvegicus
gccgctgaatcacagtggagtccaa

SEQ ID NO: 395187 - DNA, 25 bp, Rattus norvegicus
gccgctgaatcagagtggagtccaa

SEQ ID NO: 395188 - DNA, 25 bp, Rattus norvegicus
gccgctgaccttaaactttcgaaga

SEQ ID NO: 395189 - DNA, 25 bp, Rattus norvegicus
gccgctgacctttaactttcgaaga

SEQ ID NO: 395190 - DNA, 25 bp, Rattus norvegicus
gccgctgccgcgagataaaatcaaa

SEQ ID NO: 395191 - DNA, 25 bp, Rattus norvegicus
gccgctgccgcgtgataaaatcaaa

SEQ ID NO: 395192 - DNA, 25 bp, Rattus norvegicus
gccgctgcggccaagaagaccatga

SEQ ID NO: 395193 - DNA, 25 bp, Rattus norvegicus
gccgctgcggcctagaagaccatga

SEQ ID NO: 395194 - DNA, 25 bp, Rattus norvegicus
gccgctgcgtgtctgaccctggcta

SEQ ID NO: 395195 - DNA, 25 bp, Rattus norvegicus
gccgctgcgtgtgtgaccctggcta

SEQ ID NO: 395196 - DNA, 25 bp, Rattus norvegicus
gccgctgctgcacctttaagtctaa

SEQ ID NO: 395197 - DNA, 25 bp, Rattus norvegicus
gccgctgctgcagctttaagtctaa

SEQ ID NO: 395198 - DNA, 25 bp, Rattus norvegicus
gccgctggaagtcgtaaagcagctt

SEQ ID NO: 395199 - DNA, 25 bp, Rattus norvegicus
gccgctggaagtggtaaagcagctt

SEQ ID NO: 395200 - DNA, 25 bp, Rattus norvegicus
gccgctggacacagtatgcttcata

SEQ ID NO: 395201 - DNA, 25 bp, Rattus norvegicus
gccgctggacactgtatgcttcata

SEQ ID NO: 395202 - DNA, 25 bp, Rattus norvegicus
gccgctggagacattgcattaggaa

SEQ ID NO: 395203 - DNA, 25 bp, Rattus norvegicus
gccgctggagactttgcattaggaa

SEQ ID NO: 395204 - DNA, 25 bp, Rattus norvegicus
gccgctgggattatgatactcagga

SEQ ID NO: 395205 - DNA, 25 bp, Rattus norvegicus
gccgctgggattttgatactcagga

SEQ ID NO: 395206 - DNA, 25 bp, Rattus norvegicus
gccgctgtcattaacctgtaacgga

SEQ ID NO: 395207 - DNA, 25 bp, Rattus norvegicus
gccgctgtcatttacctgtaacgga

SEQ ID NO: 395208 - DNA, 25 bp, Rattus norvegicus
gccgctgtgcttctggctaaataca

SEQ ID NO: 395209 - DNA, 25 bp, Rattus norvegicus
gccgctgtgcttgtggctaaataca

SEQ ID NO: 395210 - DNA, 25 bp, Rattus norvegicus
gccgctgttcacatgtaagataaca

SEQ ID NO: 395211 - DNA, 25 bp, Rattus norvegicus
gccgctgttcacttgtaagataaca

SEQ ID NO: 395212 - DNA, 25 bp, Rattus norvegicus
gccgctgttgttacaccttcaaata

SEQ ID NO: 395213 - DNA, 25 bp, Rattus norvegicus
gccgctgttgttctgttgactgtgt

SEQ ID NO: 395214 - DNA, 25 bp, Rattus norvegicus
gccgctgttgttgtgttgactgtgt

SEQ ID NO: 395215 - DNA, 25 bp, Rattus norvegicus
gccgctgttgtttcaccttcaaata

SEQ ID NO: 395216 - DNA, 25 bp, Rattus norvegicus
gccgcttaacgcagctttagttcat

SEQ ID NO: 395217 - DNA, 25 bp, Rattus norvegicus
gccgcttaacgctgctttagttcat

SEQ ID NO: 395218 - DNA, 25 bp, Rattus norvegicus
gccgcttaatcaatgcctggttttg

SEQ ID NO: 395219 - DNA, 25 bp, Rattus norvegicus
gccgcttaatcattgcctggttttg

SEQ ID NO: 395220 - DNA, 25 bp, Rattus norvegicus
gccgcttctagcagtgtgcatgtag

SEQ ID NO: 395221 - DNA, 25 bp, Rattus norvegicus
gccgcttctagctgtgtgcatgtag

SEQ ID NO: 395222 - DNA, 25 bp, Rattus norvegicus
gccgcttctgttatatttgggatac

SEQ ID NO: 395223 - DNA, 25 bp, Rattus norvegicus
gccgcttctgttttatttgggatac

SEQ ID NO: 395224 - DNA, 25 bp, Rattus norvegicus
gccgcttgagcgcagtcagtaactt

SEQ ID NO: 395225 - DNA, 25 bp, Rattus norvegicus
gccgcttgagcggagtcagtaactt

SEQ ID NO: 395226 - DNA, 25 bp, Rattus norvegicus
gccgcttgcattctgttactagtga

SEQ ID NO: 395227 - DNA, 25 bp, Rattus norvegicus
gccgcttgcattgtgttactagtga

SEQ ID NO: 395228 - DNA, 25 bp, Rattus norvegicus
gccgcttggtacattcctcattaaa

SEQ ID NO: 395229 - DNA, 25 bp, Rattus norvegicus
gccgcttggtactttcctcattaaa

SEQ ID NO: 395230 - DNA, 25 bp, Rattus norvegicus
gccgctttagctctgtgttttcctg

SEQ ID NO: 395231 - DNA, 25 bp, Rattus norvegicus
gccgctttagctgtgtgttttcctg

SEQ ID NO: 395232 - DNA, 25 bp, Rattus norvegicus
gccgctttggatatatgcttctcaa

SEQ ID NO: 395233 - DNA, 25 bp, Rattus norvegicus
gccgctttggatttatgcttctcaa

SEQ ID NO: 395234 - DNA, 25 bp, Rattus norvegicus
gccgctttttgactgcatggttcaa

SEQ ID NO: 395235 - DNA, 25 bp, Rattus norvegicus
gccgctttttgagtgcatggttcaa

SEQ ID NO: 395236 - DNA, 25 bp, Rattus norvegicus
gccggaaaagcacgtagagttctct

SEQ ID NO: 395237 - DNA, 25 bp, Rattus norvegicus
gccggaaaagcaggtagagttctct

SEQ ID NO: 395238 - DNA, 25 bp, Rattus norvegicus
gccggaagaagtagcctcgagagat

SEQ ID NO: 395239 - DNA, 25 bp, Rattus norvegicus
gccggaagaagttgcctcgagagat

SEQ ID NO: 395240 - DNA, 25 bp, Rattus norvegicus
gccggaagtcttcgagcacagcaaa

SEQ ID NO: 395241 - DNA, 25 bp, Rattus norvegicus
gccggaagtcttggagcacagcaaa

SEQ ID NO: 395242 - DNA, 25 bp, Rattus norvegicus
gccggaatcgtccaggtgtctacat

SEQ ID NO: 395243 - DNA, 25 bp, Rattus norvegicus
gccggaatcgtcgaggtgtctacat

SEQ ID NO: 395244 - DNA, 25 bp, Rattus norvegicus
gccggacatgtcaatcttggattac

SEQ ID NO: 395245 - DNA, 25 bp, Rattus norvegicus
gccggacatgtctatcttggattac

SEQ ID NO: 395246 - DNA, 25 bp, Rattus norvegicus
gccggaccagttctaacttcattta

SEQ ID NO: 395247 - DNA, 25 bp, Rattus norvegicus
gccggaccagttgtaacttcattta

SEQ ID NO: 395248 - DNA, 25 bp, Rattus norvegicus
gccggacgcgagcagatgaacgaac

SEQ ID NO: 395249 - DNA, 25 bp, Rattus norvegicus
gccggacgcgaggagatgaacgaac

SEQ ID NO: 395250 - DNA, 25 bp, Rattus norvegicus
gccggacggctcaaggacaggacaa

SEQ ID NO: 395251 - DNA, 25 bp, Rattus norvegicus
gccggacggctctaggacaggacaa

SEQ ID NO: 395252 - DNA, 25 bp, Rattus norvegicus
gccggactgttaaggagttctgcca

SEQ ID NO: 395253 - DNA, 25 bp, Rattus norvegicus
gccggactgttatggagttctgcca

SEQ ID NO: 395254 - DNA, 25 bp, Rattus norvegicus
gccggacttctaaaaatcccagctt

SEQ ID NO: 395255 - DNA, 25 bp, Rattus norvegicus
gccggacttctataaatcccagctt

SEQ ID NO: 395256 - DNA, 25 bp, Rattus norvegicus
gccggacttgatcctttctaacctg

SEQ ID NO: 395257 - DNA, 25 bp, Rattus norvegicus
gccggacttgatgctttctaacctg

SEQ ID NO: 395258 - DNA, 25 bp, Rattus norvegicus
gccggagacagactgaaaagtgctt

SEQ ID NO: 395259 - DNA, 25 bp, Rattus norvegicus
gccggagacagagtgaaaagtgctt

SEQ ID NO: 395260 - DNA, 25 bp, Rattus norvegicus
gccggagagagaccacagtgaccca

SEQ ID NO: 395261 - DNA, 25 bp, Rattus norvegicus
gccggagagagagcacagtgaccca

SEQ ID NO: 395262 - DNA, 25 bp, Rattus norvegicus
gccggagagataatggctctgtgct

SEQ ID NO: 395263 - DNA, 25 bp, Rattus norvegicus
gccggagagatattggctctgtgct

SEQ ID NO: 395264 - DNA, 25 bp, Rattus norvegicus
gccggagcaaacattgaccttggtt

SEQ ID NO: 395265 - DNA, 25 bp, Rattus norvegicus
gccggagcaaactttgaccttggtt

SEQ ID NO: 395266 - DNA, 25 bp, Rattus norvegicus
gccggagcggagattgatgcatcta

SEQ ID NO: 395267 - DNA, 25 bp, Rattus norvegicus
gccggagcggagtttgatgcatcta

SEQ ID NO: 395268 - DNA, 25 bp, Rattus norvegicus
gccggaggaagaaggtccactgccc

SEQ ID NO: 395269 - DNA, 25 bp, Rattus norvegicus
gccggaggaagatggtccactgccc

SEQ ID NO: 395270 - DNA, 25 bp, Rattus norvegicus
gccggagggtccagcatgaactaga

SEQ ID NO: 395271 - DNA, 25 bp, Rattus norvegicus
gccggagggtcctgcatgaactaga

SEQ ID NO: 395272 - DNA, 25 bp, Rattus norvegicus
gccggaggtggtccatcttaagaaa

SEQ ID NO: 395273 - DNA, 25 bp, Rattus norvegicus
gccggaggtggtgcatcttaagaaa

SEQ ID NO: 395274 - DNA, 25 bp, Rattus norvegicus
gccggagtcatcagacagacgtttt

SEQ ID NO: 395275 - DNA, 25 bp, Rattus norvegicus
gccggagtcatctgacagacgtttt

SEQ ID NO: 395276 - DNA, 25 bp, Rattus norvegicus
gccggagtcatgaccgtgtacttat

SEQ ID NO: 395277 - DNA, 25 bp, Rattus norvegicus
gccggagtcatgtccgtgtacttat

SEQ ID NO: 395278 - DNA, 25 bp, Rattus norvegicus
gccggagttcatatctggccaatga

SEQ ID NO: 395279 - DNA, 25 bp, Rattus norvegicus
gccggagttcatttctggccaatga

SEQ ID NO: 395280 - DNA, 25 bp, Rattus norvegicus
gccggagtttaaccagtccaactcg

SEQ ID NO: 395281 - DNA, 25 bp, Rattus norvegicus
gccggagtttaagcagtccaactcg

SEQ ID NO: 395282 - DNA, 25 bp, Rattus norvegicus
gccggagttttacggcaatatcatc

SEQ ID NO: 395283 - DNA, 25 bp, Rattus norvegicus
gccggagttttagggcaatatcatc

SEQ ID NO: 395284 - DNA, 25 bp, Rattus norvegicus
gccggatcacacagtgccgaggtga

SEQ ID NO: 395285 - DNA, 25 bp, Rattus norvegicus
gccggatcacactgtgccgaggtga

SEQ ID NO: 395286 - DNA, 25 bp, Rattus norvegicus
gccggatcctggcttgtaacagtga

SEQ ID NO: 395287 - DNA, 25 bp, Rattus norvegicus
gccggatcctgggttgtaacagtga

SEQ ID NO: 395288 - DNA, 25 bp, Rattus norvegicus
gccggatgagccatactgcacagag

SEQ ID NO: 395289 - DNA, 25 bp, Rattus norvegicus
gccggatgagccttactgcacagag

SEQ ID NO: 395290 - DNA, 25 bp, Rattus norvegicus
gccggatgccaaaaccatactgctg

SEQ ID NO: 395291 - DNA, 25 bp, Rattus norvegicus
gccggatgccaataccatactgctg

SEQ ID NO: 395292 - DNA, 25 bp, Rattus norvegicus
gccggatgtgtcagttcttctgaaa

SEQ ID NO: 395293 - DNA, 25 bp, Rattus norvegicus
gccggatgtgtctgttcttctgaaa

SEQ ID NO: 395294 - DNA, 25 bp, Rattus norvegicus
gccggattattgctgcaactggcaa

SEQ ID NO: 395295 - DNA, 25 bp, Rattus norvegicus
gccggattattggtgcaactggcaa

SEQ ID NO: 395296 - DNA, 25 bp, Rattus norvegicus
gccggcactataatttatggcccct

SEQ ID NO: 395297 - DNA, 25 bp, Rattus norvegicus
gccggcactatattttatggcccct

SEQ ID NO: 395298 - DNA, 25 bp, Rattus norvegicus
gccggcacttcacctacaagagtat

SEQ ID NO: 395299 - DNA, 25 bp, Rattus norvegicus
gccggcacttcagctacaagagtat

SEQ ID NO: 395300 - DNA, 25 bp, Rattus norvegicus
gccggcagacccaagccaaatatgg

SEQ ID NO: 395301 - DNA, 25 bp, Rattus norvegicus
gccggcagaccctagccaaatatgg

SEQ ID NO: 395302 - DNA, 25 bp, Rattus norvegicus
gccggcattcaccaaactacttata

SEQ ID NO: 395303 - DNA, 25 bp, Rattus norvegicus
gccggcattcacgaaactacttata

SEQ ID NO: 395304 - DNA, 25 bp, Rattus norvegicus
gccggccacgtgcaactgactggca

SEQ ID NO: 395305 - DNA, 25 bp, Rattus norvegicus
gccggccacgtggaactgactggca

SEQ ID NO: 395306 - DNA, 25 bp, Rattus norvegicus
gccggccactggaaactgccaacag

SEQ ID NO: 395307 - DNA, 25 bp, Rattus norvegicus
gccggccactggtaactgccaacag

SEQ ID NO: 395308 - DNA, 25 bp, Rattus norvegicus
gccggccagtacagcctgaggaaac

SEQ ID NO: 395309 - DNA, 25 bp, Rattus norvegicus
gccggccagtactgcctgaggaaac

SEQ ID NO: 395310 - DNA, 25 bp, Rattus norvegicus
gccggccatcttaatccagagtaga

SEQ ID NO: 395311 - DNA, 25 bp, Rattus norvegicus
gccggccatctttatccagagtaga

SEQ ID NO: 395312 - DNA, 25 bp, Rattus norvegicus
gccggcccattgagcagttactagt

SEQ ID NO: 395313 - DNA, 25 bp, Rattus norvegicus
gccggcccattgtgcagttactagt

SEQ ID NO: 395314 - DNA, 25 bp, Rattus norvegicus
gccggccgttcaacgtgtgaaatgg

SEQ ID NO: 395315 - DNA, 25 bp, Rattus norvegicus
gccggccgttcatcgtgtgaaatgg

SEQ ID NO: 395316 - DNA, 25 bp, Rattus norvegicus
gccggcctggatcacatgagacact

SEQ ID NO: 395317 - DNA, 25 bp, Rattus norvegicus
gccggcctggatgacatgagacact

SEQ ID NO: 395318 - DNA, 25 bp, Rattus norvegicus
gccggccttgttactcaatggttat

SEQ ID NO: 395319 - DNA, 25 bp, Rattus norvegicus
gccggccttgtttctcaatggttat

SEQ ID NO: 395320 - DNA, 25 bp, Rattus norvegicus
gccggcggacagagaccatgttcaa

SEQ ID NO: 395321 - DNA, 25 bp, Rattus norvegicus
gccggcggacagtgaccatgttcaa

SEQ ID NO: 395322 - DNA, 25 bp, Rattus norvegicus
gccggcgtcgcaaactgtacgagct

SEQ ID NO: 395323 - DNA, 25 bp, Rattus norvegicus
gccggcgtcgcatactgtacgagct

SEQ ID NO: 395324 - DNA, 25 bp, Rattus norvegicus
gccggcgtgcgcaagcagtacctgt

SEQ ID NO: 395325 - DNA, 25 bp, Rattus norvegicus
gccggcgtgcgctagcagtacctgt

SEQ ID NO: 395326 - DNA, 25 bp, Rattus norvegicus
gccggctacttaccagacttctggg

SEQ ID NO: 395327 - DNA, 25 bp, Rattus norvegicus
gccggctacttagcagacttctggg

SEQ ID NO: 395328 - DNA, 25 bp, Rattus norvegicus
gccggctgaaaccatgctttgtaag

SEQ ID NO: 395329 - DNA, 25 bp, Rattus norvegicus
gccggctgaaacgatgctttgtaag

SEQ ID NO: 395330 - DNA, 25 bp, Rattus norvegicus
gccggctgacttctccttcaggaga

SEQ ID NO: 395331 - DNA, 25 bp, Rattus norvegicus
gccggctgacttgtccttcaggaga

SEQ ID NO: 395332 - DNA, 25 bp, Rattus norvegicus
gccggctggatgagcccaagcagaa

SEQ ID NO: 395333 - DNA, 25 bp, Rattus norvegicus
gccggctggatgtgcccaagcagaa

SEQ ID NO: 395334 - DNA, 25 bp, Rattus norvegicus
gccggcttagacacctcgtttttgg

SEQ ID NO: 395335 - DNA, 25 bp, Rattus norvegicus
gccggcttagactcctcgtttttgg

SEQ ID NO: 395336 - DNA, 25 bp, Rattus norvegicus
gccggcttgatcaccatcagaaaag

SEQ ID NO: 395337 - DNA, 25 bp, Rattus norvegicus
gccggcttgatctccatcagaaaag

SEQ ID NO: 395338 - DNA, 25 bp, Rattus norvegicus
gccggcttgggcatttagattgttt

SEQ ID NO: 395339 - DNA, 25 bp, Rattus norvegicus
gccggcttgggcttttagattgttt

SEQ ID NO: 395340 - DNA, 25 bp, Rattus norvegicus
gccggcttgtcacttaactcgagtt

SEQ ID NO: 395341 - DNA, 25 bp, Rattus norvegicus
gccggcttgtcagttaactcgagtt

SEQ ID NO: 395342 - DNA, 25 bp, Rattus norvegicus
gccgggaaacacactgcatctattt

SEQ ID NO: 395343 - DNA, 25 bp, Rattus norvegicus
gccgggaaacactctgcatctattt

SEQ ID NO: 395344 - DNA, 25 bp, Rattus norvegicus
gccgggaaggccacatgcttaaagt

SEQ ID NO: 395345 - DNA, 25 bp, Rattus norvegicus
gccgggaaggcctcatgcttaaagt

SEQ ID NO: 395346 - DNA, 25 bp, Rattus norvegicus
gccgggaagttgcttcactccaaga

SEQ ID NO: 395347 - DNA, 25 bp, Rattus norvegicus
gccgggaagttggttcactccaaga

SEQ ID NO: 395348 - DNA, 25 bp, Rattus norvegicus
gccgggacacagacaggagcgcatc

SEQ ID NO: 395349 - DNA, 25 bp, Rattus norvegicus
gccgggacacagtcaggagcgcatc

SEQ ID NO: 395350 - DNA, 25 bp, Rattus norvegicus
gccgggaccaacacttaaatgccaa

SEQ ID NO: 395351 - DNA, 25 bp, Rattus norvegicus
gccgggaccaactcttaaatgccaa

SEQ ID NO: 395352 - DNA, 25 bp, Rattus norvegicus
gccgggaccagaactttgcttatga

SEQ ID NO: 395353 - DNA, 25 bp, Rattus norvegicus
gccgggaccagatctttgcttatga

SEQ ID NO: 395354 - DNA, 25 bp, Rattus norvegicus
gccgggaccgacacaatctcgtttg

SEQ ID NO: 395355 - DNA, 25 bp, Rattus norvegicus
gccgggaccgactcaatctcgtttg

SEQ ID NO: 395356 - DNA, 25 bp, Rattus norvegicus
gccgggagagccctgctattctgaa

SEQ ID NO: 395357 - DNA, 25 bp, Rattus norvegicus
gccgggagagccgtgctattctgaa

SEQ ID NO: 395358 - DNA, 25 bp, Rattus norvegicus
gccgggagcacaccgattaagacat

SEQ ID NO: 395359 - DNA, 25 bp, Rattus norvegicus
gccgggagcacagcgattaagacat

SEQ ID NO: 395360 - DNA, 25 bp, Rattus norvegicus
gccgggagtaagacaaagacacctg

SEQ ID NO: 395361 - DNA, 25 bp, Rattus norvegicus
gccgggagtaagtcaaagacacctg

SEQ ID NO: 395362 - DNA, 25 bp, Rattus norvegicus
gccgggagtgtacaccaaagtcatt

SEQ ID NO: 395363 - DNA, 25 bp, Rattus norvegicus
gccgggagtgtagaccaaagtcatt

SEQ ID NO: 395364 - DNA, 25 bp, Rattus norvegicus
gccgggatcaaactctgttctggcg

SEQ ID NO: 395365 - DNA, 25 bp, Rattus norvegicus
gccgggatcaaagtctgttctggcg

SEQ ID NO: 395366 - DNA, 25 bp, Rattus norvegicus
gccgggcacaaacctgaacactaag

SEQ ID NO: 395367 - DNA, 25 bp, Rattus norvegicus
gccgggcacaaagctgaacactaag

SEQ ID NO: 395368 - DNA, 25 bp, Rattus norvegicus
gccgggcaccacatgtccttgaagt

SEQ ID NO: 395369 - DNA, 25 bp, Rattus norvegicus
gccgggcaccacttgtccttgaagt

SEQ ID NO: 395370 - DNA, 25 bp, Rattus norvegicus
gccgggccagcaactgggcttgata

SEQ ID NO: 395371 - DNA, 25 bp, Rattus norvegicus
gccgggccagcatctgggcttgata

SEQ ID NO: 395372 - DNA, 25 bp, Rattus norvegicus
gccgggccatacacaggaaatgcat

SEQ ID NO: 395373 - DNA, 25 bp, Rattus norvegicus
gccgggccatactcaggaaatgcat

SEQ ID NO: 395374 - DNA, 25 bp, Rattus norvegicus
gccgggccatgacatattactacaa

SEQ ID NO: 395375 - DNA, 25 bp, Rattus norvegicus
gccgggccatgagatattactacaa

SEQ ID NO: 395376 - DNA, 25 bp, Rattus norvegicus
gccgggccggaaagaacccagagct

SEQ ID NO: 395377 - DNA, 25 bp, Rattus norvegicus
gccgggccggaatgaacccagagct

SEQ ID NO: 395378 - DNA, 25 bp, Rattus norvegicus
gccgggcgctacactacaagaagca

SEQ ID NO: 395379 - DNA, 25 bp, Rattus norvegicus
gccgggcgctactctacaagaagca

SEQ ID NO: 395380 - DNA, 25 bp, Rattus norvegicus
gccgggcgctcaagagcgagttcct

SEQ ID NO: 395381 - DNA, 25 bp, Rattus norvegicus
gccgggcgctcatgagcgagttcct

SEQ ID NO: 395382 - DNA, 25 bp, Rattus norvegicus
gccgggctacagacccagagagtga

SEQ ID NO: 395383 - DNA, 25 bp, Rattus norvegicus
gccgggctacagtcccagagagtga

SEQ ID NO: 395384 - DNA, 25 bp, Rattus norvegicus
gccgggctattcacaaaccagtgac

SEQ ID NO: 395385 - DNA, 25 bp, Rattus norvegicus
gccgggctattctcaaaccagtgac

SEQ ID NO: 395386 - DNA, 25 bp, Rattus norvegicus
gccgggctgccaacagggttttata

SEQ ID NO: 395387 - DNA, 25 bp, Rattus norvegicus
gccgggctgccatcagggttttata

SEQ ID NO: 395388 - DNA, 25 bp, Rattus norvegicus
gccgggcttgtgaaagcaggtctca

SEQ ID NO: 395389 - DNA, 25 bp, Rattus norvegicus
gccgggcttgtgtaagcaggtctca

SEQ ID NO: 395390 - DNA, 25 bp, Rattus norvegicus
gccgggtactaccattctacaatat

SEQ ID NO: 395391 - DNA, 25 bp, Rattus norvegicus
gccgggtactacgattctacaatat

SEQ ID NO: 395392 - DNA, 25 bp, Rattus norvegicus
gccgggtgctcaactttttctagtc

SEQ ID NO: 395393 - DNA, 25 bp, Rattus norvegicus
gccgggtgctcatctttttctagtc

SEQ ID NO: 395394 - DNA, 25 bp, Rattus norvegicus
gccgggtgctgacactgatttttat

SEQ ID NO: 395395 - DNA, 25 bp, Rattus norvegicus
gccgggtgctgagactgatttttat

SEQ ID NO: 395396 - DNA, 25 bp, Rattus norvegicus
gccgggtgggccaggaagttcgagc

SEQ ID NO: 395397 - DNA, 25 bp, Rattus norvegicus
gccgggtgggcctggaagttcgagc

SEQ ID NO: 395398 - DNA, 25 bp, Rattus norvegicus
gccgggtgtggcatacaggttcaac

SEQ ID NO: 395399 - DNA, 25 bp, Rattus norvegicus
gccgggtgtggcttacaggttcaac

SEQ ID NO: 395400 - DNA, 25 bp, Rattus norvegicus
gccgggtgtggtagtttagcactca

SEQ ID NO: 395401 - DNA, 25 bp, Rattus norvegicus
gccgggtgtggttgtttagcactca

SEQ ID NO: 395402 - DNA, 25 bp, Rattus norvegicus
gccggtaatgctatctgaacaggtc

SEQ ID NO: 395403 - DNA, 25 bp, Rattus norvegicus
gccggtaatgctttctgaacaggtc

SEQ ID NO: 395404 - DNA, 25 bp, Rattus norvegicus
gccggtagtccaccttagtaggcaa

SEQ ID NO: 395405 - DNA, 25 bp, Rattus norvegicus
gccggtagtccagcttagtaggcaa

SEQ ID NO: 395406 - DNA, 25 bp, Rattus norvegicus
gccggtagtcccagtagaagctgtg

SEQ ID NO: 395407 - DNA, 25 bp, Rattus norvegicus
gccggtagtccctgtagaagctgtg

SEQ ID NO: 395408 - DNA, 25 bp, Rattus norvegicus
gccggtatacatcgcggcggtgctg

SEQ ID NO: 395409 - DNA, 25 bp, Rattus norvegicus
gccggtatacatggcggcggtgctg

SEQ ID NO: 395410 - DNA, 25 bp, Rattus norvegicus
gccggtatcctcaaaagcagttttt

SEQ ID NO: 395411 - DNA, 25 bp, Rattus norvegicus
gccggtatcctctaaagcagttttt

SEQ ID NO: 395412 - DNA, 25 bp, Rattus norvegicus
gccggtatctttatgctgtacttac

SEQ ID NO: 395413 - DNA, 25 bp, Rattus norvegicus
gccggtatctttttgctgtacttac

SEQ ID NO: 395414 - DNA, 25 bp, Rattus norvegicus
gccggtcaggccagtgatctagaag

SEQ ID NO: 395415 - DNA, 25 bp, Rattus norvegicus
gccggtcaggcctgtgatctagaag

SEQ ID NO: 395416 - DNA, 25 bp, Rattus norvegicus
gccggtcctgacctgttacaatgaa

SEQ ID NO: 395417 - DNA, 25 bp, Rattus norvegicus
gccggtcctgacgtgttacaatgaa

SEQ ID NO: 395418 - DNA, 25 bp, Rattus norvegicus
gccggtctcggcatcaggagaagaa

SEQ ID NO: 395419 - DNA, 25 bp, Rattus norvegicus
gccggtctcggcttcaggagaagaa

SEQ ID NO: 395420 - DNA, 25 bp, Rattus norvegicus
gccggtctcttactgggcgcataga

SEQ ID NO: 395421 - DNA, 25 bp, Rattus norvegicus
gccggtctcttagtgggcgcataga

SEQ ID NO: 395422 - DNA, 25 bp, Rattus norvegicus
gccggtcttgttctgattctggtaa

SEQ ID NO: 395423 - DNA, 25 bp, Rattus norvegicus
gccggtcttgttgtgattctggtaa

SEQ ID NO: 395424 - DNA, 25 bp, Rattus norvegicus
gccggtgaacctcttgcagttgttt

SEQ ID NO: 395425 - DNA, 25 bp, Rattus norvegicus
gccggtgaacctgttgcagttgttt

SEQ ID NO: 395426 - DNA, 25 bp, Rattus norvegicus
gccggtgaacgtccaaaacaggctc

SEQ ID NO: 395427 - DNA, 25 bp, Rattus norvegicus
gccggtgaacgtgcaaaacaggctc

SEQ ID NO: 395428 - DNA, 25 bp, Rattus norvegicus
gccggtgaagggagactgtcaataa

SEQ ID NO: 395429 - DNA, 25 bp, Rattus norvegicus
gccggtgaagggtgactgtcaataa

SEQ ID NO: 395430 - DNA, 25 bp, Rattus norvegicus
gccggtgaatacatacatggtctta

SEQ ID NO: 395431 - DNA, 25 bp, Rattus norvegicus
gccggtgaatacttacatggtctta

SEQ ID NO: 395432 - DNA, 25 bp, Rattus norvegicus
gccggtgagaggagtgccaaataat

SEQ ID NO: 395433 - DNA, 25 bp, Rattus norvegicus
gccggtgagaggtgtgccaaataat

SEQ ID NO: 395434 - DNA, 25 bp, Rattus norvegicus
gccggtgagcgccaatatagcccat

SEQ ID NO: 395435 - DNA, 25 bp, Rattus norvegicus
gccggtgagcgcgaatatagcccat

SEQ ID NO: 395436 - DNA, 25 bp, Rattus norvegicus
gccggtgatactcgtagttggtgtg

SEQ ID NO: 395437 - DNA, 25 bp, Rattus norvegicus
gccggtgatactggtagttggtgtg

SEQ ID NO: 395438 - DNA, 25 bp, Rattus norvegicus
gccggtgatcttcgagattttaaga

SEQ ID NO: 395439 - DNA, 25 bp, Rattus norvegicus
gccggtgatcttggagattttaaga

SEQ ID NO: 395440 - DNA, 25 bp, Rattus norvegicus
gccggtgctttacgcttttctgaac

SEQ ID NO: 395441 - DNA, 25 bp, Rattus norvegicus
gccggtgctttaggcttttctgaac

SEQ ID NO: 395442 - DNA, 25 bp, Rattus norvegicus
gccggtggcctaagcaaatcctttt

SEQ ID NO: 395443 - DNA, 25 bp, Rattus norvegicus
gccggtggcctatgcaaatcctttt

SEQ ID NO: 395444 - DNA, 25 bp, Rattus norvegicus
gccggtgtcccaagatgttcaagtg

SEQ ID NO: 395445 - DNA, 25 bp, Rattus norvegicus
gccggtgtcccatgatgttcaagtg

SEQ ID NO: 395446 - DNA, 25 bp, Rattus norvegicus
gccggtgttaacaccacggacaaag

SEQ ID NO: 395447 - DNA, 25 bp, Rattus norvegicus
gccggtgttaactccacggacaaag

SEQ ID NO: 395448 - DNA, 25 bp, Rattus norvegicus
gccggtgttgccatgtgaagagata

SEQ ID NO: 395449 - DNA, 25 bp, Rattus norvegicus
gccggtgttgccttgtgaagagata

SEQ ID NO: 395450 - DNA, 25 bp, Rattus norvegicus
gccggttagcctaatgattgacact

SEQ ID NO: 395451 - DNA, 25 bp, Rattus norvegicus
gccggttagccttatgattgacact

SEQ ID NO: 395452 - DNA, 25 bp, Rattus norvegicus
gccggttcaagccaaacacctacgt

SEQ ID NO: 395453 - DNA, 25 bp, Rattus norvegicus
gccggttcaagcgaaacacctacgt

SEQ ID NO: 395454 - DNA, 25 bp, Rattus norvegicus
gccggttccgcgagccgggcaggaa

SEQ ID NO: 395455 - DNA, 25 bp, Rattus norvegicus
gccggttccgcgtgccgggcaggaa

SEQ ID NO: 395456 - DNA, 25 bp, Rattus norvegicus
gccggttgtaatcgcacacactttt

SEQ ID NO: 395457 - DNA, 25 bp, Rattus norvegicus
gccggttgtaatggcacacactttt

SEQ ID NO: 395458 - DNA, 25 bp, Rattus norvegicus
gccggttttcttactcaatttgcag

SEQ ID NO: 395459 - DNA, 25 bp, Rattus norvegicus
gccggttttctttctcaatttgcag

SEQ ID NO: 395460 - DNA, 25 bp, Rattus norvegicus
gccgtaaacctaaactccaactgga

SEQ ID NO: 395461 - DNA, 25 bp, Rattus norvegicus
gccgtaaacctatactccaactgga

SEQ ID NO: 395462 - DNA, 25 bp, Rattus norvegicus
gccgtaacggttactgtgggtctag

SEQ ID NO: 395463 - DNA, 25 bp, Rattus norvegicus
gccgtaacggtttctgtgggtctag

SEQ ID NO: 395464 - DNA, 25 bp, Rattus norvegicus
gccgtaagtcagaattttgcaggtt

SEQ ID NO: 395465 - DNA, 25 bp, Rattus norvegicus
gccgtaagtcagtattttgcaggtt

SEQ ID NO: 395466 - DNA, 25 bp, Rattus norvegicus
gccgtaattctccactgaactatca

SEQ ID NO: 395467 - DNA, 25 bp, Rattus norvegicus
gccgtaattctcgactgaactatca

SEQ ID NO: 395468 - DNA, 25 bp, Rattus norvegicus
gccgtacagctcatgtcattaacag

SEQ ID NO: 395469 - DNA, 25 bp, Rattus norvegicus
gccgtacagctcttgtcattaacag

SEQ ID NO: 395470 - DNA, 25 bp, Rattus norvegicus
gccgtacctaagcttgtggttctga

SEQ ID NO: 395471 - DNA, 25 bp, Rattus norvegicus
gccgtacctaaggttgtggttctga

SEQ ID NO: 395472 - DNA, 25 bp, Rattus norvegicus
gccgtactatcactgggtgactggc

SEQ ID NO: 395473 - DNA, 25 bp, Rattus norvegicus
gccgtactatcagtgggtgactggc

SEQ ID NO: 395474 - DNA, 25 bp, Rattus norvegicus
gccgtactgtatctagtgttgtgtc

SEQ ID NO: 395475 - DNA, 25 bp, Rattus norvegicus
gccgtactgtatgtagtgttgtgtc

SEQ ID NO: 395476 - DNA, 25 bp, Rattus norvegicus
gccgtactttcccttgttattcata

SEQ ID NO: 395477 - DNA, 25 bp, Rattus norvegicus
gccgtactttccgttgttattcata

SEQ ID NO: 395478 - DNA, 25 bp, Rattus norvegicus
gccgtagaaaccatgctcacttaat

SEQ ID NO: 395479 - DNA, 25 bp, Rattus norvegicus
gccgtagaaaccttgctcacttaat

SEQ ID NO: 395480 - DNA, 25 bp, Rattus norvegicus
gccgtagaacccactgtgcttaaaa

SEQ ID NO: 395481 - DNA, 25 bp, Rattus norvegicus
gccgtagaaccctctgtgcttaaaa

SEQ ID NO: 395482 - DNA, 25 bp, Rattus norvegicus
gccgtagcagcaaagaaagtttttg

SEQ ID NO: 395483 - DNA, 25 bp, Rattus norvegicus
gccgtagcagcatagaaagtttttg

SEQ ID NO: 395484 - DNA, 25 bp, Rattus norvegicus
gccgtagttggtagttggtctcttt

SEQ ID NO: 395485 - DNA, 25 bp, Rattus norvegicus
gccgtagttggttgttggtctcttt

SEQ ID NO: 395486 - DNA, 25 bp, Rattus norvegicus
gccgtagtttcccacgcaatgcgca

SEQ ID NO: 395487 - DNA, 25 bp, Rattus norvegicus
gccgtagtttccgacgcaatgcgca

SEQ ID NO: 395488 - DNA, 25 bp, Rattus norvegicus
gccgtatctgtaagcacttatttta

SEQ ID NO: 395489 - DNA, 25 bp, Rattus norvegicus
gccgtatctgtatgcacttatttta

SEQ ID NO: 395490 - DNA, 25 bp, Rattus norvegicus
gccgtatggaaacattccctcccag

SEQ ID NO: 395491 - DNA, 25 bp, Rattus norvegicus
gccgtatggaaagattccctcccag

SEQ ID NO: 395492 - DNA, 25 bp, Rattus norvegicus
gccgtatttgccaacatggctttgt

SEQ ID NO: 395493 - DNA, 25 bp, Rattus norvegicus
gccgtatttgcctacatggctttgt

SEQ ID NO: 395494 - DNA, 25 bp, Rattus norvegicus
gccgtcaatgaacctagcttatcca

SEQ ID NO: 395495 - DNA, 25 bp, Rattus norvegicus
gccgtcaatgaagctagcttatcca

SEQ ID NO: 395496 - DNA, 25 bp, Rattus norvegicus
gccgtcaccaccattatgtttgttg

SEQ ID NO: 395497 - DNA, 25 bp, Rattus norvegicus
gccgtcaccacctttatgtttgttg

SEQ ID NO: 395498 - DNA, 25 bp, Rattus norvegicus
gccgtcacgggactcacacttttga

SEQ ID NO: 395499 - DNA, 25 bp, Rattus norvegicus
gccgtcacgggagtcacacttttga

SEQ ID NO: 395500 - DNA, 25 bp, Rattus norvegicus
gccgtcactggtaggtcttgagaga

SEQ ID NO: 395501 - DNA, 25 bp, Rattus norvegicus
gccgtcactggttggtcttgagaga

SEQ ID NO: 395502 - DNA, 25 bp, Rattus norvegicus
gccgtcagccagacatccataagat

SEQ ID NO: 395503 - DNA, 25 bp, Rattus norvegicus
gccgtcagccagtcatccataagat

SEQ ID NO: 395504 - DNA, 25 bp, Rattus norvegicus
gccgtcaggacgatcttactaatgt

SEQ ID NO: 395505 - DNA, 25 bp, Rattus norvegicus
gccgtcaggacgttcttactaatgt

SEQ ID NO: 395506 - DNA, 25 bp, Rattus norvegicus
gccgtcatcatcataaacgcatagt

SEQ ID NO: 395507 - DNA, 25 bp, Rattus norvegicus
gccgtcatcatcttaaacgcatagt

SEQ ID NO: 395508 - DNA, 25 bp, Rattus norvegicus
gccgtccaaattctcagggctaatt

SEQ ID NO: 395509 - DNA, 25 bp, Rattus norvegicus
gccgtccaaattgtcagggctaatt

SEQ ID NO: 395510 - DNA, 25 bp, Rattus norvegicus
gccgtccaccggattatacagaact

SEQ ID NO: 395511 - DNA, 25 bp, Rattus norvegicus
gccgtccaccggtttatacagaact

SEQ ID NO: 395512 - DNA, 25 bp, Rattus norvegicus
gccgtcccaagtctttgattaccta

SEQ ID NO: 395513 - DNA, 25 bp, Rattus norvegicus
gccgtcccaagtgtttgattaccta

SEQ ID NO: 395514 - DNA, 25 bp, Rattus norvegicus
gccgtccccagcagttgataaaatg

SEQ ID NO: 395515 - DNA, 25 bp, Rattus norvegicus
gccgtccccagctgttgataaaatg

SEQ ID NO: 395516 - DNA, 25 bp, Rattus norvegicus
gccgtccgacttcctacaaatgttt

SEQ ID NO: 395517 - DNA, 25 bp, Rattus norvegicus
gccgtccgacttgctacaaatgttt

SEQ ID NO: 395518 - DNA, 25 bp, Rattus norvegicus
gccgtcctgatgcagttctgtgcaa

SEQ ID NO: 395519 - DNA, 25 bp, Rattus norvegicus
gccgtcctgatggagttctgtgcaa

SEQ ID NO: 395520 - DNA, 25 bp, Rattus norvegicus
gccgtccttaacactgaaagacctg

SEQ ID NO: 395521 - DNA, 25 bp, Rattus norvegicus
gccgtccttaactctgaaagacctg

SEQ ID NO: 395522 - DNA, 25 bp, Rattus norvegicus
gccgtccttctgaaggtcactaaga

SEQ ID NO: 395523 - DNA, 25 bp, Rattus norvegicus
gccgtccttctgtaggtcactaaga

SEQ ID NO: 395524 - DNA, 25 bp, Rattus norvegicus
gccgtctatatgataccagtctctg

SEQ ID NO: 395525 - DNA, 25 bp, Rattus norvegicus
gccgtctatatgttaccagtctctg

SEQ ID NO: 395526 - DNA, 25 bp, Rattus norvegicus
gccgtctcggtcacctgaattaaaa

SEQ ID NO: 395527 - DNA, 25 bp, Rattus norvegicus
gccgtctcggtctcctgaattaaaa

SEQ ID NO: 395528 - DNA, 25 bp, Rattus norvegicus
gccgtctgcattcctgtcaacagta

SEQ ID NO: 395529 - DNA, 25 bp, Rattus norvegicus
gccgtctgcattgctgtcaacagta

SEQ ID NO: 395530 - DNA, 25 bp, Rattus norvegicus
gccgtctgcgagatggaaagccaaa

SEQ ID NO: 395531 - DNA, 25 bp, Rattus norvegicus
gccgtctgcgagttggaaagccaaa

SEQ ID NO: 395532 - DNA, 25 bp, Rattus norvegicus
gccgtctggcagaagcatagcactt

SEQ ID NO: 395533 - DNA, 25 bp, Rattus norvegicus
gccgtctggcagagaactttacttt

SEQ ID NO: 395534 - DNA, 25 bp, Rattus norvegicus
gccgtctggcagtagcatagcactt

SEQ ID NO: 395535 - DNA, 25 bp, Rattus norvegicus
gccgtctggcagtgaactttacttt

SEQ ID NO: 395536 - DNA, 25 bp, Rattus norvegicus
gccgtctgtgcaacaagtaccatgt

SEQ ID NO: 395537 - DNA, 25 bp, Rattus norvegicus
gccgtctgtgcatcaagtaccatgt

SEQ ID NO: 395538 - DNA, 25 bp, Rattus norvegicus
gccgtctgttatccctttgtatttt

SEQ ID NO: 395539 - DNA, 25 bp, Rattus norvegicus
gccgtctgttatgcctttgtatttt

SEQ ID NO: 395540 - DNA, 25 bp, Rattus norvegicus
gccgtcttgaggctctgttttcaat

SEQ ID NO: 395541 - DNA, 25 bp, Rattus norvegicus
gccgtcttgagggtctgttttcaat

SEQ ID NO: 395542 - DNA, 25 bp, Rattus norvegicus
gccgtctttgtcaatcctggaatat

SEQ ID NO: 395543 - DNA, 25 bp, Rattus norvegicus
gccgtctttgtctatcctggaatat

SEQ ID NO: 395544 - DNA, 25 bp, Rattus norvegicus
gccgtgaagtttaacctcgctgagt

SEQ ID NO: 395545 - DNA, 25 bp, Rattus norvegicus
gccgtgaagttttacctcgctgagt

SEQ ID NO: 395546 - DNA, 25 bp, Rattus norvegicus
gccgtgaatgacagggaaggatctt

SEQ ID NO: 395547 - DNA, 25 bp, Rattus norvegicus
gccgtgaatgactgggaaggatctt

SEQ ID NO: 395548 - DNA, 25 bp, Rattus norvegicus
gccgtgacatgcatagcctggtgat

SEQ ID NO: 395549 - DNA, 25 bp, Rattus norvegicus
gccgtgacatgcttagcctggtgat

SEQ ID NO: 395550 - DNA, 25 bp, Rattus norvegicus
gccgtgactgccaatcagaatgaca

SEQ ID NO: 395551 - DNA, 25 bp, Rattus norvegicus
gccgtgactgcctatcagaatgaca

SEQ ID NO: 395552 - DNA, 25 bp, Rattus norvegicus
gccgtgatagggaaattctcattta

SEQ ID NO: 395553 - DNA, 25 bp, Rattus norvegicus
gccgtgatagggtaattctcattta

SEQ ID NO: 395554 - DNA, 25 bp, Rattus norvegicus
gccgtgatgtcacgctatcttttgt

SEQ ID NO: 395555 - DNA, 25 bp, Rattus norvegicus
gccgtgatgtcaggctatcttttgt

SEQ ID NO: 395556 - DNA, 25 bp, Rattus norvegicus
gccgtgcaacgtagccaatcataga

SEQ ID NO: 395557 - DNA, 25 bp, Rattus norvegicus
gccgtgcaacgttgccaatcataga

SEQ ID NO: 395558 - DNA, 25 bp, Rattus norvegicus
gccgtgcacaacatagagacccgaa

SEQ ID NO: 395559 - DNA, 25 bp, Rattus norvegicus
gccgtgcacaacttagagacccgaa

SEQ ID NO: 395560 - DNA, 25 bp, Rattus norvegicus
gccgtgcattcaatcccggttgcat

SEQ ID NO: 395561 - DNA, 25 bp, Rattus norvegicus
gccgtgcattcattcccggttgcat

SEQ ID NO: 395562 - DNA, 25 bp, Rattus norvegicus
gccgtgccaccgatgattaagttaa

SEQ ID NO: 395563 - DNA, 25 bp, Rattus norvegicus
gccgtgccaccgttgattaagttaa

SEQ ID NO: 395564 - DNA, 25 bp, Rattus norvegicus
gccgtgcctggcatagaataattta

SEQ ID NO: 395565 - DNA, 25 bp, Rattus norvegicus
gccgtgcctggcttagaataattta

SEQ ID NO: 395566 - DNA, 25 bp, Rattus norvegicus
gccgtgcgggacaccgttctgggag

SEQ ID NO: 395567 - DNA, 25 bp, Rattus norvegicus
gccgtgcgggactccgttctgggag

SEQ ID NO: 395568 - DNA, 25 bp, Rattus norvegicus
gccgtgctagctcggcatagtgata

SEQ ID NO: 395569 - DNA, 25 bp, Rattus norvegicus
gccgtgctagctgggcatagtgata

SEQ ID NO: 395570 - DNA, 25 bp, Rattus norvegicus
gccgtgctcatcagacaaagctttt

SEQ ID NO: 395571 - DNA, 25 bp, Rattus norvegicus
gccgtgctcatctgacaaagctttt

SEQ ID NO: 395572 - DNA, 25 bp, Rattus norvegicus
gccgtgcttcctagacagatttaca

SEQ ID NO: 395573 - DNA, 25 bp, Rattus norvegicus
gccgtgcttccttgacagatttaca

SEQ ID NO: 395574 - DNA, 25 bp, Rattus norvegicus
gccgtggccgctagcaccgcaaagg

SEQ ID NO: 395575 - DNA, 25 bp, Rattus norvegicus
gccgtggccgcttgcaccgcaaagg

SEQ ID NO: 395576 - DNA, 25 bp, Rattus norvegicus
gccgtgggcaagacgcaagtctaga

SEQ ID NO: 395577 - DNA, 25 bp, Rattus norvegicus
gccgtgggcaagtcgcaagtctaga

SEQ ID NO: 395578 - DNA, 25 bp, Rattus norvegicus
gccgtgggtgacaagcgctatttca

SEQ ID NO: 395579 - DNA, 25 bp, Rattus norvegicus
gccgtgggtgactagcgctatttca

SEQ ID NO: 395580 - DNA, 25 bp, Rattus norvegicus
gccgtggtgacacctattgacatac

SEQ ID NO: 395581 - DNA, 25 bp, Rattus norvegicus
gccgtggtgacagctattgacatac

SEQ ID NO: 395582 - DNA, 25 bp, Rattus norvegicus
gccgtggtggttcctatcttgttcc

SEQ ID NO: 395583 - DNA, 25 bp, Rattus norvegicus
gccgtggtggttgctatcttgttcc

SEQ ID NO: 395584 - DNA, 25 bp, Rattus norvegicus
gccgtgtaatacactgcaactgcta

SEQ ID NO: 395585 - DNA, 25 bp, Rattus norvegicus
gccgtgtaatactctgcaactgcta

SEQ ID NO: 395586 - DNA, 25 bp, Rattus norvegicus
gccgtgtattctccagggatgccat

SEQ ID NO: 395587 - DNA, 25 bp, Rattus norvegicus
gccgtgtattctgcagggatgccat

SEQ ID NO: 395588 - DNA, 25 bp, Rattus norvegicus
gccgtgtcagaaacatcagacaaat

SEQ ID NO: 395589 - DNA, 25 bp, Rattus norvegicus
gccgtgtcagaatcatcagacaaat

SEQ ID NO: 395590 - DNA, 25 bp, Rattus norvegicus
gccgtgtccagtccagagtgagttc

SEQ ID NO: 395591 - DNA, 25 bp, Rattus norvegicus
gccgtgtccagtgcagagtgagttc

SEQ ID NO: 395592 - DNA, 25 bp, Rattus norvegicus
gccgtgtcccaaagctgcagcttga

SEQ ID NO: 395593 - DNA, 25 bp, Rattus norvegicus
gccgtgtcccaatgctgcagcttga

SEQ ID NO: 395594 - DNA, 25 bp, Rattus norvegicus
gccgtgtcctccctgatggaaagag

SEQ ID NO: 395595 - DNA, 25 bp, Rattus norvegicus
gccgtgtcctccgtgatggaaagag

SEQ ID NO: 395596 - DNA, 25 bp, Rattus norvegicus
gccgtgtcgcatctacaccagaaac

SEQ ID NO: 395597 - DNA, 25 bp, Rattus norvegicus
gccgtgtcgcatgtacaccagaaac

SEQ ID NO: 395598 - DNA, 25 bp, Rattus norvegicus
gccgtgtcggtcatcaataacaaga

SEQ ID NO: 395599 - DNA, 25 bp, Rattus norvegicus
gccgtgtcggtcttcaataacaaga

SEQ ID NO: 395600 - DNA, 25 bp, Rattus norvegicus
gccgtgtctctaaggttccacaaga

SEQ ID NO: 395601 - DNA, 25 bp, Rattus norvegicus
gccgtgtctctatggttccacaaga

SEQ ID NO: 395602 - DNA, 25 bp, Rattus norvegicus
gccgtgtctgcaccttcattaagga

SEQ ID NO: 395603 - DNA, 25 bp, Rattus norvegicus
gccgtgtctgcagcttcattaagga

SEQ ID NO: 395604 - DNA, 25 bp, Rattus norvegicus
gccgtgtcttctcttgtctttagca

SEQ ID NO: 395605 - DNA, 25 bp, Rattus norvegicus
gccgtgtcttctgttgtctttagca

SEQ ID NO: 395606 - DNA, 25 bp, Rattus norvegicus
gccgtgtgatctaagaggctgaaca

SEQ ID NO: 395607 - DNA, 25 bp, Rattus norvegicus
gccgtgtgatcttagaggctgaaca

SEQ ID NO: 395608 - DNA, 25 bp, Rattus norvegicus
gccgtgtggtcaccaatattggtac

SEQ ID NO: 395609 - DNA, 25 bp, Rattus norvegicus
gccgtgtggtcagcaatattggtac

SEQ ID NO: 395610 - DNA, 25 bp, Rattus norvegicus
gccgtgtgtggtatgcatttaatct

SEQ ID NO: 395611 - DNA, 25 bp, Rattus norvegicus
gccgtgtgtggtttgcatttaatct

SEQ ID NO: 395612 - DNA, 25 bp, Rattus norvegicus
gccgtgttaataatcccagtaccca

SEQ ID NO: 395613 - DNA, 25 bp, Rattus norvegicus
gccgtgttaatattcccagtaccca

SEQ ID NO: 395614 - DNA, 25 bp, Rattus norvegicus
gccgtgttcaagctctaaatttcgt

SEQ ID NO: 395615 - DNA, 25 bp, Rattus norvegicus
gccgtgttcaaggtctaaatttcgt

SEQ ID NO: 395616 - DNA, 25 bp, Rattus norvegicus
gccgtgttggttattcagttgctat

SEQ ID NO: 395617 - DNA, 25 bp, Rattus norvegicus
gccgtgttggtttttcagttgctat

SEQ ID NO: 395618 - DNA, 25 bp, Rattus norvegicus
gccgttaacggtcccatgcagcaga

SEQ ID NO: 395619 - DNA, 25 bp, Rattus norvegicus
gccgttaacggtgccatgcagcaga

SEQ ID NO: 395620 - DNA, 25 bp, Rattus norvegicus
gccgttagcataccacactattgga

SEQ ID NO: 395621 - DNA, 25 bp, Rattus norvegicus
gccgttagcatagcacactattgga

SEQ ID NO: 395622 - DNA, 25 bp, Rattus norvegicus
gccgttagctagaattataagacaa

SEQ ID NO: 395623 - DNA, 25 bp, Rattus norvegicus
gccgttagctagtattataagacaa

SEQ ID NO: 395624 - DNA, 25 bp, Rattus norvegicus
gccgttatatttccattatgtattt

SEQ ID NO: 395625 - DNA, 25 bp, Rattus norvegicus
gccgttatatttgcattatgtattt

SEQ ID NO: 395626 - DNA, 25 bp, Rattus norvegicus
gccgttcaaaagcagacagttcaaa

SEQ ID NO: 395627 - DNA, 25 bp, Rattus norvegicus
gccgttcaaaaggagacagttcaaa

SEQ ID NO: 395628 - DNA, 25 bp, Rattus norvegicus
gccgttcataacaaggcattgggaa

SEQ ID NO: 395629 - DNA, 25 bp, Rattus norvegicus
gccgttcataactaggcattgggaa

SEQ ID NO: 395630 - DNA, 25 bp, Rattus norvegicus
gccgttcctctgatgtttcagataa

SEQ ID NO: 395631 - DNA, 25 bp, Rattus norvegicus
gccgttcctctgttgtttcagataa

SEQ ID NO: 395632 - DNA, 25 bp, Rattus norvegicus
gccgttcgtgctctgttgtttattc

SEQ ID NO: 395633 - DNA, 25 bp, Rattus norvegicus
gccgttcgtgctgtgttgtttattc

SEQ ID NO: 395634 - DNA, 25 bp, Rattus norvegicus
gccgttctaaagctgtttgttttgt

SEQ ID NO: 395635 - DNA, 25 bp, Rattus norvegicus
gccgttctaaaggtgtttgttttgt

SEQ ID NO: 395636 - DNA, 25 bp, Rattus norvegicus
gccgttctgtctaaatacttacctt

SEQ ID NO: 395637 - DNA, 25 bp, Rattus norvegicus
gccgttctgtcttaatacttacctt

SEQ ID NO: 395638 - DNA, 25 bp, Rattus norvegicus
gccgttgatccgctgccaggagaat

SEQ ID NO: 395639 - DNA, 25 bp, Rattus norvegicus
gccgttgatccggtgccaggagaat

SEQ ID NO: 395640 - DNA, 25 bp, Rattus norvegicus
gccgttgctttactcccagaagtga

SEQ ID NO: 395641 - DNA, 25 bp, Rattus norvegicus
gccgttgctttagtcccagaagtga

SEQ ID NO: 395642 - DNA, 25 bp, Rattus norvegicus
gccgttggtaagatttctcctgata

SEQ ID NO: 395643 - DNA, 25 bp, Rattus norvegicus
gccgttggtaagttttctcctgata

SEQ ID NO: 395644 - DNA, 25 bp, Rattus norvegicus
gccgttgtcaaaagatgctccatct

SEQ ID NO: 395645 - DNA, 25 bp, Rattus norvegicus
gccgttgtcaaatgatgctccatct

SEQ ID NO: 395646 - DNA, 25 bp, Rattus norvegicus
gccgttgttcacaccacttgaaaat

SEQ ID NO: 395647 - DNA, 25 bp, Rattus norvegicus
gccgttgttcactccacttgaaaat

SEQ ID NO: 395648 - DNA, 25 bp, Rattus norvegicus
gccgttgtttacaagttgacctgaa

SEQ ID NO: 395649 - DNA, 25 bp, Rattus norvegicus
gccgttgtttactagttgacctgaa

SEQ ID NO: 395650 - DNA, 25 bp, Rattus norvegicus
gccgtttacgttaattgttgtatca

SEQ ID NO: 395651 - DNA, 25 bp, Rattus norvegicus
gccgtttacgtttattgttgtatca

SEQ ID NO: 395652 - DNA, 25 bp, Rattus norvegicus
gccgtttactacacagtaactcttt

SEQ ID NO: 395653 - DNA, 25 bp, Rattus norvegicus
gccgtttactactcagtaactcttt

SEQ ID NO: 395654 - DNA, 25 bp, Rattus norvegicus
gccgtttcaacgatacaatcatttt

SEQ ID NO: 395655 - DNA, 25 bp, Rattus norvegicus
gccgtttcaacgttacaatcatttt

SEQ ID NO: 395656 - DNA, 25 bp, Rattus norvegicus
gccgtttcaagtcctccaagtttgg

SEQ ID NO: 395657 - DNA, 25 bp, Rattus norvegicus
gccgtttcaagtgctccaagtttgg

SEQ ID NO: 395658 - DNA, 25 bp, Rattus norvegicus
gccgtttctattattgtccactgtt

SEQ ID NO: 395659 - DNA, 25 bp, Rattus norvegicus
gccgtttctatttttgtccactgtt

SEQ ID NO: 395660 - DNA, 25 bp, Rattus norvegicus
gccgtttctgtacaatcgaaccttt

SEQ ID NO: 395661 - DNA, 25 bp, Rattus norvegicus
gccgtttctgtagaatcgaaccttt

SEQ ID NO: 395662 - DNA, 25 bp, Rattus norvegicus
gcctaaaacaaaatttctatggtga

SEQ ID NO: 395663 - DNA, 25 bp, Rattus norvegicus
gcctaaaacaaattttctatggtga

SEQ ID NO: 395664 - DNA, 25 bp, Rattus norvegicus
gcctaaatatgtatcttaagtttgt

SEQ ID NO: 395665 - DNA, 25 bp, Rattus norvegicus
gcctaaatatgtttcttaagtttgt

SEQ ID NO: 395666 - DNA, 25 bp, Rattus norvegicus
gcctaaatgggtagtgttgagtagt

SEQ ID NO: 395667 - DNA, 25 bp, Rattus norvegicus
gcctaaatgggttgtgttgagtagt

SEQ ID NO: 395668 - DNA, 25 bp, Rattus norvegicus
gcctaaccacacatggagacactat

SEQ ID NO: 395669 - DNA, 25 bp, Rattus norvegicus
gcctaaccacacttggagacactat

SEQ ID NO: 395670 - DNA, 25 bp, Rattus norvegicus
gcctaaccattcagcattttccaag

SEQ ID NO: 395671 - DNA, 25 bp, Rattus norvegicus
gcctaaccattctgcattttccaag

SEQ ID NO: 395672 - DNA, 25 bp, Rattus norvegicus
gcctaacccttgatatctctttgta

SEQ ID NO: 395673 - DNA, 25 bp, Rattus norvegicus
gcctaacccttgttatctctttgta

SEQ ID NO: 395674 - DNA, 25 bp, Rattus norvegicus
gcctaaccgtggcagagcagcacag

SEQ ID NO: 395675 - DNA, 25 bp, Rattus norvegicus
gcctaaccgtgggagagcagcacag

SEQ ID NO: 395676 - DNA, 25 bp, Rattus norvegicus
gcctaactcttaaatcttgttgcct

SEQ ID NO: 395677 - DNA, 25 bp, Rattus norvegicus
gcctaactcttatatcttgttgcct

SEQ ID NO: 395678 - DNA, 25 bp, Rattus norvegicus
gcctaagacaacctgactgtgctca

SEQ ID NO: 395679 - DNA, 25 bp, Rattus norvegicus
gcctaagacaacgtgactgtgctca

SEQ ID NO: 395680 - DNA, 25 bp, Rattus norvegicus
gcctaagagcagctgttctcacaga

SEQ ID NO: 395681 - DNA, 25 bp, Rattus norvegicus
gcctaagagcaggtgttctcacaga

SEQ ID NO: 395682 - DNA, 25 bp, Rattus norvegicus
gcctaagctacacaaaatcctgtct

SEQ ID NO: 395683 - DNA, 25 bp, Rattus norvegicus
gcctaagctacagaaaatcctgtct

SEQ ID NO: 395684 - DNA, 25 bp, Rattus norvegicus
gcctaagctggcattcgtgaagttc

SEQ ID NO: 395685 - DNA, 25 bp, Rattus norvegicus
gcctaagctggctttcgtgaagttc

SEQ ID NO: 395686 - DNA, 25 bp, Rattus norvegicus
gcctaaggctaaatggtcttcccac

SEQ ID NO: 395687 - DNA, 25 bp, Rattus norvegicus
gcctaaggctaattggtcttcccac

SEQ ID NO: 395688 - DNA, 25 bp, Rattus norvegicus
gcctaagggactatgttttaatgat

SEQ ID NO: 395689 - DNA, 25 bp, Rattus norvegicus
gcctaagggactttgttttaatgat

SEQ ID NO: 395690 - DNA, 25 bp, Rattus norvegicus
gcctaagggcttatgatacttgcag

SEQ ID NO: 395691 - DNA, 25 bp, Rattus norvegicus
gcctaagggcttttgatacttgcag

SEQ ID NO: 395692 - DNA, 25 bp, Rattus norvegicus
gcctaagggttaaaaagtctgctgt

SEQ ID NO: 395693 - DNA, 25 bp, Rattus norvegicus
gcctaagggttataaagtctgctgt

SEQ ID NO: 395694 - DNA, 25 bp, Rattus norvegicus
gcctaaggttccattcaaggtcacg

SEQ ID NO: 395695 - DNA, 25 bp, Rattus norvegicus
gcctaaggttcctttcaaggtcacg

SEQ ID NO: 395696 - DNA, 25 bp, Rattus norvegicus
gcctaagtaaccagacactgtctca

SEQ ID NO: 395697 - DNA, 25 bp, Rattus norvegicus
gcctaagtaacctgacactgtctca

SEQ ID NO: 395698 - DNA, 25 bp, Rattus norvegicus
gcctaatctaacaatggccatgttt

SEQ ID NO: 395699 - DNA, 25 bp, Rattus norvegicus
gcctaatctaactatggccatgttt

SEQ ID NO: 395700 - DNA, 25 bp, Rattus norvegicus
gcctaatgatatcacaaacttgtgg

SEQ ID NO: 395701 - DNA, 25 bp, Rattus norvegicus
gcctaatgatatgacaaacttgtgg

SEQ ID NO: 395702 - DNA, 25 bp, Rattus norvegicus
gcctaattattaacgattcagtata

SEQ ID NO: 395703 - DNA, 25 bp, Rattus norvegicus
gcctaattattatcgattcagtata

SEQ ID NO: 395704 - DNA, 25 bp, Rattus norvegicus
gcctaattcacgctcagggtctgac

SEQ ID NO: 395705 - DNA, 25 bp, Rattus norvegicus
gcctaattcacggtcagggtctgac

SEQ ID NO: 395706 - DNA, 25 bp, Rattus norvegicus
gcctaattcaggatcttaacccaca

SEQ ID NO: 395707 - DNA, 25 bp, Rattus norvegicus
gcctaattcaggttcttaacccaca

SEQ ID NO: 395708 - DNA, 25 bp, Rattus norvegicus
gcctaattctagcaggttgcccaat

SEQ ID NO: 395709 - DNA, 25 bp, Rattus norvegicus
gcctaattctaggaggttgcccaat

SEQ ID NO: 395710 - DNA, 25 bp, Rattus norvegicus
gcctaattgattacgtccttatttc

SEQ ID NO: 395711 - DNA, 25 bp, Rattus norvegicus
gcctaattgatttcgtccttatttc

SEQ ID NO: 395712 - DNA, 25 bp, Rattus norvegicus
gcctaattgcccaactagattctaa

SEQ ID NO: 395713 - DNA, 25 bp, Rattus norvegicus
gcctaattgccctactagattctaa

SEQ ID NO: 395714 - DNA, 25 bp, Rattus norvegicus
gcctacaaaccacctcttaaaatga

SEQ ID NO: 395715 - DNA, 25 bp, Rattus norvegicus
gcctacaaaccagctcttaaaatga

SEQ ID NO: 395716 - DNA, 25 bp, Rattus norvegicus
gcctacaactctagtcactgacttg

SEQ ID NO: 395717 - DNA, 25 bp, Rattus norvegicus
gcctacaactcttgtcactgacttg

SEQ ID NO: 395718 - DNA, 25 bp, Rattus norvegicus
gcctacaaggtcaatatctgcatat

SEQ ID NO: 395719 - DNA, 25 bp, Rattus norvegicus
gcctacaaggtctatatctgcatat

SEQ ID NO: 395720 - DNA, 25 bp, Rattus norvegicus
gcctacaagtgcatccaagacagaa

SEQ ID NO: 395721 - DNA, 25 bp, Rattus norvegicus
gcctacaagtgcttccaagacagaa

SEQ ID NO: 395722 - DNA, 25 bp, Rattus norvegicus
gcctacaatcacatagtaaattctg

SEQ ID NO: 395723 - DNA, 25 bp, Rattus norvegicus
gcctacaatcacttagtaaattctg

SEQ ID NO: 395724 - DNA, 25 bp, Rattus norvegicus
gcctacacactccagaagggcaaga

SEQ ID NO: 395725 - DNA, 25 bp, Rattus norvegicus
gcctacacactcgagaagggcaaga

SEQ ID NO: 395726 - DNA, 25 bp, Rattus norvegicus
gcctacacagtgaactcagagccaa

SEQ ID NO: 395727 - DNA, 25 bp, Rattus norvegicus
gcctacacagtgtactcagagccaa

SEQ ID NO: 395728 - DNA, 25 bp, Rattus norvegicus
gcctacactgcgactggagatcatt

SEQ ID NO: 395729 - DNA, 25 bp, Rattus norvegicus
gcctacactgcgtctggagatcatt

SEQ ID NO: 395730 - DNA, 25 bp, Rattus norvegicus
gcctacactgctaggtttctaagtt

SEQ ID NO: 395731 - DNA, 25 bp, Rattus norvegicus
gcctacactgcttggtttctaagtt

SEQ ID NO: 395732 - DNA, 25 bp, Rattus norvegicus
gcctacagatggaaggtgacagatc

SEQ ID NO: 395733 - DNA, 25 bp, Rattus norvegicus
gcctacagatggtaggtgacagatc

SEQ ID NO: 395734 - DNA, 25 bp, Rattus norvegicus
gcctacatccagaagctgtcttatg

SEQ ID NO: 395735 - DNA, 25 bp, Rattus norvegicus
gcctacatccagtagctgtcttatg

SEQ ID NO: 395736 - DNA, 25 bp, Rattus norvegicus
gcctaccacattcagccttgctggt

SEQ ID NO: 395737 - DNA, 25 bp, Rattus norvegicus
gcctaccacattgagccttgctggt

SEQ ID NO: 395738 - DNA, 25 bp, Rattus norvegicus
gcctaccagaaactttgcttacctg

SEQ ID NO: 395739 - DNA, 25 bp, Rattus norvegicus
gcctaccagaaagtttgcttacctg

SEQ ID NO: 395740 - DNA, 25 bp, Rattus norvegicus
gcctaccatacccaatgaaatccat

SEQ ID NO: 395741 - DNA, 25 bp, Rattus norvegicus
gcctaccataccgaatgaaatccat

SEQ ID NO: 395742 - DNA, 25 bp, Rattus norvegicus
gcctacccagtaatgatatatcatt

SEQ ID NO: 395743 - DNA, 25 bp, Rattus norvegicus
gcctacccagtattgatatatcatt

SEQ ID NO: 395744 - DNA, 25 bp, Rattus norvegicus
gcctacccagtcagttcagagccgg

SEQ ID NO: 395745 - DNA, 25 bp, Rattus norvegicus
gcctacccagtctgttcagagccgg

SEQ ID NO: 395746 - DNA, 25 bp, Rattus norvegicus
gcctacccttatagctttctaaatt

SEQ ID NO: 395747 - DNA, 25 bp, Rattus norvegicus
gcctacccttattgctttctaaatt

SEQ ID NO: 395748 - DNA, 25 bp, Rattus norvegicus
gcctaccgaaagactcagcaagatc

SEQ ID NO: 395749 - DNA, 25 bp, Rattus norvegicus
gcctaccgaaagtctcagcaagatc

SEQ ID NO: 395750 - DNA, 25 bp, Rattus norvegicus
gcctaccggtttcagactgacattc

SEQ ID NO: 395751 - DNA, 25 bp, Rattus norvegicus
gcctaccggtttgagactgacattc

SEQ ID NO: 395752 - DNA, 25 bp, Rattus norvegicus
gcctacctctggactgaagtacaag

SEQ ID NO: 395753 - DNA, 25 bp, Rattus norvegicus
gcctacctctggtctgaagtacaag

SEQ ID NO: 395754 - DNA, 25 bp, Rattus norvegicus
gcctacctctgtaaccagcaaaaca

SEQ ID NO: 395755 - DNA, 25 bp, Rattus norvegicus
gcctacctctgttaccagcaaaaca

SEQ ID NO: 395756 - DNA, 25 bp, Rattus norvegicus
gcctacctgacgagggcaatacaga

SEQ ID NO: 395757 - DNA, 25 bp, Rattus norvegicus
gcctacctgacgtgggcaatacaga

SEQ ID NO: 395758 - DNA, 25 bp, Rattus norvegicus
gcctacctgatccacctaggtaagt

SEQ ID NO: 395759 - DNA, 25 bp, Rattus norvegicus
gcctacctgatcgacctaggtaagt

SEQ ID NO: 395760 - DNA, 25 bp, Rattus norvegicus
gcctacctgtggaatatgttggttt

SEQ ID NO: 395761 - DNA, 25 bp, Rattus norvegicus
gcctacctgtggtatatgttggttt

SEQ ID NO: 395762 - DNA, 25 bp, Rattus norvegicus
gcctaccttagccatgatttctcag

SEQ ID NO: 395763 - DNA, 25 bp, Rattus norvegicus
gcctaccttagcgatgatttctcag

SEQ ID NO: 395764 - DNA, 25 bp, Rattus norvegicus
gcctaccttgtgactggactacaga

SEQ ID NO: 395765 - DNA, 25 bp, Rattus norvegicus
gcctaccttgtgtctggactacaga

SEQ ID NO: 395766 - DNA, 25 bp, Rattus norvegicus
gcctacgaacagaaggtgacagatc

SEQ ID NO: 395767 - DNA, 25 bp, Rattus norvegicus
gcctacgaacagtaggtgacagatc

SEQ ID NO: 395768 - DNA, 25 bp, Rattus norvegicus
gcctacgcagtacattttcattttc

SEQ ID NO: 395769 - DNA, 25 bp, Rattus norvegicus
gcctacgcagtagattttcattttc

SEQ ID NO: 395770 - DNA, 25 bp, Rattus norvegicus
gcctacggatgtagtggatcttctt

SEQ ID NO: 395771 - DNA, 25 bp, Rattus norvegicus
gcctacggatgttgtggatcttctt

SEQ ID NO: 395772 - DNA, 25 bp, Rattus norvegicus
gcctacggccaacatttaacttcaa

SEQ ID NO: 395773 - DNA, 25 bp, Rattus norvegicus
gcctacggccaagatttaacttcaa

SEQ ID NO: 395774 - DNA, 25 bp, Rattus norvegicus
gcctacggtacaaattccacttaaa

SEQ ID NO: 395775 - DNA, 25 bp, Rattus norvegicus
gcctacggtacatattccacttaaa

SEQ ID NO: 395776 - DNA, 25 bp, Rattus norvegicus
gcctacgtggagagctgtattgact

SEQ ID NO: 395777 - DNA, 25 bp, Rattus norvegicus
gcctacgtggagtgctgtattgact

SEQ ID NO: 395778 - DNA, 25 bp, Rattus norvegicus
gcctacgtgtgccagccgtgtgcaa

SEQ ID NO: 395779 - DNA, 25 bp, Rattus norvegicus
gcctacgtgtgcgagccgtgtgcaa

SEQ ID NO: 395780 - DNA, 25 bp, Rattus norvegicus
gcctactacatcctgtttcgtggat

SEQ ID NO: 395781 - DNA, 25 bp, Rattus norvegicus
gcctactacatcgtgtttcgtggat

SEQ ID NO: 395782 - DNA, 25 bp, Rattus norvegicus
gcctactactgcaaacttgttcaca

SEQ ID NO: 395783 - DNA, 25 bp, Rattus norvegicus
gcctactactgctaacttgttcaca

SEQ ID NO: 395784 - DNA, 25 bp, Rattus norvegicus
gcctactcaattatgtctggcaatt

SEQ ID NO: 395785 - DNA, 25 bp, Rattus norvegicus
gcctactcaattttgtctggcaatt

SEQ ID NO: 395786 - DNA, 25 bp, Rattus norvegicus
gcctactccatgatgaccacaatga

SEQ ID NO: 395787 - DNA, 25 bp, Rattus norvegicus
gcctactccatgttgaccacaatga

SEQ ID NO: 395788 - DNA, 25 bp, Rattus norvegicus
gcctactctgttctatttatgcttg

SEQ ID NO: 395789 - DNA, 25 bp, Rattus norvegicus
gcctactctgttgtatttatgcttg

SEQ ID NO: 395790 - DNA, 25 bp, Rattus norvegicus
gcctactgatccagacagtgacgat

SEQ ID NO: 395791 - DNA, 25 bp, Rattus norvegicus
gcctactgatcctgacagtgacgat

SEQ ID NO: 395792 - DNA, 25 bp, Rattus norvegicus
gcctactgatgaatgctttagcaga

SEQ ID NO: 395793 - DNA, 25 bp, Rattus norvegicus
gcctactgatgattgctttagcaga

SEQ ID NO: 395794 - DNA, 25 bp, Rattus norvegicus
gcctactgcttacaatacctgtata

SEQ ID NO: 395795 - DNA, 25 bp, Rattus norvegicus
gcctactgcttagaatacctgtata

SEQ ID NO: 395796 - DNA, 25 bp, Rattus norvegicus
gcctactgtcctacagcaaattgac

SEQ ID NO: 395797 - DNA, 25 bp, Rattus norvegicus
gcctactgtccttcagcaaattgac

SEQ ID NO: 395798 - DNA, 25 bp, Rattus norvegicus
gcctactgttagcttctttctttaa

SEQ ID NO: 395799 - DNA, 25 bp, Rattus norvegicus
gcctactgttaggttctttctttaa

SEQ ID NO: 395800 - DNA, 25 bp, Rattus norvegicus
gcctactgttggatggttactccta

SEQ ID NO: 395801 - DNA, 25 bp, Rattus norvegicus
gcctactgttggttggttactccta

SEQ ID NO: 395802 - DNA, 25 bp, Rattus norvegicus
gcctacttcaccacaattggtgaga

SEQ ID NO: 395803 - DNA, 25 bp, Rattus norvegicus
gcctacttcacctcaattggtgaga

SEQ ID NO: 395804 - DNA, 25 bp, Rattus norvegicus
gcctacttccaccattttagctata

SEQ ID NO: 395805 - DNA, 25 bp, Rattus norvegicus
gcctacttccacgattttagctata

SEQ ID NO: 395806 - DNA, 25 bp, Rattus norvegicus
gcctacttgccaatttctgttagtg

SEQ ID NO: 395807 - DNA, 25 bp, Rattus norvegicus
gcctacttgccattttctgttagtg

SEQ ID NO: 395808 - DNA, 25 bp, Rattus norvegicus
gcctactttagcctgtattacaaat

SEQ ID NO: 395809 - DNA, 25 bp, Rattus norvegicus
gcctactttagcgtgtattacaaat

SEQ ID NO: 395810 - DNA, 25 bp, Rattus norvegicus
gcctactttcttactcatgatttgt

SEQ ID NO: 395811 - DNA, 25 bp, Rattus norvegicus
gcctactttctttctcatgatttgt

SEQ ID NO: 395812 - DNA, 25 bp, Rattus norvegicus
gcctagaaccagaacagtccacagt

SEQ ID NO: 395813 - DNA, 25 bp, Rattus norvegicus
gcctagaaccagtacagtccacagt

SEQ ID NO: 395814 - DNA, 25 bp, Rattus norvegicus
gcctagacccatacctttattttat

SEQ ID NO: 395815 - DNA, 25 bp, Rattus norvegicus
gcctagacccattcctttattttat

SEQ ID NO: 395816 - DNA, 25 bp, Rattus norvegicus
gcctagaccctcagccaacagagag

SEQ ID NO: 395817 - DNA, 25 bp, Rattus norvegicus
gcctagaccctctgccaacagagag

SEQ ID NO: 395818 - DNA, 25 bp, Rattus norvegicus
gcctagacccttatctactattaag

SEQ ID NO: 395819 - DNA, 25 bp, Rattus norvegicus
gcctagacccttttctactattaag

SEQ ID NO: 395820 - DNA, 25 bp, Rattus norvegicus
gcctagaccgagctgcaagagttct

SEQ ID NO: 395821 - DNA, 25 bp, Rattus norvegicus
gcctagaccgaggtgcaagagttct

SEQ ID NO: 395822 - DNA, 25 bp, Rattus norvegicus
gcctagacctcaaggcattgctatg

SEQ ID NO: 395823 - DNA, 25 bp, Rattus norvegicus
gcctagacctcatggcattgctatg

SEQ ID NO: 395824 - DNA, 25 bp, Rattus norvegicus
gcctagacggatcgtgcttgcacac

SEQ ID NO: 395825 - DNA, 25 bp, Rattus norvegicus
gcctagacggatggtgcttgcacac

SEQ ID NO: 395826 - DNA, 25 bp, Rattus norvegicus
gcctagagaatccagcctagagctt

SEQ ID NO: 395827 - DNA, 25 bp, Rattus norvegicus
gcctagagaatcgagcctagagctt

SEQ ID NO: 395828 - DNA, 25 bp, Rattus norvegicus
gcctagaggctaacagcactaccta

SEQ ID NO: 395829 - DNA, 25 bp, Rattus norvegicus
gcctagaggctatcagcactaccta

SEQ ID NO: 395830 - DNA, 25 bp, Rattus norvegicus
gcctagagtataaggcattttgtct

SEQ ID NO: 395831 - DNA, 25 bp, Rattus norvegicus
gcctagagtatatggcattttgtct

SEQ ID NO: 395832 - DNA, 25 bp, Rattus norvegicus
gcctagatgctgctggatggacata

SEQ ID NO: 395833 - DNA, 25 bp, Rattus norvegicus
gcctagatgctggtggatggacata

SEQ ID NO: 395834 - DNA, 25 bp, Rattus norvegicus
gcctagcaaaccagttggcaaccta

SEQ ID NO: 395835 - DNA, 25 bp, Rattus norvegicus
gcctagcaaacctgttggcaaccta

SEQ ID NO: 395836 - DNA, 25 bp, Rattus norvegicus
gcctagcaacctcattgtttccatg

SEQ ID NO: 395837 - DNA, 25 bp, Rattus norvegicus
gcctagcaacctgattgtttccatg

SEQ ID NO: 395838 - DNA, 25 bp, Rattus norvegicus
gcctagcaccgaatttctgatgtaa

SEQ ID NO: 395839 - DNA, 25 bp, Rattus norvegicus
gcctagcaccgattttctgatgtaa

SEQ ID NO: 395840 - DNA, 25 bp, Rattus norvegicus
gcctagcagctaaaatggaaccgtt

SEQ ID NO: 395841 - DNA, 25 bp, Rattus norvegicus
gcctagcagctataatggaaccgtt

SEQ ID NO: 395842 - DNA, 25 bp, Rattus norvegicus
gcctagcatcacatttcctaattgg

SEQ ID NO: 395843 - DNA, 25 bp, Rattus norvegicus
gcctagcatcacttttcctaattgg

SEQ ID NO: 395844 - DNA, 25 bp, Rattus norvegicus
gcctagcctggcctcagtgtaagaa

SEQ ID NO: 395845 - DNA, 25 bp, Rattus norvegicus
gcctagcctggcgtcagtgtaagaa

SEQ ID NO: 395846 - DNA, 25 bp, Rattus norvegicus
gcctagccttagcattgactctcaa

SEQ ID NO: 395847 - DNA, 25 bp, Rattus norvegicus
gcctagccttaggattgactctcaa

SEQ ID NO: 395848 - DNA, 25 bp, Rattus norvegicus
gcctagctacagagggcgccagtac

SEQ ID NO: 395849 - DNA, 25 bp, Rattus norvegicus
gcctagctacagtgggcgccagtac

SEQ ID NO: 395850 - DNA, 25 bp, Rattus norvegicus
gcctagctatggagcaaaagtcctt

SEQ ID NO: 395851 - DNA, 25 bp, Rattus norvegicus
gcctagctatggtgcaaaagtcctt

SEQ ID NO: 395852 - DNA, 25 bp, Rattus norvegicus
gcctagctgagccaaagcgtttgct

SEQ ID NO: 395853 - DNA, 25 bp, Rattus norvegicus
gcctagctgagcgaaagcgtttgct

SEQ ID NO: 395854 - DNA, 25 bp, Rattus norvegicus
gcctagctggttcggtctggcttta

SEQ ID NO: 395855 - DNA, 25 bp, Rattus norvegicus
gcctagctggttgggtctggcttta

SEQ ID NO: 395856 - DNA, 25 bp, Rattus norvegicus
gcctagcttcatcgtgctgtgggta

SEQ ID NO: 395857 - DNA, 25 bp, Rattus norvegicus
gcctagcttcatggtgctgtgggta

SEQ ID NO: 395858 - DNA, 25 bp, Rattus norvegicus
gcctagcttggaatgtgcatgtact

SEQ ID NO: 395859 - DNA, 25 bp, Rattus norvegicus
gcctagcttggattgtgcatgtact

SEQ ID NO: 395860 - DNA, 25 bp, Rattus norvegicus
gcctagcttggccaaggtcacttga

SEQ ID NO: 395861 - DNA, 25 bp, Rattus norvegicus
gcctagcttggcgaaggtcacttga

SEQ ID NO: 395862 - DNA, 25 bp, Rattus norvegicus
gcctagctttccctaagttttgata

SEQ ID NO: 395863 - DNA, 25 bp, Rattus norvegicus
gcctagctttccgtaagttttgata

SEQ ID NO: 395864 - DNA, 25 bp, Rattus norvegicus
gcctaggagaagagcccagatttga

SEQ ID NO: 395865 - DNA, 25 bp, Rattus norvegicus
gcctaggagaagtgcccagatttga

SEQ ID NO: 395866 - DNA, 25 bp, Rattus norvegicus
gcctaggcagttacatgagcacagc

SEQ ID NO: 395867 - DNA, 25 bp, Rattus norvegicus
gcctaggcagtttcatgagcacagc

SEQ ID NO: 395868 - DNA, 25 bp, Rattus norvegicus
gcctaggcatccattgctggagttt

SEQ ID NO: 395869 - DNA, 25 bp, Rattus norvegicus
gcctaggcatcctttgctggagttt

SEQ ID NO: 395870 - DNA, 25 bp, Rattus norvegicus
gcctaggcatgtactatttacccag

SEQ ID NO: 395871 - DNA, 25 bp, Rattus norvegicus
gcctaggcatgttctatttacccag

SEQ ID NO: 395872 - DNA, 25 bp, Rattus norvegicus
gcctaggccatacccctatagaaat

SEQ ID NO: 395873 - DNA, 25 bp, Rattus norvegicus
gcctaggccatagccctatagaaat

SEQ ID NO: 395874 - DNA, 25 bp, Rattus norvegicus
gcctaggcccacataacttattaat

SEQ ID NO: 395875 - DNA, 25 bp, Rattus norvegicus
gcctaggcccacttaacttattaat

SEQ ID NO: 395876 - DNA, 25 bp, Rattus norvegicus
gcctaggcctggaggagagccctaa

SEQ ID NO: 395877 - DNA, 25 bp, Rattus norvegicus
gcctaggcctggtggagagccctaa

SEQ ID NO: 395878 - DNA, 25 bp, Rattus norvegicus
gcctaggctatgcataactctgtct

SEQ ID NO: 395879 - DNA, 25 bp, Rattus norvegicus
gcctaggctatggataactctgtct

SEQ ID NO: 395880 - DNA, 25 bp, Rattus norvegicus
gcctaggctctactggtttccagta

SEQ ID NO: 395881 - DNA, 25 bp, Rattus norvegicus
gcctaggctctagtggtttccagta

SEQ ID NO: 395882 - DNA, 25 bp, Rattus norvegicus
gcctaggcttcgaagtatttttctc

SEQ ID NO: 395883 - DNA, 25 bp, Rattus norvegicus
gcctaggcttcgtagtatttttctc

SEQ ID NO: 395884 - DNA, 25 bp, Rattus norvegicus
gcctagggatgtcatcattgtgcca

SEQ ID NO: 395885 - DNA, 25 bp, Rattus norvegicus
gcctagggatgtgatcattgtgcca

SEQ ID NO: 395886 - DNA, 25 bp, Rattus norvegicus
gcctaggtactgcagactggcctga

SEQ ID NO: 395887 - DNA, 25 bp, Rattus norvegicus
gcctaggtactggagactggcctga

SEQ ID NO: 395888 - DNA, 25 bp, Rattus norvegicus
gcctaggtcatcatggacatctgca

SEQ ID NO: 395889 - DNA, 25 bp, Rattus norvegicus
gcctaggtcatcttggacatctgca

SEQ ID NO: 395890 - DNA, 25 bp, Rattus norvegicus
gcctaggtggacagacagacgcccg

SEQ ID NO: 395891 - DNA, 25 bp, Rattus norvegicus
gcctaggtggactgacagacgcccg

SEQ ID NO: 395892 - DNA, 25 bp, Rattus norvegicus
gcctaggttctactattaagtttca

SEQ ID NO: 395893 - DNA, 25 bp, Rattus norvegicus
gcctaggttctagtattaagtttca

SEQ ID NO: 395894 - DNA, 25 bp, Rattus norvegicus
gcctagtacctacgaagctgtttct

SEQ ID NO: 395895 - DNA, 25 bp, Rattus norvegicus
gcctagtacctaggaagctgtttct

SEQ ID NO: 395896 - DNA, 25 bp, Rattus norvegicus
gcctagtagattaggtgcagctttt

SEQ ID NO: 395897 - DNA, 25 bp, Rattus norvegicus
gcctagtagatttggtgcagctttt

SEQ ID NO: 395898 - DNA, 25 bp, Rattus norvegicus
gcctagtcacatcggtcactatgct

SEQ ID NO: 395899 - DNA, 25 bp, Rattus norvegicus
gcctagtcacatgggtcactatgct

SEQ ID NO: 395900 - DNA, 25 bp, Rattus norvegicus
gcctagtccacccataaagcttaaa

SEQ ID NO: 395901 - DNA, 25 bp, Rattus norvegicus
gcctagtccaccgataaagcttaaa

SEQ ID NO: 395902 - DNA, 25 bp, Rattus norvegicus
gcctagtcctggacggtattttaat

SEQ ID NO: 395903 - DNA, 25 bp, Rattus norvegicus
gcctagtcctggtcggtattttaat

SEQ ID NO: 395904 - DNA, 25 bp, Rattus norvegicus
gcctagtgggcccaactaaagctgg

SEQ ID NO: 395905 - DNA, 25 bp, Rattus norvegicus
gcctagtgggccgaactaaagctgg

SEQ ID NO: 395906 - DNA, 25 bp, Rattus norvegicus
gcctagttaatgacctatggtccag

SEQ ID NO: 395907 - DNA, 25 bp, Rattus norvegicus
gcctagttaatgtcctatggtccag

SEQ ID NO: 395908 - DNA, 25 bp, Rattus norvegicus
gcctagttacaaagcaggactatgt

SEQ ID NO: 395909 - DNA, 25 bp, Rattus norvegicus
gcctagttacaatgcaggactatgt

SEQ ID NO: 395910 - DNA, 25 bp, Rattus norvegicus
gcctagttcgcgcataaagtgcacc

SEQ ID NO: 395911 - DNA, 25 bp, Rattus norvegicus
gcctagttcgcggataaagtgcacc

SEQ ID NO: 395912 - DNA, 25 bp, Rattus norvegicus
gcctagttctttacacacagttctg

SEQ ID NO: 395913 - DNA, 25 bp, Rattus norvegicus
gcctagttcttttcacacagttctg

SEQ ID NO: 395914 - DNA, 25 bp, Rattus norvegicus
gcctagttgcttccgggcagcagaa

SEQ ID NO: 395915 - DNA, 25 bp, Rattus norvegicus
gcctagttgcttgcgggcagcagaa

SEQ ID NO: 395916 - DNA, 25 bp, Rattus norvegicus
gcctataaaaccaagaagcctccgt

SEQ ID NO: 395917 - DNA, 25 bp, Rattus norvegicus
gcctataaaacctagaagcctccgt

SEQ ID NO: 395918 - DNA, 25 bp, Rattus norvegicus
gcctataatccgacagtgagaaagt

SEQ ID NO: 395919 - DNA, 25 bp, Rattus norvegicus
gcctataatccgtcagtgagaaagt

SEQ ID NO: 395920 - DNA, 25 bp, Rattus norvegicus
gcctataccaccatgtaactacgtt

SEQ ID NO: 395921 - DNA, 25 bp, Rattus norvegicus
gcctataccaccttgtaactacgtt

SEQ ID NO: 395922 - DNA, 25 bp, Rattus norvegicus
gcctatataatactggtgttttctt

SEQ ID NO: 395923 - DNA, 25 bp, Rattus norvegicus
gcctatataatagtggtgttttctt

SEQ ID NO: 395924 - DNA, 25 bp, Rattus norvegicus
gcctatcaatctattctgttcactg

SEQ ID NO: 395925 - DNA, 25 bp, Rattus norvegicus
gcctatcaatcttttctgttcactg

SEQ ID NO: 395926 - DNA, 25 bp, Rattus norvegicus
gcctatcagaccattactcattaac

SEQ ID NO: 395927 - DNA, 25 bp, Rattus norvegicus
gcctatcagacctttactcattaac

SEQ ID NO: 395928 - DNA, 25 bp, Rattus norvegicus
gcctatcagctgaagtcatcactct

SEQ ID NO: 395929 - DNA, 25 bp, Rattus norvegicus
gcctatcagctgtagtcatcactct

SEQ ID NO: 395930 - DNA, 25 bp, Rattus norvegicus
gcctatcattctataaatgtctccg

SEQ ID NO: 395931 - DNA, 25 bp, Rattus norvegicus
gcctatcattctttaaatgtctccg

SEQ ID NO: 395932 - DNA, 25 bp, Rattus norvegicus
gcctatcccgccatagttgaagatg

SEQ ID NO: 395933 - DNA, 25 bp, Rattus norvegicus
gcctatcccgccttagttgaagatg

SEQ ID NO: 395934 - DNA, 25 bp, Rattus norvegicus
gcctatccgggtctgtttggattta

SEQ ID NO: 395935 - DNA, 25 bp, Rattus norvegicus
gcctatccgggtgtgtttggattta

SEQ ID NO: 395936 - DNA, 25 bp, Rattus norvegicus
gcctatcctagacaagctgacccag

SEQ ID NO: 395937 - DNA, 25 bp, Rattus norvegicus
gcctatcctagagaagctgacccag

SEQ ID NO: 395938 - DNA, 25 bp, Rattus norvegicus
gcctatcctaggctcttgaaggaga

SEQ ID NO: 395939 - DNA, 25 bp, Rattus norvegicus
gcctatcctagggtcttgaaggaga

SEQ ID NO: 395940 - DNA, 25 bp, Rattus norvegicus
gcctatcctgttccaatgtctgtaa

SEQ ID NO: 395941 - DNA, 25 bp, Rattus norvegicus
gcctatcctgttgcaatgtctgtaa

SEQ ID NO: 395942 - DNA, 25 bp, Rattus norvegicus
gcctatcgaccacatcctagaagta

SEQ ID NO: 395943 - DNA, 25 bp, Rattus norvegicus
gcctatcgaccagatcctagaagta

SEQ ID NO: 395944 - DNA, 25 bp, Rattus norvegicus
gcctatctgcctaactttatcataa

SEQ ID NO: 395945 - DNA, 25 bp, Rattus norvegicus
gcctatctgccttactttatcataa

SEQ ID NO: 395946 - DNA, 25 bp, Rattus norvegicus
gcctatctgggcaacaaaggaaact

SEQ ID NO: 395947 - DNA, 25 bp, Rattus norvegicus
gcctatctgggctacaaaggaaact

SEQ ID NO: 395948 - DNA, 25 bp, Rattus norvegicus
gcctatctggttactttcacttgaa

SEQ ID NO: 395949 - DNA, 25 bp, Rattus norvegicus
gcctatctggttcgcctttttgaag

SEQ ID NO: 395950 - DNA, 25 bp, Rattus norvegicus
gcctatctggttggcctttttgaag

SEQ ID NO: 395951 - DNA, 25 bp, Rattus norvegicus
gcctatctggtttctttcacttgaa

SEQ ID NO: 395952 - DNA, 25 bp, Rattus norvegicus
gcctatcttttaacagcatccatgg

SEQ ID NO: 395953 - DNA, 25 bp, Rattus norvegicus
gcctatcttttatcagcatccatgg

SEQ ID NO: 395954 - DNA, 25 bp, Rattus norvegicus
gcctatgaagccctccagaattgaa

SEQ ID NO: 395955 - DNA, 25 bp, Rattus norvegicus
gcctatgaagccgtccagaattgaa

SEQ ID NO: 395956 - DNA, 25 bp, Rattus norvegicus
gcctatgacagaatctacaccgagt

SEQ ID NO: 395957 - DNA, 25 bp, Rattus norvegicus
gcctatgacagattctacaccgagt

SEQ ID NO: 395958 - DNA, 25 bp, Rattus norvegicus
gcctatgcagccatgtttgatttta

SEQ ID NO: 395959 - DNA, 25 bp, Rattus norvegicus
gcctatgcagccttgtttgatttta

SEQ ID NO: 395960 - DNA, 25 bp, Rattus norvegicus
gcctatgccatcacacctgagaaag

SEQ ID NO: 395961 - DNA, 25 bp, Rattus norvegicus
gcctatgccatctcacctgagaaag

SEQ ID NO: 395962 - DNA, 25 bp, Rattus norvegicus
gcctatgccctcaatcacaataaga

SEQ ID NO: 395963 - DNA, 25 bp, Rattus norvegicus
gcctatgccctctatcacaataaga

SEQ ID NO: 395964 - DNA, 25 bp, Rattus norvegicus
gcctatgctggcatggaacttacaa

SEQ ID NO: 395965 - DNA, 25 bp, Rattus norvegicus
gcctatgctggcttggaacttacaa

SEQ ID NO: 395966 - DNA, 25 bp, Rattus norvegicus
gcctatgctttcatgagtttgctac

SEQ ID NO: 395967 - DNA, 25 bp, Rattus norvegicus
gcctatgctttcttgagtttgctac

SEQ ID NO: 395968 - DNA, 25 bp, Rattus norvegicus
gcctatggccccaaagttgacatat

SEQ ID NO: 395969 - DNA, 25 bp, Rattus norvegicus
gcctatggcccctaagttgacatat

SEQ ID NO: 395970 - DNA, 25 bp, Rattus norvegicus
gcctatgtctacaacaatttctggg

SEQ ID NO: 395971 - DNA, 25 bp, Rattus norvegicus
gcctatgtctactacaatttctggg

SEQ ID NO: 395972 - DNA, 25 bp, Rattus norvegicus
gcctatgtcttcctgagtttttatt

SEQ ID NO: 395973 - DNA, 25 bp, Rattus norvegicus
gcctatgtcttcgtgagtttttatt

SEQ ID NO: 395974 - DNA, 25 bp, Rattus norvegicus
gcctatgtggatcgccgtgacagat

SEQ ID NO: 395975 - DNA, 25 bp, Rattus norvegicus
gcctatgtggatggccgtgacagat

SEQ ID NO: 395976 - DNA, 25 bp, Rattus norvegicus
gcctatgttggtcatgcactgcata

SEQ ID NO: 395977 - DNA, 25 bp, Rattus norvegicus
gcctatgttggtgatgcactgcata

SEQ ID NO: 395978 - DNA, 25 bp, Rattus norvegicus
gcctatgttttcctctgtatatctt

SEQ ID NO: 395979 - DNA, 25 bp, Rattus norvegicus
gcctatgttttcgtctgtatatctt

SEQ ID NO: 395980 - DNA, 25 bp, Rattus norvegicus
gcctattcatatatcagccatcttt

SEQ ID NO: 395981 - DNA, 25 bp, Rattus norvegicus
gcctattcatatttcagccatcttt

SEQ ID NO: 395982 - DNA, 25 bp, Rattus norvegicus
gcctattccctgatgatatgtatgt

SEQ ID NO: 395983 - DNA, 25 bp, Rattus norvegicus
gcctattccctgttgatatgtatgt

SEQ ID NO: 395984 - DNA, 25 bp, Rattus norvegicus
gcctattctactagtgttgctccta

SEQ ID NO: 395985 - DNA, 25 bp, Rattus norvegicus
gcctattctacttgtgttgctccta

SEQ ID NO: 395986 - DNA, 25 bp, Rattus norvegicus
gcctattgccaaatgtgtactcttg

SEQ ID NO: 395987 - DNA, 25 bp, Rattus norvegicus
gcctattgccaattgtgtactcttg

SEQ ID NO: 395988 - DNA, 25 bp, Rattus norvegicus
gcctattgcctgatctattagcatc

SEQ ID NO: 395989 - DNA, 25 bp, Rattus norvegicus
gcctattgcctgttctattagcatc

SEQ ID NO: 395990 - DNA, 25 bp, Rattus norvegicus
gcctattgtattaagaattgtccac

SEQ ID NO: 395991 - DNA, 25 bp, Rattus norvegicus
gcctattgtatttagaattgtccac

SEQ ID NO: 395992 - DNA, 25 bp, Rattus norvegicus
gcctatttccgccaagctgagaacg

SEQ ID NO: 395993 - DNA, 25 bp, Rattus norvegicus
gcctatttccgcgaagctgagaacg

SEQ ID NO: 395994 - DNA, 25 bp, Rattus norvegicus
gcctatttcgatctaagggtgaaca

SEQ ID NO: 395995 - DNA, 25 bp, Rattus norvegicus
gcctatttcgatgtaagggtgaaca

SEQ ID NO: 395996 - DNA, 25 bp, Rattus norvegicus
gcctatttctcactgtatcgtgtgc

SEQ ID NO: 395997 - DNA, 25 bp, Rattus norvegicus
gcctatttctcagtgtatcgtgtgc

SEQ ID NO: 395998 - DNA, 25 bp, Rattus norvegicus
gcctatttgggactcaacacttatg

SEQ ID NO: 395999 - DNA, 25 bp, Rattus norvegicus
gcctatttgggagtcaacacttatg

SEQ ID NO: 396000 - DNA, 25 bp, Rattus norvegicus
gcctcaaacacaaaccttggcattg

SEQ ID NO: 396001 - DNA, 25 bp, Rattus norvegicus
gcctcaaacacataccttggcattg

SEQ ID NO: 396002 - DNA, 25 bp, Rattus norvegicus
gcctcaaacatgatgcccgaagtcc

SEQ ID NO: 396003 - DNA, 25 bp, Rattus norvegicus
gcctcaaacatgttgcccgaagtcc

SEQ ID NO: 396004 - DNA, 25 bp, Rattus norvegicus
gcctcaaatagcagtcctccaggaa

SEQ ID NO: 396005 - DNA, 25 bp, Rattus norvegicus
gcctcaaatagctgtcctccaggaa

SEQ ID NO: 396006 - DNA, 25 bp, Rattus norvegicus
gcctcaactgacagcgtggcgagag

SEQ ID NO: 396007 - DNA, 25 bp, Rattus norvegicus
gcctcaactgactgcgtggcgagag

SEQ ID NO: 396008 - DNA, 25 bp, Rattus norvegicus
gcctcaagacaactgcttctgtgca

SEQ ID NO: 396009 - DNA, 25 bp, Rattus norvegicus
gcctcaagacaagtgcttctgtgca

SEQ ID NO: 396010 - DNA, 25 bp, Rattus norvegicus
gcctcaagccttcgatggtcaactg

SEQ ID NO: 396011 - DNA, 25 bp, Rattus norvegicus
gcctcaagccttggatggtcaactg

SEQ ID NO: 396012 - DNA, 25 bp, Rattus norvegicus
gcctcaagggccacagagaacacat

SEQ ID NO: 396013 - DNA, 25 bp, Rattus norvegicus
gcctcaagggcctcagagaacacat

SEQ ID NO: 396014 - DNA, 25 bp, Rattus norvegicus
gcctcaagggctctacatgtgtcac

SEQ ID NO: 396015 - DNA, 25 bp, Rattus norvegicus
gcctcaagggctgtacatgtgtcac

SEQ ID NO: 396016 - DNA, 25 bp, Rattus norvegicus
gcctcaagtcggctacatcagggtg

SEQ ID NO: 396017 - DNA, 25 bp, Rattus norvegicus
gcctcaagtcgggtacatcagggtg

SEQ ID NO: 396018 - DNA, 25 bp, Rattus norvegicus
gcctcaatctctcgactgctaggat

SEQ ID NO: 396019 - DNA, 25 bp, Rattus norvegicus
gcctcaatctctggactgctaggat

SEQ ID NO: 396020 - DNA, 25 bp, Rattus norvegicus
gcctcaatgttgctacacgccttta

SEQ ID NO: 396021 - DNA, 25 bp, Rattus norvegicus
gcctcaatgttggtacacgccttta

SEQ ID NO: 396022 - DNA, 25 bp, Rattus norvegicus
gcctcaattcctacttaaggccttt

SEQ ID NO: 396023 - DNA, 25 bp, Rattus norvegicus
gcctcaattccttcttaaggccttt

SEQ ID NO: 396024 - DNA, 25 bp, Rattus norvegicus
gcctcacaaactcagctagaaccat

SEQ ID NO: 396025 - DNA, 25 bp, Rattus norvegicus
gcctcacaaactgagctagaaccat

SEQ ID NO: 396026 - DNA, 25 bp, Rattus norvegicus
gcctcacacacaaatttacctgcaa

SEQ ID NO: 396027 - DNA, 25 bp, Rattus norvegicus
gcctcacacacatatttacctgcaa

SEQ ID NO: 396028 - DNA, 25 bp, Rattus norvegicus
gcctcacacagtcatcattcaggtg

SEQ ID NO: 396029 - DNA, 25 bp, Rattus norvegicus
gcctcacacagtgatcattcaggtg

SEQ ID NO: 396030 - DNA, 25 bp, Rattus norvegicus
gcctcacagaatcgagtcgtatcct

SEQ ID NO: 396031 - DNA, 25 bp, Rattus norvegicus
gcctcacagaatggagtcgtatcct

SEQ ID NO: 396032 - DNA, 25 bp, Rattus norvegicus
gcctcacaggccattttcataggga

SEQ ID NO: 396033 - DNA, 25 bp, Rattus norvegicus
gcctcacaggcctttttcataggga

SEQ ID NO: 396034 - DNA, 25 bp, Rattus norvegicus
gcctcacaggtcatcattatctcat

SEQ ID NO: 396035 - DNA, 25 bp, Rattus norvegicus
gcctcacaggtcttcattatctcat

SEQ ID NO: 396036 - DNA, 25 bp, Rattus norvegicus
gcctcacagtgtataccatagcaat

SEQ ID NO: 396037 - DNA, 25 bp, Rattus norvegicus
gcctcacagtgtttaccatagcaat

SEQ ID NO: 396038 - DNA, 25 bp, Rattus norvegicus
gcctcacatacgactgtgtgacgtt

SEQ ID NO: 396039 - DNA, 25 bp, Rattus norvegicus
gcctcacatacgtctgtgtgacgtt

SEQ ID NO: 396040 - DNA, 25 bp, Rattus norvegicus
gcctcaccacacactggttatgaat

SEQ ID NO: 396041 - DNA, 25 bp, Rattus norvegicus
gcctcaccacactctggttatgaat

SEQ ID NO: 396042 - DNA, 25 bp, Rattus norvegicus
gcctcaccagcgagcatgtacgaaa

SEQ ID NO: 396043 - DNA, 25 bp, Rattus norvegicus
gcctcaccagcgtgcatgtacgaaa

SEQ ID NO: 396044 - DNA, 25 bp, Rattus norvegicus
gcctcacccgttaggtttcagtatt

SEQ ID NO: 396045 - DNA, 25 bp, Rattus norvegicus
gcctcacccgtttggtttcagtatt

SEQ ID NO: 396046 - DNA, 25 bp, Rattus norvegicus
gcctcaccgaaacacagatcaagat

SEQ ID NO: 396047 - DNA, 25 bp, Rattus norvegicus
gcctcaccgaaagacagatcaagat

SEQ ID NO: 396048 - DNA, 25 bp, Rattus norvegicus
gcctcaccgtctcaaggagagctta

SEQ ID NO: 396049 - DNA, 25 bp, Rattus norvegicus
gcctcaccgtctgaaggagagctta

SEQ ID NO: 396050 - DNA, 25 bp, Rattus norvegicus
gcctcacctatacaaagcttgcttg

SEQ ID NO: 396051 - DNA, 25 bp, Rattus norvegicus
gcctcacctatagaaagcttgcttg

SEQ ID NO: 396052 - DNA, 25 bp, Rattus norvegicus
gcctcacctcccaaatactgagtat

SEQ ID NO: 396053 - DNA, 25 bp, Rattus norvegicus
gcctcacctccctaatactgagtat

SEQ ID NO: 396054 - DNA, 25 bp, Rattus norvegicus
gcctcacgggcactttgttcaagat

SEQ ID NO: 396055 - DNA, 25 bp, Rattus norvegicus
gcctcacgggcagtttgttcaagat

SEQ ID NO: 396056 - DNA, 25 bp, Rattus norvegicus
gcctcacgtaatcaacagcacacaa

SEQ ID NO: 396057 - DNA, 25 bp, Rattus norvegicus
gcctcacgtaatgaacagcacacaa

SEQ ID NO: 396058 - DNA, 25 bp, Rattus norvegicus
gcctcactccgccattatgcaaatg

SEQ ID NO: 396059 - DNA, 25 bp, Rattus norvegicus
gcctcactccgcgattatgcaaatg

SEQ ID NO: 396060 - DNA, 25 bp, Rattus norvegicus
gcctcactctggcttgggaaagtaa

SEQ ID NO: 396061 - DNA, 25 bp, Rattus norvegicus
gcctcactctgggttgggaaagtaa

SEQ ID NO: 396062 - DNA, 25 bp, Rattus norvegicus
gcctcactcttcctagtgttctgaa

SEQ ID NO: 396063 - DNA, 25 bp, Rattus norvegicus
gcctcactcttcgtagtgttctgaa

SEQ ID NO: 396064 - DNA, 25 bp, Rattus norvegicus
gcctcactgagtaccttcttgaaaa

SEQ ID NO: 396065 - DNA, 25 bp, Rattus norvegicus
gcctcactgagttccttcttgaaaa

SEQ ID NO: 396066 - DNA, 25 bp, Rattus norvegicus
gcctcactgcccaatggtattttta

SEQ ID NO: 396067 - DNA, 25 bp, Rattus norvegicus
gcctcactgccctatggtattttta

SEQ ID NO: 396068 - DNA, 25 bp, Rattus norvegicus
gcctcagagaccaggatgtcatctt

SEQ ID NO: 396069 - DNA, 25 bp, Rattus norvegicus
gcctcagagacctggatgtcatctt

SEQ ID NO: 396070 - DNA, 25 bp, Rattus norvegicus
gcctcagagcatactttgggaaata

SEQ ID NO: 396071 - DNA, 25 bp, Rattus norvegicus
gcctcagagcattctttgggaaata

SEQ ID NO: 396072 - DNA, 25 bp, Rattus norvegicus
gcctcagaggagcagtattccacca

SEQ ID NO: 396073 - DNA, 25 bp, Rattus norvegicus
gcctcagaggaggagtattccacca

SEQ ID NO: 396074 - DNA, 25 bp, Rattus norvegicus
gcctcagatgagacagcctatgtga

SEQ ID NO: 396075 - DNA, 25 bp, Rattus norvegicus
gcctcagatgagtcagcctatgtga

SEQ ID NO: 396076 - DNA, 25 bp, Rattus norvegicus
gcctcagcaccgagattcagggaga

SEQ ID NO: 396077 - DNA, 25 bp, Rattus norvegicus
gcctcagcaccgtgattcagggaga

SEQ ID NO: 396078 - DNA, 25 bp, Rattus norvegicus
gcctcagcaggactttatgggactt

SEQ ID NO: 396079 - DNA, 25 bp, Rattus norvegicus
gcctcagcaggagtttatgggactt

SEQ ID NO: 396080 - DNA, 25 bp, Rattus norvegicus
gcctcagcaggcactctggtgagaa

SEQ ID NO: 396081 - DNA, 25 bp, Rattus norvegicus
gcctcagcaggctctctggtgagaa

SEQ ID NO: 396082 - DNA, 25 bp, Rattus norvegicus
gcctcagcagtcagttgttctacaa

SEQ ID NO: 396083 - DNA, 25 bp, Rattus norvegicus
gcctcagcagtctgttgttctacaa

SEQ ID NO: 396084 - DNA, 25 bp, Rattus norvegicus
gcctcagcagttatggttgccttgt

SEQ ID NO: 396085 - DNA, 25 bp, Rattus norvegicus
gcctcagcagttttggttgccttgt

SEQ ID NO: 396086 - DNA, 25 bp, Rattus norvegicus
gcctcagccaaactgcgtctaaatg

SEQ ID NO: 396087 - DNA, 25 bp, Rattus norvegicus
gcctcagccaaagtgcgtctaaatg

SEQ ID NO: 396088 - DNA, 25 bp, Rattus norvegicus
gcctcagcccttctaagagcacatg

SEQ ID NO: 396089 - DNA, 25 bp, Rattus norvegicus
gcctcagcccttgtaagagcacatg

SEQ ID NO: 396090 - DNA, 25 bp, Rattus norvegicus
gcctcagcctatccaaggcaaggta

SEQ ID NO: 396091 - DNA, 25 bp, Rattus norvegicus
gcctcagcctatgcaaggcaaggta

SEQ ID NO: 396092 - DNA, 25 bp, Rattus norvegicus
gcctcagcctgcaccataatggaag

SEQ ID NO: 396093 - DNA, 25 bp, Rattus norvegicus
gcctcagcctgctccataatggaag

SEQ ID NO: 396094 - DNA, 25 bp, Rattus norvegicus
gcctcagcgggaagccatgcgacaa

SEQ ID NO: 396095 - DNA, 25 bp, Rattus norvegicus
gcctcagcgggatgccatgcgacaa

SEQ ID NO: 396096 - DNA, 25 bp, Rattus norvegicus
gcctcagctatgctgtggctgttga

SEQ ID NO: 396097 - DNA, 25 bp, Rattus norvegicus
gcctcagctatggtgtggctgttga

SEQ ID NO: 396098 - DNA, 25 bp, Rattus norvegicus
gcctcagctccccaaaaaggatggt

SEQ ID NO: 396099 - DNA, 25 bp, Rattus norvegicus
gcctcagctcccgaaaaaggatggt

SEQ ID NO: 396100 - DNA, 25 bp, Rattus norvegicus
gcctcagctcgcatatgatttgtat

SEQ ID NO: 396101 - DNA, 25 bp, Rattus norvegicus
gcctcagctcgcttatgatttgtat

SEQ ID NO: 396102 - DNA, 25 bp, Rattus norvegicus
gcctcagctctgatttgtgtcttca

SEQ ID NO: 396103 - DNA, 25 bp, Rattus norvegicus
gcctcagctctgttttgtgtcttca

SEQ ID NO: 396104 - DNA, 25 bp, Rattus norvegicus
gcctcagctggtcctgtttgtgaaa

SEQ ID NO: 396105 - DNA, 25 bp, Rattus norvegicus
gcctcagctggtgctgtttgtgaaa

SEQ ID NO: 396106 - DNA, 25 bp, Rattus norvegicus
gcctcagcttgtactggcaatctaa

SEQ ID NO: 396107 - DNA, 25 bp, Rattus norvegicus
gcctcagcttgttctggcaatctaa

SEQ ID NO: 396108 - DNA, 25 bp, Rattus norvegicus
gcctcaggctccctaagtggacaag

SEQ ID NO: 396109 - DNA, 25 bp, Rattus norvegicus
gcctcaggctccgtaagtggacaag

SEQ ID NO: 396110 - DNA, 25 bp, Rattus norvegicus
gcctcagggacccacattgtggaaa

SEQ ID NO: 396111 - DNA, 25 bp, Rattus norvegicus
gcctcagggaccgacattgtggaaa

SEQ ID NO: 396112 - DNA, 25 bp, Rattus norvegicus
gcctcagggcttacacataatcgaa

SEQ ID NO: 396113 - DNA, 25 bp, Rattus norvegicus
gcctcagggctttcacataatcgaa

SEQ ID NO: 396114 - DNA, 25 bp, Rattus norvegicus
gcctcagggttgcaagctcttaaaa

SEQ ID NO: 396115 - DNA, 25 bp, Rattus norvegicus
gcctcagggttggaagctcttaaaa

SEQ ID NO: 396116 - DNA, 25 bp, Rattus norvegicus
gcctcaggtaaaaacccaaccatct

SEQ ID NO: 396117 - DNA, 25 bp, Rattus norvegicus
gcctcaggtaaatacccaaccatct

SEQ ID NO: 396118 - DNA, 25 bp, Rattus norvegicus
gcctcaggtagaatggtgcccacag

SEQ ID NO: 396119 - DNA, 25 bp, Rattus norvegicus
gcctcaggtagattggtgcccacag

SEQ ID NO: 396120 - DNA, 25 bp, Rattus norvegicus
gcctcaggtggcaaacttcatttta

SEQ ID NO: 396121 - DNA, 25 bp, Rattus norvegicus
gcctcaggtggctaacttcatttta

SEQ ID NO: 396122 - DNA, 25 bp, Rattus norvegicus
gcctcaggtgttactcaggcaccat

SEQ ID NO: 396123 - DNA, 25 bp, Rattus norvegicus
gcctcaggtgtttctcaggcaccat

SEQ ID NO: 396124 - DNA, 25 bp, Rattus norvegicus
gcctcagtcctgagtaataatttcc

SEQ ID NO: 396125 - DNA, 25 bp, Rattus norvegicus
gcctcagtcctgtgtaataatttcc

SEQ ID NO: 396126 - DNA, 25 bp, Rattus norvegicus
gcctcagtctctcaagttcctgggt

SEQ ID NO: 396127 - DNA, 25 bp, Rattus norvegicus
gcctcagtctctgaagttcctgggt

SEQ ID NO: 396128 - DNA, 25 bp, Rattus norvegicus
gcctcagtcttccaagtagccagga

SEQ ID NO: 396129 - DNA, 25 bp, Rattus norvegicus
gcctcagtcttcgaagtagccagga

SEQ ID NO: 396130 - DNA, 25 bp, Rattus norvegicus
gcctcagtgaaaaagtccatgccaa

SEQ ID NO: 396131 - DNA, 25 bp, Rattus norvegicus
gcctcagtgaaatagtccatgccaa

SEQ ID NO: 396132 - DNA, 25 bp, Rattus norvegicus
gcctcagtgctgagcctttgtgtaa

SEQ ID NO: 396133 - DNA, 25 bp, Rattus norvegicus
gcctcagtgctgtgcctttgtgtaa

SEQ ID NO: 396134 - DNA, 25 bp, Rattus norvegicus
gcctcagtggataagttgcttttct

SEQ ID NO: 396135 - DNA, 25 bp, Rattus norvegicus
gcctcagtggattagttgcttttct

SEQ ID NO: 396136 - DNA, 25 bp, Rattus norvegicus
gcctcagtttctccatctgtaagtg

SEQ ID NO: 396137 - DNA, 25 bp, Rattus norvegicus
gcctcagtttctgcatctgtaagtg

SEQ ID NO: 396138 - DNA, 25 bp, Rattus norvegicus
gcctcagtttggacagtatttacac

SEQ ID NO: 396139 - DNA, 25 bp, Rattus norvegicus
gcctcagtttggtcagtatttacac

SEQ ID NO: 396140 - DNA, 25 bp, Rattus norvegicus
gcctcataacttattcatagcttta

SEQ ID NO: 396141 - DNA, 25 bp, Rattus norvegicus
gcctcataactttttcatagcttta

SEQ ID NO: 396142 - DNA, 25 bp, Rattus norvegicus
gcctcataccagctgtacatacgtg

SEQ ID NO: 396143 - DNA, 25 bp, Rattus norvegicus
gcctcataccaggtgtacatacgtg

SEQ ID NO: 396144 - DNA, 25 bp, Rattus norvegicus
gcctcataggccctaattcaattgt

SEQ ID NO: 396145 - DNA, 25 bp, Rattus norvegicus
gcctcataggccgtaattcaattgt

SEQ ID NO: 396146 - DNA, 25 bp, Rattus norvegicus
gcctcatcaaaaactgactgctctc

SEQ ID NO: 396147 - DNA, 25 bp, Rattus norvegicus
gcctcatcaaaatctgactgctctc

SEQ ID NO: 396148 - DNA, 25 bp, Rattus norvegicus
gcctcatccagaatgccatcataga

SEQ ID NO: 396149 - DNA, 25 bp, Rattus norvegicus
gcctcatccagattgccatcataga

SEQ ID NO: 396150 - DNA, 25 bp, Rattus norvegicus
gcctcatcggcaacaaggacatgta

SEQ ID NO: 396151 - DNA, 25 bp, Rattus norvegicus
gcctcatcggcatcaaggacatgta

SEQ ID NO: 396152 - DNA, 25 bp, Rattus norvegicus
gcctcatgcactaagctttacacat

SEQ ID NO: 396153 - DNA, 25 bp, Rattus norvegicus
gcctcatgcacttagctttacacat

SEQ ID NO: 396154 - DNA, 25 bp, Rattus norvegicus
gcctcatgcagtagtgccatcttgg

SEQ ID NO: 396155 - DNA, 25 bp, Rattus norvegicus
gcctcatgcagttgtgccatcttgg

SEQ ID NO: 396156 - DNA, 25 bp, Rattus norvegicus
gcctcatgccatccctgatgtcagg

SEQ ID NO: 396157 - DNA, 25 bp, Rattus norvegicus
gcctcatgccatgcctgatgtcagg

SEQ ID NO: 396158 - DNA, 25 bp, Rattus norvegicus
gcctcatgccttaacatcatctttt

SEQ ID NO: 396159 - DNA, 25 bp, Rattus norvegicus
gcctcatgccttacatttatcattg

SEQ ID NO: 396160 - DNA, 25 bp, Rattus norvegicus
gcctcatgcctttacatcatctttt

SEQ ID NO: 396161 - DNA, 25 bp, Rattus norvegicus
gcctcatgcctttcatttatcattg

SEQ ID NO: 396162 - DNA, 25 bp, Rattus norvegicus
gcctcatgctgtaaaccagtgttta

SEQ ID NO: 396163 - DNA, 25 bp, Rattus norvegicus
gcctcatgctgttaaccagtgttta

SEQ ID NO: 396164 - DNA, 25 bp, Rattus norvegicus
gcctcatggcatctcgacagtatgt

SEQ ID NO: 396165 - DNA, 25 bp, Rattus norvegicus
gcctcatggcatgtcgacagtatgt

SEQ ID NO: 396166 - DNA, 25 bp, Rattus norvegicus
gcctcatggtctcgctaactagaag

SEQ ID NO: 396167 - DNA, 25 bp, Rattus norvegicus
gcctcatggtctggctaactagaag

SEQ ID NO: 396168 - DNA, 25 bp, Rattus norvegicus
gcctcattccacatttgtagatatt

SEQ ID NO: 396169 - DNA, 25 bp, Rattus norvegicus
gcctcattccacttttgtagatatt

SEQ ID NO: 396170 - DNA, 25 bp, Rattus norvegicus
gcctcattctttcagcttgtttaaa

SEQ ID NO: 396171 - DNA, 25 bp, Rattus norvegicus
gcctcattctttccccatctaagta

SEQ ID NO: 396172 - DNA, 25 bp, Rattus norvegicus
gcctcattctttgagcttgtttaaa

SEQ ID NO: 396173 - DNA, 25 bp, Rattus norvegicus
gcctcattctttgcccatctaagta

SEQ ID NO: 396174 - DNA, 25 bp, Rattus norvegicus
gcctcattgtctctctgggcagcaa

SEQ ID NO: 396175 - DNA, 25 bp, Rattus norvegicus
gcctcattgtctgtctgggcagcaa

SEQ ID NO: 396176 - DNA, 25 bp, Rattus norvegicus
gcctcattgtgtccacacgcgggag

SEQ ID NO: 396177 - DNA, 25 bp, Rattus norvegicus
gcctcattgtgtgcacacgcgggag

SEQ ID NO: 396178 - DNA, 25 bp, Rattus norvegicus
gcctcatttcatctcccagttttaa

SEQ ID NO: 396179 - DNA, 25 bp, Rattus norvegicus
gcctcatttcatgtcccagttttaa

SEQ ID NO: 396180 - DNA, 25 bp, Rattus norvegicus
gcctcatttccaagggctatgactt

SEQ ID NO: 396181 - DNA, 25 bp, Rattus norvegicus
gcctcatttccatgggctatgactt

SEQ ID NO: 396182 - DNA, 25 bp, Rattus norvegicus
gcctcattttatcatagcttattgt

SEQ ID NO: 396183 - DNA, 25 bp, Rattus norvegicus
gcctcattttatgatagcttattgt

SEQ ID NO: 396184 - DNA, 25 bp, Rattus norvegicus
gcctccaaaacaacggcccagagag

SEQ ID NO: 396185 - DNA, 25 bp, Rattus norvegicus
gcctccaaaacatcggcccagagag

SEQ ID NO: 396186 - DNA, 25 bp, Rattus norvegicus
gcctccaaactgatgtcccaatgta

SEQ ID NO: 396187 - DNA, 25 bp, Rattus norvegicus
gcctccaaactgttgtcccaatgta

SEQ ID NO: 396188 - DNA, 25 bp, Rattus norvegicus
gcctccaaagtgctagacttacagt

SEQ ID NO: 396189 - DNA, 25 bp, Rattus norvegicus
gcctccaaagtggtagacttacagt

SEQ ID NO: 396190 - DNA, 25 bp, Rattus norvegicus
gcctccaaatcacagttcatcctgt

SEQ ID NO: 396191 - DNA, 25 bp, Rattus norvegicus
gcctccaaatcagagttcatcctgt

SEQ ID NO: 396192 - DNA, 25 bp, Rattus norvegicus
gcctccaactaaatggtaagcctgg

SEQ ID NO: 396193 - DNA, 25 bp, Rattus norvegicus
gcctccaactaattggtaagcctgg

SEQ ID NO: 396194 - DNA, 25 bp, Rattus norvegicus
gcctccaatgaccactatttttagc

SEQ ID NO: 396195 - DNA, 25 bp, Rattus norvegicus
gcctccaatgacgactatttttagc

SEQ ID NO: 396196 - DNA, 25 bp, Rattus norvegicus
gcctccaatgcaacaacagcgtggt

SEQ ID NO: 396197 - DNA, 25 bp, Rattus norvegicus
gcctccaatgcatcaacagcgtggt

SEQ ID NO: 396198 - DNA, 25 bp, Rattus norvegicus
gcctccaattaaagaagggccttag

SEQ ID NO: 396199 - DNA, 25 bp, Rattus norvegicus
gcctccaattaatgaagggccttag

SEQ ID NO: 396200 - DNA, 25 bp, Rattus norvegicus
gcctccacagaaatttaacctctac

SEQ ID NO: 396201 - DNA, 25 bp, Rattus norvegicus
gcctccacagaattttaacctctac

SEQ ID NO: 396202 - DNA, 25 bp, Rattus norvegicus
gcctccacatctcaggaagcagtgt

SEQ ID NO: 396203 - DNA, 25 bp, Rattus norvegicus
gcctccacatctgaggaagcagtgt

SEQ ID NO: 396204 - DNA, 25 bp, Rattus norvegicus
gcctccacggagaatacctgggtca

SEQ ID NO: 396205 - DNA, 25 bp, Rattus norvegicus
gcctccacggagtatacctgggtca

SEQ ID NO: 396206 - DNA, 25 bp, Rattus norvegicus
gcctccacggtaactgctgatgcag

SEQ ID NO: 396207 - DNA, 25 bp, Rattus norvegicus
gcctccacggtatctgctgatgcag

SEQ ID NO: 396208 - DNA, 25 bp, Rattus norvegicus
gcctccacttacctgtgttcaaaaa

SEQ ID NO: 396209 - DNA, 25 bp, Rattus norvegicus
gcctccacttacgtgtgttcaaaaa

SEQ ID NO: 396210 - DNA, 25 bp, Rattus norvegicus
gcctccacttccaaattgcagaaaa

SEQ ID NO: 396211 - DNA, 25 bp, Rattus norvegicus
gcctccacttcctaattgcagaaaa

SEQ ID NO: 396212 - DNA, 25 bp, Rattus norvegicus
gcctccagacctatgttatcagtag

SEQ ID NO: 396213 - DNA, 25 bp, Rattus norvegicus
gcctccagacctttgttatcagtag

SEQ ID NO: 396214 - DNA, 25 bp, Rattus norvegicus
gcctccagacttatgcacaacggtg

SEQ ID NO: 396215 - DNA, 25 bp, Rattus norvegicus
gcctccagacttttgcacaacggtg

SEQ ID NO: 396216 - DNA, 25 bp, Rattus norvegicus
gcctccagccggcaatggcaaaact

SEQ ID NO: 396217 - DNA, 25 bp, Rattus norvegicus
gcctccagccgggaatggcaaaact

SEQ ID NO: 396218 - DNA, 25 bp, Rattus norvegicus
gcctccagctggctgtatgacagaa

SEQ ID NO: 396219 - DNA, 25 bp, Rattus norvegicus
gcctccagctgggtgtatgacagaa

SEQ ID NO: 396220 - DNA, 25 bp, Rattus norvegicus
gcctccaggagcaaccaatatgata

SEQ ID NO: 396221 - DNA, 25 bp, Rattus norvegicus
gcctccaggagctaccaatatgata

SEQ ID NO: 396222 - DNA, 25 bp, Rattus norvegicus
gcctccaggcagactacagactgtg

SEQ ID NO: 396223 - DNA, 25 bp, Rattus norvegicus
gcctccaggcagtctacagactgtg

SEQ ID NO: 396224 - DNA, 25 bp, Rattus norvegicus
gcctccataaatacactgctgtctg

SEQ ID NO: 396225 - DNA, 25 bp, Rattus norvegicus
gcctccataaattcactgctgtctg

SEQ ID NO: 396226 - DNA, 25 bp, Rattus norvegicus
gcctccatcaggctagacgggtgca

SEQ ID NO: 396227 - DNA, 25 bp, Rattus norvegicus
gcctccatcagggtagacgggtgca

SEQ ID NO: 396228 - DNA, 25 bp, Rattus norvegicus
gcctccatccagagttagcttttag

SEQ ID NO: 396229 - DNA, 25 bp, Rattus norvegicus
gcctccatccagtgttagcttttag

SEQ ID NO: 396230 - DNA, 25 bp, Rattus norvegicus
gcctccatccggcatttcaatatca

SEQ ID NO: 396231 - DNA, 25 bp, Rattus norvegicus
gcctccatccgggatttcaatatca

SEQ ID NO: 396232 - DNA, 25 bp, Rattus norvegicus
gcctccatcggccaggacatagaag

SEQ ID NO: 396233 - DNA, 25 bp, Rattus norvegicus
gcctccatcggcgaggacatagaag

SEQ ID NO: 396234 - DNA, 25 bp, Rattus norvegicus
gcctccatctgcagttcaggatttg

SEQ ID NO: 396235 - DNA, 25 bp, Rattus norvegicus
gcctccatctgctgttcaggatttg

SEQ ID NO: 396236 - DNA, 25 bp, Rattus norvegicus
gcctccatcttcagtaccaaagtta

SEQ ID NO: 396237 - DNA, 25 bp, Rattus norvegicus
gcctccatcttctgtaccaaagtta

SEQ ID NO: 396238 - DNA, 25 bp, Rattus norvegicus
gcctccatgacactcctatagaatg

SEQ ID NO: 396239 - DNA, 25 bp, Rattus norvegicus
gcctccatgacagtcctatagaatg

SEQ ID NO: 396240 - DNA, 25 bp, Rattus norvegicus
gcctccatgcaacaatgaatgagtt

SEQ ID NO: 396241 - DNA, 25 bp, Rattus norvegicus
gcctccatgcaagaatgaatgagtt

SEQ ID NO: 396242 - DNA, 25 bp, Rattus norvegicus
gcctccatgcacacaggggtagtgg

SEQ ID NO: 396243 - DNA, 25 bp, Rattus norvegicus
gcctccatgcactcaggggtagtgg

SEQ ID NO: 396244 - DNA, 25 bp, Rattus norvegicus
gcctccattacacacacatttttaa

SEQ ID NO: 396245 - DNA, 25 bp, Rattus norvegicus
gcctccattacagacacatttttaa

SEQ ID NO: 396246 - DNA, 25 bp, Rattus norvegicus
gcctccattcttagcacttactgaa

SEQ ID NO: 396247 - DNA, 25 bp, Rattus norvegicus
gcctccattctttgcacttactgaa

SEQ ID NO: 396248 - DNA, 25 bp, Rattus norvegicus
gcctcccaaatgaatcttttaaaga

SEQ ID NO: 396249 - DNA, 25 bp, Rattus norvegicus
gcctcccaaatgtatcttttaaaga

SEQ ID NO: 396250 - DNA, 25 bp, Rattus norvegicus
gcctcccaagagagtgtcggtagtt

SEQ ID NO: 396251 - DNA, 25 bp, Rattus norvegicus
gcctcccaagagtgtgtcggtagtt

SEQ ID NO: 396252 - DNA, 25 bp, Rattus norvegicus
gcctcccaagttctgtgaagccagg

SEQ ID NO: 396253 - DNA, 25 bp, Rattus norvegicus
gcctcccaagttgtgtgaagccagg

SEQ ID NO: 396254 - DNA, 25 bp, Rattus norvegicus
gcctcccaatccatgaaagacttgg

SEQ ID NO: 396255 - DNA, 25 bp, Rattus norvegicus
gcctcccaatccttgaaagacttgg

SEQ ID NO: 396256 - DNA, 25 bp, Rattus norvegicus
gcctcccaatttcaacagttttcag

SEQ ID NO: 396257 - DNA, 25 bp, Rattus norvegicus
gcctcccaatttgaacagttttcag

SEQ ID NO: 396258 - DNA, 25 bp, Rattus norvegicus
gcctcccacctgaagtaaatcggat

SEQ ID NO: 396259 - DNA, 25 bp, Rattus norvegicus
gcctcccacctgtagtaaatcggat

SEQ ID NO: 396260 - DNA, 25 bp, Rattus norvegicus
gcctcccagcagacagggcagtgag

SEQ ID NO: 396261 - DNA, 25 bp, Rattus norvegicus
gcctcccagcagtcagggcagtgag

SEQ ID NO: 396262 - DNA, 25 bp, Rattus norvegicus
gcctcccaggaaccattaaatttag

SEQ ID NO: 396263 - DNA, 25 bp, Rattus norvegicus
gcctcccaggaagcattaaatttag

SEQ ID NO: 396264 - DNA, 25 bp, Rattus norvegicus
gcctcccagggcaggcttagaattt

SEQ ID NO: 396265 - DNA, 25 bp, Rattus norvegicus
gcctcccagggctggcttagaattt

SEQ ID NO: 396266 - DNA, 25 bp, Rattus norvegicus
gcctcccatggaatttgcaggagaa

SEQ ID NO: 396267 - DNA, 25 bp, Rattus norvegicus
gcctcccatggattttgcaggagaa

SEQ ID NO: 396268 - DNA, 25 bp, Rattus norvegicus
gcctcccattcacttgtgttcagtc

SEQ ID NO: 396269 - DNA, 25 bp, Rattus norvegicus
gcctcccattcagttgtgttcagtc

SEQ ID NO: 396270 - DNA, 25 bp, Rattus norvegicus
gcctccccaggcatgatggaagcat

SEQ ID NO: 396271 - DNA, 25 bp, Rattus norvegicus
gcctccccaggcttgatggaagcat

SEQ ID NO: 396272 - DNA, 25 bp, Rattus norvegicus
gcctccccatggattggctgtgtag

SEQ ID NO: 396273 - DNA, 25 bp, Rattus norvegicus
gcctccccatggtttggctgtgtag

SEQ ID NO: 396274 - DNA, 25 bp, Rattus norvegicus
gcctccccgagtcatggctcttgag

SEQ ID NO: 396275 - DNA, 25 bp, Rattus norvegicus
gcctccccgagtgatggctcttgag

SEQ ID NO: 396276 - DNA, 25 bp, Rattus norvegicus
gcctcccctgtcaagacttattata

SEQ ID NO: 396277 - DNA, 25 bp, Rattus norvegicus
gcctcccctgtctagacttattata

SEQ ID NO: 396278 - DNA, 25 bp, Rattus norvegicus
gcctcccgagttaactctgattggt

SEQ ID NO: 396279 - DNA, 25 bp, Rattus norvegicus
gcctcccgagtttactctgattggt

SEQ ID NO: 396280 - DNA, 25 bp, Rattus norvegicus
gcctccctagtgacattcacattga

SEQ ID NO: 396281 - DNA, 25 bp, Rattus norvegicus
gcctccctagtgtcattcacattga

SEQ ID NO: 396282 - DNA, 25 bp, Rattus norvegicus
gcctccctgaccagatgtgtgatta

SEQ ID NO: 396283 - DNA, 25 bp, Rattus norvegicus
gcctccctgacctgatgtgtgatta

SEQ ID NO: 396284 - DNA, 25 bp, Rattus norvegicus
gcctccctgctacatgtcattatta

SEQ ID NO: 396285 - DNA, 25 bp, Rattus norvegicus
gcctccctgctagatgtcattatta

SEQ ID NO: 396286 - DNA, 25 bp, Rattus norvegicus
gcctccctggagctaaccagttcta

SEQ ID NO: 396287 - DNA, 25 bp, Rattus norvegicus
gcctccctggaggtaaccagttcta

SEQ ID NO: 396288 - DNA, 25 bp, Rattus norvegicus
gcctccctggctacactaaagatga

SEQ ID NO: 396289 - DNA, 25 bp, Rattus norvegicus
gcctccctggcttcactaaagatga

SEQ ID NO: 396290 - DNA, 25 bp, Rattus norvegicus
gcctccctgggaagcacttgaagac

SEQ ID NO: 396291 - DNA, 25 bp, Rattus norvegicus
gcctccctgggatgcacttgaagac

SEQ ID NO: 396292 - DNA, 25 bp, Rattus norvegicus
gcctccctgtggctagtacagacag

SEQ ID NO: 396293 - DNA, 25 bp, Rattus norvegicus
gcctccctgtgggtagtacagacag

SEQ ID NO: 396294 - DNA, 25 bp, Rattus norvegicus
gcctcccttaggatcaaagttgctg

SEQ ID NO: 396295 - DNA, 25 bp, Rattus norvegicus
gcctcccttaggttcaaagttgctg

SEQ ID NO: 396296 - DNA, 25 bp, Rattus norvegicus
gcctcccttgatcagtttctcttat

SEQ ID NO: 396297 - DNA, 25 bp, Rattus norvegicus
gcctcccttgatgagtttctcttat

SEQ ID NO: 396298 - DNA, 25 bp, Rattus norvegicus
gcctccctttagattcagatcaata

SEQ ID NO: 396299 - DNA, 25 bp, Rattus norvegicus
gcctccctttagtttcagatcaata

SEQ ID NO: 396300 - DNA, 25 bp, Rattus norvegicus
gcctccctttcacgttaaacaattg

SEQ ID NO: 396301 - DNA, 25 bp, Rattus norvegicus
gcctccctttcaggttaaacaattg

SEQ ID NO: 396302 - DNA, 25 bp, Rattus norvegicus
gcctccgagatcacactgctgctgg

SEQ ID NO: 396303 - DNA, 25 bp, Rattus norvegicus
gcctccgagatctcactgctgctgg

SEQ ID NO: 396304 - DNA, 25 bp, Rattus norvegicus
gcctccgagtagctataattgtgtc

SEQ ID NO: 396305 - DNA, 25 bp, Rattus norvegicus
gcctccgagtaggtataattgtgtc

SEQ ID NO: 396306 - DNA, 25 bp, Rattus norvegicus
gcctccgcgtagctgaagcaccgtg

SEQ ID NO: 396307 - DNA, 25 bp, Rattus norvegicus
gcctccgcgtaggtgaagcaccgtg

SEQ ID NO: 396308 - DNA, 25 bp, Rattus norvegicus
gcctccggataactgtaagacttat

SEQ ID NO: 396309 - DNA, 25 bp, Rattus norvegicus
gcctccggataagtgtaagacttat

SEQ ID NO: 396310 - DNA, 25 bp, Rattus norvegicus
gcctccgtaggcaagagtcaacaaa

SEQ ID NO: 396311 - DNA, 25 bp, Rattus norvegicus
gcctccgtaggctagagtcaacaaa

SEQ ID NO: 396312 - DNA, 25 bp, Rattus norvegicus
gcctccgtgagcagtgttagtaata

SEQ ID NO: 396313 - DNA, 25 bp, Rattus norvegicus
gcctccgtgagctgtgttagtaata

SEQ ID NO: 396314 - DNA, 25 bp, Rattus norvegicus
gcctccgttctcaacgtggagtagt

SEQ ID NO: 396315 - DNA, 25 bp, Rattus norvegicus
gcctccgttctctacgtggagtagt

SEQ ID NO: 396316 - DNA, 25 bp, Rattus norvegicus
gcctccgttcttataggtcagtgaa

SEQ ID NO: 396317 - DNA, 25 bp, Rattus norvegicus
gcctccgttcttttaggtcagtgaa

SEQ ID NO: 396318 - DNA, 25 bp, Rattus norvegicus
gcctccgttttcaagaagtctattt

SEQ ID NO: 396319 - DNA, 25 bp, Rattus norvegicus
gcctccgttttctagaagtctattt

SEQ ID NO: 396320 - DNA, 25 bp, Rattus norvegicus
gcctcctaaattactcttccaggaa

SEQ ID NO: 396321 - DNA, 25 bp, Rattus norvegicus
gcctcctaaatttctcttccaggaa

SEQ ID NO: 396322 - DNA, 25 bp, Rattus norvegicus
gcctcctaatccaaatatggagttt

SEQ ID NO: 396323 - DNA, 25 bp, Rattus norvegicus
gcctcctaatcctaatatggagttt

SEQ ID NO: 396324 - DNA, 25 bp, Rattus norvegicus
gcctcctacaccatttgtaattgct

SEQ ID NO: 396325 - DNA, 25 bp, Rattus norvegicus
gcctcctacaccttttgtaattgct

SEQ ID NO: 396326 - DNA, 25 bp, Rattus norvegicus
gcctcctaccttcggctgttgagta

SEQ ID NO: 396327 - DNA, 25 bp, Rattus norvegicus
gcctcctaccttgggctgttgagta

SEQ ID NO: 396328 - DNA, 25 bp, Rattus norvegicus
gcctcctacgaccacgatagagttg

SEQ ID NO: 396329 - DNA, 25 bp, Rattus norvegicus
gcctcctacgacgacgatagagttg

SEQ ID NO: 396330 - DNA, 25 bp, Rattus norvegicus
gcctcctaggacagtgcaggtgcga

SEQ ID NO: 396331 - DNA, 25 bp, Rattus norvegicus
gcctcctaggactgtgcaggtgcga

SEQ ID NO: 396332 - DNA, 25 bp, Rattus norvegicus
gcctcctagggaatactccatcaaa

SEQ ID NO: 396333 - DNA, 25 bp, Rattus norvegicus
gcctcctagggattactccatcaaa

SEQ ID NO: 396334 - DNA, 25 bp, Rattus norvegicus
gcctcctatacaccccacctgacct

SEQ ID NO: 396335 - DNA, 25 bp, Rattus norvegicus
gcctcctatacagcccacctgacct

SEQ ID NO: 396336 - DNA, 25 bp, Rattus norvegicus
gcctcctatcttaacagaagtagtt

SEQ ID NO: 396337 - DNA, 25 bp, Rattus norvegicus
gcctcctatctttacagaagtagtt

SEQ ID NO: 396338 - DNA, 25 bp, Rattus norvegicus
gcctcctcagcaaagttcccagaaa

SEQ ID NO: 396339 - DNA, 25 bp, Rattus norvegicus
gcctcctcagcatagttcccagaaa

SEQ ID NO: 396340 - DNA, 25 bp, Rattus norvegicus
gcctcctcaggcacttgaaatacaa

SEQ ID NO: 396341 - DNA, 25 bp, Rattus norvegicus
gcctcctcaggctcttgaaatacaa

SEQ ID NO: 396342 - DNA, 25 bp, Rattus norvegicus
gcctcctcaggtcccagtgtttata

SEQ ID NO: 396343 - DNA, 25 bp, Rattus norvegicus
gcctcctcaggtgccagtgtttata

SEQ ID NO: 396344 - DNA, 25 bp, Rattus norvegicus
gcctcctcagtcacatggtaacttg

SEQ ID NO: 396345 - DNA, 25 bp, Rattus norvegicus
gcctcctcagtctcatggtaacttg

SEQ ID NO: 396346 - DNA, 25 bp, Rattus norvegicus
gcctcctcagtgctgtggtacagac

SEQ ID NO: 396347 - DNA, 25 bp, Rattus norvegicus
gcctcctcagtggtgtggtacagac

SEQ ID NO: 396348 - DNA, 25 bp, Rattus norvegicus
gcctcctcattaacgccatggtgaa

SEQ ID NO: 396349 - DNA, 25 bp, Rattus norvegicus
gcctcctcattatcgccatggtgaa

SEQ ID NO: 396350 - DNA, 25 bp, Rattus norvegicus
gcctcctccattcctaagaactgaa

SEQ ID NO: 396351 - DNA, 25 bp, Rattus norvegicus
gcctcctccattgctaagaactgaa

SEQ ID NO: 396352 - DNA, 25 bp, Rattus norvegicus
gcctcctcgtgcagggataaagctg

SEQ ID NO: 396353 - DNA, 25 bp, Rattus norvegicus
gcctcctcgtgctgggataaagctg

SEQ ID NO: 396354 - DNA, 25 bp, Rattus norvegicus
gcctcctctctcaaagactgtagag

SEQ ID NO: 396355 - DNA, 25 bp, Rattus norvegicus
gcctcctctctctaagactgtagag

SEQ ID NO: 396356 - DNA, 25 bp, Rattus norvegicus
gcctcctctgtgctatatctgagaa

SEQ ID NO: 396357 - DNA, 25 bp, Rattus norvegicus
gcctcctctgtggtatatctgagaa

SEQ ID NO: 396358 - DNA, 25 bp, Rattus norvegicus
gcctcctgaatgatttcaaggttaa

SEQ ID NO: 396359 - DNA, 25 bp, Rattus norvegicus
gcctcctgaatgttttcaaggttaa

SEQ ID NO: 396360 - DNA, 25 bp, Rattus norvegicus
gcctcctgaggacacgggttcaaat

SEQ ID NO: 396361 - DNA, 25 bp, Rattus norvegicus
gcctcctgaggagacgggttcaaat

SEQ ID NO: 396362 - DNA, 25 bp, Rattus norvegicus
gcctcctgccttaaagtttgttcct

SEQ ID NO: 396363 - DNA, 25 bp, Rattus norvegicus
gcctcctgcctttaagtttgttcct

SEQ ID NO: 396364 - DNA, 25 bp, Rattus norvegicus
gcctcctggaaactgtgctcaatgt

SEQ ID NO: 396365 - DNA, 25 bp, Rattus norvegicus
gcctcctggaaagtgtgctcaatgt

SEQ ID NO: 396366 - DNA, 25 bp, Rattus norvegicus
gcctcctgggaaagaattgcattgt

SEQ ID NO: 396367 - DNA, 25 bp, Rattus norvegicus
gcctcctgggaatgaattgcattgt

SEQ ID NO: 396368 - DNA, 25 bp, Rattus norvegicus
gcctcctgggatagcaacctatacc

SEQ ID NO: 396369 - DNA, 25 bp, Rattus norvegicus
gcctcctgggattgcaacctatacc

SEQ ID NO: 396370 - DNA, 25 bp, Rattus norvegicus
gcctcctggtctatgttaattttat

SEQ ID NO: 396371 - DNA, 25 bp, Rattus norvegicus
gcctcctggtctttgttaattttat

SEQ ID NO: 396372 - DNA, 25 bp, Rattus norvegicus
gcctcctggtggacggagctagcaa

SEQ ID NO: 396373 - DNA, 25 bp, Rattus norvegicus
gcctcctggtggtcggagctagcaa

SEQ ID NO: 396374 - DNA, 25 bp, Rattus norvegicus
gcctcctggttaaagtctggccacc

SEQ ID NO: 396375 - DNA, 25 bp, Rattus norvegicus
gcctcctggttatagtctggccacc

SEQ ID NO: 396376 - DNA, 25 bp, Rattus norvegicus
gcctcctgtgctagattagcttcta

SEQ ID NO: 396377 - DNA, 25 bp, Rattus norvegicus
gcctcctgtgcttgattagcttcta

SEQ ID NO: 396378 - DNA, 25 bp, Rattus norvegicus
gcctcctgtgtgatgaacttcctgt

SEQ ID NO: 396379 - DNA, 25 bp, Rattus norvegicus
gcctcctgtgtgttgaacttcctgt

SEQ ID NO: 396380 - DNA, 25 bp, Rattus norvegicus
gcctcctgttccagtcattaagaaa

SEQ ID NO: 396381 - DNA, 25 bp, Rattus norvegicus
gcctcctgttcctgtcattaagaaa

SEQ ID NO: 396382 - DNA, 25 bp, Rattus norvegicus
gcctccttaagcctttgacctgaaa

SEQ ID NO: 396383 - DNA, 25 bp, Rattus norvegicus
gcctccttaagcgtttgacctgaaa

SEQ ID NO: 396384 - DNA, 25 bp, Rattus norvegicus
gcctccttaggtcttagtgcttaga

SEQ ID NO: 396385 - DNA, 25 bp, Rattus norvegicus
gcctccttaggtgttagtgcttaga

SEQ ID NO: 396386 - DNA, 25 bp, Rattus norvegicus
gcctccttggagaactagagcccat

SEQ ID NO: 396387 - DNA, 25 bp, Rattus norvegicus
gcctccttggagtactagagcccat

SEQ ID NO: 396388 - DNA, 25 bp, Rattus norvegicus
gcctccttggtacttgtgttttgta

SEQ ID NO: 396389 - DNA, 25 bp, Rattus norvegicus
gcctccttggtagttgtgttttgta

SEQ ID NO: 396390 - DNA, 25 bp, Rattus norvegicus
gcctccttgtttctcgatttcttta

SEQ ID NO: 396391 - DNA, 25 bp, Rattus norvegicus
gcctccttgtttgtcgatttcttta

SEQ ID NO: 396392 - DNA, 25 bp, Rattus norvegicus
gcctcctttcctatggcagtgaaga

SEQ ID NO: 396393 - DNA, 25 bp, Rattus norvegicus
gcctcctttcctttggcagtgaaga

SEQ ID NO: 396394 - DNA, 25 bp, Rattus norvegicus
gcctcctttgtaagactttctttgt

SEQ ID NO: 396395 - DNA, 25 bp, Rattus norvegicus
gcctcctttgtatgactttctttgt

SEQ ID NO: 396396 - DNA, 25 bp, Rattus norvegicus
gcctcctttgttaaacatgggcatc

SEQ ID NO: 396397 - DNA, 25 bp, Rattus norvegicus
gcctcctttgtttaacatgggcatc

SEQ ID NO: 396398 - DNA, 25 bp, Rattus norvegicus
gcctccttttccaatgtaaccattt

SEQ ID NO: 396399 - DNA, 25 bp, Rattus norvegicus
gcctccttttcctatgtaaccattt

SEQ ID NO: 396400 - DNA, 25 bp, Rattus norvegicus
gcctccttttctatggactttgaag

SEQ ID NO: 396401 - DNA, 25 bp, Rattus norvegicus
gcctccttttctttggactttgaag

SEQ ID NO: 396402 - DNA, 25 bp, Rattus norvegicus
gcctcgaaatatcggcctgggccaa

SEQ ID NO: 396403 - DNA, 25 bp, Rattus norvegicus
gcctcgaaatatgggcctgggccaa

SEQ ID NO: 396404 - DNA, 25 bp, Rattus norvegicus
gcctcgagatcacaaagcccatatt

SEQ ID NO: 396405 - DNA, 25 bp, Rattus norvegicus
gcctcgagatcagaaagcccatatt

SEQ ID NO: 396406 - DNA, 25 bp, Rattus norvegicus
gcctcgagcctcaagaatatcaact

SEQ ID NO: 396407 - DNA, 25 bp, Rattus norvegicus
gcctcgagcctctagaatatcaact

SEQ ID NO: 396408 - DNA, 25 bp, Rattus norvegicus
gcctcgaggctgatctgtgaactga

SEQ ID NO: 396409 - DNA, 25 bp, Rattus norvegicus
gcctcgaggctgttctgtgaactga

SEQ ID NO: 396410 - DNA, 25 bp, Rattus norvegicus
gcctcgatggaactcgtgggcctaa

SEQ ID NO: 396411 - DNA, 25 bp, Rattus norvegicus
gcctcgatggaagtcgtgggcctaa

SEQ ID NO: 396412 - DNA, 25 bp, Rattus norvegicus
gcctcgatgggtaaaaatcttcaca

SEQ ID NO: 396413 - DNA, 25 bp, Rattus norvegicus
gcctcgatgggttaaaatcttcaca

SEQ ID NO: 396414 - DNA, 25 bp, Rattus norvegicus
gcctcgattagcatctcatgcttta

SEQ ID NO: 396415 - DNA, 25 bp, Rattus norvegicus
gcctcgattagcttctcatgcttta

SEQ ID NO: 396416 - DNA, 25 bp, Rattus norvegicus
gcctcgcaccaaaccatcggaatat

SEQ ID NO: 396417 - DNA, 25 bp, Rattus norvegicus
gcctcgcaccaatccatcggaatat

SEQ ID NO: 396418 - DNA, 25 bp, Rattus norvegicus
gcctcgcaccagacagtcagaggag

SEQ ID NO: 396419 - DNA, 25 bp, Rattus norvegicus
gcctcgcaccagtcagtcagaggag

SEQ ID NO: 396420 - DNA, 25 bp, Rattus norvegicus
gcctcgcatttacctgtattgtgac

SEQ ID NO: 396421 - DNA, 25 bp, Rattus norvegicus
gcctcgcatttagctgtattgtgac

SEQ ID NO: 396422 - DNA, 25 bp, Rattus norvegicus
gcctcgctataaatatgcccatgat

SEQ ID NO: 396423 - DNA, 25 bp, Rattus norvegicus
gcctcgctataattatgcccatgat

SEQ ID NO: 396424 - DNA, 25 bp, Rattus norvegicus
gcctcgctgaagcaaccaggtccga

SEQ ID NO: 396425 - DNA, 25 bp, Rattus norvegicus
gcctcgctgaaggaaccaggtccga

SEQ ID NO: 396426 - DNA, 25 bp, Rattus norvegicus
gcctcgcttcccagtgttatggaaa

SEQ ID NO: 396427 - DNA, 25 bp, Rattus norvegicus
gcctcgcttccctgtgttatggaaa

SEQ ID NO: 396428 - DNA, 25 bp, Rattus norvegicus
gcctcgcttctgataactcattaaa

SEQ ID NO: 396429 - DNA, 25 bp, Rattus norvegicus
gcctcgcttctgttaactcattaaa

SEQ ID NO: 396430 - DNA, 25 bp, Rattus norvegicus
gcctcggacaagagcacgtgctgtg

SEQ ID NO: 396431 - DNA, 25 bp, Rattus norvegicus
gcctcggacaagtgcacgtgctgtg

SEQ ID NO: 396432 - DNA, 25 bp, Rattus norvegicus
gcctcggacagaatccagttacacg

SEQ ID NO: 396433 - DNA, 25 bp, Rattus norvegicus
gcctcggacagattccagttacacg

SEQ ID NO: 396434 - DNA, 25 bp, Rattus norvegicus
gcctcggacagtagcttacatgttt

SEQ ID NO: 396435 - DNA, 25 bp, Rattus norvegicus
gcctcggacagttgcttacatgttt

SEQ ID NO: 396436 - DNA, 25 bp, Rattus norvegicus
gcctcggacgagagctttggcactg

SEQ ID NO: 396437 - DNA, 25 bp, Rattus norvegicus
gcctcggacgagtgctttggcactg

SEQ ID NO: 396438 - DNA, 25 bp, Rattus norvegicus
gcctcggagcagatgtttatttatg

SEQ ID NO: 396439 - DNA, 25 bp, Rattus norvegicus
gcctcggagcagttgtttatttatg

SEQ ID NO: 396440 - DNA, 25 bp, Rattus norvegicus
gcctcggagcttcgattcctatgga

SEQ ID NO: 396441 - DNA, 25 bp, Rattus norvegicus
gcctcggagcttggattcctatgga

SEQ ID NO: 396442 - DNA, 25 bp, Rattus norvegicus
gcctcggatgctcgttacatttgat

SEQ ID NO: 396443 - DNA, 25 bp, Rattus norvegicus
gcctcggatgctggttacatttgat

SEQ ID NO: 396444 - DNA, 25 bp, Rattus norvegicus
gcctcgggagatcattctttacagt

SEQ ID NO: 396445 - DNA, 25 bp, Rattus norvegicus
gcctcgggagatgattctttacagt

SEQ ID NO: 396446 - DNA, 25 bp, Rattus norvegicus
gcctcggtatccatgattgccagta

SEQ ID NO: 396447 - DNA, 25 bp, Rattus norvegicus
gcctcggtatccttgattgccagta

SEQ ID NO: 396448 - DNA, 25 bp, Rattus norvegicus
gcctcggtcttccaaatgctggaat

SEQ ID NO: 396449 - DNA, 25 bp, Rattus norvegicus
gcctcggtcttcgaaatgctggaat

SEQ ID NO: 396450 - DNA, 25 bp, Rattus norvegicus
gcctcggtgatgaacagaaaatgga

SEQ ID NO: 396451 - DNA, 25 bp, Rattus norvegicus
gcctcggtgatgtacagaaaatgga

SEQ ID NO: 396452 - DNA, 25 bp, Rattus norvegicus
gcctcggtgcttcgagtttactgta

SEQ ID NO: 396453 - DNA, 25 bp, Rattus norvegicus
gcctcggtgcttctgcacgaacaaa

SEQ ID NO: 396454 - DNA, 25 bp, Rattus norvegicus
gcctcggtgcttggagtttactgta

SEQ ID NO: 396455 - DNA, 25 bp, Rattus norvegicus
gcctcggtgcttgtgcacgaacaaa

SEQ ID NO: 396456 - DNA, 25 bp, Rattus norvegicus
gcctcggtggatagcatttttaatt

SEQ ID NO: 396457 - DNA, 25 bp, Rattus norvegicus
gcctcggtggattgcatttttaatt

SEQ ID NO: 396458 - DNA, 25 bp, Rattus norvegicus
gcctcgtattttactcacgtatatt

SEQ ID NO: 396459 - DNA, 25 bp, Rattus norvegicus
gcctcgtatttttctcacgtatatt

SEQ ID NO: 396460 - DNA, 25 bp, Rattus norvegicus
gcctcgtccaagaagtccagtccag

SEQ ID NO: 396461 - DNA, 25 bp, Rattus norvegicus
gcctcgtccaagtagtccagtccag

SEQ ID NO: 396462 - DNA, 25 bp, Rattus norvegicus
gcctcgtctgctataaacaccatga

SEQ ID NO: 396463 - DNA, 25 bp, Rattus norvegicus
gcctcgtctgctttaaacaccatga

SEQ ID NO: 396464 - DNA, 25 bp, Rattus norvegicus
gcctcgtgaaggctataatgtcaga

SEQ ID NO: 396465 - DNA, 25 bp, Rattus norvegicus
gcctcgtgaagggtataatgtcaga

SEQ ID NO: 396466 - DNA, 25 bp, Rattus norvegicus
gcctcgtgactacacctgtttttaa

SEQ ID NO: 396467 - DNA, 25 bp, Rattus norvegicus
gcctcgtgactagacctgtttttaa

SEQ ID NO: 396468 - DNA, 25 bp, Rattus norvegicus
gcctcgtgagcacccttaattcaga

SEQ ID NO: 396469 - DNA, 25 bp, Rattus norvegicus
gcctcgtgagcagccttaattcaga

SEQ ID NO: 396470 - DNA, 25 bp, Rattus norvegicus
gcctcgtgcctcatgtagaattcag

SEQ ID NO: 396471 - DNA, 25 bp, Rattus norvegicus
gcctcgtgcctcttgtagaattcag

SEQ ID NO: 396472 - DNA, 25 bp, Rattus norvegicus
gcctcgtggaggagacatgttaact

SEQ ID NO: 396473 - DNA, 25 bp, Rattus norvegicus
gcctcgtggaggtgacatgttaact

SEQ ID NO: 396474 - DNA, 25 bp, Rattus norvegicus
gcctcgtggctcagcgagagcagaa

SEQ ID NO: 396475 - DNA, 25 bp, Rattus norvegicus
gcctcgtggctctgcgagagcagaa

SEQ ID NO: 396476 - DNA, 25 bp, Rattus norvegicus
gcctcgtgttatatatgtagcccag

SEQ ID NO: 396477 - DNA, 25 bp, Rattus norvegicus
gcctcgtgttatttatgtagcccag

SEQ ID NO: 396478 - DNA, 25 bp, Rattus norvegicus
gcctcgttaaagctgctgggcaact

SEQ ID NO: 396479 - DNA, 25 bp, Rattus norvegicus
gcctcgttaaaggtgctgggcaact

SEQ ID NO: 396480 - DNA, 25 bp, Rattus norvegicus
gcctcgttcaatctggcatttttat

SEQ ID NO: 396481 - DNA, 25 bp, Rattus norvegicus
gcctcgttcaatgtggcatttttat

SEQ ID NO: 396482 - DNA, 25 bp, Rattus norvegicus
gcctcgttcccacttgtatattttt

SEQ ID NO: 396483 - DNA, 25 bp, Rattus norvegicus
gcctcgttcccagttgtatattttt

SEQ ID NO: 396484 - DNA, 25 bp, Rattus norvegicus
gcctctaactagataaatgtgacac

SEQ ID NO: 396485 - DNA, 25 bp, Rattus norvegicus
gcctctaactagttaaatgtgacac

SEQ ID NO: 396486 - DNA, 25 bp, Rattus norvegicus
gcctctaattctagacagtcatccc

SEQ ID NO: 396487 - DNA, 25 bp, Rattus norvegicus
gcctctaattcttgacagtcatccc

SEQ ID NO: 396488 - DNA, 25 bp, Rattus norvegicus
gcctctacaactccagaggaggtct

SEQ ID NO: 396489 - DNA, 25 bp, Rattus norvegicus
gcctctacaactgcagaggaggtct

SEQ ID NO: 396490 - DNA, 25 bp, Rattus norvegicus
gcctctacaggcacatctaattgaa

SEQ ID NO: 396491 - DNA, 25 bp, Rattus norvegicus
gcctctacaggctcatctaattgaa

SEQ ID NO: 396492 - DNA, 25 bp, Rattus norvegicus
gcctctacctccaaagagctgagat

SEQ ID NO: 396493 - DNA, 25 bp, Rattus norvegicus
gcctctacctcctaagagctgagat

SEQ ID NO: 396494 - DNA, 25 bp, Rattus norvegicus
gcctctacctcgcagtgctgaatat

SEQ ID NO: 396495 - DNA, 25 bp, Rattus norvegicus
gcctctacctcggagtgctgaatat

SEQ ID NO: 396496 - DNA, 25 bp, Rattus norvegicus
gcctctacctctcaagtgaaaggat

SEQ ID NO: 396497 - DNA, 25 bp, Rattus norvegicus
gcctctacctctgaagtgaaaggat

SEQ ID NO: 396498 - DNA, 25 bp, Rattus norvegicus
gcctctaccttcaagttggttcctg

SEQ ID NO: 396499 - DNA, 25 bp, Rattus norvegicus
gcctctaccttcagggattacagta

SEQ ID NO: 396500 - DNA, 25 bp, Rattus norvegicus
gcctctaccttctagttggttcctg

SEQ ID NO: 396501 - DNA, 25 bp, Rattus norvegicus
gcctctaccttctgggattacagta

SEQ ID NO: 396502 - DNA, 25 bp, Rattus norvegicus
gcctctacgagaatgtaaagttgga

SEQ ID NO: 396503 - DNA, 25 bp, Rattus norvegicus
gcctctacgagattgtaaagttgga

SEQ ID NO: 396504 - DNA, 25 bp, Rattus norvegicus
gcctctactacacattttgcattgt

SEQ ID NO: 396505 - DNA, 25 bp, Rattus norvegicus
gcctctactacagattttgcattgt

SEQ ID NO: 396506 - DNA, 25 bp, Rattus norvegicus
gcctctacttctatgggatgcacgg

SEQ ID NO: 396507 - DNA, 25 bp, Rattus norvegicus
gcctctacttctttgggatgcacgg

SEQ ID NO: 396508 - DNA, 25 bp, Rattus norvegicus
gcctctagcctgaagcaccaaggaa

SEQ ID NO: 396509 - DNA, 25 bp, Rattus norvegicus
gcctctagcctgtagcaccaaggaa

SEQ ID NO: 396510 - DNA, 25 bp, Rattus norvegicus
gcctctaggagccaatgtgtgtacc

SEQ ID NO: 396511 - DNA, 25 bp, Rattus norvegicus
gcctctaggagcgaatgtgtgtacc

SEQ ID NO: 396512 - DNA, 25 bp, Rattus norvegicus
gcctctagggctataatgatatgat

SEQ ID NO: 396513 - DNA, 25 bp, Rattus norvegicus
gcctctagggctttaatgatatgat

SEQ ID NO: 396514 - DNA, 25 bp, Rattus norvegicus
gcctctagtaggacagcgtcgttag

SEQ ID NO: 396515 - DNA, 25 bp, Rattus norvegicus
gcctctagtaggtcagcgtcgttag

SEQ ID NO: 396516 - DNA, 25 bp, Rattus norvegicus
gcctctagtcccagaagtggcagga

SEQ ID NO: 396517 - DNA, 25 bp, Rattus norvegicus
gcctctagtccctgaagtggcagga

SEQ ID NO: 396518 - DNA, 25 bp, Rattus norvegicus
gcctctagtgcgaaccgtgccggaa

SEQ ID NO: 396519 - DNA, 25 bp, Rattus norvegicus
gcctctagtgcgtaccgtgccggaa

SEQ ID NO: 396520 - DNA, 25 bp, Rattus norvegicus
gcctctatctccaaggtgcaacaac

SEQ ID NO: 396521 - DNA, 25 bp, Rattus norvegicus
gcctctatctcctaggtgcaacaac

SEQ ID NO: 396522 - DNA, 25 bp, Rattus norvegicus
gcctctattaacctttcactctggg

SEQ ID NO: 396523 - DNA, 25 bp, Rattus norvegicus
gcctctattaacgtttcactctggg

SEQ ID NO: 396524 - DNA, 25 bp, Rattus norvegicus
gcctctattctactctcttgtggta

SEQ ID NO: 396525 - DNA, 25 bp, Rattus norvegicus
gcctctattctagtctcttgtggta

SEQ ID NO: 396526 - DNA, 25 bp, Rattus norvegicus
gcctctattgctaacttaccaaatg

SEQ ID NO: 396527 - DNA, 25 bp, Rattus norvegicus
gcctctattgcttacttaccaaatg

SEQ ID NO: 396528 - DNA, 25 bp, Rattus norvegicus
gcctctattggcattgtcttgcttg

SEQ ID NO: 396529 - DNA, 25 bp, Rattus norvegicus
gcctctattggctttgtcttgcttg

SEQ ID NO: 396530 - DNA, 25 bp, Rattus norvegicus
gcctctcaaggtacccctattttag

SEQ ID NO: 396531 - DNA, 25 bp, Rattus norvegicus
gcctctcaaggttcccctattttag

SEQ ID NO: 396532 - DNA, 25 bp, Rattus norvegicus
gcctctcacactctctttttaaaga

SEQ ID NO: 396533 - DNA, 25 bp, Rattus norvegicus
gcctctcacactgtctttttaaaga

SEQ ID NO: 396534 - DNA, 25 bp, Rattus norvegicus
gcctctcacataagctagcagcgtt

SEQ ID NO: 396535 - DNA, 25 bp, Rattus norvegicus
gcctctcacatatgctagcagcgtt

SEQ ID NO: 396536 - DNA, 25 bp, Rattus norvegicus
gcctctcaccagcaactttcaaata

SEQ ID NO: 396537 - DNA, 25 bp, Rattus norvegicus
gcctctcaccaggaactttcaaata

SEQ ID NO: 396538 - DNA, 25 bp, Rattus norvegicus
gcctctcagcatatggtttgtatcc

SEQ ID NO: 396539 - DNA, 25 bp, Rattus norvegicus
gcctctcagcatttggtttgtatcc

SEQ ID NO: 396540 - DNA, 25 bp, Rattus norvegicus
gcctctcagtggcttaaagtgccat

SEQ ID NO: 396541 - DNA, 25 bp, Rattus norvegicus
gcctctcagtgggttaaagtgccat

SEQ ID NO: 396542 - DNA, 25 bp, Rattus norvegicus
gcctctcatgggaagcttggcagaa

SEQ ID NO: 396543 - DNA, 25 bp, Rattus norvegicus
gcctctcatgggtagcttggcagaa

SEQ ID NO: 396544 - DNA, 25 bp, Rattus norvegicus
gcctctccacacaagcagctgttaa

SEQ ID NO: 396545 - DNA, 25 bp, Rattus norvegicus
gcctctccacactagcagctgttaa

SEQ ID NO: 396546 - DNA, 25 bp, Rattus norvegicus
gcctctccagatctggttactctaa

SEQ ID NO: 396547 - DNA, 25 bp, Rattus norvegicus
gcctctccagatgtggttactctaa

SEQ ID NO: 396548 - DNA, 25 bp, Rattus norvegicus
gcctctccagtgctcagattttaag

SEQ ID NO: 396549 - DNA, 25 bp, Rattus norvegicus
gcctctccagtggtcagattttaag

SEQ ID NO: 396550 - DNA, 25 bp, Rattus norvegicus
gcctctccatgccttttagttacat

SEQ ID NO: 396551 - DNA, 25 bp, Rattus norvegicus
gcctctccatgcgttttagttacat

SEQ ID NO: 396552 - DNA, 25 bp, Rattus norvegicus
gcctctccattcacatcatgaaata

SEQ ID NO: 396553 - DNA, 25 bp, Rattus norvegicus
gcctctccattctcatcatgaaata

SEQ ID NO: 396554 - DNA, 25 bp, Rattus norvegicus
gcctctccatttaaaccgcagtgag

SEQ ID NO: 396555 - DNA, 25 bp, Rattus norvegicus
gcctctccatttctactgggtgaaa

SEQ ID NO: 396556 - DNA, 25 bp, Rattus norvegicus
gcctctccatttgtactgggtgaaa

SEQ ID NO: 396557 - DNA, 25 bp, Rattus norvegicus
gcctctccattttaaccgcagtgag

SEQ ID NO: 396558 - DNA, 25 bp, Rattus norvegicus
gcctctcccacacagttttgttatg

SEQ ID NO: 396559 - DNA, 25 bp, Rattus norvegicus
gcctctcccacagagttttgttatg

SEQ ID NO: 396560 - DNA, 25 bp, Rattus norvegicus
gcctctcccacgatgttcttcatgg

SEQ ID NO: 396561 - DNA, 25 bp, Rattus norvegicus
gcctctcccacgttgttcttcatgg

SEQ ID NO: 396562 - DNA, 25 bp, Rattus norvegicus
gcctctcctgtacacacagtttagg

SEQ ID NO: 396563 - DNA, 25 bp, Rattus norvegicus
gcctctcctgtagacacagtttagg

SEQ ID NO: 396564 - DNA, 25 bp, Rattus norvegicus
gcctctcctgttacagtaccaagag

SEQ ID NO: 396565 - DNA, 25 bp, Rattus norvegicus
gcctctcctgtttcagtaccaagag

SEQ ID NO: 396566 - DNA, 25 bp, Rattus norvegicus
gcctctcgctttcgttttgtaaacg

SEQ ID NO: 396567 - DNA, 25 bp, Rattus norvegicus
gcctctcgctttggttttgtaaacg

SEQ ID NO: 396568 - DNA, 25 bp, Rattus norvegicus
gcctctcgttcactttggtggaaga

SEQ ID NO: 396569 - DNA, 25 bp, Rattus norvegicus
gcctctcgttcagtttggtggaaga

SEQ ID NO: 396570 - DNA, 25 bp, Rattus norvegicus
gcctctcgtttcattgggctttaag

SEQ ID NO: 396571 - DNA, 25 bp, Rattus norvegicus
gcctctcgtttctttgggctttaag

SEQ ID NO: 396572 - DNA, 25 bp, Rattus norvegicus
gcctctctaaggctatcaagatagt

SEQ ID NO: 396573 - DNA, 25 bp, Rattus norvegicus
gcctctctaagggtatcaagatagt

SEQ ID NO: 396574 - DNA, 25 bp, Rattus norvegicus
gcctctctaggcattatgaacttcg

SEQ ID NO: 396575 - DNA, 25 bp, Rattus norvegicus
gcctctctaggctttatgaacttcg

SEQ ID NO: 396576 - DNA, 25 bp, Rattus norvegicus
gcctctctccttcactggtgataaa

SEQ ID NO: 396577 - DNA, 25 bp, Rattus norvegicus
gcctctctccttgactggtgataaa

SEQ ID NO: 396578 - DNA, 25 bp, Rattus norvegicus
gcctctctggatccaactcttaaaa

SEQ ID NO: 396579 - DNA, 25 bp, Rattus norvegicus
gcctctctggatgcaactcttaaaa

SEQ ID NO: 396580 - DNA, 25 bp, Rattus norvegicus
gcctctctgtacattcaccaaaaat

SEQ ID NO: 396581 - DNA, 25 bp, Rattus norvegicus
gcctctctgtactttcaccaaaaat

SEQ ID NO: 396582 - DNA, 25 bp, Rattus norvegicus
gcctctctgtctcatcaggatgcaa

SEQ ID NO: 396583 - DNA, 25 bp, Rattus norvegicus
gcctctctgtctgatcaggatgcaa

SEQ ID NO: 396584 - DNA, 25 bp, Rattus norvegicus
gcctctctgtgcacctttagctggg

SEQ ID NO: 396585 - DNA, 25 bp, Rattus norvegicus
gcctctctgtgctcctttagctggg

SEQ ID NO: 396586 - DNA, 25 bp, Rattus norvegicus
gcctctcttaggcattgtggccaaa

SEQ ID NO: 396587 - DNA, 25 bp, Rattus norvegicus
gcctctcttagggattgtggccaaa

SEQ ID NO: 396588 - DNA, 25 bp, Rattus norvegicus
gcctctcttggcctatggcatgatg

SEQ ID NO: 396589 - DNA, 25 bp, Rattus norvegicus
gcctctcttggcgtatggcatgatg

SEQ ID NO: 396590 - DNA, 25 bp, Rattus norvegicus
gcctctgaaaacacatgagttctca

SEQ ID NO: 396591 - DNA, 25 bp, Rattus norvegicus
gcctctgaaaactcatgagttctca

SEQ ID NO: 396592 - DNA, 25 bp, Rattus norvegicus
gcctctgaaactctacctccagaag

SEQ ID NO: 396593 - DNA, 25 bp, Rattus norvegicus
gcctctgaaactgtacctccagaag

SEQ ID NO: 396594 - DNA, 25 bp, Rattus norvegicus
gcctctgacacaaggttattgtctg

SEQ ID NO: 396595 - DNA, 25 bp, Rattus norvegicus
gcctctgacacatggttattgtctg

SEQ ID NO: 396596 - DNA, 25 bp, Rattus norvegicus
gcctctgactctcgtatacgttcat

SEQ ID NO: 396597 - DNA, 25 bp, Rattus norvegicus
gcctctgactctggtatacgttcat

SEQ ID NO: 396598 - DNA, 25 bp, Rattus norvegicus
gcctctgactgacgtgtgattgctt

SEQ ID NO: 396599 - DNA, 25 bp, Rattus norvegicus
gcctctgactgaggtgtgattgctt

SEQ ID NO: 396600 - DNA, 25 bp, Rattus norvegicus
gcctctgagaaaatggccgccttgt

SEQ ID NO: 396601 - DNA, 25 bp, Rattus norvegicus
gcctctgagaaattggccgccttgt

SEQ ID NO: 396602 - DNA, 25 bp, Rattus norvegicus
gcctctgagattcgtatttagcctt

SEQ ID NO: 396603 - DNA, 25 bp, Rattus norvegicus
gcctctgagattggtatttagcctt

SEQ ID NO: 396604 - DNA, 25 bp, Rattus norvegicus
gcctctgagggcacttgcagttatg

SEQ ID NO: 396605 - DNA, 25 bp, Rattus norvegicus
gcctctgagggctcttgcagttatg

SEQ ID NO: 396606 - DNA, 25 bp, Rattus norvegicus
gcctctgaggtcacagattccgaga

SEQ ID NO: 396607 - DNA, 25 bp, Rattus norvegicus
gcctctgaggtctcagattccgaga

SEQ ID NO: 396608 - DNA, 25 bp, Rattus norvegicus
gcctctgagtctcccgatgatgatg

SEQ ID NO: 396609 - DNA, 25 bp, Rattus norvegicus
gcctctgagtctgccgatgatgatg

SEQ ID NO: 396610 - DNA, 25 bp, Rattus norvegicus
gcctctgatcttcacccttaatagt

SEQ ID NO: 396611 - DNA, 25 bp, Rattus norvegicus
gcctctgatcttgacccttaatagt

SEQ ID NO: 396612 - DNA, 25 bp, Rattus norvegicus
gcctctgatgaacgcccccaagaga

SEQ ID NO: 396613 - DNA, 25 bp, Rattus norvegicus
gcctctgatgaaggcccccaagaga

SEQ ID NO: 396614 - DNA, 25 bp, Rattus norvegicus
gcctctgattttccttttattttct

SEQ ID NO: 396615 - DNA, 25 bp, Rattus norvegicus
gcctctgattttgcttttattttct

SEQ ID NO: 396616 - DNA, 25 bp, Rattus norvegicus
gcctctgcaactcacgagtgacatt

SEQ ID NO: 396617 - DNA, 25 bp, Rattus norvegicus
gcctctgcaactgacgagtgacatt

SEQ ID NO: 396618 - DNA, 25 bp, Rattus norvegicus
gcctctgcactacatatgcggttca

SEQ ID NO: 396619 - DNA, 25 bp, Rattus norvegicus
gcctctgcactagatatgcggttca

SEQ ID NO: 396620 - DNA, 25 bp, Rattus norvegicus
gcctctgcactcatatctgttgtgt

SEQ ID NO: 396621 - DNA, 25 bp, Rattus norvegicus
gcctctgcactcttatctgttgtgt

SEQ ID NO: 396622 - DNA, 25 bp, Rattus norvegicus
gcctctgcaggcaaagcccttaata

SEQ ID NO: 396623 - DNA, 25 bp, Rattus norvegicus
gcctctgcaggcatacgcttggaag

SEQ ID NO: 396624 - DNA, 25 bp, Rattus norvegicus
gcctctgcaggctaagcccttaata

SEQ ID NO: 396625 - DNA, 25 bp, Rattus norvegicus
gcctctgcaggcttacgcttggaag

SEQ ID NO: 396626 - DNA, 25 bp, Rattus norvegicus
gcctctgcatcccaagtggtgaagt

SEQ ID NO: 396627 - DNA, 25 bp, Rattus norvegicus
gcctctgcatccgaagtggtgaagt

SEQ ID NO: 396628 - DNA, 25 bp, Rattus norvegicus
gcctctgccaggagggcctgtatat

SEQ ID NO: 396629 - DNA, 25 bp, Rattus norvegicus
gcctctgccaggtgggcctgtatat

SEQ ID NO: 396630 - DNA, 25 bp, Rattus norvegicus
gcctctgccctgacattagcgcggg

SEQ ID NO: 396631 - DNA, 25 bp, Rattus norvegicus
gcctctgccctgagacggactcggg

SEQ ID NO: 396632 - DNA, 25 bp, Rattus norvegicus
gcctctgccctgtcattagcgcggg

SEQ ID NO: 396633 - DNA, 25 bp, Rattus norvegicus
gcctctgccctgtgacggactcggg

SEQ ID NO: 396634 - DNA, 25 bp, Rattus norvegicus
gcctctgcctctcgattgtaggtac

SEQ ID NO: 396635 - DNA, 25 bp, Rattus norvegicus
gcctctgcctctggattgtaggtac

SEQ ID NO: 396636 - DNA, 25 bp, Rattus norvegicus
gcctctgcggctaattaaagtgtgt

SEQ ID NO: 396637 - DNA, 25 bp, Rattus norvegicus
gcctctgcggcttattaaagtgtgt

SEQ ID NO: 396638 - DNA, 25 bp, Rattus norvegicus
gcctctgctgccatggaaagtgcga

SEQ ID NO: 396639 - DNA, 25 bp, Rattus norvegicus
gcctctgctgccttggaaagtgcga

SEQ ID NO: 396640 - DNA, 25 bp, Rattus norvegicus
gcctctgctgctctatatcttggca

SEQ ID NO: 396641 - DNA, 25 bp, Rattus norvegicus
gcctctgctgctgtatatcttggca

SEQ ID NO: 396642 - DNA, 25 bp, Rattus norvegicus
gcctctggaaggagggcaaccctga

SEQ ID NO: 396643 - DNA, 25 bp, Rattus norvegicus
gcctctggaaggtgggcaaccctga

SEQ ID NO: 396644 - DNA, 25 bp, Rattus norvegicus
gcctctggaatcagggacattgtta

SEQ ID NO: 396645 - DNA, 25 bp, Rattus norvegicus
gcctctggaatctgggacattgtta

SEQ ID NO: 396646 - DNA, 25 bp, Rattus norvegicus
gcctctggataacttgcctatatgt

SEQ ID NO: 396647 - DNA, 25 bp, Rattus norvegicus
gcctctggataagttgcctatatgt

SEQ ID NO: 396648 - DNA, 25 bp, Rattus norvegicus
gcctctggatcgctctggagaatgc

SEQ ID NO: 396649 - DNA, 25 bp, Rattus norvegicus
gcctctggatcggtctggagaatgc

SEQ ID NO: 396650 - DNA, 25 bp, Rattus norvegicus
gcctctggatggctaacactggaga

SEQ ID NO: 396651 - DNA, 25 bp, Rattus norvegicus
gcctctggatgggtaacactggaga

SEQ ID NO: 396652 - DNA, 25 bp, Rattus norvegicus
gcctctggatgtattctaatctgac

SEQ ID NO: 396653 - DNA, 25 bp, Rattus norvegicus
gcctctggatgttttctaatctgac

SEQ ID NO: 396654 - DNA, 25 bp, Rattus norvegicus
gcctctggccttatgactaattttc

SEQ ID NO: 396655 - DNA, 25 bp, Rattus norvegicus
gcctctggccttttgactaattttc

SEQ ID NO: 396656 - DNA, 25 bp, Rattus norvegicus
gcctctggcttgcttcactaaagat

SEQ ID NO: 396657 - DNA, 25 bp, Rattus norvegicus
gcctctggcttggttcactaaagat

SEQ ID NO: 396658 - DNA, 25 bp, Rattus norvegicus
gcctctgggattaattctgctgaac

SEQ ID NO: 396659 - DNA, 25 bp, Rattus norvegicus
gcctctgggatttattctgctgaac

SEQ ID NO: 396660 - DNA, 25 bp, Rattus norvegicus
gcctctgggcctcagaagccagtat

SEQ ID NO: 396661 - DNA, 25 bp, Rattus norvegicus
gcctctgggcctgagaagccagtat

SEQ ID NO: 396662 - DNA, 25 bp, Rattus norvegicus
gcctctggttcaccagtgctattta

SEQ ID NO: 396663 - DNA, 25 bp, Rattus norvegicus
gcctctggttcagcagtgctattta

SEQ ID NO: 396664 - DNA, 25 bp, Rattus norvegicus
gcctctgtaacaacatggctcaaca

SEQ ID NO: 396665 - DNA, 25 bp, Rattus norvegicus
gcctctgtaacatcatggctcaaca

SEQ ID NO: 396666 - DNA, 25 bp, Rattus norvegicus
gcctctgtaggcaccggtacaagtg

SEQ ID NO: 396667 - DNA, 25 bp, Rattus norvegicus
gcctctgtaggctccggtacaagtg

SEQ ID NO: 396668 - DNA, 25 bp, Rattus norvegicus
gcctctgtatttcgaagctcttttc

SEQ ID NO: 396669 - DNA, 25 bp, Rattus norvegicus
gcctctgtatttggaagctcttttc

SEQ ID NO: 396670 - DNA, 25 bp, Rattus norvegicus
gcctctgtcaggcttgtttttgaat

SEQ ID NO: 396671 - DNA, 25 bp, Rattus norvegicus
gcctctgtcagggttgtttttgaat

SEQ ID NO: 396672 - DNA, 25 bp, Rattus norvegicus
gcctctgtcataaggttcttgagaa

SEQ ID NO: 396673 - DNA, 25 bp, Rattus norvegicus
gcctctgtcatatggttcttgagaa

SEQ ID NO: 396674 - DNA, 25 bp, Rattus norvegicus
gcctctgtcccaatttttatctagg

SEQ ID NO: 396675 - DNA, 25 bp, Rattus norvegicus
gcctctgtcccattttttatctagg

SEQ ID NO: 396676 - DNA, 25 bp, Rattus norvegicus
gcctctgtcctcagcaaagtacaga

SEQ ID NO: 396677 - DNA, 25 bp, Rattus norvegicus
gcctctgtcctctgcaaagtacaga

SEQ ID NO: 396678 - DNA, 25 bp, Rattus norvegicus
gcctctgtctttcaggtgttggatt

SEQ ID NO: 396679 - DNA, 25 bp, Rattus norvegicus
gcctctgtctttgaggtgttggatt

SEQ ID NO: 396680 - DNA, 25 bp, Rattus norvegicus
gcctctgtgaggaccagtgccagat

SEQ ID NO: 396681 - DNA, 25 bp, Rattus norvegicus
gcctctgtgaggtccagtgccagat

SEQ ID NO: 396682 - DNA, 25 bp, Rattus norvegicus
gcctctgtgggcatttgtagtgcac

SEQ ID NO: 396683 - DNA, 25 bp, Rattus norvegicus
gcctctgtgggcttttgtagtgcac

SEQ ID NO: 396684 - DNA, 25 bp, Rattus norvegicus
gcctctgtgggtcctgttgctgatt

SEQ ID NO: 396685 - DNA, 25 bp, Rattus norvegicus
gcctctgtgggtgctgttgctgatt

SEQ ID NO: 396686 - DNA, 25 bp, Rattus norvegicus
gcctctgtggtgctgacattcataa

SEQ ID NO: 396687 - DNA, 25 bp, Rattus norvegicus
gcctctgtggtggtgacattcataa

SEQ ID NO: 396688 - DNA, 25 bp, Rattus norvegicus
gcctctgtgtacatggtggttgcca

SEQ ID NO: 396689 - DNA, 25 bp, Rattus norvegicus
gcctctgtgtacttggtggttgcca

SEQ ID NO: 396690 - DNA, 25 bp, Rattus norvegicus
gcctctgtgtgtcagattccttaca

SEQ ID NO: 396691 - DNA, 25 bp, Rattus norvegicus
gcctctgtgtgtgagattccttaca

SEQ ID NO: 396692 - DNA, 25 bp, Rattus norvegicus
gcctctgttagcagatcacctgaag

SEQ ID NO: 396693 - DNA, 25 bp, Rattus norvegicus
gcctctgttagctgatcacctgaag

SEQ ID NO: 396694 - DNA, 25 bp, Rattus norvegicus
gcctctgttcctattttactgtaaa

SEQ ID NO: 396695 - DNA, 25 bp, Rattus norvegicus
gcctctgttccttttttactgtaaa

SEQ ID NO: 396696 - DNA, 25 bp, Rattus norvegicus
gcctctgttgtcctatgttgggatt

SEQ ID NO: 396697 - DNA, 25 bp, Rattus norvegicus
gcctctgttgtcgtatgttgggatt

SEQ ID NO: 396698 - DNA, 25 bp, Rattus norvegicus
gcctctgtttacaaagcttcttgaa

SEQ ID NO: 396699 - DNA, 25 bp, Rattus norvegicus
gcctctgtttactaagcttcttgaa

SEQ ID NO: 396700 - DNA, 25 bp, Rattus norvegicus
gcctctgtttccctttttgtgtaag

SEQ ID NO: 396701 - DNA, 25 bp, Rattus norvegicus
gcctctgtttccgtttttgtgtaag

SEQ ID NO: 396702 - DNA, 25 bp, Rattus norvegicus
gcctctgtttctatgtacctgtatt

SEQ ID NO: 396703 - DNA, 25 bp, Rattus norvegicus
gcctctgtttctttgtacctgtatt

SEQ ID NO: 396704 - DNA, 25 bp, Rattus norvegicus
gcctcttaaattcctgtctgcagtt

SEQ ID NO: 396705 - DNA, 25 bp, Rattus norvegicus
gcctcttaaattgctgtctgcagtt

SEQ ID NO: 396706 - DNA, 25 bp, Rattus norvegicus
gcctcttactcaagctttctagtga

SEQ ID NO: 396707 - DNA, 25 bp, Rattus norvegicus
gcctcttactcatgctttctagtga

SEQ ID NO: 396708 - DNA, 25 bp, Rattus norvegicus
gcctcttagaggcacagatggctca

SEQ ID NO: 396709 - DNA, 25 bp, Rattus norvegicus
gcctcttagagggacagatggctca

SEQ ID NO: 396710 - DNA, 25 bp, Rattus norvegicus
gcctcttatattatgccttcccata

SEQ ID NO: 396711 - DNA, 25 bp, Rattus norvegicus
gcctcttatattttgccttcccata

SEQ ID NO: 396712 - DNA, 25 bp, Rattus norvegicus
gcctcttatcagctggtacatcata

SEQ ID NO: 396713 - DNA, 25 bp, Rattus norvegicus
gcctcttatcaggtggtacatcata

SEQ ID NO: 396714 - DNA, 25 bp, Rattus norvegicus
gcctcttatcgcattttcatgcatt

SEQ ID NO: 396715 - DNA, 25 bp, Rattus norvegicus
gcctcttatcgctttttcatgcatt

SEQ ID NO: 396716 - DNA, 25 bp, Rattus norvegicus
gcctcttatgttccttctaactcct

SEQ ID NO: 396717 - DNA, 25 bp, Rattus norvegicus
gcctcttatgttgcttctaactcct

SEQ ID NO: 396718 - DNA, 25 bp, Rattus norvegicus
gcctcttcactacatcttgacagaa

SEQ ID NO: 396719 - DNA, 25 bp, Rattus norvegicus
gcctcttcactagatcttgacagaa

SEQ ID NO: 396720 - DNA, 25 bp, Rattus norvegicus
gcctcttcactcagagtcagctgaa

SEQ ID NO: 396721 - DNA, 25 bp, Rattus norvegicus
gcctcttcactctgagtcagctgaa

SEQ ID NO: 396722 - DNA, 25 bp, Rattus norvegicus
gcctcttcacttctctgtggcagaa

SEQ ID NO: 396723 - DNA, 25 bp, Rattus norvegicus
gcctcttcacttgtctgtggcagaa

SEQ ID NO: 396724 - DNA, 25 bp, Rattus norvegicus
gcctcttcaggactgaactgcgtgt

SEQ ID NO: 396725 - DNA, 25 bp, Rattus norvegicus
gcctcttcaggagtgaactgcgtgt

SEQ ID NO: 396726 - DNA, 25 bp, Rattus norvegicus
gcctcttcagtgagcaaacaacagt

SEQ ID NO: 396727 - DNA, 25 bp, Rattus norvegicus
gcctcttcagtgtgcaaacaacagt

SEQ ID NO: 396728 - DNA, 25 bp, Rattus norvegicus
gcctcttcattactctggtgccaag

SEQ ID NO: 396729 - DNA, 25 bp, Rattus norvegicus
gcctcttcattagtctggtgccaag

SEQ ID NO: 396730 - DNA, 25 bp, Rattus norvegicus
gcctcttccagaaggccctagagag

SEQ ID NO: 396731 - DNA, 25 bp, Rattus norvegicus
gcctcttccagatggccctagagag

SEQ ID NO: 396732 - DNA, 25 bp, Rattus norvegicus
gcctcttccctgatggacctgataa

SEQ ID NO: 396733 - DNA, 25 bp, Rattus norvegicus
gcctcttccctgttggacctgataa

SEQ ID NO: 396734 - DNA, 25 bp, Rattus norvegicus
gcctcttcctcacttgaaggctcag

SEQ ID NO: 396735 - DNA, 25 bp, Rattus norvegicus
gcctcttcctcagttgaaggctcag

SEQ ID NO: 396736 - DNA, 25 bp, Rattus norvegicus
gcctcttcctttctaacgttgccaa

SEQ ID NO: 396737 - DNA, 25 bp, Rattus norvegicus
gcctcttcctttgtaacgttgccaa

SEQ ID NO: 396738 - DNA, 25 bp, Rattus norvegicus
gcctcttctcatcagtatattcaca

SEQ ID NO: 396739 - DNA, 25 bp, Rattus norvegicus
gcctcttctcatgagtatattcaca

SEQ ID NO: 396740 - DNA, 25 bp, Rattus norvegicus
gcctcttctcggctgggaagtgcca

SEQ ID NO: 396741 - DNA, 25 bp, Rattus norvegicus
gcctcttctcgggtgggaagtgcca

SEQ ID NO: 396742 - DNA, 25 bp, Rattus norvegicus
gcctcttcttcacgtgcatacgttc

SEQ ID NO: 396743 - DNA, 25 bp, Rattus norvegicus
gcctcttcttcaggtgcatacgttc

SEQ ID NO: 396744 - DNA, 25 bp, Rattus norvegicus
gcctcttgacacagcatctgggaaa

SEQ ID NO: 396745 - DNA, 25 bp, Rattus norvegicus
gcctcttgacactgcatctgggaaa

SEQ ID NO: 396746 - DNA, 25 bp, Rattus norvegicus
gcctcttgacgaaggaaacttcttt

SEQ ID NO: 396747 - DNA, 25 bp, Rattus norvegicus
gcctcttgacgatggaaacttcttt

SEQ ID NO: 396748 - DNA, 25 bp, Rattus norvegicus
gcctcttgagtcagggttggctaag

SEQ ID NO: 396749 - DNA, 25 bp, Rattus norvegicus
gcctcttgagtctgggttggctaag

SEQ ID NO: 396750 - DNA, 25 bp, Rattus norvegicus
gcctcttgcaggacttgttttgaaa

SEQ ID NO: 396751 - DNA, 25 bp, Rattus norvegicus
gcctcttgcaggtcttgttttgaaa

SEQ ID NO: 396752 - DNA, 25 bp, Rattus norvegicus
gcctcttgcatgctagaagttctct

SEQ ID NO: 396753 - DNA, 25 bp, Rattus norvegicus
gcctcttgcatggtagaagttctct

SEQ ID NO: 396754 - DNA, 25 bp, Rattus norvegicus
gcctcttgccacagagccagtcaat

SEQ ID NO: 396755 - DNA, 25 bp, Rattus norvegicus
gcctcttgccactgagccagtcaat

SEQ ID NO: 396756 - DNA, 25 bp, Rattus norvegicus
gcctcttgcctgcaatcacttgaat

SEQ ID NO: 396757 - DNA, 25 bp, Rattus norvegicus
gcctcttgcctggaatcacttgaat

SEQ ID NO: 396758 - DNA, 25 bp, Rattus norvegicus
gcctcttgccttcatatgattcatg

SEQ ID NO: 396759 - DNA, 25 bp, Rattus norvegicus
gcctcttgccttgatatgattcatg

SEQ ID NO: 396760 - DNA, 25 bp, Rattus norvegicus
gcctcttgctgtacacctatatatt

SEQ ID NO: 396761 - DNA, 25 bp, Rattus norvegicus
gcctcttgctgttcacctatatatt

SEQ ID NO: 396762 - DNA, 25 bp, Rattus norvegicus
gcctcttggatgagatcccagctca

SEQ ID NO: 396763 - DNA, 25 bp, Rattus norvegicus
gcctcttggatgtgatcccagctca

SEQ ID NO: 396764 - DNA, 25 bp, Rattus norvegicus
gcctcttgggtgagtggccactagc

SEQ ID NO: 396765 - DNA, 25 bp, Rattus norvegicus
gcctcttgggtgtgtggccactagc

SEQ ID NO: 396766 - DNA, 25 bp, Rattus norvegicus
gcctcttggttcatctttcaagaga

SEQ ID NO: 396767 - DNA, 25 bp, Rattus norvegicus
gcctcttggttcttctttcaagaga

SEQ ID NO: 396768 - DNA, 25 bp, Rattus norvegicus
gcctcttgtcatcatttagctactg

SEQ ID NO: 396769 - DNA, 25 bp, Rattus norvegicus
gcctcttgtcatgatttagctactg

SEQ ID NO: 396770 - DNA, 25 bp, Rattus norvegicus
gcctctttcattcattatcaggtgt

SEQ ID NO: 396771 - DNA, 25 bp, Rattus norvegicus
gcctctttcattgattatcaggtgt

SEQ ID NO: 396772 - DNA, 25 bp, Rattus norvegicus
gcctctttcccaagtggtctgggag

SEQ ID NO: 396773 - DNA, 25 bp, Rattus norvegicus
gcctctttcccatgtggtctgggag

SEQ ID NO: 396774 - DNA, 25 bp, Rattus norvegicus
gcctctttccctcctgatgataaaa

SEQ ID NO: 396775 - DNA, 25 bp, Rattus norvegicus
gcctctttccctgctgatgataaaa

SEQ ID NO: 396776 - DNA, 25 bp, Rattus norvegicus
gcctctttcctgacttttgatttag

SEQ ID NO: 396777 - DNA, 25 bp, Rattus norvegicus
gcctctttcctgtcttttgatttag

SEQ ID NO: 396778 - DNA, 25 bp, Rattus norvegicus
gcctctttctgtctttgatttgctt

SEQ ID NO: 396779 - DNA, 25 bp, Rattus norvegicus
gcctctttctgtgtttgatttgctt

SEQ ID NO: 396780 - DNA, 25 bp, Rattus norvegicus
gcctctttgcgtcttaaatactctc

SEQ ID NO: 396781 - DNA, 25 bp, Rattus norvegicus
gcctctttgcgtgttaaatactctc

SEQ ID NO: 396782 - DNA, 25 bp, Rattus norvegicus
gcctctttgctgaagaccccaagaa

SEQ ID NO: 396783 - DNA, 25 bp, Rattus norvegicus
gcctctttgctgtagaccccaagaa

SEQ ID NO: 396784 - DNA, 25 bp, Rattus norvegicus
gcctctttggctagtggttcagtac

SEQ ID NO: 396785 - DNA, 25 bp, Rattus norvegicus
gcctctttggcttgtggttcagtac

SEQ ID NO: 396786 - DNA, 25 bp, Rattus norvegicus
gcctctttgtccatgcacggagaga

SEQ ID NO: 396787 - DNA, 25 bp, Rattus norvegicus
gcctctttgtccttgcacggagaga

SEQ ID NO: 396788 - DNA, 25 bp, Rattus norvegicus
gcctctttgtggcttatgctaagat

SEQ ID NO: 396789 - DNA, 25 bp, Rattus norvegicus
gcctctttgtgggttatgctaagat

SEQ ID NO: 396790 - DNA, 25 bp, Rattus norvegicus
gcctcttttagtaacattcagacag

SEQ ID NO: 396791 - DNA, 25 bp, Rattus norvegicus
gcctcttttagttacattcagacag

SEQ ID NO: 396792 - DNA, 25 bp, Rattus norvegicus
gcctcttttcctcttctgagcaaga

SEQ ID NO: 396793 - DNA, 25 bp, Rattus norvegicus
gcctcttttcctgttctgagcaaga

SEQ ID NO: 396794 - DNA, 25 bp, Rattus norvegicus
gcctcttttgtcactggcagtgaaa

SEQ ID NO: 396795 - DNA, 25 bp, Rattus norvegicus
gcctcttttgtctctggcagtgaaa

SEQ ID NO: 396796 - DNA, 25 bp, Rattus norvegicus
gcctcttttgttagttgttgttatg

SEQ ID NO: 396797 - DNA, 25 bp, Rattus norvegicus
gcctcttttgtttgttgttgttatg

SEQ ID NO: 396798 - DNA, 25 bp, Rattus norvegicus
gcctgaaaatggagatgtgcctgaa

SEQ ID NO: 396799 - DNA, 25 bp, Rattus norvegicus
gcctgaaaatggtgatgtgcctgaa

SEQ ID NO: 396800 - DNA, 25 bp, Rattus norvegicus
gcctgaaactgccagctgtggtgac

SEQ ID NO: 396801 - DNA, 25 bp, Rattus norvegicus
gcctgaaactgcgagctgtggtgac

SEQ ID NO: 396802 - DNA, 25 bp, Rattus norvegicus
gcctgaaagtgtatgcatgtaccat

SEQ ID NO: 396803 - DNA, 25 bp, Rattus norvegicus
gcctgaaagtgtttgcatgtaccat

SEQ ID NO: 396804 - DNA, 25 bp, Rattus norvegicus
gcctgaaattgtctgtagtcccctc

SEQ ID NO: 396805 - DNA, 25 bp, Rattus norvegicus
gcctgaaattgtgtgtagtcccctc

SEQ ID NO: 396806 - DNA, 25 bp, Rattus norvegicus
gcctgaacccctatgtgtacatagt

SEQ ID NO: 396807 - DNA, 25 bp, Rattus norvegicus
gcctgaacccctttgtgtacatagt

SEQ ID NO: 396808 - DNA, 25 bp, Rattus norvegicus
gcctgaaccggtaaagagcccttgt

SEQ ID NO: 396809 - DNA, 25 bp, Rattus norvegicus
gcctgaaccggttaagagcccttgt

SEQ ID NO: 396810 - DNA, 25 bp, Rattus norvegicus
gcctgaacgcatcctgtggctacag

SEQ ID NO: 396811 - DNA, 25 bp, Rattus norvegicus
gcctgaacgcatgctgtggctacag

SEQ ID NO: 396812 - DNA, 25 bp, Rattus norvegicus
gcctgaagacagatgtgccccactt

SEQ ID NO: 396813 - DNA, 25 bp, Rattus norvegicus
gcctgaagacagttgtgccccactt

SEQ ID NO: 396814 - DNA, 25 bp, Rattus norvegicus
gcctgaagcccaagcagtgagctta

SEQ ID NO: 396815 - DNA, 25 bp, Rattus norvegicus
gcctgaagcccatgcagtgagctta

SEQ ID NO: 396816 - DNA, 25 bp, Rattus norvegicus
gcctgaaggctaagaattcggaact

SEQ ID NO: 396817 - DNA, 25 bp, Rattus norvegicus
gcctgaaggctatgaattcggaact

SEQ ID NO: 396818 - DNA, 25 bp, Rattus norvegicus
gcctgaaggcttcttttgtggaact

SEQ ID NO: 396819 - DNA, 25 bp, Rattus norvegicus
gcctgaaggcttgttttgtggaact

SEQ ID NO: 396820 - DNA, 25 bp, Rattus norvegicus
gcctgaaggttgctggctcacatgt

SEQ ID NO: 396821 - DNA, 25 bp, Rattus norvegicus
gcctgaaggttggtggctcacatgt

SEQ ID NO: 396822 - DNA, 25 bp, Rattus norvegicus
gcctgaagtcccagaaaagagccca

SEQ ID NO: 396823 - DNA, 25 bp, Rattus norvegicus
gcctgaagtccctgaaaagagccca

SEQ ID NO: 396824 - DNA, 25 bp, Rattus norvegicus
gcctgaagtggcctaaagatgtctt

SEQ ID NO: 396825 - DNA, 25 bp, Rattus norvegicus
gcctgaagtggcgtaaagatgtctt

SEQ ID NO: 396826 - DNA, 25 bp, Rattus norvegicus
gcctgaatctacatatccacttgat

SEQ ID NO: 396827 - DNA, 25 bp, Rattus norvegicus
gcctgaatctacttatccacttgat

SEQ ID NO: 396828 - DNA, 25 bp, Rattus norvegicus
gcctgaatctagagagctacttctt

SEQ ID NO: 396829 - DNA, 25 bp, Rattus norvegicus
gcctgaatctagtgagctacttctt

SEQ ID NO: 396830 - DNA, 25 bp, Rattus norvegicus
gcctgaatgagaagcgctgtgccta

SEQ ID NO: 396831 - DNA, 25 bp, Rattus norvegicus
gcctgaatgagatgcgctgtgccta

SEQ ID NO: 396832 - DNA, 25 bp, Rattus norvegicus
gcctgaatgttcacttttagctcac

SEQ ID NO: 396833 - DNA, 25 bp, Rattus norvegicus
gcctgaatgttctcttttagctcac

SEQ ID NO: 396834 - DNA, 25 bp, Rattus norvegicus
gcctgaattacaaactgagacccaa

SEQ ID NO: 396835 - DNA, 25 bp, Rattus norvegicus
gcctgaattacatactgagacccaa

SEQ ID NO: 396836 - DNA, 25 bp, Rattus norvegicus
gcctgaattatgctctcaaccatgt

SEQ ID NO: 396837 - DNA, 25 bp, Rattus norvegicus
gcctgaattatggtctcaaccatgt

SEQ ID NO: 396838 - DNA, 25 bp, Rattus norvegicus
gcctgaattcgactctggagccgag

SEQ ID NO: 396839 - DNA, 25 bp, Rattus norvegicus
gcctgaattcgagtctggagccgag

SEQ ID NO: 396840 - DNA, 25 bp, Rattus norvegicus
gcctgaattctgagggcacccaata

SEQ ID NO: 396841 - DNA, 25 bp, Rattus norvegicus
gcctgaattctgtgggcacccaata

SEQ ID NO: 396842 - DNA, 25 bp, Rattus norvegicus
gcctgaattgtaaatccatgtctga

SEQ ID NO: 396843 - DNA, 25 bp, Rattus norvegicus
gcctgaattgtatatccatgtctga

SEQ ID NO: 396844 - DNA, 25 bp, Rattus norvegicus
gcctgaatttgaatctgtgcctcca

SEQ ID NO: 396845 - DNA, 25 bp, Rattus norvegicus
gcctgaatttgattctgtgcctcca

SEQ ID NO: 396846 - DNA, 25 bp, Rattus norvegicus
gcctgacaaacactctaagcttgtt

SEQ ID NO: 396847 - DNA, 25 bp, Rattus norvegicus
gcctgacaaacagtctaagcttgtt

SEQ ID NO: 396848 - DNA, 25 bp, Rattus norvegicus
gcctgacaacctcaaccaacataga

SEQ ID NO: 396849 - DNA, 25 bp, Rattus norvegicus
gcctgacaacctgaaccaacataga

SEQ ID NO: 396850 - DNA, 25 bp, Rattus norvegicus
gcctgacacacactaggtatttcat

SEQ ID NO: 396851 - DNA, 25 bp, Rattus norvegicus
gcctgacacacagtaggtatttcat

SEQ ID NO: 396852 - DNA, 25 bp, Rattus norvegicus
gcctgacaccagcagctgaggagat

SEQ ID NO: 396853 - DNA, 25 bp, Rattus norvegicus
gcctgacaccaggagctgaggagat

SEQ ID NO: 396854 - DNA, 25 bp, Rattus norvegicus
gcctgacacggcaacatgagaatag

SEQ ID NO: 396855 - DNA, 25 bp, Rattus norvegicus
gcctgacacggctacatgagaatag

SEQ ID NO: 396856 - DNA, 25 bp, Rattus norvegicus
gcctgacactgtacctagctggtta

SEQ ID NO: 396857 - DNA, 25 bp, Rattus norvegicus
gcctgacactgttcctagctggtta

SEQ ID NO: 396858 - DNA, 25 bp, Rattus norvegicus
gcctgacaggacaaggtcctgggtt

SEQ ID NO: 396859 - DNA, 25 bp, Rattus norvegicus
gcctgacaggactaggtcctgggtt

SEQ ID NO: 396860 - DNA, 25 bp, Rattus norvegicus
gcctgacatccccagggtgggtaat

SEQ ID NO: 396861 - DNA, 25 bp, Rattus norvegicus
gcctgacatcccgagggtgggtaat

SEQ ID NO: 396862 - DNA, 25 bp, Rattus norvegicus
gcctgacatggtcttgatggccctg

SEQ ID NO: 396863 - DNA, 25 bp, Rattus norvegicus
gcctgacatggtgttgatggccctg

SEQ ID NO: 396864 - DNA, 25 bp, Rattus norvegicus
gcctgaccacctacggcaagatgtg

SEQ ID NO: 396865 - DNA, 25 bp, Rattus norvegicus
gcctgaccaccttcggcaagatgtg

SEQ ID NO: 396866 - DNA, 25 bp, Rattus norvegicus
gcctgaccactgaactatacaacta

SEQ ID NO: 396867 - DNA, 25 bp, Rattus norvegicus
gcctgaccactgtactatacaacta

SEQ ID NO: 396868 - DNA, 25 bp, Rattus norvegicus
gcctgaccagatcatgtagctttga

SEQ ID NO: 396869 - DNA, 25 bp, Rattus norvegicus
gcctgaccagatgatgtagctttga

SEQ ID NO: 396870 - DNA, 25 bp, Rattus norvegicus
gcctgaccataacactacagactca

SEQ ID NO: 396871 - DNA, 25 bp, Rattus norvegicus
gcctgaccataagactacagactca

SEQ ID NO: 396872 - DNA, 25 bp, Rattus norvegicus
gcctgaccatgtcagctctttgaga

SEQ ID NO: 396873 - DNA, 25 bp, Rattus norvegicus
gcctgaccatgtgagctctttgaga

SEQ ID NO: 396874 - DNA, 25 bp, Rattus norvegicus
gcctgaccccagaggagaaatgcta

SEQ ID NO: 396875 - DNA, 25 bp, Rattus norvegicus
gcctgaccccagtggagaaatgcta

SEQ ID NO: 396876 - DNA, 25 bp, Rattus norvegicus
gcctgacctcatctttaagattttt

SEQ ID NO: 396877 - DNA, 25 bp, Rattus norvegicus
gcctgacctcatgtttaagattttt

SEQ ID NO: 396878 - DNA, 25 bp, Rattus norvegicus
gcctgacctgcaagaccagctgagt

SEQ ID NO: 396879 - DNA, 25 bp, Rattus norvegicus
gcctgacctgcatgaccagctgagt

SEQ ID NO: 396880 - DNA, 25 bp, Rattus norvegicus
gcctgacctggacaaatgccgacta

SEQ ID NO: 396881 - DNA, 25 bp, Rattus norvegicus
gcctgacctggactttgctgtatgg

SEQ ID NO: 396882 - DNA, 25 bp, Rattus norvegicus
gcctgacctggagaaatgccgacta

SEQ ID NO: 396883 - DNA, 25 bp, Rattus norvegicus
gcctgacctggagtttgctgtatgg

SEQ ID NO: 396884 - DNA, 25 bp, Rattus norvegicus
gcctgacctggtacttattttaaag

SEQ ID NO: 396885 - DNA, 25 bp, Rattus norvegicus
gcctgacctggttcttattttaaag

SEQ ID NO: 396886 - DNA, 25 bp, Rattus norvegicus
gcctgacctgtactggtgctggata

SEQ ID NO: 396887 - DNA, 25 bp, Rattus norvegicus
gcctgacctgtagtggtgctggata

SEQ ID NO: 396888 - DNA, 25 bp, Rattus norvegicus
gcctgaccttaacgacagatcgaat

SEQ ID NO: 396889 - DNA, 25 bp, Rattus norvegicus
gcctgaccttaaggacagatcgaat

SEQ ID NO: 396890 - DNA, 25 bp, Rattus norvegicus
gcctgacgcgcaagctttacaaatg

SEQ ID NO: 396891 - DNA, 25 bp, Rattus norvegicus
gcctgacgcgcatgctttacaaatg

SEQ ID NO: 396892 - DNA, 25 bp, Rattus norvegicus
gcctgacgtctaaattagcatggta

SEQ ID NO: 396893 - DNA, 25 bp, Rattus norvegicus
gcctgacgtctatattagcatggta

SEQ ID NO: 396894 - DNA, 25 bp, Rattus norvegicus
gcctgactagccctttatggactga

SEQ ID NO: 396895 - DNA, 25 bp, Rattus norvegicus
gcctgactagccgtttatggactga

SEQ ID NO: 396896 - DNA, 25 bp, Rattus norvegicus
gcctgactcactatgtaacactttc

SEQ ID NO: 396897 - DNA, 25 bp, Rattus norvegicus
gcctgactcactttgtaacactttc

SEQ ID NO: 396898 - DNA, 25 bp, Rattus norvegicus
gcctgactcagtacatcgtttagtt

SEQ ID NO: 396899 - DNA, 25 bp, Rattus norvegicus
gcctgactcagttcatcgtttagtt

SEQ ID NO: 396900 - DNA, 25 bp, Rattus norvegicus
gcctgactccctatagtttctttat

SEQ ID NO: 396901 - DNA, 25 bp, Rattus norvegicus
gcctgactccctttagtttctttat

SEQ ID NO: 396902 - DNA, 25 bp, Rattus norvegicus
gcctgactcgcaccttcagatgata

SEQ ID NO: 396903 - DNA, 25 bp, Rattus norvegicus
gcctgactcgcagcttcagatgata

SEQ ID NO: 396904 - DNA, 25 bp, Rattus norvegicus
gcctgactctttccccagcatatga

SEQ ID NO: 396905 - DNA, 25 bp, Rattus norvegicus
gcctgactctttgcccagcatatga

SEQ ID NO: 396906 - DNA, 25 bp, Rattus norvegicus
gcctgactgagaactaagctgaatt

SEQ ID NO: 396907 - DNA, 25 bp, Rattus norvegicus
gcctgactgagatctaagctgaatt

SEQ ID NO: 396908 - DNA, 25 bp, Rattus norvegicus
gcctgactgtctagggccagtgaga

SEQ ID NO: 396909 - DNA, 25 bp, Rattus norvegicus
gcctgactgtcttgggccagtgaga

SEQ ID NO: 396910 - DNA, 25 bp, Rattus norvegicus
gcctgacttcccaaggagagtggat

SEQ ID NO: 396911 - DNA, 25 bp, Rattus norvegicus
gcctgacttccctaggagagtggat

SEQ ID NO: 396912 - DNA, 25 bp, Rattus norvegicus
gcctgacttttgatgtttagcctta

SEQ ID NO: 396913 - DNA, 25 bp, Rattus norvegicus
gcctgacttttgttgtttagcctta

SEQ ID NO: 396914 - DNA, 25 bp, Rattus norvegicus
gcctgagaatttaaccagacttcaa

SEQ ID NO: 396915 - DNA, 25 bp, Rattus norvegicus
gcctgagaattttaccagacttcaa

SEQ ID NO: 396916 - DNA, 25 bp, Rattus norvegicus
gcctgagacagcaatcttgtttcca

SEQ ID NO: 396917 - DNA, 25 bp, Rattus norvegicus
gcctgagacagctatcttgtttcca

SEQ ID NO: 396918 - DNA, 25 bp, Rattus norvegicus
gcctgagaccttactggactgataa

SEQ ID NO: 396919 - DNA, 25 bp, Rattus norvegicus
gcctgagacctttctggactgataa

SEQ ID NO: 396920 - DNA, 25 bp, Rattus norvegicus
gcctgagagggccaaagcggtccat

SEQ ID NO: 396921 - DNA, 25 bp, Rattus norvegicus
gcctgagagggcgaaagcggtccat

SEQ ID NO: 396922 - DNA, 25 bp, Rattus norvegicus
gcctgagagtgaatctccagtgaag

SEQ ID NO: 396923 - DNA, 25 bp, Rattus norvegicus
gcctgagagtgattctccagtgaag

SEQ ID NO: 396924 - DNA, 25 bp, Rattus norvegicus
gcctgagcaagccagacgtgaagct

SEQ ID NO: 396925 - DNA, 25 bp, Rattus norvegicus
gcctgagcaagcgagacgtgaagct

SEQ ID NO: 396926 - DNA, 25 bp, Rattus norvegicus
gcctgagcacaaaattcctcttctg

SEQ ID NO: 396927 - DNA, 25 bp, Rattus norvegicus
gcctgagcacaatattcctcttctg

SEQ ID NO: 396928 - DNA, 25 bp, Rattus norvegicus
gcctgagcagtgagtatcccatgat

SEQ ID NO: 396929 - DNA, 25 bp, Rattus norvegicus
gcctgagcagtgtgtatcccatgat

SEQ ID NO: 396930 - DNA, 25 bp, Rattus norvegicus
gcctgagcatcaattcgagacactg

SEQ ID NO: 396931 - DNA, 25 bp, Rattus norvegicus
gcctgagcatcatttcgagacactg

SEQ ID NO: 396932 - DNA, 25 bp, Rattus norvegicus
gcctgagcatgtaaatggctgcaac

SEQ ID NO: 396933 - DNA, 25 bp, Rattus norvegicus
gcctgagcatgttaatggctgcaac

SEQ ID NO: 396934 - DNA, 25 bp, Rattus norvegicus
gcctgagcctccaggtgggcaatct

SEQ ID NO: 396935 - DNA, 25 bp, Rattus norvegicus
gcctgagcctcctggtgggcaatct

SEQ ID NO: 396936 - DNA, 25 bp, Rattus norvegicus
gcctgagcctctagtcctgaaatgg

SEQ ID NO: 396937 - DNA, 25 bp, Rattus norvegicus
gcctgagcctcttgtcctgaaatgg

SEQ ID NO: 396938 - DNA, 25 bp, Rattus norvegicus
gcctgagcctggatatagcagtgca

SEQ ID NO: 396939 - DNA, 25 bp, Rattus norvegicus
gcctgagcctggttatagcagtgca

SEQ ID NO: 396940 - DNA, 25 bp, Rattus norvegicus
gcctgagcctgtcgctctaaaggga

SEQ ID NO: 396941 - DNA, 25 bp, Rattus norvegicus
gcctgagcctgtggctctaaaggga

SEQ ID NO: 396942 - DNA, 25 bp, Rattus norvegicus
gcctgagccttcctggtgcagttag

SEQ ID NO: 396943 - DNA, 25 bp, Rattus norvegicus
gcctgagccttcgtggtgcagttag

SEQ ID NO: 396944 - DNA, 25 bp, Rattus norvegicus
gcctgagctcccctgaggacgtgaa

SEQ ID NO: 396945 - DNA, 25 bp, Rattus norvegicus
gcctgagctcccgtgaggacgtgaa

SEQ ID NO: 396946 - DNA, 25 bp, Rattus norvegicus
gcctgagctctgatggatgtggact

SEQ ID NO: 396947 - DNA, 25 bp, Rattus norvegicus
gcctgagctctgttggatgtggact

SEQ ID NO: 396948 - DNA, 25 bp, Rattus norvegicus
gcctgagctgatatcttaccctaaa

SEQ ID NO: 396949 - DNA, 25 bp, Rattus norvegicus
gcctgagctgatttcttaccctaaa

SEQ ID NO: 396950 - DNA, 25 bp, Rattus norvegicus
gcctgagctgcgcaatgtcttggat

SEQ ID NO: 396951 - DNA, 25 bp, Rattus norvegicus
gcctgagctgcggaatgtcttggat

SEQ ID NO: 396952 - DNA, 25 bp, Rattus norvegicus
gcctgagctgctatgacctttgtag

SEQ ID NO: 396953 - DNA, 25 bp, Rattus norvegicus
gcctgagctgctttgacctttgtag

SEQ ID NO: 396954 - DNA, 25 bp, Rattus norvegicus
gcctgagctggcacaaccaaatgga

SEQ ID NO: 396955 - DNA, 25 bp, Rattus norvegicus
gcctgagctggctcaaccaaatgga

SEQ ID NO: 396956 - DNA, 25 bp, Rattus norvegicus
gcctgaggaccccaccaagaaggga

SEQ ID NO: 396957 - DNA, 25 bp, Rattus norvegicus
gcctgaggaccccgcctacataggg

SEQ ID NO: 396958 - DNA, 25 bp, Rattus norvegicus
gcctgaggacccgaccaagaaggga

SEQ ID NO: 396959 - DNA, 25 bp, Rattus norvegicus
gcctgaggacccggcctacataggg

SEQ ID NO: 396960 - DNA, 25 bp, Rattus norvegicus
gcctgaggagttcttcatcccatac

SEQ ID NO: 396961 - DNA, 25 bp, Rattus norvegicus
gcctgaggagttgttcatcccatac

SEQ ID NO: 396962 - DNA, 25 bp, Rattus norvegicus
gcctgaggcacactttctgcactaa

SEQ ID NO: 396963 - DNA, 25 bp, Rattus norvegicus
gcctgaggcacagtttctgcactaa

SEQ ID NO: 396964 - DNA, 25 bp, Rattus norvegicus
gcctgaggcaccaggtcgtagtaga

SEQ ID NO: 396965 - DNA, 25 bp, Rattus norvegicus
gcctgaggcacctggtcgtagtaga

SEQ ID NO: 396966 - DNA, 25 bp, Rattus norvegicus
gcctgaggccttctcatatgcaata

SEQ ID NO: 396967 - DNA, 25 bp, Rattus norvegicus
gcctgaggccttgtcatatgcaata

SEQ ID NO: 396968 - DNA, 25 bp, Rattus norvegicus
gcctgaggctccatgaataccagta

SEQ ID NO: 396969 - DNA, 25 bp, Rattus norvegicus
gcctgaggctccatttcatgacaag

SEQ ID NO: 396970 - DNA, 25 bp, Rattus norvegicus
gcctgaggctccttgaataccagta

SEQ ID NO: 396971 - DNA, 25 bp, Rattus norvegicus
gcctgaggctccttttcatgacaag

SEQ ID NO: 396972 - DNA, 25 bp, Rattus norvegicus
gcctgaggctgtatattgatgcaca

SEQ ID NO: 396973 - DNA, 25 bp, Rattus norvegicus
gcctgaggctgtttattgatgcaca

SEQ ID NO: 396974 - DNA, 25 bp, Rattus norvegicus
gcctgagggacaaccggtagcagac

SEQ ID NO: 396975 - DNA, 25 bp, Rattus norvegicus
gcctgagggacatccggtagcagac

SEQ ID NO: 396976 - DNA, 25 bp, Rattus norvegicus
gcctgaggtatcacggctgtccccg

SEQ ID NO: 396977 - DNA, 25 bp, Rattus norvegicus
gcctgaggtatctcggctgtccccg

SEQ ID NO: 396978 - DNA, 25 bp, Rattus norvegicus
gcctgagtacacacagcagcttata

SEQ ID NO: 396979 - DNA, 25 bp, Rattus norvegicus
gcctgagtacactcagcagcttata

SEQ ID NO: 396980 - DNA, 25 bp, Rattus norvegicus
gcctgagtaccacatgtgtatgctt

SEQ ID NO: 396981 - DNA, 25 bp, Rattus norvegicus
gcctgagtaccagatgtgtatgctt

SEQ ID NO: 396982 - DNA, 25 bp, Rattus norvegicus
gcctgagtcactagttacacacaca

SEQ ID NO: 396983 - DNA, 25 bp, Rattus norvegicus
gcctgagtcacttgttacacacaca

SEQ ID NO: 396984 - DNA, 25 bp, Rattus norvegicus
gcctgagtcctgatggtgtgagcca

SEQ ID NO: 396985 - DNA, 25 bp, Rattus norvegicus
gcctgagtcctgttggtgtgagcca

SEQ ID NO: 396986 - DNA, 25 bp, Rattus norvegicus
gcctgagtctctccgtatggatgta

SEQ ID NO: 396987 - DNA, 25 bp, Rattus norvegicus
gcctgagtctctgcgtatggatgta

SEQ ID NO: 396988 - DNA, 25 bp, Rattus norvegicus
gcctgagtgtgcctgccaaattgga

SEQ ID NO: 396989 - DNA, 25 bp, Rattus norvegicus
gcctgagtgtgcgtgccaaattgga

SEQ ID NO: 396990 - DNA, 25 bp, Rattus norvegicus
gcctgagttacaacagaacccttta

SEQ ID NO: 396991 - DNA, 25 bp, Rattus norvegicus
gcctgagttacatcagaacccttta

SEQ ID NO: 396992 - DNA, 25 bp, Rattus norvegicus
gcctgagttgaacaagtgacactgt

SEQ ID NO: 396993 - DNA, 25 bp, Rattus norvegicus
gcctgagttgaagaagtgacactgt

SEQ ID NO: 396994 - DNA, 25 bp, Rattus norvegicus
gcctgagttggcagtgttcccacta

SEQ ID NO: 396995 - DNA, 25 bp, Rattus norvegicus
gcctgagttggctgtgttcccacta

SEQ ID NO: 396996 - DNA, 25 bp, Rattus norvegicus
gcctgataaactcagctgccgtgat

SEQ ID NO: 396997 - DNA, 25 bp, Rattus norvegicus
gcctgataaactgagctgccgtgat

SEQ ID NO: 396998 - DNA, 25 bp, Rattus norvegicus
gcctgataacctactgtgttttctt

SEQ ID NO: 396999 - DNA, 25 bp, Rattus norvegicus
gcctgataaccttctgtgttttctt

SEQ ID NO: 397000 - DNA, 25 bp, Rattus norvegicus
gcctgataagcactggcccctggga

SEQ ID NO: 397001 - DNA, 25 bp, Rattus norvegicus
gcctgataagcagtggcccctggga

SEQ ID NO: 397002 - DNA, 25 bp, Rattus norvegicus
gcctgataaggaccatttcacttct

SEQ ID NO: 397003 - DNA, 25 bp, Rattus norvegicus
gcctgataaggagcatttcacttct

SEQ ID NO: 397004 - DNA, 25 bp, Rattus norvegicus
gcctgatagcgtcttgcttttgtaa

SEQ ID NO: 397005 - DNA, 25 bp, Rattus norvegicus
gcctgatagcgtgttgcttttgtaa

SEQ ID NO: 397006 - DNA, 25 bp, Rattus norvegicus
gcctgatcaatcctatgccaagtat

SEQ ID NO: 397007 - DNA, 25 bp, Rattus norvegicus
gcctgatcaatcgtatgccaagtat

SEQ ID NO: 397008 - DNA, 25 bp, Rattus norvegicus
gcctgatcagcactggccaacagta

SEQ ID NO: 397009 - DNA, 25 bp, Rattus norvegicus
gcctgatcagcagtggccaacagta

SEQ ID NO: 397010 - DNA, 25 bp, Rattus norvegicus
gcctgatcctgccaatggagttaaa

SEQ ID NO: 397011 - DNA, 25 bp, Rattus norvegicus
gcctgatcctgcgaatggagttaaa

SEQ ID NO: 397012 - DNA, 25 bp, Rattus norvegicus
gcctgatgcgggatgcggatgatct

SEQ ID NO: 397013 - DNA, 25 bp, Rattus norvegicus
gcctgatgcgggttgcggatgatct

SEQ ID NO: 397014 - DNA, 25 bp, Rattus norvegicus
gcctgatggcctcaggtggattcat

SEQ ID NO: 397015 - DNA, 25 bp, Rattus norvegicus
gcctgatggcctgaggtggattcat

SEQ ID NO: 397016 - DNA, 25 bp, Rattus norvegicus
gcctgatgtgtgagtaagccggaac

SEQ ID NO: 397017 - DNA, 25 bp, Rattus norvegicus
gcctgatgtgtgtgtaagccggaac

SEQ ID NO: 397018 - DNA, 25 bp, Rattus norvegicus
gcctgattagatacttgatccagcc

SEQ ID NO: 397019 - DNA, 25 bp, Rattus norvegicus
gcctgattagattcttgatccagcc

SEQ ID NO: 397020 - DNA, 25 bp, Rattus norvegicus
gcctgattccagctgggtacttgaa

SEQ ID NO: 397021 - DNA, 25 bp, Rattus norvegicus
gcctgattccaggtgggtacttgaa

SEQ ID NO: 397022 - DNA, 25 bp, Rattus norvegicus
gcctgattcccaaacttgcaatttc

SEQ ID NO: 397023 - DNA, 25 bp, Rattus norvegicus
gcctgattcccatacttgcaatttc

SEQ ID NO: 397024 - DNA, 25 bp, Rattus norvegicus
gcctgattcctgacgctgtaatgaa

SEQ ID NO: 397025 - DNA, 25 bp, Rattus norvegicus
gcctgattcctgtcgctgtaatgaa

SEQ ID NO: 397026 - DNA, 25 bp, Rattus norvegicus
gcctgatttttacatacagcgcttc

SEQ ID NO: 397027 - DNA, 25 bp, Rattus norvegicus
gcctgatttttagatacagcgcttc

SEQ ID NO: 397028 - DNA, 25 bp, Rattus norvegicus
gcctgcaaacgcactttttcaagtc

SEQ ID NO: 397029 - DNA, 25 bp, Rattus norvegicus
gcctgcaaacgctctttttcaagtc

SEQ ID NO: 397030 - DNA, 25 bp, Rattus norvegicus
gcctgcaagcacacatagaaagtct

SEQ ID NO: 397031 - DNA, 25 bp, Rattus norvegicus
gcctgcaagcactcatagaaagtct

SEQ ID NO: 397032 - DNA, 25 bp, Rattus norvegicus
gcctgcacaaaacccggctttgaat

SEQ ID NO: 397033 - DNA, 25 bp, Rattus norvegicus
gcctgcacaaaagccggctttgaat

SEQ ID NO: 397034 - DNA, 25 bp, Rattus norvegicus
gcctgcacaaagagagtcctcgtaa

SEQ ID NO: 397035 - DNA, 25 bp, Rattus norvegicus
gcctgcacaaagtgagtcctcgtaa

SEQ ID NO: 397036 - DNA, 25 bp, Rattus norvegicus
gcctgcacaacaaactgggtctctt

SEQ ID NO: 397037 - DNA, 25 bp, Rattus norvegicus
gcctgcacaacatactgggtctctt

SEQ ID NO: 397038 - DNA, 25 bp, Rattus norvegicus
gcctgcacacgtatggcgacgagaa

SEQ ID NO: 397039 - DNA, 25 bp, Rattus norvegicus
gcctgcacacgtttggcgacgagaa

SEQ ID NO: 397040 - DNA, 25 bp, Rattus norvegicus
gcctgcacagagagcatgagtgtgt

SEQ ID NO: 397041 - DNA, 25 bp, Rattus norvegicus
gcctgcacagagtgcatgagtgtgt

SEQ ID NO: 397042 - DNA, 25 bp, Rattus norvegicus
gcctgcacagtgagaaccttagact

SEQ ID NO: 397043 - DNA, 25 bp, Rattus norvegicus
gcctgcacagtgtgaaccttagact

SEQ ID NO: 397044 - DNA, 25 bp, Rattus norvegicus
gcctgcacccatacctatagaagta

SEQ ID NO: 397045 - DNA, 25 bp, Rattus norvegicus
gcctgcacccattcctatagaagta

SEQ ID NO: 397046 - DNA, 25 bp, Rattus norvegicus
gcctgcaccgcactctagaatgctg

SEQ ID NO: 397047 - DNA, 25 bp, Rattus norvegicus
gcctgcaccgcagtctagaatgctg

SEQ ID NO: 397048 - DNA, 25 bp, Rattus norvegicus
gcctgcacctccagtagtagacgaa

SEQ ID NO: 397049 - DNA, 25 bp, Rattus norvegicus
gcctgcacctcctgtagtagacgaa

SEQ ID NO: 397050 - DNA, 25 bp, Rattus norvegicus
gcctgcactcagaccaacttggaaa

SEQ ID NO: 397051 - DNA, 25 bp, Rattus norvegicus
gcctgcactcagtccaacttggaaa

SEQ ID NO: 397052 - DNA, 25 bp, Rattus norvegicus
gcctgcactgttcattgtctggtaa

SEQ ID NO: 397053 - DNA, 25 bp, Rattus norvegicus
gcctgcactgttgattgtctggtaa

SEQ ID NO: 397054 - DNA, 25 bp, Rattus norvegicus
gcctgcacttgtacagtttgggttt

SEQ ID NO: 397055 - DNA, 25 bp, Rattus norvegicus
gcctgcacttgttcagtttgggttt

SEQ ID NO: 397056 - DNA, 25 bp, Rattus norvegicus
gcctgcagacacacaatgtgcaaac

SEQ ID NO: 397057 - DNA, 25 bp, Rattus norvegicus
gcctgcagacactcaatgtgcaaac

SEQ ID NO: 397058 - DNA, 25 bp, Rattus norvegicus
gcctgcagagttcagccttgtgtat

SEQ ID NO: 397059 - DNA, 25 bp, Rattus norvegicus
gcctgcagagttgagccttgtgtat

SEQ ID NO: 397060 - DNA, 25 bp, Rattus norvegicus
gcctgcagatcgaccagatgttcgc

SEQ ID NO: 397061 - DNA, 25 bp, Rattus norvegicus
gcctgcagatcgtccagatgttcgc

SEQ ID NO: 397062 - DNA, 25 bp, Rattus norvegicus
gcctgcagatgcaatgaatgcccct

SEQ ID NO: 397063 - DNA, 25 bp, Rattus norvegicus
gcctgcagatgctatgaatgcccct

SEQ ID NO: 397064 - DNA, 25 bp, Rattus norvegicus
gcctgcagcagaacactgaccagaa

SEQ ID NO: 397065 - DNA, 25 bp, Rattus norvegicus
gcctgcagcagatcactgaccagaa

SEQ ID NO: 397066 - DNA, 25 bp, Rattus norvegicus
gcctgcagcattatttctaacttat

SEQ ID NO: 397067 - DNA, 25 bp, Rattus norvegicus
gcctgcagcattttttctaacttat

SEQ ID NO: 397068 - DNA, 25 bp, Rattus norvegicus
gcctgcagctaaactttgctacttt

SEQ ID NO: 397069 - DNA, 25 bp, Rattus norvegicus
gcctgcagctaatctttgctacttt

SEQ ID NO: 397070 - DNA, 25 bp, Rattus norvegicus
gcctgcaggcctacacggaagtgaa

SEQ ID NO: 397071 - DNA, 25 bp, Rattus norvegicus
gcctgcaggcctcacgggttaattt

SEQ ID NO: 397072 - DNA, 25 bp, Rattus norvegicus
gcctgcaggcctgacgggttaattt

SEQ ID NO: 397073 - DNA, 25 bp, Rattus norvegicus
gcctgcaggccttcacggaagtgaa

SEQ ID NO: 397074 - DNA, 25 bp, Rattus norvegicus
gcctgcaggtgtacatggatcattt

SEQ ID NO: 397075 - DNA, 25 bp, Rattus norvegicus
gcctgcaggtgttcatggatcattt

SEQ ID NO: 397076 - DNA, 25 bp, Rattus norvegicus
gcctgcagtctgacattcgatattt

SEQ ID NO: 397077 - DNA, 25 bp, Rattus norvegicus
gcctgcagtctgtcattcgatattt

SEQ ID NO: 397078 - DNA, 25 bp, Rattus norvegicus
gcctgcagtgccattttatttatat

SEQ ID NO: 397079 - DNA, 25 bp, Rattus norvegicus
gcctgcagtgcctttttatttatat

SEQ ID NO: 397080 - DNA, 25 bp, Rattus norvegicus
gcctgcagtggtacagaggagacct

SEQ ID NO: 397081 - DNA, 25 bp, Rattus norvegicus
gcctgcagtggttcagaggagacct

SEQ ID NO: 397082 - DNA, 25 bp, Rattus norvegicus
gcctgcagtgtcatgcttttaacta

SEQ ID NO: 397083 - DNA, 25 bp, Rattus norvegicus
gcctgcagtgtcttgcttttaacta

SEQ ID NO: 397084 - DNA, 25 bp, Rattus norvegicus
gcctgcagtgtgaccatgtctgtta

SEQ ID NO: 397085 - DNA, 25 bp, Rattus norvegicus
gcctgcagtgtgtccatgtctgtta

SEQ ID NO: 397086 - DNA, 25 bp, Rattus norvegicus
gcctgcagttagatggaagagtcct

SEQ ID NO: 397087 - DNA, 25 bp, Rattus norvegicus
gcctgcagttagttggaagagtcct

SEQ ID NO: 397088 - DNA, 25 bp, Rattus norvegicus
gcctgcatattacttttgctatttt

SEQ ID NO: 397089 - DNA, 25 bp, Rattus norvegicus
gcctgcatattagttttgctatttt

SEQ ID NO: 397090 - DNA, 25 bp, Rattus norvegicus
gcctgcatccagaagcacaaaggga

SEQ ID NO: 397091 - DNA, 25 bp, Rattus norvegicus
gcctgcatccagatttcaacagcaa

SEQ ID NO: 397092 - DNA, 25 bp, Rattus norvegicus
gcctgcatccagtagcacaaaggga

SEQ ID NO: 397093 - DNA, 25 bp, Rattus norvegicus
gcctgcatccagttttcaacagcaa

SEQ ID NO: 397094 - DNA, 25 bp, Rattus norvegicus
gcctgcatcttcagtgatccatgga

SEQ ID NO: 397095 - DNA, 25 bp, Rattus norvegicus
gcctgcatcttctgtgatccatgga

SEQ ID NO: 397096 - DNA, 25 bp, Rattus norvegicus
gcctgcattctgaaatatcttaaca

SEQ ID NO: 397097 - DNA, 25 bp, Rattus norvegicus
gcctgcattctgaccttatttatag

SEQ ID NO: 397098 - DNA, 25 bp, Rattus norvegicus
gcctgcattctgtaatatcttaaca

SEQ ID NO: 397099 - DNA, 25 bp, Rattus norvegicus
gcctgcattctgtccttatttatag

SEQ ID NO: 397100 - DNA, 25 bp, Rattus norvegicus
gcctgcattgtactcctttgtgtat

SEQ ID NO: 397101 - DNA, 25 bp, Rattus norvegicus
gcctgcattgtagtcctttgtgtat

SEQ ID NO: 397102 - DNA, 25 bp, Rattus norvegicus
gcctgccaaacgagcctttgattag

SEQ ID NO: 397103 - DNA, 25 bp, Rattus norvegicus
gcctgccaaacgtgcctttgattag

SEQ ID NO: 397104 - DNA, 25 bp, Rattus norvegicus
gcctgccaaaggcttgtagtgtctt

SEQ ID NO: 397105 - DNA, 25 bp, Rattus norvegicus
gcctgccaaagggttgtagtgtctt

SEQ ID NO: 397106 - DNA, 25 bp, Rattus norvegicus
gcctgccaaatgagtacggttctca

SEQ ID NO: 397107 - DNA, 25 bp, Rattus norvegicus
gcctgccaaatgtgtacggttctca

SEQ ID NO: 397108 - DNA, 25 bp, Rattus norvegicus
gcctgccaattactgccatatgtga

SEQ ID NO: 397109 - DNA, 25 bp, Rattus norvegicus
gcctgccaattagtgccatatgtga

SEQ ID NO: 397110 - DNA, 25 bp, Rattus norvegicus
gcctgccacaatccacggtggaact

SEQ ID NO: 397111 - DNA, 25 bp, Rattus norvegicus
gcctgccacaatgcacggtggaact

SEQ ID NO: 397112 - DNA, 25 bp, Rattus norvegicus
gcctgccacaggcagacaaacttta

SEQ ID NO: 397113 - DNA, 25 bp, Rattus norvegicus
gcctgccacagggagacaaacttta

SEQ ID NO: 397114 - DNA, 25 bp, Rattus norvegicus
gcctgccacataccccttaggaaaa

SEQ ID NO: 397115 - DNA, 25 bp, Rattus norvegicus
gcctgccacatagcccttaggaaaa

SEQ ID NO: 397116 - DNA, 25 bp, Rattus norvegicus
gcctgccaccttactgtattaaata

SEQ ID NO: 397117 - DNA, 25 bp, Rattus norvegicus
gcctgccacctttctgtattaaata

SEQ ID NO: 397118 - DNA, 25 bp, Rattus norvegicus
gcctgccagactatatttagctttt

SEQ ID NO: 397119 - DNA, 25 bp, Rattus norvegicus
gcctgccagactttatttagctttt

SEQ ID NO: 397120 - DNA, 25 bp, Rattus norvegicus
gcctgccagataccagttcaactga

SEQ ID NO: 397121 - DNA, 25 bp, Rattus norvegicus
gcctgccagatagcagttcaactga

SEQ ID NO: 397122 - DNA, 25 bp, Rattus norvegicus
gcctgccagatcaaaagacttagca

SEQ ID NO: 397123 - DNA, 25 bp, Rattus norvegicus
gcctgccagatcatcaaactttttt

SEQ ID NO: 397124 - DNA, 25 bp, Rattus norvegicus
gcctgccagatctaaagacttagca

SEQ ID NO: 397125 - DNA, 25 bp, Rattus norvegicus
gcctgccagatcttcaaactttttt

SEQ ID NO: 397126 - DNA, 25 bp, Rattus norvegicus
gcctgccagggacaaatgacatcat

SEQ ID NO: 397127 - DNA, 25 bp, Rattus norvegicus
gcctgccagggagaaatgacatcat

SEQ ID NO: 397128 - DNA, 25 bp, Rattus norvegicus
gcctgccatgagagactgtggtgct

SEQ ID NO: 397129 - DNA, 25 bp, Rattus norvegicus
gcctgccatgagtgactgtggtgct

SEQ ID NO: 397130 - DNA, 25 bp, Rattus norvegicus
gcctgccatggacgtgcatgcctgt

SEQ ID NO: 397131 - DNA, 25 bp, Rattus norvegicus
gcctgccatggaggtgcatgcctgt

SEQ ID NO: 397132 - DNA, 25 bp, Rattus norvegicus
gcctgcccacagcactgaaggattt

SEQ ID NO: 397133 - DNA, 25 bp, Rattus norvegicus
gcctgcccacaggactgaaggattt

SEQ ID NO: 397134 - DNA, 25 bp, Rattus norvegicus
gcctgcccagtgcagcccagagtag

SEQ ID NO: 397135 - DNA, 25 bp, Rattus norvegicus
gcctgcccagtggagcccagagtag

SEQ ID NO: 397136 - DNA, 25 bp, Rattus norvegicus
gcctgcccatctagtatatagctat

SEQ ID NO: 397137 - DNA, 25 bp, Rattus norvegicus
gcctgcccatcttgtatatagctat

SEQ ID NO: 397138 - DNA, 25 bp, Rattus norvegicus
gcctgcccatgtaagtgctgattag

SEQ ID NO: 397139 - DNA, 25 bp, Rattus norvegicus
gcctgcccatgttagtgctgattag

SEQ ID NO: 397140 - DNA, 25 bp, Rattus norvegicus
gcctgcccattgatactcagtacta

SEQ ID NO: 397141 - DNA, 25 bp, Rattus norvegicus
gcctgcccattgttactcagtacta

SEQ ID NO: 397142 - DNA, 25 bp, Rattus norvegicus
gcctgccccaaaatatttcttacat

SEQ ID NO: 397143 - DNA, 25 bp, Rattus norvegicus
gcctgccccaaattatttcttacat

SEQ ID NO: 397144 - DNA, 25 bp, Rattus norvegicus
gcctgcccctctacatagaaatatg

SEQ ID NO: 397145 - DNA, 25 bp, Rattus norvegicus
gcctgcccctcttcatagaaatatg

SEQ ID NO: 397146 - DNA, 25 bp, Rattus norvegicus
gcctgcccgctgatgtaaaataatc

SEQ ID NO: 397147 - DNA, 25 bp, Rattus norvegicus
gcctgcccgctgttgtaaaataatc

SEQ ID NO: 397148 - DNA, 25 bp, Rattus norvegicus
gcctgcccggtcacttaggagacaa

SEQ ID NO: 397149 - DNA, 25 bp, Rattus norvegicus
gcctgcccggtctcttaggagacaa

SEQ ID NO: 397150 - DNA, 25 bp, Rattus norvegicus
gcctgcccttcaatttctgtgagac

SEQ ID NO: 397151 - DNA, 25 bp, Rattus norvegicus
gcctgcccttcattttctgtgagac

SEQ ID NO: 397152 - DNA, 25 bp, Rattus norvegicus
gcctgcccttctcaaagtagtggta

SEQ ID NO: 397153 - DNA, 25 bp, Rattus norvegicus
gcctgcccttctgaaagtagtggta

SEQ ID NO: 397154 - DNA, 25 bp, Rattus norvegicus
gcctgccgctcaaaagtattactac

SEQ ID NO: 397155 - DNA, 25 bp, Rattus norvegicus
gcctgccgctcataagtattactac

SEQ ID NO: 397156 - DNA, 25 bp, Rattus norvegicus
gcctgcctataaactcaacacttga

SEQ ID NO: 397157 - DNA, 25 bp, Rattus norvegicus
gcctgcctataatctcaacacttga

SEQ ID NO: 397158 - DNA, 25 bp, Rattus norvegicus
gcctgcctatcccataacttattta

SEQ ID NO: 397159 - DNA, 25 bp, Rattus norvegicus
gcctgcctatccgataacttattta

SEQ ID NO: 397160 - DNA, 25 bp, Rattus norvegicus
gcctgcctcatgcttccgacaagaa

SEQ ID NO: 397161 - DNA, 25 bp, Rattus norvegicus
gcctgcctcatggttccgacaagaa

SEQ ID NO: 397162 - DNA, 25 bp, Rattus norvegicus
gcctgcctcgaaaacacattcttga

SEQ ID NO: 397163 - DNA, 25 bp, Rattus norvegicus
gcctgcctcgaatacacattcttga

SEQ ID NO: 397164 - DNA, 25 bp, Rattus norvegicus
gcctgcctgaacactttttctaatt

SEQ ID NO: 397165 - DNA, 25 bp, Rattus norvegicus
gcctgcctgaactctttttctaatt

SEQ ID NO: 397166 - DNA, 25 bp, Rattus norvegicus
gcctgcctgaggatgttactaggtt

SEQ ID NO: 397167 - DNA, 25 bp, Rattus norvegicus
gcctgcctgaggttgttactaggtt

SEQ ID NO: 397168 - DNA, 25 bp, Rattus norvegicus
gcctgcctgcagagccaggccaaga

SEQ ID NO: 397169 - DNA, 25 bp, Rattus norvegicus
gcctgcctgcagtgccaggccaaga

SEQ ID NO: 397170 - DNA, 25 bp, Rattus norvegicus
gcctgcctgctgaaagagccggaat

SEQ ID NO: 397171 - DNA, 25 bp, Rattus norvegicus
gcctgcctgctgtaagagccggaat

SEQ ID NO: 397172 - DNA, 25 bp, Rattus norvegicus
gcctgcctggtacagcattgtgcaa

SEQ ID NO: 397173 - DNA, 25 bp, Rattus norvegicus
gcctgcctggtagagcattgtgcaa

SEQ ID NO: 397174 - DNA, 25 bp, Rattus norvegicus
gcctgcctgtctctaggagaggcca

SEQ ID NO: 397175 - DNA, 25 bp, Rattus norvegicus
gcctgcctgtctgtaggagaggcca

SEQ ID NO: 397176 - DNA, 25 bp, Rattus norvegicus
gcctgccttcctagtgagaaatcat

SEQ ID NO: 397177 - DNA, 25 bp, Rattus norvegicus
gcctgccttccttgtgagaaatcat

SEQ ID NO: 397178 - DNA, 25 bp, Rattus norvegicus
gcctgccttctgagtgtaagttaga

SEQ ID NO: 397179 - DNA, 25 bp, Rattus norvegicus
gcctgccttctgtgtgtaagttaga

SEQ ID NO: 397180 - DNA, 25 bp, Rattus norvegicus
gcctgcctttatattcatgcctgta

SEQ ID NO: 397181 - DNA, 25 bp, Rattus norvegicus
gcctgcctttattttcatgcctgta

SEQ ID NO: 397182 - DNA, 25 bp, Rattus norvegicus
gcctgcctttgacggtccagagatg

SEQ ID NO: 397183 - DNA, 25 bp, Rattus norvegicus
gcctgcctttgagggtccagagatg

SEQ ID NO: 397184 - DNA, 25 bp, Rattus norvegicus
gcctgcctttgtataaatgcttgga

SEQ ID NO: 397185 - DNA, 25 bp, Rattus norvegicus
gcctgcctttgtttaaatgcttgga

SEQ ID NO: 397186 - DNA, 25 bp, Rattus norvegicus
gcctgcgaaggccaattttagtatc

SEQ ID NO: 397187 - DNA, 25 bp, Rattus norvegicus
gcctgcgaaggcgaattttagtatc

SEQ ID NO: 397188 - DNA, 25 bp, Rattus norvegicus
gcctgcgagtgcctgcgctataaat

SEQ ID NO: 397189 - DNA, 25 bp, Rattus norvegicus
gcctgcgagtgcgtgcgctataaat

SEQ ID NO: 397190 - DNA, 25 bp, Rattus norvegicus
gcctgcgcaaggcactcattcaatt

SEQ ID NO: 397191 - DNA, 25 bp, Rattus norvegicus
gcctgcgcaagggactcattcaatt

SEQ ID NO: 397192 - DNA, 25 bp, Rattus norvegicus
gcctgcgccaaacctattccattaa

SEQ ID NO: 397193 - DNA, 25 bp, Rattus norvegicus
gcctgcgccaaagctattccattaa

SEQ ID NO: 397194 - DNA, 25 bp, Rattus norvegicus
gcctgcgcccagcaaggacttctta

SEQ ID NO: 397195 - DNA, 25 bp, Rattus norvegicus
gcctgcgcccaggaaggacttctta

SEQ ID NO: 397196 - DNA, 25 bp, Rattus norvegicus
gcctgcgcgagactgagtgtttcct

SEQ ID NO: 397197 - DNA, 25 bp, Rattus norvegicus
gcctgcgcgagagtgagtgtttcct

SEQ ID NO: 397198 - DNA, 25 bp, Rattus norvegicus
gcctgcgctaatatcttctcaaaaa

SEQ ID NO: 397199 - DNA, 25 bp, Rattus norvegicus
gcctgcgctaatttcttctcaaaaa

SEQ ID NO: 397200 - DNA, 25 bp, Rattus norvegicus
gcctgcgctcacagtggtaagggct

SEQ ID NO: 397201 - DNA, 25 bp, Rattus norvegicus
gcctgcgctcactgtggtaagggct

SEQ ID NO: 397202 - DNA, 25 bp, Rattus norvegicus
gcctgcggaattaaggaactctcct

SEQ ID NO: 397203 - DNA, 25 bp, Rattus norvegicus
gcctgcggaatttaggaactctcct

SEQ ID NO: 397204 - DNA, 25 bp, Rattus norvegicus
gcctgcggactcaaccataaaatga

SEQ ID NO: 397205 - DNA, 25 bp, Rattus norvegicus
gcctgcggactctaccataaaatga

SEQ ID NO: 397206 - DNA, 25 bp, Rattus norvegicus
gcctgcggagccagctgaggaaaca

SEQ ID NO: 397207 - DNA, 25 bp, Rattus norvegicus
gcctgcggagcctgctgaggaaaca

SEQ ID NO: 397208 - DNA, 25 bp, Rattus norvegicus
gcctgcggaggaagcagcactcact

SEQ ID NO: 397209 - DNA, 25 bp, Rattus norvegicus
gcctgcggaggatgcagcactcact

SEQ ID NO: 397210 - DNA, 25 bp, Rattus norvegicus
gcctgcggaggcattcttatctcgg

SEQ ID NO: 397211 - DNA, 25 bp, Rattus norvegicus
gcctgcggaggctttcttatctcgg

SEQ ID NO: 397212 - DNA, 25 bp, Rattus norvegicus
gcctgcgtcagtatgttccacggaa

SEQ ID NO: 397213 - DNA, 25 bp, Rattus norvegicus
gcctgcgtcagtttgttccacggaa

SEQ ID NO: 397214 - DNA, 25 bp, Rattus norvegicus
gcctgcgtttcaagtaatatgtgtc

SEQ ID NO: 397215 - DNA, 25 bp, Rattus norvegicus
gcctgcgtttcatgtaatatgtgtc

SEQ ID NO: 397216 - DNA, 25 bp, Rattus norvegicus
gcctgcgtttggaaaattgctggat

SEQ ID NO: 397217 - DNA, 25 bp, Rattus norvegicus
gcctgcgtttggtaaattgctggat

SEQ ID NO: 397218 - DNA, 25 bp, Rattus norvegicus
gcctgcgtttgtcctgagcttctca

SEQ ID NO: 397219 - DNA, 25 bp, Rattus norvegicus
gcctgcgtttgtgctgagcttctca

SEQ ID NO: 397220 - DNA, 25 bp, Rattus norvegicus
gcctgctacgacagttaaccagcgt

SEQ ID NO: 397221 - DNA, 25 bp, Rattus norvegicus
gcctgctacgactgttaaccagcgt

SEQ ID NO: 397222 - DNA, 25 bp, Rattus norvegicus
gcctgctagatgatgtctgtgccta

SEQ ID NO: 397223 - DNA, 25 bp, Rattus norvegicus
gcctgctagatgttgtctgtgccta

SEQ ID NO: 397224 - DNA, 25 bp, Rattus norvegicus
gcctgctaggttagactgacaccga

SEQ ID NO: 397225 - DNA, 25 bp, Rattus norvegicus
gcctgctaggtttgactgacaccga

SEQ ID NO: 397226 - DNA, 25 bp, Rattus norvegicus
gcctgctatagtaagtaggaaccac

SEQ ID NO: 397227 - DNA, 25 bp, Rattus norvegicus
gcctgctatagttagtaggaaccac

SEQ ID NO: 397228 - DNA, 25 bp, Rattus norvegicus
gcctgctatcccaagtttctaggag

SEQ ID NO: 397229 - DNA, 25 bp, Rattus norvegicus
gcctgctatccctagtttctaggag

SEQ ID NO: 397230 - DNA, 25 bp, Rattus norvegicus
gcctgctatttcctccttaatttat

SEQ ID NO: 397231 - DNA, 25 bp, Rattus norvegicus
gcctgctatttcgtccttaatttat

SEQ ID NO: 397232 - DNA, 25 bp, Rattus norvegicus
gcctgctcctatctcaaagtttata

SEQ ID NO: 397233 - DNA, 25 bp, Rattus norvegicus
gcctgctcctatgtcaaagtttata

SEQ ID NO: 397234 - DNA, 25 bp, Rattus norvegicus
gcctgctcctggcatttcaataaaa

SEQ ID NO: 397235 - DNA, 25 bp, Rattus norvegicus
gcctgctcctgggatttcaataaaa

SEQ ID NO: 397236 - DNA, 25 bp, Rattus norvegicus
gcctgctcggcgagtggaaagactt

SEQ ID NO: 397237 - DNA, 25 bp, Rattus norvegicus
gcctgctcggcgtgtggaaagactt

SEQ ID NO: 397238 - DNA, 25 bp, Rattus norvegicus
gcctgctctagaagacagactctgg

SEQ ID NO: 397239 - DNA, 25 bp, Rattus norvegicus
gcctgctctagatgacagactctgg

SEQ ID NO: 397240 - DNA, 25 bp, Rattus norvegicus
gcctgctctgtaaactgaccttgaa

SEQ ID NO: 397241 - DNA, 25 bp, Rattus norvegicus
gcctgctctgtatactgaccttgaa

SEQ ID NO: 397242 - DNA, 25 bp, Rattus norvegicus
gcctgctgaaggacatggatcggta

SEQ ID NO: 397243 - DNA, 25 bp, Rattus norvegicus
gcctgctgaaggtcatggatcggta

SEQ ID NO: 397244 - DNA, 25 bp, Rattus norvegicus
gcctgctgacctccttatggaaaag

SEQ ID NO: 397245 - DNA, 25 bp, Rattus norvegicus
gcctgctgacctgcttatggaaaag

SEQ ID NO: 397246 - DNA, 25 bp, Rattus norvegicus
gcctgctgagcaatgtgaatgtctg

SEQ ID NO: 397247 - DNA, 25 bp, Rattus norvegicus
gcctgctgagcattgtgaatgtctg

SEQ ID NO: 397248 - DNA, 25 bp, Rattus norvegicus
gcctgctgaggccactgagcaaagt

SEQ ID NO: 397249 - DNA, 25 bp, Rattus norvegicus
gcctgctgaggcgactgagcaaagt

SEQ ID NO: 397250 - DNA, 25 bp, Rattus norvegicus
gcctgctgagggatttctgtgccaa

SEQ ID NO: 397251 - DNA, 25 bp, Rattus norvegicus
gcctgctgagggttttctgtgccaa

SEQ ID NO: 397252 - DNA, 25 bp, Rattus norvegicus
gcctgctgagttaagacatgcctta

SEQ ID NO: 397253 - DNA, 25 bp, Rattus norvegicus
gcctgctgagtttagacatgcctta

SEQ ID NO: 397254 - DNA, 25 bp, Rattus norvegicus
gcctgctgatacatgttctgcttca

SEQ ID NO: 397255 - DNA, 25 bp, Rattus norvegicus
gcctgctgatacttgttctgcttca

SEQ ID NO: 397256 - DNA, 25 bp, Rattus norvegicus
gcctgctgcatgctaagcactggga

SEQ ID NO: 397257 - DNA, 25 bp, Rattus norvegicus
gcctgctgcatggtaagcactggga

SEQ ID NO: 397258 - DNA, 25 bp, Rattus norvegicus
gcctgctgcctgagacagtcaacat

SEQ ID NO: 397259 - DNA, 25 bp, Rattus norvegicus
gcctgctgcctgtgacagtcaacat

SEQ ID NO: 397260 - DNA, 25 bp, Rattus norvegicus
gcctgctgcggacactaggttcaaa

SEQ ID NO: 397261 - DNA, 25 bp, Rattus norvegicus
gcctgctgcggagactaggttcaaa

SEQ ID NO: 397262 - DNA, 25 bp, Rattus norvegicus
gcctgctggtacattacatttccgg

SEQ ID NO: 397263 - DNA, 25 bp, Rattus norvegicus
gcctgctggtactttacatttccgg

SEQ ID NO: 397264 - DNA, 25 bp, Rattus norvegicus
gcctgctggtgacgtcgccatgacc

SEQ ID NO: 397265 - DNA, 25 bp, Rattus norvegicus
gcctgctggtgaggtcgccatgacc

SEQ ID NO: 397266 - DNA, 25 bp, Rattus norvegicus
gcctgctggtggctgattatctcta

SEQ ID NO: 397267 - DNA, 25 bp, Rattus norvegicus
gcctgctggtgggtgattatctcta

SEQ ID NO: 397268 - DNA, 25 bp, Rattus norvegicus
gcctgctgtgaacttaccattgcca

SEQ ID NO: 397269 - DNA, 25 bp, Rattus norvegicus
gcctgctgtgaagttaccattgcca

SEQ ID NO: 397270 - DNA, 25 bp, Rattus norvegicus
gcctgctgtgagagttcacatccca

SEQ ID NO: 397271 - DNA, 25 bp, Rattus norvegicus
gcctgctgtgagtgttcacatccca

SEQ ID NO: 397272 - DNA, 25 bp, Rattus norvegicus
gcctgctgtttgaaaaagctctctg

SEQ ID NO: 397273 - DNA, 25 bp, Rattus norvegicus
gcctgctgtttgtaaaagctctctg

SEQ ID NO: 397274 - DNA, 25 bp, Rattus norvegicus
gcctgctgttttaaggtagtcctac

SEQ ID NO: 397275 - DNA, 25 bp, Rattus norvegicus
gcctgctgtttttaggtagtcctac

SEQ ID NO: 397276 - DNA, 25 bp, Rattus norvegicus
gcctgcttacggctggtagaagact

SEQ ID NO: 397277 - DNA, 25 bp, Rattus norvegicus
gcctgcttacgggtggtagaagact

SEQ ID NO: 397278 - DNA, 25 bp, Rattus norvegicus
gcctgcttagcgaggatgctcaaag

SEQ ID NO: 397279 - DNA, 25 bp, Rattus norvegicus
gcctgcttagcgtggatgctcaaag

SEQ ID NO: 397280 - DNA, 25 bp, Rattus norvegicus
gcctgcttaggcactgtactgtcta

SEQ ID NO: 397281 - DNA, 25 bp, Rattus norvegicus
gcctgcttaggctctgtactgtcta

SEQ ID NO: 397282 - DNA, 25 bp, Rattus norvegicus
gcctgcttcaaactgtttttcttca

SEQ ID NO: 397283 - DNA, 25 bp, Rattus norvegicus
gcctgcttcaaagtgtttttcttca

SEQ ID NO: 397284 - DNA, 25 bp, Rattus norvegicus
gcctgcttcctccttgtttgaatat

SEQ ID NO: 397285 - DNA, 25 bp, Rattus norvegicus
gcctgcttcctcgttgtttgaatat

SEQ ID NO: 397286 - DNA, 25 bp, Rattus norvegicus
gcctgcttcctgctgtgagaaggaa

SEQ ID NO: 397287 - DNA, 25 bp, Rattus norvegicus
gcctgcttcctggtgtgagaaggaa

SEQ ID NO: 397288 - DNA, 25 bp, Rattus norvegicus
gcctgcttctaccagagtcgtggat

SEQ ID NO: 397289 - DNA, 25 bp, Rattus norvegicus
gcctgcttctacgagagtcgtggat

SEQ ID NO: 397290 - DNA, 25 bp, Rattus norvegicus
gcctgcttctgcactgaacaatgtg

SEQ ID NO: 397291 - DNA, 25 bp, Rattus norvegicus
gcctgcttctgctctgaacaatgtg

SEQ ID NO: 397292 - DNA, 25 bp, Rattus norvegicus
gcctgcttgctgaaatctgtacaga

SEQ ID NO: 397293 - DNA, 25 bp, Rattus norvegicus
gcctgcttgctgtaatctgtacaga

SEQ ID NO: 397294 - DNA, 25 bp, Rattus norvegicus
gcctgctttgcacacattcacaatg

SEQ ID NO: 397295 - DNA, 25 bp, Rattus norvegicus
gcctgctttgcagacattcacaatg

SEQ ID NO: 397296 - DNA, 25 bp, Rattus norvegicus
gcctgctttgtaatttgactttttt

SEQ ID NO: 397297 - DNA, 25 bp, Rattus norvegicus
gcctgctttgtattttgactttttt

SEQ ID NO: 397298 - DNA, 25 bp, Rattus norvegicus
gcctgcttttccaacagatatcaag

SEQ ID NO: 397299 - DNA, 25 bp, Rattus norvegicus
gcctgcttttccacacagtttaaat

SEQ ID NO: 397300 - DNA, 25 bp, Rattus norvegicus
gcctgcttttcctacagatatcaag

SEQ ID NO: 397301 - DNA, 25 bp, Rattus norvegicus
gcctgcttttcctcacagtttaaat

SEQ ID NO: 397302 - DNA, 25 bp, Rattus norvegicus
gcctggaaagcaagggagtgacccc

SEQ ID NO: 397303 - DNA, 25 bp, Rattus norvegicus
gcctggaaagcatgggagtgacccc

SEQ ID NO: 397304 - DNA, 25 bp, Rattus norvegicus
gcctggaaatcaataacgccttgct

SEQ ID NO: 397305 - DNA, 25 bp, Rattus norvegicus
gcctggaaatcattaacgccttgct

SEQ ID NO: 397306 - DNA, 25 bp, Rattus norvegicus
gcctggaagatcatggcgttcagcc

SEQ ID NO: 397307 - DNA, 25 bp, Rattus norvegicus
gcctggaagatcttggcgttcagcc

SEQ ID NO: 397308 - DNA, 25 bp, Rattus norvegicus
gcctggaagtacaaccgggagtgca

SEQ ID NO: 397309 - DNA, 25 bp, Rattus norvegicus
gcctggaagtactaccgggagtgca

SEQ ID NO: 397310 - DNA, 25 bp, Rattus norvegicus
gcctggaagtccagaggtccggccc

SEQ ID NO: 397311 - DNA, 25 bp, Rattus norvegicus
gcctggaagtcctgaggtccggccc

SEQ ID NO: 397312 - DNA, 25 bp, Rattus norvegicus
gcctggaatctgactatgactctta

SEQ ID NO: 397313 - DNA, 25 bp, Rattus norvegicus
gcctggaatctgtctatgactctta

SEQ ID NO: 397314 - DNA, 25 bp, Rattus norvegicus
gcctggaatgcccattagcgtgtat

SEQ ID NO: 397315 - DNA, 25 bp, Rattus norvegicus
gcctggaatgccgattagcgtgtat

SEQ ID NO: 397316 - DNA, 25 bp, Rattus norvegicus
gcctggaatgttcctttgttgtccg

SEQ ID NO: 397317 - DNA, 25 bp, Rattus norvegicus
gcctggaatgttgctttgttgtccg

SEQ ID NO: 397318 - DNA, 25 bp, Rattus norvegicus
gcctggacaggcagagacgcacaga

SEQ ID NO: 397319 - DNA, 25 bp, Rattus norvegicus
gcctggacaggctgagacgcacaga

SEQ ID NO: 397320 - DNA, 25 bp, Rattus norvegicus
gcctggacatccagaaacatgacct

SEQ ID NO: 397321 - DNA, 25 bp, Rattus norvegicus
gcctggacatcctgaaacatgacct

SEQ ID NO: 397322 - DNA, 25 bp, Rattus norvegicus
gcctggaccacgacgtagcggctgc

SEQ ID NO: 397323 - DNA, 25 bp, Rattus norvegicus
gcctggaccacgtcgtagcggctgc

SEQ ID NO: 397324 - DNA, 25 bp, Rattus norvegicus
gcctggaccagaaagactcttgact

SEQ ID NO: 397325 - DNA, 25 bp, Rattus norvegicus
gcctggaccagatagactcttgact

SEQ ID NO: 397326 - DNA, 25 bp, Rattus norvegicus
gcctggacccagaaggaatggctaa

SEQ ID NO: 397327 - DNA, 25 bp, Rattus norvegicus
gcctggacccagtaggaatggctaa

SEQ ID NO: 397328 - DNA, 25 bp, Rattus norvegicus
gcctggacggtgcttaattcaaacg

SEQ ID NO: 397329 - DNA, 25 bp, Rattus norvegicus
gcctggacggtggttaattcaaacg

SEQ ID NO: 397330 - DNA, 25 bp, Rattus norvegicus
gcctggactttcatcgattctattt

SEQ ID NO: 397331 - DNA, 25 bp, Rattus norvegicus
gcctggactttcttcgattctattt

SEQ ID NO: 397332 - DNA, 25 bp, Rattus norvegicus
gcctggagaaagctcagcccactga

SEQ ID NO: 397333 - DNA, 25 bp, Rattus norvegicus
gcctggagaaaggtcagcccactga

SEQ ID NO: 397334 - DNA, 25 bp, Rattus norvegicus
gcctggagacttagtgcttgtagcc

SEQ ID NO: 397335 - DNA, 25 bp, Rattus norvegicus
gcctggagactttgtgcttgtagcc

SEQ ID NO: 397336 - DNA, 25 bp, Rattus norvegicus
gcctggagcagcacagtttggcaga

SEQ ID NO: 397337 - DNA, 25 bp, Rattus norvegicus
gcctggagcagctcagtttggcaga

SEQ ID NO: 397338 - DNA, 25 bp, Rattus norvegicus
gcctggagcctcaactgcaaaaaga

SEQ ID NO: 397339 - DNA, 25 bp, Rattus norvegicus
gcctggagcctctactgcaaaaaga

SEQ ID NO: 397340 - DNA, 25 bp, Rattus norvegicus
gcctggagcgaaagtcaagtcccct

SEQ ID NO: 397341 - DNA, 25 bp, Rattus norvegicus
gcctggagcgaatgtcaagtcccct

SEQ ID NO: 397342 - DNA, 25 bp, Rattus norvegicus
gcctggagctgtcaaagaacggcaa

SEQ ID NO: 397343 - DNA, 25 bp, Rattus norvegicus
gcctggagctgtgaaagaacggcaa

SEQ ID NO: 397344 - DNA, 25 bp, Rattus norvegicus
gcctggagttcccaaggtgacgttt

SEQ ID NO: 397345 - DNA, 25 bp, Rattus norvegicus
gcctggagttccgaaggtgacgttt

SEQ ID NO: 397346 - DNA, 25 bp, Rattus norvegicus
gcctggagttggcttgtctaagaca

SEQ ID NO: 397347 - DNA, 25 bp, Rattus norvegicus
gcctggagttgggttgtctaagaca

SEQ ID NO: 397348 - DNA, 25 bp, Rattus norvegicus
gcctggagttttcttcactcgaatg

SEQ ID NO: 397349 - DNA, 25 bp, Rattus norvegicus
gcctggagttttgttcactcgaatg

SEQ ID NO: 397350 - DNA, 25 bp, Rattus norvegicus
gcctggatgagtacccaaatctgaa

SEQ ID NO: 397351 - DNA, 25 bp, Rattus norvegicus
gcctggatgagttcccaaatctgaa

SEQ ID NO: 397352 - DNA, 25 bp, Rattus norvegicus
gcctggatgttaccacatgaccaaa

SEQ ID NO: 397353 - DNA, 25 bp, Rattus norvegicus
gcctggatgttagcacatgaccaaa

SEQ ID NO: 397354 - DNA, 25 bp, Rattus norvegicus
gcctggatttgtctgagttggcaaa

SEQ ID NO: 397355 - DNA, 25 bp, Rattus norvegicus
gcctggatttgtgtgagttggcaaa

SEQ ID NO: 397356 - DNA, 25 bp, Rattus norvegicus
gcctggcaaagactgtgtaagtcaa

SEQ ID NO: 397357 - DNA, 25 bp, Rattus norvegicus
gcctggcaaagagtgtgtaagtcaa

SEQ ID NO: 397358 - DNA, 25 bp, Rattus norvegicus
gcctggcaacagcacgacttcggtt

SEQ ID NO: 397359 - DNA, 25 bp, Rattus norvegicus
gcctggcaacaggacgacttcggtt

SEQ ID NO: 397360 - DNA, 25 bp, Rattus norvegicus
gcctggcagaacatcgacgcatcca

SEQ ID NO: 397361 - DNA, 25 bp, Rattus norvegicus
gcctggcagaacttcgacgcatcca

SEQ ID NO: 397362 - DNA, 25 bp, Rattus norvegicus
gcctggcagccacagatgtttctat

SEQ ID NO: 397363 - DNA, 25 bp, Rattus norvegicus
gcctggcagccagagatgtttctat

SEQ ID NO: 397364 - DNA, 25 bp, Rattus norvegicus
gcctggcagcctatatgtgtgtgta

SEQ ID NO: 397365 - DNA, 25 bp, Rattus norvegicus
gcctggcagcctttatgtgtgtgta

SEQ ID NO: 397366 - DNA, 25 bp, Rattus norvegicus
gcctggcagcgtctacctgaggtaa

SEQ ID NO: 397367 - DNA, 25 bp, Rattus norvegicus
gcctggcagcgtgtacctgaggtaa

SEQ ID NO: 397368 - DNA, 25 bp, Rattus norvegicus
gcctggcagctccaggttatctgag

SEQ ID NO: 397369 - DNA, 25 bp, Rattus norvegicus
gcctggcagctcgaggttatctgag

SEQ ID NO: 397370 - DNA, 25 bp, Rattus norvegicus
gcctggcatctcctttgagacaaga

SEQ ID NO: 397371 - DNA, 25 bp, Rattus norvegicus
gcctggcatctcgtttgagacaaga

SEQ ID NO: 397372 - DNA, 25 bp, Rattus norvegicus
gcctggcatgccaggttatactgag

SEQ ID NO: 397373 - DNA, 25 bp, Rattus norvegicus
gcctggcatgcctggttatactgag

SEQ ID NO: 397374 - DNA, 25 bp, Rattus norvegicus
gcctggcattggaggtgccaacatt

SEQ ID NO: 397375 - DNA, 25 bp, Rattus norvegicus
gcctggcattggtggtgccaacatt

SEQ ID NO: 397376 - DNA, 25 bp, Rattus norvegicus
gcctggcattgtaggttctatttaa

SEQ ID NO: 397377 - DNA, 25 bp, Rattus norvegicus
gcctggcattgttggttctatttaa

SEQ ID NO: 397378 - DNA, 25 bp, Rattus norvegicus
gcctggcatttgcatgctgggttaa

SEQ ID NO: 397379 - DNA, 25 bp, Rattus norvegicus
gcctggcatttggatgctgggttaa

SEQ ID NO: 397380 - DNA, 25 bp, Rattus norvegicus
gcctggcattttctgacatatggct

SEQ ID NO: 397381 - DNA, 25 bp, Rattus norvegicus
gcctggcattttgtgacatatggct

SEQ ID NO: 397382 - DNA, 25 bp, Rattus norvegicus
gcctggccacttatattatcttcat

SEQ ID NO: 397383 - DNA, 25 bp, Rattus norvegicus
gcctggccacttttattatcttcat

SEQ ID NO: 397384 - DNA, 25 bp, Rattus norvegicus
gcctggccattgcactagaactggt

SEQ ID NO: 397385 - DNA, 25 bp, Rattus norvegicus
gcctggccattggactagaactggt

SEQ ID NO: 397386 - DNA, 25 bp, Rattus norvegicus
gcctggccctttatacaacaagcaa

SEQ ID NO: 397387 - DNA, 25 bp, Rattus norvegicus
gcctggccctttttacaacaagcaa

SEQ ID NO: 397388 - DNA, 25 bp, Rattus norvegicus
gcctggccgagaactgtgccaagat

SEQ ID NO: 397389 - DNA, 25 bp, Rattus norvegicus
gcctggccgagatctgtgccaagat

SEQ ID NO: 397390 - DNA, 25 bp, Rattus norvegicus
gcctggcctaatagacagagatcat

SEQ ID NO: 397391 - DNA, 25 bp, Rattus norvegicus
gcctggcctaattgacagagatcat

SEQ ID NO: 397392 - DNA, 25 bp, Rattus norvegicus
gcctggcctaggatttaattttgta

SEQ ID NO: 397393 - DNA, 25 bp, Rattus norvegicus
gcctggcctaggttttaattttgta

SEQ ID NO: 397394 - DNA, 25 bp, Rattus norvegicus
gcctggcctcttagttcattctgag

SEQ ID NO: 397395 - DNA, 25 bp, Rattus norvegicus
gcctggcctctttgttcattctgag

SEQ ID NO: 397396 - DNA, 25 bp, Rattus norvegicus
gcctggcctgctcggaagctagact

SEQ ID NO: 397397 - DNA, 25 bp, Rattus norvegicus
gcctggcctgctgggaagctagact

SEQ ID NO: 397398 - DNA, 25 bp, Rattus norvegicus
gcctggcctgtgacctatataagtg

SEQ ID NO: 397399 - DNA, 25 bp, Rattus norvegicus
gcctggcctgtgcagtgagttccaa

SEQ ID NO: 397400 - DNA, 25 bp, Rattus norvegicus
gcctggcctgtggagtgagttccaa

SEQ ID NO: 397401 - DNA, 25 bp, Rattus norvegicus
gcctggcctgtgtcctatataagtg

SEQ ID NO: 397402 - DNA, 25 bp, Rattus norvegicus
gcctggcctgttatttcttaaacat

SEQ ID NO: 397403 - DNA, 25 bp, Rattus norvegicus
gcctggcctgttttttcttaaacat

SEQ ID NO: 397404 - DNA, 25 bp, Rattus norvegicus
gcctggcgggcaaatgacacggttt

SEQ ID NO: 397405 - DNA, 25 bp, Rattus norvegicus
gcctggcgggcatatgacacggttt

SEQ ID NO: 397406 - DNA, 25 bp, Rattus norvegicus
gcctggctaacgatgtgctgtgtca

SEQ ID NO: 397407 - DNA, 25 bp, Rattus norvegicus
gcctggctaacgttgtgctgtgtca

SEQ ID NO: 397408 - DNA, 25 bp, Rattus norvegicus
gcctggctacacaaaactacgggat

SEQ ID NO: 397409 - DNA, 25 bp, Rattus norvegicus
gcctggctacactaaactacgggat

SEQ ID NO: 397410 - DNA, 25 bp, Rattus norvegicus
gcctggctacttatttaacatattg

SEQ ID NO: 397411 - DNA, 25 bp, Rattus norvegicus
gcctggctacttttttaacatattg

SEQ ID NO: 397412 - DNA, 25 bp, Rattus norvegicus
gcctggctcataatgcttttgtgaa

SEQ ID NO: 397413 - DNA, 25 bp, Rattus norvegicus
gcctggctcatattgcttttgtgaa

SEQ ID NO: 397414 - DNA, 25 bp, Rattus norvegicus
gcctggctcccaccatgagtgctga

SEQ ID NO: 397415 - DNA, 25 bp, Rattus norvegicus
gcctggctcccagcatgagtgctga

SEQ ID NO: 397416 - DNA, 25 bp, Rattus norvegicus
gcctggctccgaattttagataccc

SEQ ID NO: 397417 - DNA, 25 bp, Rattus norvegicus
gcctggctccgatttttagataccc

SEQ ID NO: 397418 - DNA, 25 bp, Rattus norvegicus
gcctggctcggtcgcttcatagcca

SEQ ID NO: 397419 - DNA, 25 bp, Rattus norvegicus
gcctggctcggtggcttcatagcca

SEQ ID NO: 397420 - DNA, 25 bp, Rattus norvegicus
gcctggctcgtgctgctagaataac

SEQ ID NO: 397421 - DNA, 25 bp, Rattus norvegicus
gcctggctcgtggtgctagaataac

SEQ ID NO: 397422 - DNA, 25 bp, Rattus norvegicus
gcctggctctctagtatgaccaagt

SEQ ID NO: 397423 - DNA, 25 bp, Rattus norvegicus
gcctggctctcttgtatgaccaagt

SEQ ID NO: 397424 - DNA, 25 bp, Rattus norvegicus
gcctggctctgaattgttctaccga

SEQ ID NO: 397425 - DNA, 25 bp, Rattus norvegicus
gcctggctctgaatttctcagtctt

SEQ ID NO: 397426 - DNA, 25 bp, Rattus norvegicus
gcctggctctgatttgttctaccga

SEQ ID NO: 397427 - DNA, 25 bp, Rattus norvegicus
gcctggctctgattttctcagtctt

SEQ ID NO: 397428 - DNA, 25 bp, Rattus norvegicus
gcctggctgcagacggaagaacctc

SEQ ID NO: 397429 - DNA, 25 bp, Rattus norvegicus
gcctggctgcagtcggaagaacctc

SEQ ID NO: 397430 - DNA, 25 bp, Rattus norvegicus
gcctggctgcccaggctgcggaact

SEQ ID NO: 397431 - DNA, 25 bp, Rattus norvegicus
gcctggctgccctggctgcggaact

SEQ ID NO: 397432 - DNA, 25 bp, Rattus norvegicus
gcctggctgcctacatcttagagaa

SEQ ID NO: 397433 - DNA, 25 bp, Rattus norvegicus
gcctggctgccttcatcttagagaa

SEQ ID NO: 397434 - DNA, 25 bp, Rattus norvegicus
gcctggctgcggaacatgttgaagt

SEQ ID NO: 397435 - DNA, 25 bp, Rattus norvegicus
gcctggctgcggtacatgttgaagt

SEQ ID NO: 397436 - DNA, 25 bp, Rattus norvegicus
gcctggctggaccttctagcagaag

SEQ ID NO: 397437 - DNA, 25 bp, Rattus norvegicus
gcctggctggacgttctagcagaag

SEQ ID NO: 397438 - DNA, 25 bp, Rattus norvegicus
gcctggctgttgagatttggtgcaa

SEQ ID NO: 397439 - DNA, 25 bp, Rattus norvegicus
gcctggctgttgtgatttggtgcaa

SEQ ID NO: 397440 - DNA, 25 bp, Rattus norvegicus
gcctggcttagcaaacagctgtttt

SEQ ID NO: 397441 - DNA, 25 bp, Rattus norvegicus
gcctggcttagctaacagctgtttt

SEQ ID NO: 397442 - DNA, 25 bp, Rattus norvegicus
gcctggcttgagatagaagtgcact

SEQ ID NO: 397443 - DNA, 25 bp, Rattus norvegicus
gcctggcttgagttagaagtgcact

SEQ ID NO: 397444 - DNA, 25 bp, Rattus norvegicus
gcctggcttggtcagactctggtat

SEQ ID NO: 397445 - DNA, 25 bp, Rattus norvegicus
gcctggcttggtgagactctggtat

SEQ ID NO: 397446 - DNA, 25 bp, Rattus norvegicus
gcctggctttgcctggaattaaagt

SEQ ID NO: 397447 - DNA, 25 bp, Rattus norvegicus
gcctggctttgcgtggaattaaagt

SEQ ID NO: 397448 - DNA, 25 bp, Rattus norvegicus
gcctggctttgtagggttgtgctca

SEQ ID NO: 397449 - DNA, 25 bp, Rattus norvegicus
gcctggctttgttgggttgtgctca

SEQ ID NO: 397450 - DNA, 25 bp, Rattus norvegicus
gcctgggaaatacaatagtcttagt

SEQ ID NO: 397451 - DNA, 25 bp, Rattus norvegicus
gcctgggaaatagaatagtcttagt

SEQ ID NO: 397452 - DNA, 25 bp, Rattus norvegicus
gcctgggaagctccttttgctctat

SEQ ID NO: 397453 - DNA, 25 bp, Rattus norvegicus
gcctgggaagctgcttttgctctat

SEQ ID NO: 397454 - DNA, 25 bp, Rattus norvegicus
gcctgggacacacttcgagagtagt

SEQ ID NO: 397455 - DNA, 25 bp, Rattus norvegicus
gcctgggacacagttcgagagtagt

SEQ ID NO: 397456 - DNA, 25 bp, Rattus norvegicus
gcctgggacagtcttacttctttca

SEQ ID NO: 397457 - DNA, 25 bp, Rattus norvegicus
gcctgggacagtgttacttctttca

SEQ ID NO: 397458 - DNA, 25 bp, Rattus norvegicus
gcctgggaccccagtaatgaaggtt

SEQ ID NO: 397459 - DNA, 25 bp, Rattus norvegicus
gcctgggacccctgtaatgaaggtt

SEQ ID NO: 397460 - DNA, 25 bp, Rattus norvegicus
gcctgggacccgcaatgtgaatata

SEQ ID NO: 397461 - DNA, 25 bp, Rattus norvegicus
gcctgggacccggaatgtgaatata

SEQ ID NO: 397462 - DNA, 25 bp, Rattus norvegicus
gcctgggactgtcaagggcatctcc

SEQ ID NO: 397463 - DNA, 25 bp, Rattus norvegicus
gcctgggactgtgaagggcatctcc

SEQ ID NO: 397464 - DNA, 25 bp, Rattus norvegicus
gcctgggacttcaaaaactggttca

SEQ ID NO: 397465 - DNA, 25 bp, Rattus norvegicus
gcctgggacttctaaaactggttca

SEQ ID NO: 397466 - DNA, 25 bp, Rattus norvegicus
gcctgggagcgacatctaagactat

SEQ ID NO: 397467 - DNA, 25 bp, Rattus norvegicus
gcctgggagcgagatctaagactat

SEQ ID NO: 397468 - DNA, 25 bp, Rattus norvegicus
gcctgggatccccattctcaagaat

SEQ ID NO: 397469 - DNA, 25 bp, Rattus norvegicus
gcctgggatcccgattctcaagaat

SEQ ID NO: 397470 - DNA, 25 bp, Rattus norvegicus
gcctgggatggcaactctactaaca

SEQ ID NO: 397471 - DNA, 25 bp, Rattus norvegicus
gcctgggatggctactctactaaca

SEQ ID NO: 397472 - DNA, 25 bp, Rattus norvegicus
gcctgggcaagtccacaagtctttt

SEQ ID NO: 397473 - DNA, 25 bp, Rattus norvegicus
gcctgggcaagtgcacaagtctttt

SEQ ID NO: 397474 - DNA, 25 bp, Rattus norvegicus
gcctgggcaccgacatgagaattcg

SEQ ID NO: 397475 - DNA, 25 bp, Rattus norvegicus
gcctgggcaccgtcatgagaattcg

SEQ ID NO: 397476 - DNA, 25 bp, Rattus norvegicus
gcctgggcactgcatgcgatattat

SEQ ID NO: 397477 - DNA, 25 bp, Rattus norvegicus
gcctgggcactggatgcgatattat

SEQ ID NO: 397478 - DNA, 25 bp, Rattus norvegicus
gcctgggcagggagatggactttgt

SEQ ID NO: 397479 - DNA, 25 bp, Rattus norvegicus
gcctgggcagggtgatggactttgt

SEQ ID NO: 397480 - DNA, 25 bp, Rattus norvegicus
gcctgggcagtgaagtcttagcaac

SEQ ID NO: 397481 - DNA, 25 bp, Rattus norvegicus
gcctgggcagtgtagtcttagcaac

SEQ ID NO: 397482 - DNA, 25 bp, Rattus norvegicus
gcctgggcatctcaaaccttttgag

SEQ ID NO: 397483 - DNA, 25 bp, Rattus norvegicus
gcctgggcatctccggttgttcatt

SEQ ID NO: 397484 - DNA, 25 bp, Rattus norvegicus
gcctgggcatctgaaaccttttgag

SEQ ID NO: 397485 - DNA, 25 bp, Rattus norvegicus
gcctgggcatctgcggttgttcatt

SEQ ID NO: 397486 - DNA, 25 bp, Rattus norvegicus
gcctgggccaagcaggctgcattat

SEQ ID NO: 397487 - DNA, 25 bp, Rattus norvegicus
gcctgggccaaggaggctgcattat

SEQ ID NO: 397488 - DNA, 25 bp, Rattus norvegicus
gcctgggccccaagaagtgatgtgt

SEQ ID NO: 397489 - DNA, 25 bp, Rattus norvegicus
gcctgggccccatgaagtgatgtgt

SEQ ID NO: 397490 - DNA, 25 bp, Rattus norvegicus
gcctgggccttaacttttggtggag

SEQ ID NO: 397491 - DNA, 25 bp, Rattus norvegicus
gcctgggccttatcttttggtggag

SEQ ID NO: 397492 - DNA, 25 bp, Rattus norvegicus
gcctgggctactcggaatcctggaa

SEQ ID NO: 397493 - DNA, 25 bp, Rattus norvegicus
gcctgggctactgggaatcctggaa

SEQ ID NO: 397494 - DNA, 25 bp, Rattus norvegicus
gcctgggctatacagttgaagtcaa

SEQ ID NO: 397495 - DNA, 25 bp, Rattus norvegicus
gcctgggctatagagttgaagtcaa

SEQ ID NO: 397496 - DNA, 25 bp, Rattus norvegicus
gcctgggctcgcaggaactggacca

SEQ ID NO: 397497 - DNA, 25 bp, Rattus norvegicus
gcctgggctcgctggaactggacca

SEQ ID NO: 397498 - DNA, 25 bp, Rattus norvegicus
gcctgggctctgaagttgactttct

SEQ ID NO: 397499 - DNA, 25 bp, Rattus norvegicus
gcctgggctctgtagttgactttct

SEQ ID NO: 397500 - DNA, 25 bp, Rattus norvegicus
gcctgggctcttattatacaagaaa

SEQ ID NO: 397501 - DNA, 25 bp, Rattus norvegicus
gcctgggctctttttatacaagaaa

SEQ ID NO: 397502 - DNA, 25 bp, Rattus norvegicus
gcctgggctggcactcggttagaat

SEQ ID NO: 397503 - DNA, 25 bp, Rattus norvegicus
gcctgggctggctctcggttagaat

SEQ ID NO: 397504 - DNA, 25 bp, Rattus norvegicus
gcctgggcttcacagcaatatcctt

SEQ ID NO: 397505 - DNA, 25 bp, Rattus norvegicus
gcctgggcttcagagcaatatcctt

SEQ ID NO: 397506 - DNA, 25 bp, Rattus norvegicus
gcctgggcttccagcaacaggaaac

SEQ ID NO: 397507 - DNA, 25 bp, Rattus norvegicus
gcctgggcttcctgcaacaggaaac

SEQ ID NO: 397508 - DNA, 25 bp, Rattus norvegicus
gcctgggcttgtatgtttgtgcaga

SEQ ID NO: 397509 - DNA, 25 bp, Rattus norvegicus
gcctgggcttgtttgtttgtgcaga

SEQ ID NO: 397510 - DNA, 25 bp, Rattus norvegicus
gcctgggtacaaaagagcccttcag

SEQ ID NO: 397511 - DNA, 25 bp, Rattus norvegicus
gcctgggtacaatagagcccttcag

SEQ ID NO: 397512 - DNA, 25 bp, Rattus norvegicus
gcctgggtatatctcattttcctat

SEQ ID NO: 397513 - DNA, 25 bp, Rattus norvegicus
gcctgggtatatgtcattttcctat

SEQ ID NO: 397514 - DNA, 25 bp, Rattus norvegicus
gcctgggtcagtcctattttaacat

SEQ ID NO: 397515 - DNA, 25 bp, Rattus norvegicus
gcctgggtcagtgctattttaacat

SEQ ID NO: 397516 - DNA, 25 bp, Rattus norvegicus
gcctgggtccagatacaagtcatcc

SEQ ID NO: 397517 - DNA, 25 bp, Rattus norvegicus
gcctgggtccagcaagccagcagaa

SEQ ID NO: 397518 - DNA, 25 bp, Rattus norvegicus
gcctgggtccaggaagccagcagaa

SEQ ID NO: 397519 - DNA, 25 bp, Rattus norvegicus
gcctgggtccagttacaagtcatcc

SEQ ID NO: 397520 - DNA, 25 bp, Rattus norvegicus
gcctgggtcgccagtggttatgtaa

SEQ ID NO: 397521 - DNA, 25 bp, Rattus norvegicus
gcctgggtcgcctgtggttatgtaa

SEQ ID NO: 397522 - DNA, 25 bp, Rattus norvegicus
gcctgggtgaaaatacacagctcta

SEQ ID NO: 397523 - DNA, 25 bp, Rattus norvegicus
gcctgggtgaaattacacagctcta

SEQ ID NO: 397524 - DNA, 25 bp, Rattus norvegicus
gcctgggtgagaccaaactttcgat

SEQ ID NO: 397525 - DNA, 25 bp, Rattus norvegicus
gcctgggtgagagcaaactttcgat

SEQ ID NO: 397526 - DNA, 25 bp, Rattus norvegicus
gcctgggtggccactagaaatccaa

SEQ ID NO: 397527 - DNA, 25 bp, Rattus norvegicus
gcctgggtggcctctagaaatccaa

SEQ ID NO: 397528 - DNA, 25 bp, Rattus norvegicus
gcctgggttgcaagagactgtcttc

SEQ ID NO: 397529 - DNA, 25 bp, Rattus norvegicus
gcctgggttgcatgagactgtcttc

SEQ ID NO: 397530 - DNA, 25 bp, Rattus norvegicus
gcctggtaccagagttggccattaa

SEQ ID NO: 397531 - DNA, 25 bp, Rattus norvegicus
gcctggtaccagtgttggccattaa

SEQ ID NO: 397532 - DNA, 25 bp, Rattus norvegicus
gcctggtactggcagcactagcaag

SEQ ID NO: 397533 - DNA, 25 bp, Rattus norvegicus
gcctggtactgggagcactagcaag

SEQ ID NO: 397534 - DNA, 25 bp, Rattus norvegicus
gcctggtagactctgactggtgcca

SEQ ID NO: 397535 - DNA, 25 bp, Rattus norvegicus
gcctggtagactgtgactggtgcca

SEQ ID NO: 397536 - DNA, 25 bp, Rattus norvegicus
gcctggtagattactctgtcttgat

SEQ ID NO: 397537 - DNA, 25 bp, Rattus norvegicus
gcctggtagatttctctgtcttgat

SEQ ID NO: 397538 - DNA, 25 bp, Rattus norvegicus
gcctggtcaaatacaaagctttctg

SEQ ID NO: 397539 - DNA, 25 bp, Rattus norvegicus
gcctggtcaaattcaaagctttctg

SEQ ID NO: 397540 - DNA, 25 bp, Rattus norvegicus
gcctggtcaccaaagtttcatgata

SEQ ID NO: 397541 - DNA, 25 bp, Rattus norvegicus
gcctggtcaccatagtttcatgata

SEQ ID NO: 397542 - DNA, 25 bp, Rattus norvegicus
gcctggtcacgtcttagaaatccta

SEQ ID NO: 397543 - DNA, 25 bp, Rattus norvegicus
gcctggtcacgtgttagaaatccta

SEQ ID NO: 397544 - DNA, 25 bp, Rattus norvegicus
gcctggtcactgatgcttcttaaat

SEQ ID NO: 397545 - DNA, 25 bp, Rattus norvegicus
gcctggtcactgttgcttcttaaat

SEQ ID NO: 397546 - DNA, 25 bp, Rattus norvegicus
gcctggtcagctccttggagtccaa

SEQ ID NO: 397547 - DNA, 25 bp, Rattus norvegicus
gcctggtcagctgcttggagtccaa

SEQ ID NO: 397548 - DNA, 25 bp, Rattus norvegicus
gcctggtcatagatacatgcctgta

SEQ ID NO: 397549 - DNA, 25 bp, Rattus norvegicus
gcctggtcatagttacatgcctgta

SEQ ID NO: 397550 - DNA, 25 bp, Rattus norvegicus
gcctggtccaaacccgctgtaaaat

SEQ ID NO: 397551 - DNA, 25 bp, Rattus norvegicus
gcctggtccaaagccgctgtaaaat

SEQ ID NO: 397552 - DNA, 25 bp, Rattus norvegicus
gcctggtccatgatcccgaaatgag

SEQ ID NO: 397553 - DNA, 25 bp, Rattus norvegicus
gcctggtccatgttcccgaaatgag

SEQ ID NO: 397554 - DNA, 25 bp, Rattus norvegicus
gcctggtcccagaagaaaatgctca

SEQ ID NO: 397555 - DNA, 25 bp, Rattus norvegicus
gcctggtcccagtagaaaatgctca

SEQ ID NO: 397556 - DNA, 25 bp, Rattus norvegicus
gcctggtccctaatgtgaagcttgg

SEQ ID NO: 397557 - DNA, 25 bp, Rattus norvegicus
gcctggtccctattgtgaagcttgg

SEQ ID NO: 397558 - DNA, 25 bp, Rattus norvegicus
gcctggtctaaacggctaggtccaa

SEQ ID NO: 397559 - DNA, 25 bp, Rattus norvegicus
gcctggtctaaagggctaggtccaa

SEQ ID NO: 397560 - DNA, 25 bp, Rattus norvegicus
gcctggtctatgaaacgagttctag

SEQ ID NO: 397561 - DNA, 25 bp, Rattus norvegicus
gcctggtctatgaggtgtgttctat

SEQ ID NO: 397562 - DNA, 25 bp, Rattus norvegicus
gcctggtctatgatatttagtgagt

SEQ ID NO: 397563 - DNA, 25 bp, Rattus norvegicus
gcctggtctatgcaatgaggtctat

SEQ ID NO: 397564 - DNA, 25 bp, Rattus norvegicus
gcctggtctatggaatgaggtctat

SEQ ID NO: 397565 - DNA, 25 bp, Rattus norvegicus
gcctggtctatgtaacgagttctag

SEQ ID NO: 397566 - DNA, 25 bp, Rattus norvegicus
gcctggtctatgtggtgtgttctat

SEQ ID NO: 397567 - DNA, 25 bp, Rattus norvegicus
gcctggtctatgttatttagtgagt

SEQ ID NO: 397568 - DNA, 25 bp, Rattus norvegicus
gcctggtctcaaaaacaagcctgtc

SEQ ID NO: 397569 - DNA, 25 bp, Rattus norvegicus
gcctggtctcaataacaagcctgtc

SEQ ID NO: 397570 - DNA, 25 bp, Rattus norvegicus
gcctggtctctgctaagcctgtaag

SEQ ID NO: 397571 - DNA, 25 bp, Rattus norvegicus
gcctggtctctggtaagcctgtaag

SEQ ID NO: 397572 - DNA, 25 bp, Rattus norvegicus
gcctggtctgcacagcaagttgtag

SEQ ID NO: 397573 - DNA, 25 bp, Rattus norvegicus
gcctggtctgcagagcaagttgtag

SEQ ID NO: 397574 - DNA, 25 bp, Rattus norvegicus
gcctggtcttggcaatatgctagca

SEQ ID NO: 397575 - DNA, 25 bp, Rattus norvegicus
gcctggtcttgggaatatgctagca

SEQ ID NO: 397576 - DNA, 25 bp, Rattus norvegicus
gcctggtgactgctctgcttaagga

SEQ ID NO: 397577 - DNA, 25 bp, Rattus norvegicus
gcctggtgactggtctgcttaagga

SEQ ID NO: 397578 - DNA, 25 bp, Rattus norvegicus
gcctggtgatctattttgtttcctt

SEQ ID NO: 397579 - DNA, 25 bp, Rattus norvegicus
gcctggtgatcttttttgtttcctt

SEQ ID NO: 397580 - DNA, 25 bp, Rattus norvegicus
gcctggtgccagaactttgaaagat

SEQ ID NO: 397581 - DNA, 25 bp, Rattus norvegicus
gcctggtgccagtactttgaaagat

SEQ ID NO: 397582 - DNA, 25 bp, Rattus norvegicus
gcctggtgcctgcttcgaagcaaat

SEQ ID NO: 397583 - DNA, 25 bp, Rattus norvegicus
gcctggtgcctggttcgaagcaaat

SEQ ID NO: 397584 - DNA, 25 bp, Rattus norvegicus
gcctggtgcgagcattcaaccctaa

SEQ ID NO: 397585 - DNA, 25 bp, Rattus norvegicus
gcctggtgcgaggattcaaccctaa

SEQ ID NO: 397586 - DNA, 25 bp, Rattus norvegicus
gcctggtgcttcacagggagagaca

SEQ ID NO: 397587 - DNA, 25 bp, Rattus norvegicus
gcctggtgcttctcagggagagaca

SEQ ID NO: 397588 - DNA, 25 bp, Rattus norvegicus
gcctggtgctttaatcccaagtcat

SEQ ID NO: 397589 - DNA, 25 bp, Rattus norvegicus
gcctggtgcttttatcccaagtcat

SEQ ID NO: 397590 - DNA, 25 bp, Rattus norvegicus
gcctggtggcacacctaataaacat

SEQ ID NO: 397591 - DNA, 25 bp, Rattus norvegicus
gcctggtggcacctgcctgcgatct

SEQ ID NO: 397592 - DNA, 25 bp, Rattus norvegicus
gcctggtggcacgtgcctgcgatct

SEQ ID NO: 397593 - DNA, 25 bp, Rattus norvegicus
gcctggtggcactcctaataaacat

SEQ ID NO: 397594 - DNA, 25 bp, Rattus norvegicus
gcctggtggcgcagcaatcgctgca

SEQ ID NO: 397595 - DNA, 25 bp, Rattus norvegicus
gcctggtggcgctgcaatcgctgca

SEQ ID NO: 397596 - DNA, 25 bp, Rattus norvegicus
gcctggtgggcaatgagctttatta

SEQ ID NO: 397597 - DNA, 25 bp, Rattus norvegicus
gcctggtgggcattgagctttatta

SEQ ID NO: 397598 - DNA, 25 bp, Rattus norvegicus
gcctggtgtcggatgatgatctgta

SEQ ID NO: 397599 - DNA, 25 bp, Rattus norvegicus
gcctggtgtcggttgatgatctgta

SEQ ID NO: 397600 - DNA, 25 bp, Rattus norvegicus
gcctggtgtgccacactgtggaaga

SEQ ID NO: 397601 - DNA, 25 bp, Rattus norvegicus
gcctggtgtgcctcactgtggaaga

SEQ ID NO: 397602 - DNA, 25 bp, Rattus norvegicus
gcctggttaggcagctcacgaagaa

SEQ ID NO: 397603 - DNA, 25 bp, Rattus norvegicus
gcctggttaggctgctcacgaagaa

SEQ ID NO: 397604 - DNA, 25 bp, Rattus norvegicus
gcctggttataccacacagactctg

SEQ ID NO: 397605 - DNA, 25 bp, Rattus norvegicus
gcctggttatacgacacagactctg

SEQ ID NO: 397606 - DNA, 25 bp, Rattus norvegicus
gcctggttattcactcagttttctg

SEQ ID NO: 397607 - DNA, 25 bp, Rattus norvegicus
gcctggttattctctcagttttctg

SEQ ID NO: 397608 - DNA, 25 bp, Rattus norvegicus
gcctggttattgagctttcaagccc

SEQ ID NO: 397609 - DNA, 25 bp, Rattus norvegicus
gcctggttattgtgctttcaagccc

SEQ ID NO: 397610 - DNA, 25 bp, Rattus norvegicus
gcctggttcgataatgaagctgctt

SEQ ID NO: 397611 - DNA, 25 bp, Rattus norvegicus
gcctggttcgattatgaagctgctt

SEQ ID NO: 397612 - DNA, 25 bp, Rattus norvegicus
gcctggttcgcaacgtggagtatta

SEQ ID NO: 397613 - DNA, 25 bp, Rattus norvegicus
gcctggttcgcatcgtggagtatta

SEQ ID NO: 397614 - DNA, 25 bp, Rattus norvegicus
gcctggttctctcggacagtcaata

SEQ ID NO: 397615 - DNA, 25 bp, Rattus norvegicus
gcctggttctctgggacagtcaata

SEQ ID NO: 397616 - DNA, 25 bp, Rattus norvegicus
gcctggttctgaatcatggcttaat

SEQ ID NO: 397617 - DNA, 25 bp, Rattus norvegicus
gcctggttctgattcatggcttaat

SEQ ID NO: 397618 - DNA, 25 bp, Rattus norvegicus
gcctggtttttgcatgctttactca

SEQ ID NO: 397619 - DNA, 25 bp, Rattus norvegicus
gcctggtttttggatgctttactca

SEQ ID NO: 397620 - DNA, 25 bp, Rattus norvegicus
gcctgtaagcacagttctgtctgca

SEQ ID NO: 397621 - DNA, 25 bp, Rattus norvegicus
gcctgtaagcactgttctgtctgca

SEQ ID NO: 397622 - DNA, 25 bp, Rattus norvegicus
gcctgtaaggtgatccagcactgat

SEQ ID NO: 397623 - DNA, 25 bp, Rattus norvegicus
gcctgtaaggtgttccagcactgat

SEQ ID NO: 397624 - DNA, 25 bp, Rattus norvegicus
gcctgtacagccactgaggtgggaa

SEQ ID NO: 397625 - DNA, 25 bp, Rattus norvegicus
gcctgtacagcctctgaggtgggaa

SEQ ID NO: 397626 - DNA, 25 bp, Rattus norvegicus
gcctgtaccaagcaagatgttttct

SEQ ID NO: 397627 - DNA, 25 bp, Rattus norvegicus
gcctgtaccaaggaagatgttttct

SEQ ID NO: 397628 - DNA, 25 bp, Rattus norvegicus
gcctgtacctcacagatgctgggat

SEQ ID NO: 397629 - DNA, 25 bp, Rattus norvegicus
gcctgtacctcagagatgctgggat

SEQ ID NO: 397630 - DNA, 25 bp, Rattus norvegicus
gcctgtactgcgacaactgttggaa

SEQ ID NO: 397631 - DNA, 25 bp, Rattus norvegicus
gcctgtactgcgtcaactgttggaa

SEQ ID NO: 397632 - DNA, 25 bp, Rattus norvegicus
gcctgtagaagcagaaacccctgca

SEQ ID NO: 397633 - DNA, 25 bp, Rattus norvegicus
gcctgtagaagctgaaacccctgca

SEQ ID NO: 397634 - DNA, 25 bp, Rattus norvegicus
gcctgtagacgaactgggttcccag

SEQ ID NO: 397635 - DNA, 25 bp, Rattus norvegicus
gcctgtagacgatctgggttcccag

SEQ ID NO: 397636 - DNA, 25 bp, Rattus norvegicus
gcctgtagattgagtggtgagctca

SEQ ID NO: 397637 - DNA, 25 bp, Rattus norvegicus
gcctgtagattgtgtggtgagctca

SEQ ID NO: 397638 - DNA, 25 bp, Rattus norvegicus
gcctgtagcacactcttggcagatt

SEQ ID NO: 397639 - DNA, 25 bp, Rattus norvegicus
gcctgtagcacagtcttggcagatt

SEQ ID NO: 397640 - DNA, 25 bp, Rattus norvegicus
gcctgtaggtggctgactttctcag

SEQ ID NO: 397641 - DNA, 25 bp, Rattus norvegicus
gcctgtaggtgggtgactttctcag

SEQ ID NO: 397642 - DNA, 25 bp, Rattus norvegicus
gcctgtagtggtcgaaacacggccc

SEQ ID NO: 397643 - DNA, 25 bp, Rattus norvegicus
gcctgtagtggtggaaacacggccc

SEQ ID NO: 397644 - DNA, 25 bp, Rattus norvegicus
gcctgtagttatctgtgtacacagt

SEQ ID NO: 397645 - DNA, 25 bp, Rattus norvegicus
gcctgtagttatgtgtgtacacagt

SEQ ID NO: 397646 - DNA, 25 bp, Rattus norvegicus
gcctgtagttcaactgggaggtata

SEQ ID NO: 397647 - DNA, 25 bp, Rattus norvegicus
gcctgtagttcatctgggaggtata

SEQ ID NO: 397648 - DNA, 25 bp, Rattus norvegicus
gcctgtatagatcctcgatgaccat

SEQ ID NO: 397649 - DNA, 25 bp, Rattus norvegicus
gcctgtatagatgctcgatgaccat

SEQ ID NO: 397650 - DNA, 25 bp, Rattus norvegicus
gcctgtatcaggcacccaagttgtg

SEQ ID NO: 397651 - DNA, 25 bp, Rattus norvegicus
gcctgtatcagggacccaagttgtg

SEQ ID NO: 397652 - DNA, 25 bp, Rattus norvegicus
gcctgtatctgcatctgtctgtgga

SEQ ID NO: 397653 - DNA, 25 bp, Rattus norvegicus
gcctgtatctgcttctgtctgtgga

SEQ ID NO: 397654 - DNA, 25 bp, Rattus norvegicus
gcctgtatcttcactctggaattga

SEQ ID NO: 397655 - DNA, 25 bp, Rattus norvegicus
gcctgtatcttctctctggaattga

SEQ ID NO: 397656 - DNA, 25 bp, Rattus norvegicus
gcctgtatgattcggtaccgacctt

SEQ ID NO: 397657 - DNA, 25 bp, Rattus norvegicus
gcctgtatgattgggtaccgacctt

SEQ ID NO: 397658 - DNA, 25 bp, Rattus norvegicus
gcctgtatgcctaactcaagctggg

SEQ ID NO: 397659 - DNA, 25 bp, Rattus norvegicus
gcctgtatgccttactcaagctggg

SEQ ID NO: 397660 - DNA, 25 bp, Rattus norvegicus
gcctgtcaacaacactgcttttggg

SEQ ID NO: 397661 - DNA, 25 bp, Rattus norvegicus
gcctgtcaacaagactgcttttggg

SEQ ID NO: 397662 - DNA, 25 bp, Rattus norvegicus
gcctgtcaagcccttgttggagcta

SEQ ID NO: 397663 - DNA, 25 bp, Rattus norvegicus
gcctgtcaagccgttgttggagcta

SEQ ID NO: 397664 - DNA, 25 bp, Rattus norvegicus
gcctgtcactgtattcacactttat

SEQ ID NO: 397665 - DNA, 25 bp, Rattus norvegicus
gcctgtcactgttttcacactttat

SEQ ID NO: 397666 - DNA, 25 bp, Rattus norvegicus
gcctgtcactttcagggcacataaa

SEQ ID NO: 397667 - DNA, 25 bp, Rattus norvegicus
gcctgtcactttgagggcacataaa

SEQ ID NO: 397668 - DNA, 25 bp, Rattus norvegicus
gcctgtcaggctctgttaccaagga

SEQ ID NO: 397669 - DNA, 25 bp, Rattus norvegicus
gcctgtcaggctgtgttaccaagga

SEQ ID NO: 397670 - DNA, 25 bp, Rattus norvegicus
gcctgtcagggaagcttttaccaca

SEQ ID NO: 397671 - DNA, 25 bp, Rattus norvegicus
gcctgtcagggatgcttttaccaca

SEQ ID NO: 397672 - DNA, 25 bp, Rattus norvegicus
gcctgtcatcctcgcactatgaagg

SEQ ID NO: 397673 - DNA, 25 bp, Rattus norvegicus
gcctgtcatcctcgccctgaggagg

SEQ ID NO: 397674 - DNA, 25 bp, Rattus norvegicus
gcctgtcatcctggcactatgaagg

SEQ ID NO: 397675 - DNA, 25 bp, Rattus norvegicus
gcctgtcatcctggccctgaggagg

SEQ ID NO: 397676 - DNA, 25 bp, Rattus norvegicus
gcctgtcatctcactactgttctga

SEQ ID NO: 397677 - DNA, 25 bp, Rattus norvegicus
gcctgtcatctctctactgttctga

SEQ ID NO: 397678 - DNA, 25 bp, Rattus norvegicus
gcctgtccaaagaagccaccgggaa

SEQ ID NO: 397679 - DNA, 25 bp, Rattus norvegicus
gcctgtccaaagtagccaccgggaa

SEQ ID NO: 397680 - DNA, 25 bp, Rattus norvegicus
gcctgtccacgaagttttcaagcaa

SEQ ID NO: 397681 - DNA, 25 bp, Rattus norvegicus
gcctgtccacgatgttttcaagcaa

SEQ ID NO: 397682 - DNA, 25 bp, Rattus norvegicus
gcctgtccacgtcattttctgtaag

SEQ ID NO: 397683 - DNA, 25 bp, Rattus norvegicus
gcctgtccacgtgattttctgtaag

SEQ ID NO: 397684 - DNA, 25 bp, Rattus norvegicus
gcctgtccacttagatgagtctttt

SEQ ID NO: 397685 - DNA, 25 bp, Rattus norvegicus
gcctgtccactttgatgagtctttt

SEQ ID NO: 397686 - DNA, 25 bp, Rattus norvegicus
gcctgtccagatagtctttctttag

SEQ ID NO: 397687 - DNA, 25 bp, Rattus norvegicus
gcctgtccagattgtctttctttag

SEQ ID NO: 397688 - DNA, 25 bp, Rattus norvegicus
gcctgtccaggacctctcaaggaaa

SEQ ID NO: 397689 - DNA, 25 bp, Rattus norvegicus
gcctgtccaggagctctcaaggaaa

SEQ ID NO: 397690 - DNA, 25 bp, Rattus norvegicus
gcctgtccatctcttgtctgagtta

SEQ ID NO: 397691 - DNA, 25 bp, Rattus norvegicus
gcctgtccatctgttgtctgagtta

SEQ ID NO: 397692 - DNA, 25 bp, Rattus norvegicus
gcctgtccctacctacaagatgtat

SEQ ID NO: 397693 - DNA, 25 bp, Rattus norvegicus
gcctgtccctacgtacaagatgtat

SEQ ID NO: 397694 - DNA, 25 bp, Rattus norvegicus
gcctgtcctacaaagcaagcagcaa

SEQ ID NO: 397695 - DNA, 25 bp, Rattus norvegicus
gcctgtcctacatagcaagcagcaa

SEQ ID NO: 397696 - DNA, 25 bp, Rattus norvegicus
gcctgtccttctcgttattttttgt

SEQ ID NO: 397697 - DNA, 25 bp, Rattus norvegicus
gcctgtccttctggttattttttgt

SEQ ID NO: 397698 - DNA, 25 bp, Rattus norvegicus
gcctgtcggcagcatgatgtattta

SEQ ID NO: 397699 - DNA, 25 bp, Rattus norvegicus
gcctgtcggcaggatgatgtattta

SEQ ID NO: 397700 - DNA, 25 bp, Rattus norvegicus
gcctgtcgtatcaattgccgggtta

SEQ ID NO: 397701 - DNA, 25 bp, Rattus norvegicus
gcctgtcgtatctattgccgggtta

SEQ ID NO: 397702 - DNA, 25 bp, Rattus norvegicus
gcctgtctacccagtcatagttgag

SEQ ID NO: 397703 - DNA, 25 bp, Rattus norvegicus
gcctgtctaccctgtcatagttgag

SEQ ID NO: 397704 - DNA, 25 bp, Rattus norvegicus
gcctgtctagacaggcactgtaaga

SEQ ID NO: 397705 - DNA, 25 bp, Rattus norvegicus
gcctgtctagactggcactgtaaga

SEQ ID NO: 397706 - DNA, 25 bp, Rattus norvegicus
gcctgtctaggactacacgtgcaat

SEQ ID NO: 397707 - DNA, 25 bp, Rattus norvegicus
gcctgtctaggagtacacgtgcaat

SEQ ID NO: 397708 - DNA, 25 bp, Rattus norvegicus
gcctgtctatctcaaaactcttaac

SEQ ID NO: 397709 - DNA, 25 bp, Rattus norvegicus
gcctgtctatctgaaaactcttaac

SEQ ID NO: 397710 - DNA, 25 bp, Rattus norvegicus
gcctgtctcagtaatccattatgga

SEQ ID NO: 397711 - DNA, 25 bp, Rattus norvegicus
gcctgtctcagttatccattatgga

SEQ ID NO: 397712 - DNA, 25 bp, Rattus norvegicus
gcctgtctctagagaaaataaaccc

SEQ ID NO: 397713 - DNA, 25 bp, Rattus norvegicus
gcctgtctctagtgaaaataaaccc

SEQ ID NO: 397714 - DNA, 25 bp, Rattus norvegicus
gcctgtctgtcgcactggaaagatg

SEQ ID NO: 397715 - DNA, 25 bp, Rattus norvegicus
gcctgtctgtcggactggaaagatg

SEQ ID NO: 397716 - DNA, 25 bp, Rattus norvegicus
gcctgtcttcagataagccaattta

SEQ ID NO: 397717 - DNA, 25 bp, Rattus norvegicus
gcctgtcttcagttaagccaattta

SEQ ID NO: 397718 - DNA, 25 bp, Rattus norvegicus
gcctgtcttgcaaactctgggtatg

SEQ ID NO: 397719 - DNA, 25 bp, Rattus norvegicus
gcctgtcttgcatactctgggtatg

SEQ ID NO: 397720 - DNA, 25 bp, Rattus norvegicus
gcctgtcttggaacatatgtgcgtt

SEQ ID NO: 397721 - DNA, 25 bp, Rattus norvegicus
gcctgtcttggatcatatgtgcgtt

SEQ ID NO: 397722 - DNA, 25 bp, Rattus norvegicus
gcctgtgaaaggcaagatccactga

SEQ ID NO: 397723 - DNA, 25 bp, Rattus norvegicus
gcctgtgaaagggaagatccactga

SEQ ID NO: 397724 - DNA, 25 bp, Rattus norvegicus
gcctgtgaaggtattgatttgcaat

SEQ ID NO: 397725 - DNA, 25 bp, Rattus norvegicus
gcctgtgaaggttttgatttgcaat

SEQ ID NO: 397726 - DNA, 25 bp, Rattus norvegicus
gcctgtgaatagaagcgcccttgct

SEQ ID NO: 397727 - DNA, 25 bp, Rattus norvegicus
gcctgtgaatagtagcgcccttgct

SEQ ID NO: 397728 - DNA, 25 bp, Rattus norvegicus
gcctgtgaatgtagccagtcggtac

SEQ ID NO: 397729 - DNA, 25 bp, Rattus norvegicus
gcctgtgaatgttgccagtcggtac

SEQ ID NO: 397730 - DNA, 25 bp, Rattus norvegicus
gcctgtgacaccagtggtcaccgtt

SEQ ID NO: 397731 - DNA, 25 bp, Rattus norvegicus
gcctgtgacacctgtggtcaccgtt

SEQ ID NO: 397732 - DNA, 25 bp, Rattus norvegicus
gcctgtgacttaaaccaaattttgt

SEQ ID NO: 397733 - DNA, 25 bp, Rattus norvegicus
gcctgtgacttataccaaattttgt

SEQ ID NO: 397734 - DNA, 25 bp, Rattus norvegicus
gcctgtgacttcagctattctggag

SEQ ID NO: 397735 - DNA, 25 bp, Rattus norvegicus
gcctgtgacttctgctattctggag

SEQ ID NO: 397736 - DNA, 25 bp, Rattus norvegicus
gcctgtgagcatactgtgtgacctt

SEQ ID NO: 397737 - DNA, 25 bp, Rattus norvegicus
gcctgtgagcattctgtgtgacctt

SEQ ID NO: 397738 - DNA, 25 bp, Rattus norvegicus
gcctgtgaggccaagaccttgatgg

SEQ ID NO: 397739 - DNA, 25 bp, Rattus norvegicus
gcctgtgaggcctagaccttgatgg

SEQ ID NO: 397740 - DNA, 25 bp, Rattus norvegicus
gcctgtgagtacatcggttgtttga

SEQ ID NO: 397741 - DNA, 25 bp, Rattus norvegicus
gcctgtgagtacttcggttgtttga

SEQ ID NO: 397742 - DNA, 25 bp, Rattus norvegicus
gcctgtgagtgtcatagcctatttc

SEQ ID NO: 397743 - DNA, 25 bp, Rattus norvegicus
gcctgtgagtgtgatagcctatttc

SEQ ID NO: 397744 - DNA, 25 bp, Rattus norvegicus
gcctgtgatatgaccgctgggctga

SEQ ID NO: 397745 - DNA, 25 bp, Rattus norvegicus
gcctgtgatatgatttactgaagct

SEQ ID NO: 397746 - DNA, 25 bp, Rattus norvegicus
gcctgtgatatgtccgctgggctga

SEQ ID NO: 397747 - DNA, 25 bp, Rattus norvegicus
gcctgtgatatgttttactgaagct

SEQ ID NO: 397748 - DNA, 25 bp, Rattus norvegicus
gcctgtgatcaaccactgcggagtc

SEQ ID NO: 397749 - DNA, 25 bp, Rattus norvegicus
gcctgtgatcaagcactgcggagtc

SEQ ID NO: 397750 - DNA, 25 bp, Rattus norvegicus
gcctgtgatctcactgagccagagc

SEQ ID NO: 397751 - DNA, 25 bp, Rattus norvegicus
gcctgtgatctctctgagccagagc

SEQ ID NO: 397752 - DNA, 25 bp, Rattus norvegicus
gcctgtgcagacaagctagccatta

SEQ ID NO: 397753 - DNA, 25 bp, Rattus norvegicus
gcctgtgcagactagctagccatta

SEQ ID NO: 397754 - DNA, 25 bp, Rattus norvegicus
gcctgtgcagccattagtaaccaaa

SEQ ID NO: 397755 - DNA, 25 bp, Rattus norvegicus
gcctgtgcagcctttagtaaccaaa

SEQ ID NO: 397756 - DNA, 25 bp, Rattus norvegicus
gcctgtgcagggatccttatgcaga

SEQ ID NO: 397757 - DNA, 25 bp, Rattus norvegicus
gcctgtgcagggttccttatgcaga

SEQ ID NO: 397758 - DNA, 25 bp, Rattus norvegicus
gcctgtgccagcatagattgccaaa

SEQ ID NO: 397759 - DNA, 25 bp, Rattus norvegicus
gcctgtgccagcttagattgccaaa

SEQ ID NO: 397760 - DNA, 25 bp, Rattus norvegicus
gcctgtgccccaaagagtgcaaggt

SEQ ID NO: 397761 - DNA, 25 bp, Rattus norvegicus
gcctgtgccccatagagtgcaaggt

SEQ ID NO: 397762 - DNA, 25 bp, Rattus norvegicus
gcctgtgcccttagtgagcattgca

SEQ ID NO: 397763 - DNA, 25 bp, Rattus norvegicus
gcctgtgccctttgtgagcattgca

SEQ ID NO: 397764 - DNA, 25 bp, Rattus norvegicus
gcctgtgccgctcttatgaagagaa

SEQ ID NO: 397765 - DNA, 25 bp, Rattus norvegicus
gcctgtgccgctgttatgaagagaa

SEQ ID NO: 397766 - DNA, 25 bp, Rattus norvegicus
gcctgtgccggtactatcagagagt

SEQ ID NO: 397767 - DNA, 25 bp, Rattus norvegicus
gcctgtgccggttctatcagagagt

SEQ ID NO: 397768 - DNA, 25 bp, Rattus norvegicus
gcctgtgcctggctggcattattag

SEQ ID NO: 397769 - DNA, 25 bp, Rattus norvegicus
gcctgtgcctgggtggcattattag

SEQ ID NO: 397770 - DNA, 25 bp, Rattus norvegicus
gcctgtgccttcagaaagctctaca

SEQ ID NO: 397771 - DNA, 25 bp, Rattus norvegicus
gcctgtgccttctgaaagctctaca

SEQ ID NO: 397772 - DNA, 25 bp, Rattus norvegicus
gcctgtgctcacacaatcattgtca

SEQ ID NO: 397773 - DNA, 25 bp, Rattus norvegicus
gcctgtgctcacagcagatgtatgc

SEQ ID NO: 397774 - DNA, 25 bp, Rattus norvegicus
gcctgtgctcactcaatcattgtca

SEQ ID NO: 397775 - DNA, 25 bp, Rattus norvegicus
gcctgtgctcactgcagatgtatgc

SEQ ID NO: 397776 - DNA, 25 bp, Rattus norvegicus
gcctgtgctcatcggtaaaggttga

SEQ ID NO: 397777 - DNA, 25 bp, Rattus norvegicus
gcctgtgctcatgggtaaaggttga

SEQ ID NO: 397778 - DNA, 25 bp, Rattus norvegicus
gcctgtgctccaagggaaggctgca

SEQ ID NO: 397779 - DNA, 25 bp, Rattus norvegicus
gcctgtgctccatgggaaggctgca

SEQ ID NO: 397780 - DNA, 25 bp, Rattus norvegicus
gcctgtgctcttccctatgataggg

SEQ ID NO: 397781 - DNA, 25 bp, Rattus norvegicus
gcctgtgctcttgcctatgataggg

SEQ ID NO: 397782 - DNA, 25 bp, Rattus norvegicus
gcctgtgctgagcttttagcttttc

SEQ ID NO: 397783 - DNA, 25 bp, Rattus norvegicus
gcctgtgctgaggttttagcttttc

SEQ ID NO: 397784 - DNA, 25 bp, Rattus norvegicus
gcctgtgcttccagagtggtagagt

SEQ ID NO: 397785 - DNA, 25 bp, Rattus norvegicus
gcctgtgcttcctgagtggtagagt

SEQ ID NO: 397786 - DNA, 25 bp, Rattus norvegicus
gcctgtgcttctcctagtatcaatg

SEQ ID NO: 397787 - DNA, 25 bp, Rattus norvegicus
gcctgtgcttctgctagtatcaatg

SEQ ID NO: 397788 - DNA, 25 bp, Rattus norvegicus
gcctgtgcttgaactaaggtcattt

SEQ ID NO: 397789 - DNA, 25 bp, Rattus norvegicus
gcctgtgcttgatctaaggtcattt

SEQ ID NO: 397790 - DNA, 25 bp, Rattus norvegicus
gcctgtgcttgcaggagtcagacca

SEQ ID NO: 397791 - DNA, 25 bp, Rattus norvegicus
gcctgtgcttgctggagtcagacca

SEQ ID NO: 397792 - DNA, 25 bp, Rattus norvegicus
gcctgtggaatgaattcctcttccc

SEQ ID NO: 397793 - DNA, 25 bp, Rattus norvegicus
gcctgtggaatgtattcctcttccc

SEQ ID NO: 397794 - DNA, 25 bp, Rattus norvegicus
gcctgtggatcgctgactcaacttc

SEQ ID NO: 397795 - DNA, 25 bp, Rattus norvegicus
gcctgtggatcggtgactcaacttc

SEQ ID NO: 397796 - DNA, 25 bp, Rattus norvegicus
gcctgtggctttcgcattagctcca

SEQ ID NO: 397797 - DNA, 25 bp, Rattus norvegicus
gcctgtggctttggcattagctcca

SEQ ID NO: 397798 - DNA, 25 bp, Rattus norvegicus
gcctgtgggacaaacattccccatg

SEQ ID NO: 397799 - DNA, 25 bp, Rattus norvegicus
gcctgtgggacatacattccccatg

SEQ ID NO: 397800 - DNA, 25 bp, Rattus norvegicus
gcctgtggtaggctggttacacaat

SEQ ID NO: 397801 - DNA, 25 bp, Rattus norvegicus
gcctgtggtagggtggttacacaat

SEQ ID NO: 397802 - DNA, 25 bp, Rattus norvegicus
gcctgtggtagtagttgtccctgac

SEQ ID NO: 397803 - DNA, 25 bp, Rattus norvegicus
gcctgtggtagttgttgtccctgac

SEQ ID NO: 397804 - DNA, 25 bp, Rattus norvegicus
gcctgtggtccaagtctatactttt

SEQ ID NO: 397805 - DNA, 25 bp, Rattus norvegicus
gcctgtggtccatgtctatactttt

SEQ ID NO: 397806 - DNA, 25 bp, Rattus norvegicus
gcctgtggtttaagaaagcctcctt

SEQ ID NO: 397807 - DNA, 25 bp, Rattus norvegicus
gcctgtggtttatgaaagcctcctt

SEQ ID NO: 397808 - DNA, 25 bp, Rattus norvegicus
gcctgtgtacacatgcgtgtgctca

SEQ ID NO: 397809 - DNA, 25 bp, Rattus norvegicus
gcctgtgtacacttgcgtgtgctca

SEQ ID NO: 397810 - DNA, 25 bp, Rattus norvegicus
gcctgtgtacatattccttgcaaaa

SEQ ID NO: 397811 - DNA, 25 bp, Rattus norvegicus
gcctgtgtacattttccttgcaaaa

SEQ ID NO: 397812 - DNA, 25 bp, Rattus norvegicus
gcctgtgtattgaccagtgcatgat

SEQ ID NO: 397813 - DNA, 25 bp, Rattus norvegicus
gcctgtgtattgtccagtgcatgat

SEQ ID NO: 397814 - DNA, 25 bp, Rattus norvegicus
gcctgtgtcaggcacactacaaaga

SEQ ID NO: 397815 - DNA, 25 bp, Rattus norvegicus
gcctgtgtcagggacactacaaaga

SEQ ID NO: 397816 - DNA, 25 bp, Rattus norvegicus
gcctgtgtctcgactgctgggatta

SEQ ID NO: 397817 - DNA, 25 bp, Rattus norvegicus
gcctgtgtctcgtctgctgggatta

SEQ ID NO: 397818 - DNA, 25 bp, Rattus norvegicus
gcctgtgtctgcagttacggatgca

SEQ ID NO: 397819 - DNA, 25 bp, Rattus norvegicus
gcctgtgtctgctgttacggatgca

SEQ ID NO: 397820 - DNA, 25 bp, Rattus norvegicus
gcctgtgtctgtatctcagttatgt

SEQ ID NO: 397821 - DNA, 25 bp, Rattus norvegicus
gcctgtgtctgtttctcagttatgt

SEQ ID NO: 397822 - DNA, 25 bp, Rattus norvegicus
gcctgtgtgagcactccaaggagga

SEQ ID NO: 397823 - DNA, 25 bp, Rattus norvegicus
gcctgtgtgagctctccaaggagga

SEQ ID NO: 397824 - DNA, 25 bp, Rattus norvegicus
gcctgtgtgcatacacccacacgaa

SEQ ID NO: 397825 - DNA, 25 bp, Rattus norvegicus
gcctgtgtgcattcacccacacgaa

SEQ ID NO: 397826 - DNA, 25 bp, Rattus norvegicus
gcctgtgtgggtcattctcatcaaa

SEQ ID NO: 397827 - DNA, 25 bp, Rattus norvegicus
gcctgtgtgggtgattctcatcaaa

SEQ ID NO: 397828 - DNA, 25 bp, Rattus norvegicus
gcctgtgtgttccttgagctcagat

SEQ ID NO: 397829 - DNA, 25 bp, Rattus norvegicus
gcctgtgtgttcgttgagctcagat

SEQ ID NO: 397830 - DNA, 25 bp, Rattus norvegicus
gcctgtgttgccaaccacattcagc

SEQ ID NO: 397831 - DNA, 25 bp, Rattus norvegicus
gcctgtgttgcctaccacattcagc

SEQ ID NO: 397832 - DNA, 25 bp, Rattus norvegicus
gcctgtgttggcacccatagaggtg

SEQ ID NO: 397833 - DNA, 25 bp, Rattus norvegicus
gcctgtgttggcagtggcccattaa

SEQ ID NO: 397834 - DNA, 25 bp, Rattus norvegicus
gcctgtgttggctcccatagaggtg

SEQ ID NO: 397835 - DNA, 25 bp, Rattus norvegicus
gcctgtgttggctgtggcccattaa

SEQ ID NO: 397836 - DNA, 25 bp, Rattus norvegicus
gcctgtgttgtgctctttttccaaa

SEQ ID NO: 397837 - DNA, 25 bp, Rattus norvegicus
gcctgtgttgtggtctttttccaaa

SEQ ID NO: 397838 - DNA, 25 bp, Rattus norvegicus
gcctgtgtttccagagtagtggtat

SEQ ID NO: 397839 - DNA, 25 bp, Rattus norvegicus
gcctgtgtttcctgagtagtggtat

SEQ ID NO: 397840 - DNA, 25 bp, Rattus norvegicus
gcctgtgttttgatgctttagattc

SEQ ID NO: 397841 - DNA, 25 bp, Rattus norvegicus
gcctgtgttttgttgctttagattc

SEQ ID NO: 397842 - DNA, 25 bp, Rattus norvegicus
gcctgttaagcacttcagtaatgta

SEQ ID NO: 397843 - DNA, 25 bp, Rattus norvegicus
gcctgttaagcagttcagtaatgta

SEQ ID NO: 397844 - DNA, 25 bp, Rattus norvegicus
gcctgttaatctctttacttcctga

SEQ ID NO: 397845 - DNA, 25 bp, Rattus norvegicus
gcctgttaatctgtttacttcctga

SEQ ID NO: 397846 - DNA, 25 bp, Rattus norvegicus
gcctgttactgaccaatctggcaac

SEQ ID NO: 397847 - DNA, 25 bp, Rattus norvegicus
gcctgttactgagcaatctggcaac

SEQ ID NO: 397848 - DNA, 25 bp, Rattus norvegicus
gcctgttatcaacgtggccgccata

SEQ ID NO: 397849 - DNA, 25 bp, Rattus norvegicus
gcctgttatcaaggtggccgccata

SEQ ID NO: 397850 - DNA, 25 bp, Rattus norvegicus
gcctgttatcataggcctggtgcaa

SEQ ID NO: 397851 - DNA, 25 bp, Rattus norvegicus
gcctgttatcattggcctggtgcaa

SEQ ID NO: 397852 - DNA, 25 bp, Rattus norvegicus
gcctgttatctcctggtggccaata

SEQ ID NO: 397853 - DNA, 25 bp, Rattus norvegicus
gcctgttatctcgtggtggccaata

SEQ ID NO: 397854 - DNA, 25 bp, Rattus norvegicus
gcctgttcacagcactctgaatgac

SEQ ID NO: 397855 - DNA, 25 bp, Rattus norvegicus
gcctgttcacaggactctgaatgac

SEQ ID NO: 397856 - DNA, 25 bp, Rattus norvegicus
gcctgttcagagacatctagcaagt

SEQ ID NO: 397857 - DNA, 25 bp, Rattus norvegicus
gcctgttcagagtcatctagcaagt

SEQ ID NO: 397858 - DNA, 25 bp, Rattus norvegicus
gcctgttccagaattgctagaagcc

SEQ ID NO: 397859 - DNA, 25 bp, Rattus norvegicus
gcctgttccagatttgctagaagcc

SEQ ID NO: 397860 - DNA, 25 bp, Rattus norvegicus
gcctgttccctcatagatgagcaat

SEQ ID NO: 397861 - DNA, 25 bp, Rattus norvegicus
gcctgttccctcttagatgagcaat

SEQ ID NO: 397862 - DNA, 25 bp, Rattus norvegicus
gcctgttcctctatgaagacttcat

SEQ ID NO: 397863 - DNA, 25 bp, Rattus norvegicus
gcctgttcctctttgaagacttcat

SEQ ID NO: 397864 - DNA, 25 bp, Rattus norvegicus
gcctgttcggtaagtggttttttga

SEQ ID NO: 397865 - DNA, 25 bp, Rattus norvegicus
gcctgttcggtatgtggttttttga

SEQ ID NO: 397866 - DNA, 25 bp, Rattus norvegicus
gcctgttctcatctttagtgcttat

SEQ ID NO: 397867 - DNA, 25 bp, Rattus norvegicus
gcctgttctcatgtttagtgcttat

SEQ ID NO: 397868 - DNA, 25 bp, Rattus norvegicus
gcctgttctcctatgggctggacaa

SEQ ID NO: 397869 - DNA, 25 bp, Rattus norvegicus
gcctgttctcctttgggctggacaa

SEQ ID NO: 397870 - DNA, 25 bp, Rattus norvegicus
gcctgttctcttagagctcattaaa

SEQ ID NO: 397871 - DNA, 25 bp, Rattus norvegicus
gcctgttctctttgagctcattaaa

SEQ ID NO: 397872 - DNA, 25 bp, Rattus norvegicus
gcctgttctgcgatgtgcggaatca

SEQ ID NO: 397873 - DNA, 25 bp, Rattus norvegicus
gcctgttctgcgttgtgcggaatca

SEQ ID NO: 397874 - DNA, 25 bp, Rattus norvegicus
gcctgttctggactcgttgaaactg

SEQ ID NO: 397875 - DNA, 25 bp, Rattus norvegicus
gcctgttctggagtcgttgaaactg

SEQ ID NO: 397876 - DNA, 25 bp, Rattus norvegicus
gcctgttgacttcaaaacgcctaaa

SEQ ID NO: 397877 - DNA, 25 bp, Rattus norvegicus
gcctgttgacttgaaaacgcctaaa

SEQ ID NO: 397878 - DNA, 25 bp, Rattus norvegicus
gcctgttgcctgctagtcatggaca

SEQ ID NO: 397879 - DNA, 25 bp, Rattus norvegicus
gcctgttgcctggtagtcatggaca

SEQ ID NO: 397880 - DNA, 25 bp, Rattus norvegicus
gcctgttggaccattagttcctttt

SEQ ID NO: 397881 - DNA, 25 bp, Rattus norvegicus
gcctgttggacctttagttcctttt

SEQ ID NO: 397882 - DNA, 25 bp, Rattus norvegicus
gcctgttgggcactcttttgattaa

SEQ ID NO: 397883 - DNA, 25 bp, Rattus norvegicus
gcctgttgggcagtcttttgattaa

SEQ ID NO: 397884 - DNA, 25 bp, Rattus norvegicus
gcctgttgtcacattatgcttctag

SEQ ID NO: 397885 - DNA, 25 bp, Rattus norvegicus
gcctgttgtcactttatgcttctag

SEQ ID NO: 397886 - DNA, 25 bp, Rattus norvegicus
gcctgttgtgtaatttcttgattaa

SEQ ID NO: 397887 - DNA, 25 bp, Rattus norvegicus
gcctgttgtgtattttcttgattaa

SEQ ID NO: 397888 - DNA, 25 bp, Rattus norvegicus
gcctgtttaccaatatctaatttca

SEQ ID NO: 397889 - DNA, 25 bp, Rattus norvegicus
gcctgtttaccattatctaatttca

SEQ ID NO: 397890 - DNA, 25 bp, Rattus norvegicus
gcctgtttacccagtagagtctcaa

SEQ ID NO: 397891 - DNA, 25 bp, Rattus norvegicus
gcctgtttaccctgtagagtctcaa

SEQ ID NO: 397892 - DNA, 25 bp, Rattus norvegicus
gcctgtttatccagccttcaaaata

SEQ ID NO: 397893 - DNA, 25 bp, Rattus norvegicus
gcctgtttatcctgccttcaaaata

SEQ ID NO: 397894 - DNA, 25 bp, Rattus norvegicus
gcctgtttcacaccagtctgaggta

SEQ ID NO: 397895 - DNA, 25 bp, Rattus norvegicus
gcctgtttcacagcagtctgaggta

SEQ ID NO: 397896 - DNA, 25 bp, Rattus norvegicus
gcctgtttcaggaggtactctgtat

SEQ ID NO: 397897 - DNA, 25 bp, Rattus norvegicus
gcctgtttcaggcaaggtccgagtt

SEQ ID NO: 397898 - DNA, 25 bp, Rattus norvegicus
gcctgtttcagggaaggtccgagtt

SEQ ID NO: 397899 - DNA, 25 bp, Rattus norvegicus
gcctgtttcaggtggtactctgtat

SEQ ID NO: 397900 - DNA, 25 bp, Rattus norvegicus
gcctgtttcttcagtggcctgaaag

SEQ ID NO: 397901 - DNA, 25 bp, Rattus norvegicus
gcctgtttcttctgtggcctgaaag

SEQ ID NO: 397902 - DNA, 25 bp, Rattus norvegicus
gcctgtttgtttcaatgactccttc

SEQ ID NO: 397903 - DNA, 25 bp, Rattus norvegicus
gcctgtttgtttgaatgactccttc

SEQ ID NO: 397904 - DNA, 25 bp, Rattus norvegicus
gcctgttttgcacccagaggactgg

SEQ ID NO: 397905 - DNA, 25 bp, Rattus norvegicus
gcctgttttgcagccagaggactgg

SEQ ID NO: 397906 - DNA, 25 bp, Rattus norvegicus
gcctgtttttacatattcctttcat

SEQ ID NO: 397907 - DNA, 25 bp, Rattus norvegicus
gcctgtttttacttattcctttcat

SEQ ID NO: 397908 - DNA, 25 bp, Rattus norvegicus
gcctgtttttcacatcttcatggac

SEQ ID NO: 397909 - DNA, 25 bp, Rattus norvegicus
gcctgtttttcagatcttcatggac

SEQ ID NO: 397910 - DNA, 25 bp, Rattus norvegicus
gccttaaaccgtccttcaggagcta

SEQ ID NO: 397911 - DNA, 25 bp, Rattus norvegicus
gccttaaaccgtgcttcaggagcta

SEQ ID NO: 397912 - DNA, 25 bp, Rattus norvegicus
gccttaaagagcaccagactgggat

SEQ ID NO: 397913 - DNA, 25 bp, Rattus norvegicus
gccttaaagagctccagactgggat

SEQ ID NO: 397914 - DNA, 25 bp, Rattus norvegicus
gccttaacctcaatgcttttgcttt

SEQ ID NO: 397915 - DNA, 25 bp, Rattus norvegicus
gccttaacctcattgcttttgcttt

SEQ ID NO: 397916 - DNA, 25 bp, Rattus norvegicus
gccttaacgtgaacagaaatctagt

SEQ ID NO: 397917 - DNA, 25 bp, Rattus norvegicus
gccttaacgtgatcagaaatctagt

SEQ ID NO: 397918 - DNA, 25 bp, Rattus norvegicus
gccttaactcagcttgcaacatgca

SEQ ID NO: 397919 - DNA, 25 bp, Rattus norvegicus
gccttaactcaggttgcaacatgca

SEQ ID NO: 397920 - DNA, 25 bp, Rattus norvegicus
gccttaactctgaccatgttttaat

SEQ ID NO: 397921 - DNA, 25 bp, Rattus norvegicus
gccttaactctgtccatgttttaat

SEQ ID NO: 397922 - DNA, 25 bp, Rattus norvegicus
gccttaacttcaaattgccttcttt

SEQ ID NO: 397923 - DNA, 25 bp, Rattus norvegicus
gccttaacttcatattgccttcttt

SEQ ID NO: 397924 - DNA, 25 bp, Rattus norvegicus
gccttaagccggcaagtcgagagtc

SEQ ID NO: 397925 - DNA, 25 bp, Rattus norvegicus
gccttaagccgggaagtcgagagtc

SEQ ID NO: 397926 - DNA, 25 bp, Rattus norvegicus
gccttaaggaaaccgtgcccgctgt

SEQ ID NO: 397927 - DNA, 25 bp, Rattus norvegicus
gccttaaggaaagcgtgcccgctgt

SEQ ID NO: 397928 - DNA, 25 bp, Rattus norvegicus
gccttaaggcctcgtagtgcttcaa

SEQ ID NO: 397929 - DNA, 25 bp, Rattus norvegicus
gccttaaggcctggtagtgcttcaa

SEQ ID NO: 397930 - DNA, 25 bp, Rattus norvegicus
gccttaattaggaagtcagcctcaa

SEQ ID NO: 397931 - DNA, 25 bp, Rattus norvegicus
gccttaattaggtagtcagcctcaa

SEQ ID NO: 397932 - DNA, 25 bp, Rattus norvegicus
gccttacaggcacacattttctagc

SEQ ID NO: 397933 - DNA, 25 bp, Rattus norvegicus
gccttacaggcagacattttctagc

SEQ ID NO: 397934 - DNA, 25 bp, Rattus norvegicus
gccttacaggtaactaatgggcata

SEQ ID NO: 397935 - DNA, 25 bp, Rattus norvegicus
gccttacaggtatctaatgggcata

SEQ ID NO: 397936 - DNA, 25 bp, Rattus norvegicus
gccttacattttatagctagaataa

SEQ ID NO: 397937 - DNA, 25 bp, Rattus norvegicus
gccttacattttttagctagaataa

SEQ ID NO: 397938 - DNA, 25 bp, Rattus norvegicus
gccttaccactcagactttgaagta

SEQ ID NO: 397939 - DNA, 25 bp, Rattus norvegicus
gccttaccactctgactttgaagta

SEQ ID NO: 397940 - DNA, 25 bp, Rattus norvegicus
gccttacccctacttgcaagaaact

SEQ ID NO: 397941 - DNA, 25 bp, Rattus norvegicus
gccttacccctagttgcaagaaact

SEQ ID NO: 397942 - DNA, 25 bp, Rattus norvegicus
gccttaccctgtacgtttcgtgatg

SEQ ID NO: 397943 - DNA, 25 bp, Rattus norvegicus
gccttaccctgttcgtttcgtgatg

SEQ ID NO: 397944 - DNA, 25 bp, Rattus norvegicus
gccttaccgacgatacatggcagtc

SEQ ID NO: 397945 - DNA, 25 bp, Rattus norvegicus
gccttaccgacgttacatggcagtc

SEQ ID NO: 397946 - DNA, 25 bp, Rattus norvegicus
gccttacctaccacataagcttgtt

SEQ ID NO: 397947 - DNA, 25 bp, Rattus norvegicus
gccttacctacctcataagcttgtt

SEQ ID NO: 397948 - DNA, 25 bp, Rattus norvegicus
gccttacctagccagtttaaacctg

SEQ ID NO: 397949 - DNA, 25 bp, Rattus norvegicus
gccttacctagcgagtttaaacctg

SEQ ID NO: 397950 - DNA, 25 bp, Rattus norvegicus
gccttactatatcgctctgactaga

SEQ ID NO: 397951 - DNA, 25 bp, Rattus norvegicus
gccttactatatggctctgactaga

SEQ ID NO: 397952 - DNA, 25 bp, Rattus norvegicus
gccttactcctacatagtttctggg

SEQ ID NO: 397953 - DNA, 25 bp, Rattus norvegicus
gccttactcctagatagtttctggg

SEQ ID NO: 397954 - DNA, 25 bp, Rattus norvegicus
gccttactggccaaaattcaactga

SEQ ID NO: 397955 - DNA, 25 bp, Rattus norvegicus
gccttactggcctaaattcaactga

SEQ ID NO: 397956 - DNA, 25 bp, Rattus norvegicus
gccttactgggcagttgatgacaac

SEQ ID NO: 397957 - DNA, 25 bp, Rattus norvegicus
gccttactgggctgttgatgacaac

SEQ ID NO: 397958 - DNA, 25 bp, Rattus norvegicus
gccttacttgctaacaaatgcccag

SEQ ID NO: 397959 - DNA, 25 bp, Rattus norvegicus
gccttacttgcttacaaatgcccag

SEQ ID NO: 397960 - DNA, 25 bp, Rattus norvegicus
gccttagaagtgcaacagtgctcat

SEQ ID NO: 397961 - DNA, 25 bp, Rattus norvegicus
gccttagaagtggaacagtgctcat

SEQ ID NO: 397962 - DNA, 25 bp, Rattus norvegicus
gccttagagacccttgtggctcaaa

SEQ ID NO: 397963 - DNA, 25 bp, Rattus norvegicus
gccttagagaccgttgtggctcaaa

SEQ ID NO: 397964 - DNA, 25 bp, Rattus norvegicus
gccttagagggtaacagaactgatg

SEQ ID NO: 397965 - DNA, 25 bp, Rattus norvegicus
gccttagagggttacagaactgatg

SEQ ID NO: 397966 - DNA, 25 bp, Rattus norvegicus
gccttagatctcacgccgccaatgc

SEQ ID NO: 397967 - DNA, 25 bp, Rattus norvegicus
gccttagatctctcgccgccaatgc

SEQ ID NO: 397968 - DNA, 25 bp, Rattus norvegicus
gccttagatgctctggttttgtgat

SEQ ID NO: 397969 - DNA, 25 bp, Rattus norvegicus
gccttagatgctgtggttttgtgat

SEQ ID NO: 397970 - DNA, 25 bp, Rattus norvegicus
gccttagcaagtctgaaactgttca

SEQ ID NO: 397971 - DNA, 25 bp, Rattus norvegicus
gccttagcaagtgtgaaactgttca

SEQ ID NO: 397972 - DNA, 25 bp, Rattus norvegicus
gccttagccagccagtgacaagtga

SEQ ID NO: 397973 - DNA, 25 bp, Rattus norvegicus
gccttagccagcgagtgacaagtga

SEQ ID NO: 397974 - DNA, 25 bp, Rattus norvegicus
gccttagccgaccagtttgttagca

SEQ ID NO: 397975 - DNA, 25 bp, Rattus norvegicus
gccttagccgacgagtttgttagca

SEQ ID NO: 397976 - DNA, 25 bp, Rattus norvegicus
gccttagctctcctgtatgtttcag

SEQ ID NO: 397977 - DNA, 25 bp, Rattus norvegicus
gccttagctctcgtgtatgtttcag

SEQ ID NO: 397978 - DNA, 25 bp, Rattus norvegicus
gccttagctgtcagtgtggtttaga

SEQ ID NO: 397979 - DNA, 25 bp, Rattus norvegicus
gccttagctgtctgtgtggtttaga

SEQ ID NO: 397980 - DNA, 25 bp, Rattus norvegicus
gccttaggcctgaatgtcgtgcgaa

SEQ ID NO: 397981 - DNA, 25 bp, Rattus norvegicus
gccttaggcctgtatgtcgtgcgaa

SEQ ID NO: 397982 - DNA, 25 bp, Rattus norvegicus
gccttaggctcaagctgcatgctaa

SEQ ID NO: 397983 - DNA, 25 bp, Rattus norvegicus
gccttaggctcatgctgcatgctaa

SEQ ID NO: 397984 - DNA, 25 bp, Rattus norvegicus
gccttagggagtccagtggtctcca

SEQ ID NO: 397985 - DNA, 25 bp, Rattus norvegicus
gccttagggagtgcagtggtctcca

SEQ ID NO: 397986 - DNA, 25 bp, Rattus norvegicus
gccttaggtggccttggtatacatt

SEQ ID NO: 397987 - DNA, 25 bp, Rattus norvegicus
gccttaggtggcgttggtatacatt

SEQ ID NO: 397988 - DNA, 25 bp, Rattus norvegicus
gccttagtgaaaacagctgctgctc

SEQ ID NO: 397989 - DNA, 25 bp, Rattus norvegicus
gccttagtgaaatcagctgctgctc

SEQ ID NO: 397990 - DNA, 25 bp, Rattus norvegicus
gccttagtgcagagggtttaacaga

SEQ ID NO: 397991 - DNA, 25 bp, Rattus norvegicus
gccttagtgcagtgggtttaacaga

SEQ ID NO: 397992 - DNA, 25 bp, Rattus norvegicus
gccttatactatcctttggagatgg

SEQ ID NO: 397993 - DNA, 25 bp, Rattus norvegicus
gccttatactatgctttggagatgg

SEQ ID NO: 397994 - DNA, 25 bp, Rattus norvegicus
gccttatactcaacttcagatgatg

SEQ ID NO: 397995 - DNA, 25 bp, Rattus norvegicus
gccttatactcatcttcagatgatg

SEQ ID NO: 397996 - DNA, 25 bp, Rattus norvegicus
gccttataggacagggtcttaccct

SEQ ID NO: 397997 - DNA, 25 bp, Rattus norvegicus
gccttataggactgggtcttaccct

SEQ ID NO: 397998 - DNA, 25 bp, Rattus norvegicus
gccttatccactatgctttagggca

SEQ ID NO: 397999 - DNA, 25 bp, Rattus norvegicus
gccttatccactttgctttagggca

SEQ ID NO: 398000 - DNA, 25 bp, Rattus norvegicus
gccttatccattcccagaggcactg

SEQ ID NO: 398001 - DNA, 25 bp, Rattus norvegicus
gccttatccattgccagaggcactg

SEQ ID NO: 398002 - DNA, 25 bp, Rattus norvegicus
gccttatccgacatcttggtggtga

SEQ ID NO: 398003 - DNA, 25 bp, Rattus norvegicus
gccttatccgacttcttggtggtga

SEQ ID NO: 398004 - DNA, 25 bp, Rattus norvegicus
gccttatctctacggttggcattaa

SEQ ID NO: 398005 - DNA, 25 bp, Rattus norvegicus
gccttatctctagggttggcattaa

SEQ ID NO: 398006 - DNA, 25 bp, Rattus norvegicus
gccttatctgatagtcaagccttga

SEQ ID NO: 398007 - DNA, 25 bp, Rattus norvegicus
gccttatctgattgtcaagccttga

SEQ ID NO: 398008 - DNA, 25 bp, Rattus norvegicus
gccttatgcttcatgcactggcacc

SEQ ID NO: 398009 - DNA, 25 bp, Rattus norvegicus
gccttatgcttcttgcactggcacc

SEQ ID NO: 398010 - DNA, 25 bp, Rattus norvegicus
gccttatggattcttcttcttggaa

SEQ ID NO: 398011 - DNA, 25 bp, Rattus norvegicus
gccttatggattgttcttcttggaa

SEQ ID NO: 398012 - DNA, 25 bp, Rattus norvegicus
gccttatggcccctatggattaaat

SEQ ID NO: 398013 - DNA, 25 bp, Rattus norvegicus
gccttatggcccgtatggattaaat

SEQ ID NO: 398014 - DNA, 25 bp, Rattus norvegicus
gccttatggctgacgggaagatctt

SEQ ID NO: 398015 - DNA, 25 bp, Rattus norvegicus
gccttatggctgtcgggaagatctt

SEQ ID NO: 398016 - DNA, 25 bp, Rattus norvegicus
gccttattacttcccatcttgagaa

SEQ ID NO: 398017 - DNA, 25 bp, Rattus norvegicus
gccttattacttgccatcttgagaa

SEQ ID NO: 398018 - DNA, 25 bp, Rattus norvegicus
gccttattattcctgcagtgctgaa

SEQ ID NO: 398019 - DNA, 25 bp, Rattus norvegicus
gccttattattcgtgcagtgctgaa

SEQ ID NO: 398020 - DNA, 25 bp, Rattus norvegicus
gccttattcctcatttcatcagaga

SEQ ID NO: 398021 - DNA, 25 bp, Rattus norvegicus
gccttattcctcttttcatcagaga

SEQ ID NO: 398022 - DNA, 25 bp, Rattus norvegicus
gccttattcggaagtgaagcctttg

SEQ ID NO: 398023 - DNA, 25 bp, Rattus norvegicus
gccttattcggatgtgaagcctttg

SEQ ID NO: 398024 - DNA, 25 bp, Rattus norvegicus
gccttattgtcactgcattcatagt

SEQ ID NO: 398025 - DNA, 25 bp, Rattus norvegicus
gccttattgtcagtgcattcatagt

SEQ ID NO: 398026 - DNA, 25 bp, Rattus norvegicus
gccttattgtccagttcttcaggaa

SEQ ID NO: 398027 - DNA, 25 bp, Rattus norvegicus
gccttattgtcctgttcttcaggaa

SEQ ID NO: 398028 - DNA, 25 bp, Rattus norvegicus
gccttatttgtaagaattctctttg

SEQ ID NO: 398029 - DNA, 25 bp, Rattus norvegicus
gccttatttgtatgaattctctttg

SEQ ID NO: 398030 - DNA, 25 bp, Rattus norvegicus
gccttatttttaacttagtctgcat

SEQ ID NO: 398031 - DNA, 25 bp, Rattus norvegicus
gccttatttttatcttagtctgcat

SEQ ID NO: 398032 - DNA, 25 bp, Rattus norvegicus
gccttcaaaagccaagcgctatgct

SEQ ID NO: 398033 - DNA, 25 bp, Rattus norvegicus
gccttcaaaagcgaagcgctatgct

SEQ ID NO: 398034 - DNA, 25 bp, Rattus norvegicus
gccttcaagaggcagatgtcatcca

SEQ ID NO: 398035 - DNA, 25 bp, Rattus norvegicus
gccttcaagagggagatgtcatcca

SEQ ID NO: 398036 - DNA, 25 bp, Rattus norvegicus
gccttcaaggtgaggttcagcgctg

SEQ ID NO: 398037 - DNA, 25 bp, Rattus norvegicus
gccttcaaggtgtggttcagcgctg

SEQ ID NO: 398038 - DNA, 25 bp, Rattus norvegicus
gccttcaatactacgcatttttggg

SEQ ID NO: 398039 - DNA, 25 bp, Rattus norvegicus
gccttcaatacttcgcatttttggg

SEQ ID NO: 398040 - DNA, 25 bp, Rattus norvegicus
gccttcaatataccatgaaccctct

SEQ ID NO: 398041 - DNA, 25 bp, Rattus norvegicus
gccttcaatatagcatgaaccctct

SEQ ID NO: 398042 - DNA, 25 bp, Rattus norvegicus
gccttcaatggcagctcatacttca

SEQ ID NO: 398043 - DNA, 25 bp, Rattus norvegicus
gccttcaatggctgctcatacttca

SEQ ID NO: 398044 - DNA, 25 bp, Rattus norvegicus
gccttcacactgaacctacatgtat

SEQ ID NO: 398045 - DNA, 25 bp, Rattus norvegicus
gccttcacactgtacctacatgtat

SEQ ID NO: 398046 - DNA, 25 bp, Rattus norvegicus
gccttcacagatatcctatgtacaa

SEQ ID NO: 398047 - DNA, 25 bp, Rattus norvegicus
gccttcacagatttcctatgtacaa

SEQ ID NO: 398048 - DNA, 25 bp, Rattus norvegicus
gccttcaccatcaagtgatcggatg

SEQ ID NO: 398049 - DNA, 25 bp, Rattus norvegicus
gccttcaccatctagtgatcggatg

SEQ ID NO: 398050 - DNA, 25 bp, Rattus norvegicus
gccttcaccctaaagtaggaagcta

SEQ ID NO: 398051 - DNA, 25 bp, Rattus norvegicus
gccttcaccctatagtaggaagcta

SEQ ID NO: 398052 - DNA, 25 bp, Rattus norvegicus
gccttcacctgtagtaattcttcat

SEQ ID NO: 398053 - DNA, 25 bp, Rattus norvegicus
gccttcacctgttgtaattcttcat

SEQ ID NO: 398054 - DNA, 25 bp, Rattus norvegicus
gccttcacgctcatgatggctcatg

SEQ ID NO: 398055 - DNA, 25 bp, Rattus norvegicus
gccttcacgctcttgatggctcatg

SEQ ID NO: 398056 - DNA, 25 bp, Rattus norvegicus
gccttcactctgaaacagcctgttt

SEQ ID NO: 398057 - DNA, 25 bp, Rattus norvegicus
gccttcactctgtaacagcctgttt

SEQ ID NO: 398058 - DNA, 25 bp, Rattus norvegicus
gccttcacttttcaggaatgcgttc

SEQ ID NO: 398059 - DNA, 25 bp, Rattus norvegicus
gccttcacttttgaggaatgcgttc

SEQ ID NO: 398060 - DNA, 25 bp, Rattus norvegicus
gccttcagccggcactggaaacaat

SEQ ID NO: 398061 - DNA, 25 bp, Rattus norvegicus
gccttcagccgggactggaaacaat

SEQ ID NO: 398062 - DNA, 25 bp, Rattus norvegicus
gccttcagctcccaaagtgggtggt

SEQ ID NO: 398063 - DNA, 25 bp, Rattus norvegicus
gccttcagctccgaaagtgggtggt

SEQ ID NO: 398064 - DNA, 25 bp, Rattus norvegicus
gccttcagctgaaaacgtaatgttc

SEQ ID NO: 398065 - DNA, 25 bp, Rattus norvegicus
gccttcagctgataacgtaatgttc

SEQ ID NO: 398066 - DNA, 25 bp, Rattus norvegicus
gccttcagttacataccgcagtgta

SEQ ID NO: 398067 - DNA, 25 bp, Rattus norvegicus
gccttcagttacttaccgcagtgta

SEQ ID NO: 398068 - DNA, 25 bp, Rattus norvegicus
gccttcatagtcaccggcgaaaagt

SEQ ID NO: 398069 - DNA, 25 bp, Rattus norvegicus
gccttcatagtctccggcgaaaagt

SEQ ID NO: 398070 - DNA, 25 bp, Rattus norvegicus
gccttcatcctgacagggaaccaag

SEQ ID NO: 398071 - DNA, 25 bp, Rattus norvegicus
gccttcatcctgtcagggaaccaag

SEQ ID NO: 398072 - DNA, 25 bp, Rattus norvegicus
gccttcatctcgattctagtttttg

SEQ ID NO: 398073 - DNA, 25 bp, Rattus norvegicus
gccttcatctcgtttctagtttttg

SEQ ID NO: 398074 - DNA, 25 bp, Rattus norvegicus
gccttcatgagtctggcattctgtt

SEQ ID NO: 398075 - DNA, 25 bp, Rattus norvegicus
gccttcatgagtgtggcattctgtt

SEQ ID NO: 398076 - DNA, 25 bp, Rattus norvegicus
gccttcatgctcaggttagggtgag

SEQ ID NO: 398077 - DNA, 25 bp, Rattus norvegicus
gccttcatgctctggttagggtgag

SEQ ID NO: 398078 - DNA, 25 bp, Rattus norvegicus
gccttcatgtggacccttagaacag

SEQ ID NO: 398079 - DNA, 25 bp, Rattus norvegicus
gccttcatgtggtcccttagaacag

SEQ ID NO: 398080 - DNA, 25 bp, Rattus norvegicus
gccttcattactatgccatagaaat

SEQ ID NO: 398081 - DNA, 25 bp, Rattus norvegicus
gccttcattactttgccatagaaat

SEQ ID NO: 398082 - DNA, 25 bp, Rattus norvegicus
gccttcattcacagttttatgtttt

SEQ ID NO: 398083 - DNA, 25 bp, Rattus norvegicus
gccttcattcactgttttatgtttt

SEQ ID NO: 398084 - DNA, 25 bp, Rattus norvegicus
gccttcattggcagcaaggatgagt

SEQ ID NO: 398085 - DNA, 25 bp, Rattus norvegicus
gccttcattggcagcttttaccatt

SEQ ID NO: 398086 - DNA, 25 bp, Rattus norvegicus
gccttcattggctgcaaggatgagt

SEQ ID NO: 398087 - DNA, 25 bp, Rattus norvegicus
gccttcattggctgcttttaccatt

SEQ ID NO: 398088 - DNA, 25 bp, Rattus norvegicus
gccttccaaatgctatcaacctggg

SEQ ID NO: 398089 - DNA, 25 bp, Rattus norvegicus
gccttccaaatggtatcaacctggg

SEQ ID NO: 398090 - DNA, 25 bp, Rattus norvegicus
gccttccacatgagtgttgtgctac

SEQ ID NO: 398091 - DNA, 25 bp, Rattus norvegicus
gccttccacatgtgtgttgtgctac

SEQ ID NO: 398092 - DNA, 25 bp, Rattus norvegicus
gccttccactgaccttgtgtagaaa

SEQ ID NO: 398093 - DNA, 25 bp, Rattus norvegicus
gccttccactgagcttgtgtagaaa

SEQ ID NO: 398094 - DNA, 25 bp, Rattus norvegicus
gccttccactggatgttttgatagt

SEQ ID NO: 398095 - DNA, 25 bp, Rattus norvegicus
gccttccactggttgttttgatagt

SEQ ID NO: 398096 - DNA, 25 bp, Rattus norvegicus
gccttccactttaaaactccagaat

SEQ ID NO: 398097 - DNA, 25 bp, Rattus norvegicus
gccttccacttttaaactccagaat

SEQ ID NO: 398098 - DNA, 25 bp, Rattus norvegicus
gccttccagagtccaatgattaaac

SEQ ID NO: 398099 - DNA, 25 bp, Rattus norvegicus
gccttccagagtgcaatgattaaac

SEQ ID NO: 398100 - DNA, 25 bp, Rattus norvegicus
gccttccagctgctcagatattcaa

SEQ ID NO: 398101 - DNA, 25 bp, Rattus norvegicus
gccttccagctggtcagatattcaa

SEQ ID NO: 398102 - DNA, 25 bp, Rattus norvegicus
gccttccagggacaaagccatttca

SEQ ID NO: 398103 - DNA, 25 bp, Rattus norvegicus
gccttccagggagaaagccatttca

SEQ ID NO: 398104 - DNA, 25 bp, Rattus norvegicus
gccttccattctatcgctatgtgta

SEQ ID NO: 398105 - DNA, 25 bp, Rattus norvegicus
gccttccattctttcgctatgtgta

SEQ ID NO: 398106 - DNA, 25 bp, Rattus norvegicus
gccttcccaaaacgtgctgcagata

SEQ ID NO: 398107 - DNA, 25 bp, Rattus norvegicus
gccttcccaaaaggtgctgcagata

SEQ ID NO: 398108 - DNA, 25 bp, Rattus norvegicus
gccttcccagccaatttttgtaaat

SEQ ID NO: 398109 - DNA, 25 bp, Rattus norvegicus
gccttcccagcctatttttgtaaat

SEQ ID NO: 398110 - DNA, 25 bp, Rattus norvegicus
gccttcccagggaaacagggttgag

SEQ ID NO: 398111 - DNA, 25 bp, Rattus norvegicus
gccttcccagggtaacagggttgag

SEQ ID NO: 398112 - DNA, 25 bp, Rattus norvegicus
gccttcccagtaatgcaggactgaa

SEQ ID NO: 398113 - DNA, 25 bp, Rattus norvegicus
gccttcccagtattgcaggactgaa

SEQ ID NO: 398114 - DNA, 25 bp, Rattus norvegicus
gccttcccagtgctgagatcacttc

SEQ ID NO: 398115 - DNA, 25 bp, Rattus norvegicus
gccttcccagtggtgagatcacttc

SEQ ID NO: 398116 - DNA, 25 bp, Rattus norvegicus
gccttcccatgacattctgatacta

SEQ ID NO: 398117 - DNA, 25 bp, Rattus norvegicus
gccttcccatgagattctgatacta

SEQ ID NO: 398118 - DNA, 25 bp, Rattus norvegicus
gccttccccaacctattagattgtg

SEQ ID NO: 398119 - DNA, 25 bp, Rattus norvegicus
gccttccccaacgtattagattgtg

SEQ ID NO: 398120 - DNA, 25 bp, Rattus norvegicus
gccttccccgtgatgaagcactata

SEQ ID NO: 398121 - DNA, 25 bp, Rattus norvegicus
gccttccccgtgttgaagcactata

SEQ ID NO: 398122 - DNA, 25 bp, Rattus norvegicus
gccttcccctaaactatgtaaactt

SEQ ID NO: 398123 - DNA, 25 bp, Rattus norvegicus
gccttcccctaatctatgtaaactt

SEQ ID NO: 398124 - DNA, 25 bp, Rattus norvegicus
gccttccctggcaagagttttctat

SEQ ID NO: 398125 - DNA, 25 bp, Rattus norvegicus
gccttccctggctagagttttctat

SEQ ID NO: 398126 - DNA, 25 bp, Rattus norvegicus
gccttccctggtctgcataaaaaat

SEQ ID NO: 398127 - DNA, 25 bp, Rattus norvegicus
gccttccctggtgtgcataaaaaat

SEQ ID NO: 398128 - DNA, 25 bp, Rattus norvegicus
gccttcccttaaccaggactatgaa

SEQ ID NO: 398129 - DNA, 25 bp, Rattus norvegicus
gccttcccttaagcaggactatgaa

SEQ ID NO: 398130 - DNA, 25 bp, Rattus norvegicus
gccttccgatttactcagctggaga

SEQ ID NO: 398131 - DNA, 25 bp, Rattus norvegicus
gccttccgattttctcagctggaga

SEQ ID NO: 398132 - DNA, 25 bp, Rattus norvegicus
gccttccgcctcaggagtcggcgaa

SEQ ID NO: 398133 - DNA, 25 bp, Rattus norvegicus
gccttccgcctctggagtcggcgaa

SEQ ID NO: 398134 - DNA, 25 bp, Rattus norvegicus
gccttccgcgtgattttgtaagata

SEQ ID NO: 398135 - DNA, 25 bp, Rattus norvegicus
gccttccgcgtgtttttgtaagata

SEQ ID NO: 398136 - DNA, 25 bp, Rattus norvegicus
gccttccggcagagagcagttgtat

SEQ ID NO: 398137 - DNA, 25 bp, Rattus norvegicus
gccttccggcagtgagcagttgtat

SEQ ID NO: 398138 - DNA, 25 bp, Rattus norvegicus
gccttccggcgcataaagtcagcaa

SEQ ID NO: 398139 - DNA, 25 bp, Rattus norvegicus
gccttccggcgcttaaagtcagcaa

SEQ ID NO: 398140 - DNA, 25 bp, Rattus norvegicus
gccttccgttgtacttatctgtaaa

SEQ ID NO: 398141 - DNA, 25 bp, Rattus norvegicus
gccttccgttgttcttatctgtaaa

SEQ ID NO: 398142 - DNA, 25 bp, Rattus norvegicus
gccttcctaaggactgcttcatgag

SEQ ID NO: 398143 - DNA, 25 bp, Rattus norvegicus
gccttcctaaggtctgcttcatgag

SEQ ID NO: 398144 - DNA, 25 bp, Rattus norvegicus
gccttcctaatgctgccattctaat

SEQ ID NO: 398145 - DNA, 25 bp, Rattus norvegicus
gccttcctaatggtgccattctaat

SEQ ID NO: 398146 - DNA, 25 bp, Rattus norvegicus
gccttcctaattcggtactgggtct

SEQ ID NO: 398147 - DNA, 25 bp, Rattus norvegicus
gccttcctaattgggtactgggtct

SEQ ID NO: 398148 - DNA, 25 bp, Rattus norvegicus
gccttcctctcactttgtagtattg

SEQ ID NO: 398149 - DNA, 25 bp, Rattus norvegicus
gccttcctctcagtttgtagtattg

SEQ ID NO: 398150 - DNA, 25 bp, Rattus norvegicus
gccttcctcttcaatgagctcaaag

SEQ ID NO: 398151 - DNA, 25 bp, Rattus norvegicus
gccttcctcttctatgagctcaaag

SEQ ID NO: 398152 - DNA, 25 bp, Rattus norvegicus
gccttcctgaaccaccgcaagaata

SEQ ID NO: 398153 - DNA, 25 bp, Rattus norvegicus
gccttcctgaacgaccgcaagaata

SEQ ID NO: 398154 - DNA, 25 bp, Rattus norvegicus
gccttcctgaagacggctggacaga

SEQ ID NO: 398155 - DNA, 25 bp, Rattus norvegicus
gccttcctgaagtcggctggacaga

SEQ ID NO: 398156 - DNA, 25 bp, Rattus norvegicus
gccttcctgacgactaacctagaat

SEQ ID NO: 398157 - DNA, 25 bp, Rattus norvegicus
gccttcctgacgtctaacctagaat

SEQ ID NO: 398158 - DNA, 25 bp, Rattus norvegicus
gccttcctgactaggataatcctgt

SEQ ID NO: 398159 - DNA, 25 bp, Rattus norvegicus
gccttcctgacttggataatcctgt

SEQ ID NO: 398160 - DNA, 25 bp, Rattus norvegicus
gccttcctgccaacatggattctgc

SEQ ID NO: 398161 - DNA, 25 bp, Rattus norvegicus
gccttcctgccatcatggattctgc

SEQ ID NO: 398162 - DNA, 25 bp, Rattus norvegicus
gccttcctgctgatcttcaggtgaa

SEQ ID NO: 398163 - DNA, 25 bp, Rattus norvegicus
gccttcctgctgttcttcaggtgaa

SEQ ID NO: 398164 - DNA, 25 bp, Rattus norvegicus
gccttcctgcttcacttaatttgaa

SEQ ID NO: 398165 - DNA, 25 bp, Rattus norvegicus
gccttcctgcttgacttaatttgaa

SEQ ID NO: 398166 - DNA, 25 bp, Rattus norvegicus
gccttcctggtgaaagagcctgtgc

SEQ ID NO: 398167 - DNA, 25 bp, Rattus norvegicus
gccttcctggtgtaagagcctgtgc

SEQ ID NO: 398168 - DNA, 25 bp, Rattus norvegicus
gccttccttcctcaaataacacttg

SEQ ID NO: 398169 - DNA, 25 bp, Rattus norvegicus
gccttccttcctgaaataacacttg

SEQ ID NO: 398170 - DNA, 25 bp, Rattus norvegicus
gccttccttctgcaaaccaagtgag

SEQ ID NO: 398171 - DNA, 25 bp, Rattus norvegicus
gccttccttctggaaaccaagtgag

SEQ ID NO: 398172 - DNA, 25 bp, Rattus norvegicus
gccttccttgcaatgtgatgatcta

SEQ ID NO: 398173 - DNA, 25 bp, Rattus norvegicus
gccttccttgcattgtgatgatcta

SEQ ID NO: 398174 - DNA, 25 bp, Rattus norvegicus
gccttccttgccactgagggctgtg

SEQ ID NO: 398175 - DNA, 25 bp, Rattus norvegicus
gccttccttgcctctgagggctgtg

SEQ ID NO: 398176 - DNA, 25 bp, Rattus norvegicus
gccttcgacacccagctggtaaaca

SEQ ID NO: 398177 - DNA, 25 bp, Rattus norvegicus
gccttcgacaccgagctggtaaaca

SEQ ID NO: 398178 - DNA, 25 bp, Rattus norvegicus
gccttcgagggcaacaaagcaagtt

SEQ ID NO: 398179 - DNA, 25 bp, Rattus norvegicus
gccttcgagggctacaaagcaagtt

SEQ ID NO: 398180 - DNA, 25 bp, Rattus norvegicus
gccttcgagttccaggagggttctc

SEQ ID NO: 398181 - DNA, 25 bp, Rattus norvegicus
gccttcgagttcgaggagggttctc

SEQ ID NO: 398182 - DNA, 25 bp, Rattus norvegicus
gccttcgcatggctggctgctgtta

SEQ ID NO: 398183 - DNA, 25 bp, Rattus norvegicus
gccttcgcatgggtggctgctgtta

SEQ ID NO: 398184 - DNA, 25 bp, Rattus norvegicus
gccttcggaagactcatgggatcag

SEQ ID NO: 398185 - DNA, 25 bp, Rattus norvegicus
gccttcggaagagtcatgggatcag

SEQ ID NO: 398186 - DNA, 25 bp, Rattus norvegicus
gccttcggccacaattttattttgt

SEQ ID NO: 398187 - DNA, 25 bp, Rattus norvegicus
gccttcggccactattttattttgt

SEQ ID NO: 398188 - DNA, 25 bp, Rattus norvegicus
gccttcgggtacacatttgcaaatg

SEQ ID NO: 398189 - DNA, 25 bp, Rattus norvegicus
gccttcgggtactcatttgcaaatg

SEQ ID NO: 398190 - DNA, 25 bp, Rattus norvegicus
gccttcgtgtaaccagatgctctgt

SEQ ID NO: 398191 - DNA, 25 bp, Rattus norvegicus
gccttcgtgtaagcagatgctctgt

SEQ ID NO: 398192 - DNA, 25 bp, Rattus norvegicus
gccttcgtgtctagccagaatattg

SEQ ID NO: 398193 - DNA, 25 bp, Rattus norvegicus
gccttcgtgtcttgccagaatattg

SEQ ID NO: 398194 - DNA, 25 bp, Rattus norvegicus
gccttcgttggtcagctctttgagc

SEQ ID NO: 398195 - DNA, 25 bp, Rattus norvegicus
gccttcgttggtctctagctaatgg

SEQ ID NO: 398196 - DNA, 25 bp, Rattus norvegicus
gccttcgttggtgagctctttgagc

SEQ ID NO: 398197 - DNA, 25 bp, Rattus norvegicus
gccttcgttggtgtctagctaatgg

SEQ ID NO: 398198 - DNA, 25 bp, Rattus norvegicus
gccttctacctgaagcagtggcgct

SEQ ID NO: 398199 - DNA, 25 bp, Rattus norvegicus
gccttctacctgtagcagtggcgct

SEQ ID NO: 398200 - DNA, 25 bp, Rattus norvegicus
gccttctataggctctgctgattgt

SEQ ID NO: 398201 - DNA, 25 bp, Rattus norvegicus
gccttctatagggtctgctgattgt

SEQ ID NO: 398202 - DNA, 25 bp, Rattus norvegicus
gccttctatattatcgaccgcttga

SEQ ID NO: 398203 - DNA, 25 bp, Rattus norvegicus
gccttctatattttcgaccgcttga

SEQ ID NO: 398204 - DNA, 25 bp, Rattus norvegicus
gccttctcaaggaacattcagtgtc

SEQ ID NO: 398205 - DNA, 25 bp, Rattus norvegicus
gccttctcaaggtacattcagtgtc

SEQ ID NO: 398206 - DNA, 25 bp, Rattus norvegicus
gccttctcacagatgtaccaatgct

SEQ ID NO: 398207 - DNA, 25 bp, Rattus norvegicus
gccttctcacagttgtaccaatgct

SEQ ID NO: 398208 - DNA, 25 bp, Rattus norvegicus
gccttctcagataatgccaacttca

SEQ ID NO: 398209 - DNA, 25 bp, Rattus norvegicus
gccttctcagattatgccaacttca

SEQ ID NO: 398210 - DNA, 25 bp, Rattus norvegicus
gccttctcagcacttcgaggtggaa

SEQ ID NO: 398211 - DNA, 25 bp, Rattus norvegicus
gccttctcagcagttcgaggtggaa

SEQ ID NO: 398212 - DNA, 25 bp, Rattus norvegicus
gccttctcatgaccttttcttaaat

SEQ ID NO: 398213 - DNA, 25 bp, Rattus norvegicus
gccttctcatgagcttttcttaaat

SEQ ID NO: 398214 - DNA, 25 bp, Rattus norvegicus
gccttctccaaacccacatgtaaag

SEQ ID NO: 398215 - DNA, 25 bp, Rattus norvegicus
gccttctccaaagccacatgtaaag

SEQ ID NO: 398216 - DNA, 25 bp, Rattus norvegicus
gccttctccagaaccaagttgatcg

SEQ ID NO: 398217 - DNA, 25 bp, Rattus norvegicus
gccttctccagatccaagttgatcg

SEQ ID NO: 398218 - DNA, 25 bp, Rattus norvegicus
gccttctcccttagcaggaccacag

SEQ ID NO: 398219 - DNA, 25 bp, Rattus norvegicus
gccttctcccttatttatatgcagt

SEQ ID NO: 398220 - DNA, 25 bp, Rattus norvegicus
gccttctccctttgcaggaccacag

SEQ ID NO: 398221 - DNA, 25 bp, Rattus norvegicus
gccttctcccttttttatatgcagt

SEQ ID NO: 398222 - DNA, 25 bp, Rattus norvegicus
gccttctctttaaacaatacttcca

SEQ ID NO: 398223 - DNA, 25 bp, Rattus norvegicus
gccttctctttatacaatacttcca

SEQ ID NO: 398224 - DNA, 25 bp, Rattus norvegicus
gccttctgagtgcttttgggtctaa

SEQ ID NO: 398225 - DNA, 25 bp, Rattus norvegicus
gccttctgagtggttttgggtctaa

SEQ ID NO: 398226 - DNA, 25 bp, Rattus norvegicus
gccttctgatctaccttgaatctaa

SEQ ID NO: 398227 - DNA, 25 bp, Rattus norvegicus
gccttctgatcttccttgaatctaa

SEQ ID NO: 398228 - DNA, 25 bp, Rattus norvegicus
gccttctgcatgatcgttatttcta

SEQ ID NO: 398229 - DNA, 25 bp, Rattus norvegicus
gccttctgcatgttcgttatttcta

SEQ ID NO: 398230 - DNA, 25 bp, Rattus norvegicus
gccttctgccccagtgaaggtagaa

SEQ ID NO: 398231 - DNA, 25 bp, Rattus norvegicus
gccttctgcccctgtgaaggtagaa

SEQ ID NO: 398232 - DNA, 25 bp, Rattus norvegicus
gccttctgccttagggagtttggaa

SEQ ID NO: 398233 - DNA, 25 bp, Rattus norvegicus
gccttctgcctttgggagtttggaa

SEQ ID NO: 398234 - DNA, 25 bp, Rattus norvegicus
gccttctgcgatacagtgctgtcag

SEQ ID NO: 398235 - DNA, 25 bp, Rattus norvegicus
gccttctgcgattcagtgctgtcag

SEQ ID NO: 398236 - DNA, 25 bp, Rattus norvegicus
gccttctggacaattgcacattcac

SEQ ID NO: 398237 - DNA, 25 bp, Rattus norvegicus
gccttctggacatttgcacattcac

SEQ ID NO: 398238 - DNA, 25 bp, Rattus norvegicus
gccttctggcagcaacgacgtttga

SEQ ID NO: 398239 - DNA, 25 bp, Rattus norvegicus
gccttctggcaggaacgacgtttga

SEQ ID NO: 398240 - DNA, 25 bp, Rattus norvegicus
gccttctgtgaacggacagcactgt

SEQ ID NO: 398241 - DNA, 25 bp, Rattus norvegicus
gccttctgtgaagggacagcactgt

SEQ ID NO: 398242 - DNA, 25 bp, Rattus norvegicus
gccttctgttgtacatgaataatca

SEQ ID NO: 398243 - DNA, 25 bp, Rattus norvegicus
gccttctgttgttcatgaataatca

SEQ ID NO: 398244 - DNA, 25 bp, Rattus norvegicus
gccttcttccaaactacttcaggat

SEQ ID NO: 398245 - DNA, 25 bp, Rattus norvegicus
gccttcttccaatctacttcaggat

SEQ ID NO: 398246 - DNA, 25 bp, Rattus norvegicus
gccttcttccagagtttctgttgag

SEQ ID NO: 398247 - DNA, 25 bp, Rattus norvegicus
gccttcttccagtgtttctgttgag

SEQ ID NO: 398248 - DNA, 25 bp, Rattus norvegicus
gccttcttgatcacaccaactcttt

SEQ ID NO: 398249 - DNA, 25 bp, Rattus norvegicus
gccttcttgatctcaccaactcttt

SEQ ID NO: 398250 - DNA, 25 bp, Rattus norvegicus
gccttcttggcaagcactgaacaaa

SEQ ID NO: 398251 - DNA, 25 bp, Rattus norvegicus
gccttcttggcatgcactgaacaaa

SEQ ID NO: 398252 - DNA, 25 bp, Rattus norvegicus
gccttcttgggcataacggaccaga

SEQ ID NO: 398253 - DNA, 25 bp, Rattus norvegicus
gccttcttgggcttaacggaccaga

SEQ ID NO: 398254 - DNA, 25 bp, Rattus norvegicus
gccttcttgtggacagtgctgcatg

SEQ ID NO: 398255 - DNA, 25 bp, Rattus norvegicus
gccttcttgtggtcagtgctgcatg

SEQ ID NO: 398256 - DNA, 25 bp, Rattus norvegicus
gccttctttattactaacttctgtg

SEQ ID NO: 398257 - DNA, 25 bp, Rattus norvegicus
gccttctttattctatcacccaaaa

SEQ ID NO: 398258 - DNA, 25 bp, Rattus norvegicus
gccttctttattgtatcacccaaaa

SEQ ID NO: 398259 - DNA, 25 bp, Rattus norvegicus
gccttctttatttctaacttctgtg

SEQ ID NO: 398260 - DNA, 25 bp, Rattus norvegicus
gccttctttcctacagagctttgaa

SEQ ID NO: 398261 - DNA, 25 bp, Rattus norvegicus
gccttctttccttcagagctttgaa

SEQ ID NO: 398262 - DNA, 25 bp, Rattus norvegicus
gccttctttcgccagggcatctaaa

SEQ ID NO: 398263 - DNA, 25 bp, Rattus norvegicus
gccttctttcgcgagggcatctaaa

SEQ ID NO: 398264 - DNA, 25 bp, Rattus norvegicus
gccttctttgccaagctaatctgta

SEQ ID NO: 398265 - DNA, 25 bp, Rattus norvegicus
gccttctttgcctagctaatctgta

SEQ ID NO: 398266 - DNA, 25 bp, Rattus norvegicus
gccttctttgtcagtatcgtggtag

SEQ ID NO: 398267 - DNA, 25 bp, Rattus norvegicus
gccttctttgtctgtatcgtggtag

SEQ ID NO: 398268 - DNA, 25 bp, Rattus norvegicus
gccttcttttgtatcgatgtaccaa

SEQ ID NO: 398269 - DNA, 25 bp, Rattus norvegicus
gccttcttttgtattactgacctag

SEQ ID NO: 398270 - DNA, 25 bp, Rattus norvegicus
gccttcttttgtttcgatgtaccaa

SEQ ID NO: 398271 - DNA, 25 bp, Rattus norvegicus
gccttcttttgttttactgacctag

SEQ ID NO: 398272 - DNA, 25 bp, Rattus norvegicus
gccttgaacaccctatttattttga

SEQ ID NO: 398273 - DNA, 25 bp, Rattus norvegicus
gccttgaacaccgtatttattttga

SEQ ID NO: 398274 - DNA, 25 bp, Rattus norvegicus
gccttgaacattagcattgactacc

SEQ ID NO: 398275 - DNA, 25 bp, Rattus norvegicus
gccttgaacatttgcattgactacc

SEQ ID NO: 398276 - DNA, 25 bp, Rattus norvegicus
gccttgaacctaaaatcccaactca

SEQ ID NO: 398277 - DNA, 25 bp, Rattus norvegicus
gccttgaacctataatcccaactca

SEQ ID NO: 398278 - DNA, 25 bp, Rattus norvegicus
gccttgaactcccaggttttgcctg

SEQ ID NO: 398279 - DNA, 25 bp, Rattus norvegicus
gccttgaactccgaggttttgcctg

SEQ ID NO: 398280 - DNA, 25 bp, Rattus norvegicus
gccttgaactggacttgacttgcta

SEQ ID NO: 398281 - DNA, 25 bp, Rattus norvegicus
gccttgaactggtcttgacttgcta

SEQ ID NO: 398282 - DNA, 25 bp, Rattus norvegicus
gccttgaagaagcaccatgaagatg

SEQ ID NO: 398283 - DNA, 25 bp, Rattus norvegicus
gccttgaagaaggaccatgaagatg

SEQ ID NO: 398284 - DNA, 25 bp, Rattus norvegicus
gccttgaaggcacccgccacgtagt

SEQ ID NO: 398285 - DNA, 25 bp, Rattus norvegicus
gccttgaaggcagccgccacgtagt

SEQ ID NO: 398286 - DNA, 25 bp, Rattus norvegicus
gccttgaagtttacagacaggactt

SEQ ID NO: 398287 - DNA, 25 bp, Rattus norvegicus
gccttgaagttttcagacaggactt

SEQ ID NO: 398288 - DNA, 25 bp, Rattus norvegicus
gccttgaatcccagacatccagaat

SEQ ID NO: 398289 - DNA, 25 bp, Rattus norvegicus
gccttgaatccctgacatccagaat

SEQ ID NO: 398290 - DNA, 25 bp, Rattus norvegicus
gccttgaccataagttcgacctcat

SEQ ID NO: 398291 - DNA, 25 bp, Rattus norvegicus
gccttgaccatatgttcgacctcat

SEQ ID NO: 398292 - DNA, 25 bp, Rattus norvegicus
gccttgacccaaaggtcttacagga

SEQ ID NO: 398293 - DNA, 25 bp, Rattus norvegicus
gccttgacccaatggtcttacagga

SEQ ID NO: 398294 - DNA, 25 bp, Rattus norvegicus
gccttgacctgcagttgtttgatga

SEQ ID NO: 398295 - DNA, 25 bp, Rattus norvegicus
gccttgacctgctgttgtttgatga

SEQ ID NO: 398296 - DNA, 25 bp, Rattus norvegicus
gccttgactcagatgtttgcatgat

SEQ ID NO: 398297 - DNA, 25 bp, Rattus norvegicus
gccttgactcagttgtttgcatgat

SEQ ID NO: 398298 - DNA, 25 bp, Rattus norvegicus
gccttgagaatcatgtacaactgct

SEQ ID NO: 398299 - DNA, 25 bp, Rattus norvegicus
gccttgagaatcttgtacaactgct

SEQ ID NO: 398300 - DNA, 25 bp, Rattus norvegicus
gccttgagataacggttcgcctgaa

SEQ ID NO: 398301 - DNA, 25 bp, Rattus norvegicus
gccttgagataagggttcgcctgaa

SEQ ID NO: 398302 - DNA, 25 bp, Rattus norvegicus
gccttgagcgcgcagggacaacaac

SEQ ID NO: 398303 - DNA, 25 bp, Rattus norvegicus
gccttgagcgcggagggacaacaac

SEQ ID NO: 398304 - DNA, 25 bp, Rattus norvegicus
gccttgaggcccactgtttaggttg

SEQ ID NO: 398305 - DNA, 25 bp, Rattus norvegicus
gccttgaggccctctgtttaggttg

SEQ ID NO: 398306 - DNA, 25 bp, Rattus norvegicus
gccttgaggctaatccctaactgca

SEQ ID NO: 398307 - DNA, 25 bp, Rattus norvegicus
gccttgaggctattccctaactgca

SEQ ID NO: 398308 - DNA, 25 bp, Rattus norvegicus
gccttgagtacaaagcagctgtcca

SEQ ID NO: 398309 - DNA, 25 bp, Rattus norvegicus
gccttgagtacacccgctttgagaa

SEQ ID NO: 398310 - DNA, 25 bp, Rattus norvegicus
gccttgagtacagccgctttgagaa

SEQ ID NO: 398311 - DNA, 25 bp, Rattus norvegicus
gccttgagtacatagcagctgtcca

SEQ ID NO: 398312 - DNA, 25 bp, Rattus norvegicus
gccttgagtctcacatgacatatgg

SEQ ID NO: 398313 - DNA, 25 bp, Rattus norvegicus
gccttgagtctctcatgacatatgg

SEQ ID NO: 398314 - DNA, 25 bp, Rattus norvegicus
gccttgagtttgctgatgaccttga

SEQ ID NO: 398315 - DNA, 25 bp, Rattus norvegicus
gccttgagtttggtgatgaccttga

SEQ ID NO: 398316 - DNA, 25 bp, Rattus norvegicus
gccttgatacctctgactcttgata

SEQ ID NO: 398317 - DNA, 25 bp, Rattus norvegicus
gccttgatacctgtgactcttgata

SEQ ID NO: 398318 - DNA, 25 bp, Rattus norvegicus
gccttgatccaacgctacatgtatt

SEQ ID NO: 398319 - DNA, 25 bp, Rattus norvegicus
gccttgatccaaggctacatgtatt

SEQ ID NO: 398320 - DNA, 25 bp, Rattus norvegicus
gccttgatgcctctaacaccaataa

SEQ ID NO: 398321 - DNA, 25 bp, Rattus norvegicus
gccttgatgcctgtaacaccaataa

SEQ ID NO: 398322 - DNA, 25 bp, Rattus norvegicus
gccttgatggtcacgaacaagccat

SEQ ID NO: 398323 - DNA, 25 bp, Rattus norvegicus
gccttgatggtctcgaacaagccat

SEQ ID NO: 398324 - DNA, 25 bp, Rattus norvegicus
gccttgattattattctatgagctt

SEQ ID NO: 398325 - DNA, 25 bp, Rattus norvegicus
gccttgattattccagcatgcagct

SEQ ID NO: 398326 - DNA, 25 bp, Rattus norvegicus
gccttgattattgcagcatgcagct

SEQ ID NO: 398327 - DNA, 25 bp, Rattus norvegicus
gccttgattatttttctatgagctt

SEQ ID NO: 398328 - DNA, 25 bp, Rattus norvegicus
gccttgattcgtaggacctatgcaa

SEQ ID NO: 398329 - DNA, 25 bp, Rattus norvegicus
gccttgattcgttggacctatgcaa

SEQ ID NO: 398330 - DNA, 25 bp, Rattus norvegicus
gccttgattcttcagcactgagatt

SEQ ID NO: 398331 - DNA, 25 bp, Rattus norvegicus
gccttgattcttgagcactgagatt

SEQ ID NO: 398332 - DNA, 25 bp, Rattus norvegicus
gccttgatttacagttctgctctcg

SEQ ID NO: 398333 - DNA, 25 bp, Rattus norvegicus
gccttgatttaccttggttccatga

SEQ ID NO: 398334 - DNA, 25 bp, Rattus norvegicus
gccttgatttacgttggttccatga

SEQ ID NO: 398335 - DNA, 25 bp, Rattus norvegicus
gccttgatttactgttctgctctcg

SEQ ID NO: 398336 - DNA, 25 bp, Rattus norvegicus
gccttgatttccctacttgcaaaag

SEQ ID NO: 398337 - DNA, 25 bp, Rattus norvegicus
gccttgatttccgtacttgcaaaag

SEQ ID NO: 398338 - DNA, 25 bp, Rattus norvegicus
gccttgcaattgctgctctatccag

SEQ ID NO: 398339 - DNA, 25 bp, Rattus norvegicus
gccttgcaattggtgctctatccag

SEQ ID NO: 398340 - DNA, 25 bp, Rattus norvegicus
gccttgcacatcagttctgatgttt

SEQ ID NO: 398341 - DNA, 25 bp, Rattus norvegicus
gccttgcacatctgttctgatgttt

SEQ ID NO: 398342 - DNA, 25 bp, Rattus norvegicus
gccttgcaccatcctttggatattt

SEQ ID NO: 398343 - DNA, 25 bp, Rattus norvegicus
gccttgcaccatgctttggatattt

SEQ ID NO: 398344 - DNA, 25 bp, Rattus norvegicus
gccttgcacccactgaataaactgt

SEQ ID NO: 398345 - DNA, 25 bp, Rattus norvegicus
gccttgcacccagtgaataaactgt

SEQ ID NO: 398346 - DNA, 25 bp, Rattus norvegicus
gccttgcaccttaccgaagactagg

SEQ ID NO: 398347 - DNA, 25 bp, Rattus norvegicus
gccttgcacctttccgaagactagg

SEQ ID NO: 398348 - DNA, 25 bp, Rattus norvegicus
gccttgcagaatcagttccacttgt

SEQ ID NO: 398349 - DNA, 25 bp, Rattus norvegicus
gccttgcagaatgagttccacttgt

SEQ ID NO: 398350 - DNA, 25 bp, Rattus norvegicus
gccttgcatttaatagtatctctga

SEQ ID NO: 398351 - DNA, 25 bp, Rattus norvegicus
gccttgcatttattagtatctctga

SEQ ID NO: 398352 - DNA, 25 bp, Rattus norvegicus
gccttgccaagcctctgatataaga

SEQ ID NO: 398353 - DNA, 25 bp, Rattus norvegicus
gccttgccaagcgtctgatataaga

SEQ ID NO: 398354 - DNA, 25 bp, Rattus norvegicus
gccttgccaagtctaacaacgtgta

SEQ ID NO: 398355 - DNA, 25 bp, Rattus norvegicus
gccttgccaagtgtaacaacgtgta

SEQ ID NO: 398356 - DNA, 25 bp, Rattus norvegicus
gccttgccagtgacacgagccagaa

SEQ ID NO: 398357 - DNA, 25 bp, Rattus norvegicus
gccttgccagtgtcacgagccagaa

SEQ ID NO: 398358 - DNA, 25 bp, Rattus norvegicus
gccttgcccaccagcattggaatga

SEQ ID NO: 398359 - DNA, 25 bp, Rattus norvegicus
gccttgcccacctgcattggaatga

SEQ ID NO: 398360 - DNA, 25 bp, Rattus norvegicus
gccttgccctttacatttcatatta

SEQ ID NO: 398361 - DNA, 25 bp, Rattus norvegicus
gccttgcccttttcatttcatatta

SEQ ID NO: 398362 - DNA, 25 bp, Rattus norvegicus
gccttgccggaacagaaagaaccca

SEQ ID NO: 398363 - DNA, 25 bp, Rattus norvegicus
gccttgccggaagagaaagaaccca

SEQ ID NO: 398364 - DNA, 25 bp, Rattus norvegicus
gccttgcctaatatgtcagacttca

SEQ ID NO: 398365 - DNA, 25 bp, Rattus norvegicus
gccttgcctaatttgtcagacttca

SEQ ID NO: 398366 - DNA, 25 bp, Rattus norvegicus
gccttgcctattcccattattaatg

SEQ ID NO: 398367 - DNA, 25 bp, Rattus norvegicus
gccttgcctattgccattattaatg

SEQ ID NO: 398368 - DNA, 25 bp, Rattus norvegicus
gccttgcctcagaatggacagactt

SEQ ID NO: 398369 - DNA, 25 bp, Rattus norvegicus
gccttgcctcagtatggacagactt

SEQ ID NO: 398370 - DNA, 25 bp, Rattus norvegicus
gccttgccttctctttgttaactga

SEQ ID NO: 398371 - DNA, 25 bp, Rattus norvegicus
gccttgccttctgtttgttaactga

SEQ ID NO: 398372 - DNA, 25 bp, Rattus norvegicus
gccttgcctttgactgagctgcagc

SEQ ID NO: 398373 - DNA, 25 bp, Rattus norvegicus
gccttgcctttgtctgagctgcagc

SEQ ID NO: 398374 - DNA, 25 bp, Rattus norvegicus
gccttgctcaatccctttctttaaa

SEQ ID NO: 398375 - DNA, 25 bp, Rattus norvegicus
gccttgctcaatgcctttctttaaa

SEQ ID NO: 398376 - DNA, 25 bp, Rattus norvegicus
gccttgctcagcctttagccaggaa

SEQ ID NO: 398377 - DNA, 25 bp, Rattus norvegicus
gccttgctcagcgtttagccaggaa

SEQ ID NO: 398378 - DNA, 25 bp, Rattus norvegicus
gccttgctccttaccagaatgcatg

SEQ ID NO: 398379 - DNA, 25 bp, Rattus norvegicus
gccttgctcctttccagaatgcatg

SEQ ID NO: 398380 - DNA, 25 bp, Rattus norvegicus
gccttgctctgtagcaggtgtgttt

SEQ ID NO: 398381 - DNA, 25 bp, Rattus norvegicus
gccttgctctgttgcaggtgtgttt

SEQ ID NO: 398382 - DNA, 25 bp, Rattus norvegicus
gccttgctgctgatggatacacact

SEQ ID NO: 398383 - DNA, 25 bp, Rattus norvegicus
gccttgctgctgttggatacacact

SEQ ID NO: 398384 - DNA, 25 bp, Rattus norvegicus
gccttgcttaacatatgctcgggtg

SEQ ID NO: 398385 - DNA, 25 bp, Rattus norvegicus
gccttgcttaacttatgctcgggtg

SEQ ID NO: 398386 - DNA, 25 bp, Rattus norvegicus
gccttgcttcagatggaattgccac

SEQ ID NO: 398387 - DNA, 25 bp, Rattus norvegicus
gccttgcttcagttggaattgccac

SEQ ID NO: 398388 - DNA, 25 bp, Rattus norvegicus
gccttgcttggacttaagttgatgt

SEQ ID NO: 398389 - DNA, 25 bp, Rattus norvegicus
gccttgcttggagttaagttgatgt

SEQ ID NO: 398390 - DNA, 25 bp, Rattus norvegicus
gccttgctttggactagctttgcta

SEQ ID NO: 398391 - DNA, 25 bp, Rattus norvegicus
gccttgctttggtctagctttgcta

SEQ ID NO: 398392 - DNA, 25 bp, Rattus norvegicus
gccttgcttttcatcaggacggtaa

SEQ ID NO: 398393 - DNA, 25 bp, Rattus norvegicus
gccttgcttttcttcaggacggtaa

SEQ ID NO: 398394 - DNA, 25 bp, Rattus norvegicus
gccttggaaacgaggatagctctgt

SEQ ID NO: 398395 - DNA, 25 bp, Rattus norvegicus
gccttggaaacgtggatagctctgt

SEQ ID NO: 398396 - DNA, 25 bp, Rattus norvegicus
gccttggaaccaccgagatgtactt

SEQ ID NO: 398397 - DNA, 25 bp, Rattus norvegicus
gccttggaaccagcgagatgtactt

SEQ ID NO: 398398 - DNA, 25 bp, Rattus norvegicus
gccttggaatgccaggagtcaacag

SEQ ID NO: 398399 - DNA, 25 bp, Rattus norvegicus
gccttggaatgcgaggagtcaacag

SEQ ID NO: 398400 - DNA, 25 bp, Rattus norvegicus
gccttggacttcacctatggaatca

SEQ ID NO: 398401 - DNA, 25 bp, Rattus norvegicus
gccttggacttctcctatggaatca

SEQ ID NO: 398402 - DNA, 25 bp, Rattus norvegicus
gccttggagaccaccagaaaccaga

SEQ ID NO: 398403 - DNA, 25 bp, Rattus norvegicus
gccttggagacctccagaaaccaga

SEQ ID NO: 398404 - DNA, 25 bp, Rattus norvegicus
gccttggcagatatatgtttccgga

SEQ ID NO: 398405 - DNA, 25 bp, Rattus norvegicus
gccttggcagatttatgtttccgga

SEQ ID NO: 398406 - DNA, 25 bp, Rattus norvegicus
gccttggcgtgactctgaacattgg

SEQ ID NO: 398407 - DNA, 25 bp, Rattus norvegicus
gccttggcgtgagtctgaacattgg

SEQ ID NO: 398408 - DNA, 25 bp, Rattus norvegicus
gccttggctgctctatttgatttga

SEQ ID NO: 398409 - DNA, 25 bp, Rattus norvegicus
gccttggctgctgtatttgatttga

SEQ ID NO: 398410 - DNA, 25 bp, Rattus norvegicus
gccttggcttggctagggtctttat

SEQ ID NO: 398411 - DNA, 25 bp, Rattus norvegicus
gccttggcttgggtagggtctttat

SEQ ID NO: 398412 - DNA, 25 bp, Rattus norvegicus
gccttggctttgagtactcttgaaa

SEQ ID NO: 398413 - DNA, 25 bp, Rattus norvegicus
gccttggctttgtgtactcttgaaa

SEQ ID NO: 398414 - DNA, 25 bp, Rattus norvegicus
gccttggcttttctactaaactctg

SEQ ID NO: 398415 - DNA, 25 bp, Rattus norvegicus
gccttggcttttgtactaaactctg

SEQ ID NO: 398416 - DNA, 25 bp, Rattus norvegicus
gccttgggacccacatggcttgaag

SEQ ID NO: 398417 - DNA, 25 bp, Rattus norvegicus
gccttgggaccctcatggcttgaag

SEQ ID NO: 398418 - DNA, 25 bp, Rattus norvegicus
gccttgggacctatctgattatagt

SEQ ID NO: 398419 - DNA, 25 bp, Rattus norvegicus
gccttgggacctttctgattatagt

SEQ ID NO: 398420 - DNA, 25 bp, Rattus norvegicus
gccttgggatccagcgcacagcggt

SEQ ID NO: 398421 - DNA, 25 bp, Rattus norvegicus
gccttgggatcctgcgcacagcggt

SEQ ID NO: 398422 - DNA, 25 bp, Rattus norvegicus
gccttgggcaagctgcacagctagc

SEQ ID NO: 398423 - DNA, 25 bp, Rattus norvegicus
gccttgggcaaggtgcacagctagc

SEQ ID NO: 398424 - DNA, 25 bp, Rattus norvegicus
gccttgggcgttacgttacagtaat

SEQ ID NO: 398425 - DNA, 25 bp, Rattus norvegicus
gccttgggcgtttcgttacagtaat

SEQ ID NO: 398426 - DNA, 25 bp, Rattus norvegicus
gccttgggttccagtataaacaaat

SEQ ID NO: 398427 - DNA, 25 bp, Rattus norvegicus
gccttgggttcctgtataaacaaat

SEQ ID NO: 398428 - DNA, 25 bp, Rattus norvegicus
gccttggtccccaggatagcagtat

SEQ ID NO: 398429 - DNA, 25 bp, Rattus norvegicus
gccttggtcccctggatagcagtat

SEQ ID NO: 398430 - DNA, 25 bp, Rattus norvegicus
gccttggtctttcgtggtggtattc

SEQ ID NO: 398431 - DNA, 25 bp, Rattus norvegicus
gccttggtctttggtggtggtattc

SEQ ID NO: 398432 - DNA, 25 bp, Rattus norvegicus
gccttggtggacaccaggctgctga

SEQ ID NO: 398433 - DNA, 25 bp, Rattus norvegicus
gccttggtggactccaggctgctga

SEQ ID NO: 398434 - DNA, 25 bp, Rattus norvegicus
gccttggtggttcccagtccaggaa

SEQ ID NO: 398435 - DNA, 25 bp, Rattus norvegicus
gccttggtggttgccagtccaggaa

SEQ ID NO: 398436 - DNA, 25 bp, Rattus norvegicus
gccttggtgttgctgtaactacatc

SEQ ID NO: 398437 - DNA, 25 bp, Rattus norvegicus
gccttggtgttggtgtaactacatc

SEQ ID NO: 398438 - DNA, 25 bp, Rattus norvegicus
gccttggttctcatggcttgatgaa

SEQ ID NO: 398439 - DNA, 25 bp, Rattus norvegicus
gccttggttctcttggcttgatgaa

SEQ ID NO: 398440 - DNA, 25 bp, Rattus norvegicus
gccttggttgacctaacagagcctg

SEQ ID NO: 398441 - DNA, 25 bp, Rattus norvegicus
gccttggttgacgtaacagagcctg

SEQ ID NO: 398442 - DNA, 25 bp, Rattus norvegicus
gccttgtaccaaacaaaccgcgtgg

SEQ ID NO: 398443 - DNA, 25 bp, Rattus norvegicus
gccttgtaccaatcaaaccgcgtgg

SEQ ID NO: 398444 - DNA, 25 bp, Rattus norvegicus
gccttgtactgtcgaatgctaactt

SEQ ID NO: 398445 - DNA, 25 bp, Rattus norvegicus
gccttgtactgtggaatgctaactt

SEQ ID NO: 398446 - DNA, 25 bp, Rattus norvegicus
gccttgtaggtaaaacctctgccta

SEQ ID NO: 398447 - DNA, 25 bp, Rattus norvegicus
gccttgtaggtataacctctgccta

SEQ ID NO: 398448 - DNA, 25 bp, Rattus norvegicus
gccttgtatataagaaaccttccgt

SEQ ID NO: 398449 - DNA, 25 bp, Rattus norvegicus
gccttgtatatatgaaaccttccgt

SEQ ID NO: 398450 - DNA, 25 bp, Rattus norvegicus
gccttgtatcgtatataatggacca

SEQ ID NO: 398451 - DNA, 25 bp, Rattus norvegicus
gccttgtatcgtttataatggacca

SEQ ID NO: 398452 - DNA, 25 bp, Rattus norvegicus
gccttgtcacgaattctcacatttt

SEQ ID NO: 398453 - DNA, 25 bp, Rattus norvegicus
gccttgtcacgatttctcacatttt

SEQ ID NO: 398454 - DNA, 25 bp, Rattus norvegicus
gccttgtcagttagatccttctgga

SEQ ID NO: 398455 - DNA, 25 bp, Rattus norvegicus
gccttgtcagtttgatccttctgga

SEQ ID NO: 398456 - DNA, 25 bp, Rattus norvegicus
gccttgtccagaagtcttactctaa

SEQ ID NO: 398457 - DNA, 25 bp, Rattus norvegicus
gccttgtccagatgtcttactctaa

SEQ ID NO: 398458 - DNA, 25 bp, Rattus norvegicus
gccttgtcggacattggtgattatt

SEQ ID NO: 398459 - DNA, 25 bp, Rattus norvegicus
gccttgtcggactttggtgattatt

SEQ ID NO: 398460 - DNA, 25 bp, Rattus norvegicus
gccttgtctatacagcaggtagttc

SEQ ID NO: 398461 - DNA, 25 bp, Rattus norvegicus
gccttgtctatagagcaggtagttc

SEQ ID NO: 398462 - DNA, 25 bp, Rattus norvegicus
gccttgtgaaaaagttatgccctat

SEQ ID NO: 398463 - DNA, 25 bp, Rattus norvegicus
gccttgtgaaaatgttatgccctat

SEQ ID NO: 398464 - DNA, 25 bp, Rattus norvegicus
gccttgtgcatcaataaaccacaat

SEQ ID NO: 398465 - DNA, 25 bp, Rattus norvegicus
gccttgtgcatctataaaccacaat

SEQ ID NO: 398466 - DNA, 25 bp, Rattus norvegicus
gccttgtggcagaggagatgctccc

SEQ ID NO: 398467 - DNA, 25 bp, Rattus norvegicus
gccttgtggcagtggagatgctccc

SEQ ID NO: 398468 - DNA, 25 bp, Rattus norvegicus
gccttgtggccgcagaagctgatat

SEQ ID NO: 398469 - DNA, 25 bp, Rattus norvegicus
gccttgtggccggagaagctgatat

SEQ ID NO: 398470 - DNA, 25 bp, Rattus norvegicus
gccttgtgtgtaaatcagtgtaaac

SEQ ID NO: 398471 - DNA, 25 bp, Rattus norvegicus
gccttgtgtgtatatcagtgtaaac

SEQ ID NO: 398472 - DNA, 25 bp, Rattus norvegicus
gccttgttcaatacttactgtgcta

SEQ ID NO: 398473 - DNA, 25 bp, Rattus norvegicus
gccttgttcaatcgtctgacactac

SEQ ID NO: 398474 - DNA, 25 bp, Rattus norvegicus
gccttgttcaatggtctgacactac

SEQ ID NO: 398475 - DNA, 25 bp, Rattus norvegicus
gccttgttcaattcttactgtgcta

SEQ ID NO: 398476 - DNA, 25 bp, Rattus norvegicus
gccttgttcaggacacaggctggtg

SEQ ID NO: 398477 - DNA, 25 bp, Rattus norvegicus
gccttgttcaggctcacgcattgag

SEQ ID NO: 398478 - DNA, 25 bp, Rattus norvegicus
gccttgttcagggtcacgcattgag

SEQ ID NO: 398479 - DNA, 25 bp, Rattus norvegicus
gccttgttcaggtcacaggctggtg

SEQ ID NO: 398480 - DNA, 25 bp, Rattus norvegicus
gccttgttcattctcgcttgtgaaa

SEQ ID NO: 398481 - DNA, 25 bp, Rattus norvegicus
gccttgttcattgtcgcttgtgaaa

SEQ ID NO: 398482 - DNA, 25 bp, Rattus norvegicus
gccttgttgacaattactgcctgat

SEQ ID NO: 398483 - DNA, 25 bp, Rattus norvegicus
gccttgttgacatttactgcctgat

SEQ ID NO: 398484 - DNA, 25 bp, Rattus norvegicus
gccttgtttaggatcaccaccaata

SEQ ID NO: 398485 - DNA, 25 bp, Rattus norvegicus
gccttgtttaggttcaccaccaata

SEQ ID NO: 398486 - DNA, 25 bp, Rattus norvegicus
gccttgtttatgatagtgttctctg

SEQ ID NO: 398487 - DNA, 25 bp, Rattus norvegicus
gccttgtttatgttagtgttctctg

SEQ ID NO: 398488 - DNA, 25 bp, Rattus norvegicus
gccttgttttgcagtgctatagaaa

SEQ ID NO: 398489 - DNA, 25 bp, Rattus norvegicus
gccttgttttgctgtgctatagaaa

SEQ ID NO: 398490 - DNA, 25 bp, Rattus norvegicus
gccttgtttttgagcctggagtgaa

SEQ ID NO: 398491 - DNA, 25 bp, Rattus norvegicus
gccttgtttttgtgcctggagtgaa

SEQ ID NO: 398492 - DNA, 25 bp, Rattus norvegicus
gcctttaaaggcagctgtgaacaca

SEQ ID NO: 398493 - DNA, 25 bp, Rattus norvegicus
gcctttaaaggctgctgtgaacaca

SEQ ID NO: 398494 - DNA, 25 bp, Rattus norvegicus
gcctttaaccatcacggttcctgtt

SEQ ID NO: 398495 - DNA, 25 bp, Rattus norvegicus
gcctttaaccatgacggttcctgtt

SEQ ID NO: 398496 - DNA, 25 bp, Rattus norvegicus
gcctttacaagtccctggtgttttg

SEQ ID NO: 398497 - DNA, 25 bp, Rattus norvegicus
gcctttacaagtgcctggtgttttg

SEQ ID NO: 398498 - DNA, 25 bp, Rattus norvegicus
gcctttacagagctgcttggcgaag

SEQ ID NO: 398499 - DNA, 25 bp, Rattus norvegicus
gcctttacagaggtgcttggcgaag

SEQ ID NO: 398500 - DNA, 25 bp, Rattus norvegicus
gcctttacccagagcaaatgcttgt

SEQ ID NO: 398501 - DNA, 25 bp, Rattus norvegicus
gcctttacccagtgcaaatgcttgt

SEQ ID NO: 398502 - DNA, 25 bp, Rattus norvegicus
gcctttacctgcacttgagctgaat

SEQ ID NO: 398503 - DNA, 25 bp, Rattus norvegicus
gcctttacctgctcttgagctgaat

SEQ ID NO: 398504 - DNA, 25 bp, Rattus norvegicus
gcctttacgttcatgagtttattag

SEQ ID NO: 398505 - DNA, 25 bp, Rattus norvegicus
gcctttacgttcttgagtttattag

SEQ ID NO: 398506 - DNA, 25 bp, Rattus norvegicus
gcctttactcacattggttggtttg

SEQ ID NO: 398507 - DNA, 25 bp, Rattus norvegicus
gcctttactcactttggttggtttg

SEQ ID NO: 398508 - DNA, 25 bp, Rattus norvegicus
gcctttagactaatgttacctgaga

SEQ ID NO: 398509 - DNA, 25 bp, Rattus norvegicus
gcctttagactattgttacctgaga

SEQ ID NO: 398510 - DNA, 25 bp, Rattus norvegicus
gcctttagatggagtggccagtaaa

SEQ ID NO: 398511 - DNA, 25 bp, Rattus norvegicus
gcctttagatggtgtggccagtaaa

SEQ ID NO: 398512 - DNA, 25 bp, Rattus norvegicus
gcctttagcagtccccaaatggctt

SEQ ID NO: 398513 - DNA, 25 bp, Rattus norvegicus
gcctttagcagtgcccaaatggctt

SEQ ID NO: 398514 - DNA, 25 bp, Rattus norvegicus
gcctttagcatcatttcctgttaat

SEQ ID NO: 398515 - DNA, 25 bp, Rattus norvegicus
gcctttagcatcttttcctgttaat

SEQ ID NO: 398516 - DNA, 25 bp, Rattus norvegicus
gcctttaggtggaccagagtaaatt

SEQ ID NO: 398517 - DNA, 25 bp, Rattus norvegicus
gcctttaggtggtccagagtaaatt

SEQ ID NO: 398518 - DNA, 25 bp, Rattus norvegicus
gcctttatgagtcggcagcctgacg

SEQ ID NO: 398519 - DNA, 25 bp, Rattus norvegicus
gcctttatgagtgggcagcctgacg

SEQ ID NO: 398520 - DNA, 25 bp, Rattus norvegicus
gcctttatgtttatgttcaccgcct

SEQ ID NO: 398521 - DNA, 25 bp, Rattus norvegicus
gcctttatgtttttgttcaccgcct

SEQ ID NO: 398522 - DNA, 25 bp, Rattus norvegicus
gcctttattacaaacccttgtcttt

SEQ ID NO: 398523 - DNA, 25 bp, Rattus norvegicus
gcctttattacatacccttgtcttt

SEQ ID NO: 398524 - DNA, 25 bp, Rattus norvegicus
gcctttattccactcaatagcctca

SEQ ID NO: 398525 - DNA, 25 bp, Rattus norvegicus
gcctttattccagtcaatagcctca

SEQ ID NO: 398526 - DNA, 25 bp, Rattus norvegicus
gcctttattcttatggccataggga

SEQ ID NO: 398527 - DNA, 25 bp, Rattus norvegicus
gcctttattcttttggccataggga

SEQ ID NO: 398528 - DNA, 25 bp, Rattus norvegicus
gcctttatttcaatcattgccttct

SEQ ID NO: 398529 - DNA, 25 bp, Rattus norvegicus
gcctttatttcattcattgccttct

SEQ ID NO: 398530 - DNA, 25 bp, Rattus norvegicus
gcctttatttttactgatggctaag

SEQ ID NO: 398531 - DNA, 25 bp, Rattus norvegicus
gcctttattttttctgatggctaag

SEQ ID NO: 398532 - DNA, 25 bp, Rattus norvegicus
gcctttcaacagcagcacaggctga

SEQ ID NO: 398533 - DNA, 25 bp, Rattus norvegicus
gcctttcaacaggagcacaggctga

SEQ ID NO: 398534 - DNA, 25 bp, Rattus norvegicus
gcctttcaccacagcaggactgtaa

SEQ ID NO: 398535 - DNA, 25 bp, Rattus norvegicus
gcctttcaccactgcaggactgtaa

SEQ ID NO: 398536 - DNA, 25 bp, Rattus norvegicus
gcctttcacctgagactgtcagtga

SEQ ID NO: 398537 - DNA, 25 bp, Rattus norvegicus
gcctttcacctgattacatgctaat

SEQ ID NO: 398538 - DNA, 25 bp, Rattus norvegicus
gcctttcacctgtgactgtcagtga

SEQ ID NO: 398539 - DNA, 25 bp, Rattus norvegicus
gcctttcacctgtttacatgctaat

SEQ ID NO: 398540 - DNA, 25 bp, Rattus norvegicus
gcctttcagcccaaatccttaatgt

SEQ ID NO: 398541 - DNA, 25 bp, Rattus norvegicus
gcctttcagccctaatccttaatgt

SEQ ID NO: 398542 - DNA, 25 bp, Rattus norvegicus
gcctttcaggagacaagtggaagtc

SEQ ID NO: 398543 - DNA, 25 bp, Rattus norvegicus
gcctttcaggagtcaagtggaagtc

SEQ ID NO: 398544 - DNA, 25 bp, Rattus norvegicus
gcctttcagggtattcggcaaaata

SEQ ID NO: 398545 - DNA, 25 bp, Rattus norvegicus
gcctttcagggttttcggcaaaata

SEQ ID NO: 398546 - DNA, 25 bp, Rattus norvegicus
gcctttccaggaagcccagagtgag

SEQ ID NO: 398547 - DNA, 25 bp, Rattus norvegicus
gcctttccaggatgcccagagtgag

SEQ ID NO: 398548 - DNA, 25 bp, Rattus norvegicus
gcctttccagtcattgtgcaattga

SEQ ID NO: 398549 - DNA, 25 bp, Rattus norvegicus
gcctttccagtctttgtgcaattga

SEQ ID NO: 398550 - DNA, 25 bp, Rattus norvegicus
gcctttccagtgactcagaaaccag

SEQ ID NO: 398551 - DNA, 25 bp, Rattus norvegicus
gcctttccagtgtctcagaaaccag

SEQ ID NO: 398552 - DNA, 25 bp, Rattus norvegicus
gcctttccccatatcagaatacttg

SEQ ID NO: 398553 - DNA, 25 bp, Rattus norvegicus
gcctttccccatttcagaatacttg

SEQ ID NO: 398554 - DNA, 25 bp, Rattus norvegicus
gcctttcctatcacctcaaggagaa

SEQ ID NO: 398555 - DNA, 25 bp, Rattus norvegicus
gcctttcctatctcctcaaggagaa

SEQ ID NO: 398556 - DNA, 25 bp, Rattus norvegicus
gcctttcctcgaagggacacttgaa

SEQ ID NO: 398557 - DNA, 25 bp, Rattus norvegicus
gcctttcctcgatgggacacttgaa

SEQ ID NO: 398558 - DNA, 25 bp, Rattus norvegicus
gcctttcctgagaggcctcatttaa

SEQ ID NO: 398559 - DNA, 25 bp, Rattus norvegicus
gcctttcctgagtggcctcatttaa

SEQ ID NO: 398560 - DNA, 25 bp, Rattus norvegicus
gcctttcgcggactgctttggtgac

SEQ ID NO: 398561 - DNA, 25 bp, Rattus norvegicus
gcctttcgcggagtgctttggtgac

SEQ ID NO: 398562 - DNA, 25 bp, Rattus norvegicus
gcctttcgctttctgtttggagtag

SEQ ID NO: 398563 - DNA, 25 bp, Rattus norvegicus
gcctttcgctttgtgtttggagtag

SEQ ID NO: 398564 - DNA, 25 bp, Rattus norvegicus
gcctttcgtgttagatattcctcca

SEQ ID NO: 398565 - DNA, 25 bp, Rattus norvegicus
gcctttcgtgtttgatattcctcca

SEQ ID NO: 398566 - DNA, 25 bp, Rattus norvegicus
gcctttctaacccaaactgtgtgtc

SEQ ID NO: 398567 - DNA, 25 bp, Rattus norvegicus
gcctttctaaccgaaactgtgtgtc

SEQ ID NO: 398568 - DNA, 25 bp, Rattus norvegicus
gcctttctacaaccccgtggatgtg

SEQ ID NO: 398569 - DNA, 25 bp, Rattus norvegicus
gcctttctacaagcccgtggatgtg

SEQ ID NO: 398570 - DNA, 25 bp, Rattus norvegicus
gcctttctaccactgaactcttcgt

SEQ ID NO: 398571 - DNA, 25 bp, Rattus norvegicus
gcctttctaccagtgaactcttcgt

SEQ ID NO: 398572 - DNA, 25 bp, Rattus norvegicus
gcctttctcctcagtccagtgagaa

SEQ ID NO: 398573 - DNA, 25 bp, Rattus norvegicus
gcctttctcctctgtccagtgagaa

SEQ ID NO: 398574 - DNA, 25 bp, Rattus norvegicus
gcctttctcttgaggtgtttattaa

SEQ ID NO: 398575 - DNA, 25 bp, Rattus norvegicus
gcctttctcttgtggtgtttattaa

SEQ ID NO: 398576 - DNA, 25 bp, Rattus norvegicus
gcctttctgccaaagaggactagat

SEQ ID NO: 398577 - DNA, 25 bp, Rattus norvegicus
gcctttctgccatagaggactagat

SEQ ID NO: 398578 - DNA, 25 bp, Rattus norvegicus
gcctttctggagcaagaaacagcca

SEQ ID NO: 398579 - DNA, 25 bp, Rattus norvegicus
gcctttctggaggaagaaacagcca

SEQ ID NO: 398580 - DNA, 25 bp, Rattus norvegicus
gcctttcttccaacgtggacagtat

SEQ ID NO: 398581 - DNA, 25 bp, Rattus norvegicus
gcctttcttccatcgtggacagtat

SEQ ID NO: 398582 - DNA, 25 bp, Rattus norvegicus
gcctttcttgaccatttgccttgaa

SEQ ID NO: 398583 - DNA, 25 bp, Rattus norvegicus
gcctttcttgacgatttgccttgaa

SEQ ID NO: 398584 - DNA, 25 bp, Rattus norvegicus
gcctttctttacatctgagttttca

SEQ ID NO: 398585 - DNA, 25 bp, Rattus norvegicus
gcctttctttacttctgagttttca

SEQ ID NO: 398586 - DNA, 25 bp, Rattus norvegicus
gcctttgaaatcatgagcaccttcc

SEQ ID NO: 398587 - DNA, 25 bp, Rattus norvegicus
gcctttgaaatcttgagcaccttcc

SEQ ID NO: 398588 - DNA, 25 bp, Rattus norvegicus
gcctttgaacttcctcctactgaga

SEQ ID NO: 398589 - DNA, 25 bp, Rattus norvegicus
gcctttgaacttgctcctactgaga

SEQ ID NO: 398590 - DNA, 25 bp, Rattus norvegicus
gcctttgacaatcccagacacttag

SEQ ID NO: 398591 - DNA, 25 bp, Rattus norvegicus
gcctttgacaatgccagacacttag

SEQ ID NO: 398592 - DNA, 25 bp, Rattus norvegicus
gcctttgaggtccagtcagtggcat

SEQ ID NO: 398593 - DNA, 25 bp, Rattus norvegicus
gcctttgaggtcgagtcagtggcat

SEQ ID NO: 398594 - DNA, 25 bp, Rattus norvegicus
gcctttgagtaactgaagataccat

SEQ ID NO: 398595 - DNA, 25 bp, Rattus norvegicus
gcctttgagtaagtgaagataccat

SEQ ID NO: 398596 - DNA, 25 bp, Rattus norvegicus
gcctttgattttatgcatagagtaa

SEQ ID NO: 398597 - DNA, 25 bp, Rattus norvegicus
gcctttgattttttgcatagagtaa

SEQ ID NO: 398598 - DNA, 25 bp, Rattus norvegicus
gcctttgcacataggctcctaggga

SEQ ID NO: 398599 - DNA, 25 bp, Rattus norvegicus
gcctttgcacattggctcctaggga

SEQ ID NO: 398600 - DNA, 25 bp, Rattus norvegicus
gcctttgcactgacatatggaacga

SEQ ID NO: 398601 - DNA, 25 bp, Rattus norvegicus
gcctttgcactgatcttgggcatat

SEQ ID NO: 398602 - DNA, 25 bp, Rattus norvegicus
gcctttgcactgtcatatggaacga

SEQ ID NO: 398603 - DNA, 25 bp, Rattus norvegicus
gcctttgcactgttcttgggcatat

SEQ ID NO: 398604 - DNA, 25 bp, Rattus norvegicus
gcctttgcagatcagtagtgggtaa

SEQ ID NO: 398605 - DNA, 25 bp, Rattus norvegicus
gcctttgcagatgagtagtgggtaa

SEQ ID NO: 398606 - DNA, 25 bp, Rattus norvegicus
gcctttgcccagctatgcaaacgaa

SEQ ID NO: 398607 - DNA, 25 bp, Rattus norvegicus
gcctttgcccagctctgaaggtctt

SEQ ID NO: 398608 - DNA, 25 bp, Rattus norvegicus
gcctttgcccaggtatgcaaacgaa

SEQ ID NO: 398609 - DNA, 25 bp, Rattus norvegicus
gcctttgcccaggtctgaaggtctt

SEQ ID NO: 398610 - DNA, 25 bp, Rattus norvegicus
gcctttgcccttcgactgtgataaa

SEQ ID NO: 398611 - DNA, 25 bp, Rattus norvegicus
gcctttgcccttggactgtgataaa

SEQ ID NO: 398612 - DNA, 25 bp, Rattus norvegicus
gcctttgctagaaggcacttcctgt

SEQ ID NO: 398613 - DNA, 25 bp, Rattus norvegicus
gcctttgctagatggcacttcctgt

SEQ ID NO: 398614 - DNA, 25 bp, Rattus norvegicus
gcctttgctcctaggatatctcaga

SEQ ID NO: 398615 - DNA, 25 bp, Rattus norvegicus
gcctttgctccttggatatctcaga

SEQ ID NO: 398616 - DNA, 25 bp, Rattus norvegicus
gcctttgctcgtatgaactgtgtat

SEQ ID NO: 398617 - DNA, 25 bp, Rattus norvegicus
gcctttgctcgtttgaactgtgtat

SEQ ID NO: 398618 - DNA, 25 bp, Rattus norvegicus
gcctttgctctgagggatcaggatc

SEQ ID NO: 398619 - DNA, 25 bp, Rattus norvegicus
gcctttgctctgtgggatcaggatc

SEQ ID NO: 398620 - DNA, 25 bp, Rattus norvegicus
gcctttggaagtctcttgtgtccca

SEQ ID NO: 398621 - DNA, 25 bp, Rattus norvegicus
gcctttggaagtgtcttgtgtccca

SEQ ID NO: 398622 - DNA, 25 bp, Rattus norvegicus
gcctttggatgcagctgaagactca

SEQ ID NO: 398623 - DNA, 25 bp, Rattus norvegicus
gcctttggatgctgctgaagactca

SEQ ID NO: 398624 - DNA, 25 bp, Rattus norvegicus
gcctttggattgaccttgggtctaa

SEQ ID NO: 398625 - DNA, 25 bp, Rattus norvegicus
gcctttggattgtccttgggtctaa

SEQ ID NO: 398626 - DNA, 25 bp, Rattus norvegicus
gcctttggcagtaggcttgcacaaa

SEQ ID NO: 398627 - DNA, 25 bp, Rattus norvegicus
gcctttggcagttggcttgcacaaa

SEQ ID NO: 398628 - DNA, 25 bp, Rattus norvegicus
gcctttggcatcaacgagggcagct

SEQ ID NO: 398629 - DNA, 25 bp, Rattus norvegicus
gcctttggcatctacgagggcagct

SEQ ID NO: 398630 - DNA, 25 bp, Rattus norvegicus
gcctttgggagtctgctgatgatca

SEQ ID NO: 398631 - DNA, 25 bp, Rattus norvegicus
gcctttgggagtgtgctgatgatca

SEQ ID NO: 398632 - DNA, 25 bp, Rattus norvegicus
gcctttgggcagcttcggagctaca

SEQ ID NO: 398633 - DNA, 25 bp, Rattus norvegicus
gcctttgggcaggttcggagctaca

SEQ ID NO: 398634 - DNA, 25 bp, Rattus norvegicus
gcctttgggtttacaatctgatcag

SEQ ID NO: 398635 - DNA, 25 bp, Rattus norvegicus
gcctttgggttttcaatctgatcag

SEQ ID NO: 398636 - DNA, 25 bp, Rattus norvegicus
gcctttggtatcagtgattcctatg

SEQ ID NO: 398637 - DNA, 25 bp, Rattus norvegicus
gcctttggtatctgtgattcctatg

SEQ ID NO: 398638 - DNA, 25 bp, Rattus norvegicus
gcctttggttcacattctcgtttaa

SEQ ID NO: 398639 - DNA, 25 bp, Rattus norvegicus
gcctttggttcagattctcgtttaa

SEQ ID NO: 398640 - DNA, 25 bp, Rattus norvegicus
gcctttgtatgtaatgctagtctcc

SEQ ID NO: 398641 - DNA, 25 bp, Rattus norvegicus
gcctttgtatgttatgctagtctcc

SEQ ID NO: 398642 - DNA, 25 bp, Rattus norvegicus
gcctttgtcagtctagttgtgttga

SEQ ID NO: 398643 - DNA, 25 bp, Rattus norvegicus
gcctttgtcagtgtagttgtgttga

SEQ ID NO: 398644 - DNA, 25 bp, Rattus norvegicus
gcctttgtccggcacgtgcagagat

SEQ ID NO: 398645 - DNA, 25 bp, Rattus norvegicus
gcctttgtccgggacgtgcagagat

SEQ ID NO: 398646 - DNA, 25 bp, Rattus norvegicus
gcctttgtcctcaccaatttggaaa

SEQ ID NO: 398647 - DNA, 25 bp, Rattus norvegicus
gcctttgtcctctccaatttggaaa

SEQ ID NO: 398648 - DNA, 25 bp, Rattus norvegicus
gcctttgtctttcattaccgtggaa

SEQ ID NO: 398649 - DNA, 25 bp, Rattus norvegicus
gcctttgtctttgattaccgtggaa

SEQ ID NO: 398650 - DNA, 25 bp, Rattus norvegicus
gcctttgtgactacattgcaaccat

SEQ ID NO: 398651 - DNA, 25 bp, Rattus norvegicus
gcctttgtgacttcattgcaaccat

SEQ ID NO: 398652 - DNA, 25 bp, Rattus norvegicus
gcctttgtgcccatttccattggaa

SEQ ID NO: 398653 - DNA, 25 bp, Rattus norvegicus
gcctttgtgcccttttccattggaa

SEQ ID NO: 398654 - DNA, 25 bp, Rattus norvegicus
gcctttgtgccgctgtaaaattgta

SEQ ID NO: 398655 - DNA, 25 bp, Rattus norvegicus
gcctttgtgccggtgtaaaattgta

SEQ ID NO: 398656 - DNA, 25 bp, Rattus norvegicus
gcctttgtgggcatcagacatactt

SEQ ID NO: 398657 - DNA, 25 bp, Rattus norvegicus
gcctttgtgggcttcagacatactt

SEQ ID NO: 398658 - DNA, 25 bp, Rattus norvegicus
gcctttgtgtgcatttgttctcaga

SEQ ID NO: 398659 - DNA, 25 bp, Rattus norvegicus
gcctttgtgtgcttttgttctcaga

SEQ ID NO: 398660 - DNA, 25 bp, Rattus norvegicus
gcctttgtgtggcaagctgtcttac

SEQ ID NO: 398661 - DNA, 25 bp, Rattus norvegicus
gcctttgtgtgggaagctgtcttac

SEQ ID NO: 398662 - DNA, 25 bp, Rattus norvegicus
gcctttgttctcaagcactatgtac

SEQ ID NO: 398663 - DNA, 25 bp, Rattus norvegicus
gcctttgttctctagcactatgtac

SEQ ID NO: 398664 - DNA, 25 bp, Rattus norvegicus
gcctttgttgccattcattgtagtg

SEQ ID NO: 398665 - DNA, 25 bp, Rattus norvegicus
gcctttgttgcctttcattgtagtg

SEQ ID NO: 398666 - DNA, 25 bp, Rattus norvegicus
gcctttgtttccacctggatttaag

SEQ ID NO: 398667 - DNA, 25 bp, Rattus norvegicus
gcctttgtttccctgcataaatgac

SEQ ID NO: 398668 - DNA, 25 bp, Rattus norvegicus
gcctttgtttccgtgcataaatgac

SEQ ID NO: 398669 - DNA, 25 bp, Rattus norvegicus
gcctttgtttcctcctggatttaag

SEQ ID NO: 398670 - DNA, 25 bp, Rattus norvegicus
gcctttgtttgcatcaactctgaca

SEQ ID NO: 398671 - DNA, 25 bp, Rattus norvegicus
gcctttgtttgcttcaactctgaca

SEQ ID NO: 398672 - DNA, 25 bp, Rattus norvegicus
gcctttgtttggcactgatacgcac

SEQ ID NO: 398673 - DNA, 25 bp, Rattus norvegicus
gcctttgtttgggactgatacgcac

SEQ ID NO: 398674 - DNA, 25 bp, Rattus norvegicus
gcctttgttttcacttgcacttatg

SEQ ID NO: 398675 - DNA, 25 bp, Rattus norvegicus
gcctttgttttccttagctggagca

SEQ ID NO: 398676 - DNA, 25 bp, Rattus norvegicus
gcctttgttttcgttagctggagca

SEQ ID NO: 398677 - DNA, 25 bp, Rattus norvegicus
gcctttgttttctcttgcacttatg

SEQ ID NO: 398678 - DNA, 25 bp, Rattus norvegicus
gccttttaaactatgtgcctctgag

SEQ ID NO: 398679 - DNA, 25 bp, Rattus norvegicus
gccttttaaactttgtgcctctgag

SEQ ID NO: 398680 - DNA, 25 bp, Rattus norvegicus
gccttttaacatagtttctcatgta

SEQ ID NO: 398681 - DNA, 25 bp, Rattus norvegicus
gccttttaacattgtttctcatgta

SEQ ID NO: 398682 - DNA, 25 bp, Rattus norvegicus
gccttttagaagacagtcatggatg

SEQ ID NO: 398683 - DNA, 25 bp, Rattus norvegicus
gccttttagaagtcagtcatggatg

SEQ ID NO: 398684 - DNA, 25 bp, Rattus norvegicus
gccttttatactatagcttgaactg

SEQ ID NO: 398685 - DNA, 25 bp, Rattus norvegicus
gccttttatactttagcttgaactg

SEQ ID NO: 398686 - DNA, 25 bp, Rattus norvegicus
gccttttatctcagtcctgtttgac

SEQ ID NO: 398687 - DNA, 25 bp, Rattus norvegicus
gccttttatctctgtcctgtttgac

SEQ ID NO: 398688 - DNA, 25 bp, Rattus norvegicus
gccttttatgcccagagtatgtcag

SEQ ID NO: 398689 - DNA, 25 bp, Rattus norvegicus
gccttttatgccgagagtatgtcag

SEQ ID NO: 398690 - DNA, 25 bp, Rattus norvegicus
gccttttatttcattttgcctgcag

SEQ ID NO: 398691 - DNA, 25 bp, Rattus norvegicus
gccttttatttctttttgcctgcag

SEQ ID NO: 398692 - DNA, 25 bp, Rattus norvegicus
gccttttcatccattataagagtca

SEQ ID NO: 398693 - DNA, 25 bp, Rattus norvegicus
gccttttcatcctttataagagtca

SEQ ID NO: 398694 - DNA, 25 bp, Rattus norvegicus
gccttttccagtaggccggtgagta

SEQ ID NO: 398695 - DNA, 25 bp, Rattus norvegicus
gccttttccagttggccggtgagta

SEQ ID NO: 398696 - DNA, 25 bp, Rattus norvegicus
gccttttccgaaccatagactagat

SEQ ID NO: 398697 - DNA, 25 bp, Rattus norvegicus
gccttttccgaagcatagactagat

SEQ ID NO: 398698 - DNA, 25 bp, Rattus norvegicus
gccttttcctaacagtgctgtcaga

SEQ ID NO: 398699 - DNA, 25 bp, Rattus norvegicus
gccttttcctaagagtgctgtcaga

SEQ ID NO: 398700 - DNA, 25 bp, Rattus norvegicus
gccttttcctcacggggccagcaaa

SEQ ID NO: 398701 - DNA, 25 bp, Rattus norvegicus
gccttttcctcagggggccagcaaa

SEQ ID NO: 398702 - DNA, 25 bp, Rattus norvegicus
gccttttctaggatttctggtaatg

SEQ ID NO: 398703 - DNA, 25 bp, Rattus norvegicus
gccttttctaggttttctggtaatg

SEQ ID NO: 398704 - DNA, 25 bp, Rattus norvegicus
gccttttctgagacccaacttggat

SEQ ID NO: 398705 - DNA, 25 bp, Rattus norvegicus
gccttttctgagtcccaacttggat

SEQ ID NO: 398706 - DNA, 25 bp, Rattus norvegicus
gccttttctggacactgaatttcat

SEQ ID NO: 398707 - DNA, 25 bp, Rattus norvegicus
gccttttctggagactgaatttcat

SEQ ID NO: 398708 - DNA, 25 bp, Rattus norvegicus
gccttttcttgaagaccggttgata

SEQ ID NO: 398709 - DNA, 25 bp, Rattus norvegicus
gccttttcttgatgaccggttgata

SEQ ID NO: 398710 - DNA, 25 bp, Rattus norvegicus
gccttttgactgctgttcaggtgaa

SEQ ID NO: 398711 - DNA, 25 bp, Rattus norvegicus
gccttttgactggtgttcaggtgaa

SEQ ID NO: 398712 - DNA, 25 bp, Rattus norvegicus
gccttttgagtcattcagatacctg

SEQ ID NO: 398713 - DNA, 25 bp, Rattus norvegicus
gccttttgagtctttcagatacctg

SEQ ID NO: 398714 - DNA, 25 bp, Rattus norvegicus
gccttttgatagcatgctcaccgag

SEQ ID NO: 398715 - DNA, 25 bp, Rattus norvegicus
gccttttgataggatgctcaccgag

SEQ ID NO: 398716 - DNA, 25 bp, Rattus norvegicus
gccttttgcaaaaactccagttcct

SEQ ID NO: 398717 - DNA, 25 bp, Rattus norvegicus
gccttttgcaaatactccagttcct

SEQ ID NO: 398718 - DNA, 25 bp, Rattus norvegicus
gccttttgcaacaggctctactgga

SEQ ID NO: 398719 - DNA, 25 bp, Rattus norvegicus
gccttttgcaactggctctactgga

SEQ ID NO: 398720 - DNA, 25 bp, Rattus norvegicus
gccttttgccttagagtctagagag

SEQ ID NO: 398721 - DNA, 25 bp, Rattus norvegicus
gccttttgcctttgagtctagagag

SEQ ID NO: 398722 - DNA, 25 bp, Rattus norvegicus
gccttttgctagcatcttttgcata

SEQ ID NO: 398723 - DNA, 25 bp, Rattus norvegicus
gccttttgctaggatcttttgcata

SEQ ID NO: 398724 - DNA, 25 bp, Rattus norvegicus
gccttttggacactttccatggtga

SEQ ID NO: 398725 - DNA, 25 bp, Rattus norvegicus
gccttttggacagtttccatggtga

SEQ ID NO: 398726 - DNA, 25 bp, Rattus norvegicus
gccttttggatgagtttactttctt

SEQ ID NO: 398727 - DNA, 25 bp, Rattus norvegicus
gccttttggatgtgtttactttctt

SEQ ID NO: 398728 - DNA, 25 bp, Rattus norvegicus
gccttttggcctctggagacagtga

SEQ ID NO: 398729 - DNA, 25 bp, Rattus norvegicus
gccttttggcctgtggagacagtga

SEQ ID NO: 398730 - DNA, 25 bp, Rattus norvegicus
gccttttggctgaagcatttgtaga

SEQ ID NO: 398731 - DNA, 25 bp, Rattus norvegicus
gccttttggctgtagcatttgtaga

SEQ ID NO: 398732 - DNA, 25 bp, Rattus norvegicus
gccttttggttcagtggatgctcaa

SEQ ID NO: 398733 - DNA, 25 bp, Rattus norvegicus
gccttttggttcatcgaaatttcat

SEQ ID NO: 398734 - DNA, 25 bp, Rattus norvegicus
gccttttggttctgtggatgctcaa

SEQ ID NO: 398735 - DNA, 25 bp, Rattus norvegicus
gccttttggttcttcgaaatttcat

SEQ ID NO: 398736 - DNA, 25 bp, Rattus norvegicus
gccttttgtatacgtcctgggtaat

SEQ ID NO: 398737 - DNA, 25 bp, Rattus norvegicus
gccttttgtataggtcctgggtaat

SEQ ID NO: 398738 - DNA, 25 bp, Rattus norvegicus
gccttttgtccccttcttcaaaatg

SEQ ID NO: 398739 - DNA, 25 bp, Rattus norvegicus
gccttttgtcccgttcttcaaaatg

SEQ ID NO: 398740 - DNA, 25 bp, Rattus norvegicus
gccttttgtcttcctagttgaaact

SEQ ID NO: 398741 - DNA, 25 bp, Rattus norvegicus
gccttttgtcttgctagttgaaact

SEQ ID NO: 398742 - DNA, 25 bp, Rattus norvegicus
gccttttgtgagatggttggaccca

SEQ ID NO: 398743 - DNA, 25 bp, Rattus norvegicus
gccttttgtgagttggttggaccca

SEQ ID NO: 398744 - DNA, 25 bp, Rattus norvegicus
gccttttgtggcagcccaggtaaga

SEQ ID NO: 398745 - DNA, 25 bp, Rattus norvegicus
gccttttgtggctgcccaggtaaga

SEQ ID NO: 398746 - DNA, 25 bp, Rattus norvegicus
gccttttgtgggaattatcttctca

SEQ ID NO: 398747 - DNA, 25 bp, Rattus norvegicus
gccttttgtgggtattatcttctca

SEQ ID NO: 398748 - DNA, 25 bp, Rattus norvegicus
gccttttgtgttcgccggaagacta

SEQ ID NO: 398749 - DNA, 25 bp, Rattus norvegicus
gccttttgtgttggccggaagacta

SEQ ID NO: 398750 - DNA, 25 bp, Rattus norvegicus
gccttttgttgcaggccatcagaag

SEQ ID NO: 398751 - DNA, 25 bp, Rattus norvegicus
gccttttgttgctggccatcagaag

SEQ ID NO: 398752 - DNA, 25 bp, Rattus norvegicus
gccttttgttgtacgttgggacatc

SEQ ID NO: 398753 - DNA, 25 bp, Rattus norvegicus
gccttttgttgttcgttgggacatc

SEQ ID NO: 398754 - DNA, 25 bp, Rattus norvegicus
gccttttgtttgctatgtcgtgtat

SEQ ID NO: 398755 - DNA, 25 bp, Rattus norvegicus
gccttttgtttggtatgtcgtgtat

SEQ ID NO: 398756 - DNA, 25 bp, Rattus norvegicus
gcctttttacctacatgcatgcctg

SEQ ID NO: 398757 - DNA, 25 bp, Rattus norvegicus
gcctttttaccttcatgcatgcctg

SEQ ID NO: 398758 - DNA, 25 bp, Rattus norvegicus
gcctttttcaagagctttggctgtg

SEQ ID NO: 398759 - DNA, 25 bp, Rattus norvegicus
gcctttttcaagtgctttggctgtg

SEQ ID NO: 398760 - DNA, 25 bp, Rattus norvegicus
gcctttttctcacaggtcacttaat

SEQ ID NO: 398761 - DNA, 25 bp, Rattus norvegicus
gcctttttctcagaggtcacttaat

SEQ ID NO: 398762 - DNA, 25 bp, Rattus norvegicus
gcctttttctccatctatgtagtta

SEQ ID NO: 398763 - DNA, 25 bp, Rattus norvegicus
gcctttttctccttctatgtagtta

SEQ ID NO: 398764 - DNA, 25 bp, Rattus norvegicus
gcctttttgagtagccttagagaaa

SEQ ID NO: 398765 - DNA, 25 bp, Rattus norvegicus
gcctttttgagttgccttagagaaa

SEQ ID NO: 398766 - DNA, 25 bp, Rattus norvegicus
gcctttttggcccaaagactggaca

SEQ ID NO: 398767 - DNA, 25 bp, Rattus norvegicus
gcctttttggccgaaagactggaca

SEQ ID NO: 398768 - DNA, 25 bp, Rattus norvegicus
gcctttttgtctcaatcttccaata

SEQ ID NO: 398769 - DNA, 25 bp, Rattus norvegicus
gcctttttgtctgaatcttccaata

SEQ ID NO: 398770 - DNA, 25 bp, Rattus norvegicus
gccttttttagtagtatagccaaag

SEQ ID NO: 398771 - DNA, 25 bp, Rattus norvegicus
gccttttttagttgtatagccaaag

SEQ ID NO: 398772 - DNA, 25 bp, Rattus norvegicus
gccttttttcctcaggacgtggaga

SEQ ID NO: 398773 - DNA, 25 bp, Rattus norvegicus
gccttttttcctgaggacgtggaga

SEQ ID NO: 398774 - DNA, 25 bp, Rattus norvegicus
gccttttttctgcactttgtttcac

SEQ ID NO: 398775 - DNA, 25 bp, Rattus norvegicus
gccttttttctggactttgtttcac

SEQ ID NO: 398776 - DNA, 25 bp, Rattus norvegicus
gccttttttgtaaatctgttgcttt

SEQ ID NO: 398777 - DNA, 25 bp, Rattus norvegicus
gccttttttgtatatctgttgcttt

SEQ ID NO: 398778 - DNA, 25 bp, Rattus norvegicus
gcgaaaacagaaagccccacccgca

SEQ ID NO: 398779 - DNA, 25 bp, Rattus norvegicus
gcgaaaacagaatgccccacccgca

SEQ ID NO: 398780 - DNA, 25 bp, Rattus norvegicus
gcgaaaacagcacttgaggtctcat

SEQ ID NO: 398781 - DNA, 25 bp, Rattus norvegicus
gcgaaaacagcagttgaggtctcat

SEQ ID NO: 398782 - DNA, 25 bp, Rattus norvegicus
gcgaaaagtctgctgtgataccgat

SEQ ID NO: 398783 - DNA, 25 bp, Rattus norvegicus
gcgaaaagtctggtgtgataccgat

SEQ ID NO: 398784 - DNA, 25 bp, Rattus norvegicus
gcgaaacccaagatttgacccattg

SEQ ID NO: 398785 - DNA, 25 bp, Rattus norvegicus
gcgaaacccaagttttgacccattg

SEQ ID NO: 398786 - DNA, 25 bp, Rattus norvegicus
gcgaaacgtggaacatgagcatcta

SEQ ID NO: 398787 - DNA, 25 bp, Rattus norvegicus
gcgaaacgtggatcatgagcatcta

SEQ ID NO: 398788 - DNA, 25 bp, Rattus norvegicus
gcgaaactcatcagactgtgctatt

SEQ ID NO: 398789 - DNA, 25 bp, Rattus norvegicus
gcgaaactcatctgactgtgctatt

SEQ ID NO: 398790 - DNA, 25 bp, Rattus norvegicus
gcgaaactgtgaactgcggcggcac

SEQ ID NO: 398791 - DNA, 25 bp, Rattus norvegicus
gcgaaactgtgatctgcggcggcac

SEQ ID NO: 398792 - DNA, 25 bp, Rattus norvegicus
gcgaaagagaggctttgccatctaa

SEQ ID NO: 398793 - DNA, 25 bp, Rattus norvegicus
gcgaaagagagggtttgccatctaa

SEQ ID NO: 398794 - DNA, 25 bp, Rattus norvegicus
gcgaaagcagctcacggatacgtga

SEQ ID NO: 398795 - DNA, 25 bp, Rattus norvegicus
gcgaaagcagctgacggatacgtga

SEQ ID NO: 398796 - DNA, 25 bp, Rattus norvegicus
gcgaaaggaatcacctgaccctctg

SEQ ID NO: 398797 - DNA, 25 bp, Rattus norvegicus
gcgaaaggaatctcctgaccctctg

SEQ ID NO: 398798 - DNA, 25 bp, Rattus norvegicus
gcgaaagtgcatacagtccatcctg

SEQ ID NO: 398799 - DNA, 25 bp, Rattus norvegicus
gcgaaagtgcattcagtccatcctg

SEQ ID NO: 398800 - DNA, 25 bp, Rattus norvegicus
gcgaaatcctatccggtcagttgtt

SEQ ID NO: 398801 - DNA, 25 bp, Rattus norvegicus
gcgaaatcctatgcggtcagttgtt

SEQ ID NO: 398802 - DNA, 25 bp, Rattus norvegicus
gcgaaatctatgactttactgcctc

SEQ ID NO: 398803 - DNA, 25 bp, Rattus norvegicus
gcgaaatctatgtctttactgcctc

SEQ ID NO: 398804 - DNA, 25 bp, Rattus norvegicus
gcgaacacagcactaagaccacatg

SEQ ID NO: 398805 - DNA, 25 bp, Rattus norvegicus
gcgaacacagcagtaagaccacatg

SEQ ID NO: 398806 - DNA, 25 bp, Rattus norvegicus
gcgaacacgtgaaagctggagacat

SEQ ID NO: 398807 - DNA, 25 bp, Rattus norvegicus
gcgaacacgtgatagctggagacat

SEQ ID NO: 398808 - DNA, 25 bp, Rattus norvegicus
gcgaacagaacaccaccgaacagca

SEQ ID NO: 398809 - DNA, 25 bp, Rattus norvegicus
gcgaacagaacagcaccgaacagca

SEQ ID NO: 398810 - DNA, 25 bp, Rattus norvegicus
gcgaaccacgcgcagagatcttaac

SEQ ID NO: 398811 - DNA, 25 bp, Rattus norvegicus
gcgaaccacgcggagagatcttaac

SEQ ID NO: 398812 - DNA, 25 bp, Rattus norvegicus
gcgaacgtgaggactcctatggcga

SEQ ID NO: 398813 - DNA, 25 bp, Rattus norvegicus
gcgaacgtgaggtctcctatggcga

SEQ ID NO: 398814 - DNA, 25 bp, Rattus norvegicus
gcgaacgtgttaagcattgtctata

SEQ ID NO: 398815 - DNA, 25 bp, Rattus norvegicus
gcgaacgtgttatgcattgtctata

SEQ ID NO: 398816 - DNA, 25 bp, Rattus norvegicus
gcgaactaaacgctcgggcagcttc

SEQ ID NO: 398817 - DNA, 25 bp, Rattus norvegicus
gcgaactaaacggtcgggcagcttc

SEQ ID NO: 398818 - DNA, 25 bp, Rattus norvegicus
gcgaactattttcaagctcaccatt

SEQ ID NO: 398819 - DNA, 25 bp, Rattus norvegicus
gcgaactattttgaagctcaccatt

SEQ ID NO: 398820 - DNA, 25 bp, Rattus norvegicus
gcgaactctgatcaacttaccctac

SEQ ID NO: 398821 - DNA, 25 bp, Rattus norvegicus
gcgaactctgatgaacttaccctac

SEQ ID NO: 398822 - DNA, 25 bp, Rattus norvegicus
gcgaacttccacagcggcatgcgcg

SEQ ID NO: 398823 - DNA, 25 bp, Rattus norvegicus
gcgaacttccactgcggcatgcgcg

SEQ ID NO: 398824 - DNA, 25 bp, Rattus norvegicus
gcgaagaaccctccattgaatccat

SEQ ID NO: 398825 - DNA, 25 bp, Rattus norvegicus
gcgaagaaccctgcattgaatccat

SEQ ID NO: 398826 - DNA, 25 bp, Rattus norvegicus
gcgaagaactgaaactcgactgtct

SEQ ID NO: 398827 - DNA, 25 bp, Rattus norvegicus
gcgaagaactgatactcgactgtct

SEQ ID NO: 398828 - DNA, 25 bp, Rattus norvegicus
gcgaagaatgacaaggctcaactaa

SEQ ID NO: 398829 - DNA, 25 bp, Rattus norvegicus
gcgaagaatgactaggctcaactaa

SEQ ID NO: 398830 - DNA, 25 bp, Rattus norvegicus
gcgaagagaagaactggctcccctc

SEQ ID NO: 398831 - DNA, 25 bp, Rattus norvegicus
gcgaagagaagatctggctcccctc

SEQ ID NO: 398832 - DNA, 25 bp, Rattus norvegicus
gcgaagagacggaccttgtgcgtaa

SEQ ID NO: 398833 - DNA, 25 bp, Rattus norvegicus
gcgaagagacggtccttgtgcgtaa

SEQ ID NO: 398834 - DNA, 25 bp, Rattus norvegicus
gcgaagaggccgaggacaagtcccc

SEQ ID NO: 398835 - DNA, 25 bp, Rattus norvegicus
gcgaagaggccgtggacaagtcccc

SEQ ID NO: 398836 - DNA, 25 bp, Rattus norvegicus
gcgaagagttcacatgtattctcat

SEQ ID NO: 398837 - DNA, 25 bp, Rattus norvegicus
gcgaagagttcaccgatggcatcat

SEQ ID NO: 398838 - DNA, 25 bp, Rattus norvegicus
gcgaagagttcagatgtattctcat

SEQ ID NO: 398839 - DNA, 25 bp, Rattus norvegicus
gcgaagagttcagcgatggcatcat

SEQ ID NO: 398840 - DNA, 25 bp, Rattus norvegicus
gcgaagattcctagagtccagcact

SEQ ID NO: 398841 - DNA, 25 bp, Rattus norvegicus
gcgaagattccttgagtccagcact

SEQ ID NO: 398842 - DNA, 25 bp, Rattus norvegicus
gcgaagcattatatggcaagcagtt

SEQ ID NO: 398843 - DNA, 25 bp, Rattus norvegicus
gcgaagcattatttggcaagcagtt

SEQ ID NO: 398844 - DNA, 25 bp, Rattus norvegicus
gcgaagccagcgcttcctcaatgac

SEQ ID NO: 398845 - DNA, 25 bp, Rattus norvegicus
gcgaagccagcggttcctcaatgac

SEQ ID NO: 398846 - DNA, 25 bp, Rattus norvegicus
gcgaagccatttcagtgcctcgtca

SEQ ID NO: 398847 - DNA, 25 bp, Rattus norvegicus
gcgaagccatttgagtgcctcgtca

SEQ ID NO: 398848 - DNA, 25 bp, Rattus norvegicus
gcgaagcctgcacagactgcgagca

SEQ ID NO: 398849 - DNA, 25 bp, Rattus norvegicus
gcgaagcctgcagagactgcgagca

SEQ ID NO: 398850 - DNA, 25 bp, Rattus norvegicus
gcgaagctcccaaccagggaatgaa

SEQ ID NO: 398851 - DNA, 25 bp, Rattus norvegicus
gcgaagctcccatccagggaatgaa

SEQ ID NO: 398852 - DNA, 25 bp, Rattus norvegicus
gcgaagcttcaacgccgtagtcaca

SEQ ID NO: 398853 - DNA, 25 bp, Rattus norvegicus
gcgaagcttcaaggccgtagtcaca

SEQ ID NO: 398854 - DNA, 25 bp, Rattus norvegicus
gcgaagcttgggaactgaaaggcaa

SEQ ID NO: 398855 - DNA, 25 bp, Rattus norvegicus
gcgaagcttgggtactgaaaggcaa

SEQ ID NO: 398856 - DNA, 25 bp, Rattus norvegicus
gcgaaggcaacactcgattcaccta

SEQ ID NO: 398857 - DNA, 25 bp, Rattus norvegicus
gcgaaggcaacagtcgattcaccta

SEQ ID NO: 398858 - DNA, 25 bp, Rattus norvegicus
gcgaaggcccggcacctgtacaaga

SEQ ID NO: 398859 - DNA, 25 bp, Rattus norvegicus
gcgaaggcccgggacctgtacaaga

SEQ ID NO: 398860 - DNA, 25 bp, Rattus norvegicus
gcgaagggtttgaggaatctccaga

SEQ ID NO: 398861 - DNA, 25 bp, Rattus norvegicus
gcgaagggtttgtggaatctccaga

SEQ ID NO: 398862 - DNA, 25 bp, Rattus norvegicus
gcgaaggttactacccggatggtgt

SEQ ID NO: 398863 - DNA, 25 bp, Rattus norvegicus
gcgaaggttacttcccggatggtgt

SEQ ID NO: 398864 - DNA, 25 bp, Rattus norvegicus
gcgaaggttttgagtttgctgccat

SEQ ID NO: 398865 - DNA, 25 bp, Rattus norvegicus
gcgaaggttttgtgtttgctgccat

SEQ ID NO: 398866 - DNA, 25 bp, Rattus norvegicus
gcgaagtcccggctgtctactactt

SEQ ID NO: 398867 - DNA, 25 bp, Rattus norvegicus
gcgaagtcccgggtgtctactactt

SEQ ID NO: 398868 - DNA, 25 bp, Rattus norvegicus
gcgaagtcggaccaattttaccctg

SEQ ID NO: 398869 - DNA, 25 bp, Rattus norvegicus
gcgaagtcggacgaattttaccctg

SEQ ID NO: 398870 - DNA, 25 bp, Rattus norvegicus
gcgaagtgccagatgcataatttgt

SEQ ID NO: 398871 - DNA, 25 bp, Rattus norvegicus
gcgaagtgccagttgcataatttgt

SEQ ID NO: 398872 - DNA, 25 bp, Rattus norvegicus
gcgaagtgtgccagccgacgtgttt

SEQ ID NO: 398873 - DNA, 25 bp, Rattus norvegicus
gcgaagtgtgcctgccgacgtgttt

SEQ ID NO: 398874 - DNA, 25 bp, Rattus norvegicus
gcgaagtgttcgaggtagctctctg

SEQ ID NO: 398875 - DNA, 25 bp, Rattus norvegicus
gcgaagtgttcgtggtagctctctg

SEQ ID NO: 398876 - DNA, 25 bp, Rattus norvegicus
gcgaagtgttgcatctatcctaaaa

SEQ ID NO: 398877 - DNA, 25 bp, Rattus norvegicus
gcgaagtgttgcttctatcctaaaa

SEQ ID NO: 398878 - DNA, 25 bp, Rattus norvegicus
gcgaagtgtttgattaaaagtctaa

SEQ ID NO: 398879 - DNA, 25 bp, Rattus norvegicus
gcgaagtgtttgtttaaaagtctaa

SEQ ID NO: 398880 - DNA, 25 bp, Rattus norvegicus
gcgaagtgttttataatcttctcag

SEQ ID NO: 398881 - DNA, 25 bp, Rattus norvegicus
gcgaagtgttttttaatcttctcag

SEQ ID NO: 398882 - DNA, 25 bp, Rattus norvegicus
gcgaagttcactataatacgagaca

SEQ ID NO: 398883 - DNA, 25 bp, Rattus norvegicus
gcgaagttcactttaatacgagaca

SEQ ID NO: 398884 - DNA, 25 bp, Rattus norvegicus
gcgaagtttctgagtggccctttgt

SEQ ID NO: 398885 - DNA, 25 bp, Rattus norvegicus
gcgaagtttctgtgtggccctttgt

SEQ ID NO: 398886 - DNA, 25 bp, Rattus norvegicus
gcgaatatcaatcacgtcttcctaa

SEQ ID NO: 398887 - DNA, 25 bp, Rattus norvegicus
gcgaatatcaatgacgtcttcctaa

SEQ ID NO: 398888 - DNA, 25 bp, Rattus norvegicus
gcgaatattcacagttgcactgtat

SEQ ID NO: 398889 - DNA, 25 bp, Rattus norvegicus
gcgaatattcactgttgcactgtat

SEQ ID NO: 398890 - DNA, 25 bp, Rattus norvegicus
gcgaatccgcatctgtccaaagtac

SEQ ID NO: 398891 - DNA, 25 bp, Rattus norvegicus
gcgaatccgcatgtgtccaaagtac

SEQ ID NO: 398892 - DNA, 25 bp, Rattus norvegicus
gcgaatcctcaaaccgtacaatttg

SEQ ID NO: 398893 - DNA, 25 bp, Rattus norvegicus
gcgaatcctcaatccgtacaatttg

SEQ ID NO: 398894 - DNA, 25 bp, Rattus norvegicus
gcgaatcggactccattctgggtca

SEQ ID NO: 398895 - DNA, 25 bp, Rattus norvegicus
gcgaatcggactgcattctgggtca

SEQ ID NO: 398896 - DNA, 25 bp, Rattus norvegicus
gcgaatgataacagcaatccaatat

SEQ ID NO: 398897 - DNA, 25 bp, Rattus norvegicus
gcgaatgataactgcaatccaatat

SEQ ID NO: 398898 - DNA, 25 bp, Rattus norvegicus
gcgaatgcatttctgacacgcaggt

SEQ ID NO: 398899 - DNA, 25 bp, Rattus norvegicus
gcgaatgcatttgtgacacgcaggt

SEQ ID NO: 398900 - DNA, 25 bp, Rattus norvegicus
gcgaatgccttgagaacagctggac

SEQ ID NO: 398901 - DNA, 25 bp, Rattus norvegicus
gcgaatgccttgtgaacagctggac

SEQ ID NO: 398902 - DNA, 25 bp, Rattus norvegicus
gcgaatggttatctgctgtgtatgc

SEQ ID NO: 398903 - DNA, 25 bp, Rattus norvegicus
gcgaatggttatgtgctgtgtatgc

SEQ ID NO: 398904 - DNA, 25 bp, Rattus norvegicus
gcgaattagcatcaaccaggccctg

SEQ ID NO: 398905 - DNA, 25 bp, Rattus norvegicus
gcgaattagcatgaaccaggccctg

SEQ ID NO: 398906 - DNA, 25 bp, Rattus norvegicus
gcgaattcctgcacatggctcatga

SEQ ID NO: 398907 - DNA, 25 bp, Rattus norvegicus
gcgaattcctgctcatggctcatga

SEQ ID NO: 398908 - DNA, 25 bp, Rattus norvegicus
gcgaattgcggcccgttcgacataa

SEQ ID NO: 398909 - DNA, 25 bp, Rattus norvegicus
gcgaattgcggcgcgttcgacataa

SEQ ID NO: 398910 - DNA, 25 bp, Rattus norvegicus
gcgaattgtaaccatatgcttcata

SEQ ID NO: 398911 - DNA, 25 bp, Rattus norvegicus
gcgaattgtaacgatatgcttcata

SEQ ID NO: 398912 - DNA, 25 bp, Rattus norvegicus
gcgaattttggccttatgtatggga

SEQ ID NO: 398913 - DNA, 25 bp, Rattus norvegicus
gcgaattttggcgttatgtatggga

SEQ ID NO: 398914 - DNA, 25 bp, Rattus norvegicus
gcgacaacgcagcaagagcccggtt

SEQ ID NO: 398915 - DNA, 25 bp, Rattus norvegicus
gcgacaacgcaggaagagcccggtt

SEQ ID NO: 398916 - DNA, 25 bp, Rattus norvegicus
gcgacaactactccaacgtgatgat

SEQ ID NO: 398917 - DNA, 25 bp, Rattus norvegicus
gcgacaactactgcaacgtgatgat

SEQ ID NO: 398918 - DNA, 25 bp, Rattus norvegicus
gcgacaatttgtctgaactcttgag

SEQ ID NO: 398919 - DNA, 25 bp, Rattus norvegicus
gcgacaatttgtgtgaactcttgag

SEQ ID NO: 398920 - DNA, 25 bp, Rattus norvegicus
gcgacacaagttcccagtcttcatg

SEQ ID NO: 398921 - DNA, 25 bp, Rattus norvegicus
gcgacacaagttgccagtcttcatg

SEQ ID NO: 398922 - DNA, 25 bp, Rattus norvegicus
gcgacacacccgaaccgagacgccg

SEQ ID NO: 398923 - DNA, 25 bp, Rattus norvegicus
gcgacacacccgtaccgagacgccg

SEQ ID NO: 398924 - DNA, 25 bp, Rattus norvegicus
gcgacacagccaatcattattctat

SEQ ID NO: 398925 - DNA, 25 bp, Rattus norvegicus
gcgacacagccattcattattctat

SEQ ID NO: 398926 - DNA, 25 bp, Rattus norvegicus
gcgacacagtgacatccagcagttg

SEQ ID NO: 398927 - DNA, 25 bp, Rattus norvegicus
gcgacacagtgagatccagcagttg

SEQ ID NO: 398928 - DNA, 25 bp, Rattus norvegicus
gcgacacatttgagttagggattat

SEQ ID NO: 398929 - DNA, 25 bp, Rattus norvegicus
gcgacacatttgtgttagggattat

SEQ ID NO: 398930 - DNA, 25 bp, Rattus norvegicus
gcgacacgactaatggctcagttgt

SEQ ID NO: 398931 - DNA, 25 bp, Rattus norvegicus
gcgacacgactattggctcagttgt

SEQ ID NO: 398932 - DNA, 25 bp, Rattus norvegicus
gcgacacgggcacgacagtattgtt

SEQ ID NO: 398933 - DNA, 25 bp, Rattus norvegicus
gcgacacgggcaggacagtattgtt

SEQ ID NO: 398934 - DNA, 25 bp, Rattus norvegicus
gcgacactatgtactgcgttttcat

SEQ ID NO: 398935 - DNA, 25 bp, Rattus norvegicus
gcgacactatgttctgcgttttcat

SEQ ID NO: 398936 - DNA, 25 bp, Rattus norvegicus
gcgacacttccgcacagaatacttc

SEQ ID NO: 398937 - DNA, 25 bp, Rattus norvegicus
gcgacacttccggacagaatacttc

SEQ ID NO: 398938 - DNA, 25 bp, Rattus norvegicus
gcgacagagacaccggcggcaggga

SEQ ID NO: 398939 - DNA, 25 bp, Rattus norvegicus
gcgacagagacagcggcggcaggga

SEQ ID NO: 398940 - DNA, 25 bp, Rattus norvegicus
gcgacagcacagcacggcagccttt

SEQ ID NO: 398941 - DNA, 25 bp, Rattus norvegicus
gcgacagcacaggacggcagccttt

SEQ ID NO: 398942 - DNA, 25 bp, Rattus norvegicus
gcgacagccactaaagcctctttct

SEQ ID NO: 398943 - DNA, 25 bp, Rattus norvegicus
gcgacagccacttaagcctctttct

SEQ ID NO: 398944 - DNA, 25 bp, Rattus norvegicus
gcgacagcgaacctatgacttctac

SEQ ID NO: 398945 - DNA, 25 bp, Rattus norvegicus
gcgacagcgaacgtatgacttctac

SEQ ID NO: 398946 - DNA, 25 bp, Rattus norvegicus
gcgacagcgggaagtgcgttcaccc

SEQ ID NO: 398947 - DNA, 25 bp, Rattus norvegicus
gcgacagcgggatgtgcgttcaccc

SEQ ID NO: 398948 - DNA, 25 bp, Rattus norvegicus
gcgacagctgtgagtgctacttcaa

SEQ ID NO: 398949 - DNA, 25 bp, Rattus norvegicus
gcgacagctgtgtgtgctacttcaa

SEQ ID NO: 398950 - DNA, 25 bp, Rattus norvegicus
gcgacagggctcacagaaggcgtgt

SEQ ID NO: 398951 - DNA, 25 bp, Rattus norvegicus
gcgacagggctctcagaaggcgtgt

SEQ ID NO: 398952 - DNA, 25 bp, Rattus norvegicus
gcgacagtacacaagctagcaaaga

SEQ ID NO: 398953 - DNA, 25 bp, Rattus norvegicus
gcgacagtacactagctagcaaaga

SEQ ID NO: 398954 - DNA, 25 bp, Rattus norvegicus
gcgacagttggcacgggatgttctc

SEQ ID NO: 398955 - DNA, 25 bp, Rattus norvegicus
gcgacagttggctcgggatgttctc

SEQ ID NO: 398956 - DNA, 25 bp, Rattus norvegicus
gcgacatctgtaaaaagtttctgta

SEQ ID NO: 398957 - DNA, 25 bp, Rattus norvegicus
gcgacatctgtataaagtttctgta

SEQ ID NO: 398958 - DNA, 25 bp, Rattus norvegicus
gcgacatcttttctgaaccctttga

SEQ ID NO: 398959 - DNA, 25 bp, Rattus norvegicus
gcgacatcttttgtgaaccctttga

SEQ ID NO: 398960 - DNA, 25 bp, Rattus norvegicus
gcgacatgtaaactggccaccgtgc

SEQ ID NO: 398961 - DNA, 25 bp, Rattus norvegicus
gcgacatgtaaagtggccaccgtgc

SEQ ID NO: 398962 - DNA, 25 bp, Rattus norvegicus
gcgacattagcccattagcacactt

SEQ ID NO: 398963 - DNA, 25 bp, Rattus norvegicus
gcgacattagccgattagcacactt

SEQ ID NO: 398964 - DNA, 25 bp, Rattus norvegicus
gcgaccaatttaatcttatccctga

SEQ ID NO: 398965 - DNA, 25 bp, Rattus norvegicus
gcgaccaatttattcttatccctga

SEQ ID NO: 398966 - DNA, 25 bp, Rattus norvegicus
gcgaccaccttcacacttaaatagt

SEQ ID NO: 398967 - DNA, 25 bp, Rattus norvegicus
gcgaccaccttctcacttaaatagt

SEQ ID NO: 398968 - DNA, 25 bp, Rattus norvegicus
gcgaccagttatccttatctgcttg

SEQ ID NO: 398969 - DNA, 25 bp, Rattus norvegicus
gcgaccagttatgcttatctgcttg

SEQ ID NO: 398970 - DNA, 25 bp, Rattus norvegicus
gcgacccagggcagcacattgtgtg

SEQ ID NO: 398971 - DNA, 25 bp, Rattus norvegicus
gcgacccagggctgcacattgtgtg

SEQ ID NO: 398972 - DNA, 25 bp, Rattus norvegicus
gcgacccataacagcgcactacaga

SEQ ID NO: 398973 - DNA, 25 bp, Rattus norvegicus
gcgacccataactgcgcactacaga

SEQ ID NO: 398974 - DNA, 25 bp, Rattus norvegicus
gcgaccccacagaagaggaggagca

SEQ ID NO: 398975 - DNA, 25 bp, Rattus norvegicus
gcgaccccacagtagaggaggagca

SEQ ID NO: 398976 - DNA, 25 bp, Rattus norvegicus
gcgaccccagtgacaagcgtgacga

SEQ ID NO: 398977 - DNA, 25 bp, Rattus norvegicus
gcgaccccagtgtcaagcgtgacga

SEQ ID NO: 398978 - DNA, 25 bp, Rattus norvegicus
gcgaccctgggaagctgggccaaaa

SEQ ID NO: 398979 - DNA, 25 bp, Rattus norvegicus
gcgaccctgggatgctgggccaaaa

SEQ ID NO: 398980 - DNA, 25 bp, Rattus norvegicus
gcgaccgagacacctactcagagaa

SEQ ID NO: 398981 - DNA, 25 bp, Rattus norvegicus
gcgaccgagacagctactcagagaa

SEQ ID NO: 398982 - DNA, 25 bp, Rattus norvegicus
gcgaccgcaagaagcacatgcacgt

SEQ ID NO: 398983 - DNA, 25 bp, Rattus norvegicus
gcgaccgcaagatgcacatgcacgt

SEQ ID NO: 398984 - DNA, 25 bp, Rattus norvegicus
gcgaccgcaggaaccagaattctac

SEQ ID NO: 398985 - DNA, 25 bp, Rattus norvegicus
gcgaccgcaggatccagaattctac

SEQ ID NO: 398986 - DNA, 25 bp, Rattus norvegicus
gcgacctacactaaaacagcacttg

SEQ ID NO: 398987 - DNA, 25 bp, Rattus norvegicus
gcgacctacacttaaacagcacttg

SEQ ID NO: 398988 - DNA, 25 bp, Rattus norvegicus
gcgacctatccaagggcctgtgaag

SEQ ID NO: 398989 - DNA, 25 bp, Rattus norvegicus
gcgacctatccatgggcctgtgaag

SEQ ID NO: 398990 - DNA, 25 bp, Rattus norvegicus
gcgacctattgcctggtgggaactt

SEQ ID NO: 398991 - DNA, 25 bp, Rattus norvegicus
gcgacctattgcgtggtgggaactt

SEQ ID NO: 398992 - DNA, 25 bp, Rattus norvegicus
gcgacctctgccacggtggattgca

SEQ ID NO: 398993 - DNA, 25 bp, Rattus norvegicus
gcgacctctgcccaacaaaataaaa

SEQ ID NO: 398994 - DNA, 25 bp, Rattus norvegicus
gcgacctctgccgaacaaaataaaa

SEQ ID NO: 398995 - DNA, 25 bp, Rattus norvegicus
gcgacctctgcctcggtggattgca

SEQ ID NO: 398996 - DNA, 25 bp, Rattus norvegicus
gcgacctcttctaagtgacctgtga

SEQ ID NO: 398997 - DNA, 25 bp, Rattus norvegicus
gcgacctcttcttagtgacctgtga

SEQ ID NO: 398998 - DNA, 25 bp, Rattus norvegicus
gcgacctgagacctccatgagtgga

SEQ ID NO: 398999 - DNA, 25 bp, Rattus norvegicus
gcgacctgagacgtccatgagtgga

SEQ ID NO: 399000 - DNA, 25 bp, Rattus norvegicus
gcgacctgctggctgtattggaaaa

SEQ ID NO: 399001 - DNA, 25 bp, Rattus norvegicus
gcgacctgctgggtgtattggaaaa

SEQ ID NO: 399002 - DNA, 25 bp, Rattus norvegicus
gcgacctgtgacagctgtatcacta

SEQ ID NO: 399003 - DNA, 25 bp, Rattus norvegicus
gcgacctgtgactgctgtatcacta

SEQ ID NO: 399004 - DNA, 25 bp, Rattus norvegicus
gcgaccttggatccatttggactgg

SEQ ID NO: 399005 - DNA, 25 bp, Rattus norvegicus
gcgaccttggatgcatttggactgg

SEQ ID NO: 399006 - DNA, 25 bp, Rattus norvegicus
gcgaccttggtgaagtgccggctta

SEQ ID NO: 399007 - DNA, 25 bp, Rattus norvegicus
gcgaccttggtgtagtgccggctta

SEQ ID NO: 399008 - DNA, 25 bp, Rattus norvegicus
gcgacgacagggactagtcactgat

SEQ ID NO: 399009 - DNA, 25 bp, Rattus norvegicus
gcgacgacagggtctagtcactgat

SEQ ID NO: 399010 - DNA, 25 bp, Rattus norvegicus
gcgacgacggcaaaatgagctaaaa

SEQ ID NO: 399011 - DNA, 25 bp, Rattus norvegicus
gcgacgacggcataatgagctaaaa

SEQ ID NO: 399012 - DNA, 25 bp, Rattus norvegicus
gcgacgagaagcagagcccctacgg

SEQ ID NO: 399013 - DNA, 25 bp, Rattus norvegicus
gcgacgagaagctgagcccctacgg

SEQ ID NO: 399014 - DNA, 25 bp, Rattus norvegicus
gcgacgagatttctggacaagccca

SEQ ID NO: 399015 - DNA, 25 bp, Rattus norvegicus
gcgacgagatttgtggacaagccca

SEQ ID NO: 399016 - DNA, 25 bp, Rattus norvegicus
gcgacgatacccagtgctgtgattg

SEQ ID NO: 399017 - DNA, 25 bp, Rattus norvegicus
gcgacgataccctgtgctgtgattg

SEQ ID NO: 399018 - DNA, 25 bp, Rattus norvegicus
gcgacgattaccagccgtcaataga

SEQ ID NO: 399019 - DNA, 25 bp, Rattus norvegicus
gcgacgattacctgccgtcaataga

SEQ ID NO: 399020 - DNA, 25 bp, Rattus norvegicus
gcgacgcccaagatccacggacata

SEQ ID NO: 399021 - DNA, 25 bp, Rattus norvegicus
gcgacgcccaagttccacggacata

SEQ ID NO: 399022 - DNA, 25 bp, Rattus norvegicus
gcgacgcgctggcgttacagcgcaa

SEQ ID NO: 399023 - DNA, 25 bp, Rattus norvegicus
gcgacgcgctggggttacagcgcaa

SEQ ID NO: 399024 - DNA, 25 bp, Rattus norvegicus
gcgacgcgtgcgattcctgctggaa

SEQ ID NO: 399025 - DNA, 25 bp, Rattus norvegicus
gcgacgcgtgcgtttcctgctggaa

SEQ ID NO: 399026 - DNA, 25 bp, Rattus norvegicus
gcgacggataatcgcgagccccacg

SEQ ID NO: 399027 - DNA, 25 bp, Rattus norvegicus
gcgacggataatggcgagccccacg

SEQ ID NO: 399028 - DNA, 25 bp, Rattus norvegicus
gcgacggcgacgacatctcggcgac

SEQ ID NO: 399029 - DNA, 25 bp, Rattus norvegicus
gcgacggcgacgtcatctcggcgac

SEQ ID NO: 399030 - DNA, 25 bp, Rattus norvegicus
gcgacggcggcgaggccctggtcag

SEQ ID NO: 399031 - DNA, 25 bp, Rattus norvegicus
gcgacggcggcgtggccctggtcag

SEQ ID NO: 399032 - DNA, 25 bp, Rattus norvegicus
gcgacgggccccagctaagactgaa

SEQ ID NO: 399033 - DNA, 25 bp, Rattus norvegicus
gcgacgggcccctgctaagactgaa

SEQ ID NO: 399034 - DNA, 25 bp, Rattus norvegicus
gcgacgtaactgacttcaggttctt

SEQ ID NO: 399035 - DNA, 25 bp, Rattus norvegicus
gcgacgtaactgtcttcaggttctt

SEQ ID NO: 399036 - DNA, 25 bp, Rattus norvegicus
gcgacgtgggccagatcttctcgtg

SEQ ID NO: 399037 - DNA, 25 bp, Rattus norvegicus
gcgacgtgggcctgatcttctcgtg

SEQ ID NO: 399038 - DNA, 25 bp, Rattus norvegicus
gcgactaacgcgaatagtgcctaat

SEQ ID NO: 399039 - DNA, 25 bp, Rattus norvegicus
gcgactaacgcgtatagtgcctaat

SEQ ID NO: 399040 - DNA, 25 bp, Rattus norvegicus
gcgactagtcatacattcacatggt

SEQ ID NO: 399041 - DNA, 25 bp, Rattus norvegicus
gcgactagtcattcattcacatggt

SEQ ID NO: 399042 - DNA, 25 bp, Rattus norvegicus
gcgactatacccatgacgtttcagg

SEQ ID NO: 399043 - DNA, 25 bp, Rattus norvegicus
gcgactatacccttgacgtttcagg

SEQ ID NO: 399044 - DNA, 25 bp, Rattus norvegicus
gcgactattctacgcttcttcctgg

SEQ ID NO: 399045 - DNA, 25 bp, Rattus norvegicus
gcgactattctaggcttcttcctgg

SEQ ID NO: 399046 - DNA, 25 bp, Rattus norvegicus
gcgactccagtgaatacaaaaaata

SEQ ID NO: 399047 - DNA, 25 bp, Rattus norvegicus
gcgactccagtgtatacaaaaaata

SEQ ID NO: 399048 - DNA, 25 bp, Rattus norvegicus
gcgactcggtgaagtggcactacct

SEQ ID NO: 399049 - DNA, 25 bp, Rattus norvegicus
gcgactcggtgatgtggcactacct

SEQ ID NO: 399050 - DNA, 25 bp, Rattus norvegicus
gcgactctacaacaatggtgctatt

SEQ ID NO: 399051 - DNA, 25 bp, Rattus norvegicus
gcgactctacaagaatggtgctatt

SEQ ID NO: 399052 - DNA, 25 bp, Rattus norvegicus
gcgactctagatccatcccatgaat

SEQ ID NO: 399053 - DNA, 25 bp, Rattus norvegicus
gcgactctagatgcatcccatgaat

SEQ ID NO: 399054 - DNA, 25 bp, Rattus norvegicus
gcgactctcatcactgacagtatgg

SEQ ID NO: 399055 - DNA, 25 bp, Rattus norvegicus
gcgactctcatctctgacagtatgg

SEQ ID NO: 399056 - DNA, 25 bp, Rattus norvegicus
gcgactctgcttactcagtgttttg

SEQ ID NO: 399057 - DNA, 25 bp, Rattus norvegicus
gcgactctgctttctcagtgttttg

SEQ ID NO: 399058 - DNA, 25 bp, Rattus norvegicus
gcgactgactgaaatcttacccaga

SEQ ID NO: 399059 - DNA, 25 bp, Rattus norvegicus
gcgactgactgatatcttacccaga

SEQ ID NO: 399060 - DNA, 25 bp, Rattus norvegicus
gcgactgccagaaaagcaaccggga

SEQ ID NO: 399061 - DNA, 25 bp, Rattus norvegicus
gcgactgccagataagcaaccggga

SEQ ID NO: 399062 - DNA, 25 bp, Rattus norvegicus
gcgactgcctagagggaagtgatct

SEQ ID NO: 399063 - DNA, 25 bp, Rattus norvegicus
gcgactgcctagtgggaagtgatct

SEQ ID NO: 399064 - DNA, 25 bp, Rattus norvegicus
gcgactgctcatcctgaaaaccttg

SEQ ID NO: 399065 - DNA, 25 bp, Rattus norvegicus
gcgactgctcatgctgaaaaccttg

SEQ ID NO: 399066 - DNA, 25 bp, Rattus norvegicus
gcgactgctgtcatcctgtgatgag

SEQ ID NO: 399067 - DNA, 25 bp, Rattus norvegicus
gcgactgctgtcttcctgtgatgag

SEQ ID NO: 399068 - DNA, 25 bp, Rattus norvegicus
gcgactgcttaacaccctgagggaa

SEQ ID NO: 399069 - DNA, 25 bp, Rattus norvegicus
gcgactgcttaagaccctgagggaa

SEQ ID NO: 399070 - DNA, 25 bp, Rattus norvegicus
gcgactgctttacttaaatcccatt

SEQ ID NO: 399071 - DNA, 25 bp, Rattus norvegicus
gcgactgctttagttaaatcccatt

SEQ ID NO: 399072 - DNA, 25 bp, Rattus norvegicus
gcgactggaagcactggagctcaat

SEQ ID NO: 399073 - DNA, 25 bp, Rattus norvegicus
gcgactggaagctctggagctcaat

SEQ ID NO: 399074 - DNA, 25 bp, Rattus norvegicus
gcgactggaatcaactaggtcctct

SEQ ID NO: 399075 - DNA, 25 bp, Rattus norvegicus
gcgactggaatctactaggtcctct

SEQ ID NO: 399076 - DNA, 25 bp, Rattus norvegicus
gcgactggcagaacagcgtgagcaa

SEQ ID NO: 399077 - DNA, 25 bp, Rattus norvegicus
gcgactggcagatcagcgtgagcaa

SEQ ID NO: 399078 - DNA, 25 bp, Rattus norvegicus
gcgactgggactctaacggacaatt

SEQ ID NO: 399079 - DNA, 25 bp, Rattus norvegicus
gcgactgggactgtaacggacaatt

SEQ ID NO: 399080 - DNA, 25 bp, Rattus norvegicus
gcgactgtagttatagctaagactt

SEQ ID NO: 399081 - DNA, 25 bp, Rattus norvegicus
gcgactgtagttttagctaagactt

SEQ ID NO: 399082 - DNA, 25 bp, Rattus norvegicus
gcgactgtccccagaactagttagt

SEQ ID NO: 399083 - DNA, 25 bp, Rattus norvegicus
gcgactgtcccctgaactagttagt

SEQ ID NO: 399084 - DNA, 25 bp, Rattus norvegicus
gcgactgtccttctatgagactgga

SEQ ID NO: 399085 - DNA, 25 bp, Rattus norvegicus
gcgactgtccttgtatgagactgga

SEQ ID NO: 399086 - DNA, 25 bp, Rattus norvegicus
gcgactgttataaagctgactccat

SEQ ID NO: 399087 - DNA, 25 bp, Rattus norvegicus
gcgactgttatatagctgactccat

SEQ ID NO: 399088 - DNA, 25 bp, Rattus norvegicus
gcgactgttgctcttaatcactaag

SEQ ID NO: 399089 - DNA, 25 bp, Rattus norvegicus
gcgactgttgctgttaatcactaag

SEQ ID NO: 399090 - DNA, 25 bp, Rattus norvegicus
gcgacttcacatacttatgtactaa

SEQ ID NO: 399091 - DNA, 25 bp, Rattus norvegicus
gcgacttcacattcttatgtactaa

SEQ ID NO: 399092 - DNA, 25 bp, Rattus norvegicus
gcgacttcatttcctttcggtaatt

SEQ ID NO: 399093 - DNA, 25 bp, Rattus norvegicus
gcgacttcatttgctttcggtaatt

SEQ ID NO: 399094 - DNA, 25 bp, Rattus norvegicus
gcgacttctgaaatcatcctgctaa

SEQ ID NO: 399095 - DNA, 25 bp, Rattus norvegicus
gcgacttctgaattcatcctgctaa

SEQ ID NO: 399096 - DNA, 25 bp, Rattus norvegicus
gcgacttgattgagtctgtgatcag

SEQ ID NO: 399097 - DNA, 25 bp, Rattus norvegicus
gcgacttgattgtgtctgtgatcag

SEQ ID NO: 399098 - DNA, 25 bp, Rattus norvegicus
gcgacttgcaagatctcaaacttta

SEQ ID NO: 399099 - DNA, 25 bp, Rattus norvegicus
gcgacttgcaagttctcaaacttta

SEQ ID NO: 399100 - DNA, 25 bp, Rattus norvegicus
gcgacttgcgacaatgagccagata

SEQ ID NO: 399101 - DNA, 25 bp, Rattus norvegicus
gcgacttgcgactatgagccagata

SEQ ID NO: 399102 - DNA, 25 bp, Rattus norvegicus
gcgacttgtgccaaactttctatgg

SEQ ID NO: 399103 - DNA, 25 bp, Rattus norvegicus
gcgacttgtgcctaactttctatgg

SEQ ID NO: 399104 - DNA, 25 bp, Rattus norvegicus
gcgactttcaaaatctggatgtgga

SEQ ID NO: 399105 - DNA, 25 bp, Rattus norvegicus
gcgactttcaaattctggatgtgga

SEQ ID NO: 399106 - DNA, 25 bp, Rattus norvegicus
gcgacttttataagctccagtttct

SEQ ID NO: 399107 - DNA, 25 bp, Rattus norvegicus
gcgacttttatatgctccagtttct

SEQ ID NO: 399108 - DNA, 25 bp, Rattus norvegicus
gcgagaaaacgtacagccagcactc

SEQ ID NO: 399109 - DNA, 25 bp, Rattus norvegicus
gcgagaaaacgttcagccagcactc

SEQ ID NO: 399110 - DNA, 25 bp, Rattus norvegicus
gcgagaaaccttatacttgccccga

SEQ ID NO: 399111 - DNA, 25 bp, Rattus norvegicus
gcgagaaaccttttacttgccccga

SEQ ID NO: 399112 - DNA, 25 bp, Rattus norvegicus
gcgagaaccgcgaccagcaggtgga

SEQ ID NO: 399113 - DNA, 25 bp, Rattus norvegicus
gcgagaaccgcgtccagcaggtgga

SEQ ID NO: 399114 - DNA, 25 bp, Rattus norvegicus
gcgagaagaagtacagctgccccat

SEQ ID NO: 399115 - DNA, 25 bp, Rattus norvegicus
gcgagaagaagttcagctgccccat

SEQ ID NO: 399116 - DNA, 25 bp, Rattus norvegicus
gcgagaagccctcctggtacagctc

SEQ ID NO: 399117 - DNA, 25 bp, Rattus norvegicus
gcgagaagccctgctggtacagctc

SEQ ID NO: 399118 - DNA, 25 bp, Rattus norvegicus
gcgagaagccgcacgcgtgccctga

SEQ ID NO: 399119 - DNA, 25 bp, Rattus norvegicus
gcgagaagccgctcgcgtgccctga

SEQ ID NO: 399120 - DNA, 25 bp, Rattus norvegicus
gcgagaagtacgcacccaccaagat

SEQ ID NO: 399121 - DNA, 25 bp, Rattus norvegicus
gcgagaagtacggacccaccaagat

SEQ ID NO: 399122 - DNA, 25 bp, Rattus norvegicus
gcgagaagtcttcggctcaggcact

SEQ ID NO: 399123 - DNA, 25 bp, Rattus norvegicus
gcgagaagtcttgggctcaggcact

SEQ ID NO: 399124 - DNA, 25 bp, Rattus norvegicus
gcgagaattagacaacttcttgtta

SEQ ID NO: 399125 - DNA, 25 bp, Rattus norvegicus
gcgagaattagagaacttcttgtta

SEQ ID NO: 399126 - DNA, 25 bp, Rattus norvegicus
gcgagacaccagaaacctccttttc

SEQ ID NO: 399127 - DNA, 25 bp, Rattus norvegicus
gcgagacaccagtaacctccttttc

SEQ ID NO: 399128 - DNA, 25 bp, Rattus norvegicus
gcgagacggacaagctgctgagcac

SEQ ID NO: 399129 - DNA, 25 bp, Rattus norvegicus
gcgagacggacatgctgctgagcac

SEQ ID NO: 399130 - DNA, 25 bp, Rattus norvegicus
gcgagactgctgaatgttctccatg

SEQ ID NO: 399131 - DNA, 25 bp, Rattus norvegicus
gcgagactgctgtatgttctccatg

SEQ ID NO: 399132 - DNA, 25 bp, Rattus norvegicus
gcgagacttctcatttgcagatgca

SEQ ID NO: 399133 - DNA, 25 bp, Rattus norvegicus
gcgagacttctcttttgcagatgca

SEQ ID NO: 399134 - DNA, 25 bp, Rattus norvegicus
gcgagagaaagaatgagacctgcta

SEQ ID NO: 399135 - DNA, 25 bp, Rattus norvegicus
gcgagagaaagattgagacctgcta

SEQ ID NO: 399136 - DNA, 25 bp, Rattus norvegicus
gcgagagagaccaagtgacacgtca

SEQ ID NO: 399137 - DNA, 25 bp, Rattus norvegicus
gcgagagagacctagtgacacgtca

SEQ ID NO: 399138 - DNA, 25 bp, Rattus norvegicus
gcgagagcctcaccaagaaagctaa

SEQ ID NO: 399139 - DNA, 25 bp, Rattus norvegicus
gcgagagcctcagcaagaaagctaa

SEQ ID NO: 399140 - DNA, 25 bp, Rattus norvegicus
gcgagagcctctacaaagatggaaa

SEQ ID NO: 399141 - DNA, 25 bp, Rattus norvegicus
gcgagagcctcttcaaagatggaaa

SEQ ID NO: 399142 - DNA, 25 bp, Rattus norvegicus
gcgagagctgacctttagatgcaaa

SEQ ID NO: 399143 - DNA, 25 bp, Rattus norvegicus
gcgagagctgacgtttagatgcaaa

SEQ ID NO: 399144 - DNA, 25 bp, Rattus norvegicus
gcgagaggactcattctgtttaaat

SEQ ID NO: 399145 - DNA, 25 bp, Rattus norvegicus
gcgagaggactctttctgtttaaat

SEQ ID NO: 399146 - DNA, 25 bp, Rattus norvegicus
gcgagaggcgcaccaacagaacttt

SEQ ID NO: 399147 - DNA, 25 bp, Rattus norvegicus
gcgagaggcgcagcaacagaacttt

SEQ ID NO: 399148 - DNA, 25 bp, Rattus norvegicus
gcgagagtcatccacagcgtttctg

SEQ ID NO: 399149 - DNA, 25 bp, Rattus norvegicus
gcgagagtcatcgacagcgtttctg

SEQ ID NO: 399150 - DNA, 25 bp, Rattus norvegicus
gcgagataactcaaagctcatcttt

SEQ ID NO: 399151 - DNA, 25 bp, Rattus norvegicus
gcgagataactctaagctcatcttt

SEQ ID NO: 399152 - DNA, 25 bp, Rattus norvegicus
gcgagatcaggaaggcagcccacag

SEQ ID NO: 399153 - DNA, 25 bp, Rattus norvegicus
gcgagatcaggatggcagcccacag

SEQ ID NO: 399154 - DNA, 25 bp, Rattus norvegicus
gcgagatctaccagttccttcaggc

SEQ ID NO: 399155 - DNA, 25 bp, Rattus norvegicus
gcgagatctacctgttccttcaggc

SEQ ID NO: 399156 - DNA, 25 bp, Rattus norvegicus
gcgagatctgacatgatgcttgcca

SEQ ID NO: 399157 - DNA, 25 bp, Rattus norvegicus
gcgagatctgacttgatgcttgcca

SEQ ID NO: 399158 - DNA, 25 bp, Rattus norvegicus
gcgagatgacggaccggtacaccat

SEQ ID NO: 399159 - DNA, 25 bp, Rattus norvegicus
gcgagatgacggtccggtacaccat

SEQ ID NO: 399160 - DNA, 25 bp, Rattus norvegicus
gcgagatgactcactcttgagctat

SEQ ID NO: 399161 - DNA, 25 bp, Rattus norvegicus
gcgagatgactctctcttgagctat

SEQ ID NO: 399162 - DNA, 25 bp, Rattus norvegicus
gcgagatgcctacatgtggcgtcta

SEQ ID NO: 399163 - DNA, 25 bp, Rattus norvegicus
gcgagatgcctagatgtggcgtcta

SEQ ID NO: 399164 - DNA, 25 bp, Rattus norvegicus
gcgagatgcgcaagcagaacctgct

SEQ ID NO: 399165 - DNA, 25 bp, Rattus norvegicus
gcgagatgcgcatgcagaacctgct

SEQ ID NO: 399166 - DNA, 25 bp, Rattus norvegicus
gcgagatgctgaatgctcatgaatt

SEQ ID NO: 399167 - DNA, 25 bp, Rattus norvegicus
gcgagatgctgattgctcatgaatt

SEQ ID NO: 399168 - DNA, 25 bp, Rattus norvegicus
gcgagattaaatcctgcagccgtgg

SEQ ID NO: 399169 - DNA, 25 bp, Rattus norvegicus
gcgagattaaatgctgcagccgtgg

SEQ ID NO: 399170 - DNA, 25 bp, Rattus norvegicus
gcgagattgtttcacccaggcctgc

SEQ ID NO: 399171 - DNA, 25 bp, Rattus norvegicus
gcgagattgtttgacccaggcctgc

SEQ ID NO: 399172 - DNA, 25 bp, Rattus norvegicus
gcgagcaacgctcttcatttttcaa

SEQ ID NO: 399173 - DNA, 25 bp, Rattus norvegicus
gcgagcaacgctgttcatttttcaa

SEQ ID NO: 399174 - DNA, 25 bp, Rattus norvegicus
gcgagcacagccaggtgtacaaaac

SEQ ID NO: 399175 - DNA, 25 bp, Rattus norvegicus
gcgagcacagcctggtgtacaaaac

SEQ ID NO: 399176 - DNA, 25 bp, Rattus norvegicus
gcgagcacaggtcccagtccaattg

SEQ ID NO: 399177 - DNA, 25 bp, Rattus norvegicus
gcgagcacaggtgccagtccaattg

SEQ ID NO: 399178 - DNA, 25 bp, Rattus norvegicus
gcgagcacctttatctgctgagaca

SEQ ID NO: 399179 - DNA, 25 bp, Rattus norvegicus
gcgagcacctttttctgctgagaca

SEQ ID NO: 399180 - DNA, 25 bp, Rattus norvegicus
gcgagcactcagacagcggcaccag

SEQ ID NO: 399181 - DNA, 25 bp, Rattus norvegicus
gcgagcactcagtcagcggcaccag

SEQ ID NO: 399182 - DNA, 25 bp, Rattus norvegicus
gcgagcagaggcagatgttttataa

SEQ ID NO: 399183 - DNA, 25 bp, Rattus norvegicus
gcgagcagaggctgatgttttataa

SEQ ID NO: 399184 - DNA, 25 bp, Rattus norvegicus
gcgagcagccgcctgctgagaggag

SEQ ID NO: 399185 - DNA, 25 bp, Rattus norvegicus
gcgagcagccgcgtgctgagaggag

SEQ ID NO: 399186 - DNA, 25 bp, Rattus norvegicus
gcgagcagcggccaacagcagccaa

SEQ ID NO: 399187 - DNA, 25 bp, Rattus norvegicus
gcgagcagcggcgaacagcagccaa

SEQ ID NO: 399188 - DNA, 25 bp, Rattus norvegicus
gcgagcaggagccactcaggaatta

SEQ ID NO: 399189 - DNA, 25 bp, Rattus norvegicus
gcgagcaggagcgactcaggaatta

SEQ ID NO: 399190 - DNA, 25 bp, Rattus norvegicus
gcgagcaggtctatggtagccacac

SEQ ID NO: 399191 - DNA, 25 bp, Rattus norvegicus
gcgagcaggtctttggtagccacac

SEQ ID NO: 399192 - DNA, 25 bp, Rattus norvegicus
gcgagcatcaagcactctatcaatg

SEQ ID NO: 399193 - DNA, 25 bp, Rattus norvegicus
gcgagcatcaaggactctatcaatg

SEQ ID NO: 399194 - DNA, 25 bp, Rattus norvegicus
gcgagcatgcggagactttcgtccc

SEQ ID NO: 399195 - DNA, 25 bp, Rattus norvegicus
gcgagcatgcggtgactttcgtccc

SEQ ID NO: 399196 - DNA, 25 bp, Rattus norvegicus
gcgagcatgcttacttgttccgatc

SEQ ID NO: 399197 - DNA, 25 bp, Rattus norvegicus
gcgagcatgctttcttgttccgatc

SEQ ID NO: 399198 - DNA, 25 bp, Rattus norvegicus
gcgagcatgggcattactagttaat

SEQ ID NO: 399199 - DNA, 25 bp, Rattus norvegicus
gcgagcatgggctttactagttaat

SEQ ID NO: 399200 - DNA, 25 bp, Rattus norvegicus
gcgagccaaacaaaagcgcctgctt

SEQ ID NO: 399201 - DNA, 25 bp, Rattus norvegicus
gcgagccaaacataagcgcctgctt

SEQ ID NO: 399202 - DNA, 25 bp, Rattus norvegicus
gcgagcccacacatgaccaagggaa

SEQ ID NO: 399203 - DNA, 25 bp, Rattus norvegicus
gcgagcccacacttgaccaagggaa

SEQ ID NO: 399204 - DNA, 25 bp, Rattus norvegicus
gcgagcccgagtctgatggttcacc

SEQ ID NO: 399205 - DNA, 25 bp, Rattus norvegicus
gcgagcccgagtgtgatggttcacc

SEQ ID NO: 399206 - DNA, 25 bp, Rattus norvegicus
gcgagccctgggacaatgagtatgt

SEQ ID NO: 399207 - DNA, 25 bp, Rattus norvegicus
gcgagccctgggtcaatgagtatgt

SEQ ID NO: 399208 - DNA, 25 bp, Rattus norvegicus
gcgagccgggttcttgatgacccat

SEQ ID NO: 399209 - DNA, 25 bp, Rattus norvegicus
gcgagccgggttgttgatgacccat

SEQ ID NO: 399210 - DNA, 25 bp, Rattus norvegicus
gcgagcctttccaccagtagagaaa

SEQ ID NO: 399211 - DNA, 25 bp, Rattus norvegicus
gcgagcctttcctccagtagagaaa

SEQ ID NO: 399212 - DNA, 25 bp, Rattus norvegicus
gcgagcgaggacagcatctcacaag

SEQ ID NO: 399213 - DNA, 25 bp, Rattus norvegicus
gcgagcgaggactgcatctcacaag

SEQ ID NO: 399214 - DNA, 25 bp, Rattus norvegicus
gcgagcgcacagacaccggtaaaaa

SEQ ID NO: 399215 - DNA, 25 bp, Rattus norvegicus
gcgagcgcacagtcaccggtaaaaa

SEQ ID NO: 399216 - DNA, 25 bp, Rattus norvegicus
gcgagcgccgccaatatgcactgta

SEQ ID NO: 399217 - DNA, 25 bp, Rattus norvegicus
gcgagcgccgcctatatgcactgta

SEQ ID NO: 399218 - DNA, 25 bp, Rattus norvegicus
gcgagcgcttcaacagtttaagtcc

SEQ ID NO: 399219 - DNA, 25 bp, Rattus norvegicus
gcgagcgcttcatcagtttaagtcc

SEQ ID NO: 399220 - DNA, 25 bp, Rattus norvegicus
gcgagcggagtcaggagcccctaat

SEQ ID NO: 399221 - DNA, 25 bp, Rattus norvegicus
gcgagcggagtctggagcccctaat

SEQ ID NO: 399222 - DNA, 25 bp, Rattus norvegicus
gcgagcgggcttcgcgactccgagg

SEQ ID NO: 399223 - DNA, 25 bp, Rattus norvegicus
gcgagcgggcttggcgactccgagg

SEQ ID NO: 399224 - DNA, 25 bp, Rattus norvegicus
gcgagcgtacatcctttactgtgga

SEQ ID NO: 399225 - DNA, 25 bp, Rattus norvegicus
gcgagcgtacatgctttactgtgga

SEQ ID NO: 399226 - DNA, 25 bp, Rattus norvegicus
gcgagcgtgttcaacttcctgaggg

SEQ ID NO: 399227 - DNA, 25 bp, Rattus norvegicus
gcgagcgtgttctacttcctgaggg

SEQ ID NO: 399228 - DNA, 25 bp, Rattus norvegicus
gcgagcgttaccagatcaggcgaca

SEQ ID NO: 399229 - DNA, 25 bp, Rattus norvegicus
gcgagcgttacctgatcaggcgaca

SEQ ID NO: 399230 - DNA, 25 bp, Rattus norvegicus
gcgagctaacttctacttattcttg

SEQ ID NO: 399231 - DNA, 25 bp, Rattus norvegicus
gcgagctaacttgtacttattcttg

SEQ ID NO: 399232 - DNA, 25 bp, Rattus norvegicus
gcgagctaaggccaaacgcaggtct

SEQ ID NO: 399233 - DNA, 25 bp, Rattus norvegicus
gcgagctaaggcgaaacgcaggtct

SEQ ID NO: 399234 - DNA, 25 bp, Rattus norvegicus
gcgagctcatctatcagcagtgtaa

SEQ ID NO: 399235 - DNA, 25 bp, Rattus norvegicus
gcgagctcatctttcagcagtgtaa

SEQ ID NO: 399236 - DNA, 25 bp, Rattus norvegicus
gcgagctcgtggagtgcaccttttc

SEQ ID NO: 399237 - DNA, 25 bp, Rattus norvegicus
gcgagctcgtggtgtgcaccttttc

SEQ ID NO: 399238 - DNA, 25 bp, Rattus norvegicus
gcgagctctgtaatattctctaaga

SEQ ID NO: 399239 - DNA, 25 bp, Rattus norvegicus
gcgagctctgtattattctctaaga

SEQ ID NO: 399240 - DNA, 25 bp, Rattus norvegicus
gcgagctgagccatgtcatactcta

SEQ ID NO: 399241 - DNA, 25 bp, Rattus norvegicus
gcgagctgagccttgtcatactcta

SEQ ID NO: 399242 - DNA, 25 bp, Rattus norvegicus
gcgagctggcctcttagagagtaaa

SEQ ID NO: 399243 - DNA, 25 bp, Rattus norvegicus
gcgagctggcctgttagagagtaaa

SEQ ID NO: 399244 - DNA, 25 bp, Rattus norvegicus
gcgagctgtactaatcggtgaatca

SEQ ID NO: 399245 - DNA, 25 bp, Rattus norvegicus
gcgagctgtacttatcggtgaatca

SEQ ID NO: 399246 - DNA, 25 bp, Rattus norvegicus
gcgaggaaagctatcgggccatcct

SEQ ID NO: 399247 - DNA, 25 bp, Rattus norvegicus
gcgaggaaagctttcgggccatcct

SEQ ID NO: 399248 - DNA, 25 bp, Rattus norvegicus
gcgaggaacgatacagtctgctttt

SEQ ID NO: 399249 - DNA, 25 bp, Rattus norvegicus
gcgaggaacgattcagtctgctttt

SEQ ID NO: 399250 - DNA, 25 bp, Rattus norvegicus
gcgaggacacacagagccctggcca

SEQ ID NO: 399251 - DNA, 25 bp, Rattus norvegicus
gcgaggacacactgagccctggcca

SEQ ID NO: 399252 - DNA, 25 bp, Rattus norvegicus
gcgaggacatgcacaccgtgcagtc

SEQ ID NO: 399253 - DNA, 25 bp, Rattus norvegicus
gcgaggacatgctcaccgtgcagtc

SEQ ID NO: 399254 - DNA, 25 bp, Rattus norvegicus
gcgaggacgggacaaaaacagacat

SEQ ID NO: 399255 - DNA, 25 bp, Rattus norvegicus
gcgaggacgggagaaaaacagacat

SEQ ID NO: 399256 - DNA, 25 bp, Rattus norvegicus
gcgaggagactgagccactgcagca

SEQ ID NO: 399257 - DNA, 25 bp, Rattus norvegicus
gcgaggagactgtgccactgcagca

SEQ ID NO: 399258 - DNA, 25 bp, Rattus norvegicus
gcgaggagctctcgaacgtctgatt

SEQ ID NO: 399259 - DNA, 25 bp, Rattus norvegicus
gcgaggagctctggaacgtctgatt

SEQ ID NO: 399260 - DNA, 25 bp, Rattus norvegicus
gcgaggaggataacgagctgaacct

SEQ ID NO: 399261 - DNA, 25 bp, Rattus norvegicus
gcgaggaggatatcgagctgaacct

SEQ ID NO: 399262 - DNA, 25 bp, Rattus norvegicus
gcgaggagttgcctttccagcgccc

SEQ ID NO: 399263 - DNA, 25 bp, Rattus norvegicus
gcgaggagttgcgtttccagcgccc

SEQ ID NO: 399264 - DNA, 25 bp, Rattus norvegicus
gcgaggatgaggcttaagaacttct

SEQ ID NO: 399265 - DNA, 25 bp, Rattus norvegicus
gcgaggatgagggttaagaacttct

SEQ ID NO: 399266 - DNA, 25 bp, Rattus norvegicus
gcgaggatgcccacctgactcagta

SEQ ID NO: 399267 - DNA, 25 bp, Rattus norvegicus
gcgaggatgccctcctgactcagta

SEQ ID NO: 399268 - DNA, 25 bp, Rattus norvegicus
gcgaggcaacttctatcacggagat

SEQ ID NO: 399269 - DNA, 25 bp, Rattus norvegicus
gcgaggcaacttgtatcacggagat

SEQ ID NO: 399270 - DNA, 25 bp, Rattus norvegicus
gcgaggcaagggaacatcatgtcat

SEQ ID NO: 399271 - DNA, 25 bp, Rattus norvegicus
gcgaggcaagggtacatcatgtcat

SEQ ID NO: 399272 - DNA, 25 bp, Rattus norvegicus
gcgaggcactacaggccaggatgaa

SEQ ID NO: 399273 - DNA, 25 bp, Rattus norvegicus
gcgaggcactactggccaggatgaa

SEQ ID NO: 399274 - DNA, 25 bp, Rattus norvegicus
gcgaggcatgcactcaatattttgt

SEQ ID NO: 399275 - DNA, 25 bp, Rattus norvegicus
gcgaggcatgcagtcaatattttgt

SEQ ID NO: 399276 - DNA, 25 bp, Rattus norvegicus
gcgaggcctccgcaaccaaagagag

SEQ ID NO: 399277 - DNA, 25 bp, Rattus norvegicus
gcgaggcctccggaaccaaagagag

SEQ ID NO: 399278 - DNA, 25 bp, Rattus norvegicus
gcgaggcctgcaacatccggtttag

SEQ ID NO: 399279 - DNA, 25 bp, Rattus norvegicus
gcgaggcctgcatcatccggtttag

SEQ ID NO: 399280 - DNA, 25 bp, Rattus norvegicus
gcgaggccttctctgatctgcaggt

SEQ ID NO: 399281 - DNA, 25 bp, Rattus norvegicus
gcgaggccttctgtgatctgcaggt

SEQ ID NO: 399282 - DNA, 25 bp, Rattus norvegicus
gcgaggcggcggcagagtaggcggt

SEQ ID NO: 399283 - DNA, 25 bp, Rattus norvegicus
gcgaggcggcgggagagtaggcggt

SEQ ID NO: 399284 - DNA, 25 bp, Rattus norvegicus
gcgaggctgaccatctatgggatca

SEQ ID NO: 399285 - DNA, 25 bp, Rattus norvegicus
gcgaggctgaccttctatgggatca

SEQ ID NO: 399286 - DNA, 25 bp, Rattus norvegicus
gcgagggaacttaagaatctgaacc

SEQ ID NO: 399287 - DNA, 25 bp, Rattus norvegicus
gcgagggaactttagaatctgaacc

SEQ ID NO: 399288 - DNA, 25 bp, Rattus norvegicus
gcgagggacatcactgaaccttatt

SEQ ID NO: 399289 - DNA, 25 bp, Rattus norvegicus
gcgagggacatctctgaaccttatt

SEQ ID NO: 399290 - DNA, 25 bp, Rattus norvegicus
gcgagggtcttgaaagcattgcttt

SEQ ID NO: 399291 - DNA, 25 bp, Rattus norvegicus
gcgagggtcttgtaagcattgcttt

SEQ ID NO: 399292 - DNA, 25 bp, Rattus norvegicus
gcgaggtcatcaaagggcagccttt

SEQ ID NO: 399293 - DNA, 25 bp, Rattus norvegicus
gcgaggtcatcatagggcagccttt

SEQ ID NO: 399294 - DNA, 25 bp, Rattus norvegicus
gcgaggtcattcagcgtacattgga

SEQ ID NO: 399295 - DNA, 25 bp, Rattus norvegicus
gcgaggtcattctgcgtacattgga

SEQ ID NO: 399296 - DNA, 25 bp, Rattus norvegicus
gcgaggtccacacgtccaggataaa

SEQ ID NO: 399297 - DNA, 25 bp, Rattus norvegicus
gcgaggtccacaggtccaggataaa

SEQ ID NO: 399298 - DNA, 25 bp, Rattus norvegicus
gcgaggtctttgcactaggcagtaa

SEQ ID NO: 399299 - DNA, 25 bp, Rattus norvegicus
gcgaggtctttggactaggcagtaa

SEQ ID NO: 399300 - DNA, 25 bp, Rattus norvegicus
gcgaggtgatccacaaaggctcaca

SEQ ID NO: 399301 - DNA, 25 bp, Rattus norvegicus
gcgaggtgatcctcaaaggctcaca

SEQ ID NO: 399302 - DNA, 25 bp, Rattus norvegicus
gcgaggtgctgtcacaccgtgtcat

SEQ ID NO: 399303 - DNA, 25 bp, Rattus norvegicus
gcgaggtgctgtgacaccgtgtcat

SEQ ID NO: 399304 - DNA, 25 bp, Rattus norvegicus
gcgaggtggcccaagaggaaataaa

SEQ ID NO: 399305 - DNA, 25 bp, Rattus norvegicus
gcgaggtggccctagaggaaataaa

SEQ ID NO: 399306 - DNA, 25 bp, Rattus norvegicus
gcgaggttaggtagccaacacccaa

SEQ ID NO: 399307 - DNA, 25 bp, Rattus norvegicus
gcgaggttaggttgccaacacccaa

SEQ ID NO: 399308 - DNA, 25 bp, Rattus norvegicus
gcgaggttgtttagagtagcagcac

SEQ ID NO: 399309 - DNA, 25 bp, Rattus norvegicus
gcgaggttgttttgagtagcagcac

SEQ ID NO: 399310 - DNA, 25 bp, Rattus norvegicus
gcgaggttttcgcaactagcatgtg

SEQ ID NO: 399311 - DNA, 25 bp, Rattus norvegicus
gcgaggttttcggaactagcatgtg

SEQ ID NO: 399312 - DNA, 25 bp, Rattus norvegicus
gcgagtaacactagccaaacattgc

SEQ ID NO: 399313 - DNA, 25 bp, Rattus norvegicus
gcgagtaacacttgccaaacattgc

SEQ ID NO: 399314 - DNA, 25 bp, Rattus norvegicus
gcgagtacattcagttcaggtgaca

SEQ ID NO: 399315 - DNA, 25 bp, Rattus norvegicus
gcgagtacattctgttcaggtgaca

SEQ ID NO: 399316 - DNA, 25 bp, Rattus norvegicus
gcgagtacgcgcagccgatgtagcc

SEQ ID NO: 399317 - DNA, 25 bp, Rattus norvegicus
gcgagtacgcgctgccgatgtagcc

SEQ ID NO: 399318 - DNA, 25 bp, Rattus norvegicus
gcgagtacgtggcaatgttcattcc

SEQ ID NO: 399319 - DNA, 25 bp, Rattus norvegicus
gcgagtacgtgggaatgttcattcc

SEQ ID NO: 399320 - DNA, 25 bp, Rattus norvegicus
gcgagtacttgtccttcttgagcag

SEQ ID NO: 399321 - DNA, 25 bp, Rattus norvegicus
gcgagtacttgtgcttcttgagcag

SEQ ID NO: 399322 - DNA, 25 bp, Rattus norvegicus
gcgagtagagtgaaacccatcaatt

SEQ ID NO: 399323 - DNA, 25 bp, Rattus norvegicus
gcgagtagagtgtaacccatcaatt

SEQ ID NO: 399324 - DNA, 25 bp, Rattus norvegicus
gcgagtatgggcaggcttgcggcca

SEQ ID NO: 399325 - DNA, 25 bp, Rattus norvegicus
gcgagtatgggctggcttgcggcca

SEQ ID NO: 399326 - DNA, 25 bp, Rattus norvegicus
gcgagtcacccgatcttagaattta

SEQ ID NO: 399327 - DNA, 25 bp, Rattus norvegicus
gcgagtcacccgttcttagaattta

SEQ ID NO: 399328 - DNA, 25 bp, Rattus norvegicus
gcgagtccacgcaagccacagtaga

SEQ ID NO: 399329 - DNA, 25 bp, Rattus norvegicus
gcgagtccacgctagccacagtaga

SEQ ID NO: 399330 - DNA, 25 bp, Rattus norvegicus
gcgagtccccagctgaggattcttc

SEQ ID NO: 399331 - DNA, 25 bp, Rattus norvegicus
gcgagtccccaggtgaggattcttc

SEQ ID NO: 399332 - DNA, 25 bp, Rattus norvegicus
gcgagtccgcaaaagtttgtggctc

SEQ ID NO: 399333 - DNA, 25 bp, Rattus norvegicus
gcgagtccgcaatagtttgtggctc

SEQ ID NO: 399334 - DNA, 25 bp, Rattus norvegicus
gcgagtcctaaacgagaggaagtca

SEQ ID NO: 399335 - DNA, 25 bp, Rattus norvegicus
gcgagtcctaaaggagaggaagtca

SEQ ID NO: 399336 - DNA, 25 bp, Rattus norvegicus
gcgagtcctacaccaggctcaaaat

SEQ ID NO: 399337 - DNA, 25 bp, Rattus norvegicus
gcgagtcctacagcaggctcaaaat

SEQ ID NO: 399338 - DNA, 25 bp, Rattus norvegicus
gcgagtcctacgagctgagctacga

SEQ ID NO: 399339 - DNA, 25 bp, Rattus norvegicus
gcgagtcctacgtgctgagctacga

SEQ ID NO: 399340 - DNA, 25 bp, Rattus norvegicus
gcgagtcctgtcctatcagtgacaa

SEQ ID NO: 399341 - DNA, 25 bp, Rattus norvegicus
gcgagtcctgtcgtatcagtgacaa

SEQ ID NO: 399342 - DNA, 25 bp, Rattus norvegicus
gcgagtctaagcatgccacccaatt

SEQ ID NO: 399343 - DNA, 25 bp, Rattus norvegicus
gcgagtctaagcttgccacccaatt

SEQ ID NO: 399344 - DNA, 25 bp, Rattus norvegicus
gcgagtctccaacatgaacatgaat

SEQ ID NO: 399345 - DNA, 25 bp, Rattus norvegicus
gcgagtctccaagatgaacatgaat

SEQ ID NO: 399346 - DNA, 25 bp, Rattus norvegicus
gcgagtctcgtacctatacatatgt

SEQ ID NO: 399347 - DNA, 25 bp, Rattus norvegicus
gcgagtctcgtagctatacatatgt

SEQ ID NO: 399348 - DNA, 25 bp, Rattus norvegicus
gcgagtctgatactgtcatctggaa

SEQ ID NO: 399349 - DNA, 25 bp, Rattus norvegicus
gcgagtctgatagtgtcatctggaa

SEQ ID NO: 399350 - DNA, 25 bp, Rattus norvegicus
gcgagtctgtgaaggccccaaagct

SEQ ID NO: 399351 - DNA, 25 bp, Rattus norvegicus
gcgagtctgtgatggccccaaagct

SEQ ID NO: 399352 - DNA, 25 bp, Rattus norvegicus
gcgagtgactgaccttgttgattat

SEQ ID NO: 399353 - DNA, 25 bp, Rattus norvegicus
gcgagtgactgagcttgttgattat

SEQ ID NO: 399354 - DNA, 25 bp, Rattus norvegicus
gcgagtgcacgaacatgtgggtctt

SEQ ID NO: 399355 - DNA, 25 bp, Rattus norvegicus
gcgagtgcacgatcatgtgggtctt

SEQ ID NO: 399356 - DNA, 25 bp, Rattus norvegicus
gcgagtgccgctcccgacatggcta

SEQ ID NO: 399357 - DNA, 25 bp, Rattus norvegicus
gcgagtgccgctgccgacatggcta

SEQ ID NO: 399358 - DNA, 25 bp, Rattus norvegicus
gcgagtgggagaacccatgctcaaa

SEQ ID NO: 399359 - DNA, 25 bp, Rattus norvegicus
gcgagtgggagatcccatgctcaaa

SEQ ID NO: 399360 - DNA, 25 bp, Rattus norvegicus
gcgagtgtggcaagaccttctactg

SEQ ID NO: 399361 - DNA, 25 bp, Rattus norvegicus
gcgagtgtggcatgaccttctactg

SEQ ID NO: 399362 - DNA, 25 bp, Rattus norvegicus
gcgagttcctggctcaagcggtcac

SEQ ID NO: 399363 - DNA, 25 bp, Rattus norvegicus
gcgagttcctgggtcaagcggtcac

SEQ ID NO: 399364 - DNA, 25 bp, Rattus norvegicus
gcgagttctccaagtcggacgcccg

SEQ ID NO: 399365 - DNA, 25 bp, Rattus norvegicus
gcgagttctccatgtcggacgcccg

SEQ ID NO: 399366 - DNA, 25 bp, Rattus norvegicus
gcgagttggccgctctgggtaggga

SEQ ID NO: 399367 - DNA, 25 bp, Rattus norvegicus
gcgagttggccggtctgggtaggga

SEQ ID NO: 399368 - DNA, 25 bp, Rattus norvegicus
gcgagtttttaactcaggctagatc

SEQ ID NO: 399369 - DNA, 25 bp, Rattus norvegicus
gcgagtttttaagtcaggctagatc

SEQ ID NO: 399370 - DNA, 25 bp, Rattus norvegicus
gcgataaggtgtactggacttgccg

SEQ ID NO: 399371 - DNA, 25 bp, Rattus norvegicus
gcgataaggtgttctggacttgccg

SEQ ID NO: 399372 - DNA, 25 bp, Rattus norvegicus
gcgatacacttgagtttgtttctct

SEQ ID NO: 399373 - DNA, 25 bp, Rattus norvegicus
gcgatacacttgtgtttgtttctct

SEQ ID NO: 399374 - DNA, 25 bp, Rattus norvegicus
gcgatacgtcatagcttaaactact

SEQ ID NO: 399375 - DNA, 25 bp, Rattus norvegicus
gcgatacgtcattgcttaaactact

SEQ ID NO: 399376 - DNA, 25 bp, Rattus norvegicus
gcgatactgctgaggatgcaccatc

SEQ ID NO: 399377 - DNA, 25 bp, Rattus norvegicus
gcgatactgctgtggatgcaccatc

SEQ ID NO: 399378 - DNA, 25 bp, Rattus norvegicus
gcgatacttactcgagtcactctct

SEQ ID NO: 399379 - DNA, 25 bp, Rattus norvegicus
gcgatacttactggagtcactctct

SEQ ID NO: 399380 - DNA, 25 bp, Rattus norvegicus
gcgatagccattattctgccaattg

SEQ ID NO: 399381 - DNA, 25 bp, Rattus norvegicus
gcgatagccatttttctgccaattg

SEQ ID NO: 399382 - DNA, 25 bp, Rattus norvegicus
gcgataggacacagtggtgccacta

SEQ ID NO: 399383 - DNA, 25 bp, Rattus norvegicus
gcgataggacactgtggtgccacta

SEQ ID NO: 399384 - DNA, 25 bp, Rattus norvegicus
gcgataggtcttcactgctggacaa

SEQ ID NO: 399385 - DNA, 25 bp, Rattus norvegicus
gcgataggtcttgactgctggacaa

SEQ ID NO: 399386 - DNA, 25 bp, Rattus norvegicus
gcgatatccgctcgcaggttgttga

SEQ ID NO: 399387 - DNA, 25 bp, Rattus norvegicus
gcgatatccgctggcaggttgttga

SEQ ID NO: 399388 - DNA, 25 bp, Rattus norvegicus
gcgatatctcgtccgtttttgtaaa

SEQ ID NO: 399389 - DNA, 25 bp, Rattus norvegicus
gcgatatctcgtgcgtttttgtaaa

SEQ ID NO: 399390 - DNA, 25 bp, Rattus norvegicus
gcgatcaaacgcacttgcagacaaa

SEQ ID NO: 399391 - DNA, 25 bp, Rattus norvegicus
gcgatcaaacgctcttgcagacaaa

SEQ ID NO: 399392 - DNA, 25 bp, Rattus norvegicus
gcgatcacctgcaggtaagtgccaa

SEQ ID NO: 399393 - DNA, 25 bp, Rattus norvegicus
gcgatcacctgctggtaagtgccaa

SEQ ID NO: 399394 - DNA, 25 bp, Rattus norvegicus
gcgatcatggccacttggtatctaa

SEQ ID NO: 399395 - DNA, 25 bp, Rattus norvegicus
gcgatcatggcctcttggtatctaa

SEQ ID NO: 399396 - DNA, 25 bp, Rattus norvegicus
gcgatcatttgtatagatgtaggca

SEQ ID NO: 399397 - DNA, 25 bp, Rattus norvegicus
gcgatcatttgtttagatgtaggca

SEQ ID NO: 399398 - DNA, 25 bp, Rattus norvegicus
gcgatccaagatcaagtcctttgtg

SEQ ID NO: 399399 - DNA, 25 bp, Rattus norvegicus
gcgatccaagatgaagtcctttgtg

SEQ ID NO: 399400 - DNA, 25 bp, Rattus norvegicus
gcgatccagcctaatgaaactcaca

SEQ ID NO: 399401 - DNA, 25 bp, Rattus norvegicus
gcgatccagccttatgaaactcaca

SEQ ID NO: 399402 - DNA, 25 bp, Rattus norvegicus
gcgatccccggaccagcaggaccag

SEQ ID NO: 399403 - DNA, 25 bp, Rattus norvegicus
gcgatccccggagcagcaggaccag

SEQ ID NO: 399404 - DNA, 25 bp, Rattus norvegicus
gcgatccggttgatgggaaggccca

SEQ ID NO: 399405 - DNA, 25 bp, Rattus norvegicus
gcgatccggttgttgggaaggccca

SEQ ID NO: 399406 - DNA, 25 bp, Rattus norvegicus
gcgatcgcccaaaagttgaggtcca

SEQ ID NO: 399407 - DNA, 25 bp, Rattus norvegicus
gcgatcgcccaatagttgaggtcca

SEQ ID NO: 399408 - DNA, 25 bp, Rattus norvegicus
gcgatcgcgcccaggctttgagtga

SEQ ID NO: 399409 - DNA, 25 bp, Rattus norvegicus
gcgatcgcgccctggctttgagtga

SEQ ID NO: 399410 - DNA, 25 bp, Rattus norvegicus
gcgatcgctatgctccccaaagaag

SEQ ID NO: 399411 - DNA, 25 bp, Rattus norvegicus
gcgatcgctatggtccccaaagaag

SEQ ID NO: 399412 - DNA, 25 bp, Rattus norvegicus
gcgatcggcccaaggagctgtactt

SEQ ID NO: 399413 - DNA, 25 bp, Rattus norvegicus
gcgatcggcccatggagctgtactt

SEQ ID NO: 399414 - DNA, 25 bp, Rattus norvegicus
gcgatcggcggcagcgctacaagac

SEQ ID NO: 399415 - DNA, 25 bp, Rattus norvegicus
gcgatcggcggctgcgctacaagac

SEQ ID NO: 399416 - DNA, 25 bp, Rattus norvegicus
gcgatctattacagctgtgagctct

SEQ ID NO: 399417 - DNA, 25 bp, Rattus norvegicus
gcgatctattactgctgtgagctct

SEQ ID NO: 399418 - DNA, 25 bp, Rattus norvegicus
gcgatctgatagctccaaatctcaa

SEQ ID NO: 399419 - DNA, 25 bp, Rattus norvegicus
gcgatctgataggtccaaatctcaa

SEQ ID NO: 399420 - DNA, 25 bp, Rattus norvegicus
gcgatgacagttccattccaacatt

SEQ ID NO: 399421 - DNA, 25 bp, Rattus norvegicus
gcgatgacagttgcattccaacatt

SEQ ID NO: 399422 - DNA, 25 bp, Rattus norvegicus
gcgatgagccatcacaaggaaggat

SEQ ID NO: 399423 - DNA, 25 bp, Rattus norvegicus
gcgatgagccatgacaaggaaggat

SEQ ID NO: 399424 - DNA, 25 bp, Rattus norvegicus
gcgatgagctgtccccggacagtaa

SEQ ID NO: 399425 - DNA, 25 bp, Rattus norvegicus
gcgatgagctgtgcccggacagtaa

SEQ ID NO: 399426 - DNA, 25 bp, Rattus norvegicus
gcgatgaggagcaatccagtcccca

SEQ ID NO: 399427 - DNA, 25 bp, Rattus norvegicus
gcgatgaggagctatccagtcccca

SEQ ID NO: 399428 - DNA, 25 bp, Rattus norvegicus
gcgatgatatcaagcactatttctt

SEQ ID NO: 399429 - DNA, 25 bp, Rattus norvegicus
gcgatgatatcatgcactatttctt

SEQ ID NO: 399430 - DNA, 25 bp, Rattus norvegicus
gcgatgatttgtattgagggtctat

SEQ ID NO: 399431 - DNA, 25 bp, Rattus norvegicus
gcgatgatttgttttgagggtctat

SEQ ID NO: 399432 - DNA, 25 bp, Rattus norvegicus
gcgatgcactagcttttacacgttc

SEQ ID NO: 399433 - DNA, 25 bp, Rattus norvegicus
gcgatgcactaggttttacacgttc

SEQ ID NO: 399434 - DNA, 25 bp, Rattus norvegicus
gcgatgcctttgcatagtctcacgg

SEQ ID NO: 399435 - DNA, 25 bp, Rattus norvegicus
gcgatgcctttggatagtctcacgg

SEQ ID NO: 399436 - DNA, 25 bp, Rattus norvegicus
gcgatgctgcggcagctgctcttga

SEQ ID NO: 399437 - DNA, 25 bp, Rattus norvegicus
gcgatgctgcgggagctgctcttga

SEQ ID NO: 399438 - DNA, 25 bp, Rattus norvegicus
gcgatggcctccctatgagtactga

SEQ ID NO: 399439 - DNA, 25 bp, Rattus norvegicus
gcgatggcctccgtatgagtactga

SEQ ID NO: 399440 - DNA, 25 bp, Rattus norvegicus
gcgatggctccactgtaaagctgtc

SEQ ID NO: 399441 - DNA, 25 bp, Rattus norvegicus
gcgatggctccagtgtaaagctgtc

SEQ ID NO: 399442 - DNA, 25 bp, Rattus norvegicus
gcgatggctgctaaccttatgaaaa

SEQ ID NO: 399443 - DNA, 25 bp, Rattus norvegicus
gcgatggctgcttaccttatgaaaa

SEQ ID NO: 399444 - DNA, 25 bp, Rattus norvegicus
gcgatgggacatagtgtggcatttc

SEQ ID NO: 399445 - DNA, 25 bp, Rattus norvegicus
gcgatgggacattgtgtggcatttc

SEQ ID NO: 399446 - DNA, 25 bp, Rattus norvegicus
gcgatgtcagttataacactcgtta

SEQ ID NO: 399447 - DNA, 25 bp, Rattus norvegicus
gcgatgtcagttttaacactcgtta

SEQ ID NO: 399448 - DNA, 25 bp, Rattus norvegicus
gcgatgtccccgaatttgaggattt

SEQ ID NO: 399449 - DNA, 25 bp, Rattus norvegicus
gcgatgtccccgtatttgaggattt

SEQ ID NO: 399450 - DNA, 25 bp, Rattus norvegicus
gcgatgtctcgcaagaaccagttgt

SEQ ID NO: 399451 - DNA, 25 bp, Rattus norvegicus
gcgatgtctcgctagaaccagttgt

SEQ ID NO: 399452 - DNA, 25 bp, Rattus norvegicus
gcgatgttagccagaagaccctgaa

SEQ ID NO: 399453 - DNA, 25 bp, Rattus norvegicus
gcgatgttagcctgaagaccctgaa

SEQ ID NO: 399454 - DNA, 25 bp, Rattus norvegicus
gcgatgttgtacaagctgttaccgt

SEQ ID NO: 399455 - DNA, 25 bp, Rattus norvegicus
gcgatgttgtactagctgttaccgt

SEQ ID NO: 399456 - DNA, 25 bp, Rattus norvegicus
gcgatgtttacaaagagctcctcat

SEQ ID NO: 399457 - DNA, 25 bp, Rattus norvegicus
gcgatgtttacatagagctcctcat

SEQ ID NO: 399458 - DNA, 25 bp, Rattus norvegicus
gcgattaatcctaaagccccttaat

SEQ ID NO: 399459 - DNA, 25 bp, Rattus norvegicus
gcgattaatccttaagccccttaat

SEQ ID NO: 399460 - DNA, 25 bp, Rattus norvegicus
gcgattagcacccattgcatgaatt

SEQ ID NO: 399461 - DNA, 25 bp, Rattus norvegicus
gcgattagcaccgattgcatgaatt

SEQ ID NO: 399462 - DNA, 25 bp, Rattus norvegicus
gcgattattttcacatctgtaacat

SEQ ID NO: 399463 - DNA, 25 bp, Rattus norvegicus
gcgattattttctcatctgtaacat

SEQ ID NO: 399464 - DNA, 25 bp, Rattus norvegicus
gcgattcccatcacaggactggaaa

SEQ ID NO: 399465 - DNA, 25 bp, Rattus norvegicus
gcgattcccatctcaggactggaaa

SEQ ID NO: 399466 - DNA, 25 bp, Rattus norvegicus
gcgattcccattcagcttgtatttt

SEQ ID NO: 399467 - DNA, 25 bp, Rattus norvegicus
gcgattcccattgagcttgtatttt

SEQ ID NO: 399468 - DNA, 25 bp, Rattus norvegicus
gcgattccgccgactcatttttaaa

SEQ ID NO: 399469 - DNA, 25 bp, Rattus norvegicus
gcgattccgccgtctcatttttaaa

SEQ ID NO: 399470 - DNA, 25 bp, Rattus norvegicus
gcgattcctggcatattttgttgta

SEQ ID NO: 399471 - DNA, 25 bp, Rattus norvegicus
gcgattcctggcttattttgttgta

SEQ ID NO: 399472 - DNA, 25 bp, Rattus norvegicus
gcgattcggagcattgttatcagat

SEQ ID NO: 399473 - DNA, 25 bp, Rattus norvegicus
gcgattcggagctttgttatcagat

SEQ ID NO: 399474 - DNA, 25 bp, Rattus norvegicus
gcgattctaagtaattgttgccaaa

SEQ ID NO: 399475 - DNA, 25 bp, Rattus norvegicus
gcgattctaagttattgttgccaaa

SEQ ID NO: 399476 - DNA, 25 bp, Rattus norvegicus
gcgattctccttacaaaaattgcct

SEQ ID NO: 399477 - DNA, 25 bp, Rattus norvegicus
gcgattctcctttcaaaaattgcct

SEQ ID NO: 399478 - DNA, 25 bp, Rattus norvegicus
gcgattctgggcaaagtgctacttg

SEQ ID NO: 399479 - DNA, 25 bp, Rattus norvegicus
gcgattctgggctaagtgctacttg

SEQ ID NO: 399480 - DNA, 25 bp, Rattus norvegicus
gcgattcttgtaacctacagaggga

SEQ ID NO: 399481 - DNA, 25 bp, Rattus norvegicus
gcgattcttgtatcctacagaggga

SEQ ID NO: 399482 - DNA, 25 bp, Rattus norvegicus
gcgattgcctatagggtaccccaga

SEQ ID NO: 399483 - DNA, 25 bp, Rattus norvegicus
gcgattgcctattgggtaccccaga

SEQ ID NO: 399484 - DNA, 25 bp, Rattus norvegicus
gcgattgtaactatgaggccagaga

SEQ ID NO: 399485 - DNA, 25 bp, Rattus norvegicus
gcgattgtaactttgaggccagaga

SEQ ID NO: 399486 - DNA, 25 bp, Rattus norvegicus
gcgattgtccctattgaatgtacta

SEQ ID NO: 399487 - DNA, 25 bp, Rattus norvegicus
gcgattgtcccttttgaatgtacta

SEQ ID NO: 399488 - DNA, 25 bp, Rattus norvegicus
gcgattgttccacagtcaataccat

SEQ ID NO: 399489 - DNA, 25 bp, Rattus norvegicus
gcgattgttccagagtcaataccat

SEQ ID NO: 399490 - DNA, 25 bp, Rattus norvegicus
gcgattgttgcaaatgggctctaca

SEQ ID NO: 399491 - DNA, 25 bp, Rattus norvegicus
gcgattgttgcatatgggctctaca

SEQ ID NO: 399492 - DNA, 25 bp, Rattus norvegicus
gcgatttcccataaggtttttggca

SEQ ID NO: 399493 - DNA, 25 bp, Rattus norvegicus
gcgatttcccattaggtttttggca

SEQ ID NO: 399494 - DNA, 25 bp, Rattus norvegicus
gcgatttcctttaaattatcttcct

SEQ ID NO: 399495 - DNA, 25 bp, Rattus norvegicus
gcgatttccttttaattatcttcct

SEQ ID NO: 399496 - DNA, 25 bp, Rattus norvegicus
gcgatttcgacccagttcgggatcc

SEQ ID NO: 399497 - DNA, 25 bp, Rattus norvegicus
gcgatttcgaccgagttcgggatcc

SEQ ID NO: 399498 - DNA, 25 bp, Rattus norvegicus
gcgatttctctaacaaatgttgcca

SEQ ID NO: 399499 - DNA, 25 bp, Rattus norvegicus
gcgatttctctatcaaatgttgcca

SEQ ID NO: 399500 - DNA, 25 bp, Rattus norvegicus
gcgatttctggcatgattgtccctc

SEQ ID NO: 399501 - DNA, 25 bp, Rattus norvegicus
gcgatttctggcttgattgtccctc

SEQ ID NO: 399502 - DNA, 25 bp, Rattus norvegicus
gcgatttgacccattatctcagact

SEQ ID NO: 399503 - DNA, 25 bp, Rattus norvegicus
gcgatttgaccctttatctcagact

SEQ ID NO: 399504 - DNA, 25 bp, Rattus norvegicus
gcgattttccttaaatctggactaa

SEQ ID NO: 399505 - DNA, 25 bp, Rattus norvegicus
gcgattttcctttaatctggactaa

SEQ ID NO: 399506 - DNA, 25 bp, Rattus norvegicus
gcgattttgactaaggtgctcccag

SEQ ID NO: 399507 - DNA, 25 bp, Rattus norvegicus
gcgattttgacttaggtgctcccag

SEQ ID NO: 399508 - DNA, 25 bp, Rattus norvegicus
gcgattttgatcagccacactattc

SEQ ID NO: 399509 - DNA, 25 bp, Rattus norvegicus
gcgattttgatctgccacactattc

SEQ ID NO: 399510 - DNA, 25 bp, Rattus norvegicus
gcgattttgattctgtaacacactg

SEQ ID NO: 399511 - DNA, 25 bp, Rattus norvegicus
gcgattttgattgtgtaacacactg

SEQ ID NO: 399512 - DNA, 25 bp, Rattus norvegicus
gcgatttttcccaccaatgaaagga

SEQ ID NO: 399513 - DNA, 25 bp, Rattus norvegicus
gcgatttttccctccaatgaaagga

SEQ ID NO: 399514 - DNA, 25 bp, Rattus norvegicus
gcgatttttcgaatgagctctgacc

SEQ ID NO: 399515 - DNA, 25 bp, Rattus norvegicus
gcgatttttcgattgagctctgacc

SEQ ID NO: 399516 - DNA, 25 bp, Rattus norvegicus
gcgatttttgtgatctttacctagt

SEQ ID NO: 399517 - DNA, 25 bp, Rattus norvegicus
gcgatttttgtgttctttacctagt

SEQ ID NO: 399518 - DNA, 25 bp, Rattus norvegicus
gcgcaaacatttctccagtgtgata

SEQ ID NO: 399519 - DNA, 25 bp, Rattus norvegicus
gcgcaaacatttgtccagtgtgata

SEQ ID NO: 399520 - DNA, 25 bp, Rattus norvegicus
gcgcaaaggcacatgtcctgtggag

SEQ ID NO: 399521 - DNA, 25 bp, Rattus norvegicus
gcgcaaaggcacttgtcctgtggag

SEQ ID NO: 399522 - DNA, 25 bp, Rattus norvegicus
gcgcaaattaggaggcttgatacta

SEQ ID NO: 399523 - DNA, 25 bp, Rattus norvegicus
gcgcaaattaggtggcttgatacta

SEQ ID NO: 399524 - DNA, 25 bp, Rattus norvegicus
gcgcaacagaggactccaggtgtta

SEQ ID NO: 399525 - DNA, 25 bp, Rattus norvegicus
gcgcaacagaggtctccaggtgtta

SEQ ID NO: 399526 - DNA, 25 bp, Rattus norvegicus
gcgcaacagttgagagatgtcccca

SEQ ID NO: 399527 - DNA, 25 bp, Rattus norvegicus
gcgcaacagttgtgagatgtcccca

SEQ ID NO: 399528 - DNA, 25 bp, Rattus norvegicus
gcgcaacgcagacagggctctaaat

SEQ ID NO: 399529 - DNA, 25 bp, Rattus norvegicus
gcgcaacgcagagagggctctaaat

SEQ ID NO: 399530 - DNA, 25 bp, Rattus norvegicus
gcgcaacgccaacttcttcaagcaa

SEQ ID NO: 399531 - DNA, 25 bp, Rattus norvegicus
gcgcaacgccaagttcttcaagcaa

SEQ ID NO: 399532 - DNA, 25 bp, Rattus norvegicus
gcgcaacttgaaattgcaccggttt

SEQ ID NO: 399533 - DNA, 25 bp, Rattus norvegicus
gcgcaacttgaatttgcaccggttt

SEQ ID NO: 399534 - DNA, 25 bp, Rattus norvegicus
gcgcaagcaggccaatacacctatg

SEQ ID NO: 399535 - DNA, 25 bp, Rattus norvegicus
gcgcaagcaggcgaatacacctatg

SEQ ID NO: 399536 - DNA, 25 bp, Rattus norvegicus
gcgcaagctctactcactgtggatg

SEQ ID NO: 399537 - DNA, 25 bp, Rattus norvegicus
gcgcaagctctagtcactgtggatg

SEQ ID NO: 399538 - DNA, 25 bp, Rattus norvegicus
gcgcaagtacgcagtcaaggcctga

SEQ ID NO: 399539 - DNA, 25 bp, Rattus norvegicus
gcgcaagtacgctgtcaaggcctga

SEQ ID NO: 399540 - DNA, 25 bp, Rattus norvegicus
gcgcaagtattaccctggccaggag

SEQ ID NO: 399541 - DNA, 25 bp, Rattus norvegicus
gcgcaagtattagcctggccaggag

SEQ ID NO: 399542 - DNA, 25 bp, Rattus norvegicus
gcgcaagtccctcagcacagtggaa

SEQ ID NO: 399543 - DNA, 25 bp, Rattus norvegicus
gcgcaagtccctgagcacagtggaa

SEQ ID NO: 399544 - DNA, 25 bp, Rattus norvegicus
gcgcaagtcggacaaacacgtctgt

SEQ ID NO: 399545 - DNA, 25 bp, Rattus norvegicus
gcgcaagtcggagaaacacgtctgt

SEQ ID NO: 399546 - DNA, 25 bp, Rattus norvegicus
gcgcaatctctgaggtaagctttta

SEQ ID NO: 399547 - DNA, 25 bp, Rattus norvegicus
gcgcaatctctgtggtaagctttta

SEQ ID NO: 399548 - DNA, 25 bp, Rattus norvegicus
gcgcaatgcaatattgtcaccagat

SEQ ID NO: 399549 - DNA, 25 bp, Rattus norvegicus
gcgcaatgcaattttgtcaccagat

SEQ ID NO: 399550 - DNA, 25 bp, Rattus norvegicus
gcgcaatgcccaagtgaagccagga

SEQ ID NO: 399551 - DNA, 25 bp, Rattus norvegicus
gcgcaatgcccatgtgaagccagga

SEQ ID NO: 399552 - DNA, 25 bp, Rattus norvegicus
gcgcaattacgcaatgtgtacaaaa

SEQ ID NO: 399553 - DNA, 25 bp, Rattus norvegicus
gcgcaattacgctatgtgtacaaaa

SEQ ID NO: 399554 - DNA, 25 bp, Rattus norvegicus
gcgcacacacaaactgggttatctt

SEQ ID NO: 399555 - DNA, 25 bp, Rattus norvegicus
gcgcacacacaatctgggttatctt

SEQ ID NO: 399556 - DNA, 25 bp, Rattus norvegicus
gcgcacacatagatttgttgcctag

SEQ ID NO: 399557 - DNA, 25 bp, Rattus norvegicus
gcgcacacatagttttgttgcctag

SEQ ID NO: 399558 - DNA, 25 bp, Rattus norvegicus
gcgcacactgagagactcttaccaa

SEQ ID NO: 399559 - DNA, 25 bp, Rattus norvegicus
gcgcacactgagtgactcttaccaa

SEQ ID NO: 399560 - DNA, 25 bp, Rattus norvegicus
gcgcacacttgaagaaggtgttttc

SEQ ID NO: 399561 - DNA, 25 bp, Rattus norvegicus
gcgcacacttgatgaaggtgttttc

SEQ ID NO: 399562 - DNA, 25 bp, Rattus norvegicus
gcgcacagcatccagatcacagcag

SEQ ID NO: 399563 - DNA, 25 bp, Rattus norvegicus
gcgcacagcatcgagatcacagcag

SEQ ID NO: 399564 - DNA, 25 bp, Rattus norvegicus
gcgcacagctacattgaggcctcaa

SEQ ID NO: 399565 - DNA, 25 bp, Rattus norvegicus
gcgcacagctactttgaggcctcaa

SEQ ID NO: 399566 - DNA, 25 bp, Rattus norvegicus
gcgcacagctgccacaaaggttgca

SEQ ID NO: 399567 - DNA, 25 bp, Rattus norvegicus
gcgcacagctgcgacaaaggttgca

SEQ ID NO: 399568 - DNA, 25 bp, Rattus norvegicus
gcgcacatgtgtccgcgagcgcaca

SEQ ID NO: 399569 - DNA, 25 bp, Rattus norvegicus
gcgcacatgtgtgcgcgagcgcaca

SEQ ID NO: 399570 - DNA, 25 bp, Rattus norvegicus
gcgcacattgataacacgtccagac

SEQ ID NO: 399571 - DNA, 25 bp, Rattus norvegicus
gcgcacattgattacacgtccagac

SEQ ID NO: 399572 - DNA, 25 bp, Rattus norvegicus
gcgcacccaaagacttttccaagga

SEQ ID NO: 399573 - DNA, 25 bp, Rattus norvegicus
gcgcacccaaagtcttttccaagga

SEQ ID NO: 399574 - DNA, 25 bp, Rattus norvegicus
gcgcaccttgtgatcaacgatgtaa

SEQ ID NO: 399575 - DNA, 25 bp, Rattus norvegicus
gcgcaccttgtgttcaacgatgtaa

SEQ ID NO: 399576 - DNA, 25 bp, Rattus norvegicus
gcgcacgcgcagacagaacttatgg

SEQ ID NO: 399577 - DNA, 25 bp, Rattus norvegicus
gcgcacgcgcagtcagaacttatgg

SEQ ID NO: 399578 - DNA, 25 bp, Rattus norvegicus
gcgcacgcgtgtctgtgtacaacta

SEQ ID NO: 399579 - DNA, 25 bp, Rattus norvegicus
gcgcacgcgtgtgtgtgtacaacta

SEQ ID NO: 399580 - DNA, 25 bp, Rattus norvegicus
gcgcacggatcgaattactcagttt

SEQ ID NO: 399581 - DNA, 25 bp, Rattus norvegicus
gcgcacggatcgtattactcagttt

SEQ ID NO: 399582 - DNA, 25 bp, Rattus norvegicus
gcgcactacagactaggcagaatag

SEQ ID NO: 399583 - DNA, 25 bp, Rattus norvegicus
gcgcactacagagtaggcagaatag

SEQ ID NO: 399584 - DNA, 25 bp, Rattus norvegicus
gcgcactcaccccaacgatgtaaga

SEQ ID NO: 399585 - DNA, 25 bp, Rattus norvegicus
gcgcactcacccgaacgatgtaaga

SEQ ID NO: 399586 - DNA, 25 bp, Rattus norvegicus
gcgcactcaggtagcacgggcccgg

SEQ ID NO: 399587 - DNA, 25 bp, Rattus norvegicus
gcgcactcaggttgcacgggcccgg

SEQ ID NO: 399588 - DNA, 25 bp, Rattus norvegicus
gcgcactcggccagtgcgtctggca

SEQ ID NO: 399589 - DNA, 25 bp, Rattus norvegicus
gcgcactcggcctgtgcgtctggca

SEQ ID NO: 399590 - DNA, 25 bp, Rattus norvegicus
gcgcactctctcatgtgcacatttt

SEQ ID NO: 399591 - DNA, 25 bp, Rattus norvegicus
gcgcactctctcttgtgcacatttt

SEQ ID NO: 399592 - DNA, 25 bp, Rattus norvegicus
gcgcactgtcagatggtacatcatt

SEQ ID NO: 399593 - DNA, 25 bp, Rattus norvegicus
gcgcactgtcagttggtacatcatt

SEQ ID NO: 399594 - DNA, 25 bp, Rattus norvegicus
gcgcacttggatattgtttcttgaa

SEQ ID NO: 399595 - DNA, 25 bp, Rattus norvegicus
gcgcacttggattttgtttcttgaa

SEQ ID NO: 399596 - DNA, 25 bp, Rattus norvegicus
gcgcagaaagcaattaaatacaagg

SEQ ID NO: 399597 - DNA, 25 bp, Rattus norvegicus
gcgcagaaagcatttaaatacaagg

SEQ ID NO: 399598 - DNA, 25 bp, Rattus norvegicus
gcgcagaccctgcacaaagtggata

SEQ ID NO: 399599 - DNA, 25 bp, Rattus norvegicus
gcgcagaccctggacaaagtggata

SEQ ID NO: 399600 - DNA, 25 bp, Rattus norvegicus
gcgcagactcagcatctagttctaa

SEQ ID NO: 399601 - DNA, 25 bp, Rattus norvegicus
gcgcagactcaggatctagttctaa

SEQ ID NO: 399602 - DNA, 25 bp, Rattus norvegicus
gcgcagactgtgaaattggaccaat

SEQ ID NO: 399603 - DNA, 25 bp, Rattus norvegicus
gcgcagactgtgtaattggaccaat

SEQ ID NO: 399604 - DNA, 25 bp, Rattus norvegicus
gcgcagagctagagccatatccctg

SEQ ID NO: 399605 - DNA, 25 bp, Rattus norvegicus
gcgcagagctagtgccatatccctg

SEQ ID NO: 399606 - DNA, 25 bp, Rattus norvegicus
gcgcagatggacatagtcttccaga

SEQ ID NO: 399607 - DNA, 25 bp, Rattus norvegicus
gcgcagatggacttagtcttccaga

SEQ ID NO: 399608 - DNA, 25 bp, Rattus norvegicus
gcgcagcaagggactgagtcgaact

SEQ ID NO: 399609 - DNA, 25 bp, Rattus norvegicus
gcgcagcaagggtctgagtcgaact

SEQ ID NO: 399610 - DNA, 25 bp, Rattus norvegicus
gcgcagcaggtgcatcgccagcatt

SEQ ID NO: 399611 - DNA, 25 bp, Rattus norvegicus
gcgcagcaggtggatcgccagcatt

SEQ ID NO: 399612 - DNA, 25 bp, Rattus norvegicus
gcgcagcagtcgctaacgctcattg

SEQ ID NO: 399613 - DNA, 25 bp, Rattus norvegicus
gcgcagcagtcggtaacgctcattg

SEQ ID NO: 399614 - DNA, 25 bp, Rattus norvegicus
gcgcagcatgcactcaattccatga

SEQ ID NO: 399615 - DNA, 25 bp, Rattus norvegicus
gcgcagcatgcagtcaattccatga

SEQ ID NO: 399616 - DNA, 25 bp, Rattus norvegicus
gcgcagccctccagaaggtgctgga

SEQ ID NO: 399617 - DNA, 25 bp, Rattus norvegicus
gcgcagccctcctgaaggtgctgga

SEQ ID NO: 399618 - DNA, 25 bp, Rattus norvegicus
gcgcagcgcagcatgtcatctaatg

SEQ ID NO: 399619 - DNA, 25 bp, Rattus norvegicus
gcgcagcgcagcttgtcatctaatg

SEQ ID NO: 399620 - DNA, 25 bp, Rattus norvegicus
gcgcagctcacacactggactctgg

SEQ ID NO: 399621 - DNA, 25 bp, Rattus norvegicus
gcgcagctcacagactggactctgg

SEQ ID NO: 399622 - DNA, 25 bp, Rattus norvegicus
gcgcagctcttcagcgaagccgtgg

SEQ ID NO: 399623 - DNA, 25 bp, Rattus norvegicus
gcgcagctcttctgcgaagccgtgg

SEQ ID NO: 399624 - DNA, 25 bp, Rattus norvegicus
gcgcagctggaaagcacatcaggga

SEQ ID NO: 399625 - DNA, 25 bp, Rattus norvegicus
gcgcagctggaatgcacatcaggga

SEQ ID NO: 399626 - DNA, 25 bp, Rattus norvegicus
gcgcagctggctatagtgtgtacgt

SEQ ID NO: 399627 - DNA, 25 bp, Rattus norvegicus
gcgcagctggctttagtgtgtacgt

SEQ ID NO: 399628 - DNA, 25 bp, Rattus norvegicus
gcgcagcttcggagcgcgcgccatt

SEQ ID NO: 399629 - DNA, 25 bp, Rattus norvegicus
gcgcagcttcggtgcgcgcgccatt

SEQ ID NO: 399630 - DNA, 25 bp, Rattus norvegicus
gcgcagcttgataacgcagctccca

SEQ ID NO: 399631 - DNA, 25 bp, Rattus norvegicus
gcgcagcttgattacgcagctccca

SEQ ID NO: 399632 - DNA, 25 bp, Rattus norvegicus
gcgcagctttctaggataatctgaa

SEQ ID NO: 399633 - DNA, 25 bp, Rattus norvegicus
gcgcagctttcttggataatctgaa

SEQ ID NO: 399634 - DNA, 25 bp, Rattus norvegicus
gcgcaggagcctcggaacactgtaa

SEQ ID NO: 399635 - DNA, 25 bp, Rattus norvegicus
gcgcaggagcctgggaacactgtaa

SEQ ID NO: 399636 - DNA, 25 bp, Rattus norvegicus
gcgcaggcggccatcgaaaagatgc

SEQ ID NO: 399637 - DNA, 25 bp, Rattus norvegicus
gcgcaggcggccttcgaaaagatgc

SEQ ID NO: 399638 - DNA, 25 bp, Rattus norvegicus
gcgcagggaacgctggtctcaataa

SEQ ID NO: 399639 - DNA, 25 bp, Rattus norvegicus
gcgcagggaacggtggtctcaataa

SEQ ID NO: 399640 - DNA, 25 bp, Rattus norvegicus
gcgcagggaagaccagcacttactt

SEQ ID NO: 399641 - DNA, 25 bp, Rattus norvegicus
gcgcagggaagagcagcacttactt

SEQ ID NO: 399642 - DNA, 25 bp, Rattus norvegicus
gcgcagggcagcactgtggttaatt

SEQ ID NO: 399643 - DNA, 25 bp, Rattus norvegicus
gcgcagggcagctctgtggttaatt

SEQ ID NO: 399644 - DNA, 25 bp, Rattus norvegicus
gcgcagggtatcaacatggccaaca

SEQ ID NO: 399645 - DNA, 25 bp, Rattus norvegicus
gcgcagggtatctacatggccaaca

SEQ ID NO: 399646 - DNA, 25 bp, Rattus norvegicus
gcgcaggtcctgctcgctgagcaaa

SEQ ID NO: 399647 - DNA, 25 bp, Rattus norvegicus
gcgcaggtcctggtcgctgagcaaa

SEQ ID NO: 399648 - DNA, 25 bp, Rattus norvegicus
gcgcaggtgacgcccttagatctct

SEQ ID NO: 399649 - DNA, 25 bp, Rattus norvegicus
gcgcaggtgacggccttagatctct

SEQ ID NO: 399650 - DNA, 25 bp, Rattus norvegicus
gcgcagtatataatgtggacttcta

SEQ ID NO: 399651 - DNA, 25 bp, Rattus norvegicus
gcgcagtatatattgtggacttcta

SEQ ID NO: 399652 - DNA, 25 bp, Rattus norvegicus
gcgcagtcagctaccgctgaggaag

SEQ ID NO: 399653 - DNA, 25 bp, Rattus norvegicus
gcgcagtcagcttccgctgaggaag

SEQ ID NO: 399654 - DNA, 25 bp, Rattus norvegicus
gcgcagtccttccaggagctgcaga

SEQ ID NO: 399655 - DNA, 25 bp, Rattus norvegicus
gcgcagtccttcgaggagctgcaga

SEQ ID NO: 399656 - DNA, 25 bp, Rattus norvegicus
gcgcagtctgagaagaaaggccaaa

SEQ ID NO: 399657 - DNA, 25 bp, Rattus norvegicus
gcgcagtctgagtagaaaggccaaa

SEQ ID NO: 399658 - DNA, 25 bp, Rattus norvegicus
gcgcagtgaccccagacagcctgag

SEQ ID NO: 399659 - DNA, 25 bp, Rattus norvegicus
gcgcagtgacccgagacagcctgag

SEQ ID NO: 399660 - DNA, 25 bp, Rattus norvegicus
gcgcagtggttgacgccagaggaga

SEQ ID NO: 399661 - DNA, 25 bp, Rattus norvegicus
gcgcagtggttgtcgccagaggaga

SEQ ID NO: 399662 - DNA, 25 bp, Rattus norvegicus
gcgcagtgtgaaactgcccagtcta

SEQ ID NO: 399663 - DNA, 25 bp, Rattus norvegicus
gcgcagtgtgaatctgcccagtcta

SEQ ID NO: 399664 - DNA, 25 bp, Rattus norvegicus
gcgcatagacttccgcaatgaggac

SEQ ID NO: 399665 - DNA, 25 bp, Rattus norvegicus
gcgcatagacttgcgcaatgaggac

SEQ ID NO: 399666 - DNA, 25 bp, Rattus norvegicus
gcgcatatcaaaaccgcttgagttt

SEQ ID NO: 399667 - DNA, 25 bp, Rattus norvegicus
gcgcatatcaaatccgcttgagttt

SEQ ID NO: 399668 - DNA, 25 bp, Rattus norvegicus
gcgcatcatgcgatcttgggagact

SEQ ID NO: 399669 - DNA, 25 bp, Rattus norvegicus
gcgcatcatgcgttcttgggagact

SEQ ID NO: 399670 - DNA, 25 bp, Rattus norvegicus
gcgcatctgaggacgcacacaggtg

SEQ ID NO: 399671 - DNA, 25 bp, Rattus norvegicus
gcgcatctgaggagtctgacgaaat

SEQ ID NO: 399672 - DNA, 25 bp, Rattus norvegicus
gcgcatctgaggtcgcacacaggtg

SEQ ID NO: 399673 - DNA, 25 bp, Rattus norvegicus
gcgcatctgaggtgtctgacgaaat

SEQ ID NO: 399674 - DNA, 25 bp, Rattus norvegicus
gcgcatctgccgaattaagccagag

SEQ ID NO: 399675 - DNA, 25 bp, Rattus norvegicus
gcgcatctgccgtattaagccagag

SEQ ID NO: 399676 - DNA, 25 bp, Rattus norvegicus
gcgcatcttgttaatccgttctaat

SEQ ID NO: 399677 - DNA, 25 bp, Rattus norvegicus
gcgcatcttgtttatccgttctaat

SEQ ID NO: 399678 - DNA, 25 bp, Rattus norvegicus
gcgcatgactgtatctatattcctc

SEQ ID NO: 399679 - DNA, 25 bp, Rattus norvegicus
gcgcatgactgtttctatattcctc

SEQ ID NO: 399680 - DNA, 25 bp, Rattus norvegicus
gcgcatgcgctccaagatggccaga

SEQ ID NO: 399681 - DNA, 25 bp, Rattus norvegicus
gcgcatgcgctcgaagatggccaga

SEQ ID NO: 399682 - DNA, 25 bp, Rattus norvegicus
gcgcatgctcgcaagtggttagtaa

SEQ ID NO: 399683 - DNA, 25 bp, Rattus norvegicus
gcgcatgctcgctagtggttagtaa

SEQ ID NO: 399684 - DNA, 25 bp, Rattus norvegicus
gcgcatgcttttaggcttgtgcaca

SEQ ID NO: 399685 - DNA, 25 bp, Rattus norvegicus
gcgcatgcttttcggtgtttttatc

SEQ ID NO: 399686 - DNA, 25 bp, Rattus norvegicus
gcgcatgcttttgggtgtttttatc

SEQ ID NO: 399687 - DNA, 25 bp, Rattus norvegicus
gcgcatgctttttggcttgtgcaca

SEQ ID NO: 399688 - DNA, 25 bp, Rattus norvegicus
gcgcatgggcataaccggagttgta

SEQ ID NO: 399689 - DNA, 25 bp, Rattus norvegicus
gcgcatgggcattaccggagttgta

SEQ ID NO: 399690 - DNA, 25 bp, Rattus norvegicus
gcgcatgtccccaacacgtgggaag

SEQ ID NO: 399691 - DNA, 25 bp, Rattus norvegicus
gcgcatgtcccctacacgtgggaag

SEQ ID NO: 399692 - DNA, 25 bp, Rattus norvegicus
gcgcatgtctccagttgcaggcaga

SEQ ID NO: 399693 - DNA, 25 bp, Rattus norvegicus
gcgcatgtctcctgttgcaggcaga

SEQ ID NO: 399694 - DNA, 25 bp, Rattus norvegicus
gcgcatgtgtatctttgtgatcagt

SEQ ID NO: 399695 - DNA, 25 bp, Rattus norvegicus
gcgcatgtgtatgtttgtgatcagt

SEQ ID NO: 399696 - DNA, 25 bp, Rattus norvegicus
gcgcattccataaacttgggctcag

SEQ ID NO: 399697 - DNA, 25 bp, Rattus norvegicus
gcgcattccatatacttgggctcag

SEQ ID NO: 399698 - DNA, 25 bp, Rattus norvegicus
gcgcattcttgcattggtctggact

SEQ ID NO: 399699 - DNA, 25 bp, Rattus norvegicus
gcgcattcttgctttggtctggact

SEQ ID NO: 399700 - DNA, 25 bp, Rattus norvegicus
gcgcattgcatcaactggaggtgct

SEQ ID NO: 399701 - DNA, 25 bp, Rattus norvegicus
gcgcattgcatctactggaggtgct

SEQ ID NO: 399702 - DNA, 25 bp, Rattus norvegicus
gcgcatttcggaaccttgctaggtt

SEQ ID NO: 399703 - DNA, 25 bp, Rattus norvegicus
gcgcatttcggatccttgctaggtt

SEQ ID NO: 399704 - DNA, 25 bp, Rattus norvegicus
gcgcatttcgtacctctgagtgttc

SEQ ID NO: 399705 - DNA, 25 bp, Rattus norvegicus
gcgcatttcgtagctctgagtgttc

SEQ ID NO: 399706 - DNA, 25 bp, Rattus norvegicus
gcgcattttcatatgggtcttaact

SEQ ID NO: 399707 - DNA, 25 bp, Rattus norvegicus
gcgcattttcatttgggtcttaact

SEQ ID NO: 399708 - DNA, 25 bp, Rattus norvegicus
gcgccaaacgcaaggtgacacggat

SEQ ID NO: 399709 - DNA, 25 bp, Rattus norvegicus
gcgccaaacgcatggtgacacggat

SEQ ID NO: 399710 - DNA, 25 bp, Rattus norvegicus
gcgccaaattggagcaagccctgag

SEQ ID NO: 399711 - DNA, 25 bp, Rattus norvegicus
gcgccaaattggtgcaagccctgag

SEQ ID NO: 399712 - DNA, 25 bp, Rattus norvegicus
gcgccaactcgcaggtggatttgtc

SEQ ID NO: 399713 - DNA, 25 bp, Rattus norvegicus
gcgccaactcgctggtggatttgtc

SEQ ID NO: 399714 - DNA, 25 bp, Rattus norvegicus
gcgccaaggccaagtcgcggtcgtc

SEQ ID NO: 399715 - DNA, 25 bp, Rattus norvegicus
gcgccaaggccatgtcgcggtcgtc

SEQ ID NO: 399716 - DNA, 25 bp, Rattus norvegicus
gcgccaaggctgagtgcgtctttgt

SEQ ID NO: 399717 - DNA, 25 bp, Rattus norvegicus
gcgccaaggctgtgtgcgtctttgt

SEQ ID NO: 399718 - DNA, 25 bp, Rattus norvegicus
gcgccaaggttgaactctacaccaa

SEQ ID NO: 399719 - DNA, 25 bp, Rattus norvegicus
gcgccaaggttgtactctacaccaa

SEQ ID NO: 399720 - DNA, 25 bp, Rattus norvegicus
gcgccaagtgacatgagctgaagtc

SEQ ID NO: 399721 - DNA, 25 bp, Rattus norvegicus
gcgccaagtgacttgagctgaagtc

SEQ ID NO: 399722 - DNA, 25 bp, Rattus norvegicus
gcgccacaagcacagaaactcctat

SEQ ID NO: 399723 - DNA, 25 bp, Rattus norvegicus
gcgccacaagcagagaaactcctat

SEQ ID NO: 399724 - DNA, 25 bp, Rattus norvegicus
gcgccacaagctctatctggtattt

SEQ ID NO: 399725 - DNA, 25 bp, Rattus norvegicus
gcgccacaagctgtatctggtattt

SEQ ID NO: 399726 - DNA, 25 bp, Rattus norvegicus
gcgccacagaggctttgtcagaaat

SEQ ID NO: 399727 - DNA, 25 bp, Rattus norvegicus
gcgccacagagggtttgtcagaaat

SEQ ID NO: 399728 - DNA, 25 bp, Rattus norvegicus
gcgccaccaccaatttatttaagac

SEQ ID NO: 399729 - DNA, 25 bp, Rattus norvegicus
gcgccaccaccattttatttaagac

SEQ ID NO: 399730 - DNA, 25 bp, Rattus norvegicus
gcgccaccaggaagatgctaccgta

SEQ ID NO: 399731 - DNA, 25 bp, Rattus norvegicus
gcgccaccaggatgatgctaccgta

SEQ ID NO: 399732 - DNA, 25 bp, Rattus norvegicus
gcgccacctaaaagacgatgacgtc

SEQ ID NO: 399733 - DNA, 25 bp, Rattus norvegicus
gcgccacctaaatgacgatgacgtc

SEQ ID NO: 399734 - DNA, 25 bp, Rattus norvegicus
gcgccacgtgggagacttttgatta

SEQ ID NO: 399735 - DNA, 25 bp, Rattus norvegicus
gcgccacgtgggtgacttttgatta

SEQ ID NO: 399736 - DNA, 25 bp, Rattus norvegicus
gcgccactgccgacagatgggatga

SEQ ID NO: 399737 - DNA, 25 bp, Rattus norvegicus
gcgccactgccgtcagatgggatga

SEQ ID NO: 399738 - DNA, 25 bp, Rattus norvegicus
gcgccactgtctcgaaaggaagcca

SEQ ID NO: 399739 - DNA, 25 bp, Rattus norvegicus
gcgccactgtctggaaaggaagcca

SEQ ID NO: 399740 - DNA, 25 bp, Rattus norvegicus
gcgccacttggtacatccagggata

SEQ ID NO: 399741 - DNA, 25 bp, Rattus norvegicus
gcgccacttggttcatccagggata

SEQ ID NO: 399742 - DNA, 25 bp, Rattus norvegicus
gcgccagatcccagacggttgtgaa

SEQ ID NO: 399743 - DNA, 25 bp, Rattus norvegicus
gcgccagatccctgacggttgtgaa

SEQ ID NO: 399744 - DNA, 25 bp, Rattus norvegicus
gcgccaggccatacccaaggacaag

SEQ ID NO: 399745 - DNA, 25 bp, Rattus norvegicus
gcgccaggccattcccaaggacaag

SEQ ID NO: 399746 - DNA, 25 bp, Rattus norvegicus
gcgccaggctaacttacatgcacag

SEQ ID NO: 399747 - DNA, 25 bp, Rattus norvegicus
gcgccaggctaagttacatgcacag

SEQ ID NO: 399748 - DNA, 25 bp, Rattus norvegicus
gcgccagtccctcgagttgactgaa

SEQ ID NO: 399749 - DNA, 25 bp, Rattus norvegicus
gcgccagtccctggagttgactgaa

SEQ ID NO: 399750 - DNA, 25 bp, Rattus norvegicus
gcgccagttgggactttgtgatata

SEQ ID NO: 399751 - DNA, 25 bp, Rattus norvegicus
gcgccagttgggtctttgtgatata

SEQ ID NO: 399752 - DNA, 25 bp, Rattus norvegicus
gcgccatagcatcttgtagctccaa

SEQ ID NO: 399753 - DNA, 25 bp, Rattus norvegicus
gcgccatagcatgttgtagctccaa

SEQ ID NO: 399754 - DNA, 25 bp, Rattus norvegicus
gcgccatattgtaaattgtgccaag

SEQ ID NO: 399755 - DNA, 25 bp, Rattus norvegicus
gcgccatattgttaattgtgccaag

SEQ ID NO: 399756 - DNA, 25 bp, Rattus norvegicus
gcgccatgaagaagagtaactctgt

SEQ ID NO: 399757 - DNA, 25 bp, Rattus norvegicus
gcgccatgaagatgagtaactctgt

SEQ ID NO: 399758 - DNA, 25 bp, Rattus norvegicus
gcgccatgggccaggagcatatcgt

SEQ ID NO: 399759 - DNA, 25 bp, Rattus norvegicus
gcgccatgggcctggagcatatcgt

SEQ ID NO: 399760 - DNA, 25 bp, Rattus norvegicus
gcgccatgtagtagtcatagccgaa

SEQ ID NO: 399761 - DNA, 25 bp, Rattus norvegicus
gcgccatgtagttgtcatagccgaa

SEQ ID NO: 399762 - DNA, 25 bp, Rattus norvegicus
gcgccatgtgaaatcaatcccaaga

SEQ ID NO: 399763 - DNA, 25 bp, Rattus norvegicus
gcgccatgtgaattcaatcccaaga

SEQ ID NO: 399764 - DNA, 25 bp, Rattus norvegicus
gcgccattacccagggccgtcgggt

SEQ ID NO: 399765 - DNA, 25 bp, Rattus norvegicus
gcgccattaccctgggccgtcgggt

SEQ ID NO: 399766 - DNA, 25 bp, Rattus norvegicus
gcgccattcctgagctgagttgtca

SEQ ID NO: 399767 - DNA, 25 bp, Rattus norvegicus
gcgccattcctgtgctgagttgtca

SEQ ID NO: 399768 - DNA, 25 bp, Rattus norvegicus
gcgccattgtggagctttgagagtc

SEQ ID NO: 399769 - DNA, 25 bp, Rattus norvegicus
gcgccattgtggtgctttgagagtc

SEQ ID NO: 399770 - DNA, 25 bp, Rattus norvegicus
gcgccatttagcagtcctagtagta

SEQ ID NO: 399771 - DNA, 25 bp, Rattus norvegicus
gcgccatttagctgtcctagtagta

SEQ ID NO: 399772 - DNA, 25 bp, Rattus norvegicus
gcgcccaatcaaactcttagggttg

SEQ ID NO: 399773 - DNA, 25 bp, Rattus norvegicus
gcgcccaatcaatctcttagggttg

SEQ ID NO: 399774 - DNA, 25 bp, Rattus norvegicus
gcgcccacaggaacagactctcaga

SEQ ID NO: 399775 - DNA, 25 bp, Rattus norvegicus
gcgcccacaggatcagactctcaga

SEQ ID NO: 399776 - DNA, 25 bp, Rattus norvegicus
gcgcccaccgatctattttaaactt

SEQ ID NO: 399777 - DNA, 25 bp, Rattus norvegicus
gcgcccaccgatgtattttaaactt

SEQ ID NO: 399778 - DNA, 25 bp, Rattus norvegicus
gcgcccactggcaagagcgaagttc

SEQ ID NO: 399779 - DNA, 25 bp, Rattus norvegicus
gcgcccactggctagagcgaagttc

SEQ ID NO: 399780 - DNA, 25 bp, Rattus norvegicus
gcgcccactgtaacttaccaggtta

SEQ ID NO: 399781 - DNA, 25 bp, Rattus norvegicus
gcgcccactgtatcttaccaggtta

SEQ ID NO: 399782 - DNA, 25 bp, Rattus norvegicus
gcgcccacttcccaaatcatgggat

SEQ ID NO: 399783 - DNA, 25 bp, Rattus norvegicus
gcgcccacttccgaaatcatgggat

SEQ ID NO: 399784 - DNA, 25 bp, Rattus norvegicus
gcgcccagaagcagctgagtgcgtt

SEQ ID NO: 399785 - DNA, 25 bp, Rattus norvegicus
gcgcccagaagctgctgagtgcgtt

SEQ ID NO: 399786 - DNA, 25 bp, Rattus norvegicus
gcgcccagcgaaaataggtatactt

SEQ ID NO: 399787 - DNA, 25 bp, Rattus norvegicus
gcgcccagcgaatataggtatactt

SEQ ID NO: 399788 - DNA, 25 bp, Rattus norvegicus
gcgcccaggcttagagtgaccgcat

SEQ ID NO: 399789 - DNA, 25 bp, Rattus norvegicus
gcgcccaggctttgagtgaccgcat

SEQ ID NO: 399790 - DNA, 25 bp, Rattus norvegicus
gcgcccatcactaagcagaacgagc

SEQ ID NO: 399791 - DNA, 25 bp, Rattus norvegicus
gcgcccatcacttagcagaacgagc

SEQ ID NO: 399792 - DNA, 25 bp, Rattus norvegicus
gcgcccatcctacatgtgaatagca

SEQ ID NO: 399793 - DNA, 25 bp, Rattus norvegicus
gcgcccatcctagatgtgaatagca

SEQ ID NO: 399794 - DNA, 25 bp, Rattus norvegicus
gcgccccacagaatgtttctataca

SEQ ID NO: 399795 - DNA, 25 bp, Rattus norvegicus
gcgccccacagattgtttctataca

SEQ ID NO: 399796 - DNA, 25 bp, Rattus norvegicus
gcgccccagagtagcatgtgcagca

SEQ ID NO: 399797 - DNA, 25 bp, Rattus norvegicus
gcgccccagagttgcatgtgcagca

SEQ ID NO: 399798 - DNA, 25 bp, Rattus norvegicus
gcgccccgcggcagagcttcatgtg

SEQ ID NO: 399799 - DNA, 25 bp, Rattus norvegicus
gcgccccgcggctgagcttcatgtg

SEQ ID NO: 399800 - DNA, 25 bp, Rattus norvegicus
gcgcccgagcctagcagatggagaa

SEQ ID NO: 399801 - DNA, 25 bp, Rattus norvegicus
gcgcccgagccttgcagatggagaa

SEQ ID NO: 399802 - DNA, 25 bp, Rattus norvegicus
gcgcccgagggtagaggtccttcta

SEQ ID NO: 399803 - DNA, 25 bp, Rattus norvegicus
gcgcccgagggttgaggtccttcta

SEQ ID NO: 399804 - DNA, 25 bp, Rattus norvegicus
gcgcccgatctcctctgatctcgga

SEQ ID NO: 399805 - DNA, 25 bp, Rattus norvegicus
gcgcccgatctcgtctgatctcgga

SEQ ID NO: 399806 - DNA, 25 bp, Rattus norvegicus
gcgcccgctgcaaatacagtcacaa

SEQ ID NO: 399807 - DNA, 25 bp, Rattus norvegicus
gcgcccgctgcatatacagtcacaa

SEQ ID NO: 399808 - DNA, 25 bp, Rattus norvegicus
gcgcccggacaacagtcgtgttgaa

SEQ ID NO: 399809 - DNA, 25 bp, Rattus norvegicus
gcgcccggacaagagtcgtgttgaa

SEQ ID NO: 399810 - DNA, 25 bp, Rattus norvegicus
gcgcccggtgcgagcccaaggataa

SEQ ID NO: 399811 - DNA, 25 bp, Rattus norvegicus
gcgcccggtgcgtgcccaaggataa

SEQ ID NO: 399812 - DNA, 25 bp, Rattus norvegicus
gcgcccgtgatgaggcacacctggc

SEQ ID NO: 399813 - DNA, 25 bp, Rattus norvegicus
gcgcccgtgatgtggcacacctggc

SEQ ID NO: 399814 - DNA, 25 bp, Rattus norvegicus
gcgccctacagaaatggacttcgaa

SEQ ID NO: 399815 - DNA, 25 bp, Rattus norvegicus
gcgccctacagatatggacttcgaa

SEQ ID NO: 399816 - DNA, 25 bp, Rattus norvegicus
gcgccctcagttagtacttgtggga

SEQ ID NO: 399817 - DNA, 25 bp, Rattus norvegicus
gcgccctcagtttgtacttgtggga

SEQ ID NO: 399818 - DNA, 25 bp, Rattus norvegicus
gcgccctccacacaactaatagttg

SEQ ID NO: 399819 - DNA, 25 bp, Rattus norvegicus
gcgccctccacagaactaatagttg

SEQ ID NO: 399820 - DNA, 25 bp, Rattus norvegicus
gcgccctccttgatggacgagagct

SEQ ID NO: 399821 - DNA, 25 bp, Rattus norvegicus
gcgccctccttgttggacgagagct

SEQ ID NO: 399822 - DNA, 25 bp, Rattus norvegicus
gcgccctcgaataaaacaggccttg

SEQ ID NO: 399823 - DNA, 25 bp, Rattus norvegicus
gcgccctcgaattaaacaggccttg

SEQ ID NO: 399824 - DNA, 25 bp, Rattus norvegicus
gcgccctgctgaaccttgaggagga

SEQ ID NO: 399825 - DNA, 25 bp, Rattus norvegicus
gcgccctgctgatccttgaggagga

SEQ ID NO: 399826 - DNA, 25 bp, Rattus norvegicus
gcgccctgtcctcaactacaataaa

SEQ ID NO: 399827 - DNA, 25 bp, Rattus norvegicus
gcgccctgtcctgaactacaataaa

SEQ ID NO: 399828 - DNA, 25 bp, Rattus norvegicus
gcgcccttcgagcacgcgggatctt

SEQ ID NO: 399829 - DNA, 25 bp, Rattus norvegicus
gcgcccttcgaggacgcgggatctt

SEQ ID NO: 399830 - DNA, 25 bp, Rattus norvegicus
gcgccgaccgcaaagaattcgtgat

SEQ ID NO: 399831 - DNA, 25 bp, Rattus norvegicus
gcgccgaccgcatagaattcgtgat

SEQ ID NO: 399832 - DNA, 25 bp, Rattus norvegicus
gcgccgagatgaagggctttctgct

SEQ ID NO: 399833 - DNA, 25 bp, Rattus norvegicus
gcgccgagatgatgggctttctgct

SEQ ID NO: 399834 - DNA, 25 bp, Rattus norvegicus
gcgccgaggagaaaagaaagctgca

SEQ ID NO: 399835 - DNA, 25 bp, Rattus norvegicus
gcgccgaggagataagaaagctgca

SEQ ID NO: 399836 - DNA, 25 bp, Rattus norvegicus
gcgccgaggaggctgcgagccgtgt

SEQ ID NO: 399837 - DNA, 25 bp, Rattus norvegicus
gcgccgaggagggtgcgagccgtgt

SEQ ID NO: 399838 - DNA, 25 bp, Rattus norvegicus
gcgccgagtggaagctgctcaccga

SEQ ID NO: 399839 - DNA, 25 bp, Rattus norvegicus
gcgccgagtggatgctgctcaccga

SEQ ID NO: 399840 - DNA, 25 bp, Rattus norvegicus
gcgccgatgcctctcagggtgactc

SEQ ID NO: 399841 - DNA, 25 bp, Rattus norvegicus
gcgccgatgcctgtcagggtgactc

SEQ ID NO: 399842 - DNA, 25 bp, Rattus norvegicus
gcgccgccaaggactgcagatcacg

SEQ ID NO: 399843 - DNA, 25 bp, Rattus norvegicus
gcgccgccaaggtctgcagatcacg

SEQ ID NO: 399844 - DNA, 25 bp, Rattus norvegicus
gcgccgccgtcgcatgactggaaaa

SEQ ID NO: 399845 - DNA, 25 bp, Rattus norvegicus
gcgccgccgtcggatgactggaaaa

SEQ ID NO: 399846 - DNA, 25 bp, Rattus norvegicus
gcgccgcgcacgctcaagaaggtac

SEQ ID NO: 399847 - DNA, 25 bp, Rattus norvegicus
gcgccgcgcacggtcaagaaggtac

SEQ ID NO: 399848 - DNA, 25 bp, Rattus norvegicus
gcgccgcggatgaccatgagagata

SEQ ID NO: 399849 - DNA, 25 bp, Rattus norvegicus
gcgccgcggatgtccatgagagata

SEQ ID NO: 399850 - DNA, 25 bp, Rattus norvegicus
gcgccgctggcactcacctgaagac

SEQ ID NO: 399851 - DNA, 25 bp, Rattus norvegicus
gcgccgctggcagtcacctgaagac

SEQ ID NO: 399852 - DNA, 25 bp, Rattus norvegicus
gcgccggaccaaaaatgacttgcag

SEQ ID NO: 399853 - DNA, 25 bp, Rattus norvegicus
gcgccggaccaataatgacttgcag

SEQ ID NO: 399854 - DNA, 25 bp, Rattus norvegicus
gcgccggagaagaagatcaccctga

SEQ ID NO: 399855 - DNA, 25 bp, Rattus norvegicus
gcgccggagaagtagatcaccctga

SEQ ID NO: 399856 - DNA, 25 bp, Rattus norvegicus
gcgccggatcaaccggtctcgaaga

SEQ ID NO: 399857 - DNA, 25 bp, Rattus norvegicus
gcgccggatcaagcggtctcgaaga

SEQ ID NO: 399858 - DNA, 25 bp, Rattus norvegicus
gcgccggctctgattataggactaa

SEQ ID NO: 399859 - DNA, 25 bp, Rattus norvegicus
gcgccggctctgtttataggactaa

SEQ ID NO: 399860 - DNA, 25 bp, Rattus norvegicus
gcgccgggaagacgccgctactatt

SEQ ID NO: 399861 - DNA, 25 bp, Rattus norvegicus
gcgccgggaagaggccgctactatt

SEQ ID NO: 399862 - DNA, 25 bp, Rattus norvegicus
gcgccggtgcagaatctacagtatc

SEQ ID NO: 399863 - DNA, 25 bp, Rattus norvegicus
gcgccggtgcagtatctacagtatc

SEQ ID NO: 399864 - DNA, 25 bp, Rattus norvegicus
gcgccgtacctgcagacgcagaaag

SEQ ID NO: 399865 - DNA, 25 bp, Rattus norvegicus
gcgccgtacctggagacgcagaaag

SEQ ID NO: 399866 - DNA, 25 bp, Rattus norvegicus
gcgccgtcagaaccaccaaggatgt

SEQ ID NO: 399867 - DNA, 25 bp, Rattus norvegicus
gcgccgtcagaagcaccaaggatgt

SEQ ID NO: 399868 - DNA, 25 bp, Rattus norvegicus
gcgccgtcatttccctggagggcaa

SEQ ID NO: 399869 - DNA, 25 bp, Rattus norvegicus
gcgccgtcatttgcctggagggcaa

SEQ ID NO: 399870 - DNA, 25 bp, Rattus norvegicus
gcgcctacagcactatgccaagatc

SEQ ID NO: 399871 - DNA, 25 bp, Rattus norvegicus
gcgcctacagcagtatgccaagatc

SEQ ID NO: 399872 - DNA, 25 bp, Rattus norvegicus
gcgcctacgaggctctgagcataag

SEQ ID NO: 399873 - DNA, 25 bp, Rattus norvegicus
gcgcctacgagggtctgagcataag

SEQ ID NO: 399874 - DNA, 25 bp, Rattus norvegicus
gcgcctagcttcacagagactttaa

SEQ ID NO: 399875 - DNA, 25 bp, Rattus norvegicus
gcgcctagcttctcagagactttaa

SEQ ID NO: 399876 - DNA, 25 bp, Rattus norvegicus
gcgcctaggcttaacgcccaggaac

SEQ ID NO: 399877 - DNA, 25 bp, Rattus norvegicus
gcgcctaggctttacgcccaggaac

SEQ ID NO: 399878 - DNA, 25 bp, Rattus norvegicus
gcgcctatcacgaggacttctgaaa

SEQ ID NO: 399879 - DNA, 25 bp, Rattus norvegicus
gcgcctatcacgtggacttctgaaa

SEQ ID NO: 399880 - DNA, 25 bp, Rattus norvegicus
gcgcctcattttctgtgcgacatgt

SEQ ID NO: 399881 - DNA, 25 bp, Rattus norvegicus
gcgcctcattttgtgtgcgacatgt

SEQ ID NO: 399882 - DNA, 25 bp, Rattus norvegicus
gcgcctcctcctcgatgtggaaatt

SEQ ID NO: 399883 - DNA, 25 bp, Rattus norvegicus
gcgcctcctcctggatgtggaaatt

SEQ ID NO: 399884 - DNA, 25 bp, Rattus norvegicus
gcgcctctccgcaggattaagagtt

SEQ ID NO: 399885 - DNA, 25 bp, Rattus norvegicus
gcgcctctccgctggattaagagtt

SEQ ID NO: 399886 - DNA, 25 bp, Rattus norvegicus
gcgcctctgttgatgtggacatgca

SEQ ID NO: 399887 - DNA, 25 bp, Rattus norvegicus
gcgcctctgttgttgtggacatgca

SEQ ID NO: 399888 - DNA, 25 bp, Rattus norvegicus
gcgcctcttccgcaacatatttatt

SEQ ID NO: 399889 - DNA, 25 bp, Rattus norvegicus
gcgcctcttccggaacatatttatt

SEQ ID NO: 399890 - DNA, 25 bp, Rattus norvegicus
gcgcctgaaattactgatggagaac

SEQ ID NO: 399891 - DNA, 25 bp, Rattus norvegicus
gcgcctgaaatttctgatggagaac

SEQ ID NO: 399892 - DNA, 25 bp, Rattus norvegicus
gcgcctgaaggccaaagagcacatc

SEQ ID NO: 399893 - DNA, 25 bp, Rattus norvegicus
gcgcctgaaggcgaaagagcacatc

SEQ ID NO: 399894 - DNA, 25 bp, Rattus norvegicus
gcgcctgaccgacctgctaaagcaa

SEQ ID NO: 399895 - DNA, 25 bp, Rattus norvegicus
gcgcctgaccgagctgctaaagcaa

SEQ ID NO: 399896 - DNA, 25 bp, Rattus norvegicus
gcgcctgccaaccattatgaacgtt

SEQ ID NO: 399897 - DNA, 25 bp, Rattus norvegicus
gcgcctgccaacgattatgaacgtt

SEQ ID NO: 399898 - DNA, 25 bp, Rattus norvegicus
gcgcctgcgcgactacagtctcaag

SEQ ID NO: 399899 - DNA, 25 bp, Rattus norvegicus
gcgcctgcgcgagtacagtctcaag

SEQ ID NO: 399900 - DNA, 25 bp, Rattus norvegicus
gcgcctgcgcggctccgattgtttt

SEQ ID NO: 399901 - DNA, 25 bp, Rattus norvegicus
gcgcctgcgcgggtccgattgtttt

SEQ ID NO: 399902 - DNA, 25 bp, Rattus norvegicus
gcgcctgctgagagctgaggaacca

SEQ ID NO: 399903 - DNA, 25 bp, Rattus norvegicus
gcgcctgctgagtgctgaggaacca

SEQ ID NO: 399904 - DNA, 25 bp, Rattus norvegicus
gcgcctggccaaaacagcattgtgt

SEQ ID NO: 399905 - DNA, 25 bp, Rattus norvegicus
gcgcctggccaatacagcattgtgt

SEQ ID NO: 399906 - DNA, 25 bp, Rattus norvegicus
gcgcctggctttcgcgaggagccag

SEQ ID NO: 399907 - DNA, 25 bp, Rattus norvegicus
gcgcctggctttggcgaggagccag

SEQ ID NO: 399908 - DNA, 25 bp, Rattus norvegicus
gcgcctggtccgcaaaggtaacgaa

SEQ ID NO: 399909 - DNA, 25 bp, Rattus norvegicus
gcgcctggtccggaaaggtaacgaa

SEQ ID NO: 399910 - DNA, 25 bp, Rattus norvegicus
gcgcctggtgtaatttgctggtgaa

SEQ ID NO: 399911 - DNA, 25 bp, Rattus norvegicus
gcgcctggtgtattttgctggtgaa

SEQ ID NO: 399912 - DNA, 25 bp, Rattus norvegicus
gcgcctggtttcaccggacagagtt

SEQ ID NO: 399913 - DNA, 25 bp, Rattus norvegicus
gcgcctggtttctccggacagagtt

SEQ ID NO: 399914 - DNA, 25 bp, Rattus norvegicus
gcgcctgtcagcctaacactaagaa

SEQ ID NO: 399915 - DNA, 25 bp, Rattus norvegicus
gcgcctgtcagcgtaacactaagaa

SEQ ID NO: 399916 - DNA, 25 bp, Rattus norvegicus
gcgcctgtcggaagctgaaactgtt

SEQ ID NO: 399917 - DNA, 25 bp, Rattus norvegicus
gcgcctgtcggatgctgaaactgtt

SEQ ID NO: 399918 - DNA, 25 bp, Rattus norvegicus
gcgccttaaccaccaacttcgagtg

SEQ ID NO: 399919 - DNA, 25 bp, Rattus norvegicus
gcgccttaaccagcaacttcgagtg

SEQ ID NO: 399920 - DNA, 25 bp, Rattus norvegicus
gcgccttaaggcatttgatgtcccc

SEQ ID NO: 399921 - DNA, 25 bp, Rattus norvegicus
gcgccttaaggcttttgatgtcccc

SEQ ID NO: 399922 - DNA, 25 bp, Rattus norvegicus
gcgccttcatgacgccattggcaaa

SEQ ID NO: 399923 - DNA, 25 bp, Rattus norvegicus
gcgccttcatgaggccattggcaaa

SEQ ID NO: 399924 - DNA, 25 bp, Rattus norvegicus
gcgccttcccatacattttatatat

SEQ ID NO: 399925 - DNA, 25 bp, Rattus norvegicus
gcgccttcccattcattttatatat

SEQ ID NO: 399926 - DNA, 25 bp, Rattus norvegicus
gcgccttccttgctgtttggattaa

SEQ ID NO: 399927 - DNA, 25 bp, Rattus norvegicus
gcgccttccttggtgtttggattaa

SEQ ID NO: 399928 - DNA, 25 bp, Rattus norvegicus
gcgccttcggcaaaacattgttaaa

SEQ ID NO: 399929 - DNA, 25 bp, Rattus norvegicus
gcgccttcggcataacattgttaaa

SEQ ID NO: 399930 - DNA, 25 bp, Rattus norvegicus
gcgccttctgatcacgtacacggaa

SEQ ID NO: 399931 - DNA, 25 bp, Rattus norvegicus
gcgccttctgatgacgtacacggaa

SEQ ID NO: 399932 - DNA, 25 bp, Rattus norvegicus
gcgccttctggtacaaggctttgaa

SEQ ID NO: 399933 - DNA, 25 bp, Rattus norvegicus
gcgccttctggttcaaggctttgaa

SEQ ID NO: 399934 - DNA, 25 bp, Rattus norvegicus
gcgccttggccgatgaagccaggac

SEQ ID NO: 399935 - DNA, 25 bp, Rattus norvegicus
gcgccttggccgttgaagccaggac

SEQ ID NO: 399936 - DNA, 25 bp, Rattus norvegicus
gcgccttggctacactgtgaactta

SEQ ID NO: 399937 - DNA, 25 bp, Rattus norvegicus
gcgccttggctagactgtgaactta

SEQ ID NO: 399938 - DNA, 25 bp, Rattus norvegicus
gcgccttgttatcttttcctaattg

SEQ ID NO: 399939 - DNA, 25 bp, Rattus norvegicus
gcgccttgttatgttttcctaattg

SEQ ID NO: 399940 - DNA, 25 bp, Rattus norvegicus
gcgcctttaggtctccttctattta

SEQ ID NO: 399941 - DNA, 25 bp, Rattus norvegicus
gcgcctttaggtgtccttctattta

SEQ ID NO: 399942 - DNA, 25 bp, Rattus norvegicus
gcgcctttcgggagagctcagagat

SEQ ID NO: 399943 - DNA, 25 bp, Rattus norvegicus
gcgcctttcgggtgagctcagagat

SEQ ID NO: 399944 - DNA, 25 bp, Rattus norvegicus
gcgcctttctgccggacgcgagcag

SEQ ID NO: 399945 - DNA, 25 bp, Rattus norvegicus
gcgcctttctgcgggacgcgagcag

SEQ ID NO: 399946 - DNA, 25 bp, Rattus norvegicus
gcgcgaatggaaccccttacggaga

SEQ ID NO: 399947 - DNA, 25 bp, Rattus norvegicus
gcgcgaatggaagcccttacggaga

SEQ ID NO: 399948 - DNA, 25 bp, Rattus norvegicus
gcgcgacacctcaaactttttggtt

SEQ ID NO: 399949 - DNA, 25 bp, Rattus norvegicus
gcgcgacacctctaactttttggtt

SEQ ID NO: 399950 - DNA, 25 bp, Rattus norvegicus
gcgcgacactctcgaggctactaga

SEQ ID NO: 399951 - DNA, 25 bp, Rattus norvegicus
gcgcgacactctggaggctactaga

SEQ ID NO: 399952 - DNA, 25 bp, Rattus norvegicus
gcgcgaccattacatggcgctggct

SEQ ID NO: 399953 - DNA, 25 bp, Rattus norvegicus
gcgcgaccattagatggcgctggct

SEQ ID NO: 399954 - DNA, 25 bp, Rattus norvegicus
gcgcgaccttcaattagtggagctg

SEQ ID NO: 399955 - DNA, 25 bp, Rattus norvegicus
gcgcgaccttcatttagtggagctg

SEQ ID NO: 399956 - DNA, 25 bp, Rattus norvegicus
gcgcgagaagaactccacgccgact

SEQ ID NO: 399957 - DNA, 25 bp, Rattus norvegicus
gcgcgagaagaagtccacgccgact

SEQ ID NO: 399958 - DNA, 25 bp, Rattus norvegicus
gcgcgagatgaaagcccttccaggg

SEQ ID NO: 399959 - DNA, 25 bp, Rattus norvegicus
gcgcgagatgaatgcccttccaggg

SEQ ID NO: 399960 - DNA, 25 bp, Rattus norvegicus
gcgcgagtgtctctgcgggatcggg

SEQ ID NO: 399961 - DNA, 25 bp, Rattus norvegicus
gcgcgagtgtctgtgcgggatcggg

SEQ ID NO: 399962 - DNA, 25 bp, Rattus norvegicus
gcgcgatgccaccttttatgtgata

SEQ ID NO: 399963 - DNA, 25 bp, Rattus norvegicus
gcgcgatgccacgttttatgtgata

SEQ ID NO: 399964 - DNA, 25 bp, Rattus norvegicus
gcgcgcacacggacgggattaagac

SEQ ID NO: 399965 - DNA, 25 bp, Rattus norvegicus
gcgcgcacacggtcgggattaagac

SEQ ID NO: 399966 - DNA, 25 bp, Rattus norvegicus
gcgcgcagccgcagggtcattgata

SEQ ID NO: 399967 - DNA, 25 bp, Rattus norvegicus
gcgcgcagccgctgggtcattgata

SEQ ID NO: 399968 - DNA, 25 bp, Rattus norvegicus
gcgcgcagtataagacagtacgtca

SEQ ID NO: 399969 - DNA, 25 bp, Rattus norvegicus
gcgcgcagtatatgacagtacgtca

SEQ ID NO: 399970 - DNA, 25 bp, Rattus norvegicus
gcgcgccattttctgagatttacaa

SEQ ID NO: 399971 - DNA, 25 bp, Rattus norvegicus
gcgcgccattttgtgagatttacaa

SEQ ID NO: 399972 - DNA, 25 bp, Rattus norvegicus
gcgcgcctttgccaaaagatctctt

SEQ ID NO: 399973 - DNA, 25 bp, Rattus norvegicus
gcgcgcctttgcgaaaagatctctt

SEQ ID NO: 399974 - DNA, 25 bp, Rattus norvegicus
gcgcgcgacggaaatcgcagagcaa

SEQ ID NO: 399975 - DNA, 25 bp, Rattus norvegicus
gcgcgcgacggatatcgcagagcaa

SEQ ID NO: 399976 - DNA, 25 bp, Rattus norvegicus
gcgcgcgcagctactgaaacagggt

SEQ ID NO: 399977 - DNA, 25 bp, Rattus norvegicus
gcgcgcgcagcttctgaaacagggt

SEQ ID NO: 399978 - DNA, 25 bp, Rattus norvegicus
gcgcgcgccattatgtgagatttac

SEQ ID NO: 399979 - DNA, 25 bp, Rattus norvegicus
gcgcgcgccattttgtgagatttac

SEQ ID NO: 399980 - DNA, 25 bp, Rattus norvegicus
gcgcgcgccttcagcttgaggtgca

SEQ ID NO: 399981 - DNA, 25 bp, Rattus norvegicus
gcgcgcgccttctgcttgaggtgca

SEQ ID NO: 399982 - DNA, 25 bp, Rattus norvegicus
gcgcgcgctattatattgtcgtata

SEQ ID NO: 399983 - DNA, 25 bp, Rattus norvegicus
gcgcgcgctattttattgtcgtata

SEQ ID NO: 399984 - DNA, 25 bp, Rattus norvegicus
gcgcgcgctctaagcgggatttgaa

SEQ ID NO: 399985 - DNA, 25 bp, Rattus norvegicus
gcgcgcgctctatgcgggatttgaa

SEQ ID NO: 399986 - DNA, 25 bp, Rattus norvegicus
gcgcgcgcttggacgtggccacctt

SEQ ID NO: 399987 - DNA, 25 bp, Rattus norvegicus
gcgcgcgcttggtcgtggccacctt

SEQ ID NO: 399988 - DNA, 25 bp, Rattus norvegicus
gcgcgcgtcaccagctggtagtcag

SEQ ID NO: 399989 - DNA, 25 bp, Rattus norvegicus
gcgcgcgtcacctgctggtagtcag

SEQ ID NO: 399990 - DNA, 25 bp, Rattus norvegicus
gcgcgctcacctagaacgtgtaatt

SEQ ID NO: 399991 - DNA, 25 bp, Rattus norvegicus
gcgcgctcaccttgaacgtgtaatt

SEQ ID NO: 399992 - DNA, 25 bp, Rattus norvegicus
gcgcgctccagccagggaaaacaac

SEQ ID NO: 399993 - DNA, 25 bp, Rattus norvegicus
gcgcgctccagcgagggaaaacaac

SEQ ID NO: 399994 - DNA, 25 bp, Rattus norvegicus
gcgcgctctgtcaggagcggaactt

SEQ ID NO: 399995 - DNA, 25 bp, Rattus norvegicus
gcgcgctctgtctggagcggaactt

SEQ ID NO: 399996 - DNA, 25 bp, Rattus norvegicus
gcgcgctgagcacccaagagataca

SEQ ID NO: 399997 - DNA, 25 bp, Rattus norvegicus
gcgcgctgagcagccaagagataca

SEQ ID NO: 399998 - DNA, 25 bp, Rattus norvegicus
gcgcgctgcaatatgaggtgctcat

SEQ ID NO: 399999 - DNA, 25 bp, Rattus norvegicus
gcgcgctgcaatttgaggtgctcat

SEQ ID NO: 400000 - DNA, 25 bp, Rattus norvegicus
gcgcgctggcctacgctataagtga

SEQ ID NO: 400001 - DNA, 25 bp, Rattus norvegicus
gcgcgctggccttcgctataagtga

SEQ ID NO: 400002 - DNA, 25 bp, Rattus norvegicus
gcgcgcttttaaatgccacgtagaa

SEQ ID NO: 400003 - DNA, 25 bp, Rattus norvegicus
gcgcgcttttaattgccacgtagaa

SEQ ID NO: 400004 - DNA, 25 bp, Rattus norvegicus
gcgcggacaacccattccaaagaga

SEQ ID NO: 400005 - DNA, 25 bp, Rattus norvegicus
gcgcggacaaccgattccaaagaga

SEQ ID NO: 400006 - DNA, 25 bp, Rattus norvegicus
gcgcggacccaacgtatatatgcat

SEQ ID NO: 400007 - DNA, 25 bp, Rattus norvegicus
gcgcggacccaaggtatatatgcat

SEQ ID NO: 400008 - DNA, 25 bp, Rattus norvegicus
gcgcggacggttctccttccttctg

SEQ ID NO: 400009 - DNA, 25 bp, Rattus norvegicus
gcgcggacggttgtccttccttctg

SEQ ID NO: 400010 - DNA, 25 bp, Rattus norvegicus
gcgcggagaggcaaggtccccacaa

SEQ ID NO: 400011 - DNA, 25 bp, Rattus norvegicus
gcgcggagaggctaggtccccacaa

SEQ ID NO: 400012 - DNA, 25 bp, Rattus norvegicus
gcgcggagctgtcggcggctgccga

SEQ ID NO: 400013 - DNA, 25 bp, Rattus norvegicus
gcgcggagctgtgggcggctgccga

SEQ ID NO: 400014 - DNA, 25 bp, Rattus norvegicus
gcgcggccagtgatttcgttttgta

SEQ ID NO: 400015 - DNA, 25 bp, Rattus norvegicus
gcgcggccagtgttttcgttttgta

SEQ ID NO: 400016 - DNA, 25 bp, Rattus norvegicus
gcgcggcctcagattctctggagaa

SEQ ID NO: 400017 - DNA, 25 bp, Rattus norvegicus
gcgcggcctcagtttctctggagaa

SEQ ID NO: 400018 - DNA, 25 bp, Rattus norvegicus
gcgcggcgctgcagatcgattgtca

SEQ ID NO: 400019 - DNA, 25 bp, Rattus norvegicus
gcgcggcgctgctgatcgattgtca

SEQ ID NO: 400020 - DNA, 25 bp, Rattus norvegicus
gcgcggctcgcaactaaagtgtgaa

SEQ ID NO: 400021 - DNA, 25 bp, Rattus norvegicus
gcgcggctcgcatctaaagtgtgaa

SEQ ID NO: 400022 - DNA, 25 bp, Rattus norvegicus
gcgcgggccgcgatctttgtaccgc

SEQ ID NO: 400023 - DNA, 25 bp, Rattus norvegicus
gcgcgggccgcgttctttgtaccgc

SEQ ID NO: 400024 - DNA, 25 bp, Rattus norvegicus
gcgcggtctacacctgcaagagaga

SEQ ID NO: 400025 - DNA, 25 bp, Rattus norvegicus
gcgcggtctacagctgcaagagaga

SEQ ID NO: 400026 - DNA, 25 bp, Rattus norvegicus
gcgcggtggcatcggcggcgtcgag

SEQ ID NO: 400027 - DNA, 25 bp, Rattus norvegicus
gcgcggtggcatgggcggcgtcgag

SEQ ID NO: 400028 - DNA, 25 bp, Rattus norvegicus
gcgcggttagcaaaacggtccgaat

SEQ ID NO: 400029 - DNA, 25 bp, Rattus norvegicus
gcgcggttagcataacggtccgaat

SEQ ID NO: 400030 - DNA, 25 bp, Rattus norvegicus
gcgcgtagcgacacggagaatgtct

SEQ ID NO: 400031 - DNA, 25 bp, Rattus norvegicus
gcgcgtagcgactcggagaatgtct

SEQ ID NO: 400032 - DNA, 25 bp, Rattus norvegicus
gcgcgtctctgactcacgaatattg

SEQ ID NO: 400033 - DNA, 25 bp, Rattus norvegicus
gcgcgtctctgagtcacgaatattg

SEQ ID NO: 400034 - DNA, 25 bp, Rattus norvegicus
gcgcgtgaatgtcgctttggtttac

SEQ ID NO: 400035 - DNA, 25 bp, Rattus norvegicus
gcgcgtgaatgtggctttggtttac

SEQ ID NO: 400036 - DNA, 25 bp, Rattus norvegicus
gcgcgtgcacatccttcatgctgag

SEQ ID NO: 400037 - DNA, 25 bp, Rattus norvegicus
gcgcgtgcacatgcttcatgctgag

SEQ ID NO: 400038 - DNA, 25 bp, Rattus norvegicus
gcgcgtgctaggatgaagtgcttaa

SEQ ID NO: 400039 - DNA, 25 bp, Rattus norvegicus
gcgcgtgctaggttgaagtgcttaa

SEQ ID NO: 400040 - DNA, 25 bp, Rattus norvegicus
gcgcgtggcgggagggttcctcgga

SEQ ID NO: 400041 - DNA, 25 bp, Rattus norvegicus
gcgcgtggcgggtgggttcctcgga

SEQ ID NO: 400042 - DNA, 25 bp, Rattus norvegicus
gcgcgtgtgcaacctatgctgtagc

SEQ ID NO: 400043 - DNA, 25 bp, Rattus norvegicus
gcgcgtgtgcaagctatgctgtagc

SEQ ID NO: 400044 - DNA, 25 bp, Rattus norvegicus
gcgcgtgtgtctccaggtatgtact

SEQ ID NO: 400045 - DNA, 25 bp, Rattus norvegicus
gcgcgtgtgtctgcaggtatgtact

SEQ ID NO: 400046 - DNA, 25 bp, Rattus norvegicus
gcgctaaaacaaaactcgtggaatt

SEQ ID NO: 400047 - DNA, 25 bp, Rattus norvegicus
gcgctaaaacaatactcgtggaatt

SEQ ID NO: 400048 - DNA, 25 bp, Rattus norvegicus
gcgctaacaaaaagggttccctaag

SEQ ID NO: 400049 - DNA, 25 bp, Rattus norvegicus
gcgctaacaaaatgggttccctaag

SEQ ID NO: 400050 - DNA, 25 bp, Rattus norvegicus
gcgctaacacgactatggcagagaa

SEQ ID NO: 400051 - DNA, 25 bp, Rattus norvegicus
gcgctaacacgagtatggcagagaa

SEQ ID NO: 400052 - DNA, 25 bp, Rattus norvegicus
gcgctaagcccgctgcaggaacatg

SEQ ID NO: 400053 - DNA, 25 bp, Rattus norvegicus
gcgctaagcccggtgcaggaacatg

SEQ ID NO: 400054 - DNA, 25 bp, Rattus norvegicus
gcgctaagtgcgaattctgtgtgct

SEQ ID NO: 400055 - DNA, 25 bp, Rattus norvegicus
gcgctaagtgcgtattctgtgtgct

SEQ ID NO: 400056 - DNA, 25 bp, Rattus norvegicus
gcgctaatctgcattcactgatgtt

SEQ ID NO: 400057 - DNA, 25 bp, Rattus norvegicus
gcgctaatctgctttcactgatgtt

SEQ ID NO: 400058 - DNA, 25 bp, Rattus norvegicus
gcgctacacagcaatgaccgttcag

SEQ ID NO: 400059 - DNA, 25 bp, Rattus norvegicus
gcgctacacagctatgaccgttcag

SEQ ID NO: 400060 - DNA, 25 bp, Rattus norvegicus
gcgctaccccttctacgtttggaga

SEQ ID NO: 400061 - DNA, 25 bp, Rattus norvegicus
gcgctaccccttgtacgtttggaga

SEQ ID NO: 400062 - DNA, 25 bp, Rattus norvegicus
gcgctacctgttaattccggaactg

SEQ ID NO: 400063 - DNA, 25 bp, Rattus norvegicus
gcgctacctgtttattccggaactg

SEQ ID NO: 400064 - DNA, 25 bp, Rattus norvegicus
gcgctactacacagggctttaatta

SEQ ID NO: 400065 - DNA, 25 bp, Rattus norvegicus
gcgctactacactgggctttaatta

SEQ ID NO: 400066 - DNA, 25 bp, Rattus norvegicus
gcgctactccttagatgtttccata

SEQ ID NO: 400067 - DNA, 25 bp, Rattus norvegicus
gcgctactcctttgatgtttccata

SEQ ID NO: 400068 - DNA, 25 bp, Rattus norvegicus
gcgctatcccttatgattctatttt

SEQ ID NO: 400069 - DNA, 25 bp, Rattus norvegicus
gcgctatcccttttgattctatttt

SEQ ID NO: 400070 - DNA, 25 bp, Rattus norvegicus
gcgctatctcatccaagattccagt

SEQ ID NO: 400071 - DNA, 25 bp, Rattus norvegicus
gcgctatctcatgcaagattccagt

SEQ ID NO: 400072 - DNA, 25 bp, Rattus norvegicus
gcgctattgtccaggccgagtgagc

SEQ ID NO: 400073 - DNA, 25 bp, Rattus norvegicus
gcgctattgtcctggccgagtgagc

SEQ ID NO: 400074 - DNA, 25 bp, Rattus norvegicus
gcgctcaacatacatcccagctgga

SEQ ID NO: 400075 - DNA, 25 bp, Rattus norvegicus
gcgctcaacatagatcccagctgga

SEQ ID NO: 400076 - DNA, 25 bp, Rattus norvegicus
gcgctcacactccatttcatgctga

SEQ ID NO: 400077 - DNA, 25 bp, Rattus norvegicus
gcgctcacactcgatttcatgctga

SEQ ID NO: 400078 - DNA, 25 bp, Rattus norvegicus
gcgctcacactgatttcatttttga

SEQ ID NO: 400079 - DNA, 25 bp, Rattus norvegicus
gcgctcacactgttttcatttttga

SEQ ID NO: 400080 - DNA, 25 bp, Rattus norvegicus
gcgctcaccgtgcagttcgtaacag

SEQ ID NO: 400081 - DNA, 25 bp, Rattus norvegicus
gcgctcaccgtggagttcgtaacag

SEQ ID NO: 400082 - DNA, 25 bp, Rattus norvegicus
gcgctcagcccaagactataggtgt

SEQ ID NO: 400083 - DNA, 25 bp, Rattus norvegicus
gcgctcagcccatgactataggtgt

SEQ ID NO: 400084 - DNA, 25 bp, Rattus norvegicus
gcgctcagcctgcatgacgtcaaaa

SEQ ID NO: 400085 - DNA, 25 bp, Rattus norvegicus
gcgctcagcctggatgacgtcaaaa

SEQ ID NO: 400086 - DNA, 25 bp, Rattus norvegicus
gcgctcagctctccagttgatggag

SEQ ID NO: 400087 - DNA, 25 bp, Rattus norvegicus
gcgctcagctctgcagttgatggag

SEQ ID NO: 400088 - DNA, 25 bp, Rattus norvegicus
gcgctcatcagcacaaactttattc

SEQ ID NO: 400089 - DNA, 25 bp, Rattus norvegicus
gcgctcatcagctcaaactttattc

SEQ ID NO: 400090 - DNA, 25 bp, Rattus norvegicus
gcgctccaacttacccaaaatatga

SEQ ID NO: 400091 - DNA, 25 bp, Rattus norvegicus
gcgctccaactttcccaaaatatga

SEQ ID NO: 400092 - DNA, 25 bp, Rattus norvegicus
gcgctccacccgagaccggtagtga

SEQ ID NO: 400093 - DNA, 25 bp, Rattus norvegicus
gcgctccacccgtgaccggtagtga

SEQ ID NO: 400094 - DNA, 25 bp, Rattus norvegicus
gcgctccactctaaatgaactggtg

SEQ ID NO: 400095 - DNA, 25 bp, Rattus norvegicus
gcgctccactcttaatgaactggtg

SEQ ID NO: 400096 - DNA, 25 bp, Rattus norvegicus
gcgctccctcggacgtgtggatcga

SEQ ID NO: 400097 - DNA, 25 bp, Rattus norvegicus
gcgctccctcggtcgtgtggatcga

SEQ ID NO: 400098 - DNA, 25 bp, Rattus norvegicus
gcgctcctctttatcttagaatact

SEQ ID NO: 400099 - DNA, 25 bp, Rattus norvegicus
gcgctcctctttttcttagaatact

SEQ ID NO: 400100 - DNA, 25 bp, Rattus norvegicus
gcgctcctgcatctaactctaataa

SEQ ID NO: 400101 - DNA, 25 bp, Rattus norvegicus
gcgctcctgcatgtaactctaataa

SEQ ID NO: 400102 - DNA, 25 bp, Rattus norvegicus
gcgctcctgtggcactgattttaag

SEQ ID NO: 400103 - DNA, 25 bp, Rattus norvegicus
gcgctcctgtgggactgattttaag

SEQ ID NO: 400104 - DNA, 25 bp, Rattus norvegicus
gcgctcgctgacatatgccaaagag

SEQ ID NO: 400105 - DNA, 25 bp, Rattus norvegicus
gcgctcgctgacttatgccaaagag

SEQ ID NO: 400106 - DNA, 25 bp, Rattus norvegicus
gcgctcgcttggctttgtgttaatc

SEQ ID NO: 400107 - DNA, 25 bp, Rattus norvegicus
gcgctcgcttgggtttgtgttaatc

SEQ ID NO: 400108 - DNA, 25 bp, Rattus norvegicus
gcgctcggtgccagagaagatcctg

SEQ ID NO: 400109 - DNA, 25 bp, Rattus norvegicus
gcgctcggtgcctgagaagatcctg

SEQ ID NO: 400110 - DNA, 25 bp, Rattus norvegicus
gcgctctaacccctactagggacaa

SEQ ID NO: 400111 - DNA, 25 bp, Rattus norvegicus
gcgctctaacccgtactagggacaa

SEQ ID NO: 400112 - DNA, 25 bp, Rattus norvegicus
gcgctctagaggctgcacatatttt

SEQ ID NO: 400113 - DNA, 25 bp, Rattus norvegicus
gcgctctagagggtgcacatatttt

SEQ ID NO: 400114 - DNA, 25 bp, Rattus norvegicus
gcgctctagtatacaagctatcttg

SEQ ID NO: 400115 - DNA, 25 bp, Rattus norvegicus
gcgctctagtattcaagctatcttg

SEQ ID NO: 400116 - DNA, 25 bp, Rattus norvegicus
gcgctctcctcacagaatgtgcagt

SEQ ID NO: 400117 - DNA, 25 bp, Rattus norvegicus
gcgctctcctcagagaatgtgcagt

SEQ ID NO: 400118 - DNA, 25 bp, Rattus norvegicus
gcgctctcctgcaggcaacaagaaa

SEQ ID NO: 400119 - DNA, 25 bp, Rattus norvegicus
gcgctctcctgctggcaacaagaaa

SEQ ID NO: 400120 - DNA, 25 bp, Rattus norvegicus
gcgctctcgttgctttgaagacaaa

SEQ ID NO: 400121 - DNA, 25 bp, Rattus norvegicus
gcgctctcgttggtttgaagacaaa

SEQ ID NO: 400122 - DNA, 25 bp, Rattus norvegicus
gcgctctctgctccagctcaggttg

SEQ ID NO: 400123 - DNA, 25 bp, Rattus norvegicus
gcgctctctgctgcagctcaggttg

SEQ ID NO: 400124 - DNA, 25 bp, Rattus norvegicus
gcgctctcttctatacccgataaat

SEQ ID NO: 400125 - DNA, 25 bp, Rattus norvegicus
gcgctctcttctttacccgataaat

SEQ ID NO: 400126 - DNA, 25 bp, Rattus norvegicus
gcgctctggcaacgaactgaaccgt

SEQ ID NO: 400127 - DNA, 25 bp, Rattus norvegicus
gcgctctggcaaggaactgaaccgt

SEQ ID NO: 400128 - DNA, 25 bp, Rattus norvegicus
gcgctcttccgcacaaatctagatt

SEQ ID NO: 400129 - DNA, 25 bp, Rattus norvegicus
gcgctcttccgctcaaatctagatt

SEQ ID NO: 400130 - DNA, 25 bp, Rattus norvegicus
gcgctcttggatcgtagctggctta

SEQ ID NO: 400131 - DNA, 25 bp, Rattus norvegicus
gcgctcttggatggtagctggctta

SEQ ID NO: 400132 - DNA, 25 bp, Rattus norvegicus
gcgctcttgttcacggttcggtgac

SEQ ID NO: 400133 - DNA, 25 bp, Rattus norvegicus
gcgctcttgttctcggttcggtgac

SEQ ID NO: 400134 - DNA, 25 bp, Rattus norvegicus
gcgctgaaccttatcggtgggtcca

SEQ ID NO: 400135 - DNA, 25 bp, Rattus norvegicus
gcgctgaaccttttcggtgggtcca

SEQ ID NO: 400136 - DNA, 25 bp, Rattus norvegicus
gcgctgaactttcgtctggcttatt

SEQ ID NO: 400137 - DNA, 25 bp, Rattus norvegicus
gcgctgaactttggtctggcttatt

SEQ ID NO: 400138 - DNA, 25 bp, Rattus norvegicus
gcgctgaaggcccacgcagaagaaa

SEQ ID NO: 400139 - DNA, 25 bp, Rattus norvegicus
gcgctgaaggccgacgcagaagaaa

SEQ ID NO: 400140 - DNA, 25 bp, Rattus norvegicus
gcgctgacagtgcttgtccagacaa

SEQ ID NO: 400141 - DNA, 25 bp, Rattus norvegicus
gcgctgacagtggttgtccagacaa

SEQ ID NO: 400142 - DNA, 25 bp, Rattus norvegicus
gcgctgacctgtcctaaagttacca

SEQ ID NO: 400143 - DNA, 25 bp, Rattus norvegicus
gcgctgacctgtgctaaagttacca

SEQ ID NO: 400144 - DNA, 25 bp, Rattus norvegicus
gcgctgacgttaatagaggccaaag

SEQ ID NO: 400145 - DNA, 25 bp, Rattus norvegicus
gcgctgacgttattagaggccaaag

SEQ ID NO: 400146 - DNA, 25 bp, Rattus norvegicus
gcgctgagacacatggagacctcaa

SEQ ID NO: 400147 - DNA, 25 bp, Rattus norvegicus
gcgctgagacacttggagacctcaa

SEQ ID NO: 400148 - DNA, 25 bp, Rattus norvegicus
gcgctgagttctccgcgcagggctc

SEQ ID NO: 400149 - DNA, 25 bp, Rattus norvegicus
gcgctgagttctgcgcgcagggctc

SEQ ID NO: 400150 - DNA, 25 bp, Rattus norvegicus
gcgctgatgcgcagactgagagaaa

SEQ ID NO: 400151 - DNA, 25 bp, Rattus norvegicus
gcgctgatgcgctgactgagagaaa

SEQ ID NO: 400152 - DNA, 25 bp, Rattus norvegicus
gcgctgcagcctcatgtgatcagat

SEQ ID NO: 400153 - DNA, 25 bp, Rattus norvegicus
gcgctgcagcctgatgtgatcagat

SEQ ID NO: 400154 - DNA, 25 bp, Rattus norvegicus
gcgctgccggtcatcaccaaggtgg

SEQ ID NO: 400155 - DNA, 25 bp, Rattus norvegicus
gcgctgccggtcttcaccaaggtgg

SEQ ID NO: 400156 - DNA, 25 bp, Rattus norvegicus
gcgctgctactccaggaaaccagaa

SEQ ID NO: 400157 - DNA, 25 bp, Rattus norvegicus
gcgctgctactcgaggaaaccagaa

SEQ ID NO: 400158 - DNA, 25 bp, Rattus norvegicus
gcgctgctccaactgctgtataaat

SEQ ID NO: 400159 - DNA, 25 bp, Rattus norvegicus
gcgctgctccaagtgctgtataaat

SEQ ID NO: 400160 - DNA, 25 bp, Rattus norvegicus
gcgctgctgcagaacgaaaggctgc

SEQ ID NO: 400161 - DNA, 25 bp, Rattus norvegicus
gcgctgctgcagtacgaaaggctgc

SEQ ID NO: 400162 - DNA, 25 bp, Rattus norvegicus
gcgctggcctgaatgctgtgagcta

SEQ ID NO: 400163 - DNA, 25 bp, Rattus norvegicus
gcgctggcctgattgctgtgagcta

SEQ ID NO: 400164 - DNA, 25 bp, Rattus norvegicus
gcgctggcgaatccccttctggaaa

SEQ ID NO: 400165 - DNA, 25 bp, Rattus norvegicus
gcgctggcgaatgcccttctggaaa

SEQ ID NO: 400166 - DNA, 25 bp, Rattus norvegicus
gcgctggcggcaacaagagccgcct

SEQ ID NO: 400167 - DNA, 25 bp, Rattus norvegicus
gcgctggcggcatcaagagccgcct

SEQ ID NO: 400168 - DNA, 25 bp, Rattus norvegicus
gcgctggcgttacagcgcaacagca

SEQ ID NO: 400169 - DNA, 25 bp, Rattus norvegicus
gcgctggcgttagagcgcaacagca

SEQ ID NO: 400170 - DNA, 25 bp, Rattus norvegicus
gcgctggctataaatctggctcatt

SEQ ID NO: 400171 - DNA, 25 bp, Rattus norvegicus
gcgctggctatatatctggctcatt

SEQ ID NO: 400172 - DNA, 25 bp, Rattus norvegicus
gcgctggctctcaggacagtaggaa

SEQ ID NO: 400173 - DNA, 25 bp, Rattus norvegicus
gcgctggctctctggacagtaggaa

SEQ ID NO: 400174 - DNA, 25 bp, Rattus norvegicus
gcgctgggcgccaaataagtctcca

SEQ ID NO: 400175 - DNA, 25 bp, Rattus norvegicus
gcgctgggcgcctaataagtctcca

SEQ ID NO: 400176 - DNA, 25 bp, Rattus norvegicus
gcgctgggtgaaagagacccttgca

SEQ ID NO: 400177 - DNA, 25 bp, Rattus norvegicus
gcgctgggtgaatgagacccttgca

SEQ ID NO: 400178 - DNA, 25 bp, Rattus norvegicus
gcgctgggtttccaaatgccacctg

SEQ ID NO: 400179 - DNA, 25 bp, Rattus norvegicus
gcgctgggtttcgaaatgccacctg

SEQ ID NO: 400180 - DNA, 25 bp, Rattus norvegicus
gcgctggtgacgagcttatgcatgc

SEQ ID NO: 400181 - DNA, 25 bp, Rattus norvegicus
gcgctggtgacgtgcttatgcatgc

SEQ ID NO: 400182 - DNA, 25 bp, Rattus norvegicus
gcgctggtggccatcagctaccaag

SEQ ID NO: 400183 - DNA, 25 bp, Rattus norvegicus
gcgctggtggccttcagctaccaag

SEQ ID NO: 400184 - DNA, 25 bp, Rattus norvegicus
gcgctggttgcaaagttctggccct

SEQ ID NO: 400185 - DNA, 25 bp, Rattus norvegicus
gcgctggttgcatagttctggccct

SEQ ID NO: 400186 - DNA, 25 bp, Rattus norvegicus
gcgctgtaagccagacagagtgagt

SEQ ID NO: 400187 - DNA, 25 bp, Rattus norvegicus
gcgctgtaagcctgacagagtgagt

SEQ ID NO: 400188 - DNA, 25 bp, Rattus norvegicus
gcgctgtcgctcagctcttgtgtgg

SEQ ID NO: 400189 - DNA, 25 bp, Rattus norvegicus
gcgctgtcgctctgctcttgtgtgg

SEQ ID NO: 400190 - DNA, 25 bp, Rattus norvegicus
gcgctgtgagacctaaagcccttag

SEQ ID NO: 400191 - DNA, 25 bp, Rattus norvegicus
gcgctgtgagacgtaaagcccttag

SEQ ID NO: 400192 - DNA, 25 bp, Rattus norvegicus
gcgctgtgcagtcaggccctctggg

SEQ ID NO: 400193 - DNA, 25 bp, Rattus norvegicus
gcgctgtgcagtgaggccctctggg

SEQ ID NO: 400194 - DNA, 25 bp, Rattus norvegicus
gcgctgtgcatcatctcagaataca

SEQ ID NO: 400195 - DNA, 25 bp, Rattus norvegicus
gcgctgtgcatcttctcagaataca

SEQ ID NO: 400196 - DNA, 25 bp, Rattus norvegicus
gcgctgtgcattattattggtgtac

SEQ ID NO: 400197 - DNA, 25 bp, Rattus norvegicus
gcgctgtgcatttttattggtgtac

SEQ ID NO: 400198 - DNA, 25 bp, Rattus norvegicus
gcgctgtggttgaccgcgacctcac

SEQ ID NO: 400199 - DNA, 25 bp, Rattus norvegicus
gcgctgtggttgtccgcgacctcac

SEQ ID NO: 400200 - DNA, 25 bp, Rattus norvegicus
gcgctgtgtgcaaggttagtgtcca

SEQ ID NO: 400201 - DNA, 25 bp, Rattus norvegicus
gcgctgtgtgcatggttagtgtcca

SEQ ID NO: 400202 - DNA, 25 bp, Rattus norvegicus
gcgctgttccagacacgagaatgtt

SEQ ID NO: 400203 - DNA, 25 bp, Rattus norvegicus
gcgctgttccagtcacgagaatgtt

SEQ ID NO: 400204 - DNA, 25 bp, Rattus norvegicus
gcgctgttgcatacgtctcctgcag

SEQ ID NO: 400205 - DNA, 25 bp, Rattus norvegicus
gcgctgttgcattcgtctcctgcag

SEQ ID NO: 400206 - DNA, 25 bp, Rattus norvegicus
gcgctgtttaaacggtgactctcac

SEQ ID NO: 400207 - DNA, 25 bp, Rattus norvegicus
gcgctgtttaaagggtgactctcac

SEQ ID NO: 400208 - DNA, 25 bp, Rattus norvegicus
gcgcttaagtcaactatgacatgtt

SEQ ID NO: 400209 - DNA, 25 bp, Rattus norvegicus
gcgcttaagtcatctatgacatgtt

SEQ ID NO: 400210 - DNA, 25 bp, Rattus norvegicus
gcgcttacattgaaccaaaggctga

SEQ ID NO: 400211 - DNA, 25 bp, Rattus norvegicus
gcgcttacattgtaccaaaggctga

SEQ ID NO: 400212 - DNA, 25 bp, Rattus norvegicus
gcgcttactggcaagaacttgacct

SEQ ID NO: 400213 - DNA, 25 bp, Rattus norvegicus
gcgcttactggctagaacttgacct

SEQ ID NO: 400214 - DNA, 25 bp, Rattus norvegicus
gcgcttcaccatcaagataacacaa

SEQ ID NO: 400215 - DNA, 25 bp, Rattus norvegicus
gcgcttcaccatgaagataacacaa

SEQ ID NO: 400216 - DNA, 25 bp, Rattus norvegicus
gcgcttcaggagcttgaacagtcca

SEQ ID NO: 400217 - DNA, 25 bp, Rattus norvegicus
gcgcttcaggaggttgaacagtcca

SEQ ID NO: 400218 - DNA, 25 bp, Rattus norvegicus
gcgcttcatcccactctaatgaaaa

SEQ ID NO: 400219 - DNA, 25 bp, Rattus norvegicus
gcgcttcatccctctctaatgaaaa

SEQ ID NO: 400220 - DNA, 25 bp, Rattus norvegicus
gcgcttccttgcagaactggcatat

SEQ ID NO: 400221 - DNA, 25 bp, Rattus norvegicus
gcgcttccttgctgaactggcatat

SEQ ID NO: 400222 - DNA, 25 bp, Rattus norvegicus
gcgcttctggtcagctaaatatata

SEQ ID NO: 400223 - DNA, 25 bp, Rattus norvegicus
gcgcttctggtctgctaaatatata

SEQ ID NO: 400224 - DNA, 25 bp, Rattus norvegicus
gcgcttgatcggcacctggatttta

SEQ ID NO: 400225 - DNA, 25 bp, Rattus norvegicus
gcgcttgatcgggacctggatttta

SEQ ID NO: 400226 - DNA, 25 bp, Rattus norvegicus
gcgcttgcccttattggtttcttca

SEQ ID NO: 400227 - DNA, 25 bp, Rattus norvegicus
gcgcttgccctttttggtttcttca

SEQ ID NO: 400228 - DNA, 25 bp, Rattus norvegicus
gcgcttgcctcgagtatcttagaac

SEQ ID NO: 400229 - DNA, 25 bp, Rattus norvegicus
gcgcttgcctcgtgtatcttagaac

SEQ ID NO: 400230 - DNA, 25 bp, Rattus norvegicus
gcgcttggtgtgacctgcgaccagt

SEQ ID NO: 400231 - DNA, 25 bp, Rattus norvegicus
gcgcttggtgtgtcctgcgaccagt

SEQ ID NO: 400232 - DNA, 25 bp, Rattus norvegicus
gcgctttactgcagggctgtatgac

SEQ ID NO: 400233 - DNA, 25 bp, Rattus norvegicus
gcgctttactgctgggctgtatgac

SEQ ID NO: 400234 - DNA, 25 bp, Rattus norvegicus
gcgctttgagacagagaagcctccg

SEQ ID NO: 400235 - DNA, 25 bp, Rattus norvegicus
gcgctttgagactgagaagcctccg

SEQ ID NO: 400236 - DNA, 25 bp, Rattus norvegicus
gcgcttttccttcaagaagtccttc

SEQ ID NO: 400237 - DNA, 25 bp, Rattus norvegicus
gcgcttttccttgaagaagtccttc

SEQ ID NO: 400238 - DNA, 25 bp, Rattus norvegicus
gcggaaaaccgccatttggcggcaa

SEQ ID NO: 400239 - DNA, 25 bp, Rattus norvegicus
gcggaaaaccgcgatttggcggcaa

SEQ ID NO: 400240 - DNA, 25 bp, Rattus norvegicus
gcggaaacatcaagtcagtcgcggg

SEQ ID NO: 400241 - DNA, 25 bp, Rattus norvegicus
gcggaaacatcatgtcagtcgcggg

SEQ ID NO: 400242 - DNA, 25 bp, Rattus norvegicus
gcggaaagaacacacaggcctgcga

SEQ ID NO: 400243 - DNA, 25 bp, Rattus norvegicus
gcggaaagaacagacaggcctgcga

SEQ ID NO: 400244 - DNA, 25 bp, Rattus norvegicus
gcggaaattcttctgcgcacacttg

SEQ ID NO: 400245 - DNA, 25 bp, Rattus norvegicus
gcggaaattcttgtgcgcacacttg

SEQ ID NO: 400246 - DNA, 25 bp, Rattus norvegicus
gcggaacatgttcaagtcgtgtcca

SEQ ID NO: 400247 - DNA, 25 bp, Rattus norvegicus
gcggaacatgttgaagtcgtgtcca

SEQ ID NO: 400248 - DNA, 25 bp, Rattus norvegicus
gcggaacgccgtccacatcaaggga

SEQ ID NO: 400249 - DNA, 25 bp, Rattus norvegicus
gcggaacgccgtgcacatcaaggga

SEQ ID NO: 400250 - DNA, 25 bp, Rattus norvegicus
gcggaagaggctaccactgcgtgtt

SEQ ID NO: 400251 - DNA, 25 bp, Rattus norvegicus
gcggaagaggcttccactgcgtgtt

SEQ ID NO: 400252 - DNA, 25 bp, Rattus norvegicus
gcggaagataatagtctgtctcaaa

SEQ ID NO: 400253 - DNA, 25 bp, Rattus norvegicus
gcggaagataattgtctgtctcaaa

SEQ ID NO: 400254 - DNA, 25 bp, Rattus norvegicus
gcggaagcaagaccgatcagattct

SEQ ID NO: 400255 - DNA, 25 bp, Rattus norvegicus
gcggaagcaagagcgatcagattct

SEQ ID NO: 400256 - DNA, 25 bp, Rattus norvegicus
gcggaagccagaaactaaccacgtt

SEQ ID NO: 400257 - DNA, 25 bp, Rattus norvegicus
gcggaagccagatactaaccacgtt

SEQ ID NO: 400258 - DNA, 25 bp, Rattus norvegicus
gcggaagcccttaggtgactttatg

SEQ ID NO: 400259 - DNA, 25 bp, Rattus norvegicus
gcggaagccctttggtgactttatg

SEQ ID NO: 400260 - DNA, 25 bp, Rattus norvegicus
gcggaaggaaaacctgctctctctg

SEQ ID NO: 400261 - DNA, 25 bp, Rattus norvegicus
gcggaaggaaaagctgctctctctg

SEQ ID NO: 400262 - DNA, 25 bp, Rattus norvegicus
gcggaaggacacagtacacgctttc

SEQ ID NO: 400263 - DNA, 25 bp, Rattus norvegicus
gcggaaggacactgtacacgctttc

SEQ ID NO: 400264 - DNA, 25 bp, Rattus norvegicus
gcggaagtcacaaccacaggagctt

SEQ ID NO: 400265 - DNA, 25 bp, Rattus norvegicus
gcggaagtcacatccacaggagctt

SEQ ID NO: 400266 - DNA, 25 bp, Rattus norvegicus
gcggaagtcccgaagccaacctgtg

SEQ ID NO: 400267 - DNA, 25 bp, Rattus norvegicus
gcggaagtcccgtagccaacctgtg

SEQ ID NO: 400268 - DNA, 25 bp, Rattus norvegicus
gcggaagtctgcacccgggcgaaat

SEQ ID NO: 400269 - DNA, 25 bp, Rattus norvegicus
gcggaagtctgctcccgggcgaaat

SEQ ID NO: 400270 - DNA, 25 bp, Rattus norvegicus
gcggaataacaacttgtccctagca

SEQ ID NO: 400271 - DNA, 25 bp, Rattus norvegicus
gcggaataacaagttgtccctagca

SEQ ID NO: 400272 - DNA, 25 bp, Rattus norvegicus
gcggaatatccgatatggtttcaat

SEQ ID NO: 400273 - DNA, 25 bp, Rattus norvegicus
gcggaatatccgttatggtttcaat

SEQ ID NO: 400274 - DNA, 25 bp, Rattus norvegicus
gcggaatgacatacatggttcacaa

SEQ ID NO: 400275 - DNA, 25 bp, Rattus norvegicus
gcggaatgacattcatggttcacaa

SEQ ID NO: 400276 - DNA, 25 bp, Rattus norvegicus
gcggaatgtctcagctcgaatgggc

SEQ ID NO: 400277 - DNA, 25 bp, Rattus norvegicus
gcggaatgtctctgctcgaatgggc

SEQ ID NO: 400278 - DNA, 25 bp, Rattus norvegicus
gcggaatgtggcagtatgcttctac

SEQ ID NO: 400279 - DNA, 25 bp, Rattus norvegicus
gcggaatgtggctgtatgcttctac

SEQ ID NO: 400280 - DNA, 25 bp, Rattus norvegicus
gcggaattgcttatgttgccataaa

SEQ ID NO: 400281 - DNA, 25 bp, Rattus norvegicus
gcggaattgcttttgttgccataaa

SEQ ID NO: 400282 - DNA, 25 bp, Rattus norvegicus
gcggacaaaatactcagacctatag

SEQ ID NO: 400283 - DNA, 25 bp, Rattus norvegicus
gcggacaaaatagtcagacctatag

SEQ ID NO: 400284 - DNA, 25 bp, Rattus norvegicus
gcggacactctgcagggcattccat

SEQ ID NO: 400285 - DNA, 25 bp, Rattus norvegicus
gcggacactctggagggcattccat

SEQ ID NO: 400286 - DNA, 25 bp, Rattus norvegicus
gcggacactgtcattcatacaacta

SEQ ID NO: 400287 - DNA, 25 bp, Rattus norvegicus
gcggacactgtctttcatacaacta

SEQ ID NO: 400288 - DNA, 25 bp, Rattus norvegicus
gcggacagcatcattctgcctgaag

SEQ ID NO: 400289 - DNA, 25 bp, Rattus norvegicus
gcggacagcatctttctgcctgaag

SEQ ID NO: 400290 - DNA, 25 bp, Rattus norvegicus
gcggacatcattcgagcggctctga

SEQ ID NO: 400291 - DNA, 25 bp, Rattus norvegicus
gcggacatcattggagcggctctga

SEQ ID NO: 400292 - DNA, 25 bp, Rattus norvegicus
gcggacatccttattcgaatgctaa

SEQ ID NO: 400293 - DNA, 25 bp, Rattus norvegicus
gcggacatcctttttcgaatgctaa

SEQ ID NO: 400294 - DNA, 25 bp, Rattus norvegicus
gcggacatgctcacatcagtgcaat

SEQ ID NO: 400295 - DNA, 25 bp, Rattus norvegicus
gcggacatgctctcatcagtgcaat

SEQ ID NO: 400296 - DNA, 25 bp, Rattus norvegicus
gcggacatgttaactttgccatcag

SEQ ID NO: 400297 - DNA, 25 bp, Rattus norvegicus
gcggacatgttatctttgccatcag

SEQ ID NO: 400298 - DNA, 25 bp, Rattus norvegicus
gcggacatgttgacttctcctgaca

SEQ ID NO: 400299 - DNA, 25 bp, Rattus norvegicus
gcggacatgttgtcttctcctgaca

SEQ ID NO: 400300 - DNA, 25 bp, Rattus norvegicus
gcggacatttcacgatttgcagccc

SEQ ID NO: 400301 - DNA, 25 bp, Rattus norvegicus
gcggacatttcaggatttgcagccc

SEQ ID NO: 400302 - DNA, 25 bp, Rattus norvegicus
gcggaccacctgatgaaagctcatt

SEQ ID NO: 400303 - DNA, 25 bp, Rattus norvegicus
gcggaccacctgttgaaagctcatt

SEQ ID NO: 400304 - DNA, 25 bp, Rattus norvegicus
gcggacccctttcaagtatttatgc

SEQ ID NO: 400305 - DNA, 25 bp, Rattus norvegicus
gcggacccctttgaagtatttatgc

SEQ ID NO: 400306 - DNA, 25 bp, Rattus norvegicus
gcggacctacatccgtgccatagag

SEQ ID NO: 400307 - DNA, 25 bp, Rattus norvegicus
gcggacctacatgcgtgccatagag

SEQ ID NO: 400308 - DNA, 25 bp, Rattus norvegicus
gcggacctgcacagagtggaccaca

SEQ ID NO: 400309 - DNA, 25 bp, Rattus norvegicus
gcggacctgcactgagtggaccaca

SEQ ID NO: 400310 - DNA, 25 bp, Rattus norvegicus
gcggacgactagagttgggcctaca

SEQ ID NO: 400311 - DNA, 25 bp, Rattus norvegicus
gcggacgactagtgttgggcctaca

SEQ ID NO: 400312 - DNA, 25 bp, Rattus norvegicus
gcggacgcatctaagagctctcagg

SEQ ID NO: 400313 - DNA, 25 bp, Rattus norvegicus
gcggacgcatcttagagctctcagg

SEQ ID NO: 400314 - DNA, 25 bp, Rattus norvegicus
gcggacggcccgcagcaccagaggg

SEQ ID NO: 400315 - DNA, 25 bp, Rattus norvegicus
gcggacggcccggagcaccagaggg

SEQ ID NO: 400316 - DNA, 25 bp, Rattus norvegicus
gcggactagactcgcctggtactca

SEQ ID NO: 400317 - DNA, 25 bp, Rattus norvegicus
gcggactagactggcctggtactca

SEQ ID NO: 400318 - DNA, 25 bp, Rattus norvegicus
gcggactgagtcaggtgcgatgctg

SEQ ID NO: 400319 - DNA, 25 bp, Rattus norvegicus
gcggactgagtctggtgcgatgctg

SEQ ID NO: 400320 - DNA, 25 bp, Rattus norvegicus
gcggactgcagtacttcacgaggag

SEQ ID NO: 400321 - DNA, 25 bp, Rattus norvegicus
gcggactgcagttcttcacgaggag

SEQ ID NO: 400322 - DNA, 25 bp, Rattus norvegicus
gcggactggcccagagtgacatgct

SEQ ID NO: 400323 - DNA, 25 bp, Rattus norvegicus
gcggactggccctgagtgacatgct

SEQ ID NO: 400324 - DNA, 25 bp, Rattus norvegicus
gcggactgtccgcaaataccaggag

SEQ ID NO: 400325 - DNA, 25 bp, Rattus norvegicus
gcggactgtccggaaataccaggag

SEQ ID NO: 400326 - DNA, 25 bp, Rattus norvegicus
gcggactgtgtcattccaagcgaag

SEQ ID NO: 400327 - DNA, 25 bp, Rattus norvegicus
gcggactgtgtctttccaagcgaag

SEQ ID NO: 400328 - DNA, 25 bp, Rattus norvegicus
gcggacttatctactttttgcaggc

SEQ ID NO: 400329 - DNA, 25 bp, Rattus norvegicus
gcggacttatcttctttttgcaggc

SEQ ID NO: 400330 - DNA, 25 bp, Rattus norvegicus
gcggacttcagtatccaagaccaat

SEQ ID NO: 400331 - DNA, 25 bp, Rattus norvegicus
gcggacttcagtttccaagaccaat

SEQ ID NO: 400332 - DNA, 25 bp, Rattus norvegicus
gcggacttgtgcaattcctttacaa

SEQ ID NO: 400333 - DNA, 25 bp, Rattus norvegicus
gcggacttgtgctattcctttacaa

SEQ ID NO: 400334 - DNA, 25 bp, Rattus norvegicus
gcggacttttaacctgctgtgttga

SEQ ID NO: 400335 - DNA, 25 bp, Rattus norvegicus
gcggacttttaagctgctgtgttga

SEQ ID NO: 400336 - DNA, 25 bp, Rattus norvegicus
gcggagaacaatcccaccatctatg

SEQ ID NO: 400337 - DNA, 25 bp, Rattus norvegicus
gcggagaacaatgccaccatctatg

SEQ ID NO: 400338 - DNA, 25 bp, Rattus norvegicus
gcggagacaggaactgccaatgtta

SEQ ID NO: 400339 - DNA, 25 bp, Rattus norvegicus
gcggagacaggatctgccaatgtta

SEQ ID NO: 400340 - DNA, 25 bp, Rattus norvegicus
gcggagaccattacaatctgtgact

SEQ ID NO: 400341 - DNA, 25 bp, Rattus norvegicus
gcggagaccatttcaatctgtgact

SEQ ID NO: 400342 - DNA, 25 bp, Rattus norvegicus
gcggagaccctgataactactatgt

SEQ ID NO: 400343 - DNA, 25 bp, Rattus norvegicus
gcggagaccctgttaactactatgt

SEQ ID NO: 400344 - DNA, 25 bp, Rattus norvegicus
gcggagactgtcaggcttgagataa

SEQ ID NO: 400345 - DNA, 25 bp, Rattus norvegicus
gcggagactgtctggcttgagataa

SEQ ID NO: 400346 - DNA, 25 bp, Rattus norvegicus
gcggagagaaacagtcaccttgaac

SEQ ID NO: 400347 - DNA, 25 bp, Rattus norvegicus
gcggagagaaactgtcaccttgaac

SEQ ID NO: 400348 - DNA, 25 bp, Rattus norvegicus
gcggagagagaaaaacctcctgtct

SEQ ID NO: 400349 - DNA, 25 bp, Rattus norvegicus
gcggagagagaataacctcctgtct

SEQ ID NO: 400350 - DNA, 25 bp, Rattus norvegicus
gcggagatagatactggatcagacc

SEQ ID NO: 400351 - DNA, 25 bp, Rattus norvegicus
gcggagatagattctggatcagacc

SEQ ID NO: 400352 - DNA, 25 bp, Rattus norvegicus
gcggagatccagatagcaggcccaa

SEQ ID NO: 400353 - DNA, 25 bp, Rattus norvegicus
gcggagatccagttagcaggcccaa

SEQ ID NO: 400354 - DNA, 25 bp, Rattus norvegicus
gcggagatctcaaaaggccctaccc

SEQ ID NO: 400355 - DNA, 25 bp, Rattus norvegicus
gcggagatctcataaggccctaccc

SEQ ID NO: 400356 - DNA, 25 bp, Rattus norvegicus
gcggagcaggtgaaatgcgcctccc

SEQ ID NO: 400357 - DNA, 25 bp, Rattus norvegicus
gcggagcaggtgtaatgcgcctccc

SEQ ID NO: 400358 - DNA, 25 bp, Rattus norvegicus
gcggagccactcagaaaaggactct

SEQ ID NO: 400359 - DNA, 25 bp, Rattus norvegicus
gcggagccactctgaaaaggactct

SEQ ID NO: 400360 - DNA, 25 bp, Rattus norvegicus
gcggagcccaaacccggatactact

SEQ ID NO: 400361 - DNA, 25 bp, Rattus norvegicus
gcggagcccaaagccggatactact

SEQ ID NO: 400362 - DNA, 25 bp, Rattus norvegicus
gcggagcctgggacgtcttgctcct

SEQ ID NO: 400363 - DNA, 25 bp, Rattus norvegicus
gcggagcctgggtcgtcttgctcct

SEQ ID NO: 400364 - DNA, 25 bp, Rattus norvegicus
gcggagcgagccactgaacagcttt

SEQ ID NO: 400365 - DNA, 25 bp, Rattus norvegicus
gcggagcgagcctctgaacagcttt

SEQ ID NO: 400366 - DNA, 25 bp, Rattus norvegicus
gcggagcgcgtcacgcagcagctct

SEQ ID NO: 400367 - DNA, 25 bp, Rattus norvegicus
gcggagcgcgtctcgcagcagctct

SEQ ID NO: 400368 - DNA, 25 bp, Rattus norvegicus
gcggagcggcggcagctaaccagat

SEQ ID NO: 400369 - DNA, 25 bp, Rattus norvegicus
gcggagcggcgggagctaaccagat

SEQ ID NO: 400370 - DNA, 25 bp, Rattus norvegicus
gcggagctcatgctttccaaaggca

SEQ ID NO: 400371 - DNA, 25 bp, Rattus norvegicus
gcggagctcatggtttccaaaggca

SEQ ID NO: 400372 - DNA, 25 bp, Rattus norvegicus
gcggaggacttacccgatatgtcat

SEQ ID NO: 400373 - DNA, 25 bp, Rattus norvegicus
gcggaggacttagccgatatgtcat

SEQ ID NO: 400374 - DNA, 25 bp, Rattus norvegicus
gcggaggccagaccaaggtcctatt

SEQ ID NO: 400375 - DNA, 25 bp, Rattus norvegicus
gcggaggccagagcaaggtcctatt

SEQ ID NO: 400376 - DNA, 25 bp, Rattus norvegicus
gcggaggcccagaccagcaattaag

SEQ ID NO: 400377 - DNA, 25 bp, Rattus norvegicus
gcggaggcccagagatcagatgcat

SEQ ID NO: 400378 - DNA, 25 bp, Rattus norvegicus
gcggaggcccagtccagcaattaag

SEQ ID NO: 400379 - DNA, 25 bp, Rattus norvegicus
gcggaggcccagtgatcagatgcat

SEQ ID NO: 400380 - DNA, 25 bp, Rattus norvegicus
gcggaggcgcacagagagcattaac

SEQ ID NO: 400381 - DNA, 25 bp, Rattus norvegicus
gcggaggcgcactgagagcattaac

SEQ ID NO: 400382 - DNA, 25 bp, Rattus norvegicus
gcggaggcgtccatgaacgatctcg

SEQ ID NO: 400383 - DNA, 25 bp, Rattus norvegicus
gcggaggcgtccttgaacgatctcg

SEQ ID NO: 400384 - DNA, 25 bp, Rattus norvegicus
gcggagggaaaacatgcagaatatc

SEQ ID NO: 400385 - DNA, 25 bp, Rattus norvegicus
gcggagggaaaagatgcagaatatc

SEQ ID NO: 400386 - DNA, 25 bp, Rattus norvegicus
gcggagggagtcactcaaacttctc

SEQ ID NO: 400387 - DNA, 25 bp, Rattus norvegicus
gcggagggagtctctcaaacttctc

SEQ ID NO: 400388 - DNA, 25 bp, Rattus norvegicus
gcggaggttaggatcctgtagctaa

SEQ ID NO: 400389 - DNA, 25 bp, Rattus norvegicus
gcggaggttaggttcctgtagctaa

SEQ ID NO: 400390 - DNA, 25 bp, Rattus norvegicus
gcggaggtttgtcgctgagcgtgat

SEQ ID NO: 400391 - DNA, 25 bp, Rattus norvegicus
gcggaggtttgtggctgagcgtgat

SEQ ID NO: 400392 - DNA, 25 bp, Rattus norvegicus
gcggagtgtgcacgccacgtacaac

SEQ ID NO: 400393 - DNA, 25 bp, Rattus norvegicus
gcggagtgtgcaggccacgtacaac

SEQ ID NO: 400394 - DNA, 25 bp, Rattus norvegicus
gcggagtgttcacatcagtagccaa

SEQ ID NO: 400395 - DNA, 25 bp, Rattus norvegicus
gcggagtgttcagatcagtagccaa

SEQ ID NO: 400396 - DNA, 25 bp, Rattus norvegicus
gcggagttctaaatggcccacgtgc

SEQ ID NO: 400397 - DNA, 25 bp, Rattus norvegicus
gcggagttctaattggcccacgtgc

SEQ ID NO: 400398 - DNA, 25 bp, Rattus norvegicus
gcggagtttgtgacccacctgggat

SEQ ID NO: 400399 - DNA, 25 bp, Rattus norvegicus
gcggagtttgtgtcccacctgggat

SEQ ID NO: 400400 - DNA, 25 bp, Rattus norvegicus
gcggataaagatccccaggacagta

SEQ ID NO: 400401 - DNA, 25 bp, Rattus norvegicus
gcggataaagatgcccaggacagta

SEQ ID NO: 400402 - DNA, 25 bp, Rattus norvegicus
gcggatagccagcacattctgcttc

SEQ ID NO: 400403 - DNA, 25 bp, Rattus norvegicus
gcggatagccaggacattctgcttc

SEQ ID NO: 400404 - DNA, 25 bp, Rattus norvegicus
gcggatatggacaggccgtcttccc

SEQ ID NO: 400405 - DNA, 25 bp, Rattus norvegicus
gcggatatggactggccgtcttccc

SEQ ID NO: 400406 - DNA, 25 bp, Rattus norvegicus
gcggatatgtacaggctctagttta

SEQ ID NO: 400407 - DNA, 25 bp, Rattus norvegicus
gcggatatgtactggctctagttta

SEQ ID NO: 400408 - DNA, 25 bp, Rattus norvegicus
gcggatcaatggcatgctcatggca

SEQ ID NO: 400409 - DNA, 25 bp, Rattus norvegicus
gcggatcaatgggatgctcatggca

SEQ ID NO: 400410 - DNA, 25 bp, Rattus norvegicus
gcggatcatactctttcactttgtg

SEQ ID NO: 400411 - DNA, 25 bp, Rattus norvegicus
gcggatcatactgtttcactttgtg

SEQ ID NO: 400412 - DNA, 25 bp, Rattus norvegicus
gcggatctgaaacctctgctgtaca

SEQ ID NO: 400413 - DNA, 25 bp, Rattus norvegicus
gcggatctgaaagctctgctgtaca

SEQ ID NO: 400414 - DNA, 25 bp, Rattus norvegicus
gcggatgaatggactgtaacactgt

SEQ ID NO: 400415 - DNA, 25 bp, Rattus norvegicus
gcggatgaatggtctgtaacactgt

SEQ ID NO: 400416 - DNA, 25 bp, Rattus norvegicus
gcggatgaattacctttcaacattg

SEQ ID NO: 400417 - DNA, 25 bp, Rattus norvegicus
gcggatgaattagctttcaacattg

SEQ ID NO: 400418 - DNA, 25 bp, Rattus norvegicus
gcggatgaccagatgctgcaaggct

SEQ ID NO: 400419 - DNA, 25 bp, Rattus norvegicus
gcggatgaccagttgctgcaaggct

SEQ ID NO: 400420 - DNA, 25 bp, Rattus norvegicus
gcggatgactcacaaaagggtgcac

SEQ ID NO: 400421 - DNA, 25 bp, Rattus norvegicus
gcggatgactcagaaaagggtgcac

SEQ ID NO: 400422 - DNA, 25 bp, Rattus norvegicus
gcggatgagaccagcctggactcgt

SEQ ID NO: 400423 - DNA, 25 bp, Rattus norvegicus
gcggatgagacctgcctggactcgt

SEQ ID NO: 400424 - DNA, 25 bp, Rattus norvegicus
gcggatgcctccactattaaaatgt

SEQ ID NO: 400425 - DNA, 25 bp, Rattus norvegicus
gcggatgcctcctctattaaaatgt

SEQ ID NO: 400426 - DNA, 25 bp, Rattus norvegicus
gcggatgcgcaacccatccaggaac

SEQ ID NO: 400427 - DNA, 25 bp, Rattus norvegicus
gcggatgcgcaagccatccaggaac

SEQ ID NO: 400428 - DNA, 25 bp, Rattus norvegicus
gcggatggacgcaactgcataagag

SEQ ID NO: 400429 - DNA, 25 bp, Rattus norvegicus
gcggatggacgctactgcataagag

SEQ ID NO: 400430 - DNA, 25 bp, Rattus norvegicus
gcggatggatacagggcctcccaga

SEQ ID NO: 400431 - DNA, 25 bp, Rattus norvegicus
gcggatggatactgggcctcccaga

SEQ ID NO: 400432 - DNA, 25 bp, Rattus norvegicus
gcggatgtgctgaggtgactcaact

SEQ ID NO: 400433 - DNA, 25 bp, Rattus norvegicus
gcggatgtgctgtggtgactcaact

SEQ ID NO: 400434 - DNA, 25 bp, Rattus norvegicus
gcggattggccgagtcatgtgtatt

SEQ ID NO: 400435 - DNA, 25 bp, Rattus norvegicus
gcggattggccgtgtcatgtgtatt

SEQ ID NO: 400436 - DNA, 25 bp, Rattus norvegicus
gcggattgttacagaaacggcatat

SEQ ID NO: 400437 - DNA, 25 bp, Rattus norvegicus
gcggattgttactgaaacggcatat

SEQ ID NO: 400438 - DNA, 25 bp, Rattus norvegicus
gcggatttattgctctgcattttaa

SEQ ID NO: 400439 - DNA, 25 bp, Rattus norvegicus
gcggatttattggtctgcattttaa

SEQ ID NO: 400440 - DNA, 25 bp, Rattus norvegicus
gcggatttctcacacttgcgggaaa

SEQ ID NO: 400441 - DNA, 25 bp, Rattus norvegicus
gcggatttctcagacttgcgggaaa

SEQ ID NO: 400442 - DNA, 25 bp, Rattus norvegicus
gcggattttaaacaagcccattctt

SEQ ID NO: 400443 - DNA, 25 bp, Rattus norvegicus
gcggattttaaagaagcccattctt

SEQ ID NO: 400444 - DNA, 25 bp, Rattus norvegicus
gcggcaaccgaaaggctaagaccaa

SEQ ID NO: 400445 - DNA, 25 bp, Rattus norvegicus
gcggcaaccgaatggctaagaccaa

SEQ ID NO: 400446 - DNA, 25 bp, Rattus norvegicus
gcggcaactctacagacacgaagac

SEQ ID NO: 400447 - DNA, 25 bp, Rattus norvegicus
gcggcaactctagagacacgaagac

SEQ ID NO: 400448 - DNA, 25 bp, Rattus norvegicus
gcggcaagacatctgtgaccgtgta

SEQ ID NO: 400449 - DNA, 25 bp, Rattus norvegicus
gcggcaagacatgtgtgaccgtgta

SEQ ID NO: 400450 - DNA, 25 bp, Rattus norvegicus
gcggcaagcagtacactgacttgag

SEQ ID NO: 400451 - DNA, 25 bp, Rattus norvegicus
gcggcaagcagttcactgacttgag

SEQ ID NO: 400452 - DNA, 25 bp, Rattus norvegicus
gcggcaagccgcactgcctgggcaa

SEQ ID NO: 400453 - DNA, 25 bp, Rattus norvegicus
gcggcaagccgctctgcctgggcaa

SEQ ID NO: 400454 - DNA, 25 bp, Rattus norvegicus
gcggcaaggccaaggtcaaccagga

SEQ ID NO: 400455 - DNA, 25 bp, Rattus norvegicus
gcggcaaggccaattccagaggaga

SEQ ID NO: 400456 - DNA, 25 bp, Rattus norvegicus
gcggcaaggccatggtcaaccagga

SEQ ID NO: 400457 - DNA, 25 bp, Rattus norvegicus
gcggcaaggccatttccagaggaga

SEQ ID NO: 400458 - DNA, 25 bp, Rattus norvegicus
gcggcaaggcctatgctgagctgaa

SEQ ID NO: 400459 - DNA, 25 bp, Rattus norvegicus
gcggcaaggcctttgctgagctgaa

SEQ ID NO: 400460 - DNA, 25 bp, Rattus norvegicus
gcggcacacgacacaggcttttaat

SEQ ID NO: 400461 - DNA, 25 bp, Rattus norvegicus
gcggcacacgactcaggcttttaat

SEQ ID NO: 400462 - DNA, 25 bp, Rattus norvegicus
gcggcaccatgaaagcctgggcttt

SEQ ID NO: 400463 - DNA, 25 bp, Rattus norvegicus
gcggcaccatgatagcctgggcttt

SEQ ID NO: 400464 - DNA, 25 bp, Rattus norvegicus
gcggcacctacccaaatctgatgtg

SEQ ID NO: 400465 - DNA, 25 bp, Rattus norvegicus
gcggcacctaccgaaatctgatgtg

SEQ ID NO: 400466 - DNA, 25 bp, Rattus norvegicus
gcggcacgagctctacaaggcacat

SEQ ID NO: 400467 - DNA, 25 bp, Rattus norvegicus
gcggcacgagctgtacaaggcacat

SEQ ID NO: 400468 - DNA, 25 bp, Rattus norvegicus
gcggcacgtccacgccaggagccat

SEQ ID NO: 400469 - DNA, 25 bp, Rattus norvegicus
gcggcacgtccaggccaggagccat

SEQ ID NO: 400470 - DNA, 25 bp, Rattus norvegicus
gcggcactgcccatttatttatatt

SEQ ID NO: 400471 - DNA, 25 bp, Rattus norvegicus
gcggcactgcccttttatttatatt

SEQ ID NO: 400472 - DNA, 25 bp, Rattus norvegicus
gcggcagacacaccaggcatctata

SEQ ID NO: 400473 - DNA, 25 bp, Rattus norvegicus
gcggcagacacagcaggcatctata

SEQ ID NO: 400474 - DNA, 25 bp, Rattus norvegicus
gcggcagacctaagatgctctcaga

SEQ ID NO: 400475 - DNA, 25 bp, Rattus norvegicus
gcggcagacctatgatgctctcaga

SEQ ID NO: 400476 - DNA, 25 bp, Rattus norvegicus
gcggcagcacaacggtcaagagaat

SEQ ID NO: 400477 - DNA, 25 bp, Rattus norvegicus
gcggcagcacaagggtcaagagaat

SEQ ID NO: 400478 - DNA, 25 bp, Rattus norvegicus
gcggcagcagcgctcgggagcgtct

SEQ ID NO: 400479 - DNA, 25 bp, Rattus norvegicus
gcggcagcagcggtcgggagcgtct

SEQ ID NO: 400480 - DNA, 25 bp, Rattus norvegicus
gcggcagcagctcgatgatctccga

SEQ ID NO: 400481 - DNA, 25 bp, Rattus norvegicus
gcggcagcagctggatgatctccga

SEQ ID NO: 400482 - DNA, 25 bp, Rattus norvegicus
gcggcagctcagattttggaaaagt

SEQ ID NO: 400483 - DNA, 25 bp, Rattus norvegicus
gcggcagctcagtttttggaaaagt

SEQ ID NO: 400484 - DNA, 25 bp, Rattus norvegicus
gcggcagcttttccagtgccagtca

SEQ ID NO: 400485 - DNA, 25 bp, Rattus norvegicus
gcggcagcttttgcagtgccagtca

SEQ ID NO: 400486 - DNA, 25 bp, Rattus norvegicus
gcggcagggaacactacaagtgttt

SEQ ID NO: 400487 - DNA, 25 bp, Rattus norvegicus
gcggcagggaactctacaagtgttt

SEQ ID NO: 400488 - DNA, 25 bp, Rattus norvegicus
gcggcagtaaataccagttctttga

SEQ ID NO: 400489 - DNA, 25 bp, Rattus norvegicus
gcggcagtaaattccagttctttga

SEQ ID NO: 400490 - DNA, 25 bp, Rattus norvegicus
gcggcagtcaaacctcagtctatga

SEQ ID NO: 400491 - DNA, 25 bp, Rattus norvegicus
gcggcagtcaaagctcagtctatga

SEQ ID NO: 400492 - DNA, 25 bp, Rattus norvegicus
gcggcagtgctgatcattactggaa

SEQ ID NO: 400493 - DNA, 25 bp, Rattus norvegicus
gcggcagtgctgttcattactggaa

SEQ ID NO: 400494 - DNA, 25 bp, Rattus norvegicus
gcggcagttgtaaggccaggacatt

SEQ ID NO: 400495 - DNA, 25 bp, Rattus norvegicus
gcggcagttgtatggccaggacatt

SEQ ID NO: 400496 - DNA, 25 bp, Rattus norvegicus
gcggcagttttgctcttagagctct

SEQ ID NO: 400497 - DNA, 25 bp, Rattus norvegicus
gcggcagttttggtcttagagctct

SEQ ID NO: 400498 - DNA, 25 bp, Rattus norvegicus
gcggcatcagatcttgcctaaggat

SEQ ID NO: 400499 - DNA, 25 bp, Rattus norvegicus
gcggcatcagatgttgcctaaggat

SEQ ID NO: 400500 - DNA, 25 bp, Rattus norvegicus
gcggcatcagctacctggtgtatga

SEQ ID NO: 400501 - DNA, 25 bp, Rattus norvegicus
gcggcatcagcttcctggtgtatga

SEQ ID NO: 400502 - DNA, 25 bp, Rattus norvegicus
gcggcatgccccagagttagtcgat

SEQ ID NO: 400503 - DNA, 25 bp, Rattus norvegicus
gcggcatgcccctgagttagtcgat

SEQ ID NO: 400504 - DNA, 25 bp, Rattus norvegicus
gcggcatgccttcttcagcagaaga

SEQ ID NO: 400505 - DNA, 25 bp, Rattus norvegicus
gcggcatgccttgttcagcagaaga

SEQ ID NO: 400506 - DNA, 25 bp, Rattus norvegicus
gcggcatggtgcaagttgaataacc

SEQ ID NO: 400507 - DNA, 25 bp, Rattus norvegicus
gcggcatggtgctagttgaataacc

SEQ ID NO: 400508 - DNA, 25 bp, Rattus norvegicus
gcggcattcatgacactgtgttgtc

SEQ ID NO: 400509 - DNA, 25 bp, Rattus norvegicus
gcggcattcatgtcactgtgttgtc

SEQ ID NO: 400510 - DNA, 25 bp, Rattus norvegicus
gcggcattctccaagctttaattga

SEQ ID NO: 400511 - DNA, 25 bp, Rattus norvegicus
gcggcattctcctagctttaattga

SEQ ID NO: 400512 - DNA, 25 bp, Rattus norvegicus
gcggcatttactagggtcctgtata

SEQ ID NO: 400513 - DNA, 25 bp, Rattus norvegicus
gcggcatttacttgggtcctgtata

SEQ ID NO: 400514 - DNA, 25 bp, Rattus norvegicus
gcggccaaaggcagcgagatgcatc

SEQ ID NO: 400515 - DNA, 25 bp, Rattus norvegicus
gcggccaaaggctgcgagatgcatc

SEQ ID NO: 400516 - DNA, 25 bp, Rattus norvegicus
gcggccaaccgacaagactgtcttc

SEQ ID NO: 400517 - DNA, 25 bp, Rattus norvegicus
gcggccaaccgagaagactgtcttc

SEQ ID NO: 400518 - DNA, 25 bp, Rattus norvegicus
gcggccaatgctacctggtggagaa

SEQ ID NO: 400519 - DNA, 25 bp, Rattus norvegicus
gcggccaatgcttcctggtggagaa

SEQ ID NO: 400520 - DNA, 25 bp, Rattus norvegicus
gcggccaatgtgagtctgctgtagt

SEQ ID NO: 400521 - DNA, 25 bp, Rattus norvegicus
gcggccaatgtgtgtctgctgtagt

SEQ ID NO: 400522 - DNA, 25 bp, Rattus norvegicus
gcggccacaaatctcttaggtctaa

SEQ ID NO: 400523 - DNA, 25 bp, Rattus norvegicus
gcggccacaaatgtcttaggtctaa

SEQ ID NO: 400524 - DNA, 25 bp, Rattus norvegicus
gcggccacacacagagtgtgctgat

SEQ ID NO: 400525 - DNA, 25 bp, Rattus norvegicus
gcggccacacactgagtgtgctgat

SEQ ID NO: 400526 - DNA, 25 bp, Rattus norvegicus
gcggccacattgaactgatcctcag

SEQ ID NO: 400527 - DNA, 25 bp, Rattus norvegicus
gcggccacattgtactgatcctcag

SEQ ID NO: 400528 - DNA, 25 bp, Rattus norvegicus
gcggccaccacacgagcaatattgt

SEQ ID NO: 400529 - DNA, 25 bp, Rattus norvegicus
gcggccaccacaggagcaatattgt

SEQ ID NO: 400530 - DNA, 25 bp, Rattus norvegicus
gcggccacggcgagtatctgcagca

SEQ ID NO: 400531 - DNA, 25 bp, Rattus norvegicus
gcggccacggcgtgtatctgcagca

SEQ ID NO: 400532 - DNA, 25 bp, Rattus norvegicus
gcggccagactgctttctagcaagt

SEQ ID NO: 400533 - DNA, 25 bp, Rattus norvegicus
gcggccagactggtttctagcaagt

SEQ ID NO: 400534 - DNA, 25 bp, Rattus norvegicus
gcggccagcacgaactggttgatca

SEQ ID NO: 400535 - DNA, 25 bp, Rattus norvegicus
gcggccagcacgtactggttgatca

SEQ ID NO: 400536 - DNA, 25 bp, Rattus norvegicus
gcggccagtgatccccttaacaaga

SEQ ID NO: 400537 - DNA, 25 bp, Rattus norvegicus
gcggccagtgatgcccttaacaaga

SEQ ID NO: 400538 - DNA, 25 bp, Rattus norvegicus
gcggccataactcactgctgagaga

SEQ ID NO: 400539 - DNA, 25 bp, Rattus norvegicus
gcggccataactgactgctgagaga

SEQ ID NO: 400540 - DNA, 25 bp, Rattus norvegicus
gcggccatggcacctcaagagtttt

SEQ ID NO: 400541 - DNA, 25 bp, Rattus norvegicus
gcggccatggcagctcaagagtttt

SEQ ID NO: 400542 - DNA, 25 bp, Rattus norvegicus
gcggccattgcgattgttaagttcc

SEQ ID NO: 400543 - DNA, 25 bp, Rattus norvegicus
gcggccattgcgtttgttaagttcc

SEQ ID NO: 400544 - DNA, 25 bp, Rattus norvegicus
gcggccattggtaaatatgtctttc

SEQ ID NO: 400545 - DNA, 25 bp, Rattus norvegicus
gcggccattggttaatatgtctttc

SEQ ID NO: 400546 - DNA, 25 bp, Rattus norvegicus
gcggcccaagtcattagccctaagg

SEQ ID NO: 400547 - DNA, 25 bp, Rattus norvegicus
gcggcccaagtctttagccctaagg

SEQ ID NO: 400548 - DNA, 25 bp, Rattus norvegicus
gcggcccctgatatctgaggtgtga

SEQ ID NO: 400549 - DNA, 25 bp, Rattus norvegicus
gcggcccctgatttctgaggtgtga

SEQ ID NO: 400550 - DNA, 25 bp, Rattus norvegicus
gcggccccttctaattttatacaat

SEQ ID NO: 400551 - DNA, 25 bp, Rattus norvegicus
gcggccccttcttattttatacaat

SEQ ID NO: 400552 - DNA, 25 bp, Rattus norvegicus
gcggcccgcagcatgtaaaaccaga

SEQ ID NO: 400553 - DNA, 25 bp, Rattus norvegicus
gcggcccgcagcttgtaaaaccaga

SEQ ID NO: 400554 - DNA, 25 bp, Rattus norvegicus
gcggcccgggatcgcggcggctgag

SEQ ID NO: 400555 - DNA, 25 bp, Rattus norvegicus
gcggcccgggatggcggcggctgag

SEQ ID NO: 400556 - DNA, 25 bp, Rattus norvegicus
gcggccctactcagacaggcaggac

SEQ ID NO: 400557 - DNA, 25 bp, Rattus norvegicus
gcggccctactctgacaggcaggac

SEQ ID NO: 400558 - DNA, 25 bp, Rattus norvegicus
gcggccgctaagaaagtaagacgtc

SEQ ID NO: 400559 - DNA, 25 bp, Rattus norvegicus
gcggccgctaagtaagtaagacgtc

SEQ ID NO: 400560 - DNA, 25 bp, Rattus norvegicus
gcggccggacctcgatgagatccat

SEQ ID NO: 400561 - DNA, 25 bp, Rattus norvegicus
gcggccggacctggatgagatccat

SEQ ID NO: 400562 - DNA, 25 bp, Rattus norvegicus
gcggccggcggcagcgggcgcgcgt

SEQ ID NO: 400563 - DNA, 25 bp, Rattus norvegicus
gcggccggcggctgcgggcgcgcgt

SEQ ID NO: 400564 - DNA, 25 bp, Rattus norvegicus
gcggccgggaccaggtcttctcaat

SEQ ID NO: 400565 - DNA, 25 bp, Rattus norvegicus
gcggccgggacctggtcttctcaat

SEQ ID NO: 400566 - DNA, 25 bp, Rattus norvegicus
gcggccgtgggtatttggcatatac

SEQ ID NO: 400567 - DNA, 25 bp, Rattus norvegicus
gcggccgtgggtttttggcatatac

SEQ ID NO: 400568 - DNA, 25 bp, Rattus norvegicus
gcggccgtggtcattgagcattgta

SEQ ID NO: 400569 - DNA, 25 bp, Rattus norvegicus
gcggccgtggtctttgagcattgta

SEQ ID NO: 400570 - DNA, 25 bp, Rattus norvegicus
gcggcctaagttacagcagctggtc

SEQ ID NO: 400571 - DNA, 25 bp, Rattus norvegicus
gcggcctaagtttcagcagctggtc

SEQ ID NO: 400572 - DNA, 25 bp, Rattus norvegicus
gcggcctattgcaacgcttagtgac

SEQ ID NO: 400573 - DNA, 25 bp, Rattus norvegicus
gcggcctattgctacgcttagtgac

SEQ ID NO: 400574 - DNA, 25 bp, Rattus norvegicus
gcggcctcacacatgttttagaaac

SEQ ID NO: 400575 - DNA, 25 bp, Rattus norvegicus
gcggcctcacacttgttttagaaac

SEQ ID NO: 400576 - DNA, 25 bp, Rattus norvegicus
gcggcctccacaaactaaatgttct

SEQ ID NO: 400577 - DNA, 25 bp, Rattus norvegicus
gcggcctccacatactaaatgttct

SEQ ID NO: 400578 - DNA, 25 bp, Rattus norvegicus
gcggcctccataaggttactactga

SEQ ID NO: 400579 - DNA, 25 bp, Rattus norvegicus
gcggcctccatatggttactactga

SEQ ID NO: 400580 - DNA, 25 bp, Rattus norvegicus
gcggcctccggtcgaaattcgagac

SEQ ID NO: 400581 - DNA, 25 bp, Rattus norvegicus
gcggcctccggtggaaattcgagac

SEQ ID NO: 400582 - DNA, 25 bp, Rattus norvegicus
gcggcctcctctacattatttaatg

SEQ ID NO: 400583 - DNA, 25 bp, Rattus norvegicus
gcggcctcctcttcattatttaatg

SEQ ID NO: 400584 - DNA, 25 bp, Rattus norvegicus
gcggcctcggctcgtaaggtcacaa

SEQ ID NO: 400585 - DNA, 25 bp, Rattus norvegicus
gcggcctcggctggtaaggtcacaa

SEQ ID NO: 400586 - DNA, 25 bp, Rattus norvegicus
gcggcctctcttattattgttccaa

SEQ ID NO: 400587 - DNA, 25 bp, Rattus norvegicus
gcggcctctctttttattgttccaa

SEQ ID NO: 400588 - DNA, 25 bp, Rattus norvegicus
gcggcctgctgcctacagtagtgac

SEQ ID NO: 400589 - DNA, 25 bp, Rattus norvegicus
gcggcctgctgcgtacagtagtgac

SEQ ID NO: 400590 - DNA, 25 bp, Rattus norvegicus
gcggcctggactacatcaaagtcac

SEQ ID NO: 400591 - DNA, 25 bp, Rattus norvegicus
gcggcctggacttcatcaaagtcac

SEQ ID NO: 400592 - DNA, 25 bp, Rattus norvegicus
gcggccttactgaagaccctgaaaa

SEQ ID NO: 400593 - DNA, 25 bp, Rattus norvegicus
gcggccttactgtagaccctgaaaa

SEQ ID NO: 400594 - DNA, 25 bp, Rattus norvegicus
gcggccttcttgcttatgacattaa

SEQ ID NO: 400595 - DNA, 25 bp, Rattus norvegicus
gcggccttcttggttatgacattaa

SEQ ID NO: 400596 - DNA, 25 bp, Rattus norvegicus
gcggcgaccgagactaggagtctaa

SEQ ID NO: 400597 - DNA, 25 bp, Rattus norvegicus
gcggcgaccgagtctaggagtctaa

SEQ ID NO: 400598 - DNA, 25 bp, Rattus norvegicus
gcggcgacggacacgttcataggaa

SEQ ID NO: 400599 - DNA, 25 bp, Rattus norvegicus
gcggcgacggactcgttcataggaa

SEQ ID NO: 400600 - DNA, 25 bp, Rattus norvegicus
gcggcgagaggaccgggcacaccca

SEQ ID NO: 400601 - DNA, 25 bp, Rattus norvegicus
gcggcgagaggagcgggcacaccca

SEQ ID NO: 400602 - DNA, 25 bp, Rattus norvegicus
gcggcgagatctcggctcgggttga

SEQ ID NO: 400603 - DNA, 25 bp, Rattus norvegicus
gcggcgagatctgggctcgggttga

SEQ ID NO: 400604 - DNA, 25 bp, Rattus norvegicus
gcggcgaggacgaaactcagcacga

SEQ ID NO: 400605 - DNA, 25 bp, Rattus norvegicus
gcggcgaggacgtaactcagcacga

SEQ ID NO: 400606 - DNA, 25 bp, Rattus norvegicus
gcggcgcacagacggttagatactt

SEQ ID NO: 400607 - DNA, 25 bp, Rattus norvegicus
gcggcgcacagagggttagatactt

SEQ ID NO: 400608 - DNA, 25 bp, Rattus norvegicus
gcggcgcactccaatagtcatttta

SEQ ID NO: 400609 - DNA, 25 bp, Rattus norvegicus
gcggcgcactcctatagtcatttta

SEQ ID NO: 400610 - DNA, 25 bp, Rattus norvegicus
gcggcgccgcaaccgctttaagcga

SEQ ID NO: 400611 - DNA, 25 bp, Rattus norvegicus
gcggcgccgcaagcgctttaagcga

SEQ ID NO: 400612 - DNA, 25 bp, Rattus norvegicus
gcggcgccgctactttgaggtgagt

SEQ ID NO: 400613 - DNA, 25 bp, Rattus norvegicus
gcggcgccgctagtttgaggtgagt

SEQ ID NO: 400614 - DNA, 25 bp, Rattus norvegicus
gcggcgcgaccgagctctatctgcg

SEQ ID NO: 400615 - DNA, 25 bp, Rattus norvegicus
gcggcgcgaccgtgctctatctgcg

SEQ ID NO: 400616 - DNA, 25 bp, Rattus norvegicus
gcggcgcgcggcacgcaactaaagt

SEQ ID NO: 400617 - DNA, 25 bp, Rattus norvegicus
gcggcgcgcggctcgcaactaaagt

SEQ ID NO: 400618 - DNA, 25 bp, Rattus norvegicus
gcggcgcggaacactggaatgcata

SEQ ID NO: 400619 - DNA, 25 bp, Rattus norvegicus
gcggcgcggaactctggaatgcata

SEQ ID NO: 400620 - DNA, 25 bp, Rattus norvegicus
gcggcgcggccgctacttgtaatcc

SEQ ID NO: 400621 - DNA, 25 bp, Rattus norvegicus
gcggcgcggccggtacttgtaatcc

SEQ ID NO: 400622 - DNA, 25 bp, Rattus norvegicus
gcggcgctattcaaactcctatgga

SEQ ID NO: 400623 - DNA, 25 bp, Rattus norvegicus
gcggcgctattctaactcctatgga

SEQ ID NO: 400624 - DNA, 25 bp, Rattus norvegicus
gcggcgctgaacatgtttctcagta

SEQ ID NO: 400625 - DNA, 25 bp, Rattus norvegicus
gcggcgctgaacttgtttctcagta

SEQ ID NO: 400626 - DNA, 25 bp, Rattus norvegicus
gcggcggaatcacaggctgattacc

SEQ ID NO: 400627 - DNA, 25 bp, Rattus norvegicus
gcggcggaatcagaggctgattacc

SEQ ID NO: 400628 - DNA, 25 bp, Rattus norvegicus
gcggcggacctacatgcgtgccata

SEQ ID NO: 400629 - DNA, 25 bp, Rattus norvegicus
gcggcggacctagatgcgtgccata

SEQ ID NO: 400630 - DNA, 25 bp, Rattus norvegicus
gcggcggaggctcattccgtttccc

SEQ ID NO: 400631 - DNA, 25 bp, Rattus norvegicus
gcggcggaggctgattccgtttccc

SEQ ID NO: 400632 - DNA, 25 bp, Rattus norvegicus
gcggcggagtcccactgagggtggt

SEQ ID NO: 400633 - DNA, 25 bp, Rattus norvegicus
gcggcggagtccgactgagggtggt

SEQ ID NO: 400634 - DNA, 25 bp, Rattus norvegicus
gcggcggcaatcctgcgcaatgaag

SEQ ID NO: 400635 - DNA, 25 bp, Rattus norvegicus
gcggcggcaatcgtgcgcaatgaag

SEQ ID NO: 400636 - DNA, 25 bp, Rattus norvegicus
gcggcgggtgctaatcttagacaac

SEQ ID NO: 400637 - DNA, 25 bp, Rattus norvegicus
gcggcgggtgcttatcttagacaac

SEQ ID NO: 400638 - DNA, 25 bp, Rattus norvegicus
gcggcggtggctacaagtcatcttc

SEQ ID NO: 400639 - DNA, 25 bp, Rattus norvegicus
gcggcggtggcttcaagtcatcttc

SEQ ID NO: 400640 - DNA, 25 bp, Rattus norvegicus
gcggcgtacagtactctgttttagt

SEQ ID NO: 400641 - DNA, 25 bp, Rattus norvegicus
gcggcgtacagttctctgttttagt

SEQ ID NO: 400642 - DNA, 25 bp, Rattus norvegicus
gcggcgtagctcattaagagggacc

SEQ ID NO: 400643 - DNA, 25 bp, Rattus norvegicus
gcggcgtagctctttaagagggacc

SEQ ID NO: 400644 - DNA, 25 bp, Rattus norvegicus
gcggcgtcacagatgctgaagccaa

SEQ ID NO: 400645 - DNA, 25 bp, Rattus norvegicus
gcggcgtcacagttgctgaagccaa

SEQ ID NO: 400646 - DNA, 25 bp, Rattus norvegicus
gcggcgtcacgtcagcggtcggaga

SEQ ID NO: 400647 - DNA, 25 bp, Rattus norvegicus
gcggcgtcacgtgagcggtcggaga

SEQ ID NO: 400648 - DNA, 25 bp, Rattus norvegicus
gcggcgtctacgaaaggctctgttg

SEQ ID NO: 400649 - DNA, 25 bp, Rattus norvegicus
gcggcgtctacgtaaggctctgttg

SEQ ID NO: 400650 - DNA, 25 bp, Rattus norvegicus
gcggcgtgcgacatgtgtaacacat

SEQ ID NO: 400651 - DNA, 25 bp, Rattus norvegicus
gcggcgtgcgacttgtgtaacacat

SEQ ID NO: 400652 - DNA, 25 bp, Rattus norvegicus
gcggctacacataccacaaagtgct

SEQ ID NO: 400653 - DNA, 25 bp, Rattus norvegicus
gcggctacacattccacaaagtgct

SEQ ID NO: 400654 - DNA, 25 bp, Rattus norvegicus
gcggctatcacgagcttgaaacctg

SEQ ID NO: 400655 - DNA, 25 bp, Rattus norvegicus
gcggctatcacgtgcttgaaacctg

SEQ ID NO: 400656 - DNA, 25 bp, Rattus norvegicus
gcggctccccttaggaaattccaag

SEQ ID NO: 400657 - DNA, 25 bp, Rattus norvegicus
gcggctcccctttggaaattccaag

SEQ ID NO: 400658 - DNA, 25 bp, Rattus norvegicus
gcggctccgacaaaggcttttgtaa

SEQ ID NO: 400659 - DNA, 25 bp, Rattus norvegicus
gcggctccgacataggcttttgtaa

SEQ ID NO: 400660 - DNA, 25 bp, Rattus norvegicus
gcggctccgattcttttggctttcc

SEQ ID NO: 400661 - DNA, 25 bp, Rattus norvegicus
gcggctccgattgttttggctttcc

SEQ ID NO: 400662 - DNA, 25 bp, Rattus norvegicus
gcggctcgcaacaaaagtgtgaaag

SEQ ID NO: 400663 - DNA, 25 bp, Rattus norvegicus
gcggctcgcaactaaagtgtgaaag

SEQ ID NO: 400664 - DNA, 25 bp, Rattus norvegicus
gcggctcgcagcagccagtttcgtt

SEQ ID NO: 400665 - DNA, 25 bp, Rattus norvegicus
gcggctcgcagctgccagtttcgtt

SEQ ID NO: 400666 - DNA, 25 bp, Rattus norvegicus
gcggctcgccttatagattaatggg

SEQ ID NO: 400667 - DNA, 25 bp, Rattus norvegicus
gcggctcgccttttagattaatggg

SEQ ID NO: 400668 - DNA, 25 bp, Rattus norvegicus
gcggctctcacaagaggcctcccgg

SEQ ID NO: 400669 - DNA, 25 bp, Rattus norvegicus
gcggctctcacatgaggcctcccgg

SEQ ID NO: 400670 - DNA, 25 bp, Rattus norvegicus
gcggctctgattcagcaagccacaa

SEQ ID NO: 400671 - DNA, 25 bp, Rattus norvegicus
gcggctctgattcatcagtcctggg

SEQ ID NO: 400672 - DNA, 25 bp, Rattus norvegicus
gcggctctgattgagcaagccacaa

SEQ ID NO: 400673 - DNA, 25 bp, Rattus norvegicus
gcggctctgattgatcagtcctggg

SEQ ID NO: 400674 - DNA, 25 bp, Rattus norvegicus
gcggctctttttaagcttttggtca

SEQ ID NO: 400675 - DNA, 25 bp, Rattus norvegicus
gcggctcttttttagcttttggtca

SEQ ID NO: 400676 - DNA, 25 bp, Rattus norvegicus
gcggctgagcatatattcccatgat

SEQ ID NO: 400677 - DNA, 25 bp, Rattus norvegicus
gcggctgagcatttattcccatgat

SEQ ID NO: 400678 - DNA, 25 bp, Rattus norvegicus
gcggctgagcctaagaactgactgc

SEQ ID NO: 400679 - DNA, 25 bp, Rattus norvegicus
gcggctgagccttagaactgactgc

SEQ ID NO: 400680 - DNA, 25 bp, Rattus norvegicus
gcggctgagggcacagcccggccga

SEQ ID NO: 400681 - DNA, 25 bp, Rattus norvegicus
gcggctgagggctcagcccggccga

SEQ ID NO: 400682 - DNA, 25 bp, Rattus norvegicus
gcggctgcactgaaaggcggtccta

SEQ ID NO: 400683 - DNA, 25 bp, Rattus norvegicus
gcggctgcactgtaaggcggtccta

SEQ ID NO: 400684 - DNA, 25 bp, Rattus norvegicus
gcggctgcagatcacataaagcttt

SEQ ID NO: 400685 - DNA, 25 bp, Rattus norvegicus
gcggctgcagatgacataaagcttt

SEQ ID NO: 400686 - DNA, 25 bp, Rattus norvegicus
gcggctgcatcaaattctctgctta

SEQ ID NO: 400687 - DNA, 25 bp, Rattus norvegicus
gcggctgcatcatattctctgctta

SEQ ID NO: 400688 - DNA, 25 bp, Rattus norvegicus
gcggctgcccttcctaagattaaat

SEQ ID NO: 400689 - DNA, 25 bp, Rattus norvegicus
gcggctgcccttgctaagattaaat

SEQ ID NO: 400690 - DNA, 25 bp, Rattus norvegicus
gcggctgctagtcttaaaattgtct

SEQ ID NO: 400691 - DNA, 25 bp, Rattus norvegicus
gcggctgctagtcttttgtttacat

SEQ ID NO: 400692 - DNA, 25 bp, Rattus norvegicus
gcggctgctagtgttaaaattgtct

SEQ ID NO: 400693 - DNA, 25 bp, Rattus norvegicus
gcggctgctagtgttttgtttacat

SEQ ID NO: 400694 - DNA, 25 bp, Rattus norvegicus
gcggctgctccaagcgcccgagaag

SEQ ID NO: 400695 - DNA, 25 bp, Rattus norvegicus
gcggctgctccatgcgcccgagaag

SEQ ID NO: 400696 - DNA, 25 bp, Rattus norvegicus
gcggctgctggcagaatgtttacac

SEQ ID NO: 400697 - DNA, 25 bp, Rattus norvegicus
gcggctgctggctgaatgtttacac

SEQ ID NO: 400698 - DNA, 25 bp, Rattus norvegicus
gcggctgctgttctggtcagcacaa

SEQ ID NO: 400699 - DNA, 25 bp, Rattus norvegicus
gcggctgctgttgtggtcagcacaa

SEQ ID NO: 400700 - DNA, 25 bp, Rattus norvegicus
gcggctggcatcagcttcaaggaac

SEQ ID NO: 400701 - DNA, 25 bp, Rattus norvegicus
gcggctggcatctgcttcaaggaac

SEQ ID NO: 400702 - DNA, 25 bp, Rattus norvegicus
gcggctggctctaaggtttgtaaga

SEQ ID NO: 400703 - DNA, 25 bp, Rattus norvegicus
gcggctggctcttaggtttgtaaga

SEQ ID NO: 400704 - DNA, 25 bp, Rattus norvegicus
gcggctgggaaacctgcagttacaa

SEQ ID NO: 400705 - DNA, 25 bp, Rattus norvegicus
gcggctgggaaagctgcagttacaa

SEQ ID NO: 400706 - DNA, 25 bp, Rattus norvegicus
gcggctgtcattcctgtgactcgat

SEQ ID NO: 400707 - DNA, 25 bp, Rattus norvegicus
gcggctgtcattgctgtgactcgat

SEQ ID NO: 400708 - DNA, 25 bp, Rattus norvegicus
gcggctgtcggtcagttcgaacaaa

SEQ ID NO: 400709 - DNA, 25 bp, Rattus norvegicus
gcggctgtcggtgagttcgaacaaa

SEQ ID NO: 400710 - DNA, 25 bp, Rattus norvegicus
gcggctgtttctaggttgaccacac

SEQ ID NO: 400711 - DNA, 25 bp, Rattus norvegicus
gcggctgtttcttggttgaccacac

SEQ ID NO: 400712 - DNA, 25 bp, Rattus norvegicus
gcggcttaggctatatttctgttta

SEQ ID NO: 400713 - DNA, 25 bp, Rattus norvegicus
gcggcttaggctttatttctgttta

SEQ ID NO: 400714 - DNA, 25 bp, Rattus norvegicus
gcggcttatctgacaaccaggtgca

SEQ ID NO: 400715 - DNA, 25 bp, Rattus norvegicus
gcggcttatctgtcaaccaggtgca

SEQ ID NO: 400716 - DNA, 25 bp, Rattus norvegicus
gcggcttcagaaaactggagttcat

SEQ ID NO: 400717 - DNA, 25 bp, Rattus norvegicus
gcggcttcagaatactggagttcat

SEQ ID NO: 400718 - DNA, 25 bp, Rattus norvegicus
gcggcttctcctacaagaagagcaa

SEQ ID NO: 400719 - DNA, 25 bp, Rattus norvegicus
gcggcttctccttcaagaagagcaa

SEQ ID NO: 400720 - DNA, 25 bp, Rattus norvegicus
gcggcttgcattacagctgtccaaa

SEQ ID NO: 400721 - DNA, 25 bp, Rattus norvegicus
gcggcttgcatttcagctgtccaaa

SEQ ID NO: 400722 - DNA, 25 bp, Rattus norvegicus
gcggcttgtccgcagatacacaaac

SEQ ID NO: 400723 - DNA, 25 bp, Rattus norvegicus
gcggcttgtccggagatacacaaac

SEQ ID NO: 400724 - DNA, 25 bp, Rattus norvegicus
gcggcttgttcaatggattaagaaa

SEQ ID NO: 400725 - DNA, 25 bp, Rattus norvegicus
gcggcttgttcattggattaagaaa

SEQ ID NO: 400726 - DNA, 25 bp, Rattus norvegicus
gcggctttcctgacacatcagagtt

SEQ ID NO: 400727 - DNA, 25 bp, Rattus norvegicus
gcggctttcctgtcacatcagagtt

SEQ ID NO: 400728 - DNA, 25 bp, Rattus norvegicus
gcggctttgtgcattgtgaacaaac

SEQ ID NO: 400729 - DNA, 25 bp, Rattus norvegicus
gcggctttgtgctttgtgaacaaac

SEQ ID NO: 400730 - DNA, 25 bp, Rattus norvegicus
gcggcttttaatagacttgactcct

SEQ ID NO: 400731 - DNA, 25 bp, Rattus norvegicus
gcggcttttaattgacttgactcct

SEQ ID NO: 400732 - DNA, 25 bp, Rattus norvegicus
gcgggaaaatgtcacctagcctgga

SEQ ID NO: 400733 - DNA, 25 bp, Rattus norvegicus
gcgggaaaatgtgacctagcctgga

SEQ ID NO: 400734 - DNA, 25 bp, Rattus norvegicus
gcgggaaacactcggtttgccatcc

SEQ ID NO: 400735 - DNA, 25 bp, Rattus norvegicus
gcgggaaacactgggtttgccatcc

SEQ ID NO: 400736 - DNA, 25 bp, Rattus norvegicus
gcgggaaactttccatttctctctc

SEQ ID NO: 400737 - DNA, 25 bp, Rattus norvegicus
gcgggaaactttgcatttctctctc

SEQ ID NO: 400738 - DNA, 25 bp, Rattus norvegicus
gcgggaaagagcatccagtgttaaa

SEQ ID NO: 400739 - DNA, 25 bp, Rattus norvegicus
gcgggaaagagcttccagtgttaaa

SEQ ID NO: 400740 - DNA, 25 bp, Rattus norvegicus
gcgggaaagcagcaccattaccatt

SEQ ID NO: 400741 - DNA, 25 bp, Rattus norvegicus
gcgggaaagcaggaccattaccatt

SEQ ID NO: 400742 - DNA, 25 bp, Rattus norvegicus
gcgggaaccagcatttccgaatcaa

SEQ ID NO: 400743 - DNA, 25 bp, Rattus norvegicus
gcgggaaccagcttttccgaatcaa

SEQ ID NO: 400744 - DNA, 25 bp, Rattus norvegicus
gcgggaacctgcaacgcgcagcgaa

SEQ ID NO: 400745 - DNA, 25 bp, Rattus norvegicus
gcgggaacctgctacgcgcagcgaa

SEQ ID NO: 400746 - DNA, 25 bp, Rattus norvegicus
gcgggaactgaacatccgagagtaa

SEQ ID NO: 400747 - DNA, 25 bp, Rattus norvegicus
gcgggaactgaagatccgagagtaa

SEQ ID NO: 400748 - DNA, 25 bp, Rattus norvegicus
gcgggaatcgacactggttcacatg

SEQ ID NO: 400749 - DNA, 25 bp, Rattus norvegicus
gcgggaatcgactctggttcacatg

SEQ ID NO: 400750 - DNA, 25 bp, Rattus norvegicus
gcgggacatcgacacctgctcaatt

SEQ ID NO: 400751 - DNA, 25 bp, Rattus norvegicus
gcgggacatcgagacctgctcaatt

SEQ ID NO: 400752 - DNA, 25 bp, Rattus norvegicus
gcgggacatggtacaggccagccct

SEQ ID NO: 400753 - DNA, 25 bp, Rattus norvegicus
gcgggacatggttcaggccagccct

SEQ ID NO: 400754 - DNA, 25 bp, Rattus norvegicus
gcgggaccagctacctcaaaagaga

SEQ ID NO: 400755 - DNA, 25 bp, Rattus norvegicus
gcgggaccagcttcctcaaaagaga

SEQ ID NO: 400756 - DNA, 25 bp, Rattus norvegicus
gcgggaccggaaccttttacacaca

SEQ ID NO: 400757 - DNA, 25 bp, Rattus norvegicus
gcgggaccggaagcttttacacaca

SEQ ID NO: 400758 - DNA, 25 bp, Rattus norvegicus
gcgggaccgggaactgtcaaaaact

SEQ ID NO: 400759 - DNA, 25 bp, Rattus norvegicus
gcgggaccgggatctgtcaaaaact

SEQ ID NO: 400760 - DNA, 25 bp, Rattus norvegicus
gcgggaccggtgagagtgtgaggga

SEQ ID NO: 400761 - DNA, 25 bp, Rattus norvegicus
gcgggaccggtgtgagtgtgaggga

SEQ ID NO: 400762 - DNA, 25 bp, Rattus norvegicus
gcgggacgctgaatggtgttcttac

SEQ ID NO: 400763 - DNA, 25 bp, Rattus norvegicus
gcgggacgctgattggtgttcttac

SEQ ID NO: 400764 - DNA, 25 bp, Rattus norvegicus
gcgggacggtcaaatgcacccatta

SEQ ID NO: 400765 - DNA, 25 bp, Rattus norvegicus
gcgggacggtcatatgcacccatta

SEQ ID NO: 400766 - DNA, 25 bp, Rattus norvegicus
gcgggactacctcctgttaagcgtg

SEQ ID NO: 400767 - DNA, 25 bp, Rattus norvegicus
gcgggactacctgctgttaagcgtg

SEQ ID NO: 400768 - DNA, 25 bp, Rattus norvegicus
gcgggactcctgcatagcatgactc

SEQ ID NO: 400769 - DNA, 25 bp, Rattus norvegicus
gcgggactcctggatagcatgactc

SEQ ID NO: 400770 - DNA, 25 bp, Rattus norvegicus
gcgggacttcaaccagaacttcatc

SEQ ID NO: 400771 - DNA, 25 bp, Rattus norvegicus
gcgggacttcaagcagaacttcatc

SEQ ID NO: 400772 - DNA, 25 bp, Rattus norvegicus
gcgggactttatcctgatcacaaac

SEQ ID NO: 400773 - DNA, 25 bp, Rattus norvegicus
gcgggactttatgctgatcacaaac

SEQ ID NO: 400774 - DNA, 25 bp, Rattus norvegicus
gcgggagaggccactgcagaaacaa

SEQ ID NO: 400775 - DNA, 25 bp, Rattus norvegicus
gcgggagaggcctctgcagaaacaa

SEQ ID NO: 400776 - DNA, 25 bp, Rattus norvegicus
gcgggagaggttaattagtgccaaa

SEQ ID NO: 400777 - DNA, 25 bp, Rattus norvegicus
gcgggagaggtttattagtgccaaa

SEQ ID NO: 400778 - DNA, 25 bp, Rattus norvegicus
gcgggagatctcatttggcactaca

SEQ ID NO: 400779 - DNA, 25 bp, Rattus norvegicus
gcgggagatctcttttggcactaca

SEQ ID NO: 400780 - DNA, 25 bp, Rattus norvegicus
gcgggagcacttcctaatagatcgt

SEQ ID NO: 400781 - DNA, 25 bp, Rattus norvegicus
gcgggagcacttgctaatagatcgt

SEQ ID NO: 400782 - DNA, 25 bp, Rattus norvegicus
gcgggagcatccaagacatcagaga

SEQ ID NO: 400783 - DNA, 25 bp, Rattus norvegicus
gcgggagcatcctagacatcagaga

SEQ ID NO: 400784 - DNA, 25 bp, Rattus norvegicus
gcgggagcctgaacctctaagatat

SEQ ID NO: 400785 - DNA, 25 bp, Rattus norvegicus
gcgggagcctgatcctctaagatat

SEQ ID NO: 400786 - DNA, 25 bp, Rattus norvegicus
gcgggagctcttagtacagtctgaa

SEQ ID NO: 400787 - DNA, 25 bp, Rattus norvegicus
gcgggagctctttgtacagtctgaa

SEQ ID NO: 400788 - DNA, 25 bp, Rattus norvegicus
gcgggagctgctaaggtctgtaaac

SEQ ID NO: 400789 - DNA, 25 bp, Rattus norvegicus
gcgggagctgcttaggtctgtaaac

SEQ ID NO: 400790 - DNA, 25 bp, Rattus norvegicus
gcgggaggcgtgactatgcttctct

SEQ ID NO: 400791 - DNA, 25 bp, Rattus norvegicus
gcgggaggcgtgtctatgcttctct

SEQ ID NO: 400792 - DNA, 25 bp, Rattus norvegicus
gcgggaggtcctaatcagattttaa

SEQ ID NO: 400793 - DNA, 25 bp, Rattus norvegicus
gcgggaggtccttatcagattttaa

SEQ ID NO: 400794 - DNA, 25 bp, Rattus norvegicus
gcgggagttcagattgctttgtaaa

SEQ ID NO: 400795 - DNA, 25 bp, Rattus norvegicus
gcgggagttcagtttgctttgtaaa

SEQ ID NO: 400796 - DNA, 25 bp, Rattus norvegicus
gcgggataatttcgccaagctacta

SEQ ID NO: 400797 - DNA, 25 bp, Rattus norvegicus
gcgggataatttggccaagctacta

SEQ ID NO: 400798 - DNA, 25 bp, Rattus norvegicus
gcgggatacgccagtgacgaccaga

SEQ ID NO: 400799 - DNA, 25 bp, Rattus norvegicus
gcgggatacgcctgtgacgaccaga

SEQ ID NO: 400800 - DNA, 25 bp, Rattus norvegicus
gcgggatcagataaccaggaacata

SEQ ID NO: 400801 - DNA, 25 bp, Rattus norvegicus
gcgggatcagattaccaggaacata

SEQ ID NO: 400802 - DNA, 25 bp, Rattus norvegicus
gcgggatccaggacgtgctggtcac

SEQ ID NO: 400803 - DNA, 25 bp, Rattus norvegicus
gcgggatccaggtcgtgctggtcac

SEQ ID NO: 400804 - DNA, 25 bp, Rattus norvegicus
gcgggatccccaatatgctgttgaa

SEQ ID NO: 400805 - DNA, 25 bp, Rattus norvegicus
gcgggatccccattatgctgttgaa

SEQ ID NO: 400806 - DNA, 25 bp, Rattus norvegicus
gcgggatcttacagtgtcaacctaa

SEQ ID NO: 400807 - DNA, 25 bp, Rattus norvegicus
gcgggatcttactgtgtcaacctaa

SEQ ID NO: 400808 - DNA, 25 bp, Rattus norvegicus
gcgggatgatggctcattcccataa

SEQ ID NO: 400809 - DNA, 25 bp, Rattus norvegicus
gcgggatgatgggtcattcccataa

SEQ ID NO: 400810 - DNA, 25 bp, Rattus norvegicus
gcgggatggactactgcaccactgg

SEQ ID NO: 400811 - DNA, 25 bp, Rattus norvegicus
gcgggatggacttctgcaccactgg

SEQ ID NO: 400812 - DNA, 25 bp, Rattus norvegicus
gcgggattcagaacatgctgcagtt

SEQ ID NO: 400813 - DNA, 25 bp, Rattus norvegicus
gcgggattcagatcatgctgcagtt

SEQ ID NO: 400814 - DNA, 25 bp, Rattus norvegicus
gcgggattcttgctcattctttgaa

SEQ ID NO: 400815 - DNA, 25 bp, Rattus norvegicus
gcgggattcttggtcattctttgaa

SEQ ID NO: 400816 - DNA, 25 bp, Rattus norvegicus
gcgggattgtcactggcatttagtt

SEQ ID NO: 400817 - DNA, 25 bp, Rattus norvegicus
gcgggattgtcagtggcatttagtt

SEQ ID NO: 400818 - DNA, 25 bp, Rattus norvegicus
gcgggatttaatccttcgagacact

SEQ ID NO: 400819 - DNA, 25 bp, Rattus norvegicus
gcgggatttaatgcttcgagacact

SEQ ID NO: 400820 - DNA, 25 bp, Rattus norvegicus
gcgggatttcagcagatacaactat

SEQ ID NO: 400821 - DNA, 25 bp, Rattus norvegicus
gcgggatttcaggagatacaactat

SEQ ID NO: 400822 - DNA, 25 bp, Rattus norvegicus
gcgggatttttgattccagcaccaa

SEQ ID NO: 400823 - DNA, 25 bp, Rattus norvegicus
gcgggatttttgtttccagcaccaa

SEQ ID NO: 400824 - DNA, 25 bp, Rattus norvegicus
gcgggcacggccagacaaaggcgcg

SEQ ID NO: 400825 - DNA, 25 bp, Rattus norvegicus
gcgggcacggcctgacaaaggcgcg

SEQ ID NO: 400826 - DNA, 25 bp, Rattus norvegicus
gcgggcactgatcgcattactctgc

SEQ ID NO: 400827 - DNA, 25 bp, Rattus norvegicus
gcgggcactgatggcattactctgc

SEQ ID NO: 400828 - DNA, 25 bp, Rattus norvegicus
gcgggcagaagcagcgcatcgccat

SEQ ID NO: 400829 - DNA, 25 bp, Rattus norvegicus
gcgggcagaagctgcgcatcgccat

SEQ ID NO: 400830 - DNA, 25 bp, Rattus norvegicus
gcgggcatcgcgctcaggtggtcgg

SEQ ID NO: 400831 - DNA, 25 bp, Rattus norvegicus
gcgggcatcgcggtcaggtggtcgg

SEQ ID NO: 400832 - DNA, 25 bp, Rattus norvegicus
gcgggcatgggcacatatgtgcaac

SEQ ID NO: 400833 - DNA, 25 bp, Rattus norvegicus
gcgggcatgggctcatatgtgcaac

SEQ ID NO: 400834 - DNA, 25 bp, Rattus norvegicus
gcgggcattattcctccatattgga

SEQ ID NO: 400835 - DNA, 25 bp, Rattus norvegicus
gcgggcattattgctccatattgga

SEQ ID NO: 400836 - DNA, 25 bp, Rattus norvegicus
gcgggcattgcaaacacgtggtacg

SEQ ID NO: 400837 - DNA, 25 bp, Rattus norvegicus
gcgggcattgcatacacgtggtacg

SEQ ID NO: 400838 - DNA, 25 bp, Rattus norvegicus
gcgggccaatttagagagggtcctt

SEQ ID NO: 400839 - DNA, 25 bp, Rattus norvegicus
gcgggccaattttgagagggtcctt

SEQ ID NO: 400840 - DNA, 25 bp, Rattus norvegicus
gcgggccatggtacggtaactctga

SEQ ID NO: 400841 - DNA, 25 bp, Rattus norvegicus
gcgggccatggttcggtaactctga

SEQ ID NO: 400842 - DNA, 25 bp, Rattus norvegicus
gcgggccccagcagcagtattggag

SEQ ID NO: 400843 - DNA, 25 bp, Rattus norvegicus
gcgggccccagctgcagtattggag

SEQ ID NO: 400844 - DNA, 25 bp, Rattus norvegicus
gcgggcccctagcagcaataaggat

SEQ ID NO: 400845 - DNA, 25 bp, Rattus norvegicus
gcgggcccctaggagcaataaggat

SEQ ID NO: 400846 - DNA, 25 bp, Rattus norvegicus
gcgggccgcggccagcaagctggaa

SEQ ID NO: 400847 - DNA, 25 bp, Rattus norvegicus
gcgggccgcggcgagcaagctggaa

SEQ ID NO: 400848 - DNA, 25 bp, Rattus norvegicus
gcgggccggcaacaaggccttcaaa

SEQ ID NO: 400849 - DNA, 25 bp, Rattus norvegicus
gcgggccggcaagaaggccttcaaa

SEQ ID NO: 400850 - DNA, 25 bp, Rattus norvegicus
gcgggccttcacatttaaccagtga

SEQ ID NO: 400851 - DNA, 25 bp, Rattus norvegicus
gcgggccttcacttttaaccagtga

SEQ ID NO: 400852 - DNA, 25 bp, Rattus norvegicus
gcgggccttcctaacattaaatgtg

SEQ ID NO: 400853 - DNA, 25 bp, Rattus norvegicus
gcgggccttccttacattaaatgtg

SEQ ID NO: 400854 - DNA, 25 bp, Rattus norvegicus
gcgggccttgcaaacttaaacatct

SEQ ID NO: 400855 - DNA, 25 bp, Rattus norvegicus
gcgggccttgcatacttaaacatct

SEQ ID NO: 400856 - DNA, 25 bp, Rattus norvegicus
gcgggcgcagacacccgaaacggct

SEQ ID NO: 400857 - DNA, 25 bp, Rattus norvegicus
gcgggcgcagactcccgaaacggct

SEQ ID NO: 400858 - DNA, 25 bp, Rattus norvegicus
gcgggcgcaggactccaccaagaaa

SEQ ID NO: 400859 - DNA, 25 bp, Rattus norvegicus
gcgggcgcaggagtccaccaagaaa

SEQ ID NO: 400860 - DNA, 25 bp, Rattus norvegicus
gcgggcgctaagaactttttcaagt

SEQ ID NO: 400861 - DNA, 25 bp, Rattus norvegicus
gcgggcgctaagtactttttcaagt

SEQ ID NO: 400862 - DNA, 25 bp, Rattus norvegicus
gcgggcgttgacagcagactctcag

SEQ ID NO: 400863 - DNA, 25 bp, Rattus norvegicus
gcgggcgttgactgcagactctcag

SEQ ID NO: 400864 - DNA, 25 bp, Rattus norvegicus
gcgggctaacgaaaaccagctggtt

SEQ ID NO: 400865 - DNA, 25 bp, Rattus norvegicus
gcgggctaacgataaccagctggtt

SEQ ID NO: 400866 - DNA, 25 bp, Rattus norvegicus
gcgggctcgaacatgcatttggaaa

SEQ ID NO: 400867 - DNA, 25 bp, Rattus norvegicus
gcgggctcgaacttgcatttggaaa

SEQ ID NO: 400868 - DNA, 25 bp, Rattus norvegicus
gcgggctctgacatcggaaagtgac

SEQ ID NO: 400869 - DNA, 25 bp, Rattus norvegicus
gcgggctctgacttcggaaagtgac

SEQ ID NO: 400870 - DNA, 25 bp, Rattus norvegicus
gcgggctgcttgaacatcgttgtca

SEQ ID NO: 400871 - DNA, 25 bp, Rattus norvegicus
gcgggctgcttgtacatcgttgtca

SEQ ID NO: 400872 - DNA, 25 bp, Rattus norvegicus
gcgggctgtcacacatgagggcatc

SEQ ID NO: 400873 - DNA, 25 bp, Rattus norvegicus
gcgggctgtcactcatgagggcatc

SEQ ID NO: 400874 - DNA, 25 bp, Rattus norvegicus
gcgggctgtcatccagaagcgtatt

SEQ ID NO: 400875 - DNA, 25 bp, Rattus norvegicus
gcgggctgtcatgcagaagcgtatt

SEQ ID NO: 400876 - DNA, 25 bp, Rattus norvegicus
gcgggcttctgtaaattttgtctgt

SEQ ID NO: 400877 - DNA, 25 bp, Rattus norvegicus
gcgggcttctgttaattttgtctgt

SEQ ID NO: 400878 - DNA, 25 bp, Rattus norvegicus
gcgggctttcttctggctcaataaa

SEQ ID NO: 400879 - DNA, 25 bp, Rattus norvegicus
gcgggctttcttgtggctcaataaa

SEQ ID NO: 400880 - DNA, 25 bp, Rattus norvegicus
gcgggcttttgcagattgtggattc

SEQ ID NO: 400881 - DNA, 25 bp, Rattus norvegicus
gcgggcttttgctgattgtggattc

SEQ ID NO: 400882 - DNA, 25 bp, Rattus norvegicus
gcgggtactcacacgaacgcgtggt

SEQ ID NO: 400883 - DNA, 25 bp, Rattus norvegicus
gcgggtactcactcgaacgcgtggt

SEQ ID NO: 400884 - DNA, 25 bp, Rattus norvegicus
gcgggtatcaggatcaaatgagcca

SEQ ID NO: 400885 - DNA, 25 bp, Rattus norvegicus
gcgggtatcaggttcaaatgagcca

SEQ ID NO: 400886 - DNA, 25 bp, Rattus norvegicus
gcgggtcatcatcagcaagaggcta

SEQ ID NO: 400887 - DNA, 25 bp, Rattus norvegicus
gcgggtcatcatgagcaagaggcta

SEQ ID NO: 400888 - DNA, 25 bp, Rattus norvegicus
gcgggtcggctgctattgatcacct

SEQ ID NO: 400889 - DNA, 25 bp, Rattus norvegicus
gcgggtcggctggtattgatcacct

SEQ ID NO: 400890 - DNA, 25 bp, Rattus norvegicus
gcgggtcgggccaactaatgtcagt

SEQ ID NO: 400891 - DNA, 25 bp, Rattus norvegicus
gcgggtcgggcctactaatgtcagt

SEQ ID NO: 400892 - DNA, 25 bp, Rattus norvegicus
gcgggtctaacaatgcatgcatcaa

SEQ ID NO: 400893 - DNA, 25 bp, Rattus norvegicus
gcgggtctaacattgcatgcatcaa

SEQ ID NO: 400894 - DNA, 25 bp, Rattus norvegicus
gcgggtgacaaaaccctccctcttg

SEQ ID NO: 400895 - DNA, 25 bp, Rattus norvegicus
gcgggtgacaaatccctccctcttg

SEQ ID NO: 400896 - DNA, 25 bp, Rattus norvegicus
gcgggtgaccgacatactagattac

SEQ ID NO: 400897 - DNA, 25 bp, Rattus norvegicus
gcgggtgaccgagatactagattac

SEQ ID NO: 400898 - DNA, 25 bp, Rattus norvegicus
gcgggtgacgttcttgttagactac

SEQ ID NO: 400899 - DNA, 25 bp, Rattus norvegicus
gcgggtgacgttgttgttagactac

SEQ ID NO: 400900 - DNA, 25 bp, Rattus norvegicus
gcgggtgactctcttggacacttga

SEQ ID NO: 400901 - DNA, 25 bp, Rattus norvegicus
gcgggtgactctgttggacacttga

SEQ ID NO: 400902 - DNA, 25 bp, Rattus norvegicus
gcgggtgatgttcatgtaaagttct

SEQ ID NO: 400903 - DNA, 25 bp, Rattus norvegicus
gcgggtgatgttgatgtaaagttct

SEQ ID NO: 400904 - DNA, 25 bp, Rattus norvegicus
gcgggtggatctagcagacttcgac

SEQ ID NO: 400905 - DNA, 25 bp, Rattus norvegicus
gcgggtggatcttgcagacttcgac

SEQ ID NO: 400906 - DNA, 25 bp, Rattus norvegicus
gcgggtggcagacaccgttttccta

SEQ ID NO: 400907 - DNA, 25 bp, Rattus norvegicus
gcgggtggcagagaccgttttccta

SEQ ID NO: 400908 - DNA, 25 bp, Rattus norvegicus
gcgggtgttgttaacggagtccatc

SEQ ID NO: 400909 - DNA, 25 bp, Rattus norvegicus
gcgggtgttgtttacggagtccatc

SEQ ID NO: 400910 - DNA, 25 bp, Rattus norvegicus
gcgggtgtttttctttgtgccatta

SEQ ID NO: 400911 - DNA, 25 bp, Rattus norvegicus
gcgggtgtttttgtttgtgccatta

SEQ ID NO: 400912 - DNA, 25 bp, Rattus norvegicus
gcgggttagtgacgatctcttgatc

SEQ ID NO: 400913 - DNA, 25 bp, Rattus norvegicus
gcgggttagtgaggatctcttgatc

SEQ ID NO: 400914 - DNA, 25 bp, Rattus norvegicus
gcgggttatggcacttggtgctcaa

SEQ ID NO: 400915 - DNA, 25 bp, Rattus norvegicus
gcgggttatggctcttggtgctcaa

SEQ ID NO: 400916 - DNA, 25 bp, Rattus norvegicus
gcgggttcagctctacatcgataca

SEQ ID NO: 400917 - DNA, 25 bp, Rattus norvegicus
gcgggttcagctgtacatcgataca

SEQ ID NO: 400918 - DNA, 25 bp, Rattus norvegicus
gcgggttgaagtacacgctctcagc

SEQ ID NO: 400919 - DNA, 25 bp, Rattus norvegicus
gcgggttgaagttcacgctctcagc

SEQ ID NO: 400920 - DNA, 25 bp, Rattus norvegicus
gcgggtttcaggacgtctagaagat

SEQ ID NO: 400921 - DNA, 25 bp, Rattus norvegicus
gcgggtttcaggtcgtctagaagat

SEQ ID NO: 400922 - DNA, 25 bp, Rattus norvegicus
gcgggtttgggaaagcagacacact

SEQ ID NO: 400923 - DNA, 25 bp, Rattus norvegicus
gcgggtttgggatagcagacacact

SEQ ID NO: 400924 - DNA, 25 bp, Rattus norvegicus
gcgggttttggtaagttcttgctat

SEQ ID NO: 400925 - DNA, 25 bp, Rattus norvegicus
gcgggttttggttagttcttgctat

SEQ ID NO: 400926 - DNA, 25 bp, Rattus norvegicus
gcggtaaatgacagctatcttcggt

SEQ ID NO: 400927 - DNA, 25 bp, Rattus norvegicus
gcggtaaatgactgctatcttcggt

SEQ ID NO: 400928 - DNA, 25 bp, Rattus norvegicus
gcggtaacgaacacctgctctgcgt

SEQ ID NO: 400929 - DNA, 25 bp, Rattus norvegicus
gcggtaacgaactcctgctctgcgt

SEQ ID NO: 400930 - DNA, 25 bp, Rattus norvegicus
gcggtaactatcaacaaactattgt

SEQ ID NO: 400931 - DNA, 25 bp, Rattus norvegicus
gcggtaactatctacaaactattgt

SEQ ID NO: 400932 - DNA, 25 bp, Rattus norvegicus
gcggtacatcaacctgggcattcca

SEQ ID NO: 400933 - DNA, 25 bp, Rattus norvegicus
gcggtacatcaagctgggcattcca

SEQ ID NO: 400934 - DNA, 25 bp, Rattus norvegicus
gcggtaccaagtcactttgccagaa

SEQ ID NO: 400935 - DNA, 25 bp, Rattus norvegicus
gcggtaccaagtgactttgccagaa

SEQ ID NO: 400936 - DNA, 25 bp, Rattus norvegicus
gcggtacctggccatgaacaagaga

SEQ ID NO: 400937 - DNA, 25 bp, Rattus norvegicus
gcggtacctggcgatgaacaagaga

SEQ ID NO: 400938 - DNA, 25 bp, Rattus norvegicus
gcggtaccttctacatggtttggaa

SEQ ID NO: 400939 - DNA, 25 bp, Rattus norvegicus
gcggtaccttcttcatggtttggaa

SEQ ID NO: 400940 - DNA, 25 bp, Rattus norvegicus
gcggtacgtgttaagctggcttcta

SEQ ID NO: 400941 - DNA, 25 bp, Rattus norvegicus
gcggtacgtgtttagctggcttcta

SEQ ID NO: 400942 - DNA, 25 bp, Rattus norvegicus
gcggtagccacccactgcaatggtt

SEQ ID NO: 400943 - DNA, 25 bp, Rattus norvegicus
gcggtagccaccgactgcaatggtt

SEQ ID NO: 400944 - DNA, 25 bp, Rattus norvegicus
gcggtagggctactttctgtcacca

SEQ ID NO: 400945 - DNA, 25 bp, Rattus norvegicus
gcggtagggctagtttctgtcacca

SEQ ID NO: 400946 - DNA, 25 bp, Rattus norvegicus
gcggtatctagtatatcgagtctca

SEQ ID NO: 400947 - DNA, 25 bp, Rattus norvegicus
gcggtatctagtttatcgagtctca

SEQ ID NO: 400948 - DNA, 25 bp, Rattus norvegicus
gcggtatttaagctagcgtcagcta

SEQ ID NO: 400949 - DNA, 25 bp, Rattus norvegicus
gcggtatttaaggtagcgtcagcta

SEQ ID NO: 400950 - DNA, 25 bp, Rattus norvegicus
gcggtatttgcgctatctactctcc

SEQ ID NO: 400951 - DNA, 25 bp, Rattus norvegicus
gcggtatttgcggtatctactctcc

SEQ ID NO: 400952 - DNA, 25 bp, Rattus norvegicus
gcggtcaccctgacgttcatgagac

SEQ ID NO: 400953 - DNA, 25 bp, Rattus norvegicus
gcggtcaccctgtcgttcatgagac

SEQ ID NO: 400954 - DNA, 25 bp, Rattus norvegicus
gcggtcagagtcaggagcattgccc

SEQ ID NO: 400955 - DNA, 25 bp, Rattus norvegicus
gcggtcagagtctggagcattgccc

SEQ ID NO: 400956 - DNA, 25 bp, Rattus norvegicus
gcggtcaggaacctttaaagtctct

SEQ ID NO: 400957 - DNA, 25 bp, Rattus norvegicus
gcggtcaggaacgtttaaagtctct

SEQ ID NO: 400958 - DNA, 25 bp, Rattus norvegicus
gcggtcagggacaggccttcagatc

SEQ ID NO: 400959 - DNA, 25 bp, Rattus norvegicus
gcggtcagggactggccttcagatc

SEQ ID NO: 400960 - DNA, 25 bp, Rattus norvegicus
gcggtcagtgtcagtcacacagtga

SEQ ID NO: 400961 - DNA, 25 bp, Rattus norvegicus
gcggtcagtgtctgtcacacagtga

SEQ ID NO: 400962 - DNA, 25 bp, Rattus norvegicus
gcggtcattagtcttcccagaggca

SEQ ID NO: 400963 - DNA, 25 bp, Rattus norvegicus
gcggtcattagtgttcccagaggca

SEQ ID NO: 400964 - DNA, 25 bp, Rattus norvegicus
gcggtcatttacagcaggaggacct

SEQ ID NO: 400965 - DNA, 25 bp, Rattus norvegicus
gcggtcatttactgcaggaggacct

SEQ ID NO: 400966 - DNA, 25 bp, Rattus norvegicus
gcggtcatttccaagctagtactta

SEQ ID NO: 400967 - DNA, 25 bp, Rattus norvegicus
gcggtcatttcctagctagtactta

SEQ ID NO: 400968 - DNA, 25 bp, Rattus norvegicus
gcggtcccggagatcggttccatct

SEQ ID NO: 400969 - DNA, 25 bp, Rattus norvegicus
gcggtcccggagttcggttccatct

SEQ ID NO: 400970 - DNA, 25 bp, Rattus norvegicus
gcggtccctcagagtgtacggtaca

SEQ ID NO: 400971 - DNA, 25 bp, Rattus norvegicus
gcggtccctcagtgtgtacggtaca

SEQ ID NO: 400972 - DNA, 25 bp, Rattus norvegicus
gcggtccgcaagcatattctgggca

SEQ ID NO: 400973 - DNA, 25 bp, Rattus norvegicus
gcggtccgcaaggatattctgggca

SEQ ID NO: 400974 - DNA, 25 bp, Rattus norvegicus
gcggtcgacattacagaaatcaagc

SEQ ID NO: 400975 - DNA, 25 bp, Rattus norvegicus
gcggtcgacatttcagaaatcaagc

SEQ ID NO: 400976 - DNA, 25 bp, Rattus norvegicus
gcggtcgcaacacaccgggctgttt

SEQ ID NO: 400977 - DNA, 25 bp, Rattus norvegicus
gcggtcgcaacagaccgggctgttt

SEQ ID NO: 400978 - DNA, 25 bp, Rattus norvegicus
gcggtcggaaccactgtggtgtaat

SEQ ID NO: 400979 - DNA, 25 bp, Rattus norvegicus
gcggtcggaacctctgtggtgtaat

SEQ ID NO: 400980 - DNA, 25 bp, Rattus norvegicus
gcggtctccattacgaggtgtttat

SEQ ID NO: 400981 - DNA, 25 bp, Rattus norvegicus
gcggtctccatttcgaggtgtttat

SEQ ID NO: 400982 - DNA, 25 bp, Rattus norvegicus
gcggtctccggcctaagagctaaga

SEQ ID NO: 400983 - DNA, 25 bp, Rattus norvegicus
gcggtctccggcgtaagagctaaga

SEQ ID NO: 400984 - DNA, 25 bp, Rattus norvegicus
gcggtctcgattatcatgctagttt

SEQ ID NO: 400985 - DNA, 25 bp, Rattus norvegicus
gcggtctcgattttcatgctagttt

SEQ ID NO: 400986 - DNA, 25 bp, Rattus norvegicus
gcggtctgagccatctcaatgtgaa

SEQ ID NO: 400987 - DNA, 25 bp, Rattus norvegicus
gcggtctgagccttctcaatgtgaa

SEQ ID NO: 400988 - DNA, 25 bp, Rattus norvegicus
gcggtcttcgccaaccttgaggagg

SEQ ID NO: 400989 - DNA, 25 bp, Rattus norvegicus
gcggtcttcgcctaccttgaggagg

SEQ ID NO: 400990 - DNA, 25 bp, Rattus norvegicus
gcggtcttgagcagcatgggaaatc

SEQ ID NO: 400991 - DNA, 25 bp, Rattus norvegicus
gcggtcttgagctgcatgggaaatc

SEQ ID NO: 400992 - DNA, 25 bp, Rattus norvegicus
gcggtcttgtggatgtcttttcgaa

SEQ ID NO: 400993 - DNA, 25 bp, Rattus norvegicus
gcggtcttgtggttgtcttttcgaa

SEQ ID NO: 400994 - DNA, 25 bp, Rattus norvegicus
gcggtctttaagctcacgtatctaa

SEQ ID NO: 400995 - DNA, 25 bp, Rattus norvegicus
gcggtctttaaggtcacgtatctaa

SEQ ID NO: 400996 - DNA, 25 bp, Rattus norvegicus
gcggtctttctcagaaggactttgt

SEQ ID NO: 400997 - DNA, 25 bp, Rattus norvegicus
gcggtctttctctgaaggactttgt

SEQ ID NO: 400998 - DNA, 25 bp, Rattus norvegicus
gcggtgaatcaccagctatgtgaaa

SEQ ID NO: 400999 - DNA, 25 bp, Rattus norvegicus
gcggtgaatcacgagctatgtgaaa

SEQ ID NO: 401000 - DNA, 25 bp, Rattus norvegicus
gcggtgacatccctgagaggttcta

SEQ ID NO: 401001 - DNA, 25 bp, Rattus norvegicus
gcggtgacatccgtgagaggttcta

SEQ ID NO: 401002 - DNA, 25 bp, Rattus norvegicus
gcggtgaccgtgagcgccatgatcc

SEQ ID NO: 401003 - DNA, 25 bp, Rattus norvegicus
gcggtgaccgtgtgcgccatgatcc

SEQ ID NO: 401004 - DNA, 25 bp, Rattus norvegicus
gcggtgacctgactaatgcaattct

SEQ ID NO: 401005 - DNA, 25 bp, Rattus norvegicus
gcggtgacctgagtaatgcaattct

SEQ ID NO: 401006 - DNA, 25 bp, Rattus norvegicus
gcggtgacttaacaatccagagcca

SEQ ID NO: 401007 - DNA, 25 bp, Rattus norvegicus
gcggtgacttaagaatccagagcca

SEQ ID NO: 401008 - DNA, 25 bp, Rattus norvegicus
gcggtgattcacacgggacagcgac

SEQ ID NO: 401009 - DNA, 25 bp, Rattus norvegicus
gcggtgattcactcgggacagcgac

SEQ ID NO: 401010 - DNA, 25 bp, Rattus norvegicus
gcggtgcacacaaggtaagctctca

SEQ ID NO: 401011 - DNA, 25 bp, Rattus norvegicus
gcggtgcacacatggtaagctctca

SEQ ID NO: 401012 - DNA, 25 bp, Rattus norvegicus
gcggtgcacagcctaacgctacgag

SEQ ID NO: 401013 - DNA, 25 bp, Rattus norvegicus
gcggtgcacagcgtaacgctacgag

SEQ ID NO: 401014 - DNA, 25 bp, Rattus norvegicus
gcggtgcatcaaacacggagctatt

SEQ ID NO: 401015 - DNA, 25 bp, Rattus norvegicus
gcggtgcatcaatcacggagctatt

SEQ ID NO: 401016 - DNA, 25 bp, Rattus norvegicus
gcggtgccgaagcaacacatgctca

SEQ ID NO: 401017 - DNA, 25 bp, Rattus norvegicus
gcggtgccgaaggaacacatgctca

SEQ ID NO: 401018 - DNA, 25 bp, Rattus norvegicus
gcggtgccggcaaactgacttcagg

SEQ ID NO: 401019 - DNA, 25 bp, Rattus norvegicus
gcggtgccggcatactgacttcagg

SEQ ID NO: 401020 - DNA, 25 bp, Rattus norvegicus
gcggtgcctgcgatgtccaaggctt

SEQ ID NO: 401021 - DNA, 25 bp, Rattus norvegicus
gcggtgcctgcgttgtccaaggctt

SEQ ID NO: 401022 - DNA, 25 bp, Rattus norvegicus
gcggtgcgtgcaatagttcccaata

SEQ ID NO: 401023 - DNA, 25 bp, Rattus norvegicus
gcggtgcgtgcattagttcccaata

SEQ ID NO: 401024 - DNA, 25 bp, Rattus norvegicus
gcggtgctgtgcagtggtggtgaag

SEQ ID NO: 401025 - DNA, 25 bp, Rattus norvegicus
gcggtgctgtgctgtggtggtgaag

SEQ ID NO: 401026 - DNA, 25 bp, Rattus norvegicus
gcggtggaaaggcacactgcacttc

SEQ ID NO: 401027 - DNA, 25 bp, Rattus norvegicus
gcggtggaaagggacactgcacttc

SEQ ID NO: 401028 - DNA, 25 bp, Rattus norvegicus
gcggtggcacaaaccagcagaaact

SEQ ID NO: 401029 - DNA, 25 bp, Rattus norvegicus
gcggtggcacaatccagcagaaact

SEQ ID NO: 401030 - DNA, 25 bp, Rattus norvegicus
gcggtggcccatagtgcattgcgat

SEQ ID NO: 401031 - DNA, 25 bp, Rattus norvegicus
gcggtggcccattgtgcattgcgat

SEQ ID NO: 401032 - DNA, 25 bp, Rattus norvegicus
gcggtggcttttacgacctggcaga

SEQ ID NO: 401033 - DNA, 25 bp, Rattus norvegicus
gcggtggctttttcgacctggcaga

SEQ ID NO: 401034 - DNA, 25 bp, Rattus norvegicus
gcggtgggtgaaaaaattcagcctc

SEQ ID NO: 401035 - DNA, 25 bp, Rattus norvegicus
gcggtgggtgaataaattcagcctc

SEQ ID NO: 401036 - DNA, 25 bp, Rattus norvegicus
gcggtgggtttcagtactctggccc

SEQ ID NO: 401037 - DNA, 25 bp, Rattus norvegicus
gcggtgggtttctgtactctggccc

SEQ ID NO: 401038 - DNA, 25 bp, Rattus norvegicus
gcggtggtattaattgtggatcgta

SEQ ID NO: 401039 - DNA, 25 bp, Rattus norvegicus
gcggtggtattatttgtggatcgta

SEQ ID NO: 401040 - DNA, 25 bp, Rattus norvegicus
gcggtggtttgtactgcattggcaa

SEQ ID NO: 401041 - DNA, 25 bp, Rattus norvegicus
gcggtggtttgttctgcattggcaa

SEQ ID NO: 401042 - DNA, 25 bp, Rattus norvegicus
gcggtgtacgctcagagtgccacat

SEQ ID NO: 401043 - DNA, 25 bp, Rattus norvegicus
gcggtgtacgctgagagtgccacat

SEQ ID NO: 401044 - DNA, 25 bp, Rattus norvegicus
gcggtgtccggaccggaggacgctc

SEQ ID NO: 401045 - DNA, 25 bp, Rattus norvegicus
gcggtgtccggagcggaggacgctc

SEQ ID NO: 401046 - DNA, 25 bp, Rattus norvegicus
gcggtgtcttcaaaaccacttggat

SEQ ID NO: 401047 - DNA, 25 bp, Rattus norvegicus
gcggtgtcttcataaccacttggat

SEQ ID NO: 401048 - DNA, 25 bp, Rattus norvegicus
gcggtgttgccgatcttgaaattag

SEQ ID NO: 401049 - DNA, 25 bp, Rattus norvegicus
gcggtgttgccgttcttgaaattag

SEQ ID NO: 401050 - DNA, 25 bp, Rattus norvegicus
gcggtgttgggcagcttcgttctac

SEQ ID NO: 401051 - DNA, 25 bp, Rattus norvegicus
gcggtgttgggctgcttcgttctac

SEQ ID NO: 401052 - DNA, 25 bp, Rattus norvegicus
gcggtgttggtcatcacatcagaga

SEQ ID NO: 401053 - DNA, 25 bp, Rattus norvegicus
gcggtgttggtcttcacatcagaga

SEQ ID NO: 401054 - DNA, 25 bp, Rattus norvegicus
gcggttacttctcggaattcacctt

SEQ ID NO: 401055 - DNA, 25 bp, Rattus norvegicus
gcggttacttctgggaattcacctt

SEQ ID NO: 401056 - DNA, 25 bp, Rattus norvegicus
gcggttaggcacagaagcccaggcc

SEQ ID NO: 401057 - DNA, 25 bp, Rattus norvegicus
gcggttaggcactgaagcccaggcc

SEQ ID NO: 401058 - DNA, 25 bp, Rattus norvegicus
gcggttagtactattcaatctgcca

SEQ ID NO: 401059 - DNA, 25 bp, Rattus norvegicus
gcggttagtacttttcaatctgcca

SEQ ID NO: 401060 - DNA, 25 bp, Rattus norvegicus
gcggttattgcaatgtttccaagat

SEQ ID NO: 401061 - DNA, 25 bp, Rattus norvegicus
gcggttattgcattgtttccaagat

SEQ ID NO: 401062 - DNA, 25 bp, Rattus norvegicus
gcggttcaaacccatctgtaactat

SEQ ID NO: 401063 - DNA, 25 bp, Rattus norvegicus
gcggttcaaaccgatctgtaactat

SEQ ID NO: 401064 - DNA, 25 bp, Rattus norvegicus
gcggttcaggagcttgattcctagc

SEQ ID NO: 401065 - DNA, 25 bp, Rattus norvegicus
gcggttcaggaggttgattcctagc

SEQ ID NO: 401066 - DNA, 25 bp, Rattus norvegicus
gcggttcagttccatgggtgccatt

SEQ ID NO: 401067 - DNA, 25 bp, Rattus norvegicus
gcggttcagttcgatgggtgccatt

SEQ ID NO: 401068 - DNA, 25 bp, Rattus norvegicus
gcggttcctaagaagcgcaaacaga

SEQ ID NO: 401069 - DNA, 25 bp, Rattus norvegicus
gcggttcctaagtagcgcaaacaga

SEQ ID NO: 401070 - DNA, 25 bp, Rattus norvegicus
gcggttcttagcctgtaggtcatga

SEQ ID NO: 401071 - DNA, 25 bp, Rattus norvegicus
gcggttcttagcgtgtaggtcatga

SEQ ID NO: 401072 - DNA, 25 bp, Rattus norvegicus
gcggttgaccagatcaggactattc

SEQ ID NO: 401073 - DNA, 25 bp, Rattus norvegicus
gcggttgaccagttcaggactattc

SEQ ID NO: 401074 - DNA, 25 bp, Rattus norvegicus
gcggttgagagtcacaagcccttaa

SEQ ID NO: 401075 - DNA, 25 bp, Rattus norvegicus
gcggttgagagtgacaagcccttaa

SEQ ID NO: 401076 - DNA, 25 bp, Rattus norvegicus
gcggttgcttccagcagggtgatcc

SEQ ID NO: 401077 - DNA, 25 bp, Rattus norvegicus
gcggttgcttcctgcagggtgatcc

SEQ ID NO: 401078 - DNA, 25 bp, Rattus norvegicus
gcggttggacacacagagtgcgcca

SEQ ID NO: 401079 - DNA, 25 bp, Rattus norvegicus
gcggttggacactcagagtgcgcca

SEQ ID NO: 401080 - DNA, 25 bp, Rattus norvegicus
gcggttgtaagcctctcagactaag

SEQ ID NO: 401081 - DNA, 25 bp, Rattus norvegicus
gcggttgtaagcgtctcagactaag

SEQ ID NO: 401082 - DNA, 25 bp, Rattus norvegicus
gcggttgtagtcagcatttggcctt

SEQ ID NO: 401083 - DNA, 25 bp, Rattus norvegicus
gcggttgtagtctgcatttggcctt

SEQ ID NO: 401084 - DNA, 25 bp, Rattus norvegicus
gcggtttaccctaccagcgaggatg

SEQ ID NO: 401085 - DNA, 25 bp, Rattus norvegicus
gcggtttacccttccagcgaggatg

SEQ ID NO: 401086 - DNA, 25 bp, Rattus norvegicus
gcggtttcaggtacttttataatct

SEQ ID NO: 401087 - DNA, 25 bp, Rattus norvegicus
gcggtttcaggttcttttataatct

SEQ ID NO: 401088 - DNA, 25 bp, Rattus norvegicus
gcggtttcataacttcctcggtatt

SEQ ID NO: 401089 - DNA, 25 bp, Rattus norvegicus
gcggtttcataagttcctcggtatt

SEQ ID NO: 401090 - DNA, 25 bp, Rattus norvegicus
gcggtttccctcctggatgtgttaa

SEQ ID NO: 401091 - DNA, 25 bp, Rattus norvegicus
gcggtttccctcgtggatgtgttaa

SEQ ID NO: 401092 - DNA, 25 bp, Rattus norvegicus
gcggtttctcagatgattcatcact

SEQ ID NO: 401093 - DNA, 25 bp, Rattus norvegicus
gcggtttctcagttgattcatcact

SEQ ID NO: 401094 - DNA, 25 bp, Rattus norvegicus
gcggtttgtctaataccattcctac

SEQ ID NO: 401095 - DNA, 25 bp, Rattus norvegicus
gcggtttgtctattaccattcctac

SEQ ID NO: 401096 - DNA, 25 bp, Rattus norvegicus
gcggttttcattactgatgtctctg

SEQ ID NO: 401097 - DNA, 25 bp, Rattus norvegicus
gcggttttcatttctgatgtctctg

SEQ ID NO: 401098 - DNA, 25 bp, Rattus norvegicus
gcgtaaactctacctctcggtgaga

SEQ ID NO: 401099 - DNA, 25 bp, Rattus norvegicus
gcgtaaactctagctctcggtgaga

SEQ ID NO: 401100 - DNA, 25 bp, Rattus norvegicus
gcgtaaaggagcatgtcagcacact

SEQ ID NO: 401101 - DNA, 25 bp, Rattus norvegicus
gcgtaaaggagcttgtcagcacact

SEQ ID NO: 401102 - DNA, 25 bp, Rattus norvegicus
gcgtaacacacgaagtcagctccag

SEQ ID NO: 401103 - DNA, 25 bp, Rattus norvegicus
gcgtaacacacgtagtcagctccag

SEQ ID NO: 401104 - DNA, 25 bp, Rattus norvegicus
gcgtaaccagatcctgccagatgta

SEQ ID NO: 401105 - DNA, 25 bp, Rattus norvegicus
gcgtaaccagatgctgccagatgta

SEQ ID NO: 401106 - DNA, 25 bp, Rattus norvegicus
gcgtaaccatccagtgcgtattgca

SEQ ID NO: 401107 - DNA, 25 bp, Rattus norvegicus
gcgtaaccatcctgtgcgtattgca

SEQ ID NO: 401108 - DNA, 25 bp, Rattus norvegicus
gcgtaagcacctcttccgaaataag

SEQ ID NO: 401109 - DNA, 25 bp, Rattus norvegicus
gcgtaagcacctgttccgaaataag

SEQ ID NO: 401110 - DNA, 25 bp, Rattus norvegicus
gcgtaagcagccctcactggttggt

SEQ ID NO: 401111 - DNA, 25 bp, Rattus norvegicus
gcgtaagcagccgtcactggttggt

SEQ ID NO: 401112 - DNA, 25 bp, Rattus norvegicus
gcgtaaggcaataaacccacacttt

SEQ ID NO: 401113 - DNA, 25 bp, Rattus norvegicus
gcgtaaggcaattaacccacacttt

SEQ ID NO: 401114 - DNA, 25 bp, Rattus norvegicus
gcgtaagtgtcaagtgcgtgccagt

SEQ ID NO: 401115 - DNA, 25 bp, Rattus norvegicus
gcgtaagtgtcatgtgcgtgccagt

SEQ ID NO: 401116 - DNA, 25 bp, Rattus norvegicus
gcgtaataccaacagctcagtgcct

SEQ ID NO: 401117 - DNA, 25 bp, Rattus norvegicus
gcgtaataccaagagctcagtgcct

SEQ ID NO: 401118 - DNA, 25 bp, Rattus norvegicus
gcgtaatctctgatggcaactccta

SEQ ID NO: 401119 - DNA, 25 bp, Rattus norvegicus
gcgtaatctctgttggcaactccta

SEQ ID NO: 401120 - DNA, 25 bp, Rattus norvegicus
gcgtacagggacacaatggagacca

SEQ ID NO: 401121 - DNA, 25 bp, Rattus norvegicus
gcgtacagggactcaatggagacca

SEQ ID NO: 401122 - DNA, 25 bp, Rattus norvegicus
gcgtacccatgaacctggtaggcaa

SEQ ID NO: 401123 - DNA, 25 bp, Rattus norvegicus
gcgtacccatgatcctggtaggcaa

SEQ ID NO: 401124 - DNA, 25 bp, Rattus norvegicus
gcgtacgtctctactgatcaacaag

SEQ ID NO: 401125 - DNA, 25 bp, Rattus norvegicus
gcgtacgtctcttctgatcaacaag

SEQ ID NO: 401126 - DNA, 25 bp, Rattus norvegicus
gcgtactcgagtcgacatatttaac

SEQ ID NO: 401127 - DNA, 25 bp, Rattus norvegicus
gcgtactcgagtggacatatttaac

SEQ ID NO: 401128 - DNA, 25 bp, Rattus norvegicus
gcgtactcttctagtttttcatcaa

SEQ ID NO: 401129 - DNA, 25 bp, Rattus norvegicus
gcgtactcttcttgtttttcatcaa

SEQ ID NO: 401130 - DNA, 25 bp, Rattus norvegicus
gcgtactgcagacggcgcccaatgc

SEQ ID NO: 401131 - DNA, 25 bp, Rattus norvegicus
gcgtactgcagagggcgcccaatgc

SEQ ID NO: 401132 - DNA, 25 bp, Rattus norvegicus
gcgtacttacgtccagtcagaatcg

SEQ ID NO: 401133 - DNA, 25 bp, Rattus norvegicus
gcgtacttacgtgcagtcagaatcg

SEQ ID NO: 401134 - DNA, 25 bp, Rattus norvegicus
gcgtacttcgtaagtcagagtctca

SEQ ID NO: 401135 - DNA, 25 bp, Rattus norvegicus
gcgtacttcgtatgtcagagtctca

SEQ ID NO: 401136 - DNA, 25 bp, Rattus norvegicus
gcgtacttgaagacggtttctctca

SEQ ID NO: 401137 - DNA, 25 bp, Rattus norvegicus
gcgtacttgaagtcggtttctctca

SEQ ID NO: 401138 - DNA, 25 bp, Rattus norvegicus
gcgtagactagcaatctgacctgtt

SEQ ID NO: 401139 - DNA, 25 bp, Rattus norvegicus
gcgtagactagctatctgacctgtt

SEQ ID NO: 401140 - DNA, 25 bp, Rattus norvegicus
gcgtagagatgtatgtacctgtcaa

SEQ ID NO: 401141 - DNA, 25 bp, Rattus norvegicus
gcgtagagatgtttgtacctgtcaa

SEQ ID NO: 401142 - DNA, 25 bp, Rattus norvegicus
gcgtagcaacgtcagagaagtccca

SEQ ID NO: 401143 - DNA, 25 bp, Rattus norvegicus
gcgtagcaacgtgagagaagtccca

SEQ ID NO: 401144 - DNA, 25 bp, Rattus norvegicus
gcgtagcaccatacctaagcagatg

SEQ ID NO: 401145 - DNA, 25 bp, Rattus norvegicus
gcgtagcaccattcctaagcagatg

SEQ ID NO: 401146 - DNA, 25 bp, Rattus norvegicus
gcgtagcagctcctggcttcaggac

SEQ ID NO: 401147 - DNA, 25 bp, Rattus norvegicus
gcgtagcagctcgtggcttcaggac

SEQ ID NO: 401148 - DNA, 25 bp, Rattus norvegicus
gcgtagccactgatactcagtagtt

SEQ ID NO: 401149 - DNA, 25 bp, Rattus norvegicus
gcgtagccactgttactcagtagtt

SEQ ID NO: 401150 - DNA, 25 bp, Rattus norvegicus
gcgtagtggaataagtcccgcacca

SEQ ID NO: 401151 - DNA, 25 bp, Rattus norvegicus
gcgtagtggaattagtcccgcacca

SEQ ID NO: 401152 - DNA, 25 bp, Rattus norvegicus
gcgtagtggactatagaacctgaaa

SEQ ID NO: 401153 - DNA, 25 bp, Rattus norvegicus
gcgtagtggactttagaacctgaaa

SEQ ID NO: 401154 - DNA, 25 bp, Rattus norvegicus
gcgtagttgactaaccacttcactg

SEQ ID NO: 401155 - DNA, 25 bp, Rattus norvegicus
gcgtagttgacttaccacttcactg

SEQ ID NO: 401156 - DNA, 25 bp, Rattus norvegicus
gcgtatcattcacgttttctttttt

SEQ ID NO: 401157 - DNA, 25 bp, Rattus norvegicus
gcgtatcattcaggttttctttttt

SEQ ID NO: 401158 - DNA, 25 bp, Rattus norvegicus
gcgtatcccaagaccatgtctaagg

SEQ ID NO: 401159 - DNA, 25 bp, Rattus norvegicus
gcgtatcccaagtccatgtctaagg

SEQ ID NO: 401160 - DNA, 25 bp, Rattus norvegicus
gcgtatctcttcaaggcatctgact

SEQ ID NO: 401161 - DNA, 25 bp, Rattus norvegicus
gcgtatctcttctaggcatctgact

SEQ ID NO: 401162 - DNA, 25 bp, Rattus norvegicus
gcgtatgaccacaacaatgacctga

SEQ ID NO: 401163 - DNA, 25 bp, Rattus norvegicus
gcgtatgaccactacaatgacctga

SEQ ID NO: 401164 - DNA, 25 bp, Rattus norvegicus
gcgtatgccggtattacttaacact

SEQ ID NO: 401165 - DNA, 25 bp, Rattus norvegicus
gcgtatgccggttttacttaacact

SEQ ID NO: 401166 - DNA, 25 bp, Rattus norvegicus
gcgtatgccttaataatagccctta

SEQ ID NO: 401167 - DNA, 25 bp, Rattus norvegicus
gcgtatgccttattaatagccctta

SEQ ID NO: 401168 - DNA, 25 bp, Rattus norvegicus
gcgtatggaccgatattgcttgtaa

SEQ ID NO: 401169 - DNA, 25 bp, Rattus norvegicus
gcgtatggaccgttattgcttgtaa

SEQ ID NO: 401170 - DNA, 25 bp, Rattus norvegicus
gcgtatgggtgtatcacctacgtgt

SEQ ID NO: 401171 - DNA, 25 bp, Rattus norvegicus
gcgtatgggtgtttcacctacgtgt

SEQ ID NO: 401172 - DNA, 25 bp, Rattus norvegicus
gcgtatgtgctgctagagcaagcta

SEQ ID NO: 401173 - DNA, 25 bp, Rattus norvegicus
gcgtatgtgctggtagagcaagcta

SEQ ID NO: 401174 - DNA, 25 bp, Rattus norvegicus
gcgtatgtgttacagcaggcttctt

SEQ ID NO: 401175 - DNA, 25 bp, Rattus norvegicus
gcgtatgtgttagagcaggcttctt

SEQ ID NO: 401176 - DNA, 25 bp, Rattus norvegicus
gcgtattcgtgcaatcaatcctggc

SEQ ID NO: 401177 - DNA, 25 bp, Rattus norvegicus
gcgtattcgtgctatcaatcctggc

SEQ ID NO: 401178 - DNA, 25 bp, Rattus norvegicus
gcgtattctattattgctgattctc

SEQ ID NO: 401179 - DNA, 25 bp, Rattus norvegicus
gcgtattctatttttgctgattctc

SEQ ID NO: 401180 - DNA, 25 bp, Rattus norvegicus
gcgtcaaaaccaccttcaacagact

SEQ ID NO: 401181 - DNA, 25 bp, Rattus norvegicus
gcgtcaaaaccagcttcaacagact

SEQ ID NO: 401182 - DNA, 25 bp, Rattus norvegicus
gcgtcaacaggtaacacttccgctg

SEQ ID NO: 401183 - DNA, 25 bp, Rattus norvegicus
gcgtcaacaggttacacttccgctg

SEQ ID NO: 401184 - DNA, 25 bp, Rattus norvegicus
gcgtcaagctccagtgccaagagaa

SEQ ID NO: 401185 - DNA, 25 bp, Rattus norvegicus
gcgtcaagctcctgtgccaagagaa

SEQ ID NO: 401186 - DNA, 25 bp, Rattus norvegicus
gcgtcaattacgaaggcgccgaccg

SEQ ID NO: 401187 - DNA, 25 bp, Rattus norvegicus
gcgtcaattacgtaggcgccgaccg

SEQ ID NO: 401188 - DNA, 25 bp, Rattus norvegicus
gcgtcaattcacaaaaactctgctt

SEQ ID NO: 401189 - DNA, 25 bp, Rattus norvegicus
gcgtcaattcactaaaactctgctt

SEQ ID NO: 401190 - DNA, 25 bp, Rattus norvegicus
gcgtcacagcagagggtgtagtaat

SEQ ID NO: 401191 - DNA, 25 bp, Rattus norvegicus
gcgtcacagcagtgggtgtagtaat

SEQ ID NO: 401192 - DNA, 25 bp, Rattus norvegicus
gcgtcacagcctctatctatgaaga

SEQ ID NO: 401193 - DNA, 25 bp, Rattus norvegicus
gcgtcacagcctgtatctatgaaga

SEQ ID NO: 401194 - DNA, 25 bp, Rattus norvegicus
gcgtcacataatagctgccagggaa

SEQ ID NO: 401195 - DNA, 25 bp, Rattus norvegicus
gcgtcacataattgctgccagggaa

SEQ ID NO: 401196 - DNA, 25 bp, Rattus norvegicus
gcgtcacctttgacatgggcctaag

SEQ ID NO: 401197 - DNA, 25 bp, Rattus norvegicus
gcgtcacctttgtcatgggcctaag

SEQ ID NO: 401198 - DNA, 25 bp, Rattus norvegicus
gcgtcactgtggaactaactgtctt

SEQ ID NO: 401199 - DNA, 25 bp, Rattus norvegicus
gcgtcactgtggtactaactgtctt

SEQ ID NO: 401200 - DNA, 25 bp, Rattus norvegicus
gcgtcagagctgagccactgtaaat

SEQ ID NO: 401201 - DNA, 25 bp, Rattus norvegicus
gcgtcagagctgtgccactgtaaat

SEQ ID NO: 401202 - DNA, 25 bp, Rattus norvegicus
gcgtcagggactctgtttacttgaa

SEQ ID NO: 401203 - DNA, 25 bp, Rattus norvegicus
gcgtcagggactgtgtttacttgaa

SEQ ID NO: 401204 - DNA, 25 bp, Rattus norvegicus
gcgtcagtcaaaactcggtgctcag

SEQ ID NO: 401205 - DNA, 25 bp, Rattus norvegicus
gcgtcagtcaaatctcggtgctcag

SEQ ID NO: 401206 - DNA, 25 bp, Rattus norvegicus
gcgtcagtgaccattatcctgtgga

SEQ ID NO: 401207 - DNA, 25 bp, Rattus norvegicus
gcgtcagtgacctttatcctgtgga

SEQ ID NO: 401208 - DNA, 25 bp, Rattus norvegicus
gcgtcagttcgacgacctaaaccga

SEQ ID NO: 401209 - DNA, 25 bp, Rattus norvegicus
gcgtcagttcgaggacctaaaccga

SEQ ID NO: 401210 - DNA, 25 bp, Rattus norvegicus
gcgtcagttcttaccgcacacgtat

SEQ ID NO: 401211 - DNA, 25 bp, Rattus norvegicus
gcgtcagttctttccgcacacgtat

SEQ ID NO: 401212 - DNA, 25 bp, Rattus norvegicus
gcgtcatcagaacgtgcatggccat

SEQ ID NO: 401213 - DNA, 25 bp, Rattus norvegicus
gcgtcatcagaaggtgcatggccat

SEQ ID NO: 401214 - DNA, 25 bp, Rattus norvegicus
gcgtcatccactaggttgggcacaa

SEQ ID NO: 401215 - DNA, 25 bp, Rattus norvegicus
gcgtcatccacttggttgggcacaa

SEQ ID NO: 401216 - DNA, 25 bp, Rattus norvegicus
gcgtcatccagcagccaggagtcgc

SEQ ID NO: 401217 - DNA, 25 bp, Rattus norvegicus
gcgtcatccagctgccaggagtcgc

SEQ ID NO: 401218 - DNA, 25 bp, Rattus norvegicus
gcgtcatctctgcttctggttggaa

SEQ ID NO: 401219 - DNA, 25 bp, Rattus norvegicus
gcgtcatctctggttctggttggaa

SEQ ID NO: 401220 - DNA, 25 bp, Rattus norvegicus
gcgtcatgatgaacttaagaaagat

SEQ ID NO: 401221 - DNA, 25 bp, Rattus norvegicus
gcgtcatgatgatcttaagaaagat

SEQ ID NO: 401222 - DNA, 25 bp, Rattus norvegicus
gcgtcatggcgcagtacaagaggtt

SEQ ID NO: 401223 - DNA, 25 bp, Rattus norvegicus
gcgtcatggcgctgtacaagaggtt

SEQ ID NO: 401224 - DNA, 25 bp, Rattus norvegicus
gcgtcatgtcgtaggatgtaaccct

SEQ ID NO: 401225 - DNA, 25 bp, Rattus norvegicus
gcgtcatgtcgttggatgtaaccct

SEQ ID NO: 401226 - DNA, 25 bp, Rattus norvegicus
gcgtcattgcttagcgacactttaa

SEQ ID NO: 401227 - DNA, 25 bp, Rattus norvegicus
gcgtcattgctttgcgacactttaa

SEQ ID NO: 401228 - DNA, 25 bp, Rattus norvegicus
gcgtcatttgagaacagcagtgcct

SEQ ID NO: 401229 - DNA, 25 bp, Rattus norvegicus
gcgtcatttgagtacagcagtgcct

SEQ ID NO: 401230 - DNA, 25 bp, Rattus norvegicus
gcgtccaaattcatgttactgtcta

SEQ ID NO: 401231 - DNA, 25 bp, Rattus norvegicus
gcgtccaaattcttgttactgtcta

SEQ ID NO: 401232 - DNA, 25 bp, Rattus norvegicus
gcgtccaactctagaccaaattctt

SEQ ID NO: 401233 - DNA, 25 bp, Rattus norvegicus
gcgtccaactcttgaccaaattctt

SEQ ID NO: 401234 - DNA, 25 bp, Rattus norvegicus
gcgtccaagtatctttctctttatc

SEQ ID NO: 401235 - DNA, 25 bp, Rattus norvegicus
gcgtccaagtatgtttctctttatc

SEQ ID NO: 401236 - DNA, 25 bp, Rattus norvegicus
gcgtccaatgacaggcgtaccaagt

SEQ ID NO: 401237 - DNA, 25 bp, Rattus norvegicus
gcgtccaatgactggcgtaccaagt

SEQ ID NO: 401238 - DNA, 25 bp, Rattus norvegicus
gcgtccacacctctcatttttagga

SEQ ID NO: 401239 - DNA, 25 bp, Rattus norvegicus
gcgtccacacctgtcatttttagga

SEQ ID NO: 401240 - DNA, 25 bp, Rattus norvegicus
gcgtccacactaagccattgatgtc

SEQ ID NO: 401241 - DNA, 25 bp, Rattus norvegicus
gcgtccacactatgccattgatgtc

SEQ ID NO: 401242 - DNA, 25 bp, Rattus norvegicus
gcgtccagtagtaaatctcacccat

SEQ ID NO: 401243 - DNA, 25 bp, Rattus norvegicus
gcgtccagtagttaatctcacccat

SEQ ID NO: 401244 - DNA, 25 bp, Rattus norvegicus
gcgtccagttcacacttggcctttt

SEQ ID NO: 401245 - DNA, 25 bp, Rattus norvegicus
gcgtccagttcagacttggcctttt

SEQ ID NO: 401246 - DNA, 25 bp, Rattus norvegicus
gcgtccatccagaaagcatcttcat

SEQ ID NO: 401247 - DNA, 25 bp, Rattus norvegicus
gcgtccatccagtaagcatcttcat

SEQ ID NO: 401248 - DNA, 25 bp, Rattus norvegicus
gcgtccattacaaaacacctgtctt

SEQ ID NO: 401249 - DNA, 25 bp, Rattus norvegicus
gcgtccattacataacacctgtctt

SEQ ID NO: 401250 - DNA, 25 bp, Rattus norvegicus
gcgtcccacaaaacagctgctgaga

SEQ ID NO: 401251 - DNA, 25 bp, Rattus norvegicus
gcgtcccacaaatcagctgctgaga

SEQ ID NO: 401252 - DNA, 25 bp, Rattus norvegicus
gcgtcccacatgcttctgactagaa

SEQ ID NO: 401253 - DNA, 25 bp, Rattus norvegicus
gcgtcccacatggttctgactagaa

SEQ ID NO: 401254 - DNA, 25 bp, Rattus norvegicus
gcgtcccaggcaattgcagcagaat

SEQ ID NO: 401255 - DNA, 25 bp, Rattus norvegicus
gcgtcccaggcatttgcagcagaat

SEQ ID NO: 401256 - DNA, 25 bp, Rattus norvegicus
gcgtcccgaaaacacagtcagctat

SEQ ID NO: 401257 - DNA, 25 bp, Rattus norvegicus
gcgtcccgaaaagacagtcagctat

SEQ ID NO: 401258 - DNA, 25 bp, Rattus norvegicus
gcgtcccgatataggaagctttcta

SEQ ID NO: 401259 - DNA, 25 bp, Rattus norvegicus
gcgtcccgatattggaagctttcta

SEQ ID NO: 401260 - DNA, 25 bp, Rattus norvegicus
gcgtccctaccgaggtaacattcat

SEQ ID NO: 401261 - DNA, 25 bp, Rattus norvegicus
gcgtccctaccgtggtaacattcat

SEQ ID NO: 401262 - DNA, 25 bp, Rattus norvegicus
gcgtcccttatgattgtctctttat

SEQ ID NO: 401263 - DNA, 25 bp, Rattus norvegicus
gcgtcccttatgtttgtctctttat

SEQ ID NO: 401264 - DNA, 25 bp, Rattus norvegicus
gcgtcccttgtcaattcccaaataa

SEQ ID NO: 401265 - DNA, 25 bp, Rattus norvegicus
gcgtcccttgtctattcccaaataa

SEQ ID NO: 401266 - DNA, 25 bp, Rattus norvegicus
gcgtcccttttgatttgcactatga

SEQ ID NO: 401267 - DNA, 25 bp, Rattus norvegicus
gcgtcccttttgttttgcactatga

SEQ ID NO: 401268 - DNA, 25 bp, Rattus norvegicus
gcgtccgaaagccttcgactgggca

SEQ ID NO: 401269 - DNA, 25 bp, Rattus norvegicus
gcgtccgaaagcgttcgactgggca

SEQ ID NO: 401270 - DNA, 25 bp, Rattus norvegicus
gcgtccgaaccacctcagatggagg

SEQ ID NO: 401271 - DNA, 25 bp, Rattus norvegicus
gcgtccgaaccagctcagatggagg

SEQ ID NO: 401272 - DNA, 25 bp, Rattus norvegicus
gcgtccgccgagatcttaaggtctt

SEQ ID NO: 401273 - DNA, 25 bp, Rattus norvegicus
gcgtccgccgagttcttaaggtctt

SEQ ID NO: 401274 - DNA, 25 bp, Rattus norvegicus
gcgtccgtcagtcctgtcagttgtc

SEQ ID NO: 401275 - DNA, 25 bp, Rattus norvegicus
gcgtccgtcagtgctgtcagttgtc

SEQ ID NO: 401276 - DNA, 25 bp, Rattus norvegicus
gcgtcctatctaacttccatggtga

SEQ ID NO: 401277 - DNA, 25 bp, Rattus norvegicus
gcgtcctatctatcttccatggtga

SEQ ID NO: 401278 - DNA, 25 bp, Rattus norvegicus
gcgtcctcagctcgatagattttgt

SEQ ID NO: 401279 - DNA, 25 bp, Rattus norvegicus
gcgtcctcagctggatagattttgt

SEQ ID NO: 401280 - DNA, 25 bp, Rattus norvegicus
gcgtcctccattatctgatgaacaa

SEQ ID NO: 401281 - DNA, 25 bp, Rattus norvegicus
gcgtcctccattttctgatgaacaa

SEQ ID NO: 401282 - DNA, 25 bp, Rattus norvegicus
gcgtcctcggtgcaagcttttattt

SEQ ID NO: 401283 - DNA, 25 bp, Rattus norvegicus
gcgtcctcggtggaagcttttattt

SEQ ID NO: 401284 - DNA, 25 bp, Rattus norvegicus
gcgtcctgaatgcttcgacttgtta

SEQ ID NO: 401285 - DNA, 25 bp, Rattus norvegicus
gcgtcctgaatggttcgacttgtta

SEQ ID NO: 401286 - DNA, 25 bp, Rattus norvegicus
gcgtcctgagcaactgatttcatgg

SEQ ID NO: 401287 - DNA, 25 bp, Rattus norvegicus
gcgtcctgagcatctgatttcatgg

SEQ ID NO: 401288 - DNA, 25 bp, Rattus norvegicus
gcgtcctgcatcaggtgatggtgct

SEQ ID NO: 401289 - DNA, 25 bp, Rattus norvegicus
gcgtcctgcatctggtgatggtgct

SEQ ID NO: 401290 - DNA, 25 bp, Rattus norvegicus
gcgtcctgggttccctggtaccaca

SEQ ID NO: 401291 - DNA, 25 bp, Rattus norvegicus
gcgtcctgggttgcctggtaccaca

SEQ ID NO: 401292 - DNA, 25 bp, Rattus norvegicus
gcgtccttagaccacttaacagtta

SEQ ID NO: 401293 - DNA, 25 bp, Rattus norvegicus
gcgtccttagacgacttaacagtta

SEQ ID NO: 401294 - DNA, 25 bp, Rattus norvegicus
gcgtccttagccatttctttgaaga

SEQ ID NO: 401295 - DNA, 25 bp, Rattus norvegicus
gcgtccttagccttttctttgaaga

SEQ ID NO: 401296 - DNA, 25 bp, Rattus norvegicus
gcgtccttaggtagttgagtgcatc

SEQ ID NO: 401297 - DNA, 25 bp, Rattus norvegicus
gcgtccttaggttgttgagtgcatc

SEQ ID NO: 401298 - DNA, 25 bp, Rattus norvegicus
gcgtcctttatgacacagcttcaaa

SEQ ID NO: 401299 - DNA, 25 bp, Rattus norvegicus
gcgtcctttatgtcacagcttcaaa

SEQ ID NO: 401300 - DNA, 25 bp, Rattus norvegicus
gcgtcgaccagaaggtgtggtccat

SEQ ID NO: 401301 - DNA, 25 bp, Rattus norvegicus
gcgtcgaccagatggtgtggtccat

SEQ ID NO: 401302 - DNA, 25 bp, Rattus norvegicus
gcgtcgaggcacacaaagaagaggt

SEQ ID NO: 401303 - DNA, 25 bp, Rattus norvegicus
gcgtcgaggcactcaaagaagaggt

SEQ ID NO: 401304 - DNA, 25 bp, Rattus norvegicus
gcgtcgatgttcagccaggcgcatg

SEQ ID NO: 401305 - DNA, 25 bp, Rattus norvegicus
gcgtcgatgttctgccaggcgcatg

SEQ ID NO: 401306 - DNA, 25 bp, Rattus norvegicus
gcgtcgcgaattcccggcagcaggt

SEQ ID NO: 401307 - DNA, 25 bp, Rattus norvegicus
gcgtcgcgaattgccggcagcaggt

SEQ ID NO: 401308 - DNA, 25 bp, Rattus norvegicus
gcgtcgcttccgacccgggaagagc

SEQ ID NO: 401309 - DNA, 25 bp, Rattus norvegicus
gcgtcgcttccgtcccgggaagagc

SEQ ID NO: 401310 - DNA, 25 bp, Rattus norvegicus
gcgtcggagctaagcggtgcacatc

SEQ ID NO: 401311 - DNA, 25 bp, Rattus norvegicus
gcgtcggagctatgcggtgcacatc

SEQ ID NO: 401312 - DNA, 25 bp, Rattus norvegicus
gcgtcggccaacaaatcactgtgag

SEQ ID NO: 401313 - DNA, 25 bp, Rattus norvegicus
gcgtcggccaactaatcactgtgag

SEQ ID NO: 401314 - DNA, 25 bp, Rattus norvegicus
gcgtcgggctgcatcagcattagca

SEQ ID NO: 401315 - DNA, 25 bp, Rattus norvegicus
gcgtcgggctgcttcagcattagca

SEQ ID NO: 401316 - DNA, 25 bp, Rattus norvegicus
gcgtcgtacgttctgattgtggcat

SEQ ID NO: 401317 - DNA, 25 bp, Rattus norvegicus
gcgtcgtacgttgtgattgtggcat

SEQ ID NO: 401318 - DNA, 25 bp, Rattus norvegicus
gcgtcgtcaagaagatccacctgga

SEQ ID NO: 401319 - DNA, 25 bp, Rattus norvegicus
gcgtcgtcaagatgatccacctgga

SEQ ID NO: 401320 - DNA, 25 bp, Rattus norvegicus
gcgtcgtccgcaacgtcgtccgagg

SEQ ID NO: 401321 - DNA, 25 bp, Rattus norvegicus
gcgtcgtccgcatcgtcgtccgagg

SEQ ID NO: 401322 - DNA, 25 bp, Rattus norvegicus
gcgtcgtcgtcgcagcccaacttgg

SEQ ID NO: 401323 - DNA, 25 bp, Rattus norvegicus
gcgtcgtcgtcggagcccaacttgg

SEQ ID NO: 401324 - DNA, 25 bp, Rattus norvegicus
gcgtcgtctgcccaagattctggaa

SEQ ID NO: 401325 - DNA, 25 bp, Rattus norvegicus
gcgtcgtctgccgaagattctggaa

SEQ ID NO: 401326 - DNA, 25 bp, Rattus norvegicus
gcgtcgtttcccctcaagaatgagg

SEQ ID NO: 401327 - DNA, 25 bp, Rattus norvegicus
gcgtcgtttcccgtcaagaatgagg

SEQ ID NO: 401328 - DNA, 25 bp, Rattus norvegicus
gcgtctaatatgacattgccgatga

SEQ ID NO: 401329 - DNA, 25 bp, Rattus norvegicus
gcgtctaatatgtcattgccgatga

SEQ ID NO: 401330 - DNA, 25 bp, Rattus norvegicus
gcgtctaccagaacatggtgctctt

SEQ ID NO: 401331 - DNA, 25 bp, Rattus norvegicus
gcgtctaccagatcatggtgctctt

SEQ ID NO: 401332 - DNA, 25 bp, Rattus norvegicus
gcgtctacccagcagtcagatgtga

SEQ ID NO: 401333 - DNA, 25 bp, Rattus norvegicus
gcgtctacccaggagtcagatgtga

SEQ ID NO: 401334 - DNA, 25 bp, Rattus norvegicus
gcgtctacctgaagctcctaaatga

SEQ ID NO: 401335 - DNA, 25 bp, Rattus norvegicus
gcgtctacctgatgctcctaaatga

SEQ ID NO: 401336 - DNA, 25 bp, Rattus norvegicus
gcgtctactgcacccggaggaaata

SEQ ID NO: 401337 - DNA, 25 bp, Rattus norvegicus
gcgtctactgcagccggaggaaata

SEQ ID NO: 401338 - DNA, 25 bp, Rattus norvegicus
gcgtctagacgccttttgcaaatac

SEQ ID NO: 401339 - DNA, 25 bp, Rattus norvegicus
gcgtctagacgcgttttgcaaatac

SEQ ID NO: 401340 - DNA, 25 bp, Rattus norvegicus
gcgtctagtactatgaggccagtct

SEQ ID NO: 401341 - DNA, 25 bp, Rattus norvegicus
gcgtctagtactttgaggccagtct

SEQ ID NO: 401342 - DNA, 25 bp, Rattus norvegicus
gcgtctatgctaaaccaccatttta

SEQ ID NO: 401343 - DNA, 25 bp, Rattus norvegicus
gcgtctatgctataccaccatttta

SEQ ID NO: 401344 - DNA, 25 bp, Rattus norvegicus
gcgtctcacagaagcgaagttccag

SEQ ID NO: 401345 - DNA, 25 bp, Rattus norvegicus
gcgtctcacagatgcgaagttccag

SEQ ID NO: 401346 - DNA, 25 bp, Rattus norvegicus
gcgtctcacattaagagaggcctag

SEQ ID NO: 401347 - DNA, 25 bp, Rattus norvegicus
gcgtctcacatttagagaggcctag

SEQ ID NO: 401348 - DNA, 25 bp, Rattus norvegicus
gcgtctcagaggacagagcggcatt

SEQ ID NO: 401349 - DNA, 25 bp, Rattus norvegicus
gcgtctcagaggtcagagcggcatt

SEQ ID NO: 401350 - DNA, 25 bp, Rattus norvegicus
gcgtctcagggtcacagtttactaa

SEQ ID NO: 401351 - DNA, 25 bp, Rattus norvegicus
gcgtctcagggtgacagtttactaa

SEQ ID NO: 401352 - DNA, 25 bp, Rattus norvegicus
gcgtctcagtggacgctgcagaaaa

SEQ ID NO: 401353 - DNA, 25 bp, Rattus norvegicus
gcgtctcagtggtcgctgcagaaaa

SEQ ID NO: 401354 - DNA, 25 bp, Rattus norvegicus
gcgtctccacctactacaaagtgag

SEQ ID NO: 401355 - DNA, 25 bp, Rattus norvegicus
gcgtctccaccttctacaaagtgag

SEQ ID NO: 401356 - DNA, 25 bp, Rattus norvegicus
gcgtctcctcaacttgcagaacgaa

SEQ ID NO: 401357 - DNA, 25 bp, Rattus norvegicus
gcgtctcctcaagttgcagaacgaa

SEQ ID NO: 401358 - DNA, 25 bp, Rattus norvegicus
gcgtctcctgctcaagacactacat

SEQ ID NO: 401359 - DNA, 25 bp, Rattus norvegicus
gcgtctcctgctgaagacactacat

SEQ ID NO: 401360 - DNA, 25 bp, Rattus norvegicus
gcgtctcttcacctactcagaatga

SEQ ID NO: 401361 - DNA, 25 bp, Rattus norvegicus
gcgtctcttcacgtactcagaatga

SEQ ID NO: 401362 - DNA, 25 bp, Rattus norvegicus
gcgtctcttcgtcgcttctaaaaaa

SEQ ID NO: 401363 - DNA, 25 bp, Rattus norvegicus
gcgtctcttcgtggcttctaaaaaa

SEQ ID NO: 401364 - DNA, 25 bp, Rattus norvegicus
gcgtctcttggaaggtctgaagcat

SEQ ID NO: 401365 - DNA, 25 bp, Rattus norvegicus
gcgtctcttggatggtctgaagcat

SEQ ID NO: 401366 - DNA, 25 bp, Rattus norvegicus
gcgtctgaaggcaagatgggtcacc

SEQ ID NO: 401367 - DNA, 25 bp, Rattus norvegicus
gcgtctgaaggctagatgggtcacc

SEQ ID NO: 401368 - DNA, 25 bp, Rattus norvegicus
gcgtctgactatagccgcagcgaag

SEQ ID NO: 401369 - DNA, 25 bp, Rattus norvegicus
gcgtctgactattgccgcagcgaag

SEQ ID NO: 401370 - DNA, 25 bp, Rattus norvegicus
gcgtctgactttaaaggcatccttc

SEQ ID NO: 401371 - DNA, 25 bp, Rattus norvegicus
gcgtctgacttttaaggcatccttc

SEQ ID NO: 401372 - DNA, 25 bp, Rattus norvegicus
gcgtctgatagacacgtttccagtt

SEQ ID NO: 401373 - DNA, 25 bp, Rattus norvegicus
gcgtctgatagagacgtttccagtt

SEQ ID NO: 401374 - DNA, 25 bp, Rattus norvegicus
gcgtctgcagggaagagcagtctct

SEQ ID NO: 401375 - DNA, 25 bp, Rattus norvegicus
gcgtctgcagggtagagcagtctct

SEQ ID NO: 401376 - DNA, 25 bp, Rattus norvegicus
gcgtctgcgcaaagcccctcggtag

SEQ ID NO: 401377 - DNA, 25 bp, Rattus norvegicus
gcgtctgcgcaatgcccctcggtag

SEQ ID NO: 401378 - DNA, 25 bp, Rattus norvegicus
gcgtctgcgtctaggcttgtgatta

SEQ ID NO: 401379 - DNA, 25 bp, Rattus norvegicus
gcgtctgcgtcttggcttgtgatta

SEQ ID NO: 401380 - DNA, 25 bp, Rattus norvegicus
gcgtctgctgttagctcttcgagaa

SEQ ID NO: 401381 - DNA, 25 bp, Rattus norvegicus
gcgtctgctgtttgctcttcgagaa

SEQ ID NO: 401382 - DNA, 25 bp, Rattus norvegicus
gcgtctgcttccagagtggtggaat

SEQ ID NO: 401383 - DNA, 25 bp, Rattus norvegicus
gcgtctgcttcctgagtggtggaat

SEQ ID NO: 401384 - DNA, 25 bp, Rattus norvegicus
gcgtctggaggaaaaacagcgactt

SEQ ID NO: 401385 - DNA, 25 bp, Rattus norvegicus
gcgtctggaggataaacagcgactt

SEQ ID NO: 401386 - DNA, 25 bp, Rattus norvegicus
gcgtctgtacgcctagggagatcat

SEQ ID NO: 401387 - DNA, 25 bp, Rattus norvegicus
gcgtctgtacgcgtagggagatcat

SEQ ID NO: 401388 - DNA, 25 bp, Rattus norvegicus
gcgtctgtagttattgcacttggga

SEQ ID NO: 401389 - DNA, 25 bp, Rattus norvegicus
gcgtctgtagtttttgcacttggga

SEQ ID NO: 401390 - DNA, 25 bp, Rattus norvegicus
gcgtctgtctggagcgtggatccaa

SEQ ID NO: 401391 - DNA, 25 bp, Rattus norvegicus
gcgtctgtctggtgcgtggatccaa

SEQ ID NO: 401392 - DNA, 25 bp, Rattus norvegicus
gcgtctgtgggtagctaactgaact

SEQ ID NO: 401393 - DNA, 25 bp, Rattus norvegicus
gcgtctgtgggttgctaactgaact

SEQ ID NO: 401394 - DNA, 25 bp, Rattus norvegicus
gcgtctgttatgcagtagggaccat

SEQ ID NO: 401395 - DNA, 25 bp, Rattus norvegicus
gcgtctgttatggagtagggaccat

SEQ ID NO: 401396 - DNA, 25 bp, Rattus norvegicus
gcgtctgttgacagaatctgtggta

SEQ ID NO: 401397 - DNA, 25 bp, Rattus norvegicus
gcgtctgttgactgaatctgtggta

SEQ ID NO: 401398 - DNA, 25 bp, Rattus norvegicus
gcgtctgttgcccattatttcaaag

SEQ ID NO: 401399 - DNA, 25 bp, Rattus norvegicus
gcgtctgttgccgattatttcaaag

SEQ ID NO: 401400 - DNA, 25 bp, Rattus norvegicus
gcgtcttcacagcttcatcaggaag

SEQ ID NO: 401401 - DNA, 25 bp, Rattus norvegicus
gcgtcttcacaggttcatcaggaag

SEQ ID NO: 401402 - DNA, 25 bp, Rattus norvegicus
gcgtcttcagaacagcctccggagc

SEQ ID NO: 401403 - DNA, 25 bp, Rattus norvegicus
gcgtcttcagaagagcctccggagc

SEQ ID NO: 401404 - DNA, 25 bp, Rattus norvegicus
gcgtcttcatttcagtgtgtgtgca

SEQ ID NO: 401405 - DNA, 25 bp, Rattus norvegicus
gcgtcttcatttgagtgtgtgtgca

SEQ ID NO: 401406 - DNA, 25 bp, Rattus norvegicus
gcgtcttcccggagaatttcacaga

SEQ ID NO: 401407 - DNA, 25 bp, Rattus norvegicus
gcgtcttcccggtgaatttcacaga

SEQ ID NO: 401408 - DNA, 25 bp, Rattus norvegicus
gcgtcttcctgcatagaatcatttt

SEQ ID NO: 401409 - DNA, 25 bp, Rattus norvegicus
gcgtcttcctgcttagaatcatttt

SEQ ID NO: 401410 - DNA, 25 bp, Rattus norvegicus
gcgtcttcgcggaggcatcatcgag

SEQ ID NO: 401411 - DNA, 25 bp, Rattus norvegicus
gcgtcttcgcggtggcatcatcgag

SEQ ID NO: 401412 - DNA, 25 bp, Rattus norvegicus
gcgtcttctctcaaagtccaatgat

SEQ ID NO: 401413 - DNA, 25 bp, Rattus norvegicus
gcgtcttctctctaagtccaatgat

SEQ ID NO: 401414 - DNA, 25 bp, Rattus norvegicus
gcgtcttgagacctaggccttggta

SEQ ID NO: 401415 - DNA, 25 bp, Rattus norvegicus
gcgtcttgagacgtaggccttggta

SEQ ID NO: 401416 - DNA, 25 bp, Rattus norvegicus
gcgtcttgtgccagagttcgcttgt

SEQ ID NO: 401417 - DNA, 25 bp, Rattus norvegicus
gcgtcttgtgcctgagttcgcttgt

SEQ ID NO: 401418 - DNA, 25 bp, Rattus norvegicus
gcgtcttttagcaccatcctagaga

SEQ ID NO: 401419 - DNA, 25 bp, Rattus norvegicus
gcgtcttttagctccatcctagaga

SEQ ID NO: 401420 - DNA, 25 bp, Rattus norvegicus
gcgtgaaagttactgctactctaga

SEQ ID NO: 401421 - DNA, 25 bp, Rattus norvegicus
gcgtgaaagttagtgctactctaga

SEQ ID NO: 401422 - DNA, 25 bp, Rattus norvegicus
gcgtgaaatcagattagccctttgt

SEQ ID NO: 401423 - DNA, 25 bp, Rattus norvegicus
gcgtgaaatcagtttagccctttgt

SEQ ID NO: 401424 - DNA, 25 bp, Rattus norvegicus
gcgtgaaatgttcccgaaacttcct

SEQ ID NO: 401425 - DNA, 25 bp, Rattus norvegicus
gcgtgaaatgttgccgaaacttcct

SEQ ID NO: 401426 - DNA, 25 bp, Rattus norvegicus
gcgtgaacctccatcatgagacatg

SEQ ID NO: 401427 - DNA, 25 bp, Rattus norvegicus
gcgtgaacctccttcatgagacatg

SEQ ID NO: 401428 - DNA, 25 bp, Rattus norvegicus
gcgtgaacgtggagctgaagcccca

SEQ ID NO: 401429 - DNA, 25 bp, Rattus norvegicus
gcgtgaacgtggtgctgaagcccca

SEQ ID NO: 401430 - DNA, 25 bp, Rattus norvegicus
gcgtgaacttttaaggccacttcct

SEQ ID NO: 401431 - DNA, 25 bp, Rattus norvegicus
gcgtgaactttttaggccacttcct

SEQ ID NO: 401432 - DNA, 25 bp, Rattus norvegicus
gcgtgaaggtgacacattgtttgca

SEQ ID NO: 401433 - DNA, 25 bp, Rattus norvegicus
gcgtgaaggtgagacattgtttgca

SEQ ID NO: 401434 - DNA, 25 bp, Rattus norvegicus
gcgtgaagttgactctgctccagat

SEQ ID NO: 401435 - DNA, 25 bp, Rattus norvegicus
gcgtgaagttgagtctgctccagat

SEQ ID NO: 401436 - DNA, 25 bp, Rattus norvegicus
gcgtgacactggacaaacttgttga

SEQ ID NO: 401437 - DNA, 25 bp, Rattus norvegicus
gcgtgacactggtcaaacttgttga

SEQ ID NO: 401438 - DNA, 25 bp, Rattus norvegicus
gcgtgaccgggcagaagacatcctt

SEQ ID NO: 401439 - DNA, 25 bp, Rattus norvegicus
gcgtgaccgggctgaagacatcctt

SEQ ID NO: 401440 - DNA, 25 bp, Rattus norvegicus
gcgtgacctcatataataacataca

SEQ ID NO: 401441 - DNA, 25 bp, Rattus norvegicus
gcgtgacctcatttaataacataca

SEQ ID NO: 401442 - DNA, 25 bp, Rattus norvegicus
gcgtgacctggtacatgctggttat

SEQ ID NO: 401443 - DNA, 25 bp, Rattus norvegicus
gcgtgacctggttcatgctggttat

SEQ ID NO: 401444 - DNA, 25 bp, Rattus norvegicus
gcgtgacctttacctaaggagccat

SEQ ID NO: 401445 - DNA, 25 bp, Rattus norvegicus
gcgtgacctttagctaaggagccat

SEQ ID NO: 401446 - DNA, 25 bp, Rattus norvegicus
gcgtgactcacaacgcaaatgtgga

SEQ ID NO: 401447 - DNA, 25 bp, Rattus norvegicus
gcgtgactcacatcgcaaatgtgga

SEQ ID NO: 401448 - DNA, 25 bp, Rattus norvegicus
gcgtgactgtatatgttaacccctg

SEQ ID NO: 401449 - DNA, 25 bp, Rattus norvegicus
gcgtgactgtatttgttaacccctg

SEQ ID NO: 401450 - DNA, 25 bp, Rattus norvegicus
gcgtgagaatccaaagggctttagt

SEQ ID NO: 401451 - DNA, 25 bp, Rattus norvegicus
gcgtgagaatcctaagggctttagt

SEQ ID NO: 401452 - DNA, 25 bp, Rattus norvegicus
gcgtgagaattgctttggcttcaaa

SEQ ID NO: 401453 - DNA, 25 bp, Rattus norvegicus
gcgtgagaattggtttggcttcaaa

SEQ ID NO: 401454 - DNA, 25 bp, Rattus norvegicus
gcgtgagcaaagagcgcagttcctc

SEQ ID NO: 401455 - DNA, 25 bp, Rattus norvegicus
gcgtgagcaaagtgcgcagttcctc

SEQ ID NO: 401456 - DNA, 25 bp, Rattus norvegicus
gcgtgagcagcaaccgctacgagaa

SEQ ID NO: 401457 - DNA, 25 bp, Rattus norvegicus
gcgtgagcagcatccgctacgagaa

SEQ ID NO: 401458 - DNA, 25 bp, Rattus norvegicus
gcgtgaggacctcagctcaaaccac

SEQ ID NO: 401459 - DNA, 25 bp, Rattus norvegicus
gcgtgaggacctgagctcaaaccac

SEQ ID NO: 401460 - DNA, 25 bp, Rattus norvegicus
gcgtgagggaacagcgcaacttcct

SEQ ID NO: 401461 - DNA, 25 bp, Rattus norvegicus
gcgtgagggaactgcgcaacttcct

SEQ ID NO: 401462 - DNA, 25 bp, Rattus norvegicus
gcgtgaggtcctccttttcagagtg

SEQ ID NO: 401463 - DNA, 25 bp, Rattus norvegicus
gcgtgaggtcctgcttttcagagtg

SEQ ID NO: 401464 - DNA, 25 bp, Rattus norvegicus
gcgtgaggttttacagagtgcatct

SEQ ID NO: 401465 - DNA, 25 bp, Rattus norvegicus
gcgtgaggtttttcagagtgcatct

SEQ ID NO: 401466 - DNA, 25 bp, Rattus norvegicus
gcgtgagttgcaaatctggattttt

SEQ ID NO: 401467 - DNA, 25 bp, Rattus norvegicus
gcgtgagttgcatatctggattttt

SEQ ID NO: 401468 - DNA, 25 bp, Rattus norvegicus
gcgtgatctgatcttttagccaatc

SEQ ID NO: 401469 - DNA, 25 bp, Rattus norvegicus
gcgtgatctgatgttttagccaatc

SEQ ID NO: 401470 - DNA, 25 bp, Rattus norvegicus
gcgtgatgaaaacccagcagacagt

SEQ ID NO: 401471 - DNA, 25 bp, Rattus norvegicus
gcgtgatgaaaagccagcagacagt

SEQ ID NO: 401472 - DNA, 25 bp, Rattus norvegicus
gcgtgatgcagtacaacgacatcct

SEQ ID NO: 401473 - DNA, 25 bp, Rattus norvegicus
gcgtgatgcagttcaacgacatcct

SEQ ID NO: 401474 - DNA, 25 bp, Rattus norvegicus
gcgtgattacacagggtcgggactc

SEQ ID NO: 401475 - DNA, 25 bp, Rattus norvegicus
gcgtgattacactgggtcgggactc

SEQ ID NO: 401476 - DNA, 25 bp, Rattus norvegicus
gcgtgattctgcagcacgaattcat

SEQ ID NO: 401477 - DNA, 25 bp, Rattus norvegicus
gcgtgattctgctgcacgaattcat

SEQ ID NO: 401478 - DNA, 25 bp, Rattus norvegicus
gcgtgatttccgcttcgttaaagca

SEQ ID NO: 401479 - DNA, 25 bp, Rattus norvegicus
gcgtgatttccggttcgttaaagca

SEQ ID NO: 401480 - DNA, 25 bp, Rattus norvegicus
gcgtgcaacggcagatgctgagctc

SEQ ID NO: 401481 - DNA, 25 bp, Rattus norvegicus
gcgtgcaacggctgatgctgagctc

SEQ ID NO: 401482 - DNA, 25 bp, Rattus norvegicus
gcgtgcaactaaccccaattttgat

SEQ ID NO: 401483 - DNA, 25 bp, Rattus norvegicus
gcgtgcaactaagcccaattttgat

SEQ ID NO: 401484 - DNA, 25 bp, Rattus norvegicus
gcgtgcacaaggctgcattccttgt

SEQ ID NO: 401485 - DNA, 25 bp, Rattus norvegicus
gcgtgcacaagggtgcattccttgt

SEQ ID NO: 401486 - DNA, 25 bp, Rattus norvegicus
gcgtgcacacctccgtacaggaagt

SEQ ID NO: 401487 - DNA, 25 bp, Rattus norvegicus
gcgtgcacacctgcgtacaggaagt

SEQ ID NO: 401488 - DNA, 25 bp, Rattus norvegicus
gcgtgcaccgcaatggacagacaaa

SEQ ID NO: 401489 - DNA, 25 bp, Rattus norvegicus
gcgtgcaccgcattggacagacaaa

SEQ ID NO: 401490 - DNA, 25 bp, Rattus norvegicus
gcgtgcacggatctcaggaaccctg

SEQ ID NO: 401491 - DNA, 25 bp, Rattus norvegicus
gcgtgcacggatgtcaggaaccctg

SEQ ID NO: 401492 - DNA, 25 bp, Rattus norvegicus
gcgtgcacgtgaagctggcgaacct

SEQ ID NO: 401493 - DNA, 25 bp, Rattus norvegicus
gcgtgcacgtgatgctggcgaacct

SEQ ID NO: 401494 - DNA, 25 bp, Rattus norvegicus
gcgtgcagcctgattgacacccgaa

SEQ ID NO: 401495 - DNA, 25 bp, Rattus norvegicus
gcgtgcagcctgtttgacacccgaa

SEQ ID NO: 401496 - DNA, 25 bp, Rattus norvegicus
gcgtgcagtcttaatgtacagtgat

SEQ ID NO: 401497 - DNA, 25 bp, Rattus norvegicus
gcgtgcagtctttatgtacagtgat

SEQ ID NO: 401498 - DNA, 25 bp, Rattus norvegicus
gcgtgcagttatctggacctcagga

SEQ ID NO: 401499 - DNA, 25 bp, Rattus norvegicus
gcgtgcagttatgtggacctcagga

SEQ ID NO: 401500 - DNA, 25 bp, Rattus norvegicus
gcgtgcatctgaatgaatccctcaa

SEQ ID NO: 401501 - DNA, 25 bp, Rattus norvegicus
gcgtgcatctgattgaatccctcaa

SEQ ID NO: 401502 - DNA, 25 bp, Rattus norvegicus
gcgtgcatctgtacagcgtgaccat

SEQ ID NO: 401503 - DNA, 25 bp, Rattus norvegicus
gcgtgcatctgttcagcgtgaccat

SEQ ID NO: 401504 - DNA, 25 bp, Rattus norvegicus
gcgtgcatgcgtctggagtcaactc

SEQ ID NO: 401505 - DNA, 25 bp, Rattus norvegicus
gcgtgcatgcgtgtggagtcaactc

SEQ ID NO: 401506 - DNA, 25 bp, Rattus norvegicus
gcgtgcatgtgcctttattgtttct

SEQ ID NO: 401507 - DNA, 25 bp, Rattus norvegicus
gcgtgcatgtgcgtttattgtttct

SEQ ID NO: 401508 - DNA, 25 bp, Rattus norvegicus
gcgtgccagggaactattactttac

SEQ ID NO: 401509 - DNA, 25 bp, Rattus norvegicus
gcgtgccagggatctattactttac

SEQ ID NO: 401510 - DNA, 25 bp, Rattus norvegicus
gcgtgccatagaccatgtgtgttga

SEQ ID NO: 401511 - DNA, 25 bp, Rattus norvegicus
gcgtgccatagagcatgtgtgttga

SEQ ID NO: 401512 - DNA, 25 bp, Rattus norvegicus
gcgtgccctgtgactgggccatgtt

SEQ ID NO: 401513 - DNA, 25 bp, Rattus norvegicus
gcgtgccctgtgtctgggccatgtt

SEQ ID NO: 401514 - DNA, 25 bp, Rattus norvegicus
gcgtgccggaatagcgattaccagc

SEQ ID NO: 401515 - DNA, 25 bp, Rattus norvegicus
gcgtgccggaattgcgattaccagc

SEQ ID NO: 401516 - DNA, 25 bp, Rattus norvegicus
gcgtgcctacatacccgagggacag

SEQ ID NO: 401517 - DNA, 25 bp, Rattus norvegicus
gcgtgcctacattcccgagggacag

SEQ ID NO: 401518 - DNA, 25 bp, Rattus norvegicus
gcgtgcctatggatgtgcctgctgc

SEQ ID NO: 401519 - DNA, 25 bp, Rattus norvegicus
gcgtgcctatggttgtgcctgctgc

SEQ ID NO: 401520 - DNA, 25 bp, Rattus norvegicus
gcgtgcctgcctacagctcgggctg

SEQ ID NO: 401521 - DNA, 25 bp, Rattus norvegicus
gcgtgcctgccttcagctcgggctg

SEQ ID NO: 401522 - DNA, 25 bp, Rattus norvegicus
gcgtgcctgcgtagaatgtttgctt

SEQ ID NO: 401523 - DNA, 25 bp, Rattus norvegicus
gcgtgcctgcgttgaatgtttgctt

SEQ ID NO: 401524 - DNA, 25 bp, Rattus norvegicus
gcgtgcgacctcagcgtggtggccc

SEQ ID NO: 401525 - DNA, 25 bp, Rattus norvegicus
gcgtgcgacctctgcgtggtggccc

SEQ ID NO: 401526 - DNA, 25 bp, Rattus norvegicus
gcgtgcgagcgtcttgctccaataa

SEQ ID NO: 401527 - DNA, 25 bp, Rattus norvegicus
gcgtgcgagcgtgttgctccaataa

SEQ ID NO: 401528 - DNA, 25 bp, Rattus norvegicus
gcgtgcgcacagcttctcctagttc

SEQ ID NO: 401529 - DNA, 25 bp, Rattus norvegicus
gcgtgcgcacaggttctcctagttc

SEQ ID NO: 401530 - DNA, 25 bp, Rattus norvegicus
gcgtgcgctagcagtacctgtacgc

SEQ ID NO: 401531 - DNA, 25 bp, Rattus norvegicus
gcgtgcgctagctgtacctgtacgc

SEQ ID NO: 401532 - DNA, 25 bp, Rattus norvegicus
gcgtgcggcaggaagcaccttccag

SEQ ID NO: 401533 - DNA, 25 bp, Rattus norvegicus
gcgtgcggcaggtagcaccttccag

SEQ ID NO: 401534 - DNA, 25 bp, Rattus norvegicus
gcgtgcgtgtgtaaaatcattgcct

SEQ ID NO: 401535 - DNA, 25 bp, Rattus norvegicus
gcgtgcgtgtgttaaatcattgcct

SEQ ID NO: 401536 - DNA, 25 bp, Rattus norvegicus
gcgtgctcagtgacctcacagtgac

SEQ ID NO: 401537 - DNA, 25 bp, Rattus norvegicus
gcgtgctcagtgtcctcacagtgac

SEQ ID NO: 401538 - DNA, 25 bp, Rattus norvegicus
gcgtgctcccttccacagaacagag

SEQ ID NO: 401539 - DNA, 25 bp, Rattus norvegicus
gcgtgctcccttgcacagaacagag

SEQ ID NO: 401540 - DNA, 25 bp, Rattus norvegicus
gcgtgctcctcaccgactggtggct

SEQ ID NO: 401541 - DNA, 25 bp, Rattus norvegicus
gcgtgctcctcagcgactggtggct

SEQ ID NO: 401542 - DNA, 25 bp, Rattus norvegicus
gcgtgctctataatatttcctctca

SEQ ID NO: 401543 - DNA, 25 bp, Rattus norvegicus
gcgtgctctatattatttcctctca

SEQ ID NO: 401544 - DNA, 25 bp, Rattus norvegicus
gcgtgctcttggactgcgagccagc

SEQ ID NO: 401545 - DNA, 25 bp, Rattus norvegicus
gcgtgctcttggtctgcgagccagc

SEQ ID NO: 401546 - DNA, 25 bp, Rattus norvegicus
gcgtgctgaagaaccagagcctttt

SEQ ID NO: 401547 - DNA, 25 bp, Rattus norvegicus
gcgtgctgaagatccagagcctttt

SEQ ID NO: 401548 - DNA, 25 bp, Rattus norvegicus
gcgtgctgctaacaaattcgaattc

SEQ ID NO: 401549 - DNA, 25 bp, Rattus norvegicus
gcgtgctgctaagaaattcgaattc

SEQ ID NO: 401550 - DNA, 25 bp, Rattus norvegicus
gcgtgctgtgttactgttatactta

SEQ ID NO: 401551 - DNA, 25 bp, Rattus norvegicus
gcgtgctgtgtttctgttatactta

SEQ ID NO: 401552 - DNA, 25 bp, Rattus norvegicus
gcgtgcttaatgcaaggctccaatc

SEQ ID NO: 401553 - DNA, 25 bp, Rattus norvegicus
gcgtgcttaatggaaggctccaatc

SEQ ID NO: 401554 - DNA, 25 bp, Rattus norvegicus
gcgtgcttatttcaagcctcattct

SEQ ID NO: 401555 - DNA, 25 bp, Rattus norvegicus
gcgtgcttatttgaagcctcattct

SEQ ID NO: 401556 - DNA, 25 bp, Rattus norvegicus
gcgtgcttcactattaacagctcaa

SEQ ID NO: 401557 - DNA, 25 bp, Rattus norvegicus
gcgtgcttcacttttaacagctcaa

SEQ ID NO: 401558 - DNA, 25 bp, Rattus norvegicus
gcgtgcttctaactccgcagtaaag

SEQ ID NO: 401559 - DNA, 25 bp, Rattus norvegicus
gcgtgcttctaagtccgcagtaaag

SEQ ID NO: 401560 - DNA, 25 bp, Rattus norvegicus
gcgtgcttggttatatgtaactcaa

SEQ ID NO: 401561 - DNA, 25 bp, Rattus norvegicus
gcgtgcttggttttatgtaactcaa

SEQ ID NO: 401562 - DNA, 25 bp, Rattus norvegicus
gcgtgcttttgaatttagtgctcat

SEQ ID NO: 401563 - DNA, 25 bp, Rattus norvegicus
gcgtgcttttgattttagtgctcat

SEQ ID NO: 401564 - DNA, 25 bp, Rattus norvegicus
gcgtgctttttaatttcttacttcg

SEQ ID NO: 401565 - DNA, 25 bp, Rattus norvegicus
gcgtgctttttattttcttacttcg

SEQ ID NO: 401566 - DNA, 25 bp, Rattus norvegicus
gcgtggaactccctattccttattc

SEQ ID NO: 401567 - DNA, 25 bp, Rattus norvegicus
gcgtggaactccgtattccttattc

SEQ ID NO: 401568 - DNA, 25 bp, Rattus norvegicus
gcgtggaactgaaaagcctgcagca

SEQ ID NO: 401569 - DNA, 25 bp, Rattus norvegicus
gcgtggaactgataagcctgcagca

SEQ ID NO: 401570 - DNA, 25 bp, Rattus norvegicus
gcgtggacatccaatcactaagcgt

SEQ ID NO: 401571 - DNA, 25 bp, Rattus norvegicus
gcgtggacatcctatcactaagcgt

SEQ ID NO: 401572 - DNA, 25 bp, Rattus norvegicus
gcgtggaccaagatagaccctgggt

SEQ ID NO: 401573 - DNA, 25 bp, Rattus norvegicus
gcgtggaccaagttagaccctgggt

SEQ ID NO: 401574 - DNA, 25 bp, Rattus norvegicus
gcgtggaccttaaacttttgagaca

SEQ ID NO: 401575 - DNA, 25 bp, Rattus norvegicus
gcgtggaccttatacttttgagaca

SEQ ID NO: 401576 - DNA, 25 bp, Rattus norvegicus
gcgtggactacgctttagtgtattt

SEQ ID NO: 401577 - DNA, 25 bp, Rattus norvegicus
gcgtggactacggtttagtgtattt

SEQ ID NO: 401578 - DNA, 25 bp, Rattus norvegicus
gcgtggagacagcttgatactgcct

SEQ ID NO: 401579 - DNA, 25 bp, Rattus norvegicus
gcgtggagacaggttgatactgcct

SEQ ID NO: 401580 - DNA, 25 bp, Rattus norvegicus
gcgtggatgcgcagatgactaagta

SEQ ID NO: 401581 - DNA, 25 bp, Rattus norvegicus
gcgtggatgcgctgatgactaagta

SEQ ID NO: 401582 - DNA, 25 bp, Rattus norvegicus
gcgtggattattcggcgagttcttt

SEQ ID NO: 401583 - DNA, 25 bp, Rattus norvegicus
gcgtggattattgggcgagttcttt

SEQ ID NO: 401584 - DNA, 25 bp, Rattus norvegicus
gcgtggcaaatgcatgtaaatattt

SEQ ID NO: 401585 - DNA, 25 bp, Rattus norvegicus
gcgtggcaaatggatgtaaatattt

SEQ ID NO: 401586 - DNA, 25 bp, Rattus norvegicus
gcgtggcacctcagtttggagtacc

SEQ ID NO: 401587 - DNA, 25 bp, Rattus norvegicus
gcgtggcacctctgtttggagtacc

SEQ ID NO: 401588 - DNA, 25 bp, Rattus norvegicus
gcgtggcagagaagactcggacata

SEQ ID NO: 401589 - DNA, 25 bp, Rattus norvegicus
gcgtggcagagatgactcggacata

SEQ ID NO: 401590 - DNA, 25 bp, Rattus norvegicus
gcgtggcagcacattcatttaattc

SEQ ID NO: 401591 - DNA, 25 bp, Rattus norvegicus
gcgtggcagcactttcatttaattc

SEQ ID NO: 401592 - DNA, 25 bp, Rattus norvegicus
gcgtggccacacagttataatttgc

SEQ ID NO: 401593 - DNA, 25 bp, Rattus norvegicus
gcgtggccacactgttataatttgc

SEQ ID NO: 401594 - DNA, 25 bp, Rattus norvegicus
gcgtggcccctgacagaaatgtgat

SEQ ID NO: 401595 - DNA, 25 bp, Rattus norvegicus
gcgtggcccctgtcagaaatgtgat

SEQ ID NO: 401596 - DNA, 25 bp, Rattus norvegicus
gcgtggccctatattagaatacgtg

SEQ ID NO: 401597 - DNA, 25 bp, Rattus norvegicus
gcgtggccctattttagaatacgtg

SEQ ID NO: 401598 - DNA, 25 bp, Rattus norvegicus
gcgtggcctcctctatgctgagaaa

SEQ ID NO: 401599 - DNA, 25 bp, Rattus norvegicus
gcgtggcctcctgtatgctgagaaa

SEQ ID NO: 401600 - DNA, 25 bp, Rattus norvegicus
gcgtggcggcctatattaccattag

SEQ ID NO: 401601 - DNA, 25 bp, Rattus norvegicus
gcgtggcggcctttattaccattag

SEQ ID NO: 401602 - DNA, 25 bp, Rattus norvegicus
gcgtggcgggcaagaccagttcaat

SEQ ID NO: 401603 - DNA, 25 bp, Rattus norvegicus
gcgtggcgggcatgaccagttcaat

SEQ ID NO: 401604 - DNA, 25 bp, Rattus norvegicus
gcgtggcttgtcagttggagtcatc

SEQ ID NO: 401605 - DNA, 25 bp, Rattus norvegicus
gcgtggcttgtctgttggagtcatc

SEQ ID NO: 401606 - DNA, 25 bp, Rattus norvegicus
gcgtgggaggtgacagcaaaagctt

SEQ ID NO: 401607 - DNA, 25 bp, Rattus norvegicus
gcgtgggaggtgtcagcaaaagctt

SEQ ID NO: 401608 - DNA, 25 bp, Rattus norvegicus
gcgtgggcacatagtccgagcagtc

SEQ ID NO: 401609 - DNA, 25 bp, Rattus norvegicus
gcgtgggcacatctgtgctcacatt

SEQ ID NO: 401610 - DNA, 25 bp, Rattus norvegicus
gcgtgggcacatgtgtgctcacatt

SEQ ID NO: 401611 - DNA, 25 bp, Rattus norvegicus
gcgtgggcacattgtccgagcagtc

SEQ ID NO: 401612 - DNA, 25 bp, Rattus norvegicus
gcgtgggcatctcgctaccaaggaa

SEQ ID NO: 401613 - DNA, 25 bp, Rattus norvegicus
gcgtgggcatctggctaccaaggaa

SEQ ID NO: 401614 - DNA, 25 bp, Rattus norvegicus
gcgtgggccattacgatcctgtgac

SEQ ID NO: 401615 - DNA, 25 bp, Rattus norvegicus
gcgtgggccatttcgatcctgtgac

SEQ ID NO: 401616 - DNA, 25 bp, Rattus norvegicus
gcgtgggccgggaatcccacttgtt

SEQ ID NO: 401617 - DNA, 25 bp, Rattus norvegicus
gcgtgggccgggtatcccacttgtt

SEQ ID NO: 401618 - DNA, 25 bp, Rattus norvegicus
gcgtgggcctttccacaaggttaca

SEQ ID NO: 401619 - DNA, 25 bp, Rattus norvegicus
gcgtgggcctttgcacaaggttaca

SEQ ID NO: 401620 - DNA, 25 bp, Rattus norvegicus
gcgtgggcttcgaagtcaagctgct

SEQ ID NO: 401621 - DNA, 25 bp, Rattus norvegicus
gcgtgggcttcgtagtcaagctgct

SEQ ID NO: 401622 - DNA, 25 bp, Rattus norvegicus
gcgtgggtacgcaggtggttgagca

SEQ ID NO: 401623 - DNA, 25 bp, Rattus norvegicus
gcgtgggtacgctggtggttgagca

SEQ ID NO: 401624 - DNA, 25 bp, Rattus norvegicus
gcgtgggtcacaattggagatctta

SEQ ID NO: 401625 - DNA, 25 bp, Rattus norvegicus
gcgtgggtcacatttggagatctta

SEQ ID NO: 401626 - DNA, 25 bp, Rattus norvegicus
gcgtgggtgcagactccactccaag

SEQ ID NO: 401627 - DNA, 25 bp, Rattus norvegicus
gcgtgggtgcagtctccactccaag

SEQ ID NO: 401628 - DNA, 25 bp, Rattus norvegicus
gcgtggtatctcaattatgatcctg

SEQ ID NO: 401629 - DNA, 25 bp, Rattus norvegicus
gcgtggtatctctattatgatcctg

SEQ ID NO: 401630 - DNA, 25 bp, Rattus norvegicus
gcgtggtcacaacatcctgaaagta

SEQ ID NO: 401631 - DNA, 25 bp, Rattus norvegicus
gcgtggtcacaagatcctgaaagta

SEQ ID NO: 401632 - DNA, 25 bp, Rattus norvegicus
gcgtggtcgcacctgtctttaattc

SEQ ID NO: 401633 - DNA, 25 bp, Rattus norvegicus
gcgtggtcgcacgtgtctttaattc

SEQ ID NO: 401634 - DNA, 25 bp, Rattus norvegicus
gcgtggtgaaatcagggatctcttt

SEQ ID NO: 401635 - DNA, 25 bp, Rattus norvegicus
gcgtggtgaaatgagggatctcttt

SEQ ID NO: 401636 - DNA, 25 bp, Rattus norvegicus
gcgtggtgcagtactggcatactta

SEQ ID NO: 401637 - DNA, 25 bp, Rattus norvegicus
gcgtggtgcagttctggcatactta

SEQ ID NO: 401638 - DNA, 25 bp, Rattus norvegicus
gcgtggtgcgctactgggccgagga

SEQ ID NO: 401639 - DNA, 25 bp, Rattus norvegicus
gcgtggtgcgcttctgggccgagga

SEQ ID NO: 401640 - DNA, 25 bp, Rattus norvegicus
gcgtggtgtcacatgctttaatccc

SEQ ID NO: 401641 - DNA, 25 bp, Rattus norvegicus
gcgtggtgtcacttgctttaatccc

SEQ ID NO: 401642 - DNA, 25 bp, Rattus norvegicus
gcgtggttagtgcaacacaccccaa

SEQ ID NO: 401643 - DNA, 25 bp, Rattus norvegicus
gcgtggttagtggaacacaccccaa

SEQ ID NO: 401644 - DNA, 25 bp, Rattus norvegicus
gcgtggttccgcagacgaagcactt

SEQ ID NO: 401645 - DNA, 25 bp, Rattus norvegicus
gcgtggttccgctgacgaagcactt

SEQ ID NO: 401646 - DNA, 25 bp, Rattus norvegicus
gcgtggttcttcctgtctgcgatgt

SEQ ID NO: 401647 - DNA, 25 bp, Rattus norvegicus
gcgtggttcttcgtgtctgcgatgt

SEQ ID NO: 401648 - DNA, 25 bp, Rattus norvegicus
gcgtggttgttgagtagtcgctcat

SEQ ID NO: 401649 - DNA, 25 bp, Rattus norvegicus
gcgtggttgttgtgtagtcgctcat

SEQ ID NO: 401650 - DNA, 25 bp, Rattus norvegicus
gcgtgtaacgctattcccagtttat

SEQ ID NO: 401651 - DNA, 25 bp, Rattus norvegicus
gcgtgtaacgcttttcccagtttat

SEQ ID NO: 401652 - DNA, 25 bp, Rattus norvegicus
gcgtgtaccactaataggttcaaaa

SEQ ID NO: 401653 - DNA, 25 bp, Rattus norvegicus
gcgtgtaccacttataggttcaaaa

SEQ ID NO: 401654 - DNA, 25 bp, Rattus norvegicus
gcgtgtactgtgaaagccttgcaaa

SEQ ID NO: 401655 - DNA, 25 bp, Rattus norvegicus
gcgtgtactgtgtaagccttgcaaa

SEQ ID NO: 401656 - DNA, 25 bp, Rattus norvegicus
gcgtgtagactcaccagaaagcctg

SEQ ID NO: 401657 - DNA, 25 bp, Rattus norvegicus
gcgtgtagactctccagaaagcctg

SEQ ID NO: 401658 - DNA, 25 bp, Rattus norvegicus
gcgtgtatcgtgctttctgttggaa

SEQ ID NO: 401659 - DNA, 25 bp, Rattus norvegicus
gcgtgtatcgtggtttctgttggaa

SEQ ID NO: 401660 - DNA, 25 bp, Rattus norvegicus
gcgtgtatgggaattgagccactac

SEQ ID NO: 401661 - DNA, 25 bp, Rattus norvegicus
gcgtgtatgggatttgagccactac

SEQ ID NO: 401662 - DNA, 25 bp, Rattus norvegicus
gcgtgtattagcacatgttctcttt

SEQ ID NO: 401663 - DNA, 25 bp, Rattus norvegicus
gcgtgtattagctcatgttctcttt

SEQ ID NO: 401664 - DNA, 25 bp, Rattus norvegicus
gcgtgtcaccatataactgcacttc

SEQ ID NO: 401665 - DNA, 25 bp, Rattus norvegicus
gcgtgtcaccatttaactgcacttc

SEQ ID NO: 401666 - DNA, 25 bp, Rattus norvegicus
gcgtgtcagatacgtggtgcaccac

SEQ ID NO: 401667 - DNA, 25 bp, Rattus norvegicus
gcgtgtcagataggtggtgcaccac

SEQ ID NO: 401668 - DNA, 25 bp, Rattus norvegicus
gcgtgtcatagactacatcctcgac

SEQ ID NO: 401669 - DNA, 25 bp, Rattus norvegicus
gcgtgtcatagagtacatcctcgac

SEQ ID NO: 401670 - DNA, 25 bp, Rattus norvegicus
gcgtgtcatagcaatgccatgtgta

SEQ ID NO: 401671 - DNA, 25 bp, Rattus norvegicus
gcgtgtcatagctatgccatgtgta

SEQ ID NO: 401672 - DNA, 25 bp, Rattus norvegicus
gcgtgtcccatgactttcttttaaa

SEQ ID NO: 401673 - DNA, 25 bp, Rattus norvegicus
gcgtgtcccatgtctttcttttaaa

SEQ ID NO: 401674 - DNA, 25 bp, Rattus norvegicus
gcgtgtcctctgaccttaaatacat

SEQ ID NO: 401675 - DNA, 25 bp, Rattus norvegicus
gcgtgtcctctgtccttaaatacat

SEQ ID NO: 401676 - DNA, 25 bp, Rattus norvegicus
gcgtgtcctgccaactgagctgtac

SEQ ID NO: 401677 - DNA, 25 bp, Rattus norvegicus
gcgtgtcctgcctactgagctgtac

SEQ ID NO: 401678 - DNA, 25 bp, Rattus norvegicus
gcgtgtcctttaattggcttgtaag

SEQ ID NO: 401679 - DNA, 25 bp, Rattus norvegicus
gcgtgtcctttatttggcttgtaag

SEQ ID NO: 401680 - DNA, 25 bp, Rattus norvegicus
gcgtgtcgccctctcacgaggctgt

SEQ ID NO: 401681 - DNA, 25 bp, Rattus norvegicus
gcgtgtcgccctgtcacgaggctgt

SEQ ID NO: 401682 - DNA, 25 bp, Rattus norvegicus
gcgtgtctcatgacactatgtctgt

SEQ ID NO: 401683 - DNA, 25 bp, Rattus norvegicus
gcgtgtctcatgtcactatgtctgt

SEQ ID NO: 401684 - DNA, 25 bp, Rattus norvegicus
gcgtgtctcgcaagttgcactgtaa

SEQ ID NO: 401685 - DNA, 25 bp, Rattus norvegicus
gcgtgtctcgcatgttgcactgtaa

SEQ ID NO: 401686 - DNA, 25 bp, Rattus norvegicus
gcgtgtctgacaatctgacctacta

SEQ ID NO: 401687 - DNA, 25 bp, Rattus norvegicus
gcgtgtctgacattctgacctacta

SEQ ID NO: 401688 - DNA, 25 bp, Rattus norvegicus
gcgtgtcttactcctcattgaatca

SEQ ID NO: 401689 - DNA, 25 bp, Rattus norvegicus
gcgtgtcttactgctcattgaatca

SEQ ID NO: 401690 - DNA, 25 bp, Rattus norvegicus
gcgtgtgcacacaaaccttaacaag

SEQ ID NO: 401691 - DNA, 25 bp, Rattus norvegicus
gcgtgtgcacacaaggactggaacc

SEQ ID NO: 401692 - DNA, 25 bp, Rattus norvegicus
gcgtgtgcacactaaccttaacaag

SEQ ID NO: 401693 - DNA, 25 bp, Rattus norvegicus
gcgtgtgcacactaggactggaacc

SEQ ID NO: 401694 - DNA, 25 bp, Rattus norvegicus
gcgtgtgcagcacatgcaggaccat

SEQ ID NO: 401695 - DNA, 25 bp, Rattus norvegicus
gcgtgtgcagcagatgcaggaccat

SEQ ID NO: 401696 - DNA, 25 bp, Rattus norvegicus
gcgtgtgcattacgagcccgaagta

SEQ ID NO: 401697 - DNA, 25 bp, Rattus norvegicus
gcgtgtgcattaggagcccgaagta

SEQ ID NO: 401698 - DNA, 25 bp, Rattus norvegicus
gcgtgtgccaccatatttagctaag

SEQ ID NO: 401699 - DNA, 25 bp, Rattus norvegicus
gcgtgtgccaccttatttagctaag

SEQ ID NO: 401700 - DNA, 25 bp, Rattus norvegicus
gcgtgtgccagacatgcttgttaaa

SEQ ID NO: 401701 - DNA, 25 bp, Rattus norvegicus
gcgtgtgccagagatgcttgttaaa

SEQ ID NO: 401702 - DNA, 25 bp, Rattus norvegicus
gcgtgtgcgtctattcttagcaaaa

SEQ ID NO: 401703 - DNA, 25 bp, Rattus norvegicus
gcgtgtgcgtcttttcttagcaaaa

SEQ ID NO: 401704 - DNA, 25 bp, Rattus norvegicus
gcgtgtgctacgctccccagaagaa

SEQ ID NO: 401705 - DNA, 25 bp, Rattus norvegicus
gcgtgtgctacggtccccagaagaa

SEQ ID NO: 401706 - DNA, 25 bp, Rattus norvegicus
gcgtgtggccccagaggagcaccct

SEQ ID NO: 401707 - DNA, 25 bp, Rattus norvegicus
gcgtgtggcccctgaggagcaccct

SEQ ID NO: 401708 - DNA, 25 bp, Rattus norvegicus
gcgtgtgggcacaattttgtactta

SEQ ID NO: 401709 - DNA, 25 bp, Rattus norvegicus
gcgtgtgggcactattttgtactta

SEQ ID NO: 401710 - DNA, 25 bp, Rattus norvegicus
gcgtgtgggtgtccattcaagttca

SEQ ID NO: 401711 - DNA, 25 bp, Rattus norvegicus
gcgtgtgggtgtgcattcaagttca

SEQ ID NO: 401712 - DNA, 25 bp, Rattus norvegicus
gcgtgtgtactaagcctggtgtctc

SEQ ID NO: 401713 - DNA, 25 bp, Rattus norvegicus
gcgtgtgtactatgcctggtgtctc

SEQ ID NO: 401714 - DNA, 25 bp, Rattus norvegicus
gcgtgtgtattgatagccctattgt

SEQ ID NO: 401715 - DNA, 25 bp, Rattus norvegicus
gcgtgtgtattgttagccctattgt

SEQ ID NO: 401716 - DNA, 25 bp, Rattus norvegicus
gcgtgtgtctgcacatgcctgtctg

SEQ ID NO: 401717 - DNA, 25 bp, Rattus norvegicus
gcgtgtgtctgctcatgcctgtctg

SEQ ID NO: 401718 - DNA, 25 bp, Rattus norvegicus
gcgtgtgtgaagaccaactcgggaa

SEQ ID NO: 401719 - DNA, 25 bp, Rattus norvegicus
gcgtgtgtgaagtccaactcgggaa

SEQ ID NO: 401720 - DNA, 25 bp, Rattus norvegicus
gcgtgtgtgcaaactcttgagggtt

SEQ ID NO: 401721 - DNA, 25 bp, Rattus norvegicus
gcgtgtgtgcaatctcttgagggtt

SEQ ID NO: 401722 - DNA, 25 bp, Rattus norvegicus
gcgtgtgtgtcgctgacttacccat

SEQ ID NO: 401723 - DNA, 25 bp, Rattus norvegicus
gcgtgtgtgtcggtgacttacccat

SEQ ID NO: 401724 - DNA, 25 bp, Rattus norvegicus
gcgtgtgttcgcctgtgtgtataaa

SEQ ID NO: 401725 - DNA, 25 bp, Rattus norvegicus
gcgtgtgttcgcgtgtgtgtataaa

SEQ ID NO: 401726 - DNA, 25 bp, Rattus norvegicus
gcgtgttacccgaggaaagccatct

SEQ ID NO: 401727 - DNA, 25 bp, Rattus norvegicus
gcgtgttacccgtggaaagccatct

SEQ ID NO: 401728 - DNA, 25 bp, Rattus norvegicus
gcgtgttagtgaattctgttttctg

SEQ ID NO: 401729 - DNA, 25 bp, Rattus norvegicus
gcgtgttagtgatttctgttttctg

SEQ ID NO: 401730 - DNA, 25 bp, Rattus norvegicus
gcgtgttatgctcgactgcgtgtca

SEQ ID NO: 401731 - DNA, 25 bp, Rattus norvegicus
gcgtgttatgctggactgcgtgtca

SEQ ID NO: 401732 - DNA, 25 bp, Rattus norvegicus
gcgtgttcagacagcactgactcag

SEQ ID NO: 401733 - DNA, 25 bp, Rattus norvegicus
gcgtgttcagactgcactgactcag

SEQ ID NO: 401734 - DNA, 25 bp, Rattus norvegicus
gcgtgttcgtgtctctacaagatct

SEQ ID NO: 401735 - DNA, 25 bp, Rattus norvegicus
gcgtgttcgtgtgtctacaagatct

SEQ ID NO: 401736 - DNA, 25 bp, Rattus norvegicus
gcgtgttctcccatctgaaataagt

SEQ ID NO: 401737 - DNA, 25 bp, Rattus norvegicus
gcgtgttctcccttctgaaataagt

SEQ ID NO: 401738 - DNA, 25 bp, Rattus norvegicus
gcgtgttctctgacttaatgctttg

SEQ ID NO: 401739 - DNA, 25 bp, Rattus norvegicus
gcgtgttctctgtcttaatgctttg

SEQ ID NO: 401740 - DNA, 25 bp, Rattus norvegicus
gcgtgttgattgaggaactgcttct

SEQ ID NO: 401741 - DNA, 25 bp, Rattus norvegicus
gcgtgttgattgtggaactgcttct

SEQ ID NO: 401742 - DNA, 25 bp, Rattus norvegicus
gcgtgttgcagtctacatcggtatt

SEQ ID NO: 401743 - DNA, 25 bp, Rattus norvegicus
gcgtgttgcagtgtacatcggtatt

SEQ ID NO: 401744 - DNA, 25 bp, Rattus norvegicus
gcgtgttgctttctcagtgtgtgta

SEQ ID NO: 401745 - DNA, 25 bp, Rattus norvegicus
gcgtgttgctttgtcagtgtgtgta

SEQ ID NO: 401746 - DNA, 25 bp, Rattus norvegicus
gcgtgttggatcagtggcttcagca

SEQ ID NO: 401747 - DNA, 25 bp, Rattus norvegicus
gcgtgttggatctgtggcttcagca

SEQ ID NO: 401748 - DNA, 25 bp, Rattus norvegicus
gcgtgttgtgccacgagcaaggaca

SEQ ID NO: 401749 - DNA, 25 bp, Rattus norvegicus
gcgtgttgtgcctcgagcaaggaca

SEQ ID NO: 401750 - DNA, 25 bp, Rattus norvegicus
gcgtgtttaagcatgccctcaccag

SEQ ID NO: 401751 - DNA, 25 bp, Rattus norvegicus
gcgtgtttaagcttgccctcaccag

SEQ ID NO: 401752 - DNA, 25 bp, Rattus norvegicus
gcgtgtttacttaaggcagcattca

SEQ ID NO: 401753 - DNA, 25 bp, Rattus norvegicus
gcgtgtttactttaggcagcattca

SEQ ID NO: 401754 - DNA, 25 bp, Rattus norvegicus
gcgtgtttccggagccatgtcagaa

SEQ ID NO: 401755 - DNA, 25 bp, Rattus norvegicus
gcgtgtttccggtgccatgtcagaa

SEQ ID NO: 401756 - DNA, 25 bp, Rattus norvegicus
gcgtgtttggctaccccaatgagga

SEQ ID NO: 401757 - DNA, 25 bp, Rattus norvegicus
gcgtgtttggcttccccaatgagga

SEQ ID NO: 401758 - DNA, 25 bp, Rattus norvegicus
gcgtgtttttgtaaatcagttcctt

SEQ ID NO: 401759 - DNA, 25 bp, Rattus norvegicus
gcgtgtttttgttaatcagttcctt

SEQ ID NO: 401760 - DNA, 25 bp, Rattus norvegicus
gcgttaactggcatcatcactgatt

SEQ ID NO: 401761 - DNA, 25 bp, Rattus norvegicus
gcgttaactggcttcatcactgatt

SEQ ID NO: 401762 - DNA, 25 bp, Rattus norvegicus
gcgttaagtacgagagaagcctcca

SEQ ID NO: 401763 - DNA, 25 bp, Rattus norvegicus
gcgttaagtacgtgagaagcctcca

SEQ ID NO: 401764 - DNA, 25 bp, Rattus norvegicus
gcgttaccattcacatttcttgaca

SEQ ID NO: 401765 - DNA, 25 bp, Rattus norvegicus
gcgttaccattctcatttcttgaca

SEQ ID NO: 401766 - DNA, 25 bp, Rattus norvegicus
gcgttacccggacacgacaatcaac

SEQ ID NO: 401767 - DNA, 25 bp, Rattus norvegicus
gcgttacccggagacgacaatcaac

SEQ ID NO: 401768 - DNA, 25 bp, Rattus norvegicus
gcgttactcctccagtgacggatgt

SEQ ID NO: 401769 - DNA, 25 bp, Rattus norvegicus
gcgttactcctcgagtgacggatgt

SEQ ID NO: 401770 - DNA, 25 bp, Rattus norvegicus
gcgttactgcctctgtatagtataa

SEQ ID NO: 401771 - DNA, 25 bp, Rattus norvegicus
gcgttactgcctgtgtatagtataa

SEQ ID NO: 401772 - DNA, 25 bp, Rattus norvegicus
gcgttactgcgaaagcatatcctat

SEQ ID NO: 401773 - DNA, 25 bp, Rattus norvegicus
gcgttactgcgatagcatatcctat

SEQ ID NO: 401774 - DNA, 25 bp, Rattus norvegicus
gcgttagacacgattctgttgctat

SEQ ID NO: 401775 - DNA, 25 bp, Rattus norvegicus
gcgttagacacgtttctgttgctat

SEQ ID NO: 401776 - DNA, 25 bp, Rattus norvegicus
gcgttagacattacttaccgagccc

SEQ ID NO: 401777 - DNA, 25 bp, Rattus norvegicus
gcgttagacatttcttaccgagccc

SEQ ID NO: 401778 - DNA, 25 bp, Rattus norvegicus
gcgttagatgttcagttcttccacc

SEQ ID NO: 401779 - DNA, 25 bp, Rattus norvegicus
gcgttagatgttgagttcttccacc

SEQ ID NO: 401780 - DNA, 25 bp, Rattus norvegicus
gcgttagcactgagggcagcaccat

SEQ ID NO: 401781 - DNA, 25 bp, Rattus norvegicus
gcgttagcactgtgggcagcaccat

SEQ ID NO: 401782 - DNA, 25 bp, Rattus norvegicus
gcgttagccataacatgcttcttca

SEQ ID NO: 401783 - DNA, 25 bp, Rattus norvegicus
gcgttagccatatcatgcttcttca

SEQ ID NO: 401784 - DNA, 25 bp, Rattus norvegicus
gcgttagctgccagattactttatg

SEQ ID NO: 401785 - DNA, 25 bp, Rattus norvegicus
gcgttagctgcctgattactttatg

SEQ ID NO: 401786 - DNA, 25 bp, Rattus norvegicus
gcgttagtgccactattgagttgta

SEQ ID NO: 401787 - DNA, 25 bp, Rattus norvegicus
gcgttagtgccagtattgagttgta

SEQ ID NO: 401788 - DNA, 25 bp, Rattus norvegicus
gcgttatagcatataagcagtctga

SEQ ID NO: 401789 - DNA, 25 bp, Rattus norvegicus
gcgttatagcatttaagcagtctga

SEQ ID NO: 401790 - DNA, 25 bp, Rattus norvegicus
gcgttatcacgcacagtattacaca

SEQ ID NO: 401791 - DNA, 25 bp, Rattus norvegicus
gcgttatcacgctcagtattacaca

SEQ ID NO: 401792 - DNA, 25 bp, Rattus norvegicus
gcgttatccccgataaggagacatt

SEQ ID NO: 401793 - DNA, 25 bp, Rattus norvegicus
gcgttatccccgttaaggagacatt

SEQ ID NO: 401794 - DNA, 25 bp, Rattus norvegicus
gcgttatccgggatctgatgtcaga

SEQ ID NO: 401795 - DNA, 25 bp, Rattus norvegicus
gcgttatccgggttctgatgtcaga

SEQ ID NO: 401796 - DNA, 25 bp, Rattus norvegicus
gcgttatctcagcttcttcaggcgg

SEQ ID NO: 401797 - DNA, 25 bp, Rattus norvegicus
gcgttatctcaggttcttcaggcgg

SEQ ID NO: 401798 - DNA, 25 bp, Rattus norvegicus
gcgttattatctccccaaatggcgg

SEQ ID NO: 401799 - DNA, 25 bp, Rattus norvegicus
gcgttattatctgcccaaatggcgg

SEQ ID NO: 401800 - DNA, 25 bp, Rattus norvegicus
gcgttcaaaattccatttctcccgg

SEQ ID NO: 401801 - DNA, 25 bp, Rattus norvegicus
gcgttcaaaattgcatttctcccgg

SEQ ID NO: 401802 - DNA, 25 bp, Rattus norvegicus
gcgttcacctacacgccacagattt

SEQ ID NO: 401803 - DNA, 25 bp, Rattus norvegicus
gcgttcacctactcgccacagattt

SEQ ID NO: 401804 - DNA, 25 bp, Rattus norvegicus
gcgttcacgcttaggtgcgtgttcc

SEQ ID NO: 401805 - DNA, 25 bp, Rattus norvegicus
gcgttcacgctttggtgcgtgttcc

SEQ ID NO: 401806 - DNA, 25 bp, Rattus norvegicus
gcgttcacggttccaagcgatgttg

SEQ ID NO: 401807 - DNA, 25 bp, Rattus norvegicus
gcgttcacggttgcaagcgatgttg

SEQ ID NO: 401808 - DNA, 25 bp, Rattus norvegicus
gcgttcagaaccaatccctgtagat

SEQ ID NO: 401809 - DNA, 25 bp, Rattus norvegicus
gcgttcagaacctatccctgtagat

SEQ ID NO: 401810 - DNA, 25 bp, Rattus norvegicus
gcgttcagatgcaattgggccaaga

SEQ ID NO: 401811 - DNA, 25 bp, Rattus norvegicus
gcgttcagatgctattgggccaaga

SEQ ID NO: 401812 - DNA, 25 bp, Rattus norvegicus
gcgttcagcggcatttctcgcctga

SEQ ID NO: 401813 - DNA, 25 bp, Rattus norvegicus
gcgttcagcggcttttctcgcctga

SEQ ID NO: 401814 - DNA, 25 bp, Rattus norvegicus
gcgttcagtagtaccgtatgcacaa

SEQ ID NO: 401815 - DNA, 25 bp, Rattus norvegicus
gcgttcagtagttccgtatgcacaa

SEQ ID NO: 401816 - DNA, 25 bp, Rattus norvegicus
gcgttcattgaaccagtattctcaa

SEQ ID NO: 401817 - DNA, 25 bp, Rattus norvegicus
gcgttcattgaagcagtattctcaa

SEQ ID NO: 401818 - DNA, 25 bp, Rattus norvegicus
gcgttcatttcaatcggcaagcgga

SEQ ID NO: 401819 - DNA, 25 bp, Rattus norvegicus
gcgttcatttcattcggcaagcgga

SEQ ID NO: 401820 - DNA, 25 bp, Rattus norvegicus
gcgttcccgatccagagaccgtgga

SEQ ID NO: 401821 - DNA, 25 bp, Rattus norvegicus
gcgttcccgatcgagagaccgtgga

SEQ ID NO: 401822 - DNA, 25 bp, Rattus norvegicus
gcgttcccggttcatgccataaagg

SEQ ID NO: 401823 - DNA, 25 bp, Rattus norvegicus
gcgttcccggttgatgccataaagg

SEQ ID NO: 401824 - DNA, 25 bp, Rattus norvegicus
gcgttcctcacacacaagagccagt

SEQ ID NO: 401825 - DNA, 25 bp, Rattus norvegicus
gcgttcctcacagacaagagccagt

SEQ ID NO: 401826 - DNA, 25 bp, Rattus norvegicus
gcgttcctgcgcaaagggatcagtg

SEQ ID NO: 401827 - DNA, 25 bp, Rattus norvegicus
gcgttcctgcgctaagggatcagtg

SEQ ID NO: 401828 - DNA, 25 bp, Rattus norvegicus
gcgttcgatcgaaagttactaccac

SEQ ID NO: 401829 - DNA, 25 bp, Rattus norvegicus
gcgttcgatcgatagttactaccac

SEQ ID NO: 401830 - DNA, 25 bp, Rattus norvegicus
gcgttcgcagttccagcgattgcaa

SEQ ID NO: 401831 - DNA, 25 bp, Rattus norvegicus
gcgttcgcagttgcagcgattgcaa

SEQ ID NO: 401832 - DNA, 25 bp, Rattus norvegicus
gcgttcgcgtgcacgaagtggcctc

SEQ ID NO: 401833 - DNA, 25 bp, Rattus norvegicus
gcgttcgcgtgctcgaagtggcctc

SEQ ID NO: 401834 - DNA, 25 bp, Rattus norvegicus
gcgttcggacctcaggccagtgcca

SEQ ID NO: 401835 - DNA, 25 bp, Rattus norvegicus
gcgttcggacctgaggccagtgcca

SEQ ID NO: 401836 - DNA, 25 bp, Rattus norvegicus
gcgttcgttggaccgagcacctcaa

SEQ ID NO: 401837 - DNA, 25 bp, Rattus norvegicus
gcgttcgttggagcgagcacctcaa

SEQ ID NO: 401838 - DNA, 25 bp, Rattus norvegicus
gcgttcgtttctctattatattctg

SEQ ID NO: 401839 - DNA, 25 bp, Rattus norvegicus
gcgttcgtttctgtattatattctg

SEQ ID NO: 401840 - DNA, 25 bp, Rattus norvegicus
gcgttctatagacacctcattcatt

SEQ ID NO: 401841 - DNA, 25 bp, Rattus norvegicus
gcgttctatagagacctcattcatt

SEQ ID NO: 401842 - DNA, 25 bp, Rattus norvegicus
gcgttctatgagcagtttgccaact

SEQ ID NO: 401843 - DNA, 25 bp, Rattus norvegicus
gcgttctatgaggagtttgccaact

SEQ ID NO: 401844 - DNA, 25 bp, Rattus norvegicus
gcgttctccgagaggcctctgtaga

SEQ ID NO: 401845 - DNA, 25 bp, Rattus norvegicus
gcgttctccgagtggcctctgtaga

SEQ ID NO: 401846 - DNA, 25 bp, Rattus norvegicus
gcgttctgacctaacagccaaggaa

SEQ ID NO: 401847 - DNA, 25 bp, Rattus norvegicus
gcgttctgaccttacagccaaggaa

SEQ ID NO: 401848 - DNA, 25 bp, Rattus norvegicus
gcgttctgcctacattcttctggaa

SEQ ID NO: 401849 - DNA, 25 bp, Rattus norvegicus
gcgttctgcctagattcttctggaa

SEQ ID NO: 401850 - DNA, 25 bp, Rattus norvegicus
gcgttctgccttctgttgacttgag

SEQ ID NO: 401851 - DNA, 25 bp, Rattus norvegicus
gcgttctgccttgtgttgacttgag

SEQ ID NO: 401852 - DNA, 25 bp, Rattus norvegicus
gcgttcttagataccacatgcttca

SEQ ID NO: 401853 - DNA, 25 bp, Rattus norvegicus
gcgttcttagattccacatgcttca

SEQ ID NO: 401854 - DNA, 25 bp, Rattus norvegicus
gcgttcttcacgctttgagtagctt

SEQ ID NO: 401855 - DNA, 25 bp, Rattus norvegicus
gcgttcttcacggtttgagtagctt

SEQ ID NO: 401856 - DNA, 25 bp, Rattus norvegicus
gcgttcttccgacgacccataggga

SEQ ID NO: 401857 - DNA, 25 bp, Rattus norvegicus
gcgttcttccgaggacccataggga

SEQ ID NO: 401858 - DNA, 25 bp, Rattus norvegicus
gcgttcttctcacactgacttaaaa

SEQ ID NO: 401859 - DNA, 25 bp, Rattus norvegicus
gcgttcttctcagactgacttaaaa

SEQ ID NO: 401860 - DNA, 25 bp, Rattus norvegicus
gcgttgacctttatacatatttaat

SEQ ID NO: 401861 - DNA, 25 bp, Rattus norvegicus
gcgttgacctttttacatatttaat

SEQ ID NO: 401862 - DNA, 25 bp, Rattus norvegicus
gcgttgacttaactgacccctgaga

SEQ ID NO: 401863 - DNA, 25 bp, Rattus norvegicus
gcgttgacttaagtgacccctgaga

SEQ ID NO: 401864 - DNA, 25 bp, Rattus norvegicus
gcgttgagcgataccgttgttagct

SEQ ID NO: 401865 - DNA, 25 bp, Rattus norvegicus
gcgttgagcgattccgttgttagct

SEQ ID NO: 401866 - DNA, 25 bp, Rattus norvegicus
gcgttgatttcaattttctggcttt

SEQ ID NO: 401867 - DNA, 25 bp, Rattus norvegicus
gcgttgatttcatttttctggcttt

SEQ ID NO: 401868 - DNA, 25 bp, Rattus norvegicus
gcgttgcagctgaagagacggctca

SEQ ID NO: 401869 - DNA, 25 bp, Rattus norvegicus
gcgttgcagctgtagagacggctca

SEQ ID NO: 401870 - DNA, 25 bp, Rattus norvegicus
gcgttgctaggaatgcgtcagtttt

SEQ ID NO: 401871 - DNA, 25 bp, Rattus norvegicus
gcgttgctaggattgcgtcagtttt

SEQ ID NO: 401872 - DNA, 25 bp, Rattus norvegicus
gcgttgctcagtacccatcaataaa

SEQ ID NO: 401873 - DNA, 25 bp, Rattus norvegicus
gcgttgctcagttcccatcaataaa

SEQ ID NO: 401874 - DNA, 25 bp, Rattus norvegicus
gcgttgcttgttcctcacatgatct

SEQ ID NO: 401875 - DNA, 25 bp, Rattus norvegicus
gcgttgcttgttgctcacatgatct

SEQ ID NO: 401876 - DNA, 25 bp, Rattus norvegicus
gcgttgggttgtatccttatacaga

SEQ ID NO: 401877 - DNA, 25 bp, Rattus norvegicus
gcgttgggttgtttccttatacaga

SEQ ID NO: 401878 - DNA, 25 bp, Rattus norvegicus
gcgttggtagagacgagcaccgcac

SEQ ID NO: 401879 - DNA, 25 bp, Rattus norvegicus
gcgttggtagagtcgagcaccgcac

SEQ ID NO: 401880 - DNA, 25 bp, Rattus norvegicus
gcgttggtgaccatgtacagccatg

SEQ ID NO: 401881 - DNA, 25 bp, Rattus norvegicus
gcgttggtgaccttgtacagccatg

SEQ ID NO: 401882 - DNA, 25 bp, Rattus norvegicus
gcgttggtgtgcatagggcctaaaa

SEQ ID NO: 401883 - DNA, 25 bp, Rattus norvegicus
gcgttggtgtgcttagggcctaaaa

SEQ ID NO: 401884 - DNA, 25 bp, Rattus norvegicus
gcgttggtttaaactctccttataa

SEQ ID NO: 401885 - DNA, 25 bp, Rattus norvegicus
gcgttggtttaatctctccttataa

SEQ ID NO: 401886 - DNA, 25 bp, Rattus norvegicus
gcgttgtactgacagcactcatgga

SEQ ID NO: 401887 - DNA, 25 bp, Rattus norvegicus
gcgttgtactgagagcactcatgga

SEQ ID NO: 401888 - DNA, 25 bp, Rattus norvegicus
gcgttgtcacatattccattgctta

SEQ ID NO: 401889 - DNA, 25 bp, Rattus norvegicus
gcgttgtcacattttccattgctta

SEQ ID NO: 401890 - DNA, 25 bp, Rattus norvegicus
gcgttgtctggacttcctgtaggaa

SEQ ID NO: 401891 - DNA, 25 bp, Rattus norvegicus
gcgttgtctggagttcctgtaggaa

SEQ ID NO: 401892 - DNA, 25 bp, Rattus norvegicus
gcgttgtcttatctttcttttatcc

SEQ ID NO: 401893 - DNA, 25 bp, Rattus norvegicus
gcgttgtcttatgtttcttttatcc

SEQ ID NO: 401894 - DNA, 25 bp, Rattus norvegicus
gcgttgtgatacacatgcaatgtgc

SEQ ID NO: 401895 - DNA, 25 bp, Rattus norvegicus
gcgttgtgatactcatgcaatgtgc

SEQ ID NO: 401896 - DNA, 25 bp, Rattus norvegicus
gcgttgttaggcatactttgtcctt

SEQ ID NO: 401897 - DNA, 25 bp, Rattus norvegicus
gcgttgttaggcttactttgtcctt

SEQ ID NO: 401898 - DNA, 25 bp, Rattus norvegicus
gcgttgttgcttaggatggccttcc

SEQ ID NO: 401899 - DNA, 25 bp, Rattus norvegicus
gcgttgttgctttggatggccttcc

SEQ ID NO: 401900 - DNA, 25 bp, Rattus norvegicus
gcgtttaacatcactcagaggcaga

SEQ ID NO: 401901 - DNA, 25 bp, Rattus norvegicus
gcgtttaacatctctcagaggcaga

SEQ ID NO: 401902 - DNA, 25 bp, Rattus norvegicus
gcgtttaagttcattctccagtgta

SEQ ID NO: 401903 - DNA, 25 bp, Rattus norvegicus
gcgtttaagttctttctccagtgta

SEQ ID NO: 401904 - DNA, 25 bp, Rattus norvegicus
gcgtttaggaaacaccagagctagc

SEQ ID NO: 401905 - DNA, 25 bp, Rattus norvegicus
gcgtttaggaaagaccagagctagc

SEQ ID NO: 401906 - DNA, 25 bp, Rattus norvegicus
gcgtttcattggaggagagctttga

SEQ ID NO: 401907 - DNA, 25 bp, Rattus norvegicus
gcgtttcattggtggagagctttga

SEQ ID NO: 401908 - DNA, 25 bp, Rattus norvegicus
gcgtttcatttcaactgtgattgtt

SEQ ID NO: 401909 - DNA, 25 bp, Rattus norvegicus
gcgtttcatttctactgtgattgtt

SEQ ID NO: 401910 - DNA, 25 bp, Rattus norvegicus
gcgtttccacgtaataacgattggg

SEQ ID NO: 401911 - DNA, 25 bp, Rattus norvegicus
gcgtttccacgttataacgattggg

SEQ ID NO: 401912 - DNA, 25 bp, Rattus norvegicus
gcgtttccatatcgtttggtttcat

SEQ ID NO: 401913 - DNA, 25 bp, Rattus norvegicus
gcgtttccatatggtttggtttcat

SEQ ID NO: 401914 - DNA, 25 bp, Rattus norvegicus
gcgtttcccaggcagtgacccgtgt

SEQ ID NO: 401915 - DNA, 25 bp, Rattus norvegicus
gcgtttcccagggagtgacccgtgt

SEQ ID NO: 401916 - DNA, 25 bp, Rattus norvegicus
gcgtttcctctgaggaaaatatgtg

SEQ ID NO: 401917 - DNA, 25 bp, Rattus norvegicus
gcgtttcctctgtggaaaatatgtg

SEQ ID NO: 401918 - DNA, 25 bp, Rattus norvegicus
gcgtttcctttgaaatctaacctga

SEQ ID NO: 401919 - DNA, 25 bp, Rattus norvegicus
gcgtttcctttgtaatctaacctga

SEQ ID NO: 401920 - DNA, 25 bp, Rattus norvegicus
gcgtttctaagtatgtatgtgtcta

SEQ ID NO: 401921 - DNA, 25 bp, Rattus norvegicus
gcgtttctaagtttgtatgtgtcta

SEQ ID NO: 401922 - DNA, 25 bp, Rattus norvegicus
gcgtttctatctcggcactaaaaca

SEQ ID NO: 401923 - DNA, 25 bp, Rattus norvegicus
gcgtttctatctgggcactaaaaca

SEQ ID NO: 401924 - DNA, 25 bp, Rattus norvegicus
gcgtttcttgtgcttgtgctgttaa

SEQ ID NO: 401925 - DNA, 25 bp, Rattus norvegicus
gcgtttcttgtggttgtgctgttaa

SEQ ID NO: 401926 - DNA, 25 bp, Rattus norvegicus
gcgtttgagtttcagcttatgccag

SEQ ID NO: 401927 - DNA, 25 bp, Rattus norvegicus
gcgtttgagtttgagcttatgccag

SEQ ID NO: 401928 - DNA, 25 bp, Rattus norvegicus
gcgtttgccctccatggtgtggtaa

SEQ ID NO: 401929 - DNA, 25 bp, Rattus norvegicus
gcgtttgccctcgatggtgtggtaa

SEQ ID NO: 401930 - DNA, 25 bp, Rattus norvegicus
gcgtttgcgagtcagcgtgtacact

SEQ ID NO: 401931 - DNA, 25 bp, Rattus norvegicus
gcgtttgcgagtgagcgtgtacact

SEQ ID NO: 401932 - DNA, 25 bp, Rattus norvegicus
gcgtttgcttggctctggtaccaaa

SEQ ID NO: 401933 - DNA, 25 bp, Rattus norvegicus
gcgtttgcttgggtctggtaccaaa

SEQ ID NO: 401934 - DNA, 25 bp, Rattus norvegicus
gcgtttgtagttactgcagctttcc

SEQ ID NO: 401935 - DNA, 25 bp, Rattus norvegicus
gcgtttgtagtttctgcagctttcc

SEQ ID NO: 401936 - DNA, 25 bp, Rattus norvegicus
gcgtttgtgcacaggctccatggga

SEQ ID NO: 401937 - DNA, 25 bp, Rattus norvegicus
gcgtttgtgcactggctccatggga

SEQ ID NO: 401938 - DNA, 25 bp, Rattus norvegicus
gcgtttgtgctgagcttctcattga

SEQ ID NO: 401939 - DNA, 25 bp, Rattus norvegicus
gcgtttgtgctgtgcttctcattga

SEQ ID NO: 401940 - DNA, 25 bp, Rattus norvegicus
gcgtttgttataccgtttgcccatt

SEQ ID NO: 401941 - DNA, 25 bp, Rattus norvegicus
gcgtttgttatagcgtttgcccatt

SEQ ID NO: 401942 - DNA, 25 bp, Rattus norvegicus
gcgtttgttcagctgcttccggttc

SEQ ID NO: 401943 - DNA, 25 bp, Rattus norvegicus
gcgtttgttcaggtgcttccggttc

SEQ ID NO: 401944 - DNA, 25 bp, Rattus norvegicus
gcgtttgttcccaagaactttggat

SEQ ID NO: 401945 - DNA, 25 bp, Rattus norvegicus
gcgtttgttccctagaactttggat

SEQ ID NO: 401946 - DNA, 25 bp, Rattus norvegicus
gcgtttgttcttactctccagagag

SEQ ID NO: 401947 - DNA, 25 bp, Rattus norvegicus
gcgtttgttctttctctccagagag

SEQ ID NO: 401948 - DNA, 25 bp, Rattus norvegicus
gcgttttaatacctaggctctgtta

SEQ ID NO: 401949 - DNA, 25 bp, Rattus norvegicus
gcgttttaatacgtaggctctgtta

SEQ ID NO: 401950 - DNA, 25 bp, Rattus norvegicus
gcgttttagtgacggccagctccaa

SEQ ID NO: 401951 - DNA, 25 bp, Rattus norvegicus
gcgttttagtgagggccagctccaa

SEQ ID NO: 401952 - DNA, 25 bp, Rattus norvegicus
gcgttttcattcatgtatttgacta

SEQ ID NO: 401953 - DNA, 25 bp, Rattus norvegicus
gcgttttcattcttgtatttgacta

SEQ ID NO: 401954 - DNA, 25 bp, Rattus norvegicus
gcgttttccaacagtatagatctca

SEQ ID NO: 401955 - DNA, 25 bp, Rattus norvegicus
gcgttttccaactgtatagatctca

SEQ ID NO: 401956 - DNA, 25 bp, Rattus norvegicus
gcgttttccaccctatctaaatgta

SEQ ID NO: 401957 - DNA, 25 bp, Rattus norvegicus
gcgttttccaccgtatctaaatgta

SEQ ID NO: 401958 - DNA, 25 bp, Rattus norvegicus
gcgttttcctcccatataatcaaga

SEQ ID NO: 401959 - DNA, 25 bp, Rattus norvegicus
gcgttttcctccgatataatcaaga

SEQ ID NO: 401960 - DNA, 25 bp, Rattus norvegicus
gcgttttctacgacttattaccatt

SEQ ID NO: 401961 - DNA, 25 bp, Rattus norvegicus
gcgttttctacgtcttattaccatt

SEQ ID NO: 401962 - DNA, 25 bp, Rattus norvegicus
gcgttttctccgaacctgtgtgaaa

SEQ ID NO: 401963 - DNA, 25 bp, Rattus norvegicus
gcgttttctccgtacctgtgtgaaa

SEQ ID NO: 401964 - DNA, 25 bp, Rattus norvegicus
gcgttttgataacagcgacctctct

SEQ ID NO: 401965 - DNA, 25 bp, Rattus norvegicus
gcgttttgataagagcgacctctct

SEQ ID NO: 401966 - DNA, 25 bp, Rattus norvegicus
gcgttttgcccgcagcgatgagctc

SEQ ID NO: 401967 - DNA, 25 bp, Rattus norvegicus
gcgttttgcccggagcgatgagctc

SEQ ID NO: 401968 - DNA, 25 bp, Rattus norvegicus
gcgtttttaagtagttgtttagcag

SEQ ID NO: 401969 - DNA, 25 bp, Rattus norvegicus
gcgtttttaagttgttgtttagcag

SEQ ID NO: 401970 - DNA, 25 bp, Rattus norvegicus
gcgtttttatacatgatgcagtcaa

SEQ ID NO: 401971 - DNA, 25 bp, Rattus norvegicus
gcgtttttatacttgatgcagtcaa

SEQ ID NO: 401972 - DNA, 25 bp, Rattus norvegicus
gcgtttttcaacaaggagtccagga

SEQ ID NO: 401973 - DNA, 25 bp, Rattus norvegicus
gcgtttttcaactaggagtccagga

SEQ ID NO: 401974 - DNA, 25 bp, Rattus norvegicus
gcgtttttcaccagtacgaggagta

SEQ ID NO: 401975 - DNA, 25 bp, Rattus norvegicus
gcgtttttcacctgtacgaggagta

SEQ ID NO: 401976 - DNA, 25 bp, Rattus norvegicus
gcgtttttcacgaggcttcgggaag

SEQ ID NO: 401977 - DNA, 25 bp, Rattus norvegicus
gcgtttttcacgtggcttcgggaag

SEQ ID NO: 401978 - DNA, 25 bp, Rattus norvegicus
gcgtttttctatcttatcctgtgtg

SEQ ID NO: 401979 - DNA, 25 bp, Rattus norvegicus
gcgtttttctatgttatcctgtgtg

SEQ ID NO: 401980 - DNA, 25 bp, Rattus norvegicus
gcgtttttgtccctctgatagacat

SEQ ID NO: 401981 - DNA, 25 bp, Rattus norvegicus
gcgtttttgtccgtctgatagacat

SEQ ID NO: 401982 - DNA, 25 bp, Rattus norvegicus
gcgtttttgtcgaaaacctgttatg

SEQ ID NO: 401983 - DNA, 25 bp, Rattus norvegicus
gcgtttttgtcgtaaacctgttatg

SEQ ID NO: 401984 - DNA, 25 bp, Rattus norvegicus
gcgttttttgcaacgtgtgtttggc

SEQ ID NO: 401985 - DNA, 25 bp, Rattus norvegicus
gcgttttttgcatcgtgtgtttggc

SEQ ID NO: 401986 - DNA, 25 bp, Rattus norvegicus
gctaaaaatgccctttgtttctatt

SEQ ID NO: 401987 - DNA, 25 bp, Rattus norvegicus
gctaaaaatgccgtttgtttctatt

SEQ ID NO: 401988 - DNA, 25 bp, Rattus norvegicus
gctaaaacatctagctccagtaaaa

SEQ ID NO: 401989 - DNA, 25 bp, Rattus norvegicus
gctaaaacatcttgctccagtaaaa

SEQ ID NO: 401990 - DNA, 25 bp, Rattus norvegicus
gctaaaacccctcgcaaaactgtct

SEQ ID NO: 401991 - DNA, 25 bp, Rattus norvegicus
gctaaaacccctggcaaaactgtct

SEQ ID NO: 401992 - DNA, 25 bp, Rattus norvegicus
gctaaaacgtttctcccaggccttg

SEQ ID NO: 401993 - DNA, 25 bp, Rattus norvegicus
gctaaaacgtttgtcccaggccttg

SEQ ID NO: 401994 - DNA, 25 bp, Rattus norvegicus
gctaaaagaatccacttccctcggg

SEQ ID NO: 401995 - DNA, 25 bp, Rattus norvegicus
gctaaaagaatcgacttccctcggg

SEQ ID NO: 401996 - DNA, 25 bp, Rattus norvegicus
gctaaaagcggtaatcacgatgatt

SEQ ID NO: 401997 - DNA, 25 bp, Rattus norvegicus
gctaaaagcggttatcacgatgatt

SEQ ID NO: 401998 - DNA, 25 bp, Rattus norvegicus
gctaaaagctaacgatttctcttca

SEQ ID NO: 401999 - DNA, 25 bp, Rattus norvegicus
gctaaaagctaaggatttctcttca

SEQ ID NO: 402000 - DNA, 25 bp, Rattus norvegicus
gctaaaagtggcagtgaactctctg

SEQ ID NO: 402001 - DNA, 25 bp, Rattus norvegicus
gctaaaagtggctgtgaactctctg

SEQ ID NO: 402002 - DNA, 25 bp, Rattus norvegicus
gctaaaagttctcccagtggccact

SEQ ID NO: 402003 - DNA, 25 bp, Rattus norvegicus
gctaaaagttctgccagtggccact

SEQ ID NO: 402004 - DNA, 25 bp, Rattus norvegicus
gctaaaagtttccaagagagtccgt

SEQ ID NO: 402005 - DNA, 25 bp, Rattus norvegicus
gctaaaagtttcgaagagagtccgt

SEQ ID NO: 402006 - DNA, 25 bp, Rattus norvegicus
gctaaaatccatccaagactgtcat

SEQ ID NO: 402007 - DNA, 25 bp, Rattus norvegicus
gctaaaatccatgcaagactgtcat

SEQ ID NO: 402008 - DNA, 25 bp, Rattus norvegicus
gctaaaatgaggcaccgcaccacca

SEQ ID NO: 402009 - DNA, 25 bp, Rattus norvegicus
gctaaaatgagggaccgcaccacca

SEQ ID NO: 402010 - DNA, 25 bp, Rattus norvegicus
gctaaaatgcagatgctcacgcctg

SEQ ID NO: 402011 - DNA, 25 bp, Rattus norvegicus
gctaaaatgcagttgctcacgcctg

SEQ ID NO: 402012 - DNA, 25 bp, Rattus norvegicus
gctaaacagtcgcttgatcccagac

SEQ ID NO: 402013 - DNA, 25 bp, Rattus norvegicus
gctaaacagtcggttgatcccagac

SEQ ID NO: 402014 - DNA, 25 bp, Rattus norvegicus
gctaaacccaaccacattctgattt

SEQ ID NO: 402015 - DNA, 25 bp, Rattus norvegicus
gctaaacccaacgacattctgattt

SEQ ID NO: 402016 - DNA, 25 bp, Rattus norvegicus
gctaaacctgatcccaaacctgagt

SEQ ID NO: 402017 - DNA, 25 bp, Rattus norvegicus
gctaaacctgatgccaaacctgagt

SEQ ID NO: 402018 - DNA, 25 bp, Rattus norvegicus
gctaaaccttttacacgaacttgat

SEQ ID NO: 402019 - DNA, 25 bp, Rattus norvegicus
gctaaacctttttcacgaacttgat

SEQ ID NO: 402020 - DNA, 25 bp, Rattus norvegicus
gctaaacgagggacgcgtcacatcg

SEQ ID NO: 402021 - DNA, 25 bp, Rattus norvegicus
gctaaacgagggtcgcgtcacatcg

SEQ ID NO: 402022 - DNA, 25 bp, Rattus norvegicus
gctaaacgctggaattgttgattaa

SEQ ID NO: 402023 - DNA, 25 bp, Rattus norvegicus
gctaaacgctggtattgttgattaa

SEQ ID NO: 402024 - DNA, 25 bp, Rattus norvegicus
gctaaactgagtaccagacgtgtct

SEQ ID NO: 402025 - DNA, 25 bp, Rattus norvegicus
gctaaactgagttccagacgtgtct

SEQ ID NO: 402026 - DNA, 25 bp, Rattus norvegicus
gctaaacttcatctgtgtcccatca

SEQ ID NO: 402027 - DNA, 25 bp, Rattus norvegicus
gctaaacttcatgtgtgtcccatca

SEQ ID NO: 402028 - DNA, 25 bp, Rattus norvegicus
gctaaacttctcattcccattggtt

SEQ ID NO: 402029 - DNA, 25 bp, Rattus norvegicus
gctaaacttctctttcccattggtt

SEQ ID NO: 402030 - DNA, 25 bp, Rattus norvegicus
gctaaactttcaattgtacttttat

SEQ ID NO: 402031 - DNA, 25 bp, Rattus norvegicus
gctaaactttcatttgtacttttat

SEQ ID NO: 402032 - DNA, 25 bp, Rattus norvegicus
gctaaactttgcctccagtggttaa

SEQ ID NO: 402033 - DNA, 25 bp, Rattus norvegicus
gctaaactttgcgtccagtggttaa

SEQ ID NO: 402034 - DNA, 25 bp, Rattus norvegicus
gctaaagaaactatattcaggccac

SEQ ID NO: 402035 - DNA, 25 bp, Rattus norvegicus
gctaaagaaactttattcaggccac

SEQ ID NO: 402036 - DNA, 25 bp, Rattus norvegicus
gctaaagatgttcgtagagtgcctg

SEQ ID NO: 402037 - DNA, 25 bp, Rattus norvegicus
gctaaagatgttggtagagtgcctg

SEQ ID NO: 402038 - DNA, 25 bp, Rattus norvegicus
gctaaagcaagcaagccaggccctt

SEQ ID NO: 402039 - DNA, 25 bp, Rattus norvegicus
gctaaagcaagctagccaggccctt

SEQ ID NO: 402040 - DNA, 25 bp, Rattus norvegicus
gctaaagcactacgccgggagtacg

SEQ ID NO: 402041 - DNA, 25 bp, Rattus norvegicus
gctaaagcactaggccgggagtacg

SEQ ID NO: 402042 - DNA, 25 bp, Rattus norvegicus
gctaaagctcgtcctatcaatttga

SEQ ID NO: 402043 - DNA, 25 bp, Rattus norvegicus
gctaaagctcgtgctatcaatttga

SEQ ID NO: 402044 - DNA, 25 bp, Rattus norvegicus
gctaaaggaaacacgccagcgccgt

SEQ ID NO: 402045 - DNA, 25 bp, Rattus norvegicus
gctaaaggaaactcgccagcgccgt

SEQ ID NO: 402046 - DNA, 25 bp, Rattus norvegicus
gctaaaggacttcttggaccagatc

SEQ ID NO: 402047 - DNA, 25 bp, Rattus norvegicus
gctaaaggacttgttggaccagatc

SEQ ID NO: 402048 - DNA, 25 bp, Rattus norvegicus
gctaaagggtaccaacttgtcattg

SEQ ID NO: 402049 - DNA, 25 bp, Rattus norvegicus
gctaaagggtacgaacttgtcattg

SEQ ID NO: 402050 - DNA, 25 bp, Rattus norvegicus
gctaaaggtgacagactacatcgca

SEQ ID NO: 402051 - DNA, 25 bp, Rattus norvegicus
gctaaaggtgactgactacatcgca

SEQ ID NO: 402052 - DNA, 25 bp, Rattus norvegicus
gctaaagtatgcatcctgaacggaa

SEQ ID NO: 402053 - DNA, 25 bp, Rattus norvegicus
gctaaagtatgcttcctgaacggaa

SEQ ID NO: 402054 - DNA, 25 bp, Rattus norvegicus
gctaaagtcccaatctctcaggaga

SEQ ID NO: 402055 - DNA, 25 bp, Rattus norvegicus
gctaaagtcccattctctcaggaga

SEQ ID NO: 402056 - DNA, 25 bp, Rattus norvegicus
gctaaagtcctgctcgtaagtttca

SEQ ID NO: 402057 - DNA, 25 bp, Rattus norvegicus
gctaaagtcctggtcgtaagtttca

SEQ ID NO: 402058 - DNA, 25 bp, Rattus norvegicus
gctaaagtggccaagaacctcaaac

SEQ ID NO: 402059 - DNA, 25 bp, Rattus norvegicus
gctaaagtggcctagaacctcaaac

SEQ ID NO: 402060 - DNA, 25 bp, Rattus norvegicus
gctaaagtggctccgtctgactgga

SEQ ID NO: 402061 - DNA, 25 bp, Rattus norvegicus
gctaaagtggctgcgtctgactgga

SEQ ID NO: 402062 - DNA, 25 bp, Rattus norvegicus
gctaaataatttcttctgcttgtgt

SEQ ID NO: 402063 - DNA, 25 bp, Rattus norvegicus
gctaaataatttgttctgcttgtgt

SEQ ID NO: 402064 - DNA, 25 bp, Rattus norvegicus
gctaaatacagtacctccccaattg

SEQ ID NO: 402065 - DNA, 25 bp, Rattus norvegicus
gctaaatacagttcctccccaattg

SEQ ID NO: 402066 - DNA, 25 bp, Rattus norvegicus
gctaaatactagattgtgggcaatt

SEQ ID NO: 402067 - DNA, 25 bp, Rattus norvegicus
gctaaatactagtttgtgggcaatt

SEQ ID NO: 402068 - DNA, 25 bp, Rattus norvegicus
gctaaatcgtacctaacacattgtt

SEQ ID NO: 402069 - DNA, 25 bp, Rattus norvegicus
gctaaatcgtacgtaacacattgtt

SEQ ID NO: 402070 - DNA, 25 bp, Rattus norvegicus
gctaaatgaactcacagctgcttta

SEQ ID NO: 402071 - DNA, 25 bp, Rattus norvegicus
gctaaatgaactgacagctgcttta

SEQ ID NO: 402072 - DNA, 25 bp, Rattus norvegicus
gctaaatgaataatatccctaacac

SEQ ID NO: 402073 - DNA, 25 bp, Rattus norvegicus
gctaaatgaatattatccctaacac

SEQ ID NO: 402074 - DNA, 25 bp, Rattus norvegicus
gctaaatgacccattgaagctcaga

SEQ ID NO: 402075 - DNA, 25 bp, Rattus norvegicus
gctaaatgaccctttgaagctcaga

SEQ ID NO: 402076 - DNA, 25 bp, Rattus norvegicus
gctaaatgctcaactgtgtcagcga

SEQ ID NO: 402077 - DNA, 25 bp, Rattus norvegicus
gctaaatgctcatctgtgtcagcga

SEQ ID NO: 402078 - DNA, 25 bp, Rattus norvegicus
gctaaatggaatacatggaccccac

SEQ ID NO: 402079 - DNA, 25 bp, Rattus norvegicus
gctaaatggaattcatggaccccac

SEQ ID NO: 402080 - DNA, 25 bp, Rattus norvegicus
gctaaatggactcacttgggttaca

SEQ ID NO: 402081 - DNA, 25 bp, Rattus norvegicus
gctaaatggactgacttgggttaca

SEQ ID NO: 402082 - DNA, 25 bp, Rattus norvegicus
gctaaatggcacagcattcctcggg

SEQ ID NO: 402083 - DNA, 25 bp, Rattus norvegicus
gctaaatggcactgcattcctcggg

SEQ ID NO: 402084 - DNA, 25 bp, Rattus norvegicus
gctaaatgtgtaaatcctggactct

SEQ ID NO: 402085 - DNA, 25 bp, Rattus norvegicus
gctaaatgtgtatatcctggactct

SEQ ID NO: 402086 - DNA, 25 bp, Rattus norvegicus
gctaaattacaacccactggatttt

SEQ ID NO: 402087 - DNA, 25 bp, Rattus norvegicus
gctaaattacaagccactggatttt

SEQ ID NO: 402088 - DNA, 25 bp, Rattus norvegicus
gctaaattacctatgtgtgtgtgtg

SEQ ID NO: 402089 - DNA, 25 bp, Rattus norvegicus
gctaaattacctttgtgtgtgtgtg

SEQ ID NO: 402090 - DNA, 25 bp, Rattus norvegicus
gctaaattctgtactgagggactga

SEQ ID NO: 402091 - DNA, 25 bp, Rattus norvegicus
gctaaattctgttctgagggactga

SEQ ID NO: 402092 - DNA, 25 bp, Rattus norvegicus
gctaaattggtactttttctgtcct

SEQ ID NO: 402093 - DNA, 25 bp, Rattus norvegicus
gctaaattggtagtttttctgtcct

SEQ ID NO: 402094 - DNA, 25 bp, Rattus norvegicus
gctaacaaagtcacactggccagat

SEQ ID NO: 402095 - DNA, 25 bp, Rattus norvegicus
gctaacaaagtctcactggccagat

SEQ ID NO: 402096 - DNA, 25 bp, Rattus norvegicus
gctaacaaattcatcacctggtcag

SEQ ID NO: 402097 - DNA, 25 bp, Rattus norvegicus
gctaacaaattcttcacctggtcag

SEQ ID NO: 402098 - DNA, 25 bp, Rattus norvegicus
gctaacaacagtcacgctctggctt

SEQ ID NO: 402099 - DNA, 25 bp, Rattus norvegicus
gctaacaacagtgacgctctggctt

SEQ ID NO: 402100 - DNA, 25 bp, Rattus norvegicus
gctaacaacttgctggctggcctaa

SEQ ID NO: 402101 - DNA, 25 bp, Rattus norvegicus
gctaacaacttggtggctggcctaa

SEQ ID NO: 402102 - DNA, 25 bp, Rattus norvegicus
gctaacaatctacacggctttcact

SEQ ID NO: 402103 - DNA, 25 bp, Rattus norvegicus
gctaacaatctagacggctttcact

SEQ ID NO: 402104 - DNA, 25 bp, Rattus norvegicus
gctaacacatatccctgtctctaga

SEQ ID NO: 402105 - DNA, 25 bp, Rattus norvegicus
gctaacacatatgcctgtctctaga

SEQ ID NO: 402106 - DNA, 25 bp, Rattus norvegicus
gctaacaccaaacaaggcttctctg

SEQ ID NO: 402107 - DNA, 25 bp, Rattus norvegicus
gctaacaccaaagaaggcttctctg

SEQ ID NO: 402108 - DNA, 25 bp, Rattus norvegicus
gctaacaccttgcactttggacaga

SEQ ID NO: 402109 - DNA, 25 bp, Rattus norvegicus
gctaacaccttggactttggacaga

SEQ ID NO: 402110 - DNA, 25 bp, Rattus norvegicus
gctaacacggttactgcttttcaaa

SEQ ID NO: 402111 - DNA, 25 bp, Rattus norvegicus
gctaacacggtttctgcttttcaaa

SEQ ID NO: 402112 - DNA, 25 bp, Rattus norvegicus
gctaacagacgaagaggaagacctc

SEQ ID NO: 402113 - DNA, 25 bp, Rattus norvegicus
gctaacagacgatgaggaagacctc

SEQ ID NO: 402114 - DNA, 25 bp, Rattus norvegicus
gctaacagacggatggttttgcatt

SEQ ID NO: 402115 - DNA, 25 bp, Rattus norvegicus
gctaacagacggttggttttgcatt

SEQ ID NO: 402116 - DNA, 25 bp, Rattus norvegicus
gctaacagggtaacctctttttcag

SEQ ID NO: 402117 - DNA, 25 bp, Rattus norvegicus
gctaacagggtatcctctttttcag

SEQ ID NO: 402118 - DNA, 25 bp, Rattus norvegicus
gctaacatactcaggattctgcgca

SEQ ID NO: 402119 - DNA, 25 bp, Rattus norvegicus
gctaacatactctggattctgcgca

SEQ ID NO: 402120 - DNA, 25 bp, Rattus norvegicus
gctaacataggtacgctggcttgaa

SEQ ID NO: 402121 - DNA, 25 bp, Rattus norvegicus
gctaacataggttcgctggcttgaa

SEQ ID NO: 402122 - DNA, 25 bp, Rattus norvegicus
gctaacatctcaccagcttctttat

SEQ ID NO: 402123 - DNA, 25 bp, Rattus norvegicus
gctaacatctcagcagcttctttat

SEQ ID NO: 402124 - DNA, 25 bp, Rattus norvegicus
gctaacatgccgatcgttgagttgg

SEQ ID NO: 402125 - DNA, 25 bp, Rattus norvegicus
gctaacatgccgttcgttgagttgg

SEQ ID NO: 402126 - DNA, 25 bp, Rattus norvegicus
gctaacatgttgaacttccaggccc

SEQ ID NO: 402127 - DNA, 25 bp, Rattus norvegicus
gctaacatgttgtacttccaggccc

SEQ ID NO: 402128 - DNA, 25 bp, Rattus norvegicus
gctaacattggcactttaattcaaa

SEQ ID NO: 402129 - DNA, 25 bp, Rattus norvegicus
gctaacattggctctttaattcaaa

SEQ ID NO: 402130 - DNA, 25 bp, Rattus norvegicus
gctaacatttggagtcttgtccgta

SEQ ID NO: 402131 - DNA, 25 bp, Rattus norvegicus
gctaacatttggtgtcttgtccgta

SEQ ID NO: 402132 - DNA, 25 bp, Rattus norvegicus
gctaacccacacctggtggtggtgt

SEQ ID NO: 402133 - DNA, 25 bp, Rattus norvegicus
gctaacccacacgtggtggtggtgt

SEQ ID NO: 402134 - DNA, 25 bp, Rattus norvegicus
gctaacccaggcaatgctagaacga

SEQ ID NO: 402135 - DNA, 25 bp, Rattus norvegicus
gctaacccaggctatgctagaacga

SEQ ID NO: 402136 - DNA, 25 bp, Rattus norvegicus
gctaacccctacaacatgcttattg

SEQ ID NO: 402137 - DNA, 25 bp, Rattus norvegicus
gctaacccctacaggatcaatcgag

SEQ ID NO: 402138 - DNA, 25 bp, Rattus norvegicus
gctaacccctactacatgcttattg

SEQ ID NO: 402139 - DNA, 25 bp, Rattus norvegicus
gctaacccctactggatcaatcgag

SEQ ID NO: 402140 - DNA, 25 bp, Rattus norvegicus
gctaacccctagcagtggtgtaatg

SEQ ID NO: 402141 - DNA, 25 bp, Rattus norvegicus
gctaacccctaggagtggtgtaatg

SEQ ID NO: 402142 - DNA, 25 bp, Rattus norvegicus
gctaaccgctgtcgttccttttata

SEQ ID NO: 402143 - DNA, 25 bp, Rattus norvegicus
gctaaccgctgtggttccttttata

SEQ ID NO: 402144 - DNA, 25 bp, Rattus norvegicus
gctaaccgggcaatccagaagatgg

SEQ ID NO: 402145 - DNA, 25 bp, Rattus norvegicus
gctaaccgggcattccagaagatgg

SEQ ID NO: 402146 - DNA, 25 bp, Rattus norvegicus
gctaacctaatgacggaaaccagtg

SEQ ID NO: 402147 - DNA, 25 bp, Rattus norvegicus
gctaacctaatgtcggaaaccagtg

SEQ ID NO: 402148 - DNA, 25 bp, Rattus norvegicus
gctaacctcgataattttaccttct

SEQ ID NO: 402149 - DNA, 25 bp, Rattus norvegicus
gctaacctcgattattttaccttct

SEQ ID NO: 402150 - DNA, 25 bp, Rattus norvegicus
gctaacctcgcccaggcttcagtag

SEQ ID NO: 402151 - DNA, 25 bp, Rattus norvegicus
gctaacctcgccgaggcttcagtag

SEQ ID NO: 402152 - DNA, 25 bp, Rattus norvegicus
gctaacctgcaactccctatgtaga

SEQ ID NO: 402153 - DNA, 25 bp, Rattus norvegicus
gctaacctgcaagtccctatgtaga

SEQ ID NO: 402154 - DNA, 25 bp, Rattus norvegicus
gctaacctgggcaacacaatgagag

SEQ ID NO: 402155 - DNA, 25 bp, Rattus norvegicus
gctaacctgggctacacaatgagag

SEQ ID NO: 402156 - DNA, 25 bp, Rattus norvegicus
gctaacgaaacgctaccccaagaat

SEQ ID NO: 402157 - DNA, 25 bp, Rattus norvegicus
gctaacgaaacggtaccccaagaat

SEQ ID NO: 402158 - DNA, 25 bp, Rattus norvegicus
gctaacgcctcaatgttttattaga

SEQ ID NO: 402159 - DNA, 25 bp, Rattus norvegicus
gctaacgcctcattgttttattaga

SEQ ID NO: 402160 - DNA, 25 bp, Rattus norvegicus
gctaacggtatgaaaatctatcact

SEQ ID NO: 402161 - DNA, 25 bp, Rattus norvegicus
gctaacggtatgtaaatctatcact

SEQ ID NO: 402162 - DNA, 25 bp, Rattus norvegicus
gctaacggtcctcggagctagtgta

SEQ ID NO: 402163 - DNA, 25 bp, Rattus norvegicus
gctaacggtcctgggagctagtgta

SEQ ID NO: 402164 - DNA, 25 bp, Rattus norvegicus
gctaacgtcattcttgagcttttta

SEQ ID NO: 402165 - DNA, 25 bp, Rattus norvegicus
gctaacgtcattgttgagcttttta

SEQ ID NO: 402166 - DNA, 25 bp, Rattus norvegicus
gctaacgtcgatcgctctgtgaatt

SEQ ID NO: 402167 - DNA, 25 bp, Rattus norvegicus
gctaacgtcgatggctctgtgaatt

SEQ ID NO: 402168 - DNA, 25 bp, Rattus norvegicus
gctaacgtggctacatatgacctag

SEQ ID NO: 402169 - DNA, 25 bp, Rattus norvegicus
gctaacgtggcttcatatgacctag

SEQ ID NO: 402170 - DNA, 25 bp, Rattus norvegicus
gctaacgtttatccagtgtttcctc

SEQ ID NO: 402171 - DNA, 25 bp, Rattus norvegicus
gctaacgtttatgcagtgtttcctc

SEQ ID NO: 402172 - DNA, 25 bp, Rattus norvegicus
gctaactcaacaacagcactcaagt

SEQ ID NO: 402173 - DNA, 25 bp, Rattus norvegicus
gctaactcaacatcagcactcaagt

SEQ ID NO: 402174 - DNA, 25 bp, Rattus norvegicus
gctaactcagggacatctcaacaga

SEQ ID NO: 402175 - DNA, 25 bp, Rattus norvegicus
gctaactcagggtcatctcaacaga

SEQ ID NO: 402176 - DNA, 25 bp, Rattus norvegicus
gctaactcggatccattagccaagg

SEQ ID NO: 402177 - DNA, 25 bp, Rattus norvegicus
gctaactcggatgcattagccaagg

SEQ ID NO: 402178 - DNA, 25 bp, Rattus norvegicus
gctaactctgcaagtcggcaaacac

SEQ ID NO: 402179 - DNA, 25 bp, Rattus norvegicus
gctaactctgcatgtcggcaaacac

SEQ ID NO: 402180 - DNA, 25 bp, Rattus norvegicus
gctaactgaagaaacgccactgcat

SEQ ID NO: 402181 - DNA, 25 bp, Rattus norvegicus
gctaactgaagatacgccactgcat

SEQ ID NO: 402182 - DNA, 25 bp, Rattus norvegicus
gctaactgccagaagcacgcataat

SEQ ID NO: 402183 - DNA, 25 bp, Rattus norvegicus
gctaactgccagtagcacgcataat

SEQ ID NO: 402184 - DNA, 25 bp, Rattus norvegicus
gctaactgctgtccttgtagagctg

SEQ ID NO: 402185 - DNA, 25 bp, Rattus norvegicus
gctaactgctgtgcttgtagagctg

SEQ ID NO: 402186 - DNA, 25 bp, Rattus norvegicus
gctaactgctttcgtggtaaaccca

SEQ ID NO: 402187 - DNA, 25 bp, Rattus norvegicus
gctaactgctttggtggtaaaccca

SEQ ID NO: 402188 - DNA, 25 bp, Rattus norvegicus
gctaactgtgaaagcctgtctcaaa

SEQ ID NO: 402189 - DNA, 25 bp, Rattus norvegicus
gctaactgtgaatgcctgtctcaaa

SEQ ID NO: 402190 - DNA, 25 bp, Rattus norvegicus
gctaactgttatcgacgcctcatct

SEQ ID NO: 402191 - DNA, 25 bp, Rattus norvegicus
gctaactgttatggacgcctcatct

SEQ ID NO: 402192 - DNA, 25 bp, Rattus norvegicus
gctaactgttgtccattgtttccaa

SEQ ID NO: 402193 - DNA, 25 bp, Rattus norvegicus
gctaactgttgtgcattgtttccaa

SEQ ID NO: 402194 - DNA, 25 bp, Rattus norvegicus
gctaacttacatcgcaggactgtgt

SEQ ID NO: 402195 - DNA, 25 bp, Rattus norvegicus
gctaacttacatggcaggactgtgt

SEQ ID NO: 402196 - DNA, 25 bp, Rattus norvegicus
gctaacttacttccgtagaacacgt

SEQ ID NO: 402197 - DNA, 25 bp, Rattus norvegicus
gctaacttacttgcgtagaacacgt

SEQ ID NO: 402198 - DNA, 25 bp, Rattus norvegicus
gctaacttcgtcatggcaacaggcc

SEQ ID NO: 402199 - DNA, 25 bp, Rattus norvegicus
gctaacttcgtcttggcaacaggcc

SEQ ID NO: 402200 - DNA, 25 bp, Rattus norvegicus
gctaacttcttgagtggttcacctt

SEQ ID NO: 402201 - DNA, 25 bp, Rattus norvegicus
gctaacttcttgtgtggttcacctt

SEQ ID NO: 402202 - DNA, 25 bp, Rattus norvegicus
gctaacttggaactcttaagtccca

SEQ ID NO: 402203 - DNA, 25 bp, Rattus norvegicus
gctaacttggaagtcttaagtccca

SEQ ID NO: 402204 - DNA, 25 bp, Rattus norvegicus
gctaactttcctatgttcgatacaa

SEQ ID NO: 402205 - DNA, 25 bp, Rattus norvegicus
gctaactttcctttgttcgatacaa

SEQ ID NO: 402206 - DNA, 25 bp, Rattus norvegicus
gctaactttgacacctttacccagg

SEQ ID NO: 402207 - DNA, 25 bp, Rattus norvegicus
gctaactttgactcctttacccagg

SEQ ID NO: 402208 - DNA, 25 bp, Rattus norvegicus
gctaactttggcatttacacacctg

SEQ ID NO: 402209 - DNA, 25 bp, Rattus norvegicus
gctaactttggcttttacacacctg

SEQ ID NO: 402210 - DNA, 25 bp, Rattus norvegicus
gctaacttttccataaatcgctttg

SEQ ID NO: 402211 - DNA, 25 bp, Rattus norvegicus
gctaacttttccttaaatcgctttg

SEQ ID NO: 402212 - DNA, 25 bp, Rattus norvegicus
gctaagaagctcagtggtgccatct

SEQ ID NO: 402213 - DNA, 25 bp, Rattus norvegicus
gctaagaagctctgtggtgccatct

SEQ ID NO: 402214 - DNA, 25 bp, Rattus norvegicus
gctaagaatcataacctcaccttgt

SEQ ID NO: 402215 - DNA, 25 bp, Rattus norvegicus
gctaagaatcattacctcaccttgt

SEQ ID NO: 402216 - DNA, 25 bp, Rattus norvegicus
gctaagaattctcatgcccggataa

SEQ ID NO: 402217 - DNA, 25 bp, Rattus norvegicus
gctaagaattctgatgcccggataa

SEQ ID NO: 402218 - DNA, 25 bp, Rattus norvegicus
gctaagacaccaaaggcctggaatt

SEQ ID NO: 402219 - DNA, 25 bp, Rattus norvegicus
gctaagacaccataggcctggaatt

SEQ ID NO: 402220 - DNA, 25 bp, Rattus norvegicus
gctaagacacctccctacgaattaa

SEQ ID NO: 402221 - DNA, 25 bp, Rattus norvegicus
gctaagacacctgcctacgaattaa

SEQ ID NO: 402222 - DNA, 25 bp, Rattus norvegicus
gctaagacgctgactgttcaaggag

SEQ ID NO: 402223 - DNA, 25 bp, Rattus norvegicus
gctaagacgctgtctgttcaaggag

SEQ ID NO: 402224 - DNA, 25 bp, Rattus norvegicus
gctaagactcagattctctttctga

SEQ ID NO: 402225 - DNA, 25 bp, Rattus norvegicus
gctaagactcagtttctctttctga

SEQ ID NO: 402226 - DNA, 25 bp, Rattus norvegicus
gctaagacttctcccaattttatta

SEQ ID NO: 402227 - DNA, 25 bp, Rattus norvegicus
gctaagacttctgccaattttatta

SEQ ID NO: 402228 - DNA, 25 bp, Rattus norvegicus
gctaagagattgcatgccatcattt

SEQ ID NO: 402229 - DNA, 25 bp, Rattus norvegicus
gctaagagattggatgccatcattt

SEQ ID NO: 402230 - DNA, 25 bp, Rattus norvegicus
gctaagatctacaacctcgactata

SEQ ID NO: 402231 - DNA, 25 bp, Rattus norvegicus
gctaagatctactacctcgactata

SEQ ID NO: 402232 - DNA, 25 bp, Rattus norvegicus
gctaagatctgcaactacaccaact

SEQ ID NO: 402233 - DNA, 25 bp, Rattus norvegicus
gctaagatctgctactacaccaact

SEQ ID NO: 402234 - DNA, 25 bp, Rattus norvegicus
gctaagatggtgatcctgtggactg

SEQ ID NO: 402235 - DNA, 25 bp, Rattus norvegicus
gctaagatggtgttcctgtggactg

SEQ ID NO: 402236 - DNA, 25 bp, Rattus norvegicus
gctaagcaaacaagggactcaccct

SEQ ID NO: 402237 - DNA, 25 bp, Rattus norvegicus
gctaagcaaacatgggactcaccct

SEQ ID NO: 402238 - DNA, 25 bp, Rattus norvegicus
gctaagcaaagtactctacctctaa

SEQ ID NO: 402239 - DNA, 25 bp, Rattus norvegicus
gctaagcaaagttctctacctctaa

SEQ ID NO: 402240 - DNA, 25 bp, Rattus norvegicus
gctaagcactgtataatttgactct

SEQ ID NO: 402241 - DNA, 25 bp, Rattus norvegicus
gctaagcactgtttaatttgactct

SEQ ID NO: 402242 - DNA, 25 bp, Rattus norvegicus
gctaagcatcacaatggttacattt

SEQ ID NO: 402243 - DNA, 25 bp, Rattus norvegicus
gctaagcatcactatggttacattt

SEQ ID NO: 402244 - DNA, 25 bp, Rattus norvegicus
gctaagccagccagcgttcaccttt

SEQ ID NO: 402245 - DNA, 25 bp, Rattus norvegicus
gctaagccagcctgcgttcaccttt

SEQ ID NO: 402246 - DNA, 25 bp, Rattus norvegicus
gctaagccagtcctaggcatcttaa

SEQ ID NO: 402247 - DNA, 25 bp, Rattus norvegicus
gctaagccagtcgtaggcatcttaa

SEQ ID NO: 402248 - DNA, 25 bp, Rattus norvegicus
gctaagcctgagaagttttttgtta

SEQ ID NO: 402249 - DNA, 25 bp, Rattus norvegicus
gctaagcctgagtagttttttgtta

SEQ ID NO: 402250 - DNA, 25 bp, Rattus norvegicus
gctaagcctgatcgtagactaacta

SEQ ID NO: 402251 - DNA, 25 bp, Rattus norvegicus
gctaagcctgatggtagactaacta

SEQ ID NO: 402252 - DNA, 25 bp, Rattus norvegicus
gctaagcgagctaccagaatctaca

SEQ ID NO: 402253 - DNA, 25 bp, Rattus norvegicus
gctaagcgagcttccagaatctaca

SEQ ID NO: 402254 - DNA, 25 bp, Rattus norvegicus
gctaagctattaactgtattttcat

SEQ ID NO: 402255 - DNA, 25 bp, Rattus norvegicus
gctaagctattatctgtattttcat

SEQ ID NO: 402256 - DNA, 25 bp, Rattus norvegicus
gctaagctcctcaattttctaagtg

SEQ ID NO: 402257 - DNA, 25 bp, Rattus norvegicus
gctaagctcctctattttctaagtg

SEQ ID NO: 402258 - DNA, 25 bp, Rattus norvegicus
gctaagctgcacaatgagaccctat

SEQ ID NO: 402259 - DNA, 25 bp, Rattus norvegicus
gctaagctgcactatgagaccctat

SEQ ID NO: 402260 - DNA, 25 bp, Rattus norvegicus
gctaagctggccagttgggctccca

SEQ ID NO: 402261 - DNA, 25 bp, Rattus norvegicus
gctaagctggcctgttgggctccca

SEQ ID NO: 402262 - DNA, 25 bp, Rattus norvegicus
gctaagcttgggaaccattctcgct

SEQ ID NO: 402263 - DNA, 25 bp, Rattus norvegicus
gctaagcttgggtaccattctcgct

SEQ ID NO: 402264 - DNA, 25 bp, Rattus norvegicus
gctaaggaacagcatgctcagcaaa

SEQ ID NO: 402265 - DNA, 25 bp, Rattus norvegicus
gctaaggaacaggatgctcagcaaa

SEQ ID NO: 402266 - DNA, 25 bp, Rattus norvegicus
gctaaggagtcccaggctacgatgc

SEQ ID NO: 402267 - DNA, 25 bp, Rattus norvegicus
gctaaggagtccgaggctacgatgc

SEQ ID NO: 402268 - DNA, 25 bp, Rattus norvegicus
gctaaggcaggcaccccagaaaagt

SEQ ID NO: 402269 - DNA, 25 bp, Rattus norvegicus
gctaaggcaggctccccagaaaagt

SEQ ID NO: 402270 - DNA, 25 bp, Rattus norvegicus
gctaaggcatctactgtgtggaaca

SEQ ID NO: 402271 - DNA, 25 bp, Rattus norvegicus
gctaaggcatcttctgtgtggaaca

SEQ ID NO: 402272 - DNA, 25 bp, Rattus norvegicus
gctaaggcatgtactgttctgcaga

SEQ ID NO: 402273 - DNA, 25 bp, Rattus norvegicus
gctaaggcatgttctgttctgcaga

SEQ ID NO: 402274 - DNA, 25 bp, Rattus norvegicus
gctaaggccacaagactagttgcaa

SEQ ID NO: 402275 - DNA, 25 bp, Rattus norvegicus
gctaaggccacatgactagttgcaa

SEQ ID NO: 402276 - DNA, 25 bp, Rattus norvegicus
gctaaggccccaccagttttctaaa

SEQ ID NO: 402277 - DNA, 25 bp, Rattus norvegicus
gctaaggccccagcagttttctaaa

SEQ ID NO: 402278 - DNA, 25 bp, Rattus norvegicus
gctaaggctctgagactcaagtcag

SEQ ID NO: 402279 - DNA, 25 bp, Rattus norvegicus
gctaaggctctgtgactcaagtcag

SEQ ID NO: 402280 - DNA, 25 bp, Rattus norvegicus
gctaaggctgagatctgtggccatt

SEQ ID NO: 402281 - DNA, 25 bp, Rattus norvegicus
gctaaggctgagttctgtggccatt

SEQ ID NO: 402282 - DNA, 25 bp, Rattus norvegicus
gctaaggctgatcgaattgtctcaa

SEQ ID NO: 402283 - DNA, 25 bp, Rattus norvegicus
gctaaggctgatggaattgtctcaa

SEQ ID NO: 402284 - DNA, 25 bp, Rattus norvegicus
gctaaggctgctcggaagtacaaac

SEQ ID NO: 402285 - DNA, 25 bp, Rattus norvegicus
gctaaggctgctgggaagtacaaac

SEQ ID NO: 402286 - DNA, 25 bp, Rattus norvegicus
gctaaggctgtgaggtcaatactaa

SEQ ID NO: 402287 - DNA, 25 bp, Rattus norvegicus
gctaaggctgtgtggtcaatactaa

SEQ ID NO: 402288 - DNA, 25 bp, Rattus norvegicus
gctaagggaagacatttcttttctt

SEQ ID NO: 402289 - DNA, 25 bp, Rattus norvegicus
gctaagggaagagatttcttttctt

SEQ ID NO: 402290 - DNA, 25 bp, Rattus norvegicus
gctaaggtcctgagtattgattttt

SEQ ID NO: 402291 - DNA, 25 bp, Rattus norvegicus
gctaaggtcctgtgtattgattttt

SEQ ID NO: 402292 - DNA, 25 bp, Rattus norvegicus
gctaaggtgaacacgcaatccctga

SEQ ID NO: 402293 - DNA, 25 bp, Rattus norvegicus
gctaaggtgaactcgcaatccctga

SEQ ID NO: 402294 - DNA, 25 bp, Rattus norvegicus
gctaaggtgcatattcctatccggg

SEQ ID NO: 402295 - DNA, 25 bp, Rattus norvegicus
gctaaggtgcattttcctatccggg

SEQ ID NO: 402296 - DNA, 25 bp, Rattus norvegicus
gctaaggtggccacagtttatcaca

SEQ ID NO: 402297 - DNA, 25 bp, Rattus norvegicus
gctaaggtggcctcagtttatcaca

SEQ ID NO: 402298 - DNA, 25 bp, Rattus norvegicus
gctaaggtggtcctacattctgtat

SEQ ID NO: 402299 - DNA, 25 bp, Rattus norvegicus
gctaaggtggtcgtacattctgtat

SEQ ID NO: 402300 - DNA, 25 bp, Rattus norvegicus
gctaagtaaactattcagcagggtt

SEQ ID NO: 402301 - DNA, 25 bp, Rattus norvegicus
gctaagtaaacttttcagcagggtt

SEQ ID NO: 402302 - DNA, 25 bp, Rattus norvegicus
gctaagtaaggtccacagttcagtg

SEQ ID NO: 402303 - DNA, 25 bp, Rattus norvegicus
gctaagtaaggtgcacagttcagtg

SEQ ID NO: 402304 - DNA, 25 bp, Rattus norvegicus
gctaagtattttagccttacctaag

SEQ ID NO: 402305 - DNA, 25 bp, Rattus norvegicus
gctaagtatttttgccttacctaag

SEQ ID NO: 402306 - DNA, 25 bp, Rattus norvegicus
gctaagtccatgattattaaccgaa

SEQ ID NO: 402307 - DNA, 25 bp, Rattus norvegicus
gctaagtccatgtttattaaccgaa

SEQ ID NO: 402308 - DNA, 25 bp, Rattus norvegicus
gctaagtccttcctgttcacatgtt

SEQ ID NO: 402309 - DNA, 25 bp, Rattus norvegicus
gctaagtccttcgtgttcacatgtt

SEQ ID NO: 402310 - DNA, 25 bp, Rattus norvegicus
gctaagtctatcaggcatgtccaac

SEQ ID NO: 402311 - DNA, 25 bp, Rattus norvegicus
gctaagtctatctggcatgtccaac

SEQ ID NO: 402312 - DNA, 25 bp, Rattus norvegicus
gctaagtctcttcaaatctgcaaca

SEQ ID NO: 402313 - DNA, 25 bp, Rattus norvegicus
gctaagtctcttgaaatctgcaaca

SEQ ID NO: 402314 - DNA, 25 bp, Rattus norvegicus
gctaagtgccttctgggtatcccat

SEQ ID NO: 402315 - DNA, 25 bp, Rattus norvegicus
gctaagtgccttgtgggtatcccat

SEQ ID NO: 402316 - DNA, 25 bp, Rattus norvegicus
gctaagtgggacagctcagctagtt

SEQ ID NO: 402317 - DNA, 25 bp, Rattus norvegicus
gctaagtgggactgctcagctagtt

SEQ ID NO: 402318 - DNA, 25 bp, Rattus norvegicus
gctaagtgggtacaagcaaataact

SEQ ID NO: 402319 - DNA, 25 bp, Rattus norvegicus
gctaagtgggtagaagcaaataact

SEQ ID NO: 402320 - DNA, 25 bp, Rattus norvegicus
gctaagtggtgtcatcatcagggtc

SEQ ID NO: 402321 - DNA, 25 bp, Rattus norvegicus
gctaagtggtgtgatcatcagggtc

SEQ ID NO: 402322 - DNA, 25 bp, Rattus norvegicus
gctaagtggttcaacaagccattat

SEQ ID NO: 402323 - DNA, 25 bp, Rattus norvegicus
gctaagtggttctacaagccattat

SEQ ID NO: 402324 - DNA, 25 bp, Rattus norvegicus
gctaagttcactatgtcactgttga

SEQ ID NO: 402325 - DNA, 25 bp, Rattus norvegicus
gctaagttcactttgtcactgttga

SEQ ID NO: 402326 - DNA, 25 bp, Rattus norvegicus
gctaagttggatctccttgggcctt

SEQ ID NO: 402327 - DNA, 25 bp, Rattus norvegicus
gctaagttggatgtccttgggcctt

SEQ ID NO: 402328 - DNA, 25 bp, Rattus norvegicus
gctaagtttcaaacagccctttact

SEQ ID NO: 402329 - DNA, 25 bp, Rattus norvegicus
gctaagtttcaatcagccctttact

SEQ ID NO: 402330 - DNA, 25 bp, Rattus norvegicus
gctaataaccgtatggcagtgtctg

SEQ ID NO: 402331 - DNA, 25 bp, Rattus norvegicus
gctaataaccgtttggcagtgtctg

SEQ ID NO: 402332 - DNA, 25 bp, Rattus norvegicus
gctaataatagtccttccattctgg

SEQ ID NO: 402333 - DNA, 25 bp, Rattus norvegicus
gctaataatagtgcttccattctgg

SEQ ID NO: 402334 - DNA, 25 bp, Rattus norvegicus
gctaatacacatcccgagttacctg

SEQ ID NO: 402335 - DNA, 25 bp, Rattus norvegicus
gctaatacacatgccgagttacctg

SEQ ID NO: 402336 - DNA, 25 bp, Rattus norvegicus
gctaatacagagatgcacctcccaa

SEQ ID NO: 402337 - DNA, 25 bp, Rattus norvegicus
gctaatacagagttgcacctcccaa

SEQ ID NO: 402338 - DNA, 25 bp, Rattus norvegicus
gctaatacgtgtctaagctcgtcca

SEQ ID NO: 402339 - DNA, 25 bp, Rattus norvegicus
gctaatacgtgtgtaagctcgtcca

SEQ ID NO: 402340 - DNA, 25 bp, Rattus norvegicus
gctaatactagcagatgtgcctctc

SEQ ID NO: 402341 - DNA, 25 bp, Rattus norvegicus
gctaatactagctgatgtgcctctc

SEQ ID NO: 402342 - DNA, 25 bp, Rattus norvegicus
gctaatactgtgagttggagcttta

SEQ ID NO: 402343 - DNA, 25 bp, Rattus norvegicus
gctaatactgtgtgttggagcttta

SEQ ID NO: 402344 - DNA, 25 bp, Rattus norvegicus
gctaatagctgtcctcagagacgct

SEQ ID NO: 402345 - DNA, 25 bp, Rattus norvegicus
gctaatagctgtgctcagagacgct

SEQ ID NO: 402346 - DNA, 25 bp, Rattus norvegicus
gctaatagtcacaagtgcccagtac

SEQ ID NO: 402347 - DNA, 25 bp, Rattus norvegicus
gctaatagtcactagtgcccagtac

SEQ ID NO: 402348 - DNA, 25 bp, Rattus norvegicus
gctaatatgtttaaggctcacccta

SEQ ID NO: 402349 - DNA, 25 bp, Rattus norvegicus
gctaatatgttttaggctcacccta

SEQ ID NO: 402350 - DNA, 25 bp, Rattus norvegicus
gctaatattgctatgagaatctcgt

SEQ ID NO: 402351 - DNA, 25 bp, Rattus norvegicus
gctaatattgctttgagaatctcgt

SEQ ID NO: 402352 - DNA, 25 bp, Rattus norvegicus
gctaatatttgtatctcctggacct

SEQ ID NO: 402353 - DNA, 25 bp, Rattus norvegicus
gctaatatttgtttctcctggacct

SEQ ID NO: 402354 - DNA, 25 bp, Rattus norvegicus
gctaatcaaggcatattcttttcaa

SEQ ID NO: 402355 - DNA, 25 bp, Rattus norvegicus
gctaatcaaggcttattcttttcaa

SEQ ID NO: 402356 - DNA, 25 bp, Rattus norvegicus
gctaatcaatgtacttgctcactga

SEQ ID NO: 402357 - DNA, 25 bp, Rattus norvegicus
gctaatcaatgttcttgctcactga

SEQ ID NO: 402358 - DNA, 25 bp, Rattus norvegicus
gctaatcagggactttgtgcaattt

SEQ ID NO: 402359 - DNA, 25 bp, Rattus norvegicus
gctaatcagggagtttgtgcaattt

SEQ ID NO: 402360 - DNA, 25 bp, Rattus norvegicus
gctaatccatgcaaacagagtgaga

SEQ ID NO: 402361 - DNA, 25 bp, Rattus norvegicus
gctaatccatgctaacagagtgaga

SEQ ID NO: 402362 - DNA, 25 bp, Rattus norvegicus
gctaatccgccaaatagtctattct

SEQ ID NO: 402363 - DNA, 25 bp, Rattus norvegicus
gctaatccgccatatagtctattct

SEQ ID NO: 402364 - DNA, 25 bp, Rattus norvegicus
gctaatctccatcccatgggcatag

SEQ ID NO: 402365 - DNA, 25 bp, Rattus norvegicus
gctaatctccatgccatgggcatag

SEQ ID NO: 402366 - DNA, 25 bp, Rattus norvegicus
gctaatctgagtccatgctggtcaa

SEQ ID NO: 402367 - DNA, 25 bp, Rattus norvegicus
gctaatctgagtgcatgctggtcaa

SEQ ID NO: 402368 - DNA, 25 bp, Rattus norvegicus
gctaatctggctcaacaaatgtcat

SEQ ID NO: 402369 - DNA, 25 bp, Rattus norvegicus
gctaatctggctctatatctggttt

SEQ ID NO: 402370 - DNA, 25 bp, Rattus norvegicus
gctaatctggctgaacaaatgtcat

SEQ ID NO: 402371 - DNA, 25 bp, Rattus norvegicus
gctaatctggctgtatatctggttt

SEQ ID NO: 402372 - DNA, 25 bp, Rattus norvegicus
gctaatcttttcattcatgcttttc

SEQ ID NO: 402373 - DNA, 25 bp, Rattus norvegicus
gctaatcttttctttcatgcttttc

SEQ ID NO: 402374 - DNA, 25 bp, Rattus norvegicus
gctaatgacatgaaggccaccctta

SEQ ID NO: 402375 - DNA, 25 bp, Rattus norvegicus
gctaatgacatgtaggccaccctta

SEQ ID NO: 402376 - DNA, 25 bp, Rattus norvegicus
gctaatgagcaacccttctctgaag

SEQ ID NO: 402377 - DNA, 25 bp, Rattus norvegicus
gctaatgagcaagccttctctgaag

SEQ ID NO: 402378 - DNA, 25 bp, Rattus norvegicus
gctaatgatcttacctagaggctca

SEQ ID NO: 402379 - DNA, 25 bp, Rattus norvegicus
gctaatgatctttcctagaggctca

SEQ ID NO: 402380 - DNA, 25 bp, Rattus norvegicus
gctaatgatgtcatttgcagtgcat

SEQ ID NO: 402381 - DNA, 25 bp, Rattus norvegicus
gctaatgatgtcttttgcagtgcat

SEQ ID NO: 402382 - DNA, 25 bp, Rattus norvegicus
gctaatgctagtctatacttcaatg

SEQ ID NO: 402383 - DNA, 25 bp, Rattus norvegicus
gctaatgctagtgtatacttcaatg

SEQ ID NO: 402384 - DNA, 25 bp, Rattus norvegicus
gctaatgctcttatgttctcttgaa

SEQ ID NO: 402385 - DNA, 25 bp, Rattus norvegicus
gctaatgctcttttgttctcttgaa

SEQ ID NO: 402386 - DNA, 25 bp, Rattus norvegicus
gctaatgctgccaaggtagtgcctc

SEQ ID NO: 402387 - DNA, 25 bp, Rattus norvegicus
gctaatgctgcctaggtagtgcctc

SEQ ID NO: 402388 - DNA, 25 bp, Rattus norvegicus
gctaatggcgggacttcctggccca

SEQ ID NO: 402389 - DNA, 25 bp, Rattus norvegicus
gctaatggcgggtcttcctggccca

SEQ ID NO: 402390 - DNA, 25 bp, Rattus norvegicus
gctaatgggcttcacatgtgctaac

SEQ ID NO: 402391 - DNA, 25 bp, Rattus norvegicus
gctaatgggcttgacatgtgctaac

SEQ ID NO: 402392 - DNA, 25 bp, Rattus norvegicus
gctaatgtccttcctcatgttgtaa

SEQ ID NO: 402393 - DNA, 25 bp, Rattus norvegicus
gctaatgtccttgctcatgttgtaa

SEQ ID NO: 402394 - DNA, 25 bp, Rattus norvegicus
gctaatgtgcctaatgagacctcga

SEQ ID NO: 402395 - DNA, 25 bp, Rattus norvegicus
gctaatgtgccttatgagacctcga

SEQ ID NO: 402396 - DNA, 25 bp, Rattus norvegicus
gctaatgttgttcccctcctacaga

SEQ ID NO: 402397 - DNA, 25 bp, Rattus norvegicus
gctaatgttgttgccctcctacaga

SEQ ID NO: 402398 - DNA, 25 bp, Rattus norvegicus
gctaattaaagtctcccttgaacat

SEQ ID NO: 402399 - DNA, 25 bp, Rattus norvegicus
gctaattaaagtgtcccttgaacat

SEQ ID NO: 402400 - DNA, 25 bp, Rattus norvegicus
gctaattaactcatgtgttccctgc

SEQ ID NO: 402401 - DNA, 25 bp, Rattus norvegicus
gctaattaactcttgtgttccctgc

SEQ ID NO: 402402 - DNA, 25 bp, Rattus norvegicus
gctaattacagcatgccatcacaga

SEQ ID NO: 402403 - DNA, 25 bp, Rattus norvegicus
gctaattacagcttgccatcacaga

SEQ ID NO: 402404 - DNA, 25 bp, Rattus norvegicus
gctaattagcatctttgtaaactat

SEQ ID NO: 402405 - DNA, 25 bp, Rattus norvegicus
gctaattagcatgtttgtaaactat

SEQ ID NO: 402406 - DNA, 25 bp, Rattus norvegicus
gctaattaggatcgccatgcggtgc

SEQ ID NO: 402407 - DNA, 25 bp, Rattus norvegicus
gctaattaggatggccatgcggtgc

SEQ ID NO: 402408 - DNA, 25 bp, Rattus norvegicus
gctaattcctgcagtatttacttat

SEQ ID NO: 402409 - DNA, 25 bp, Rattus norvegicus
gctaattcctgctgtatttacttat

SEQ ID NO: 402410 - DNA, 25 bp, Rattus norvegicus
gctaattctcagacttcaacttgtg

SEQ ID NO: 402411 - DNA, 25 bp, Rattus norvegicus
gctaattctcagtcttcaacttgtg

SEQ ID NO: 402412 - DNA, 25 bp, Rattus norvegicus
gctaattctcccagatggtgctata

SEQ ID NO: 402413 - DNA, 25 bp, Rattus norvegicus
gctaattctccctgatggtgctata

SEQ ID NO: 402414 - DNA, 25 bp, Rattus norvegicus
gctaattcttttcaggagcatttgg

SEQ ID NO: 402415 - DNA, 25 bp, Rattus norvegicus
gctaattcttttgaggagcatttgg

SEQ ID NO: 402416 - DNA, 25 bp, Rattus norvegicus
gctaattgccttatctatgtgccaa

SEQ ID NO: 402417 - DNA, 25 bp, Rattus norvegicus
gctaattgccttttctatgtgccaa

SEQ ID NO: 402418 - DNA, 25 bp, Rattus norvegicus
gctaattgtccgctgcttaagctat

SEQ ID NO: 402419 - DNA, 25 bp, Rattus norvegicus
gctaattgtccggtgcttaagctat

SEQ ID NO: 402420 - DNA, 25 bp, Rattus norvegicus
gctaatttccttatcaagtgaaatg

SEQ ID NO: 402421 - DNA, 25 bp, Rattus norvegicus
gctaatttccttttcaagtgaaatg

SEQ ID NO: 402422 - DNA, 25 bp, Rattus norvegicus
gctaatttgatcctgtgttttgcct

SEQ ID NO: 402423 - DNA, 25 bp, Rattus norvegicus
gctaatttgatcgtgtgttttgcct

SEQ ID NO: 402424 - DNA, 25 bp, Rattus norvegicus
gctaatttgattcaaggaactgttt

SEQ ID NO: 402425 - DNA, 25 bp, Rattus norvegicus
gctaatttgattgaaggaactgttt

SEQ ID NO: 402426 - DNA, 25 bp, Rattus norvegicus
gctaatttgtaacctgcttcttcaa

SEQ ID NO: 402427 - DNA, 25 bp, Rattus norvegicus
gctaatttgtaagctgcttcttcaa

SEQ ID NO: 402428 - DNA, 25 bp, Rattus norvegicus
gctaattttcatactaactttcgat

SEQ ID NO: 402429 - DNA, 25 bp, Rattus norvegicus
gctaattttcattctaactttcgat

SEQ ID NO: 402430 - DNA, 25 bp, Rattus norvegicus
gctacaaacagtccctcaagtacca

SEQ ID NO: 402431 - DNA, 25 bp, Rattus norvegicus
gctacaaacagtgcctcaagtacca

SEQ ID NO: 402432 - DNA, 25 bp, Rattus norvegicus
gctacaaagcaaattcaaaaccagc

SEQ ID NO: 402433 - DNA, 25 bp, Rattus norvegicus
gctacaaagcaactactgggaattc

SEQ ID NO: 402434 - DNA, 25 bp, Rattus norvegicus
gctacaaagcaagtactgggaattc

SEQ ID NO: 402435 - DNA, 25 bp, Rattus norvegicus
gctacaaagcaatttcaaaaccagc

SEQ ID NO: 402436 - DNA, 25 bp, Rattus norvegicus
gctacaaattgtctctgggctttct

SEQ ID NO: 402437 - DNA, 25 bp, Rattus norvegicus
gctacaaattgtgtctgggctttct

SEQ ID NO: 402438 - DNA, 25 bp, Rattus norvegicus
gctacaaccacaagcttcgcaagaa

SEQ ID NO: 402439 - DNA, 25 bp, Rattus norvegicus
gctacaaccacatgcttcgcaagaa

SEQ ID NO: 402440 - DNA, 25 bp, Rattus norvegicus
gctacaaccgtgagcgctatgatga

SEQ ID NO: 402441 - DNA, 25 bp, Rattus norvegicus
gctacaaccgtgtgcgctatgatga

SEQ ID NO: 402442 - DNA, 25 bp, Rattus norvegicus
gctacaacctgcagtggccacagtt

SEQ ID NO: 402443 - DNA, 25 bp, Rattus norvegicus
gctacaacctgctgtggccacagtt

SEQ ID NO: 402444 - DNA, 25 bp, Rattus norvegicus
gctacaacgtgcctgactttatttc

SEQ ID NO: 402445 - DNA, 25 bp, Rattus norvegicus
gctacaacgtgcgtgactttatttc

SEQ ID NO: 402446 - DNA, 25 bp, Rattus norvegicus
gctacaagaagaacctgggcacctt

SEQ ID NO: 402447 - DNA, 25 bp, Rattus norvegicus
gctacaagaagatcctgggcacctt

SEQ ID NO: 402448 - DNA, 25 bp, Rattus norvegicus
gctacaagatataccaggctgcatg

SEQ ID NO: 402449 - DNA, 25 bp, Rattus norvegicus
gctacaagatattccaggctgcatg

SEQ ID NO: 402450 - DNA, 25 bp, Rattus norvegicus
gctacaagatccactatcggcagaa

SEQ ID NO: 402451 - DNA, 25 bp, Rattus norvegicus
gctacaagatcctctatcggcagaa

SEQ ID NO: 402452 - DNA, 25 bp, Rattus norvegicus
gctacaagcgcccaggcttcgcgtt

SEQ ID NO: 402453 - DNA, 25 bp, Rattus norvegicus
gctacaagcgccgaggcttcgcgtt

SEQ ID NO: 402454 - DNA, 25 bp, Rattus norvegicus
gctacaaggctgagtggttcggcaa

SEQ ID NO: 402455 - DNA, 25 bp, Rattus norvegicus
gctacaaggctgtgtggttcggcaa

SEQ ID NO: 402456 - DNA, 25 bp, Rattus norvegicus
gctacaagtgcacctgtgaccccgg

SEQ ID NO: 402457 - DNA, 25 bp, Rattus norvegicus
gctacaagtgcagctgtgaccccgg

SEQ ID NO: 402458 - DNA, 25 bp, Rattus norvegicus
gctacaataaatccagctggcagca

SEQ ID NO: 402459 - DNA, 25 bp, Rattus norvegicus
gctacaataaatgcagctggcagca

SEQ ID NO: 402460 - DNA, 25 bp, Rattus norvegicus
gctacaatataccatccatctccag

SEQ ID NO: 402461 - DNA, 25 bp, Rattus norvegicus
gctacaatatacgatccatctccag

SEQ ID NO: 402462 - DNA, 25 bp, Rattus norvegicus
gctacaattcatatgactcaactga

SEQ ID NO: 402463 - DNA, 25 bp, Rattus norvegicus
gctacaattcatttgactcaactga

SEQ ID NO: 402464 - DNA, 25 bp, Rattus norvegicus
gctacacaacgaattcctgggacaa

SEQ ID NO: 402465 - DNA, 25 bp, Rattus norvegicus
gctacacaacgatttcctgggacaa

SEQ ID NO: 402466 - DNA, 25 bp, Rattus norvegicus
gctacacacagaccaagtcatcttt

SEQ ID NO: 402467 - DNA, 25 bp, Rattus norvegicus
gctacacacagagcaagtcatcttt

SEQ ID NO: 402468 - DNA, 25 bp, Rattus norvegicus
gctacacagcaacgtgctttctctt

SEQ ID NO: 402469 - DNA, 25 bp, Rattus norvegicus
gctacacagcaaggtgctttctctt

SEQ ID NO: 402470 - DNA, 25 bp, Rattus norvegicus
gctacacatttcattggctctctaa

SEQ ID NO: 402471 - DNA, 25 bp, Rattus norvegicus
gctacacatttctttggctctctaa

SEQ ID NO: 402472 - DNA, 25 bp, Rattus norvegicus
gctacaccaccactactcagagaat

SEQ ID NO: 402473 - DNA, 25 bp, Rattus norvegicus
gctacaccaccagtactcagagaat

SEQ ID NO: 402474 - DNA, 25 bp, Rattus norvegicus
gctacaccttaacattcccagggca

SEQ ID NO: 402475 - DNA, 25 bp, Rattus norvegicus
gctacaccttaagattcccagggca

SEQ ID NO: 402476 - DNA, 25 bp, Rattus norvegicus
gctacacggattaaatgcagaaggt

SEQ ID NO: 402477 - DNA, 25 bp, Rattus norvegicus
gctacacggatttaatgcagaaggt

SEQ ID NO: 402478 - DNA, 25 bp, Rattus norvegicus
gctacactaactctgtgtttggcat

SEQ ID NO: 402479 - DNA, 25 bp, Rattus norvegicus
gctacactaactgtgtgtttggcat

SEQ ID NO: 402480 - DNA, 25 bp, Rattus norvegicus
gctacactaagcattgcagcctggg

SEQ ID NO: 402481 - DNA, 25 bp, Rattus norvegicus
gctacactaagctttgcagcctggg

SEQ ID NO: 402482 - DNA, 25 bp, Rattus norvegicus
gctacactacatacagatcacacgt

SEQ ID NO: 402483 - DNA, 25 bp, Rattus norvegicus
gctacactacattcagatcacacgt

SEQ ID NO: 402484 - DNA, 25 bp, Rattus norvegicus
gctacactgccaaggagctcaatgt

SEQ ID NO: 402485 - DNA, 25 bp, Rattus norvegicus
gctacactgccatggagctcaatgt

SEQ ID NO: 402486 - DNA, 25 bp, Rattus norvegicus
gctacactgggacctacaatgctta

SEQ ID NO: 402487 - DNA, 25 bp, Rattus norvegicus
gctacactgggagctacaatgctta

SEQ ID NO: 402488 - DNA, 25 bp, Rattus norvegicus
gctacacttcctaatactttcaaat

SEQ ID NO: 402489 - DNA, 25 bp, Rattus norvegicus
gctacacttccttatactttcaaat

SEQ ID NO: 402490 - DNA, 25 bp, Rattus norvegicus
gctacagaacgaagagtgcacaggg

SEQ ID NO: 402491 - DNA, 25 bp, Rattus norvegicus
gctacagaacgatgagtgcacaggg

SEQ ID NO: 402492 - DNA, 25 bp, Rattus norvegicus
gctacagacagacagctcaccaaca

SEQ ID NO: 402493 - DNA, 25 bp, Rattus norvegicus
gctacagacagagagctcaccaaca

SEQ ID NO: 402494 - DNA, 25 bp, Rattus norvegicus
gctacagacgaaagcttatcttggt

SEQ ID NO: 402495 - DNA, 25 bp, Rattus norvegicus
gctacagacgaatgcttatcttggt

SEQ ID NO: 402496 - DNA, 25 bp, Rattus norvegicus
gctacagagctgagttctcattctt

SEQ ID NO: 402497 - DNA, 25 bp, Rattus norvegicus
gctacagagctgtgttctcattctt

SEQ ID NO: 402498 - DNA, 25 bp, Rattus norvegicus
gctacagagggccccagtacctgct

SEQ ID NO: 402499 - DNA, 25 bp, Rattus norvegicus
gctacagagggcgccagtacctgct

SEQ ID NO: 402500 - DNA, 25 bp, Rattus norvegicus
gctacagaggtcactgacaccagaa

SEQ ID NO: 402501 - DNA, 25 bp, Rattus norvegicus
gctacagaggtccaccatcttagtg

SEQ ID NO: 402502 - DNA, 25 bp, Rattus norvegicus
gctacagaggtcgaccatcttagtg

SEQ ID NO: 402503 - DNA, 25 bp, Rattus norvegicus
gctacagaggtctctgacaccagaa

SEQ ID NO: 402504 - DNA, 25 bp, Rattus norvegicus
gctacagagtgaagctagtttcata

SEQ ID NO: 402505 - DNA, 25 bp, Rattus norvegicus
gctacagagtgatgctagtttcata

SEQ ID NO: 402506 - DNA, 25 bp, Rattus norvegicus
gctacagagttaagagcctgtctca

SEQ ID NO: 402507 - DNA, 25 bp, Rattus norvegicus
gctacagagttatgagcctgtctca

SEQ ID NO: 402508 - DNA, 25 bp, Rattus norvegicus
gctacagatattaggttgcttgatt

SEQ ID NO: 402509 - DNA, 25 bp, Rattus norvegicus
gctacagatatttggttgcttgatt

SEQ ID NO: 402510 - DNA, 25 bp, Rattus norvegicus
gctacagcaacaatcaaaagtgaca

SEQ ID NO: 402511 - DNA, 25 bp, Rattus norvegicus
gctacagcaacattcaaaagtgaca

SEQ ID NO: 402512 - DNA, 25 bp, Rattus norvegicus
gctacagcagatcggtgctctctaa

SEQ ID NO: 402513 - DNA, 25 bp, Rattus norvegicus
gctacagcagatgggtgctctctaa

SEQ ID NO: 402514 - DNA, 25 bp, Rattus norvegicus
gctacagcagcgagccagatgggaa

SEQ ID NO: 402515 - DNA, 25 bp, Rattus norvegicus
gctacagcagcgtgccagatgggaa

SEQ ID NO: 402516 - DNA, 25 bp, Rattus norvegicus
gctacagcagtgcatatcccttcac

SEQ ID NO: 402517 - DNA, 25 bp, Rattus norvegicus
gctacagcagtggatatcccttcac

SEQ ID NO: 402518 - DNA, 25 bp, Rattus norvegicus
gctacagccaagattctgtttgttg

SEQ ID NO: 402519 - DNA, 25 bp, Rattus norvegicus
gctacagccaagtttctgtttgttg

SEQ ID NO: 402520 - DNA, 25 bp, Rattus norvegicus
gctacagccctgactttgagagaaa

SEQ ID NO: 402521 - DNA, 25 bp, Rattus norvegicus
gctacagccctgtctttgagagaaa

SEQ ID NO: 402522 - DNA, 25 bp, Rattus norvegicus
gctacagcctgactgaagaatttcc

SEQ ID NO: 402523 - DNA, 25 bp, Rattus norvegicus
gctacagcctgagtgaagaatttcc

SEQ ID NO: 402524 - DNA, 25 bp, Rattus norvegicus
gctacagcctgtatggtttctcctt

SEQ ID NO: 402525 - DNA, 25 bp, Rattus norvegicus
gctacagcctgtttggtttctcctt

SEQ ID NO: 402526 - DNA, 25 bp, Rattus norvegicus
gctacagctcgacggtagaggctta

SEQ ID NO: 402527 - DNA, 25 bp, Rattus norvegicus
gctacagctcgagggtagaggctta

SEQ ID NO: 402528 - DNA, 25 bp, Rattus norvegicus
gctacagcttgtaaaacttgaatct

SEQ ID NO: 402529 - DNA, 25 bp, Rattus norvegicus
gctacagcttgttaaacttgaatct

SEQ ID NO: 402530 - DNA, 25 bp, Rattus norvegicus
gctacagctttaatagtggttacct

SEQ ID NO: 402531 - DNA, 25 bp, Rattus norvegicus
gctacagctttattagtggttacct

SEQ ID NO: 402532 - DNA, 25 bp, Rattus norvegicus
gctacaggaccaccttatgtgatta

SEQ ID NO: 402533 - DNA, 25 bp, Rattus norvegicus
gctacaggaccagcttatgtgatta

SEQ ID NO: 402534 - DNA, 25 bp, Rattus norvegicus
gctacaggactgagcatagtgtggt

SEQ ID NO: 402535 - DNA, 25 bp, Rattus norvegicus
gctacaggactgtgcatagtgtggt

SEQ ID NO: 402536 - DNA, 25 bp, Rattus norvegicus
gctacagggagcatggcacctggac

SEQ ID NO: 402537 - DNA, 25 bp, Rattus norvegicus
gctacagggagcttggcacctggac

SEQ ID NO: 402538 - DNA, 25 bp, Rattus norvegicus
gctacagggagtctgacactctcaa

SEQ ID NO: 402539 - DNA, 25 bp, Rattus norvegicus
gctacagggagtgtgacactctcaa

SEQ ID NO: 402540 - DNA, 25 bp, Rattus norvegicus
gctacagggcttcactctgacagaa

SEQ ID NO: 402541 - DNA, 25 bp, Rattus norvegicus
gctacagggcttgactctgacagaa

SEQ ID NO: 402542 - DNA, 25 bp, Rattus norvegicus
gctacaggtactacatgcacatgct

SEQ ID NO: 402543 - DNA, 25 bp, Rattus norvegicus
gctacaggtacttcatgcacatgct

SEQ ID NO: 402544 - DNA, 25 bp, Rattus norvegicus
gctacaggtagcaccataacgatga

SEQ ID NO: 402545 - DNA, 25 bp, Rattus norvegicus
gctacaggtagctccataacgatga

SEQ ID NO: 402546 - DNA, 25 bp, Rattus norvegicus
gctacagtaaacatgcacactctca

SEQ ID NO: 402547 - DNA, 25 bp, Rattus norvegicus
gctacagtaaacttgcacactctca

SEQ ID NO: 402548 - DNA, 25 bp, Rattus norvegicus
gctacagtaatgcttttcctgccta

SEQ ID NO: 402549 - DNA, 25 bp, Rattus norvegicus
gctacagtaatggttttcctgccta

SEQ ID NO: 402550 - DNA, 25 bp, Rattus norvegicus
gctacagtcattatgtgtggcacac

SEQ ID NO: 402551 - DNA, 25 bp, Rattus norvegicus
gctacagtcattttgtgtggcacac

SEQ ID NO: 402552 - DNA, 25 bp, Rattus norvegicus
gctacagtccagagacgtcacggaa

SEQ ID NO: 402553 - DNA, 25 bp, Rattus norvegicus
gctacagtccagtgacgtcacggaa

SEQ ID NO: 402554 - DNA, 25 bp, Rattus norvegicus
gctacagtctgcagaagtggacctt

SEQ ID NO: 402555 - DNA, 25 bp, Rattus norvegicus
gctacagtctgctgaagtggacctt

SEQ ID NO: 402556 - DNA, 25 bp, Rattus norvegicus
gctacagtgcacatatatacctaaa

SEQ ID NO: 402557 - DNA, 25 bp, Rattus norvegicus
gctacagtgcacttatatacctaaa

SEQ ID NO: 402558 - DNA, 25 bp, Rattus norvegicus
gctacagtgcatcaccgccgagtaa

SEQ ID NO: 402559 - DNA, 25 bp, Rattus norvegicus
gctacagtgcatgaccgccgagtaa

SEQ ID NO: 402560 - DNA, 25 bp, Rattus norvegicus
gctacagtgctgagtgagttctaaa

SEQ ID NO: 402561 - DNA, 25 bp, Rattus norvegicus
gctacagtgctgtgtgagttctaaa

SEQ ID NO: 402562 - DNA, 25 bp, Rattus norvegicus
gctacagtgtatcgtttttcagagt

SEQ ID NO: 402563 - DNA, 25 bp, Rattus norvegicus
gctacagtgtatggtttttcagagt

SEQ ID NO: 402564 - DNA, 25 bp, Rattus norvegicus
gctacagtgtgccaaacctttggcc

SEQ ID NO: 402565 - DNA, 25 bp, Rattus norvegicus
gctacagtgtgcgaaacctttggcc

SEQ ID NO: 402566 - DNA, 25 bp, Rattus norvegicus
gctacagttcatattcctggatttt

SEQ ID NO: 402567 - DNA, 25 bp, Rattus norvegicus
gctacagttcattttcctggatttt

SEQ ID NO: 402568 - DNA, 25 bp, Rattus norvegicus
gctacagttggacctgggaaacaga

SEQ ID NO: 402569 - DNA, 25 bp, Rattus norvegicus
gctacagttggagctgggaaacaga

SEQ ID NO: 402570 - DNA, 25 bp, Rattus norvegicus
gctacagttgtcatctcctcagata

SEQ ID NO: 402571 - DNA, 25 bp, Rattus norvegicus
gctacagttgtcttctcctcagata

SEQ ID NO: 402572 - DNA, 25 bp, Rattus norvegicus
gctacataatatccaaggcccagtg

SEQ ID NO: 402573 - DNA, 25 bp, Rattus norvegicus
gctacataatatgcaaggcccagtg

SEQ ID NO: 402574 - DNA, 25 bp, Rattus norvegicus
gctacatagctaattttgctttgga

SEQ ID NO: 402575 - DNA, 25 bp, Rattus norvegicus
gctacatagctatttttgctttgga

SEQ ID NO: 402576 - DNA, 25 bp, Rattus norvegicus
gctacatagtgaagtccgacctcag

SEQ ID NO: 402577 - DNA, 25 bp, Rattus norvegicus
gctacatagtgatgtccgacctcag

SEQ ID NO: 402578 - DNA, 25 bp, Rattus norvegicus
gctacatatgcacctctatccaggc

SEQ ID NO: 402579 - DNA, 25 bp, Rattus norvegicus
gctacatatgcagctctatccaggc

SEQ ID NO: 402580 - DNA, 25 bp, Rattus norvegicus
gctacatcactccttcatacaaaaa

SEQ ID NO: 402581 - DNA, 25 bp, Rattus norvegicus
gctacatcactcgttcatacaaaaa

SEQ ID NO: 402582 - DNA, 25 bp, Rattus norvegicus
gctacatcatacatgtggttccgaa

SEQ ID NO: 402583 - DNA, 25 bp, Rattus norvegicus
gctacatcatacttgtggttccgaa

SEQ ID NO: 402584 - DNA, 25 bp, Rattus norvegicus
gctacatccctgataaagtgccttt

SEQ ID NO: 402585 - DNA, 25 bp, Rattus norvegicus
gctacatccctgttaaagtgccttt

SEQ ID NO: 402586 - DNA, 25 bp, Rattus norvegicus
gctacatcccttcgatttgccagtc

SEQ ID NO: 402587 - DNA, 25 bp, Rattus norvegicus
gctacatcccttggatttgccagtc

SEQ ID NO: 402588 - DNA, 25 bp, Rattus norvegicus
gctacatctggacagcactgtgcat

SEQ ID NO: 402589 - DNA, 25 bp, Rattus norvegicus
gctacatctggagagcactgtgcat

SEQ ID NO: 402590 - DNA, 25 bp, Rattus norvegicus
gctacatctgtaccctagcttttta

SEQ ID NO: 402591 - DNA, 25 bp, Rattus norvegicus
gctacatctgtagcctagcttttta

SEQ ID NO: 402592 - DNA, 25 bp, Rattus norvegicus
gctacatcttgacctgcaggctgag

SEQ ID NO: 402593 - DNA, 25 bp, Rattus norvegicus
gctacatcttgagctgcaggctgag

SEQ ID NO: 402594 - DNA, 25 bp, Rattus norvegicus
gctacatctttcctgaagtgattgt

SEQ ID NO: 402595 - DNA, 25 bp, Rattus norvegicus
gctacatctttcgtgaagtgattgt

SEQ ID NO: 402596 - DNA, 25 bp, Rattus norvegicus
gctacatgagatactatcttccaga

SEQ ID NO: 402597 - DNA, 25 bp, Rattus norvegicus
gctacatgagatcctacttccaaac

SEQ ID NO: 402598 - DNA, 25 bp, Rattus norvegicus
gctacatgagatgctacttccaaac

SEQ ID NO: 402599 - DNA, 25 bp, Rattus norvegicus
gctacatgagattctatcttccaga

SEQ ID NO: 402600 - DNA, 25 bp, Rattus norvegicus
gctacatgctgcaggttaactactg

SEQ ID NO: 402601 - DNA, 25 bp, Rattus norvegicus
gctacatgctgctggttaactactg

SEQ ID NO: 402602 - DNA, 25 bp, Rattus norvegicus
gctacatgtgccaatctaattacac

SEQ ID NO: 402603 - DNA, 25 bp, Rattus norvegicus
gctacatgtgcctatctaattacac

SEQ ID NO: 402604 - DNA, 25 bp, Rattus norvegicus
gctacatgtgtaagtctgcctaaat

SEQ ID NO: 402605 - DNA, 25 bp, Rattus norvegicus
gctacatgtgtatgtctgcctaaat

SEQ ID NO: 402606 - DNA, 25 bp, Rattus norvegicus
gctacattcaggcttacccattgaa

SEQ ID NO: 402607 - DNA, 25 bp, Rattus norvegicus
gctacattcagggttacccattgaa

SEQ ID NO: 402608 - DNA, 25 bp, Rattus norvegicus
gctacattccagacccaggatactt

SEQ ID NO: 402609 - DNA, 25 bp, Rattus norvegicus
gctacattccagatccgcgtgagtc

SEQ ID NO: 402610 - DNA, 25 bp, Rattus norvegicus
gctacattccagtcccaggatactt

SEQ ID NO: 402611 - DNA, 25 bp, Rattus norvegicus
gctacattccagttccgcgtgagtc

SEQ ID NO: 402612 - DNA, 25 bp, Rattus norvegicus
gctacattctccacagtggcaaaaa

SEQ ID NO: 402613 - DNA, 25 bp, Rattus norvegicus
gctacattctcctcagtggcaaaaa

SEQ ID NO: 402614 - DNA, 25 bp, Rattus norvegicus
gctacattcttcattgctttaaacg

SEQ ID NO: 402615 - DNA, 25 bp, Rattus norvegicus
gctacattcttctttgctttaaacg

SEQ ID NO: 402616 - DNA, 25 bp, Rattus norvegicus
gctacatttaaacaccatccctcag

SEQ ID NO: 402617 - DNA, 25 bp, Rattus norvegicus
gctacatttaaagaccatccctcag

SEQ ID NO: 402618 - DNA, 25 bp, Rattus norvegicus
gctacatttacacatctagcagtca

SEQ ID NO: 402619 - DNA, 25 bp, Rattus norvegicus
gctacatttacagatctagcagtca

SEQ ID NO: 402620 - DNA, 25 bp, Rattus norvegicus
gctacatttagaagcacctgtgaaa

SEQ ID NO: 402621 - DNA, 25 bp, Rattus norvegicus
gctacatttagatgcacctgtgaaa

SEQ ID NO: 402622 - DNA, 25 bp, Rattus norvegicus
gctacatttgctcagattttcctgg

SEQ ID NO: 402623 - DNA, 25 bp, Rattus norvegicus
gctacatttgctgagattttcctgg

SEQ ID NO: 402624 - DNA, 25 bp, Rattus norvegicus
gctacatttgtcaactgagtcccca

SEQ ID NO: 402625 - DNA, 25 bp, Rattus norvegicus
gctacatttgtctactgagtcccca

SEQ ID NO: 402626 - DNA, 25 bp, Rattus norvegicus
gctacattttagatttatgctgaaa

SEQ ID NO: 402627 - DNA, 25 bp, Rattus norvegicus
gctacattttagttttatgctgaaa

SEQ ID NO: 402628 - DNA, 25 bp, Rattus norvegicus
gctacattttgaatttgaaggctgc

SEQ ID NO: 402629 - DNA, 25 bp, Rattus norvegicus
gctacattttgattttgaaggctgc

SEQ ID NO: 402630 - DNA, 25 bp, Rattus norvegicus
gctaccaaaccccacatgagagaga

SEQ ID NO: 402631 - DNA, 25 bp, Rattus norvegicus
gctaccaaacccgacatgagagaga

SEQ ID NO: 402632 - DNA, 25 bp, Rattus norvegicus
gctaccaagctgatgatctgggttc

SEQ ID NO: 402633 - DNA, 25 bp, Rattus norvegicus
gctaccaagctgttgatctgggttc

SEQ ID NO: 402634 - DNA, 25 bp, Rattus norvegicus
gctaccaaggatatgtgggctgcga

SEQ ID NO: 402635 - DNA, 25 bp, Rattus norvegicus
gctaccaaggatttgtgggctgcga

SEQ ID NO: 402636 - DNA, 25 bp, Rattus norvegicus
gctaccaagtggagagagcttcccg

SEQ ID NO: 402637 - DNA, 25 bp, Rattus norvegicus
gctaccaagtggtgagagcttcccg

SEQ ID NO: 402638 - DNA, 25 bp, Rattus norvegicus
gctaccaccactccaaatgtgctga

SEQ ID NO: 402639 - DNA, 25 bp, Rattus norvegicus
gctaccaccactgcaaatgtgctga

SEQ ID NO: 402640 - DNA, 25 bp, Rattus norvegicus
gctaccacccatctcgagtgaggtc

SEQ ID NO: 402641 - DNA, 25 bp, Rattus norvegicus
gctaccacccatgtcgagtgaggtc

SEQ ID NO: 402642 - DNA, 25 bp, Rattus norvegicus
gctaccacgagcaactgtgcaaaat

SEQ ID NO: 402643 - DNA, 25 bp, Rattus norvegicus
gctaccacgagctactgtgcaaaat

SEQ ID NO: 402644 - DNA, 25 bp, Rattus norvegicus
gctaccacgcagctcgagaagaagt

SEQ ID NO: 402645 - DNA, 25 bp, Rattus norvegicus
gctaccacgcaggtcgagaagaagt

SEQ ID NO: 402646 - DNA, 25 bp, Rattus norvegicus
gctaccactctaagagctcaatggc

SEQ ID NO: 402647 - DNA, 25 bp, Rattus norvegicus
gctaccactctatgagctcaatggc

SEQ ID NO: 402648 - DNA, 25 bp, Rattus norvegicus
gctaccactgtgcactcttgggagt

SEQ ID NO: 402649 - DNA, 25 bp, Rattus norvegicus
gctaccactgtggactcttgggagt

SEQ ID NO: 402650 - DNA, 25 bp, Rattus norvegicus
gctaccagcatgagcgggagtctta

SEQ ID NO: 402651 - DNA, 25 bp, Rattus norvegicus
gctaccagcatgtgcgggagtctta

SEQ ID NO: 402652 - DNA, 25 bp, Rattus norvegicus
gctaccagctaaacgctcttataaa

SEQ ID NO: 402653 - DNA, 25 bp, Rattus norvegicus
gctaccagctaatcgctcttataaa

SEQ ID NO: 402654 - DNA, 25 bp, Rattus norvegicus
gctaccagggagctgtatcagacaa

SEQ ID NO: 402655 - DNA, 25 bp, Rattus norvegicus
gctaccagggaggtgtatcagacaa

SEQ ID NO: 402656 - DNA, 25 bp, Rattus norvegicus
gctaccagggtacgcagtcacgtgt

SEQ ID NO: 402657 - DNA, 25 bp, Rattus norvegicus
gctaccagggtaggcagtcacgtgt

SEQ ID NO: 402658 - DNA, 25 bp, Rattus norvegicus
gctaccagttctcataagaccctac

SEQ ID NO: 402659 - DNA, 25 bp, Rattus norvegicus
gctaccagttctgataagaccctac

SEQ ID NO: 402660 - DNA, 25 bp, Rattus norvegicus
gctaccatacctattgggaaacatg

SEQ ID NO: 402661 - DNA, 25 bp, Rattus norvegicus
gctaccataccttttgggaaacatg

SEQ ID NO: 402662 - DNA, 25 bp, Rattus norvegicus
gctaccatccggctctatattgata

SEQ ID NO: 402663 - DNA, 25 bp, Rattus norvegicus
gctaccatccgggtctatattgata

SEQ ID NO: 402664 - DNA, 25 bp, Rattus norvegicus
gctaccattctcatattgctacgac

SEQ ID NO: 402665 - DNA, 25 bp, Rattus norvegicus
gctaccattctcttattgctacgac

SEQ ID NO: 402666 - DNA, 25 bp, Rattus norvegicus
gctaccattgtgctgtgaattctac

SEQ ID NO: 402667 - DNA, 25 bp, Rattus norvegicus
gctaccattgtggtgtgaattctac

SEQ ID NO: 402668 - DNA, 25 bp, Rattus norvegicus
gctacccaaccaactctagagtaag

SEQ ID NO: 402669 - DNA, 25 bp, Rattus norvegicus
gctacccaaccatctctagagtaag

SEQ ID NO: 402670 - DNA, 25 bp, Rattus norvegicus
gctacccaagctccacattgtggat

SEQ ID NO: 402671 - DNA, 25 bp, Rattus norvegicus
gctacccaagctgcacattgtggat

SEQ ID NO: 402672 - DNA, 25 bp, Rattus norvegicus
gctacccaatgaccagatttttgag

SEQ ID NO: 402673 - DNA, 25 bp, Rattus norvegicus
gctacccaatgagcagatttttgag

SEQ ID NO: 402674 - DNA, 25 bp, Rattus norvegicus
gctacccagaagcagggcactatat

SEQ ID NO: 402675 - DNA, 25 bp, Rattus norvegicus
gctacccagaaggagggcactatat

SEQ ID NO: 402676 - DNA, 25 bp, Rattus norvegicus
gctacccagctgagcacttggaaat

SEQ ID NO: 402677 - DNA, 25 bp, Rattus norvegicus
gctacccagctgtgcacttggaaat

SEQ ID NO: 402678 - DNA, 25 bp, Rattus norvegicus
gctacccatagcacacaagtcaaag

SEQ ID NO: 402679 - DNA, 25 bp, Rattus norvegicus
gctacccatagctcacaagtcaaag

SEQ ID NO: 402680 - DNA, 25 bp, Rattus norvegicus
gctacccatgtactcagtggctata

SEQ ID NO: 402681 - DNA, 25 bp, Rattus norvegicus
gctacccatgtagtcagtggctata

SEQ ID NO: 402682 - DNA, 25 bp, Rattus norvegicus
gctacccattcacttgagagcacag

SEQ ID NO: 402683 - DNA, 25 bp, Rattus norvegicus
gctacccattcagttgagagcacag

SEQ ID NO: 402684 - DNA, 25 bp, Rattus norvegicus
gctaccccaatcattgagtccagag

SEQ ID NO: 402685 - DNA, 25 bp, Rattus norvegicus
gctaccccaatctttgagtccagag

SEQ ID NO: 402686 - DNA, 25 bp, Rattus norvegicus
gctaccccaggacagtttctgtgtt

SEQ ID NO: 402687 - DNA, 25 bp, Rattus norvegicus
gctaccccaggagagtttctgtgtt

SEQ ID NO: 402688 - DNA, 25 bp, Rattus norvegicus
gctaccccatgactctatgtgtgga

SEQ ID NO: 402689 - DNA, 25 bp, Rattus norvegicus
gctaccccatgagtctatgtgtgga

SEQ ID NO: 402690 - DNA, 25 bp, Rattus norvegicus
gctacccctggccaaattaaacaat

SEQ ID NO: 402691 - DNA, 25 bp, Rattus norvegicus
gctacccctggcgaaattaaacaat

SEQ ID NO: 402692 - DNA, 25 bp, Rattus norvegicus
gctacccctgggaggaggagatcct

SEQ ID NO: 402693 - DNA, 25 bp, Rattus norvegicus
gctacccctgggtggaggagatcct

SEQ ID NO: 402694 - DNA, 25 bp, Rattus norvegicus
gctaccccttcacgatttggttggt

SEQ ID NO: 402695 - DNA, 25 bp, Rattus norvegicus
gctaccccttcaggatttggttggt

SEQ ID NO: 402696 - DNA, 25 bp, Rattus norvegicus
gctacccctttcaagaacaaggtct

SEQ ID NO: 402697 - DNA, 25 bp, Rattus norvegicus
gctacccctttctagaacaaggtct

SEQ ID NO: 402698 - DNA, 25 bp, Rattus norvegicus
gctaccctccttcatgttaatcttg

SEQ ID NO: 402699 - DNA, 25 bp, Rattus norvegicus
gctaccctccttctgagtctaagaa

SEQ ID NO: 402700 - DNA, 25 bp, Rattus norvegicus
gctaccctccttgatgttaatcttg

SEQ ID NO: 402701 - DNA, 25 bp, Rattus norvegicus
gctaccctccttgtgagtctaagaa

SEQ ID NO: 402702 - DNA, 25 bp, Rattus norvegicus
gctaccctctataacttctacaaga

SEQ ID NO: 402703 - DNA, 25 bp, Rattus norvegicus
gctaccctctattacttctacaaga

SEQ ID NO: 402704 - DNA, 25 bp, Rattus norvegicus
gctaccctggaaatgaaattgtttt

SEQ ID NO: 402705 - DNA, 25 bp, Rattus norvegicus
gctaccctggaattgaaattgtttt

SEQ ID NO: 402706 - DNA, 25 bp, Rattus norvegicus
gctaccctgggcaattctatttatt

SEQ ID NO: 402707 - DNA, 25 bp, Rattus norvegicus
gctaccctgggctattctatttatt

SEQ ID NO: 402708 - DNA, 25 bp, Rattus norvegicus
gctaccctgtggacccgaagggcaa

SEQ ID NO: 402709 - DNA, 25 bp, Rattus norvegicus
gctaccctgtggtcccgaagggcaa

SEQ ID NO: 402710 - DNA, 25 bp, Rattus norvegicus
gctacccttggaatctaggatgctt

SEQ ID NO: 402711 - DNA, 25 bp, Rattus norvegicus
gctacccttggattctaggatgctt

SEQ ID NO: 402712 - DNA, 25 bp, Rattus norvegicus
gctacccttggcaattcagtgaagt

SEQ ID NO: 402713 - DNA, 25 bp, Rattus norvegicus
gctacccttggctattcagtgaagt

SEQ ID NO: 402714 - DNA, 25 bp, Rattus norvegicus
gctaccggcttgcaggagactatga

SEQ ID NO: 402715 - DNA, 25 bp, Rattus norvegicus
gctaccggcttggaggagactatga

SEQ ID NO: 402716 - DNA, 25 bp, Rattus norvegicus
gctaccgggctcagcttttagagaa

SEQ ID NO: 402717 - DNA, 25 bp, Rattus norvegicus
gctaccgggctctgcttttagagaa

SEQ ID NO: 402718 - DNA, 25 bp, Rattus norvegicus
gctaccgggttaatatgctgtttca

SEQ ID NO: 402719 - DNA, 25 bp, Rattus norvegicus
gctaccgggttattatgctgtttca

SEQ ID NO: 402720 - DNA, 25 bp, Rattus norvegicus
gctaccggtgacaggaaaggcctca

SEQ ID NO: 402721 - DNA, 25 bp, Rattus norvegicus
gctaccggtgactggaaaggcctca

SEQ ID NO: 402722 - DNA, 25 bp, Rattus norvegicus
gctaccggtgggaattcaggaccaa

SEQ ID NO: 402723 - DNA, 25 bp, Rattus norvegicus
gctaccggtgggtattcaggaccaa

SEQ ID NO: 402724 - DNA, 25 bp, Rattus norvegicus
gctaccggttgcagaacactcagta

SEQ ID NO: 402725 - DNA, 25 bp, Rattus norvegicus
gctaccggttgctgaacactcagta

SEQ ID NO: 402726 - DNA, 25 bp, Rattus norvegicus
gctaccgtcagtcaaatcgtgctca

SEQ ID NO: 402727 - DNA, 25 bp, Rattus norvegicus
gctaccgtcagtgaaatcgtgctca

SEQ ID NO: 402728 - DNA, 25 bp, Rattus norvegicus
gctaccgtccgtcagttggtatcag

SEQ ID NO: 402729 - DNA, 25 bp, Rattus norvegicus
gctaccgtccgtgagttggtatcag

SEQ ID NO: 402730 - DNA, 25 bp, Rattus norvegicus
gctaccgtgggcagcagtatctgct

SEQ ID NO: 402731 - DNA, 25 bp, Rattus norvegicus
gctaccgtgggctgcagtatctgct

SEQ ID NO: 402732 - DNA, 25 bp, Rattus norvegicus
gctaccgtgtacatggctggttgga

SEQ ID NO: 402733 - DNA, 25 bp, Rattus norvegicus
gctaccgtgtacttggctggttgga

SEQ ID NO: 402734 - DNA, 25 bp, Rattus norvegicus
gctaccgtgttgcttttggccaatg

SEQ ID NO: 402735 - DNA, 25 bp, Rattus norvegicus
gctaccgtgttggttttggccaatg

SEQ ID NO: 402736 - DNA, 25 bp, Rattus norvegicus
gctacctaagtaattcagtgaacct

SEQ ID NO: 402737 - DNA, 25 bp, Rattus norvegicus
gctacctaagtatttcagtgaacct

SEQ ID NO: 402738 - DNA, 25 bp, Rattus norvegicus
gctacctaccacctgttttcaagaa

SEQ ID NO: 402739 - DNA, 25 bp, Rattus norvegicus
gctacctaccacgtgttttcaagaa

SEQ ID NO: 402740 - DNA, 25 bp, Rattus norvegicus
gctacctagagcaatcttgtaatac

SEQ ID NO: 402741 - DNA, 25 bp, Rattus norvegicus
gctacctagagctatcttgtaatac

SEQ ID NO: 402742 - DNA, 25 bp, Rattus norvegicus
gctacctaggctcacagacttggaa

SEQ ID NO: 402743 - DNA, 25 bp, Rattus norvegicus
gctacctaggctgacagacttggaa

SEQ ID NO: 402744 - DNA, 25 bp, Rattus norvegicus
gctacctagggtatactttcagaca

SEQ ID NO: 402745 - DNA, 25 bp, Rattus norvegicus
gctacctagggtttactttcagaca

SEQ ID NO: 402746 - DNA, 25 bp, Rattus norvegicus
gctacctcactaaatgacaaggcag

SEQ ID NO: 402747 - DNA, 25 bp, Rattus norvegicus
gctacctcactatatgacaaggcag

SEQ ID NO: 402748 - DNA, 25 bp, Rattus norvegicus
gctacctcaggtcttttttacctca

SEQ ID NO: 402749 - DNA, 25 bp, Rattus norvegicus
gctacctcaggtgttttttacctca

SEQ ID NO: 402750 - DNA, 25 bp, Rattus norvegicus
gctacctccaccaatgagtgcaata

SEQ ID NO: 402751 - DNA, 25 bp, Rattus norvegicus
gctacctccacctatgagtgcaata

SEQ ID NO: 402752 - DNA, 25 bp, Rattus norvegicus
gctacctccgggatgtgacaggcaa

SEQ ID NO: 402753 - DNA, 25 bp, Rattus norvegicus
gctacctccgggttgtgacaggcaa

SEQ ID NO: 402754 - DNA, 25 bp, Rattus norvegicus
gctacctcctaaactatagtggctg

SEQ ID NO: 402755 - DNA, 25 bp, Rattus norvegicus
gctacctcctaatctatagtggctg

SEQ ID NO: 402756 - DNA, 25 bp, Rattus norvegicus
gctacctccttaagcatgttggcaa

SEQ ID NO: 402757 - DNA, 25 bp, Rattus norvegicus
gctacctccttatgcatgttggcaa

SEQ ID NO: 402758 - DNA, 25 bp, Rattus norvegicus
gctacctcggagattctgaagtggg

SEQ ID NO: 402759 - DNA, 25 bp, Rattus norvegicus
gctacctcggagtttctgaagtggg

SEQ ID NO: 402760 - DNA, 25 bp, Rattus norvegicus
gctacctctggtcatctaactctat

SEQ ID NO: 402761 - DNA, 25 bp, Rattus norvegicus
gctacctctggtgatctaactctat

SEQ ID NO: 402762 - DNA, 25 bp, Rattus norvegicus
gctacctctgttccaggtgactgga

SEQ ID NO: 402763 - DNA, 25 bp, Rattus norvegicus
gctacctctgttgcaggtgactgga

SEQ ID NO: 402764 - DNA, 25 bp, Rattus norvegicus
gctacctcttctattgaaattccta

SEQ ID NO: 402765 - DNA, 25 bp, Rattus norvegicus
gctacctcttcttttgaaattccta

SEQ ID NO: 402766 - DNA, 25 bp, Rattus norvegicus
gctacctgaacgatgattccactca

SEQ ID NO: 402767 - DNA, 25 bp, Rattus norvegicus
gctacctgaacgttgattccactca

SEQ ID NO: 402768 - DNA, 25 bp, Rattus norvegicus
gctacctgaagcacagcaaagcctt

SEQ ID NO: 402769 - DNA, 25 bp, Rattus norvegicus
gctacctgaagctcagcaaagcctt

SEQ ID NO: 402770 - DNA, 25 bp, Rattus norvegicus
gctacctgaccccaaggagaaggat

SEQ ID NO: 402771 - DNA, 25 bp, Rattus norvegicus
gctacctgacccgaaggagaaggat

SEQ ID NO: 402772 - DNA, 25 bp, Rattus norvegicus
gctacctgagggacatctgaatcat

SEQ ID NO: 402773 - DNA, 25 bp, Rattus norvegicus
gctacctgagggtcatctgaatcat

SEQ ID NO: 402774 - DNA, 25 bp, Rattus norvegicus
gctacctgcggcaggatgggaattt

SEQ ID NO: 402775 - DNA, 25 bp, Rattus norvegicus
gctacctgcggctggatgggaattt

SEQ ID NO: 402776 - DNA, 25 bp, Rattus norvegicus
gctacctggttgattgacgctatga

SEQ ID NO: 402777 - DNA, 25 bp, Rattus norvegicus
gctacctggttgtttgacgctatga

SEQ ID NO: 402778 - DNA, 25 bp, Rattus norvegicus
gctacctgtatcacagattggactc

SEQ ID NO: 402779 - DNA, 25 bp, Rattus norvegicus
gctacctgtatctcagattggactc

SEQ ID NO: 402780 - DNA, 25 bp, Rattus norvegicus
gctacctgtgagagggcagactcct

SEQ ID NO: 402781 - DNA, 25 bp, Rattus norvegicus
gctacctgtgagtgggcagactcct

SEQ ID NO: 402782 - DNA, 25 bp, Rattus norvegicus
gctacctgtttaactgcacagcccg

SEQ ID NO: 402783 - DNA, 25 bp, Rattus norvegicus
gctacctgtttatctgcacagcccg

SEQ ID NO: 402784 - DNA, 25 bp, Rattus norvegicus
gctaccttaaacctatgtccacagt

SEQ ID NO: 402785 - DNA, 25 bp, Rattus norvegicus
gctaccttaaacgtatgtccacagt

SEQ ID NO: 402786 - DNA, 25 bp, Rattus norvegicus
gctaccttatttatgtcaccgactg

SEQ ID NO: 402787 - DNA, 25 bp, Rattus norvegicus
gctaccttatttttgtcaccgactg

SEQ ID NO: 402788 - DNA, 25 bp, Rattus norvegicus
gctaccttccctctagagaagatat

SEQ ID NO: 402789 - DNA, 25 bp, Rattus norvegicus
gctaccttccctgtagagaagatat

SEQ ID NO: 402790 - DNA, 25 bp, Rattus norvegicus
gctaccttcctgactgcgggtggag

SEQ ID NO: 402791 - DNA, 25 bp, Rattus norvegicus
gctaccttcctgtctgcgggtggag

SEQ ID NO: 402792 - DNA, 25 bp, Rattus norvegicus
gctaccttctctataaagtcactca

SEQ ID NO: 402793 - DNA, 25 bp, Rattus norvegicus
gctaccttctctttaaagtcactca

SEQ ID NO: 402794 - DNA, 25 bp, Rattus norvegicus
gctaccttctggagcttgctatgaa

SEQ ID NO: 402795 - DNA, 25 bp, Rattus norvegicus
gctaccttctggtgcttgctatgaa

SEQ ID NO: 402796 - DNA, 25 bp, Rattus norvegicus
gctaccttcttgatacactgttttg

SEQ ID NO: 402797 - DNA, 25 bp, Rattus norvegicus
gctaccttcttgttacactgttttg

SEQ ID NO: 402798 - DNA, 25 bp, Rattus norvegicus
gctaccttgtccaaacctgagtaat

SEQ ID NO: 402799 - DNA, 25 bp, Rattus norvegicus
gctaccttgtcctaacctgagtaat

SEQ ID NO: 402800 - DNA, 25 bp, Rattus norvegicus
gctaccttgttcattgtgtttttat

SEQ ID NO: 402801 - DNA, 25 bp, Rattus norvegicus
gctaccttgttctttgtgtttttat

SEQ ID NO: 402802 - DNA, 25 bp, Rattus norvegicus
gctacctttgtaaagaatgcctgtg

SEQ ID NO: 402803 - DNA, 25 bp, Rattus norvegicus
gctacctttgtatagaatgcctgtg

SEQ ID NO: 402804 - DNA, 25 bp, Rattus norvegicus
gctaccttttcaagtgtgcactgga

SEQ ID NO: 402805 - DNA, 25 bp, Rattus norvegicus
gctaccttttcatgtgtgcactgga

SEQ ID NO: 402806 - DNA, 25 bp, Rattus norvegicus
gctacgacgagtaccgcggctgctc

SEQ ID NO: 402807 - DNA, 25 bp, Rattus norvegicus
gctacgacgagttccgcggctgctc

SEQ ID NO: 402808 - DNA, 25 bp, Rattus norvegicus
gctacgacgctcagtactatggcta

SEQ ID NO: 402809 - DNA, 25 bp, Rattus norvegicus
gctacgacgctctgtactatggcta

SEQ ID NO: 402810 - DNA, 25 bp, Rattus norvegicus
gctacgactatgatggcttcaccaa

SEQ ID NO: 402811 - DNA, 25 bp, Rattus norvegicus
gctacgactatgttggcttcaccaa

SEQ ID NO: 402812 - DNA, 25 bp, Rattus norvegicus
gctacgactctgaaagtgtcacctt

SEQ ID NO: 402813 - DNA, 25 bp, Rattus norvegicus
gctacgactctgtaagtgtcacctt

SEQ ID NO: 402814 - DNA, 25 bp, Rattus norvegicus
gctacgactgataccagctcctagt

SEQ ID NO: 402815 - DNA, 25 bp, Rattus norvegicus
gctacgactgattccagctcctagt

SEQ ID NO: 402816 - DNA, 25 bp, Rattus norvegicus
gctacgacttcccaaaggcgcagga

SEQ ID NO: 402817 - DNA, 25 bp, Rattus norvegicus
gctacgacttccgaaaggcgcagga

SEQ ID NO: 402818 - DNA, 25 bp, Rattus norvegicus
gctacgagcagccttgaagactcag

SEQ ID NO: 402819 - DNA, 25 bp, Rattus norvegicus
gctacgagcagcgttgaagactcag

SEQ ID NO: 402820 - DNA, 25 bp, Rattus norvegicus
gctacgagccggagctctttgaaga

SEQ ID NO: 402821 - DNA, 25 bp, Rattus norvegicus
gctacgagccggtgctctttgaaga

SEQ ID NO: 402822 - DNA, 25 bp, Rattus norvegicus
gctacgagcgggataacagtcctga

SEQ ID NO: 402823 - DNA, 25 bp, Rattus norvegicus
gctacgagcgggttaacagtcctga

SEQ ID NO: 402824 - DNA, 25 bp, Rattus norvegicus
gctacgagctgtaatgtgccatcct

SEQ ID NO: 402825 - DNA, 25 bp, Rattus norvegicus
gctacgagctgttatgtgccatcct

SEQ ID NO: 402826 - DNA, 25 bp, Rattus norvegicus
gctacgaggtaaatcccttcacaga

SEQ ID NO: 402827 - DNA, 25 bp, Rattus norvegicus
gctacgaggtaattcccttcacaga

SEQ ID NO: 402828 - DNA, 25 bp, Rattus norvegicus
gctacgcagttgagggtgcccttga

SEQ ID NO: 402829 - DNA, 25 bp, Rattus norvegicus
gctacgcagttgtgggtgcccttga

SEQ ID NO: 402830 - DNA, 25 bp, Rattus norvegicus
gctacgcatcttagctcaaggatgt

SEQ ID NO: 402831 - DNA, 25 bp, Rattus norvegicus
gctacgcatctttgctcaaggatgt

SEQ ID NO: 402832 - DNA, 25 bp, Rattus norvegicus
gctacgcatgaacagagggctcaat

SEQ ID NO: 402833 - DNA, 25 bp, Rattus norvegicus
gctacgcatgaagagagggctcaat

SEQ ID NO: 402834 - DNA, 25 bp, Rattus norvegicus
gctacgccacttacttgagattcat

SEQ ID NO: 402835 - DNA, 25 bp, Rattus norvegicus
gctacgccactttcttgagattcat

SEQ ID NO: 402836 - DNA, 25 bp, Rattus norvegicus
gctacgcgacagacaagagcctatc

SEQ ID NO: 402837 - DNA, 25 bp, Rattus norvegicus
gctacgcgacagtcaagagcctatc

SEQ ID NO: 402838 - DNA, 25 bp, Rattus norvegicus
gctacggcaaccaagagcttaagaa

SEQ ID NO: 402839 - DNA, 25 bp, Rattus norvegicus
gctacggcaacctagagcttaagaa

SEQ ID NO: 402840 - DNA, 25 bp, Rattus norvegicus
gctacgggacggatgctgtcatcta

SEQ ID NO: 402841 - DNA, 25 bp, Rattus norvegicus
gctacgggacggttgctgtcatcta

SEQ ID NO: 402842 - DNA, 25 bp, Rattus norvegicus
gctacggtgttcaatctccaatact

SEQ ID NO: 402843 - DNA, 25 bp, Rattus norvegicus
gctacggtgttctatctccaatact

SEQ ID NO: 402844 - DNA, 25 bp, Rattus norvegicus
gctacggttgcaattctgttttcta

SEQ ID NO: 402845 - DNA, 25 bp, Rattus norvegicus
gctacggttgcatttctgttttcta

SEQ ID NO: 402846 - DNA, 25 bp, Rattus norvegicus
gctacggttggaatcttagtctgca

SEQ ID NO: 402847 - DNA, 25 bp, Rattus norvegicus
gctacggttggattcttagtctgca

SEQ ID NO: 402848 - DNA, 25 bp, Rattus norvegicus
gctacgtagcccaggattttgagaa

SEQ ID NO: 402849 - DNA, 25 bp, Rattus norvegicus
gctacgtagccctggattttgagaa

SEQ ID NO: 402850 - DNA, 25 bp, Rattus norvegicus
gctacgtagcctactgttgcaagga

SEQ ID NO: 402851 - DNA, 25 bp, Rattus norvegicus
gctacgtagccttctgttgcaagga

SEQ ID NO: 402852 - DNA, 25 bp, Rattus norvegicus
gctacgtagtgacgtcctgcttcaa

SEQ ID NO: 402853 - DNA, 25 bp, Rattus norvegicus
gctacgtagtgaggtcctgcttcaa

SEQ ID NO: 402854 - DNA, 25 bp, Rattus norvegicus
gctacgtatatgatagtcaggccat

SEQ ID NO: 402855 - DNA, 25 bp, Rattus norvegicus
gctacgtatatgttagtcaggccat

SEQ ID NO: 402856 - DNA, 25 bp, Rattus norvegicus
gctacgtcaagtcgattccgcatga

SEQ ID NO: 402857 - DNA, 25 bp, Rattus norvegicus
gctacgtcaagtggattccgcatga

SEQ ID NO: 402858 - DNA, 25 bp, Rattus norvegicus
gctacgtccatccatgaggtgttat

SEQ ID NO: 402859 - DNA, 25 bp, Rattus norvegicus
gctacgtccatcgatgaggtgttat

SEQ ID NO: 402860 - DNA, 25 bp, Rattus norvegicus
gctacgtccgtgagaactgcaaacc

SEQ ID NO: 402861 - DNA, 25 bp, Rattus norvegicus
gctacgtccgtgtgaactgcaaacc

SEQ ID NO: 402862 - DNA, 25 bp, Rattus norvegicus
gctacgtcgtggaccaggcgcgtct

SEQ ID NO: 402863 - DNA, 25 bp, Rattus norvegicus
gctacgtcgtggtccaggcgcgtct

SEQ ID NO: 402864 - DNA, 25 bp, Rattus norvegicus
gctacgtgactcagggctgcatggc

SEQ ID NO: 402865 - DNA, 25 bp, Rattus norvegicus
gctacgtgactctgggctgcatggc

SEQ ID NO: 402866 - DNA, 25 bp, Rattus norvegicus
gctacgtgactgaaaaggctccttg

SEQ ID NO: 402867 - DNA, 25 bp, Rattus norvegicus
gctacgtgactgtaaaggctccttg

SEQ ID NO: 402868 - DNA, 25 bp, Rattus norvegicus
gctacgtgctgtactaccaattgat

SEQ ID NO: 402869 - DNA, 25 bp, Rattus norvegicus
gctacgtgctgttctaccaattgat

SEQ ID NO: 402870 - DNA, 25 bp, Rattus norvegicus
gctacgtggtgaagtgaatgccttt

SEQ ID NO: 402871 - DNA, 25 bp, Rattus norvegicus
gctacgtggtgatgtgaatgccttt

SEQ ID NO: 402872 - DNA, 25 bp, Rattus norvegicus
gctacgtgtagccatcgtgacctag

SEQ ID NO: 402873 - DNA, 25 bp, Rattus norvegicus
gctacgtgtagccattgtgactgtg

SEQ ID NO: 402874 - DNA, 25 bp, Rattus norvegicus
gctacgtgtagcgatcgtgacctag

SEQ ID NO: 402875 - DNA, 25 bp, Rattus norvegicus
gctacgtgtagcgattgtgactgtg

SEQ ID NO: 402876 - DNA, 25 bp, Rattus norvegicus
gctacgtgttctaatttttaccgat

SEQ ID NO: 402877 - DNA, 25 bp, Rattus norvegicus
gctacgtgttcttatttttaccgat

SEQ ID NO: 402878 - DNA, 25 bp, Rattus norvegicus
gctacgtttggtccgaagtgacttc

SEQ ID NO: 402879 - DNA, 25 bp, Rattus norvegicus
gctacgtttggtgcgaagtgacttc

SEQ ID NO: 402880 - DNA, 25 bp, Rattus norvegicus
gctactaaaacaatgctcacgctgt

SEQ ID NO: 402881 - DNA, 25 bp, Rattus norvegicus
gctactaaaacattgctcacgctgt

SEQ ID NO: 402882 - DNA, 25 bp, Rattus norvegicus
gctactaacaacctgaacacttgtg

SEQ ID NO: 402883 - DNA, 25 bp, Rattus norvegicus
gctactaacaacgtgaacacttgtg

SEQ ID NO: 402884 - DNA, 25 bp, Rattus norvegicus
gctactaacttgaaaactgctaggg

SEQ ID NO: 402885 - DNA, 25 bp, Rattus norvegicus
gctactaacttgtaaactgctaggg

SEQ ID NO: 402886 - DNA, 25 bp, Rattus norvegicus
gctactaaggtcattctccagccca

SEQ ID NO: 402887 - DNA, 25 bp, Rattus norvegicus
gctactaaggtctttctccagccca

SEQ ID NO: 402888 - DNA, 25 bp, Rattus norvegicus
gctactaatgccatctattgctcta

SEQ ID NO: 402889 - DNA, 25 bp, Rattus norvegicus
gctactaatgccttctattgctcta

SEQ ID NO: 402890 - DNA, 25 bp, Rattus norvegicus
gctactaattgaaatcgacccaccg

SEQ ID NO: 402891 - DNA, 25 bp, Rattus norvegicus
gctactaattgatatcgacccaccg

SEQ ID NO: 402892 - DNA, 25 bp, Rattus norvegicus
gctactactgcaagatggaacccct

SEQ ID NO: 402893 - DNA, 25 bp, Rattus norvegicus
gctactactgcatgatggaacccct

SEQ ID NO: 402894 - DNA, 25 bp, Rattus norvegicus
gctactactggtcctgaggtcatca

SEQ ID NO: 402895 - DNA, 25 bp, Rattus norvegicus
gctactactggtgctgaggtcatca

SEQ ID NO: 402896 - DNA, 25 bp, Rattus norvegicus
gctactacttcgaccagcagcaggt

SEQ ID NO: 402897 - DNA, 25 bp, Rattus norvegicus
gctactacttcgtccagcagcaggt

SEQ ID NO: 402898 - DNA, 25 bp, Rattus norvegicus
gctactacttgccttgctttgtgac

SEQ ID NO: 402899 - DNA, 25 bp, Rattus norvegicus
gctactacttgcgttgctttgtgac

SEQ ID NO: 402900 - DNA, 25 bp, Rattus norvegicus
gctactagaagaactcatgcctttc

SEQ ID NO: 402901 - DNA, 25 bp, Rattus norvegicus
gctactagaagatctcatgcctttc

SEQ ID NO: 402902 - DNA, 25 bp, Rattus norvegicus
gctactagacttatgctggagacac

SEQ ID NO: 402903 - DNA, 25 bp, Rattus norvegicus
gctactagacttttgctggagacac

SEQ ID NO: 402904 - DNA, 25 bp, Rattus norvegicus
gctactagcagcataagtgttccta

SEQ ID NO: 402905 - DNA, 25 bp, Rattus norvegicus
gctactagcagcttaagtgttccta

SEQ ID NO: 402906 - DNA, 25 bp, Rattus norvegicus
gctactagcttgaccatagagcata

SEQ ID NO: 402907 - DNA, 25 bp, Rattus norvegicus
gctactagcttgtccatagagcata

SEQ ID NO: 402908 - DNA, 25 bp, Rattus norvegicus
gctactaggaaccttcggagttctt

SEQ ID NO: 402909 - DNA, 25 bp, Rattus norvegicus
gctactaggaacgttcggagttctt

SEQ ID NO: 402910 - DNA, 25 bp, Rattus norvegicus
gctactatctgcaaggaactctgtg

SEQ ID NO: 402911 - DNA, 25 bp, Rattus norvegicus
gctactatctgctaggaactctgtg

SEQ ID NO: 402912 - DNA, 25 bp, Rattus norvegicus
gctactatgagtactgaggccaccg

SEQ ID NO: 402913 - DNA, 25 bp, Rattus norvegicus
gctactatgagttctgaggccaccg

SEQ ID NO: 402914 - DNA, 25 bp, Rattus norvegicus
gctactatgcttcccattgtagaat

SEQ ID NO: 402915 - DNA, 25 bp, Rattus norvegicus
gctactatgcttgccattgtagaat

SEQ ID NO: 402916 - DNA, 25 bp, Rattus norvegicus
gctactatggagacagacaacaggc

SEQ ID NO: 402917 - DNA, 25 bp, Rattus norvegicus
gctactatggagtcagacaacaggc

SEQ ID NO: 402918 - DNA, 25 bp, Rattus norvegicus
gctactatgtgtccaagggcctgga

SEQ ID NO: 402919 - DNA, 25 bp, Rattus norvegicus
gctactatgtgtgcaagggcctgga

SEQ ID NO: 402920 - DNA, 25 bp, Rattus norvegicus
gctactatgttaattctgactgttc

SEQ ID NO: 402921 - DNA, 25 bp, Rattus norvegicus
gctactatgttatttctgactgttc

SEQ ID NO: 402922 - DNA, 25 bp, Rattus norvegicus
gctactatttggatctcagcagaat

SEQ ID NO: 402923 - DNA, 25 bp, Rattus norvegicus
gctactatttggttctcagcagaat

SEQ ID NO: 402924 - DNA, 25 bp, Rattus norvegicus
gctactcagaatagtacacaacctg

SEQ ID NO: 402925 - DNA, 25 bp, Rattus norvegicus
gctactcagaattgtacacaacctg

SEQ ID NO: 402926 - DNA, 25 bp, Rattus norvegicus
gctactcagagaaacacttacttga

SEQ ID NO: 402927 - DNA, 25 bp, Rattus norvegicus
gctactcagagatacacttacttga

SEQ ID NO: 402928 - DNA, 25 bp, Rattus norvegicus
gctactcagggccatgtggtgatta

SEQ ID NO: 402929 - DNA, 25 bp, Rattus norvegicus
gctactcagggcgatgtggtgatta

SEQ ID NO: 402930 - DNA, 25 bp, Rattus norvegicus
gctactccaagcacaaggaactggt

SEQ ID NO: 402931 - DNA, 25 bp, Rattus norvegicus
gctactccaagctcaaggaactggt

SEQ ID NO: 402932 - DNA, 25 bp, Rattus norvegicus
gctactcccaggattatgacaccag

SEQ ID NO: 402933 - DNA, 25 bp, Rattus norvegicus
gctactcccaggtttatgacaccag

SEQ ID NO: 402934 - DNA, 25 bp, Rattus norvegicus
gctactcctcgaaggtgttcactga

SEQ ID NO: 402935 - DNA, 25 bp, Rattus norvegicus
gctactcctcgatggtgttcactga

SEQ ID NO: 402936 - DNA, 25 bp, Rattus norvegicus
gctactccttttaccctgaagagga

SEQ ID NO: 402937 - DNA, 25 bp, Rattus norvegicus
gctactcctttttccctgaagagga

SEQ ID NO: 402938 - DNA, 25 bp, Rattus norvegicus
gctactcgcgctctgagcattgcaa

SEQ ID NO: 402939 - DNA, 25 bp, Rattus norvegicus
gctactcgcgctgtgagcattgcaa

SEQ ID NO: 402940 - DNA, 25 bp, Rattus norvegicus
gctactcgtgtgcagttatgtgtat

SEQ ID NO: 402941 - DNA, 25 bp, Rattus norvegicus
gctactcgtgtggagttatgtgtat

SEQ ID NO: 402942 - DNA, 25 bp, Rattus norvegicus
gctactctgagaattcctgacgctg

SEQ ID NO: 402943 - DNA, 25 bp, Rattus norvegicus
gctactctgagatttcctgacgctg

SEQ ID NO: 402944 - DNA, 25 bp, Rattus norvegicus
gctactctgaggatgctactcttgg

SEQ ID NO: 402945 - DNA, 25 bp, Rattus norvegicus
gctactctgaggttgctactcttgg

SEQ ID NO: 402946 - DNA, 25 bp, Rattus norvegicus
gctactctgcttaagaggtgaattc

SEQ ID NO: 402947 - DNA, 25 bp, Rattus norvegicus
gctactctgctttagaggtgaattc

SEQ ID NO: 402948 - DNA, 25 bp, Rattus norvegicus
gctactctggaaatctgtaaatact

SEQ ID NO: 402949 - DNA, 25 bp, Rattus norvegicus
gctactctggaattctgtaaatact

SEQ ID NO: 402950 - DNA, 25 bp, Rattus norvegicus
gctactctgttcatggattctacct

SEQ ID NO: 402951 - DNA, 25 bp, Rattus norvegicus
gctactctgttcttggattctacct

SEQ ID NO: 402952 - DNA, 25 bp, Rattus norvegicus
gctactcttaagatccttgggttgg

SEQ ID NO: 402953 - DNA, 25 bp, Rattus norvegicus
gctactcttaagttccttgggttgg

SEQ ID NO: 402954 - DNA, 25 bp, Rattus norvegicus
gctactcttggcatttacttgcaat

SEQ ID NO: 402955 - DNA, 25 bp, Rattus norvegicus
gctactcttggcttttacttgcaat

SEQ ID NO: 402956 - DNA, 25 bp, Rattus norvegicus
gctactgaagacattgcaattgcat

SEQ ID NO: 402957 - DNA, 25 bp, Rattus norvegicus
gctactgaagactttgcaattgcat

SEQ ID NO: 402958 - DNA, 25 bp, Rattus norvegicus
gctactgaagcactggtcactaatt

SEQ ID NO: 402959 - DNA, 25 bp, Rattus norvegicus
gctactgaagcagtggtcactaatt

SEQ ID NO: 402960 - DNA, 25 bp, Rattus norvegicus
gctactgacaagaatgatccccact

SEQ ID NO: 402961 - DNA, 25 bp, Rattus norvegicus
gctactgacaagtatgatccccact

SEQ ID NO: 402962 - DNA, 25 bp, Rattus norvegicus
gctactgaccagagttttctatgtg

SEQ ID NO: 402963 - DNA, 25 bp, Rattus norvegicus
gctactgaccagtgttttctatgtg

SEQ ID NO: 402964 - DNA, 25 bp, Rattus norvegicus
gctactgatcctaaatgcagctatc

SEQ ID NO: 402965 - DNA, 25 bp, Rattus norvegicus
gctactgatccttaatgcagctatc

SEQ ID NO: 402966 - DNA, 25 bp, Rattus norvegicus
gctactgattggatcaagctggaat

SEQ ID NO: 402967 - DNA, 25 bp, Rattus norvegicus
gctactgattggttcaagctggaat

SEQ ID NO: 402968 - DNA, 25 bp, Rattus norvegicus
gctactgcaattactgacattccca

SEQ ID NO: 402969 - DNA, 25 bp, Rattus norvegicus
gctactgcaatttctgacattccca

SEQ ID NO: 402970 - DNA, 25 bp, Rattus norvegicus
gctactgcactgatttagaacatcc

SEQ ID NO: 402971 - DNA, 25 bp, Rattus norvegicus
gctactgcactgttttagaacatcc

SEQ ID NO: 402972 - DNA, 25 bp, Rattus norvegicus
gctactgcagttagtcacgggaacc

SEQ ID NO: 402973 - DNA, 25 bp, Rattus norvegicus
gctactgcagtttgtcacgggaacc

SEQ ID NO: 402974 - DNA, 25 bp, Rattus norvegicus
gctactgccagtacttagccatctg

SEQ ID NO: 402975 - DNA, 25 bp, Rattus norvegicus
gctactgccagttcttagccatctg

SEQ ID NO: 402976 - DNA, 25 bp, Rattus norvegicus
gctactgccatcatcctgtattaga

SEQ ID NO: 402977 - DNA, 25 bp, Rattus norvegicus
gctactgccatcttcctgtattaga

SEQ ID NO: 402978 - DNA, 25 bp, Rattus norvegicus
gctactgcccggagaattggccaag

SEQ ID NO: 402979 - DNA, 25 bp, Rattus norvegicus
gctactgcccggtgaattggccaag

SEQ ID NO: 402980 - DNA, 25 bp, Rattus norvegicus
gctactgcctgactgagttgttctc

SEQ ID NO: 402981 - DNA, 25 bp, Rattus norvegicus
gctactgcctgagtgagttgttctc

SEQ ID NO: 402982 - DNA, 25 bp, Rattus norvegicus
gctactgctattactaattatatga

SEQ ID NO: 402983 - DNA, 25 bp, Rattus norvegicus
gctactgctatttctaattatatga

SEQ ID NO: 402984 - DNA, 25 bp, Rattus norvegicus
gctactgctgaaatgcctgtgtgag

SEQ ID NO: 402985 - DNA, 25 bp, Rattus norvegicus
gctactgctgaattgcctgtgtgag

SEQ ID NO: 402986 - DNA, 25 bp, Rattus norvegicus
gctactgctgcccatttgaaatgcg

SEQ ID NO: 402987 - DNA, 25 bp, Rattus norvegicus
gctactgctgccgatttgaaatgcg

SEQ ID NO: 402988 - DNA, 25 bp, Rattus norvegicus
gctactggaaggagggatgtctgca

SEQ ID NO: 402989 - DNA, 25 bp, Rattus norvegicus
gctactggaaggtgggatgtctgca

SEQ ID NO: 402990 - DNA, 25 bp, Rattus norvegicus
gctactggaccaaggacatgctgtt

SEQ ID NO: 402991 - DNA, 25 bp, Rattus norvegicus
gctactggaccatggacatgctgtt

SEQ ID NO: 402992 - DNA, 25 bp, Rattus norvegicus
gctactggccacattgttgctaaat

SEQ ID NO: 402993 - DNA, 25 bp, Rattus norvegicus
gctactggccactttgttgctaaat

SEQ ID NO: 402994 - DNA, 25 bp, Rattus norvegicus
gctactggccggaaagcgccgctgt

SEQ ID NO: 402995 - DNA, 25 bp, Rattus norvegicus
gctactggccggtaagcgccgctgt

SEQ ID NO: 402996 - DNA, 25 bp, Rattus norvegicus
gctactggctacaagcttggctgat

SEQ ID NO: 402997 - DNA, 25 bp, Rattus norvegicus
gctactggctactagcttggctgat

SEQ ID NO: 402998 - DNA, 25 bp, Rattus norvegicus
gctactggctttaaggtctgtgtta

SEQ ID NO: 402999 - DNA, 25 bp, Rattus norvegicus
gctactggcttttaggtctgtgtta

SEQ ID NO: 403000 - DNA, 25 bp, Rattus norvegicus
gctactgggcttctcagagctaaga

SEQ ID NO: 403001 - DNA, 25 bp, Rattus norvegicus
gctactgggcttgtcagagctaaga

SEQ ID NO: 403002 - DNA, 25 bp, Rattus norvegicus
gctactgggtctactactgtgcatg

SEQ ID NO: 403003 - DNA, 25 bp, Rattus norvegicus
gctactgggtcttctactgtgcatg

SEQ ID NO: 403004 - DNA, 25 bp, Rattus norvegicus
gctactggtcacattctaatcttta

SEQ ID NO: 403005 - DNA, 25 bp, Rattus norvegicus
gctactggtcactttctaatcttta

SEQ ID NO: 403006 - DNA, 25 bp, Rattus norvegicus
gctactggtcatcagcgtgttcaca

SEQ ID NO: 403007 - DNA, 25 bp, Rattus norvegicus
gctactggtcatgagcgtgttcaca

SEQ ID NO: 403008 - DNA, 25 bp, Rattus norvegicus
gctactggtgaacaaggtgcatcaa

SEQ ID NO: 403009 - DNA, 25 bp, Rattus norvegicus
gctactggtgaagaaggtgcatcaa

SEQ ID NO: 403010 - DNA, 25 bp, Rattus norvegicus
gctactgtaaatcgcaactggcatt

SEQ ID NO: 403011 - DNA, 25 bp, Rattus norvegicus
gctactgtaaatggcaactggcatt

SEQ ID NO: 403012 - DNA, 25 bp, Rattus norvegicus
gctactgtacatattggtcctgcta

SEQ ID NO: 403013 - DNA, 25 bp, Rattus norvegicus
gctactgtacattttggtcctgcta

SEQ ID NO: 403014 - DNA, 25 bp, Rattus norvegicus
gctactgtagtccttggtctgcttg

SEQ ID NO: 403015 - DNA, 25 bp, Rattus norvegicus
gctactgtagtcgttggtctgcttg

SEQ ID NO: 403016 - DNA, 25 bp, Rattus norvegicus
gctactgtagttatggtgtggcacc

SEQ ID NO: 403017 - DNA, 25 bp, Rattus norvegicus
gctactgtagttttggtgtggcacc

SEQ ID NO: 403018 - DNA, 25 bp, Rattus norvegicus
gctactgtattgaggcttgcataat

SEQ ID NO: 403019 - DNA, 25 bp, Rattus norvegicus
gctactgtattgtggcttgcataat

SEQ ID NO: 403020 - DNA, 25 bp, Rattus norvegicus
gctactgtcagaaagtccatccatc

SEQ ID NO: 403021 - DNA, 25 bp, Rattus norvegicus
gctactgtcagatagtccatccatc

SEQ ID NO: 403022 - DNA, 25 bp, Rattus norvegicus
gctactgtccatagagcttcgggaa

SEQ ID NO: 403023 - DNA, 25 bp, Rattus norvegicus
gctactgtccattgagcttcgggaa

SEQ ID NO: 403024 - DNA, 25 bp, Rattus norvegicus
gctactgtgagtatgtaatttccct

SEQ ID NO: 403025 - DNA, 25 bp, Rattus norvegicus
gctactgtgagtttgtaatttccct

SEQ ID NO: 403026 - DNA, 25 bp, Rattus norvegicus
gctactgtggctccagtgtctggaa

SEQ ID NO: 403027 - DNA, 25 bp, Rattus norvegicus
gctactgtggctgcagtgtctggaa

SEQ ID NO: 403028 - DNA, 25 bp, Rattus norvegicus
gctactgtgttacattgtgcacgat

SEQ ID NO: 403029 - DNA, 25 bp, Rattus norvegicus
gctactgtgttagattgtgcacgat

SEQ ID NO: 403030 - DNA, 25 bp, Rattus norvegicus
gctactgttacacccttctggcaca

SEQ ID NO: 403031 - DNA, 25 bp, Rattus norvegicus
gctactgttacagccttctggcaca

SEQ ID NO: 403032 - DNA, 25 bp, Rattus norvegicus
gctactgttctcatgtaccgctgta

SEQ ID NO: 403033 - DNA, 25 bp, Rattus norvegicus
gctactgttctcttgtaccgctgta

SEQ ID NO: 403034 - DNA, 25 bp, Rattus norvegicus
gctactgttgttctaacgcaatcct

SEQ ID NO: 403035 - DNA, 25 bp, Rattus norvegicus
gctactgttgttgtaacgcaatcct

SEQ ID NO: 403036 - DNA, 25 bp, Rattus norvegicus
gctacttaatgacttctgggccatc

SEQ ID NO: 403037 - DNA, 25 bp, Rattus norvegicus
gctacttaatgagttctgggccatc

SEQ ID NO: 403038 - DNA, 25 bp, Rattus norvegicus
gctacttactagaaaaccgctgatg

SEQ ID NO: 403039 - DNA, 25 bp, Rattus norvegicus
gctacttactagtaaaccgctgatg

SEQ ID NO: 403040 - DNA, 25 bp, Rattus norvegicus
gctacttagaccatctgcatcgttt

SEQ ID NO: 403041 - DNA, 25 bp, Rattus norvegicus
gctacttagaccttctgcatcgttt

SEQ ID NO: 403042 - DNA, 25 bp, Rattus norvegicus
gctacttatggtccatttcacagaa

SEQ ID NO: 403043 - DNA, 25 bp, Rattus norvegicus
gctacttatggtgcatttcacagaa

SEQ ID NO: 403044 - DNA, 25 bp, Rattus norvegicus
gctacttcacaacgagactgacatg

SEQ ID NO: 403045 - DNA, 25 bp, Rattus norvegicus
gctacttcacaaggagactgacatg

SEQ ID NO: 403046 - DNA, 25 bp, Rattus norvegicus
gctacttcaccaagggcctgtatga

SEQ ID NO: 403047 - DNA, 25 bp, Rattus norvegicus
gctacttcaccatgggcctgtatga

SEQ ID NO: 403048 - DNA, 25 bp, Rattus norvegicus
gctacttcactgaatttctcactta

SEQ ID NO: 403049 - DNA, 25 bp, Rattus norvegicus
gctacttcactgtatttctcactta

SEQ ID NO: 403050 - DNA, 25 bp, Rattus norvegicus
gctacttcagctactttgggagcca

SEQ ID NO: 403051 - DNA, 25 bp, Rattus norvegicus
gctacttcagcttctttgggagcca

SEQ ID NO: 403052 - DNA, 25 bp, Rattus norvegicus
gctacttcatccacgtgctcaagaa

SEQ ID NO: 403053 - DNA, 25 bp, Rattus norvegicus
gctacttcatcctcgtgctcaagaa

SEQ ID NO: 403054 - DNA, 25 bp, Rattus norvegicus
gctacttcattaatgagccaaaaga

SEQ ID NO: 403055 - DNA, 25 bp, Rattus norvegicus
gctacttcattattgagccaaaaga

SEQ ID NO: 403056 - DNA, 25 bp, Rattus norvegicus
gctacttcctgcataaagtgtctgg

SEQ ID NO: 403057 - DNA, 25 bp, Rattus norvegicus
gctacttcctgcttaaagtgtctgg

SEQ ID NO: 403058 - DNA, 25 bp, Rattus norvegicus
gctacttctaatatctctgcaactt

SEQ ID NO: 403059 - DNA, 25 bp, Rattus norvegicus
gctacttctaatttctctgcaactt

SEQ ID NO: 403060 - DNA, 25 bp, Rattus norvegicus
gctacttctgatagctttagacccg

SEQ ID NO: 403061 - DNA, 25 bp, Rattus norvegicus
gctacttctgattgctttagacccg

SEQ ID NO: 403062 - DNA, 25 bp, Rattus norvegicus
gctacttctgttattgcccaacttc

SEQ ID NO: 403063 - DNA, 25 bp, Rattus norvegicus
gctacttctgtttttgcccaacttc

SEQ ID NO: 403064 - DNA, 25 bp, Rattus norvegicus
gctacttgacagagggtaacaacat

SEQ ID NO: 403065 - DNA, 25 bp, Rattus norvegicus
gctacttgacagtgggtaacaacat

SEQ ID NO: 403066 - DNA, 25 bp, Rattus norvegicus
gctacttgctaacgtgttctgtaca

SEQ ID NO: 403067 - DNA, 25 bp, Rattus norvegicus
gctacttgctaaggtgttctgtaca

SEQ ID NO: 403068 - DNA, 25 bp, Rattus norvegicus
gctacttgctggagagatcctctga

SEQ ID NO: 403069 - DNA, 25 bp, Rattus norvegicus
gctacttgctggtgagatcctctga

SEQ ID NO: 403070 - DNA, 25 bp, Rattus norvegicus
gctactttactccagaattttgtta

SEQ ID NO: 403071 - DNA, 25 bp, Rattus norvegicus
gctactttactcgagaattttgtta

SEQ ID NO: 403072 - DNA, 25 bp, Rattus norvegicus
gctactttatggctttcttgtccag

SEQ ID NO: 403073 - DNA, 25 bp, Rattus norvegicus
gctactttatgggtttcttgtccag

SEQ ID NO: 403074 - DNA, 25 bp, Rattus norvegicus
gctactttcctacttacatatttaa

SEQ ID NO: 403075 - DNA, 25 bp, Rattus norvegicus
gctactttcctagttacatatttaa

SEQ ID NO: 403076 - DNA, 25 bp, Rattus norvegicus
gctactttctaaagttgtcattcct

SEQ ID NO: 403077 - DNA, 25 bp, Rattus norvegicus
gctactttctaatgttgtcattcct

SEQ ID NO: 403078 - DNA, 25 bp, Rattus norvegicus
gctactttctatctttaaggtacaa

SEQ ID NO: 403079 - DNA, 25 bp, Rattus norvegicus
gctactttctatgtttaaggtacaa

SEQ ID NO: 403080 - DNA, 25 bp, Rattus norvegicus
gctactttgaccctgatggttcatt

SEQ ID NO: 403081 - DNA, 25 bp, Rattus norvegicus
gctactttgaccgtgatggttcatt

SEQ ID NO: 403082 - DNA, 25 bp, Rattus norvegicus
gctactttgcataatattaaactat

SEQ ID NO: 403083 - DNA, 25 bp, Rattus norvegicus
gctactttgcattatattaaactat

SEQ ID NO: 403084 - DNA, 25 bp, Rattus norvegicus
gctactttgtggcttctttctctac

SEQ ID NO: 403085 - DNA, 25 bp, Rattus norvegicus
gctactttgtgggttctttctctac

SEQ ID NO: 403086 - DNA, 25 bp, Rattus norvegicus
gctactttgttgagtggatccccaa

SEQ ID NO: 403087 - DNA, 25 bp, Rattus norvegicus
gctactttgttgtgtggatccccaa

SEQ ID NO: 403088 - DNA, 25 bp, Rattus norvegicus
gctacttttacaagagcttggtccc

SEQ ID NO: 403089 - DNA, 25 bp, Rattus norvegicus
gctacttttacatgagcttggtccc

SEQ ID NO: 403090 - DNA, 25 bp, Rattus norvegicus
gctacttttgcactgttttatcaac

SEQ ID NO: 403091 - DNA, 25 bp, Rattus norvegicus
gctacttttgcagtgttttatcaac

SEQ ID NO: 403092 - DNA, 25 bp, Rattus norvegicus
gctagaaaccttcatgtgctgaccc

SEQ ID NO: 403093 - DNA, 25 bp, Rattus norvegicus
gctagaaaccttgatgtgctgaccc

SEQ ID NO: 403094 - DNA, 25 bp, Rattus norvegicus
gctagaacaataaacccaggagtgg

SEQ ID NO: 403095 - DNA, 25 bp, Rattus norvegicus
gctagaacaatatacccaggagtgg

SEQ ID NO: 403096 - DNA, 25 bp, Rattus norvegicus
gctagaaccaggctgggcctcaaga

SEQ ID NO: 403097 - DNA, 25 bp, Rattus norvegicus
gctagaaccagggtgggcctcaaga

SEQ ID NO: 403098 - DNA, 25 bp, Rattus norvegicus
gctagaacctacacggtggccgttt

SEQ ID NO: 403099 - DNA, 25 bp, Rattus norvegicus
gctagaacctactcggtggccgttt

SEQ ID NO: 403100 - DNA, 25 bp, Rattus norvegicus
gctagaactgtacttattgggtcaa

SEQ ID NO: 403101 - DNA, 25 bp, Rattus norvegicus
gctagaactgtagttattgggtcaa

SEQ ID NO: 403102 - DNA, 25 bp, Rattus norvegicus
gctagaactttgaacctctcagaga

SEQ ID NO: 403103 - DNA, 25 bp, Rattus norvegicus
gctagaactttgtacctctcagaga

SEQ ID NO: 403104 - DNA, 25 bp, Rattus norvegicus
gctagaatcctcatcttaaacccca

SEQ ID NO: 403105 - DNA, 25 bp, Rattus norvegicus
gctagaatcctcttcttaaacccca

SEQ ID NO: 403106 - DNA, 25 bp, Rattus norvegicus
gctagaatggatcaaactctctgaa

SEQ ID NO: 403107 - DNA, 25 bp, Rattus norvegicus
gctagaatggatgaaactctctgaa

SEQ ID NO: 403108 - DNA, 25 bp, Rattus norvegicus
gctagaattcttaaactctttacct

SEQ ID NO: 403109 - DNA, 25 bp, Rattus norvegicus
gctagaattctttaactctttacct

SEQ ID NO: 403110 - DNA, 25 bp, Rattus norvegicus
gctagacaaaggatgacagacactt

SEQ ID NO: 403111 - DNA, 25 bp, Rattus norvegicus
gctagacaaaggttgacagacactt

SEQ ID NO: 403112 - DNA, 25 bp, Rattus norvegicus
gctagacaatgtctggcatcgcttt

SEQ ID NO: 403113 - DNA, 25 bp, Rattus norvegicus
gctagacaatgtgtggcatcgcttt

SEQ ID NO: 403114 - DNA, 25 bp, Rattus norvegicus
gctagacatagcacacccgaagtgg

SEQ ID NO: 403115 - DNA, 25 bp, Rattus norvegicus
gctagacatagctcacccgaagtgg

SEQ ID NO: 403116 - DNA, 25 bp, Rattus norvegicus
gctagacccaaaccaagacttgagt

SEQ ID NO: 403117 - DNA, 25 bp, Rattus norvegicus
gctagacccaaagcaagacttgagt

SEQ ID NO: 403118 - DNA, 25 bp, Rattus norvegicus
gctagaccccgcagtaatcattaaa

SEQ ID NO: 403119 - DNA, 25 bp, Rattus norvegicus
gctagaccccgctgtaatcattaaa

SEQ ID NO: 403120 - DNA, 25 bp, Rattus norvegicus
gctagacccgccatgggcattatga

SEQ ID NO: 403121 - DNA, 25 bp, Rattus norvegicus
gctagacccgccttgggcattatga

SEQ ID NO: 403122 - DNA, 25 bp, Rattus norvegicus
gctagaccgtgcagagaatgttaaa

SEQ ID NO: 403123 - DNA, 25 bp, Rattus norvegicus
gctagaccgtgctgagaatgttaaa

SEQ ID NO: 403124 - DNA, 25 bp, Rattus norvegicus
gctagacctgagagcctgagacaga

SEQ ID NO: 403125 - DNA, 25 bp, Rattus norvegicus
gctagacctgagtgcctgagacaga

SEQ ID NO: 403126 - DNA, 25 bp, Rattus norvegicus
gctagacctgtaaattctcttgtga

SEQ ID NO: 403127 - DNA, 25 bp, Rattus norvegicus
gctagacctgtatattctcttgtga

SEQ ID NO: 403128 - DNA, 25 bp, Rattus norvegicus
gctagacctgtcatggcaaaccgag

SEQ ID NO: 403129 - DNA, 25 bp, Rattus norvegicus
gctagacctgtcttggcaaaccgag

SEQ ID NO: 403130 - DNA, 25 bp, Rattus norvegicus
gctagacgccacaacagctcagagt

SEQ ID NO: 403131 - DNA, 25 bp, Rattus norvegicus
gctagacgccactacagctcagagt

SEQ ID NO: 403132 - DNA, 25 bp, Rattus norvegicus
gctagacggattactcttgtgtaca

SEQ ID NO: 403133 - DNA, 25 bp, Rattus norvegicus
gctagacggatttctcttgtgtaca

SEQ ID NO: 403134 - DNA, 25 bp, Rattus norvegicus
gctagacgtcaactgcattgtgtgc

SEQ ID NO: 403135 - DNA, 25 bp, Rattus norvegicus
gctagacgtcaagtgcattgtgtgc

SEQ ID NO: 403136 - DNA, 25 bp, Rattus norvegicus
gctagactactgatgatttcctggc

SEQ ID NO: 403137 - DNA, 25 bp, Rattus norvegicus
gctagactactgttgatttcctggc

SEQ ID NO: 403138 - DNA, 25 bp, Rattus norvegicus
gctagactgaaaacaactcccaaag

SEQ ID NO: 403139 - DNA, 25 bp, Rattus norvegicus
gctagactgaaatcaactcccaaag

SEQ ID NO: 403140 - DNA, 25 bp, Rattus norvegicus
gctagactggaccaagtacagggat

SEQ ID NO: 403141 - DNA, 25 bp, Rattus norvegicus
gctagactggacgaagtacagggat

SEQ ID NO: 403142 - DNA, 25 bp, Rattus norvegicus
gctagactggctacggtacttggta

SEQ ID NO: 403143 - DNA, 25 bp, Rattus norvegicus
gctagactggcttcggtacttggta

SEQ ID NO: 403144 - DNA, 25 bp, Rattus norvegicus
gctagactggtaaacccatacaata

SEQ ID NO: 403145 - DNA, 25 bp, Rattus norvegicus
gctagactggtatacccatacaata

SEQ ID NO: 403146 - DNA, 25 bp, Rattus norvegicus
gctagacttccgaccactgaagaaa

SEQ ID NO: 403147 - DNA, 25 bp, Rattus norvegicus
gctagacttccgtccactgaagaaa

SEQ ID NO: 403148 - DNA, 25 bp, Rattus norvegicus
gctagagaaacaccttctccaacag

SEQ ID NO: 403149 - DNA, 25 bp, Rattus norvegicus
gctagagaaacagcttctccaacag

SEQ ID NO: 403150 - DNA, 25 bp, Rattus norvegicus
gctagagagctcctagtcttaacaa

SEQ ID NO: 403151 - DNA, 25 bp, Rattus norvegicus
gctagagagctcgtagtcttaacaa

SEQ ID NO: 403152 - DNA, 25 bp, Rattus norvegicus
gctagagatcctccagcttctgaaa

SEQ ID NO: 403153 - DNA, 25 bp, Rattus norvegicus
gctagagatcctgcagcttctgaaa

SEQ ID NO: 403154 - DNA, 25 bp, Rattus norvegicus
gctagagatgaccatggtctgccat

SEQ ID NO: 403155 - DNA, 25 bp, Rattus norvegicus
gctagagatgacgatggtctgccat

SEQ ID NO: 403156 - DNA, 25 bp, Rattus norvegicus
gctagagatggtcgacacttggcct

SEQ ID NO: 403157 - DNA, 25 bp, Rattus norvegicus
gctagagatggtggacacttggcct

SEQ ID NO: 403158 - DNA, 25 bp, Rattus norvegicus
gctagagcagagagcgatggcctca

SEQ ID NO: 403159 - DNA, 25 bp, Rattus norvegicus
gctagagcagagtgcgatggcctca

SEQ ID NO: 403160 - DNA, 25 bp, Rattus norvegicus
gctagagccctgactgagcctttag

SEQ ID NO: 403161 - DNA, 25 bp, Rattus norvegicus
gctagagccctgtctgagcctttag

SEQ ID NO: 403162 - DNA, 25 bp, Rattus norvegicus
gctagagccgctacgtagaacacag

SEQ ID NO: 403163 - DNA, 25 bp, Rattus norvegicus
gctagagccgcttcgtagaacacag

SEQ ID NO: 403164 - DNA, 25 bp, Rattus norvegicus
gctagagcctcacaagcctatatat

SEQ ID NO: 403165 - DNA, 25 bp, Rattus norvegicus
gctagagcctcagaagcctatatat

SEQ ID NO: 403166 - DNA, 25 bp, Rattus norvegicus
gctagagcgattacagctgatagaa

SEQ ID NO: 403167 - DNA, 25 bp, Rattus norvegicus
gctagagcgatttcagctgatagaa

SEQ ID NO: 403168 - DNA, 25 bp, Rattus norvegicus
gctagagcttaacagatgtcccggc

SEQ ID NO: 403169 - DNA, 25 bp, Rattus norvegicus
gctagagcttaagagatgtcccggc

SEQ ID NO: 403170 - DNA, 25 bp, Rattus norvegicus
gctagaggatctacagctctcagaa

SEQ ID NO: 403171 - DNA, 25 bp, Rattus norvegicus
gctagaggatcttcagctctcagaa

SEQ ID NO: 403172 - DNA, 25 bp, Rattus norvegicus
gctagaggcagcactcagcttcttt

SEQ ID NO: 403173 - DNA, 25 bp, Rattus norvegicus
gctagaggcagctctcagcttcttt

SEQ ID NO: 403174 - DNA, 25 bp, Rattus norvegicus
gctagaggctcccaaagtcgctgtc

SEQ ID NO: 403175 - DNA, 25 bp, Rattus norvegicus
gctagaggctccgaaagtcgctgtc

SEQ ID NO: 403176 - DNA, 25 bp, Rattus norvegicus
gctagaggctgcagcacaggctgca

SEQ ID NO: 403177 - DNA, 25 bp, Rattus norvegicus
gctagaggctgctgcacaggctgca

SEQ ID NO: 403178 - DNA, 25 bp, Rattus norvegicus
gctagaggtctcacatcgcttggga

SEQ ID NO: 403179 - DNA, 25 bp, Rattus norvegicus
gctagaggtctctcatcgcttggga

SEQ ID NO: 403180 - DNA, 25 bp, Rattus norvegicus
gctagagtgaccattgtatgtagtt

SEQ ID NO: 403181 - DNA, 25 bp, Rattus norvegicus
gctagagtgacctttgtatgtagtt

SEQ ID NO: 403182 - DNA, 25 bp, Rattus norvegicus
gctagagtgttgacccataatcctt

SEQ ID NO: 403183 - DNA, 25 bp, Rattus norvegicus
gctagagtgttgtcccataatcctt

SEQ ID NO: 403184 - DNA, 25 bp, Rattus norvegicus
gctagagttcttactgttccaggac

SEQ ID NO: 403185 - DNA, 25 bp, Rattus norvegicus
gctagagttctttctgttccaggac

SEQ ID NO: 403186 - DNA, 25 bp, Rattus norvegicus
gctagataataaagtcctcgccttc

SEQ ID NO: 403187 - DNA, 25 bp, Rattus norvegicus
gctagataataatgtcctcgccttc

SEQ ID NO: 403188 - DNA, 25 bp, Rattus norvegicus
gctagatagactctttcttggacaa

SEQ ID NO: 403189 - DNA, 25 bp, Rattus norvegicus
gctagatagactgtttcttggacaa

SEQ ID NO: 403190 - DNA, 25 bp, Rattus norvegicus
gctagatctgctagagactgtaaaa

SEQ ID NO: 403191 - DNA, 25 bp, Rattus norvegicus
gctagatctgcttgagactgtaaaa

SEQ ID NO: 403192 - DNA, 25 bp, Rattus norvegicus
gctagatgacttctgccgaggcaaa

SEQ ID NO: 403193 - DNA, 25 bp, Rattus norvegicus
gctagatgacttgtgccgaggcaaa

SEQ ID NO: 403194 - DNA, 25 bp, Rattus norvegicus
gctagatgtattcgctgtccctcac

SEQ ID NO: 403195 - DNA, 25 bp, Rattus norvegicus
gctagatgtattggctgtccctcac

SEQ ID NO: 403196 - DNA, 25 bp, Rattus norvegicus
gctagattcttcacagacttcactt

SEQ ID NO: 403197 - DNA, 25 bp, Rattus norvegicus
gctagattcttctcagacttcactt

SEQ ID NO: 403198 - DNA, 25 bp, Rattus norvegicus
gctagatttaacaatcccactgtgt

SEQ ID NO: 403199 - DNA, 25 bp, Rattus norvegicus
gctagatttaactatcccactgtgt

SEQ ID NO: 403200 - DNA, 25 bp, Rattus norvegicus
gctagattttctaagtcgtttcgga

SEQ ID NO: 403201 - DNA, 25 bp, Rattus norvegicus
gctagattttcttagtcgtttcgga

SEQ ID NO: 403202 - DNA, 25 bp, Rattus norvegicus
gctagcaacaacagcaccattgatt

SEQ ID NO: 403203 - DNA, 25 bp, Rattus norvegicus
gctagcaacaactgcaccattgatt

SEQ ID NO: 403204 - DNA, 25 bp, Rattus norvegicus
gctagcaaccccattcgaaacatga

SEQ ID NO: 403205 - DNA, 25 bp, Rattus norvegicus
gctagcaacccctttcgaaacatga

SEQ ID NO: 403206 - DNA, 25 bp, Rattus norvegicus
gctagcaagacaaggagctctggat

SEQ ID NO: 403207 - DNA, 25 bp, Rattus norvegicus
gctagcaagacatggagctctggat

SEQ ID NO: 403208 - DNA, 25 bp, Rattus norvegicus
gctagcaaggctctcaagttaccat

SEQ ID NO: 403209 - DNA, 25 bp, Rattus norvegicus
gctagcaaggctgtcaagttaccat

SEQ ID NO: 403210 - DNA, 25 bp, Rattus norvegicus
gctagcaagtacatacctgtttgtt

SEQ ID NO: 403211 - DNA, 25 bp, Rattus norvegicus
gctagcaagtacttacctgtttgtt

SEQ ID NO: 403212 - DNA, 25 bp, Rattus norvegicus
gctagcactcaaaagtcttgtgttc

SEQ ID NO: 403213 - DNA, 25 bp, Rattus norvegicus
gctagcactcaatagtcttgtgttc

SEQ ID NO: 403214 - DNA, 25 bp, Rattus norvegicus
gctagcagaatgactgtgtgaccct

SEQ ID NO: 403215 - DNA, 25 bp, Rattus norvegicus
gctagcagaatgtctgtgtgaccct

SEQ ID NO: 403216 - DNA, 25 bp, Rattus norvegicus
gctagcagcttaacagcatttctga

SEQ ID NO: 403217 - DNA, 25 bp, Rattus norvegicus
gctagcagcttatcagcatttctga

SEQ ID NO: 403218 - DNA, 25 bp, Rattus norvegicus
gctagcaggattccctggtgcgtaa

SEQ ID NO: 403219 - DNA, 25 bp, Rattus norvegicus
gctagcaggattgcctggtgcgtaa

SEQ ID NO: 403220 - DNA, 25 bp, Rattus norvegicus
gctagcaggttcacttgtgtacatg

SEQ ID NO: 403221 - DNA, 25 bp, Rattus norvegicus
gctagcaggttctcttgtgtacatg

SEQ ID NO: 403222 - DNA, 25 bp, Rattus norvegicus
gctagcatctttatcgatcgaccaa

SEQ ID NO: 403223 - DNA, 25 bp, Rattus norvegicus
gctagcatctttttcgatcgaccaa

SEQ ID NO: 403224 - DNA, 25 bp, Rattus norvegicus
gctagcatggtacagttatctcccc

SEQ ID NO: 403225 - DNA, 25 bp, Rattus norvegicus
gctagcatggtagagttatctcccc

SEQ ID NO: 403226 - DNA, 25 bp, Rattus norvegicus
gctagcattcaaagttctgacctct

SEQ ID NO: 403227 - DNA, 25 bp, Rattus norvegicus
gctagcattcaatgttctgacctct

SEQ ID NO: 403228 - DNA, 25 bp, Rattus norvegicus
gctagcatttacaattttgagatca

SEQ ID NO: 403229 - DNA, 25 bp, Rattus norvegicus
gctagcatttactattttgagatca

SEQ ID NO: 403230 - DNA, 25 bp, Rattus norvegicus
gctagccaagctaccagtaagtgtg

SEQ ID NO: 403231 - DNA, 25 bp, Rattus norvegicus
gctagccaagcttccagtaagtgtg

SEQ ID NO: 403232 - DNA, 25 bp, Rattus norvegicus
gctagccacattcttttgtttgttt

SEQ ID NO: 403233 - DNA, 25 bp, Rattus norvegicus
gctagccacattgttttgtttgttt

SEQ ID NO: 403234 - DNA, 25 bp, Rattus norvegicus
gctagccaggctattaaaccggtct

SEQ ID NO: 403235 - DNA, 25 bp, Rattus norvegicus
gctagccaggcttttaaaccggtct

SEQ ID NO: 403236 - DNA, 25 bp, Rattus norvegicus
gctagccagggcagtgcagtgcaaa

SEQ ID NO: 403237 - DNA, 25 bp, Rattus norvegicus
gctagccagggctgtgcagtgcaaa

SEQ ID NO: 403238 - DNA, 25 bp, Rattus norvegicus
gctagccaggtaagctgtgacagct

SEQ ID NO: 403239 - DNA, 25 bp, Rattus norvegicus
gctagccaggtatgctgtgacagct

SEQ ID NO: 403240 - DNA, 25 bp, Rattus norvegicus
gctagccattgcctgcacagaagat

SEQ ID NO: 403241 - DNA, 25 bp, Rattus norvegicus
gctagccattgcgtgcacagaagat

SEQ ID NO: 403242 - DNA, 25 bp, Rattus norvegicus
gctagcccaaaacttcttacagtct

SEQ ID NO: 403243 - DNA, 25 bp, Rattus norvegicus
gctagcccaaaagttcttacagtct

SEQ ID NO: 403244 - DNA, 25 bp, Rattus norvegicus
gctagcccagtcaggagatcagtgt

SEQ ID NO: 403245 - DNA, 25 bp, Rattus norvegicus
gctagcccagtctggagatcagtgt

SEQ ID NO: 403246 - DNA, 25 bp, Rattus norvegicus
gctagccccacgactaagataacta

SEQ ID NO: 403247 - DNA, 25 bp, Rattus norvegicus
gctagccccacgtctaagataacta

SEQ ID NO: 403248 - DNA, 25 bp, Rattus norvegicus
gctagcctaaggaagttcctttcag

SEQ ID NO: 403249 - DNA, 25 bp, Rattus norvegicus
gctagcctaaggtagttcctttcag

SEQ ID NO: 403250 - DNA, 25 bp, Rattus norvegicus
gctagcctagctcctaattgtcaga

SEQ ID NO: 403251 - DNA, 25 bp, Rattus norvegicus
gctagcctagctgctaattgtcaga

SEQ ID NO: 403252 - DNA, 25 bp, Rattus norvegicus
gctagcctaggcaattcaccaagac

SEQ ID NO: 403253 - DNA, 25 bp, Rattus norvegicus
gctagcctaggctattcaccaagac

SEQ ID NO: 403254 - DNA, 25 bp, Rattus norvegicus
gctagcctatgcctgtgtgatattg

SEQ ID NO: 403255 - DNA, 25 bp, Rattus norvegicus
gctagcctatgcgtgtgtgatattg

SEQ ID NO: 403256 - DNA, 25 bp, Rattus norvegicus
gctagcctcaaactcgttggtataa

SEQ ID NO: 403257 - DNA, 25 bp, Rattus norvegicus
gctagcctcaaagtcgttggtataa

SEQ ID NO: 403258 - DNA, 25 bp, Rattus norvegicus
gctagcctcagacttagtggatcct

SEQ ID NO: 403259 - DNA, 25 bp, Rattus norvegicus
gctagcctcagagttagtggatcct

SEQ ID NO: 403260 - DNA, 25 bp, Rattus norvegicus
gctagcctcggtcgcaggcggcggt

SEQ ID NO: 403261 - DNA, 25 bp, Rattus norvegicus
gctagcctcggtggcaggcggcggt

SEQ ID NO: 403262 - DNA, 25 bp, Rattus norvegicus
gctagcctctaaattctacttgtag

SEQ ID NO: 403263 - DNA, 25 bp, Rattus norvegicus
gctagcctctaatttctacttgtag

SEQ ID NO: 403264 - DNA, 25 bp, Rattus norvegicus
gctagcctgactatccttctggttt

SEQ ID NO: 403265 - DNA, 25 bp, Rattus norvegicus
gctagcctgactttccttctggttt

SEQ ID NO: 403266 - DNA, 25 bp, Rattus norvegicus
gctagcctgattccttaatcttttt

SEQ ID NO: 403267 - DNA, 25 bp, Rattus norvegicus
gctagcctgattgcttaatcttttt

SEQ ID NO: 403268 - DNA, 25 bp, Rattus norvegicus
gctagcctgctcaactgatacaaat

SEQ ID NO: 403269 - DNA, 25 bp, Rattus norvegicus
gctagcctgctctactgatacaaat

SEQ ID NO: 403270 - DNA, 25 bp, Rattus norvegicus
gctagcctggctacttgaaacactg

SEQ ID NO: 403271 - DNA, 25 bp, Rattus norvegicus
gctagcctggcttcttgaaacactg

SEQ ID NO: 403272 - DNA, 25 bp, Rattus norvegicus
gctagcctgttactggcatggcaca

SEQ ID NO: 403273 - DNA, 25 bp, Rattus norvegicus
gctagcctgttagtggcatggcaca

SEQ ID NO: 403274 - DNA, 25 bp, Rattus norvegicus
gctagccttgtgagaaatgcctttg

SEQ ID NO: 403275 - DNA, 25 bp, Rattus norvegicus
gctagccttgtgtgaaatgcctttg

SEQ ID NO: 403276 - DNA, 25 bp, Rattus norvegicus
gctagccttttaacaggtcctctgg

SEQ ID NO: 403277 - DNA, 25 bp, Rattus norvegicus
gctagccttttatcaggtcctctgg

SEQ ID NO: 403278 - DNA, 25 bp, Rattus norvegicus
gctagccttttcacacttatatcag

SEQ ID NO: 403279 - DNA, 25 bp, Rattus norvegicus
gctagccttttctcacttatatcag

SEQ ID NO: 403280 - DNA, 25 bp, Rattus norvegicus
gctagcgagggtatgtggttttgat

SEQ ID NO: 403281 - DNA, 25 bp, Rattus norvegicus
gctagcgagggtttgtggttttgat

SEQ ID NO: 403282 - DNA, 25 bp, Rattus norvegicus
gctagcgtcttgatagttgaacttt

SEQ ID NO: 403283 - DNA, 25 bp, Rattus norvegicus
gctagcgtcttgttagttgaacttt

SEQ ID NO: 403284 - DNA, 25 bp, Rattus norvegicus
gctagctaaggcattatgcgtggta

SEQ ID NO: 403285 - DNA, 25 bp, Rattus norvegicus
gctagctaaggctttatgcgtggta

SEQ ID NO: 403286 - DNA, 25 bp, Rattus norvegicus
gctagctaggctagtgtggaaccag

SEQ ID NO: 403287 - DNA, 25 bp, Rattus norvegicus
gctagctaggcttgtgtggaaccag

SEQ ID NO: 403288 - DNA, 25 bp, Rattus norvegicus
gctagctagtcccatgtctttgaac

SEQ ID NO: 403289 - DNA, 25 bp, Rattus norvegicus
gctagctagtccgatgtctttgaac

SEQ ID NO: 403290 - DNA, 25 bp, Rattus norvegicus
gctagctagttcacacatttacctt

SEQ ID NO: 403291 - DNA, 25 bp, Rattus norvegicus
gctagctagttctcacatttacctt

SEQ ID NO: 403292 - DNA, 25 bp, Rattus norvegicus
gctagctattgcacttacccagaaa

SEQ ID NO: 403293 - DNA, 25 bp, Rattus norvegicus
gctagctattgctcttacccagaaa

SEQ ID NO: 403294 - DNA, 25 bp, Rattus norvegicus
gctagctcgcctaacgatgatgtga

SEQ ID NO: 403295 - DNA, 25 bp, Rattus norvegicus
gctagctcgccttacgatgatgtga

SEQ ID NO: 403296 - DNA, 25 bp, Rattus norvegicus
gctagctcttagcagaacttgaaca

SEQ ID NO: 403297 - DNA, 25 bp, Rattus norvegicus
gctagctcttaggagaacttgaaca

SEQ ID NO: 403298 - DNA, 25 bp, Rattus norvegicus
gctagctgacctaagtgaaagcccc

SEQ ID NO: 403299 - DNA, 25 bp, Rattus norvegicus
gctagctgaccttagtgaaagcccc

SEQ ID NO: 403300 - DNA, 25 bp, Rattus norvegicus
gctagctgccaaatcaaagtcttta

SEQ ID NO: 403301 - DNA, 25 bp, Rattus norvegicus
gctagctgccaattcaaagtcttta

SEQ ID NO: 403302 - DNA, 25 bp, Rattus norvegicus
gctagctgccagacaaagggttcga

SEQ ID NO: 403303 - DNA, 25 bp, Rattus norvegicus
gctagctgccagtcaaagggttcga

SEQ ID NO: 403304 - DNA, 25 bp, Rattus norvegicus
gctagctgtctcactcttttttggg

SEQ ID NO: 403305 - DNA, 25 bp, Rattus norvegicus
gctagctgtctctctcttttttggg

SEQ ID NO: 403306 - DNA, 25 bp, Rattus norvegicus
gctagctgttttccgggtctggaaa

SEQ ID NO: 403307 - DNA, 25 bp, Rattus norvegicus
gctagctgttttgcgggtctggaaa

SEQ ID NO: 403308 - DNA, 25 bp, Rattus norvegicus
gctagcttcacccaggctctccgag

SEQ ID NO: 403309 - DNA, 25 bp, Rattus norvegicus
gctagcttcaccgaggctctccgag

SEQ ID NO: 403310 - DNA, 25 bp, Rattus norvegicus
gctagcttctctatcactgttataa

SEQ ID NO: 403311 - DNA, 25 bp, Rattus norvegicus
gctagcttctctttcactgttataa

SEQ ID NO: 403312 - DNA, 25 bp, Rattus norvegicus
gctagcttcttccaacagttgtctg

SEQ ID NO: 403313 - DNA, 25 bp, Rattus norvegicus
gctagcttcttcgaacagttgtctg

SEQ ID NO: 403314 - DNA, 25 bp, Rattus norvegicus
gctagcttgatgcattcaacagcaa

SEQ ID NO: 403315 - DNA, 25 bp, Rattus norvegicus
gctagcttgatggattcaacagcaa

SEQ ID NO: 403316 - DNA, 25 bp, Rattus norvegicus
gctagcttgctgaccatattgaatg

SEQ ID NO: 403317 - DNA, 25 bp, Rattus norvegicus
gctagcttgctgtccatattgaatg

SEQ ID NO: 403318 - DNA, 25 bp, Rattus norvegicus
gctagcttggttatcacatgaggtt

SEQ ID NO: 403319 - DNA, 25 bp, Rattus norvegicus
gctagcttggttttcacatgaggtt

SEQ ID NO: 403320 - DNA, 25 bp, Rattus norvegicus
gctagcttgtatctgagtgtcccgt

SEQ ID NO: 403321 - DNA, 25 bp, Rattus norvegicus
gctagcttgtatgtgagtgtcccgt

SEQ ID NO: 403322 - DNA, 25 bp, Rattus norvegicus
gctagcttgttaacttactcttgat

SEQ ID NO: 403323 - DNA, 25 bp, Rattus norvegicus
gctagcttgttatcttactcttgat

SEQ ID NO: 403324 - DNA, 25 bp, Rattus norvegicus
gctagctttcagagccttgagggaa

SEQ ID NO: 403325 - DNA, 25 bp, Rattus norvegicus
gctagctttcagtgccttgagggaa

SEQ ID NO: 403326 - DNA, 25 bp, Rattus norvegicus
gctagctttgcactgcttcagatgt

SEQ ID NO: 403327 - DNA, 25 bp, Rattus norvegicus
gctagctttgcagtgcttcagatgt

SEQ ID NO: 403328 - DNA, 25 bp, Rattus norvegicus
gctagctttgttacagggcactaaa

SEQ ID NO: 403329 - DNA, 25 bp, Rattus norvegicus
gctagctttgtttcagggcactaaa

SEQ ID NO: 403330 - DNA, 25 bp, Rattus norvegicus
gctaggaaattcctgacacccgagg

SEQ ID NO: 403331 - DNA, 25 bp, Rattus norvegicus
gctaggaaattcgtgacacccgagg

SEQ ID NO: 403332 - DNA, 25 bp, Rattus norvegicus
gctaggaacagcagaaaccagagct

SEQ ID NO: 403333 - DNA, 25 bp, Rattus norvegicus
gctaggaacagctgaaaccagagct

SEQ ID NO: 403334 - DNA, 25 bp, Rattus norvegicus
gctaggaaccttcttgttctcgata

SEQ ID NO: 403335 - DNA, 25 bp, Rattus norvegicus
gctaggaaccttgttgttctcgata

SEQ ID NO: 403336 - DNA, 25 bp, Rattus norvegicus
gctaggaagttccagtttctgccgc

SEQ ID NO: 403337 - DNA, 25 bp, Rattus norvegicus
gctaggaagttcgagtttctgccgc

SEQ ID NO: 403338 - DNA, 25 bp, Rattus norvegicus
gctaggagcactatctttccattta

SEQ ID NO: 403339 - DNA, 25 bp, Rattus norvegicus
gctaggagcactttctttccattta

SEQ ID NO: 403340 - DNA, 25 bp, Rattus norvegicus
gctaggagttaaatccactgtgttc

SEQ ID NO: 403341 - DNA, 25 bp, Rattus norvegicus
gctaggagttaattccactgtgttc

SEQ ID NO: 403342 - DNA, 25 bp, Rattus norvegicus
gctaggatagcacgccgggtttacc

SEQ ID NO: 403343 - DNA, 25 bp, Rattus norvegicus
gctaggatagcaggccgggtttacc

SEQ ID NO: 403344 - DNA, 25 bp, Rattus norvegicus
gctaggatataaccccgagcgacaa

SEQ ID NO: 403345 - DNA, 25 bp, Rattus norvegicus
gctaggatataagcccgagcgacaa

SEQ ID NO: 403346 - DNA, 25 bp, Rattus norvegicus
gctaggatccgacctaccacgaaaa

SEQ ID NO: 403347 - DNA, 25 bp, Rattus norvegicus
gctaggatccgagctaccacgaaaa

SEQ ID NO: 403348 - DNA, 25 bp, Rattus norvegicus
gctaggcaacttagtttcccttagt

SEQ ID NO: 403349 - DNA, 25 bp, Rattus norvegicus
gctaggcaactttgtttcccttagt

SEQ ID NO: 403350 - DNA, 25 bp, Rattus norvegicus
gctaggcacaagcattgtctattct

SEQ ID NO: 403351 - DNA, 25 bp, Rattus norvegicus
gctaggcacaagcttttctgttttt

SEQ ID NO: 403352 - DNA, 25 bp, Rattus norvegicus
gctaggcacaaggattgtctattct

SEQ ID NO: 403353 - DNA, 25 bp, Rattus norvegicus
gctaggcacaaggttttctgttttt

SEQ ID NO: 403354 - DNA, 25 bp, Rattus norvegicus
gctaggcacaatacctgggcacaga

SEQ ID NO: 403355 - DNA, 25 bp, Rattus norvegicus
gctaggcacaattcctgggcacaga

SEQ ID NO: 403356 - DNA, 25 bp, Rattus norvegicus
gctaggcaccccattgaattggaat

SEQ ID NO: 403357 - DNA, 25 bp, Rattus norvegicus
gctaggcacccctttgaattggaat

SEQ ID NO: 403358 - DNA, 25 bp, Rattus norvegicus
gctaggcagacaaaccaccgtggaa

SEQ ID NO: 403359 - DNA, 25 bp, Rattus norvegicus
gctaggcagacataccaccgtggaa

SEQ ID NO: 403360 - DNA, 25 bp, Rattus norvegicus
gctaggcagggcaggcattccctgt

SEQ ID NO: 403361 - DNA, 25 bp, Rattus norvegicus
gctaggcagggctggcattccctgt

SEQ ID NO: 403362 - DNA, 25 bp, Rattus norvegicus
gctaggcatggcagttgtcctggaa

SEQ ID NO: 403363 - DNA, 25 bp, Rattus norvegicus
gctaggcatggctgttgtcctggaa

SEQ ID NO: 403364 - DNA, 25 bp, Rattus norvegicus
gctaggcatgtaacactacgtccag

SEQ ID NO: 403365 - DNA, 25 bp, Rattus norvegicus
gctaggcatgtatcactacgtccag

SEQ ID NO: 403366 - DNA, 25 bp, Rattus norvegicus
gctaggccaagacccagaaggcata

SEQ ID NO: 403367 - DNA, 25 bp, Rattus norvegicus
gctaggccaagagccagaaggcata

SEQ ID NO: 403368 - DNA, 25 bp, Rattus norvegicus
gctaggccagatcacgggaactcga

SEQ ID NO: 403369 - DNA, 25 bp, Rattus norvegicus
gctaggccagatgacgggaactcga

SEQ ID NO: 403370 - DNA, 25 bp, Rattus norvegicus
gctaggccatctcctctgaaaaaag

SEQ ID NO: 403371 - DNA, 25 bp, Rattus norvegicus
gctaggccatctgctctgaaaaaag

SEQ ID NO: 403372 - DNA, 25 bp, Rattus norvegicus
gctaggccgatgatctccgaggaga

SEQ ID NO: 403373 - DNA, 25 bp, Rattus norvegicus
gctaggccgatgttctccgaggaga

SEQ ID NO: 403374 - DNA, 25 bp, Rattus norvegicus
gctaggcctaagattttgagttaac

SEQ ID NO: 403375 - DNA, 25 bp, Rattus norvegicus
gctaggcctaagtttttgagttaac

SEQ ID NO: 403376 - DNA, 25 bp, Rattus norvegicus
gctaggcggatgaacacactgtgga

SEQ ID NO: 403377 - DNA, 25 bp, Rattus norvegicus
gctaggcggatgtacacactgtgga

SEQ ID NO: 403378 - DNA, 25 bp, Rattus norvegicus
gctaggctaatgaatgtggcttcca

SEQ ID NO: 403379 - DNA, 25 bp, Rattus norvegicus
gctaggctaatgtatgtggcttcca

SEQ ID NO: 403380 - DNA, 25 bp, Rattus norvegicus
gctaggcttcagactatcagtgttt

SEQ ID NO: 403381 - DNA, 25 bp, Rattus norvegicus
gctaggcttcagtctatcagtgttt

SEQ ID NO: 403382 - DNA, 25 bp, Rattus norvegicus
gctagggaccagagtagaagaatca

SEQ ID NO: 403383 - DNA, 25 bp, Rattus norvegicus
gctagggaccagtgtagaagaatca

SEQ ID NO: 403384 - DNA, 25 bp, Rattus norvegicus
gctagggactctagttactgttaac

SEQ ID NO: 403385 - DNA, 25 bp, Rattus norvegicus
gctagggactcttgttactgttaac

SEQ ID NO: 403386 - DNA, 25 bp, Rattus norvegicus
gctagggacttacaattcttcggaa

SEQ ID NO: 403387 - DNA, 25 bp, Rattus norvegicus
gctagggacttagaattcttcggaa

SEQ ID NO: 403388 - DNA, 25 bp, Rattus norvegicus
gctagggagcctaacagctacatgg

SEQ ID NO: 403389 - DNA, 25 bp, Rattus norvegicus
gctagggagccttacagctacatgg

SEQ ID NO: 403390 - DNA, 25 bp, Rattus norvegicus
gctagggagctcatttggtcaggtt

SEQ ID NO: 403391 - DNA, 25 bp, Rattus norvegicus
gctagggagctcttttggtcaggtt

SEQ ID NO: 403392 - DNA, 25 bp, Rattus norvegicus
gctagggagcttacgatgtgcaata

SEQ ID NO: 403393 - DNA, 25 bp, Rattus norvegicus
gctagggagctttcgatgtgcaata

SEQ ID NO: 403394 - DNA, 25 bp, Rattus norvegicus
gctagggatagtctcagcactgaat

SEQ ID NO: 403395 - DNA, 25 bp, Rattus norvegicus
gctagggatagtgtcagcactgaat

SEQ ID NO: 403396 - DNA, 25 bp, Rattus norvegicus
gctagggatccacatgtagtggaat

SEQ ID NO: 403397 - DNA, 25 bp, Rattus norvegicus
gctagggatccagatgtagtggaat

SEQ ID NO: 403398 - DNA, 25 bp, Rattus norvegicus
gctagggatctaattgctcatgttc

SEQ ID NO: 403399 - DNA, 25 bp, Rattus norvegicus
gctagggatctatttgctcatgttc

SEQ ID NO: 403400 - DNA, 25 bp, Rattus norvegicus
gctagggatttgagtgtcctggaca

SEQ ID NO: 403401 - DNA, 25 bp, Rattus norvegicus
gctagggatttgtgtgtcctggaca

SEQ ID NO: 403402 - DNA, 25 bp, Rattus norvegicus
gctagggcttgaccacttcaacaaa

SEQ ID NO: 403403 - DNA, 25 bp, Rattus norvegicus
gctagggcttgagcacttcaacaaa

SEQ ID NO: 403404 - DNA, 25 bp, Rattus norvegicus
gctagggtatgcctggtttctaacc

SEQ ID NO: 403405 - DNA, 25 bp, Rattus norvegicus
gctagggtatgcgtggtttctaacc

SEQ ID NO: 403406 - DNA, 25 bp, Rattus norvegicus
gctagggtattgacaccatggctcc

SEQ ID NO: 403407 - DNA, 25 bp, Rattus norvegicus
gctagggtattgtcaccatggctcc

SEQ ID NO: 403408 - DNA, 25 bp, Rattus norvegicus
gctaggtacctgcactttccagttt

SEQ ID NO: 403409 - DNA, 25 bp, Rattus norvegicus
gctaggtacctggactttccagttt

SEQ ID NO: 403410 - DNA, 25 bp, Rattus norvegicus
gctaggtagttactttactcccact

SEQ ID NO: 403411 - DNA, 25 bp, Rattus norvegicus
gctaggtagttagtttactcccact

SEQ ID NO: 403412 - DNA, 25 bp, Rattus norvegicus
gctaggtatccactgtctattgcac

SEQ ID NO: 403413 - DNA, 25 bp, Rattus norvegicus
gctaggtatccagtgtctattgcac

SEQ ID NO: 403414 - DNA, 25 bp, Rattus norvegicus
gctaggtctgcaacttggaaaggcc

SEQ ID NO: 403415 - DNA, 25 bp, Rattus norvegicus
gctaggtctgcatcttggaaaggcc

SEQ ID NO: 403416 - DNA, 25 bp, Rattus norvegicus
gctaggtgcccacgaacgtcatgat

SEQ ID NO: 403417 - DNA, 25 bp, Rattus norvegicus
gctaggtgcccaggaacgtcatgat

SEQ ID NO: 403418 - DNA, 25 bp, Rattus norvegicus
gctaggtgtactctttgctgtgcat

SEQ ID NO: 403419 - DNA, 25 bp, Rattus norvegicus
gctaggtgtactgtttgctgtgcat

SEQ ID NO: 403420 - DNA, 25 bp, Rattus norvegicus
gctaggttcagtcatggcacattca

SEQ ID NO: 403421 - DNA, 25 bp, Rattus norvegicus
gctaggttcagtgatggcacattca

SEQ ID NO: 403422 - DNA, 25 bp, Rattus norvegicus
gctaggttttacagccacacagaga

SEQ ID NO: 403423 - DNA, 25 bp, Rattus norvegicus
gctaggttttactgccacacagaga

SEQ ID NO: 403424 - DNA, 25 bp, Rattus norvegicus
gctagtaaagtacacactgcgcagt

SEQ ID NO: 403425 - DNA, 25 bp, Rattus norvegicus
gctagtaaagtagacactgcgcagt

SEQ ID NO: 403426 - DNA, 25 bp, Rattus norvegicus
gctagtaaagttacaggcttgttcc

SEQ ID NO: 403427 - DNA, 25 bp, Rattus norvegicus
gctagtaaagtttcaggcttgttcc

SEQ ID NO: 403428 - DNA, 25 bp, Rattus norvegicus
gctagtaacagtccagcaacccttt

SEQ ID NO: 403429 - DNA, 25 bp, Rattus norvegicus
gctagtaacagtgcagcaacccttt

SEQ ID NO: 403430 - DNA, 25 bp, Rattus norvegicus
gctagtaactaaaacacccttctct

SEQ ID NO: 403431 - DNA, 25 bp, Rattus norvegicus
gctagtaactaatacacccttctct

SEQ ID NO: 403432 - DNA, 25 bp, Rattus norvegicus
gctagtaagcagactattgcaagat

SEQ ID NO: 403433 - DNA, 25 bp, Rattus norvegicus
gctagtaagcagtctattgcaagat

SEQ ID NO: 403434 - DNA, 25 bp, Rattus norvegicus
gctagtaattgtctgttacctggat

SEQ ID NO: 403435 - DNA, 25 bp, Rattus norvegicus
gctagtaattgtgtgttacctggat

SEQ ID NO: 403436 - DNA, 25 bp, Rattus norvegicus
gctagtaatttacctcccaatttga

SEQ ID NO: 403437 - DNA, 25 bp, Rattus norvegicus
gctagtaatttagctcccaatttga

SEQ ID NO: 403438 - DNA, 25 bp, Rattus norvegicus
gctagtacacggacaggacaaggtt

SEQ ID NO: 403439 - DNA, 25 bp, Rattus norvegicus
gctagtacacggtcaggacaaggtt

SEQ ID NO: 403440 - DNA, 25 bp, Rattus norvegicus
gctagtagatgtagccctccaaaat

SEQ ID NO: 403441 - DNA, 25 bp, Rattus norvegicus
gctagtagatgttgccctccaaaat

SEQ ID NO: 403442 - DNA, 25 bp, Rattus norvegicus
gctagtatacatcaagatttcctca

SEQ ID NO: 403443 - DNA, 25 bp, Rattus norvegicus
gctagtatacatgaagatttcctca

SEQ ID NO: 403444 - DNA, 25 bp, Rattus norvegicus
gctagtatcgcacaccccagagggt

SEQ ID NO: 403445 - DNA, 25 bp, Rattus norvegicus
gctagtatcgcagaccccagagggt

SEQ ID NO: 403446 - DNA, 25 bp, Rattus norvegicus
gctagtcagtgaagtatccccagca

SEQ ID NO: 403447 - DNA, 25 bp, Rattus norvegicus
gctagtcagtgacgcgatttttata

SEQ ID NO: 403448 - DNA, 25 bp, Rattus norvegicus
gctagtcagtgaggcgatttttata

SEQ ID NO: 403449 - DNA, 25 bp, Rattus norvegicus
gctagtcagtgatgtatccccagca

SEQ ID NO: 403450 - DNA, 25 bp, Rattus norvegicus
gctagtccacagaacggctttgaac

SEQ ID NO: 403451 - DNA, 25 bp, Rattus norvegicus
gctagtccacagtacggctttgaac

SEQ ID NO: 403452 - DNA, 25 bp, Rattus norvegicus
gctagtccagccctgaagaaaaaga

SEQ ID NO: 403453 - DNA, 25 bp, Rattus norvegicus
gctagtccagccgtgaagaaaaaga

SEQ ID NO: 403454 - DNA, 25 bp, Rattus norvegicus
gctagtccctaactggagctctata

SEQ ID NO: 403455 - DNA, 25 bp, Rattus norvegicus
gctagtccctaagtggagctctata

SEQ ID NO: 403456 - DNA, 25 bp, Rattus norvegicus
gctagtcctctactatccaggtata

SEQ ID NO: 403457 - DNA, 25 bp, Rattus norvegicus
gctagtcctctagtatccaggtata

SEQ ID NO: 403458 - DNA, 25 bp, Rattus norvegicus
gctagtccttcaatttcatgcaaat

SEQ ID NO: 403459 - DNA, 25 bp, Rattus norvegicus
gctagtccttcattttcatgcaaat

SEQ ID NO: 403460 - DNA, 25 bp, Rattus norvegicus
gctagtctagcccacagctctgaac

SEQ ID NO: 403461 - DNA, 25 bp, Rattus norvegicus
gctagtctagccgacagctctgaac

SEQ ID NO: 403462 - DNA, 25 bp, Rattus norvegicus
gctagtctcaaacttgtcatttagg

SEQ ID NO: 403463 - DNA, 25 bp, Rattus norvegicus
gctagtctcaaagttgtcatttagg

SEQ ID NO: 403464 - DNA, 25 bp, Rattus norvegicus
gctagtctgcgaagagcctaactga

SEQ ID NO: 403465 - DNA, 25 bp, Rattus norvegicus
gctagtctgcgatgagcctaactga

SEQ ID NO: 403466 - DNA, 25 bp, Rattus norvegicus
gctagtctgtatattttgttcgaac

SEQ ID NO: 403467 - DNA, 25 bp, Rattus norvegicus
gctagtctgtattttttgttcgaac

SEQ ID NO: 403468 - DNA, 25 bp, Rattus norvegicus
gctagtcttatcatgtccacagtca

SEQ ID NO: 403469 - DNA, 25 bp, Rattus norvegicus
gctagtcttatcttgtccacagtca

SEQ ID NO: 403470 - DNA, 25 bp, Rattus norvegicus
gctagtcttgcgattccatttcaaa

SEQ ID NO: 403471 - DNA, 25 bp, Rattus norvegicus
gctagtcttgcgtttccatttcaaa

SEQ ID NO: 403472 - DNA, 25 bp, Rattus norvegicus
gctagtgaaagactgggctgcccaa

SEQ ID NO: 403473 - DNA, 25 bp, Rattus norvegicus
gctagtgaaagagtgggctgcccaa

SEQ ID NO: 403474 - DNA, 25 bp, Rattus norvegicus
gctagtgaccccagcaggctcatag

SEQ ID NO: 403475 - DNA, 25 bp, Rattus norvegicus
gctagtgacccctgcaggctcatag

SEQ ID NO: 403476 - DNA, 25 bp, Rattus norvegicus
gctagtgatatgacaactgtgcggg

SEQ ID NO: 403477 - DNA, 25 bp, Rattus norvegicus
gctagtgatatgtcaactgtgcggg

SEQ ID NO: 403478 - DNA, 25 bp, Rattus norvegicus
gctagtgatgggattttgttcaaca

SEQ ID NO: 403479 - DNA, 25 bp, Rattus norvegicus
gctagtgatgggtttttgttcaaca

SEQ ID NO: 403480 - DNA, 25 bp, Rattus norvegicus
gctagtgcctctcgtgtcctgggta

SEQ ID NO: 403481 - DNA, 25 bp, Rattus norvegicus
gctagtgcctctggtgtcctgggta

SEQ ID NO: 403482 - DNA, 25 bp, Rattus norvegicus
gctagtggacacaggcctcaattat

SEQ ID NO: 403483 - DNA, 25 bp, Rattus norvegicus
gctagtggacactggcctcaattat

SEQ ID NO: 403484 - DNA, 25 bp, Rattus norvegicus
gctagtggccttatgccatgaacac

SEQ ID NO: 403485 - DNA, 25 bp, Rattus norvegicus
gctagtggccttttgccatgaacac

SEQ ID NO: 403486 - DNA, 25 bp, Rattus norvegicus
gctagtggcttgaccctggaaagga

SEQ ID NO: 403487 - DNA, 25 bp, Rattus norvegicus
gctagtggcttgtccctggaaagga

SEQ ID NO: 403488 - DNA, 25 bp, Rattus norvegicus
gctagtgtactgatactggtgtgac

SEQ ID NO: 403489 - DNA, 25 bp, Rattus norvegicus
gctagtgtactgttactggtgtgac

SEQ ID NO: 403490 - DNA, 25 bp, Rattus norvegicus
gctagtgtagtgaaagtgctttaaa

SEQ ID NO: 403491 - DNA, 25 bp, Rattus norvegicus
gctagtgtagtgtaagtgctttaaa

SEQ ID NO: 403492 - DNA, 25 bp, Rattus norvegicus
gctagtgtctaacttaaactctaag

SEQ ID NO: 403493 - DNA, 25 bp, Rattus norvegicus
gctagtgtctaagttaaactctaag

SEQ ID NO: 403494 - DNA, 25 bp, Rattus norvegicus
gctagtgtgacactaggcattccct

SEQ ID NO: 403495 - DNA, 25 bp, Rattus norvegicus
gctagtgtgacagtaggcattccct

SEQ ID NO: 403496 - DNA, 25 bp, Rattus norvegicus
gctagtgtgttcagtgcctgctcca

SEQ ID NO: 403497 - DNA, 25 bp, Rattus norvegicus
gctagtgtgttctgtgcctgctcca

SEQ ID NO: 403498 - DNA, 25 bp, Rattus norvegicus
gctagtgttatgctacttgaatact

SEQ ID NO: 403499 - DNA, 25 bp, Rattus norvegicus
gctagtgttatggtacttgaatact

SEQ ID NO: 403500 - DNA, 25 bp, Rattus norvegicus
gctagtgtttgtaccaccatgtact

SEQ ID NO: 403501 - DNA, 25 bp, Rattus norvegicus
gctagtgtttgttccaccatgtact

SEQ ID NO: 403502 - DNA, 25 bp, Rattus norvegicus
gctagttaagctatgccttttgcct

SEQ ID NO: 403503 - DNA, 25 bp, Rattus norvegicus
gctagttaagctttgccttttgcct

SEQ ID NO: 403504 - DNA, 25 bp, Rattus norvegicus
gctagttaataccttccatgtcctg

SEQ ID NO: 403505 - DNA, 25 bp, Rattus norvegicus
gctagttaatacgttccatgtcctg

SEQ ID NO: 403506 - DNA, 25 bp, Rattus norvegicus
gctagttaccgcacttaacaatgga

SEQ ID NO: 403507 - DNA, 25 bp, Rattus norvegicus
gctagttaccgctcttaacaatgga

SEQ ID NO: 403508 - DNA, 25 bp, Rattus norvegicus
gctagttatgatatctacctgccat

SEQ ID NO: 403509 - DNA, 25 bp, Rattus norvegicus
gctagttatgatttctacctgccat

SEQ ID NO: 403510 - DNA, 25 bp, Rattus norvegicus
gctagttccactagacacaagtaaa

SEQ ID NO: 403511 - DNA, 25 bp, Rattus norvegicus
gctagttccacttgacacaagtaaa

SEQ ID NO: 403512 - DNA, 25 bp, Rattus norvegicus
gctagttcctggcagaagcttcctg

SEQ ID NO: 403513 - DNA, 25 bp, Rattus norvegicus
gctagttcctgggagaagcttcctg

SEQ ID NO: 403514 - DNA, 25 bp, Rattus norvegicus
gctagttctggcctggagattgcac

SEQ ID NO: 403515 - DNA, 25 bp, Rattus norvegicus
gctagttctggcgtggagattgcac

SEQ ID NO: 403516 - DNA, 25 bp, Rattus norvegicus
gctagttgggttctgttctgcatga

SEQ ID NO: 403517 - DNA, 25 bp, Rattus norvegicus
gctagttgggttgtgttctgcatga

SEQ ID NO: 403518 - DNA, 25 bp, Rattus norvegicus
gctagttgtttcctttgctgatatt

SEQ ID NO: 403519 - DNA, 25 bp, Rattus norvegicus
gctagttgtttcgtttgctgatatt

SEQ ID NO: 403520 - DNA, 25 bp, Rattus norvegicus
gctagttgtttgagtatttccagaa

SEQ ID NO: 403521 - DNA, 25 bp, Rattus norvegicus
gctagttgtttgtgtatttccagaa

SEQ ID NO: 403522 - DNA, 25 bp, Rattus norvegicus
gctagtttagccattgaatgcgtga

SEQ ID NO: 403523 - DNA, 25 bp, Rattus norvegicus
gctagtttagcctttgaatgcgtga

SEQ ID NO: 403524 - DNA, 25 bp, Rattus norvegicus
gctagtttaggtactggcttaagca

SEQ ID NO: 403525 - DNA, 25 bp, Rattus norvegicus
gctagtttaggttctggcttaagca

SEQ ID NO: 403526 - DNA, 25 bp, Rattus norvegicus
gctagtttagtccttctatttatca

SEQ ID NO: 403527 - DNA, 25 bp, Rattus norvegicus
gctagtttagtcgttctatttatca

SEQ ID NO: 403528 - DNA, 25 bp, Rattus norvegicus
gctagtttagttcctagagcactac

SEQ ID NO: 403529 - DNA, 25 bp, Rattus norvegicus
gctagtttagttgctagagcactac

SEQ ID NO: 403530 - DNA, 25 bp, Rattus norvegicus
gctagtttcaagcaactcgccagct

SEQ ID NO: 403531 - DNA, 25 bp, Rattus norvegicus
gctagtttcaaggaactcgccagct

SEQ ID NO: 403532 - DNA, 25 bp, Rattus norvegicus
gctagtttcttaactgcgaacggaa

SEQ ID NO: 403533 - DNA, 25 bp, Rattus norvegicus
gctagtttcttatctgcgaacggaa

SEQ ID NO: 403534 - DNA, 25 bp, Rattus norvegicus
gctagttttttcattgtgcttctaa

SEQ ID NO: 403535 - DNA, 25 bp, Rattus norvegicus
gctagttttttctttgtgcttctaa

SEQ ID NO: 403536 - DNA, 25 bp, Rattus norvegicus
gctataaacagtacgtgggtcacca

SEQ ID NO: 403537 - DNA, 25 bp, Rattus norvegicus
gctataaacagttcgtgggtcacca

SEQ ID NO: 403538 - DNA, 25 bp, Rattus norvegicus
gctataaagaacacaggccggtgct

SEQ ID NO: 403539 - DNA, 25 bp, Rattus norvegicus
gctataaagaactcaggccggtgct

SEQ ID NO: 403540 - DNA, 25 bp, Rattus norvegicus
gctataaattccagaaggcgctgaa

SEQ ID NO: 403541 - DNA, 25 bp, Rattus norvegicus
gctataaattcctgaaggcgctgaa

SEQ ID NO: 403542 - DNA, 25 bp, Rattus norvegicus
gctataaatttcaccggtcgcgagg

SEQ ID NO: 403543 - DNA, 25 bp, Rattus norvegicus
gctataaatttctccggtcgcgagg

SEQ ID NO: 403544 - DNA, 25 bp, Rattus norvegicus
gctataacagctctcacagtcagga

SEQ ID NO: 403545 - DNA, 25 bp, Rattus norvegicus
gctataacagctgtcacagtcagga

SEQ ID NO: 403546 - DNA, 25 bp, Rattus norvegicus
gctataaccagcattttgtctcacc

SEQ ID NO: 403547 - DNA, 25 bp, Rattus norvegicus
gctataaccagctttttgtctcacc

SEQ ID NO: 403548 - DNA, 25 bp, Rattus norvegicus
gctataacctgtccttttcgtctca

SEQ ID NO: 403549 - DNA, 25 bp, Rattus norvegicus
gctataacctgtgcttttcgtctca

SEQ ID NO: 403550 - DNA, 25 bp, Rattus norvegicus
gctataactaagatccctgcttctg

SEQ ID NO: 403551 - DNA, 25 bp, Rattus norvegicus
gctataactaagttccctgcttctg

SEQ ID NO: 403552 - DNA, 25 bp, Rattus norvegicus
gctataactactctatcactttcat

SEQ ID NO: 403553 - DNA, 25 bp, Rattus norvegicus
gctataactactgtatcactttcat

SEQ ID NO: 403554 - DNA, 25 bp, Rattus norvegicus
gctataactgttcggccatggcctt

SEQ ID NO: 403555 - DNA, 25 bp, Rattus norvegicus
gctataactgttgggccatggcctt

SEQ ID NO: 403556 - DNA, 25 bp, Rattus norvegicus
gctataagcctgctttacagggtaa

SEQ ID NO: 403557 - DNA, 25 bp, Rattus norvegicus
gctataagcctggtttacagggtaa

SEQ ID NO: 403558 - DNA, 25 bp, Rattus norvegicus
gctataatgcaacctggccaggtca

SEQ ID NO: 403559 - DNA, 25 bp, Rattus norvegicus
gctataatgcaagctggccaggtca

SEQ ID NO: 403560 - DNA, 25 bp, Rattus norvegicus
gctataatgtatattgccccagaat

SEQ ID NO: 403561 - DNA, 25 bp, Rattus norvegicus
gctataatgtattttgccccagaat

SEQ ID NO: 403562 - DNA, 25 bp, Rattus norvegicus
gctatacagagtatcaggctggcaa

SEQ ID NO: 403563 - DNA, 25 bp, Rattus norvegicus
gctatacagagtttcaggctggcaa

SEQ ID NO: 403564 - DNA, 25 bp, Rattus norvegicus
gctatacatataacaatccactaat

SEQ ID NO: 403565 - DNA, 25 bp, Rattus norvegicus
gctatacatatatcaatccactaat

SEQ ID NO: 403566 - DNA, 25 bp, Rattus norvegicus
gctataccaaggcatcttcactgaa

SEQ ID NO: 403567 - DNA, 25 bp, Rattus norvegicus
gctataccaagggatcttcactgaa

SEQ ID NO: 403568 - DNA, 25 bp, Rattus norvegicus
gctataccccagaggcttatcagaa

SEQ ID NO: 403569 - DNA, 25 bp, Rattus norvegicus
gctataccccagtggcttatcagaa

SEQ ID NO: 403570 - DNA, 25 bp, Rattus norvegicus
gctataccgtgaaccacaagcagtt

SEQ ID NO: 403571 - DNA, 25 bp, Rattus norvegicus
gctataccgtgatccacaagcagtt

SEQ ID NO: 403572 - DNA, 25 bp, Rattus norvegicus
gctatacctgagattcttttccctt

SEQ ID NO: 403573 - DNA, 25 bp, Rattus norvegicus
gctatacctgagtttcttttccctt

SEQ ID NO: 403574 - DNA, 25 bp, Rattus norvegicus
gctatacctgtacttgtttgactac

SEQ ID NO: 403575 - DNA, 25 bp, Rattus norvegicus
gctatacctgtagttgtttgactac

SEQ ID NO: 403576 - DNA, 25 bp, Rattus norvegicus
gctatactacaccaagaaccctgag

SEQ ID NO: 403577 - DNA, 25 bp, Rattus norvegicus
gctatactacacgaagaaccctgag

SEQ ID NO: 403578 - DNA, 25 bp, Rattus norvegicus
gctatactccccagagaacaaagaa

SEQ ID NO: 403579 - DNA, 25 bp, Rattus norvegicus
gctatactcccctgagaacaaagaa

SEQ ID NO: 403580 - DNA, 25 bp, Rattus norvegicus
gctatactggccacagaaatggcaa

SEQ ID NO: 403581 - DNA, 25 bp, Rattus norvegicus
gctatactggcctcagaaatggcaa

SEQ ID NO: 403582 - DNA, 25 bp, Rattus norvegicus
gctatactgttacctacacctttag

SEQ ID NO: 403583 - DNA, 25 bp, Rattus norvegicus
gctatactgttagctacacctttag

SEQ ID NO: 403584 - DNA, 25 bp, Rattus norvegicus
gctatagaaagtagtggcttccaag

SEQ ID NO: 403585 - DNA, 25 bp, Rattus norvegicus
gctatagaaagttgtggcttccaag

SEQ ID NO: 403586 - DNA, 25 bp, Rattus norvegicus
gctatagaatctatgaaaccttttg

SEQ ID NO: 403587 - DNA, 25 bp, Rattus norvegicus
gctatagaatctttgaaaccttttg

SEQ ID NO: 403588 - DNA, 25 bp, Rattus norvegicus
gctatagagattcgcctgggctttc

SEQ ID NO: 403589 - DNA, 25 bp, Rattus norvegicus
gctatagagattggcctgggctttc

SEQ ID NO: 403590 - DNA, 25 bp, Rattus norvegicus
gctatagaggatctggaggattcca

SEQ ID NO: 403591 - DNA, 25 bp, Rattus norvegicus
gctatagaggatgtggaggattcca

SEQ ID NO: 403592 - DNA, 25 bp, Rattus norvegicus
gctatagctttcactagtagctttg

SEQ ID NO: 403593 - DNA, 25 bp, Rattus norvegicus
gctatagctttctctagtagctttg

SEQ ID NO: 403594 - DNA, 25 bp, Rattus norvegicus
gctatagggtttctggcttgtcaca

SEQ ID NO: 403595 - DNA, 25 bp, Rattus norvegicus
gctatagggtttgtggcttgtcaca

SEQ ID NO: 403596 - DNA, 25 bp, Rattus norvegicus
gctatagttacaccagcctgccata

SEQ ID NO: 403597 - DNA, 25 bp, Rattus norvegicus
gctatagttacagcagcctgccata

SEQ ID NO: 403598 - DNA, 25 bp, Rattus norvegicus
gctatagtttttcttaatgaccttt

SEQ ID NO: 403599 - DNA, 25 bp, Rattus norvegicus
gctatagtttttcttccttgtggac

SEQ ID NO: 403600 - DNA, 25 bp, Rattus norvegicus
gctatagtttttgttaatgaccttt

SEQ ID NO: 403601 - DNA, 25 bp, Rattus norvegicus
gctatagtttttgttccttgtggac

SEQ ID NO: 403602 - DNA, 25 bp, Rattus norvegicus
gctatatactgtcatcctgatacta

SEQ ID NO: 403603 - DNA, 25 bp, Rattus norvegicus
gctatatactgtgatcctgatacta

SEQ ID NO: 403604 - DNA, 25 bp, Rattus norvegicus
gctatatagttgaatttatctcctt

SEQ ID NO: 403605 - DNA, 25 bp, Rattus norvegicus
gctatatagttgtatttatctcctt

SEQ ID NO: 403606 - DNA, 25 bp, Rattus norvegicus
gctatatattctattcagttggctc

SEQ ID NO: 403607 - DNA, 25 bp, Rattus norvegicus
gctatatattcttttcagttggctc

SEQ ID NO: 403608 - DNA, 25 bp, Rattus norvegicus
gctatatcagcaccacatgcaatat

SEQ ID NO: 403609 - DNA, 25 bp, Rattus norvegicus
gctatatcagcagcacatgcaatat

SEQ ID NO: 403610 - DNA, 25 bp, Rattus norvegicus
gctatatgcatcagttctactgtag

SEQ ID NO: 403611 - DNA, 25 bp, Rattus norvegicus
gctatatgcatctgttctactgtag

SEQ ID NO: 403612 - DNA, 25 bp, Rattus norvegicus
gctatatggctaaatgttccccact

SEQ ID NO: 403613 - DNA, 25 bp, Rattus norvegicus
gctatatggctatatgttccccact

SEQ ID NO: 403614 - DNA, 25 bp, Rattus norvegicus
gctatatgtccccacatgcaggcta

SEQ ID NO: 403615 - DNA, 25 bp, Rattus norvegicus
gctatatgtcccgacatgcaggcta

SEQ ID NO: 403616 - DNA, 25 bp, Rattus norvegicus
gctatattacgtctgtgctgagaat

SEQ ID NO: 403617 - DNA, 25 bp, Rattus norvegicus
gctatattacgtgtgtgctgagaat

SEQ ID NO: 403618 - DNA, 25 bp, Rattus norvegicus
gctatatttgtcaacagtcatccta

SEQ ID NO: 403619 - DNA, 25 bp, Rattus norvegicus
gctatatttgtctacagtcatccta

SEQ ID NO: 403620 - DNA, 25 bp, Rattus norvegicus
gctatcaactatcctggtccagcag

SEQ ID NO: 403621 - DNA, 25 bp, Rattus norvegicus
gctatcaactatgctggtccagcag

SEQ ID NO: 403622 - DNA, 25 bp, Rattus norvegicus
gctatcacagggactctaaactttt

SEQ ID NO: 403623 - DNA, 25 bp, Rattus norvegicus
gctatcacagggtctctaaactttt

SEQ ID NO: 403624 - DNA, 25 bp, Rattus norvegicus
gctatcacatcgaagttggaaggct

SEQ ID NO: 403625 - DNA, 25 bp, Rattus norvegicus
gctatcacatcgtagttggaaggct

SEQ ID NO: 403626 - DNA, 25 bp, Rattus norvegicus
gctatcactgccaggctttgtgtaa

SEQ ID NO: 403627 - DNA, 25 bp, Rattus norvegicus
gctatcactgcctggctttgtgtaa

SEQ ID NO: 403628 - DNA, 25 bp, Rattus norvegicus
gctatcagctatagggttctcagga

SEQ ID NO: 403629 - DNA, 25 bp, Rattus norvegicus
gctatcagctattgggttctcagga

SEQ ID NO: 403630 - DNA, 25 bp, Rattus norvegicus
gctatcagtagactgtccacacctt

SEQ ID NO: 403631 - DNA, 25 bp, Rattus norvegicus
gctatcagtagagtgtccacacctt

SEQ ID NO: 403632 - DNA, 25 bp, Rattus norvegicus
gctatcatagccctattaagcctat

SEQ ID NO: 403633 - DNA, 25 bp, Rattus norvegicus
gctatcatagccgtattaagcctat

SEQ ID NO: 403634 - DNA, 25 bp, Rattus norvegicus
gctatcatcgtgaacccttgggaaa

SEQ ID NO: 403635 - DNA, 25 bp, Rattus norvegicus
gctatcatcgtgtacccttgggaaa

SEQ ID NO: 403636 - DNA, 25 bp, Rattus norvegicus
gctatcatgttaccaaagtgccttg

SEQ ID NO: 403637 - DNA, 25 bp, Rattus norvegicus
gctatcatgttagcaaagtgccttg

SEQ ID NO: 403638 - DNA, 25 bp, Rattus norvegicus
gctatcattgaacgtctgcaggaaa

SEQ ID NO: 403639 - DNA, 25 bp, Rattus norvegicus
gctatcattgaaggtctgcaggaaa

SEQ ID NO: 403640 - DNA, 25 bp, Rattus norvegicus
gctatcattggcctgtgttgtaccg

SEQ ID NO: 403641 - DNA, 25 bp, Rattus norvegicus
gctatcattggcgtgtgttgtaccg

SEQ ID NO: 403642 - DNA, 25 bp, Rattus norvegicus
gctatccaacccagttttcaatgtg

SEQ ID NO: 403643 - DNA, 25 bp, Rattus norvegicus
gctatccaaccctgttttcaatgtg

SEQ ID NO: 403644 - DNA, 25 bp, Rattus norvegicus
gctatccaatgccaacagggtattc

SEQ ID NO: 403645 - DNA, 25 bp, Rattus norvegicus
gctatccaatgcgaacagggtattc

SEQ ID NO: 403646 - DNA, 25 bp, Rattus norvegicus
gctatccagctacgtgtgttacaga

SEQ ID NO: 403647 - DNA, 25 bp, Rattus norvegicus
gctatccagctaggtgtgttacaga

SEQ ID NO: 403648 - DNA, 25 bp, Rattus norvegicus
gctatccatgccctgaacaaattgc

SEQ ID NO: 403649 - DNA, 25 bp, Rattus norvegicus
gctatccatgccgtgaacaaattgc

SEQ ID NO: 403650 - DNA, 25 bp, Rattus norvegicus
gctatccctgttattgagggcaaca

SEQ ID NO: 403651 - DNA, 25 bp, Rattus norvegicus
gctatccctgtttttgagggcaaca

SEQ ID NO: 403652 - DNA, 25 bp, Rattus norvegicus
gctatcccttacatattaactacct

SEQ ID NO: 403653 - DNA, 25 bp, Rattus norvegicus
gctatcccttacttattaactacct

SEQ ID NO: 403654 - DNA, 25 bp, Rattus norvegicus
gctatccctttgagcctgagcaaat

SEQ ID NO: 403655 - DNA, 25 bp, Rattus norvegicus
gctatccctttgtgcctgagcaaat

SEQ ID NO: 403656 - DNA, 25 bp, Rattus norvegicus
gctatccgcaaaccgagggctgtgt

SEQ ID NO: 403657 - DNA, 25 bp, Rattus norvegicus
gctatccgcaaagcgagggctgtgt

SEQ ID NO: 403658 - DNA, 25 bp, Rattus norvegicus
gctatccgcggtaaccctagttctg

SEQ ID NO: 403659 - DNA, 25 bp, Rattus norvegicus
gctatccgcggttaccctagttctg

SEQ ID NO: 403660 - DNA, 25 bp, Rattus norvegicus
gctatccggcagactatctcaaaag

SEQ ID NO: 403661 - DNA, 25 bp, Rattus norvegicus
gctatccggcagtctatctcaaaag

SEQ ID NO: 403662 - DNA, 25 bp, Rattus norvegicus
gctatccggctaactgatctggaca

SEQ ID NO: 403663 - DNA, 25 bp, Rattus norvegicus
gctatccggctatctgatctggaca

SEQ ID NO: 403664 - DNA, 25 bp, Rattus norvegicus
gctatcctccatatggtgctagagt

SEQ ID NO: 403665 - DNA, 25 bp, Rattus norvegicus
gctatcctccatttggtgctagagt

SEQ ID NO: 403666 - DNA, 25 bp, Rattus norvegicus
gctatcctgccaactctatcgtggt

SEQ ID NO: 403667 - DNA, 25 bp, Rattus norvegicus
gctatcctgccatctctatcgtggt

SEQ ID NO: 403668 - DNA, 25 bp, Rattus norvegicus
gctatcctggacctcactattacag

SEQ ID NO: 403669 - DNA, 25 bp, Rattus norvegicus
gctatcctggacgtcactattacag

SEQ ID NO: 403670 - DNA, 25 bp, Rattus norvegicus
gctatccttaaactgcagctatgat

SEQ ID NO: 403671 - DNA, 25 bp, Rattus norvegicus
gctatccttaaagtgcagctatgat

SEQ ID NO: 403672 - DNA, 25 bp, Rattus norvegicus
gctatccttctgatcacagcaagct

SEQ ID NO: 403673 - DNA, 25 bp, Rattus norvegicus
gctatccttctgttcacagcaagct

SEQ ID NO: 403674 - DNA, 25 bp, Rattus norvegicus
gctatcgacagtcaggcgagttcca

SEQ ID NO: 403675 - DNA, 25 bp, Rattus norvegicus
gctatcgacagtgaggcgagttcca

SEQ ID NO: 403676 - DNA, 25 bp, Rattus norvegicus
gctatcgagttgcaaattgcttgtc

SEQ ID NO: 403677 - DNA, 25 bp, Rattus norvegicus
gctatcgagttggaaattgcttgtc

SEQ ID NO: 403678 - DNA, 25 bp, Rattus norvegicus
gctatcgcatggagcagcctcgaaa

SEQ ID NO: 403679 - DNA, 25 bp, Rattus norvegicus
gctatcgcatggtgcagcctcgaaa

SEQ ID NO: 403680 - DNA, 25 bp, Rattus norvegicus
gctatcgctcttaggatgaatcttt

SEQ ID NO: 403681 - DNA, 25 bp, Rattus norvegicus
gctatcgctctttggatgaatcttt

SEQ ID NO: 403682 - DNA, 25 bp, Rattus norvegicus
gctatcggagcacatgtctcggaga

SEQ ID NO: 403683 - DNA, 25 bp, Rattus norvegicus
gctatcggagcagatgtctcggaga

SEQ ID NO: 403684 - DNA, 25 bp, Rattus norvegicus
gctatcgttgaaaacttaggtcaga

SEQ ID NO: 403685 - DNA, 25 bp, Rattus norvegicus
gctatcgttgaatacttaggtcaga

SEQ ID NO: 403686 - DNA, 25 bp, Rattus norvegicus
gctatctaccccattaattccaaca

SEQ ID NO: 403687 - DNA, 25 bp, Rattus norvegicus
gctatctacccctttaattccaaca

SEQ ID NO: 403688 - DNA, 25 bp, Rattus norvegicus
gctatctactggatctgttctttta

SEQ ID NO: 403689 - DNA, 25 bp, Rattus norvegicus
gctatctactggttctgttctttta

SEQ ID NO: 403690 - DNA, 25 bp, Rattus norvegicus
gctatctactgtcatactccctaga

SEQ ID NO: 403691 - DNA, 25 bp, Rattus norvegicus
gctatctactgtgatactccctaga

SEQ ID NO: 403692 - DNA, 25 bp, Rattus norvegicus
gctatctatcccctaggtacacgat

SEQ ID NO: 403693 - DNA, 25 bp, Rattus norvegicus
gctatctatcccgtaggtacacgat

SEQ ID NO: 403694 - DNA, 25 bp, Rattus norvegicus
gctatctcacggctttatgttttga

SEQ ID NO: 403695 - DNA, 25 bp, Rattus norvegicus
gctatctcacgggtttatgttttga

SEQ ID NO: 403696 - DNA, 25 bp, Rattus norvegicus
gctatctccagcaaacgcagtatta

SEQ ID NO: 403697 - DNA, 25 bp, Rattus norvegicus
gctatctccagctaacgcagtatta

SEQ ID NO: 403698 - DNA, 25 bp, Rattus norvegicus
gctatctccatccagcatgtgggaa

SEQ ID NO: 403699 - DNA, 25 bp, Rattus norvegicus
gctatctccatcgagcatgtgggaa

SEQ ID NO: 403700 - DNA, 25 bp, Rattus norvegicus
gctatctcctttcggcagcagtcca

SEQ ID NO: 403701 - DNA, 25 bp, Rattus norvegicus
gctatctcctttgggcagcagtcca

SEQ ID NO: 403702 - DNA, 25 bp, Rattus norvegicus
gctatctctccaagctctcaaaata

SEQ ID NO: 403703 - DNA, 25 bp, Rattus norvegicus
gctatctctccatgctctcaaaata

SEQ ID NO: 403704 - DNA, 25 bp, Rattus norvegicus
gctatctctggaaggtaaacactga

SEQ ID NO: 403705 - DNA, 25 bp, Rattus norvegicus
gctatctctggatggtaaacactga

SEQ ID NO: 403706 - DNA, 25 bp, Rattus norvegicus
gctatctcttatctcttaacacatc

SEQ ID NO: 403707 - DNA, 25 bp, Rattus norvegicus
gctatctcttatgtcttaacacatc

SEQ ID NO: 403708 - DNA, 25 bp, Rattus norvegicus
gctatctgaagcaaacacagacagt

SEQ ID NO: 403709 - DNA, 25 bp, Rattus norvegicus
gctatctgaagctaacacagacagt

SEQ ID NO: 403710 - DNA, 25 bp, Rattus norvegicus
gctatctgacctccaatttaaagtg

SEQ ID NO: 403711 - DNA, 25 bp, Rattus norvegicus
gctatctgacctgcaatttaaagtg

SEQ ID NO: 403712 - DNA, 25 bp, Rattus norvegicus
gctatctgctgcagctttgaaggca

SEQ ID NO: 403713 - DNA, 25 bp, Rattus norvegicus
gctatctgctgctgctttgaaggca

SEQ ID NO: 403714 - DNA, 25 bp, Rattus norvegicus
gctatctgcttgatccatcatgtag

SEQ ID NO: 403715 - DNA, 25 bp, Rattus norvegicus
gctatctgcttgttccatcatgtag

SEQ ID NO: 403716 - DNA, 25 bp, Rattus norvegicus
gctatctgggagagtgtaccacgga

SEQ ID NO: 403717 - DNA, 25 bp, Rattus norvegicus
gctatctgggagtgtgtaccacgga

SEQ ID NO: 403718 - DNA, 25 bp, Rattus norvegicus
gctatcttgagtattagtgccatgt

SEQ ID NO: 403719 - DNA, 25 bp, Rattus norvegicus
gctatcttgagttttagtgccatgt

SEQ ID NO: 403720 - DNA, 25 bp, Rattus norvegicus
gctatcttgctgacatgttatgtat

SEQ ID NO: 403721 - DNA, 25 bp, Rattus norvegicus
gctatcttgctgtcatgttatgtat

SEQ ID NO: 403722 - DNA, 25 bp, Rattus norvegicus
gctatcttttggagctgctaactca

SEQ ID NO: 403723 - DNA, 25 bp, Rattus norvegicus
gctatcttttggtgctgctaactca

SEQ ID NO: 403724 - DNA, 25 bp, Rattus norvegicus
gctatgaaactgagccacattttag

SEQ ID NO: 403725 - DNA, 25 bp, Rattus norvegicus
gctatgaaactgtgccacattttag

SEQ ID NO: 403726 - DNA, 25 bp, Rattus norvegicus
gctatgaaatgcatgcccaggccca

SEQ ID NO: 403727 - DNA, 25 bp, Rattus norvegicus
gctatgaaatgcttgcccaggccca

SEQ ID NO: 403728 - DNA, 25 bp, Rattus norvegicus
gctatgaacactagacagaccgaaa

SEQ ID NO: 403729 - DNA, 25 bp, Rattus norvegicus
gctatgaacacttgacagaccgaaa

SEQ ID NO: 403730 - DNA, 25 bp, Rattus norvegicus
gctatgaacatgaacttgcagaaag

SEQ ID NO: 403731 - DNA, 25 bp, Rattus norvegicus
gctatgaacatgtacttgcagaaag

SEQ ID NO: 403732 - DNA, 25 bp, Rattus norvegicus
gctatgaagagcattgttccccaaa

SEQ ID NO: 403733 - DNA, 25 bp, Rattus norvegicus
gctatgaagagctttgttccccaaa

SEQ ID NO: 403734 - DNA, 25 bp, Rattus norvegicus
gctatgaaggtgaacgtgaagcact

SEQ ID NO: 403735 - DNA, 25 bp, Rattus norvegicus
gctatgaaggtgtacgtgaagcact

SEQ ID NO: 403736 - DNA, 25 bp, Rattus norvegicus
gctatgaagtgtcgctgcagcagta

SEQ ID NO: 403737 - DNA, 25 bp, Rattus norvegicus
gctatgaagtgtggctgcagcagta

SEQ ID NO: 403738 - DNA, 25 bp, Rattus norvegicus
gctatgaatgtcaagtttgctttta

SEQ ID NO: 403739 - DNA, 25 bp, Rattus norvegicus
gctatgaatgtctagtttgctttta

SEQ ID NO: 403740 - DNA, 25 bp, Rattus norvegicus
gctatgaattttatcctccagacaa

SEQ ID NO: 403741 - DNA, 25 bp, Rattus norvegicus
gctatgaattttttcctccagacaa

SEQ ID NO: 403742 - DNA, 25 bp, Rattus norvegicus
gctatgaccagccttgatgccacta

SEQ ID NO: 403743 - DNA, 25 bp, Rattus norvegicus
gctatgaccagcgttgatgccacta

SEQ ID NO: 403744 - DNA, 25 bp, Rattus norvegicus
gctatgaccctcaacgaggctatgg

SEQ ID NO: 403745 - DNA, 25 bp, Rattus norvegicus
gctatgaccctctacgaggctatgg

SEQ ID NO: 403746 - DNA, 25 bp, Rattus norvegicus
gctatgaccttgctgagatcctgag

SEQ ID NO: 403747 - DNA, 25 bp, Rattus norvegicus
gctatgaccttggtgagatcctgag

SEQ ID NO: 403748 - DNA, 25 bp, Rattus norvegicus
gctatgagaattcaggttccccttc

SEQ ID NO: 403749 - DNA, 25 bp, Rattus norvegicus
gctatgagaattgaggttccccttc

SEQ ID NO: 403750 - DNA, 25 bp, Rattus norvegicus
gctatgagatgacctgcagccagaa

SEQ ID NO: 403751 - DNA, 25 bp, Rattus norvegicus
gctatgagatgagctgcagccagaa

SEQ ID NO: 403752 - DNA, 25 bp, Rattus norvegicus
gctatgagatttctgcaggattgct

SEQ ID NO: 403753 - DNA, 25 bp, Rattus norvegicus
gctatgagatttgtgcaggattgct

SEQ ID NO: 403754 - DNA, 25 bp, Rattus norvegicus
gctatgagccagaccgtgagggcat

SEQ ID NO: 403755 - DNA, 25 bp, Rattus norvegicus
gctatgagccagtccgtgagggcat

SEQ ID NO: 403756 - DNA, 25 bp, Rattus norvegicus
gctatgagccctctgatccttaatt

SEQ ID NO: 403757 - DNA, 25 bp, Rattus norvegicus
gctatgagccctgtgatccttaatt

SEQ ID NO: 403758 - DNA, 25 bp, Rattus norvegicus
gctatgagcgcaaccagcagctgga

SEQ ID NO: 403759 - DNA, 25 bp, Rattus norvegicus
gctatgagcgcatccagcagctgga

SEQ ID NO: 403760 - DNA, 25 bp, Rattus norvegicus
gctatgatccacagaagcagctcat

SEQ ID NO: 403761 - DNA, 25 bp, Rattus norvegicus
gctatgatccactgaagcagctcat

SEQ ID NO: 403762 - DNA, 25 bp, Rattus norvegicus
gctatgatctaaatcctcagtgtat

SEQ ID NO: 403763 - DNA, 25 bp, Rattus norvegicus
gctatgatctaattcctcagtgtat

SEQ ID NO: 403764 - DNA, 25 bp, Rattus norvegicus
gctatgatgaaccatccccagatgt

SEQ ID NO: 403765 - DNA, 25 bp, Rattus norvegicus
gctatgatgaacgatccccagatgt

SEQ ID NO: 403766 - DNA, 25 bp, Rattus norvegicus
gctatgatgcttatacacagtattt

SEQ ID NO: 403767 - DNA, 25 bp, Rattus norvegicus
gctatgatgcttttacacagtattt

SEQ ID NO: 403768 - DNA, 25 bp, Rattus norvegicus
gctatgattgtaatgtgcgttctta

SEQ ID NO: 403769 - DNA, 25 bp, Rattus norvegicus
gctatgattgtattgtgcgttctta

SEQ ID NO: 403770 - DNA, 25 bp, Rattus norvegicus
gctatgcaagccagatgtccagagt

SEQ ID NO: 403771 - DNA, 25 bp, Rattus norvegicus
gctatgcaagccagggttcaaactt

SEQ ID NO: 403772 - DNA, 25 bp, Rattus norvegicus
gctatgcaagcctgatgtccagagt

SEQ ID NO: 403773 - DNA, 25 bp, Rattus norvegicus
gctatgcaagcctgggttcaaactt

SEQ ID NO: 403774 - DNA, 25 bp, Rattus norvegicus
gctatgcagggacatgcagccctga

SEQ ID NO: 403775 - DNA, 25 bp, Rattus norvegicus
gctatgcagggagatgcagccctga

SEQ ID NO: 403776 - DNA, 25 bp, Rattus norvegicus
gctatgcagtagacgtcgggccatg

SEQ ID NO: 403777 - DNA, 25 bp, Rattus norvegicus
gctatgcagtagtcgtcgggccatg

SEQ ID NO: 403778 - DNA, 25 bp, Rattus norvegicus
gctatgcatgccctgtggacaaagt

SEQ ID NO: 403779 - DNA, 25 bp, Rattus norvegicus
gctatgcatgccgtgtggacaaagt

SEQ ID NO: 403780 - DNA, 25 bp, Rattus norvegicus
gctatgcattttacgtgtttgggtc

SEQ ID NO: 403781 - DNA, 25 bp, Rattus norvegicus
gctatgcatttttcgtgtttgggtc

SEQ ID NO: 403782 - DNA, 25 bp, Rattus norvegicus
gctatgccaaaacccactgtgctgg

SEQ ID NO: 403783 - DNA, 25 bp, Rattus norvegicus
gctatgccaaaagccactgtgctgg

SEQ ID NO: 403784 - DNA, 25 bp, Rattus norvegicus
gctatgccacacaactgcagcagat

SEQ ID NO: 403785 - DNA, 25 bp, Rattus norvegicus
gctatgccacactactgcagcagat

SEQ ID NO: 403786 - DNA, 25 bp, Rattus norvegicus
gctatgccaccaagctggctgaata

SEQ ID NO: 403787 - DNA, 25 bp, Rattus norvegicus
gctatgccaccatgctggctgaata

SEQ ID NO: 403788 - DNA, 25 bp, Rattus norvegicus
gctatgccgctgatactcataactt

SEQ ID NO: 403789 - DNA, 25 bp, Rattus norvegicus
gctatgccgctgttactcataactt

SEQ ID NO: 403790 - DNA, 25 bp, Rattus norvegicus
gctatgcctgctctgtagtggtaga

SEQ ID NO: 403791 - DNA, 25 bp, Rattus norvegicus
gctatgcctgctgtgtagtggtaga

SEQ ID NO: 403792 - DNA, 25 bp, Rattus norvegicus
gctatgccttgtatagtgtatccaa

SEQ ID NO: 403793 - DNA, 25 bp, Rattus norvegicus
gctatgccttgtttagtgtatccaa

SEQ ID NO: 403794 - DNA, 25 bp, Rattus norvegicus
gctatgcggccaacagaaaggctca

SEQ ID NO: 403795 - DNA, 25 bp, Rattus norvegicus
gctatgcggccaatcgggaaggaac

SEQ ID NO: 403796 - DNA, 25 bp, Rattus norvegicus
gctatgcggccatcagaaaggctca

SEQ ID NO: 403797 - DNA, 25 bp, Rattus norvegicus
gctatgcggccattcgggaaggaac

SEQ ID NO: 403798 - DNA, 25 bp, Rattus norvegicus
gctatgcgtgatcgcacatacccat

SEQ ID NO: 403799 - DNA, 25 bp, Rattus norvegicus
gctatgcgtgatggcacatacccat

SEQ ID NO: 403800 - DNA, 25 bp, Rattus norvegicus
gctatgctaaccctctgtcaataaa

SEQ ID NO: 403801 - DNA, 25 bp, Rattus norvegicus
gctatgctaaccgtctgtcaataaa

SEQ ID NO: 403802 - DNA, 25 bp, Rattus norvegicus
gctatgctagctatcagtgccttga

SEQ ID NO: 403803 - DNA, 25 bp, Rattus norvegicus
gctatgctagctttcagtgccttga

SEQ ID NO: 403804 - DNA, 25 bp, Rattus norvegicus
gctatgctatatcatgctgttttca

SEQ ID NO: 403805 - DNA, 25 bp, Rattus norvegicus
gctatgctatatgatgctgttttca

SEQ ID NO: 403806 - DNA, 25 bp, Rattus norvegicus
gctatgctgtaaaccgctgtgttaa

SEQ ID NO: 403807 - DNA, 25 bp, Rattus norvegicus
gctatgctgtaatccgctgtgttaa

SEQ ID NO: 403808 - DNA, 25 bp, Rattus norvegicus
gctatgctgtgaaccatgcagttaa

SEQ ID NO: 403809 - DNA, 25 bp, Rattus norvegicus
gctatgctgtgatccatgcagttaa

SEQ ID NO: 403810 - DNA, 25 bp, Rattus norvegicus
gctatgcttgcactatcttctccag

SEQ ID NO: 403811 - DNA, 25 bp, Rattus norvegicus
gctatgcttgcagtatcttctccag

SEQ ID NO: 403812 - DNA, 25 bp, Rattus norvegicus
gctatgcttgctagactttgtctga

SEQ ID NO: 403813 - DNA, 25 bp, Rattus norvegicus
gctatgcttgcttgactttgtctga

SEQ ID NO: 403814 - DNA, 25 bp, Rattus norvegicus
gctatgctttttactgccacaaaac

SEQ ID NO: 403815 - DNA, 25 bp, Rattus norvegicus
gctatgcttttttctgccacaaaac

SEQ ID NO: 403816 - DNA, 25 bp, Rattus norvegicus
gctatggaacctctacatctcgtca

SEQ ID NO: 403817 - DNA, 25 bp, Rattus norvegicus
gctatggaacctgtacatctcgtca

SEQ ID NO: 403818 - DNA, 25 bp, Rattus norvegicus
gctatggaactacagctcagcctcc

SEQ ID NO: 403819 - DNA, 25 bp, Rattus norvegicus
gctatggaactagagctcagcctcc

SEQ ID NO: 403820 - DNA, 25 bp, Rattus norvegicus
gctatggaccttacatttcttttca

SEQ ID NO: 403821 - DNA, 25 bp, Rattus norvegicus
gctatggacctttcatttcttttca

SEQ ID NO: 403822 - DNA, 25 bp, Rattus norvegicus
gctatggatagcaatgtggcattat

SEQ ID NO: 403823 - DNA, 25 bp, Rattus norvegicus
gctatggatagctatgtggcattat

SEQ ID NO: 403824 - DNA, 25 bp, Rattus norvegicus
gctatggcagccatgtgatcagttc

SEQ ID NO: 403825 - DNA, 25 bp, Rattus norvegicus
gctatggcagccttgtgatcagttc

SEQ ID NO: 403826 - DNA, 25 bp, Rattus norvegicus
gctatggcagctcaaatggcagccc

SEQ ID NO: 403827 - DNA, 25 bp, Rattus norvegicus
gctatggcagctgaaatggcagccc

SEQ ID NO: 403828 - DNA, 25 bp, Rattus norvegicus
gctatggccgtgagctccgaagaat

SEQ ID NO: 403829 - DNA, 25 bp, Rattus norvegicus
gctatggccgtgtgctccgaagaat

SEQ ID NO: 403830 - DNA, 25 bp, Rattus norvegicus
gctatggctctcattattttcacaa

SEQ ID NO: 403831 - DNA, 25 bp, Rattus norvegicus
gctatggctctctttattttcacaa

SEQ ID NO: 403832 - DNA, 25 bp, Rattus norvegicus
gctatggctgcaatggctacatcgt

SEQ ID NO: 403833 - DNA, 25 bp, Rattus norvegicus
gctatggctgcattggctacatcgt

SEQ ID NO: 403834 - DNA, 25 bp, Rattus norvegicus
gctatgggactaaggcaaggcctga

SEQ ID NO: 403835 - DNA, 25 bp, Rattus norvegicus
gctatgggactatggcaaggcctga

SEQ ID NO: 403836 - DNA, 25 bp, Rattus norvegicus
gctatgggatgaacaggcctgctag

SEQ ID NO: 403837 - DNA, 25 bp, Rattus norvegicus
gctatgggatgatcaggcctgctag

SEQ ID NO: 403838 - DNA, 25 bp, Rattus norvegicus
gctatggtccccaaagaagagcagg

SEQ ID NO: 403839 - DNA, 25 bp, Rattus norvegicus
gctatggtcccctaagaagagcagg

SEQ ID NO: 403840 - DNA, 25 bp, Rattus norvegicus
gctatggtctctacctgtatttatg

SEQ ID NO: 403841 - DNA, 25 bp, Rattus norvegicus
gctatggtctcttcctgtatttatg

SEQ ID NO: 403842 - DNA, 25 bp, Rattus norvegicus
gctatggtcttgaacttacagtgcc

SEQ ID NO: 403843 - DNA, 25 bp, Rattus norvegicus
gctatggtcttgtacttacagtgcc

SEQ ID NO: 403844 - DNA, 25 bp, Rattus norvegicus
gctatggtggccatcagtattctga

SEQ ID NO: 403845 - DNA, 25 bp, Rattus norvegicus
gctatggtggccttcagtattctga

SEQ ID NO: 403846 - DNA, 25 bp, Rattus norvegicus
gctatggtggttatctgcggcgtca

SEQ ID NO: 403847 - DNA, 25 bp, Rattus norvegicus
gctatggtggttttctgcggcgtca

SEQ ID NO: 403848 - DNA, 25 bp, Rattus norvegicus
gctatggtttcaatacctaccgtta

SEQ ID NO: 403849 - DNA, 25 bp, Rattus norvegicus
gctatggtttcattacctaccgtta

SEQ ID NO: 403850 - DNA, 25 bp, Rattus norvegicus
gctatgtaacttccgtttttgtgta

SEQ ID NO: 403851 - DNA, 25 bp, Rattus norvegicus
gctatgtaacttgcgtttttgtgta

SEQ ID NO: 403852 - DNA, 25 bp, Rattus norvegicus
gctatgtaccatactttgctaacaa

SEQ ID NO: 403853 - DNA, 25 bp, Rattus norvegicus
gctatgtaccattctttgctaacaa

SEQ ID NO: 403854 - DNA, 25 bp, Rattus norvegicus
gctatgtaccttactaatagaacat

SEQ ID NO: 403855 - DNA, 25 bp, Rattus norvegicus
gctatgtacctttctaatagaacat

SEQ ID NO: 403856 - DNA, 25 bp, Rattus norvegicus
gctatgtagacaatactgcctcgaa

SEQ ID NO: 403857 - DNA, 25 bp, Rattus norvegicus
gctatgtagacattactgcctcgaa

SEQ ID NO: 403858 - DNA, 25 bp, Rattus norvegicus
gctatgtagccaatctgcatttcca

SEQ ID NO: 403859 - DNA, 25 bp, Rattus norvegicus
gctatgtagccattctgcatttcca

SEQ ID NO: 403860 - DNA, 25 bp, Rattus norvegicus
gctatgtatttgaacccttaccttt

SEQ ID NO: 403861 - DNA, 25 bp, Rattus norvegicus
gctatgtatttgtacccttaccttt

SEQ ID NO: 403862 - DNA, 25 bp, Rattus norvegicus
gctatgtcccacagaagcacagaaa

SEQ ID NO: 403863 - DNA, 25 bp, Rattus norvegicus
gctatgtcccactgaagcacagaaa

SEQ ID NO: 403864 - DNA, 25 bp, Rattus norvegicus
gctatgtccctcactggaaggtgca

SEQ ID NO: 403865 - DNA, 25 bp, Rattus norvegicus
gctatgtccctctctggaaggtgca

SEQ ID NO: 403866 - DNA, 25 bp, Rattus norvegicus
gctatgtccttcactgttgggctgg

SEQ ID NO: 403867 - DNA, 25 bp, Rattus norvegicus
gctatgtccttctctgttgggctgg

SEQ ID NO: 403868 - DNA, 25 bp, Rattus norvegicus
gctatgtctttaaaactgagtcaat

SEQ ID NO: 403869 - DNA, 25 bp, Rattus norvegicus
gctatgtctttataactgagtcaat

SEQ ID NO: 403870 - DNA, 25 bp, Rattus norvegicus
gctatgttcactatatcccaatcaa

SEQ ID NO: 403871 - DNA, 25 bp, Rattus norvegicus
gctatgttcactttatcccaatcaa

SEQ ID NO: 403872 - DNA, 25 bp, Rattus norvegicus
gctatgttcatgagcattcagatgg

SEQ ID NO: 403873 - DNA, 25 bp, Rattus norvegicus
gctatgttcatgtgcattcagatgg

SEQ ID NO: 403874 - DNA, 25 bp, Rattus norvegicus
gctatgttctacactcagctatgaa

SEQ ID NO: 403875 - DNA, 25 bp, Rattus norvegicus
gctatgttctactctcagctatgaa

SEQ ID NO: 403876 - DNA, 25 bp, Rattus norvegicus
gctatgttgctgcttgtttaatatc

SEQ ID NO: 403877 - DNA, 25 bp, Rattus norvegicus
gctatgttgctggttgtttaatatc

SEQ ID NO: 403878 - DNA, 25 bp, Rattus norvegicus
gctatgtttcctaagttttgcacta

SEQ ID NO: 403879 - DNA, 25 bp, Rattus norvegicus
gctatgtttccttagttttgcacta

SEQ ID NO: 403880 - DNA, 25 bp, Rattus norvegicus
gctattaagaacaaggacatcctga

SEQ ID NO: 403881 - DNA, 25 bp, Rattus norvegicus
gctattaagaactaggacatcctga

SEQ ID NO: 403882 - DNA, 25 bp, Rattus norvegicus
gctattaattctacagtctgcattc

SEQ ID NO: 403883 - DNA, 25 bp, Rattus norvegicus
gctattaattcttcagtctgcattc

SEQ ID NO: 403884 - DNA, 25 bp, Rattus norvegicus
gctattacatgtatgcccagggtgc

SEQ ID NO: 403885 - DNA, 25 bp, Rattus norvegicus
gctattacatgtttgcccagggtgc

SEQ ID NO: 403886 - DNA, 25 bp, Rattus norvegicus
gctattactggtactctttggaaag

SEQ ID NO: 403887 - DNA, 25 bp, Rattus norvegicus
gctattactggttctctttggaaag

SEQ ID NO: 403888 - DNA, 25 bp, Rattus norvegicus
gctattagcctaaatcacatggagt

SEQ ID NO: 403889 - DNA, 25 bp, Rattus norvegicus
gctattagcctatatcacatggagt

SEQ ID NO: 403890 - DNA, 25 bp, Rattus norvegicus
gctattaggatcagtttgctgtgca

SEQ ID NO: 403891 - DNA, 25 bp, Rattus norvegicus
gctattaggatctgtttgctgtgca

SEQ ID NO: 403892 - DNA, 25 bp, Rattus norvegicus
gctattatatgtcggtgctggaagt

SEQ ID NO: 403893 - DNA, 25 bp, Rattus norvegicus
gctattatatgtgggtgctggaagt

SEQ ID NO: 403894 - DNA, 25 bp, Rattus norvegicus
gctattatcaagctgcatttccaaa

SEQ ID NO: 403895 - DNA, 25 bp, Rattus norvegicus
gctattatcaaggtgcatttccaaa

SEQ ID NO: 403896 - DNA, 25 bp, Rattus norvegicus
gctattatctgtattttcatccata

SEQ ID NO: 403897 - DNA, 25 bp, Rattus norvegicus
gctattatctgttttttcatccata

SEQ ID NO: 403898 - DNA, 25 bp, Rattus norvegicus
gctattcaccaacaccctatgtcaa

SEQ ID NO: 403899 - DNA, 25 bp, Rattus norvegicus
gctattcaccaagaccctatgtcaa

SEQ ID NO: 403900 - DNA, 25 bp, Rattus norvegicus
gctattcagtgcaagctctatcaat

SEQ ID NO: 403901 - DNA, 25 bp, Rattus norvegicus
gctattcagtgccaaagctctgtca

SEQ ID NO: 403902 - DNA, 25 bp, Rattus norvegicus
gctattcagtgcgaaagctctgtca

SEQ ID NO: 403903 - DNA, 25 bp, Rattus norvegicus
gctattcagtgctagctctatcaat

SEQ ID NO: 403904 - DNA, 25 bp, Rattus norvegicus
gctattcattctctcaaagggcttt

SEQ ID NO: 403905 - DNA, 25 bp, Rattus norvegicus
gctattcattctgtcaaagggcttt

SEQ ID NO: 403906 - DNA, 25 bp, Rattus norvegicus
gctattccaagtcaaggatggcttc

SEQ ID NO: 403907 - DNA, 25 bp, Rattus norvegicus
gctattccaagtgaaggatggcttc

SEQ ID NO: 403908 - DNA, 25 bp, Rattus norvegicus
gctattccatagcacttaaccgtag

SEQ ID NO: 403909 - DNA, 25 bp, Rattus norvegicus
gctattccataggacttaaccgtag

SEQ ID NO: 403910 - DNA, 25 bp, Rattus norvegicus
gctattccctatccaacagatgatc

SEQ ID NO: 403911 - DNA, 25 bp, Rattus norvegicus
gctattccctatgcaacagatgatc

SEQ ID NO: 403912 - DNA, 25 bp, Rattus norvegicus
gctattcctggcaggaggcacttgt

SEQ ID NO: 403913 - DNA, 25 bp, Rattus norvegicus
gctattcctggctggaggcacttgt

SEQ ID NO: 403914 - DNA, 25 bp, Rattus norvegicus
gctattcctttgagatgcacaccag

SEQ ID NO: 403915 - DNA, 25 bp, Rattus norvegicus
gctattcctttgtgatgcacaccag

SEQ ID NO: 403916 - DNA, 25 bp, Rattus norvegicus
gctattccttttctataatgaccac

SEQ ID NO: 403917 - DNA, 25 bp, Rattus norvegicus
gctattccttttgtataatgaccac

SEQ ID NO: 403918 - DNA, 25 bp, Rattus norvegicus
gctattcggaaaatctgaccctcaa

SEQ ID NO: 403919 - DNA, 25 bp, Rattus norvegicus
gctattcggaaattctgaccctcaa

SEQ ID NO: 403920 - DNA, 25 bp, Rattus norvegicus
gctattcgtaagatccgtgcagttt

SEQ ID NO: 403921 - DNA, 25 bp, Rattus norvegicus
gctattcgtaagttccgtgcagttt

SEQ ID NO: 403922 - DNA, 25 bp, Rattus norvegicus
gctattctaagacactcagggctcc

SEQ ID NO: 403923 - DNA, 25 bp, Rattus norvegicus
gctattctaagagactcagggctcc

SEQ ID NO: 403924 - DNA, 25 bp, Rattus norvegicus
gctattctagcacaaaagtcttggg

SEQ ID NO: 403925 - DNA, 25 bp, Rattus norvegicus
gctattctagcagaaaagtcttggg

SEQ ID NO: 403926 - DNA, 25 bp, Rattus norvegicus
gctattctatggcttacggccgtgc

SEQ ID NO: 403927 - DNA, 25 bp, Rattus norvegicus
gctattctatgggttacggccgtgc

SEQ ID NO: 403928 - DNA, 25 bp, Rattus norvegicus
gctattctcttacacgtgttccgaa

SEQ ID NO: 403929 - DNA, 25 bp, Rattus norvegicus
gctattctcttagacgtgttccgaa

SEQ ID NO: 403930 - DNA, 25 bp, Rattus norvegicus
gctattctgataatatgtcccattc

SEQ ID NO: 403931 - DNA, 25 bp, Rattus norvegicus
gctattctgatattatgtcccattc

SEQ ID NO: 403932 - DNA, 25 bp, Rattus norvegicus
gctattctgattaccaagaccttag

SEQ ID NO: 403933 - DNA, 25 bp, Rattus norvegicus
gctattctgatttccaagaccttag

SEQ ID NO: 403934 - DNA, 25 bp, Rattus norvegicus
gctattctgtccagtttctttgcaa

SEQ ID NO: 403935 - DNA, 25 bp, Rattus norvegicus
gctattctgtcctgtttctttgcaa

SEQ ID NO: 403936 - DNA, 25 bp, Rattus norvegicus
gctattctgtgtaactcaggctctt

SEQ ID NO: 403937 - DNA, 25 bp, Rattus norvegicus
gctattctgtgttactcaggctctt

SEQ ID NO: 403938 - DNA, 25 bp, Rattus norvegicus
gctattctttaacctattggccaat

SEQ ID NO: 403939 - DNA, 25 bp, Rattus norvegicus
gctattctttaagctattggccaat

SEQ ID NO: 403940 - DNA, 25 bp, Rattus norvegicus
gctattgacataaccactcttcgaa

SEQ ID NO: 403941 - DNA, 25 bp, Rattus norvegicus
gctattgacatatccactcttcgaa

SEQ ID NO: 403942 - DNA, 25 bp, Rattus norvegicus
gctattgatatcaggccaacgctgt

SEQ ID NO: 403943 - DNA, 25 bp, Rattus norvegicus
gctattgatatctggccaacgctgt

SEQ ID NO: 403944 - DNA, 25 bp, Rattus norvegicus
gctattgattatattcagtctccca

SEQ ID NO: 403945 - DNA, 25 bp, Rattus norvegicus
gctattgattattttcagtctccca

SEQ ID NO: 403946 - DNA, 25 bp, Rattus norvegicus
gctattgcatttacagattgacccg

SEQ ID NO: 403947 - DNA, 25 bp, Rattus norvegicus
gctattgcattttcagattgacccg

SEQ ID NO: 403948 - DNA, 25 bp, Rattus norvegicus
gctattgccatgataatgcccttta

SEQ ID NO: 403949 - DNA, 25 bp, Rattus norvegicus
gctattgccatgttaatgcccttta

SEQ ID NO: 403950 - DNA, 25 bp, Rattus norvegicus
gctattgcggctcttctgtaatgtt

SEQ ID NO: 403951 - DNA, 25 bp, Rattus norvegicus
gctattgcggctgttctgtaatgtt

SEQ ID NO: 403952 - DNA, 25 bp, Rattus norvegicus
gctattgctcctagtaccctggaag

SEQ ID NO: 403953 - DNA, 25 bp, Rattus norvegicus
gctattgctccttgtaccctggaag

SEQ ID NO: 403954 - DNA, 25 bp, Rattus norvegicus
gctattgctgtaaataccatttggt

SEQ ID NO: 403955 - DNA, 25 bp, Rattus norvegicus
gctattgctgtatataccatttggt

SEQ ID NO: 403956 - DNA, 25 bp, Rattus norvegicus
gctattggcctaactgtgtaacttt

SEQ ID NO: 403957 - DNA, 25 bp, Rattus norvegicus
gctattggcctatctgtgtaacttt

SEQ ID NO: 403958 - DNA, 25 bp, Rattus norvegicus
gctattggtcggcttcttggaagat

SEQ ID NO: 403959 - DNA, 25 bp, Rattus norvegicus
gctattggtcgggttcttggaagat

SEQ ID NO: 403960 - DNA, 25 bp, Rattus norvegicus
gctattgtacacatcaagggaatga

SEQ ID NO: 403961 - DNA, 25 bp, Rattus norvegicus
gctattgtacacttcaagggaatga

SEQ ID NO: 403962 - DNA, 25 bp, Rattus norvegicus
gctattgtccttaatggtttttgct

SEQ ID NO: 403963 - DNA, 25 bp, Rattus norvegicus
gctattgtcctttatggtttttgct

SEQ ID NO: 403964 - DNA, 25 bp, Rattus norvegicus
gctattgtctctcgtgcagtggaaa

SEQ ID NO: 403965 - DNA, 25 bp, Rattus norvegicus
gctattgtctctggtgcagtggaaa

SEQ ID NO: 403966 - DNA, 25 bp, Rattus norvegicus
gctattgttggcatccaagctcagt

SEQ ID NO: 403967 - DNA, 25 bp, Rattus norvegicus
gctattgttggcttccaagctcagt

SEQ ID NO: 403968 - DNA, 25 bp, Rattus norvegicus
gctattgtttatcctacccacagag

SEQ ID NO: 403969 - DNA, 25 bp, Rattus norvegicus
gctattgtttatgctacccacagag

SEQ ID NO: 403970 - DNA, 25 bp, Rattus norvegicus
gctatttaatgtctcagtgtatcta

SEQ ID NO: 403971 - DNA, 25 bp, Rattus norvegicus
gctatttaatgtgtcagtgtatcta

SEQ ID NO: 403972 - DNA, 25 bp, Rattus norvegicus
gctatttagagcctttgacatcctt

SEQ ID NO: 403973 - DNA, 25 bp, Rattus norvegicus
gctatttagagcgtttgacatcctt

SEQ ID NO: 403974 - DNA, 25 bp, Rattus norvegicus
gctatttatttaaacccgtggtggc

SEQ ID NO: 403975 - DNA, 25 bp, Rattus norvegicus
gctatttatttatacccgtggtggc

SEQ ID NO: 403976 - DNA, 25 bp, Rattus norvegicus
gctatttcaagcatcaatggcctct

SEQ ID NO: 403977 - DNA, 25 bp, Rattus norvegicus
gctatttcaagcttcaatggcctct

SEQ ID NO: 403978 - DNA, 25 bp, Rattus norvegicus
gctatttcacctctaagccgaacta

SEQ ID NO: 403979 - DNA, 25 bp, Rattus norvegicus
gctatttcacctgtaagccgaacta

SEQ ID NO: 403980 - DNA, 25 bp, Rattus norvegicus
gctatttccaagcatgcgtgaaggg

SEQ ID NO: 403981 - DNA, 25 bp, Rattus norvegicus
gctatttccaaggatgcgtgaaggg

SEQ ID NO: 403982 - DNA, 25 bp, Rattus norvegicus
gctatttcccacaaaattcaccttt

SEQ ID NO: 403983 - DNA, 25 bp, Rattus norvegicus
gctatttcccactaaattcaccttt

SEQ ID NO: 403984 - DNA, 25 bp, Rattus norvegicus
gctatttcctaacctgcaggcagaa

SEQ ID NO: 403985 - DNA, 25 bp, Rattus norvegicus
gctatttcctaagctgcaggcagaa

SEQ ID NO: 403986 - DNA, 25 bp, Rattus norvegicus
gctatttcggtaacttacttctctc

SEQ ID NO: 403987 - DNA, 25 bp, Rattus norvegicus
gctatttcggtatcttacttctctc

SEQ ID NO: 403988 - DNA, 25 bp, Rattus norvegicus
gctatttcggttcatcatggctgat

SEQ ID NO: 403989 - DNA, 25 bp, Rattus norvegicus
gctatttcggttgatcatggctgat

SEQ ID NO: 403990 - DNA, 25 bp, Rattus norvegicus
gctatttctaaaatccactttcctt

SEQ ID NO: 403991 - DNA, 25 bp, Rattus norvegicus
gctatttctaaattccactttcctt

SEQ ID NO: 403992 - DNA, 25 bp, Rattus norvegicus
gctatttctttccactgggtaaatg

SEQ ID NO: 403993 - DNA, 25 bp, Rattus norvegicus
gctatttctttcgactgggtaaatg

SEQ ID NO: 403994 - DNA, 25 bp, Rattus norvegicus
gctatttgaaacaggctcccaggtt

SEQ ID NO: 403995 - DNA, 25 bp, Rattus norvegicus
gctatttgaaactggctcccaggtt

SEQ ID NO: 403996 - DNA, 25 bp, Rattus norvegicus
gctatttgaatacggtggctcagtt

SEQ ID NO: 403997 - DNA, 25 bp, Rattus norvegicus
gctatttgaatagggtggctcagtt

SEQ ID NO: 403998 - DNA, 25 bp, Rattus norvegicus
gctatttgacgcaggtaactgacaa

SEQ ID NO: 403999 - DNA, 25 bp, Rattus norvegicus
gctatttgacgctggtaactgacaa

SEQ ID NO: 404000 - DNA, 25 bp, Rattus norvegicus
gctatttgctgaccgtgcatgccca

SEQ ID NO: 404001 - DNA, 25 bp, Rattus norvegicus
gctatttgctgagcgtgcatgccca

SEQ ID NO: 404002 - DNA, 25 bp, Rattus norvegicus
gctatttgtaggaggtccctggtat

SEQ ID NO: 404003 - DNA, 25 bp, Rattus norvegicus
gctatttgtaggtggtccctggtat

SEQ ID NO: 404004 - DNA, 25 bp, Rattus norvegicus
gctatttgtcagatgttatgtcctt

SEQ ID NO: 404005 - DNA, 25 bp, Rattus norvegicus
gctatttgtcagttgttatgtcctt

SEQ ID NO: 404006 - DNA, 25 bp, Rattus norvegicus
gctatttgttgtaagactggctgca

SEQ ID NO: 404007 - DNA, 25 bp, Rattus norvegicus
gctatttgttgttagactggctgca

SEQ ID NO: 404008 - DNA, 25 bp, Rattus norvegicus
gctattttagttacctcttgctgta

SEQ ID NO: 404009 - DNA, 25 bp, Rattus norvegicus
gctattttagtttcctcttgctgta

SEQ ID NO: 404010 - DNA, 25 bp, Rattus norvegicus
gctattttcatgctccgggatggga

SEQ ID NO: 404011 - DNA, 25 bp, Rattus norvegicus
gctattttcatggtccgggatggga

SEQ ID NO: 404012 - DNA, 25 bp, Rattus norvegicus
gctattttccacaccttacagataa

SEQ ID NO: 404013 - DNA, 25 bp, Rattus norvegicus
gctattttccactccttacagataa

SEQ ID NO: 404014 - DNA, 25 bp, Rattus norvegicus
gctattttcctaccacagtgttgag

SEQ ID NO: 404015 - DNA, 25 bp, Rattus norvegicus
gctattttcctagcacagtgttgag

SEQ ID NO: 404016 - DNA, 25 bp, Rattus norvegicus
gctattttgggaatgtgtgtattat

SEQ ID NO: 404017 - DNA, 25 bp, Rattus norvegicus
gctattttgggattgtgtgtattat

SEQ ID NO: 404018 - DNA, 25 bp, Rattus norvegicus
gctattttgttcctttgcttacttt

SEQ ID NO: 404019 - DNA, 25 bp, Rattus norvegicus
gctattttgttcgtttgcttacttt

SEQ ID NO: 404020 - DNA, 25 bp, Rattus norvegicus
gctatttttaatatcctgtgaggag

SEQ ID NO: 404021 - DNA, 25 bp, Rattus norvegicus
gctatttttaatttcctgtgaggag

SEQ ID NO: 404022 - DNA, 25 bp, Rattus norvegicus
gctatttttagtacgcatcatgacc

SEQ ID NO: 404023 - DNA, 25 bp, Rattus norvegicus
gctatttttagttcgcatcatgacc

SEQ ID NO: 404024 - DNA, 25 bp, Rattus norvegicus
gctatttttgctaatgattccagag

SEQ ID NO: 404025 - DNA, 25 bp, Rattus norvegicus
gctatttttgcttatgattccagag

SEQ ID NO: 404026 - DNA, 25 bp, Rattus norvegicus
gctatttttggtacgattcctgtca

SEQ ID NO: 404027 - DNA, 25 bp, Rattus norvegicus
gctatttttggttcgattcctgtca

SEQ ID NO: 404028 - DNA, 25 bp, Rattus norvegicus
gctatttttgtgacagttcctgcag

SEQ ID NO: 404029 - DNA, 25 bp, Rattus norvegicus
gctatttttgtgtcagttcctgcag

SEQ ID NO: 404030 - DNA, 25 bp, Rattus norvegicus
gctcaaaaaggacaagttcgccttc

SEQ ID NO: 404031 - DNA, 25 bp, Rattus norvegicus
gctcaaaaaggagaagttcgccttc

SEQ ID NO: 404032 - DNA, 25 bp, Rattus norvegicus
gctcaaaaccgacttcctttaatca

SEQ ID NO: 404033 - DNA, 25 bp, Rattus norvegicus
gctcaaaaccgagttcctttaatca

SEQ ID NO: 404034 - DNA, 25 bp, Rattus norvegicus
gctcaaaagccacccggatcacaaa

SEQ ID NO: 404035 - DNA, 25 bp, Rattus norvegicus
gctcaaaagccagccggatcacaaa

SEQ ID NO: 404036 - DNA, 25 bp, Rattus norvegicus
gctcaaacatatacattgctgctat

SEQ ID NO: 404037 - DNA, 25 bp, Rattus norvegicus
gctcaaacatattcattgctgctat

SEQ ID NO: 404038 - DNA, 25 bp, Rattus norvegicus
gctcaaactcttatttctccacaaa

SEQ ID NO: 404039 - DNA, 25 bp, Rattus norvegicus
gctcaaactcttttttctccacaaa

SEQ ID NO: 404040 - DNA, 25 bp, Rattus norvegicus
gctcaaactgggactgctgcaaatt

SEQ ID NO: 404041 - DNA, 25 bp, Rattus norvegicus
gctcaaactgggtctgctgcaaatt

SEQ ID NO: 404042 - DNA, 25 bp, Rattus norvegicus
gctcaaactgttcctggattgtcaa

SEQ ID NO: 404043 - DNA, 25 bp, Rattus norvegicus
gctcaaactgttgctggattgtcaa

SEQ ID NO: 404044 - DNA, 25 bp, Rattus norvegicus
gctcaaagagctctttaccctggat

SEQ ID NO: 404045 - DNA, 25 bp, Rattus norvegicus
gctcaaagagctgtttaccctggat

SEQ ID NO: 404046 - DNA, 25 bp, Rattus norvegicus
gctcaaagtgacaaggtgactctgg

SEQ ID NO: 404047 - DNA, 25 bp, Rattus norvegicus
gctcaaagtgactaggtgactctgg

SEQ ID NO: 404048 - DNA, 25 bp, Rattus norvegicus
gctcaaataatacgcagcagctttc

SEQ ID NO: 404049 - DNA, 25 bp, Rattus norvegicus
gctcaaataataggcagcagctttc

SEQ ID NO: 404050 - DNA, 25 bp, Rattus norvegicus
gctcaaatctagattctgggctcta

SEQ ID NO: 404051 - DNA, 25 bp, Rattus norvegicus
gctcaaatctagtttctgggctcta

SEQ ID NO: 404052 - DNA, 25 bp, Rattus norvegicus
gctcaaatgagaactttccaggccc

SEQ ID NO: 404053 - DNA, 25 bp, Rattus norvegicus
gctcaaatgagatctttccaggccc

SEQ ID NO: 404054 - DNA, 25 bp, Rattus norvegicus
gctcaaatgtgtaactctgttactg

SEQ ID NO: 404055 - DNA, 25 bp, Rattus norvegicus
gctcaaatgtgttactctgttactg

SEQ ID NO: 404056 - DNA, 25 bp, Rattus norvegicus
gctcaaattgctcaacacccagtct

SEQ ID NO: 404057 - DNA, 25 bp, Rattus norvegicus
gctcaaattgctgaacacccagtct

SEQ ID NO: 404058 - DNA, 25 bp, Rattus norvegicus
gctcaacaatttcgacaaggtcctg

SEQ ID NO: 404059 - DNA, 25 bp, Rattus norvegicus
gctcaacaatttggacaaggtcctg

SEQ ID NO: 404060 - DNA, 25 bp, Rattus norvegicus
gctcaacacgagagcctcaggatat

SEQ ID NO: 404061 - DNA, 25 bp, Rattus norvegicus
gctcaacacgagtgcctcaggatat

SEQ ID NO: 404062 - DNA, 25 bp, Rattus norvegicus
gctcaaccacacagcagaagtctgt

SEQ ID NO: 404063 - DNA, 25 bp, Rattus norvegicus
gctcaaccacactgcagaagtctgt

SEQ ID NO: 404064 - DNA, 25 bp, Rattus norvegicus
gctcaacgacaaatcaggccctgaa

SEQ ID NO: 404065 - DNA, 25 bp, Rattus norvegicus
gctcaacgacaattcaggccctgaa

SEQ ID NO: 404066 - DNA, 25 bp, Rattus norvegicus
gctcaacgttttatcctttgctgaa

SEQ ID NO: 404067 - DNA, 25 bp, Rattus norvegicus
gctcaacgttttttcctttgctgaa

SEQ ID NO: 404068 - DNA, 25 bp, Rattus norvegicus
gctcaactatttatccatgcttcaa

SEQ ID NO: 404069 - DNA, 25 bp, Rattus norvegicus
gctcaactatttttccatgcttcaa

SEQ ID NO: 404070 - DNA, 25 bp, Rattus norvegicus
gctcaactgaaacaggctcgggtca

SEQ ID NO: 404071 - DNA, 25 bp, Rattus norvegicus
gctcaactgaaagaggctcgggtca

SEQ ID NO: 404072 - DNA, 25 bp, Rattus norvegicus
gctcaactgtctaccaacatgggtt

SEQ ID NO: 404073 - DNA, 25 bp, Rattus norvegicus
gctcaactgtcttccaacatgggtt

SEQ ID NO: 404074 - DNA, 25 bp, Rattus norvegicus
gctcaactgtgaatctgtgcatcta

SEQ ID NO: 404075 - DNA, 25 bp, Rattus norvegicus
gctcaactgtgattctgtgcatcta

SEQ ID NO: 404076 - DNA, 25 bp, Rattus norvegicus
gctcaagaacatcggctatgccgcc

SEQ ID NO: 404077 - DNA, 25 bp, Rattus norvegicus
gctcaagaacatgggctatgccgcc

SEQ ID NO: 404078 - DNA, 25 bp, Rattus norvegicus
gctcaagaagcaagcaggcgtggac

SEQ ID NO: 404079 - DNA, 25 bp, Rattus norvegicus
gctcaagaagcaagcggccctttcg

SEQ ID NO: 404080 - DNA, 25 bp, Rattus norvegicus
gctcaagaagcatgcaggcgtggac

SEQ ID NO: 404081 - DNA, 25 bp, Rattus norvegicus
gctcaagaagcatgcggccctttcg

SEQ ID NO: 404082 - DNA, 25 bp, Rattus norvegicus
gctcaagagagcagtctagctttgt

SEQ ID NO: 404083 - DNA, 25 bp, Rattus norvegicus
gctcaagagagctgtctagctttgt

SEQ ID NO: 404084 - DNA, 25 bp, Rattus norvegicus
gctcaagatgttaaaggccctgggt

SEQ ID NO: 404085 - DNA, 25 bp, Rattus norvegicus
gctcaagatgtttaaggccctgggt

SEQ ID NO: 404086 - DNA, 25 bp, Rattus norvegicus
gctcaagccctacgttaattaccga

SEQ ID NO: 404087 - DNA, 25 bp, Rattus norvegicus
gctcaagccctaggttaattaccga

SEQ ID NO: 404088 - DNA, 25 bp, Rattus norvegicus
gctcaagctgacctgggccagagat

SEQ ID NO: 404089 - DNA, 25 bp, Rattus norvegicus
gctcaagctgacgtgggccagagat

SEQ ID NO: 404090 - DNA, 25 bp, Rattus norvegicus
gctcaagcttgtccagaacctgttt

SEQ ID NO: 404091 - DNA, 25 bp, Rattus norvegicus
gctcaagcttgtgcagaacctgttt

SEQ ID NO: 404092 - DNA, 25 bp, Rattus norvegicus
gctcaagctttaaggcctacacaga

SEQ ID NO: 404093 - DNA, 25 bp, Rattus norvegicus
gctcaagctttatggcctacacaga

SEQ ID NO: 404094 - DNA, 25 bp, Rattus norvegicus
gctcaaggacacaaggaaaccattc

SEQ ID NO: 404095 - DNA, 25 bp, Rattus norvegicus
gctcaaggacactaggaaaccattc

SEQ ID NO: 404096 - DNA, 25 bp, Rattus norvegicus
gctcaaggactgagcaagccaacag

SEQ ID NO: 404097 - DNA, 25 bp, Rattus norvegicus
gctcaaggactgtgcaagccaacag

SEQ ID NO: 404098 - DNA, 25 bp, Rattus norvegicus
gctcaaggaggccagccacaaggct

SEQ ID NO: 404099 - DNA, 25 bp, Rattus norvegicus
gctcaaggaggcgagccacaaggct

SEQ ID NO: 404100 - DNA, 25 bp, Rattus norvegicus
gctcaaggcctgagcgaggtgctat

SEQ ID NO: 404101 - DNA, 25 bp, Rattus norvegicus
gctcaaggcctgtgcgaggtgctat

SEQ ID NO: 404102 - DNA, 25 bp, Rattus norvegicus
gctcaaggcttccaaggtgtggatt

SEQ ID NO: 404103 - DNA, 25 bp, Rattus norvegicus
gctcaaggcttcgaaggtgtggatt

SEQ ID NO: 404104 - DNA, 25 bp, Rattus norvegicus
gctcaagggatccagctgccaatat

SEQ ID NO: 404105 - DNA, 25 bp, Rattus norvegicus
gctcaagggatcgagctgccaatat

SEQ ID NO: 404106 - DNA, 25 bp, Rattus norvegicus
gctcaaggttaacccactggcacga

SEQ ID NO: 404107 - DNA, 25 bp, Rattus norvegicus
gctcaaggttaagccactggcacga

SEQ ID NO: 404108 - DNA, 25 bp, Rattus norvegicus
gctcaagtaagcagggacaccagtg

SEQ ID NO: 404109 - DNA, 25 bp, Rattus norvegicus
gctcaagtaagctgggacaccagtg

SEQ ID NO: 404110 - DNA, 25 bp, Rattus norvegicus
gctcaagtacttcatgtgcctggtg

SEQ ID NO: 404111 - DNA, 25 bp, Rattus norvegicus
gctcaagtacttgatgtgcctggtg

SEQ ID NO: 404112 - DNA, 25 bp, Rattus norvegicus
gctcaagtagggaggcttccagcct

SEQ ID NO: 404113 - DNA, 25 bp, Rattus norvegicus
gctcaagtagggtggcttccagcct

SEQ ID NO: 404114 - DNA, 25 bp, Rattus norvegicus
gctcaagtatgcattgcagcacctc

SEQ ID NO: 404115 - DNA, 25 bp, Rattus norvegicus
gctcaagtatgctttgcagcacctc

SEQ ID NO: 404116 - DNA, 25 bp, Rattus norvegicus
gctcaagtctgtactgtgtgctttc

SEQ ID NO: 404117 - DNA, 25 bp, Rattus norvegicus
gctcaagtctgttctgtgtgctttc

SEQ ID NO: 404118 - DNA, 25 bp, Rattus norvegicus
gctcaagtgcagctccagaacagta

SEQ ID NO: 404119 - DNA, 25 bp, Rattus norvegicus
gctcaagtgcaggtccagaacagta

SEQ ID NO: 404120 - DNA, 25 bp, Rattus norvegicus
gctcaagtggcccacgagacgtcct

SEQ ID NO: 404121 - DNA, 25 bp, Rattus norvegicus
gctcaagtggccgacgagacgtcct

SEQ ID NO: 404122 - DNA, 25 bp, Rattus norvegicus
gctcaataaactaggcctcaacagt

SEQ ID NO: 404123 - DNA, 25 bp, Rattus norvegicus
gctcaataaacttggcctcaacagt

SEQ ID NO: 404124 - DNA, 25 bp, Rattus norvegicus
gctcaatactataggctcagccacc

SEQ ID NO: 404125 - DNA, 25 bp, Rattus norvegicus
gctcaatactattggctcagccacc

SEQ ID NO: 404126 - DNA, 25 bp, Rattus norvegicus
gctcaatctgttccctgactaattt

SEQ ID NO: 404127 - DNA, 25 bp, Rattus norvegicus
gctcaatctgttgcctgactaattt

SEQ ID NO: 404128 - DNA, 25 bp, Rattus norvegicus
gctcaatctttgacaggcctctgaa

SEQ ID NO: 404129 - DNA, 25 bp, Rattus norvegicus
gctcaatctttgtcaggcctctgaa

SEQ ID NO: 404130 - DNA, 25 bp, Rattus norvegicus
gctcaatgacaaaggaggcctccct

SEQ ID NO: 404131 - DNA, 25 bp, Rattus norvegicus
gctcaatgacaatggaggcctccct

SEQ ID NO: 404132 - DNA, 25 bp, Rattus norvegicus
gctcaatgatttccattcaggccgc

SEQ ID NO: 404133 - DNA, 25 bp, Rattus norvegicus
gctcaatgatttgcattcaggccgc

SEQ ID NO: 404134 - DNA, 25 bp, Rattus norvegicus
gctcaatgccttctctacgggaaag

SEQ ID NO: 404135 - DNA, 25 bp, Rattus norvegicus
gctcaatgccttgtctacgggaaag

SEQ ID NO: 404136 - DNA, 25 bp, Rattus norvegicus
gctcaatggtacagcttcacgactg

SEQ ID NO: 404137 - DNA, 25 bp, Rattus norvegicus
gctcaatggtactgcttcacgactg

SEQ ID NO: 404138 - DNA, 25 bp, Rattus norvegicus
gctcaatggttaagaggccctggat

SEQ ID NO: 404139 - DNA, 25 bp, Rattus norvegicus
gctcaatggttatgaggccctggat

SEQ ID NO: 404140 - DNA, 25 bp, Rattus norvegicus
gctcaatgtggcctcatctgactta

SEQ ID NO: 404141 - DNA, 25 bp, Rattus norvegicus
gctcaatgtggcgtcatctgactta

SEQ ID NO: 404142 - DNA, 25 bp, Rattus norvegicus
gctcaattattccagtacctcaggg

SEQ ID NO: 404143 - DNA, 25 bp, Rattus norvegicus
gctcaattattcgagtacctcaggg

SEQ ID NO: 404144 - DNA, 25 bp, Rattus norvegicus
gctcaattgagcacccaagacctgg

SEQ ID NO: 404145 - DNA, 25 bp, Rattus norvegicus
gctcaattgagctcccaagacctgg

SEQ ID NO: 404146 - DNA, 25 bp, Rattus norvegicus
gctcaattgccaagttttcccttta

SEQ ID NO: 404147 - DNA, 25 bp, Rattus norvegicus
gctcaattgccatgttttcccttta

SEQ ID NO: 404148 - DNA, 25 bp, Rattus norvegicus
gctcaatttagcaggtaacactaca

SEQ ID NO: 404149 - DNA, 25 bp, Rattus norvegicus
gctcaatttagctggtaacactaca

SEQ ID NO: 404150 - DNA, 25 bp, Rattus norvegicus
gctcacaagaaccaacctgcaataa

SEQ ID NO: 404151 - DNA, 25 bp, Rattus norvegicus
gctcacaagaacgaacctgcaataa

SEQ ID NO: 404152 - DNA, 25 bp, Rattus norvegicus
gctcacacacagaaggcttggtctt

SEQ ID NO: 404153 - DNA, 25 bp, Rattus norvegicus
gctcacacacagtaggcttggtctt

SEQ ID NO: 404154 - DNA, 25 bp, Rattus norvegicus
gctcacacccagatgacttttttaa

SEQ ID NO: 404155 - DNA, 25 bp, Rattus norvegicus
gctcacacccagttgacttttttaa

SEQ ID NO: 404156 - DNA, 25 bp, Rattus norvegicus
gctcacacgtagactgcgggcattt

SEQ ID NO: 404157 - DNA, 25 bp, Rattus norvegicus
gctcacacgtagtctgcgggcattt

SEQ ID NO: 404158 - DNA, 25 bp, Rattus norvegicus
gctcacactcatcatggcctattga

SEQ ID NO: 404159 - DNA, 25 bp, Rattus norvegicus
gctcacactcatgatggcctattga

SEQ ID NO: 404160 - DNA, 25 bp, Rattus norvegicus
gctcacagacacacaaatgcacatg

SEQ ID NO: 404161 - DNA, 25 bp, Rattus norvegicus
gctcacagacactcaaatgcacatg

SEQ ID NO: 404162 - DNA, 25 bp, Rattus norvegicus
gctcacagacagcacgaagctgatt

SEQ ID NO: 404163 - DNA, 25 bp, Rattus norvegicus
gctcacagacaggacgaagctgatt

SEQ ID NO: 404164 - DNA, 25 bp, Rattus norvegicus
gctcacagaggcatgtcaatgacca

SEQ ID NO: 404165 - DNA, 25 bp, Rattus norvegicus
gctcacagaggcttgtcaatgacca

SEQ ID NO: 404166 - DNA, 25 bp, Rattus norvegicus
gctcacagagtgcttgctttcggtc

SEQ ID NO: 404167 - DNA, 25 bp, Rattus norvegicus
gctcacagagtggttgctttcggtc

SEQ ID NO: 404168 - DNA, 25 bp, Rattus norvegicus
gctcacagatgcaggcttgtcagta

SEQ ID NO: 404169 - DNA, 25 bp, Rattus norvegicus
gctcacagatgctggcttgtcagta

SEQ ID NO: 404170 - DNA, 25 bp, Rattus norvegicus
gctcacagccagaaatacgatcttt

SEQ ID NO: 404171 - DNA, 25 bp, Rattus norvegicus
gctcacagccagtaatacgatcttt

SEQ ID NO: 404172 - DNA, 25 bp, Rattus norvegicus
gctcacagccgactttgtggtactc

SEQ ID NO: 404173 - DNA, 25 bp, Rattus norvegicus
gctcacagccgagtttgtggtactc

SEQ ID NO: 404174 - DNA, 25 bp, Rattus norvegicus
gctcacagccttcattttataacct

SEQ ID NO: 404175 - DNA, 25 bp, Rattus norvegicus
gctcacagccttgattttataacct

SEQ ID NO: 404176 - DNA, 25 bp, Rattus norvegicus
gctcacatagtgcagtggtccccaa

SEQ ID NO: 404177 - DNA, 25 bp, Rattus norvegicus
gctcacatagtggagtggtccccaa

SEQ ID NO: 404178 - DNA, 25 bp, Rattus norvegicus
gctcacatcggtcctacacaagcta

SEQ ID NO: 404179 - DNA, 25 bp, Rattus norvegicus
gctcacatcggtgctacacaagcta

SEQ ID NO: 404180 - DNA, 25 bp, Rattus norvegicus
gctcacatctctcgctgaattttgt

SEQ ID NO: 404181 - DNA, 25 bp, Rattus norvegicus
gctcacatctctggctgaattttgt

SEQ ID NO: 404182 - DNA, 25 bp, Rattus norvegicus
gctcacatcttcatattttttctta

SEQ ID NO: 404183 - DNA, 25 bp, Rattus norvegicus
gctcacatcttcttattttttctta

SEQ ID NO: 404184 - DNA, 25 bp, Rattus norvegicus
gctcacatgtaacactaccactggg

SEQ ID NO: 404185 - DNA, 25 bp, Rattus norvegicus
gctcacatgtaagactaccactggg

SEQ ID NO: 404186 - DNA, 25 bp, Rattus norvegicus
gctcacattaataaaatcaccttgc

SEQ ID NO: 404187 - DNA, 25 bp, Rattus norvegicus
gctcacattaattaaatcaccttgc

SEQ ID NO: 404188 - DNA, 25 bp, Rattus norvegicus
gctcacattcacctttacttaaact

SEQ ID NO: 404189 - DNA, 25 bp, Rattus norvegicus
gctcacattcacgtttacttaaact

SEQ ID NO: 404190 - DNA, 25 bp, Rattus norvegicus
gctcacattggcagaagggatttat

SEQ ID NO: 404191 - DNA, 25 bp, Rattus norvegicus
gctcacattggctgaagggatttat

SEQ ID NO: 404192 - DNA, 25 bp, Rattus norvegicus
gctcacatttctagggattcacttg

SEQ ID NO: 404193 - DNA, 25 bp, Rattus norvegicus
gctcacatttcttgggattcacttg

SEQ ID NO: 404194 - DNA, 25 bp, Rattus norvegicus
gctcaccaagagcactgaacacagt

SEQ ID NO: 404195 - DNA, 25 bp, Rattus norvegicus
gctcaccaagaggactgaacacagt

SEQ ID NO: 404196 - DNA, 25 bp, Rattus norvegicus
gctcaccaaggcaattatatatttg

SEQ ID NO: 404197 - DNA, 25 bp, Rattus norvegicus
gctcaccaaggctattatatatttg

SEQ ID NO: 404198 - DNA, 25 bp, Rattus norvegicus
gctcaccaagtcactgcttttgtaa

SEQ ID NO: 404199 - DNA, 25 bp, Rattus norvegicus
gctcaccaagtctctgcttttgtaa

SEQ ID NO: 404200 - DNA, 25 bp, Rattus norvegicus
gctcaccaatgcaacgttttacgta

SEQ ID NO: 404201 - DNA, 25 bp, Rattus norvegicus
gctcaccaatgctacgttttacgta

SEQ ID NO: 404202 - DNA, 25 bp, Rattus norvegicus
gctcaccactgtaactttcttgaga

SEQ ID NO: 404203 - DNA, 25 bp, Rattus norvegicus
gctcaccactgttactttcttgaga

SEQ ID NO: 404204 - DNA, 25 bp, Rattus norvegicus
gctcaccaggttcctgagtagccag

SEQ ID NO: 404205 - DNA, 25 bp, Rattus norvegicus
gctcaccaggttgctgagtagccag

SEQ ID NO: 404206 - DNA, 25 bp, Rattus norvegicus
gctcaccatcctattcattgctatt

SEQ ID NO: 404207 - DNA, 25 bp, Rattus norvegicus
gctcaccatccttttcattgctatt

SEQ ID NO: 404208 - DNA, 25 bp, Rattus norvegicus
gctcaccattgcattatatcgtagt

SEQ ID NO: 404209 - DNA, 25 bp, Rattus norvegicus
gctcaccattgctttatatcgtagt

SEQ ID NO: 404210 - DNA, 25 bp, Rattus norvegicus
gctcacccaaccaacagaatcaata

SEQ ID NO: 404211 - DNA, 25 bp, Rattus norvegicus
gctcacccaacctacagaatcaata

SEQ ID NO: 404212 - DNA, 25 bp, Rattus norvegicus
gctcacccctcacgagatagatgaa

SEQ ID NO: 404213 - DNA, 25 bp, Rattus norvegicus
gctcacccctcaggagatagatgaa

SEQ ID NO: 404214 - DNA, 25 bp, Rattus norvegicus
gctcacccgagcaagcagcatgaat

SEQ ID NO: 404215 - DNA, 25 bp, Rattus norvegicus
gctcacccgagctagcagcatgaat

SEQ ID NO: 404216 - DNA, 25 bp, Rattus norvegicus
gctcacccgggacacagaatgacct

SEQ ID NO: 404217 - DNA, 25 bp, Rattus norvegicus
gctcacccgggagacagaatgacct

SEQ ID NO: 404218 - DNA, 25 bp, Rattus norvegicus
gctcacccgttccaacatatgaata

SEQ ID NO: 404219 - DNA, 25 bp, Rattus norvegicus
gctcacccgttcgaacatatgaata

SEQ ID NO: 404220 - DNA, 25 bp, Rattus norvegicus
gctcaccctagacagtggcactatt

SEQ ID NO: 404221 - DNA, 25 bp, Rattus norvegicus
gctcaccctagagagtggcactatt

SEQ ID NO: 404222 - DNA, 25 bp, Rattus norvegicus
gctcaccctcatactttcaaaagga

SEQ ID NO: 404223 - DNA, 25 bp, Rattus norvegicus
gctcaccctcattctttcaaaagga

SEQ ID NO: 404224 - DNA, 25 bp, Rattus norvegicus
gctcaccctcttatgactttgtata

SEQ ID NO: 404225 - DNA, 25 bp, Rattus norvegicus
gctcaccctcttttgactttgtata

SEQ ID NO: 404226 - DNA, 25 bp, Rattus norvegicus
gctcaccctgtcaactgtagcagag

SEQ ID NO: 404227 - DNA, 25 bp, Rattus norvegicus
gctcaccctgtctactgtagcagag

SEQ ID NO: 404228 - DNA, 25 bp, Rattus norvegicus
gctcaccgagttccaggccaagata

SEQ ID NO: 404229 - DNA, 25 bp, Rattus norvegicus
gctcaccgagttgcaggccaagata

SEQ ID NO: 404230 - DNA, 25 bp, Rattus norvegicus
gctcaccgtgatcactgtgtggtaa

SEQ ID NO: 404231 - DNA, 25 bp, Rattus norvegicus
gctcaccgtgatgactgtgtggtaa

SEQ ID NO: 404232 - DNA, 25 bp, Rattus norvegicus
gctcacctaatcacttctgttattg

SEQ ID NO: 404233 - DNA, 25 bp, Rattus norvegicus
gctcacctaatctcttctgttattg

SEQ ID NO: 404234 - DNA, 25 bp, Rattus norvegicus
gctcacctctttactttcatacaag

SEQ ID NO: 404235 - DNA, 25 bp, Rattus norvegicus
gctcacctcttttctttcatacaag

SEQ ID NO: 404236 - DNA, 25 bp, Rattus norvegicus
gctcacctgcttcttcttacagagg

SEQ ID NO: 404237 - DNA, 25 bp, Rattus norvegicus
gctcacctgcttgttcttacagagg

SEQ ID NO: 404238 - DNA, 25 bp, Rattus norvegicus
gctcacctggaaccgcctagtggca

SEQ ID NO: 404239 - DNA, 25 bp, Rattus norvegicus
gctcacctggaagcgcctagtggca

SEQ ID NO: 404240 - DNA, 25 bp, Rattus norvegicus
gctcacctggtcagcagctagaatg

SEQ ID NO: 404241 - DNA, 25 bp, Rattus norvegicus
gctcacctggtctgcagctagaatg

SEQ ID NO: 404242 - DNA, 25 bp, Rattus norvegicus
gctcacctgtttagcagtcattgca

SEQ ID NO: 404243 - DNA, 25 bp, Rattus norvegicus
gctcacctgttttgcagtcattgca

SEQ ID NO: 404244 - DNA, 25 bp, Rattus norvegicus
gctcaccttcaacaagacattgtcc

SEQ ID NO: 404245 - DNA, 25 bp, Rattus norvegicus
gctcaccttcaagaagacattgtcc

SEQ ID NO: 404246 - DNA, 25 bp, Rattus norvegicus
gctcacctttagcagctcaacaatg

SEQ ID NO: 404247 - DNA, 25 bp, Rattus norvegicus
gctcacctttaggagctcaacaatg

SEQ ID NO: 404248 - DNA, 25 bp, Rattus norvegicus
gctcacctttgtagtctcagcactt

SEQ ID NO: 404249 - DNA, 25 bp, Rattus norvegicus
gctcacctttgttgtctcagcactt

SEQ ID NO: 404250 - DNA, 25 bp, Rattus norvegicus
gctcacgactacatgtctagtttca

SEQ ID NO: 404251 - DNA, 25 bp, Rattus norvegicus
gctcacgactacttgtctagtttca

SEQ ID NO: 404252 - DNA, 25 bp, Rattus norvegicus
gctcacgcgcagactgtgggcatga

SEQ ID NO: 404253 - DNA, 25 bp, Rattus norvegicus
gctcacgcgcagtctgtgggcatga

SEQ ID NO: 404254 - DNA, 25 bp, Rattus norvegicus
gctcacgggtaacaggaactcaggt

SEQ ID NO: 404255 - DNA, 25 bp, Rattus norvegicus
gctcacgggtaagaggaactcaggt

SEQ ID NO: 404256 - DNA, 25 bp, Rattus norvegicus
gctcacgtagttatttcagttttat

SEQ ID NO: 404257 - DNA, 25 bp, Rattus norvegicus
gctcacgtagttttttcagttttat

SEQ ID NO: 404258 - DNA, 25 bp, Rattus norvegicus
gctcacgttccacgctatttaattg

SEQ ID NO: 404259 - DNA, 25 bp, Rattus norvegicus
gctcacgttccaggctatttaattg

SEQ ID NO: 404260 - DNA, 25 bp, Rattus norvegicus
gctcactaacatatccatatttcat

SEQ ID NO: 404261 - DNA, 25 bp, Rattus norvegicus
gctcactaacatttccatatttcat

SEQ ID NO: 404262 - DNA, 25 bp, Rattus norvegicus
gctcactaggttaatctgatcacat

SEQ ID NO: 404263 - DNA, 25 bp, Rattus norvegicus
gctcactaggtttatctgatcacat

SEQ ID NO: 404264 - DNA, 25 bp, Rattus norvegicus
gctcactatgcaatctactgtctgt

SEQ ID NO: 404265 - DNA, 25 bp, Rattus norvegicus
gctcactatgcattctactgtctgt

SEQ ID NO: 404266 - DNA, 25 bp, Rattus norvegicus
gctcactcaaacatctgttcacata

SEQ ID NO: 404267 - DNA, 25 bp, Rattus norvegicus
gctcactcaaacttctgttcacata

SEQ ID NO: 404268 - DNA, 25 bp, Rattus norvegicus
gctcactcacctcaagtcttgacaa

SEQ ID NO: 404269 - DNA, 25 bp, Rattus norvegicus
gctcactcacctgaagtcttgacaa

SEQ ID NO: 404270 - DNA, 25 bp, Rattus norvegicus
gctcactcagggatttcgagttgag

SEQ ID NO: 404271 - DNA, 25 bp, Rattus norvegicus
gctcactcagggttttcgagttgag

SEQ ID NO: 404272 - DNA, 25 bp, Rattus norvegicus
gctcactcagtgagtctatcttctg

SEQ ID NO: 404273 - DNA, 25 bp, Rattus norvegicus
gctcactcagtgtgtctatcttctg

SEQ ID NO: 404274 - DNA, 25 bp, Rattus norvegicus
gctcactccctgagtggtcaattaa

SEQ ID NO: 404275 - DNA, 25 bp, Rattus norvegicus
gctcactccctgtgtggtcaattaa

SEQ ID NO: 404276 - DNA, 25 bp, Rattus norvegicus
gctcactctagaatttgtctcctga

SEQ ID NO: 404277 - DNA, 25 bp, Rattus norvegicus
gctcactctagattttgtctcctga

SEQ ID NO: 404278 - DNA, 25 bp, Rattus norvegicus
gctcactctcaaagcctgggaaggt

SEQ ID NO: 404279 - DNA, 25 bp, Rattus norvegicus
gctcactctcaatgcctgggaaggt

SEQ ID NO: 404280 - DNA, 25 bp, Rattus norvegicus
gctcactctgacacacacgagatgt

SEQ ID NO: 404281 - DNA, 25 bp, Rattus norvegicus
gctcactctgactcacacgagatgt

SEQ ID NO: 404282 - DNA, 25 bp, Rattus norvegicus
gctcactgaggcatctagttctgaa

SEQ ID NO: 404283 - DNA, 25 bp, Rattus norvegicus
gctcactgaggcttctagttctgaa

SEQ ID NO: 404284 - DNA, 25 bp, Rattus norvegicus
gctcactgccttccggaataagagt

SEQ ID NO: 404285 - DNA, 25 bp, Rattus norvegicus
gctcactgccttgcggaataagagt

SEQ ID NO: 404286 - DNA, 25 bp, Rattus norvegicus
gctcactgtcttcaaccatactttg

SEQ ID NO: 404287 - DNA, 25 bp, Rattus norvegicus
gctcactgtcttgaaccatactttg

SEQ ID NO: 404288 - DNA, 25 bp, Rattus norvegicus
gctcactgtgtccttggcctcgaaa

SEQ ID NO: 404289 - DNA, 25 bp, Rattus norvegicus
gctcactgtgtcgttggcctcgaaa

SEQ ID NO: 404290 - DNA, 25 bp, Rattus norvegicus
gctcacttacaccatcctagtaaag

SEQ ID NO: 404291 - DNA, 25 bp, Rattus norvegicus
gctcacttacacgatcctagtaaag

SEQ ID NO: 404292 - DNA, 25 bp, Rattus norvegicus
gctcacttagtacgccagtttctgt

SEQ ID NO: 404293 - DNA, 25 bp, Rattus norvegicus
gctcacttagtaggccagtttctgt

SEQ ID NO: 404294 - DNA, 25 bp, Rattus norvegicus
gctcacttctgaatggtttactctt

SEQ ID NO: 404295 - DNA, 25 bp, Rattus norvegicus
gctcacttctgattggtttactctt

SEQ ID NO: 404296 - DNA, 25 bp, Rattus norvegicus
gctcactttcagcaggatcctggaa

SEQ ID NO: 404297 - DNA, 25 bp, Rattus norvegicus
gctcactttcaggaggatcctggaa

SEQ ID NO: 404298 - DNA, 25 bp, Rattus norvegicus
gctcactttgttatagggcctgcac

SEQ ID NO: 404299 - DNA, 25 bp, Rattus norvegicus
gctcactttgttttagggcctgcac

SEQ ID NO: 404300 - DNA, 25 bp, Rattus norvegicus
gctcacttttaaattgacctcccta

SEQ ID NO: 404301 - DNA, 25 bp, Rattus norvegicus
gctcacttttaatttgacctcccta

SEQ ID NO: 404302 - DNA, 25 bp, Rattus norvegicus
gctcagaaaacacacgtgcatcctt

SEQ ID NO: 404303 - DNA, 25 bp, Rattus norvegicus
gctcagaaaacagacgtgcatcctt

SEQ ID NO: 404304 - DNA, 25 bp, Rattus norvegicus
gctcagaaagctcctcaaagtacct

SEQ ID NO: 404305 - DNA, 25 bp, Rattus norvegicus
gctcagaaagctgctcaaagtacct

SEQ ID NO: 404306 - DNA, 25 bp, Rattus norvegicus
gctcagaaataaatggctcctcttt

SEQ ID NO: 404307 - DNA, 25 bp, Rattus norvegicus
gctcagaaataattggctcctcttt

SEQ ID NO: 404308 - DNA, 25 bp, Rattus norvegicus
gctcagaacattaacttttcttcag

SEQ ID NO: 404309 - DNA, 25 bp, Rattus norvegicus
gctcagaacatttacttttcttcag

SEQ ID NO: 404310 - DNA, 25 bp, Rattus norvegicus
gctcagaaccaaattagtggctccc

SEQ ID NO: 404311 - DNA, 25 bp, Rattus norvegicus
gctcagaaccaatttagtggctccc

SEQ ID NO: 404312 - DNA, 25 bp, Rattus norvegicus
gctcagaacttactacacagtgctt

SEQ ID NO: 404313 - DNA, 25 bp, Rattus norvegicus
gctcagaacttagtacacagtgctt

SEQ ID NO: 404314 - DNA, 25 bp, Rattus norvegicus
gctcagaaggctccactgctgtggc

SEQ ID NO: 404315 - DNA, 25 bp, Rattus norvegicus
gctcagaaggctgcactgctgtggc

SEQ ID NO: 404316 - DNA, 25 bp, Rattus norvegicus
gctcagaatggcattaaagttcctt

SEQ ID NO: 404317 - DNA, 25 bp, Rattus norvegicus
gctcagaatggctttaaagttcctt

SEQ ID NO: 404318 - DNA, 25 bp, Rattus norvegicus
gctcagaccattacttgttctgttt

SEQ ID NO: 404319 - DNA, 25 bp, Rattus norvegicus
gctcagaccatttcttgttctgttt

SEQ ID NO: 404320 - DNA, 25 bp, Rattus norvegicus
gctcagacccaacataaggctaatc

SEQ ID NO: 404321 - DNA, 25 bp, Rattus norvegicus
gctcagacccaagataaggctaatc

SEQ ID NO: 404322 - DNA, 25 bp, Rattus norvegicus
gctcagacctgcatgtagtcatcat

SEQ ID NO: 404323 - DNA, 25 bp, Rattus norvegicus
gctcagacctgcttgtagtcatcat

SEQ ID NO: 404324 - DNA, 25 bp, Rattus norvegicus
gctcagactggcctaggatttacta

SEQ ID NO: 404325 - DNA, 25 bp, Rattus norvegicus
gctcagactggcgtaggatttacta

SEQ ID NO: 404326 - DNA, 25 bp, Rattus norvegicus
gctcagacttgacacactttctgtt

SEQ ID NO: 404327 - DNA, 25 bp, Rattus norvegicus
gctcagacttgagacactttctgtt

SEQ ID NO: 404328 - DNA, 25 bp, Rattus norvegicus
gctcagagagatccccgtatagatg

SEQ ID NO: 404329 - DNA, 25 bp, Rattus norvegicus
gctcagagagatgcccgtatagatg

SEQ ID NO: 404330 - DNA, 25 bp, Rattus norvegicus
gctcagagcttcagtgattcacagt

SEQ ID NO: 404331 - DNA, 25 bp, Rattus norvegicus
gctcagagcttctgtgattcacagt

SEQ ID NO: 404332 - DNA, 25 bp, Rattus norvegicus
gctcagaggccgcatatcatggaag

SEQ ID NO: 404333 - DNA, 25 bp, Rattus norvegicus
gctcagaggccggatatcatggaag

SEQ ID NO: 404334 - DNA, 25 bp, Rattus norvegicus
gctcagaggctgctctcataggcaa

SEQ ID NO: 404335 - DNA, 25 bp, Rattus norvegicus
gctcagaggctggtctcataggcaa

SEQ ID NO: 404336 - DNA, 25 bp, Rattus norvegicus
gctcagagtccaatgcagcacttag

SEQ ID NO: 404337 - DNA, 25 bp, Rattus norvegicus
gctcagagtccattgcagcacttag

SEQ ID NO: 404338 - DNA, 25 bp, Rattus norvegicus
gctcagagttcaagctgtacagttt

SEQ ID NO: 404339 - DNA, 25 bp, Rattus norvegicus
gctcagagttcatgctgtacagttt

SEQ ID NO: 404340 - DNA, 25 bp, Rattus norvegicus
gctcagagttcgaggtcgttggaaa

SEQ ID NO: 404341 - DNA, 25 bp, Rattus norvegicus
gctcagagttcgtggtcgttggaaa

SEQ ID NO: 404342 - DNA, 25 bp, Rattus norvegicus
gctcagataaatagctcagcccctc

SEQ ID NO: 404343 - DNA, 25 bp, Rattus norvegicus
gctcagataaattgctcagcccctc

SEQ ID NO: 404344 - DNA, 25 bp, Rattus norvegicus
gctcagatcctaattaattccacat

SEQ ID NO: 404345 - DNA, 25 bp, Rattus norvegicus
gctcagatcctatttaattccacat

SEQ ID NO: 404346 - DNA, 25 bp, Rattus norvegicus
gctcagatggcacagacgatccgat

SEQ ID NO: 404347 - DNA, 25 bp, Rattus norvegicus
gctcagatggcagagacgatccgat

SEQ ID NO: 404348 - DNA, 25 bp, Rattus norvegicus
gctcagatgggaagctttacatggt

SEQ ID NO: 404349 - DNA, 25 bp, Rattus norvegicus
gctcagatgggatgctttacatggt

SEQ ID NO: 404350 - DNA, 25 bp, Rattus norvegicus
gctcagattaatatctgtggcccat

SEQ ID NO: 404351 - DNA, 25 bp, Rattus norvegicus
gctcagattaatttctgtggcccat

SEQ ID NO: 404352 - DNA, 25 bp, Rattus norvegicus
gctcagattcatatcggacgtatcg

SEQ ID NO: 404353 - DNA, 25 bp, Rattus norvegicus
gctcagattcatttcggacgtatcg

SEQ ID NO: 404354 - DNA, 25 bp, Rattus norvegicus
gctcagattttcagactcgaagcct

SEQ ID NO: 404355 - DNA, 25 bp, Rattus norvegicus
gctcagattttctgactcgaagcct

SEQ ID NO: 404356 - DNA, 25 bp, Rattus norvegicus
gctcagcaaagcaggttcaggacta

SEQ ID NO: 404357 - DNA, 25 bp, Rattus norvegicus
gctcagcaaagctggttcaggacta

SEQ ID NO: 404358 - DNA, 25 bp, Rattus norvegicus
gctcagcaattcattcatttgccca

SEQ ID NO: 404359 - DNA, 25 bp, Rattus norvegicus
gctcagcaattctttcatttgccca

SEQ ID NO: 404360 - DNA, 25 bp, Rattus norvegicus
gctcagcacctcaatggttctgcag

SEQ ID NO: 404361 - DNA, 25 bp, Rattus norvegicus
gctcagcacctctatggttctgcag

SEQ ID NO: 404362 - DNA, 25 bp, Rattus norvegicus
gctcagcagcttccttacagactgg

SEQ ID NO: 404363 - DNA, 25 bp, Rattus norvegicus
gctcagcagcttgcttacagactgg

SEQ ID NO: 404364 - DNA, 25 bp, Rattus norvegicus
gctcagcaggagcaactgtgacctc

SEQ ID NO: 404365 - DNA, 25 bp, Rattus norvegicus
gctcagcaggaggaactgtgacctc

SEQ ID NO: 404366 - DNA, 25 bp, Rattus norvegicus
gctcagcaggctctagtctcagtag

SEQ ID NO: 404367 - DNA, 25 bp, Rattus norvegicus
gctcagcaggctgtagtctcagtag

SEQ ID NO: 404368 - DNA, 25 bp, Rattus norvegicus
gctcagcatatgcagacacctggca

SEQ ID NO: 404369 - DNA, 25 bp, Rattus norvegicus
gctcagcatatggagacacctggca

SEQ ID NO: 404370 - DNA, 25 bp, Rattus norvegicus
gctcagcatcttcttctttgacgag

SEQ ID NO: 404371 - DNA, 25 bp, Rattus norvegicus
gctcagcatcttgttctttgacgag

SEQ ID NO: 404372 - DNA, 25 bp, Rattus norvegicus
gctcagcatgaaagcatccctggag

SEQ ID NO: 404373 - DNA, 25 bp, Rattus norvegicus
gctcagcatgaatgcatccctggag

SEQ ID NO: 404374 - DNA, 25 bp, Rattus norvegicus
gctcagccagatcactacaaagagg

SEQ ID NO: 404375 - DNA, 25 bp, Rattus norvegicus
gctcagccagatgactacaaagagg

SEQ ID NO: 404376 - DNA, 25 bp, Rattus norvegicus
gctcagcctaagaaattcaaacagt

SEQ ID NO: 404377 - DNA, 25 bp, Rattus norvegicus
gctcagcctaagtaattcaaacagt

SEQ ID NO: 404378 - DNA, 25 bp, Rattus norvegicus
gctcagcctcagatctgccttataa

SEQ ID NO: 404379 - DNA, 25 bp, Rattus norvegicus
gctcagcctcagttctgccttataa

SEQ ID NO: 404380 - DNA, 25 bp, Rattus norvegicus
gctcagcctttcctgtattatcaga

SEQ ID NO: 404381 - DNA, 25 bp, Rattus norvegicus
gctcagcctttcgtgtattatcaga

SEQ ID NO: 404382 - DNA, 25 bp, Rattus norvegicus
gctcagcgactacagccgctcggat

SEQ ID NO: 404383 - DNA, 25 bp, Rattus norvegicus
gctcagcgactagagccgctcggat

SEQ ID NO: 404384 - DNA, 25 bp, Rattus norvegicus
gctcagcggtaaagctgcacaacat

SEQ ID NO: 404385 - DNA, 25 bp, Rattus norvegicus
gctcagcggtaatgctgcacaacat

SEQ ID NO: 404386 - DNA, 25 bp, Rattus norvegicus
gctcagcgtgttactacatgcagat

SEQ ID NO: 404387 - DNA, 25 bp, Rattus norvegicus
gctcagcgtgtttctacatgcagat

SEQ ID NO: 404388 - DNA, 25 bp, Rattus norvegicus
gctcagctcattcgcctagaagatg

SEQ ID NO: 404389 - DNA, 25 bp, Rattus norvegicus
gctcagctcattggcctagaagatg

SEQ ID NO: 404390 - DNA, 25 bp, Rattus norvegicus
gctcagctccgcattgcttttaata

SEQ ID NO: 404391 - DNA, 25 bp, Rattus norvegicus
gctcagctccgctttgcttttaata

SEQ ID NO: 404392 - DNA, 25 bp, Rattus norvegicus
gctcagctctgtcagtagggctctg

SEQ ID NO: 404393 - DNA, 25 bp, Rattus norvegicus
gctcagctctgtgagtagggctctg

SEQ ID NO: 404394 - DNA, 25 bp, Rattus norvegicus
gctcagctcttaattcagggcatca

SEQ ID NO: 404395 - DNA, 25 bp, Rattus norvegicus
gctcagctcttatttcagggcatca

SEQ ID NO: 404396 - DNA, 25 bp, Rattus norvegicus
gctcagctgcctctttgcgggacca

SEQ ID NO: 404397 - DNA, 25 bp, Rattus norvegicus
gctcagctgcctgtttgcgggacca

SEQ ID NO: 404398 - DNA, 25 bp, Rattus norvegicus
gctcagctggtaatgtggacttatg

SEQ ID NO: 404399 - DNA, 25 bp, Rattus norvegicus
gctcagctggtattgtggacttatg

SEQ ID NO: 404400 - DNA, 25 bp, Rattus norvegicus
gctcagcttcctcctggaacggaaa

SEQ ID NO: 404401 - DNA, 25 bp, Rattus norvegicus
gctcagcttcctgctggaacggaaa

SEQ ID NO: 404402 - DNA, 25 bp, Rattus norvegicus
gctcagcttgtgcttaattaggcaa

SEQ ID NO: 404403 - DNA, 25 bp, Rattus norvegicus
gctcagcttgtggttaattaggcaa

SEQ ID NO: 404404 - DNA, 25 bp, Rattus norvegicus
gctcagctttttcgcttcctttttg

SEQ ID NO: 404405 - DNA, 25 bp, Rattus norvegicus
gctcagctttttggcttcctttttg

SEQ ID NO: 404406 - DNA, 25 bp, Rattus norvegicus
gctcaggaaaccacaggccttaggc

SEQ ID NO: 404407 - DNA, 25 bp, Rattus norvegicus
gctcaggaaacctcaggccttaggc

SEQ ID NO: 404408 - DNA, 25 bp, Rattus norvegicus
gctcaggaaagcacgtgcagaagct

SEQ ID NO: 404409 - DNA, 25 bp, Rattus norvegicus
gctcaggaaagctcgtgcagaagct

SEQ ID NO: 404410 - DNA, 25 bp, Rattus norvegicus
gctcaggacagtagcaccacagaag

SEQ ID NO: 404411 - DNA, 25 bp, Rattus norvegicus
gctcaggacagttgcaccacagaag

SEQ ID NO: 404412 - DNA, 25 bp, Rattus norvegicus
gctcaggatacacggcaagggcatc

SEQ ID NO: 404413 - DNA, 25 bp, Rattus norvegicus
gctcaggatacagggcaagggcatc

SEQ ID NO: 404414 - DNA, 25 bp, Rattus norvegicus
gctcaggataggaaacagccaagtt

SEQ ID NO: 404415 - DNA, 25 bp, Rattus norvegicus
gctcaggataggtaacagccaagtt

SEQ ID NO: 404416 - DNA, 25 bp, Rattus norvegicus
gctcaggcactgcaatcaatgctca

SEQ ID NO: 404417 - DNA, 25 bp, Rattus norvegicus
gctcaggcactgcttgtcaggtctg

SEQ ID NO: 404418 - DNA, 25 bp, Rattus norvegicus
gctcaggcactggaatcaatgctca

SEQ ID NO: 404419 - DNA, 25 bp, Rattus norvegicus
gctcaggcactggttgtcaggtctg

SEQ ID NO: 404420 - DNA, 25 bp, Rattus norvegicus
gctcaggcatccatgcagaagagtg

SEQ ID NO: 404421 - DNA, 25 bp, Rattus norvegicus
gctcaggcatccttgcagaagagtg

SEQ ID NO: 404422 - DNA, 25 bp, Rattus norvegicus
gctcaggcatgacgatgcaccccag

SEQ ID NO: 404423 - DNA, 25 bp, Rattus norvegicus
gctcaggcatgaggatgcaccccag

SEQ ID NO: 404424 - DNA, 25 bp, Rattus norvegicus
gctcaggctcggagtcggtctccgc

SEQ ID NO: 404425 - DNA, 25 bp, Rattus norvegicus
gctcaggctcggtgtcggtctccgc

SEQ ID NO: 404426 - DNA, 25 bp, Rattus norvegicus
gctcaggctgccatggagggactaa

SEQ ID NO: 404427 - DNA, 25 bp, Rattus norvegicus
gctcaggctgccttggagggactaa

SEQ ID NO: 404428 - DNA, 25 bp, Rattus norvegicus
gctcagggaaatccacttgctatgc

SEQ ID NO: 404429 - DNA, 25 bp, Rattus norvegicus
gctcagggaaatgcacttgctatgc

SEQ ID NO: 404430 - DNA, 25 bp, Rattus norvegicus
gctcagggatgtagcagccagcctc

SEQ ID NO: 404431 - DNA, 25 bp, Rattus norvegicus
gctcagggatgtcatcttgggacaa

SEQ ID NO: 404432 - DNA, 25 bp, Rattus norvegicus
gctcagggatgtgatcttgggacaa

SEQ ID NO: 404433 - DNA, 25 bp, Rattus norvegicus
gctcagggatgttgcagccagcctc

SEQ ID NO: 404434 - DNA, 25 bp, Rattus norvegicus
gctcagggctcaccctccgaggagt

SEQ ID NO: 404435 - DNA, 25 bp, Rattus norvegicus
gctcagggctcagcctccgaggagt

SEQ ID NO: 404436 - DNA, 25 bp, Rattus norvegicus
gctcagggtcagcattaaaccagaa

SEQ ID NO: 404437 - DNA, 25 bp, Rattus norvegicus
gctcagggtcaggattaaaccagaa

SEQ ID NO: 404438 - DNA, 25 bp, Rattus norvegicus
gctcaggtaccgcatgtgtgctaaa

SEQ ID NO: 404439 - DNA, 25 bp, Rattus norvegicus
gctcaggtaccggatgtgtgctaaa

SEQ ID NO: 404440 - DNA, 25 bp, Rattus norvegicus
gctcaggtcctgactctctttagcc

SEQ ID NO: 404441 - DNA, 25 bp, Rattus norvegicus
gctcaggtcctgtctctctttagcc

SEQ ID NO: 404442 - DNA, 25 bp, Rattus norvegicus
gctcaggtctgcatagctgacagca

SEQ ID NO: 404443 - DNA, 25 bp, Rattus norvegicus
gctcaggtctgcatgcatggtggat

SEQ ID NO: 404444 - DNA, 25 bp, Rattus norvegicus
gctcaggtctgcttagctgacagca

SEQ ID NO: 404445 - DNA, 25 bp, Rattus norvegicus
gctcaggtctgcttgcatggtggat

SEQ ID NO: 404446 - DNA, 25 bp, Rattus norvegicus
gctcaggtgtctagtgccttggcca

SEQ ID NO: 404447 - DNA, 25 bp, Rattus norvegicus
gctcaggtgtcttgtgccttggcca

SEQ ID NO: 404448 - DNA, 25 bp, Rattus norvegicus
gctcaggttagaagtgtctgggtct

SEQ ID NO: 404449 - DNA, 25 bp, Rattus norvegicus
gctcaggttagatgtgtctgggtct

SEQ ID NO: 404450 - DNA, 25 bp, Rattus norvegicus
gctcaggttctaaacagagccctgt

SEQ ID NO: 404451 - DNA, 25 bp, Rattus norvegicus
gctcaggttctatacagagccctgt

SEQ ID NO: 404452 - DNA, 25 bp, Rattus norvegicus
gctcaggttgttccttcgaatccca

SEQ ID NO: 404453 - DNA, 25 bp, Rattus norvegicus
gctcaggttgttgcttcgaatccca

SEQ ID NO: 404454 - DNA, 25 bp, Rattus norvegicus
gctcagtaactcaatccacaggatc

SEQ ID NO: 404455 - DNA, 25 bp, Rattus norvegicus
gctcagtaactctatccacaggatc

SEQ ID NO: 404456 - DNA, 25 bp, Rattus norvegicus
gctcagtacatccagtggtgagtcg

SEQ ID NO: 404457 - DNA, 25 bp, Rattus norvegicus
gctcagtacatcgagtggtgagtcg

SEQ ID NO: 404458 - DNA, 25 bp, Rattus norvegicus
gctcagtatcagagcacttgcttag

SEQ ID NO: 404459 - DNA, 25 bp, Rattus norvegicus
gctcagtatcagtgcacttgcttag

SEQ ID NO: 404460 - DNA, 25 bp, Rattus norvegicus
gctcagtatgtcagcatgggaacac

SEQ ID NO: 404461 - DNA, 25 bp, Rattus norvegicus
gctcagtatgtctgcatgggaacac

SEQ ID NO: 404462 - DNA, 25 bp, Rattus norvegicus
gctcagtattctatggtcctgggaa

SEQ ID NO: 404463 - DNA, 25 bp, Rattus norvegicus
gctcagtattctttggtcctgggaa

SEQ ID NO: 404464 - DNA, 25 bp, Rattus norvegicus
gctcagtattggactcttgtggcta

SEQ ID NO: 404465 - DNA, 25 bp, Rattus norvegicus
gctcagtattggtctcttgtggcta

SEQ ID NO: 404466 - DNA, 25 bp, Rattus norvegicus
gctcagtcagaactcttgccaaggt

SEQ ID NO: 404467 - DNA, 25 bp, Rattus norvegicus
gctcagtcagaagtcttgccaaggt

SEQ ID NO: 404468 - DNA, 25 bp, Rattus norvegicus
gctcagtcaggaacagtgttaccat

SEQ ID NO: 404469 - DNA, 25 bp, Rattus norvegicus
gctcagtcaggatcagtgttaccat

SEQ ID NO: 404470 - DNA, 25 bp, Rattus norvegicus
gctcagtctgaccattcttactaat

SEQ ID NO: 404471 - DNA, 25 bp, Rattus norvegicus
gctcagtctgacgattcttactaat

SEQ ID NO: 404472 - DNA, 25 bp, Rattus norvegicus
gctcagtgattaccacataggttct

SEQ ID NO: 404473 - DNA, 25 bp, Rattus norvegicus
gctcagtgattagcacataggttct

SEQ ID NO: 404474 - DNA, 25 bp, Rattus norvegicus
gctcagtgctcccatttgactccta

SEQ ID NO: 404475 - DNA, 25 bp, Rattus norvegicus
gctcagtgctccgatttgactccta

SEQ ID NO: 404476 - DNA, 25 bp, Rattus norvegicus
gctcagtgctggagaatatttactt

SEQ ID NO: 404477 - DNA, 25 bp, Rattus norvegicus
gctcagtgctggtgaatatttactt

SEQ ID NO: 404478 - DNA, 25 bp, Rattus norvegicus
gctcagtgctgtagttatgacctat

SEQ ID NO: 404479 - DNA, 25 bp, Rattus norvegicus
gctcagtgctgttgttatgacctat

SEQ ID NO: 404480 - DNA, 25 bp, Rattus norvegicus
gctcagtgggagagatgatctaaca

SEQ ID NO: 404481 - DNA, 25 bp, Rattus norvegicus
gctcagtgggagtgatgatctaaca

SEQ ID NO: 404482 - DNA, 25 bp, Rattus norvegicus
gctcagtggtaaacttttcctctac

SEQ ID NO: 404483 - DNA, 25 bp, Rattus norvegicus
gctcagtggtaatcttttcctctac

SEQ ID NO: 404484 - DNA, 25 bp, Rattus norvegicus
gctcagtgtagcaaaggtcagtctt

SEQ ID NO: 404485 - DNA, 25 bp, Rattus norvegicus
gctcagtgtagctaaggtcagtctt

SEQ ID NO: 404486 - DNA, 25 bp, Rattus norvegicus
gctcagtgtctacattccagatcga

SEQ ID NO: 404487 - DNA, 25 bp, Rattus norvegicus
gctcagtgtctagattccagatcga

SEQ ID NO: 404488 - DNA, 25 bp, Rattus norvegicus
gctcagttaaaaacctccggtgcct

SEQ ID NO: 404489 - DNA, 25 bp, Rattus norvegicus
gctcagttaaaatcctccggtgcct

SEQ ID NO: 404490 - DNA, 25 bp, Rattus norvegicus
gctcagttccaaagaccttgtcaaa

SEQ ID NO: 404491 - DNA, 25 bp, Rattus norvegicus
gctcagttccaatgaccttgtcaaa

SEQ ID NO: 404492 - DNA, 25 bp, Rattus norvegicus
gctcagttccacacttgatcttagt

SEQ ID NO: 404493 - DNA, 25 bp, Rattus norvegicus
gctcagttccactcttgatcttagt

SEQ ID NO: 404494 - DNA, 25 bp, Rattus norvegicus
gctcagttcccaagcagctagagtt

SEQ ID NO: 404495 - DNA, 25 bp, Rattus norvegicus
gctcagttcccatgcagctagagtt

SEQ ID NO: 404496 - DNA, 25 bp, Rattus norvegicus
gctcagttgatcaccaagattccac

SEQ ID NO: 404497 - DNA, 25 bp, Rattus norvegicus
gctcagttgatctccaagattccac

SEQ ID NO: 404498 - DNA, 25 bp, Rattus norvegicus
gctcagttggtaaaggcccttgcca

SEQ ID NO: 404499 - DNA, 25 bp, Rattus norvegicus
gctcagttggtataggcccttgcca

SEQ ID NO: 404500 - DNA, 25 bp, Rattus norvegicus
gctcagttgttaagacctccgactg

SEQ ID NO: 404501 - DNA, 25 bp, Rattus norvegicus
gctcagttgttatgacctccgactg

SEQ ID NO: 404502 - DNA, 25 bp, Rattus norvegicus
gctcagttgtttcaggcaagcccaa

SEQ ID NO: 404503 - DNA, 25 bp, Rattus norvegicus
gctcagttgtttgaggcaagcccaa

SEQ ID NO: 404504 - DNA, 25 bp, Rattus norvegicus
gctcagtttagcaggtaaccctcca

SEQ ID NO: 404505 - DNA, 25 bp, Rattus norvegicus
gctcagtttagctggtaaccctcca

SEQ ID NO: 404506 - DNA, 25 bp, Rattus norvegicus
gctcagtttatacaacagtccaaag

SEQ ID NO: 404507 - DNA, 25 bp, Rattus norvegicus
gctcagtttatagaacagtccaaag

SEQ ID NO: 404508 - DNA, 25 bp, Rattus norvegicus
gctcagtttcccacagctatgaatg

SEQ ID NO: 404509 - DNA, 25 bp, Rattus norvegicus
gctcagtttccctcagctatgaatg

SEQ ID NO: 404510 - DNA, 25 bp, Rattus norvegicus
gctcataaagctacgtgggtgggat

SEQ ID NO: 404511 - DNA, 25 bp, Rattus norvegicus
gctcataaagcttcgtgggtgggat

SEQ ID NO: 404512 - DNA, 25 bp, Rattus norvegicus
gctcatacatcaccccaaaacggtt

SEQ ID NO: 404513 - DNA, 25 bp, Rattus norvegicus
gctcatacatcagcccaaaacggtt

SEQ ID NO: 404514 - DNA, 25 bp, Rattus norvegicus
gctcatacctgtctcttactgggtt

SEQ ID NO: 404515 - DNA, 25 bp, Rattus norvegicus
gctcatacctgtgtcttactgggtt

SEQ ID NO: 404516 - DNA, 25 bp, Rattus norvegicus
gctcatacgcatactctgtacatgt

SEQ ID NO: 404517 - DNA, 25 bp, Rattus norvegicus
gctcatacgcattctctgtacatgt

SEQ ID NO: 404518 - DNA, 25 bp, Rattus norvegicus
gctcatactctgatagatctgaccg

SEQ ID NO: 404519 - DNA, 25 bp, Rattus norvegicus
gctcatactctgttagatctgaccg

SEQ ID NO: 404520 - DNA, 25 bp, Rattus norvegicus
gctcatatcacaagacctacatcca

SEQ ID NO: 404521 - DNA, 25 bp, Rattus norvegicus
gctcatatcacatgacctacatcca

SEQ ID NO: 404522 - DNA, 25 bp, Rattus norvegicus
gctcatatcctgagaaaagcaccat

SEQ ID NO: 404523 - DNA, 25 bp, Rattus norvegicus
gctcatatcctgtgaaaagcaccat

SEQ ID NO: 404524 - DNA, 25 bp, Rattus norvegicus
gctcatatgaacactgtacaggctg

SEQ ID NO: 404525 - DNA, 25 bp, Rattus norvegicus
gctcatatgaactctgtacaggctg

SEQ ID NO: 404526 - DNA, 25 bp, Rattus norvegicus
gctcatatgttcctaatgggccaca

SEQ ID NO: 404527 - DNA, 25 bp, Rattus norvegicus
gctcatatgttcgtaatgggccaca

SEQ ID NO: 404528 - DNA, 25 bp, Rattus norvegicus
gctcatattgctctagatggcctca

SEQ ID NO: 404529 - DNA, 25 bp, Rattus norvegicus
gctcatattgctgtagatggcctca

SEQ ID NO: 404530 - DNA, 25 bp, Rattus norvegicus
gctcatatttaacctctgtttggga

SEQ ID NO: 404531 - DNA, 25 bp, Rattus norvegicus
gctcatatttaagctctgtttggga

SEQ ID NO: 404532 - DNA, 25 bp, Rattus norvegicus
gctcatcaaagaacttagtgccctg

SEQ ID NO: 404533 - DNA, 25 bp, Rattus norvegicus
gctcatcaaagatcttagtgccctg

SEQ ID NO: 404534 - DNA, 25 bp, Rattus norvegicus
gctcatcaccgcagaacgatctgtt

SEQ ID NO: 404535 - DNA, 25 bp, Rattus norvegicus
gctcatcaccgctgaacgatctgtt

SEQ ID NO: 404536 - DNA, 25 bp, Rattus norvegicus
gctcatcaggatcagtaaggcattt

SEQ ID NO: 404537 - DNA, 25 bp, Rattus norvegicus
gctcatcaggatgagtaaggcattt

SEQ ID NO: 404538 - DNA, 25 bp, Rattus norvegicus
gctcatcagttcagagttcacctga

SEQ ID NO: 404539 - DNA, 25 bp, Rattus norvegicus
gctcatcagttctgagttcacctga

SEQ ID NO: 404540 - DNA, 25 bp, Rattus norvegicus
gctcatcataggagacaggtagtca

SEQ ID NO: 404541 - DNA, 25 bp, Rattus norvegicus
gctcatcataggtgacaggtagtca

SEQ ID NO: 404542 - DNA, 25 bp, Rattus norvegicus
gctcatcatgacagtggcaattttt

SEQ ID NO: 404543 - DNA, 25 bp, Rattus norvegicus
gctcatcatgactgtggcaattttt

SEQ ID NO: 404544 - DNA, 25 bp, Rattus norvegicus
gctcatccaataaaggtgccgttgt

SEQ ID NO: 404545 - DNA, 25 bp, Rattus norvegicus
gctcatccaatataggtgccgttgt

SEQ ID NO: 404546 - DNA, 25 bp, Rattus norvegicus
gctcatccatgtcgtaactggctct

SEQ ID NO: 404547 - DNA, 25 bp, Rattus norvegicus
gctcatccatgtggtaactggctct

SEQ ID NO: 404548 - DNA, 25 bp, Rattus norvegicus
gctcatcccctaacctgagaaataa

SEQ ID NO: 404549 - DNA, 25 bp, Rattus norvegicus
gctcatcccctatcctgagaaataa

SEQ ID NO: 404550 - DNA, 25 bp, Rattus norvegicus
gctcatccgagcctctgattgagga

SEQ ID NO: 404551 - DNA, 25 bp, Rattus norvegicus
gctcatccgagcgtctgattgagga

SEQ ID NO: 404552 - DNA, 25 bp, Rattus norvegicus
gctcatccgagtcttttatggcagg

SEQ ID NO: 404553 - DNA, 25 bp, Rattus norvegicus
gctcatccgagtgttttatggcagg

SEQ ID NO: 404554 - DNA, 25 bp, Rattus norvegicus
gctcatcctgggaaaggctcaggat

SEQ ID NO: 404555 - DNA, 25 bp, Rattus norvegicus
gctcatcctgggtaaggctcaggat

SEQ ID NO: 404556 - DNA, 25 bp, Rattus norvegicus
gctcatcgtggacaccatggaggaa

SEQ ID NO: 404557 - DNA, 25 bp, Rattus norvegicus
gctcatcgtggagaccatggaggaa

SEQ ID NO: 404558 - DNA, 25 bp, Rattus norvegicus
gctcatctacagcaggtgacaacta

SEQ ID NO: 404559 - DNA, 25 bp, Rattus norvegicus
gctcatctacaggaggtgacaacta

SEQ ID NO: 404560 - DNA, 25 bp, Rattus norvegicus
gctcatcttcctactctaagttaaa

SEQ ID NO: 404561 - DNA, 25 bp, Rattus norvegicus
gctcatcttccttctctaagttaaa

SEQ ID NO: 404562 - DNA, 25 bp, Rattus norvegicus
gctcatgactttctgtgctatttga

SEQ ID NO: 404563 - DNA, 25 bp, Rattus norvegicus
gctcatgactttgtgtgctatttga

SEQ ID NO: 404564 - DNA, 25 bp, Rattus norvegicus
gctcatgagcgaaggcgtgtctttc

SEQ ID NO: 404565 - DNA, 25 bp, Rattus norvegicus
gctcatgagcgatggcgtgtctttc

SEQ ID NO: 404566 - DNA, 25 bp, Rattus norvegicus
gctcatgatgctagtctggttccag

SEQ ID NO: 404567 - DNA, 25 bp, Rattus norvegicus
gctcatgatgcttgtctggttccag

SEQ ID NO: 404568 - DNA, 25 bp, Rattus norvegicus
gctcatgccccactctgaaaaaaga

SEQ ID NO: 404569 - DNA, 25 bp, Rattus norvegicus
gctcatgccccagtctgaaaaaaga

SEQ ID NO: 404570 - DNA, 25 bp, Rattus norvegicus
gctcatgcctgacaatcagcggcta

SEQ ID NO: 404571 - DNA, 25 bp, Rattus norvegicus
gctcatgcctgagaatcagcggcta

SEQ ID NO: 404572 - DNA, 25 bp, Rattus norvegicus
gctcatgcctgtactctcagaagtt

SEQ ID NO: 404573 - DNA, 25 bp, Rattus norvegicus
gctcatgcctgttctctcagaagtt

SEQ ID NO: 404574 - DNA, 25 bp, Rattus norvegicus
gctcatgcgaggatggtggcactta

SEQ ID NO: 404575 - DNA, 25 bp, Rattus norvegicus
gctcatgcgaggttggtggcactta

SEQ ID NO: 404576 - DNA, 25 bp, Rattus norvegicus
gctcatgctcccatttatatgtatt

SEQ ID NO: 404577 - DNA, 25 bp, Rattus norvegicus
gctcatgctcccttttatatgtatt

SEQ ID NO: 404578 - DNA, 25 bp, Rattus norvegicus
gctcatgctgacaggctggtcatca

SEQ ID NO: 404579 - DNA, 25 bp, Rattus norvegicus
gctcatgctgactggctggtcatca

SEQ ID NO: 404580 - DNA, 25 bp, Rattus norvegicus
gctcatggaccaagggcagtctcat

SEQ ID NO: 404581 - DNA, 25 bp, Rattus norvegicus
gctcatggaccatgggcagtctcat

SEQ ID NO: 404582 - DNA, 25 bp, Rattus norvegicus
gctcatggcagcacggaacttgaaa

SEQ ID NO: 404583 - DNA, 25 bp, Rattus norvegicus
gctcatggcagctcggaacttgaaa

SEQ ID NO: 404584 - DNA, 25 bp, Rattus norvegicus
gctcatggccagattgtcattctgt

SEQ ID NO: 404585 - DNA, 25 bp, Rattus norvegicus
gctcatggccagtttgtcattctgt

SEQ ID NO: 404586 - DNA, 25 bp, Rattus norvegicus
gctcatggcgtgagttcacagcagt

SEQ ID NO: 404587 - DNA, 25 bp, Rattus norvegicus
gctcatggcgtgtgttcacagcagt

SEQ ID NO: 404588 - DNA, 25 bp, Rattus norvegicus
gctcatgggagccaaagcgacaatg

SEQ ID NO: 404589 - DNA, 25 bp, Rattus norvegicus
gctcatgggagcgaaagcgacaatg

SEQ ID NO: 404590 - DNA, 25 bp, Rattus norvegicus
gctcatggtacgcttactgattagt

SEQ ID NO: 404591 - DNA, 25 bp, Rattus norvegicus
gctcatggtacggttactgattagt

SEQ ID NO: 404592 - DNA, 25 bp, Rattus norvegicus
gctcatggtccaattataatgctaa

SEQ ID NO: 404593 - DNA, 25 bp, Rattus norvegicus
gctcatggtccatttataatgctaa

SEQ ID NO: 404594 - DNA, 25 bp, Rattus norvegicus
gctcatggtggcaccttttcatgaa

SEQ ID NO: 404595 - DNA, 25 bp, Rattus norvegicus
gctcatggtggctccttttcatgaa

SEQ ID NO: 404596 - DNA, 25 bp, Rattus norvegicus
gctcatggttgaaatctcagccact

SEQ ID NO: 404597 - DNA, 25 bp, Rattus norvegicus
gctcatggttgatatctcagccact

SEQ ID NO: 404598 - DNA, 25 bp, Rattus norvegicus
gctcatgtacaaccctttcctaagg

SEQ ID NO: 404599 - DNA, 25 bp, Rattus norvegicus
gctcatgtacaagcctttcctaagg

SEQ ID NO: 404600 - DNA, 25 bp, Rattus norvegicus
gctcatgtataaagtctggatgcaa

SEQ ID NO: 404601 - DNA, 25 bp, Rattus norvegicus
gctcatgtataatgtctggatgcaa

SEQ ID NO: 404602 - DNA, 25 bp, Rattus norvegicus
gctcatgtatgcaccactaaactta

SEQ ID NO: 404603 - DNA, 25 bp, Rattus norvegicus
gctcatgtatgctccactaaactta

SEQ ID NO: 404604 - DNA, 25 bp, Rattus norvegicus
gctcatgtcaggaccaatgtctgtt

SEQ ID NO: 404605 - DNA, 25 bp, Rattus norvegicus
gctcatgtcaggtccaatgtctgtt

SEQ ID NO: 404606 - DNA, 25 bp, Rattus norvegicus
gctcatgtctaaattaactgcattt

SEQ ID NO: 404607 - DNA, 25 bp, Rattus norvegicus
gctcatgtctaatttaactgcattt

SEQ ID NO: 404608 - DNA, 25 bp, Rattus norvegicus
gctcatgtctccagcatatgtatcc

SEQ ID NO: 404609 - DNA, 25 bp, Rattus norvegicus
gctcatgtctcctgcatatgtatcc

SEQ ID NO: 404610 - DNA, 25 bp, Rattus norvegicus
gctcatgtctctaccatctaaggtg

SEQ ID NO: 404611 - DNA, 25 bp, Rattus norvegicus
gctcatgtctcttccatctaaggtg

SEQ ID NO: 404612 - DNA, 25 bp, Rattus norvegicus
gctcatgtggatctatcttaaatat

SEQ ID NO: 404613 - DNA, 25 bp, Rattus norvegicus
gctcatgtggatgtatcttaaatat

SEQ ID NO: 404614 - DNA, 25 bp, Rattus norvegicus
gctcatgttcaactttttacaagga

SEQ ID NO: 404615 - DNA, 25 bp, Rattus norvegicus
gctcatgttcaagtttttacaagga

SEQ ID NO: 404616 - DNA, 25 bp, Rattus norvegicus
gctcatgttcctcggcttaggcaaa

SEQ ID NO: 404617 - DNA, 25 bp, Rattus norvegicus
gctcatgttcctgggcttaggcaaa

SEQ ID NO: 404618 - DNA, 25 bp, Rattus norvegicus
gctcatgttctacgcagcaaggctt

SEQ ID NO: 404619 - DNA, 25 bp, Rattus norvegicus
gctcatgttctaggcagcaaggctt

SEQ ID NO: 404620 - DNA, 25 bp, Rattus norvegicus
gctcatgtttccaccgatatcggga

SEQ ID NO: 404621 - DNA, 25 bp, Rattus norvegicus
gctcatgtttcctccgatatcggga

SEQ ID NO: 404622 - DNA, 25 bp, Rattus norvegicus
gctcattcagcaccgaggacttgtg

SEQ ID NO: 404623 - DNA, 25 bp, Rattus norvegicus
gctcattcagcagcgaggacttgtg

SEQ ID NO: 404624 - DNA, 25 bp, Rattus norvegicus
gctcattccgatattaatagtgaca

SEQ ID NO: 404625 - DNA, 25 bp, Rattus norvegicus
gctcattccgattttaatagtgaca

SEQ ID NO: 404626 - DNA, 25 bp, Rattus norvegicus
gctcattcctagcaaggcgtgtcag

SEQ ID NO: 404627 - DNA, 25 bp, Rattus norvegicus
gctcattcctaggaaggcgtgtcag

SEQ ID NO: 404628 - DNA, 25 bp, Rattus norvegicus
gctcattcgctactcaaaccataga

SEQ ID NO: 404629 - DNA, 25 bp, Rattus norvegicus
gctcattcgctagtcaaaccataga

SEQ ID NO: 404630 - DNA, 25 bp, Rattus norvegicus
gctcattctagtagccagtatggcc

SEQ ID NO: 404631 - DNA, 25 bp, Rattus norvegicus
gctcattctagttgccagtatggcc

SEQ ID NO: 404632 - DNA, 25 bp, Rattus norvegicus
gctcattcttcacgcaactttcagt

SEQ ID NO: 404633 - DNA, 25 bp, Rattus norvegicus
gctcattcttcaggcaactttcagt

SEQ ID NO: 404634 - DNA, 25 bp, Rattus norvegicus
gctcattgaatcatcaggcttgaat

SEQ ID NO: 404635 - DNA, 25 bp, Rattus norvegicus
gctcattgaatcttcaggcttgaat

SEQ ID NO: 404636 - DNA, 25 bp, Rattus norvegicus
gctcattgccaacccaggacataga

SEQ ID NO: 404637 - DNA, 25 bp, Rattus norvegicus
gctcattgccaagccaggacataga

SEQ ID NO: 404638 - DNA, 25 bp, Rattus norvegicus
gctcattgccaccaactattgaatt

SEQ ID NO: 404639 - DNA, 25 bp, Rattus norvegicus
gctcattgccacgaactattgaatt

SEQ ID NO: 404640 - DNA, 25 bp, Rattus norvegicus
gctcattgccctaagtttcatacac

SEQ ID NO: 404641 - DNA, 25 bp, Rattus norvegicus
gctcattgcccttagtttcatacac

SEQ ID NO: 404642 - DNA, 25 bp, Rattus norvegicus
gctcattgctggctacttacaagga

SEQ ID NO: 404643 - DNA, 25 bp, Rattus norvegicus
gctcattgctgggtacttacaagga

SEQ ID NO: 404644 - DNA, 25 bp, Rattus norvegicus
gctcattgtaagcatgcactggact

SEQ ID NO: 404645 - DNA, 25 bp, Rattus norvegicus
gctcattgtaaggatgcactggact

SEQ ID NO: 404646 - DNA, 25 bp, Rattus norvegicus
gctcatttacatatggagacccttt

SEQ ID NO: 404647 - DNA, 25 bp, Rattus norvegicus
gctcatttacatttggagacccttt

SEQ ID NO: 404648 - DNA, 25 bp, Rattus norvegicus
gctcatttacccctgtagtgggaag

SEQ ID NO: 404649 - DNA, 25 bp, Rattus norvegicus
gctcatttacccgtgtagtgggaag

SEQ ID NO: 404650 - DNA, 25 bp, Rattus norvegicus
gctcatttagccaggtgcggagtaa

SEQ ID NO: 404651 - DNA, 25 bp, Rattus norvegicus
gctcatttagcctggtgcggagtaa

SEQ ID NO: 404652 - DNA, 25 bp, Rattus norvegicus
gctcatttatttatacctcccatca

SEQ ID NO: 404653 - DNA, 25 bp, Rattus norvegicus
gctcatttatttttacctcccatca

SEQ ID NO: 404654 - DNA, 25 bp, Rattus norvegicus
gctcatttcattctgctctgtggat

SEQ ID NO: 404655 - DNA, 25 bp, Rattus norvegicus
gctcatttcattgtgctctgtggat

SEQ ID NO: 404656 - DNA, 25 bp, Rattus norvegicus
gctcatttcctgattatcattttca

SEQ ID NO: 404657 - DNA, 25 bp, Rattus norvegicus
gctcatttcctgtttatcattttca

SEQ ID NO: 404658 - DNA, 25 bp, Rattus norvegicus
gctcatttgaatacaggtgttccga

SEQ ID NO: 404659 - DNA, 25 bp, Rattus norvegicus
gctcatttgaattcaggtgttccga

SEQ ID NO: 404660 - DNA, 25 bp, Rattus norvegicus
gctcatttgctcataaacctgtcag

SEQ ID NO: 404661 - DNA, 25 bp, Rattus norvegicus
gctcatttgctcttaaacctgtcag

SEQ ID NO: 404662 - DNA, 25 bp, Rattus norvegicus
gctcatttgtaaaattgtcctaatt

SEQ ID NO: 404663 - DNA, 25 bp, Rattus norvegicus
gctcatttgtaatattgtcctaatt

SEQ ID NO: 404664 - DNA, 25 bp, Rattus norvegicus
gctcatttgtcccactggtcaaaaa

SEQ ID NO: 404665 - DNA, 25 bp, Rattus norvegicus
gctcatttgtccgactggtcaaaaa

SEQ ID NO: 404666 - DNA, 25 bp, Rattus norvegicus
gctcattttcatagtcagcctaatt

SEQ ID NO: 404667 - DNA, 25 bp, Rattus norvegicus
gctcattttcattgtcagcctaatt

SEQ ID NO: 404668 - DNA, 25 bp, Rattus norvegicus
gctcattttgagcaagcaggtcttg

SEQ ID NO: 404669 - DNA, 25 bp, Rattus norvegicus
gctcattttgaggaagcaggtcttg

SEQ ID NO: 404670 - DNA, 25 bp, Rattus norvegicus
gctccaaaaggcacagcatgcagga

SEQ ID NO: 404671 - DNA, 25 bp, Rattus norvegicus
gctccaaaaggctcagcatgcagga

SEQ ID NO: 404672 - DNA, 25 bp, Rattus norvegicus
gctccaaaccatcttgtggtctcac

SEQ ID NO: 404673 - DNA, 25 bp, Rattus norvegicus
gctccaaaccatgttgtggtctcac

SEQ ID NO: 404674 - DNA, 25 bp, Rattus norvegicus
gctccaaacctcaggcaccaaaggg

SEQ ID NO: 404675 - DNA, 25 bp, Rattus norvegicus
gctccaaacctctggcaccaaaggg

SEQ ID NO: 404676 - DNA, 25 bp, Rattus norvegicus
gctccaaactttcttctgctcaaga

SEQ ID NO: 404677 - DNA, 25 bp, Rattus norvegicus
gctccaaactttgttctgctcaaga

SEQ ID NO: 404678 - DNA, 25 bp, Rattus norvegicus
gctccaaagactacttttttctcct

SEQ ID NO: 404679 - DNA, 25 bp, Rattus norvegicus
gctccaaagacttcttttttctcct

SEQ ID NO: 404680 - DNA, 25 bp, Rattus norvegicus
gctccaaatacaatgcctgtcttgc

SEQ ID NO: 404681 - DNA, 25 bp, Rattus norvegicus
gctccaaatacattgcctgtcttgc

SEQ ID NO: 404682 - DNA, 25 bp, Rattus norvegicus
gctccaaatgttctttctatctctg

SEQ ID NO: 404683 - DNA, 25 bp, Rattus norvegicus
gctccaaatgttgtttctatctctg

SEQ ID NO: 404684 - DNA, 25 bp, Rattus norvegicus
gctccaacactaaccagtatgcatg

SEQ ID NO: 404685 - DNA, 25 bp, Rattus norvegicus
gctccaacactatccagtatgcatg

SEQ ID NO: 404686 - DNA, 25 bp, Rattus norvegicus
gctccaacccgtcttggtggaccgg

SEQ ID NO: 404687 - DNA, 25 bp, Rattus norvegicus
gctccaacccgtgttggtggaccgg

SEQ ID NO: 404688 - DNA, 25 bp, Rattus norvegicus
gctccaaccggaagtgcacacgaag

SEQ ID NO: 404689 - DNA, 25 bp, Rattus norvegicus
gctccaaccggatgtgcacacgaag

SEQ ID NO: 404690 - DNA, 25 bp, Rattus norvegicus
gctccaacgcgcagcggaaggaaag

SEQ ID NO: 404691 - DNA, 25 bp, Rattus norvegicus
gctccaacgcgctgcggaaggaaag

SEQ ID NO: 404692 - DNA, 25 bp, Rattus norvegicus
gctccaactgttctgtgcttttatg

SEQ ID NO: 404693 - DNA, 25 bp, Rattus norvegicus
gctccaactgttgtgtgcttttatg

SEQ ID NO: 404694 - DNA, 25 bp, Rattus norvegicus
gctccaagcaggcacagctctgaga

SEQ ID NO: 404695 - DNA, 25 bp, Rattus norvegicus
gctccaagcagggacagctctgaga

SEQ ID NO: 404696 - DNA, 25 bp, Rattus norvegicus
gctccaagccagcaggaagccaatt

SEQ ID NO: 404697 - DNA, 25 bp, Rattus norvegicus
gctccaagccaggaggaagccaatt

SEQ ID NO: 404698 - DNA, 25 bp, Rattus norvegicus
gctccaaggaacagctcatgctctt

SEQ ID NO: 404699 - DNA, 25 bp, Rattus norvegicus
gctccaaggaactgctcatgctctt

SEQ ID NO: 404700 - DNA, 25 bp, Rattus norvegicus
gctccaagtcataccgtctatttag

SEQ ID NO: 404701 - DNA, 25 bp, Rattus norvegicus
gctccaagtcattccgtctatttag

SEQ ID NO: 404702 - DNA, 25 bp, Rattus norvegicus
gctccaagtccaagagaactaaggc

SEQ ID NO: 404703 - DNA, 25 bp, Rattus norvegicus
gctccaagtccatgagaactaaggc

SEQ ID NO: 404704 - DNA, 25 bp, Rattus norvegicus
gctccaagtgtcacaatctctggga

SEQ ID NO: 404705 - DNA, 25 bp, Rattus norvegicus
gctccaagtgtctcaatctctggga

SEQ ID NO: 404706 - DNA, 25 bp, Rattus norvegicus
gctccacaaatgacaaagtgcttga

SEQ ID NO: 404707 - DNA, 25 bp, Rattus norvegicus
gctccacaaatgtcaaagtgcttga

SEQ ID NO: 404708 - DNA, 25 bp, Rattus norvegicus
gctccacagagtcatgtatgccatt

SEQ ID NO: 404709 - DNA, 25 bp, Rattus norvegicus
gctccacagagtgatgtatgccatt

SEQ ID NO: 404710 - DNA, 25 bp, Rattus norvegicus
gctccacagcagcttgggtagcaga

SEQ ID NO: 404711 - DNA, 25 bp, Rattus norvegicus
gctccacagcaggttgggtagcaga

SEQ ID NO: 404712 - DNA, 25 bp, Rattus norvegicus
gctccacagggacacgtgtacaatt

SEQ ID NO: 404713 - DNA, 25 bp, Rattus norvegicus
gctccacagggagacgtgtacaatt

SEQ ID NO: 404714 - DNA, 25 bp, Rattus norvegicus
gctccacatgtaagggatttccagt

SEQ ID NO: 404715 - DNA, 25 bp, Rattus norvegicus
gctccacatgtatgggatttccagt

SEQ ID NO: 404716 - DNA, 25 bp, Rattus norvegicus
gctccacatttaaagcagttttgaa

SEQ ID NO: 404717 - DNA, 25 bp, Rattus norvegicus
gctccacatttatagcagttttgaa

SEQ ID NO: 404718 - DNA, 25 bp, Rattus norvegicus
gctccaccaacacccttaagaagtg

SEQ ID NO: 404719 - DNA, 25 bp, Rattus norvegicus
gctccaccaacagccttaagaagtg

SEQ ID NO: 404720 - DNA, 25 bp, Rattus norvegicus
gctccaccagataccttgagattgt

SEQ ID NO: 404721 - DNA, 25 bp, Rattus norvegicus
gctccaccagattccttgagattgt

SEQ ID NO: 404722 - DNA, 25 bp, Rattus norvegicus
gctccaccatggctcattgtgagga

SEQ ID NO: 404723 - DNA, 25 bp, Rattus norvegicus
gctccaccatgggtcattgtgagga

SEQ ID NO: 404724 - DNA, 25 bp, Rattus norvegicus
gctccaccattcatgacatctgtga

SEQ ID NO: 404725 - DNA, 25 bp, Rattus norvegicus
gctccaccattcttgacatctgtga

SEQ ID NO: 404726 - DNA, 25 bp, Rattus norvegicus
gctccacctcttcacttatggttga

SEQ ID NO: 404727 - DNA, 25 bp, Rattus norvegicus
gctccacctcttgacttatggttga

SEQ ID NO: 404728 - DNA, 25 bp, Rattus norvegicus
gctccacgggaacattgagggccat

SEQ ID NO: 404729 - DNA, 25 bp, Rattus norvegicus
gctccacgggaagattgagggccat

SEQ ID NO: 404730 - DNA, 25 bp, Rattus norvegicus
gctccacgtccaatgagagaccctg

SEQ ID NO: 404731 - DNA, 25 bp, Rattus norvegicus
gctccacgtccattgagagaccctg

SEQ ID NO: 404732 - DNA, 25 bp, Rattus norvegicus
gctccacgtctcacgagagcaagaa

SEQ ID NO: 404733 - DNA, 25 bp, Rattus norvegicus
gctccacgtctctcgagagcaagaa

SEQ ID NO: 404734 - DNA, 25 bp, Rattus norvegicus
gctccactggagatcttgagggcct

SEQ ID NO: 404735 - DNA, 25 bp, Rattus norvegicus
gctccactggagttcttgagggcct

SEQ ID NO: 404736 - DNA, 25 bp, Rattus norvegicus
gctccactggtgattcttactgaga

SEQ ID NO: 404737 - DNA, 25 bp, Rattus norvegicus
gctccactggtgtttcttactgaga

SEQ ID NO: 404738 - DNA, 25 bp, Rattus norvegicus
gctccacttaccaattttagccaaa

SEQ ID NO: 404739 - DNA, 25 bp, Rattus norvegicus
gctccacttacctattttagccaaa

SEQ ID NO: 404740 - DNA, 25 bp, Rattus norvegicus
gctccacttcttagtccttagatta

SEQ ID NO: 404741 - DNA, 25 bp, Rattus norvegicus
gctccacttctttgtccttagatta

SEQ ID NO: 404742 - DNA, 25 bp, Rattus norvegicus
gctccactttgcactaaacatctct

SEQ ID NO: 404743 - DNA, 25 bp, Rattus norvegicus
gctccactttgctctaaacatctct

SEQ ID NO: 404744 - DNA, 25 bp, Rattus norvegicus
gctccagaaatgctgctctcaactg

SEQ ID NO: 404745 - DNA, 25 bp, Rattus norvegicus
gctccagaaatggtgctctcaactg

SEQ ID NO: 404746 - DNA, 25 bp, Rattus norvegicus
gctccagaatcactttgttttgttt

SEQ ID NO: 404747 - DNA, 25 bp, Rattus norvegicus
gctccagaatcagtttgttttgttt

SEQ ID NO: 404748 - DNA, 25 bp, Rattus norvegicus
gctccagagcacaggacagacgctg

SEQ ID NO: 404749 - DNA, 25 bp, Rattus norvegicus
gctccagagcactggacagacgctg

SEQ ID NO: 404750 - DNA, 25 bp, Rattus norvegicus
gctccagagccaatcagggttttat

SEQ ID NO: 404751 - DNA, 25 bp, Rattus norvegicus
gctccagagccattcagggttttat

SEQ ID NO: 404752 - DNA, 25 bp, Rattus norvegicus
gctccagagcctaaatgtttttcgt

SEQ ID NO: 404753 - DNA, 25 bp, Rattus norvegicus
gctccagagccttaatgtttttcgt

SEQ ID NO: 404754 - DNA, 25 bp, Rattus norvegicus
gctccagagctgagtctgtctagtc

SEQ ID NO: 404755 - DNA, 25 bp, Rattus norvegicus
gctccagagctgtgtctgtctagtc

SEQ ID NO: 404756 - DNA, 25 bp, Rattus norvegicus
gctccagagggaacgctttcggtga

SEQ ID NO: 404757 - DNA, 25 bp, Rattus norvegicus
gctccagagggatcgctttcggtga

SEQ ID NO: 404758 - DNA, 25 bp, Rattus norvegicus
gctccagatctgagactgctcttgg

SEQ ID NO: 404759 - DNA, 25 bp, Rattus norvegicus
gctccagatctgcagtagctggtca

SEQ ID NO: 404760 - DNA, 25 bp, Rattus norvegicus
gctccagatctggagtagctggtca

SEQ ID NO: 404761 - DNA, 25 bp, Rattus norvegicus
gctccagatctgtgactgctcttgg

SEQ ID NO: 404762 - DNA, 25 bp, Rattus norvegicus
gctccagcaagaaaacctccagatt

SEQ ID NO: 404763 - DNA, 25 bp, Rattus norvegicus
gctccagcaagataacctccagatt

SEQ ID NO: 404764 - DNA, 25 bp, Rattus norvegicus
gctccagcacacacttgaagatctt

SEQ ID NO: 404765 - DNA, 25 bp, Rattus norvegicus
gctccagcacactcttgaagatctt

SEQ ID NO: 404766 - DNA, 25 bp, Rattus norvegicus
gctccagcagacacacagggcggaa

SEQ ID NO: 404767 - DNA, 25 bp, Rattus norvegicus
gctccagcagactcacagggcggaa

SEQ ID NO: 404768 - DNA, 25 bp, Rattus norvegicus
gctccagcatgaatgacctcatcag

SEQ ID NO: 404769 - DNA, 25 bp, Rattus norvegicus
gctccagcatgattgacctcatcag

SEQ ID NO: 404770 - DNA, 25 bp, Rattus norvegicus
gctccagccaaaaatgttgcagcag

SEQ ID NO: 404771 - DNA, 25 bp, Rattus norvegicus
gctccagccaaatatgttgcagcag

SEQ ID NO: 404772 - DNA, 25 bp, Rattus norvegicus
gctccagccgacaggcttgggatta

SEQ ID NO: 404773 - DNA, 25 bp, Rattus norvegicus
gctccagccgactggcttgggatta

SEQ ID NO: 404774 - DNA, 25 bp, Rattus norvegicus
gctccagcgaccctatggcgtgtaa

SEQ ID NO: 404775 - DNA, 25 bp, Rattus norvegicus
gctccagcgaccgtatggcgtgtaa

SEQ ID NO: 404776 - DNA, 25 bp, Rattus norvegicus
gctccagctattcttccaggaagga

SEQ ID NO: 404777 - DNA, 25 bp, Rattus norvegicus
gctccagctattgttccaggaagga

SEQ ID NO: 404778 - DNA, 25 bp, Rattus norvegicus
gctccagctcttaataaaatgccat

SEQ ID NO: 404779 - DNA, 25 bp, Rattus norvegicus
gctccagctctttataaaatgccat

SEQ ID NO: 404780 - DNA, 25 bp, Rattus norvegicus
gctccaggaacgacttcatcaggtt

SEQ ID NO: 404781 - DNA, 25 bp, Rattus norvegicus
gctccaggaacgtcttcatcaggtt

SEQ ID NO: 404782 - DNA, 25 bp, Rattus norvegicus
gctccaggcagaccttgccataaat

SEQ ID NO: 404783 - DNA, 25 bp, Rattus norvegicus
gctccaggcagagcttgccataaat

SEQ ID NO: 404784 - DNA, 25 bp, Rattus norvegicus
gctccaggcctcagagagtcatgtt

SEQ ID NO: 404785 - DNA, 25 bp, Rattus norvegicus
gctccaggcctctgagagtcatgtt

SEQ ID NO: 404786 - DNA, 25 bp, Rattus norvegicus
gctccaggccttcatttttcaagtg

SEQ ID NO: 404787 - DNA, 25 bp, Rattus norvegicus
gctccaggccttgatttttcaagtg

SEQ ID NO: 404788 - DNA, 25 bp, Rattus norvegicus
gctccaggcttgaggttgttagcca

SEQ ID NO: 404789 - DNA, 25 bp, Rattus norvegicus
gctccaggcttgtggttgttagcca

SEQ ID NO: 404790 - DNA, 25 bp, Rattus norvegicus
gctccagggacacttcaaaggtctg

SEQ ID NO: 404791 - DNA, 25 bp, Rattus norvegicus
gctccagggacagttcaaaggtctg

SEQ ID NO: 404792 - DNA, 25 bp, Rattus norvegicus
gctccagggcctacagctgcagggt

SEQ ID NO: 404793 - DNA, 25 bp, Rattus norvegicus
gctccagggccttcagctgcagggt

SEQ ID NO: 404794 - DNA, 25 bp, Rattus norvegicus
gctccaggttcccagatggcaggta

SEQ ID NO: 404795 - DNA, 25 bp, Rattus norvegicus
gctccaggttccgagatggcaggta

SEQ ID NO: 404796 - DNA, 25 bp, Rattus norvegicus
gctccaggtttccagcttttagaga

SEQ ID NO: 404797 - DNA, 25 bp, Rattus norvegicus
gctccaggtttcgagcttttagaga

SEQ ID NO: 404798 - DNA, 25 bp, Rattus norvegicus
gctccagtattaatcagttcctctt

SEQ ID NO: 404799 - DNA, 25 bp, Rattus norvegicus
gctccagtattattcagttcctctt

SEQ ID NO: 404800 - DNA, 25 bp, Rattus norvegicus
gctccagtcaccctaggaaacagat

SEQ ID NO: 404801 - DNA, 25 bp, Rattus norvegicus
gctccagtcaccgtaggaaacagat

SEQ ID NO: 404802 - DNA, 25 bp, Rattus norvegicus
gctccagtccatcgtggtgcagctt

SEQ ID NO: 404803 - DNA, 25 bp, Rattus norvegicus
gctccagtccatggtggtgcagctt

SEQ ID NO: 404804 - DNA, 25 bp, Rattus norvegicus
gctccagtcctgatggaccttggaa

SEQ ID NO: 404805 - DNA, 25 bp, Rattus norvegicus
gctccagtcctgttggaccttggaa

SEQ ID NO: 404806 - DNA, 25 bp, Rattus norvegicus
gctccagttacacaaggctctcgaa

SEQ ID NO: 404807 - DNA, 25 bp, Rattus norvegicus
gctccagttacagaaggctctcgaa

SEQ ID NO: 404808 - DNA, 25 bp, Rattus norvegicus
gctccagttactctcaacagtggct

SEQ ID NO: 404809 - DNA, 25 bp, Rattus norvegicus
gctccagttactgtcaacagtggct

SEQ ID NO: 404810 - DNA, 25 bp, Rattus norvegicus
gctccagttagtattgtgcacatgt

SEQ ID NO: 404811 - DNA, 25 bp, Rattus norvegicus
gctccagttagttttgtgcacatgt

SEQ ID NO: 404812 - DNA, 25 bp, Rattus norvegicus
gctccagttggactgctcagaatac

SEQ ID NO: 404813 - DNA, 25 bp, Rattus norvegicus
gctccagttggagtgctcagaatac

SEQ ID NO: 404814 - DNA, 25 bp, Rattus norvegicus
gctccatactgcagaaccctgtgga

SEQ ID NO: 404815 - DNA, 25 bp, Rattus norvegicus
gctccatactgctgaaccctgtgga

SEQ ID NO: 404816 - DNA, 25 bp, Rattus norvegicus
gctccatactggatgccttgtgaag

SEQ ID NO: 404817 - DNA, 25 bp, Rattus norvegicus
gctccatactggttgccttgtgaag

SEQ ID NO: 404818 - DNA, 25 bp, Rattus norvegicus
gctccatcaaccagcgtatgaggca

SEQ ID NO: 404819 - DNA, 25 bp, Rattus norvegicus
gctccatcaacctgcgtatgaggca

SEQ ID NO: 404820 - DNA, 25 bp, Rattus norvegicus
gctccatcacacattattccattag

SEQ ID NO: 404821 - DNA, 25 bp, Rattus norvegicus
gctccatcacactttattccattag

SEQ ID NO: 404822 - DNA, 25 bp, Rattus norvegicus
gctccatccaagacacagtcactgg

SEQ ID NO: 404823 - DNA, 25 bp, Rattus norvegicus
gctccatccaagtcacagtcactgg

SEQ ID NO: 404824 - DNA, 25 bp, Rattus norvegicus
gctccatcccacaggtgtgaggaaa

SEQ ID NO: 404825 - DNA, 25 bp, Rattus norvegicus
gctccatcccactggtgtgaggaaa

SEQ ID NO: 404826 - DNA, 25 bp, Rattus norvegicus
gctccatgactcattttggtgctaa

SEQ ID NO: 404827 - DNA, 25 bp, Rattus norvegicus
gctccatgactctttttggtgctaa

SEQ ID NO: 404828 - DNA, 25 bp, Rattus norvegicus
gctccatgagcgctctgggatgtta

SEQ ID NO: 404829 - DNA, 25 bp, Rattus norvegicus
gctccatgagcggtctgggatgtta

SEQ ID NO: 404830 - DNA, 25 bp, Rattus norvegicus
gctccatgcaagagtctgggcctgg

SEQ ID NO: 404831 - DNA, 25 bp, Rattus norvegicus
gctccatgcaagtgtctgggcctgg

SEQ ID NO: 404832 - DNA, 25 bp, Rattus norvegicus
gctccatgccatccatatctaggaa

SEQ ID NO: 404833 - DNA, 25 bp, Rattus norvegicus
gctccatgccatgcatatctaggaa

SEQ ID NO: 404834 - DNA, 25 bp, Rattus norvegicus
gctccatgccttaaaaattctccga

SEQ ID NO: 404835 - DNA, 25 bp, Rattus norvegicus
gctccatgcctttaaaattctccga

SEQ ID NO: 404836 - DNA, 25 bp, Rattus norvegicus
gctccatggacaaaccttctgtaaa

SEQ ID NO: 404837 - DNA, 25 bp, Rattus norvegicus
gctccatggacataccttctgtaaa

SEQ ID NO: 404838 - DNA, 25 bp, Rattus norvegicus
gctccatgtactaaacaaaaaccag

SEQ ID NO: 404839 - DNA, 25 bp, Rattus norvegicus
gctccatgtacttaacaaaaaccag

SEQ ID NO: 404840 - DNA, 25 bp, Rattus norvegicus
gctccatgtcatagggtttcaacac

SEQ ID NO: 404841 - DNA, 25 bp, Rattus norvegicus
gctccatgtcattgggtttcaacac

SEQ ID NO: 404842 - DNA, 25 bp, Rattus norvegicus
gctccatgtccaactgagactaggg

SEQ ID NO: 404843 - DNA, 25 bp, Rattus norvegicus
gctccatgtccatctgagactaggg

SEQ ID NO: 404844 - DNA, 25 bp, Rattus norvegicus
gctccatgtggaaggcttgccggtc

SEQ ID NO: 404845 - DNA, 25 bp, Rattus norvegicus
gctccatgtggatggcttgccggtc

SEQ ID NO: 404846 - DNA, 25 bp, Rattus norvegicus
gctccattactcattttcggtgcta

SEQ ID NO: 404847 - DNA, 25 bp, Rattus norvegicus
gctccattactctttttcggtgcta

SEQ ID NO: 404848 - DNA, 25 bp, Rattus norvegicus
gctccattcatcagtgaagttcagt

SEQ ID NO: 404849 - DNA, 25 bp, Rattus norvegicus
gctccattcatctgtgaagttcagt

SEQ ID NO: 404850 - DNA, 25 bp, Rattus norvegicus
gctccattgaggaaaggcactaaat

SEQ ID NO: 404851 - DNA, 25 bp, Rattus norvegicus
gctccattgaggtaaggcactaaat

SEQ ID NO: 404852 - DNA, 25 bp, Rattus norvegicus
gctccattgtgtctgttttcttcaa

SEQ ID NO: 404853 - DNA, 25 bp, Rattus norvegicus
gctccattgtgtgtgttttcttcaa

SEQ ID NO: 404854 - DNA, 25 bp, Rattus norvegicus
gctccatttgacacatgactctaga

SEQ ID NO: 404855 - DNA, 25 bp, Rattus norvegicus
gctccatttgactcatgactctaga

SEQ ID NO: 404856 - DNA, 25 bp, Rattus norvegicus
gctcccaaactccttgtggttttat

SEQ ID NO: 404857 - DNA, 25 bp, Rattus norvegicus
gctcccaaactcgttgtggttttat

SEQ ID NO: 404858 - DNA, 25 bp, Rattus norvegicus
gctcccaagggactgtttctgaaga

SEQ ID NO: 404859 - DNA, 25 bp, Rattus norvegicus
gctcccaagggagtgtttctgaaga

SEQ ID NO: 404860 - DNA, 25 bp, Rattus norvegicus
gctcccaagtgcacttagacatcag

SEQ ID NO: 404861 - DNA, 25 bp, Rattus norvegicus
gctcccaagtgctcttagacatcag

SEQ ID NO: 404862 - DNA, 25 bp, Rattus norvegicus
gctcccacaatactatcctaatttt

SEQ ID NO: 404863 - DNA, 25 bp, Rattus norvegicus
gctcccacaatagtatcctaatttt

SEQ ID NO: 404864 - DNA, 25 bp, Rattus norvegicus
gctcccaccttcaatctagttaaga

SEQ ID NO: 404865 - DNA, 25 bp, Rattus norvegicus
gctcccaccttctatctagttaaga

SEQ ID NO: 404866 - DNA, 25 bp, Rattus norvegicus
gctcccacgggaaggaatgctgtat

SEQ ID NO: 404867 - DNA, 25 bp, Rattus norvegicus
gctcccacgggatggaatgctgtat

SEQ ID NO: 404868 - DNA, 25 bp, Rattus norvegicus
gctcccacgtgcagactgtactaaa

SEQ ID NO: 404869 - DNA, 25 bp, Rattus norvegicus
gctcccacgtgctgactgtactaaa

SEQ ID NO: 404870 - DNA, 25 bp, Rattus norvegicus
gctcccactgttccttttcaaaatg

SEQ ID NO: 404871 - DNA, 25 bp, Rattus norvegicus
gctcccactgttgcttttcaaaatg

SEQ ID NO: 404872 - DNA, 25 bp, Rattus norvegicus
gctcccagactgctcatatgcggat

SEQ ID NO: 404873 - DNA, 25 bp, Rattus norvegicus
gctcccagactggtcatatgcggat

SEQ ID NO: 404874 - DNA, 25 bp, Rattus norvegicus
gctcccagccatcttttactttgat

SEQ ID NO: 404875 - DNA, 25 bp, Rattus norvegicus
gctcccagccatgttttactttgat

SEQ ID NO: 404876 - DNA, 25 bp, Rattus norvegicus
gctcccagcggcaccagtgtaaatt

SEQ ID NO: 404877 - DNA, 25 bp, Rattus norvegicus
gctcccagcggctccagtgtaaatt

SEQ ID NO: 404878 - DNA, 25 bp, Rattus norvegicus
gctcccaggctgaggaagtctgact

SEQ ID NO: 404879 - DNA, 25 bp, Rattus norvegicus
gctcccaggctgtggaagtctgact

SEQ ID NO: 404880 - DNA, 25 bp, Rattus norvegicus
gctcccaggcttcagaaaatcatcc

SEQ ID NO: 404881 - DNA, 25 bp, Rattus norvegicus
gctcccaggcttgagaaaatcatcc

SEQ ID NO: 404882 - DNA, 25 bp, Rattus norvegicus
gctcccagggttacttatcccgatg

SEQ ID NO: 404883 - DNA, 25 bp, Rattus norvegicus
gctcccagggtttcttatcccgatg

SEQ ID NO: 404884 - DNA, 25 bp, Rattus norvegicus
gctcccagttccaacagtacaatgt

SEQ ID NO: 404885 - DNA, 25 bp, Rattus norvegicus
gctcccagttcctacagtacaatgt

SEQ ID NO: 404886 - DNA, 25 bp, Rattus norvegicus
gctcccatagctataacttgtcaaa

SEQ ID NO: 404887 - DNA, 25 bp, Rattus norvegicus
gctcccatagctttaacttgtcaaa

SEQ ID NO: 404888 - DNA, 25 bp, Rattus norvegicus
gctcccatctgcaaatgactttatc

SEQ ID NO: 404889 - DNA, 25 bp, Rattus norvegicus
gctcccatctgctaatgactttatc

SEQ ID NO: 404890 - DNA, 25 bp, Rattus norvegicus
gctcccatgtgtatcctatgtatga

SEQ ID NO: 404891 - DNA, 25 bp, Rattus norvegicus
gctcccatgtgtttcctatgtatga

SEQ ID NO: 404892 - DNA, 25 bp, Rattus norvegicus
gctcccatttataattgtgccctta

SEQ ID NO: 404893 - DNA, 25 bp, Rattus norvegicus
gctcccatttattattgtgccctta

SEQ ID NO: 404894 - DNA, 25 bp, Rattus norvegicus
gctccccaaagaagcacttgattta

SEQ ID NO: 404895 - DNA, 25 bp, Rattus norvegicus
gctccccaaagatgcacttgattta

SEQ ID NO: 404896 - DNA, 25 bp, Rattus norvegicus
gctccccaaatcatagtcctattta

SEQ ID NO: 404897 - DNA, 25 bp, Rattus norvegicus
gctccccaaatcttagtcctattta

SEQ ID NO: 404898 - DNA, 25 bp, Rattus norvegicus
gctccccactacctgtgaggaagat

SEQ ID NO: 404899 - DNA, 25 bp, Rattus norvegicus
gctccccactacgtgtgaggaagat

SEQ ID NO: 404900 - DNA, 25 bp, Rattus norvegicus
gctccccagcaccttggtaaagact

SEQ ID NO: 404901 - DNA, 25 bp, Rattus norvegicus
gctccccagcacgttggtaaagact

SEQ ID NO: 404902 - DNA, 25 bp, Rattus norvegicus
gctccccagtccatactagtgagga

SEQ ID NO: 404903 - DNA, 25 bp, Rattus norvegicus
gctccccagtccttactagtgagga

SEQ ID NO: 404904 - DNA, 25 bp, Rattus norvegicus
gctccccagtgtccagaactcagtg

SEQ ID NO: 404905 - DNA, 25 bp, Rattus norvegicus
gctccccagtgtgcagaactcagtg

SEQ ID NO: 404906 - DNA, 25 bp, Rattus norvegicus
gctccccggtgaaccaaggagacaa

SEQ ID NO: 404907 - DNA, 25 bp, Rattus norvegicus
gctccccggtgatccaaggagacaa

SEQ ID NO: 404908 - DNA, 25 bp, Rattus norvegicus
gctccccgtcccaggaaatctgagt

SEQ ID NO: 404909 - DNA, 25 bp, Rattus norvegicus
gctccccgtccctggaaatctgagt

SEQ ID NO: 404910 - DNA, 25 bp, Rattus norvegicus
gctcccctacttagcatggacattt

SEQ ID NO: 404911 - DNA, 25 bp, Rattus norvegicus
gctcccctactttgcatggacattt

SEQ ID NO: 404912 - DNA, 25 bp, Rattus norvegicus
gctcccctccttaagtgatgtatat

SEQ ID NO: 404913 - DNA, 25 bp, Rattus norvegicus
gctcccctcctttagtgatgtatat

SEQ ID NO: 404914 - DNA, 25 bp, Rattus norvegicus
gctcccctctctatatttaaggtga

SEQ ID NO: 404915 - DNA, 25 bp, Rattus norvegicus
gctcccctctctttatttaaggtga

SEQ ID NO: 404916 - DNA, 25 bp, Rattus norvegicus
gctcccctgtgacttactgtgtaat

SEQ ID NO: 404917 - DNA, 25 bp, Rattus norvegicus
gctcccctgtgagttactgtgtaat

SEQ ID NO: 404918 - DNA, 25 bp, Rattus norvegicus
gctcccctttctaggtataagtgca

SEQ ID NO: 404919 - DNA, 25 bp, Rattus norvegicus
gctcccctttcttggtataagtgca

SEQ ID NO: 404920 - DNA, 25 bp, Rattus norvegicus
gctcccgagagcacttgacaacttg

SEQ ID NO: 404921 - DNA, 25 bp, Rattus norvegicus
gctcccgagagctcttgacaacttg

SEQ ID NO: 404922 - DNA, 25 bp, Rattus norvegicus
gctcccgatgtaagttgtctgtgtc

SEQ ID NO: 404923 - DNA, 25 bp, Rattus norvegicus
gctcccgatgtatgttgtctgtgtc

SEQ ID NO: 404924 - DNA, 25 bp, Rattus norvegicus
gctcccgcaccgaggtagccattgg

SEQ ID NO: 404925 - DNA, 25 bp, Rattus norvegicus
gctcccgcaccgtggtagccattgg

SEQ ID NO: 404926 - DNA, 25 bp, Rattus norvegicus
gctcccggagctcggtggcggctgt

SEQ ID NO: 404927 - DNA, 25 bp, Rattus norvegicus
gctcccggagctgggtggcggctgt

SEQ ID NO: 404928 - DNA, 25 bp, Rattus norvegicus
gctcccggagtcattgtgatgacac

SEQ ID NO: 404929 - DNA, 25 bp, Rattus norvegicus
gctcccggagtctttgtgatgacac

SEQ ID NO: 404930 - DNA, 25 bp, Rattus norvegicus
gctcccggcaagacggacagggctc

SEQ ID NO: 404931 - DNA, 25 bp, Rattus norvegicus
gctcccggcaagtcggacagggctc

SEQ ID NO: 404932 - DNA, 25 bp, Rattus norvegicus
gctcccgtcctcatgaagatgctga

SEQ ID NO: 404933 - DNA, 25 bp, Rattus norvegicus
gctcccgtcctcttgaagatgctga

SEQ ID NO: 404934 - DNA, 25 bp, Rattus norvegicus
gctcccgtcttaatgctatttttaa

SEQ ID NO: 404935 - DNA, 25 bp, Rattus norvegicus
gctcccgtcttattgctatttttaa

SEQ ID NO: 404936 - DNA, 25 bp, Rattus norvegicus
gctcccgtgggacagtcatgcaaac

SEQ ID NO: 404937 - DNA, 25 bp, Rattus norvegicus
gctcccgtgggagagtcatgcaaac

SEQ ID NO: 404938 - DNA, 25 bp, Rattus norvegicus
gctcccgttgctagggtgagagtta

SEQ ID NO: 404939 - DNA, 25 bp, Rattus norvegicus
gctcccgttgctagtgggaactgtt

SEQ ID NO: 404940 - DNA, 25 bp, Rattus norvegicus
gctcccgttgcttgggtgagagtta

SEQ ID NO: 404941 - DNA, 25 bp, Rattus norvegicus
gctcccgttgcttgtgggaactgtt

SEQ ID NO: 404942 - DNA, 25 bp, Rattus norvegicus
gctcccgtttgtcaggatccgaatt

SEQ ID NO: 404943 - DNA, 25 bp, Rattus norvegicus
gctcccgtttgtgaggatccgaatt

SEQ ID NO: 404944 - DNA, 25 bp, Rattus norvegicus
gctccctaccaacttcactgtgggt

SEQ ID NO: 404945 - DNA, 25 bp, Rattus norvegicus
gctccctaccaagttcactgtgggt

SEQ ID NO: 404946 - DNA, 25 bp, Rattus norvegicus
gctccctacgcaacatacttgaatt

SEQ ID NO: 404947 - DNA, 25 bp, Rattus norvegicus
gctccctacgcatcatacttgaatt

SEQ ID NO: 404948 - DNA, 25 bp, Rattus norvegicus
gctccctagggactcctgagaactg

SEQ ID NO: 404949 - DNA, 25 bp, Rattus norvegicus
gctccctagggagtcctgagaactg

SEQ ID NO: 404950 - DNA, 25 bp, Rattus norvegicus
gctccctagggcaaggcagacagga

SEQ ID NO: 404951 - DNA, 25 bp, Rattus norvegicus
gctccctagggctaggcagacagga

SEQ ID NO: 404952 - DNA, 25 bp, Rattus norvegicus
gctccctatctgctcatgggacaga

SEQ ID NO: 404953 - DNA, 25 bp, Rattus norvegicus
gctccctatctggtcatgggacaga

SEQ ID NO: 404954 - DNA, 25 bp, Rattus norvegicus
gctccctcaacaatttgtgcaccag

SEQ ID NO: 404955 - DNA, 25 bp, Rattus norvegicus
gctccctcaacattttgtgcaccag

SEQ ID NO: 404956 - DNA, 25 bp, Rattus norvegicus
gctccctcaggactgggcccatgat

SEQ ID NO: 404957 - DNA, 25 bp, Rattus norvegicus
gctccctcaggagtgggcccatgat

SEQ ID NO: 404958 - DNA, 25 bp, Rattus norvegicus
gctccctccaccaatgaagaagcat

SEQ ID NO: 404959 - DNA, 25 bp, Rattus norvegicus
gctccctccacctatgaagaagcat

SEQ ID NO: 404960 - DNA, 25 bp, Rattus norvegicus
gctccctccagccttgaggatgtta

SEQ ID NO: 404961 - DNA, 25 bp, Rattus norvegicus
gctccctccagcgttgaggatgtta

SEQ ID NO: 404962 - DNA, 25 bp, Rattus norvegicus
gctccctccgagagaatgcccagga

SEQ ID NO: 404963 - DNA, 25 bp, Rattus norvegicus
gctccctccgagtgaatgcccagga

SEQ ID NO: 404964 - DNA, 25 bp, Rattus norvegicus
gctccctcctttcgacaaggaagtg

SEQ ID NO: 404965 - DNA, 25 bp, Rattus norvegicus
gctccctcctttggacaaggaagtg

SEQ ID NO: 404966 - DNA, 25 bp, Rattus norvegicus
gctccctcttcaacagtgtgtaaat

SEQ ID NO: 404967 - DNA, 25 bp, Rattus norvegicus
gctccctcttcatcagtgtgtaaat

SEQ ID NO: 404968 - DNA, 25 bp, Rattus norvegicus
gctccctcttctactcaggtgaaaa

SEQ ID NO: 404969 - DNA, 25 bp, Rattus norvegicus
gctccctcttcttctcaggtgaaaa

SEQ ID NO: 404970 - DNA, 25 bp, Rattus norvegicus
gctccctgaagaatttcagctgtga

SEQ ID NO: 404971 - DNA, 25 bp, Rattus norvegicus
gctccctgaagattttcagctgtga

SEQ ID NO: 404972 - DNA, 25 bp, Rattus norvegicus
gctccctgaagcagtcacttggtta

SEQ ID NO: 404973 - DNA, 25 bp, Rattus norvegicus
gctccctgaagctgtcacttggtta

SEQ ID NO: 404974 - DNA, 25 bp, Rattus norvegicus
gctccctgattgagcaaagctatat

SEQ ID NO: 404975 - DNA, 25 bp, Rattus norvegicus
gctccctgattgtgcaaagctatat

SEQ ID NO: 404976 - DNA, 25 bp, Rattus norvegicus
gctccctgccttcaaatagcacata

SEQ ID NO: 404977 - DNA, 25 bp, Rattus norvegicus
gctccctgccttgaaatagcacata

SEQ ID NO: 404978 - DNA, 25 bp, Rattus norvegicus
gctccctggaacatgaactcgctgt

SEQ ID NO: 404979 - DNA, 25 bp, Rattus norvegicus
gctccctggaacttgaactcgctgt

SEQ ID NO: 404980 - DNA, 25 bp, Rattus norvegicus
gctccctggacaacttttaattaca

SEQ ID NO: 404981 - DNA, 25 bp, Rattus norvegicus
gctccctggacatcttttaattaca

SEQ ID NO: 404982 - DNA, 25 bp, Rattus norvegicus
gctccctggagtccctatttatttc

SEQ ID NO: 404983 - DNA, 25 bp, Rattus norvegicus
gctccctggagtgcctatttatttc

SEQ ID NO: 404984 - DNA, 25 bp, Rattus norvegicus
gctccctggcaaatgtaactgctga

SEQ ID NO: 404985 - DNA, 25 bp, Rattus norvegicus
gctccctggcaattgtaactgctga

SEQ ID NO: 404986 - DNA, 25 bp, Rattus norvegicus
gctccctggcttatgtgaaccacaa

SEQ ID NO: 404987 - DNA, 25 bp, Rattus norvegicus
gctccctggcttttgtgaaccacaa

SEQ ID NO: 404988 - DNA, 25 bp, Rattus norvegicus
gctccctgggcaatcgtgtggtgaa

SEQ ID NO: 404989 - DNA, 25 bp, Rattus norvegicus
gctccctgggcattcgtgtggtgaa

SEQ ID NO: 404990 - DNA, 25 bp, Rattus norvegicus
gctccctggtttcatccagcaatat

SEQ ID NO: 404991 - DNA, 25 bp, Rattus norvegicus
gctccctggtttgatccagcaatat

SEQ ID NO: 404992 - DNA, 25 bp, Rattus norvegicus
gctccctgttgccagcgtgctgaag

SEQ ID NO: 404993 - DNA, 25 bp, Rattus norvegicus
gctccctgttgcgagcgtgctgaag

SEQ ID NO: 404994 - DNA, 25 bp, Rattus norvegicus
gctcccttactgcatgtgagaacct

SEQ ID NO: 404995 - DNA, 25 bp, Rattus norvegicus
gctcccttactggatgtgagaacct

SEQ ID NO: 404996 - DNA, 25 bp, Rattus norvegicus
gctcccttcaggctgttgaggctca

SEQ ID NO: 404997 - DNA, 25 bp, Rattus norvegicus
gctcccttcagggtgttgaggctca

SEQ ID NO: 404998 - DNA, 25 bp, Rattus norvegicus
gctcccttccatcgaacaaagctga

SEQ ID NO: 404999 - DNA, 25 bp, Rattus norvegicus
gctcccttccatggaacaaagctga

SEQ ID NO: 405000 - DNA, 25 bp, Rattus norvegicus
gctcccttctctatgtaattgttta

SEQ ID NO: 405001 - DNA, 25 bp, Rattus norvegicus
gctcccttctctttgtaattgttta

SEQ ID NO: 405002 - DNA, 25 bp, Rattus norvegicus
gctcccttgggacacaattccacat

SEQ ID NO: 405003 - DNA, 25 bp, Rattus norvegicus
gctcccttgggagacaattccacat

SEQ ID NO: 405004 - DNA, 25 bp, Rattus norvegicus
gctcccttgggcaagaggctgaaca

SEQ ID NO: 405005 - DNA, 25 bp, Rattus norvegicus
gctcccttgggctagaggctgaaca

SEQ ID NO: 405006 - DNA, 25 bp, Rattus norvegicus
gctcccttggtacttgttctgttca

SEQ ID NO: 405007 - DNA, 25 bp, Rattus norvegicus
gctcccttggtagttgttctgttca

SEQ ID NO: 405008 - DNA, 25 bp, Rattus norvegicus
gctcccttggtcattcactaaaaat

SEQ ID NO: 405009 - DNA, 25 bp, Rattus norvegicus
gctcccttggtctttcactaaaaat

SEQ ID NO: 405010 - DNA, 25 bp, Rattus norvegicus
gctccctttctcatgagagtggtag

SEQ ID NO: 405011 - DNA, 25 bp, Rattus norvegicus
gctccctttctcttgagagtggtag

SEQ ID NO: 405012 - DNA, 25 bp, Rattus norvegicus
gctccgacatctatgtggaagcttc

SEQ ID NO: 405013 - DNA, 25 bp, Rattus norvegicus
gctccgacatctttgtggaagcttc

SEQ ID NO: 405014 - DNA, 25 bp, Rattus norvegicus
gctccgacctggcagacggaagcat

SEQ ID NO: 405015 - DNA, 25 bp, Rattus norvegicus
gctccgacctgggagacggaagcat

SEQ ID NO: 405016 - DNA, 25 bp, Rattus norvegicus
gctccgactgacactggtgttggga

SEQ ID NO: 405017 - DNA, 25 bp, Rattus norvegicus
gctccgactgactctggtgttggga

SEQ ID NO: 405018 - DNA, 25 bp, Rattus norvegicus
gctccgagggccaagcaaggatttt

SEQ ID NO: 405019 - DNA, 25 bp, Rattus norvegicus
gctccgagggcctagcaaggatttt

SEQ ID NO: 405020 - DNA, 25 bp, Rattus norvegicus
gctccgccaggaatgtgggagaccc

SEQ ID NO: 405021 - DNA, 25 bp, Rattus norvegicus
gctccgccaggattgtgggagaccc

SEQ ID NO: 405022 - DNA, 25 bp, Rattus norvegicus
gctccgcctcccagtctttaggaga

SEQ ID NO: 405023 - DNA, 25 bp, Rattus norvegicus
gctccgcctccctgtctttaggaga

SEQ ID NO: 405024 - DNA, 25 bp, Rattus norvegicus
gctccgccttcacagggaactcatg

SEQ ID NO: 405025 - DNA, 25 bp, Rattus norvegicus
gctccgccttcagagggaactcatg

SEQ ID NO: 405026 - DNA, 25 bp, Rattus norvegicus
gctccgcctttgaaggagtccacac

SEQ ID NO: 405027 - DNA, 25 bp, Rattus norvegicus
gctccgcctttgtaggagtccacac

SEQ ID NO: 405028 - DNA, 25 bp, Rattus norvegicus
gctccgcggtacacggtgtatgaga

SEQ ID NO: 405029 - DNA, 25 bp, Rattus norvegicus
gctccgcggtactcggtgtatgaga

SEQ ID NO: 405030 - DNA, 25 bp, Rattus norvegicus
gctccgctctgtctctgaagaagaa

SEQ ID NO: 405031 - DNA, 25 bp, Rattus norvegicus
gctccgctctgtgtctgaagaagaa

SEQ ID NO: 405032 - DNA, 25 bp, Rattus norvegicus
gctccgctcttaaagccttggtaaa

SEQ ID NO: 405033 - DNA, 25 bp, Rattus norvegicus
gctccgctcttatagccttggtaaa

SEQ ID NO: 405034 - DNA, 25 bp, Rattus norvegicus
gctccgctggctagtttatcaggga

SEQ ID NO: 405035 - DNA, 25 bp, Rattus norvegicus
gctccgctggcttgtttatcaggga

SEQ ID NO: 405036 - DNA, 25 bp, Rattus norvegicus
gctccgctgtcccttacctttagga

SEQ ID NO: 405037 - DNA, 25 bp, Rattus norvegicus
gctccgctgtccgttacctttagga

SEQ ID NO: 405038 - DNA, 25 bp, Rattus norvegicus
gctccgcttgtgacccagggaaaaa

SEQ ID NO: 405039 - DNA, 25 bp, Rattus norvegicus
gctccgcttgtgtcccagggaaaaa

SEQ ID NO: 405040 - DNA, 25 bp, Rattus norvegicus
gctccggaatcccagcacatagaaa

SEQ ID NO: 405041 - DNA, 25 bp, Rattus norvegicus
gctccggaatccgagcacatagaaa

SEQ ID NO: 405042 - DNA, 25 bp, Rattus norvegicus
gctccggaatcgaaactgcacagtc

SEQ ID NO: 405043 - DNA, 25 bp, Rattus norvegicus
gctccggaatcgtaactgcacagtc

SEQ ID NO: 405044 - DNA, 25 bp, Rattus norvegicus
gctccggagaggaggcgctcaacac

SEQ ID NO: 405045 - DNA, 25 bp, Rattus norvegicus
gctccggagaggtggcgctcaacac

SEQ ID NO: 405046 - DNA, 25 bp, Rattus norvegicus
gctccggaggccagacgaaggatca

SEQ ID NO: 405047 - DNA, 25 bp, Rattus norvegicus
gctccggaggcctgacgaaggatca

SEQ ID NO: 405048 - DNA, 25 bp, Rattus norvegicus
gctccggcaaataaggtctgacttt

SEQ ID NO: 405049 - DNA, 25 bp, Rattus norvegicus
gctccggcaaattaggtctgacttt

SEQ ID NO: 405050 - DNA, 25 bp, Rattus norvegicus
gctccggccagtccgaatacatgtt

SEQ ID NO: 405051 - DNA, 25 bp, Rattus norvegicus
gctccggccagtgcgaatacatgtt

SEQ ID NO: 405052 - DNA, 25 bp, Rattus norvegicus
gctccggctaggactagttgcagta

SEQ ID NO: 405053 - DNA, 25 bp, Rattus norvegicus
gctccggctaggtctagttgcagta

SEQ ID NO: 405054 - DNA, 25 bp, Rattus norvegicus
gctccggctcctatggaaacctgga

SEQ ID NO: 405055 - DNA, 25 bp, Rattus norvegicus
gctccggctcctttggaaacctgga

SEQ ID NO: 405056 - DNA, 25 bp, Rattus norvegicus
gctccgggagagcaatccacactgt

SEQ ID NO: 405057 - DNA, 25 bp, Rattus norvegicus
gctccgggagaggaatccacactgt

SEQ ID NO: 405058 - DNA, 25 bp, Rattus norvegicus
gctccggtctacacctagttagtat

SEQ ID NO: 405059 - DNA, 25 bp, Rattus norvegicus
gctccggtctactcctagttagtat

SEQ ID NO: 405060 - DNA, 25 bp, Rattus norvegicus
gctccggtgggacaggttctttaag

SEQ ID NO: 405061 - DNA, 25 bp, Rattus norvegicus
gctccggtgggagaggttctttaag

SEQ ID NO: 405062 - DNA, 25 bp, Rattus norvegicus
gctccggttctgctgatgtggccac

SEQ ID NO: 405063 - DNA, 25 bp, Rattus norvegicus
gctccggttctggtgatgtggccac

SEQ ID NO: 405064 - DNA, 25 bp, Rattus norvegicus
gctccgtagtaaacatggcggcggc

SEQ ID NO: 405065 - DNA, 25 bp, Rattus norvegicus
gctccgtagtaacgccctggatcaa

SEQ ID NO: 405066 - DNA, 25 bp, Rattus norvegicus
gctccgtagtaaggccctggatcaa

SEQ ID NO: 405067 - DNA, 25 bp, Rattus norvegicus
gctccgtagtaatcatggcggcggc

SEQ ID NO: 405068 - DNA, 25 bp, Rattus norvegicus
gctccgtatttccaccttagtgtta

SEQ ID NO: 405069 - DNA, 25 bp, Rattus norvegicus
gctccgtatttcgaccttagtgtta

SEQ ID NO: 405070 - DNA, 25 bp, Rattus norvegicus
gctccgtcagctacgaggactttgt

SEQ ID NO: 405071 - DNA, 25 bp, Rattus norvegicus
gctccgtcagcttcgaggactttgt

SEQ ID NO: 405072 - DNA, 25 bp, Rattus norvegicus
gctccgtcatgcagggtacagcaga

SEQ ID NO: 405073 - DNA, 25 bp, Rattus norvegicus
gctccgtcatgctgggtacagcaga

SEQ ID NO: 405074 - DNA, 25 bp, Rattus norvegicus
gctccgtcctctactgtaaattggt

SEQ ID NO: 405075 - DNA, 25 bp, Rattus norvegicus
gctccgtcctcttctgtaaattggt

SEQ ID NO: 405076 - DNA, 25 bp, Rattus norvegicus
gctccgtctgagatatcttgtaaag

SEQ ID NO: 405077 - DNA, 25 bp, Rattus norvegicus
gctccgtctgagttatcttgtaaag

SEQ ID NO: 405078 - DNA, 25 bp, Rattus norvegicus
gctccgtctgtgaaccgaagtggaa

SEQ ID NO: 405079 - DNA, 25 bp, Rattus norvegicus
gctccgtctgtgtaccgaagtggaa

SEQ ID NO: 405080 - DNA, 25 bp, Rattus norvegicus
gctccgtgagaaagttactgctgac

SEQ ID NO: 405081 - DNA, 25 bp, Rattus norvegicus
gctccgtgagaatgttactgctgac

SEQ ID NO: 405082 - DNA, 25 bp, Rattus norvegicus
gctccgtgcttgcttgcgatgttca

SEQ ID NO: 405083 - DNA, 25 bp, Rattus norvegicus
gctccgtgcttggttgcgatgttca

SEQ ID NO: 405084 - DNA, 25 bp, Rattus norvegicus
gctccgtggcggagaagcccttaaa

SEQ ID NO: 405085 - DNA, 25 bp, Rattus norvegicus
gctccgtggcggtgaagcccttaaa

SEQ ID NO: 405086 - DNA, 25 bp, Rattus norvegicus
gctccgtgggctatgcagttagata

SEQ ID NO: 405087 - DNA, 25 bp, Rattus norvegicus
gctccgtgggctttgcagttagata

SEQ ID NO: 405088 - DNA, 25 bp, Rattus norvegicus
gctccgtggtcacgtctactttgtt

SEQ ID NO: 405089 - DNA, 25 bp, Rattus norvegicus
gctccgtggtcaggtctactttgtt

SEQ ID NO: 405090 - DNA, 25 bp, Rattus norvegicus
gctccgtgtctgacatgtcatcgaa

SEQ ID NO: 405091 - DNA, 25 bp, Rattus norvegicus
gctccgtgtctgtcatgtcatcgaa

SEQ ID NO: 405092 - DNA, 25 bp, Rattus norvegicus
gctccgtgttatcctagggacagtg

SEQ ID NO: 405093 - DNA, 25 bp, Rattus norvegicus
gctccgtgttatgctagggacagtg

SEQ ID NO: 405094 - DNA, 25 bp, Rattus norvegicus
gctccgttgtgtacaacaaaccatt

SEQ ID NO: 405095 - DNA, 25 bp, Rattus norvegicus
gctccgttgtgttcaacaaaccatt

SEQ ID NO: 405096 - DNA, 25 bp, Rattus norvegicus
gctcctaaacctcaagattatctta

SEQ ID NO: 405097 - DNA, 25 bp, Rattus norvegicus
gctcctaaacctgaagattatctta

SEQ ID NO: 405098 - DNA, 25 bp, Rattus norvegicus
gctcctaaagctatgtcatatacag

SEQ ID NO: 405099 - DNA, 25 bp, Rattus norvegicus
gctcctaaagctttgtcatatacag

SEQ ID NO: 405100 - DNA, 25 bp, Rattus norvegicus
gctcctaacccaccatatgtgatag

SEQ ID NO: 405101 - DNA, 25 bp, Rattus norvegicus
gctcctaacccagcatatgtgatag

SEQ ID NO: 405102 - DNA, 25 bp, Rattus norvegicus
gctcctaattggaatatttgctcag

SEQ ID NO: 405103 - DNA, 25 bp, Rattus norvegicus
gctcctaattggtatatttgctcag

SEQ ID NO: 405104 - DNA, 25 bp, Rattus norvegicus
gctcctacagttccattcttagaca

SEQ ID NO: 405105 - DNA, 25 bp, Rattus norvegicus
gctcctacagttgcattcttagaca

SEQ ID NO: 405106 - DNA, 25 bp, Rattus norvegicus
gctcctaccctgctttaatgtttgg

SEQ ID NO: 405107 - DNA, 25 bp, Rattus norvegicus
gctcctaccctggtttaatgtttgg

SEQ ID NO: 405108 - DNA, 25 bp, Rattus norvegicus
gctcctacctcacaagattgcgtga

SEQ ID NO: 405109 - DNA, 25 bp, Rattus norvegicus
gctcctacctcagaagattgcgtga

SEQ ID NO: 405110 - DNA, 25 bp, Rattus norvegicus
gctcctacgggacaatttacatgaa

SEQ ID NO: 405111 - DNA, 25 bp, Rattus norvegicus
gctcctacgggagaatttacatgaa

SEQ ID NO: 405112 - DNA, 25 bp, Rattus norvegicus
gctcctagactgagtgtcagggact

SEQ ID NO: 405113 - DNA, 25 bp, Rattus norvegicus
gctcctagactgcacagatgccatt

SEQ ID NO: 405114 - DNA, 25 bp, Rattus norvegicus
gctcctagactggacagatgccatt

SEQ ID NO: 405115 - DNA, 25 bp, Rattus norvegicus
gctcctagactgtgtgtcagggact

SEQ ID NO: 405116 - DNA, 25 bp, Rattus norvegicus
gctcctaggtctcgcccatgggcag

SEQ ID NO: 405117 - DNA, 25 bp, Rattus norvegicus
gctcctaggtctggcccatgggcag

SEQ ID NO: 405118 - DNA, 25 bp, Rattus norvegicus
gctcctataggcatccgtgtggtaa

SEQ ID NO: 405119 - DNA, 25 bp, Rattus norvegicus
gctcctataggcttccgtgtggtaa

SEQ ID NO: 405120 - DNA, 25 bp, Rattus norvegicus
gctcctatatccagtggccatggta

SEQ ID NO: 405121 - DNA, 25 bp, Rattus norvegicus
gctcctatatcctgtggccatggta

SEQ ID NO: 405122 - DNA, 25 bp, Rattus norvegicus
gctcctatgagcactgctagcagaa

SEQ ID NO: 405123 - DNA, 25 bp, Rattus norvegicus
gctcctatgagctctgctagcagaa

SEQ ID NO: 405124 - DNA, 25 bp, Rattus norvegicus
gctcctcagcgcattgggaagaagt

SEQ ID NO: 405125 - DNA, 25 bp, Rattus norvegicus
gctcctcagcgctttgggaagaagt

SEQ ID NO: 405126 - DNA, 25 bp, Rattus norvegicus
gctcctcagctactgacagcaatga

SEQ ID NO: 405127 - DNA, 25 bp, Rattus norvegicus
gctcctcagctagtgacagcaatga

SEQ ID NO: 405128 - DNA, 25 bp, Rattus norvegicus
gctcctcagtgtctcaataagactt

SEQ ID NO: 405129 - DNA, 25 bp, Rattus norvegicus
gctcctcagtgtgtcaataagactt

SEQ ID NO: 405130 - DNA, 25 bp, Rattus norvegicus
gctcctcatagcctggtgttgtatt

SEQ ID NO: 405131 - DNA, 25 bp, Rattus norvegicus
gctcctcatagcgtggtgttgtatt

SEQ ID NO: 405132 - DNA, 25 bp, Rattus norvegicus
gctcctcatgttcagcggtgacagg

SEQ ID NO: 405133 - DNA, 25 bp, Rattus norvegicus
gctcctcatgttgagcggtgacagg

SEQ ID NO: 405134 - DNA, 25 bp, Rattus norvegicus
gctcctcatttccaaagctgaactg

SEQ ID NO: 405135 - DNA, 25 bp, Rattus norvegicus
gctcctcatttcgaaagctgaactg

SEQ ID NO: 405136 - DNA, 25 bp, Rattus norvegicus
gctcctcccaccaagtagagtatga

SEQ ID NO: 405137 - DNA, 25 bp, Rattus norvegicus
gctcctcccacctagtagagtatga

SEQ ID NO: 405138 - DNA, 25 bp, Rattus norvegicus
gctcctcccgttagatttaacattg

SEQ ID NO: 405139 - DNA, 25 bp, Rattus norvegicus
gctcctcccgtttgatttaacattg

SEQ ID NO: 405140 - DNA, 25 bp, Rattus norvegicus
gctcctccgggcagcatattccagg

SEQ ID NO: 405141 - DNA, 25 bp, Rattus norvegicus
gctcctccgggctgcatattccagg

SEQ ID NO: 405142 - DNA, 25 bp, Rattus norvegicus
gctcctcctcagacacggaacgtta

SEQ ID NO: 405143 - DNA, 25 bp, Rattus norvegicus
gctcctcctcagtcacggaacgtta

SEQ ID NO: 405144 - DNA, 25 bp, Rattus norvegicus
gctcctcctgagaaccatcggaaag

SEQ ID NO: 405145 - DNA, 25 bp, Rattus norvegicus
gctcctcctgagtaccatcggaaag

SEQ ID NO: 405146 - DNA, 25 bp, Rattus norvegicus
gctcctcctgcaatttatgtgcaag

SEQ ID NO: 405147 - DNA, 25 bp, Rattus norvegicus
gctcctcctgcattttatgtgcaag

SEQ ID NO: 405148 - DNA, 25 bp, Rattus norvegicus
gctcctcgagagcaggtactttgtc

SEQ ID NO: 405149 - DNA, 25 bp, Rattus norvegicus
gctcctcgagaggaggtactttgtc

SEQ ID NO: 405150 - DNA, 25 bp, Rattus norvegicus
gctcctcgctgacactttaaggcaa

SEQ ID NO: 405151 - DNA, 25 bp, Rattus norvegicus
gctcctcgctgagactttaaggcaa

SEQ ID NO: 405152 - DNA, 25 bp, Rattus norvegicus
gctcctcggatcaacttgactttta

SEQ ID NO: 405153 - DNA, 25 bp, Rattus norvegicus
gctcctcggatctacttgactttta

SEQ ID NO: 405154 - DNA, 25 bp, Rattus norvegicus
gctcctcgggcactcaaagaaattc

SEQ ID NO: 405155 - DNA, 25 bp, Rattus norvegicus
gctcctcgggcagtcaaagaaattc

SEQ ID NO: 405156 - DNA, 25 bp, Rattus norvegicus
gctcctcggtgtaggtttgcaataa

SEQ ID NO: 405157 - DNA, 25 bp, Rattus norvegicus
gctcctcggtgttggtttgcaataa

SEQ ID NO: 405158 - DNA, 25 bp, Rattus norvegicus
gctcctcgtctccagacttgataga

SEQ ID NO: 405159 - DNA, 25 bp, Rattus norvegicus
gctcctcgtctcgagacttgataga

SEQ ID NO: 405160 - DNA, 25 bp, Rattus norvegicus
gctcctcgtgagaccaagtggatat

SEQ ID NO: 405161 - DNA, 25 bp, Rattus norvegicus
gctcctcgtgagtccaagtggatat

SEQ ID NO: 405162 - DNA, 25 bp, Rattus norvegicus
gctcctcgtgtcctaatggtgctaa

SEQ ID NO: 405163 - DNA, 25 bp, Rattus norvegicus
gctcctcgtgtcgtaatggtgctaa

SEQ ID NO: 405164 - DNA, 25 bp, Rattus norvegicus
gctcctctacttctaaactcttgga

SEQ ID NO: 405165 - DNA, 25 bp, Rattus norvegicus
gctcctctacttgtaaactcttgga

SEQ ID NO: 405166 - DNA, 25 bp, Rattus norvegicus
gctcctctcacaaagcttgtttaca

SEQ ID NO: 405167 - DNA, 25 bp, Rattus norvegicus
gctcctctcacatagcttgtttaca

SEQ ID NO: 405168 - DNA, 25 bp, Rattus norvegicus
gctcctctctcccagtggttaaaaa

SEQ ID NO: 405169 - DNA, 25 bp, Rattus norvegicus
gctcctctctccgagtggttaaaaa

SEQ ID NO: 405170 - DNA, 25 bp, Rattus norvegicus
gctcctctgaggaagccactgatga

SEQ ID NO: 405171 - DNA, 25 bp, Rattus norvegicus
gctcctctgaggatttttattactc

SEQ ID NO: 405172 - DNA, 25 bp, Rattus norvegicus
gctcctctgaggtagccactgatga

SEQ ID NO: 405173 - DNA, 25 bp, Rattus norvegicus
gctcctctgaggttttttattactc

SEQ ID NO: 405174 - DNA, 25 bp, Rattus norvegicus
gctcctctgagtagttagtctgtga

SEQ ID NO: 405175 - DNA, 25 bp, Rattus norvegicus
gctcctctgagttgttagtctgtga

SEQ ID NO: 405176 - DNA, 25 bp, Rattus norvegicus
gctcctctggctactattttgaaat

SEQ ID NO: 405177 - DNA, 25 bp, Rattus norvegicus
gctcctctggcttctattttgaaat

SEQ ID NO: 405178 - DNA, 25 bp, Rattus norvegicus
gctcctctggttacttgaatgggca

SEQ ID NO: 405179 - DNA, 25 bp, Rattus norvegicus
gctcctctggtttcttgaatgggca

SEQ ID NO: 405180 - DNA, 25 bp, Rattus norvegicus
gctcctctgtagagagctgagagac

SEQ ID NO: 405181 - DNA, 25 bp, Rattus norvegicus
gctcctctgtagtgagctgagagac

SEQ ID NO: 405182 - DNA, 25 bp, Rattus norvegicus
gctcctcttcgtccttaatgaaaga

SEQ ID NO: 405183 - DNA, 25 bp, Rattus norvegicus
gctcctcttcgtgcttaatgaaaga

SEQ ID NO: 405184 - DNA, 25 bp, Rattus norvegicus
gctcctctttgtagttagcactcgt

SEQ ID NO: 405185 - DNA, 25 bp, Rattus norvegicus
gctcctctttgttgttagcactcgt

SEQ ID NO: 405186 - DNA, 25 bp, Rattus norvegicus
gctcctgaaagacacttgctgtaat

SEQ ID NO: 405187 - DNA, 25 bp, Rattus norvegicus
gctcctgaaagagacttgctgtaat

SEQ ID NO: 405188 - DNA, 25 bp, Rattus norvegicus
gctcctgaacacacaagtttaatta

SEQ ID NO: 405189 - DNA, 25 bp, Rattus norvegicus
gctcctgaacactcaagtttaatta

SEQ ID NO: 405190 - DNA, 25 bp, Rattus norvegicus
gctcctgaagcactgaggtttctgt

SEQ ID NO: 405191 - DNA, 25 bp, Rattus norvegicus
gctcctgaagcagtgaggtttctgt

SEQ ID NO: 405192 - DNA, 25 bp, Rattus norvegicus
gctcctgaagcccaagggctgcaga

SEQ ID NO: 405193 - DNA, 25 bp, Rattus norvegicus
gctcctgaagccgaagggctgcaga

SEQ ID NO: 405194 - DNA, 25 bp, Rattus norvegicus
gctcctgaaggacgttcccgagacg

SEQ ID NO: 405195 - DNA, 25 bp, Rattus norvegicus
gctcctgaaggaggttcccgagacg

SEQ ID NO: 405196 - DNA, 25 bp, Rattus norvegicus
gctcctgaaggcctctgtacattgt

SEQ ID NO: 405197 - DNA, 25 bp, Rattus norvegicus
gctcctgaaggcgtctgtacattgt

SEQ ID NO: 405198 - DNA, 25 bp, Rattus norvegicus
gctcctgacacacccttatttaagg

SEQ ID NO: 405199 - DNA, 25 bp, Rattus norvegicus
gctcctgacacagccttatttaagg

SEQ ID NO: 405200 - DNA, 25 bp, Rattus norvegicus
gctcctgacccaagtttgctttgtg

SEQ ID NO: 405201 - DNA, 25 bp, Rattus norvegicus
gctcctgacccatgtttgctttgtg

SEQ ID NO: 405202 - DNA, 25 bp, Rattus norvegicus
gctcctgagcagataccaatgcaat

SEQ ID NO: 405203 - DNA, 25 bp, Rattus norvegicus
gctcctgagcagttaccaatgcaat

SEQ ID NO: 405204 - DNA, 25 bp, Rattus norvegicus
gctcctgatgatccctacccagaaa

SEQ ID NO: 405205 - DNA, 25 bp, Rattus norvegicus
gctcctgatgatgcctacccagaaa

SEQ ID NO: 405206 - DNA, 25 bp, Rattus norvegicus
gctcctgatggacttggcagccaat

SEQ ID NO: 405207 - DNA, 25 bp, Rattus norvegicus
gctcctgatggagttggcagccaat

SEQ ID NO: 405208 - DNA, 25 bp, Rattus norvegicus
gctcctgcaaggatgctcttgagga

SEQ ID NO: 405209 - DNA, 25 bp, Rattus norvegicus
gctcctgcaaggttgctcttgagga

SEQ ID NO: 405210 - DNA, 25 bp, Rattus norvegicus
gctcctgcaccgctgagggatagtt

SEQ ID NO: 405211 - DNA, 25 bp, Rattus norvegicus
gctcctgcaccggtgagggatagtt

SEQ ID NO: 405212 - DNA, 25 bp, Rattus norvegicus
gctcctgcactgatgcgtttgaaag

SEQ ID NO: 405213 - DNA, 25 bp, Rattus norvegicus
gctcctgcactgttgcgtttgaaag

SEQ ID NO: 405214 - DNA, 25 bp, Rattus norvegicus
gctcctgcacttagccacaggcatg

SEQ ID NO: 405215 - DNA, 25 bp, Rattus norvegicus
gctcctgcactttgccacaggcatg

SEQ ID NO: 405216 - DNA, 25 bp, Rattus norvegicus
gctcctgcagtacatgttaggtgtt

SEQ ID NO: 405217 - DNA, 25 bp, Rattus norvegicus
gctcctgcagtagatgttaggtgtt

SEQ ID NO: 405218 - DNA, 25 bp, Rattus norvegicus
gctcctgcatgacctgtgagcagca

SEQ ID NO: 405219 - DNA, 25 bp, Rattus norvegicus
gctcctgcatgagctgtgagcagca

SEQ ID NO: 405220 - DNA, 25 bp, Rattus norvegicus
gctcctgcccgaactactgggtagg

SEQ ID NO: 405221 - DNA, 25 bp, Rattus norvegicus
gctcctgcccgatctactgggtagg

SEQ ID NO: 405222 - DNA, 25 bp, Rattus norvegicus
gctcctgccgatcgcctgaggcgaa

SEQ ID NO: 405223 - DNA, 25 bp, Rattus norvegicus
gctcctgccgatggcctgaggcgaa

SEQ ID NO: 405224 - DNA, 25 bp, Rattus norvegicus
gctcctgccgtgctgttaaaaacaa

SEQ ID NO: 405225 - DNA, 25 bp, Rattus norvegicus
gctcctgccgtggtgttaaaaacaa

SEQ ID NO: 405226 - DNA, 25 bp, Rattus norvegicus
gctcctgcctgtagttctgacacaa

SEQ ID NO: 405227 - DNA, 25 bp, Rattus norvegicus
gctcctgcctgttgttctgacacaa

SEQ ID NO: 405228 - DNA, 25 bp, Rattus norvegicus
gctcctgcgatcagcttgtggaata

SEQ ID NO: 405229 - DNA, 25 bp, Rattus norvegicus
gctcctgcgatctgcttgtggaata

SEQ ID NO: 405230 - DNA, 25 bp, Rattus norvegicus
gctcctgctcttctttctgaaaatg

SEQ ID NO: 405231 - DNA, 25 bp, Rattus norvegicus
gctcctgctcttgtttctgaaaatg

SEQ ID NO: 405232 - DNA, 25 bp, Rattus norvegicus
gctcctgctgatctggatggccgaa

SEQ ID NO: 405233 - DNA, 25 bp, Rattus norvegicus
gctcctgctgatgtggatggccgaa

SEQ ID NO: 405234 - DNA, 25 bp, Rattus norvegicus
gctcctgctgccaatgggtctgggc

SEQ ID NO: 405235 - DNA, 25 bp, Rattus norvegicus
gctcctgctgcccatgcaagagaag

SEQ ID NO: 405236 - DNA, 25 bp, Rattus norvegicus
gctcctgctgccgatgcaagagaag

SEQ ID NO: 405237 - DNA, 25 bp, Rattus norvegicus
gctcctgctgcctatgggtctgggc

SEQ ID NO: 405238 - DNA, 25 bp, Rattus norvegicus
gctcctgctgctctctatataagat

SEQ ID NO: 405239 - DNA, 25 bp, Rattus norvegicus
gctcctgctgctgtctatataagat

SEQ ID NO: 405240 - DNA, 25 bp, Rattus norvegicus
gctcctgctggaattgggtttcgtg

SEQ ID NO: 405241 - DNA, 25 bp, Rattus norvegicus
gctcctgctggatttgggtttcgtg

SEQ ID NO: 405242 - DNA, 25 bp, Rattus norvegicus
gctcctgctttacccgagaggacaa

SEQ ID NO: 405243 - DNA, 25 bp, Rattus norvegicus
gctcctgctttagccgagaggacaa

SEQ ID NO: 405244 - DNA, 25 bp, Rattus norvegicus
gctcctggaaataactgcacatgat

SEQ ID NO: 405245 - DNA, 25 bp, Rattus norvegicus
gctcctggaaattactgcacatgat

SEQ ID NO: 405246 - DNA, 25 bp, Rattus norvegicus
gctcctggaagcctggcagctcctg

SEQ ID NO: 405247 - DNA, 25 bp, Rattus norvegicus
gctcctggaagcgtggcagctcctg

SEQ ID NO: 405248 - DNA, 25 bp, Rattus norvegicus
gctcctggaggccatcccagtaaac

SEQ ID NO: 405249 - DNA, 25 bp, Rattus norvegicus
gctcctggaggcgatcccagtaaac

SEQ ID NO: 405250 - DNA, 25 bp, Rattus norvegicus
gctcctggagtgacctagctttcag

SEQ ID NO: 405251 - DNA, 25 bp, Rattus norvegicus
gctcctggagtgtcctagctttcag

SEQ ID NO: 405252 - DNA, 25 bp, Rattus norvegicus
gctcctggataaatgcttgattctc

SEQ ID NO: 405253 - DNA, 25 bp, Rattus norvegicus
gctcctggataattgcttgattctc

SEQ ID NO: 405254 - DNA, 25 bp, Rattus norvegicus
gctcctggcagaatgtatgccttgc

SEQ ID NO: 405255 - DNA, 25 bp, Rattus norvegicus
gctcctggcagattgtatgccttgc

SEQ ID NO: 405256 - DNA, 25 bp, Rattus norvegicus
gctcctggccatcttcaacaagaag

SEQ ID NO: 405257 - DNA, 25 bp, Rattus norvegicus
gctcctggccatgttcaacaagaag

SEQ ID NO: 405258 - DNA, 25 bp, Rattus norvegicus
gctcctggcctcatgtagtgatgat

SEQ ID NO: 405259 - DNA, 25 bp, Rattus norvegicus
gctcctggcctcttgtagtgatgat

SEQ ID NO: 405260 - DNA, 25 bp, Rattus norvegicus
gctcctggctgaccctgtgggcaaa

SEQ ID NO: 405261 - DNA, 25 bp, Rattus norvegicus
gctcctggctgagcctgtgggcaaa

SEQ ID NO: 405262 - DNA, 25 bp, Rattus norvegicus
gctcctgggtttctgtgtcctgaaa

SEQ ID NO: 405263 - DNA, 25 bp, Rattus norvegicus
gctcctgggtttgtgtgtcctgaaa

SEQ ID NO: 405264 - DNA, 25 bp, Rattus norvegicus
gctcctggtaaaccagtgggctcac

SEQ ID NO: 405265 - DNA, 25 bp, Rattus norvegicus
gctcctggtaaagcagtgggctcac

SEQ ID NO: 405266 - DNA, 25 bp, Rattus norvegicus
gctcctggtccaagctttgcaggaa

SEQ ID NO: 405267 - DNA, 25 bp, Rattus norvegicus
gctcctggtccatgctttgcaggaa

SEQ ID NO: 405268 - DNA, 25 bp, Rattus norvegicus
gctcctggttcccaagtgattcaga

SEQ ID NO: 405269 - DNA, 25 bp, Rattus norvegicus
gctcctggttccgaagtgattcaga

SEQ ID NO: 405270 - DNA, 25 bp, Rattus norvegicus
gctcctggttttcttcctgagataa

SEQ ID NO: 405271 - DNA, 25 bp, Rattus norvegicus
gctcctggttttgttcctgagataa

SEQ ID NO: 405272 - DNA, 25 bp, Rattus norvegicus
gctcctgtcacaaccttgatgttag

SEQ ID NO: 405273 - DNA, 25 bp, Rattus norvegicus
gctcctgtcacatccttgatgttag

SEQ ID NO: 405274 - DNA, 25 bp, Rattus norvegicus
gctcctgtcatcaaactgctttaat

SEQ ID NO: 405275 - DNA, 25 bp, Rattus norvegicus
gctcctgtcatctaactgctttaat

SEQ ID NO: 405276 - DNA, 25 bp, Rattus norvegicus
gctcctgtgctcacctgtaagaaga

SEQ ID NO: 405277 - DNA, 25 bp, Rattus norvegicus
gctcctgtgctctcctgtaagaaga

SEQ ID NO: 405278 - DNA, 25 bp, Rattus norvegicus
gctcctgtgctgagggcctaagctg

SEQ ID NO: 405279 - DNA, 25 bp, Rattus norvegicus
gctcctgtgctgatcatgctgaaat

SEQ ID NO: 405280 - DNA, 25 bp, Rattus norvegicus
gctcctgtgctgtgggcctaagctg

SEQ ID NO: 405281 - DNA, 25 bp, Rattus norvegicus
gctcctgtgctgttcatgctgaaat

SEQ ID NO: 405282 - DNA, 25 bp, Rattus norvegicus
gctcctgtggcaaagccatgctaat

SEQ ID NO: 405283 - DNA, 25 bp, Rattus norvegicus
gctcctgtggcatagccatgctaat

SEQ ID NO: 405284 - DNA, 25 bp, Rattus norvegicus
gctcctgtggtgatgagtttggcca

SEQ ID NO: 405285 - DNA, 25 bp, Rattus norvegicus
gctcctgtggtgttgagtttggcca

SEQ ID NO: 405286 - DNA, 25 bp, Rattus norvegicus
gctcctgtggttcctacattttgaa

SEQ ID NO: 405287 - DNA, 25 bp, Rattus norvegicus
gctcctgtggttgctacattttgaa

SEQ ID NO: 405288 - DNA, 25 bp, Rattus norvegicus
gctcctgtgtaaccattcaatcagt

SEQ ID NO: 405289 - DNA, 25 bp, Rattus norvegicus
gctcctgtgtaagcattcaatcagt

SEQ ID NO: 405290 - DNA, 25 bp, Rattus norvegicus
gctcctgtgtataaggcaatgccga

SEQ ID NO: 405291 - DNA, 25 bp, Rattus norvegicus
gctcctgtgtattaggcaatgccga

SEQ ID NO: 405292 - DNA, 25 bp, Rattus norvegicus
gctcctgtgtggaaagcactacctt

SEQ ID NO: 405293 - DNA, 25 bp, Rattus norvegicus
gctcctgtgtggctctctctgaggt

SEQ ID NO: 405294 - DNA, 25 bp, Rattus norvegicus
gctcctgtgtgggtctctctgaggt

SEQ ID NO: 405295 - DNA, 25 bp, Rattus norvegicus
gctcctgtgtggtaagcactacctt

SEQ ID NO: 405296 - DNA, 25 bp, Rattus norvegicus
gctcctgttataagctgggaactgt

SEQ ID NO: 405297 - DNA, 25 bp, Rattus norvegicus
gctcctgttatatgctgggaactgt

SEQ ID NO: 405298 - DNA, 25 bp, Rattus norvegicus
gctcctgttgccataatacgcagat

SEQ ID NO: 405299 - DNA, 25 bp, Rattus norvegicus
gctcctgttgccttaatacgcagat

SEQ ID NO: 405300 - DNA, 25 bp, Rattus norvegicus
gctcctgtttcactgccttggtgaa

SEQ ID NO: 405301 - DNA, 25 bp, Rattus norvegicus
gctcctgtttcagtgccttggtgaa

SEQ ID NO: 405302 - DNA, 25 bp, Rattus norvegicus
gctcctgtttgaatcttttggtcat

SEQ ID NO: 405303 - DNA, 25 bp, Rattus norvegicus
gctcctgtttgattcttttggtcat

SEQ ID NO: 405304 - DNA, 25 bp, Rattus norvegicus
gctccttaatatatgcaaccttttt

SEQ ID NO: 405305 - DNA, 25 bp, Rattus norvegicus
gctccttaatatttgcaaccttttt

SEQ ID NO: 405306 - DNA, 25 bp, Rattus norvegicus
gctccttacatcagaaatggcttac

SEQ ID NO: 405307 - DNA, 25 bp, Rattus norvegicus
gctccttacatctgaaatggcttac

SEQ ID NO: 405308 - DNA, 25 bp, Rattus norvegicus
gctccttagagaaaacgtcgtggct

SEQ ID NO: 405309 - DNA, 25 bp, Rattus norvegicus
gctccttagagataacgtcgtggct

SEQ ID NO: 405310 - DNA, 25 bp, Rattus norvegicus
gctccttatccaaatatttctccat

SEQ ID NO: 405311 - DNA, 25 bp, Rattus norvegicus
gctccttatccatatatttctccat

SEQ ID NO: 405312 - DNA, 25 bp, Rattus norvegicus
gctccttatttcagccgttttatac

SEQ ID NO: 405313 - DNA, 25 bp, Rattus norvegicus
gctccttatttctgccgttttatac

SEQ ID NO: 405314 - DNA, 25 bp, Rattus norvegicus
gctccttcaagacctgttctgaaac

SEQ ID NO: 405315 - DNA, 25 bp, Rattus norvegicus
gctccttcaagagctgttctgaaac

SEQ ID NO: 405316 - DNA, 25 bp, Rattus norvegicus
gctccttcaaggcacccttaattat

SEQ ID NO: 405317 - DNA, 25 bp, Rattus norvegicus
gctccttcaagggacccttaattat

SEQ ID NO: 405318 - DNA, 25 bp, Rattus norvegicus
gctccttcactgacccaagtaagag

SEQ ID NO: 405319 - DNA, 25 bp, Rattus norvegicus
gctccttcactgtcccaagtaagag

SEQ ID NO: 405320 - DNA, 25 bp, Rattus norvegicus
gctccttcaggacaattggcatctc

SEQ ID NO: 405321 - DNA, 25 bp, Rattus norvegicus
gctccttcaggagaattggcatctc

SEQ ID NO: 405322 - DNA, 25 bp, Rattus norvegicus
gctccttcatctactacagcttaga

SEQ ID NO: 405323 - DNA, 25 bp, Rattus norvegicus
gctccttcatcttctacagcttaga

SEQ ID NO: 405324 - DNA, 25 bp, Rattus norvegicus
gctccttccattccaactagttttt

SEQ ID NO: 405325 - DNA, 25 bp, Rattus norvegicus
gctccttccattgcaactagttttt

SEQ ID NO: 405326 - DNA, 25 bp, Rattus norvegicus
gctccttccttgaggccagtgaaat

SEQ ID NO: 405327 - DNA, 25 bp, Rattus norvegicus
gctccttccttgtggccagtgaaat

SEQ ID NO: 405328 - DNA, 25 bp, Rattus norvegicus
gctccttctccaatctctggaaaca

SEQ ID NO: 405329 - DNA, 25 bp, Rattus norvegicus
gctccttctccattctctggaaaca

SEQ ID NO: 405330 - DNA, 25 bp, Rattus norvegicus
gctccttctcttcaaggactgaagt

SEQ ID NO: 405331 - DNA, 25 bp, Rattus norvegicus
gctccttctcttgaaggactgaagt

SEQ ID NO: 405332 - DNA, 25 bp, Rattus norvegicus
gctccttctgctcagacttaattgc

SEQ ID NO: 405333 - DNA, 25 bp, Rattus norvegicus
gctccttctgctgagacttaattgc

SEQ ID NO: 405334 - DNA, 25 bp, Rattus norvegicus
gctccttgaaggagaatttgcctca

SEQ ID NO: 405335 - DNA, 25 bp, Rattus norvegicus
gctccttgaaggtgaatttgcctca

SEQ ID NO: 405336 - DNA, 25 bp, Rattus norvegicus
gctccttgagctagagcaccagctg

SEQ ID NO: 405337 - DNA, 25 bp, Rattus norvegicus
gctccttgagcttgagcaccagctg

SEQ ID NO: 405338 - DNA, 25 bp, Rattus norvegicus
gctccttgccttcggtgaatacaga

SEQ ID NO: 405339 - DNA, 25 bp, Rattus norvegicus
gctccttgccttgggtgaatacaga

SEQ ID NO: 405340 - DNA, 25 bp, Rattus norvegicus
gctccttgctaactgaagtggcgtc

SEQ ID NO: 405341 - DNA, 25 bp, Rattus norvegicus
gctccttgctaagtgaagtggcgtc

SEQ ID NO: 405342 - DNA, 25 bp, Rattus norvegicus
gctccttggacacctttaatgccta

SEQ ID NO: 405343 - DNA, 25 bp, Rattus norvegicus
gctccttggacagctttaatgccta

SEQ ID NO: 405344 - DNA, 25 bp, Rattus norvegicus
gctccttgggctcaggaacatttct

SEQ ID NO: 405345 - DNA, 25 bp, Rattus norvegicus
gctccttgggctgaggaacatttct

SEQ ID NO: 405346 - DNA, 25 bp, Rattus norvegicus
gctccttgtagactcttagcatctt

SEQ ID NO: 405347 - DNA, 25 bp, Rattus norvegicus
gctccttgtagagtcttagcatctt

SEQ ID NO: 405348 - DNA, 25 bp, Rattus norvegicus
gctcctttaagacaatctgcccttg

SEQ ID NO: 405349 - DNA, 25 bp, Rattus norvegicus
gctcctttaagagaatctgcccttg

SEQ ID NO: 405350 - DNA, 25 bp, Rattus norvegicus
gctcctttaagcatgttcttcttca

SEQ ID NO: 405351 - DNA, 25 bp, Rattus norvegicus
gctcctttaagcttgttcttcttca

SEQ ID NO: 405352 - DNA, 25 bp, Rattus norvegicus
gctcctttacccattcctatttgag

SEQ ID NO: 405353 - DNA, 25 bp, Rattus norvegicus
gctcctttaccctttcctatttgag

SEQ ID NO: 405354 - DNA, 25 bp, Rattus norvegicus
gctcctttatggctcagatcatgaa

SEQ ID NO: 405355 - DNA, 25 bp, Rattus norvegicus
gctcctttatgggtcagatcatgaa

SEQ ID NO: 405356 - DNA, 25 bp, Rattus norvegicus
gctcctttcagactttctggaggct

SEQ ID NO: 405357 - DNA, 25 bp, Rattus norvegicus
gctcctttcagagtttctggaggct

SEQ ID NO: 405358 - DNA, 25 bp, Rattus norvegicus
gctcctttcagccattaggtcattg

SEQ ID NO: 405359 - DNA, 25 bp, Rattus norvegicus
gctcctttcagcgattaggtcattg

SEQ ID NO: 405360 - DNA, 25 bp, Rattus norvegicus
gctcctttcccactttgaattcaat

SEQ ID NO: 405361 - DNA, 25 bp, Rattus norvegicus
gctcctttcccagtttgaattcaat

SEQ ID NO: 405362 - DNA, 25 bp, Rattus norvegicus
gctcctttccttcgctgctggagaa

SEQ ID NO: 405363 - DNA, 25 bp, Rattus norvegicus
gctcctttccttggctgctggagaa

SEQ ID NO: 405364 - DNA, 25 bp, Rattus norvegicus
gctcctttctaaagtacttgtgctg

SEQ ID NO: 405365 - DNA, 25 bp, Rattus norvegicus
gctcctttctaatgtacttgtgctg

SEQ ID NO: 405366 - DNA, 25 bp, Rattus norvegicus
gctcctttctggctgattcagaaca

SEQ ID NO: 405367 - DNA, 25 bp, Rattus norvegicus
gctcctttctgggtgattcagaaca

SEQ ID NO: 405368 - DNA, 25 bp, Rattus norvegicus
gctcctttcttccaaagaacactct

SEQ ID NO: 405369 - DNA, 25 bp, Rattus norvegicus
gctcctttcttcgaaagaacactct

SEQ ID NO: 405370 - DNA, 25 bp, Rattus norvegicus
gctcctttgacgaggtccatgtgaa

SEQ ID NO: 405371 - DNA, 25 bp, Rattus norvegicus
gctcctttgacgtggtccatgtgaa

SEQ ID NO: 405372 - DNA, 25 bp, Rattus norvegicus
gctcctttgggcctttgtggctaca

SEQ ID NO: 405373 - DNA, 25 bp, Rattus norvegicus
gctcctttgggcgtttgtggctaca

SEQ ID NO: 405374 - DNA, 25 bp, Rattus norvegicus
gctcctttgtacctctctttacttt

SEQ ID NO: 405375 - DNA, 25 bp, Rattus norvegicus
gctcctttgtacgtctctttacttt

SEQ ID NO: 405376 - DNA, 25 bp, Rattus norvegicus
gctcctttgttaccagcagtcaaac

SEQ ID NO: 405377 - DNA, 25 bp, Rattus norvegicus
gctcctttgttagcagcagtcaaac

SEQ ID NO: 405378 - DNA, 25 bp, Rattus norvegicus
gctccttttctacctgtgtgacaat

SEQ ID NO: 405379 - DNA, 25 bp, Rattus norvegicus
gctccttttctagctgtgtgacaat

SEQ ID NO: 405380 - DNA, 25 bp, Rattus norvegicus
gctccttttctgattatggtaccaa

SEQ ID NO: 405381 - DNA, 25 bp, Rattus norvegicus
gctccttttctgtttatggtaccaa

SEQ ID NO: 405382 - DNA, 25 bp, Rattus norvegicus
gctccttttgtcagcgcggagccgg

SEQ ID NO: 405383 - DNA, 25 bp, Rattus norvegicus
gctccttttgtctgcgcggagccgg

SEQ ID NO: 405384 - DNA, 25 bp, Rattus norvegicus
gctcgaaaatctaactcagcttttt

SEQ ID NO: 405385 - DNA, 25 bp, Rattus norvegicus
gctcgaaaatcttactcagcttttt

SEQ ID NO: 405386 - DNA, 25 bp, Rattus norvegicus
gctcgaaacctaccagtgacacaga

SEQ ID NO: 405387 - DNA, 25 bp, Rattus norvegicus
gctcgaaacctagcagtgacacaga

SEQ ID NO: 405388 - DNA, 25 bp, Rattus norvegicus
gctcgaaacttcagtgggctgtgca

SEQ ID NO: 405389 - DNA, 25 bp, Rattus norvegicus
gctcgaaacttctgtgggctgtgca

SEQ ID NO: 405390 - DNA, 25 bp, Rattus norvegicus
gctcgaacgcacatctttatgtcaa

SEQ ID NO: 405391 - DNA, 25 bp, Rattus norvegicus
gctcgaacgcacttctttatgtcaa

SEQ ID NO: 405392 - DNA, 25 bp, Rattus norvegicus
gctcgaagcgccaggccgtgtgtaa

SEQ ID NO: 405393 - DNA, 25 bp, Rattus norvegicus
gctcgaagcgcctggccgtgtgtaa

SEQ ID NO: 405394 - DNA, 25 bp, Rattus norvegicus
gctcgaagcggacagtgcgggcacg

SEQ ID NO: 405395 - DNA, 25 bp, Rattus norvegicus
gctcgaagcggagagtgcgggcacg

SEQ ID NO: 405396 - DNA, 25 bp, Rattus norvegicus
gctcgacaaaatatactcacattca

SEQ ID NO: 405397 - DNA, 25 bp, Rattus norvegicus
gctcgacaaaatttactcacattca

SEQ ID NO: 405398 - DNA, 25 bp, Rattus norvegicus
gctcgactgtaactctcacatgtga

SEQ ID NO: 405399 - DNA, 25 bp, Rattus norvegicus
gctcgactgtaagtctcacatgtga

SEQ ID NO: 405400 - DNA, 25 bp, Rattus norvegicus
gctcgagagacacggaagccatgtt

SEQ ID NO: 405401 - DNA, 25 bp, Rattus norvegicus
gctcgagagacagggaagccatgtt

SEQ ID NO: 405402 - DNA, 25 bp, Rattus norvegicus
gctcgagcgccaagcccggcgggag

SEQ ID NO: 405403 - DNA, 25 bp, Rattus norvegicus
gctcgagcgccatgcccggcgggag

SEQ ID NO: 405404 - DNA, 25 bp, Rattus norvegicus
gctcgaggccatcatgaaatctccg

SEQ ID NO: 405405 - DNA, 25 bp, Rattus norvegicus
gctcgaggccatgatgaaatctccg

SEQ ID NO: 405406 - DNA, 25 bp, Rattus norvegicus
gctcgaggctccagggacctagcca

SEQ ID NO: 405407 - DNA, 25 bp, Rattus norvegicus
gctcgaggctcctgggacctagcca

SEQ ID NO: 405408 - DNA, 25 bp, Rattus norvegicus
gctcgagtcatcacaaggtagtgga

SEQ ID NO: 405409 - DNA, 25 bp, Rattus norvegicus
gctcgagtcatctcaaggtagtgga

SEQ ID NO: 405410 - DNA, 25 bp, Rattus norvegicus
gctcgattttgtctctgctctcaga

SEQ ID NO: 405411 - DNA, 25 bp, Rattus norvegicus
gctcgattttgtgtctgctctcaga

SEQ ID NO: 405412 - DNA, 25 bp, Rattus norvegicus
gctcgcaaatgtctggctcctggaa

SEQ ID NO: 405413 - DNA, 25 bp, Rattus norvegicus
gctcgcaaatgtgtggctcctggaa

SEQ ID NO: 405414 - DNA, 25 bp, Rattus norvegicus
gctcgcaaccatcagttctgcagga

SEQ ID NO: 405415 - DNA, 25 bp, Rattus norvegicus
gctcgcaaccatgagttctgcagga

SEQ ID NO: 405416 - DNA, 25 bp, Rattus norvegicus
gctcgcaccggaacaagcacgagga

SEQ ID NO: 405417 - DNA, 25 bp, Rattus norvegicus
gctcgcaccggatcaagcacgagga

SEQ ID NO: 405418 - DNA, 25 bp, Rattus norvegicus
gctcgcagagctatggcttgctgta

SEQ ID NO: 405419 - DNA, 25 bp, Rattus norvegicus
gctcgcagagctttggcttgctgta

SEQ ID NO: 405420 - DNA, 25 bp, Rattus norvegicus
gctcgcaggttcattacatatctta

SEQ ID NO: 405421 - DNA, 25 bp, Rattus norvegicus
gctcgcaggttctttacatatctta

SEQ ID NO: 405422 - DNA, 25 bp, Rattus norvegicus
gctcgccacaaaaatgggtactgcg

SEQ ID NO: 405423 - DNA, 25 bp, Rattus norvegicus
gctcgccacaaatatgggtactgcg

SEQ ID NO: 405424 - DNA, 25 bp, Rattus norvegicus
gctcgcccaatcatttgtaatactg

SEQ ID NO: 405425 - DNA, 25 bp, Rattus norvegicus
gctcgcccaatcttttgtaatactg

SEQ ID NO: 405426 - DNA, 25 bp, Rattus norvegicus
gctcgccgcgatcttaatccagatt

SEQ ID NO: 405427 - DNA, 25 bp, Rattus norvegicus
gctcgccgcgatgttaatccagatt

SEQ ID NO: 405428 - DNA, 25 bp, Rattus norvegicus
gctcgcctactacagacttcatgga

SEQ ID NO: 405429 - DNA, 25 bp, Rattus norvegicus
gctcgcctactagagacttcatgga

SEQ ID NO: 405430 - DNA, 25 bp, Rattus norvegicus
gctcgcctagggatacgtagcagga

SEQ ID NO: 405431 - DNA, 25 bp, Rattus norvegicus
gctcgcctagggttacgtagcagga

SEQ ID NO: 405432 - DNA, 25 bp, Rattus norvegicus
gctcgcctttgtatgctgatacagt

SEQ ID NO: 405433 - DNA, 25 bp, Rattus norvegicus
gctcgcctttgtttgctgatacagt

SEQ ID NO: 405434 - DNA, 25 bp, Rattus norvegicus
gctcgcgcaacgaccgtctagctgg

SEQ ID NO: 405435 - DNA, 25 bp, Rattus norvegicus
gctcgcgcaacgtccgtctagctgg

SEQ ID NO: 405436 - DNA, 25 bp, Rattus norvegicus
gctcgcgctggcacgtggtcaacgt

SEQ ID NO: 405437 - DNA, 25 bp, Rattus norvegicus
gctcgcgctggctcgtggtcaacgt

SEQ ID NO: 405438 - DNA, 25 bp, Rattus norvegicus
gctcgcgcttcaattccctcattgt

SEQ ID NO: 405439 - DNA, 25 bp, Rattus norvegicus
gctcgcgcttcatttccctcattgt

SEQ ID NO: 405440 - DNA, 25 bp, Rattus norvegicus
gctcgcggaagcagcgaccgcactg

SEQ ID NO: 405441 - DNA, 25 bp, Rattus norvegicus
gctcgcggaagctgcgaccgcactg

SEQ ID NO: 405442 - DNA, 25 bp, Rattus norvegicus
gctcgctactaccataggctgtgtt

SEQ ID NO: 405443 - DNA, 25 bp, Rattus norvegicus
gctcgctactacgataggctgtgtt

SEQ ID NO: 405444 - DNA, 25 bp, Rattus norvegicus
gctcgctaggcaattgtgttacaat

SEQ ID NO: 405445 - DNA, 25 bp, Rattus norvegicus
gctcgctaggcatttgtgttacaat

SEQ ID NO: 405446 - DNA, 25 bp, Rattus norvegicus
gctcgctatactactggctcattaa

SEQ ID NO: 405447 - DNA, 25 bp, Rattus norvegicus
gctcgctatacttctggctcattaa

SEQ ID NO: 405448 - DNA, 25 bp, Rattus norvegicus
gctcgctatcacagtgtaggtacca

SEQ ID NO: 405449 - DNA, 25 bp, Rattus norvegicus
gctcgctatcactgtgtaggtacca

SEQ ID NO: 405450 - DNA, 25 bp, Rattus norvegicus
gctcgctcacttctccatgagaata

SEQ ID NO: 405451 - DNA, 25 bp, Rattus norvegicus
gctcgctcacttgtccatgagaata

SEQ ID NO: 405452 - DNA, 25 bp, Rattus norvegicus
gctcgctcatcaacatcagctttat

SEQ ID NO: 405453 - DNA, 25 bp, Rattus norvegicus
gctcgctcatcatcatcagctttat

SEQ ID NO: 405454 - DNA, 25 bp, Rattus norvegicus
gctcgctcccatagtttgtacagtt

SEQ ID NO: 405455 - DNA, 25 bp, Rattus norvegicus
gctcgctcccattgtttgtacagtt

SEQ ID NO: 405456 - DNA, 25 bp, Rattus norvegicus
gctcgctctagacctggcttcagga

SEQ ID NO: 405457 - DNA, 25 bp, Rattus norvegicus
gctcgctctagagctggcttcagga

SEQ ID NO: 405458 - DNA, 25 bp, Rattus norvegicus
gctcgctcttccaaattagatgcta

SEQ ID NO: 405459 - DNA, 25 bp, Rattus norvegicus
gctcgctcttcctaattagatgcta

SEQ ID NO: 405460 - DNA, 25 bp, Rattus norvegicus
gctcgctgacaaagcccaggacagt

SEQ ID NO: 405461 - DNA, 25 bp, Rattus norvegicus
gctcgctgacaatgcccaggacagt

SEQ ID NO: 405462 - DNA, 25 bp, Rattus norvegicus
gctcgctgcagaccctttgtgaaga

SEQ ID NO: 405463 - DNA, 25 bp, Rattus norvegicus
gctcgctgcagagcctttgtgaaga

SEQ ID NO: 405464 - DNA, 25 bp, Rattus norvegicus
gctcgctgtctcagattctgatcaa

SEQ ID NO: 405465 - DNA, 25 bp, Rattus norvegicus
gctcgctgtctctgattctgatcaa

SEQ ID NO: 405466 - DNA, 25 bp, Rattus norvegicus
gctcgctgttgaactgggctgacct

SEQ ID NO: 405467 - DNA, 25 bp, Rattus norvegicus
gctcgctgttgatctgggctgacct

SEQ ID NO: 405468 - DNA, 25 bp, Rattus norvegicus
gctcgcttcagcagcacatattatt

SEQ ID NO: 405469 - DNA, 25 bp, Rattus norvegicus
gctcgcttcagctgcacatattatt

SEQ ID NO: 405470 - DNA, 25 bp, Rattus norvegicus
gctcgcttgcatcccagaaagtaat

SEQ ID NO: 405471 - DNA, 25 bp, Rattus norvegicus
gctcgcttgcatgccagaaagtaat

SEQ ID NO: 405472 - DNA, 25 bp, Rattus norvegicus
gctcgcttgctaagcatgttcttaa

SEQ ID NO: 405473 - DNA, 25 bp, Rattus norvegicus
gctcgcttgctatgcatgttcttaa

SEQ ID NO: 405474 - DNA, 25 bp, Rattus norvegicus
gctcgctttggccactggcataaaa

SEQ ID NO: 405475 - DNA, 25 bp, Rattus norvegicus
gctcgctttggcgactggcataaaa

SEQ ID NO: 405476 - DNA, 25 bp, Rattus norvegicus
gctcggaaccggcaaggctataaca

SEQ ID NO: 405477 - DNA, 25 bp, Rattus norvegicus
gctcggaaccgggaaggctataaca

SEQ ID NO: 405478 - DNA, 25 bp, Rattus norvegicus
gctcggaacgctcgacttctacatg

SEQ ID NO: 405479 - DNA, 25 bp, Rattus norvegicus
gctcggaacgctggacttctacatg

SEQ ID NO: 405480 - DNA, 25 bp, Rattus norvegicus
gctcggaaggatagctcacggactt

SEQ ID NO: 405481 - DNA, 25 bp, Rattus norvegicus
gctcggaaggattgctcacggactt

SEQ ID NO: 405482 - DNA, 25 bp, Rattus norvegicus
gctcggaagggcattatcgggaacc

SEQ ID NO: 405483 - DNA, 25 bp, Rattus norvegicus
gctcggaagggctttatcgggaacc

SEQ ID NO: 405484 - DNA, 25 bp, Rattus norvegicus
gctcggaatccactgctagcactta

SEQ ID NO: 405485 - DNA, 25 bp, Rattus norvegicus
gctcggaatccagtgctagcactta

SEQ ID NO: 405486 - DNA, 25 bp, Rattus norvegicus
gctcggactccactgacatatctat

SEQ ID NO: 405487 - DNA, 25 bp, Rattus norvegicus
gctcggactccagtgacatatctat

SEQ ID NO: 405488 - DNA, 25 bp, Rattus norvegicus
gctcggagacacagcgcgcggccat

SEQ ID NO: 405489 - DNA, 25 bp, Rattus norvegicus
gctcggagacactgcgcgcggccat

SEQ ID NO: 405490 - DNA, 25 bp, Rattus norvegicus
gctcggagcaaacaggttccccatg

SEQ ID NO: 405491 - DNA, 25 bp, Rattus norvegicus
gctcggagcaaagaggttccccatg

SEQ ID NO: 405492 - DNA, 25 bp, Rattus norvegicus
gctcggagccgaaggtgactcgcat

SEQ ID NO: 405493 - DNA, 25 bp, Rattus norvegicus
gctcggagccgatggtgactcgcat

SEQ ID NO: 405494 - DNA, 25 bp, Rattus norvegicus
gctcggagctcaacaaactgtgcca

SEQ ID NO: 405495 - DNA, 25 bp, Rattus norvegicus
gctcggagctcatcaaactgtgcca

SEQ ID NO: 405496 - DNA, 25 bp, Rattus norvegicus
gctcggagttccaaaagtctgctca

SEQ ID NO: 405497 - DNA, 25 bp, Rattus norvegicus
gctcggagttcctaaagtctgctca

SEQ ID NO: 405498 - DNA, 25 bp, Rattus norvegicus
gctcggatatctagttgttgctcaa

SEQ ID NO: 405499 - DNA, 25 bp, Rattus norvegicus
gctcggatatcttgttgttgctcaa

SEQ ID NO: 405500 - DNA, 25 bp, Rattus norvegicus
gctcggatgtagcatgttctatgta

SEQ ID NO: 405501 - DNA, 25 bp, Rattus norvegicus
gctcggatgtaggatgttctatgta

SEQ ID NO: 405502 - DNA, 25 bp, Rattus norvegicus
gctcggcgatttaccttacacgaaa

SEQ ID NO: 405503 - DNA, 25 bp, Rattus norvegicus
gctcggcgattttccttacacgaaa

SEQ ID NO: 405504 - DNA, 25 bp, Rattus norvegicus
gctcggctagccagtacctattagg

SEQ ID NO: 405505 - DNA, 25 bp, Rattus norvegicus
gctcggctagcctgtacctattagg

SEQ ID NO: 405506 - DNA, 25 bp, Rattus norvegicus
gctcggctcttgatttatgggctaa

SEQ ID NO: 405507 - DNA, 25 bp, Rattus norvegicus
gctcggctcttgttttatgggctaa

SEQ ID NO: 405508 - DNA, 25 bp, Rattus norvegicus
gctcggctgacgatttcactaaact

SEQ ID NO: 405509 - DNA, 25 bp, Rattus norvegicus
gctcggctgacgttttcactaaact

SEQ ID NO: 405510 - DNA, 25 bp, Rattus norvegicus
gctcggctgcctattgtgtgacaga

SEQ ID NO: 405511 - DNA, 25 bp, Rattus norvegicus
gctcggctgccttttgtgtgacaga

SEQ ID NO: 405512 - DNA, 25 bp, Rattus norvegicus
gctcggctggagctcgcatagctct

SEQ ID NO: 405513 - DNA, 25 bp, Rattus norvegicus
gctcggctggaggtcgcatagctct

SEQ ID NO: 405514 - DNA, 25 bp, Rattus norvegicus
gctcggctgggtatccatgtgcaga

SEQ ID NO: 405515 - DNA, 25 bp, Rattus norvegicus
gctcggctgggtttccatgtgcaga

SEQ ID NO: 405516 - DNA, 25 bp, Rattus norvegicus
gctcggctgtgtatcagacactcaa

SEQ ID NO: 405517 - DNA, 25 bp, Rattus norvegicus
gctcggctgtgtttcagacactcaa

SEQ ID NO: 405518 - DNA, 25 bp, Rattus norvegicus
gctcggctttgcctatggtcaatga

SEQ ID NO: 405519 - DNA, 25 bp, Rattus norvegicus
gctcggctttgcgtatggtcaatga

SEQ ID NO: 405520 - DNA, 25 bp, Rattus norvegicus
gctcgggagactactgcaccaaggg

SEQ ID NO: 405521 - DNA, 25 bp, Rattus norvegicus
gctcgggagacttctgcaccaaggg

SEQ ID NO: 405522 - DNA, 25 bp, Rattus norvegicus
gctcgggagagtcttctttatccaa

SEQ ID NO: 405523 - DNA, 25 bp, Rattus norvegicus
gctcgggagagtgttctttatccaa

SEQ ID NO: 405524 - DNA, 25 bp, Rattus norvegicus
gctcgggagccgcagtgacggcaga

SEQ ID NO: 405525 - DNA, 25 bp, Rattus norvegicus
gctcgggagccggagtgacggcaga

SEQ ID NO: 405526 - DNA, 25 bp, Rattus norvegicus
gctcgggattgcagatgctgtcatc

SEQ ID NO: 405527 - DNA, 25 bp, Rattus norvegicus
gctcgggattgctgatgctgtcatc

SEQ ID NO: 405528 - DNA, 25 bp, Rattus norvegicus
gctcgggcggtacgcgcactaggca

SEQ ID NO: 405529 - DNA, 25 bp, Rattus norvegicus
gctcgggcggtaggcgcactaggca

SEQ ID NO: 405530 - DNA, 25 bp, Rattus norvegicus
gctcgggctcagcttcaggctctga

SEQ ID NO: 405531 - DNA, 25 bp, Rattus norvegicus
gctcgggctcaggttcaggctctga

SEQ ID NO: 405532 - DNA, 25 bp, Rattus norvegicus
gctcgggtttggctgaagctgggac

SEQ ID NO: 405533 - DNA, 25 bp, Rattus norvegicus
gctcgggtttgggtgaagctgggac

SEQ ID NO: 405534 - DNA, 25 bp, Rattus norvegicus
gctcggtaaggtaagcggcgtctcc

SEQ ID NO: 405535 - DNA, 25 bp, Rattus norvegicus
gctcggtaaggttagcggcgtctcc

SEQ ID NO: 405536 - DNA, 25 bp, Rattus norvegicus
gctcggtacttacattcttatgctt

SEQ ID NO: 405537 - DNA, 25 bp, Rattus norvegicus
gctcggtacttagattcttatgctt

SEQ ID NO: 405538 - DNA, 25 bp, Rattus norvegicus
gctcggtccaacagctttattagat

SEQ ID NO: 405539 - DNA, 25 bp, Rattus norvegicus
gctcggtccaactgctttattagat

SEQ ID NO: 405540 - DNA, 25 bp, Rattus norvegicus
gctcggtcccgcaaaataattctgg

SEQ ID NO: 405541 - DNA, 25 bp, Rattus norvegicus
gctcggtcccgctaaataattctgg

SEQ ID NO: 405542 - DNA, 25 bp, Rattus norvegicus
gctcggttccttaatgtcttttaag

SEQ ID NO: 405543 - DNA, 25 bp, Rattus norvegicus
gctcggttcctttatgtcttttaag

SEQ ID NO: 405544 - DNA, 25 bp, Rattus norvegicus
gctcggtttcttacgtagctgtgac

SEQ ID NO: 405545 - DNA, 25 bp, Rattus norvegicus
gctcggtttctttcgtagctgtgac

SEQ ID NO: 405546 - DNA, 25 bp, Rattus norvegicus
gctcgtaactctccaatcacagtga

SEQ ID NO: 405547 - DNA, 25 bp, Rattus norvegicus
gctcgtaactctgcaatcacagtga

SEQ ID NO: 405548 - DNA, 25 bp, Rattus norvegicus
gctcgtagctcaatctgtgtgcaaa

SEQ ID NO: 405549 - DNA, 25 bp, Rattus norvegicus
gctcgtagctcattctgtgtgcaaa

SEQ ID NO: 405550 - DNA, 25 bp, Rattus norvegicus
gctcgtagctgccacttgttaagtt

SEQ ID NO: 405551 - DNA, 25 bp, Rattus norvegicus
gctcgtagctgcgacttgttaagtt

SEQ ID NO: 405552 - DNA, 25 bp, Rattus norvegicus
gctcgtagtccactcgctgctcggg

SEQ ID NO: 405553 - DNA, 25 bp, Rattus norvegicus
gctcgtagtccagtcgctgctcggg

SEQ ID NO: 405554 - DNA, 25 bp, Rattus norvegicus
gctcgtatttctctaggttgtacct

SEQ ID NO: 405555 - DNA, 25 bp, Rattus norvegicus
gctcgtatttctgtaggttgtacct

SEQ ID NO: 405556 - DNA, 25 bp, Rattus norvegicus
gctcgtcagagtctggctgtgtcat

SEQ ID NO: 405557 - DNA, 25 bp, Rattus norvegicus
gctcgtcagagtgtggctgtgtcat

SEQ ID NO: 405558 - DNA, 25 bp, Rattus norvegicus
gctcgtcccggccaagatggagtaa

SEQ ID NO: 405559 - DNA, 25 bp, Rattus norvegicus
gctcgtcccggcgaagatggagtaa

SEQ ID NO: 405560 - DNA, 25 bp, Rattus norvegicus
gctcgtccctagctggtcagagtta

SEQ ID NO: 405561 - DNA, 25 bp, Rattus norvegicus
gctcgtccctaggtggtcagagtta

SEQ ID NO: 405562 - DNA, 25 bp, Rattus norvegicus
gctcgtcctgcaagatcgcagggat

SEQ ID NO: 405563 - DNA, 25 bp, Rattus norvegicus
gctcgtcctgcatgatcgcagggat

SEQ ID NO: 405564 - DNA, 25 bp, Rattus norvegicus
gctcgtcctgtccagatggtctgaa

SEQ ID NO: 405565 - DNA, 25 bp, Rattus norvegicus
gctcgtcctgtcgagatggtctgaa

SEQ ID NO: 405566 - DNA, 25 bp, Rattus norvegicus
gctcgtcgccacatgacaacaaaga

SEQ ID NO: 405567 - DNA, 25 bp, Rattus norvegicus
gctcgtcgccacttgacaacaaaga

SEQ ID NO: 405568 - DNA, 25 bp, Rattus norvegicus
gctcgtctcctcagagggcagattc

SEQ ID NO: 405569 - DNA, 25 bp, Rattus norvegicus
gctcgtctcctctgagggcagattc

SEQ ID NO: 405570 - DNA, 25 bp, Rattus norvegicus
gctcgtgaacatcgcatagctgaca

SEQ ID NO: 405571 - DNA, 25 bp, Rattus norvegicus
gctcgtgaacatggcatagctgaca

SEQ ID NO: 405572 - DNA, 25 bp, Rattus norvegicus
gctcgtgacgtgcagcgctagccaa

SEQ ID NO: 405573 - DNA, 25 bp, Rattus norvegicus
gctcgtgacgtggagcgctagccaa

SEQ ID NO: 405574 - DNA, 25 bp, Rattus norvegicus
gctcgtgcttaacggctctgcagat

SEQ ID NO: 405575 - DNA, 25 bp, Rattus norvegicus
gctcgtgcttaagggctctgcagat

SEQ ID NO: 405576 - DNA, 25 bp, Rattus norvegicus
gctcgtggacccagtggtagctgca

SEQ ID NO: 405577 - DNA, 25 bp, Rattus norvegicus
gctcgtggaccctgtggtagctgca

SEQ ID NO: 405578 - DNA, 25 bp, Rattus norvegicus
gctcgtggcagaaggtccctattaa

SEQ ID NO: 405579 - DNA, 25 bp, Rattus norvegicus
gctcgtggcagatggtccctattaa

SEQ ID NO: 405580 - DNA, 25 bp, Rattus norvegicus
gctcgtggttccctgtgcaaaattg

SEQ ID NO: 405581 - DNA, 25 bp, Rattus norvegicus
gctcgtggttccgtgtgcaaaattg

SEQ ID NO: 405582 - DNA, 25 bp, Rattus norvegicus
gctcgtgtcaaaaaggccatttctg

SEQ ID NO: 405583 - DNA, 25 bp, Rattus norvegicus
gctcgtgtcaaataggccatttctg

SEQ ID NO: 405584 - DNA, 25 bp, Rattus norvegicus
gctcgtgtggcaccgcagcagccaa

SEQ ID NO: 405585 - DNA, 25 bp, Rattus norvegicus
gctcgtgtggcagcgcagcagccaa

SEQ ID NO: 405586 - DNA, 25 bp, Rattus norvegicus
gctcgtgttcggagtggttttctac

SEQ ID NO: 405587 - DNA, 25 bp, Rattus norvegicus
gctcgtgttcggtgtggttttctac

SEQ ID NO: 405588 - DNA, 25 bp, Rattus norvegicus
gctcgtgttgagatgtggcccacag

SEQ ID NO: 405589 - DNA, 25 bp, Rattus norvegicus
gctcgtgttgagttgtggcccacag

SEQ ID NO: 405590 - DNA, 25 bp, Rattus norvegicus
gctcgtgtttttcagtggttgccag

SEQ ID NO: 405591 - DNA, 25 bp, Rattus norvegicus
gctcgtgtttttgagtggttgccag

SEQ ID NO: 405592 - DNA, 25 bp, Rattus norvegicus
gctcgttgctccctgagtatgtgat

SEQ ID NO: 405593 - DNA, 25 bp, Rattus norvegicus
gctcgttgctccgtgagtatgtgat

SEQ ID NO: 405594 - DNA, 25 bp, Rattus norvegicus
gctcgttgtgcactgcagtggttaa

SEQ ID NO: 405595 - DNA, 25 bp, Rattus norvegicus
gctcgttgtgcagtgcagtggttaa

SEQ ID NO: 405596 - DNA, 25 bp, Rattus norvegicus
gctcgtttgaacagtgtataggcaa

SEQ ID NO: 405597 - DNA, 25 bp, Rattus norvegicus
gctcgtttgaactgtgtataggcaa

SEQ ID NO: 405598 - DNA, 25 bp, Rattus norvegicus
gctcgttttaaacgcccagactgct

SEQ ID NO: 405599 - DNA, 25 bp, Rattus norvegicus
gctcgttttaaaggcccagactgct

SEQ ID NO: 405600 - DNA, 25 bp, Rattus norvegicus
gctctaaaatatctcggttcctctc

SEQ ID NO: 405601 - DNA, 25 bp, Rattus norvegicus
gctctaaaatatgtcggttcctctc

SEQ ID NO: 405602 - DNA, 25 bp, Rattus norvegicus
gctctaaacacccttggaacgtctt

SEQ ID NO: 405603 - DNA, 25 bp, Rattus norvegicus
gctctaaacaccgttggaacgtctt

SEQ ID NO: 405604 - DNA, 25 bp, Rattus norvegicus
gctctaaatctactgaattgctttt

SEQ ID NO: 405605 - DNA, 25 bp, Rattus norvegicus
gctctaaatctagtgaattgctttt

SEQ ID NO: 405606 - DNA, 25 bp, Rattus norvegicus
gctctaacaggaccccaaatcatgg

SEQ ID NO: 405607 - DNA, 25 bp, Rattus norvegicus
gctctaacaggagcccaaatcatgg

SEQ ID NO: 405608 - DNA, 25 bp, Rattus norvegicus
gctctaacgagaatattctgtcccg

SEQ ID NO: 405609 - DNA, 25 bp, Rattus norvegicus
gctctaacgagattattctgtcccg

SEQ ID NO: 405610 - DNA, 25 bp, Rattus norvegicus
gctctaactcggcaagggtctctgg

SEQ ID NO: 405611 - DNA, 25 bp, Rattus norvegicus
gctctaactcgggaagggtctctgg

SEQ ID NO: 405612 - DNA, 25 bp, Rattus norvegicus
gctctaagaggtcgtttccattttg

SEQ ID NO: 405613 - DNA, 25 bp, Rattus norvegicus
gctctaagaggtggtttccattttg

SEQ ID NO: 405614 - DNA, 25 bp, Rattus norvegicus
gctctaagcaaaagtgacacccaag

SEQ ID NO: 405615 - DNA, 25 bp, Rattus norvegicus
gctctaagcaaatgtgacacccaag

SEQ ID NO: 405616 - DNA, 25 bp, Rattus norvegicus
gctctaagccttctacatgcatttg

SEQ ID NO: 405617 - DNA, 25 bp, Rattus norvegicus
gctctaagccttgtacatgcatttg

SEQ ID NO: 405618 - DNA, 25 bp, Rattus norvegicus
gctctaaggaacaacatggcccatt

SEQ ID NO: 405619 - DNA, 25 bp, Rattus norvegicus
gctctaaggaactacatggcccatt

SEQ ID NO: 405620 - DNA, 25 bp, Rattus norvegicus
gctctaagtaagatcctgacgctgt

SEQ ID NO: 405621 - DNA, 25 bp, Rattus norvegicus
gctctaagtaagttcctgacgctgt

SEQ ID NO: 405622 - DNA, 25 bp, Rattus norvegicus
gctctaagtcggagcagtgcccagt

SEQ ID NO: 405623 - DNA, 25 bp, Rattus norvegicus
gctctaagtcggtgcagtgcccagt

SEQ ID NO: 405624 - DNA, 25 bp, Rattus norvegicus
gctctaatctcactggccatggcta

SEQ ID NO: 405625 - DNA, 25 bp, Rattus norvegicus
gctctaatctcagtggccatggcta

SEQ ID NO: 405626 - DNA, 25 bp, Rattus norvegicus
gctctaatgtgtaatatttcctcag

SEQ ID NO: 405627 - DNA, 25 bp, Rattus norvegicus
gctctaatgtgttatatttcctcag

SEQ ID NO: 405628 - DNA, 25 bp, Rattus norvegicus
gctctaattgatctgcagcagttta

SEQ ID NO: 405629 - DNA, 25 bp, Rattus norvegicus
gctctaattgatgtgcagcagttta

SEQ ID NO: 405630 - DNA, 25 bp, Rattus norvegicus
gctctacaagcaacctactttgaat

SEQ ID NO: 405631 - DNA, 25 bp, Rattus norvegicus
gctctacaagcatcctactttgaat

SEQ ID NO: 405632 - DNA, 25 bp, Rattus norvegicus
gctctacaatgacgccgtggtgcag

SEQ ID NO: 405633 - DNA, 25 bp, Rattus norvegicus
gctctacaatgaggccgtggtgcag

SEQ ID NO: 405634 - DNA, 25 bp, Rattus norvegicus
gctctacacacacagcttgtgaggt

SEQ ID NO: 405635 - DNA, 25 bp, Rattus norvegicus
gctctacacacagagcttgtgaggt

SEQ ID NO: 405636 - DNA, 25 bp, Rattus norvegicus
gctctacacgtcagactagggcatt

SEQ ID NO: 405637 - DNA, 25 bp, Rattus norvegicus
gctctacacgtctgactagggcatt

SEQ ID NO: 405638 - DNA, 25 bp, Rattus norvegicus
gctctacactctatatgatgggcct

SEQ ID NO: 405639 - DNA, 25 bp, Rattus norvegicus
gctctacactctttatgatgggcct

SEQ ID NO: 405640 - DNA, 25 bp, Rattus norvegicus
gctctacagtctatctctgatcaat

SEQ ID NO: 405641 - DNA, 25 bp, Rattus norvegicus
gctctacagtctttctctgatcaat

SEQ ID NO: 405642 - DNA, 25 bp, Rattus norvegicus
gctctacatgccagagctatgtgtt

SEQ ID NO: 405643 - DNA, 25 bp, Rattus norvegicus
gctctacatgcctgagctatgtgtt

SEQ ID NO: 405644 - DNA, 25 bp, Rattus norvegicus
gctctaccaaggaggttagctgcct

SEQ ID NO: 405645 - DNA, 25 bp, Rattus norvegicus
gctctaccaaggtggttagctgcct

SEQ ID NO: 405646 - DNA, 25 bp, Rattus norvegicus
gctctaccacccaagcattaatgat

SEQ ID NO: 405647 - DNA, 25 bp, Rattus norvegicus
gctctaccaccctagcattaatgat

SEQ ID NO: 405648 - DNA, 25 bp, Rattus norvegicus
gctctaccactgagatgcacatcaa

SEQ ID NO: 405649 - DNA, 25 bp, Rattus norvegicus
gctctaccactgtgatgcacatcaa

SEQ ID NO: 405650 - DNA, 25 bp, Rattus norvegicus
gctctaccagaaacatcatcaccat

SEQ ID NO: 405651 - DNA, 25 bp, Rattus norvegicus
gctctaccagaatcatcatcaccat

SEQ ID NO: 405652 - DNA, 25 bp, Rattus norvegicus
gctctacccaagcaagacactgtta

SEQ ID NO: 405653 - DNA, 25 bp, Rattus norvegicus
gctctacccaaggaagacactgtta

SEQ ID NO: 405654 - DNA, 25 bp, Rattus norvegicus
gctctacccatcaaaactacctttt

SEQ ID NO: 405655 - DNA, 25 bp, Rattus norvegicus
gctctacccatctaaactacctttt

SEQ ID NO: 405656 - DNA, 25 bp, Rattus norvegicus
gctctacccgaaacattccagtaaa

SEQ ID NO: 405657 - DNA, 25 bp, Rattus norvegicus
gctctacccgaatcattccagtaaa

SEQ ID NO: 405658 - DNA, 25 bp, Rattus norvegicus
gctctacctggtaactctttaggat

SEQ ID NO: 405659 - DNA, 25 bp, Rattus norvegicus
gctctacctggttactctttaggat

SEQ ID NO: 405660 - DNA, 25 bp, Rattus norvegicus
gctctacgctaaaacacagtccttg

SEQ ID NO: 405661 - DNA, 25 bp, Rattus norvegicus
gctctacgctaatacacagtccttg

SEQ ID NO: 405662 - DNA, 25 bp, Rattus norvegicus
gctctactagacaggagtgttcatc

SEQ ID NO: 405663 - DNA, 25 bp, Rattus norvegicus
gctctactagactggagtgttcatc

SEQ ID NO: 405664 - DNA, 25 bp, Rattus norvegicus
gctctactatttctaaaggccctca

SEQ ID NO: 405665 - DNA, 25 bp, Rattus norvegicus
gctctactatttgtaaaggccctca

SEQ ID NO: 405666 - DNA, 25 bp, Rattus norvegicus
gctctactcgtgattcattaccata

SEQ ID NO: 405667 - DNA, 25 bp, Rattus norvegicus
gctctactcgtgtttcattaccata

SEQ ID NO: 405668 - DNA, 25 bp, Rattus norvegicus
gctctactgacaataattcaggcaa

SEQ ID NO: 405669 - DNA, 25 bp, Rattus norvegicus
gctctactgacattaattcaggcaa

SEQ ID NO: 405670 - DNA, 25 bp, Rattus norvegicus
gctctactggctaagactttcagat

SEQ ID NO: 405671 - DNA, 25 bp, Rattus norvegicus
gctctactggcttagactttcagat

SEQ ID NO: 405672 - DNA, 25 bp, Rattus norvegicus
gctctagacatcagacttctgattt

SEQ ID NO: 405673 - DNA, 25 bp, Rattus norvegicus
gctctagacatctgacttctgattt

SEQ ID NO: 405674 - DNA, 25 bp, Rattus norvegicus
gctctagagtctatggagtctccta

SEQ ID NO: 405675 - DNA, 25 bp, Rattus norvegicus
gctctagagtctttggagtctccta

SEQ ID NO: 405676 - DNA, 25 bp, Rattus norvegicus
gctctagcaccaattctttactcaa

SEQ ID NO: 405677 - DNA, 25 bp, Rattus norvegicus
gctctagcaccatttctttactcaa

SEQ ID NO: 405678 - DNA, 25 bp, Rattus norvegicus
gctctagcactacacctgggtcctg

SEQ ID NO: 405679 - DNA, 25 bp, Rattus norvegicus
gctctagcactagacctgggtcctg

SEQ ID NO: 405680 - DNA, 25 bp, Rattus norvegicus
gctctagctctcaggcatatgacaa

SEQ ID NO: 405681 - DNA, 25 bp, Rattus norvegicus
gctctagctctctggcatatgacaa

SEQ ID NO: 405682 - DNA, 25 bp, Rattus norvegicus
gctctagctgatcagtatgaggcca

SEQ ID NO: 405683 - DNA, 25 bp, Rattus norvegicus
gctctagctgatgagtatgaggcca

SEQ ID NO: 405684 - DNA, 25 bp, Rattus norvegicus
gctctaggaagcaccgaagggcagt

SEQ ID NO: 405685 - DNA, 25 bp, Rattus norvegicus
gctctaggaagcagccgggccataa

SEQ ID NO: 405686 - DNA, 25 bp, Rattus norvegicus
gctctaggaagctccgaagggcagt

SEQ ID NO: 405687 - DNA, 25 bp, Rattus norvegicus
gctctaggaagctgccgggccataa

SEQ ID NO: 405688 - DNA, 25 bp, Rattus norvegicus
gctctaggctgcatcacattttaaa

SEQ ID NO: 405689 - DNA, 25 bp, Rattus norvegicus
gctctaggctgcttcacattttaaa

SEQ ID NO: 405690 - DNA, 25 bp, Rattus norvegicus
gctctagggaagcttgtctctggaa

SEQ ID NO: 405691 - DNA, 25 bp, Rattus norvegicus
gctctagggaaggttgtctctggaa

SEQ ID NO: 405692 - DNA, 25 bp, Rattus norvegicus
gctctagggcctctttgaatattca

SEQ ID NO: 405693 - DNA, 25 bp, Rattus norvegicus
gctctagggcctgtttgaatattca

SEQ ID NO: 405694 - DNA, 25 bp, Rattus norvegicus
gctctagtccaaagggaagcatgcc

SEQ ID NO: 405695 - DNA, 25 bp, Rattus norvegicus
gctctagtccaatgggaagcatgcc

SEQ ID NO: 405696 - DNA, 25 bp, Rattus norvegicus
gctctagtgctgaccgctgaaagtc

SEQ ID NO: 405697 - DNA, 25 bp, Rattus norvegicus
gctctagtgctgtccgctgaaagtc

SEQ ID NO: 405698 - DNA, 25 bp, Rattus norvegicus
gctctagtgtcaattctgatgctca

SEQ ID NO: 405699 - DNA, 25 bp, Rattus norvegicus
gctctagtgtcatttctgatgctca

SEQ ID NO: 405700 - DNA, 25 bp, Rattus norvegicus
gctctagttgatcccggtgacaaac

SEQ ID NO: 405701 - DNA, 25 bp, Rattus norvegicus
gctctagttgatgccggtgacaaac

SEQ ID NO: 405702 - DNA, 25 bp, Rattus norvegicus
gctctagtttgcatctttgtgaaca

SEQ ID NO: 405703 - DNA, 25 bp, Rattus norvegicus
gctctagtttgcttctttgtgaaca

SEQ ID NO: 405704 - DNA, 25 bp, Rattus norvegicus
gctctatacagtatcatagcgcccc

SEQ ID NO: 405705 - DNA, 25 bp, Rattus norvegicus
gctctatacagtttcatagcgcccc

SEQ ID NO: 405706 - DNA, 25 bp, Rattus norvegicus
gctctatacgtactgaggacccaga

SEQ ID NO: 405707 - DNA, 25 bp, Rattus norvegicus
gctctatacgtagtgaggacccaga

SEQ ID NO: 405708 - DNA, 25 bp, Rattus norvegicus
gctctatactgacagcagctttcac

SEQ ID NO: 405709 - DNA, 25 bp, Rattus norvegicus
gctctatactgagagcagctttcac

SEQ ID NO: 405710 - DNA, 25 bp, Rattus norvegicus
gctctatagtgcatttggcgttatc

SEQ ID NO: 405711 - DNA, 25 bp, Rattus norvegicus
gctctatagtgcttttggcgttatc

SEQ ID NO: 405712 - DNA, 25 bp, Rattus norvegicus
gctctatatagccttggtgtctacc

SEQ ID NO: 405713 - DNA, 25 bp, Rattus norvegicus
gctctatatagcgttggtgtctacc

SEQ ID NO: 405714 - DNA, 25 bp, Rattus norvegicus
gctctatcagccagggagggacagt

SEQ ID NO: 405715 - DNA, 25 bp, Rattus norvegicus
gctctatcagcctgggagggacagt

SEQ ID NO: 405716 - DNA, 25 bp, Rattus norvegicus
gctctatcggttacatacatggcta

SEQ ID NO: 405717 - DNA, 25 bp, Rattus norvegicus
gctctatcggtttcatacatggcta

SEQ ID NO: 405718 - DNA, 25 bp, Rattus norvegicus
gctctatcgtagctctgaggttcga

SEQ ID NO: 405719 - DNA, 25 bp, Rattus norvegicus
gctctatcgtaggtctgaggttcga

SEQ ID NO: 405720 - DNA, 25 bp, Rattus norvegicus
gctctatctcatcgctaagtcagtt

SEQ ID NO: 405721 - DNA, 25 bp, Rattus norvegicus
gctctatctcatggctaagtcagtt

SEQ ID NO: 405722 - DNA, 25 bp, Rattus norvegicus
gctctatcttctcggaagcctggaa

SEQ ID NO: 405723 - DNA, 25 bp, Rattus norvegicus
gctctatcttctgggaagcctggaa

SEQ ID NO: 405724 - DNA, 25 bp, Rattus norvegicus
gctctatgagttctatctacaaagt

SEQ ID NO: 405725 - DNA, 25 bp, Rattus norvegicus
gctctatgagttgtatctacaaagt

SEQ ID NO: 405726 - DNA, 25 bp, Rattus norvegicus
gctctatgatcaaggcactggtgca

SEQ ID NO: 405727 - DNA, 25 bp, Rattus norvegicus
gctctatgatcatggcactggtgca

SEQ ID NO: 405728 - DNA, 25 bp, Rattus norvegicus
gctctatgcagtataattccaggta

SEQ ID NO: 405729 - DNA, 25 bp, Rattus norvegicus
gctctatgcagtttaattccaggta

SEQ ID NO: 405730 - DNA, 25 bp, Rattus norvegicus
gctctatgtatacgcctacttgggt

SEQ ID NO: 405731 - DNA, 25 bp, Rattus norvegicus
gctctatgtataggcctacttgggt

SEQ ID NO: 405732 - DNA, 25 bp, Rattus norvegicus
gctctatgtttgagccttttaatta

SEQ ID NO: 405733 - DNA, 25 bp, Rattus norvegicus
gctctatgtttgtgccttttaatta

SEQ ID NO: 405734 - DNA, 25 bp, Rattus norvegicus
gctctcaacgatatgacttccatag

SEQ ID NO: 405735 - DNA, 25 bp, Rattus norvegicus
gctctcaacgatttgacttccatag

SEQ ID NO: 405736 - DNA, 25 bp, Rattus norvegicus
gctctcaagagcatcaacaacgcgg

SEQ ID NO: 405737 - DNA, 25 bp, Rattus norvegicus
gctctcaagagcttcaacaacgcgg

SEQ ID NO: 405738 - DNA, 25 bp, Rattus norvegicus
gctctcaagcccatggaacccagaa

SEQ ID NO: 405739 - DNA, 25 bp, Rattus norvegicus
gctctcaagcccttggaacccagaa

SEQ ID NO: 405740 - DNA, 25 bp, Rattus norvegicus
gctctcaatgacaattcaggctgat

SEQ ID NO: 405741 - DNA, 25 bp, Rattus norvegicus
gctctcaatgactattcaggctgat

SEQ ID NO: 405742 - DNA, 25 bp, Rattus norvegicus
gctctcaatgggactacaggcaact

SEQ ID NO: 405743 - DNA, 25 bp, Rattus norvegicus
gctctcaatgggtctacaggcaact

SEQ ID NO: 405744 - DNA, 25 bp, Rattus norvegicus
gctctcaattttcgattatcagtat

SEQ ID NO: 405745 - DNA, 25 bp, Rattus norvegicus
gctctcaattttggattatcagtat

SEQ ID NO: 405746 - DNA, 25 bp, Rattus norvegicus
gctctcacaggcaggcgacttaagt

SEQ ID NO: 405747 - DNA, 25 bp, Rattus norvegicus
gctctcacaggctggcgacttaagt

SEQ ID NO: 405748 - DNA, 25 bp, Rattus norvegicus
gctctcaccctgatttggttgcaaa

SEQ ID NO: 405749 - DNA, 25 bp, Rattus norvegicus
gctctcaccctgttttggttgcaaa

SEQ ID NO: 405750 - DNA, 25 bp, Rattus norvegicus
gctctcacggacattcaataatgct

SEQ ID NO: 405751 - DNA, 25 bp, Rattus norvegicus
gctctcacggactttcaataatgct

SEQ ID NO: 405752 - DNA, 25 bp, Rattus norvegicus
gctctcactagtactcggttagtag

SEQ ID NO: 405753 - DNA, 25 bp, Rattus norvegicus
gctctcactagttctcggttagtag

SEQ ID NO: 405754 - DNA, 25 bp, Rattus norvegicus
gctctcactggaagctacacatgaa

SEQ ID NO: 405755 - DNA, 25 bp, Rattus norvegicus
gctctcactggatgctacacatgaa

SEQ ID NO: 405756 - DNA, 25 bp, Rattus norvegicus
gctctcagctctctgtataaactgt

SEQ ID NO: 405757 - DNA, 25 bp, Rattus norvegicus
gctctcagctctgtgtataaactgt

SEQ ID NO: 405758 - DNA, 25 bp, Rattus norvegicus
gctctcagctgtagagtggtccgaa

SEQ ID NO: 405759 - DNA, 25 bp, Rattus norvegicus
gctctcagctgttgagtggtccgaa

SEQ ID NO: 405760 - DNA, 25 bp, Rattus norvegicus
gctctcagcttgagccttataaata

SEQ ID NO: 405761 - DNA, 25 bp, Rattus norvegicus
gctctcagcttgtgccttataaata

SEQ ID NO: 405762 - DNA, 25 bp, Rattus norvegicus
gctctcaggcaactgggtacattat

SEQ ID NO: 405763 - DNA, 25 bp, Rattus norvegicus
gctctcaggcaagtgggtacattat

SEQ ID NO: 405764 - DNA, 25 bp, Rattus norvegicus
gctctcaggctgacgtggtcttctc

SEQ ID NO: 405765 - DNA, 25 bp, Rattus norvegicus
gctctcaggctgtcgtggtcttctc

SEQ ID NO: 405766 - DNA, 25 bp, Rattus norvegicus
gctctcagggaaagcttttcttgtt

SEQ ID NO: 405767 - DNA, 25 bp, Rattus norvegicus
gctctcagggaatgcttttcttgtt

SEQ ID NO: 405768 - DNA, 25 bp, Rattus norvegicus
gctctcagggccatggcgaggcgaa

SEQ ID NO: 405769 - DNA, 25 bp, Rattus norvegicus
gctctcagggccttggcgaggcgaa

SEQ ID NO: 405770 - DNA, 25 bp, Rattus norvegicus
gctctcagtcaaaatctccaacggg

SEQ ID NO: 405771 - DNA, 25 bp, Rattus norvegicus
gctctcagtcaatatctccaacggg

SEQ ID NO: 405772 - DNA, 25 bp, Rattus norvegicus
gctctcagtctcattgtgacactga

SEQ ID NO: 405773 - DNA, 25 bp, Rattus norvegicus
gctctcagtctctttgtgacactga

SEQ ID NO: 405774 - DNA, 25 bp, Rattus norvegicus
gctctcagtgagcactcttttgtta

SEQ ID NO: 405775 - DNA, 25 bp, Rattus norvegicus
gctctcagtgaggactcttttgtta

SEQ ID NO: 405776 - DNA, 25 bp, Rattus norvegicus
gctctcatggatacagatggctctg

SEQ ID NO: 405777 - DNA, 25 bp, Rattus norvegicus
gctctcatggattcagatggctctg

SEQ ID NO: 405778 - DNA, 25 bp, Rattus norvegicus
gctctcatggcaaatcagaactcat

SEQ ID NO: 405779 - DNA, 25 bp, Rattus norvegicus
gctctcatggcatatcagaactcat

SEQ ID NO: 405780 - DNA, 25 bp, Rattus norvegicus
gctctcatggtgactagtcacacga

SEQ ID NO: 405781 - DNA, 25 bp, Rattus norvegicus
gctctcatggtgtctagtcacacga

SEQ ID NO: 405782 - DNA, 25 bp, Rattus norvegicus
gctctcatgtttagcctgttacaga

SEQ ID NO: 405783 - DNA, 25 bp, Rattus norvegicus
gctctcatgttttgcctgttacaga

SEQ ID NO: 405784 - DNA, 25 bp, Rattus norvegicus
gctctcattaaaccagctggtgtca

SEQ ID NO: 405785 - DNA, 25 bp, Rattus norvegicus
gctctcattaaagcagctggtgtca

SEQ ID NO: 405786 - DNA, 25 bp, Rattus norvegicus
gctctccaacctccatcagaaggat

SEQ ID NO: 405787 - DNA, 25 bp, Rattus norvegicus
gctctccaacctgcatcagaaggat

SEQ ID NO: 405788 - DNA, 25 bp, Rattus norvegicus
gctctccaatacagtctactctttg

SEQ ID NO: 405789 - DNA, 25 bp, Rattus norvegicus
gctctccaatactgtctactctttg

SEQ ID NO: 405790 - DNA, 25 bp, Rattus norvegicus
gctctccacaaacttctgatgtcat

SEQ ID NO: 405791 - DNA, 25 bp, Rattus norvegicus
gctctccacaaagttctgatgtcat

SEQ ID NO: 405792 - DNA, 25 bp, Rattus norvegicus
gctctccactctattctgttaagaa

SEQ ID NO: 405793 - DNA, 25 bp, Rattus norvegicus
gctctccactcttttctgttaagaa

SEQ ID NO: 405794 - DNA, 25 bp, Rattus norvegicus
gctctccagcctacttttgggaaaa

SEQ ID NO: 405795 - DNA, 25 bp, Rattus norvegicus
gctctccagccttcttttgggaaaa

SEQ ID NO: 405796 - DNA, 25 bp, Rattus norvegicus
gctctccagctgatcttaggccggg

SEQ ID NO: 405797 - DNA, 25 bp, Rattus norvegicus
gctctccagctgttcttaggccggg

SEQ ID NO: 405798 - DNA, 25 bp, Rattus norvegicus
gctctccagtatcgctgcaaacact

SEQ ID NO: 405799 - DNA, 25 bp, Rattus norvegicus
gctctccagtatggctgcaaacact

SEQ ID NO: 405800 - DNA, 25 bp, Rattus norvegicus
gctctccatagaagaagcctccagg

SEQ ID NO: 405801 - DNA, 25 bp, Rattus norvegicus
gctctccatagatgaagcctccagg

SEQ ID NO: 405802 - DNA, 25 bp, Rattus norvegicus
gctctcccactccatatatataata

SEQ ID NO: 405803 - DNA, 25 bp, Rattus norvegicus
gctctcccactcgatatatataata

SEQ ID NO: 405804 - DNA, 25 bp, Rattus norvegicus
gctctcccagagacatacatgcagg

SEQ ID NO: 405805 - DNA, 25 bp, Rattus norvegicus
gctctcccagagtcatacatgcagg

SEQ ID NO: 405806 - DNA, 25 bp, Rattus norvegicus
gctctccccaccatgtaaaacaaag

SEQ ID NO: 405807 - DNA, 25 bp, Rattus norvegicus
gctctccccaccttgtaaaacaaag

SEQ ID NO: 405808 - DNA, 25 bp, Rattus norvegicus
gctctcccggaacgaattctggttt

SEQ ID NO: 405809 - DNA, 25 bp, Rattus norvegicus
gctctcccggaaggaattctggttt

SEQ ID NO: 405810 - DNA, 25 bp, Rattus norvegicus
gctctccctaataatcttaccagaa

SEQ ID NO: 405811 - DNA, 25 bp, Rattus norvegicus
gctctccctaattatcttaccagaa

SEQ ID NO: 405812 - DNA, 25 bp, Rattus norvegicus
gctctccctggtaagcgactcaaag

SEQ ID NO: 405813 - DNA, 25 bp, Rattus norvegicus
gctctccctggttagcgactcaaag

SEQ ID NO: 405814 - DNA, 25 bp, Rattus norvegicus
gctctccctgtaatctgtcttgagg

SEQ ID NO: 405815 - DNA, 25 bp, Rattus norvegicus
gctctccctgtattctgtcttgagg

SEQ ID NO: 405816 - DNA, 25 bp, Rattus norvegicus
gctctccgctacactagtgaatcag

SEQ ID NO: 405817 - DNA, 25 bp, Rattus norvegicus
gctctccgctactctagtgaatcag

SEQ ID NO: 405818 - DNA, 25 bp, Rattus norvegicus
gctctccggaacattttaaccttgt

SEQ ID NO: 405819 - DNA, 25 bp, Rattus norvegicus
gctctccggaactttttaaccttgt

SEQ ID NO: 405820 - DNA, 25 bp, Rattus norvegicus
gctctcctaaggacatttgaaatag

SEQ ID NO: 405821 - DNA, 25 bp, Rattus norvegicus
gctctcctaaggtcatttgaaatag

SEQ ID NO: 405822 - DNA, 25 bp, Rattus norvegicus
gctctcctacttacacagattcaga

SEQ ID NO: 405823 - DNA, 25 bp, Rattus norvegicus
gctctcctactttcacagattcaga

SEQ ID NO: 405824 - DNA, 25 bp, Rattus norvegicus
gctctcctcaggaaaatgacatcac

SEQ ID NO: 405825 - DNA, 25 bp, Rattus norvegicus
gctctcctcaggtaaatgacatcac

SEQ ID NO: 405826 - DNA, 25 bp, Rattus norvegicus
gctctcctccacactagctaaagag

SEQ ID NO: 405827 - DNA, 25 bp, Rattus norvegicus
gctctcctccactctagctaaagag

SEQ ID NO: 405828 - DNA, 25 bp, Rattus norvegicus
gctctcctcctgattatgactaaat

SEQ ID NO: 405829 - DNA, 25 bp, Rattus norvegicus
gctctcctcctgtttatgactaaat

SEQ ID NO: 405830 - DNA, 25 bp, Rattus norvegicus
gctctcctggaactcagacggtgga

SEQ ID NO: 405831 - DNA, 25 bp, Rattus norvegicus
gctctcctggaagtcagacggtgga

SEQ ID NO: 405832 - DNA, 25 bp, Rattus norvegicus
gctctcctggagactagggactttc

SEQ ID NO: 405833 - DNA, 25 bp, Rattus norvegicus
gctctcctggagtctagggactttc

SEQ ID NO: 405834 - DNA, 25 bp, Rattus norvegicus
gctctcctgtaacaagacatcatta

SEQ ID NO: 405835 - DNA, 25 bp, Rattus norvegicus
gctctcctgtaagaagacatcatta

SEQ ID NO: 405836 - DNA, 25 bp, Rattus norvegicus
gctctccttatgcaattgcatctca

SEQ ID NO: 405837 - DNA, 25 bp, Rattus norvegicus
gctctccttatggaattgcatctca

SEQ ID NO: 405838 - DNA, 25 bp, Rattus norvegicus
gctctccttcaacaagtgtccaggc

SEQ ID NO: 405839 - DNA, 25 bp, Rattus norvegicus
gctctccttcaagaagtgtccaggc

SEQ ID NO: 405840 - DNA, 25 bp, Rattus norvegicus
gctctccttccaagaatgtctgtga

SEQ ID NO: 405841 - DNA, 25 bp, Rattus norvegicus
gctctccttccaagtgtacatagct

SEQ ID NO: 405842 - DNA, 25 bp, Rattus norvegicus
gctctccttccatgaatgtctgtga

SEQ ID NO: 405843 - DNA, 25 bp, Rattus norvegicus
gctctccttccatgtgtacatagct

SEQ ID NO: 405844 - DNA, 25 bp, Rattus norvegicus
gctctccttgagctacaattacagg

SEQ ID NO: 405845 - DNA, 25 bp, Rattus norvegicus
gctctccttgaggtacaattacagg

SEQ ID NO: 405846 - DNA, 25 bp, Rattus norvegicus
gctctccttggcctttaagatctag

SEQ ID NO: 405847 - DNA, 25 bp, Rattus norvegicus
gctctccttggcgtttaagatctag

SEQ ID NO: 405848 - DNA, 25 bp, Rattus norvegicus
gctctccttttcagctttatgaagt

SEQ ID NO: 405849 - DNA, 25 bp, Rattus norvegicus
gctctccttttctgctttatgaagt

SEQ ID NO: 405850 - DNA, 25 bp, Rattus norvegicus
gctctccttttgctatgttttttaa

SEQ ID NO: 405851 - DNA, 25 bp, Rattus norvegicus
gctctccttttggtatgttttttaa

SEQ ID NO: 405852 - DNA, 25 bp, Rattus norvegicus
gctctcgaaaccaatcttatcgctc

SEQ ID NO: 405853 - DNA, 25 bp, Rattus norvegicus
gctctcgaaacctatcttatcgctc

SEQ ID NO: 405854 - DNA, 25 bp, Rattus norvegicus
gctctcgacaggaggtgttggctca

SEQ ID NO: 405855 - DNA, 25 bp, Rattus norvegicus
gctctcgacaggtggtgttggctca

SEQ ID NO: 405856 - DNA, 25 bp, Rattus norvegicus
gctctcgcatgtcttccaaatgaag

SEQ ID NO: 405857 - DNA, 25 bp, Rattus norvegicus
gctctcgcatgtgttccaaatgaag

SEQ ID NO: 405858 - DNA, 25 bp, Rattus norvegicus
gctctcgctgaaatggactctggac

SEQ ID NO: 405859 - DNA, 25 bp, Rattus norvegicus
gctctcgctgaattggactctggac

SEQ ID NO: 405860 - DNA, 25 bp, Rattus norvegicus
gctctcggaagacgagacgcccctg

SEQ ID NO: 405861 - DNA, 25 bp, Rattus norvegicus
gctctcggaagaggagacgcccctg

SEQ ID NO: 405862 - DNA, 25 bp, Rattus norvegicus
gctctcggagtcagaggtcagccag

SEQ ID NO: 405863 - DNA, 25 bp, Rattus norvegicus
gctctcggagtctgaggtcagccag

SEQ ID NO: 405864 - DNA, 25 bp, Rattus norvegicus
gctctcggttgcatgttttgaatga

SEQ ID NO: 405865 - DNA, 25 bp, Rattus norvegicus
gctctcggttgcttgttttgaatga

SEQ ID NO: 405866 - DNA, 25 bp, Rattus norvegicus
gctctcgtatatactctgcaccagg

SEQ ID NO: 405867 - DNA, 25 bp, Rattus norvegicus
gctctcgtatattctctgcaccagg

SEQ ID NO: 405868 - DNA, 25 bp, Rattus norvegicus
gctctcgtgatcctgtctaaaggca

SEQ ID NO: 405869 - DNA, 25 bp, Rattus norvegicus
gctctcgtgatcgtgtctaaaggca

SEQ ID NO: 405870 - DNA, 25 bp, Rattus norvegicus
gctctctaagttccagactatcaca

SEQ ID NO: 405871 - DNA, 25 bp, Rattus norvegicus
gctctctaagttgcagactatcaca

SEQ ID NO: 405872 - DNA, 25 bp, Rattus norvegicus
gctctctacagacacctcaaaatga

SEQ ID NO: 405873 - DNA, 25 bp, Rattus norvegicus
gctctctacagagacctcaaaatga

SEQ ID NO: 405874 - DNA, 25 bp, Rattus norvegicus
gctctctagagccaggaggcttcat

SEQ ID NO: 405875 - DNA, 25 bp, Rattus norvegicus
gctctctagagcgaggaggcttcat

SEQ ID NO: 405876 - DNA, 25 bp, Rattus norvegicus
gctctctagcacctataaccaggat

SEQ ID NO: 405877 - DNA, 25 bp, Rattus norvegicus
gctctctagcacgtataaccaggat

SEQ ID NO: 405878 - DNA, 25 bp, Rattus norvegicus
gctctctagtcaacaggttctttga

SEQ ID NO: 405879 - DNA, 25 bp, Rattus norvegicus
gctctctagtcatcaggttctttga

SEQ ID NO: 405880 - DNA, 25 bp, Rattus norvegicus
gctctctcaatcctgctttggatgg

SEQ ID NO: 405881 - DNA, 25 bp, Rattus norvegicus
gctctctcaatcgtgctttggatgg

SEQ ID NO: 405882 - DNA, 25 bp, Rattus norvegicus
gctctctcagctcatagaactcatt

SEQ ID NO: 405883 - DNA, 25 bp, Rattus norvegicus
gctctctcagctgatagaactcatt

SEQ ID NO: 405884 - DNA, 25 bp, Rattus norvegicus
gctctctcaggccaggacttagtga

SEQ ID NO: 405885 - DNA, 25 bp, Rattus norvegicus
gctctctcaggcgaggacttagtga

SEQ ID NO: 405886 - DNA, 25 bp, Rattus norvegicus
gctctctcatctcctcttggtgttt

SEQ ID NO: 405887 - DNA, 25 bp, Rattus norvegicus
gctctctcatctgctcttggtgttt

SEQ ID NO: 405888 - DNA, 25 bp, Rattus norvegicus
gctctctcccaacttacgaaagatg

SEQ ID NO: 405889 - DNA, 25 bp, Rattus norvegicus
gctctctcccaagttacgaaagatg

SEQ ID NO: 405890 - DNA, 25 bp, Rattus norvegicus
gctctctccgttcaacagttgttta

SEQ ID NO: 405891 - DNA, 25 bp, Rattus norvegicus
gctctctccgttgaacagttgttta

SEQ ID NO: 405892 - DNA, 25 bp, Rattus norvegicus
gctctctcctatagaaaatgcccac

SEQ ID NO: 405893 - DNA, 25 bp, Rattus norvegicus
gctctctcctattgaaaatgcccac

SEQ ID NO: 405894 - DNA, 25 bp, Rattus norvegicus
gctctctcgaatacaagtcgggtat

SEQ ID NO: 405895 - DNA, 25 bp, Rattus norvegicus
gctctctcgaattcaagtcgggtat

SEQ ID NO: 405896 - DNA, 25 bp, Rattus norvegicus
gctctctcggagaccagcaatatgt

SEQ ID NO: 405897 - DNA, 25 bp, Rattus norvegicus
gctctctcggagtccagcaatatgt

SEQ ID NO: 405898 - DNA, 25 bp, Rattus norvegicus
gctctctctctaccagcatgaggaa

SEQ ID NO: 405899 - DNA, 25 bp, Rattus norvegicus
gctctctctctagcagcatgaggaa

SEQ ID NO: 405900 - DNA, 25 bp, Rattus norvegicus
gctctctctcttagaaattacctca

SEQ ID NO: 405901 - DNA, 25 bp, Rattus norvegicus
gctctctctctttgaaattacctca

SEQ ID NO: 405902 - DNA, 25 bp, Rattus norvegicus
gctctctctgagatagtgggtttta

SEQ ID NO: 405903 - DNA, 25 bp, Rattus norvegicus
gctctctctgagttagtgggtttta

SEQ ID NO: 405904 - DNA, 25 bp, Rattus norvegicus
gctctctgaagcatggagggaccga

SEQ ID NO: 405905 - DNA, 25 bp, Rattus norvegicus
gctctctgaagcttggagggaccga

SEQ ID NO: 405906 - DNA, 25 bp, Rattus norvegicus
gctctctgacaaactgctgctgaag

SEQ ID NO: 405907 - DNA, 25 bp, Rattus norvegicus
gctctctgacaatctgctgctgaag

SEQ ID NO: 405908 - DNA, 25 bp, Rattus norvegicus
gctctctgatgtctgtgggagacca

SEQ ID NO: 405909 - DNA, 25 bp, Rattus norvegicus
gctctctgatgtgtgtgggagacca

SEQ ID NO: 405910 - DNA, 25 bp, Rattus norvegicus
gctctctgcacaacaggttcatttg

SEQ ID NO: 405911 - DNA, 25 bp, Rattus norvegicus
gctctctgcacatcaggttcatttg

SEQ ID NO: 405912 - DNA, 25 bp, Rattus norvegicus
gctctctgcctacaaaaactacttt

SEQ ID NO: 405913 - DNA, 25 bp, Rattus norvegicus
gctctctgcctagaaaaactacttt

SEQ ID NO: 405914 - DNA, 25 bp, Rattus norvegicus
gctctctgctacaaggaggatctca

SEQ ID NO: 405915 - DNA, 25 bp, Rattus norvegicus
gctctctgctactaggaggatctca

SEQ ID NO: 405916 - DNA, 25 bp, Rattus norvegicus
gctctctgctcacctacttttaaaa

SEQ ID NO: 405917 - DNA, 25 bp, Rattus norvegicus
gctctctgctcagctacttttaaaa

SEQ ID NO: 405918 - DNA, 25 bp, Rattus norvegicus
gctctctgctgcacacttttaaata

SEQ ID NO: 405919 - DNA, 25 bp, Rattus norvegicus
gctctctgctgctcacttttaaata

SEQ ID NO: 405920 - DNA, 25 bp, Rattus norvegicus
gctctctgctttctggtgtcattga

SEQ ID NO: 405921 - DNA, 25 bp, Rattus norvegicus
gctctctgctttgtggtgtcattga

SEQ ID NO: 405922 - DNA, 25 bp, Rattus norvegicus
gctctctggagcctgatgaattact

SEQ ID NO: 405923 - DNA, 25 bp, Rattus norvegicus
gctctctggagcgtgatgaattact

SEQ ID NO: 405924 - DNA, 25 bp, Rattus norvegicus
gctctctggcacattgtacgtgtgg

SEQ ID NO: 405925 - DNA, 25 bp, Rattus norvegicus
gctctctggcactttgtacgtgtgg

SEQ ID NO: 405926 - DNA, 25 bp, Rattus norvegicus
gctctctggcctagcaagggttagt

SEQ ID NO: 405927 - DNA, 25 bp, Rattus norvegicus
gctctctggccttgcaagggttagt

SEQ ID NO: 405928 - DNA, 25 bp, Rattus norvegicus
gctctctggctcagcagaaattctc

SEQ ID NO: 405929 - DNA, 25 bp, Rattus norvegicus
gctctctggctctgcagaaattctc

SEQ ID NO: 405930 - DNA, 25 bp, Rattus norvegicus
gctctctgggagatgtctaacttca

SEQ ID NO: 405931 - DNA, 25 bp, Rattus norvegicus
gctctctgggagttgtctaacttca

SEQ ID NO: 405932 - DNA, 25 bp, Rattus norvegicus
gctctctgggatattggacctgcct

SEQ ID NO: 405933 - DNA, 25 bp, Rattus norvegicus
gctctctgggattttggacctgcct

SEQ ID NO: 405934 - DNA, 25 bp, Rattus norvegicus
gctctctgtcctaggtgatcacctg

SEQ ID NO: 405935 - DNA, 25 bp, Rattus norvegicus
gctctctgtccttggtgatcacctg

SEQ ID NO: 405936 - DNA, 25 bp, Rattus norvegicus
gctctctgtggacttcgataactgg

SEQ ID NO: 405937 - DNA, 25 bp, Rattus norvegicus
gctctctgtggagttcgataactgg

SEQ ID NO: 405938 - DNA, 25 bp, Rattus norvegicus
gctctctgtgtcaagtactaggtta

SEQ ID NO: 405939 - DNA, 25 bp, Rattus norvegicus
gctctctgtgtctagtactaggtta

SEQ ID NO: 405940 - DNA, 25 bp, Rattus norvegicus
gctctctgtgttcggaggcaatttt

SEQ ID NO: 405941 - DNA, 25 bp, Rattus norvegicus
gctctctgtgttgggaggcaatttt

SEQ ID NO: 405942 - DNA, 25 bp, Rattus norvegicus
gctctctgttgtacactttcaagca

SEQ ID NO: 405943 - DNA, 25 bp, Rattus norvegicus
gctctctgttgttcactttcaagca

SEQ ID NO: 405944 - DNA, 25 bp, Rattus norvegicus
gctctcttaagcagattctttatcg

SEQ ID NO: 405945 - DNA, 25 bp, Rattus norvegicus
gctctcttaagctgattctttatcg

SEQ ID NO: 405946 - DNA, 25 bp, Rattus norvegicus
gctctcttaccaaaacctactttag

SEQ ID NO: 405947 - DNA, 25 bp, Rattus norvegicus
gctctcttaccataacctactttag

SEQ ID NO: 405948 - DNA, 25 bp, Rattus norvegicus
gctctcttaggacttcaggttttaa

SEQ ID NO: 405949 - DNA, 25 bp, Rattus norvegicus
gctctcttaggagttcaggttttaa

SEQ ID NO: 405950 - DNA, 25 bp, Rattus norvegicus
gctctcttcagacgtcaatccaatc

SEQ ID NO: 405951 - DNA, 25 bp, Rattus norvegicus
gctctcttcagaggtcaatccaatc

SEQ ID NO: 405952 - DNA, 25 bp, Rattus norvegicus
gctctcttccaaagtacactggcat

SEQ ID NO: 405953 - DNA, 25 bp, Rattus norvegicus
gctctcttccaatgtacactggcat

SEQ ID NO: 405954 - DNA, 25 bp, Rattus norvegicus
gctctcttccttactaattagtcga

SEQ ID NO: 405955 - DNA, 25 bp, Rattus norvegicus
gctctcttcctttctaattagtcga

SEQ ID NO: 405956 - DNA, 25 bp, Rattus norvegicus
gctctcttctgacatgcagggcatt

SEQ ID NO: 405957 - DNA, 25 bp, Rattus norvegicus
gctctcttctgagatgcagggcatt

SEQ ID NO: 405958 - DNA, 25 bp, Rattus norvegicus
gctctcttctggactttgctggacc

SEQ ID NO: 405959 - DNA, 25 bp, Rattus norvegicus
gctctcttctggtctttgctggacc

SEQ ID NO: 405960 - DNA, 25 bp, Rattus norvegicus
gctctcttgaggcagaaaactagac

SEQ ID NO: 405961 - DNA, 25 bp, Rattus norvegicus
gctctcttgagggagaaaactagac

SEQ ID NO: 405962 - DNA, 25 bp, Rattus norvegicus
gctctcttgcctcataatccagtga

SEQ ID NO: 405963 - DNA, 25 bp, Rattus norvegicus
gctctcttgcctgataatccagtga

SEQ ID NO: 405964 - DNA, 25 bp, Rattus norvegicus
gctctcttggtcctgcatttgcatt

SEQ ID NO: 405965 - DNA, 25 bp, Rattus norvegicus
gctctcttggtcgtgcatttgcatt

SEQ ID NO: 405966 - DNA, 25 bp, Rattus norvegicus
gctctcttgtgcagccattgttaaa

SEQ ID NO: 405967 - DNA, 25 bp, Rattus norvegicus
gctctcttgtgctgccattgttaaa

SEQ ID NO: 405968 - DNA, 25 bp, Rattus norvegicus
gctctctttgacaaggtcggtcgga

SEQ ID NO: 405969 - DNA, 25 bp, Rattus norvegicus
gctctctttgactaggtcggtcgga

SEQ ID NO: 405970 - DNA, 25 bp, Rattus norvegicus
gctctcttttgtagccttattattc

SEQ ID NO: 405971 - DNA, 25 bp, Rattus norvegicus
gctctcttttgttgccttattattc

SEQ ID NO: 405972 - DNA, 25 bp, Rattus norvegicus
gctctgaaacccaggacctacaaga

SEQ ID NO: 405973 - DNA, 25 bp, Rattus norvegicus
gctctgaaaccctggacctacaaga

SEQ ID NO: 405974 - DNA, 25 bp, Rattus norvegicus
gctctgaaactcactttgtatacca

SEQ ID NO: 405975 - DNA, 25 bp, Rattus norvegicus
gctctgaaactctctttgtatacca

SEQ ID NO: 405976 - DNA, 25 bp, Rattus norvegicus
gctctgaactccaggcggtagaggt

SEQ ID NO: 405977 - DNA, 25 bp, Rattus norvegicus
gctctgaactcctggcggtagaggt

SEQ ID NO: 405978 - DNA, 25 bp, Rattus norvegicus
gctctgaagagcaccaacaaacaag

SEQ ID NO: 405979 - DNA, 25 bp, Rattus norvegicus
gctctgaagagctccaacaaacaag

SEQ ID NO: 405980 - DNA, 25 bp, Rattus norvegicus
gctctgaagctaaattctgcacacg

SEQ ID NO: 405981 - DNA, 25 bp, Rattus norvegicus
gctctgaagctatattctgcacacg

SEQ ID NO: 405982 - DNA, 25 bp, Rattus norvegicus
gctctgaaggaacacatttggctga

SEQ ID NO: 405983 - DNA, 25 bp, Rattus norvegicus
gctctgaaggaagacatttggctga

SEQ ID NO: 405984 - DNA, 25 bp, Rattus norvegicus
gctctgaattcacggccaacattgt

SEQ ID NO: 405985 - DNA, 25 bp, Rattus norvegicus
gctctgaattcagggccaacattgt

SEQ ID NO: 405986 - DNA, 25 bp, Rattus norvegicus
gctctgaatttcaatgctcacctaa

SEQ ID NO: 405987 - DNA, 25 bp, Rattus norvegicus
gctctgaatttctatgctcacctaa

SEQ ID NO: 405988 - DNA, 25 bp, Rattus norvegicus
gctctgacacacagtcggatgatgt

SEQ ID NO: 405989 - DNA, 25 bp, Rattus norvegicus
gctctgacacactgtcggatgatgt

SEQ ID NO: 405990 - DNA, 25 bp, Rattus norvegicus
gctctgacatctaaattttctgtac

SEQ ID NO: 405991 - DNA, 25 bp, Rattus norvegicus
gctctgacatcttaattttctgtac

SEQ ID NO: 405992 - DNA, 25 bp, Rattus norvegicus
gctctgaccagacatactagtactt

SEQ ID NO: 405993 - DNA, 25 bp, Rattus norvegicus
gctctgaccagagatactagtactt

SEQ ID NO: 405994 - DNA, 25 bp, Rattus norvegicus
gctctgactaacaacacacagtgag

SEQ ID NO: 405995 - DNA, 25 bp, Rattus norvegicus
gctctgactaactacacacagtgag

SEQ ID NO: 405996 - DNA, 25 bp, Rattus norvegicus
gctctgactatgagcagcttcttaa

SEQ ID NO: 405997 - DNA, 25 bp, Rattus norvegicus
gctctgactatgtgcagcttcttaa

SEQ ID NO: 405998 - DNA, 25 bp, Rattus norvegicus
gctctgactctgcagttcatgtatg

SEQ ID NO: 405999 - DNA, 25 bp, Rattus norvegicus
gctctgactctggagttcatgtatg

SEQ ID NO: 406000 - DNA, 25 bp, Rattus norvegicus
gctctgagaatacgctttcccacaa

SEQ ID NO: 406001 - DNA, 25 bp, Rattus norvegicus
gctctgagaataggctttcccacaa

SEQ ID NO: 406002 - DNA, 25 bp, Rattus norvegicus
gctctgagaatgctactgggccctg

SEQ ID NO: 406003 - DNA, 25 bp, Rattus norvegicus
gctctgagaatggtactgggccctg

SEQ ID NO: 406004 - DNA, 25 bp, Rattus norvegicus
gctctgagagaccttgctgtgttgc

SEQ ID NO: 406005 - DNA, 25 bp, Rattus norvegicus
gctctgagagacgttgctgtgttgc

SEQ ID NO: 406006 - DNA, 25 bp, Rattus norvegicus
gctctgagagccattctgagctgct

SEQ ID NO: 406007 - DNA, 25 bp, Rattus norvegicus
gctctgagagcctttctgagctgct

SEQ ID NO: 406008 - DNA, 25 bp, Rattus norvegicus
gctctgagctcaaggaatggagttt

SEQ ID NO: 406009 - DNA, 25 bp, Rattus norvegicus
gctctgagctcatggaatggagttt

SEQ ID NO: 406010 - DNA, 25 bp, Rattus norvegicus
gctctgaggaaacaccagcggtccc

SEQ ID NO: 406011 - DNA, 25 bp, Rattus norvegicus
gctctgaggaaagaccagcggtccc

SEQ ID NO: 406012 - DNA, 25 bp, Rattus norvegicus
gctctgaggtgaattttagtggcaa

SEQ ID NO: 406013 - DNA, 25 bp, Rattus norvegicus
gctctgaggtgatttttagtggcaa

SEQ ID NO: 406014 - DNA, 25 bp, Rattus norvegicus
gctctgagtgccaccataaagaaat

SEQ ID NO: 406015 - DNA, 25 bp, Rattus norvegicus
gctctgagtgcctccataaagaaat

SEQ ID NO: 406016 - DNA, 25 bp, Rattus norvegicus
gctctgagtggcaggaagcttcccc

SEQ ID NO: 406017 - DNA, 25 bp, Rattus norvegicus
gctctgagtggctggaagcttcccc

SEQ ID NO: 406018 - DNA, 25 bp, Rattus norvegicus
gctctgagttttcggacagtcacat

SEQ ID NO: 406019 - DNA, 25 bp, Rattus norvegicus
gctctgagttttgggacagtcacat

SEQ ID NO: 406020 - DNA, 25 bp, Rattus norvegicus
gctctgataagcacgtgggatgtct

SEQ ID NO: 406021 - DNA, 25 bp, Rattus norvegicus
gctctgataagctcgtgggatgtct

SEQ ID NO: 406022 - DNA, 25 bp, Rattus norvegicus
gctctgatactaacttcttgtccat

SEQ ID NO: 406023 - DNA, 25 bp, Rattus norvegicus
gctctgatactatcttcttgtccat

SEQ ID NO: 406024 - DNA, 25 bp, Rattus norvegicus
gctctgatattcatttatgtcttgg

SEQ ID NO: 406025 - DNA, 25 bp, Rattus norvegicus
gctctgatattcttttatgtcttgg

SEQ ID NO: 406026 - DNA, 25 bp, Rattus norvegicus
gctctgatcagaaaagcttcaataa

SEQ ID NO: 406027 - DNA, 25 bp, Rattus norvegicus
gctctgatcagataagcttcaataa

SEQ ID NO: 406028 - DNA, 25 bp, Rattus norvegicus
gctctgatgagcagaccaggcacat

SEQ ID NO: 406029 - DNA, 25 bp, Rattus norvegicus
gctctgatgagctgaccaggcacat

SEQ ID NO: 406030 - DNA, 25 bp, Rattus norvegicus
gctctgatgctgaagaatgaccgaa

SEQ ID NO: 406031 - DNA, 25 bp, Rattus norvegicus
gctctgatgctgtagaatgaccgaa

SEQ ID NO: 406032 - DNA, 25 bp, Rattus norvegicus
gctctgattcttcccaaaatgagac

SEQ ID NO: 406033 - DNA, 25 bp, Rattus norvegicus
gctctgattcttgccaaaatgagac

SEQ ID NO: 406034 - DNA, 25 bp, Rattus norvegicus
gctctgcaccgtcgctatgggaaga

SEQ ID NO: 406035 - DNA, 25 bp, Rattus norvegicus
gctctgcaccgtggctatgggaaga

SEQ ID NO: 406036 - DNA, 25 bp, Rattus norvegicus
gctctgcactttcaacctggttaat

SEQ ID NO: 406037 - DNA, 25 bp, Rattus norvegicus
gctctgcactttgaacctggttaat

SEQ ID NO: 406038 - DNA, 25 bp, Rattus norvegicus
gctctgcagcgtctgttggatttga

SEQ ID NO: 406039 - DNA, 25 bp, Rattus norvegicus
gctctgcagcgtgtgttggatttga

SEQ ID NO: 406040 - DNA, 25 bp, Rattus norvegicus
gctctgcagtagctttggaactgta

SEQ ID NO: 406041 - DNA, 25 bp, Rattus norvegicus
gctctgcagtaggtttggaactgta

SEQ ID NO: 406042 - DNA, 25 bp, Rattus norvegicus
gctctgcagtttatatgtggaccaa

SEQ ID NO: 406043 - DNA, 25 bp, Rattus norvegicus
gctctgcagtttttatgtggaccaa

SEQ ID NO: 406044 - DNA, 25 bp, Rattus norvegicus
gctctgcattctccagtcacagaag

SEQ ID NO: 406045 - DNA, 25 bp, Rattus norvegicus
gctctgcattctgcagtcacagaag

SEQ ID NO: 406046 - DNA, 25 bp, Rattus norvegicus
gctctgcatttgaattttggtccca

SEQ ID NO: 406047 - DNA, 25 bp, Rattus norvegicus
gctctgcatttgtattttggtccca

SEQ ID NO: 406048 - DNA, 25 bp, Rattus norvegicus
gctctgcattttatgtgccacaggt

SEQ ID NO: 406049 - DNA, 25 bp, Rattus norvegicus
gctctgcattttttgtgccacaggt

SEQ ID NO: 406050 - DNA, 25 bp, Rattus norvegicus
gctctgccagcacctcaaggataag

SEQ ID NO: 406051 - DNA, 25 bp, Rattus norvegicus
gctctgccagcagctcaaggataag

SEQ ID NO: 406052 - DNA, 25 bp, Rattus norvegicus
gctctgccctggatatataatctgt

SEQ ID NO: 406053 - DNA, 25 bp, Rattus norvegicus
gctctgccctggttatataatctgt

SEQ ID NO: 406054 - DNA, 25 bp, Rattus norvegicus
gctctgcctaagctgctgtgaggaa

SEQ ID NO: 406055 - DNA, 25 bp, Rattus norvegicus
gctctgcctaaggtgctgtgaggaa

SEQ ID NO: 406056 - DNA, 25 bp, Rattus norvegicus
gctctgcctgatcctgaaacaaaac

SEQ ID NO: 406057 - DNA, 25 bp, Rattus norvegicus
gctctgcctgatgctgaaacaaaac

SEQ ID NO: 406058 - DNA, 25 bp, Rattus norvegicus
gctctgcctgtgactagttctgaag

SEQ ID NO: 406059 - DNA, 25 bp, Rattus norvegicus
gctctgcctgtgtctagttctgaag

SEQ ID NO: 406060 - DNA, 25 bp, Rattus norvegicus
gctctgccttaaaatactccttttt

SEQ ID NO: 406061 - DNA, 25 bp, Rattus norvegicus
gctctgccttaatatactccttttt

SEQ ID NO: 406062 - DNA, 25 bp, Rattus norvegicus
gctctgccttgtaatgacctctgta

SEQ ID NO: 406063 - DNA, 25 bp, Rattus norvegicus
gctctgccttgttatgacctctgta

SEQ ID NO: 406064 - DNA, 25 bp, Rattus norvegicus
gctctgcgcattactccagcctgga

SEQ ID NO: 406065 - DNA, 25 bp, Rattus norvegicus
gctctgcgcatttctccagcctgga

SEQ ID NO: 406066 - DNA, 25 bp, Rattus norvegicus
gctctgcggtgtatcatctatttta

SEQ ID NO: 406067 - DNA, 25 bp, Rattus norvegicus
gctctgcggtgtttcatctatttta

SEQ ID NO: 406068 - DNA, 25 bp, Rattus norvegicus
gctctgcgtgaaaaggacgggctat

SEQ ID NO: 406069 - DNA, 25 bp, Rattus norvegicus
gctctgcgtgaataggacgggctat

SEQ ID NO: 406070 - DNA, 25 bp, Rattus norvegicus
gctctgctaagcatctggaccgaga

SEQ ID NO: 406071 - DNA, 25 bp, Rattus norvegicus
gctctgctaagcttctggaccgaga

SEQ ID NO: 406072 - DNA, 25 bp, Rattus norvegicus
gctctgctagaactggagtttcctt

SEQ ID NO: 406073 - DNA, 25 bp, Rattus norvegicus
gctctgctagaagtggagtttcctt

SEQ ID NO: 406074 - DNA, 25 bp, Rattus norvegicus
gctctgctagcaaggtgtggtgtac

SEQ ID NO: 406075 - DNA, 25 bp, Rattus norvegicus
gctctgctagcatggtgtggtgtac

SEQ ID NO: 406076 - DNA, 25 bp, Rattus norvegicus
gctctgctatgcattgtacctgaat

SEQ ID NO: 406077 - DNA, 25 bp, Rattus norvegicus
gctctgctatgctttgtacctgaat

SEQ ID NO: 406078 - DNA, 25 bp, Rattus norvegicus
gctctgctcatcactgtaggacagg

SEQ ID NO: 406079 - DNA, 25 bp, Rattus norvegicus
gctctgctcatctctgtaggacagg

SEQ ID NO: 406080 - DNA, 25 bp, Rattus norvegicus
gctctgctcatgcaccaaggactgt

SEQ ID NO: 406081 - DNA, 25 bp, Rattus norvegicus
gctctgctcatggaccaaggactgt

SEQ ID NO: 406082 - DNA, 25 bp, Rattus norvegicus
gctctgctcgcacgacgggaaagtc

SEQ ID NO: 406083 - DNA, 25 bp, Rattus norvegicus
gctctgctcgcaggacgggaaagtc

SEQ ID NO: 406084 - DNA, 25 bp, Rattus norvegicus
gctctgctctcacctttaagactga

SEQ ID NO: 406085 - DNA, 25 bp, Rattus norvegicus
gctctgctctcagctttaagactga

SEQ ID NO: 406086 - DNA, 25 bp, Rattus norvegicus
gctctgctctgacacggtggcatta

SEQ ID NO: 406087 - DNA, 25 bp, Rattus norvegicus
gctctgctctgagacggtggcatta

SEQ ID NO: 406088 - DNA, 25 bp, Rattus norvegicus
gctctgctctgtcccgaacacagaa

SEQ ID NO: 406089 - DNA, 25 bp, Rattus norvegicus
gctctgctctgtgccgaacacagaa

SEQ ID NO: 406090 - DNA, 25 bp, Rattus norvegicus
gctctgctggtcaccggaggcttga

SEQ ID NO: 406091 - DNA, 25 bp, Rattus norvegicus
gctctgctggtctccggaggcttga

SEQ ID NO: 406092 - DNA, 25 bp, Rattus norvegicus
gctctgctgtttctataccttctta

SEQ ID NO: 406093 - DNA, 25 bp, Rattus norvegicus
gctctgctgtttgtataccttctta

SEQ ID NO: 406094 - DNA, 25 bp, Rattus norvegicus
gctctgcttagaaaggtaccctggc

SEQ ID NO: 406095 - DNA, 25 bp, Rattus norvegicus
gctctgcttagataggtaccctggc

SEQ ID NO: 406096 - DNA, 25 bp, Rattus norvegicus
gctctgcttagtctcagctttcaaa

SEQ ID NO: 406097 - DNA, 25 bp, Rattus norvegicus
gctctgcttagtgtcagctttcaaa

SEQ ID NO: 406098 - DNA, 25 bp, Rattus norvegicus
gctctgcttctcagtgatggcccaa

SEQ ID NO: 406099 - DNA, 25 bp, Rattus norvegicus
gctctgcttctctgtgatggcccaa

SEQ ID NO: 406100 - DNA, 25 bp, Rattus norvegicus
gctctgcttgtccaaacacaataat

SEQ ID NO: 406101 - DNA, 25 bp, Rattus norvegicus
gctctgcttgtcgaaacacaataat

SEQ ID NO: 406102 - DNA, 25 bp, Rattus norvegicus
gctctgctttctctaaggctgtgaa

SEQ ID NO: 406103 - DNA, 25 bp, Rattus norvegicus
gctctgctttctgtaaggctgtgaa

SEQ ID NO: 406104 - DNA, 25 bp, Rattus norvegicus
gctctggaagcgaggcggtttaaat

SEQ ID NO: 406105 - DNA, 25 bp, Rattus norvegicus
gctctggaagcgtggcggtttaaat

SEQ ID NO: 406106 - DNA, 25 bp, Rattus norvegicus
gctctggacgtgaaatacttcggta

SEQ ID NO: 406107 - DNA, 25 bp, Rattus norvegicus
gctctggacgtgtaatacttcggta

SEQ ID NO: 406108 - DNA, 25 bp, Rattus norvegicus
gctctggactctcaaggcaataaat

SEQ ID NO: 406109 - DNA, 25 bp, Rattus norvegicus
gctctggactctccgtataacgttt

SEQ ID NO: 406110 - DNA, 25 bp, Rattus norvegicus
gctctggactctgaaggcaataaat

SEQ ID NO: 406111 - DNA, 25 bp, Rattus norvegicus
gctctggactctgcgtataacgttt

SEQ ID NO: 406112 - DNA, 25 bp, Rattus norvegicus
gctctggagaatcccagtccacagc

SEQ ID NO: 406113 - DNA, 25 bp, Rattus norvegicus
gctctggagaatgccagtccacagc

SEQ ID NO: 406114 - DNA, 25 bp, Rattus norvegicus
gctctggagacacggtcttcactaa

SEQ ID NO: 406115 - DNA, 25 bp, Rattus norvegicus
gctctggagacagggtcttcactaa

SEQ ID NO: 406116 - DNA, 25 bp, Rattus norvegicus
gctctggagagaaactggactgatt

SEQ ID NO: 406117 - DNA, 25 bp, Rattus norvegicus
gctctggagagatactggactgatt

SEQ ID NO: 406118 - DNA, 25 bp, Rattus norvegicus
gctctggagagcaggactttactta

SEQ ID NO: 406119 - DNA, 25 bp, Rattus norvegicus
gctctggagagctggactttactta

SEQ ID NO: 406120 - DNA, 25 bp, Rattus norvegicus
gctctggagccaagggaaactgcaa

SEQ ID NO: 406121 - DNA, 25 bp, Rattus norvegicus
gctctggagccatgggaaactgcaa

SEQ ID NO: 406122 - DNA, 25 bp, Rattus norvegicus
gctctggaggcaacggtgctgtcaa

SEQ ID NO: 406123 - DNA, 25 bp, Rattus norvegicus
gctctggaggcatcggtgctgtcaa

SEQ ID NO: 406124 - DNA, 25 bp, Rattus norvegicus
gctctggagtccagagtggaagtct

SEQ ID NO: 406125 - DNA, 25 bp, Rattus norvegicus
gctctggagtcctgagtggaagtct

SEQ ID NO: 406126 - DNA, 25 bp, Rattus norvegicus
gctctggattcaaaactggactttg

SEQ ID NO: 406127 - DNA, 25 bp, Rattus norvegicus
gctctggattcataactggactttg

SEQ ID NO: 406128 - DNA, 25 bp, Rattus norvegicus
gctctggattccctatgagtggatt

SEQ ID NO: 406129 - DNA, 25 bp, Rattus norvegicus
gctctggattccgtatgagtggatt

SEQ ID NO: 406130 - DNA, 25 bp, Rattus norvegicus
gctctggattctctggactttttaa

SEQ ID NO: 406131 - DNA, 25 bp, Rattus norvegicus
gctctggattctgtggactttttaa

SEQ ID NO: 406132 - DNA, 25 bp, Rattus norvegicus
gctctggattgtctggtgttcttac

SEQ ID NO: 406133 - DNA, 25 bp, Rattus norvegicus
gctctggattgtgtggtgttcttac

SEQ ID NO: 406134 - DNA, 25 bp, Rattus norvegicus
gctctggcactgaattttgaatgac

SEQ ID NO: 406135 - DNA, 25 bp, Rattus norvegicus
gctctggcactgtattttgaatgac

SEQ ID NO: 406136 - DNA, 25 bp, Rattus norvegicus
gctctggcagagcatctcggttcaa

SEQ ID NO: 406137 - DNA, 25 bp, Rattus norvegicus
gctctggcagaggatctcggttcaa

SEQ ID NO: 406138 - DNA, 25 bp, Rattus norvegicus
gctctggcaggaagaatgggtcctt

SEQ ID NO: 406139 - DNA, 25 bp, Rattus norvegicus
gctctggcaggatgaatgggtcctt

SEQ ID NO: 406140 - DNA, 25 bp, Rattus norvegicus
gctctggcagttcccaatagtggta

SEQ ID NO: 406141 - DNA, 25 bp, Rattus norvegicus
gctctggcagttgccaatagtggta

SEQ ID NO: 406142 - DNA, 25 bp, Rattus norvegicus
gctctggccaagagcctaattctta

SEQ ID NO: 406143 - DNA, 25 bp, Rattus norvegicus
gctctggccaagtgcctaattctta

SEQ ID NO: 406144 - DNA, 25 bp, Rattus norvegicus
gctctggcctaactggatgccataa

SEQ ID NO: 406145 - DNA, 25 bp, Rattus norvegicus
gctctggcctaagtggatgccataa

SEQ ID NO: 406146 - DNA, 25 bp, Rattus norvegicus
gctctggccttgcaaatacactgta

SEQ ID NO: 406147 - DNA, 25 bp, Rattus norvegicus
gctctggccttggaaatacactgta

SEQ ID NO: 406148 - DNA, 25 bp, Rattus norvegicus
gctctggctaatcgcaaatgactga

SEQ ID NO: 406149 - DNA, 25 bp, Rattus norvegicus
gctctggctaatggcaaatgactga

SEQ ID NO: 406150 - DNA, 25 bp, Rattus norvegicus
gctctggcttctaattccaactgaa

SEQ ID NO: 406151 - DNA, 25 bp, Rattus norvegicus
gctctggcttcttattccaactgaa

SEQ ID NO: 406152 - DNA, 25 bp, Rattus norvegicus
gctctggctttcatcatgatagtgc

SEQ ID NO: 406153 - DNA, 25 bp, Rattus norvegicus
gctctggctttcttcatgatagtgc

SEQ ID NO: 406154 - DNA, 25 bp, Rattus norvegicus
gctctggcttttatatgtctgtgtc

SEQ ID NO: 406155 - DNA, 25 bp, Rattus norvegicus
gctctggcttttttatgtctgtgtc

SEQ ID NO: 406156 - DNA, 25 bp, Rattus norvegicus
gctctgggacataggcacgcactgg

SEQ ID NO: 406157 - DNA, 25 bp, Rattus norvegicus
gctctgggacataggccagctgtga

SEQ ID NO: 406158 - DNA, 25 bp, Rattus norvegicus
gctctgggacattggcacgcactgg

SEQ ID NO: 406159 - DNA, 25 bp, Rattus norvegicus
gctctgggacattggccagctgtga

SEQ ID NO: 406160 - DNA, 25 bp, Rattus norvegicus
gctctgggagacagtttctgggtct

SEQ ID NO: 406161 - DNA, 25 bp, Rattus norvegicus
gctctgggagactgtttctgggtct

SEQ ID NO: 406162 - DNA, 25 bp, Rattus norvegicus
gctctgggaggcaatgtcattcact

SEQ ID NO: 406163 - DNA, 25 bp, Rattus norvegicus
gctctgggaggctatgtcattcact

SEQ ID NO: 406164 - DNA, 25 bp, Rattus norvegicus
gctctgggcaagctgtcactgacca

SEQ ID NO: 406165 - DNA, 25 bp, Rattus norvegicus
gctctgggcaaggtgtcactgacca

SEQ ID NO: 406166 - DNA, 25 bp, Rattus norvegicus
gctctgggctatcagaagctttctc

SEQ ID NO: 406167 - DNA, 25 bp, Rattus norvegicus
gctctgggctatgagaagctttctc

SEQ ID NO: 406168 - DNA, 25 bp, Rattus norvegicus
gctctgggctgcatcatacttaaaa

SEQ ID NO: 406169 - DNA, 25 bp, Rattus norvegicus
gctctgggctgcttcatacttaaaa

SEQ ID NO: 406170 - DNA, 25 bp, Rattus norvegicus
gctctggggaggacacatgtgcttc

SEQ ID NO: 406171 - DNA, 25 bp, Rattus norvegicus
gctctggggaggtcacatgtgcttc

SEQ ID NO: 406172 - DNA, 25 bp, Rattus norvegicus
gctctgggtactactgcaaaccgat

SEQ ID NO: 406173 - DNA, 25 bp, Rattus norvegicus
gctctgggtacttctgcaaaccgat

SEQ ID NO: 406174 - DNA, 25 bp, Rattus norvegicus
gctctgggtcacacaactagtaaat

SEQ ID NO: 406175 - DNA, 25 bp, Rattus norvegicus
gctctgggtcactcaactagtaaat

SEQ ID NO: 406176 - DNA, 25 bp, Rattus norvegicus
gctctgggtcatacgcaaacaacta

SEQ ID NO: 406177 - DNA, 25 bp, Rattus norvegicus
gctctgggtcattcgcaaacaacta

SEQ ID NO: 406178 - DNA, 25 bp, Rattus norvegicus
gctctgggtcttattgccaggagat

SEQ ID NO: 406179 - DNA, 25 bp, Rattus norvegicus
gctctgggtctttttgccaggagat

SEQ ID NO: 406180 - DNA, 25 bp, Rattus norvegicus
gctctgggtgagcttttcttttcaa

SEQ ID NO: 406181 - DNA, 25 bp, Rattus norvegicus
gctctgggtgaggttttcttttcaa

SEQ ID NO: 406182 - DNA, 25 bp, Rattus norvegicus
gctctgggtgtgattttgtttttat

SEQ ID NO: 406183 - DNA, 25 bp, Rattus norvegicus
gctctgggtgtgtttttgtttttat

SEQ ID NO: 406184 - DNA, 25 bp, Rattus norvegicus
gctctgggtgttactgttagtgtaa

SEQ ID NO: 406185 - DNA, 25 bp, Rattus norvegicus
gctctgggtgtttctgttagtgtaa

SEQ ID NO: 406186 - DNA, 25 bp, Rattus norvegicus
gctctgggtttcattcctaacttga

SEQ ID NO: 406187 - DNA, 25 bp, Rattus norvegicus
gctctgggtttctttcctaacttga

SEQ ID NO: 406188 - DNA, 25 bp, Rattus norvegicus
gctctgggttttctttaagggcatc

SEQ ID NO: 406189 - DNA, 25 bp, Rattus norvegicus
gctctgggttttgtttaagggcatc

SEQ ID NO: 406190 - DNA, 25 bp, Rattus norvegicus
gctctggtaataacttgcctgaaaa

SEQ ID NO: 406191 - DNA, 25 bp, Rattus norvegicus
gctctggtaatatcttgcctgaaaa

SEQ ID NO: 406192 - DNA, 25 bp, Rattus norvegicus
gctctggtacacattctcttttgta

SEQ ID NO: 406193 - DNA, 25 bp, Rattus norvegicus
gctctggtacactttctcttttgta

SEQ ID NO: 406194 - DNA, 25 bp, Rattus norvegicus
gctctggtatccaatgtaacgtata

SEQ ID NO: 406195 - DNA, 25 bp, Rattus norvegicus
gctctggtatcctatgtaacgtata

SEQ ID NO: 406196 - DNA, 25 bp, Rattus norvegicus
gctctggtccagaagcacttgacaa

SEQ ID NO: 406197 - DNA, 25 bp, Rattus norvegicus
gctctggtccagtagcacttgacaa

SEQ ID NO: 406198 - DNA, 25 bp, Rattus norvegicus
gctctggtggtgacgtgtactgtta

SEQ ID NO: 406199 - DNA, 25 bp, Rattus norvegicus
gctctggtggtgattgggtccctca

SEQ ID NO: 406200 - DNA, 25 bp, Rattus norvegicus
gctctggtggtgtcgtgtactgtta

SEQ ID NO: 406201 - DNA, 25 bp, Rattus norvegicus
gctctggtggtgtttgggtccctca

SEQ ID NO: 406202 - DNA, 25 bp, Rattus norvegicus
gctctggtgtcaaagccttagatgg

SEQ ID NO: 406203 - DNA, 25 bp, Rattus norvegicus
gctctggtgtcatagccttagatgg

SEQ ID NO: 406204 - DNA, 25 bp, Rattus norvegicus
gctctggttagcctttatgtagtca

SEQ ID NO: 406205 - DNA, 25 bp, Rattus norvegicus
gctctggttagcgtttatgtagtca

SEQ ID NO: 406206 - DNA, 25 bp, Rattus norvegicus
gctctggtttccacttcaaaggata

SEQ ID NO: 406207 - DNA, 25 bp, Rattus norvegicus
gctctggtttcctcttcaaaggata

SEQ ID NO: 406208 - DNA, 25 bp, Rattus norvegicus
gctctggttttaaaaaggtactgca

SEQ ID NO: 406209 - DNA, 25 bp, Rattus norvegicus
gctctggttttataaaggtactgca

SEQ ID NO: 406210 - DNA, 25 bp, Rattus norvegicus
gctctggttttgcactgatctgatt

SEQ ID NO: 406211 - DNA, 25 bp, Rattus norvegicus
gctctggttttggactgatctgatt

SEQ ID NO: 406212 - DNA, 25 bp, Rattus norvegicus
gctctgtaaatcagcaccgcgggct

SEQ ID NO: 406213 - DNA, 25 bp, Rattus norvegicus
gctctgtaaatctgcaccgcgggct

SEQ ID NO: 406214 - DNA, 25 bp, Rattus norvegicus
gctctgtaacctagatgctctgtaa

SEQ ID NO: 406215 - DNA, 25 bp, Rattus norvegicus
gctctgtaaccttgatgctctgtaa

SEQ ID NO: 406216 - DNA, 25 bp, Rattus norvegicus
gctctgtacttcctttcagtggaat

SEQ ID NO: 406217 - DNA, 25 bp, Rattus norvegicus
gctctgtacttcgtttcagtggaat

SEQ ID NO: 406218 - DNA, 25 bp, Rattus norvegicus
gctctgtacttgactagtgctgtta

SEQ ID NO: 406219 - DNA, 25 bp, Rattus norvegicus
gctctgtacttgtctagtgctgtta

SEQ ID NO: 406220 - DNA, 25 bp, Rattus norvegicus
gctctgtaggctccccttgaattca

SEQ ID NO: 406221 - DNA, 25 bp, Rattus norvegicus
gctctgtaggctgcccttgaattca

SEQ ID NO: 406222 - DNA, 25 bp, Rattus norvegicus
gctctgtatcagacgctaggctatt

SEQ ID NO: 406223 - DNA, 25 bp, Rattus norvegicus
gctctgtatcagtcgctaggctatt

SEQ ID NO: 406224 - DNA, 25 bp, Rattus norvegicus
gctctgtcaagccatttcttaacac

SEQ ID NO: 406225 - DNA, 25 bp, Rattus norvegicus
gctctgtcaagcgatttcttaacac

SEQ ID NO: 406226 - DNA, 25 bp, Rattus norvegicus
gctctgtcaatcatatggtctcacc

SEQ ID NO: 406227 - DNA, 25 bp, Rattus norvegicus
gctctgtcaatcttatggtctcacc

SEQ ID NO: 406228 - DNA, 25 bp, Rattus norvegicus
gctctgtcagtcacggatgggcagt

SEQ ID NO: 406229 - DNA, 25 bp, Rattus norvegicus
gctctgtcagtcatactttggtgta

SEQ ID NO: 406230 - DNA, 25 bp, Rattus norvegicus
gctctgtcagtctcggatgggcagt

SEQ ID NO: 406231 - DNA, 25 bp, Rattus norvegicus
gctctgtcagtcttactttggtgta

SEQ ID NO: 406232 - DNA, 25 bp, Rattus norvegicus
gctctgtcagttatgaggactttgt

SEQ ID NO: 406233 - DNA, 25 bp, Rattus norvegicus
gctctgtcagttttgaggactttgt

SEQ ID NO: 406234 - DNA, 25 bp, Rattus norvegicus
gctctgtccaccaatagcatatatc

SEQ ID NO: 406235 - DNA, 25 bp, Rattus norvegicus
gctctgtccacctatagcatatatc

SEQ ID NO: 406236 - DNA, 25 bp, Rattus norvegicus
gctctgtccctgctctagcaataaa

SEQ ID NO: 406237 - DNA, 25 bp, Rattus norvegicus
gctctgtccctggtctagcaataaa

SEQ ID NO: 406238 - DNA, 25 bp, Rattus norvegicus
gctctgtctccaactagctatggaa

SEQ ID NO: 406239 - DNA, 25 bp, Rattus norvegicus
gctctgtctccatctagctatggaa

SEQ ID NO: 406240 - DNA, 25 bp, Rattus norvegicus
gctctgtctgggagcagtatgcagt

SEQ ID NO: 406241 - DNA, 25 bp, Rattus norvegicus
gctctgtctgggtgcagtatgcagt

SEQ ID NO: 406242 - DNA, 25 bp, Rattus norvegicus
gctctgtgagctctcctgtggtctg

SEQ ID NO: 406243 - DNA, 25 bp, Rattus norvegicus
gctctgtgagctctgaaatatattt

SEQ ID NO: 406244 - DNA, 25 bp, Rattus norvegicus
gctctgtgagctgtcctgtggtctg

SEQ ID NO: 406245 - DNA, 25 bp, Rattus norvegicus
gctctgtgagctgtgaaatatattt

SEQ ID NO: 406246 - DNA, 25 bp, Rattus norvegicus
gctctgtgataaaaagacccctccc

SEQ ID NO: 406247 - DNA, 25 bp, Rattus norvegicus
gctctgtgataataagacccctccc

SEQ ID NO: 406248 - DNA, 25 bp, Rattus norvegicus
gctctgtgatctatgctattggact

SEQ ID NO: 406249 - DNA, 25 bp, Rattus norvegicus
gctctgtgatctttgctattggact

SEQ ID NO: 406250 - DNA, 25 bp, Rattus norvegicus
gctctgtgcctgctatccaaagaat

SEQ ID NO: 406251 - DNA, 25 bp, Rattus norvegicus
gctctgtgcctggtatccaaagaat

SEQ ID NO: 406252 - DNA, 25 bp, Rattus norvegicus
gctctgtgcgaaccagctaggacta

SEQ ID NO: 406253 - DNA, 25 bp, Rattus norvegicus
gctctgtgcgaagcagctaggacta

SEQ ID NO: 406254 - DNA, 25 bp, Rattus norvegicus
gctctgtgctgcaaggttgtggcca

SEQ ID NO: 406255 - DNA, 25 bp, Rattus norvegicus
gctctgtgctgctaggttgtggcca

SEQ ID NO: 406256 - DNA, 25 bp, Rattus norvegicus
gctctgtgctggctcagaatgcaaa

SEQ ID NO: 406257 - DNA, 25 bp, Rattus norvegicus
gctctgtgctgggtcagaatgcaaa

SEQ ID NO: 406258 - DNA, 25 bp, Rattus norvegicus
gctctgtgcttcaagagtgtgggaa

SEQ ID NO: 406259 - DNA, 25 bp, Rattus norvegicus
gctctgtgcttctagagtgtgggaa

SEQ ID NO: 406260 - DNA, 25 bp, Rattus norvegicus
gctctgtggctgattctaatactgt

SEQ ID NO: 406261 - DNA, 25 bp, Rattus norvegicus
gctctgtggctgtttctaatactgt

SEQ ID NO: 406262 - DNA, 25 bp, Rattus norvegicus
gctctgtggcttcacggactagtta

SEQ ID NO: 406263 - DNA, 25 bp, Rattus norvegicus
gctctgtggcttgacggactagtta

SEQ ID NO: 406264 - DNA, 25 bp, Rattus norvegicus
gctctgtgggtgctattttcatgca

SEQ ID NO: 406265 - DNA, 25 bp, Rattus norvegicus
gctctgtgggtggtattttcatgca

SEQ ID NO: 406266 - DNA, 25 bp, Rattus norvegicus
gctctgtggtggaatacgcttttaa

SEQ ID NO: 406267 - DNA, 25 bp, Rattus norvegicus
gctctgtggtggtatacgcttttaa

SEQ ID NO: 406268 - DNA, 25 bp, Rattus norvegicus
gctctgtgtaaaagactgtggacct

SEQ ID NO: 406269 - DNA, 25 bp, Rattus norvegicus
gctctgtgtaaatgactgtggacct

SEQ ID NO: 406270 - DNA, 25 bp, Rattus norvegicus
gctctgtgtcttaataatgtccttc

SEQ ID NO: 406271 - DNA, 25 bp, Rattus norvegicus
gctctgtgtctttataatgtccttc

SEQ ID NO: 406272 - DNA, 25 bp, Rattus norvegicus
gctctgtgtgcgactgaattgtgga

SEQ ID NO: 406273 - DNA, 25 bp, Rattus norvegicus
gctctgtgtgcgtctgaattgtgga

SEQ ID NO: 406274 - DNA, 25 bp, Rattus norvegicus
gctctgtgtgtcaccaaaacttcaa

SEQ ID NO: 406275 - DNA, 25 bp, Rattus norvegicus
gctctgtgtgtctccaaaacttcaa

SEQ ID NO: 406276 - DNA, 25 bp, Rattus norvegicus
gctctgttaaggatgaactttgcca

SEQ ID NO: 406277 - DNA, 25 bp, Rattus norvegicus
gctctgttaaggttgaactttgcca

SEQ ID NO: 406278 - DNA, 25 bp, Rattus norvegicus
gctctgttactgagagagaccagcc

SEQ ID NO: 406279 - DNA, 25 bp, Rattus norvegicus
gctctgttactgtgagagaccagcc

SEQ ID NO: 406280 - DNA, 25 bp, Rattus norvegicus
gctctgttatttaactcctgatcat

SEQ ID NO: 406281 - DNA, 25 bp, Rattus norvegicus
gctctgttattttactcctgatcat

SEQ ID NO: 406282 - DNA, 25 bp, Rattus norvegicus
gctctgttccatctcggaaagcagt

SEQ ID NO: 406283 - DNA, 25 bp, Rattus norvegicus
gctctgttccatgtcggaaagcagt

SEQ ID NO: 406284 - DNA, 25 bp, Rattus norvegicus
gctctgttctcccaaacacaggata

SEQ ID NO: 406285 - DNA, 25 bp, Rattus norvegicus
gctctgttctccgaaacacaggata

SEQ ID NO: 406286 - DNA, 25 bp, Rattus norvegicus
gctctgttgatcactcactcagaaa

SEQ ID NO: 406287 - DNA, 25 bp, Rattus norvegicus
gctctgttgatctctcactcagaaa

SEQ ID NO: 406288 - DNA, 25 bp, Rattus norvegicus
gctctgtttcagctcttctgagaca

SEQ ID NO: 406289 - DNA, 25 bp, Rattus norvegicus
gctctgtttcaggtcttctgagaca

SEQ ID NO: 406290 - DNA, 25 bp, Rattus norvegicus
gctctgtttcccacagtaatgttga

SEQ ID NO: 406291 - DNA, 25 bp, Rattus norvegicus
gctctgtttccctcagtaatgttga

SEQ ID NO: 406292 - DNA, 25 bp, Rattus norvegicus
gctctgtttggcagtaatttaattc

SEQ ID NO: 406293 - DNA, 25 bp, Rattus norvegicus
gctctgtttggctgtaatttaattc

SEQ ID NO: 406294 - DNA, 25 bp, Rattus norvegicus
gctctgtttggtagcactgctggca

SEQ ID NO: 406295 - DNA, 25 bp, Rattus norvegicus
gctctgtttggttgcactgctggca

SEQ ID NO: 406296 - DNA, 25 bp, Rattus norvegicus
gctctgttttataggcactgtgccc

SEQ ID NO: 406297 - DNA, 25 bp, Rattus norvegicus
gctctgttttattggcactgtgccc

SEQ ID NO: 406298 - DNA, 25 bp, Rattus norvegicus
gctctgttttctcccacaaaattag

SEQ ID NO: 406299 - DNA, 25 bp, Rattus norvegicus
gctctgttttctgccacaaaattag

SEQ ID NO: 406300 - DNA, 25 bp, Rattus norvegicus
gctcttaaacaccagcttgccttta

SEQ ID NO: 406301 - DNA, 25 bp, Rattus norvegicus
gctcttaaacacgagcttgccttta

SEQ ID NO: 406302 - DNA, 25 bp, Rattus norvegicus
gctcttaacctgacctgtatttatt

SEQ ID NO: 406303 - DNA, 25 bp, Rattus norvegicus
gctcttaacctgtcctgtatttatt

SEQ ID NO: 406304 - DNA, 25 bp, Rattus norvegicus
gctcttaagcagagtaactccgttt

SEQ ID NO: 406305 - DNA, 25 bp, Rattus norvegicus
gctcttaagcagtgtaactccgttt

SEQ ID NO: 406306 - DNA, 25 bp, Rattus norvegicus
gctcttaaggagattctggactgcc

SEQ ID NO: 406307 - DNA, 25 bp, Rattus norvegicus
gctcttaaggagtttctggactgcc

SEQ ID NO: 406308 - DNA, 25 bp, Rattus norvegicus
gctcttaatcaacgctgtctgcttc

SEQ ID NO: 406309 - DNA, 25 bp, Rattus norvegicus
gctcttaatcaaggctgtctgcttc

SEQ ID NO: 406310 - DNA, 25 bp, Rattus norvegicus
gctcttacaaagcaaagtgcctgca

SEQ ID NO: 406311 - DNA, 25 bp, Rattus norvegicus
gctcttacaaaggaaagtgcctgca

SEQ ID NO: 406312 - DNA, 25 bp, Rattus norvegicus
gctcttacagagaaggccacacgct

SEQ ID NO: 406313 - DNA, 25 bp, Rattus norvegicus
gctcttacagagtaggccacacgct

SEQ ID NO: 406314 - DNA, 25 bp, Rattus norvegicus
gctcttacatctagacccttgaaac

SEQ ID NO: 406315 - DNA, 25 bp, Rattus norvegicus
gctcttacatcttgacccttgaaac

SEQ ID NO: 406316 - DNA, 25 bp, Rattus norvegicus
gctcttacctggatgcatttggtta

SEQ ID NO: 406317 - DNA, 25 bp, Rattus norvegicus
gctcttacctggttgcatttggtta

SEQ ID NO: 406318 - DNA, 25 bp, Rattus norvegicus
gctcttactgtaaaatgtctcttgt

SEQ ID NO: 406319 - DNA, 25 bp, Rattus norvegicus
gctcttactgtacattggaccactt

SEQ ID NO: 406320 - DNA, 25 bp, Rattus norvegicus
gctcttactgtagattggaccactt

SEQ ID NO: 406321 - DNA, 25 bp, Rattus norvegicus
gctcttactgtataatgtctcttgt

SEQ ID NO: 406322 - DNA, 25 bp, Rattus norvegicus
gctcttactgtcatcaggaactggt

SEQ ID NO: 406323 - DNA, 25 bp, Rattus norvegicus
gctcttactgtcttcaggaactggt

SEQ ID NO: 406324 - DNA, 25 bp, Rattus norvegicus
gctcttacttggatattactgcata

SEQ ID NO: 406325 - DNA, 25 bp, Rattus norvegicus
gctcttacttggttattactgcata

SEQ ID NO: 406326 - DNA, 25 bp, Rattus norvegicus
gctcttagctggagttgcaagccat

SEQ ID NO: 406327 - DNA, 25 bp, Rattus norvegicus
gctcttagctggtgttgcaagccat

SEQ ID NO: 406328 - DNA, 25 bp, Rattus norvegicus
gctcttaggactatttgcaattgct

SEQ ID NO: 406329 - DNA, 25 bp, Rattus norvegicus
gctcttaggactttttgcaattgct

SEQ ID NO: 406330 - DNA, 25 bp, Rattus norvegicus
gctcttaggagaaaacactgttcat

SEQ ID NO: 406331 - DNA, 25 bp, Rattus norvegicus
gctcttaggagataacactgttcat

SEQ ID NO: 406332 - DNA, 25 bp, Rattus norvegicus
gctcttatactcagcctattgtctg

SEQ ID NO: 406333 - DNA, 25 bp, Rattus norvegicus
gctcttatactctgcctattgtctg

SEQ ID NO: 406334 - DNA, 25 bp, Rattus norvegicus
gctcttatcaatcaagcagccgatc

SEQ ID NO: 406335 - DNA, 25 bp, Rattus norvegicus
gctcttatcaatgaagcagccgatc

SEQ ID NO: 406336 - DNA, 25 bp, Rattus norvegicus
gctcttatgctcatatatgtgtgaa

SEQ ID NO: 406337 - DNA, 25 bp, Rattus norvegicus
gctcttatgctcttatatgtgtgaa

SEQ ID NO: 406338 - DNA, 25 bp, Rattus norvegicus
gctcttatgtgcattggaacctgaa

SEQ ID NO: 406339 - DNA, 25 bp, Rattus norvegicus
gctcttatgtgctttggaacctgaa

SEQ ID NO: 406340 - DNA, 25 bp, Rattus norvegicus
gctcttcagaggacctaagttcaat

SEQ ID NO: 406341 - DNA, 25 bp, Rattus norvegicus
gctcttcagaggtcctaagttcaat

SEQ ID NO: 406342 - DNA, 25 bp, Rattus norvegicus
gctcttcagtaaccatgtccatgtg

SEQ ID NO: 406343 - DNA, 25 bp, Rattus norvegicus
gctcttcagtaagcatgtccatgtg

SEQ ID NO: 406344 - DNA, 25 bp, Rattus norvegicus
gctcttcagtgaactttgtgccaat

SEQ ID NO: 406345 - DNA, 25 bp, Rattus norvegicus
gctcttcagtgatctttgtgccaat

SEQ ID NO: 406346 - DNA, 25 bp, Rattus norvegicus
gctcttcagtggcagctgcatgaaa

SEQ ID NO: 406347 - DNA, 25 bp, Rattus norvegicus
gctcttcagtgggagctgcatgaaa

SEQ ID NO: 406348 - DNA, 25 bp, Rattus norvegicus
gctcttcatcctagaggaattccag

SEQ ID NO: 406349 - DNA, 25 bp, Rattus norvegicus
gctcttcatccttgaggaattccag

SEQ ID NO: 406350 - DNA, 25 bp, Rattus norvegicus
gctcttccaatgacttctcaatgtt

SEQ ID NO: 406351 - DNA, 25 bp, Rattus norvegicus
gctcttccaatgtcttctcaatgtt

SEQ ID NO: 406352 - DNA, 25 bp, Rattus norvegicus
gctcttccagggaactcatgtttgg

SEQ ID NO: 406353 - DNA, 25 bp, Rattus norvegicus
gctcttccagggtactcatgtttgg

SEQ ID NO: 406354 - DNA, 25 bp, Rattus norvegicus
gctcttccagtgaacctgaattcat

SEQ ID NO: 406355 - DNA, 25 bp, Rattus norvegicus
gctcttccagtgtacctgaattcat

SEQ ID NO: 406356 - DNA, 25 bp, Rattus norvegicus
gctcttccattgaactgcgttatta

SEQ ID NO: 406357 - DNA, 25 bp, Rattus norvegicus
gctcttccattgatccttcacaatt

SEQ ID NO: 406358 - DNA, 25 bp, Rattus norvegicus
gctcttccattgtactgcgttatta

SEQ ID NO: 406359 - DNA, 25 bp, Rattus norvegicus
gctcttccattgttccttcacaatt

SEQ ID NO: 406360 - DNA, 25 bp, Rattus norvegicus
gctcttcccatgagtgtagttgtta

SEQ ID NO: 406361 - DNA, 25 bp, Rattus norvegicus
gctcttcccatgtgtgtagttgtta

SEQ ID NO: 406362 - DNA, 25 bp, Rattus norvegicus
gctcttccccagatgcattatgatt

SEQ ID NO: 406363 - DNA, 25 bp, Rattus norvegicus
gctcttccccagttgcattatgatt

SEQ ID NO: 406364 - DNA, 25 bp, Rattus norvegicus
gctcttccctgaaggccaaagtgtt

SEQ ID NO: 406365 - DNA, 25 bp, Rattus norvegicus
gctcttccctgatggccaaagtgtt

SEQ ID NO: 406366 - DNA, 25 bp, Rattus norvegicus
gctcttccgtcgctcagtgagagat

SEQ ID NO: 406367 - DNA, 25 bp, Rattus norvegicus
gctcttccgtcggtcagtgagagat

SEQ ID NO: 406368 - DNA, 25 bp, Rattus norvegicus
gctcttcctgacagacttttttgtg

SEQ ID NO: 406369 - DNA, 25 bp, Rattus norvegicus
gctcttcctgactgacttttttgtg

SEQ ID NO: 406370 - DNA, 25 bp, Rattus norvegicus
gctcttcctgcgacgtaacaagtga

SEQ ID NO: 406371 - DNA, 25 bp, Rattus norvegicus
gctcttcctgcgtcgtaacaagtga

SEQ ID NO: 406372 - DNA, 25 bp, Rattus norvegicus
gctcttcctggaaagccgctggaat

SEQ ID NO: 406373 - DNA, 25 bp, Rattus norvegicus
gctcttcctggaatttcttcgataa

SEQ ID NO: 406374 - DNA, 25 bp, Rattus norvegicus
gctcttcctggatagccgctggaat

SEQ ID NO: 406375 - DNA, 25 bp, Rattus norvegicus
gctcttcctggattttcttcgataa

SEQ ID NO: 406376 - DNA, 25 bp, Rattus norvegicus
gctcttccttccaatcattcagtga

SEQ ID NO: 406377 - DNA, 25 bp, Rattus norvegicus
gctcttccttccagagtcgggaaca

SEQ ID NO: 406378 - DNA, 25 bp, Rattus norvegicus
gctcttccttcctatcattcagtga

SEQ ID NO: 406379 - DNA, 25 bp, Rattus norvegicus
gctcttccttcctgagtcgggaaca

SEQ ID NO: 406380 - DNA, 25 bp, Rattus norvegicus
gctcttcgaaggagtggtgcgccaa

SEQ ID NO: 406381 - DNA, 25 bp, Rattus norvegicus
gctcttcgaaggtgtggtgcgccaa

SEQ ID NO: 406382 - DNA, 25 bp, Rattus norvegicus
gctcttctaaggatgtatgtgttgg

SEQ ID NO: 406383 - DNA, 25 bp, Rattus norvegicus
gctcttctaaggttgtatgtgttgg

SEQ ID NO: 406384 - DNA, 25 bp, Rattus norvegicus
gctcttctgtatctgacaacatttt

SEQ ID NO: 406385 - DNA, 25 bp, Rattus norvegicus
gctcttctgtatgtgacaacatttt

SEQ ID NO: 406386 - DNA, 25 bp, Rattus norvegicus
gctcttctgtcaaatctctagtctt

SEQ ID NO: 406387 - DNA, 25 bp, Rattus norvegicus
gctcttctgtcatatctctagtctt

SEQ ID NO: 406388 - DNA, 25 bp, Rattus norvegicus
gctcttctgtctactgaacttcggg

SEQ ID NO: 406389 - DNA, 25 bp, Rattus norvegicus
gctcttctgtcttctgaacttcggg

SEQ ID NO: 406390 - DNA, 25 bp, Rattus norvegicus
gctcttctgtgactgcaggtcgtga

SEQ ID NO: 406391 - DNA, 25 bp, Rattus norvegicus
gctcttctgtgagtgcaggtcgtga

SEQ ID NO: 406392 - DNA, 25 bp, Rattus norvegicus
gctcttctgttaaatctctttggtt

SEQ ID NO: 406393 - DNA, 25 bp, Rattus norvegicus
gctcttctgttatatctctttggtt

SEQ ID NO: 406394 - DNA, 25 bp, Rattus norvegicus
gctcttctgtttcatggtcgccttc

SEQ ID NO: 406395 - DNA, 25 bp, Rattus norvegicus
gctcttctgtttgatggtcgccttc

SEQ ID NO: 406396 - DNA, 25 bp, Rattus norvegicus
gctcttcttgtgacttggtgttaga

SEQ ID NO: 406397 - DNA, 25 bp, Rattus norvegicus
gctcttcttgtgtcttggtgttaga

SEQ ID NO: 406398 - DNA, 25 bp, Rattus norvegicus
gctcttctttaaccacatgcagtgt

SEQ ID NO: 406399 - DNA, 25 bp, Rattus norvegicus
gctcttctttaagcacatgcagtgt

SEQ ID NO: 406400 - DNA, 25 bp, Rattus norvegicus
gctcttgaaaagcaaactgcatcta

SEQ ID NO: 406401 - DNA, 25 bp, Rattus norvegicus
gctcttgaaaaggaaactgcatcta

SEQ ID NO: 406402 - DNA, 25 bp, Rattus norvegicus
gctcttgaagctccccgggatttta

SEQ ID NO: 406403 - DNA, 25 bp, Rattus norvegicus
gctcttgaagctgcccgggatttta

SEQ ID NO: 406404 - DNA, 25 bp, Rattus norvegicus
gctcttgaccacagtctgatatcat

SEQ ID NO: 406405 - DNA, 25 bp, Rattus norvegicus
gctcttgaccactgtctgatatcat

SEQ ID NO: 406406 - DNA, 25 bp, Rattus norvegicus
gctcttgagaaacgcacgtgactaa

SEQ ID NO: 406407 - DNA, 25 bp, Rattus norvegicus
gctcttgagaaaggcacgtgactaa

SEQ ID NO: 406408 - DNA, 25 bp, Rattus norvegicus
gctcttgagaatacagtcagccaga

SEQ ID NO: 406409 - DNA, 25 bp, Rattus norvegicus
gctcttgagaattcagtcagccaga

SEQ ID NO: 406410 - DNA, 25 bp, Rattus norvegicus
gctcttgaggtccttcttggcatca

SEQ ID NO: 406411 - DNA, 25 bp, Rattus norvegicus
gctcttgaggtcgttcttggcatca

SEQ ID NO: 406412 - DNA, 25 bp, Rattus norvegicus
gctcttgatatactccctgtggaat

SEQ ID NO: 406413 - DNA, 25 bp, Rattus norvegicus
gctcttgatatagtccctgtggaat

SEQ ID NO: 406414 - DNA, 25 bp, Rattus norvegicus
gctcttgatgcccatttcaggataa

SEQ ID NO: 406415 - DNA, 25 bp, Rattus norvegicus
gctcttgatgccgatttcaggataa

SEQ ID NO: 406416 - DNA, 25 bp, Rattus norvegicus
gctcttgcacagatcttctcaaata

SEQ ID NO: 406417 - DNA, 25 bp, Rattus norvegicus
gctcttgcacagttcttctcaaata

SEQ ID NO: 406418 - DNA, 25 bp, Rattus norvegicus
gctcttgcagagacaacagcacaat

SEQ ID NO: 406419 - DNA, 25 bp, Rattus norvegicus
gctcttgcagagatttcgggacaca

SEQ ID NO: 406420 - DNA, 25 bp, Rattus norvegicus
gctcttgcagagtcaacagcacaat

SEQ ID NO: 406421 - DNA, 25 bp, Rattus norvegicus
gctcttgcagagttttcgggacaca

SEQ ID NO: 406422 - DNA, 25 bp, Rattus norvegicus
gctcttgcattcattgtataccttt

SEQ ID NO: 406423 - DNA, 25 bp, Rattus norvegicus
gctcttgcattctttgtataccttt

SEQ ID NO: 406424 - DNA, 25 bp, Rattus norvegicus
gctcttgccaagaacgggtttccta

SEQ ID NO: 406425 - DNA, 25 bp, Rattus norvegicus
gctcttgccaagtacgggtttccta

SEQ ID NO: 406426 - DNA, 25 bp, Rattus norvegicus
gctcttgccggtcatttaatctact

SEQ ID NO: 406427 - DNA, 25 bp, Rattus norvegicus
gctcttgccggtgatttaatctact

SEQ ID NO: 406428 - DNA, 25 bp, Rattus norvegicus
gctcttgcctacattcttgaagaca

SEQ ID NO: 406429 - DNA, 25 bp, Rattus norvegicus
gctcttgcctactttcttgaagaca

SEQ ID NO: 406430 - DNA, 25 bp, Rattus norvegicus
gctcttgcctttaagctatgagggt

SEQ ID NO: 406431 - DNA, 25 bp, Rattus norvegicus
gctcttgccttttagctatgagggt

SEQ ID NO: 406432 - DNA, 25 bp, Rattus norvegicus
gctcttgcggttacttttcagtaag

SEQ ID NO: 406433 - DNA, 25 bp, Rattus norvegicus
gctcttgcggtttcttttcagtaag

SEQ ID NO: 406434 - DNA, 25 bp, Rattus norvegicus
gctcttgctgaactctctgagcaaa

SEQ ID NO: 406435 - DNA, 25 bp, Rattus norvegicus
gctcttgctgaagtctctgagcaaa

SEQ ID NO: 406436 - DNA, 25 bp, Rattus norvegicus
gctcttgctttaagtcagaagtctc

SEQ ID NO: 406437 - DNA, 25 bp, Rattus norvegicus
gctcttgctttatgtcagaagtctc

SEQ ID NO: 406438 - DNA, 25 bp, Rattus norvegicus
gctcttggacacaggcttaaataaa

SEQ ID NO: 406439 - DNA, 25 bp, Rattus norvegicus
gctcttggacactggcttaaataaa

SEQ ID NO: 406440 - DNA, 25 bp, Rattus norvegicus
gctcttggactactactaagcctgt

SEQ ID NO: 406441 - DNA, 25 bp, Rattus norvegicus
gctcttggactagtactaagcctgt

SEQ ID NO: 406442 - DNA, 25 bp, Rattus norvegicus
gctcttggatggctgtcatgacgac

SEQ ID NO: 406443 - DNA, 25 bp, Rattus norvegicus
gctcttggatgggtgtcatgacgac

SEQ ID NO: 406444 - DNA, 25 bp, Rattus norvegicus
gctcttggctaaacttaaacgtgct

SEQ ID NO: 406445 - DNA, 25 bp, Rattus norvegicus
gctcttggctaatcttaaacgtgct

SEQ ID NO: 406446 - DNA, 25 bp, Rattus norvegicus
gctcttggcttaatttggcttcatt

SEQ ID NO: 406447 - DNA, 25 bp, Rattus norvegicus
gctcttggcttattttggcttcatt

SEQ ID NO: 406448 - DNA, 25 bp, Rattus norvegicus
gctcttgggatgctcttttggcata

SEQ ID NO: 406449 - DNA, 25 bp, Rattus norvegicus
gctcttgggatggtcttttggcata

SEQ ID NO: 406450 - DNA, 25 bp, Rattus norvegicus
gctcttgggtccagccttgacaaag

SEQ ID NO: 406451 - DNA, 25 bp, Rattus norvegicus
gctcttgggtcctgccttgacaaag

SEQ ID NO: 406452 - DNA, 25 bp, Rattus norvegicus
gctcttgggttcacacagacttaaa

SEQ ID NO: 406453 - DNA, 25 bp, Rattus norvegicus
gctcttgggttctcacagacttaaa

SEQ ID NO: 406454 - DNA, 25 bp, Rattus norvegicus
gctcttggtaatatggctcagtgtg

SEQ ID NO: 406455 - DNA, 25 bp, Rattus norvegicus
gctcttggtaatttggctcagtgtg

SEQ ID NO: 406456 - DNA, 25 bp, Rattus norvegicus
gctcttggtgtgagtaggacgtcta

SEQ ID NO: 406457 - DNA, 25 bp, Rattus norvegicus
gctcttggtgtgtgtaggacgtcta

SEQ ID NO: 406458 - DNA, 25 bp, Rattus norvegicus
gctcttgtaccccaggagattgtaa

SEQ ID NO: 406459 - DNA, 25 bp, Rattus norvegicus
gctcttgtacccgaggagattgtaa

SEQ ID NO: 406460 - DNA, 25 bp, Rattus norvegicus
gctcttgtagcccttggctggactt

SEQ ID NO: 406461 - DNA, 25 bp, Rattus norvegicus
gctcttgtagccgttggctggactt

SEQ ID NO: 406462 - DNA, 25 bp, Rattus norvegicus
gctcttgtatctctgaactttcatt

SEQ ID NO: 406463 - DNA, 25 bp, Rattus norvegicus
gctcttgtatctgtgaactttcatt

SEQ ID NO: 406464 - DNA, 25 bp, Rattus norvegicus
gctcttgtatttagtcaaaggcagt

SEQ ID NO: 406465 - DNA, 25 bp, Rattus norvegicus
gctcttgtattttgtcaaaggcagt

SEQ ID NO: 406466 - DNA, 25 bp, Rattus norvegicus
gctcttgtcagcagcaggtcttaaa

SEQ ID NO: 406467 - DNA, 25 bp, Rattus norvegicus
gctcttgtcagctgcaggtcttaaa

SEQ ID NO: 406468 - DNA, 25 bp, Rattus norvegicus
gctcttgtcattactggtatatgta

SEQ ID NO: 406469 - DNA, 25 bp, Rattus norvegicus
gctcttgtcatttctggtatatgta

SEQ ID NO: 406470 - DNA, 25 bp, Rattus norvegicus
gctcttgtgaaacgcccatgattta

SEQ ID NO: 406471 - DNA, 25 bp, Rattus norvegicus
gctcttgtgaaaggcccatgattta

SEQ ID NO: 406472 - DNA, 25 bp, Rattus norvegicus
gctcttgtgagccatgactgataat

SEQ ID NO: 406473 - DNA, 25 bp, Rattus norvegicus
gctcttgtgagcgatgactgataat

SEQ ID NO: 406474 - DNA, 25 bp, Rattus norvegicus
gctcttgtgcaaatgttttgcccca

SEQ ID NO: 406475 - DNA, 25 bp, Rattus norvegicus
gctcttgtgcaattgttttgcccca

SEQ ID NO: 406476 - DNA, 25 bp, Rattus norvegicus
gctcttgtgggaatccaatgcttct

SEQ ID NO: 406477 - DNA, 25 bp, Rattus norvegicus
gctcttgtgggattccaatgcttct

SEQ ID NO: 406478 - DNA, 25 bp, Rattus norvegicus
gctcttgttgatatgagggcactta

SEQ ID NO: 406479 - DNA, 25 bp, Rattus norvegicus
gctcttgttgatttgagggcactta

SEQ ID NO: 406480 - DNA, 25 bp, Rattus norvegicus
gctcttgttggcaggttcattaagt

SEQ ID NO: 406481 - DNA, 25 bp, Rattus norvegicus
gctcttgttggctggttcattaagt

SEQ ID NO: 406482 - DNA, 25 bp, Rattus norvegicus
gctcttgtttctatgtcctgggaga

SEQ ID NO: 406483 - DNA, 25 bp, Rattus norvegicus
gctcttgtttctttgtcctgggaga

SEQ ID NO: 406484 - DNA, 25 bp, Rattus norvegicus
gctctttaaggaagagaaagccctc

SEQ ID NO: 406485 - DNA, 25 bp, Rattus norvegicus
gctctttaaggatgagaaagccctc

SEQ ID NO: 406486 - DNA, 25 bp, Rattus norvegicus
gctctttacaatcttttgcgctgat

SEQ ID NO: 406487 - DNA, 25 bp, Rattus norvegicus
gctctttacaatgttttgcgctgat

SEQ ID NO: 406488 - DNA, 25 bp, Rattus norvegicus
gctctttaccatagagctatacccc

SEQ ID NO: 406489 - DNA, 25 bp, Rattus norvegicus
gctctttaccattgagctatacccc

SEQ ID NO: 406490 - DNA, 25 bp, Rattus norvegicus
gctctttaggacaggatgcggctca

SEQ ID NO: 406491 - DNA, 25 bp, Rattus norvegicus
gctctttaggactggatgcggctca

SEQ ID NO: 406492 - DNA, 25 bp, Rattus norvegicus
gctctttagtctatcactcggatga

SEQ ID NO: 406493 - DNA, 25 bp, Rattus norvegicus
gctctttagtctttcactcggatga

SEQ ID NO: 406494 - DNA, 25 bp, Rattus norvegicus
gctctttagttcattctgctggctt

SEQ ID NO: 406495 - DNA, 25 bp, Rattus norvegicus
gctctttagttctttctgctggctt

SEQ ID NO: 406496 - DNA, 25 bp, Rattus norvegicus
gctctttataacattgtattctaca

SEQ ID NO: 406497 - DNA, 25 bp, Rattus norvegicus
gctctttataactttgtattctaca

SEQ ID NO: 406498 - DNA, 25 bp, Rattus norvegicus
gctctttattggaggcttaagcttt

SEQ ID NO: 406499 - DNA, 25 bp, Rattus norvegicus
gctctttattggtggcttaagcttt

SEQ ID NO: 406500 - DNA, 25 bp, Rattus norvegicus
gctctttcaattccagggtcttgta

SEQ ID NO: 406501 - DNA, 25 bp, Rattus norvegicus
gctctttcaattgcagggtcttgta

SEQ ID NO: 406502 - DNA, 25 bp, Rattus norvegicus
gctctttcagagcaggtttgcagtt

SEQ ID NO: 406503 - DNA, 25 bp, Rattus norvegicus
gctctttcagaggaggtttgcagtt

SEQ ID NO: 406504 - DNA, 25 bp, Rattus norvegicus
gctctttccgagatttatcttatca

SEQ ID NO: 406505 - DNA, 25 bp, Rattus norvegicus
gctctttccgagttttatcttatca

SEQ ID NO: 406506 - DNA, 25 bp, Rattus norvegicus
gctctttctagcatttaagccagca

SEQ ID NO: 406507 - DNA, 25 bp, Rattus norvegicus
gctctttctagcttttaagccagca

SEQ ID NO: 406508 - DNA, 25 bp, Rattus norvegicus
gctctttctctcactgtggaagcat

SEQ ID NO: 406509 - DNA, 25 bp, Rattus norvegicus
gctctttctctcagtgaaatgtgtt

SEQ ID NO: 406510 - DNA, 25 bp, Rattus norvegicus
gctctttctctctctgtggaagcat

SEQ ID NO: 406511 - DNA, 25 bp, Rattus norvegicus
gctctttctctctgtgaaatgtgtt

SEQ ID NO: 406512 - DNA, 25 bp, Rattus norvegicus
gctctttcttgtcatctctggagaa

SEQ ID NO: 406513 - DNA, 25 bp, Rattus norvegicus
gctctttcttgtgatctctggagaa

SEQ ID NO: 406514 - DNA, 25 bp, Rattus norvegicus
gctctttgaagaactgccggaggct

SEQ ID NO: 406515 - DNA, 25 bp, Rattus norvegicus
gctctttgaagatctgccggaggct

SEQ ID NO: 406516 - DNA, 25 bp, Rattus norvegicus
gctctttgacagacttcctggacaa

SEQ ID NO: 406517 - DNA, 25 bp, Rattus norvegicus
gctctttgacagtcttcctggacaa

SEQ ID NO: 406518 - DNA, 25 bp, Rattus norvegicus
gctctttgaggtatgccttgggaga

SEQ ID NO: 406519 - DNA, 25 bp, Rattus norvegicus
gctctttgaggtttgccttgggaga

SEQ ID NO: 406520 - DNA, 25 bp, Rattus norvegicus
gctctttgatctatacataccacca

SEQ ID NO: 406521 - DNA, 25 bp, Rattus norvegicus
gctctttgatctttacataccacca

SEQ ID NO: 406522 - DNA, 25 bp, Rattus norvegicus
gctctttggagacaatcgtagactc

SEQ ID NO: 406523 - DNA, 25 bp, Rattus norvegicus
gctctttggagagaatcgtagactc

SEQ ID NO: 406524 - DNA, 25 bp, Rattus norvegicus
gctctttggaggaagccatcagtct

SEQ ID NO: 406525 - DNA, 25 bp, Rattus norvegicus
gctctttggaggtagccatcagtct

SEQ ID NO: 406526 - DNA, 25 bp, Rattus norvegicus
gctctttgggttcatgccgaagaga

SEQ ID NO: 406527 - DNA, 25 bp, Rattus norvegicus
gctctttgggttgatgccgaagaga

SEQ ID NO: 406528 - DNA, 25 bp, Rattus norvegicus
gctctttgtagtagggtctaacact

SEQ ID NO: 406529 - DNA, 25 bp, Rattus norvegicus
gctctttgtagttgggtctaacact

SEQ ID NO: 406530 - DNA, 25 bp, Rattus norvegicus
gctctttgtattagcttacctttta

SEQ ID NO: 406531 - DNA, 25 bp, Rattus norvegicus
gctctttgtatttgcttacctttta

SEQ ID NO: 406532 - DNA, 25 bp, Rattus norvegicus
gctctttgtccaaatgctctaatca

SEQ ID NO: 406533 - DNA, 25 bp, Rattus norvegicus
gctctttgtccatatgctctaatca

SEQ ID NO: 406534 - DNA, 25 bp, Rattus norvegicus
gctctttgtgagaccgcagcgacgg

SEQ ID NO: 406535 - DNA, 25 bp, Rattus norvegicus
gctctttgtgagtccgcagcgacgg

SEQ ID NO: 406536 - DNA, 25 bp, Rattus norvegicus
gctctttgtgtcatgtggtcaatgt

SEQ ID NO: 406537 - DNA, 25 bp, Rattus norvegicus
gctctttgtgtcttgtggtcaatgt

SEQ ID NO: 406538 - DNA, 25 bp, Rattus norvegicus
gctctttgtttccttatattcgcta

SEQ ID NO: 406539 - DNA, 25 bp, Rattus norvegicus
gctctttgtttcgttatattcgcta

SEQ ID NO: 406540 - DNA, 25 bp, Rattus norvegicus
gctcttttcaaaatcgtggtcctat

SEQ ID NO: 406541 - DNA, 25 bp, Rattus norvegicus
gctcttttcaaattcgtggtcctat

SEQ ID NO: 406542 - DNA, 25 bp, Rattus norvegicus
gctcttttcagtatcgcttaagcct

SEQ ID NO: 406543 - DNA, 25 bp, Rattus norvegicus
gctcttttcagtttcgcttaagcct

SEQ ID NO: 406544 - DNA, 25 bp, Rattus norvegicus
gctcttttccctaccaaatattcaa

SEQ ID NO: 406545 - DNA, 25 bp, Rattus norvegicus
gctcttttcccttccaaatattcaa

SEQ ID NO: 406546 - DNA, 25 bp, Rattus norvegicus
gctcttttctagattcaagtgctat

SEQ ID NO: 406547 - DNA, 25 bp, Rattus norvegicus
gctcttttctagtttcaagtgctat

SEQ ID NO: 406548 - DNA, 25 bp, Rattus norvegicus
gctcttttctttagccttgatggtg

SEQ ID NO: 406549 - DNA, 25 bp, Rattus norvegicus
gctcttttcttttgccttgatggtg

SEQ ID NO: 406550 - DNA, 25 bp, Rattus norvegicus
gctcttttgaggaatatgatgcccc

SEQ ID NO: 406551 - DNA, 25 bp, Rattus norvegicus
gctcttttgaggtatatgatgcccc

SEQ ID NO: 406552 - DNA, 25 bp, Rattus norvegicus
gctcttttggctctgtttattatgt

SEQ ID NO: 406553 - DNA, 25 bp, Rattus norvegicus
gctcttttggctgtgtttattatgt

SEQ ID NO: 406554 - DNA, 25 bp, Rattus norvegicus
gctcttttggtaatccaaggtctgg

SEQ ID NO: 406555 - DNA, 25 bp, Rattus norvegicus
gctcttttggtattccaaggtctgg

SEQ ID NO: 406556 - DNA, 25 bp, Rattus norvegicus
gctcttttgtgcatagtgactgttt

SEQ ID NO: 406557 - DNA, 25 bp, Rattus norvegicus
gctcttttgtgcttagtgactgttt

SEQ ID NO: 406558 - DNA, 25 bp, Rattus norvegicus
gctcttttgtggagtctgtagttaa

SEQ ID NO: 406559 - DNA, 25 bp, Rattus norvegicus
gctcttttgtggtgtctgtagttaa

SEQ ID NO: 406560 - DNA, 25 bp, Rattus norvegicus
gctctttttaaccactgggccgaga

SEQ ID NO: 406561 - DNA, 25 bp, Rattus norvegicus
gctctttttaacgactgggccgaga

SEQ ID NO: 406562 - DNA, 25 bp, Rattus norvegicus
gctctttttctgatcatggtttgct

SEQ ID NO: 406563 - DNA, 25 bp, Rattus norvegicus
gctctttttctgttcatggtttgct

SEQ ID NO: 406564 - DNA, 25 bp, Rattus norvegicus
gctgaaaaatctcctccagggtctg

SEQ ID NO: 406565 - DNA, 25 bp, Rattus norvegicus
gctgaaaaatctgctccagggtctg

SEQ ID NO: 406566 - DNA, 25 bp, Rattus norvegicus
gctgaaaacaaaccagtcttctcta

SEQ ID NO: 406567 - DNA, 25 bp, Rattus norvegicus
gctgaaaacaaagcagtcttctcta

SEQ ID NO: 406568 - DNA, 25 bp, Rattus norvegicus
gctgaaaaccttcacagaccggaat

SEQ ID NO: 406569 - DNA, 25 bp, Rattus norvegicus
gctgaaaaccttgacagaccggaat

SEQ ID NO: 406570 - DNA, 25 bp, Rattus norvegicus
gctgaaaactttcatgcggccatct

SEQ ID NO: 406571 - DNA, 25 bp, Rattus norvegicus
gctgaaaactttgatgcggccatct

SEQ ID NO: 406572 - DNA, 25 bp, Rattus norvegicus
gctgaaaatcgcatctgtgattgag

SEQ ID NO: 406573 - DNA, 25 bp, Rattus norvegicus
gctgaaaatcgcttctgtgattgag

SEQ ID NO: 406574 - DNA, 25 bp, Rattus norvegicus
gctgaaaatttactgcaactctaat

SEQ ID NO: 406575 - DNA, 25 bp, Rattus norvegicus
gctgaaaatttagtgcaactctaat

SEQ ID NO: 406576 - DNA, 25 bp, Rattus norvegicus
gctgaaaccctgaatctcggtgcag

SEQ ID NO: 406577 - DNA, 25 bp, Rattus norvegicus
gctgaaaccctgagctggaggctgc

SEQ ID NO: 406578 - DNA, 25 bp, Rattus norvegicus
gctgaaaccctgtatctcggtgcag

SEQ ID NO: 406579 - DNA, 25 bp, Rattus norvegicus
gctgaaaccctgtgctggaggctgc

SEQ ID NO: 406580 - DNA, 25 bp, Rattus norvegicus
gctgaaacctacaggcccgaagatt

SEQ ID NO: 406581 - DNA, 25 bp, Rattus norvegicus
gctgaaacctactggcccgaagatt

SEQ ID NO: 406582 - DNA, 25 bp, Rattus norvegicus
gctgaaacctcaaaagcgttgttgt

SEQ ID NO: 406583 - DNA, 25 bp, Rattus norvegicus
gctgaaacctcataagcgttgttgt

SEQ ID NO: 406584 - DNA, 25 bp, Rattus norvegicus
gctgaaacctgtccggactctgcaa

SEQ ID NO: 406585 - DNA, 25 bp, Rattus norvegicus
gctgaaacctgtgcggactctgcaa

SEQ ID NO: 406586 - DNA, 25 bp, Rattus norvegicus
gctgaaactcatatacgtctgtgta

SEQ ID NO: 406587 - DNA, 25 bp, Rattus norvegicus
gctgaaactcatttacgtctgtgta

SEQ ID NO: 406588 - DNA, 25 bp, Rattus norvegicus
gctgaaactggacgatactgacttt

SEQ ID NO: 406589 - DNA, 25 bp, Rattus norvegicus
gctgaaactggaggatactgacttt

SEQ ID NO: 406590 - DNA, 25 bp, Rattus norvegicus
gctgaaactgtaagacaggtcccga

SEQ ID NO: 406591 - DNA, 25 bp, Rattus norvegicus
gctgaaactgtatgacaggtcccga

SEQ ID NO: 406592 - DNA, 25 bp, Rattus norvegicus
gctgaaacttttcagcgggactttt

SEQ ID NO: 406593 - DNA, 25 bp, Rattus norvegicus
gctgaaacttttgagcgggactttt

SEQ ID NO: 406594 - DNA, 25 bp, Rattus norvegicus
gctgaaagaccacccttttaagcgt

SEQ ID NO: 406595 - DNA, 25 bp, Rattus norvegicus
gctgaaagaccagccttttaagcgt

SEQ ID NO: 406596 - DNA, 25 bp, Rattus norvegicus
gctgaaagacttacgcgatgcctac

SEQ ID NO: 406597 - DNA, 25 bp, Rattus norvegicus
gctgaaagactttcgcgatgcctac

SEQ ID NO: 406598 - DNA, 25 bp, Rattus norvegicus
gctgaaagcataccctcctgtagct

SEQ ID NO: 406599 - DNA, 25 bp, Rattus norvegicus
gctgaaagcatagcctcctgtagct

SEQ ID NO: 406600 - DNA, 25 bp, Rattus norvegicus
gctgaaagctcacatcttgatccac

SEQ ID NO: 406601 - DNA, 25 bp, Rattus norvegicus
gctgaaagctcagatcttgatccac

SEQ ID NO: 406602 - DNA, 25 bp, Rattus norvegicus
gctgaaagctttcccacagtcggga

SEQ ID NO: 406603 - DNA, 25 bp, Rattus norvegicus
gctgaaagctttgccacagtcggga

SEQ ID NO: 406604 - DNA, 25 bp, Rattus norvegicus
gctgaaagggagacgtttgcaagac

SEQ ID NO: 406605 - DNA, 25 bp, Rattus norvegicus
gctgaaagggagtcgtttgcaagac

SEQ ID NO: 406606 - DNA, 25 bp, Rattus norvegicus
gctgaaaggtgaattactttcccat

SEQ ID NO: 406607 - DNA, 25 bp, Rattus norvegicus
gctgaaaggtgatttactttcccat

SEQ ID NO: 406608 - DNA, 25 bp, Rattus norvegicus
gctgaaatagatccccgcctgaagg

SEQ ID NO: 406609 - DNA, 25 bp, Rattus norvegicus
gctgaaatagatgcccgcctgaagg

SEQ ID NO: 406610 - DNA, 25 bp, Rattus norvegicus
gctgaaatgtataagcctacctaga

SEQ ID NO: 406611 - DNA, 25 bp, Rattus norvegicus
gctgaaatgtattagcctacctaga

SEQ ID NO: 406612 - DNA, 25 bp, Rattus norvegicus
gctgaaatgtccctttgcacatgga

SEQ ID NO: 406613 - DNA, 25 bp, Rattus norvegicus
gctgaaatgtccgtttgcacatgga

SEQ ID NO: 406614 - DNA, 25 bp, Rattus norvegicus
gctgaaattttccataaccgcgaag

SEQ ID NO: 406615 - DNA, 25 bp, Rattus norvegicus
gctgaaattttcgataaccgcgaag

SEQ ID NO: 406616 - DNA, 25 bp, Rattus norvegicus
gctgaacaacatcccaaacttctgt

SEQ ID NO: 406617 - DNA, 25 bp, Rattus norvegicus
gctgaacaacatgccaaacttctgt

SEQ ID NO: 406618 - DNA, 25 bp, Rattus norvegicus
gctgaacaatgtacgatatccctta

SEQ ID NO: 406619 - DNA, 25 bp, Rattus norvegicus
gctgaacaatgttcgatatccctta

SEQ ID NO: 406620 - DNA, 25 bp, Rattus norvegicus
gctgaacagatacagagcctcacag

SEQ ID NO: 406621 - DNA, 25 bp, Rattus norvegicus
gctgaacagatagagagcctcacag

SEQ ID NO: 406622 - DNA, 25 bp, Rattus norvegicus
gctgaacagcacagtcctgtgtaaa

SEQ ID NO: 406623 - DNA, 25 bp, Rattus norvegicus
gctgaacagcactgtcctgtgtaaa

SEQ ID NO: 406624 - DNA, 25 bp, Rattus norvegicus
gctgaacagcgcaaggagacaatca

SEQ ID NO: 406625 - DNA, 25 bp, Rattus norvegicus
gctgaacagcgctaggagacaatca

SEQ ID NO: 406626 - DNA, 25 bp, Rattus norvegicus
gctgaacagttcatgtgtgtcttat

SEQ ID NO: 406627 - DNA, 25 bp, Rattus norvegicus
gctgaacagttcttgtgtgtcttat

SEQ ID NO: 406628 - DNA, 25 bp, Rattus norvegicus
gctgaacatctgaagctgctgtttt

SEQ ID NO: 406629 - DNA, 25 bp, Rattus norvegicus
gctgaacatctgtagctgctgtttt

SEQ ID NO: 406630 - DNA, 25 bp, Rattus norvegicus
gctgaaccaaacagcttcatctgat

SEQ ID NO: 406631 - DNA, 25 bp, Rattus norvegicus
gctgaaccaaactgcttcatctgat

SEQ ID NO: 406632 - DNA, 25 bp, Rattus norvegicus
gctgaacccaaactacaagtgggtt

SEQ ID NO: 406633 - DNA, 25 bp, Rattus norvegicus
gctgaacccaaagtacaagtgggtt

SEQ ID NO: 406634 - DNA, 25 bp, Rattus norvegicus
gctgaaccccatatcttctgtttca

SEQ ID NO: 406635 - DNA, 25 bp, Rattus norvegicus
gctgaaccccatttcttctgtttca

SEQ ID NO: 406636 - DNA, 25 bp, Rattus norvegicus
gctgaaccgcacagtggtcgtgtaa

SEQ ID NO: 406637 - DNA, 25 bp, Rattus norvegicus
gctgaaccgcactgtggtcgtgtaa

SEQ ID NO: 406638 - DNA, 25 bp, Rattus norvegicus
gctgaaccgtcaaactttttatctg

SEQ ID NO: 406639 - DNA, 25 bp, Rattus norvegicus
gctgaaccgtcatactttttatctg

SEQ ID NO: 406640 - DNA, 25 bp, Rattus norvegicus
gctgaacctgtgaccttagggacgt

SEQ ID NO: 406641 - DNA, 25 bp, Rattus norvegicus
gctgaacctgtgtccttagggacgt

SEQ ID NO: 406642 - DNA, 25 bp, Rattus norvegicus
gctgaaccttcaccatagtactttt

SEQ ID NO: 406643 - DNA, 25 bp, Rattus norvegicus
gctgaaccttcagcatagtactttt

SEQ ID NO: 406644 - DNA, 25 bp, Rattus norvegicus
gctgaaccttctaatgggccgaaca

SEQ ID NO: 406645 - DNA, 25 bp, Rattus norvegicus
gctgaaccttcttatgggccgaaca

SEQ ID NO: 406646 - DNA, 25 bp, Rattus norvegicus
gctgaacggcttctgttgtaggcaa

SEQ ID NO: 406647 - DNA, 25 bp, Rattus norvegicus
gctgaacggcttgtgttgtaggcaa

SEQ ID NO: 406648 - DNA, 25 bp, Rattus norvegicus
gctgaacgggaacctcactggcatg

SEQ ID NO: 406649 - DNA, 25 bp, Rattus norvegicus
gctgaacgggaagctcactggcatg

SEQ ID NO: 406650 - DNA, 25 bp, Rattus norvegicus
gctgaactacagagacattccaatc

SEQ ID NO: 406651 - DNA, 25 bp, Rattus norvegicus
gctgaactacagtgacattccaatc

SEQ ID NO: 406652 - DNA, 25 bp, Rattus norvegicus
gctgaactattactgctaactctgc

SEQ ID NO: 406653 - DNA, 25 bp, Rattus norvegicus
gctgaactattagtgctaactctgc

SEQ ID NO: 406654 - DNA, 25 bp, Rattus norvegicus
gctgaactattcacccatgggcaag

SEQ ID NO: 406655 - DNA, 25 bp, Rattus norvegicus
gctgaactattctcccatgggcaag

SEQ ID NO: 406656 - DNA, 25 bp, Rattus norvegicus
gctgaactcaataactacacataca

SEQ ID NO: 406657 - DNA, 25 bp, Rattus norvegicus
gctgaactcaattactacacataca

SEQ ID NO: 406658 - DNA, 25 bp, Rattus norvegicus
gctgaactcattcccatcttggatg

SEQ ID NO: 406659 - DNA, 25 bp, Rattus norvegicus
gctgaactcattgccatcttggatg

SEQ ID NO: 406660 - DNA, 25 bp, Rattus norvegicus
gctgaactcgccagctatttgatat

SEQ ID NO: 406661 - DNA, 25 bp, Rattus norvegicus
gctgaactcgcctgctatttgatat

SEQ ID NO: 406662 - DNA, 25 bp, Rattus norvegicus
gctgaactctttagagcctactgta

SEQ ID NO: 406663 - DNA, 25 bp, Rattus norvegicus
gctgaactcttttgagcctactgta

SEQ ID NO: 406664 - DNA, 25 bp, Rattus norvegicus
gctgaactgacaagagcctcataga

SEQ ID NO: 406665 - DNA, 25 bp, Rattus norvegicus
gctgaactgacatgagcctcataga

SEQ ID NO: 406666 - DNA, 25 bp, Rattus norvegicus
gctgaactgagaatcattccccgag

SEQ ID NO: 406667 - DNA, 25 bp, Rattus norvegicus
gctgaactgagattcattccccgag

SEQ ID NO: 406668 - DNA, 25 bp, Rattus norvegicus
gctgaactgcagctgaaggatccca

SEQ ID NO: 406669 - DNA, 25 bp, Rattus norvegicus
gctgaactgcaggtgaaggatccca

SEQ ID NO: 406670 - DNA, 25 bp, Rattus norvegicus
gctgaactgtatcgagcctgtccta

SEQ ID NO: 406671 - DNA, 25 bp, Rattus norvegicus
gctgaactgtatggagcctgtccta

SEQ ID NO: 406672 - DNA, 25 bp, Rattus norvegicus
gctgaactgtcaagtgaacactgaa

SEQ ID NO: 406673 - DNA, 25 bp, Rattus norvegicus
gctgaactgtcatgtgaacactgaa

SEQ ID NO: 406674 - DNA, 25 bp, Rattus norvegicus
gctgaactgttaacaatccctaccc

SEQ ID NO: 406675 - DNA, 25 bp, Rattus norvegicus
gctgaactgttatcaatccctaccc

SEQ ID NO: 406676 - DNA, 25 bp, Rattus norvegicus
gctgaacttaataatgaggcaccaa

SEQ ID NO: 406677 - DNA, 25 bp, Rattus norvegicus
gctgaacttaattatgaggcaccaa

SEQ ID NO: 406678 - DNA, 25 bp, Rattus norvegicus
gctgaacttcgtagctgcactggaa

SEQ ID NO: 406679 - DNA, 25 bp, Rattus norvegicus
gctgaacttcgttgctgcactggaa

SEQ ID NO: 406680 - DNA, 25 bp, Rattus norvegicus
gctgaactttagctttccacttctt

SEQ ID NO: 406681 - DNA, 25 bp, Rattus norvegicus
gctgaactttaggtttccacttctt

SEQ ID NO: 406682 - DNA, 25 bp, Rattus norvegicus
gctgaagaacgacaacgccctgctt

SEQ ID NO: 406683 - DNA, 25 bp, Rattus norvegicus
gctgaagaacgagaacgccctgctt

SEQ ID NO: 406684 - DNA, 25 bp, Rattus norvegicus
gctgaagacccaatcattgcaatcc

SEQ ID NO: 406685 - DNA, 25 bp, Rattus norvegicus
gctgaagacccattcattgcaatcc

SEQ ID NO: 406686 - DNA, 25 bp, Rattus norvegicus
gctgaagaccttaagtgcttgcttt

SEQ ID NO: 406687 - DNA, 25 bp, Rattus norvegicus
gctgaagacctttagtgcttgcttt

SEQ ID NO: 406688 - DNA, 25 bp, Rattus norvegicus
gctgaagacggtatgggagttactc

SEQ ID NO: 406689 - DNA, 25 bp, Rattus norvegicus
gctgaagacggtttgggagttactc

SEQ ID NO: 406690 - DNA, 25 bp, Rattus norvegicus
gctgaagagccgcacatgcacctgc

SEQ ID NO: 406691 - DNA, 25 bp, Rattus norvegicus
gctgaagagccggacatgcacctgc

SEQ ID NO: 406692 - DNA, 25 bp, Rattus norvegicus
gctgaagatgatactcttgcccatt

SEQ ID NO: 406693 - DNA, 25 bp, Rattus norvegicus
gctgaagatgattctcttgcccatt

SEQ ID NO: 406694 - DNA, 25 bp, Rattus norvegicus
gctgaagattatctgccccggaaag

SEQ ID NO: 406695 - DNA, 25 bp, Rattus norvegicus
gctgaagattatgtgccccggaaag

SEQ ID NO: 406696 - DNA, 25 bp, Rattus norvegicus
gctgaagattgaaccacctctgtgt

SEQ ID NO: 406697 - DNA, 25 bp, Rattus norvegicus
gctgaagattgatccacctctgtgt

SEQ ID NO: 406698 - DNA, 25 bp, Rattus norvegicus
gctgaagcactcaatgagcctgtct

SEQ ID NO: 406699 - DNA, 25 bp, Rattus norvegicus
gctgaagcactctatgagcctgtct

SEQ ID NO: 406700 - DNA, 25 bp, Rattus norvegicus
gctgaagcagcccgcatattaggcg

SEQ ID NO: 406701 - DNA, 25 bp, Rattus norvegicus
gctgaagcagccggcatattaggcg

SEQ ID NO: 406702 - DNA, 25 bp, Rattus norvegicus
gctgaagcagctacaaaaccgagga

SEQ ID NO: 406703 - DNA, 25 bp, Rattus norvegicus
gctgaagcagcttcaaaaccgagga

SEQ ID NO: 406704 - DNA, 25 bp, Rattus norvegicus
gctgaagcaggcaccaggactgaca

SEQ ID NO: 406705 - DNA, 25 bp, Rattus norvegicus
gctgaagcaggctccaggactgaca

SEQ ID NO: 406706 - DNA, 25 bp, Rattus norvegicus
gctgaagcatcacaggtttccaacc

SEQ ID NO: 406707 - DNA, 25 bp, Rattus norvegicus
gctgaagcatcagaggtttccaacc

SEQ ID NO: 406708 - DNA, 25 bp, Rattus norvegicus
gctgaagccaatcgaattgcactgt

SEQ ID NO: 406709 - DNA, 25 bp, Rattus norvegicus
gctgaagccaatggaattgcactgt

SEQ ID NO: 406710 - DNA, 25 bp, Rattus norvegicus
gctgaagccaccatttcatatcttt

SEQ ID NO: 406711 - DNA, 25 bp, Rattus norvegicus
gctgaagccaccttttcatatcttt

SEQ ID NO: 406712 - DNA, 25 bp, Rattus norvegicus
gctgaagcccttacacatttttaat

SEQ ID NO: 406713 - DNA, 25 bp, Rattus norvegicus
gctgaagcccttctgagtcataaca

SEQ ID NO: 406714 - DNA, 25 bp, Rattus norvegicus
gctgaagcccttgtgagtcataaca

SEQ ID NO: 406715 - DNA, 25 bp, Rattus norvegicus
gctgaagccctttcacatttttaat

SEQ ID NO: 406716 - DNA, 25 bp, Rattus norvegicus
gctgaagccggaagactctaggagt

SEQ ID NO: 406717 - DNA, 25 bp, Rattus norvegicus
gctgaagccggatgactctaggagt

SEQ ID NO: 406718 - DNA, 25 bp, Rattus norvegicus
gctgaagcctgaatttactttggtt

SEQ ID NO: 406719 - DNA, 25 bp, Rattus norvegicus
gctgaagcctgattttactttggtt

SEQ ID NO: 406720 - DNA, 25 bp, Rattus norvegicus
gctgaagcctgtaagtaggtgtgat

SEQ ID NO: 406721 - DNA, 25 bp, Rattus norvegicus
gctgaagcctgttagtaggtgtgat

SEQ ID NO: 406722 - DNA, 25 bp, Rattus norvegicus
gctgaagcgagcacagacctcaaac

SEQ ID NO: 406723 - DNA, 25 bp, Rattus norvegicus
gctgaagcgagctcagacctcaaac

SEQ ID NO: 406724 - DNA, 25 bp, Rattus norvegicus
gctgaagctgtcacagagagtgaaa

SEQ ID NO: 406725 - DNA, 25 bp, Rattus norvegicus
gctgaagctgtctcagagagtgaaa

SEQ ID NO: 406726 - DNA, 25 bp, Rattus norvegicus
gctgaagcttcgaccctcaaagtga

SEQ ID NO: 406727 - DNA, 25 bp, Rattus norvegicus
gctgaagcttcgtccctcaaagtga

SEQ ID NO: 406728 - DNA, 25 bp, Rattus norvegicus
gctgaaggaaatatctgggtaccca

SEQ ID NO: 406729 - DNA, 25 bp, Rattus norvegicus
gctgaaggaaatttctgggtaccca

SEQ ID NO: 406730 - DNA, 25 bp, Rattus norvegicus
gctgaaggaacaacattgcactgaa

SEQ ID NO: 406731 - DNA, 25 bp, Rattus norvegicus
gctgaaggaacatcattgcactgaa

SEQ ID NO: 406732 - DNA, 25 bp, Rattus norvegicus
gctgaaggacttacgcaaccacgaa

SEQ ID NO: 406733 - DNA, 25 bp, Rattus norvegicus
gctgaaggactttcgcaaccacgaa

SEQ ID NO: 406734 - DNA, 25 bp, Rattus norvegicus
gctgaaggcaggaggccctgacaca

SEQ ID NO: 406735 - DNA, 25 bp, Rattus norvegicus
gctgaaggcaggtggccctgacaca

SEQ ID NO: 406736 - DNA, 25 bp, Rattus norvegicus
gctgaaggccatcgcaagcgagctt

SEQ ID NO: 406737 - DNA, 25 bp, Rattus norvegicus
gctgaaggccatggcaagcgagctt

SEQ ID NO: 406738 - DNA, 25 bp, Rattus norvegicus
gctgaaggccctctatcttattgtt

SEQ ID NO: 406739 - DNA, 25 bp, Rattus norvegicus
gctgaaggccctgtatcttattgtt

SEQ ID NO: 406740 - DNA, 25 bp, Rattus norvegicus
gctgaaggctctcggctcattatcc

SEQ ID NO: 406741 - DNA, 25 bp, Rattus norvegicus
gctgaaggctctgggctcattatcc

SEQ ID NO: 406742 - DNA, 25 bp, Rattus norvegicus
gctgaagtacggcactcatcctggg

SEQ ID NO: 406743 - DNA, 25 bp, Rattus norvegicus
gctgaagtacgggactcatcctggg

SEQ ID NO: 406744 - DNA, 25 bp, Rattus norvegicus
gctgaagtcactctgtacacaccct

SEQ ID NO: 406745 - DNA, 25 bp, Rattus norvegicus
gctgaagtcactgtgtacacaccct

SEQ ID NO: 406746 - DNA, 25 bp, Rattus norvegicus
gctgaagtcatcactctgagaacca

SEQ ID NO: 406747 - DNA, 25 bp, Rattus norvegicus
gctgaagtcatctctctgagaacca

SEQ ID NO: 406748 - DNA, 25 bp, Rattus norvegicus
gctgaagtcgttactgtatgtgctg

SEQ ID NO: 406749 - DNA, 25 bp, Rattus norvegicus
gctgaagtcgtttctgtatgtgctg

SEQ ID NO: 406750 - DNA, 25 bp, Rattus norvegicus
gctgaagttgaccttcctaaactgg

SEQ ID NO: 406751 - DNA, 25 bp, Rattus norvegicus
gctgaagttgacgttcctaaactgg

SEQ ID NO: 406752 - DNA, 25 bp, Rattus norvegicus
gctgaagttggtaggccctgctgca

SEQ ID NO: 406753 - DNA, 25 bp, Rattus norvegicus
gctgaagttggtatgctcgccacag

SEQ ID NO: 406754 - DNA, 25 bp, Rattus norvegicus
gctgaagttggttggccctgctgca

SEQ ID NO: 406755 - DNA, 25 bp, Rattus norvegicus
gctgaagttggtttgctcgccacag

SEQ ID NO: 406756 - DNA, 25 bp, Rattus norvegicus
gctgaataacatcaaccgctttttt

SEQ ID NO: 406757 - DNA, 25 bp, Rattus norvegicus
gctgaataacatgaaccgctttttt

SEQ ID NO: 406758 - DNA, 25 bp, Rattus norvegicus
gctgaataccggaacttccaggctt

SEQ ID NO: 406759 - DNA, 25 bp, Rattus norvegicus
gctgaataccggtacttccaggctt

SEQ ID NO: 406760 - DNA, 25 bp, Rattus norvegicus
gctgaatacgcacgccagcaggagc

SEQ ID NO: 406761 - DNA, 25 bp, Rattus norvegicus
gctgaatacgcaggccagcaggagc

SEQ ID NO: 406762 - DNA, 25 bp, Rattus norvegicus
gctgaatatttcatgtctgggcttt

SEQ ID NO: 406763 - DNA, 25 bp, Rattus norvegicus
gctgaatatttcttgtctgggcttt

SEQ ID NO: 406764 - DNA, 25 bp, Rattus norvegicus
gctgaatcacatcctgggtattctt

SEQ ID NO: 406765 - DNA, 25 bp, Rattus norvegicus
gctgaatcacatgctgggtattctt

SEQ ID NO: 406766 - DNA, 25 bp, Rattus norvegicus
gctgaatcagagctccaggttgtaa

SEQ ID NO: 406767 - DNA, 25 bp, Rattus norvegicus
gctgaatcagaggtccaggttgtaa

SEQ ID NO: 406768 - DNA, 25 bp, Rattus norvegicus
gctgaatcgttgactctggactaca

SEQ ID NO: 406769 - DNA, 25 bp, Rattus norvegicus
gctgaatcgttgtctctggactaca

SEQ ID NO: 406770 - DNA, 25 bp, Rattus norvegicus
gctgaatctaggcttaaacctcctg

SEQ ID NO: 406771 - DNA, 25 bp, Rattus norvegicus
gctgaatctagggttaaacctcctg

SEQ ID NO: 406772 - DNA, 25 bp, Rattus norvegicus
gctgaatctctgcaaacaacacttt

SEQ ID NO: 406773 - DNA, 25 bp, Rattus norvegicus
gctgaatctctggaaacaacacttt

SEQ ID NO: 406774 - DNA, 25 bp, Rattus norvegicus
gctgaatctttcctggttgaagcaa

SEQ ID NO: 406775 - DNA, 25 bp, Rattus norvegicus
gctgaatctttcgtggttgaagcaa

SEQ ID NO: 406776 - DNA, 25 bp, Rattus norvegicus
gctgaatgaagcctgccccagcctt

SEQ ID NO: 406777 - DNA, 25 bp, Rattus norvegicus
gctgaatgaagcgtgccccagcctt

SEQ ID NO: 406778 - DNA, 25 bp, Rattus norvegicus
gctgaatgccaaagcccgaagccag

SEQ ID NO: 406779 - DNA, 25 bp, Rattus norvegicus
gctgaatgccaatgcccgaagccag

SEQ ID NO: 406780 - DNA, 25 bp, Rattus norvegicus
gctgaatgcttcaagggtgtagtac

SEQ ID NO: 406781 - DNA, 25 bp, Rattus norvegicus
gctgaatgcttctagggtgtagtac

SEQ ID NO: 406782 - DNA, 25 bp, Rattus norvegicus
gctgaatggcgtcatgctcatggca

SEQ ID NO: 406783 - DNA, 25 bp, Rattus norvegicus
gctgaatggcgtgatgctcatggca

SEQ ID NO: 406784 - DNA, 25 bp, Rattus norvegicus
gctgaatggtacaccgtgtgttaat

SEQ ID NO: 406785 - DNA, 25 bp, Rattus norvegicus
gctgaatggtactccgtgtgttaat

SEQ ID NO: 406786 - DNA, 25 bp, Rattus norvegicus
gctgaatgtcaaaaggtttagcccc

SEQ ID NO: 406787 - DNA, 25 bp, Rattus norvegicus
gctgaatgtcaataggtttagcccc

SEQ ID NO: 406788 - DNA, 25 bp, Rattus norvegicus
gctgaatgtttccatcttagtaata

SEQ ID NO: 406789 - DNA, 25 bp, Rattus norvegicus
gctgaatgtttcgatcttagtaata

SEQ ID NO: 406790 - DNA, 25 bp, Rattus norvegicus
gctgaattcagacgatctccgacct

SEQ ID NO: 406791 - DNA, 25 bp, Rattus norvegicus
gctgaattcagaggatctccgacct

SEQ ID NO: 406792 - DNA, 25 bp, Rattus norvegicus
gctgaattcatgaacgtctcctaaa

SEQ ID NO: 406793 - DNA, 25 bp, Rattus norvegicus
gctgaattcatgtacgtctcctaaa

SEQ ID NO: 406794 - DNA, 25 bp, Rattus norvegicus
gctgaattcctgagaaacaccgaaa

SEQ ID NO: 406795 - DNA, 25 bp, Rattus norvegicus
gctgaattcctgtgaaacaccgaaa

SEQ ID NO: 406796 - DNA, 25 bp, Rattus norvegicus
gctgaattccttcctttcaaagtta

SEQ ID NO: 406797 - DNA, 25 bp, Rattus norvegicus
gctgaattccttgctttcaaagtta

SEQ ID NO: 406798 - DNA, 25 bp, Rattus norvegicus
gctgaattcggacaggtgctactag

SEQ ID NO: 406799 - DNA, 25 bp, Rattus norvegicus
gctgaattcggagaggtgctactag

SEQ ID NO: 406800 - DNA, 25 bp, Rattus norvegicus
gctgaattctggaactgcctctgca

SEQ ID NO: 406801 - DNA, 25 bp, Rattus norvegicus
gctgaattctggtactgcctctgca

SEQ ID NO: 406802 - DNA, 25 bp, Rattus norvegicus
gctgaattctgtaggtattctacca

SEQ ID NO: 406803 - DNA, 25 bp, Rattus norvegicus
gctgaattctgttggtattctacca

SEQ ID NO: 406804 - DNA, 25 bp, Rattus norvegicus
gctgaattctttagtagctactgaa

SEQ ID NO: 406805 - DNA, 25 bp, Rattus norvegicus
gctgaattcttttgtagctactgaa

SEQ ID NO: 406806 - DNA, 25 bp, Rattus norvegicus
gctgaatttattcccgtgccatgag

SEQ ID NO: 406807 - DNA, 25 bp, Rattus norvegicus
gctgaatttattgccgtgccatgag

SEQ ID NO: 406808 - DNA, 25 bp, Rattus norvegicus
gctgaatttcagcaccttgacagtt

SEQ ID NO: 406809 - DNA, 25 bp, Rattus norvegicus
gctgaatttcaggaccttgacagtt

SEQ ID NO: 406810 - DNA, 25 bp, Rattus norvegicus
gctgaatttttcctcctgttattaa

SEQ ID NO: 406811 - DNA, 25 bp, Rattus norvegicus
gctgaatttttcgtcctgttattaa

SEQ ID NO: 406812 - DNA, 25 bp, Rattus norvegicus
gctgacaaaagtaaggtccttggcc

SEQ ID NO: 406813 - DNA, 25 bp, Rattus norvegicus
gctgacaaaagttaggtccttggcc

SEQ ID NO: 406814 - DNA, 25 bp, Rattus norvegicus
gctgacacagctatgagtaaactaa

SEQ ID NO: 406815 - DNA, 25 bp, Rattus norvegicus
gctgacacagctttgagtaaactaa

SEQ ID NO: 406816 - DNA, 25 bp, Rattus norvegicus
gctgacacaggtaccatttgttaca

SEQ ID NO: 406817 - DNA, 25 bp, Rattus norvegicus
gctgacacaggtctctagtgttcta

SEQ ID NO: 406818 - DNA, 25 bp, Rattus norvegicus
gctgacacaggtgtctagtgttcta

SEQ ID NO: 406819 - DNA, 25 bp, Rattus norvegicus
gctgacacaggttccatttgttaca

SEQ ID NO: 406820 - DNA, 25 bp, Rattus norvegicus
gctgacacccagcagaaacctgtgc

SEQ ID NO: 406821 - DNA, 25 bp, Rattus norvegicus
gctgacacccaggagaaacctgtgc

SEQ ID NO: 406822 - DNA, 25 bp, Rattus norvegicus
gctgacacgcgtccactaagcaagt

SEQ ID NO: 406823 - DNA, 25 bp, Rattus norvegicus
gctgacacgcgtgcactaagcaagt

SEQ ID NO: 406824 - DNA, 25 bp, Rattus norvegicus
gctgacactgaaacacttgctaggc

SEQ ID NO: 406825 - DNA, 25 bp, Rattus norvegicus
gctgacactgaatcacttgctaggc

SEQ ID NO: 406826 - DNA, 25 bp, Rattus norvegicus
gctgacactgacaatggcctttttg

SEQ ID NO: 406827 - DNA, 25 bp, Rattus norvegicus
gctgacactgactatggcctttttg

SEQ ID NO: 406828 - DNA, 25 bp, Rattus norvegicus
gctgacagctctaaaataacccctc

SEQ ID NO: 406829 - DNA, 25 bp, Rattus norvegicus
gctgacagctcttaaataacccctc

SEQ ID NO: 406830 - DNA, 25 bp, Rattus norvegicus
gctgacagtcaacgcgtctatgtat

SEQ ID NO: 406831 - DNA, 25 bp, Rattus norvegicus
gctgacagtcaaggcgtctatgtat

SEQ ID NO: 406832 - DNA, 25 bp, Rattus norvegicus
gctgacagtctgaacaaacctacct

SEQ ID NO: 406833 - DNA, 25 bp, Rattus norvegicus
gctgacagtctgtacaaacctacct

SEQ ID NO: 406834 - DNA, 25 bp, Rattus norvegicus
gctgacagttcacaggtttcctcca

SEQ ID NO: 406835 - DNA, 25 bp, Rattus norvegicus
gctgacagttcagaggtttcctcca

SEQ ID NO: 406836 - DNA, 25 bp, Rattus norvegicus
gctgacataaagcagttcacgactt

SEQ ID NO: 406837 - DNA, 25 bp, Rattus norvegicus
gctgacataaaggagttcacgactt

SEQ ID NO: 406838 - DNA, 25 bp, Rattus norvegicus
gctgacatcaacagccaataccaat

SEQ ID NO: 406839 - DNA, 25 bp, Rattus norvegicus
gctgacatcaactgccaataccaat

SEQ ID NO: 406840 - DNA, 25 bp, Rattus norvegicus
gctgacatcatcctgacttggcaaa

SEQ ID NO: 406841 - DNA, 25 bp, Rattus norvegicus
gctgacatcatcgtgacttggcaaa

SEQ ID NO: 406842 - DNA, 25 bp, Rattus norvegicus
gctgacatccacagcgagaactgca

SEQ ID NO: 406843 - DNA, 25 bp, Rattus norvegicus
gctgacatccactgcgagaactgca

SEQ ID NO: 406844 - DNA, 25 bp, Rattus norvegicus
gctgacatccagaacttcaccagtt

SEQ ID NO: 406845 - DNA, 25 bp, Rattus norvegicus
gctgacatccagtacttcaccagtt

SEQ ID NO: 406846 - DNA, 25 bp, Rattus norvegicus
gctgacatccccatgatgaacgagg

SEQ ID NO: 406847 - DNA, 25 bp, Rattus norvegicus
gctgacatccccttgatgaacgagg

SEQ ID NO: 406848 - DNA, 25 bp, Rattus norvegicus
gctgacattgcaagggcgttctacc

SEQ ID NO: 406849 - DNA, 25 bp, Rattus norvegicus
gctgacattgcatgggcgttctacc

SEQ ID NO: 406850 - DNA, 25 bp, Rattus norvegicus
gctgacattggcaggcgttacgaat

SEQ ID NO: 406851 - DNA, 25 bp, Rattus norvegicus
gctgacattggctggcgttacgaat

SEQ ID NO: 406852 - DNA, 25 bp, Rattus norvegicus
gctgaccaaattactgctactctta

SEQ ID NO: 406853 - DNA, 25 bp, Rattus norvegicus
gctgaccaaatttctgctactctta

SEQ ID NO: 406854 - DNA, 25 bp, Rattus norvegicus
gctgaccaacaacccttaacggaag

SEQ ID NO: 406855 - DNA, 25 bp, Rattus norvegicus
gctgaccaacaagccttaacggaag

SEQ ID NO: 406856 - DNA, 25 bp, Rattus norvegicus
gctgaccaacaccaggtatatctga

SEQ ID NO: 406857 - DNA, 25 bp, Rattus norvegicus
gctgaccaacacgaggtatatctga

SEQ ID NO: 406858 - DNA, 25 bp, Rattus norvegicus
gctgaccaaccaactgaatgcacta

SEQ ID NO: 406859 - DNA, 25 bp, Rattus norvegicus
gctgaccaaccatctgaatgcacta

SEQ ID NO: 406860 - DNA, 25 bp, Rattus norvegicus
gctgaccactaaccgctgtgaggag

SEQ ID NO: 406861 - DNA, 25 bp, Rattus norvegicus
gctgaccactaagcgctgtgaggag

SEQ ID NO: 406862 - DNA, 25 bp, Rattus norvegicus
gctgaccagaacaaatgcttccatg

SEQ ID NO: 406863 - DNA, 25 bp, Rattus norvegicus
gctgaccagaactaatgcttccatg

SEQ ID NO: 406864 - DNA, 25 bp, Rattus norvegicus
gctgaccagacacaagcagaggcaa

SEQ ID NO: 406865 - DNA, 25 bp, Rattus norvegicus
gctgaccagacagaagcagaggcaa

SEQ ID NO: 406866 - DNA, 25 bp, Rattus norvegicus
gctgaccaggtaagatcttcactca

SEQ ID NO: 406867 - DNA, 25 bp, Rattus norvegicus
gctgaccaggtatgatcttcactca

SEQ ID NO: 406868 - DNA, 25 bp, Rattus norvegicus
gctgaccattagctgtaccaggctt

SEQ ID NO: 406869 - DNA, 25 bp, Rattus norvegicus
gctgaccattaggtgtaccaggctt

SEQ ID NO: 406870 - DNA, 25 bp, Rattus norvegicus
gctgacccaagacttctagtttcta

SEQ ID NO: 406871 - DNA, 25 bp, Rattus norvegicus
gctgacccaagagttctagtttcta

SEQ ID NO: 406872 - DNA, 25 bp, Rattus norvegicus
gctgacccaattcgctgccaaaaga

SEQ ID NO: 406873 - DNA, 25 bp, Rattus norvegicus
gctgacccaattggctgccaaaaga

SEQ ID NO: 406874 - DNA, 25 bp, Rattus norvegicus
gctgacccattaatggatgcccaag

SEQ ID NO: 406875 - DNA, 25 bp, Rattus norvegicus
gctgacccattattggatgcccaag

SEQ ID NO: 406876 - DNA, 25 bp, Rattus norvegicus
gctgaccctcatcaatatgctttcg

SEQ ID NO: 406877 - DNA, 25 bp, Rattus norvegicus
gctgaccctcatgaatatgctttcg

SEQ ID NO: 406878 - DNA, 25 bp, Rattus norvegicus
gctgaccctgccatgtgattaagaa

SEQ ID NO: 406879 - DNA, 25 bp, Rattus norvegicus
gctgaccctgccttgtgattaagaa

SEQ ID NO: 406880 - DNA, 25 bp, Rattus norvegicus
gctgacccttaacgccgggacgcgt

SEQ ID NO: 406881 - DNA, 25 bp, Rattus norvegicus
gctgacccttaaggccgggacgcgt

SEQ ID NO: 406882 - DNA, 25 bp, Rattus norvegicus
gctgacccttagacccagggatgat

SEQ ID NO: 406883 - DNA, 25 bp, Rattus norvegicus
gctgacccttagtcccagggatgat

SEQ ID NO: 406884 - DNA, 25 bp, Rattus norvegicus
gctgacccttgaactctgaagcaaa

SEQ ID NO: 406885 - DNA, 25 bp, Rattus norvegicus
gctgacccttgatctctgaagcaaa

SEQ ID NO: 406886 - DNA, 25 bp, Rattus norvegicus
gctgaccgcttgaatgtctacagta

SEQ ID NO: 406887 - DNA, 25 bp, Rattus norvegicus
gctgaccgcttgtatgtctacagta

SEQ ID NO: 406888 - DNA, 25 bp, Rattus norvegicus
gctgaccggcgtcacagatggcttc

SEQ ID NO: 406889 - DNA, 25 bp, Rattus norvegicus
gctgaccggcgtgacagatggcttc

SEQ ID NO: 406890 - DNA, 25 bp, Rattus norvegicus
gctgacctaaagctggcgttcaaac

SEQ ID NO: 406891 - DNA, 25 bp, Rattus norvegicus
gctgacctaaaggtggcgttcaaac

SEQ ID NO: 406892 - DNA, 25 bp, Rattus norvegicus
gctgacctcaataatttgttccaaa

SEQ ID NO: 406893 - DNA, 25 bp, Rattus norvegicus
gctgacctcaatctatgcaaacctc

SEQ ID NO: 406894 - DNA, 25 bp, Rattus norvegicus
gctgacctcaatgtatgcaaacctc

SEQ ID NO: 406895 - DNA, 25 bp, Rattus norvegicus
gctgacctcaattatttgttccaaa

SEQ ID NO: 406896 - DNA, 25 bp, Rattus norvegicus
gctgacctcaggcacaagcagtgtg

SEQ ID NO: 406897 - DNA, 25 bp, Rattus norvegicus
gctgacctcagggacaagcagtgtg

SEQ ID NO: 406898 - DNA, 25 bp, Rattus norvegicus
gctgacctccctatttacatacagg

SEQ ID NO: 406899 - DNA, 25 bp, Rattus norvegicus
gctgacctccctttttacatacagg

SEQ ID NO: 406900 - DNA, 25 bp, Rattus norvegicus
gctgacctcttcatctgtctgtcca

SEQ ID NO: 406901 - DNA, 25 bp, Rattus norvegicus
gctgacctcttcttctgtctgtcca

SEQ ID NO: 406902 - DNA, 25 bp, Rattus norvegicus
gctgacctggcaatgagtgggcatt

SEQ ID NO: 406903 - DNA, 25 bp, Rattus norvegicus
gctgacctggcattgagtgggcatt

SEQ ID NO: 406904 - DNA, 25 bp, Rattus norvegicus
gctgacctgtgtacctgaactatga

SEQ ID NO: 406905 - DNA, 25 bp, Rattus norvegicus
gctgacctgtgttcctgaactatga

SEQ ID NO: 406906 - DNA, 25 bp, Rattus norvegicus
gctgaccttaggagaagcccttcag

SEQ ID NO: 406907 - DNA, 25 bp, Rattus norvegicus
gctgaccttaggtgaagcccttcag

SEQ ID NO: 406908 - DNA, 25 bp, Rattus norvegicus
gctgaccttgggagagccctttgag

SEQ ID NO: 406909 - DNA, 25 bp, Rattus norvegicus
gctgaccttgggtgagccctttgag

SEQ ID NO: 406910 - DNA, 25 bp, Rattus norvegicus
gctgacgacaatcctcaacagtcaa

SEQ ID NO: 406911 - DNA, 25 bp, Rattus norvegicus
gctgacgacaatgctcaacagtcaa

SEQ ID NO: 406912 - DNA, 25 bp, Rattus norvegicus
gctgacgactatataccaatgcttt

SEQ ID NO: 406913 - DNA, 25 bp, Rattus norvegicus
gctgacgactatttaccaatgcttt

SEQ ID NO: 406914 - DNA, 25 bp, Rattus norvegicus
gctgacgactccagcgagagcaccg

SEQ ID NO: 406915 - DNA, 25 bp, Rattus norvegicus
gctgacgactcctgcgagagcaccg

SEQ ID NO: 406916 - DNA, 25 bp, Rattus norvegicus
gctgacgcgtctcaactggaactgt

SEQ ID NO: 406917 - DNA, 25 bp, Rattus norvegicus
gctgacgcgtctgaactggaactgt

SEQ ID NO: 406918 - DNA, 25 bp, Rattus norvegicus
gctgacgtactgagctgtttaaaca

SEQ ID NO: 406919 - DNA, 25 bp, Rattus norvegicus
gctgacgtactgtgctgtttaaaca

SEQ ID NO: 406920 - DNA, 25 bp, Rattus norvegicus
gctgacgtattcaagaccgtgctga

SEQ ID NO: 406921 - DNA, 25 bp, Rattus norvegicus
gctgacgtattctagaccgtgctga

SEQ ID NO: 406922 - DNA, 25 bp, Rattus norvegicus
gctgacgtgctgaaactttacataa

SEQ ID NO: 406923 - DNA, 25 bp, Rattus norvegicus
gctgacgtgctgtaactttacataa

SEQ ID NO: 406924 - DNA, 25 bp, Rattus norvegicus
gctgacgtgggacttcattcgtaga

SEQ ID NO: 406925 - DNA, 25 bp, Rattus norvegicus
gctgacgtgggagttcattcgtaga

SEQ ID NO: 406926 - DNA, 25 bp, Rattus norvegicus
gctgactaccgaagagaccctgact

SEQ ID NO: 406927 - DNA, 25 bp, Rattus norvegicus
gctgactaccgatgagaccctgact

SEQ ID NO: 406928 - DNA, 25 bp, Rattus norvegicus
gctgactactcaagcattgcttgaa

SEQ ID NO: 406929 - DNA, 25 bp, Rattus norvegicus
gctgactactcatgcattgcttgaa

SEQ ID NO: 406930 - DNA, 25 bp, Rattus norvegicus
gctgactactgacggacacgtgtgt

SEQ ID NO: 406931 - DNA, 25 bp, Rattus norvegicus
gctgactactgagggacacgtgtgt

SEQ ID NO: 406932 - DNA, 25 bp, Rattus norvegicus
gctgactagagtcaagccctgctca

SEQ ID NO: 406933 - DNA, 25 bp, Rattus norvegicus
gctgactagagtgaagccctgctca

SEQ ID NO: 406934 - DNA, 25 bp, Rattus norvegicus
gctgactcaagtaggagtactcctt

SEQ ID NO: 406935 - DNA, 25 bp, Rattus norvegicus
gctgactcaagttggagtactcctt

SEQ ID NO: 406936 - DNA, 25 bp, Rattus norvegicus
gctgactcacacaactccgagtgtc

SEQ ID NO: 406937 - DNA, 25 bp, Rattus norvegicus
gctgactcacactactccgagtgtc

SEQ ID NO: 406938 - DNA, 25 bp, Rattus norvegicus
gctgactcacccagtgtaatgggct

SEQ ID NO: 406939 - DNA, 25 bp, Rattus norvegicus
gctgactcaccctgtgtaatgggct

SEQ ID NO: 406940 - DNA, 25 bp, Rattus norvegicus
gctgactcagctcaagatgaaccgt

SEQ ID NO: 406941 - DNA, 25 bp, Rattus norvegicus
gctgactcagctgaagatgaaccgt

SEQ ID NO: 406942 - DNA, 25 bp, Rattus norvegicus
gctgactccactccggtttgtgaaa

SEQ ID NO: 406943 - DNA, 25 bp, Rattus norvegicus
gctgactccactgcggtttgtgaaa

SEQ ID NO: 406944 - DNA, 25 bp, Rattus norvegicus
gctgactccctacactggtgagtga

SEQ ID NO: 406945 - DNA, 25 bp, Rattus norvegicus
gctgactccctagactggtgagtga

SEQ ID NO: 406946 - DNA, 25 bp, Rattus norvegicus
gctgactctattaatgttccactac

SEQ ID NO: 406947 - DNA, 25 bp, Rattus norvegicus
gctgactctatttatgttccactac

SEQ ID NO: 406948 - DNA, 25 bp, Rattus norvegicus
gctgactctctaaggactgtgctga

SEQ ID NO: 406949 - DNA, 25 bp, Rattus norvegicus
gctgactctctatggactgtgctga

SEQ ID NO: 406950 - DNA, 25 bp, Rattus norvegicus
gctgactctggcagggtatcatgta

SEQ ID NO: 406951 - DNA, 25 bp, Rattus norvegicus
gctgactctggctgggtatcatgta

SEQ ID NO: 406952 - DNA, 25 bp, Rattus norvegicus
gctgactcttctctgtgtatatgca

SEQ ID NO: 406953 - DNA, 25 bp, Rattus norvegicus
gctgactcttctgtgtgtatatgca

SEQ ID NO: 406954 - DNA, 25 bp, Rattus norvegicus
gctgactcttgtaacccacagaggg

SEQ ID NO: 406955 - DNA, 25 bp, Rattus norvegicus
gctgactcttgttacccacagaggg

SEQ ID NO: 406956 - DNA, 25 bp, Rattus norvegicus
gctgactgaagcagttcttggagat

SEQ ID NO: 406957 - DNA, 25 bp, Rattus norvegicus
gctgactgaagctgttcttggagat

SEQ ID NO: 406958 - DNA, 25 bp, Rattus norvegicus
gctgactgacagatgtttgcttggt

SEQ ID NO: 406959 - DNA, 25 bp, Rattus norvegicus
gctgactgacagttgtttgcttggt

SEQ ID NO: 406960 - DNA, 25 bp, Rattus norvegicus
gctgactgacctccgacccagatga

SEQ ID NO: 406961 - DNA, 25 bp, Rattus norvegicus
gctgactgacctgcgacccagatga

SEQ ID NO: 406962 - DNA, 25 bp, Rattus norvegicus
gctgactgactgaaaacctgactgg

SEQ ID NO: 406963 - DNA, 25 bp, Rattus norvegicus
gctgactgactgtaaacctgactgg

SEQ ID NO: 406964 - DNA, 25 bp, Rattus norvegicus
gctgactgagtgacctaacttcaag

SEQ ID NO: 406965 - DNA, 25 bp, Rattus norvegicus
gctgactgagtgtcctaacttcaag

SEQ ID NO: 406966 - DNA, 25 bp, Rattus norvegicus
gctgactgatggctcctctaggaac

SEQ ID NO: 406967 - DNA, 25 bp, Rattus norvegicus
gctgactgatgggtcctctaggaac

SEQ ID NO: 406968 - DNA, 25 bp, Rattus norvegicus
gctgactgcatcagaggtaatacct

SEQ ID NO: 406969 - DNA, 25 bp, Rattus norvegicus
gctgactgcatctgaggtaatacct

SEQ ID NO: 406970 - DNA, 25 bp, Rattus norvegicus
gctgactgccatcaacagatttgtc

SEQ ID NO: 406971 - DNA, 25 bp, Rattus norvegicus
gctgactgccatgaacagatttgtc

SEQ ID NO: 406972 - DNA, 25 bp, Rattus norvegicus
gctgactgcgtgctacccatcgaca

SEQ ID NO: 406973 - DNA, 25 bp, Rattus norvegicus
gctgactgcgtggtacccatcgaca

SEQ ID NO: 406974 - DNA, 25 bp, Rattus norvegicus
gctgactggaaaaggcttgggtttt

SEQ ID NO: 406975 - DNA, 25 bp, Rattus norvegicus
gctgactggaaatggcttgggtttt

SEQ ID NO: 406976 - DNA, 25 bp, Rattus norvegicus
gctgactgtagcatgtgcctgaagt

SEQ ID NO: 406977 - DNA, 25 bp, Rattus norvegicus
gctgactgtagcttgtgcctgaagt

SEQ ID NO: 406978 - DNA, 25 bp, Rattus norvegicus
gctgactgtgacagactccgtgggt

SEQ ID NO: 406979 - DNA, 25 bp, Rattus norvegicus
gctgactgtgactgactccgtgggt

SEQ ID NO: 406980 - DNA, 25 bp, Rattus norvegicus
gctgacttaaagctgaagcgatcca

SEQ ID NO: 406981 - DNA, 25 bp, Rattus norvegicus
gctgacttaaaggtgaagcgatcca

SEQ ID NO: 406982 - DNA, 25 bp, Rattus norvegicus
gctgacttaactctttacctataaa

SEQ ID NO: 406983 - DNA, 25 bp, Rattus norvegicus
gctgacttaactgtttacctataaa

SEQ ID NO: 406984 - DNA, 25 bp, Rattus norvegicus
gctgacttacatcgcaggtatatgt

SEQ ID NO: 406985 - DNA, 25 bp, Rattus norvegicus
gctgacttacatggcaggtatatgt

SEQ ID NO: 406986 - DNA, 25 bp, Rattus norvegicus
gctgacttactgctctgaagaacaa

SEQ ID NO: 406987 - DNA, 25 bp, Rattus norvegicus
gctgacttactggtctgaagaacaa

SEQ ID NO: 406988 - DNA, 25 bp, Rattus norvegicus
gctgacttcaaacatgtgccttttg

SEQ ID NO: 406989 - DNA, 25 bp, Rattus norvegicus
gctgacttcaaagatgtgccttttg

SEQ ID NO: 406990 - DNA, 25 bp, Rattus norvegicus
gctgacttcagtaacatgcttgttt

SEQ ID NO: 406991 - DNA, 25 bp, Rattus norvegicus
gctgacttcagtaatttatccaaat

SEQ ID NO: 406992 - DNA, 25 bp, Rattus norvegicus
gctgacttcagtatcattgactaga

SEQ ID NO: 406993 - DNA, 25 bp, Rattus norvegicus
gctgacttcagttacatgcttgttt

SEQ ID NO: 406994 - DNA, 25 bp, Rattus norvegicus
gctgacttcagttatttatccaaat

SEQ ID NO: 406995 - DNA, 25 bp, Rattus norvegicus
gctgacttcagtttcattgactaga

SEQ ID NO: 406996 - DNA, 25 bp, Rattus norvegicus
gctgacttccagctctgccttgaaa

SEQ ID NO: 406997 - DNA, 25 bp, Rattus norvegicus
gctgacttccagctggatgatgtca

SEQ ID NO: 406998 - DNA, 25 bp, Rattus norvegicus
gctgacttccaggtctgccttgaaa

SEQ ID NO: 406999 - DNA, 25 bp, Rattus norvegicus
gctgacttccaggtggatgatgtca

SEQ ID NO: 407000 - DNA, 25 bp, Rattus norvegicus
gctgacttcccactgatttgactaa

SEQ ID NO: 407001 - DNA, 25 bp, Rattus norvegicus
gctgacttcccagtgatttgactaa

SEQ ID NO: 407002 - DNA, 25 bp, Rattus norvegicus
gctgacttcctcaagcaaagccgag

SEQ ID NO: 407003 - DNA, 25 bp, Rattus norvegicus
gctgacttcctctagcaaagccgag

SEQ ID NO: 407004 - DNA, 25 bp, Rattus norvegicus
gctgacttcctgcaacttgaaccca

SEQ ID NO: 407005 - DNA, 25 bp, Rattus norvegicus
gctgacttcctggaacttgaaccca

SEQ ID NO: 407006 - DNA, 25 bp, Rattus norvegicus
gctgacttgcccaggacagaatcat

SEQ ID NO: 407007 - DNA, 25 bp, Rattus norvegicus
gctgacttgccctggacagaatcat

SEQ ID NO: 407008 - DNA, 25 bp, Rattus norvegicus
gctgacttgtctactgttatacaaa

SEQ ID NO: 407009 - DNA, 25 bp, Rattus norvegicus
gctgacttgtcttctgttatacaaa

SEQ ID NO: 407010 - DNA, 25 bp, Rattus norvegicus
gctgactttgatctgtgcatgggtt

SEQ ID NO: 407011 - DNA, 25 bp, Rattus norvegicus
gctgactttgatgtgtgcatgggtt

SEQ ID NO: 407012 - DNA, 25 bp, Rattus norvegicus
gctgactttgttaagcattagctgt

SEQ ID NO: 407013 - DNA, 25 bp, Rattus norvegicus
gctgactttgtttagcattagctgt

SEQ ID NO: 407014 - DNA, 25 bp, Rattus norvegicus
gctgacttttgacctttcgttttat

SEQ ID NO: 407015 - DNA, 25 bp, Rattus norvegicus
gctgacttttgagctttcgttttat

SEQ ID NO: 407016 - DNA, 25 bp, Rattus norvegicus
gctgagaacaatcgcctgctattcc

SEQ ID NO: 407017 - DNA, 25 bp, Rattus norvegicus
gctgagaacaatggcctgctattcc

SEQ ID NO: 407018 - DNA, 25 bp, Rattus norvegicus
gctgagaacatcaagcggctcctgt

SEQ ID NO: 407019 - DNA, 25 bp, Rattus norvegicus
gctgagaacatctagcggctcctgt

SEQ ID NO: 407020 - DNA, 25 bp, Rattus norvegicus
gctgagaaccatcattctcggctca

SEQ ID NO: 407021 - DNA, 25 bp, Rattus norvegicus
gctgagaaccatgattctcggctca

SEQ ID NO: 407022 - DNA, 25 bp, Rattus norvegicus
gctgagaactaaaggtgcctcccac

SEQ ID NO: 407023 - DNA, 25 bp, Rattus norvegicus
gctgagaactaatggtgcctcccac

SEQ ID NO: 407024 - DNA, 25 bp, Rattus norvegicus
gctgagaagaacacactgccttcat

SEQ ID NO: 407025 - DNA, 25 bp, Rattus norvegicus
gctgagaagaactcactgccttcat

SEQ ID NO: 407026 - DNA, 25 bp, Rattus norvegicus
gctgagaagactaagccctctgccc

SEQ ID NO: 407027 - DNA, 25 bp, Rattus norvegicus
gctgagaagacttagccctctgccc

SEQ ID NO: 407028 - DNA, 25 bp, Rattus norvegicus
gctgagaagcacagctataagcctg

SEQ ID NO: 407029 - DNA, 25 bp, Rattus norvegicus
gctgagaagcactgctataagcctg

SEQ ID NO: 407030 - DNA, 25 bp, Rattus norvegicus
gctgagaagcagagccctgtccaga

SEQ ID NO: 407031 - DNA, 25 bp, Rattus norvegicus
gctgagaagcagtgccctgtccaga

SEQ ID NO: 407032 - DNA, 25 bp, Rattus norvegicus
gctgagaagctcaacttggcggacc

SEQ ID NO: 407033 - DNA, 25 bp, Rattus norvegicus
gctgagaagctctacttggcggacc

SEQ ID NO: 407034 - DNA, 25 bp, Rattus norvegicus
gctgagacaactacattctcctcta

SEQ ID NO: 407035 - DNA, 25 bp, Rattus norvegicus
gctgagacaacttcattctcctcta

SEQ ID NO: 407036 - DNA, 25 bp, Rattus norvegicus
gctgagacacagaggctctgagcac

SEQ ID NO: 407037 - DNA, 25 bp, Rattus norvegicus
gctgagacacagtggctctgagcac

SEQ ID NO: 407038 - DNA, 25 bp, Rattus norvegicus
gctgagacacgaccagagcacatgt

SEQ ID NO: 407039 - DNA, 25 bp, Rattus norvegicus
gctgagacacgagcagagcacatgt

SEQ ID NO: 407040 - DNA, 25 bp, Rattus norvegicus
gctgagacagataccagggcactga

SEQ ID NO: 407041 - DNA, 25 bp, Rattus norvegicus
gctgagacagattccagggcactga

SEQ ID NO: 407042 - DNA, 25 bp, Rattus norvegicus
gctgagacatctactgagtcttcca

SEQ ID NO: 407043 - DNA, 25 bp, Rattus norvegicus
gctgagacatcttctgagtcttcca

SEQ ID NO: 407044 - DNA, 25 bp, Rattus norvegicus
gctgagacccagatctggtgttgtt

SEQ ID NO: 407045 - DNA, 25 bp, Rattus norvegicus
gctgagacccagttctggtgttgtt

SEQ ID NO: 407046 - DNA, 25 bp, Rattus norvegicus
gctgagactcataccttggtgaagg

SEQ ID NO: 407047 - DNA, 25 bp, Rattus norvegicus
gctgagactcattccttggtgaagg

SEQ ID NO: 407048 - DNA, 25 bp, Rattus norvegicus
gctgagactctgactggtttcttga

SEQ ID NO: 407049 - DNA, 25 bp, Rattus norvegicus
gctgagactctgtctggtttcttga

SEQ ID NO: 407050 - DNA, 25 bp, Rattus norvegicus
gctgagagaacactcttcttgctgg

SEQ ID NO: 407051 - DNA, 25 bp, Rattus norvegicus
gctgagagaacagtcttcttgctgg

SEQ ID NO: 407052 - DNA, 25 bp, Rattus norvegicus
gctgagagagctccgtaaccatcct

SEQ ID NO: 407053 - DNA, 25 bp, Rattus norvegicus
gctgagagagctgcgtaaccatcct

SEQ ID NO: 407054 - DNA, 25 bp, Rattus norvegicus
gctgagagtcccacacgaagtgaaa

SEQ ID NO: 407055 - DNA, 25 bp, Rattus norvegicus
gctgagagtccctcacgaagtgaaa

SEQ ID NO: 407056 - DNA, 25 bp, Rattus norvegicus
gctgagatcattcattgccctagtc

SEQ ID NO: 407057 - DNA, 25 bp, Rattus norvegicus
gctgagatcattgattgccctagtc

SEQ ID NO: 407058 - DNA, 25 bp, Rattus norvegicus
gctgagatgcccaggatggctcgcc

SEQ ID NO: 407059 - DNA, 25 bp, Rattus norvegicus
gctgagatgccctggatggctcgcc

SEQ ID NO: 407060 - DNA, 25 bp, Rattus norvegicus
gctgagatgcgtaactgctttgaaa

SEQ ID NO: 407061 - DNA, 25 bp, Rattus norvegicus
gctgagatgcgttactgctttgaaa

SEQ ID NO: 407062 - DNA, 25 bp, Rattus norvegicus
gctgagattatccttcatgaaccat

SEQ ID NO: 407063 - DNA, 25 bp, Rattus norvegicus
gctgagattatcgttcatgaaccat

SEQ ID NO: 407064 - DNA, 25 bp, Rattus norvegicus
gctgagcacaggattcttatcattt

SEQ ID NO: 407065 - DNA, 25 bp, Rattus norvegicus
gctgagcacaggtttcttatcattt

SEQ ID NO: 407066 - DNA, 25 bp, Rattus norvegicus
gctgagcactcccaccaagaagaat

SEQ ID NO: 407067 - DNA, 25 bp, Rattus norvegicus
gctgagcactccgaccaagaagaat

SEQ ID NO: 407068 - DNA, 25 bp, Rattus norvegicus
gctgagcagcagagtccaataacgt

SEQ ID NO: 407069 - DNA, 25 bp, Rattus norvegicus
gctgagcagcagcatggcctgataa

SEQ ID NO: 407070 - DNA, 25 bp, Rattus norvegicus
gctgagcagcaggatggcctgataa

SEQ ID NO: 407071 - DNA, 25 bp, Rattus norvegicus
gctgagcagcagtgtccaataacgt

SEQ ID NO: 407072 - DNA, 25 bp, Rattus norvegicus
gctgagcagcgaccagacagtgaat

SEQ ID NO: 407073 - DNA, 25 bp, Rattus norvegicus
gctgagcagcgagcagacagtgaat

SEQ ID NO: 407074 - DNA, 25 bp, Rattus norvegicus
gctgagcagctcctataggcctaaa

SEQ ID NO: 407075 - DNA, 25 bp, Rattus norvegicus
gctgagcagctcgtataggcctaaa

SEQ ID NO: 407076 - DNA, 25 bp, Rattus norvegicus
gctgagcagctgcttatccaagagt

SEQ ID NO: 407077 - DNA, 25 bp, Rattus norvegicus
gctgagcagctggttatccaagagt

SEQ ID NO: 407078 - DNA, 25 bp, Rattus norvegicus
gctgagcagtacagctgcagcacga

SEQ ID NO: 407079 - DNA, 25 bp, Rattus norvegicus
gctgagcagtactgctgcagcacga

SEQ ID NO: 407080 - DNA, 25 bp, Rattus norvegicus
gctgagcatcctccaccgataaggc

SEQ ID NO: 407081 - DNA, 25 bp, Rattus norvegicus
gctgagcatcctgcaccgataaggc

SEQ ID NO: 407082 - DNA, 25 bp, Rattus norvegicus
gctgagcatgatacatcatacctgt

SEQ ID NO: 407083 - DNA, 25 bp, Rattus norvegicus
gctgagcatgattcatcatacctgt

SEQ ID NO: 407084 - DNA, 25 bp, Rattus norvegicus
gctgagcattcccaagatggcacta

SEQ ID NO: 407085 - DNA, 25 bp, Rattus norvegicus
gctgagcattccgaagatggcacta

SEQ ID NO: 407086 - DNA, 25 bp, Rattus norvegicus
gctgagcatttaattggtgcccgtt

SEQ ID NO: 407087 - DNA, 25 bp, Rattus norvegicus
gctgagcatttatttggtgcccgtt

SEQ ID NO: 407088 - DNA, 25 bp, Rattus norvegicus
gctgagccaactctaatttctagtt

SEQ ID NO: 407089 - DNA, 25 bp, Rattus norvegicus
gctgagccaactgtaatttctagtt

SEQ ID NO: 407090 - DNA, 25 bp, Rattus norvegicus
gctgagccacgtataataaaccagt

SEQ ID NO: 407091 - DNA, 25 bp, Rattus norvegicus
gctgagccacgtttaataaaccagt

SEQ ID NO: 407092 - DNA, 25 bp, Rattus norvegicus
gctgagccagcaagggctgcctaat

SEQ ID NO: 407093 - DNA, 25 bp, Rattus norvegicus
gctgagccagcatgggctgcctaat

SEQ ID NO: 407094 - DNA, 25 bp, Rattus norvegicus
gctgagccaggaaaaagcttttctt

SEQ ID NO: 407095 - DNA, 25 bp, Rattus norvegicus
gctgagccaggataaagcttttctt

SEQ ID NO: 407096 - DNA, 25 bp, Rattus norvegicus
gctgagccatctattaagtccatta

SEQ ID NO: 407097 - DNA, 25 bp, Rattus norvegicus
gctgagccatcttttaagtccatta

SEQ ID NO: 407098 - DNA, 25 bp, Rattus norvegicus
gctgagccccatctcaagttgttaa

SEQ ID NO: 407099 - DNA, 25 bp, Rattus norvegicus
gctgagccccatgtcaagttgttaa

SEQ ID NO: 407100 - DNA, 25 bp, Rattus norvegicus
gctgagccgagacctgaatctgcaa

SEQ ID NO: 407101 - DNA, 25 bp, Rattus norvegicus
gctgagccgagagctgaatctgcaa

SEQ ID NO: 407102 - DNA, 25 bp, Rattus norvegicus
gctgagccttgaacccgtggagaac

SEQ ID NO: 407103 - DNA, 25 bp, Rattus norvegicus
gctgagccttgatcccgtggagaac

SEQ ID NO: 407104 - DNA, 25 bp, Rattus norvegicus
gctgagcgcaaaccccagaaagaaa

SEQ ID NO: 407105 - DNA, 25 bp, Rattus norvegicus
gctgagcgcaaagcccagaaagaaa

SEQ ID NO: 407106 - DNA, 25 bp, Rattus norvegicus
gctgagcgctctattttgtgattgt

SEQ ID NO: 407107 - DNA, 25 bp, Rattus norvegicus
gctgagcgctcttttttgtgattgt

SEQ ID NO: 407108 - DNA, 25 bp, Rattus norvegicus
gctgagctagagcaacccgcagact

SEQ ID NO: 407109 - DNA, 25 bp, Rattus norvegicus
gctgagctagaggaacccgcagact

SEQ ID NO: 407110 - DNA, 25 bp, Rattus norvegicus
gctgagctatatagccaactccttt

SEQ ID NO: 407111 - DNA, 25 bp, Rattus norvegicus
gctgagctatattgccaactccttt

SEQ ID NO: 407112 - DNA, 25 bp, Rattus norvegicus
gctgagctatcacgagtgctccgtt

SEQ ID NO: 407113 - DNA, 25 bp, Rattus norvegicus
gctgagctatcaggagtgctccgtt

SEQ ID NO: 407114 - DNA, 25 bp, Rattus norvegicus
gctgagctatctctgtttttccaat

SEQ ID NO: 407115 - DNA, 25 bp, Rattus norvegicus
gctgagctatctgtgtttttccaat

SEQ ID NO: 407116 - DNA, 25 bp, Rattus norvegicus
gctgagctccctccaagttgtggca

SEQ ID NO: 407117 - DNA, 25 bp, Rattus norvegicus
gctgagctccctgcaagttgtggca

SEQ ID NO: 407118 - DNA, 25 bp, Rattus norvegicus
gctgagctctacctgttccggaaca

SEQ ID NO: 407119 - DNA, 25 bp, Rattus norvegicus
gctgagctctacgtgttccggaaca

SEQ ID NO: 407120 - DNA, 25 bp, Rattus norvegicus
gctgagctctagacaggaccacaga

SEQ ID NO: 407121 - DNA, 25 bp, Rattus norvegicus
gctgagctctagtcaggaccacaga

SEQ ID NO: 407122 - DNA, 25 bp, Rattus norvegicus
gctgagctctgtaaagcccttgaga

SEQ ID NO: 407123 - DNA, 25 bp, Rattus norvegicus
gctgagctctgttaagcccttgaga

SEQ ID NO: 407124 - DNA, 25 bp, Rattus norvegicus
gctgagctgcagatgtctttgtttc

SEQ ID NO: 407125 - DNA, 25 bp, Rattus norvegicus
gctgagctgcagttgtctttgtttc

SEQ ID NO: 407126 - DNA, 25 bp, Rattus norvegicus
gctgagcttagaccaagcttggctc

SEQ ID NO: 407127 - DNA, 25 bp, Rattus norvegicus
gctgagcttagagcaagcttggctc

SEQ ID NO: 407128 - DNA, 25 bp, Rattus norvegicus
gctgagcttctcattgaactctaaa

SEQ ID NO: 407129 - DNA, 25 bp, Rattus norvegicus
gctgagcttctctttgaactctaaa

SEQ ID NO: 407130 - DNA, 25 bp, Rattus norvegicus
gctgagcttttgatagagtaactta

SEQ ID NO: 407131 - DNA, 25 bp, Rattus norvegicus
gctgagcttttgttagagtaactta

SEQ ID NO: 407132 - DNA, 25 bp, Rattus norvegicus
gctgaggaaagccatcattttcttt

SEQ ID NO: 407133 - DNA, 25 bp, Rattus norvegicus
gctgaggaaagcgatcattttcttt

SEQ ID NO: 407134 - DNA, 25 bp, Rattus norvegicus
gctgaggacatgatcggtctgcccc

SEQ ID NO: 407135 - DNA, 25 bp, Rattus norvegicus
gctgaggacatgttcggtctgcccc

SEQ ID NO: 407136 - DNA, 25 bp, Rattus norvegicus
gctgaggacattattgtgactgggt

SEQ ID NO: 407137 - DNA, 25 bp, Rattus norvegicus
gctgaggacatttttgtgactgggt

SEQ ID NO: 407138 - DNA, 25 bp, Rattus norvegicus
gctgaggaccaaaaccaaggtgctt

SEQ ID NO: 407139 - DNA, 25 bp, Rattus norvegicus
gctgaggaccaataccaaggtgctt

SEQ ID NO: 407140 - DNA, 25 bp, Rattus norvegicus
gctgaggaccgcaggccgtcaatga

SEQ ID NO: 407141 - DNA, 25 bp, Rattus norvegicus
gctgaggaccgctggccgtcaatga

SEQ ID NO: 407142 - DNA, 25 bp, Rattus norvegicus
gctgaggatcgcatgcattgccacc

SEQ ID NO: 407143 - DNA, 25 bp, Rattus norvegicus
gctgaggatcgcttgcattgccacc

SEQ ID NO: 407144 - DNA, 25 bp, Rattus norvegicus
gctgaggatgccaaggacttcttca

SEQ ID NO: 407145 - DNA, 25 bp, Rattus norvegicus
gctgaggatgcctaggacttcttca

SEQ ID NO: 407146 - DNA, 25 bp, Rattus norvegicus
gctgaggcagacagcccttgatgag

SEQ ID NO: 407147 - DNA, 25 bp, Rattus norvegicus
gctgaggcagactgcccttgatgag

SEQ ID NO: 407148 - DNA, 25 bp, Rattus norvegicus
gctgaggcaggcaagaccctgtcta

SEQ ID NO: 407149 - DNA, 25 bp, Rattus norvegicus
gctgaggcaggctagaccctgtcta

SEQ ID NO: 407150 - DNA, 25 bp, Rattus norvegicus
gctgaggccaaacaggaacacggat

SEQ ID NO: 407151 - DNA, 25 bp, Rattus norvegicus
gctgaggccaaagaggaacacggat

SEQ ID NO: 407152 - DNA, 25 bp, Rattus norvegicus
gctgaggccagcataccaggcaagt

SEQ ID NO: 407153 - DNA, 25 bp, Rattus norvegicus
gctgaggccagcttaccaggcaagt

SEQ ID NO: 407154 - DNA, 25 bp, Rattus norvegicus
gctgaggccatgctatatccggtca

SEQ ID NO: 407155 - DNA, 25 bp, Rattus norvegicus
gctgaggccatggtatatccggtca

SEQ ID NO: 407156 - DNA, 25 bp, Rattus norvegicus
gctgaggcccaaagactccgaagaa

SEQ ID NO: 407157 - DNA, 25 bp, Rattus norvegicus
gctgaggcccaatgactccgaagaa

SEQ ID NO: 407158 - DNA, 25 bp, Rattus norvegicus
gctgaggctaacagctgttttatta

SEQ ID NO: 407159 - DNA, 25 bp, Rattus norvegicus
gctgaggctaactgctgttttatta

SEQ ID NO: 407160 - DNA, 25 bp, Rattus norvegicus
gctgaggctcagatggtcttggcat

SEQ ID NO: 407161 - DNA, 25 bp, Rattus norvegicus
gctgaggctcagttggtcttggcat

SEQ ID NO: 407162 - DNA, 25 bp, Rattus norvegicus
gctgaggctcatccagggacactgc

SEQ ID NO: 407163 - DNA, 25 bp, Rattus norvegicus
gctgaggctcatgcagggacactgc

SEQ ID NO: 407164 - DNA, 25 bp, Rattus norvegicus
gctgaggctgaacgactggactcca

SEQ ID NO: 407165 - DNA, 25 bp, Rattus norvegicus
gctgaggctgaaggactggactcca

SEQ ID NO: 407166 - DNA, 25 bp, Rattus norvegicus
gctgaggctgaccagtactgccaaa

SEQ ID NO: 407167 - DNA, 25 bp, Rattus norvegicus
gctgaggctgacgagtactgccaaa

SEQ ID NO: 407168 - DNA, 25 bp, Rattus norvegicus
gctgaggctgcgagttcccttttta

SEQ ID NO: 407169 - DNA, 25 bp, Rattus norvegicus
gctgaggctgcgtgttcccttttta

SEQ ID NO: 407170 - DNA, 25 bp, Rattus norvegicus
gctgaggcttgacacctgcattcgg

SEQ ID NO: 407171 - DNA, 25 bp, Rattus norvegicus
gctgaggcttgagacctgcattcgg

SEQ ID NO: 407172 - DNA, 25 bp, Rattus norvegicus
gctgagggcgtaataattctatctt

SEQ ID NO: 407173 - DNA, 25 bp, Rattus norvegicus
gctgagggcgtattaattctatctt

SEQ ID NO: 407174 - DNA, 25 bp, Rattus norvegicus
gctgagggctacagagcactgccat

SEQ ID NO: 407175 - DNA, 25 bp, Rattus norvegicus
gctgagggctactgagcactgccat

SEQ ID NO: 407176 - DNA, 25 bp, Rattus norvegicus
gctgagggctctagcttggacagcc

SEQ ID NO: 407177 - DNA, 25 bp, Rattus norvegicus
gctgagggctcttgcttggacagcc

SEQ ID NO: 407178 - DNA, 25 bp, Rattus norvegicus
gctgagggtaagaggctctgtagca

SEQ ID NO: 407179 - DNA, 25 bp, Rattus norvegicus
gctgagggtaagtggctctgtagca

SEQ ID NO: 407180 - DNA, 25 bp, Rattus norvegicus
gctgagggttcactgccaggcttca

SEQ ID NO: 407181 - DNA, 25 bp, Rattus norvegicus
gctgagggttcagtgccaggcttca

SEQ ID NO: 407182 - DNA, 25 bp, Rattus norvegicus
gctgaggtattcatgcaatctgtgt

SEQ ID NO: 407183 - DNA, 25 bp, Rattus norvegicus
gctgaggtattcttgcaatctgtgt

SEQ ID NO: 407184 - DNA, 25 bp, Rattus norvegicus
gctgaggtccagactcacagactca

SEQ ID NO: 407185 - DNA, 25 bp, Rattus norvegicus
gctgaggtccagtctcacagactca

SEQ ID NO: 407186 - DNA, 25 bp, Rattus norvegicus
gctgaggtgagtactaggccactga

SEQ ID NO: 407187 - DNA, 25 bp, Rattus norvegicus
gctgaggtgagttctaggccactga

SEQ ID NO: 407188 - DNA, 25 bp, Rattus norvegicus
gctgaggtgcagctaatccacttca

SEQ ID NO: 407189 - DNA, 25 bp, Rattus norvegicus
gctgaggtgcaggtaatccacttca

SEQ ID NO: 407190 - DNA, 25 bp, Rattus norvegicus
gctgaggtggctatgtgtgctcatc

SEQ ID NO: 407191 - DNA, 25 bp, Rattus norvegicus
gctgaggtggctttgtgtgctcatc

SEQ ID NO: 407192 - DNA, 25 bp, Rattus norvegicus
gctgaggttcctacacgttttaaat

SEQ ID NO: 407193 - DNA, 25 bp, Rattus norvegicus
gctgaggttccttcacgttttaaat

SEQ ID NO: 407194 - DNA, 25 bp, Rattus norvegicus
gctgagtacggtccccaggaactgc

SEQ ID NO: 407195 - DNA, 25 bp, Rattus norvegicus
gctgagtacggtgcccaggaactgc

SEQ ID NO: 407196 - DNA, 25 bp, Rattus norvegicus
gctgagtatctgatcactttgcgat

SEQ ID NO: 407197 - DNA, 25 bp, Rattus norvegicus
gctgagtatctgttcactttgcgat

SEQ ID NO: 407198 - DNA, 25 bp, Rattus norvegicus
gctgagtatgctctggctaacgaca

SEQ ID NO: 407199 - DNA, 25 bp, Rattus norvegicus
gctgagtatgctgtggctaacgaca

SEQ ID NO: 407200 - DNA, 25 bp, Rattus norvegicus
gctgagtatggtcgaatataccttt

SEQ ID NO: 407201 - DNA, 25 bp, Rattus norvegicus
gctgagtatggtggaatataccttt

SEQ ID NO: 407202 - DNA, 25 bp, Rattus norvegicus
gctgagtcagaacgcacaaaagtgt

SEQ ID NO: 407203 - DNA, 25 bp, Rattus norvegicus
gctgagtcagaaggcacaaaagtgt

SEQ ID NO: 407204 - DNA, 25 bp, Rattus norvegicus
gctgagtcccgacggcgcgctgcaa

SEQ ID NO: 407205 - DNA, 25 bp, Rattus norvegicus
gctgagtcccgagggcgcgctgcaa

SEQ ID NO: 407206 - DNA, 25 bp, Rattus norvegicus
gctgagtctacaacttctcctaaga

SEQ ID NO: 407207 - DNA, 25 bp, Rattus norvegicus
gctgagtctacatcttctcctaaga

SEQ ID NO: 407208 - DNA, 25 bp, Rattus norvegicus
gctgagtctatacttctgtccggga

SEQ ID NO: 407209 - DNA, 25 bp, Rattus norvegicus
gctgagtctatagttctgtccggga

SEQ ID NO: 407210 - DNA, 25 bp, Rattus norvegicus
gctgagtctcagctttaactacatg

SEQ ID NO: 407211 - DNA, 25 bp, Rattus norvegicus
gctgagtctcaggtttaactacatg

SEQ ID NO: 407212 - DNA, 25 bp, Rattus norvegicus
gctgagtgaacaatggccatggaaa

SEQ ID NO: 407213 - DNA, 25 bp, Rattus norvegicus
gctgagtgaacattggccatggaaa

SEQ ID NO: 407214 - DNA, 25 bp, Rattus norvegicus
gctgagtgaggcactcattcttttt

SEQ ID NO: 407215 - DNA, 25 bp, Rattus norvegicus
gctgagtgaggctctcattcttttt

SEQ ID NO: 407216 - DNA, 25 bp, Rattus norvegicus
gctgagtgataactgtgtctgccta

SEQ ID NO: 407217 - DNA, 25 bp, Rattus norvegicus
gctgagtgataagtgtgtctgccta

SEQ ID NO: 407218 - DNA, 25 bp, Rattus norvegicus
gctgagtgcctaaagctcactgtgc

SEQ ID NO: 407219 - DNA, 25 bp, Rattus norvegicus
gctgagtgcctatagctcactgtgc

SEQ ID NO: 407220 - DNA, 25 bp, Rattus norvegicus
gctgagtgcctcagatcagacagct

SEQ ID NO: 407221 - DNA, 25 bp, Rattus norvegicus
gctgagtgcctctgatcagacagct

SEQ ID NO: 407222 - DNA, 25 bp, Rattus norvegicus
gctgagtgggttagcaagtttgtaa

SEQ ID NO: 407223 - DNA, 25 bp, Rattus norvegicus
gctgagtgggtttgcaagtttgtaa

SEQ ID NO: 407224 - DNA, 25 bp, Rattus norvegicus
gctgagtggtttaaaaatgcatccc

SEQ ID NO: 407225 - DNA, 25 bp, Rattus norvegicus
gctgagtggttttaaaatgcatccc

SEQ ID NO: 407226 - DNA, 25 bp, Rattus norvegicus
gctgagtgtcgcagaccgagagtat

SEQ ID NO: 407227 - DNA, 25 bp, Rattus norvegicus
gctgagtgtcgctgaccgagagtat

SEQ ID NO: 407228 - DNA, 25 bp, Rattus norvegicus
gctgagtgtctactttgcttgaaat

SEQ ID NO: 407229 - DNA, 25 bp, Rattus norvegicus
gctgagtgtctagtttgcttgaaat

SEQ ID NO: 407230 - DNA, 25 bp, Rattus norvegicus
gctgagttatcactgcctaagggca

SEQ ID NO: 407231 - DNA, 25 bp, Rattus norvegicus
gctgagttatcagtgcctaagggca

SEQ ID NO: 407232 - DNA, 25 bp, Rattus norvegicus
gctgagttcccacaaactgaatctt

SEQ ID NO: 407233 - DNA, 25 bp, Rattus norvegicus
gctgagttcccagaaactgaatctt

SEQ ID NO: 407234 - DNA, 25 bp, Rattus norvegicus
gctgagttctgcaatgctgggatac

SEQ ID NO: 407235 - DNA, 25 bp, Rattus norvegicus
gctgagttctgctatgctgggatac

SEQ ID NO: 407236 - DNA, 25 bp, Rattus norvegicus
gctgagttgcggagtctctgtagaa

SEQ ID NO: 407237 - DNA, 25 bp, Rattus norvegicus
gctgagttgcggtgtctctgtagaa

SEQ ID NO: 407238 - DNA, 25 bp, Rattus norvegicus
gctgagttgtgaatggtgtttgcaa

SEQ ID NO: 407239 - DNA, 25 bp, Rattus norvegicus
gctgagttgtgattggtgtttgcaa

SEQ ID NO: 407240 - DNA, 25 bp, Rattus norvegicus
gctgagtttaacatttattacctat

SEQ ID NO: 407241 - DNA, 25 bp, Rattus norvegicus
gctgagtttaacttttattacctat

SEQ ID NO: 407242 - DNA, 25 bp, Rattus norvegicus
gctgagtttagcatctggacccgag

SEQ ID NO: 407243 - DNA, 25 bp, Rattus norvegicus
gctgagtttagcttctggacccgag

SEQ ID NO: 407244 - DNA, 25 bp, Rattus norvegicus
gctgagtttcacagcccaaggtcaa

SEQ ID NO: 407245 - DNA, 25 bp, Rattus norvegicus
gctgagtttcactgcccaaggtcaa

SEQ ID NO: 407246 - DNA, 25 bp, Rattus norvegicus
gctgagtttcagctgctctatcgaa

SEQ ID NO: 407247 - DNA, 25 bp, Rattus norvegicus
gctgagtttcaggtgctctatcgaa

SEQ ID NO: 407248 - DNA, 25 bp, Rattus norvegicus
gctgagttttctcccttgggacaga

SEQ ID NO: 407249 - DNA, 25 bp, Rattus norvegicus
gctgagttttctgccttgggacaga

SEQ ID NO: 407250 - DNA, 25 bp, Rattus norvegicus
gctgatacccgaagagccaggcatc

SEQ ID NO: 407251 - DNA, 25 bp, Rattus norvegicus
gctgatacccgatgagccaggcatc

SEQ ID NO: 407252 - DNA, 25 bp, Rattus norvegicus
gctgatactgctcattattgtgtgt

SEQ ID NO: 407253 - DNA, 25 bp, Rattus norvegicus
gctgatactgctgattattgtgtgt

SEQ ID NO: 407254 - DNA, 25 bp, Rattus norvegicus
gctgatacttcacctagggaacctg

SEQ ID NO: 407255 - DNA, 25 bp, Rattus norvegicus
gctgatacttcagctagggaacctg

SEQ ID NO: 407256 - DNA, 25 bp, Rattus norvegicus
gctgataggcttaatatatgtacca

SEQ ID NO: 407257 - DNA, 25 bp, Rattus norvegicus
gctgataggctttatatatgtacca

SEQ ID NO: 407258 - DNA, 25 bp, Rattus norvegicus
gctgatagtctcatactgtgtcgat

SEQ ID NO: 407259 - DNA, 25 bp, Rattus norvegicus
gctgatagtctcttactgtgtcgat

SEQ ID NO: 407260 - DNA, 25 bp, Rattus norvegicus
gctgatatatgccatcacatccctt

SEQ ID NO: 407261 - DNA, 25 bp, Rattus norvegicus
gctgatatatgcgatcacatccctt

SEQ ID NO: 407262 - DNA, 25 bp, Rattus norvegicus
gctgatatccacatcagtgacctga

SEQ ID NO: 407263 - DNA, 25 bp, Rattus norvegicus
gctgatatccacttcagtgacctga

SEQ ID NO: 407264 - DNA, 25 bp, Rattus norvegicus
gctgatatctccatttgcttaacaa

SEQ ID NO: 407265 - DNA, 25 bp, Rattus norvegicus
gctgatatctccttttgcttaacaa

SEQ ID NO: 407266 - DNA, 25 bp, Rattus norvegicus
gctgatatttatcttgcaaacatca

SEQ ID NO: 407267 - DNA, 25 bp, Rattus norvegicus
gctgatatttatgttgcaaacatca

SEQ ID NO: 407268 - DNA, 25 bp, Rattus norvegicus
gctgatcagtaaaggccacttgcca

SEQ ID NO: 407269 - DNA, 25 bp, Rattus norvegicus
gctgatcagtaatggccacttgcca

SEQ ID NO: 407270 - DNA, 25 bp, Rattus norvegicus
gctgatcagttacacaggcttgcat

SEQ ID NO: 407271 - DNA, 25 bp, Rattus norvegicus
gctgatcagttagacaggcttgcat

SEQ ID NO: 407272 - DNA, 25 bp, Rattus norvegicus
gctgatcataacatcatttctcccc

SEQ ID NO: 407273 - DNA, 25 bp, Rattus norvegicus
gctgatcataacttcatttctcccc

SEQ ID NO: 407274 - DNA, 25 bp, Rattus norvegicus
gctgatcatggtccatttgagtgaa

SEQ ID NO: 407275 - DNA, 25 bp, Rattus norvegicus
gctgatcatggtgcatttgagtgaa

SEQ ID NO: 407276 - DNA, 25 bp, Rattus norvegicus
gctgatccaagacgaatgtgtgtca

SEQ ID NO: 407277 - DNA, 25 bp, Rattus norvegicus
gctgatccaagaggaatgtgtgtca

SEQ ID NO: 407278 - DNA, 25 bp, Rattus norvegicus
gctgatccacctatacaattactat

SEQ ID NO: 407279 - DNA, 25 bp, Rattus norvegicus
gctgatccacctttacaattactat

SEQ ID NO: 407280 - DNA, 25 bp, Rattus norvegicus
gctgatccagagagagcatccgtga

SEQ ID NO: 407281 - DNA, 25 bp, Rattus norvegicus
gctgatccagagtgagcatccgtga

SEQ ID NO: 407282 - DNA, 25 bp, Rattus norvegicus
gctgatccagctcaaaggcttggct

SEQ ID NO: 407283 - DNA, 25 bp, Rattus norvegicus
gctgatccagctgaaaggcttggct

SEQ ID NO: 407284 - DNA, 25 bp, Rattus norvegicus
gctgatccgctgaatcgtggagtat

SEQ ID NO: 407285 - DNA, 25 bp, Rattus norvegicus
gctgatccgctgtatcgtggagtat

SEQ ID NO: 407286 - DNA, 25 bp, Rattus norvegicus
gctgatcctgagaaagtagttccta

SEQ ID NO: 407287 - DNA, 25 bp, Rattus norvegicus
gctgatcctgagtaagtagttccta

SEQ ID NO: 407288 - DNA, 25 bp, Rattus norvegicus
gctgatcctgatccatggccagtaa

SEQ ID NO: 407289 - DNA, 25 bp, Rattus norvegicus
gctgatcctgatgcatggccagtaa

SEQ ID NO: 407290 - DNA, 25 bp, Rattus norvegicus
gctgatcgctcacccaagcaagtaa

SEQ ID NO: 407291 - DNA, 25 bp, Rattus norvegicus
gctgatcgctcagccaagcaagtaa

SEQ ID NO: 407292 - DNA, 25 bp, Rattus norvegicus
gctgatcggaacagtatgtggtcaa

SEQ ID NO: 407293 - DNA, 25 bp, Rattus norvegicus
gctgatcggaactgtatgtggtcaa

SEQ ID NO: 407294 - DNA, 25 bp, Rattus norvegicus
gctgatcggagcactttattcttaa

SEQ ID NO: 407295 - DNA, 25 bp, Rattus norvegicus
gctgatcggagctctttattcttaa

SEQ ID NO: 407296 - DNA, 25 bp, Rattus norvegicus
gctgatctaccaaggccgaaaacct

SEQ ID NO: 407297 - DNA, 25 bp, Rattus norvegicus
gctgatctaccatggccgaaaacct

SEQ ID NO: 407298 - DNA, 25 bp, Rattus norvegicus
gctgatctcagcagtatttgtgtta

SEQ ID NO: 407299 - DNA, 25 bp, Rattus norvegicus
gctgatctcagctgtatttgtgtta

SEQ ID NO: 407300 - DNA, 25 bp, Rattus norvegicus
gctgatctcgaactgtaccaaaata

SEQ ID NO: 407301 - DNA, 25 bp, Rattus norvegicus
gctgatctcgaagtgtaccaaaata

SEQ ID NO: 407302 - DNA, 25 bp, Rattus norvegicus
gctgatctctgaagttcatgtcatc

SEQ ID NO: 407303 - DNA, 25 bp, Rattus norvegicus
gctgatctctgatgttcatgtcatc

SEQ ID NO: 407304 - DNA, 25 bp, Rattus norvegicus
gctgatctgctgcttgtataatgtc

SEQ ID NO: 407305 - DNA, 25 bp, Rattus norvegicus
gctgatctgctggttgtataatgtc

SEQ ID NO: 407306 - DNA, 25 bp, Rattus norvegicus
gctgatctggagagggctgacttca

SEQ ID NO: 407307 - DNA, 25 bp, Rattus norvegicus
gctgatctggagtgggctgacttca

SEQ ID NO: 407308 - DNA, 25 bp, Rattus norvegicus
gctgatctgtgaaaactttgcattt

SEQ ID NO: 407309 - DNA, 25 bp, Rattus norvegicus
gctgatctgtgataactttgcattt

SEQ ID NO: 407310 - DNA, 25 bp, Rattus norvegicus
gctgatctgttcaggttggaggcac

SEQ ID NO: 407311 - DNA, 25 bp, Rattus norvegicus
gctgatctgttctggttggaggcac

SEQ ID NO: 407312 - DNA, 25 bp, Rattus norvegicus
gctgatcttgcgctccaaaaatggt

SEQ ID NO: 407313 - DNA, 25 bp, Rattus norvegicus
gctgatcttgcggtccaaaaatggt

SEQ ID NO: 407314 - DNA, 25 bp, Rattus norvegicus
gctgatgaactcctgcatatgacga

SEQ ID NO: 407315 - DNA, 25 bp, Rattus norvegicus
gctgatgaactcgtgcatatgacga

SEQ ID NO: 407316 - DNA, 25 bp, Rattus norvegicus
gctgatgaagctatgccctgatttg

SEQ ID NO: 407317 - DNA, 25 bp, Rattus norvegicus
gctgatgaagctttgccctgatttg

SEQ ID NO: 407318 - DNA, 25 bp, Rattus norvegicus
gctgatgacagtagtggcagctcat

SEQ ID NO: 407319 - DNA, 25 bp, Rattus norvegicus
gctgatgacagttgtggcagctcat

SEQ ID NO: 407320 - DNA, 25 bp, Rattus norvegicus
gctgatgagcatcgaccagaggaaa

SEQ ID NO: 407321 - DNA, 25 bp, Rattus norvegicus
gctgatgagcatggaccagaggaaa

SEQ ID NO: 407322 - DNA, 25 bp, Rattus norvegicus
gctgatgaggttccttttgtctttg

SEQ ID NO: 407323 - DNA, 25 bp, Rattus norvegicus
gctgatgaggttgcttttgtctttg

SEQ ID NO: 407324 - DNA, 25 bp, Rattus norvegicus
gctgatgatcttaccatgtccatga

SEQ ID NO: 407325 - DNA, 25 bp, Rattus norvegicus
gctgatgatctttccatgtccatga

SEQ ID NO: 407326 - DNA, 25 bp, Rattus norvegicus
gctgatgatgaaataactgttcccc

SEQ ID NO: 407327 - DNA, 25 bp, Rattus norvegicus
gctgatgatgaattaactgttcccc

SEQ ID NO: 407328 - DNA, 25 bp, Rattus norvegicus
gctgatgcactgataggcgtctacc

SEQ ID NO: 407329 - DNA, 25 bp, Rattus norvegicus
gctgatgcactgttaggcgtctacc

SEQ ID NO: 407330 - DNA, 25 bp, Rattus norvegicus
gctgatgcacttccaagtaggccgt

SEQ ID NO: 407331 - DNA, 25 bp, Rattus norvegicus
gctgatgcacttgcaagtaggccgt

SEQ ID NO: 407332 - DNA, 25 bp, Rattus norvegicus
gctgatgcagctactcgttctcggc

SEQ ID NO: 407333 - DNA, 25 bp, Rattus norvegicus
gctgatgcagcttctcgttctcggc

SEQ ID NO: 407334 - DNA, 25 bp, Rattus norvegicus
gctgatgccaagaagtgtatcctga

SEQ ID NO: 407335 - DNA, 25 bp, Rattus norvegicus
gctgatgccaagtagtgtatcctga

SEQ ID NO: 407336 - DNA, 25 bp, Rattus norvegicus
gctgatgccagtcggcaagcactga

SEQ ID NO: 407337 - DNA, 25 bp, Rattus norvegicus
gctgatgccagtgggcaagcactga

SEQ ID NO: 407338 - DNA, 25 bp, Rattus norvegicus
gctgatgccattcagtttccatttt

SEQ ID NO: 407339 - DNA, 25 bp, Rattus norvegicus
gctgatgccattcctaagagctgga

SEQ ID NO: 407340 - DNA, 25 bp, Rattus norvegicus
gctgatgccattgagtttccatttt

SEQ ID NO: 407341 - DNA, 25 bp, Rattus norvegicus
gctgatgccattgctaagagctgga

SEQ ID NO: 407342 - DNA, 25 bp, Rattus norvegicus
gctgatgcccaaacaaactatgtaa

SEQ ID NO: 407343 - DNA, 25 bp, Rattus norvegicus
gctgatgcccaatcaaactatgtaa

SEQ ID NO: 407344 - DNA, 25 bp, Rattus norvegicus
gctgatgcctccactttacaaagag

SEQ ID NO: 407345 - DNA, 25 bp, Rattus norvegicus
gctgatgcctcctctttacaaagag

SEQ ID NO: 407346 - DNA, 25 bp, Rattus norvegicus
gctgatgcctggaggagtctgtcac

SEQ ID NO: 407347 - DNA, 25 bp, Rattus norvegicus
gctgatgcctggtggagtctgtcac

SEQ ID NO: 407348 - DNA, 25 bp, Rattus norvegicus
gctgatgccttcattggctttggag

SEQ ID NO: 407349 - DNA, 25 bp, Rattus norvegicus
gctgatgccttctttggctttggag

SEQ ID NO: 407350 - DNA, 25 bp, Rattus norvegicus
gctgatgctgcgagaacgctggcat

SEQ ID NO: 407351 - DNA, 25 bp, Rattus norvegicus
gctgatgctgcgtgaacgctggcat

SEQ ID NO: 407352 - DNA, 25 bp, Rattus norvegicus
gctgatgctgggaaatggaatgaat

SEQ ID NO: 407353 - DNA, 25 bp, Rattus norvegicus
gctgatgctgggtaatggaatgaat

SEQ ID NO: 407354 - DNA, 25 bp, Rattus norvegicus
gctgatggaaacagagcctccttta

SEQ ID NO: 407355 - DNA, 25 bp, Rattus norvegicus
gctgatggaaactgagcctccttta

SEQ ID NO: 407356 - DNA, 25 bp, Rattus norvegicus
gctgatggaaccactgactctggaa

SEQ ID NO: 407357 - DNA, 25 bp, Rattus norvegicus
gctgatggaacctctgactctggaa

SEQ ID NO: 407358 - DNA, 25 bp, Rattus norvegicus
gctgatggacatagtggctgccgat

SEQ ID NO: 407359 - DNA, 25 bp, Rattus norvegicus
gctgatggacattgtggctgccgat

SEQ ID NO: 407360 - DNA, 25 bp, Rattus norvegicus
gctgatggatccatctctgatgaga

SEQ ID NO: 407361 - DNA, 25 bp, Rattus norvegicus
gctgatggatccttctctgatgaga

SEQ ID NO: 407362 - DNA, 25 bp, Rattus norvegicus
gctgatggcagcaaggagcactcat

SEQ ID NO: 407363 - DNA, 25 bp, Rattus norvegicus
gctgatggcagctaggagcactcat

SEQ ID NO: 407364 - DNA, 25 bp, Rattus norvegicus
gctgatggctgtaagatcccagtgt

SEQ ID NO: 407365 - DNA, 25 bp, Rattus norvegicus
gctgatggctgttagatcccagtgt

SEQ ID NO: 407366 - DNA, 25 bp, Rattus norvegicus
gctgatgggcaaaagtacctctcat

SEQ ID NO: 407367 - DNA, 25 bp, Rattus norvegicus
gctgatgggcaatagtacctctcat

SEQ ID NO: 407368 - DNA, 25 bp, Rattus norvegicus
gctgatgggcatccctgctggcctt

SEQ ID NO: 407369 - DNA, 25 bp, Rattus norvegicus
gctgatgggcatgcctgctggcctt

SEQ ID NO: 407370 - DNA, 25 bp, Rattus norvegicus
gctgatggtgcaatgacctttcaat

SEQ ID NO: 407371 - DNA, 25 bp, Rattus norvegicus
gctgatggtgcattgacctttcaat

SEQ ID NO: 407372 - DNA, 25 bp, Rattus norvegicus
gctgatggttccagcatcttggaca

SEQ ID NO: 407373 - DNA, 25 bp, Rattus norvegicus
gctgatggttcctgcatcttggaca

SEQ ID NO: 407374 - DNA, 25 bp, Rattus norvegicus
gctgatgtactacacatgggaactt

SEQ ID NO: 407375 - DNA, 25 bp, Rattus norvegicus
gctgatgtactagacatgggaactt

SEQ ID NO: 407376 - DNA, 25 bp, Rattus norvegicus
gctgatgtatacacacgggcaagga

SEQ ID NO: 407377 - DNA, 25 bp, Rattus norvegicus
gctgatgtatactcacgggcaagga

SEQ ID NO: 407378 - DNA, 25 bp, Rattus norvegicus
gctgatgtccatcaaccaattgttg

SEQ ID NO: 407379 - DNA, 25 bp, Rattus norvegicus
gctgatgtccatgaaccaattgttg

SEQ ID NO: 407380 - DNA, 25 bp, Rattus norvegicus
gctgatgtccgaatgatgttttcca

SEQ ID NO: 407381 - DNA, 25 bp, Rattus norvegicus
gctgatgtccgattgatgttttcca

SEQ ID NO: 407382 - DNA, 25 bp, Rattus norvegicus
gctgatgtctatcatcgagacccca

SEQ ID NO: 407383 - DNA, 25 bp, Rattus norvegicus
gctgatgtctatgatcgagacccca

SEQ ID NO: 407384 - DNA, 25 bp, Rattus norvegicus
gctgatgtgcctcccgcttaagaac

SEQ ID NO: 407385 - DNA, 25 bp, Rattus norvegicus
gctgatgtgcctgccgcttaagaac

SEQ ID NO: 407386 - DNA, 25 bp, Rattus norvegicus
gctgatgttaagatgctccctgcaa

SEQ ID NO: 407387 - DNA, 25 bp, Rattus norvegicus
gctgatgttaagttgctccctgcaa

SEQ ID NO: 407388 - DNA, 25 bp, Rattus norvegicus
gctgatgttctcctgactttaaagg

SEQ ID NO: 407389 - DNA, 25 bp, Rattus norvegicus
gctgatgttctcgtgactttaaagg

SEQ ID NO: 407390 - DNA, 25 bp, Rattus norvegicus
gctgatgttcttcctgtgacttgga

SEQ ID NO: 407391 - DNA, 25 bp, Rattus norvegicus
gctgatgttcttgctgtgacttgga

SEQ ID NO: 407392 - DNA, 25 bp, Rattus norvegicus
gctgattaaaatctgcatcgctaat

SEQ ID NO: 407393 - DNA, 25 bp, Rattus norvegicus
gctgattaaaatgtgcatcgctaat

SEQ ID NO: 407394 - DNA, 25 bp, Rattus norvegicus
gctgattaacacaagggctctgtgc

SEQ ID NO: 407395 - DNA, 25 bp, Rattus norvegicus
gctgattaacactagggctctgtgc

SEQ ID NO: 407396 - DNA, 25 bp, Rattus norvegicus
gctgattaataaatgctacctggat

SEQ ID NO: 407397 - DNA, 25 bp, Rattus norvegicus
gctgattaataattgctacctggat

SEQ ID NO: 407398 - DNA, 25 bp, Rattus norvegicus
gctgattaccagcttggccttgtct

SEQ ID NO: 407399 - DNA, 25 bp, Rattus norvegicus
gctgattaccaggttggccttgtct

SEQ ID NO: 407400 - DNA, 25 bp, Rattus norvegicus
gctgattaggtcagaagggctcttc

SEQ ID NO: 407401 - DNA, 25 bp, Rattus norvegicus
gctgattaggtctgaagggctcttc

SEQ ID NO: 407402 - DNA, 25 bp, Rattus norvegicus
gctgattatgctactggaccctgag

SEQ ID NO: 407403 - DNA, 25 bp, Rattus norvegicus
gctgattatgcttctggaccctgag

SEQ ID NO: 407404 - DNA, 25 bp, Rattus norvegicus
gctgattcaaaaagtgccaccaccc

SEQ ID NO: 407405 - DNA, 25 bp, Rattus norvegicus
gctgattcaaaatgtgccaccaccc

SEQ ID NO: 407406 - DNA, 25 bp, Rattus norvegicus
gctgattccagacctcactgttgtg

SEQ ID NO: 407407 - DNA, 25 bp, Rattus norvegicus
gctgattccagagctcactgttgtg

SEQ ID NO: 407408 - DNA, 25 bp, Rattus norvegicus
gctgattcgaaacctctttggtcgg

SEQ ID NO: 407409 - DNA, 25 bp, Rattus norvegicus
gctgattcgaaagctctttggtcgg

SEQ ID NO: 407410 - DNA, 25 bp, Rattus norvegicus
gctgattcgattagaggtgacctga

SEQ ID NO: 407411 - DNA, 25 bp, Rattus norvegicus
gctgattcgatttgaggtgacctga

SEQ ID NO: 407412 - DNA, 25 bp, Rattus norvegicus
gctgattcgttaaaacataccttta

SEQ ID NO: 407413 - DNA, 25 bp, Rattus norvegicus
gctgattcgttataacataccttta

SEQ ID NO: 407414 - DNA, 25 bp, Rattus norvegicus
gctgattctcagagaactcttgttt

SEQ ID NO: 407415 - DNA, 25 bp, Rattus norvegicus
gctgattctcagtgaactcttgttt

SEQ ID NO: 407416 - DNA, 25 bp, Rattus norvegicus
gctgattctgtaccaaactggtctc

SEQ ID NO: 407417 - DNA, 25 bp, Rattus norvegicus
gctgattctgtagcaaactggtctc

SEQ ID NO: 407418 - DNA, 25 bp, Rattus norvegicus
gctgattctgtgagtgggcctgtca

SEQ ID NO: 407419 - DNA, 25 bp, Rattus norvegicus
gctgattctgtgtgtgggcctgtca

SEQ ID NO: 407420 - DNA, 25 bp, Rattus norvegicus
gctgattcttccacacttatttatt

SEQ ID NO: 407421 - DNA, 25 bp, Rattus norvegicus
gctgattcttcctcacttatttatt

SEQ ID NO: 407422 - DNA, 25 bp, Rattus norvegicus
gctgattggctacagtcttcttaag

SEQ ID NO: 407423 - DNA, 25 bp, Rattus norvegicus
gctgattggctagagtcttcttaag

SEQ ID NO: 407424 - DNA, 25 bp, Rattus norvegicus
gctgattggtgtacaaattgcccta

SEQ ID NO: 407425 - DNA, 25 bp, Rattus norvegicus
gctgattggtgttcaaattgcccta

SEQ ID NO: 407426 - DNA, 25 bp, Rattus norvegicus
gctgattggttgctaagccacacta

SEQ ID NO: 407427 - DNA, 25 bp, Rattus norvegicus
gctgattggttggtaagccacacta

SEQ ID NO: 407428 - DNA, 25 bp, Rattus norvegicus
gctgatttcagacggatattcacta

SEQ ID NO: 407429 - DNA, 25 bp, Rattus norvegicus
gctgatttcagagggatattcacta

SEQ ID NO: 407430 - DNA, 25 bp, Rattus norvegicus
gctgatttcagcagggaacttcaca

SEQ ID NO: 407431 - DNA, 25 bp, Rattus norvegicus
gctgatttcagctgggaacttcaca

SEQ ID NO: 407432 - DNA, 25 bp, Rattus norvegicus
gctgatttccagcactattttgtgt

SEQ ID NO: 407433 - DNA, 25 bp, Rattus norvegicus
gctgatttccaggactattttgtgt

SEQ ID NO: 407434 - DNA, 25 bp, Rattus norvegicus
gctgatttctgtctcaggtttgaca

SEQ ID NO: 407435 - DNA, 25 bp, Rattus norvegicus
gctgatttctgtgtcaggtttgaca

SEQ ID NO: 407436 - DNA, 25 bp, Rattus norvegicus
gctgatttgagcatttgttgttgtt

SEQ ID NO: 407437 - DNA, 25 bp, Rattus norvegicus
gctgatttgagcttttgttgttgtt

SEQ ID NO: 407438 - DNA, 25 bp, Rattus norvegicus
gctgattttgacaaagccgctgagg

SEQ ID NO: 407439 - DNA, 25 bp, Rattus norvegicus
gctgattttgacctgttgcctattc

SEQ ID NO: 407440 - DNA, 25 bp, Rattus norvegicus
gctgattttgacgtgttgcctattc

SEQ ID NO: 407441 - DNA, 25 bp, Rattus norvegicus
gctgattttgactaagccgctgagg

SEQ ID NO: 407442 - DNA, 25 bp, Rattus norvegicus
gctgcaaaagccaaagaaactccga

SEQ ID NO: 407443 - DNA, 25 bp, Rattus norvegicus
gctgcaaaagcctaagaaactccga

SEQ ID NO: 407444 - DNA, 25 bp, Rattus norvegicus
gctgcaaacagcctggaattggccc

SEQ ID NO: 407445 - DNA, 25 bp, Rattus norvegicus
gctgcaaacagcgtggaattggccc

SEQ ID NO: 407446 - DNA, 25 bp, Rattus norvegicus
gctgcaaacagtcctttctgtgaaa

SEQ ID NO: 407447 - DNA, 25 bp, Rattus norvegicus
gctgcaaacagtcgagtgtgcctgt

SEQ ID NO: 407448 - DNA, 25 bp, Rattus norvegicus
gctgcaaacagtgctttctgtgaaa

SEQ ID NO: 407449 - DNA, 25 bp, Rattus norvegicus
gctgcaaacagtggagtgtgcctgt

SEQ ID NO: 407450 - DNA, 25 bp, Rattus norvegicus
gctgcaaaccctagctgtgaagggt

SEQ ID NO: 407451 - DNA, 25 bp, Rattus norvegicus
gctgcaaacccttgctgtgaagggt

SEQ ID NO: 407452 - DNA, 25 bp, Rattus norvegicus
gctgcaaaccttacctcttgagata

SEQ ID NO: 407453 - DNA, 25 bp, Rattus norvegicus
gctgcaaacctttcctcttgagata

SEQ ID NO: 407454 - DNA, 25 bp, Rattus norvegicus
gctgcaaaggcaagtaattcattaa

SEQ ID NO: 407455 - DNA, 25 bp, Rattus norvegicus
gctgcaaaggcatgtaattcattaa

SEQ ID NO: 407456 - DNA, 25 bp, Rattus norvegicus
gctgcaactgggaggactgtaactt

SEQ ID NO: 407457 - DNA, 25 bp, Rattus norvegicus
gctgcaactgggtggactgtaactt

SEQ ID NO: 407458 - DNA, 25 bp, Rattus norvegicus
gctgcaagcactcatggacattctg

SEQ ID NO: 407459 - DNA, 25 bp, Rattus norvegicus
gctgcaagcactgatggacattctg

SEQ ID NO: 407460 - DNA, 25 bp, Rattus norvegicus
gctgcaagcaggattttactggtgt

SEQ ID NO: 407461 - DNA, 25 bp, Rattus norvegicus
gctgcaagcaggtttttactggtgt

SEQ ID NO: 407462 - DNA, 25 bp, Rattus norvegicus
gctgcaagcatcaaatttactgttt

SEQ ID NO: 407463 - DNA, 25 bp, Rattus norvegicus
gctgcaagcatctaatttactgttt

SEQ ID NO: 407464 - DNA, 25 bp, Rattus norvegicus
gctgcaagccttctctgtggtagag

SEQ ID NO: 407465 - DNA, 25 bp, Rattus norvegicus
gctgcaagccttgtctgtggtagag

SEQ ID NO: 407466 - DNA, 25 bp, Rattus norvegicus
gctgcaagctgtatgtcaatcatca

SEQ ID NO: 407467 - DNA, 25 bp, Rattus norvegicus
gctgcaagctgtttgtcaatcatca

SEQ ID NO: 407468 - DNA, 25 bp, Rattus norvegicus
gctgcaagtctgaaatgtgtgcctt

SEQ ID NO: 407469 - DNA, 25 bp, Rattus norvegicus
gctgcaagtctgtaatgtgtgcctt

SEQ ID NO: 407470 - DNA, 25 bp, Rattus norvegicus
gctgcaagtgtacccctctaggagg

SEQ ID NO: 407471 - DNA, 25 bp, Rattus norvegicus
gctgcaagtgtagccctctaggagg

SEQ ID NO: 407472 - DNA, 25 bp, Rattus norvegicus
gctgcaagttatcttctgagcaata

SEQ ID NO: 407473 - DNA, 25 bp, Rattus norvegicus
gctgcaagttatgttctgagcaata

SEQ ID NO: 407474 - DNA, 25 bp, Rattus norvegicus
gctgcaatactgatgctatttccca

SEQ ID NO: 407475 - DNA, 25 bp, Rattus norvegicus
gctgcaatactgttgctatttccca

SEQ ID NO: 407476 - DNA, 25 bp, Rattus norvegicus
gctgcaatattgagaaaatcccggg

SEQ ID NO: 407477 - DNA, 25 bp, Rattus norvegicus
gctgcaatattgtgaaaatcccggg

SEQ ID NO: 407478 - DNA, 25 bp, Rattus norvegicus
gctgcaatcaaactgcttccaacta

SEQ ID NO: 407479 - DNA, 25 bp, Rattus norvegicus
gctgcaatcaaagtgcttccaacta

SEQ ID NO: 407480 - DNA, 25 bp, Rattus norvegicus
gctgcaatcgataattacctacggt

SEQ ID NO: 407481 - DNA, 25 bp, Rattus norvegicus
gctgcaatcgattattacctacggt

SEQ ID NO: 407482 - DNA, 25 bp, Rattus norvegicus
gctgcaatgcttcggagcccagtag

SEQ ID NO: 407483 - DNA, 25 bp, Rattus norvegicus
gctgcaatgcttgggagcccagtag

SEQ ID NO: 407484 - DNA, 25 bp, Rattus norvegicus
gctgcaatgttacaaaggctcttta

SEQ ID NO: 407485 - DNA, 25 bp, Rattus norvegicus
gctgcaatgttagaaaggctcttta

SEQ ID NO: 407486 - DNA, 25 bp, Rattus norvegicus
gctgcaattaatcaaacgtgtgtat

SEQ ID NO: 407487 - DNA, 25 bp, Rattus norvegicus
gctgcaattaatgaaacgtgtgtat

SEQ ID NO: 407488 - DNA, 25 bp, Rattus norvegicus
gctgcaattcggcagacctcttgtc

SEQ ID NO: 407489 - DNA, 25 bp, Rattus norvegicus
gctgcaattcgggagacctcttgtc

SEQ ID NO: 407490 - DNA, 25 bp, Rattus norvegicus
gctgcacagagcaggcaaggcttga

SEQ ID NO: 407491 - DNA, 25 bp, Rattus norvegicus
gctgcacagagctggcaaggcttga

SEQ ID NO: 407492 - DNA, 25 bp, Rattus norvegicus
gctgcacagttcatactttcctatt

SEQ ID NO: 407493 - DNA, 25 bp, Rattus norvegicus
gctgcacagttcttactttcctatt

SEQ ID NO: 407494 - DNA, 25 bp, Rattus norvegicus
gctgcacataccactgatgagtcca

SEQ ID NO: 407495 - DNA, 25 bp, Rattus norvegicus
gctgcacatacctctgatgagtcca

SEQ ID NO: 407496 - DNA, 25 bp, Rattus norvegicus
gctgcacatagaccccatgtcaata

SEQ ID NO: 407497 - DNA, 25 bp, Rattus norvegicus
gctgcacatagagcccatgtcaata

SEQ ID NO: 407498 - DNA, 25 bp, Rattus norvegicus
gctgcacatcatattgccatggttt

SEQ ID NO: 407499 - DNA, 25 bp, Rattus norvegicus
gctgcacatcattttgccatggttt

SEQ ID NO: 407500 - DNA, 25 bp, Rattus norvegicus
gctgcacatggtctctatgccttta

SEQ ID NO: 407501 - DNA, 25 bp, Rattus norvegicus
gctgcacatggtgtctatgccttta

SEQ ID NO: 407502 - DNA, 25 bp, Rattus norvegicus
gctgcaccaaagattccaccttcag

SEQ ID NO: 407503 - DNA, 25 bp, Rattus norvegicus
gctgcaccaaagtttccaccttcag

SEQ ID NO: 407504 - DNA, 25 bp, Rattus norvegicus
gctgcaccatgtcgttttttacaac

SEQ ID NO: 407505 - DNA, 25 bp, Rattus norvegicus
gctgcaccatgtggttttttacaac

SEQ ID NO: 407506 - DNA, 25 bp, Rattus norvegicus
gctgcaccccgacgaactcatagaa

SEQ ID NO: 407507 - DNA, 25 bp, Rattus norvegicus
gctgcaccccgaggaactcatagaa

SEQ ID NO: 407508 - DNA, 25 bp, Rattus norvegicus
gctgcaccggtgatgccaatgggca

SEQ ID NO: 407509 - DNA, 25 bp, Rattus norvegicus
gctgcaccggtgttgccaatgggca

SEQ ID NO: 407510 - DNA, 25 bp, Rattus norvegicus
gctgcacctgagatatgccaagaat

SEQ ID NO: 407511 - DNA, 25 bp, Rattus norvegicus
gctgcacctgagttatgccaagaat

SEQ ID NO: 407512 - DNA, 25 bp, Rattus norvegicus
gctgcaccttagagcactttgaaat

SEQ ID NO: 407513 - DNA, 25 bp, Rattus norvegicus
gctgcaccttagtgcactttgaaat

SEQ ID NO: 407514 - DNA, 25 bp, Rattus norvegicus
gctgcacgagacatactggttcatt

SEQ ID NO: 407515 - DNA, 25 bp, Rattus norvegicus
gctgcacgagacttactggttcatt

SEQ ID NO: 407516 - DNA, 25 bp, Rattus norvegicus
gctgcacgcttgagtgtctgtagca

SEQ ID NO: 407517 - DNA, 25 bp, Rattus norvegicus
gctgcacgcttgtgtgtctgtagca

SEQ ID NO: 407518 - DNA, 25 bp, Rattus norvegicus
gctgcacggaatccgcggtgccctt

SEQ ID NO: 407519 - DNA, 25 bp, Rattus norvegicus
gctgcacggaatgcgcggtgccctt

SEQ ID NO: 407520 - DNA, 25 bp, Rattus norvegicus
gctgcactagtccttcaaagtcgtg

SEQ ID NO: 407521 - DNA, 25 bp, Rattus norvegicus
gctgcactagtcgttcaaagtcgtg

SEQ ID NO: 407522 - DNA, 25 bp, Rattus norvegicus
gctgcactcagccatggagacgtta

SEQ ID NO: 407523 - DNA, 25 bp, Rattus norvegicus
gctgcactcagcgatggagacgtta

SEQ ID NO: 407524 - DNA, 25 bp, Rattus norvegicus
gctgcactctgccattggacaagac

SEQ ID NO: 407525 - DNA, 25 bp, Rattus norvegicus
gctgcactctgcgattggacaagac

SEQ ID NO: 407526 - DNA, 25 bp, Rattus norvegicus
gctgcactgatgagacactgggttt

SEQ ID NO: 407527 - DNA, 25 bp, Rattus norvegicus
gctgcactgatgtgacactgggttt

SEQ ID NO: 407528 - DNA, 25 bp, Rattus norvegicus
gctgcactgattagttcttcataca

SEQ ID NO: 407529 - DNA, 25 bp, Rattus norvegicus
gctgcactgatttgttcttcataca

SEQ ID NO: 407530 - DNA, 25 bp, Rattus norvegicus
gctgcactgcttctgctgcttctgc

SEQ ID NO: 407531 - DNA, 25 bp, Rattus norvegicus
gctgcactgcttgtgctgcttctgc

SEQ ID NO: 407532 - DNA, 25 bp, Rattus norvegicus
gctgcactggaaagaccttgcttgt

SEQ ID NO: 407533 - DNA, 25 bp, Rattus norvegicus
gctgcactggaatgaccttgcttgt

SEQ ID NO: 407534 - DNA, 25 bp, Rattus norvegicus
gctgcactggcacccaaatcggaga

SEQ ID NO: 407535 - DNA, 25 bp, Rattus norvegicus
gctgcactggcagccaaatcggaga

SEQ ID NO: 407536 - DNA, 25 bp, Rattus norvegicus
gctgcactggtgcaatgcctcgtta

SEQ ID NO: 407537 - DNA, 25 bp, Rattus norvegicus
gctgcactggtggaatgcctcgtta

SEQ ID NO: 407538 - DNA, 25 bp, Rattus norvegicus
gctgcacttaatacatcttccgatt

SEQ ID NO: 407539 - DNA, 25 bp, Rattus norvegicus
gctgcacttaatatcatggacacca

SEQ ID NO: 407540 - DNA, 25 bp, Rattus norvegicus
gctgcacttaattcatcttccgatt

SEQ ID NO: 407541 - DNA, 25 bp, Rattus norvegicus
gctgcacttaatttcatggacacca

SEQ ID NO: 407542 - DNA, 25 bp, Rattus norvegicus
gctgcacttactcatctatggcttg

SEQ ID NO: 407543 - DNA, 25 bp, Rattus norvegicus
gctgcacttactgatctatggcttg

SEQ ID NO: 407544 - DNA, 25 bp, Rattus norvegicus
gctgcacttccaatgtctgtaaaat

SEQ ID NO: 407545 - DNA, 25 bp, Rattus norvegicus
gctgcacttccattgtctgtaaaat

SEQ ID NO: 407546 - DNA, 25 bp, Rattus norvegicus
gctgcacttggacagatggccacca

SEQ ID NO: 407547 - DNA, 25 bp, Rattus norvegicus
gctgcacttggagagatggccacca

SEQ ID NO: 407548 - DNA, 25 bp, Rattus norvegicus
gctgcactttgtcaagcaacataga

SEQ ID NO: 407549 - DNA, 25 bp, Rattus norvegicus
gctgcactttgtgaagcaacataga

SEQ ID NO: 407550 - DNA, 25 bp, Rattus norvegicus
gctgcacttttgcttctgtggaaga

SEQ ID NO: 407551 - DNA, 25 bp, Rattus norvegicus
gctgcacttttggttctgtggaaga

SEQ ID NO: 407552 - DNA, 25 bp, Rattus norvegicus
gctgcagaaccacctggctgaatgt

SEQ ID NO: 407553 - DNA, 25 bp, Rattus norvegicus
gctgcagaaccagctggctgaatgt

SEQ ID NO: 407554 - DNA, 25 bp, Rattus norvegicus
gctgcagaacttcatgtacaccatg

SEQ ID NO: 407555 - DNA, 25 bp, Rattus norvegicus
gctgcagaacttgatgtacaccatg

SEQ ID NO: 407556 - DNA, 25 bp, Rattus norvegicus
gctgcagaaggaagtgcttctctct

SEQ ID NO: 407557 - DNA, 25 bp, Rattus norvegicus
gctgcagaaggaattttattttgtt

SEQ ID NO: 407558 - DNA, 25 bp, Rattus norvegicus
gctgcagaaggatgtgcttctctct

SEQ ID NO: 407559 - DNA, 25 bp, Rattus norvegicus
gctgcagaaggatttttattttgtt

SEQ ID NO: 407560 - DNA, 25 bp, Rattus norvegicus
gctgcagaagttccgaggttcctca

SEQ ID NO: 407561 - DNA, 25 bp, Rattus norvegicus
gctgcagaagttgcgaggttcctca

SEQ ID NO: 407562 - DNA, 25 bp, Rattus norvegicus
gctgcagacattacacgtggacttc

SEQ ID NO: 407563 - DNA, 25 bp, Rattus norvegicus
gctgcagacatttcacgtggacttc

SEQ ID NO: 407564 - DNA, 25 bp, Rattus norvegicus
gctgcagagctgctagcctggaaaa

SEQ ID NO: 407565 - DNA, 25 bp, Rattus norvegicus
gctgcagagctggtagcctggaaaa

SEQ ID NO: 407566 - DNA, 25 bp, Rattus norvegicus
gctgcagagtttctgattcggacga

SEQ ID NO: 407567 - DNA, 25 bp, Rattus norvegicus
gctgcagagtttgtgattcggacga

SEQ ID NO: 407568 - DNA, 25 bp, Rattus norvegicus
gctgcagatctcacaagtatccgta

SEQ ID NO: 407569 - DNA, 25 bp, Rattus norvegicus
gctgcagatctctcaagtatccgta

SEQ ID NO: 407570 - DNA, 25 bp, Rattus norvegicus
gctgcagattcaaaggcactaggaa

SEQ ID NO: 407571 - DNA, 25 bp, Rattus norvegicus
gctgcagattcataggcactaggaa

SEQ ID NO: 407572 - DNA, 25 bp, Rattus norvegicus
gctgcagcactcactagagctggga

SEQ ID NO: 407573 - DNA, 25 bp, Rattus norvegicus
gctgcagcactctctagagctggga

SEQ ID NO: 407574 - DNA, 25 bp, Rattus norvegicus
gctgcagcagccatgtaggtgtgat

SEQ ID NO: 407575 - DNA, 25 bp, Rattus norvegicus
gctgcagcagccttgtaggtgtgat

SEQ ID NO: 407576 - DNA, 25 bp, Rattus norvegicus
gctgcagcagcgacttgttgcgtta

SEQ ID NO: 407577 - DNA, 25 bp, Rattus norvegicus
gctgcagcagcgtcttgttgcgtta

SEQ ID NO: 407578 - DNA, 25 bp, Rattus norvegicus
gctgcagcaggtccatccactgagt

SEQ ID NO: 407579 - DNA, 25 bp, Rattus norvegicus
gctgcagcaggtgcatccactgagt

SEQ ID NO: 407580 - DNA, 25 bp, Rattus norvegicus
gctgcagcatccacgtctggaaaag

SEQ ID NO: 407581 - DNA, 25 bp, Rattus norvegicus
gctgcagcatcctcgtctggaaaag

SEQ ID NO: 407582 - DNA, 25 bp, Rattus norvegicus
gctgcagcatggcacaaggagattc

SEQ ID NO: 407583 - DNA, 25 bp, Rattus norvegicus
gctgcagcatgggacaaggagattc

SEQ ID NO: 407584 - DNA, 25 bp, Rattus norvegicus
gctgcagccaacattgccattaaaa

SEQ ID NO: 407585 - DNA, 25 bp, Rattus norvegicus
gctgcagccaactttgccattaaaa

SEQ ID NO: 407586 - DNA, 25 bp, Rattus norvegicus
gctgcagccccgcataagacagagg

SEQ ID NO: 407587 - DNA, 25 bp, Rattus norvegicus
gctgcagccccggataagacagagg

SEQ ID NO: 407588 - DNA, 25 bp, Rattus norvegicus
gctgcagccgcgatcgaaaacggat

SEQ ID NO: 407589 - DNA, 25 bp, Rattus norvegicus
gctgcagccgcgttcgaaaacggat

SEQ ID NO: 407590 - DNA, 25 bp, Rattus norvegicus
gctgcagcctccaagaaaagatgca

SEQ ID NO: 407591 - DNA, 25 bp, Rattus norvegicus
gctgcagcctcctagaaaagatgca

SEQ ID NO: 407592 - DNA, 25 bp, Rattus norvegicus
gctgcagcctttaaacatagtttct

SEQ ID NO: 407593 - DNA, 25 bp, Rattus norvegicus
gctgcagccttttaacatagtttct

SEQ ID NO: 407594 - DNA, 25 bp, Rattus norvegicus
gctgcagcggttagagctcttcgga

SEQ ID NO: 407595 - DNA, 25 bp, Rattus norvegicus
gctgcagcggtttgagctcttcgga

SEQ ID NO: 407596 - DNA, 25 bp, Rattus norvegicus
gctgcagctagtcacagtgtgtgtt

SEQ ID NO: 407597 - DNA, 25 bp, Rattus norvegicus
gctgcagctagtgacagtgtgtgtt

SEQ ID NO: 407598 - DNA, 25 bp, Rattus norvegicus
gctgcagctgaacatggaccccaag

SEQ ID NO: 407599 - DNA, 25 bp, Rattus norvegicus
gctgcagctgaagatggaccccaag

SEQ ID NO: 407600 - DNA, 25 bp, Rattus norvegicus
gctgcagctgccagatcaactatgg

SEQ ID NO: 407601 - DNA, 25 bp, Rattus norvegicus
gctgcagctgcctgatcaactatgg

SEQ ID NO: 407602 - DNA, 25 bp, Rattus norvegicus
gctgcagcttagatgacagtttctg

SEQ ID NO: 407603 - DNA, 25 bp, Rattus norvegicus
gctgcagcttagttgacagtttctg

SEQ ID NO: 407604 - DNA, 25 bp, Rattus norvegicus
gctgcaggaatcatccggtgctgat

SEQ ID NO: 407605 - DNA, 25 bp, Rattus norvegicus
gctgcaggaatcttccggtgctgat

SEQ ID NO: 407606 - DNA, 25 bp, Rattus norvegicus
gctgcaggacaacctggcgacgact

SEQ ID NO: 407607 - DNA, 25 bp, Rattus norvegicus
gctgcaggacaagctggcgacgact

SEQ ID NO: 407608 - DNA, 25 bp, Rattus norvegicus
gctgcaggactcatccaccctaggg

SEQ ID NO: 407609 - DNA, 25 bp, Rattus norvegicus
gctgcaggactcttccaccctaggg

SEQ ID NO: 407610 - DNA, 25 bp, Rattus norvegicus
gctgcaggatcccatgacacactaa

SEQ ID NO: 407611 - DNA, 25 bp, Rattus norvegicus
gctgcaggatccgatgacacactaa

SEQ ID NO: 407612 - DNA, 25 bp, Rattus norvegicus
gctgcaggattaagccaactcttat

SEQ ID NO: 407613 - DNA, 25 bp, Rattus norvegicus
gctgcaggattatgccaactcttat

SEQ ID NO: 407614 - DNA, 25 bp, Rattus norvegicus
gctgcaggattcacagtctccagaa

SEQ ID NO: 407615 - DNA, 25 bp, Rattus norvegicus
gctgcaggattctcagtctccagaa

SEQ ID NO: 407616 - DNA, 25 bp, Rattus norvegicus
gctgcaggcattctagacctttcgg

SEQ ID NO: 407617 - DNA, 25 bp, Rattus norvegicus
gctgcaggcattgtagacctttcgg

SEQ ID NO: 407618 - DNA, 25 bp, Rattus norvegicus
gctgcaggcctcctggataacagga

SEQ ID NO: 407619 - DNA, 25 bp, Rattus norvegicus
gctgcaggcctcgtggataacagga

SEQ ID NO: 407620 - DNA, 25 bp, Rattus norvegicus
gctgcaggctatagttgtacgtgta

SEQ ID NO: 407621 - DNA, 25 bp, Rattus norvegicus
gctgcaggctattgttgtacgtgta

SEQ ID NO: 407622 - DNA, 25 bp, Rattus norvegicus
gctgcaggctttacactgaaaacga

SEQ ID NO: 407623 - DNA, 25 bp, Rattus norvegicus
gctgcaggcttttcactgaaaacga

SEQ ID NO: 407624 - DNA, 25 bp, Rattus norvegicus
gctgcagggaagagggtgccaggat

SEQ ID NO: 407625 - DNA, 25 bp, Rattus norvegicus
gctgcagggaagtgggtgccaggat

SEQ ID NO: 407626 - DNA, 25 bp, Rattus norvegicus
gctgcagggtagacacattcatttc

SEQ ID NO: 407627 - DNA, 25 bp, Rattus norvegicus
gctgcagggtagtcacattcatttc

SEQ ID NO: 407628 - DNA, 25 bp, Rattus norvegicus
gctgcaggtcctctttggaaaccct

SEQ ID NO: 407629 - DNA, 25 bp, Rattus norvegicus
gctgcaggtcctgtttggaaaccct

SEQ ID NO: 407630 - DNA, 25 bp, Rattus norvegicus
gctgcaggtggactgcgtggtgtgc

SEQ ID NO: 407631 - DNA, 25 bp, Rattus norvegicus
gctgcaggtggagtgcgtggtgtgc

SEQ ID NO: 407632 - DNA, 25 bp, Rattus norvegicus
gctgcaggtggcaggtgaggcacat

SEQ ID NO: 407633 - DNA, 25 bp, Rattus norvegicus
gctgcaggtggctggtgaggcacat

SEQ ID NO: 407634 - DNA, 25 bp, Rattus norvegicus
gctgcagtaaacctggtgactggtt

SEQ ID NO: 407635 - DNA, 25 bp, Rattus norvegicus
gctgcagtaaacgtggtgactggtt

SEQ ID NO: 407636 - DNA, 25 bp, Rattus norvegicus
gctgcagtcggaagaacctcccctt

SEQ ID NO: 407637 - DNA, 25 bp, Rattus norvegicus
gctgcagtcggatgaacctcccctt

SEQ ID NO: 407638 - DNA, 25 bp, Rattus norvegicus
gctgcagtctgcaaaccatcataga

SEQ ID NO: 407639 - DNA, 25 bp, Rattus norvegicus
gctgcagtctgctaaccatcataga

SEQ ID NO: 407640 - DNA, 25 bp, Rattus norvegicus
gctgcagtctggatctcctgggaga

SEQ ID NO: 407641 - DNA, 25 bp, Rattus norvegicus
gctgcagtctggttctcctgggaga

SEQ ID NO: 407642 - DNA, 25 bp, Rattus norvegicus
gctgcagtgaacaacgcccgagctg

SEQ ID NO: 407643 - DNA, 25 bp, Rattus norvegicus
gctgcagtgaacacaggtttctcaa

SEQ ID NO: 407644 - DNA, 25 bp, Rattus norvegicus
gctgcagtgaactacgcccgagctg

SEQ ID NO: 407645 - DNA, 25 bp, Rattus norvegicus
gctgcagtgaactcaggtttctcaa

SEQ ID NO: 407646 - DNA, 25 bp, Rattus norvegicus
gctgcagtggccctgatctcagtag

SEQ ID NO: 407647 - DNA, 25 bp, Rattus norvegicus
gctgcagtggccgtgatctcagtag

SEQ ID NO: 407648 - DNA, 25 bp, Rattus norvegicus
gctgcagtggctcgagcaacgacat

SEQ ID NO: 407649 - DNA, 25 bp, Rattus norvegicus
gctgcagtggctggagcaacgacat

SEQ ID NO: 407650 - DNA, 25 bp, Rattus norvegicus
gctgcagtgtcaacccatgagggaa

SEQ ID NO: 407651 - DNA, 25 bp, Rattus norvegicus
gctgcagtgtcatcccatgagggaa

SEQ ID NO: 407652 - DNA, 25 bp, Rattus norvegicus
gctgcagttacaaatggtgcccaac

SEQ ID NO: 407653 - DNA, 25 bp, Rattus norvegicus
gctgcagttacatatggtgcccaac

SEQ ID NO: 407654 - DNA, 25 bp, Rattus norvegicus
gctgcagttcatacagtcgacacta

SEQ ID NO: 407655 - DNA, 25 bp, Rattus norvegicus
gctgcagttcattcagtcgacacta

SEQ ID NO: 407656 - DNA, 25 bp, Rattus norvegicus
gctgcagttctcagagcaacttcaa

SEQ ID NO: 407657 - DNA, 25 bp, Rattus norvegicus
gctgcagttctctgagcaacttcaa

SEQ ID NO: 407658 - DNA, 25 bp, Rattus norvegicus
gctgcagttggaacttaagccctaa

SEQ ID NO: 407659 - DNA, 25 bp, Rattus norvegicus
gctgcagttggatcttaagccctaa

SEQ ID NO: 407660 - DNA, 25 bp, Rattus norvegicus
gctgcagttgtgagccaacattcca

SEQ ID NO: 407661 - DNA, 25 bp, Rattus norvegicus
gctgcagttgtgtgccaacattcca

SEQ ID NO: 407662 - DNA, 25 bp, Rattus norvegicus
gctgcagtttctcaggagcattcca

SEQ ID NO: 407663 - DNA, 25 bp, Rattus norvegicus
gctgcagtttctgaggagcattcca

SEQ ID NO: 407664 - DNA, 25 bp, Rattus norvegicus
gctgcataaagcatgtggtcctaat

SEQ ID NO: 407665 - DNA, 25 bp, Rattus norvegicus
gctgcataaagcttgtggtcctaat

SEQ ID NO: 407666 - DNA, 25 bp, Rattus norvegicus
gctgcataaataacaccacacacct

SEQ ID NO: 407667 - DNA, 25 bp, Rattus norvegicus
gctgcataaatatcaccacacacct

SEQ ID NO: 407668 - DNA, 25 bp, Rattus norvegicus
gctgcataatttactcctgttgacc

SEQ ID NO: 407669 - DNA, 25 bp, Rattus norvegicus
gctgcataattttctcctgttgacc

SEQ ID NO: 407670 - DNA, 25 bp, Rattus norvegicus
gctgcatagctcatctattccagaa

SEQ ID NO: 407671 - DNA, 25 bp, Rattus norvegicus
gctgcatagctcttctattccagaa

SEQ ID NO: 407672 - DNA, 25 bp, Rattus norvegicus
gctgcatatctgctctttcatttgt

SEQ ID NO: 407673 - DNA, 25 bp, Rattus norvegicus
gctgcatatctggtctttcatttgt

SEQ ID NO: 407674 - DNA, 25 bp, Rattus norvegicus
gctgcatatgccattactagactgt

SEQ ID NO: 407675 - DNA, 25 bp, Rattus norvegicus
gctgcatatgcctttactagactgt

SEQ ID NO: 407676 - DNA, 25 bp, Rattus norvegicus
gctgcatcatacagaggaattctga

SEQ ID NO: 407677 - DNA, 25 bp, Rattus norvegicus
gctgcatcatactgaggaattctga

SEQ ID NO: 407678 - DNA, 25 bp, Rattus norvegicus
gctgcatccaaaccccagtagagaa

SEQ ID NO: 407679 - DNA, 25 bp, Rattus norvegicus
gctgcatccaaagcccagtagagaa

SEQ ID NO: 407680 - DNA, 25 bp, Rattus norvegicus
gctgcatccctcatctaatacaaag

SEQ ID NO: 407681 - DNA, 25 bp, Rattus norvegicus
gctgcatccctcttctaatacaaag

SEQ ID NO: 407682 - DNA, 25 bp, Rattus norvegicus
gctgcatctatccatcatctgaaga

SEQ ID NO: 407683 - DNA, 25 bp, Rattus norvegicus
gctgcatctatcgatcatctgaaga

SEQ ID NO: 407684 - DNA, 25 bp, Rattus norvegicus
gctgcatctgcaaagaggcttcgga

SEQ ID NO: 407685 - DNA, 25 bp, Rattus norvegicus
gctgcatctgcatagaggcttcgga

SEQ ID NO: 407686 - DNA, 25 bp, Rattus norvegicus
gctgcatctgctcgaagtgttgctg

SEQ ID NO: 407687 - DNA, 25 bp, Rattus norvegicus
gctgcatctgctggaagtgttgctg

SEQ ID NO: 407688 - DNA, 25 bp, Rattus norvegicus
gctgcatcttgtctcaccacagaat

SEQ ID NO: 407689 - DNA, 25 bp, Rattus norvegicus
gctgcatcttgtgtcaccacagaat

SEQ ID NO: 407690 - DNA, 25 bp, Rattus norvegicus
gctgcatctttgactaatttacttt

SEQ ID NO: 407691 - DNA, 25 bp, Rattus norvegicus
gctgcatctttgtctaatttacttt

SEQ ID NO: 407692 - DNA, 25 bp, Rattus norvegicus
gctgcatgacacctaaggaattccc

SEQ ID NO: 407693 - DNA, 25 bp, Rattus norvegicus
gctgcatgacacgtaaggaattccc

SEQ ID NO: 407694 - DNA, 25 bp, Rattus norvegicus
gctgcatgagcactttggctccata

SEQ ID NO: 407695 - DNA, 25 bp, Rattus norvegicus
gctgcatgagcagtttggctccata

SEQ ID NO: 407696 - DNA, 25 bp, Rattus norvegicus
gctgcatgccacaaagcctggagga

SEQ ID NO: 407697 - DNA, 25 bp, Rattus norvegicus
gctgcatgccactaagcctggagga

SEQ ID NO: 407698 - DNA, 25 bp, Rattus norvegicus
gctgcatgccctcatctgggaaaga

SEQ ID NO: 407699 - DNA, 25 bp, Rattus norvegicus
gctgcatgccctgatctgggaaaga

SEQ ID NO: 407700 - DNA, 25 bp, Rattus norvegicus
gctgcatggcagctatccagaagac

SEQ ID NO: 407701 - DNA, 25 bp, Rattus norvegicus
gctgcatggcaggtatccagaagac

SEQ ID NO: 407702 - DNA, 25 bp, Rattus norvegicus
gctgcatggcccctttaatgaggtg

SEQ ID NO: 407703 - DNA, 25 bp, Rattus norvegicus
gctgcatggcccgtttaatgaggtg

SEQ ID NO: 407704 - DNA, 25 bp, Rattus norvegicus
gctgcatggtatattcttgttgaat

SEQ ID NO: 407705 - DNA, 25 bp, Rattus norvegicus
gctgcatggtattttcttgttgaat

SEQ ID NO: 407706 - DNA, 25 bp, Rattus norvegicus
gctgcatgtcagaacagggctttca

SEQ ID NO: 407707 - DNA, 25 bp, Rattus norvegicus
gctgcatgtcagtacagggctttca

SEQ ID NO: 407708 - DNA, 25 bp, Rattus norvegicus
gctgcatgtgataaaccgatctgat

SEQ ID NO: 407709 - DNA, 25 bp, Rattus norvegicus
gctgcatgtgattaaccgatctgat

SEQ ID NO: 407710 - DNA, 25 bp, Rattus norvegicus
gctgcattatatatacaaccgtgtg

SEQ ID NO: 407711 - DNA, 25 bp, Rattus norvegicus
gctgcattatatttacaaccgtgtg

SEQ ID NO: 407712 - DNA, 25 bp, Rattus norvegicus
gctgcattcatgaggcacagagaca

SEQ ID NO: 407713 - DNA, 25 bp, Rattus norvegicus
gctgcattcatgtggcacagagaca

SEQ ID NO: 407714 - DNA, 25 bp, Rattus norvegicus
gctgcattcccaataggtgtcctaa

SEQ ID NO: 407715 - DNA, 25 bp, Rattus norvegicus
gctgcattcccattaggtgtcctaa

SEQ ID NO: 407716 - DNA, 25 bp, Rattus norvegicus
gctgcattccttctgcacagggtaa

SEQ ID NO: 407717 - DNA, 25 bp, Rattus norvegicus
gctgcattccttgtgcacagggtaa

SEQ ID NO: 407718 - DNA, 25 bp, Rattus norvegicus
gctgcattctgcatcactggaaact

SEQ ID NO: 407719 - DNA, 25 bp, Rattus norvegicus
gctgcattctgcttcactggaaact

SEQ ID NO: 407720 - DNA, 25 bp, Rattus norvegicus
gctgcattggagctcacatcctttc

SEQ ID NO: 407721 - DNA, 25 bp, Rattus norvegicus
gctgcattggaggtcacatcctttc

SEQ ID NO: 407722 - DNA, 25 bp, Rattus norvegicus
gctgcatttcagcagcacttgagac

SEQ ID NO: 407723 - DNA, 25 bp, Rattus norvegicus
gctgcatttcaggagcacttgagac

SEQ ID NO: 407724 - DNA, 25 bp, Rattus norvegicus
gctgcatttggaatccatgcttgtt

SEQ ID NO: 407725 - DNA, 25 bp, Rattus norvegicus
gctgcatttggattccatgcttgtt

SEQ ID NO: 407726 - DNA, 25 bp, Rattus norvegicus
gctgcatttgtcaggactccataga

SEQ ID NO: 407727 - DNA, 25 bp, Rattus norvegicus
gctgcatttgtctggactccataga

SEQ ID NO: 407728 - DNA, 25 bp, Rattus norvegicus
gctgcattttacaactttttaggag

SEQ ID NO: 407729 - DNA, 25 bp, Rattus norvegicus
gctgcattttactactttttaggag

SEQ ID NO: 407730 - DNA, 25 bp, Rattus norvegicus
gctgcatttttaccacatgcctgta

SEQ ID NO: 407731 - DNA, 25 bp, Rattus norvegicus
gctgcatttttagcacatgcctgta

SEQ ID NO: 407732 - DNA, 25 bp, Rattus norvegicus
gctgccaaaagaaactccacacaca

SEQ ID NO: 407733 - DNA, 25 bp, Rattus norvegicus
gctgccaaaagatactccacacaca

SEQ ID NO: 407734 - DNA, 25 bp, Rattus norvegicus
gctgccaaagcgcaaacagccgcag

SEQ ID NO: 407735 - DNA, 25 bp, Rattus norvegicus
gctgccaaagcggaaacagccgcag

SEQ ID NO: 407736 - DNA, 25 bp, Rattus norvegicus
gctgccaacctaccaatttgagttc

SEQ ID NO: 407737 - DNA, 25 bp, Rattus norvegicus
gctgccaacctagcaatttgagttc

SEQ ID NO: 407738 - DNA, 25 bp, Rattus norvegicus
gctgccaactggacaccattatgtt

SEQ ID NO: 407739 - DNA, 25 bp, Rattus norvegicus
gctgccaactggtcaccattatgtt

SEQ ID NO: 407740 - DNA, 25 bp, Rattus norvegicus
gctgccaagctgacccacaataagg

SEQ ID NO: 407741 - DNA, 25 bp, Rattus norvegicus
gctgccaagctgtcccacaataagg

SEQ ID NO: 407742 - DNA, 25 bp, Rattus norvegicus
gctgccaataatagagcccgtgatt

SEQ ID NO: 407743 - DNA, 25 bp, Rattus norvegicus
gctgccaataattgagcccgtgatt

SEQ ID NO: 407744 - DNA, 25 bp, Rattus norvegicus
gctgccaatgcactcgatcttgtca

SEQ ID NO: 407745 - DNA, 25 bp, Rattus norvegicus
gctgccaatgcagtcgatcttgtca

SEQ ID NO: 407746 - DNA, 25 bp, Rattus norvegicus
gctgccaattgtacctcagcaaagg

SEQ ID NO: 407747 - DNA, 25 bp, Rattus norvegicus
gctgccaattgttcctcagcaaagg

SEQ ID NO: 407748 - DNA, 25 bp, Rattus norvegicus
gctgccacaagcagaaccttcaaaa

SEQ ID NO: 407749 - DNA, 25 bp, Rattus norvegicus
gctgccacaagctgaaccttcaaaa

SEQ ID NO: 407750 - DNA, 25 bp, Rattus norvegicus
gctgccacaggaaccgaaggcgtgt

SEQ ID NO: 407751 - DNA, 25 bp, Rattus norvegicus
gctgccacaggatccgaaggcgtgt

SEQ ID NO: 407752 - DNA, 25 bp, Rattus norvegicus
gctgccacagggaccttcggagtta

SEQ ID NO: 407753 - DNA, 25 bp, Rattus norvegicus
gctgccacagggtccttcggagtta

SEQ ID NO: 407754 - DNA, 25 bp, Rattus norvegicus
gctgccaccccaaacttaaagaaca

SEQ ID NO: 407755 - DNA, 25 bp, Rattus norvegicus
gctgccaccccatacttaaagaaca

SEQ ID NO: 407756 - DNA, 25 bp, Rattus norvegicus
gctgccaccctcaatggaaactgag

SEQ ID NO: 407757 - DNA, 25 bp, Rattus norvegicus
gctgccaccctctatggaaactgag

SEQ ID NO: 407758 - DNA, 25 bp, Rattus norvegicus
gctgccacctgcctggagacaaagg

SEQ ID NO: 407759 - DNA, 25 bp, Rattus norvegicus
gctgccacctgcgtggagacaaagg

SEQ ID NO: 407760 - DNA, 25 bp, Rattus norvegicus
gctgccacgttaataacaggtcgtt

SEQ ID NO: 407761 - DNA, 25 bp, Rattus norvegicus
gctgccacgttattaacaggtcgtt

SEQ ID NO: 407762 - DNA, 25 bp, Rattus norvegicus
gctgccactgtcatgagtagcttca

SEQ ID NO: 407763 - DNA, 25 bp, Rattus norvegicus
gctgccactgtcctgtaataaagtc

SEQ ID NO: 407764 - DNA, 25 bp, Rattus norvegicus
gctgccactgtcgtgtaataaagtc

SEQ ID NO: 407765 - DNA, 25 bp, Rattus norvegicus
gctgccactgtcttgagtagcttca

SEQ ID NO: 407766 - DNA, 25 bp, Rattus norvegicus
gctgccagagaccatgatagatcta

SEQ ID NO: 407767 - DNA, 25 bp, Rattus norvegicus
gctgccagagacgatgatagatcta

SEQ ID NO: 407768 - DNA, 25 bp, Rattus norvegicus
gctgccagagctctaccataaaata

SEQ ID NO: 407769 - DNA, 25 bp, Rattus norvegicus
gctgccagagctcttccacaagata

SEQ ID NO: 407770 - DNA, 25 bp, Rattus norvegicus
gctgccagagctgtaccataaaata

SEQ ID NO: 407771 - DNA, 25 bp, Rattus norvegicus
gctgccagagctgttccacaagata

SEQ ID NO: 407772 - DNA, 25 bp, Rattus norvegicus
gctgccagagtgacgccttttaatt

SEQ ID NO: 407773 - DNA, 25 bp, Rattus norvegicus
gctgccagagtgtcgccttttaatt

SEQ ID NO: 407774 - DNA, 25 bp, Rattus norvegicus
gctgccagataccacaaatgttaga

SEQ ID NO: 407775 - DNA, 25 bp, Rattus norvegicus
gctgccagatacgacaaatgttaga

SEQ ID NO: 407776 - DNA, 25 bp, Rattus norvegicus
gctgccagcagtcactattgtccaa

SEQ ID NO: 407777 - DNA, 25 bp, Rattus norvegicus
gctgccagcagtgactattgtccaa

SEQ ID NO: 407778 - DNA, 25 bp, Rattus norvegicus
gctgccagcatcaatcacctttagt

SEQ ID NO: 407779 - DNA, 25 bp, Rattus norvegicus
gctgccagcatctatcacctttagt

SEQ ID NO: 407780 - DNA, 25 bp, Rattus norvegicus
gctgccagcccacagaattccagag

SEQ ID NO: 407781 - DNA, 25 bp, Rattus norvegicus
gctgccagcccagagaattccagag

SEQ ID NO: 407782 - DNA, 25 bp, Rattus norvegicus
gctgccagcgatcactacagaggat

SEQ ID NO: 407783 - DNA, 25 bp, Rattus norvegicus
gctgccagcgatgactacagaggat

SEQ ID NO: 407784 - DNA, 25 bp, Rattus norvegicus
gctgccagctcactggtgcttccag

SEQ ID NO: 407785 - DNA, 25 bp, Rattus norvegicus
gctgccagctcagtggtgcttccag

SEQ ID NO: 407786 - DNA, 25 bp, Rattus norvegicus
gctgccaggaacacccgagctaggg

SEQ ID NO: 407787 - DNA, 25 bp, Rattus norvegicus
gctgccaggaactcccgagctaggg

SEQ ID NO: 407788 - DNA, 25 bp, Rattus norvegicus
gctgccagggcgagaagagctccgg

SEQ ID NO: 407789 - DNA, 25 bp, Rattus norvegicus
gctgccagggcgtgaagagctccgg

SEQ ID NO: 407790 - DNA, 25 bp, Rattus norvegicus
gctgccagtcagcttcagacaggag

SEQ ID NO: 407791 - DNA, 25 bp, Rattus norvegicus
gctgccagtcaggttcagacaggag

SEQ ID NO: 407792 - DNA, 25 bp, Rattus norvegicus
gctgccagtgagagtgagcttttgc

SEQ ID NO: 407793 - DNA, 25 bp, Rattus norvegicus
gctgccagtgagtgtgagcttttgc

SEQ ID NO: 407794 - DNA, 25 bp, Rattus norvegicus
gctgccatacttcaactcatcagga

SEQ ID NO: 407795 - DNA, 25 bp, Rattus norvegicus
gctgccatacttgaactcatcagga

SEQ ID NO: 407796 - DNA, 25 bp, Rattus norvegicus
gctgccatatttccacctttaagat

SEQ ID NO: 407797 - DNA, 25 bp, Rattus norvegicus
gctgccatatttgcacctttaagat

SEQ ID NO: 407798 - DNA, 25 bp, Rattus norvegicus
gctgccatcatcaatctgctcagat

SEQ ID NO: 407799 - DNA, 25 bp, Rattus norvegicus
gctgccatcatctatctgctcagat

SEQ ID NO: 407800 - DNA, 25 bp, Rattus norvegicus
gctgccatctatcaccacagagatc

SEQ ID NO: 407801 - DNA, 25 bp, Rattus norvegicus
gctgccatctatgaccacagagatc

SEQ ID NO: 407802 - DNA, 25 bp, Rattus norvegicus
gctgccatggtcaaagctaagtttg

SEQ ID NO: 407803 - DNA, 25 bp, Rattus norvegicus
gctgccatggtctaagctaagtttg

SEQ ID NO: 407804 - DNA, 25 bp, Rattus norvegicus
gctgccattactcacctgtgaacta

SEQ ID NO: 407805 - DNA, 25 bp, Rattus norvegicus
gctgccattactgacctgtgaacta

SEQ ID NO: 407806 - DNA, 25 bp, Rattus norvegicus
gctgccattcagcatgcggtgtaag

SEQ ID NO: 407807 - DNA, 25 bp, Rattus norvegicus
gctgccattcaggatgcggtgtaag

SEQ ID NO: 407808 - DNA, 25 bp, Rattus norvegicus
gctgccattcccagtgtgtaaattt

SEQ ID NO: 407809 - DNA, 25 bp, Rattus norvegicus
gctgccattccctgtgtgtaaattt

SEQ ID NO: 407810 - DNA, 25 bp, Rattus norvegicus
gctgccattctaatacaattcctga

SEQ ID NO: 407811 - DNA, 25 bp, Rattus norvegicus
gctgccattctattacaattcctga

SEQ ID NO: 407812 - DNA, 25 bp, Rattus norvegicus
gctgccattgtcctgatagtagacg

SEQ ID NO: 407813 - DNA, 25 bp, Rattus norvegicus
gctgccattgtcgtgatagtagacg

SEQ ID NO: 407814 - DNA, 25 bp, Rattus norvegicus
gctgccatttcaaccacaacgcaga

SEQ ID NO: 407815 - DNA, 25 bp, Rattus norvegicus
gctgccatttcatccacaacgcaga

SEQ ID NO: 407816 - DNA, 25 bp, Rattus norvegicus
gctgccatttgtatgatctgaccat

SEQ ID NO: 407817 - DNA, 25 bp, Rattus norvegicus
gctgccatttgtttgatctgaccat

SEQ ID NO: 407818 - DNA, 25 bp, Rattus norvegicus
gctgccattttcaagattgccaccc

SEQ ID NO: 407819 - DNA, 25 bp, Rattus norvegicus
gctgccattttctagattgccaccc

SEQ ID NO: 407820 - DNA, 25 bp, Rattus norvegicus
gctgcccaccagcaagcaatagcat

SEQ ID NO: 407821 - DNA, 25 bp, Rattus norvegicus
gctgcccaccaggaagcaatagcat

SEQ ID NO: 407822 - DNA, 25 bp, Rattus norvegicus
gctgcccacggcattatttatgagt

SEQ ID NO: 407823 - DNA, 25 bp, Rattus norvegicus
gctgcccacggctttatttatgagt

SEQ ID NO: 407824 - DNA, 25 bp, Rattus norvegicus
gctgcccacgtgacttcggaagaac

SEQ ID NO: 407825 - DNA, 25 bp, Rattus norvegicus
gctgcccacgtgtcttcggaagaac

SEQ ID NO: 407826 - DNA, 25 bp, Rattus norvegicus
gctgcccactcacaggatcctggta

SEQ ID NO: 407827 - DNA, 25 bp, Rattus norvegicus
gctgcccactcagaggatcctggta

SEQ ID NO: 407828 - DNA, 25 bp, Rattus norvegicus
gctgcccaggatcctgctatttaaa

SEQ ID NO: 407829 - DNA, 25 bp, Rattus norvegicus
gctgcccaggatgctgctatttaaa

SEQ ID NO: 407830 - DNA, 25 bp, Rattus norvegicus
gctgcccatatacactgaccttaaa

SEQ ID NO: 407831 - DNA, 25 bp, Rattus norvegicus
gctgcccatatagactgaccttaaa

SEQ ID NO: 407832 - DNA, 25 bp, Rattus norvegicus
gctgcccatattcagtccggactct

SEQ ID NO: 407833 - DNA, 25 bp, Rattus norvegicus
gctgcccatattgagtccggactct

SEQ ID NO: 407834 - DNA, 25 bp, Rattus norvegicus
gctgcccattccaggatgagtagga

SEQ ID NO: 407835 - DNA, 25 bp, Rattus norvegicus
gctgcccattcctggatgagtagga

SEQ ID NO: 407836 - DNA, 25 bp, Rattus norvegicus
gctgccccactgagcatggagcagg

SEQ ID NO: 407837 - DNA, 25 bp, Rattus norvegicus
gctgccccactgtgcatggagcagg

SEQ ID NO: 407838 - DNA, 25 bp, Rattus norvegicus
gctgccccagccagtgagaagaaca

SEQ ID NO: 407839 - DNA, 25 bp, Rattus norvegicus
gctgccccagccattttggtatcat

SEQ ID NO: 407840 - DNA, 25 bp, Rattus norvegicus
gctgccccagcctgtgagaagaaca

SEQ ID NO: 407841 - DNA, 25 bp, Rattus norvegicus
gctgccccagcctttttggtatcat

SEQ ID NO: 407842 - DNA, 25 bp, Rattus norvegicus
gctgcccctaacctgtgaataattt

SEQ ID NO: 407843 - DNA, 25 bp, Rattus norvegicus
gctgcccctaacgtgtgaataattt

SEQ ID NO: 407844 - DNA, 25 bp, Rattus norvegicus
gctgcccctatgctcagaggaggaa

SEQ ID NO: 407845 - DNA, 25 bp, Rattus norvegicus
gctgcccctatggtcagaggaggaa

SEQ ID NO: 407846 - DNA, 25 bp, Rattus norvegicus
gctgcccctgctcatgaaaatacaa

SEQ ID NO: 407847 - DNA, 25 bp, Rattus norvegicus
gctgcccctgctgatgaaaatacaa

SEQ ID NO: 407848 - DNA, 25 bp, Rattus norvegicus
gctgcccggattcgaatcaccatga

SEQ ID NO: 407849 - DNA, 25 bp, Rattus norvegicus
gctgcccggattggaatcaccatga

SEQ ID NO: 407850 - DNA, 25 bp, Rattus norvegicus
gctgcccgggacagcattgatgatt

SEQ ID NO: 407851 - DNA, 25 bp, Rattus norvegicus
gctgcccgggactgcattgatgatt

SEQ ID NO: 407852 - DNA, 25 bp, Rattus norvegicus
gctgcccgggcgcaaagcttccttt

SEQ ID NO: 407853 - DNA, 25 bp, Rattus norvegicus
gctgcccgggcggaaagcttccttt

SEQ ID NO: 407854 - DNA, 25 bp, Rattus norvegicus
gctgcccgggtgacgactgccggca

SEQ ID NO: 407855 - DNA, 25 bp, Rattus norvegicus
gctgcccgggtgtcgactgccggca

SEQ ID NO: 407856 - DNA, 25 bp, Rattus norvegicus
gctgccctaaaaagtgcacctgctg

SEQ ID NO: 407857 - DNA, 25 bp, Rattus norvegicus
gctgccctaaaatgtgcacctgctg

SEQ ID NO: 407858 - DNA, 25 bp, Rattus norvegicus
gctgccctagacacagacgtagtca

SEQ ID NO: 407859 - DNA, 25 bp, Rattus norvegicus
gctgccctagactcagacgtagtca

SEQ ID NO: 407860 - DNA, 25 bp, Rattus norvegicus
gctgccctcactctgtgcaaagtga

SEQ ID NO: 407861 - DNA, 25 bp, Rattus norvegicus
gctgccctcactgtgtgcaaagtga

SEQ ID NO: 407862 - DNA, 25 bp, Rattus norvegicus
gctgccctcagcacataaatcttaa

SEQ ID NO: 407863 - DNA, 25 bp, Rattus norvegicus
gctgccctcagctcataaatcttaa

SEQ ID NO: 407864 - DNA, 25 bp, Rattus norvegicus
gctgccctcattagtcagctaatta

SEQ ID NO: 407865 - DNA, 25 bp, Rattus norvegicus
gctgccctcatttgtcagctaatta

SEQ ID NO: 407866 - DNA, 25 bp, Rattus norvegicus
gctgccctctgacttgctatggaga

SEQ ID NO: 407867 - DNA, 25 bp, Rattus norvegicus
gctgccctctgagttgctatggaga

SEQ ID NO: 407868 - DNA, 25 bp, Rattus norvegicus
gctgccctgaggaacattaagtttt

SEQ ID NO: 407869 - DNA, 25 bp, Rattus norvegicus
gctgccctgaggtacattaagtttt

SEQ ID NO: 407870 - DNA, 25 bp, Rattus norvegicus
gctgccctggctcattacaaactga

SEQ ID NO: 407871 - DNA, 25 bp, Rattus norvegicus
gctgccctggctgattacaaactga

SEQ ID NO: 407872 - DNA, 25 bp, Rattus norvegicus
gctgccctgggaatgtctgatgtaa

SEQ ID NO: 407873 - DNA, 25 bp, Rattus norvegicus
gctgccctgggattgtctgatgtaa

SEQ ID NO: 407874 - DNA, 25 bp, Rattus norvegicus
gctgcccttccgcatcgtggaagct

SEQ ID NO: 407875 - DNA, 25 bp, Rattus norvegicus
gctgcccttccggatcgtggaagct

SEQ ID NO: 407876 - DNA, 25 bp, Rattus norvegicus
gctgccctttccagtaatttatgtc

SEQ ID NO: 407877 - DNA, 25 bp, Rattus norvegicus
gctgccctttcctgtaatttatgtc

SEQ ID NO: 407878 - DNA, 25 bp, Rattus norvegicus
gctgccgaacagacttcatttttga

SEQ ID NO: 407879 - DNA, 25 bp, Rattus norvegicus
gctgccgaacagtcttcatttttga

SEQ ID NO: 407880 - DNA, 25 bp, Rattus norvegicus
gctgccgactgtaaatttcactgtg

SEQ ID NO: 407881 - DNA, 25 bp, Rattus norvegicus
gctgccgactgttaatttcactgtg

SEQ ID NO: 407882 - DNA, 25 bp, Rattus norvegicus
gctgccgagatgagaaaaacacctt

SEQ ID NO: 407883 - DNA, 25 bp, Rattus norvegicus
gctgccgagatgtgaaaaacacctt

SEQ ID NO: 407884 - DNA, 25 bp, Rattus norvegicus
gctgccgatgacagccgatataagt

SEQ ID NO: 407885 - DNA, 25 bp, Rattus norvegicus
gctgccgatgactgccgatataagt

SEQ ID NO: 407886 - DNA, 25 bp, Rattus norvegicus
gctgccgccgaaagacagtgctatt

SEQ ID NO: 407887 - DNA, 25 bp, Rattus norvegicus
gctgccgccgaatgacagtgctatt

SEQ ID NO: 407888 - DNA, 25 bp, Rattus norvegicus
gctgccgccgggacaacaatgaaat

SEQ ID NO: 407889 - DNA, 25 bp, Rattus norvegicus
gctgccgccgggtcaacaatgaaat

SEQ ID NO: 407890 - DNA, 25 bp, Rattus norvegicus
gctgccgcctctctttacaaagctt

SEQ ID NO: 407891 - DNA, 25 bp, Rattus norvegicus
gctgccgcctctgtttacaaagctt

SEQ ID NO: 407892 - DNA, 25 bp, Rattus norvegicus
gctgccgcctgcacgtggatgacgc

SEQ ID NO: 407893 - DNA, 25 bp, Rattus norvegicus
gctgccgcctgctcgtggatgacgc

SEQ ID NO: 407894 - DNA, 25 bp, Rattus norvegicus
gctgccgcctttaaaggcactgcgg

SEQ ID NO: 407895 - DNA, 25 bp, Rattus norvegicus
gctgccgccttttaaggcactgcgg

SEQ ID NO: 407896 - DNA, 25 bp, Rattus norvegicus
gctgccgcggctattacgacgtgat

SEQ ID NO: 407897 - DNA, 25 bp, Rattus norvegicus
gctgccgcggcttttacgacgtgat

SEQ ID NO: 407898 - DNA, 25 bp, Rattus norvegicus
gctgccgcgttgaaatgcttcgaga

SEQ ID NO: 407899 - DNA, 25 bp, Rattus norvegicus
gctgccgcgttgtaatgcttcgaga

SEQ ID NO: 407900 - DNA, 25 bp, Rattus norvegicus
gctgccgctggcaagaagctatctg

SEQ ID NO: 407901 - DNA, 25 bp, Rattus norvegicus
gctgccgctggctagaagctatctg

SEQ ID NO: 407902 - DNA, 25 bp, Rattus norvegicus
gctgccgctgggacctcacggacgt

SEQ ID NO: 407903 - DNA, 25 bp, Rattus norvegicus
gctgccgctgggtcctcacggacgt

SEQ ID NO: 407904 - DNA, 25 bp, Rattus norvegicus
gctgccgctgtgagatgctttgaca

SEQ ID NO: 407905 - DNA, 25 bp, Rattus norvegicus
gctgccgctgtgtgatgctttgaca

SEQ ID NO: 407906 - DNA, 25 bp, Rattus norvegicus
gctgccggagtgagattctagagtc

SEQ ID NO: 407907 - DNA, 25 bp, Rattus norvegicus
gctgccggagtgtgattctagagtc

SEQ ID NO: 407908 - DNA, 25 bp, Rattus norvegicus
gctgccggccacaggagctactgat

SEQ ID NO: 407909 - DNA, 25 bp, Rattus norvegicus
gctgccggccactggagctactgat

SEQ ID NO: 407910 - DNA, 25 bp, Rattus norvegicus
gctgccggcccgagggcgagccgag

SEQ ID NO: 407911 - DNA, 25 bp, Rattus norvegicus
gctgccggcccgtgggcgagccgag

SEQ ID NO: 407912 - DNA, 25 bp, Rattus norvegicus
gctgccgggctgaggatgtctactt

SEQ ID NO: 407913 - DNA, 25 bp, Rattus norvegicus
gctgccgggctgtggatgtctactt

SEQ ID NO: 407914 - DNA, 25 bp, Rattus norvegicus
gctgccggtctacgacaagcaccat

SEQ ID NO: 407915 - DNA, 25 bp, Rattus norvegicus
gctgccggtctaggacaagcaccat

SEQ ID NO: 407916 - DNA, 25 bp, Rattus norvegicus
gctgccgtaagacatgccatcgctg

SEQ ID NO: 407917 - DNA, 25 bp, Rattus norvegicus
gctgccgtaagagatgccatcgctg

SEQ ID NO: 407918 - DNA, 25 bp, Rattus norvegicus
gctgccgtaatgatggaggcctgaa

SEQ ID NO: 407919 - DNA, 25 bp, Rattus norvegicus
gctgccgtaatgttggaggcctgaa

SEQ ID NO: 407920 - DNA, 25 bp, Rattus norvegicus
gctgccgtcaccacgcggagaaggg

SEQ ID NO: 407921 - DNA, 25 bp, Rattus norvegicus
gctgccgtcacctcgcggagaaggg

SEQ ID NO: 407922 - DNA, 25 bp, Rattus norvegicus
gctgccgtgcttactacaataatga

SEQ ID NO: 407923 - DNA, 25 bp, Rattus norvegicus
gctgccgtgctttctacaataatga

SEQ ID NO: 407924 - DNA, 25 bp, Rattus norvegicus
gctgccgtgggtattgcctggattc

SEQ ID NO: 407925 - DNA, 25 bp, Rattus norvegicus
gctgccgtgggttttgcctggattc

SEQ ID NO: 407926 - DNA, 25 bp, Rattus norvegicus
gctgccgtgtgcagtcatgtgaaca

SEQ ID NO: 407927 - DNA, 25 bp, Rattus norvegicus
gctgccgtgtgctgtcatgtgaaca

SEQ ID NO: 407928 - DNA, 25 bp, Rattus norvegicus
gctgccgtgtggagaacgagctctt

SEQ ID NO: 407929 - DNA, 25 bp, Rattus norvegicus
gctgccgtgtggtgaacgagctctt

SEQ ID NO: 407930 - DNA, 25 bp, Rattus norvegicus
gctgccgttgacctgagatgactga

SEQ ID NO: 407931 - DNA, 25 bp, Rattus norvegicus
gctgccgttgacgtgagatgactga

SEQ ID NO: 407932 - DNA, 25 bp, Rattus norvegicus
gctgcctaaatgagcaacctgttac

SEQ ID NO: 407933 - DNA, 25 bp, Rattus norvegicus
gctgcctaaatgtgcaacctgttac

SEQ ID NO: 407934 - DNA, 25 bp, Rattus norvegicus
gctgcctacagcagcatgaaaccaa

SEQ ID NO: 407935 - DNA, 25 bp, Rattus norvegicus
gctgcctacagctgcatgaaaccaa

SEQ ID NO: 407936 - DNA, 25 bp, Rattus norvegicus
gctgcctagaatcgatgcgtgtgct

SEQ ID NO: 407937 - DNA, 25 bp, Rattus norvegicus
gctgcctagaatggatgcgtgtgct

SEQ ID NO: 407938 - DNA, 25 bp, Rattus norvegicus
gctgcctatgatcctgagaattgct

SEQ ID NO: 407939 - DNA, 25 bp, Rattus norvegicus
gctgcctatgatgctgagaattgct

SEQ ID NO: 407940 - DNA, 25 bp, Rattus norvegicus
gctgcctatggcctttatttcaaca

SEQ ID NO: 407941 - DNA, 25 bp, Rattus norvegicus
gctgcctatggcgtttatttcaaca

SEQ ID NO: 407942 - DNA, 25 bp, Rattus norvegicus
gctgcctcaagtaaagccacagtat

SEQ ID NO: 407943 - DNA, 25 bp, Rattus norvegicus
gctgcctcaagttaagccacagtat

SEQ ID NO: 407944 - DNA, 25 bp, Rattus norvegicus
gctgcctcaatgagtaaaagtgttt

SEQ ID NO: 407945 - DNA, 25 bp, Rattus norvegicus
gctgcctcaatgatttttctgctgg

SEQ ID NO: 407946 - DNA, 25 bp, Rattus norvegicus
gctgcctcaatgtgtaaaagtgttt

SEQ ID NO: 407947 - DNA, 25 bp, Rattus norvegicus
gctgcctcaatgttttttctgctgg

SEQ ID NO: 407948 - DNA, 25 bp, Rattus norvegicus
gctgcctcacagcatggagtattgt

SEQ ID NO: 407949 - DNA, 25 bp, Rattus norvegicus
gctgcctcacaggatggagtattgt

SEQ ID NO: 407950 - DNA, 25 bp, Rattus norvegicus
gctgcctcaccacagatctagaaga

SEQ ID NO: 407951 - DNA, 25 bp, Rattus norvegicus
gctgcctcaccagagatctagaaga

SEQ ID NO: 407952 - DNA, 25 bp, Rattus norvegicus
gctgcctcactaatcctctgagtaa

SEQ ID NO: 407953 - DNA, 25 bp, Rattus norvegicus
gctgcctcactattcctctgagtaa

SEQ ID NO: 407954 - DNA, 25 bp, Rattus norvegicus
gctgcctcagagatacccgaacaag

SEQ ID NO: 407955 - DNA, 25 bp, Rattus norvegicus
gctgcctcagagttacccgaacaag

SEQ ID NO: 407956 - DNA, 25 bp, Rattus norvegicus
gctgcctcccgaaacgagaaggtgc

SEQ ID NO: 407957 - DNA, 25 bp, Rattus norvegicus
gctgcctcccgatacgagaaggtgc

SEQ ID NO: 407958 - DNA, 25 bp, Rattus norvegicus
gctgcctcctgaacattccagaaga

SEQ ID NO: 407959 - DNA, 25 bp, Rattus norvegicus
gctgcctcctgatcattccagaaga

SEQ ID NO: 407960 - DNA, 25 bp, Rattus norvegicus
gctgcctcctggacttaatgcactg

SEQ ID NO: 407961 - DNA, 25 bp, Rattus norvegicus
gctgcctcctggtcttaatgcactg

SEQ ID NO: 407962 - DNA, 25 bp, Rattus norvegicus
gctgcctcggcacaagtgcctagta

SEQ ID NO: 407963 - DNA, 25 bp, Rattus norvegicus
gctgcctcggcagaagtgcctagta

SEQ ID NO: 407964 - DNA, 25 bp, Rattus norvegicus
gctgcctctaacctgatactcagtt

SEQ ID NO: 407965 - DNA, 25 bp, Rattus norvegicus
gctgcctctaacgtgatactcagtt

SEQ ID NO: 407966 - DNA, 25 bp, Rattus norvegicus
gctgcctctggaatctggtcaggga

SEQ ID NO: 407967 - DNA, 25 bp, Rattus norvegicus
gctgcctctggattctggtcaggga

SEQ ID NO: 407968 - DNA, 25 bp, Rattus norvegicus
gctgcctctggtcatgtacaaacat

SEQ ID NO: 407969 - DNA, 25 bp, Rattus norvegicus
gctgcctctggtgatgtacaaacat

SEQ ID NO: 407970 - DNA, 25 bp, Rattus norvegicus
gctgcctctgtgaaagatgccattt

SEQ ID NO: 407971 - DNA, 25 bp, Rattus norvegicus
gctgcctctgtgacctcaggaagtg

SEQ ID NO: 407972 - DNA, 25 bp, Rattus norvegicus
gctgcctctgtgctcaatgtgaatt

SEQ ID NO: 407973 - DNA, 25 bp, Rattus norvegicus
gctgcctctgtggtcaatgtgaatt

SEQ ID NO: 407974 - DNA, 25 bp, Rattus norvegicus
gctgcctctgtgtaagatgccattt

SEQ ID NO: 407975 - DNA, 25 bp, Rattus norvegicus
gctgcctctgtgtcctcaggaagtg

SEQ ID NO: 407976 - DNA, 25 bp, Rattus norvegicus
gctgcctcttgccaagtttcagagt

SEQ ID NO: 407977 - DNA, 25 bp, Rattus norvegicus
gctgcctcttgcgaagtttcagagt

SEQ ID NO: 407978 - DNA, 25 bp, Rattus norvegicus
gctgcctgaaacattatccaacctg

SEQ ID NO: 407979 - DNA, 25 bp, Rattus norvegicus
gctgcctgaaactttatccaacctg

SEQ ID NO: 407980 - DNA, 25 bp, Rattus norvegicus
gctgcctgacatatgtgccatgcaa

SEQ ID NO: 407981 - DNA, 25 bp, Rattus norvegicus
gctgcctgacatttgtgccatgcaa

SEQ ID NO: 407982 - DNA, 25 bp, Rattus norvegicus
gctgcctgcaaacctgaaactgatt

SEQ ID NO: 407983 - DNA, 25 bp, Rattus norvegicus
gctgcctgcaaagctgaaactgatt

SEQ ID NO: 407984 - DNA, 25 bp, Rattus norvegicus
gctgcctgcagacttgttattcagt

SEQ ID NO: 407985 - DNA, 25 bp, Rattus norvegicus
gctgcctgcagagttgttattcagt

SEQ ID NO: 407986 - DNA, 25 bp, Rattus norvegicus
gctgcctgcagtaagttcttctaca

SEQ ID NO: 407987 - DNA, 25 bp, Rattus norvegicus
gctgcctgcagttagttcttctaca

SEQ ID NO: 407988 - DNA, 25 bp, Rattus norvegicus
gctgcctgcgttaccttaggaacaa

SEQ ID NO: 407989 - DNA, 25 bp, Rattus norvegicus
gctgcctgcgtttccttaggaacaa

SEQ ID NO: 407990 - DNA, 25 bp, Rattus norvegicus
gctgcctggcatccagcagaaggtc

SEQ ID NO: 407991 - DNA, 25 bp, Rattus norvegicus
gctgcctggcatgcagcagaaggtc

SEQ ID NO: 407992 - DNA, 25 bp, Rattus norvegicus
gctgcctggcccatagaggctgtaa

SEQ ID NO: 407993 - DNA, 25 bp, Rattus norvegicus
gctgcctggcccttagaggctgtaa

SEQ ID NO: 407994 - DNA, 25 bp, Rattus norvegicus
gctgcctggtctctgtaattttata

SEQ ID NO: 407995 - DNA, 25 bp, Rattus norvegicus
gctgcctggtctgtgtaattttata

SEQ ID NO: 407996 - DNA, 25 bp, Rattus norvegicus
gctgcctgtactcctgaagctgtac

SEQ ID NO: 407997 - DNA, 25 bp, Rattus norvegicus
gctgcctgtactgctgaagctgtac

SEQ ID NO: 407998 - DNA, 25 bp, Rattus norvegicus
gctgcctgtagcagaatccttggaa

SEQ ID NO: 407999 - DNA, 25 bp, Rattus norvegicus
gctgcctgtagctgaatccttggaa

SEQ ID NO: 408000 - DNA, 25 bp, Rattus norvegicus
gctgcctgtctgacaagctggctgg

SEQ ID NO: 408001 - DNA, 25 bp, Rattus norvegicus
gctgcctgtctgtcaagctggctgg

SEQ ID NO: 408002 - DNA, 25 bp, Rattus norvegicus
gctgcctgtggccaggacctaaagt

SEQ ID NO: 408003 - DNA, 25 bp, Rattus norvegicus
gctgcctgtggcgaggacctaaagt

SEQ ID NO: 408004 - DNA, 25 bp, Rattus norvegicus
gctgcctgtgttcttactgggtcaa

SEQ ID NO: 408005 - DNA, 25 bp, Rattus norvegicus
gctgcctgtgttgttactgggtcaa

SEQ ID NO: 408006 - DNA, 25 bp, Rattus norvegicus
gctgcctgttatcactgtcatgtaa

SEQ ID NO: 408007 - DNA, 25 bp, Rattus norvegicus
gctgcctgttatgactgtcatgtaa

SEQ ID NO: 408008 - DNA, 25 bp, Rattus norvegicus
gctgcctgttgtctggaatgatcca

SEQ ID NO: 408009 - DNA, 25 bp, Rattus norvegicus
gctgcctgttgtgtggaatgatcca

SEQ ID NO: 408010 - DNA, 25 bp, Rattus norvegicus
gctgccttaaagcatgttgtaacct

SEQ ID NO: 408011 - DNA, 25 bp, Rattus norvegicus
gctgccttaaaggatgttgtaacct

SEQ ID NO: 408012 - DNA, 25 bp, Rattus norvegicus
gctgccttaaatcgccctgtgtaat

SEQ ID NO: 408013 - DNA, 25 bp, Rattus norvegicus
gctgccttaaatggccctgtgtaat

SEQ ID NO: 408014 - DNA, 25 bp, Rattus norvegicus
gctgccttacagcttcacaggtgag

SEQ ID NO: 408015 - DNA, 25 bp, Rattus norvegicus
gctgccttacaggttcacaggtgag

SEQ ID NO: 408016 - DNA, 25 bp, Rattus norvegicus
gctgccttactcacacgagtgtgtg

SEQ ID NO: 408017 - DNA, 25 bp, Rattus norvegicus
gctgccttactctcacgagtgtgtg

SEQ ID NO: 408018 - DNA, 25 bp, Rattus norvegicus
gctgccttatcaagtagtccacggt

SEQ ID NO: 408019 - DNA, 25 bp, Rattus norvegicus
gctgccttatcatgtagtccacggt

SEQ ID NO: 408020 - DNA, 25 bp, Rattus norvegicus
gctgccttcactcaacacggaagaa

SEQ ID NO: 408021 - DNA, 25 bp, Rattus norvegicus
gctgccttcactgaacacggaagaa

SEQ ID NO: 408022 - DNA, 25 bp, Rattus norvegicus
gctgccttcaggatgtgggtgatca

SEQ ID NO: 408023 - DNA, 25 bp, Rattus norvegicus
gctgccttcaggttgtgggtgatca

SEQ ID NO: 408024 - DNA, 25 bp, Rattus norvegicus
gctgccttccgtaggaaccaaggaa

SEQ ID NO: 408025 - DNA, 25 bp, Rattus norvegicus
gctgccttccgttggaaccaaggaa

SEQ ID NO: 408026 - DNA, 25 bp, Rattus norvegicus
gctgccttcgggaccaggacaggaa

SEQ ID NO: 408027 - DNA, 25 bp, Rattus norvegicus
gctgccttcgggtccaggacaggaa

SEQ ID NO: 408028 - DNA, 25 bp, Rattus norvegicus
gctgccttctcaaggctgaggaagc

SEQ ID NO: 408029 - DNA, 25 bp, Rattus norvegicus
gctgccttctcatggctgaggaagc

SEQ ID NO: 408030 - DNA, 25 bp, Rattus norvegicus
gctgccttctgaagggccacagttt

SEQ ID NO: 408031 - DNA, 25 bp, Rattus norvegicus
gctgccttctgatgggccacagttt

SEQ ID NO: 408032 - DNA, 25 bp, Rattus norvegicus
gctgccttctggacatctggattgc

SEQ ID NO: 408033 - DNA, 25 bp, Rattus norvegicus
gctgccttctggtcatctggattgc

SEQ ID NO: 408034 - DNA, 25 bp, Rattus norvegicus
gctgccttctgtagattttggcaaa

SEQ ID NO: 408035 - DNA, 25 bp, Rattus norvegicus
gctgccttctgttgattttggcaaa

SEQ ID NO: 408036 - DNA, 25 bp, Rattus norvegicus
gctgccttgaagatgctgtcctaga

SEQ ID NO: 408037 - DNA, 25 bp, Rattus norvegicus
gctgccttgaagttgctgtcctaga

SEQ ID NO: 408038 - DNA, 25 bp, Rattus norvegicus
gctgccttgctcactgaagcttcag

SEQ ID NO: 408039 - DNA, 25 bp, Rattus norvegicus
gctgccttgctcattgttccaagag

SEQ ID NO: 408040 - DNA, 25 bp, Rattus norvegicus
gctgccttgctctctgaagcttcag

SEQ ID NO: 408041 - DNA, 25 bp, Rattus norvegicus
gctgccttgctctttgttccaagag

SEQ ID NO: 408042 - DNA, 25 bp, Rattus norvegicus
gctgccttggcaagaattagagaac

SEQ ID NO: 408043 - DNA, 25 bp, Rattus norvegicus
gctgccttggcatgaattagagaac

SEQ ID NO: 408044 - DNA, 25 bp, Rattus norvegicus
gctgccttgggcactttaatattgc

SEQ ID NO: 408045 - DNA, 25 bp, Rattus norvegicus
gctgccttgggctctttaatattgc

SEQ ID NO: 408046 - DNA, 25 bp, Rattus norvegicus
gctgccttggtccagtgacagcaag

SEQ ID NO: 408047 - DNA, 25 bp, Rattus norvegicus
gctgccttggtcgagtgacagcaag

SEQ ID NO: 408048 - DNA, 25 bp, Rattus norvegicus
gctgccttggttatgtgatgggtca

SEQ ID NO: 408049 - DNA, 25 bp, Rattus norvegicus
gctgccttggttttgtgatgggtca

SEQ ID NO: 408050 - DNA, 25 bp, Rattus norvegicus
gctgcctttggaagttgctgatttc

SEQ ID NO: 408051 - DNA, 25 bp, Rattus norvegicus
gctgcctttggatgttgctgatttc

SEQ ID NO: 408052 - DNA, 25 bp, Rattus norvegicus
gctgcctttggtcttttgacatgaa

SEQ ID NO: 408053 - DNA, 25 bp, Rattus norvegicus
gctgcctttggtgttttgacatgaa

SEQ ID NO: 408054 - DNA, 25 bp, Rattus norvegicus
gctgcctttttgcacagggttacca

SEQ ID NO: 408055 - DNA, 25 bp, Rattus norvegicus
gctgcctttttggacagggttacca

SEQ ID NO: 408056 - DNA, 25 bp, Rattus norvegicus
gctgcgaaagcgagtactacactat

SEQ ID NO: 408057 - DNA, 25 bp, Rattus norvegicus
gctgcgaaagcgtgtactacactat

SEQ ID NO: 408058 - DNA, 25 bp, Rattus norvegicus
gctgcgaccagtagtgaaataccct

SEQ ID NO: 408059 - DNA, 25 bp, Rattus norvegicus
gctgcgaccagttgtgaaataccct

SEQ ID NO: 408060 - DNA, 25 bp, Rattus norvegicus
gctgcgactctcatcattgtggtat

SEQ ID NO: 408061 - DNA, 25 bp, Rattus norvegicus
gctgcgactctcttcattgtggtat

SEQ ID NO: 408062 - DNA, 25 bp, Rattus norvegicus
gctgcgagaggcacggcgttccgag

SEQ ID NO: 408063 - DNA, 25 bp, Rattus norvegicus
gctgcgagaggctcggcgttccgag

SEQ ID NO: 408064 - DNA, 25 bp, Rattus norvegicus
gctgcgagcacgacctggacgactg

SEQ ID NO: 408065 - DNA, 25 bp, Rattus norvegicus
gctgcgagcacgtcctggacgactg

SEQ ID NO: 408066 - DNA, 25 bp, Rattus norvegicus
gctgcgagctcaacaatggcatcga

SEQ ID NO: 408067 - DNA, 25 bp, Rattus norvegicus
gctgcgagctcatcaatggcatcga

SEQ ID NO: 408068 - DNA, 25 bp, Rattus norvegicus
gctgcgatcacaatggtgcctgtaa

SEQ ID NO: 408069 - DNA, 25 bp, Rattus norvegicus
gctgcgatcacattggtgcctgtaa

SEQ ID NO: 408070 - DNA, 25 bp, Rattus norvegicus
gctgcgcagccaacccgttgaggcg

SEQ ID NO: 408071 - DNA, 25 bp, Rattus norvegicus
gctgcgcagccatcccgttgaggcg

SEQ ID NO: 408072 - DNA, 25 bp, Rattus norvegicus
gctgcgcatcatctaatcctcatta

SEQ ID NO: 408073 - DNA, 25 bp, Rattus norvegicus
gctgcgcatcatgtaatcctcatta

SEQ ID NO: 408074 - DNA, 25 bp, Rattus norvegicus
gctgcgcatttaattagttacttat

SEQ ID NO: 408075 - DNA, 25 bp, Rattus norvegicus
gctgcgcatttatttagttacttat

SEQ ID NO: 408076 - DNA, 25 bp, Rattus norvegicus
gctgcgcccagtagactgcacatgg

SEQ ID NO: 408077 - DNA, 25 bp, Rattus norvegicus
gctgcgcccagttgactgcacatgg

SEQ ID NO: 408078 - DNA, 25 bp, Rattus norvegicus
gctgcgcccgttcacgttcatgagg

SEQ ID NO: 408079 - DNA, 25 bp, Rattus norvegicus
gctgcgcccgttgacgttcatgagg

SEQ ID NO: 408080 - DNA, 25 bp, Rattus norvegicus
gctgcgcgactgatggtagaactca

SEQ ID NO: 408081 - DNA, 25 bp, Rattus norvegicus
gctgcgcgactgttggtagaactca

SEQ ID NO: 408082 - DNA, 25 bp, Rattus norvegicus
gctgcgcggcagacggaacaagcat

SEQ ID NO: 408083 - DNA, 25 bp, Rattus norvegicus
gctgcgcggcagtcggaacaagcat

SEQ ID NO: 408084 - DNA, 25 bp, Rattus norvegicus
gctgcgcgtgtgagctggttattta

SEQ ID NO: 408085 - DNA, 25 bp, Rattus norvegicus
gctgcgcgtgtgtgctggttattta

SEQ ID NO: 408086 - DNA, 25 bp, Rattus norvegicus
gctgcgctaagaacaaactttcctt

SEQ ID NO: 408087 - DNA, 25 bp, Rattus norvegicus
gctgcgctaagatcaaactttcctt

SEQ ID NO: 408088 - DNA, 25 bp, Rattus norvegicus
gctgcgctatgaaacatgtctcact

SEQ ID NO: 408089 - DNA, 25 bp, Rattus norvegicus
gctgcgctatgatacatgtctcact

SEQ ID NO: 408090 - DNA, 25 bp, Rattus norvegicus
gctgcgctgcttagcctaagttgag

SEQ ID NO: 408091 - DNA, 25 bp, Rattus norvegicus
gctgcgctgctttgcctaagttgag

SEQ ID NO: 408092 - DNA, 25 bp, Rattus norvegicus
gctgcgctgtcactatctgggttaa

SEQ ID NO: 408093 - DNA, 25 bp, Rattus norvegicus
gctgcgctgtcagtatctgggttaa

SEQ ID NO: 408094 - DNA, 25 bp, Rattus norvegicus
gctgcgctttttaatccaatgcttt

SEQ ID NO: 408095 - DNA, 25 bp, Rattus norvegicus
gctgcgcttttttatccaatgcttt

SEQ ID NO: 408096 - DNA, 25 bp, Rattus norvegicus
gctgcggacagacaccacttagtgc

SEQ ID NO: 408097 - DNA, 25 bp, Rattus norvegicus
gctgcggacagagaccacttagtgc

SEQ ID NO: 408098 - DNA, 25 bp, Rattus norvegicus
gctgcggatgtgcagtctttcctaa

SEQ ID NO: 408099 - DNA, 25 bp, Rattus norvegicus
gctgcggatgtggagtctttcctaa

SEQ ID NO: 408100 - DNA, 25 bp, Rattus norvegicus
gctgcggcaaccataaccatacaaa

SEQ ID NO: 408101 - DNA, 25 bp, Rattus norvegicus
gctgcggcaaccttaaccatacaaa

SEQ ID NO: 408102 - DNA, 25 bp, Rattus norvegicus
gctgcggcacggatcgattcaaggt

SEQ ID NO: 408103 - DNA, 25 bp, Rattus norvegicus
gctgcggcacggttcgattcaaggt

SEQ ID NO: 408104 - DNA, 25 bp, Rattus norvegicus
gctgcggcatccaatatggcggacg

SEQ ID NO: 408105 - DNA, 25 bp, Rattus norvegicus
gctgcggcatcctatatggcggacg

SEQ ID NO: 408106 - DNA, 25 bp, Rattus norvegicus
gctgcgggaaagctgagcaccataa

SEQ ID NO: 408107 - DNA, 25 bp, Rattus norvegicus
gctgcgggaaaggtgagcaccataa

SEQ ID NO: 408108 - DNA, 25 bp, Rattus norvegicus
gctgcgggcagtaggatagctctct

SEQ ID NO: 408109 - DNA, 25 bp, Rattus norvegicus
gctgcgggcagttggatagctctct

SEQ ID NO: 408110 - DNA, 25 bp, Rattus norvegicus
gctgcgggcgtgaagctcaagtact

SEQ ID NO: 408111 - DNA, 25 bp, Rattus norvegicus
gctgcgggcgtgtagctcaagtact

SEQ ID NO: 408112 - DNA, 25 bp, Rattus norvegicus
gctgcgggtgccctgagcccgagca

SEQ ID NO: 408113 - DNA, 25 bp, Rattus norvegicus
gctgcgggtgccgtgagcccgagca

SEQ ID NO: 408114 - DNA, 25 bp, Rattus norvegicus
gctgcggttccacgagtatgacttc

SEQ ID NO: 408115 - DNA, 25 bp, Rattus norvegicus
gctgcggttccaggagtatgacttc

SEQ ID NO: 408116 - DNA, 25 bp, Rattus norvegicus
gctgcgtccattagtctgcttagat

SEQ ID NO: 408117 - DNA, 25 bp, Rattus norvegicus
gctgcgtccatttgtctgcttagat

SEQ ID NO: 408118 - DNA, 25 bp, Rattus norvegicus
gctgcgtctagaaaggctgcaccaa

SEQ ID NO: 408119 - DNA, 25 bp, Rattus norvegicus
gctgcgtctagataggctgcaccaa

SEQ ID NO: 408120 - DNA, 25 bp, Rattus norvegicus
gctgcgtctgccatgtttacagagg

SEQ ID NO: 408121 - DNA, 25 bp, Rattus norvegicus
gctgcgtctgccttgtttacagagg

SEQ ID NO: 408122 - DNA, 25 bp, Rattus norvegicus
gctgcgtctggcaagaatgcacagt

SEQ ID NO: 408123 - DNA, 25 bp, Rattus norvegicus
gctgcgtctggctagaatgcacagt

SEQ ID NO: 408124 - DNA, 25 bp, Rattus norvegicus
gctgcgtgcgagatgtatggttaat

SEQ ID NO: 408125 - DNA, 25 bp, Rattus norvegicus
gctgcgtgcgagttgtatggttaat

SEQ ID NO: 408126 - DNA, 25 bp, Rattus norvegicus
gctgcgtgggcaccactctgaagca

SEQ ID NO: 408127 - DNA, 25 bp, Rattus norvegicus
gctgcgtgggcagcactctgaagca

SEQ ID NO: 408128 - DNA, 25 bp, Rattus norvegicus
gctgcgtttacaagctcagcagttc

SEQ ID NO: 408129 - DNA, 25 bp, Rattus norvegicus
gctgcgtttacatgctcagcagttc

SEQ ID NO: 408130 - DNA, 25 bp, Rattus norvegicus
gctgcgtttgcacatgttgtcactg

SEQ ID NO: 408131 - DNA, 25 bp, Rattus norvegicus
gctgcgtttgcagatgttgtcactg

SEQ ID NO: 408132 - DNA, 25 bp, Rattus norvegicus
gctgcgttttacaccctttctttga

SEQ ID NO: 408133 - DNA, 25 bp, Rattus norvegicus
gctgcgttttactccctttctttga

SEQ ID NO: 408134 - DNA, 25 bp, Rattus norvegicus
gctgctaaagaaagtcgacgtcgaa

SEQ ID NO: 408135 - DNA, 25 bp, Rattus norvegicus
gctgctaaagaatgtcgacgtcgaa

SEQ ID NO: 408136 - DNA, 25 bp, Rattus norvegicus
gctgctaaatgtactctttgccata

SEQ ID NO: 408137 - DNA, 25 bp, Rattus norvegicus
gctgctaaatgttctctttgccata

SEQ ID NO: 408138 - DNA, 25 bp, Rattus norvegicus
gctgctaaattacatctcgctttct

SEQ ID NO: 408139 - DNA, 25 bp, Rattus norvegicus
gctgctaaattagatctcgctttct

SEQ ID NO: 408140 - DNA, 25 bp, Rattus norvegicus
gctgctaacaatcgagctttacccc

SEQ ID NO: 408141 - DNA, 25 bp, Rattus norvegicus
gctgctaacaatggagctttacccc

SEQ ID NO: 408142 - DNA, 25 bp, Rattus norvegicus
gctgctaacagaacccaggtttttg

SEQ ID NO: 408143 - DNA, 25 bp, Rattus norvegicus
gctgctaacagatcccaggtttttg

SEQ ID NO: 408144 - DNA, 25 bp, Rattus norvegicus
gctgctaaccaaagtctgcgggaaa

SEQ ID NO: 408145 - DNA, 25 bp, Rattus norvegicus
gctgctaaccaatgtctgcgggaaa

SEQ ID NO: 408146 - DNA, 25 bp, Rattus norvegicus
gctgctaaggctagagcccacattg

SEQ ID NO: 408147 - DNA, 25 bp, Rattus norvegicus
gctgctaaggcttgagcccacattg

SEQ ID NO: 408148 - DNA, 25 bp, Rattus norvegicus
gctgctaatgtgagttgttcttggt

SEQ ID NO: 408149 - DNA, 25 bp, Rattus norvegicus
gctgctaatgtgtgttgttcttggt

SEQ ID NO: 408150 - DNA, 25 bp, Rattus norvegicus
gctgctaattgtagtgtgatccttt

SEQ ID NO: 408151 - DNA, 25 bp, Rattus norvegicus
gctgctaattgttgtgtgatccttt

SEQ ID NO: 408152 - DNA, 25 bp, Rattus norvegicus
gctgctacaaaacctcgtggaactg

SEQ ID NO: 408153 - DNA, 25 bp, Rattus norvegicus
gctgctacaaaagctcgtggaactg

SEQ ID NO: 408154 - DNA, 25 bp, Rattus norvegicus
gctgctacaccgaaaagaaaacaac

SEQ ID NO: 408155 - DNA, 25 bp, Rattus norvegicus
gctgctacaccgtaaagaaaacaac

SEQ ID NO: 408156 - DNA, 25 bp, Rattus norvegicus
gctgctacatttatggaggttctgg

SEQ ID NO: 408157 - DNA, 25 bp, Rattus norvegicus
gctgctacatttttggaggttctgg

SEQ ID NO: 408158 - DNA, 25 bp, Rattus norvegicus
gctgctaccacccttttgaaaagca

SEQ ID NO: 408159 - DNA, 25 bp, Rattus norvegicus
gctgctaccaccgttttgaaaagca

SEQ ID NO: 408160 - DNA, 25 bp, Rattus norvegicus
gctgctacctagacaagtgtttttg

SEQ ID NO: 408161 - DNA, 25 bp, Rattus norvegicus
gctgctacctagtcaagtgtttttg

SEQ ID NO: 408162 - DNA, 25 bp, Rattus norvegicus
gctgctacctgtaaacgcatctgta

SEQ ID NO: 408163 - DNA, 25 bp, Rattus norvegicus
gctgctacctgttaacgcatctgta

SEQ ID NO: 408164 - DNA, 25 bp, Rattus norvegicus
gctgctactaaacatggatgccctt

SEQ ID NO: 408165 - DNA, 25 bp, Rattus norvegicus
gctgctactaaagatggatgccctt

SEQ ID NO: 408166 - DNA, 25 bp, Rattus norvegicus
gctgctactaggaaccttcggagtt

SEQ ID NO: 408167 - DNA, 25 bp, Rattus norvegicus
gctgctactaggtaccttcggagtt

SEQ ID NO: 408168 - DNA, 25 bp, Rattus norvegicus
gctgctactgcgctcttgaaatgat

SEQ ID NO: 408169 - DNA, 25 bp, Rattus norvegicus
gctgctactgcggtcttgaaatgat

SEQ ID NO: 408170 - DNA, 25 bp, Rattus norvegicus
gctgctactgctcgaggtgatgcta

SEQ ID NO: 408171 - DNA, 25 bp, Rattus norvegicus
gctgctactgctggaggtgatgcta

SEQ ID NO: 408172 - DNA, 25 bp, Rattus norvegicus
gctgctacttctatacagtgtggct

SEQ ID NO: 408173 - DNA, 25 bp, Rattus norvegicus
gctgctacttctttacagtgtggct

SEQ ID NO: 408174 - DNA, 25 bp, Rattus norvegicus
gctgctacttttacctttatatatt

SEQ ID NO: 408175 - DNA, 25 bp, Rattus norvegicus
gctgctactttttcctttatatatt

SEQ ID NO: 408176 - DNA, 25 bp, Rattus norvegicus
gctgctagccctctgtggttgtgca

SEQ ID NO: 408177 - DNA, 25 bp, Rattus norvegicus
gctgctagccctgtgtggttgtgca

SEQ ID NO: 408178 - DNA, 25 bp, Rattus norvegicus
gctgctagctaccattgtccataaa

SEQ ID NO: 408179 - DNA, 25 bp, Rattus norvegicus
gctgctagctacgattgtccataaa

SEQ ID NO: 408180 - DNA, 25 bp, Rattus norvegicus
gctgctagcttgagtgtggccctgc

SEQ ID NO: 408181 - DNA, 25 bp, Rattus norvegicus
gctgctagcttgtgtgtggccctgc

SEQ ID NO: 408182 - DNA, 25 bp, Rattus norvegicus
gctgctaggttacttggtctgtcta

SEQ ID NO: 408183 - DNA, 25 bp, Rattus norvegicus
gctgctaggttagttggtctgtcta

SEQ ID NO: 408184 - DNA, 25 bp, Rattus norvegicus
gctgctatcaaacgaggctggctgc

SEQ ID NO: 408185 - DNA, 25 bp, Rattus norvegicus
gctgctatcaaaggaggctggctgc

SEQ ID NO: 408186 - DNA, 25 bp, Rattus norvegicus
gctgctatctctattggctgattgc

SEQ ID NO: 408187 - DNA, 25 bp, Rattus norvegicus
gctgctatctcttttggctgattgc

SEQ ID NO: 408188 - DNA, 25 bp, Rattus norvegicus
gctgctatgctgcttgaagctggct

SEQ ID NO: 408189 - DNA, 25 bp, Rattus norvegicus
gctgctatgctggttgaagctggct

SEQ ID NO: 408190 - DNA, 25 bp, Rattus norvegicus
gctgctattctaattacccattttg

SEQ ID NO: 408191 - DNA, 25 bp, Rattus norvegicus
gctgctattctatttacccattttg

SEQ ID NO: 408192 - DNA, 25 bp, Rattus norvegicus
gctgctatttcgctaacttacttct

SEQ ID NO: 408193 - DNA, 25 bp, Rattus norvegicus
gctgctatttcggtaacttacttct

SEQ ID NO: 408194 - DNA, 25 bp, Rattus norvegicus
gctgctcacaggctgaccaagagat

SEQ ID NO: 408195 - DNA, 25 bp, Rattus norvegicus
gctgctcacagggtgaccaagagat

SEQ ID NO: 408196 - DNA, 25 bp, Rattus norvegicus
gctgctcaccacaattttacagaac

SEQ ID NO: 408197 - DNA, 25 bp, Rattus norvegicus
gctgctcaccactattttacagaac

SEQ ID NO: 408198 - DNA, 25 bp, Rattus norvegicus
gctgctcagcatattgggttttctc

SEQ ID NO: 408199 - DNA, 25 bp, Rattus norvegicus
gctgctcagcattttgggttttctc

SEQ ID NO: 408200 - DNA, 25 bp, Rattus norvegicus
gctgctcagcctagttactgagttt

SEQ ID NO: 408201 - DNA, 25 bp, Rattus norvegicus
gctgctcagccttgttactgagttt

SEQ ID NO: 408202 - DNA, 25 bp, Rattus norvegicus
gctgctccaaaactcagacacctgt

SEQ ID NO: 408203 - DNA, 25 bp, Rattus norvegicus
gctgctccaaaagtcagacacctgt

SEQ ID NO: 408204 - DNA, 25 bp, Rattus norvegicus
gctgctccatcaactgtgtgaatca

SEQ ID NO: 408205 - DNA, 25 bp, Rattus norvegicus
gctgctccatcatctgtgtgaatca

SEQ ID NO: 408206 - DNA, 25 bp, Rattus norvegicus
gctgctcccaataatgtctctatga

SEQ ID NO: 408207 - DNA, 25 bp, Rattus norvegicus
gctgctcccaattatgtctctatga

SEQ ID NO: 408208 - DNA, 25 bp, Rattus norvegicus
gctgctcccaggacttgaagaatgt

SEQ ID NO: 408209 - DNA, 25 bp, Rattus norvegicus
gctgctcccaggtcttgaagaatgt

SEQ ID NO: 408210 - DNA, 25 bp, Rattus norvegicus
gctgctcccataatcagtctgtatt

SEQ ID NO: 408211 - DNA, 25 bp, Rattus norvegicus
gctgctcccatattcagtctgtatt

SEQ ID NO: 408212 - DNA, 25 bp, Rattus norvegicus
gctgctccgagaagctcttcaagcc

SEQ ID NO: 408213 - DNA, 25 bp, Rattus norvegicus
gctgctccgagatgctcttcaagcc

SEQ ID NO: 408214 - DNA, 25 bp, Rattus norvegicus
gctgctcctgacaagtgtgtgttca

SEQ ID NO: 408215 - DNA, 25 bp, Rattus norvegicus
gctgctcctgactagtgtgtgttca

SEQ ID NO: 408216 - DNA, 25 bp, Rattus norvegicus
gctgctcctgttcccctgcaggatg

SEQ ID NO: 408217 - DNA, 25 bp, Rattus norvegicus
gctgctcctgttgccctgcaggatg

SEQ ID NO: 408218 - DNA, 25 bp, Rattus norvegicus
gctgctccttggctatgaatctata

SEQ ID NO: 408219 - DNA, 25 bp, Rattus norvegicus
gctgctccttgggtatgaatctata

SEQ ID NO: 408220 - DNA, 25 bp, Rattus norvegicus
gctgctcctttcattatagtaaggc

SEQ ID NO: 408221 - DNA, 25 bp, Rattus norvegicus
gctgctcctttctttatagtaaggc

SEQ ID NO: 408222 - DNA, 25 bp, Rattus norvegicus
gctgctcctttgcatctgctggaaa

SEQ ID NO: 408223 - DNA, 25 bp, Rattus norvegicus
gctgctcctttggatctgctggaaa

SEQ ID NO: 408224 - DNA, 25 bp, Rattus norvegicus
gctgctcggagacgtctccacaaat

SEQ ID NO: 408225 - DNA, 25 bp, Rattus norvegicus
gctgctcggagaggtctccacaaat

SEQ ID NO: 408226 - DNA, 25 bp, Rattus norvegicus
gctgctcggcgcacgggactaacgt

SEQ ID NO: 408227 - DNA, 25 bp, Rattus norvegicus
gctgctcggcgctcgggactaacgt

SEQ ID NO: 408228 - DNA, 25 bp, Rattus norvegicus
gctgctcgtgcacttctgtacaaat

SEQ ID NO: 408229 - DNA, 25 bp, Rattus norvegicus
gctgctcgtgcagttctgtacaaat

SEQ ID NO: 408230 - DNA, 25 bp, Rattus norvegicus
gctgctctaacacatgacccggtat

SEQ ID NO: 408231 - DNA, 25 bp, Rattus norvegicus
gctgctctaacagatgacccggtat

SEQ ID NO: 408232 - DNA, 25 bp, Rattus norvegicus
gctgctctagccaaagtcagaccag

SEQ ID NO: 408233 - DNA, 25 bp, Rattus norvegicus
gctgctctagcctaagtcagaccag

SEQ ID NO: 408234 - DNA, 25 bp, Rattus norvegicus
gctgctctcacactggcttgtaaca

SEQ ID NO: 408235 - DNA, 25 bp, Rattus norvegicus
gctgctctcacagtggcttgtaaca

SEQ ID NO: 408236 - DNA, 25 bp, Rattus norvegicus
gctgctctcaggattcctgtgagaa

SEQ ID NO: 408237 - DNA, 25 bp, Rattus norvegicus
gctgctctcaggtttcctgtgagaa

SEQ ID NO: 408238 - DNA, 25 bp, Rattus norvegicus
gctgctctcagtaattttgtgtcca

SEQ ID NO: 408239 - DNA, 25 bp, Rattus norvegicus
gctgctctcagttattttgtgtcca

SEQ ID NO: 408240 - DNA, 25 bp, Rattus norvegicus
gctgctctcatcatcagaaaccaag

SEQ ID NO: 408241 - DNA, 25 bp, Rattus norvegicus
gctgctctcatcttcagaaaccaag

SEQ ID NO: 408242 - DNA, 25 bp, Rattus norvegicus
gctgctctccaacgctaccaagaag

SEQ ID NO: 408243 - DNA, 25 bp, Rattus norvegicus
gctgctctccaaggctaccaagaag

SEQ ID NO: 408244 - DNA, 25 bp, Rattus norvegicus
gctgctctcttcagcctctgaagaa

SEQ ID NO: 408245 - DNA, 25 bp, Rattus norvegicus
gctgctctcttctgcctctgaagaa

SEQ ID NO: 408246 - DNA, 25 bp, Rattus norvegicus
gctgctctgagacgcccgagtgcaa

SEQ ID NO: 408247 - DNA, 25 bp, Rattus norvegicus
gctgctctgagaggcccgagtgcaa

SEQ ID NO: 408248 - DNA, 25 bp, Rattus norvegicus
gctgctctgccaataatcccaggaa

SEQ ID NO: 408249 - DNA, 25 bp, Rattus norvegicus
gctgctctgccattaatcccaggaa

SEQ ID NO: 408250 - DNA, 25 bp, Rattus norvegicus
gctgctctgcccagctgggaagttc

SEQ ID NO: 408251 - DNA, 25 bp, Rattus norvegicus
gctgctctgccccatgaactttgtg

SEQ ID NO: 408252 - DNA, 25 bp, Rattus norvegicus
gctgctctgcccgatgaactttgtg

SEQ ID NO: 408253 - DNA, 25 bp, Rattus norvegicus
gctgctctgccctgctgggaagttc

SEQ ID NO: 408254 - DNA, 25 bp, Rattus norvegicus
gctgctctggacctcgttgacgaaa

SEQ ID NO: 408255 - DNA, 25 bp, Rattus norvegicus
gctgctctggacgtcgttgacgaaa

SEQ ID NO: 408256 - DNA, 25 bp, Rattus norvegicus
gctgctctggtcagctgatgagtac

SEQ ID NO: 408257 - DNA, 25 bp, Rattus norvegicus
gctgctctggtctgctgatgagtac

SEQ ID NO: 408258 - DNA, 25 bp, Rattus norvegicus
gctgctctgtgtagactgtatgtgc

SEQ ID NO: 408259 - DNA, 25 bp, Rattus norvegicus
gctgctctgtgttgactgtatgtgc

SEQ ID NO: 408260 - DNA, 25 bp, Rattus norvegicus
gctgctctgttaccaatcttctatt

SEQ ID NO: 408261 - DNA, 25 bp, Rattus norvegicus
gctgctctgttagcaatcttctatt

SEQ ID NO: 408262 - DNA, 25 bp, Rattus norvegicus
gctgctcttcataatgtaagcttat

SEQ ID NO: 408263 - DNA, 25 bp, Rattus norvegicus
gctgctcttcatcaaggagctggag

SEQ ID NO: 408264 - DNA, 25 bp, Rattus norvegicus
gctgctcttcatgaaggagctggag

SEQ ID NO: 408265 - DNA, 25 bp, Rattus norvegicus
gctgctcttcattatgtaagcttat

SEQ ID NO: 408266 - DNA, 25 bp, Rattus norvegicus
gctgctcttcgcaggcatgcagata

SEQ ID NO: 408267 - DNA, 25 bp, Rattus norvegicus
gctgctcttcgctggcatgcagata

SEQ ID NO: 408268 - DNA, 25 bp, Rattus norvegicus
gctgctgaacatctgccaaagtttt

SEQ ID NO: 408269 - DNA, 25 bp, Rattus norvegicus
gctgctgaacatgtgccaaagtttt

SEQ ID NO: 408270 - DNA, 25 bp, Rattus norvegicus
gctgctgacaccctgcaaaatggct

SEQ ID NO: 408271 - DNA, 25 bp, Rattus norvegicus
gctgctgacaccgtgcaaaatggct

SEQ ID NO: 408272 - DNA, 25 bp, Rattus norvegicus
gctgctgacattatagctaatcaaa

SEQ ID NO: 408273 - DNA, 25 bp, Rattus norvegicus
gctgctgacattttagctaatcaaa

SEQ ID NO: 408274 - DNA, 25 bp, Rattus norvegicus
gctgctgaccagagccatgaagatc

SEQ ID NO: 408275 - DNA, 25 bp, Rattus norvegicus
gctgctgaccagtgccatgaagatc

SEQ ID NO: 408276 - DNA, 25 bp, Rattus norvegicus
gctgctgaccatacacagagacgca

SEQ ID NO: 408277 - DNA, 25 bp, Rattus norvegicus
gctgctgaccattcacagagacgca

SEQ ID NO: 408278 - DNA, 25 bp, Rattus norvegicus
gctgctgacctgagatttaaacccc

SEQ ID NO: 408279 - DNA, 25 bp, Rattus norvegicus
gctgctgacctgtgatttaaacccc

SEQ ID NO: 408280 - DNA, 25 bp, Rattus norvegicus
gctgctgacttcacacagtttacag

SEQ ID NO: 408281 - DNA, 25 bp, Rattus norvegicus
gctgctgacttctcacagtttacag

SEQ ID NO: 408282 - DNA, 25 bp, Rattus norvegicus
gctgctgaggccagagtccttattg

SEQ ID NO: 408283 - DNA, 25 bp, Rattus norvegicus
gctgctgaggcctgagtccttattg

SEQ ID NO: 408284 - DNA, 25 bp, Rattus norvegicus
gctgctgaggcgctctcggactcct

SEQ ID NO: 408285 - DNA, 25 bp, Rattus norvegicus
gctgctgaggcggtctcggactcct

SEQ ID NO: 408286 - DNA, 25 bp, Rattus norvegicus
gctgctgagggcactagtcgccaaa

SEQ ID NO: 408287 - DNA, 25 bp, Rattus norvegicus
gctgctgagggctctagtcgccaaa

SEQ ID NO: 408288 - DNA, 25 bp, Rattus norvegicus
gctgctgaggttagggtcatctgct

SEQ ID NO: 408289 - DNA, 25 bp, Rattus norvegicus
gctgctgaggtttgggtcatctgct

SEQ ID NO: 408290 - DNA, 25 bp, Rattus norvegicus
gctgctgagtaaacccgggcggcgg

SEQ ID NO: 408291 - DNA, 25 bp, Rattus norvegicus
gctgctgagtaatcccgggcggcgg

SEQ ID NO: 408292 - DNA, 25 bp, Rattus norvegicus
gctgctgatgccaagtgcccctaaa

SEQ ID NO: 408293 - DNA, 25 bp, Rattus norvegicus
gctgctgatgcctagtgcccctaaa

SEQ ID NO: 408294 - DNA, 25 bp, Rattus norvegicus
gctgctgattttctactttagtctc

SEQ ID NO: 408295 - DNA, 25 bp, Rattus norvegicus
gctgctgattttgtactttagtctc

SEQ ID NO: 408296 - DNA, 25 bp, Rattus norvegicus
gctgctgcagccaggattttatatg

SEQ ID NO: 408297 - DNA, 25 bp, Rattus norvegicus
gctgctgcagccagtctggagaaag

SEQ ID NO: 408298 - DNA, 25 bp, Rattus norvegicus
gctgctgcagcctggattttatatg

SEQ ID NO: 408299 - DNA, 25 bp, Rattus norvegicus
gctgctgcagcctgtctggagaaag

SEQ ID NO: 408300 - DNA, 25 bp, Rattus norvegicus
gctgctgcagcgaacctgtgcacat

SEQ ID NO: 408301 - DNA, 25 bp, Rattus norvegicus
gctgctgcagcgtacctgtgcacat

SEQ ID NO: 408302 - DNA, 25 bp, Rattus norvegicus
gctgctgcagctactgagagccttc

SEQ ID NO: 408303 - DNA, 25 bp, Rattus norvegicus
gctgctgcagctaggaatgatgtga

SEQ ID NO: 408304 - DNA, 25 bp, Rattus norvegicus
gctgctgcagcttctgagagccttc

SEQ ID NO: 408305 - DNA, 25 bp, Rattus norvegicus
gctgctgcagcttggaatgatgtga

SEQ ID NO: 408306 - DNA, 25 bp, Rattus norvegicus
gctgctgcaggcacctcaagtagaa

SEQ ID NO: 408307 - DNA, 25 bp, Rattus norvegicus
gctgctgcaggccatttgtcaaaat

SEQ ID NO: 408308 - DNA, 25 bp, Rattus norvegicus
gctgctgcaggcgatttgtcaaaat

SEQ ID NO: 408309 - DNA, 25 bp, Rattus norvegicus
gctgctgcaggctcctcaagtagaa

SEQ ID NO: 408310 - DNA, 25 bp, Rattus norvegicus
gctgctgcagggatctgagctctca

SEQ ID NO: 408311 - DNA, 25 bp, Rattus norvegicus
gctgctgcagggatttaaggtgaca

SEQ ID NO: 408312 - DNA, 25 bp, Rattus norvegicus
gctgctgcagggttctgagctctca

SEQ ID NO: 408313 - DNA, 25 bp, Rattus norvegicus
gctgctgcagggttttaaggtgaca

SEQ ID NO: 408314 - DNA, 25 bp, Rattus norvegicus
gctgctgcagtgagatttagggctt

SEQ ID NO: 408315 - DNA, 25 bp, Rattus norvegicus
gctgctgcagtgtgatttagggctt

SEQ ID NO: 408316 - DNA, 25 bp, Rattus norvegicus
gctgctgcataactggtgtgcctga

SEQ ID NO: 408317 - DNA, 25 bp, Rattus norvegicus
gctgctgcataacttacttttctaa

SEQ ID NO: 408318 - DNA, 25 bp, Rattus norvegicus
gctgctgcataagtggtgtgcctga

SEQ ID NO: 408319 - DNA, 25 bp, Rattus norvegicus
gctgctgcataagttacttttctaa

SEQ ID NO: 408320 - DNA, 25 bp, Rattus norvegicus
gctgctgcattgcactgtgggacta

SEQ ID NO: 408321 - DNA, 25 bp, Rattus norvegicus
gctgctgcattgcatagccaggctc

SEQ ID NO: 408322 - DNA, 25 bp, Rattus norvegicus
gctgctgcattggactgtgggacta

SEQ ID NO: 408323 - DNA, 25 bp, Rattus norvegicus
gctgctgcattggatagccaggctc

SEQ ID NO: 408324 - DNA, 25 bp, Rattus norvegicus
gctgctgccaacagtcctaagaatg

SEQ ID NO: 408325 - DNA, 25 bp, Rattus norvegicus
gctgctgccaactgtcctaagaatg

SEQ ID NO: 408326 - DNA, 25 bp, Rattus norvegicus
gctgctgccagcacaagtgagacaa

SEQ ID NO: 408327 - DNA, 25 bp, Rattus norvegicus
gctgctgccagcacgaagaaggtga

SEQ ID NO: 408328 - DNA, 25 bp, Rattus norvegicus
gctgctgccagctcaagtgagacaa

SEQ ID NO: 408329 - DNA, 25 bp, Rattus norvegicus
gctgctgccagctcgaagaaggtga

SEQ ID NO: 408330 - DNA, 25 bp, Rattus norvegicus
gctgctgcccaacttcaagcggaaa

SEQ ID NO: 408331 - DNA, 25 bp, Rattus norvegicus
gctgctgcccaagttcaagcggaaa

SEQ ID NO: 408332 - DNA, 25 bp, Rattus norvegicus
gctgctgcccagatgttaaatgctt

SEQ ID NO: 408333 - DNA, 25 bp, Rattus norvegicus
gctgctgcccagttgttaaatgctt

SEQ ID NO: 408334 - DNA, 25 bp, Rattus norvegicus
gctgctgccctcatgagtggataca

SEQ ID NO: 408335 - DNA, 25 bp, Rattus norvegicus
gctgctgccctcttgagtggataca

SEQ ID NO: 408336 - DNA, 25 bp, Rattus norvegicus
gctgctgccgaccaaaccagtatta

SEQ ID NO: 408337 - DNA, 25 bp, Rattus norvegicus
gctgctgccgacgaaaccagtatta

SEQ ID NO: 408338 - DNA, 25 bp, Rattus norvegicus
gctgctgccgctctgactgtattta

SEQ ID NO: 408339 - DNA, 25 bp, Rattus norvegicus
gctgctgccgctgtgactgtattta

SEQ ID NO: 408340 - DNA, 25 bp, Rattus norvegicus
gctgctgcctcacgtttattaaaag

SEQ ID NO: 408341 - DNA, 25 bp, Rattus norvegicus
gctgctgcctcaggtttattaaaag

SEQ ID NO: 408342 - DNA, 25 bp, Rattus norvegicus
gctgctgcggttagtaatgccttga

SEQ ID NO: 408343 - DNA, 25 bp, Rattus norvegicus
gctgctgcggtttgtaatgccttga

SEQ ID NO: 408344 - DNA, 25 bp, Rattus norvegicus
gctgctgctaagattttctgaacat

SEQ ID NO: 408345 - DNA, 25 bp, Rattus norvegicus
gctgctgctaagtttttctgaacat

SEQ ID NO: 408346 - DNA, 25 bp, Rattus norvegicus
gctgctgctacaactcaggcaaaca

SEQ ID NO: 408347 - DNA, 25 bp, Rattus norvegicus
gctgctgctacatctcaggcaaaca

SEQ ID NO: 408348 - DNA, 25 bp, Rattus norvegicus
gctgctgctccacgctttaggagag

SEQ ID NO: 408349 - DNA, 25 bp, Rattus norvegicus
gctgctgctccaggctttaggagag

SEQ ID NO: 408350 - DNA, 25 bp, Rattus norvegicus
gctgctgctggaatcggattcacaa

SEQ ID NO: 408351 - DNA, 25 bp, Rattus norvegicus
gctgctgctggattcggattcacaa

SEQ ID NO: 408352 - DNA, 25 bp, Rattus norvegicus
gctgctgctggtctgatggaacttc

SEQ ID NO: 408353 - DNA, 25 bp, Rattus norvegicus
gctgctgctggtgtgatggaacttc

SEQ ID NO: 408354 - DNA, 25 bp, Rattus norvegicus
gctgctgctgtaccatccagagaag

SEQ ID NO: 408355 - DNA, 25 bp, Rattus norvegicus
gctgctgctgtagcatccagagaag

SEQ ID NO: 408356 - DNA, 25 bp, Rattus norvegicus
gctgctgctgtcattgtacgaagac

SEQ ID NO: 408357 - DNA, 25 bp, Rattus norvegicus
gctgctgctgtctttgtacgaagac

SEQ ID NO: 408358 - DNA, 25 bp, Rattus norvegicus
gctgctgcttcccatttggttacaa

SEQ ID NO: 408359 - DNA, 25 bp, Rattus norvegicus
gctgctgcttccgatttggttacaa

SEQ ID NO: 408360 - DNA, 25 bp, Rattus norvegicus
gctgctgcttctacaagaggaggaa

SEQ ID NO: 408361 - DNA, 25 bp, Rattus norvegicus
gctgctgcttcttcaagaggaggaa

SEQ ID NO: 408362 - DNA, 25 bp, Rattus norvegicus
gctgctggaattcatgttgtctaca

SEQ ID NO: 408363 - DNA, 25 bp, Rattus norvegicus
gctgctggaattgatgttgtctaca

SEQ ID NO: 408364 - DNA, 25 bp, Rattus norvegicus
gctgctggaccactaattgcaatat

SEQ ID NO: 408365 - DNA, 25 bp, Rattus norvegicus
gctgctggaccagtaattgcaatat

SEQ ID NO: 408366 - DNA, 25 bp, Rattus norvegicus
gctgctggacccagcattgctgaac

SEQ ID NO: 408367 - DNA, 25 bp, Rattus norvegicus
gctgctggaccctgcattgctgaac

SEQ ID NO: 408368 - DNA, 25 bp, Rattus norvegicus
gctgctggacctaacatatctgaca

SEQ ID NO: 408369 - DNA, 25 bp, Rattus norvegicus
gctgctggaccttacatatctgaca

SEQ ID NO: 408370 - DNA, 25 bp, Rattus norvegicus
gctgctggacttaaccaactggttc

SEQ ID NO: 408371 - DNA, 25 bp, Rattus norvegicus
gctgctggactttaccaactggttc

SEQ ID NO: 408372 - DNA, 25 bp, Rattus norvegicus
gctgctggagaactacatggtcctc

SEQ ID NO: 408373 - DNA, 25 bp, Rattus norvegicus
gctgctggagaagtacatggtcctc

SEQ ID NO: 408374 - DNA, 25 bp, Rattus norvegicus
gctgctggagccaaagccaatcaga

SEQ ID NO: 408375 - DNA, 25 bp, Rattus norvegicus
gctgctggagcctaagccaatcaga

SEQ ID NO: 408376 - DNA, 25 bp, Rattus norvegicus
gctgctggattcagtctttgtattt

SEQ ID NO: 408377 - DNA, 25 bp, Rattus norvegicus
gctgctggattctgtctttgtattt

SEQ ID NO: 408378 - DNA, 25 bp, Rattus norvegicus
gctgctggcaatatgaaaggcacga

SEQ ID NO: 408379 - DNA, 25 bp, Rattus norvegicus
gctgctggcaatttgaaaggcacga

SEQ ID NO: 408380 - DNA, 25 bp, Rattus norvegicus
gctgctggcaccaggcatggatgta

SEQ ID NO: 408381 - DNA, 25 bp, Rattus norvegicus
gctgctggcacctggcatggatgta

SEQ ID NO: 408382 - DNA, 25 bp, Rattus norvegicus
gctgctggcagtcagtcttgacttc

SEQ ID NO: 408383 - DNA, 25 bp, Rattus norvegicus
gctgctggcagtgagtcttgacttc

SEQ ID NO: 408384 - DNA, 25 bp, Rattus norvegicus
gctgctggcccacatacagaggaac

SEQ ID NO: 408385 - DNA, 25 bp, Rattus norvegicus
gctgctggcccagatacagaggaac

SEQ ID NO: 408386 - DNA, 25 bp, Rattus norvegicus
gctgctggcccgagactttgagaag

SEQ ID NO: 408387 - DNA, 25 bp, Rattus norvegicus
gctgctggcccgtgactttgagaag

SEQ ID NO: 408388 - DNA, 25 bp, Rattus norvegicus
gctgctggctagcacctatctccgt

SEQ ID NO: 408389 - DNA, 25 bp, Rattus norvegicus
gctgctggctaggacctatctccgt

SEQ ID NO: 408390 - DNA, 25 bp, Rattus norvegicus
gctgctgggagacgcttcgtctaac

SEQ ID NO: 408391 - DNA, 25 bp, Rattus norvegicus
gctgctgggagaggcttcgtctaac

SEQ ID NO: 408392 - DNA, 25 bp, Rattus norvegicus
gctgctgggaggaggtaatttttct

SEQ ID NO: 408393 - DNA, 25 bp, Rattus norvegicus
gctgctgggaggtggtaatttttct

SEQ ID NO: 408394 - DNA, 25 bp, Rattus norvegicus
gctgctgggcataaaaacccacctg

SEQ ID NO: 408395 - DNA, 25 bp, Rattus norvegicus
gctgctgggcattaaaacccacctg

SEQ ID NO: 408396 - DNA, 25 bp, Rattus norvegicus
gctgctgggtaaagcttgtgacctc

SEQ ID NO: 408397 - DNA, 25 bp, Rattus norvegicus
gctgctgggtaatgcttgtgacctc

SEQ ID NO: 408398 - DNA, 25 bp, Rattus norvegicus
gctgctgggtcacaaatgcttcttc

SEQ ID NO: 408399 - DNA, 25 bp, Rattus norvegicus
gctgctgggtcagaaatgcttcttc

SEQ ID NO: 408400 - DNA, 25 bp, Rattus norvegicus
gctgctggtctgctcaaggaaatga

SEQ ID NO: 408401 - DNA, 25 bp, Rattus norvegicus
gctgctggtctggtcaaggaaatga

SEQ ID NO: 408402 - DNA, 25 bp, Rattus norvegicus
gctgctggtgaactgtgtctccaca

SEQ ID NO: 408403 - DNA, 25 bp, Rattus norvegicus
gctgctggtgaagtgtgtctccaca

SEQ ID NO: 408404 - DNA, 25 bp, Rattus norvegicus
gctgctggtgcacgattcttatcaa

SEQ ID NO: 408405 - DNA, 25 bp, Rattus norvegicus
gctgctggtgcaggattcttatcaa

SEQ ID NO: 408406 - DNA, 25 bp, Rattus norvegicus
gctgctggttaccttttatcagaga

SEQ ID NO: 408407 - DNA, 25 bp, Rattus norvegicus
gctgctggttacgttttatcagaga

SEQ ID NO: 408408 - DNA, 25 bp, Rattus norvegicus
gctgctggttgtaatatggctgctg

SEQ ID NO: 408409 - DNA, 25 bp, Rattus norvegicus
gctgctggttgttatatggctgctg

SEQ ID NO: 408410 - DNA, 25 bp, Rattus norvegicus
gctgctggttttacaaaccttgaat

SEQ ID NO: 408411 - DNA, 25 bp, Rattus norvegicus
gctgctggtttttcaaaccttgaat

SEQ ID NO: 408412 - DNA, 25 bp, Rattus norvegicus
gctgctgtaacacttgcctgtaatc

SEQ ID NO: 408413 - DNA, 25 bp, Rattus norvegicus
gctgctgtaacagttgcctgtaatc

SEQ ID NO: 408414 - DNA, 25 bp, Rattus norvegicus
gctgctgtaattaaactcgttctgg

SEQ ID NO: 408415 - DNA, 25 bp, Rattus norvegicus
gctgctgtaatttaactcgttctgg

SEQ ID NO: 408416 - DNA, 25 bp, Rattus norvegicus
gctgctgtagctcttcctggaacca

SEQ ID NO: 408417 - DNA, 25 bp, Rattus norvegicus
gctgctgtagctgttcctggaacca

SEQ ID NO: 408418 - DNA, 25 bp, Rattus norvegicus
gctgctgtatttaaaccagtggttc

SEQ ID NO: 408419 - DNA, 25 bp, Rattus norvegicus
gctgctgtattttaaccagtggttc

SEQ ID NO: 408420 - DNA, 25 bp, Rattus norvegicus
gctgctgtcaacacactttatctga

SEQ ID NO: 408421 - DNA, 25 bp, Rattus norvegicus
gctgctgtcaactcactttatctga

SEQ ID NO: 408422 - DNA, 25 bp, Rattus norvegicus
gctgctgtcaagaacctaaacctgg

SEQ ID NO: 408423 - DNA, 25 bp, Rattus norvegicus
gctgctgtcaagtacctaaacctgg

SEQ ID NO: 408424 - DNA, 25 bp, Rattus norvegicus
gctgctgtcaatccgttgcatggca

SEQ ID NO: 408425 - DNA, 25 bp, Rattus norvegicus
gctgctgtcaatgcgttgcatggca

SEQ ID NO: 408426 - DNA, 25 bp, Rattus norvegicus
gctgctgtcaccaggagactgtgca

SEQ ID NO: 408427 - DNA, 25 bp, Rattus norvegicus
gctgctgtcacctggagactgtgca

SEQ ID NO: 408428 - DNA, 25 bp, Rattus norvegicus
gctgctgtcaggctgacatctgcat

SEQ ID NO: 408429 - DNA, 25 bp, Rattus norvegicus
gctgctgtcagggtgacatctgcat

SEQ ID NO: 408430 - DNA, 25 bp, Rattus norvegicus
gctgctgtccctcttactcagttta

SEQ ID NO: 408431 - DNA, 25 bp, Rattus norvegicus
gctgctgtccctgttactcagttta

SEQ ID NO: 408432 - DNA, 25 bp, Rattus norvegicus
gctgctgtctttaactgctgtggga

SEQ ID NO: 408433 - DNA, 25 bp, Rattus norvegicus
gctgctgtctttctttgcacatgaa

SEQ ID NO: 408434 - DNA, 25 bp, Rattus norvegicus
gctgctgtctttgtttgcacatgaa

SEQ ID NO: 408435 - DNA, 25 bp, Rattus norvegicus
gctgctgtcttttactgctgtggga

SEQ ID NO: 408436 - DNA, 25 bp, Rattus norvegicus
gctgctgtgaaccagaaccgactgc

SEQ ID NO: 408437 - DNA, 25 bp, Rattus norvegicus
gctgctgtgaacgagaaccgactgc

SEQ ID NO: 408438 - DNA, 25 bp, Rattus norvegicus
gctgctgtgaatctgccactaggtg

SEQ ID NO: 408439 - DNA, 25 bp, Rattus norvegicus
gctgctgtgaatgtgccactaggtg

SEQ ID NO: 408440 - DNA, 25 bp, Rattus norvegicus
gctgctgtgacccttgtatattaca

SEQ ID NO: 408441 - DNA, 25 bp, Rattus norvegicus
gctgctgtgaccgttgtatattaca

SEQ ID NO: 408442 - DNA, 25 bp, Rattus norvegicus
gctgctgtgatgctactgtaatgta

SEQ ID NO: 408443 - DNA, 25 bp, Rattus norvegicus
gctgctgtgatggtactgtaatgta

SEQ ID NO: 408444 - DNA, 25 bp, Rattus norvegicus
gctgctgtgcaaactcatttctcag

SEQ ID NO: 408445 - DNA, 25 bp, Rattus norvegicus
gctgctgtgcaatctcatttctcag

SEQ ID NO: 408446 - DNA, 25 bp, Rattus norvegicus
gctgctgtgcgaagtatgatgtacc

SEQ ID NO: 408447 - DNA, 25 bp, Rattus norvegicus
gctgctgtgcgatgtatgatgtacc

SEQ ID NO: 408448 - DNA, 25 bp, Rattus norvegicus
gctgctgttacacaccaagaactca

SEQ ID NO: 408449 - DNA, 25 bp, Rattus norvegicus
gctgctgttacagaccaagaactca

SEQ ID NO: 408450 - DNA, 25 bp, Rattus norvegicus
gctgctgttacccaaggtactttag

SEQ ID NO: 408451 - DNA, 25 bp, Rattus norvegicus
gctgctgttaccgaaggtactttag

SEQ ID NO: 408452 - DNA, 25 bp, Rattus norvegicus
gctgctgttcatagtgtacgcgtac

SEQ ID NO: 408453 - DNA, 25 bp, Rattus norvegicus
gctgctgttcattgtgtacgcgtac

SEQ ID NO: 408454 - DNA, 25 bp, Rattus norvegicus
gctgctgttccaatcgagcttggat

SEQ ID NO: 408455 - DNA, 25 bp, Rattus norvegicus
gctgctgttccattcgagcttggat

SEQ ID NO: 408456 - DNA, 25 bp, Rattus norvegicus
gctgctgttctgagtacatagtcat

SEQ ID NO: 408457 - DNA, 25 bp, Rattus norvegicus
gctgctgttctgtgtacatagtcat

SEQ ID NO: 408458 - DNA, 25 bp, Rattus norvegicus
gctgctgttgagactgtgtcagtct

SEQ ID NO: 408459 - DNA, 25 bp, Rattus norvegicus
gctgctgttgagtctgtgtcagtct

SEQ ID NO: 408460 - DNA, 25 bp, Rattus norvegicus
gctgcttaaaagctgggcctgccaa

SEQ ID NO: 408461 - DNA, 25 bp, Rattus norvegicus
gctgcttaaaaggtgggcctgccaa

SEQ ID NO: 408462 - DNA, 25 bp, Rattus norvegicus
gctgcttaaagacgcacttggacta

SEQ ID NO: 408463 - DNA, 25 bp, Rattus norvegicus
gctgcttaaagaggcacttggacta

SEQ ID NO: 408464 - DNA, 25 bp, Rattus norvegicus
gctgcttaaaggagcattgagtttt

SEQ ID NO: 408465 - DNA, 25 bp, Rattus norvegicus
gctgcttaaaggtgcattgagtttt

SEQ ID NO: 408466 - DNA, 25 bp, Rattus norvegicus
gctgcttaatcaacttcgggtgttc

SEQ ID NO: 408467 - DNA, 25 bp, Rattus norvegicus
gctgcttaatcatcttcgggtgttc

SEQ ID NO: 408468 - DNA, 25 bp, Rattus norvegicus
gctgcttacaagcttgtttgtgcgt

SEQ ID NO: 408469 - DNA, 25 bp, Rattus norvegicus
gctgcttacaaggttgtttgtgcgt

SEQ ID NO: 408470 - DNA, 25 bp, Rattus norvegicus
gctgcttagcctcgcttggattgca

SEQ ID NO: 408471 - DNA, 25 bp, Rattus norvegicus
gctgcttagcctggcttggattgca

SEQ ID NO: 408472 - DNA, 25 bp, Rattus norvegicus
gctgcttagctgagtattcctgacg

SEQ ID NO: 408473 - DNA, 25 bp, Rattus norvegicus
gctgcttagctgtgtattcctgacg

SEQ ID NO: 408474 - DNA, 25 bp, Rattus norvegicus
gctgcttatagaatttcctgaaaac

SEQ ID NO: 408475 - DNA, 25 bp, Rattus norvegicus
gctgcttatagattttcctgaaaac

SEQ ID NO: 408476 - DNA, 25 bp, Rattus norvegicus
gctgcttatgagctcagttgtctct

SEQ ID NO: 408477 - DNA, 25 bp, Rattus norvegicus
gctgcttatgaggtcagttgtctct

SEQ ID NO: 408478 - DNA, 25 bp, Rattus norvegicus
gctgcttatgtgctacagtggctaa

SEQ ID NO: 408479 - DNA, 25 bp, Rattus norvegicus
gctgcttatgtggtacagtggctaa

SEQ ID NO: 408480 - DNA, 25 bp, Rattus norvegicus
gctgcttcaagactttcgccgacag

SEQ ID NO: 408481 - DNA, 25 bp, Rattus norvegicus
gctgcttcaagagtttcgccgacag

SEQ ID NO: 408482 - DNA, 25 bp, Rattus norvegicus
gctgcttcaaggatcctgagccgga

SEQ ID NO: 408483 - DNA, 25 bp, Rattus norvegicus
gctgcttcaaggttcctgagccgga

SEQ ID NO: 408484 - DNA, 25 bp, Rattus norvegicus
gctgcttcagcccaattgcttgttt

SEQ ID NO: 408485 - DNA, 25 bp, Rattus norvegicus
gctgcttcagccgaattgcttgttt

SEQ ID NO: 408486 - DNA, 25 bp, Rattus norvegicus
gctgcttcccctcaggacaatgtga

SEQ ID NO: 408487 - DNA, 25 bp, Rattus norvegicus
gctgcttcccctgaggacaatgtga

SEQ ID NO: 408488 - DNA, 25 bp, Rattus norvegicus
gctgcttccttgacctcagtttgaa

SEQ ID NO: 408489 - DNA, 25 bp, Rattus norvegicus
gctgcttccttgtcctcagtttgaa

SEQ ID NO: 408490 - DNA, 25 bp, Rattus norvegicus
gctgcttcctttaaaatgagcctca

SEQ ID NO: 408491 - DNA, 25 bp, Rattus norvegicus
gctgcttccttttaaatgagcctca

SEQ ID NO: 408492 - DNA, 25 bp, Rattus norvegicus
gctgcttcgagtcctaagtcggatt

SEQ ID NO: 408493 - DNA, 25 bp, Rattus norvegicus
gctgcttcgagtgctaagtcggatt

SEQ ID NO: 408494 - DNA, 25 bp, Rattus norvegicus
gctgcttcggataatctcatacgtt

SEQ ID NO: 408495 - DNA, 25 bp, Rattus norvegicus
gctgcttcggattatctcatacgtt

SEQ ID NO: 408496 - DNA, 25 bp, Rattus norvegicus
gctgcttctaccacacaagtactga

SEQ ID NO: 408497 - DNA, 25 bp, Rattus norvegicus
gctgcttctacctcacaagtactga

SEQ ID NO: 408498 - DNA, 25 bp, Rattus norvegicus
gctgcttctcccatggagacatgga

SEQ ID NO: 408499 - DNA, 25 bp, Rattus norvegicus
gctgcttctcccttggagacatgga

SEQ ID NO: 408500 - DNA, 25 bp, Rattus norvegicus
gctgcttctctaagtttaatcttaa

SEQ ID NO: 408501 - DNA, 25 bp, Rattus norvegicus
gctgcttctctatgtttaatcttaa

SEQ ID NO: 408502 - DNA, 25 bp, Rattus norvegicus
gctgcttctgacacggatggcatgt

SEQ ID NO: 408503 - DNA, 25 bp, Rattus norvegicus
gctgcttctgactcggatggcatgt

SEQ ID NO: 408504 - DNA, 25 bp, Rattus norvegicus
gctgcttctgagaggcaatgtgaaa

SEQ ID NO: 408505 - DNA, 25 bp, Rattus norvegicus
gctgcttctgagtggcaatgtgaaa

SEQ ID NO: 408506 - DNA, 25 bp, Rattus norvegicus
gctgcttctgtgagttggccaaggc

SEQ ID NO: 408507 - DNA, 25 bp, Rattus norvegicus
gctgcttctgtgtgttggccaaggc

SEQ ID NO: 408508 - DNA, 25 bp, Rattus norvegicus
gctgcttgaacccactgatttatgt

SEQ ID NO: 408509 - DNA, 25 bp, Rattus norvegicus
gctgcttgaaccgactgatttatgt

SEQ ID NO: 408510 - DNA, 25 bp, Rattus norvegicus
gctgcttgaagcacttgtcacactc

SEQ ID NO: 408511 - DNA, 25 bp, Rattus norvegicus
gctgcttgaagctcttgtcacactc

SEQ ID NO: 408512 - DNA, 25 bp, Rattus norvegicus
gctgcttgaagtcttaggccggctt

SEQ ID NO: 408513 - DNA, 25 bp, Rattus norvegicus
gctgcttgaagtgttaggccggctt

SEQ ID NO: 408514 - DNA, 25 bp, Rattus norvegicus
gctgcttgagcaacctgcaaaacat

SEQ ID NO: 408515 - DNA, 25 bp, Rattus norvegicus
gctgcttgagcatcctgcaaaacat

SEQ ID NO: 408516 - DNA, 25 bp, Rattus norvegicus
gctgcttgagctaagccatgaccat

SEQ ID NO: 408517 - DNA, 25 bp, Rattus norvegicus
gctgcttgagcttagccatgaccat

SEQ ID NO: 408518 - DNA, 25 bp, Rattus norvegicus
gctgcttgctcgctgattcgcatcc

SEQ ID NO: 408519 - DNA, 25 bp, Rattus norvegicus
gctgcttgctcggtgattcgcatcc

SEQ ID NO: 408520 - DNA, 25 bp, Rattus norvegicus
gctgcttgctttctttggagtcctg

SEQ ID NO: 408521 - DNA, 25 bp, Rattus norvegicus
gctgcttgctttgtttggagtcctg

SEQ ID NO: 408522 - DNA, 25 bp, Rattus norvegicus
gctgcttggagccttaactctggaa

SEQ ID NO: 408523 - DNA, 25 bp, Rattus norvegicus
gctgcttggagcgttaactctggaa

SEQ ID NO: 408524 - DNA, 25 bp, Rattus norvegicus
gctgcttggattctgcctggaatat

SEQ ID NO: 408525 - DNA, 25 bp, Rattus norvegicus
gctgcttggattgtgcctggaatat

SEQ ID NO: 408526 - DNA, 25 bp, Rattus norvegicus
gctgcttggccaccagaatctgaag

SEQ ID NO: 408527 - DNA, 25 bp, Rattus norvegicus
gctgcttggccagcagaatctgaag

SEQ ID NO: 408528 - DNA, 25 bp, Rattus norvegicus
gctgcttgtctgacatcccataaat

SEQ ID NO: 408529 - DNA, 25 bp, Rattus norvegicus
gctgcttgtctgtcatcccataaat

SEQ ID NO: 408530 - DNA, 25 bp, Rattus norvegicus
gctgcttgtcttatagttgactcca

SEQ ID NO: 408531 - DNA, 25 bp, Rattus norvegicus
gctgcttgtcttttagttgactcca

SEQ ID NO: 408532 - DNA, 25 bp, Rattus norvegicus
gctgcttgtgctctcacacacgcgg

SEQ ID NO: 408533 - DNA, 25 bp, Rattus norvegicus
gctgcttgtgctgtcacacacgcgg

SEQ ID NO: 408534 - DNA, 25 bp, Rattus norvegicus
gctgcttgtgggaagctgtgcatcc

SEQ ID NO: 408535 - DNA, 25 bp, Rattus norvegicus
gctgcttgtgggtagctgtgcatcc

SEQ ID NO: 408536 - DNA, 25 bp, Rattus norvegicus
gctgcttgttacctttcttcaaaac

SEQ ID NO: 408537 - DNA, 25 bp, Rattus norvegicus
gctgcttgttacgtttcttcaaaac

SEQ ID NO: 408538 - DNA, 25 bp, Rattus norvegicus
gctgcttgttttcaagctggtgcct

SEQ ID NO: 408539 - DNA, 25 bp, Rattus norvegicus
gctgcttgttttgaagctggtgcct

SEQ ID NO: 408540 - DNA, 25 bp, Rattus norvegicus
gctgctttaaggagcctatgctttc

SEQ ID NO: 408541 - DNA, 25 bp, Rattus norvegicus
gctgctttaaggtgcctatgctttc

SEQ ID NO: 408542 - DNA, 25 bp, Rattus norvegicus
gctgctttaggaccccaagtggcaa

SEQ ID NO: 408543 - DNA, 25 bp, Rattus norvegicus
gctgctttaggagcccaagtggcaa

SEQ ID NO: 408544 - DNA, 25 bp, Rattus norvegicus
gctgctttcaaactccttcacattg

SEQ ID NO: 408545 - DNA, 25 bp, Rattus norvegicus
gctgctttcaaagtccttcacattg

SEQ ID NO: 408546 - DNA, 25 bp, Rattus norvegicus
gctgctttcattacttggctattgt

SEQ ID NO: 408547 - DNA, 25 bp, Rattus norvegicus
gctgctttcatttcttggctattgt

SEQ ID NO: 408548 - DNA, 25 bp, Rattus norvegicus
gctgctttccatcctgcttatgagt

SEQ ID NO: 408549 - DNA, 25 bp, Rattus norvegicus
gctgctttccatgctgcttatgagt

SEQ ID NO: 408550 - DNA, 25 bp, Rattus norvegicus
gctgctttcctgacaacttgactga

SEQ ID NO: 408551 - DNA, 25 bp, Rattus norvegicus
gctgctttcctgcagtgatgactgg

SEQ ID NO: 408552 - DNA, 25 bp, Rattus norvegicus
gctgctttcctggagtgatgactgg

SEQ ID NO: 408553 - DNA, 25 bp, Rattus norvegicus
gctgctttcctgtcaacttgactga

SEQ ID NO: 408554 - DNA, 25 bp, Rattus norvegicus
gctgctttctcacggatcctgagtt

SEQ ID NO: 408555 - DNA, 25 bp, Rattus norvegicus
gctgctttctcagggatcctgagtt

SEQ ID NO: 408556 - DNA, 25 bp, Rattus norvegicus
gctgctttcttgatttgttccgtat

SEQ ID NO: 408557 - DNA, 25 bp, Rattus norvegicus
gctgctttcttgttttgttccgtat

SEQ ID NO: 408558 - DNA, 25 bp, Rattus norvegicus
gctgctttgatcatacttttctgaa

SEQ ID NO: 408559 - DNA, 25 bp, Rattus norvegicus
gctgctttgatcttacttttctgaa

SEQ ID NO: 408560 - DNA, 25 bp, Rattus norvegicus
gctgctttgggaagaagctctctga

SEQ ID NO: 408561 - DNA, 25 bp, Rattus norvegicus
gctgctttgggatgaagctctctga

SEQ ID NO: 408562 - DNA, 25 bp, Rattus norvegicus
gctgcttttaatctgctgtggactg

SEQ ID NO: 408563 - DNA, 25 bp, Rattus norvegicus
gctgcttttaatgtgctgtggactg

SEQ ID NO: 408564 - DNA, 25 bp, Rattus norvegicus
gctgcttttctaaatcgtgctgctc

SEQ ID NO: 408565 - DNA, 25 bp, Rattus norvegicus
gctgcttttctatatcgtgctgctc

SEQ ID NO: 408566 - DNA, 25 bp, Rattus norvegicus
gctgcttttcttattataccctgat

SEQ ID NO: 408567 - DNA, 25 bp, Rattus norvegicus
gctgcttttcttcattctggttgaa

SEQ ID NO: 408568 - DNA, 25 bp, Rattus norvegicus
gctgcttttcttgattctggttgaa

SEQ ID NO: 408569 - DNA, 25 bp, Rattus norvegicus
gctgcttttctttttataccctgat

SEQ ID NO: 408570 - DNA, 25 bp, Rattus norvegicus
gctgcttttggtatcttcattttct

SEQ ID NO: 408571 - DNA, 25 bp, Rattus norvegicus
gctgcttttggtttcttcattttct

SEQ ID NO: 408572 - DNA, 25 bp, Rattus norvegicus
gctgcttttgtactcggacttgtcc

SEQ ID NO: 408573 - DNA, 25 bp, Rattus norvegicus
gctgcttttgtagtcggacttgtcc

SEQ ID NO: 408574 - DNA, 25 bp, Rattus norvegicus
gctgcttttttgcagtgtcctgtag

SEQ ID NO: 408575 - DNA, 25 bp, Rattus norvegicus
gctgcttttttggagtgtcctgtag

SEQ ID NO: 408576 - DNA, 25 bp, Rattus norvegicus
gctggaaaacgtacttgcaccctga

SEQ ID NO: 408577 - DNA, 25 bp, Rattus norvegicus
gctggaaaacgttcttgcaccctga

SEQ ID NO: 408578 - DNA, 25 bp, Rattus norvegicus
gctggaaaacttcacatattgctgt

SEQ ID NO: 408579 - DNA, 25 bp, Rattus norvegicus
gctggaaaacttgacatattgctgt

SEQ ID NO: 408580 - DNA, 25 bp, Rattus norvegicus
gctggaaaagatacatcccactgga

SEQ ID NO: 408581 - DNA, 25 bp, Rattus norvegicus
gctggaaaagattcatcccactgga

SEQ ID NO: 408582 - DNA, 25 bp, Rattus norvegicus
gctggaaacatcactgcgtactgga

SEQ ID NO: 408583 - DNA, 25 bp, Rattus norvegicus
gctggaaacatctctgcgtactgga

SEQ ID NO: 408584 - DNA, 25 bp, Rattus norvegicus
gctggaaacgccctccgtgagttcc

SEQ ID NO: 408585 - DNA, 25 bp, Rattus norvegicus
gctggaaacgccgtccgtgagttcc

SEQ ID NO: 408586 - DNA, 25 bp, Rattus norvegicus
gctggaaagatgcttgagctgttct

SEQ ID NO: 408587 - DNA, 25 bp, Rattus norvegicus
gctggaaagatggttgagctgttct

SEQ ID NO: 408588 - DNA, 25 bp, Rattus norvegicus
gctggaaagcaaccctcaagtgact

SEQ ID NO: 408589 - DNA, 25 bp, Rattus norvegicus
gctggaaagcaagcctcaagtgact

SEQ ID NO: 408590 - DNA, 25 bp, Rattus norvegicus
gctggaaagctcatactgtacgtca

SEQ ID NO: 408591 - DNA, 25 bp, Rattus norvegicus
gctggaaagctcttactgtacgtca

SEQ ID NO: 408592 - DNA, 25 bp, Rattus norvegicus
gctggaaaggagcttaagtacccat

SEQ ID NO: 408593 - DNA, 25 bp, Rattus norvegicus
gctggaaaggaggttaagtacccat

SEQ ID NO: 408594 - DNA, 25 bp, Rattus norvegicus
gctggaaagttgagacccctgggat

SEQ ID NO: 408595 - DNA, 25 bp, Rattus norvegicus
gctggaaagttgtgacccctgggat

SEQ ID NO: 408596 - DNA, 25 bp, Rattus norvegicus
gctggaaatccaacatcttactcaa

SEQ ID NO: 408597 - DNA, 25 bp, Rattus norvegicus
gctggaaatccatcatcttactcaa

SEQ ID NO: 408598 - DNA, 25 bp, Rattus norvegicus
gctggaaatggtatctttccccacc

SEQ ID NO: 408599 - DNA, 25 bp, Rattus norvegicus
gctggaaatggtttctttccccacc

SEQ ID NO: 408600 - DNA, 25 bp, Rattus norvegicus
gctggaaatgtgaacgtatgcctaa

SEQ ID NO: 408601 - DNA, 25 bp, Rattus norvegicus
gctggaaatgtgtacgtatgcctaa

SEQ ID NO: 408602 - DNA, 25 bp, Rattus norvegicus
gctggaaattttctttttcaagtct

SEQ ID NO: 408603 - DNA, 25 bp, Rattus norvegicus
gctggaaattttgtttttcaagtct

SEQ ID NO: 408604 - DNA, 25 bp, Rattus norvegicus
gctggaacactactcggagctgcta

SEQ ID NO: 408605 - DNA, 25 bp, Rattus norvegicus
gctggaacactagtcggagctgcta

SEQ ID NO: 408606 - DNA, 25 bp, Rattus norvegicus
gctggaacccataccatcgaggaat

SEQ ID NO: 408607 - DNA, 25 bp, Rattus norvegicus
gctggaacccattccatcgaggaat

SEQ ID NO: 408608 - DNA, 25 bp, Rattus norvegicus
gctggaaccccaacactatgaacaa

SEQ ID NO: 408609 - DNA, 25 bp, Rattus norvegicus
gctggaaccccatcactatgaacaa

SEQ ID NO: 408610 - DNA, 25 bp, Rattus norvegicus
gctggaacgccaaacataattacat

SEQ ID NO: 408611 - DNA, 25 bp, Rattus norvegicus
gctggaacgccatacataattacat

SEQ ID NO: 408612 - DNA, 25 bp, Rattus norvegicus
gctggaacggccacattcatgatct

SEQ ID NO: 408613 - DNA, 25 bp, Rattus norvegicus
gctggaacggcctcattcatgatct

SEQ ID NO: 408614 - DNA, 25 bp, Rattus norvegicus
gctggaactacacccttggctttct

SEQ ID NO: 408615 - DNA, 25 bp, Rattus norvegicus
gctggaactacagccttggctttct

SEQ ID NO: 408616 - DNA, 25 bp, Rattus norvegicus
gctggaactagaagtccctcaggcc

SEQ ID NO: 408617 - DNA, 25 bp, Rattus norvegicus
gctggaactagatgtccctcaggcc

SEQ ID NO: 408618 - DNA, 25 bp, Rattus norvegicus
gctggaactctacgtacacaccaac

SEQ ID NO: 408619 - DNA, 25 bp, Rattus norvegicus
gctggaactctaggtacacaccaac

SEQ ID NO: 408620 - DNA, 25 bp, Rattus norvegicus
gctggaactgaacccacattcgtca

SEQ ID NO: 408621 - DNA, 25 bp, Rattus norvegicus
gctggaactgaagccacattcgtca

SEQ ID NO: 408622 - DNA, 25 bp, Rattus norvegicus
gctggaactgcacaggctgagctca

SEQ ID NO: 408623 - DNA, 25 bp, Rattus norvegicus
gctggaactgcagaggctgagctca

SEQ ID NO: 408624 - DNA, 25 bp, Rattus norvegicus
gctggaactgctcatatgtggacta

SEQ ID NO: 408625 - DNA, 25 bp, Rattus norvegicus
gctggaactgctgatatgtggacta

SEQ ID NO: 408626 - DNA, 25 bp, Rattus norvegicus
gctggaactgttcctggaacctggt

SEQ ID NO: 408627 - DNA, 25 bp, Rattus norvegicus
gctggaactgttgctggaacctggt

SEQ ID NO: 408628 - DNA, 25 bp, Rattus norvegicus
gctggaagaagccaccgctggaata

SEQ ID NO: 408629 - DNA, 25 bp, Rattus norvegicus
gctggaagaagcgaccgctggaata

SEQ ID NO: 408630 - DNA, 25 bp, Rattus norvegicus
gctggaagactgatcatgagggact

SEQ ID NO: 408631 - DNA, 25 bp, Rattus norvegicus
gctggaagactgttcatgagggact

SEQ ID NO: 408632 - DNA, 25 bp, Rattus norvegicus
gctggaagacttcaagccttggcca

SEQ ID NO: 408633 - DNA, 25 bp, Rattus norvegicus
gctggaagacttgaagccttggcca

SEQ ID NO: 408634 - DNA, 25 bp, Rattus norvegicus
gctggaagatgtcgccttgataacc

SEQ ID NO: 408635 - DNA, 25 bp, Rattus norvegicus
gctggaagatgtggccttgataacc

SEQ ID NO: 408636 - DNA, 25 bp, Rattus norvegicus
gctggaagcagtcaggctgcccaaa

SEQ ID NO: 408637 - DNA, 25 bp, Rattus norvegicus
gctggaagcagtgaggctgcccaaa

SEQ ID NO: 408638 - DNA, 25 bp, Rattus norvegicus
gctggaagcgccagcctacgaagga

SEQ ID NO: 408639 - DNA, 25 bp, Rattus norvegicus
gctggaagcgcctgcctacgaagga

SEQ ID NO: 408640 - DNA, 25 bp, Rattus norvegicus
gctggaagcttcctgctatctgtac

SEQ ID NO: 408641 - DNA, 25 bp, Rattus norvegicus
gctggaagcttcgtgctatctgtac

SEQ ID NO: 408642 - DNA, 25 bp, Rattus norvegicus
gctggaagggcaacaactcaactga

SEQ ID NO: 408643 - DNA, 25 bp, Rattus norvegicus
gctggaagggcatcaactcaactga

SEQ ID NO: 408644 - DNA, 25 bp, Rattus norvegicus
gctggaagggttacaaggtccttgc

SEQ ID NO: 408645 - DNA, 25 bp, Rattus norvegicus
gctggaagggtttcaaggtccttgc

SEQ ID NO: 408646 - DNA, 25 bp, Rattus norvegicus
gctggaagtcagacccatcctgcag

SEQ ID NO: 408647 - DNA, 25 bp, Rattus norvegicus
gctggaagtcagtcccatcctgcag

SEQ ID NO: 408648 - DNA, 25 bp, Rattus norvegicus
gctggaatagatactcttctccgaa

SEQ ID NO: 408649 - DNA, 25 bp, Rattus norvegicus
gctggaatagattctcttctccgaa

SEQ ID NO: 408650 - DNA, 25 bp, Rattus norvegicus
gctggaatagttcttcgggtttctc

SEQ ID NO: 408651 - DNA, 25 bp, Rattus norvegicus
gctggaatagttgttcgggtttctc

SEQ ID NO: 408652 - DNA, 25 bp, Rattus norvegicus
gctggaatatgtaccaatcccagaa

SEQ ID NO: 408653 - DNA, 25 bp, Rattus norvegicus
gctggaatatgttccaatcccagaa

SEQ ID NO: 408654 - DNA, 25 bp, Rattus norvegicus
gctggaatatttcgcctatcattct

SEQ ID NO: 408655 - DNA, 25 bp, Rattus norvegicus
gctggaatatttggcctatcattct

SEQ ID NO: 408656 - DNA, 25 bp, Rattus norvegicus
gctggaatccatcctaagttctcta

SEQ ID NO: 408657 - DNA, 25 bp, Rattus norvegicus
gctggaatccatgctaagttctcta

SEQ ID NO: 408658 - DNA, 25 bp, Rattus norvegicus
gctggaatctccaagaaccctgtaa

SEQ ID NO: 408659 - DNA, 25 bp, Rattus norvegicus
gctggaatctcctagaaccctgtaa

SEQ ID NO: 408660 - DNA, 25 bp, Rattus norvegicus
gctggaatgacacacctttaatccc

SEQ ID NO: 408661 - DNA, 25 bp, Rattus norvegicus
gctggaatgacagacctttaatccc

SEQ ID NO: 408662 - DNA, 25 bp, Rattus norvegicus
gctggaatgaccacagaaatagtct

SEQ ID NO: 408663 - DNA, 25 bp, Rattus norvegicus
gctggaatgacctcagaaatagtct

SEQ ID NO: 408664 - DNA, 25 bp, Rattus norvegicus
gctggaatgactcccctgttaagaa

SEQ ID NO: 408665 - DNA, 25 bp, Rattus norvegicus
gctggaatgactgccctgttaagaa

SEQ ID NO: 408666 - DNA, 25 bp, Rattus norvegicus
gctggaatgcagcactcattgtaat

SEQ ID NO: 408667 - DNA, 25 bp, Rattus norvegicus
gctggaatgcaggactcattgtaat

SEQ ID NO: 408668 - DNA, 25 bp, Rattus norvegicus
gctggaattctcattgccaagttca

SEQ ID NO: 408669 - DNA, 25 bp, Rattus norvegicus
gctggaattctctttgccaagttca

SEQ ID NO: 408670 - DNA, 25 bp, Rattus norvegicus
gctggacaatggacaagggagaccc

SEQ ID NO: 408671 - DNA, 25 bp, Rattus norvegicus
gctggacaatggtcaagggagaccc

SEQ ID NO: 408672 - DNA, 25 bp, Rattus norvegicus
gctggacaccaacatgcctggcgaa

SEQ ID NO: 408673 - DNA, 25 bp, Rattus norvegicus
gctggacaccaagatgcctggcgaa

SEQ ID NO: 408674 - DNA, 25 bp, Rattus norvegicus
gctggacaccttagagtaccagggc

SEQ ID NO: 408675 - DNA, 25 bp, Rattus norvegicus
gctggacacctttgagtaccagggc

SEQ ID NO: 408676 - DNA, 25 bp, Rattus norvegicus
gctggacacttaccattgtttggtt

SEQ ID NO: 408677 - DNA, 25 bp, Rattus norvegicus
gctggacacttagcattgtttggtt

SEQ ID NO: 408678 - DNA, 25 bp, Rattus norvegicus
gctggacagacaagctcgtcgtgaa

SEQ ID NO: 408679 - DNA, 25 bp, Rattus norvegicus
gctggacagacatgctcgtcgtgaa

SEQ ID NO: 408680 - DNA, 25 bp, Rattus norvegicus
gctggacagatcatccccactcaat

SEQ ID NO: 408681 - DNA, 25 bp, Rattus norvegicus
gctggacagatcttccccactcaat

SEQ ID NO: 408682 - DNA, 25 bp, Rattus norvegicus
gctggacagccaacatggaacggat

SEQ ID NO: 408683 - DNA, 25 bp, Rattus norvegicus
gctggacagccatcatggaacggat

SEQ ID NO: 408684 - DNA, 25 bp, Rattus norvegicus
gctggacagcggaacttcacagtgt

SEQ ID NO: 408685 - DNA, 25 bp, Rattus norvegicus
gctggacagcggtacttcacagtgt

SEQ ID NO: 408686 - DNA, 25 bp, Rattus norvegicus
gctggacagtcaatgacaagtaaga

SEQ ID NO: 408687 - DNA, 25 bp, Rattus norvegicus
gctggacagtcaatggacccgagag

SEQ ID NO: 408688 - DNA, 25 bp, Rattus norvegicus
gctggacagtcattgacaagtaaga

SEQ ID NO: 408689 - DNA, 25 bp, Rattus norvegicus
gctggacagtcattggacccgagag

SEQ ID NO: 408690 - DNA, 25 bp, Rattus norvegicus
gctggacagtgacgccctccggata

SEQ ID NO: 408691 - DNA, 25 bp, Rattus norvegicus
gctggacagtgaggccctccggata

SEQ ID NO: 408692 - DNA, 25 bp, Rattus norvegicus
gctggacagttcagtgggtagctct

SEQ ID NO: 408693 - DNA, 25 bp, Rattus norvegicus
gctggacagttctgtgggtagctct

SEQ ID NO: 408694 - DNA, 25 bp, Rattus norvegicus
gctggacatcatcccttggttaaaa

SEQ ID NO: 408695 - DNA, 25 bp, Rattus norvegicus
gctggacatcatgccttggttaaaa

SEQ ID NO: 408696 - DNA, 25 bp, Rattus norvegicus
gctggacatcttcatggtcacagac

SEQ ID NO: 408697 - DNA, 25 bp, Rattus norvegicus
gctggacatcttgatggtcacagac

SEQ ID NO: 408698 - DNA, 25 bp, Rattus norvegicus
gctggacattacagaactttttctt

SEQ ID NO: 408699 - DNA, 25 bp, Rattus norvegicus
gctggacattactgaactttttctt

SEQ ID NO: 408700 - DNA, 25 bp, Rattus norvegicus
gctggacatttcagcgggagacatc

SEQ ID NO: 408701 - DNA, 25 bp, Rattus norvegicus
gctggacatttctgcgggagacatc

SEQ ID NO: 408702 - DNA, 25 bp, Rattus norvegicus
gctggacattttaatatttgtaaga

SEQ ID NO: 408703 - DNA, 25 bp, Rattus norvegicus
gctggacattttcttgcaacctcac

SEQ ID NO: 408704 - DNA, 25 bp, Rattus norvegicus
gctggacattttgttgcaacctcac

SEQ ID NO: 408705 - DNA, 25 bp, Rattus norvegicus
gctggacatttttatatttgtaaga

SEQ ID NO: 408706 - DNA, 25 bp, Rattus norvegicus
gctggaccacttctttgtagtcttc

SEQ ID NO: 408707 - DNA, 25 bp, Rattus norvegicus
gctggaccacttgtttgtagtcttc

SEQ ID NO: 408708 - DNA, 25 bp, Rattus norvegicus
gctggaccagatctgaggactgttt

SEQ ID NO: 408709 - DNA, 25 bp, Rattus norvegicus
gctggaccagatgtgaggactgttt

SEQ ID NO: 408710 - DNA, 25 bp, Rattus norvegicus
gctggaccaggacgtgtcttctctg

SEQ ID NO: 408711 - DNA, 25 bp, Rattus norvegicus
gctggaccaggaggtgtcttctctg

SEQ ID NO: 408712 - DNA, 25 bp, Rattus norvegicus
gctggaccaggcaacgaactttgaa

SEQ ID NO: 408713 - DNA, 25 bp, Rattus norvegicus
gctggaccaggctacgaactttgaa

SEQ ID NO: 408714 - DNA, 25 bp, Rattus norvegicus
gctggacccatcatagggctcagga

SEQ ID NO: 408715 - DNA, 25 bp, Rattus norvegicus
gctggacccatcttagggctcagga

SEQ ID NO: 408716 - DNA, 25 bp, Rattus norvegicus
gctggaccccagatgtgaggattac

SEQ ID NO: 408717 - DNA, 25 bp, Rattus norvegicus
gctggaccccagttgtgaggattac

SEQ ID NO: 408718 - DNA, 25 bp, Rattus norvegicus
gctggacccgggagccattatggaa

SEQ ID NO: 408719 - DNA, 25 bp, Rattus norvegicus
gctggacccgggtgccattatggaa

SEQ ID NO: 408720 - DNA, 25 bp, Rattus norvegicus
gctggaccctgaaacctcttaggaa

SEQ ID NO: 408721 - DNA, 25 bp, Rattus norvegicus
gctggaccctgatacctcttaggaa

SEQ ID NO: 408722 - DNA, 25 bp, Rattus norvegicus
gctggacctgaacggttgatgccaa

SEQ ID NO: 408723 - DNA, 25 bp, Rattus norvegicus
gctggacctgaagggttgatgccaa

SEQ ID NO: 408724 - DNA, 25 bp, Rattus norvegicus
gctggacctgtaatggagacctaaa

SEQ ID NO: 408725 - DNA, 25 bp, Rattus norvegicus
gctggacctgtattggagacctaaa

SEQ ID NO: 408726 - DNA, 25 bp, Rattus norvegicus
gctggacgagctcaaggcggccctg

SEQ ID NO: 408727 - DNA, 25 bp, Rattus norvegicus
gctggacgagctgaaggcggccctg

SEQ ID NO: 408728 - DNA, 25 bp, Rattus norvegicus
gctggacgctacaccggacgcaaag

SEQ ID NO: 408729 - DNA, 25 bp, Rattus norvegicus
gctggacgctactccggacgcaaag

SEQ ID NO: 408730 - DNA, 25 bp, Rattus norvegicus
gctggacggcacacttgaaggctgt

SEQ ID NO: 408731 - DNA, 25 bp, Rattus norvegicus
gctggacggcactcttgaaggctgt

SEQ ID NO: 408732 - DNA, 25 bp, Rattus norvegicus
gctggactacacactttgcaactac

SEQ ID NO: 408733 - DNA, 25 bp, Rattus norvegicus
gctggactacactctttgcaactac

SEQ ID NO: 408734 - DNA, 25 bp, Rattus norvegicus
gctggactacgacatggtgcatttt

SEQ ID NO: 408735 - DNA, 25 bp, Rattus norvegicus
gctggactacgagatggtgcatttt

SEQ ID NO: 408736 - DNA, 25 bp, Rattus norvegicus
gctggactcaacattacacatgcac

SEQ ID NO: 408737 - DNA, 25 bp, Rattus norvegicus
gctggactcaactttacacatgcac

SEQ ID NO: 408738 - DNA, 25 bp, Rattus norvegicus
gctggactcagtacacatgtgtaac

SEQ ID NO: 408739 - DNA, 25 bp, Rattus norvegicus
gctggactcagttcacatgtgtaac

SEQ ID NO: 408740 - DNA, 25 bp, Rattus norvegicus
gctggactccaactgtatctgttta

SEQ ID NO: 408741 - DNA, 25 bp, Rattus norvegicus
gctggactccaagtgtatctgttta

SEQ ID NO: 408742 - DNA, 25 bp, Rattus norvegicus
gctggactgatcactcttgatttca

SEQ ID NO: 408743 - DNA, 25 bp, Rattus norvegicus
gctggactgatctctcttgatttca

SEQ ID NO: 408744 - DNA, 25 bp, Rattus norvegicus
gctggactgcttataaatatttatc

SEQ ID NO: 408745 - DNA, 25 bp, Rattus norvegicus
gctggactgcttttaaatatttatc

SEQ ID NO: 408746 - DNA, 25 bp, Rattus norvegicus
gctggactggtaactctgggagaca

SEQ ID NO: 408747 - DNA, 25 bp, Rattus norvegicus
gctggactggtatctctgggagaca

SEQ ID NO: 408748 - DNA, 25 bp, Rattus norvegicus
gctggactgtgcacctcacgaaaag

SEQ ID NO: 408749 - DNA, 25 bp, Rattus norvegicus
gctggactgtgccaacaaggtcact

SEQ ID NO: 408750 - DNA, 25 bp, Rattus norvegicus
gctggactgtgcgaacaaggtcact

SEQ ID NO: 408751 - DNA, 25 bp, Rattus norvegicus
gctggactgtgctcctcacgaaaag

SEQ ID NO: 408752 - DNA, 25 bp, Rattus norvegicus
gctggacttgctctacaaagttctt

SEQ ID NO: 408753 - DNA, 25 bp, Rattus norvegicus
gctggacttgctgtacaaagttctt

SEQ ID NO: 408754 - DNA, 25 bp, Rattus norvegicus
gctggactttgacctacttgtatta

SEQ ID NO: 408755 - DNA, 25 bp, Rattus norvegicus
gctggactttgagctacttgtatta

SEQ ID NO: 408756 - DNA, 25 bp, Rattus norvegicus
gctggactttgtcgctatcctagat

SEQ ID NO: 408757 - DNA, 25 bp, Rattus norvegicus
gctggactttgtcttggctgctgta

SEQ ID NO: 408758 - DNA, 25 bp, Rattus norvegicus
gctggactttgtggctatcctagat

SEQ ID NO: 408759 - DNA, 25 bp, Rattus norvegicus
gctggactttgtgttggctgctgta

SEQ ID NO: 408760 - DNA, 25 bp, Rattus norvegicus
gctggagaaaaaacagaccttcttt

SEQ ID NO: 408761 - DNA, 25 bp, Rattus norvegicus
gctggagaaaaatcagaccttcttt

SEQ ID NO: 408762 - DNA, 25 bp, Rattus norvegicus
gctggagaactgaaaatggtcactt

SEQ ID NO: 408763 - DNA, 25 bp, Rattus norvegicus
gctggagaactgtaaatggtcactt

SEQ ID NO: 408764 - DNA, 25 bp, Rattus norvegicus
gctggagaacttcgaagcttatttc

SEQ ID NO: 408765 - DNA, 25 bp, Rattus norvegicus
gctggagaacttggaagcttatttc

SEQ ID NO: 408766 - DNA, 25 bp, Rattus norvegicus
gctggagacagcatttgatcatagt

SEQ ID NO: 408767 - DNA, 25 bp, Rattus norvegicus
gctggagacagcttttgatcatagt

SEQ ID NO: 408768 - DNA, 25 bp, Rattus norvegicus
gctggagacccaaacaatgtacagg

SEQ ID NO: 408769 - DNA, 25 bp, Rattus norvegicus
gctggagacccatacaatgtacagg

SEQ ID NO: 408770 - DNA, 25 bp, Rattus norvegicus
gctggagaccctaagccgtgatctg

SEQ ID NO: 408771 - DNA, 25 bp, Rattus norvegicus
gctggagacccttagccgtgatctg

SEQ ID NO: 408772 - DNA, 25 bp, Rattus norvegicus
gctggagacggaacctaaggcttct

SEQ ID NO: 408773 - DNA, 25 bp, Rattus norvegicus
gctggagacggatcctaaggcttct

SEQ ID NO: 408774 - DNA, 25 bp, Rattus norvegicus
gctggagactacacctgccaagcct

SEQ ID NO: 408775 - DNA, 25 bp, Rattus norvegicus
gctggagactactcctgccaagcct

SEQ ID NO: 408776 - DNA, 25 bp, Rattus norvegicus
gctggagactccatgcccagaggaa

SEQ ID NO: 408777 - DNA, 25 bp, Rattus norvegicus
gctggagactccttgcccagaggaa

SEQ ID NO: 408778 - DNA, 25 bp, Rattus norvegicus
gctggagagattcccaggactgctt

SEQ ID NO: 408779 - DNA, 25 bp, Rattus norvegicus
gctggagagattgccaggactgctt

SEQ ID NO: 408780 - DNA, 25 bp, Rattus norvegicus
gctggagatcaaccttcggaactct

SEQ ID NO: 408781 - DNA, 25 bp, Rattus norvegicus
gctggagatcaagcttcggaactct

SEQ ID NO: 408782 - DNA, 25 bp, Rattus norvegicus
gctggagatcatccgcaaagccatc

SEQ ID NO: 408783 - DNA, 25 bp, Rattus norvegicus
gctggagatcatgcgcaaagccatc

SEQ ID NO: 408784 - DNA, 25 bp, Rattus norvegicus
gctggagatccacaagcctcaggtg

SEQ ID NO: 408785 - DNA, 25 bp, Rattus norvegicus
gctggagatccagaagcctcaggtg

SEQ ID NO: 408786 - DNA, 25 bp, Rattus norvegicus
gctggagattacagtgaccaccttt

SEQ ID NO: 408787 - DNA, 25 bp, Rattus norvegicus
gctggagattactgtgaccaccttt

SEQ ID NO: 408788 - DNA, 25 bp, Rattus norvegicus
gctggagattctcgtgaaccatgaa

SEQ ID NO: 408789 - DNA, 25 bp, Rattus norvegicus
gctggagattctggtgaaccatgaa

SEQ ID NO: 408790 - DNA, 25 bp, Rattus norvegicus
gctggagattgtccctactttaagt

SEQ ID NO: 408791 - DNA, 25 bp, Rattus norvegicus
gctggagattgtgcctactttaagt

SEQ ID NO: 408792 - DNA, 25 bp, Rattus norvegicus
gctggagcaatgaccacagtgctat

SEQ ID NO: 408793 - DNA, 25 bp, Rattus norvegicus
gctggagcaatgtccacagtgctat

SEQ ID NO: 408794 - DNA, 25 bp, Rattus norvegicus
gctggagcacctagaattcctagag

SEQ ID NO: 408795 - DNA, 25 bp, Rattus norvegicus
gctggagcacctccctgggagtcgg

SEQ ID NO: 408796 - DNA, 25 bp, Rattus norvegicus
gctggagcacctgcctgggagtcgg

SEQ ID NO: 408797 - DNA, 25 bp, Rattus norvegicus
gctggagcaccttgaattcctagag

SEQ ID NO: 408798 - DNA, 25 bp, Rattus norvegicus
gctggagccacaagccgacagggat

SEQ ID NO: 408799 - DNA, 25 bp, Rattus norvegicus
gctggagccacatgccgacagggat

SEQ ID NO: 408800 - DNA, 25 bp, Rattus norvegicus
gctggagccagtatgacttgtgaga

SEQ ID NO: 408801 - DNA, 25 bp, Rattus norvegicus
gctggagccagtttgacttgtgaga

SEQ ID NO: 408802 - DNA, 25 bp, Rattus norvegicus
gctggagcccagagactttgatttc

SEQ ID NO: 408803 - DNA, 25 bp, Rattus norvegicus
gctggagcccagtgactttgatttc

SEQ ID NO: 408804 - DNA, 25 bp, Rattus norvegicus
gctggagcccgaaaagcaagatggt

SEQ ID NO: 408805 - DNA, 25 bp, Rattus norvegicus
gctggagcccgaacccaggccagag

SEQ ID NO: 408806 - DNA, 25 bp, Rattus norvegicus
gctggagcccgataagcaagatggt

SEQ ID NO: 408807 - DNA, 25 bp, Rattus norvegicus
gctggagcccgatcccaggccagag

SEQ ID NO: 408808 - DNA, 25 bp, Rattus norvegicus
gctggagcctgaagacactacaact

SEQ ID NO: 408809 - DNA, 25 bp, Rattus norvegicus
gctggagcctgatgacactacaact

SEQ ID NO: 408810 - DNA, 25 bp, Rattus norvegicus
gctggagcctgcaattgcatttaca

SEQ ID NO: 408811 - DNA, 25 bp, Rattus norvegicus
gctggagcctgctattgcatttaca

SEQ ID NO: 408812 - DNA, 25 bp, Rattus norvegicus
gctggagcgatgagccattttccat

SEQ ID NO: 408813 - DNA, 25 bp, Rattus norvegicus
gctggagcgatgtgccattttccat

SEQ ID NO: 408814 - DNA, 25 bp, Rattus norvegicus
gctggagcgcttacattgcagtgga

SEQ ID NO: 408815 - DNA, 25 bp, Rattus norvegicus
gctggagcgctttcattgcagtgga

SEQ ID NO: 408816 - DNA, 25 bp, Rattus norvegicus
gctggagctgctaacatcaagactt

SEQ ID NO: 408817 - DNA, 25 bp, Rattus norvegicus
gctggagctgctcacaatcactggg

SEQ ID NO: 408818 - DNA, 25 bp, Rattus norvegicus
gctggagctgctgacaatcactggg

SEQ ID NO: 408819 - DNA, 25 bp, Rattus norvegicus
gctggagctgcttacatcaagactt

SEQ ID NO: 408820 - DNA, 25 bp, Rattus norvegicus
gctggaggagttacgccgcttcaga

SEQ ID NO: 408821 - DNA, 25 bp, Rattus norvegicus
gctggaggagtttcgccgcttcaga

SEQ ID NO: 408822 - DNA, 25 bp, Rattus norvegicus
gctggaggcgagagtaacttatttt

SEQ ID NO: 408823 - DNA, 25 bp, Rattus norvegicus
gctggaggcgagtgtaacttatttt

SEQ ID NO: 408824 - DNA, 25 bp, Rattus norvegicus
gctggaggctgaaccttcgaagtca

SEQ ID NO: 408825 - DNA, 25 bp, Rattus norvegicus
gctggaggctgatccttcgaagtca

SEQ ID NO: 408826 - DNA, 25 bp, Rattus norvegicus
gctggagggaggaggccaggcaccc

SEQ ID NO: 408827 - DNA, 25 bp, Rattus norvegicus
gctggagggaggtggccaggcaccc

SEQ ID NO: 408828 - DNA, 25 bp, Rattus norvegicus
gctggagggtcgatctctttagcac

SEQ ID NO: 408829 - DNA, 25 bp, Rattus norvegicus
gctggagggtcgttctctttagcac

SEQ ID NO: 408830 - DNA, 25 bp, Rattus norvegicus
gctggaggttcaagccacagaccga

SEQ ID NO: 408831 - DNA, 25 bp, Rattus norvegicus
gctggaggttcatgccacagaccga

SEQ ID NO: 408832 - DNA, 25 bp, Rattus norvegicus
gctggaggttgacagttctagattt

SEQ ID NO: 408833 - DNA, 25 bp, Rattus norvegicus
gctggaggttgagagttctagattt

SEQ ID NO: 408834 - DNA, 25 bp, Rattus norvegicus
gctggagtaacactcacttgtgatc

SEQ ID NO: 408835 - DNA, 25 bp, Rattus norvegicus
gctggagtaacagtcacttgtgatc

SEQ ID NO: 408836 - DNA, 25 bp, Rattus norvegicus
gctggagtcaagcacttcgttggtc

SEQ ID NO: 408837 - DNA, 25 bp, Rattus norvegicus
gctggagtcaaggacttcgttggtc

SEQ ID NO: 408838 - DNA, 25 bp, Rattus norvegicus
gctggagtcacgatgggagtcatca

SEQ ID NO: 408839 - DNA, 25 bp, Rattus norvegicus
gctggagtcacgttgggagtcatca

SEQ ID NO: 408840 - DNA, 25 bp, Rattus norvegicus
gctggagtccgccaaggaactcact

SEQ ID NO: 408841 - DNA, 25 bp, Rattus norvegicus
gctggagtccgcgaaggaactcact

SEQ ID NO: 408842 - DNA, 25 bp, Rattus norvegicus
gctggagtcttccttgtgtcctaga

SEQ ID NO: 408843 - DNA, 25 bp, Rattus norvegicus
gctggagtcttcgttgtgtcctaga

SEQ ID NO: 408844 - DNA, 25 bp, Rattus norvegicus
gctggagtgggtagcatacattagt

SEQ ID NO: 408845 - DNA, 25 bp, Rattus norvegicus
gctggagtgggttgcatacattagt

SEQ ID NO: 408846 - DNA, 25 bp, Rattus norvegicus
gctggagtgtccagaatttcactta

SEQ ID NO: 408847 - DNA, 25 bp, Rattus norvegicus
gctggagtgtcctgaatttcactta

SEQ ID NO: 408848 - DNA, 25 bp, Rattus norvegicus
gctggagttcatcctggcggcacac

SEQ ID NO: 408849 - DNA, 25 bp, Rattus norvegicus
gctggagttcatgctggcggcacac

SEQ ID NO: 408850 - DNA, 25 bp, Rattus norvegicus
gctggagtttagcatttcctgtttc

SEQ ID NO: 408851 - DNA, 25 bp, Rattus norvegicus
gctggagtttaggatttcctgtttc

SEQ ID NO: 408852 - DNA, 25 bp, Rattus norvegicus
gctggagtttgtacgcattgacccc

SEQ ID NO: 408853 - DNA, 25 bp, Rattus norvegicus
gctggagtttgttcgcattgacccc

SEQ ID NO: 408854 - DNA, 25 bp, Rattus norvegicus
gctggatacatccacggacgagctg

SEQ ID NO: 408855 - DNA, 25 bp, Rattus norvegicus
gctggatacatcgacggacgagctg

SEQ ID NO: 408856 - DNA, 25 bp, Rattus norvegicus
gctggataccctattttattcttga

SEQ ID NO: 408857 - DNA, 25 bp, Rattus norvegicus
gctggatacccttttttattcttga

SEQ ID NO: 408858 - DNA, 25 bp, Rattus norvegicus
gctggatagattctggtcccctagg

SEQ ID NO: 408859 - DNA, 25 bp, Rattus norvegicus
gctggatagattgtggtcccctagg

SEQ ID NO: 408860 - DNA, 25 bp, Rattus norvegicus
gctggatatgccctgcagagcactc

SEQ ID NO: 408861 - DNA, 25 bp, Rattus norvegicus
gctggatatgccgtgcagagcactc

SEQ ID NO: 408862 - DNA, 25 bp, Rattus norvegicus
gctggatattttctgcctttgacaa

SEQ ID NO: 408863 - DNA, 25 bp, Rattus norvegicus
gctggatattttgtgcctttgacaa

SEQ ID NO: 408864 - DNA, 25 bp, Rattus norvegicus
gctggatccatgaactatttctgca

SEQ ID NO: 408865 - DNA, 25 bp, Rattus norvegicus
gctggatccatgtactatttctgca

SEQ ID NO: 408866 - DNA, 25 bp, Rattus norvegicus
gctggatccgtgactccagtgacaa

SEQ ID NO: 408867 - DNA, 25 bp, Rattus norvegicus
gctggatccgtgtctccagtgacaa

SEQ ID NO: 408868 - DNA, 25 bp, Rattus norvegicus
gctggatcctgcatgctatataata

SEQ ID NO: 408869 - DNA, 25 bp, Rattus norvegicus
gctggatcctgcttgctatataata

SEQ ID NO: 408870 - DNA, 25 bp, Rattus norvegicus
gctggatcgagcaacacctgaatgg

SEQ ID NO: 408871 - DNA, 25 bp, Rattus norvegicus
gctggatcgagctacacctgaatgg

SEQ ID NO: 408872 - DNA, 25 bp, Rattus norvegicus
gctggatctcacaagttacatcgta

SEQ ID NO: 408873 - DNA, 25 bp, Rattus norvegicus
gctggatctcactagttacatcgta

SEQ ID NO: 408874 - DNA, 25 bp, Rattus norvegicus
gctggatctctcaccacaataggga

SEQ ID NO: 408875 - DNA, 25 bp, Rattus norvegicus
gctggatctctctccacaataggga

SEQ ID NO: 408876 - DNA, 25 bp, Rattus norvegicus
gctggatctgctctttgaagcgcag

SEQ ID NO: 408877 - DNA, 25 bp, Rattus norvegicus
gctggatctgctgtttgaagcgcag

SEQ ID NO: 408878 - DNA, 25 bp, Rattus norvegicus
gctggatctttaaatctgctccctt

SEQ ID NO: 408879 - DNA, 25 bp, Rattus norvegicus
gctggatctttatatctgctccctt

SEQ ID NO: 408880 - DNA, 25 bp, Rattus norvegicus
gctggatgaggtaggacacaccttt

SEQ ID NO: 408881 - DNA, 25 bp, Rattus norvegicus
gctggatgaggttggacacaccttt

SEQ ID NO: 408882 - DNA, 25 bp, Rattus norvegicus
gctggatgatgtaccactttcagaa

SEQ ID NO: 408883 - DNA, 25 bp, Rattus norvegicus
gctggatgatgttccactttcagaa

SEQ ID NO: 408884 - DNA, 25 bp, Rattus norvegicus
gctggatgtggtcctagtgactcat

SEQ ID NO: 408885 - DNA, 25 bp, Rattus norvegicus
gctggatgtggtgctagtgactcat

SEQ ID NO: 408886 - DNA, 25 bp, Rattus norvegicus
gctggattaacactaagcacattta

SEQ ID NO: 408887 - DNA, 25 bp, Rattus norvegicus
gctggattaacagtaagcacattta

SEQ ID NO: 408888 - DNA, 25 bp, Rattus norvegicus
gctggattagtaacgttgggactta

SEQ ID NO: 408889 - DNA, 25 bp, Rattus norvegicus
gctggattagtatcgttgggactta

SEQ ID NO: 408890 - DNA, 25 bp, Rattus norvegicus
gctggattccaacactttgaacttc

SEQ ID NO: 408891 - DNA, 25 bp, Rattus norvegicus
gctggattccaagactttgaacttc

SEQ ID NO: 408892 - DNA, 25 bp, Rattus norvegicus
gctggattcccaagcccatatttct

SEQ ID NO: 408893 - DNA, 25 bp, Rattus norvegicus
gctggattcccatgcccatatttct

SEQ ID NO: 408894 - DNA, 25 bp, Rattus norvegicus
gctggattcctgctcaatatcatcg

SEQ ID NO: 408895 - DNA, 25 bp, Rattus norvegicus
gctggattcctggtcaatatcatcg

SEQ ID NO: 408896 - DNA, 25 bp, Rattus norvegicus
gctggattccttaagtagaccaaat

SEQ ID NO: 408897 - DNA, 25 bp, Rattus norvegicus
gctggattcctttagtagaccaaat

SEQ ID NO: 408898 - DNA, 25 bp, Rattus norvegicus
gctggattcgctcagcatcatggga

SEQ ID NO: 408899 - DNA, 25 bp, Rattus norvegicus
gctggattcgctgagcatcatggga

SEQ ID NO: 408900 - DNA, 25 bp, Rattus norvegicus
gctggatttaatcattcctgcccta

SEQ ID NO: 408901 - DNA, 25 bp, Rattus norvegicus
gctggatttaatgattcctgcccta

SEQ ID NO: 408902 - DNA, 25 bp, Rattus norvegicus
gctggattttacaccttgatttcaa

SEQ ID NO: 408903 - DNA, 25 bp, Rattus norvegicus
gctggattttactccttgatttcaa

SEQ ID NO: 408904 - DNA, 25 bp, Rattus norvegicus
gctggattttcaacaccgtgtttga

SEQ ID NO: 408905 - DNA, 25 bp, Rattus norvegicus
gctggattttcatcaccgtgtttga

SEQ ID NO: 408906 - DNA, 25 bp, Rattus norvegicus
gctggatttttactacttctgacaa

SEQ ID NO: 408907 - DNA, 25 bp, Rattus norvegicus
gctggatttttagtacttctgacaa

SEQ ID NO: 408908 - DNA, 25 bp, Rattus norvegicus
gctggcaaatgaactacttttcttt

SEQ ID NO: 408909 - DNA, 25 bp, Rattus norvegicus
gctggcaaatgatctacttttcttt

SEQ ID NO: 408910 - DNA, 25 bp, Rattus norvegicus
gctggcaaccacctatttattttct

SEQ ID NO: 408911 - DNA, 25 bp, Rattus norvegicus
gctggcaaccacgtatttattttct

SEQ ID NO: 408912 - DNA, 25 bp, Rattus norvegicus
gctggcaacttaattctgatggctt

SEQ ID NO: 408913 - DNA, 25 bp, Rattus norvegicus
gctggcaacttatttctgatggctt

SEQ ID NO: 408914 - DNA, 25 bp, Rattus norvegicus
gctggcaagatcagtgatgcttttt

SEQ ID NO: 408915 - DNA, 25 bp, Rattus norvegicus
gctggcaagatctgtgatgcttttt

SEQ ID NO: 408916 - DNA, 25 bp, Rattus norvegicus
gctggcaagctcaagaaggacacat

SEQ ID NO: 408917 - DNA, 25 bp, Rattus norvegicus
gctggcaagctctagaaggacacat

SEQ ID NO: 408918 - DNA, 25 bp, Rattus norvegicus
gctggcaagtggcacagagcttcta

SEQ ID NO: 408919 - DNA, 25 bp, Rattus norvegicus
gctggcaagtgggacagagcttcta

SEQ ID NO: 408920 - DNA, 25 bp, Rattus norvegicus
gctggcacaagtaaagccgaggcct

SEQ ID NO: 408921 - DNA, 25 bp, Rattus norvegicus
gctggcacaagttaagccgaggcct

SEQ ID NO: 408922 - DNA, 25 bp, Rattus norvegicus
gctggcacacagaacttatgaactt

SEQ ID NO: 408923 - DNA, 25 bp, Rattus norvegicus
gctggcacacagtacttatgaactt

SEQ ID NO: 408924 - DNA, 25 bp, Rattus norvegicus
gctggcacaccaatcttattgttga

SEQ ID NO: 408925 - DNA, 25 bp, Rattus norvegicus
gctggcacaccacatgcagctggaa

SEQ ID NO: 408926 - DNA, 25 bp, Rattus norvegicus
gctggcacaccagatgcagctggaa

SEQ ID NO: 408927 - DNA, 25 bp, Rattus norvegicus
gctggcacaccattcttattgttga

SEQ ID NO: 408928 - DNA, 25 bp, Rattus norvegicus
gctggcacaggaattcttttcttaa

SEQ ID NO: 408929 - DNA, 25 bp, Rattus norvegicus
gctggcacaggaccgaatgaccttc

SEQ ID NO: 408930 - DNA, 25 bp, Rattus norvegicus
gctggcacaggagcgaatgaccttc

SEQ ID NO: 408931 - DNA, 25 bp, Rattus norvegicus
gctggcacaggatttcttttcttaa

SEQ ID NO: 408932 - DNA, 25 bp, Rattus norvegicus
gctggcaccacaaaccatgttacaa

SEQ ID NO: 408933 - DNA, 25 bp, Rattus norvegicus
gctggcaccacataccatgttacaa

SEQ ID NO: 408934 - DNA, 25 bp, Rattus norvegicus
gctggcaccctccaactagaaataa

SEQ ID NO: 408935 - DNA, 25 bp, Rattus norvegicus
gctggcaccctcgaactagaaataa

SEQ ID NO: 408936 - DNA, 25 bp, Rattus norvegicus
gctggcaccttgactctagagaaca

SEQ ID NO: 408937 - DNA, 25 bp, Rattus norvegicus
gctggcaccttgtctctagagaaca

SEQ ID NO: 408938 - DNA, 25 bp, Rattus norvegicus
gctggcacctttaatgtctgcatct

SEQ ID NO: 408939 - DNA, 25 bp, Rattus norvegicus
gctggcaccttttatgtctgcatct

SEQ ID NO: 408940 - DNA, 25 bp, Rattus norvegicus
gctggcactctgcatgtctagtgat

SEQ ID NO: 408941 - DNA, 25 bp, Rattus norvegicus
gctggcactctggatgtctagtgat

SEQ ID NO: 408942 - DNA, 25 bp, Rattus norvegicus
gctggcactgatcttacgttctgtc

SEQ ID NO: 408943 - DNA, 25 bp, Rattus norvegicus
gctggcactgatgttacgttctgtc

SEQ ID NO: 408944 - DNA, 25 bp, Rattus norvegicus
gctggcactgccaatctggtgtagc

SEQ ID NO: 408945 - DNA, 25 bp, Rattus norvegicus
gctggcactgcctatctggtgtagc

SEQ ID NO: 408946 - DNA, 25 bp, Rattus norvegicus
gctggcagcaacaagcctcggcctt

SEQ ID NO: 408947 - DNA, 25 bp, Rattus norvegicus
gctggcagcaaccatttgtcgcaaa

SEQ ID NO: 408948 - DNA, 25 bp, Rattus norvegicus
gctggcagcaacgatttgtcgcaaa

SEQ ID NO: 408949 - DNA, 25 bp, Rattus norvegicus
gctggcagcaactagcctcggcctt

SEQ ID NO: 408950 - DNA, 25 bp, Rattus norvegicus
gctggcagcatcaggacgcactgat

SEQ ID NO: 408951 - DNA, 25 bp, Rattus norvegicus
gctggcagcatctggacgcactgat

SEQ ID NO: 408952 - DNA, 25 bp, Rattus norvegicus
gctggcagccaaccaagaggatcct

SEQ ID NO: 408953 - DNA, 25 bp, Rattus norvegicus
gctggcagccaagcaagaggatcct

SEQ ID NO: 408954 - DNA, 25 bp, Rattus norvegicus
gctggcagcctgagtagaccttgag

SEQ ID NO: 408955 - DNA, 25 bp, Rattus norvegicus
gctggcagcctgtgtagaccttgag

SEQ ID NO: 408956 - DNA, 25 bp, Rattus norvegicus
gctggcagctgtaatcatgcgcggt

SEQ ID NO: 408957 - DNA, 25 bp, Rattus norvegicus
gctggcagctgttatcatgcgcggt

SEQ ID NO: 408958 - DNA, 25 bp, Rattus norvegicus
gctggcaggccactagttaaagcta

SEQ ID NO: 408959 - DNA, 25 bp, Rattus norvegicus
gctggcaggccagtagttaaagcta

SEQ ID NO: 408960 - DNA, 25 bp, Rattus norvegicus
gctggcaggcttaggaaaggccttt

SEQ ID NO: 408961 - DNA, 25 bp, Rattus norvegicus
gctggcaggctttggaaaggccttt

SEQ ID NO: 408962 - DNA, 25 bp, Rattus norvegicus
gctggcagggtcaaactaagttcat

SEQ ID NO: 408963 - DNA, 25 bp, Rattus norvegicus
gctggcagggtctaactaagttcat

SEQ ID NO: 408964 - DNA, 25 bp, Rattus norvegicus
gctggcagtcacatcatagcacaga

SEQ ID NO: 408965 - DNA, 25 bp, Rattus norvegicus
gctggcagtcacttcatagcacaga

SEQ ID NO: 408966 - DNA, 25 bp, Rattus norvegicus
gctggcagttttcttgaacttgctt

SEQ ID NO: 408967 - DNA, 25 bp, Rattus norvegicus
gctggcagttttgttgaacttgctt

SEQ ID NO: 408968 - DNA, 25 bp, Rattus norvegicus
gctggcatatgtctgtaatcctgtt

SEQ ID NO: 408969 - DNA, 25 bp, Rattus norvegicus
gctggcatatgtgtgtaatcctgtt

SEQ ID NO: 408970 - DNA, 25 bp, Rattus norvegicus
gctggcatccttagcagcaaaccaa

SEQ ID NO: 408971 - DNA, 25 bp, Rattus norvegicus
gctggcatcctttgcagcaaaccaa

SEQ ID NO: 408972 - DNA, 25 bp, Rattus norvegicus
gctggcatctcacggaatcccaatg

SEQ ID NO: 408973 - DNA, 25 bp, Rattus norvegicus
gctggcatctcagggaatcccaatg

SEQ ID NO: 408974 - DNA, 25 bp, Rattus norvegicus
gctggcatctccaagtcgagcagaa

SEQ ID NO: 408975 - DNA, 25 bp, Rattus norvegicus
gctggcatctcctagtcgagcagaa

SEQ ID NO: 408976 - DNA, 25 bp, Rattus norvegicus
gctggcatgagtatgtgggcacact

SEQ ID NO: 408977 - DNA, 25 bp, Rattus norvegicus
gctggcatgagtttgtgggcacact

SEQ ID NO: 408978 - DNA, 25 bp, Rattus norvegicus
gctggcatgcctatggctttgtgta

SEQ ID NO: 408979 - DNA, 25 bp, Rattus norvegicus
gctggcatgcctttggctttgtgta

SEQ ID NO: 408980 - DNA, 25 bp, Rattus norvegicus
gctggcatggaaccagagccgctct

SEQ ID NO: 408981 - DNA, 25 bp, Rattus norvegicus
gctggcatggaagcagagccgctct

SEQ ID NO: 408982 - DNA, 25 bp, Rattus norvegicus
gctggcatgtctaaaatgacttaat

SEQ ID NO: 408983 - DNA, 25 bp, Rattus norvegicus
gctggcatgtcttaaatgacttaat

SEQ ID NO: 408984 - DNA, 25 bp, Rattus norvegicus
gctggcattcctcgtactgtataat

SEQ ID NO: 408985 - DNA, 25 bp, Rattus norvegicus
gctggcattcctggtactgtataat

SEQ ID NO: 408986 - DNA, 25 bp, Rattus norvegicus
gctggcattctcacaagtcttggac

SEQ ID NO: 408987 - DNA, 25 bp, Rattus norvegicus
gctggcattctctcaagtcttggac

SEQ ID NO: 408988 - DNA, 25 bp, Rattus norvegicus
gctggcattgctagttctgttctca

SEQ ID NO: 408989 - DNA, 25 bp, Rattus norvegicus
gctggcattgctctcaatgacaaca

SEQ ID NO: 408990 - DNA, 25 bp, Rattus norvegicus
gctggcattgctgtcaatgacaaca

SEQ ID NO: 408991 - DNA, 25 bp, Rattus norvegicus
gctggcattgcttgttctgttctca

SEQ ID NO: 408992 - DNA, 25 bp, Rattus norvegicus
gctggcatttatcatttggctggca

SEQ ID NO: 408993 - DNA, 25 bp, Rattus norvegicus
gctggcatttatgatttggctggca

SEQ ID NO: 408994 - DNA, 25 bp, Rattus norvegicus
gctggcatttggcagaattgtccct

SEQ ID NO: 408995 - DNA, 25 bp, Rattus norvegicus
gctggcatttgggagaattgtccct

SEQ ID NO: 408996 - DNA, 25 bp, Rattus norvegicus
gctggccaagcaagccgtgtcggaa

SEQ ID NO: 408997 - DNA, 25 bp, Rattus norvegicus
gctggccaagcatgccgtgtcggaa

SEQ ID NO: 408998 - DNA, 25 bp, Rattus norvegicus
gctggccaagttactggagccgata

SEQ ID NO: 408999 - DNA, 25 bp, Rattus norvegicus
gctggccaagtttctggagccgata

SEQ ID NO: 409000 - DNA, 25 bp, Rattus norvegicus
gctggccacacacgcagtgggcaac

SEQ ID NO: 409001 - DNA, 25 bp, Rattus norvegicus
gctggccacacaggcagtgggcaac

SEQ ID NO: 409002 - DNA, 25 bp, Rattus norvegicus
gctggccacataattctaatgcaag

SEQ ID NO: 409003 - DNA, 25 bp, Rattus norvegicus
gctggccacatatttctaatgcaag

SEQ ID NO: 409004 - DNA, 25 bp, Rattus norvegicus
gctggccaccaaccaactttgtaaa

SEQ ID NO: 409005 - DNA, 25 bp, Rattus norvegicus
gctggccaccaagcaactttgtaaa

SEQ ID NO: 409006 - DNA, 25 bp, Rattus norvegicus
gctggccacctcaatggagtttatt

SEQ ID NO: 409007 - DNA, 25 bp, Rattus norvegicus
gctggccacctctatggagtttatt

SEQ ID NO: 409008 - DNA, 25 bp, Rattus norvegicus
gctggccacgctagctgtgtcggtc

SEQ ID NO: 409009 - DNA, 25 bp, Rattus norvegicus
gctggccacgcttgctgtgtcggtc

SEQ ID NO: 409010 - DNA, 25 bp, Rattus norvegicus
gctggccacttactataggtcataa

SEQ ID NO: 409011 - DNA, 25 bp, Rattus norvegicus
gctggccacttagtataggtcataa

SEQ ID NO: 409012 - DNA, 25 bp, Rattus norvegicus
gctggccatattatgcttttctgac

SEQ ID NO: 409013 - DNA, 25 bp, Rattus norvegicus
gctggccatattttgcttttctgac

SEQ ID NO: 409014 - DNA, 25 bp, Rattus norvegicus
gctggccatcagaagccatcaggga

SEQ ID NO: 409015 - DNA, 25 bp, Rattus norvegicus
gctggccatcagtagccatcaggga

SEQ ID NO: 409016 - DNA, 25 bp, Rattus norvegicus
gctggccatggaattcatctgataa

SEQ ID NO: 409017 - DNA, 25 bp, Rattus norvegicus
gctggccatggatttcatctgataa

SEQ ID NO: 409018 - DNA, 25 bp, Rattus norvegicus
gctggccatgtcagagcttcacaga

SEQ ID NO: 409019 - DNA, 25 bp, Rattus norvegicus
gctggccatgtctgagcttcacaga

SEQ ID NO: 409020 - DNA, 25 bp, Rattus norvegicus
gctggccattgacctcgacttggag

SEQ ID NO: 409021 - DNA, 25 bp, Rattus norvegicus
gctggccattgagctcgacttggag

SEQ ID NO: 409022 - DNA, 25 bp, Rattus norvegicus
gctggccattgtattacttgctgta

SEQ ID NO: 409023 - DNA, 25 bp, Rattus norvegicus
gctggccattgttttacttgctgta

SEQ ID NO: 409024 - DNA, 25 bp, Rattus norvegicus
gctggcccaatacttaatctttttt

SEQ ID NO: 409025 - DNA, 25 bp, Rattus norvegicus
gctggcccaatagttaatctttttt

SEQ ID NO: 409026 - DNA, 25 bp, Rattus norvegicus
gctggcccacatctatctttgtgta

SEQ ID NO: 409027 - DNA, 25 bp, Rattus norvegicus
gctggcccacatgtatctttgtgta

SEQ ID NO: 409028 - DNA, 25 bp, Rattus norvegicus
gctggcccacctcacatataaaaag

SEQ ID NO: 409029 - DNA, 25 bp, Rattus norvegicus
gctggcccacctgacatataaaaag

SEQ ID NO: 409030 - DNA, 25 bp, Rattus norvegicus
gctggcccagaactcgcagaaatct

SEQ ID NO: 409031 - DNA, 25 bp, Rattus norvegicus
gctggcccagaagtcgcagaaatct

SEQ ID NO: 409032 - DNA, 25 bp, Rattus norvegicus
gctggcccatgaccttgaagtgact

SEQ ID NO: 409033 - DNA, 25 bp, Rattus norvegicus
gctggcccatgagcttgaagtgact

SEQ ID NO: 409034 - DNA, 25 bp, Rattus norvegicus
gctggcccatgtaggttttatgttt

SEQ ID NO: 409035 - DNA, 25 bp, Rattus norvegicus
gctggcccatgttggttttatgttt

SEQ ID NO: 409036 - DNA, 25 bp, Rattus norvegicus
gctggccccaaacgaatgtgtgaag

SEQ ID NO: 409037 - DNA, 25 bp, Rattus norvegicus
gctggccccaaaggaatgtgtgaag

SEQ ID NO: 409038 - DNA, 25 bp, Rattus norvegicus
gctggcccctcaatattcaggaaca

SEQ ID NO: 409039 - DNA, 25 bp, Rattus norvegicus
gctggcccctcattattcaggaaca

SEQ ID NO: 409040 - DNA, 25 bp, Rattus norvegicus
gctggcccctccataaagagttggt

SEQ ID NO: 409041 - DNA, 25 bp, Rattus norvegicus
gctggcccctccttaaagagttggt

SEQ ID NO: 409042 - DNA, 25 bp, Rattus norvegicus
gctggcccgctgcactataagagag

SEQ ID NO: 409043 - DNA, 25 bp, Rattus norvegicus
gctggcccgctggactataagagag

SEQ ID NO: 409044 - DNA, 25 bp, Rattus norvegicus
gctggcccgggaagtaggacatttc

SEQ ID NO: 409045 - DNA, 25 bp, Rattus norvegicus
gctggcccgggatgtaggacatttc

SEQ ID NO: 409046 - DNA, 25 bp, Rattus norvegicus
gctggccctgagaactaccaaattt

SEQ ID NO: 409047 - DNA, 25 bp, Rattus norvegicus
gctggccctgagtactaccaaattt

SEQ ID NO: 409048 - DNA, 25 bp, Rattus norvegicus
gctggccctgggaaaaatgctcaac

SEQ ID NO: 409049 - DNA, 25 bp, Rattus norvegicus
gctggccctgggtaaaatgctcaac

SEQ ID NO: 409050 - DNA, 25 bp, Rattus norvegicus
gctggccctgtgatctccttttgta

SEQ ID NO: 409051 - DNA, 25 bp, Rattus norvegicus
gctggccctgtgttctccttttgta

SEQ ID NO: 409052 - DNA, 25 bp, Rattus norvegicus
gctggccgtgcacatgtttatcgac

SEQ ID NO: 409053 - DNA, 25 bp, Rattus norvegicus
gctggccgtgcagatgtttatcgac

SEQ ID NO: 409054 - DNA, 25 bp, Rattus norvegicus
gctggcctacgcaataagtgaccgg

SEQ ID NO: 409055 - DNA, 25 bp, Rattus norvegicus
gctggcctacgctataagtgaccgg

SEQ ID NO: 409056 - DNA, 25 bp, Rattus norvegicus
gctggcctactacatttcttttata

SEQ ID NO: 409057 - DNA, 25 bp, Rattus norvegicus
gctggcctactagatttcttttata

SEQ ID NO: 409058 - DNA, 25 bp, Rattus norvegicus
gctggcctacttagctgaagactac

SEQ ID NO: 409059 - DNA, 25 bp, Rattus norvegicus
gctggcctactttgctgaagactac

SEQ ID NO: 409060 - DNA, 25 bp, Rattus norvegicus
gctggcctagcacaacggtgcaaca

SEQ ID NO: 409061 - DNA, 25 bp, Rattus norvegicus
gctggcctagcagaacggtgcaaca

SEQ ID NO: 409062 - DNA, 25 bp, Rattus norvegicus
gctggcctagccaaataaagcgttg

SEQ ID NO: 409063 - DNA, 25 bp, Rattus norvegicus
gctggcctagcctaataaagcgttg

SEQ ID NO: 409064 - DNA, 25 bp, Rattus norvegicus
gctggcctcaaaatttaaagattca

SEQ ID NO: 409065 - DNA, 25 bp, Rattus norvegicus
gctggcctcaaactgtcagtcttac

SEQ ID NO: 409066 - DNA, 25 bp, Rattus norvegicus
gctggcctcaaagtgtcagtcttac

SEQ ID NO: 409067 - DNA, 25 bp, Rattus norvegicus
gctggcctcaaattttaaagattca

SEQ ID NO: 409068 - DNA, 25 bp, Rattus norvegicus
gctggcctcataatcactgtgtttg

SEQ ID NO: 409069 - DNA, 25 bp, Rattus norvegicus
gctggcctcatattcactgtgtttg

SEQ ID NO: 409070 - DNA, 25 bp, Rattus norvegicus
gctggcctcgagaacacaggtccat

SEQ ID NO: 409071 - DNA, 25 bp, Rattus norvegicus
gctggcctcgagtacacaggtccat

SEQ ID NO: 409072 - DNA, 25 bp, Rattus norvegicus
gctggcctcgatatcagagagatct

SEQ ID NO: 409073 - DNA, 25 bp, Rattus norvegicus
gctggcctcgatttcagagagatct

SEQ ID NO: 409074 - DNA, 25 bp, Rattus norvegicus
gctggcctgctgactcatggaatga

SEQ ID NO: 409075 - DNA, 25 bp, Rattus norvegicus
gctggcctgctgtctcatggaatga

SEQ ID NO: 409076 - DNA, 25 bp, Rattus norvegicus
gctggcctggatacactgcacaaga

SEQ ID NO: 409077 - DNA, 25 bp, Rattus norvegicus
gctggcctggattcactgcacaaga

SEQ ID NO: 409078 - DNA, 25 bp, Rattus norvegicus
gctggccttaaaatcaccatctagt

SEQ ID NO: 409079 - DNA, 25 bp, Rattus norvegicus
gctggccttaaattcaccatctagt

SEQ ID NO: 409080 - DNA, 25 bp, Rattus norvegicus
gctggccttcaaactatgatcctta

SEQ ID NO: 409081 - DNA, 25 bp, Rattus norvegicus
gctggccttcaatctatgatcctta

SEQ ID NO: 409082 - DNA, 25 bp, Rattus norvegicus
gctggccttcccatctatattggga

SEQ ID NO: 409083 - DNA, 25 bp, Rattus norvegicus
gctggccttcccttctatattggga

SEQ ID NO: 409084 - DNA, 25 bp, Rattus norvegicus
gctggccttggaactccatttgtag

SEQ ID NO: 409085 - DNA, 25 bp, Rattus norvegicus
gctggccttggaactgagttattta

SEQ ID NO: 409086 - DNA, 25 bp, Rattus norvegicus
gctggccttggatctccatttgtag

SEQ ID NO: 409087 - DNA, 25 bp, Rattus norvegicus
gctggccttggatctgagttattta

SEQ ID NO: 409088 - DNA, 25 bp, Rattus norvegicus
gctggccttggtcacagatgcagac

SEQ ID NO: 409089 - DNA, 25 bp, Rattus norvegicus
gctggccttggtgacagatgcagac

SEQ ID NO: 409090 - DNA, 25 bp, Rattus norvegicus
gctggccttgttacacacaatatca

SEQ ID NO: 409091 - DNA, 25 bp, Rattus norvegicus
gctggccttgtttcacacaatatca

SEQ ID NO: 409092 - DNA, 25 bp, Rattus norvegicus
gctggcgacgacacagaaaaagctg

SEQ ID NO: 409093 - DNA, 25 bp, Rattus norvegicus
gctggcgacgactcagaaaaagctg

SEQ ID NO: 409094 - DNA, 25 bp, Rattus norvegicus
gctggcgactgaatgattcctacct

SEQ ID NO: 409095 - DNA, 25 bp, Rattus norvegicus
gctggcgactgattgattcctacct

SEQ ID NO: 409096 - DNA, 25 bp, Rattus norvegicus
gctggcgagctcaagtttctgggct

SEQ ID NO: 409097 - DNA, 25 bp, Rattus norvegicus
gctggcgagctctagtttctgggct

SEQ ID NO: 409098 - DNA, 25 bp, Rattus norvegicus
gctggcgatgagaatgggtatccct

SEQ ID NO: 409099 - DNA, 25 bp, Rattus norvegicus
gctggcgatgagtatgggtatccct

SEQ ID NO: 409100 - DNA, 25 bp, Rattus norvegicus
gctggcgcagctatggaaattgtct

SEQ ID NO: 409101 - DNA, 25 bp, Rattus norvegicus
gctggcgcagctttggaaattgtct

SEQ ID NO: 409102 - DNA, 25 bp, Rattus norvegicus
gctggcgctcaacgtggtccttcgt

SEQ ID NO: 409103 - DNA, 25 bp, Rattus norvegicus
gctggcgctcaaggtggtccttcgt

SEQ ID NO: 409104 - DNA, 25 bp, Rattus norvegicus
gctggcgctggaatcggatcgacac

SEQ ID NO: 409105 - DNA, 25 bp, Rattus norvegicus
gctggcgctggattcggatcgacac

SEQ ID NO: 409106 - DNA, 25 bp, Rattus norvegicus
gctggcggtggtacttggcatccta

SEQ ID NO: 409107 - DNA, 25 bp, Rattus norvegicus
gctggcggtggttcttggcatccta

SEQ ID NO: 409108 - DNA, 25 bp, Rattus norvegicus
gctggcgtcagtcggtgcttctcca

SEQ ID NO: 409109 - DNA, 25 bp, Rattus norvegicus
gctggcgtcagtgggtgcttctcca

SEQ ID NO: 409110 - DNA, 25 bp, Rattus norvegicus
gctggcgttcagcatactgtgattc

SEQ ID NO: 409111 - DNA, 25 bp, Rattus norvegicus
gctggcgttcaggatactgtgattc

SEQ ID NO: 409112 - DNA, 25 bp, Rattus norvegicus
gctggcgtttaactttccactctga

SEQ ID NO: 409113 - DNA, 25 bp, Rattus norvegicus
gctggcgtttaagtttccactctga

SEQ ID NO: 409114 - DNA, 25 bp, Rattus norvegicus
gctggcgtttgcactatgaacacat

SEQ ID NO: 409115 - DNA, 25 bp, Rattus norvegicus
gctggcgtttgctctatgaacacat

SEQ ID NO: 409116 - DNA, 25 bp, Rattus norvegicus
gctggctaaactagctgtgactttc

SEQ ID NO: 409117 - DNA, 25 bp, Rattus norvegicus
gctggctaaacttgctgtgactttc

SEQ ID NO: 409118 - DNA, 25 bp, Rattus norvegicus
gctggctacggtcttggctttgacc

SEQ ID NO: 409119 - DNA, 25 bp, Rattus norvegicus
gctggctacggtgttggctttgacc

SEQ ID NO: 409120 - DNA, 25 bp, Rattus norvegicus
gctggctagccgaccttagggaaga

SEQ ID NO: 409121 - DNA, 25 bp, Rattus norvegicus
gctggctagccgtccttagggaaga

SEQ ID NO: 409122 - DNA, 25 bp, Rattus norvegicus
gctggctagtggcacatggtctttt

SEQ ID NO: 409123 - DNA, 25 bp, Rattus norvegicus
gctggctagtgggacatggtctttt

SEQ ID NO: 409124 - DNA, 25 bp, Rattus norvegicus
gctggctatccaccggacatagtca

SEQ ID NO: 409125 - DNA, 25 bp, Rattus norvegicus
gctggctatccagcggacatagtca

SEQ ID NO: 409126 - DNA, 25 bp, Rattus norvegicus
gctggctcaggccttgtatgaacta

SEQ ID NO: 409127 - DNA, 25 bp, Rattus norvegicus
gctggctcaggcgttgtatgaacta

SEQ ID NO: 409128 - DNA, 25 bp, Rattus norvegicus
gctggctcatttaccctaattttta

SEQ ID NO: 409129 - DNA, 25 bp, Rattus norvegicus
gctggctcattttccctaattttta

SEQ ID NO: 409130 - DNA, 25 bp, Rattus norvegicus
gctggctccaataaaaggttgtcct

SEQ ID NO: 409131 - DNA, 25 bp, Rattus norvegicus
gctggctccaattaaaggttgtcct

SEQ ID NO: 409132 - DNA, 25 bp, Rattus norvegicus
gctggctcccatattgccgaggttc

SEQ ID NO: 409133 - DNA, 25 bp, Rattus norvegicus
gctggctcccattttgccgaggttc

SEQ ID NO: 409134 - DNA, 25 bp, Rattus norvegicus
gctggctctcctatcgatttgaagg

SEQ ID NO: 409135 - DNA, 25 bp, Rattus norvegicus
gctggctctcctttcgatttgaagg

SEQ ID NO: 409136 - DNA, 25 bp, Rattus norvegicus
gctggctctcttagcctgagggaaa

SEQ ID NO: 409137 - DNA, 25 bp, Rattus norvegicus
gctggctctctttgcctgagggaaa

SEQ ID NO: 409138 - DNA, 25 bp, Rattus norvegicus
gctggctctgagcatttcactgtgg

SEQ ID NO: 409139 - DNA, 25 bp, Rattus norvegicus
gctggctctgaggatttcactgtgg

SEQ ID NO: 409140 - DNA, 25 bp, Rattus norvegicus
gctggctctgtaagtgtgggaaccc

SEQ ID NO: 409141 - DNA, 25 bp, Rattus norvegicus
gctggctctgtatgtgtgggaaccc

SEQ ID NO: 409142 - DNA, 25 bp, Rattus norvegicus
gctggctgatgtattgaggcgtctt

SEQ ID NO: 409143 - DNA, 25 bp, Rattus norvegicus
gctggctgatgttttgaggcgtctt

SEQ ID NO: 409144 - DNA, 25 bp, Rattus norvegicus
gctggctgattaattctcttgtgtt

SEQ ID NO: 409145 - DNA, 25 bp, Rattus norvegicus
gctggctgattatttctcttgtgtt

SEQ ID NO: 409146 - DNA, 25 bp, Rattus norvegicus
gctggctgcagcacaaaacagtgcc

SEQ ID NO: 409147 - DNA, 25 bp, Rattus norvegicus
gctggctgcagctcaaaacagtgcc

SEQ ID NO: 409148 - DNA, 25 bp, Rattus norvegicus
gctggctgcattcggaaacccttgg

SEQ ID NO: 409149 - DNA, 25 bp, Rattus norvegicus
gctggctgcattgggaaacccttgg

SEQ ID NO: 409150 - DNA, 25 bp, Rattus norvegicus
gctggctgcctaagctcgaaggaag

SEQ ID NO: 409151 - DNA, 25 bp, Rattus norvegicus
gctggctgcctatgctcgaaggaag

SEQ ID NO: 409152 - DNA, 25 bp, Rattus norvegicus
gctggctgcgcaatcagaagtgtgt

SEQ ID NO: 409153 - DNA, 25 bp, Rattus norvegicus
gctggctgcgcattcagaagtgtgt

SEQ ID NO: 409154 - DNA, 25 bp, Rattus norvegicus
gctggctgcgtaattttctctgcaa

SEQ ID NO: 409155 - DNA, 25 bp, Rattus norvegicus
gctggctgcgtatttttctctgcaa

SEQ ID NO: 409156 - DNA, 25 bp, Rattus norvegicus
gctggctgctgcaacaccgtaaaga

SEQ ID NO: 409157 - DNA, 25 bp, Rattus norvegicus
gctggctgctgctacaccgtaaaga

SEQ ID NO: 409158 - DNA, 25 bp, Rattus norvegicus
gctggctgcttgagggactttagag

SEQ ID NO: 409159 - DNA, 25 bp, Rattus norvegicus
gctggctgcttgtgggactttagag

SEQ ID NO: 409160 - DNA, 25 bp, Rattus norvegicus
gctggctgctttcgtttggaccacg

SEQ ID NO: 409161 - DNA, 25 bp, Rattus norvegicus
gctggctgctttggtttggaccacg

SEQ ID NO: 409162 - DNA, 25 bp, Rattus norvegicus
gctggctggcttaaggacatggcct

SEQ ID NO: 409163 - DNA, 25 bp, Rattus norvegicus
gctggctggcttatccaggcaggat

SEQ ID NO: 409164 - DNA, 25 bp, Rattus norvegicus
gctggctggctttaggacatggcct

SEQ ID NO: 409165 - DNA, 25 bp, Rattus norvegicus
gctggctggcttttccaggcaggat

SEQ ID NO: 409166 - DNA, 25 bp, Rattus norvegicus
gctggctggtgtcaatgcatgctta

SEQ ID NO: 409167 - DNA, 25 bp, Rattus norvegicus
gctggctggtgtgaatgcatgctta

SEQ ID NO: 409168 - DNA, 25 bp, Rattus norvegicus
gctggctgtgaaatactgactggta

SEQ ID NO: 409169 - DNA, 25 bp, Rattus norvegicus
gctggctgtgaattactgactggta

SEQ ID NO: 409170 - DNA, 25 bp, Rattus norvegicus
gctggctgtgctcttagtctctgta

SEQ ID NO: 409171 - DNA, 25 bp, Rattus norvegicus
gctggctgtgctgttagtctctgta

SEQ ID NO: 409172 - DNA, 25 bp, Rattus norvegicus
gctggctgtggcaagacgtttgcaa

SEQ ID NO: 409173 - DNA, 25 bp, Rattus norvegicus
gctggctgtggctagacgtttgcaa

SEQ ID NO: 409174 - DNA, 25 bp, Rattus norvegicus
gctggctgtggtagcatatatttat

SEQ ID NO: 409175 - DNA, 25 bp, Rattus norvegicus
gctggctgtggttgcatatatttat

SEQ ID NO: 409176 - DNA, 25 bp, Rattus norvegicus
gctggctgtgtcacacccctgctta

SEQ ID NO: 409177 - DNA, 25 bp, Rattus norvegicus
gctggctgtgtctcacccctgctta

SEQ ID NO: 409178 - DNA, 25 bp, Rattus norvegicus
gctggctgttcaaacatattactct

SEQ ID NO: 409179 - DNA, 25 bp, Rattus norvegicus
gctggctgttcatacatattactct

SEQ ID NO: 409180 - DNA, 25 bp, Rattus norvegicus
gctggctgttgtcctgattatcatg

SEQ ID NO: 409181 - DNA, 25 bp, Rattus norvegicus
gctggctgttgtgctgattatcatg

SEQ ID NO: 409182 - DNA, 25 bp, Rattus norvegicus
gctggcttacccagggatcatgtta

SEQ ID NO: 409183 - DNA, 25 bp, Rattus norvegicus
gctggcttaccctgggatcatgtta

SEQ ID NO: 409184 - DNA, 25 bp, Rattus norvegicus
gctggcttactgcaaccaagagagc

SEQ ID NO: 409185 - DNA, 25 bp, Rattus norvegicus
gctggcttactggaaccaagagagc

SEQ ID NO: 409186 - DNA, 25 bp, Rattus norvegicus
gctggcttagccaaacctcagttta

SEQ ID NO: 409187 - DNA, 25 bp, Rattus norvegicus
gctggcttagcctaacctcagttta

SEQ ID NO: 409188 - DNA, 25 bp, Rattus norvegicus
gctggcttagtgagctcgaggttca

SEQ ID NO: 409189 - DNA, 25 bp, Rattus norvegicus
gctggcttagtgtgctcgaggttca

SEQ ID NO: 409190 - DNA, 25 bp, Rattus norvegicus
gctggcttatatattgtcctctgta

SEQ ID NO: 409191 - DNA, 25 bp, Rattus norvegicus
gctggcttatattttgtcctctgta

SEQ ID NO: 409192 - DNA, 25 bp, Rattus norvegicus
gctggcttcaagaggcaggacttca

SEQ ID NO: 409193 - DNA, 25 bp, Rattus norvegicus
gctggcttcaagtggcaggacttca

SEQ ID NO: 409194 - DNA, 25 bp, Rattus norvegicus
gctggcttccagaaaggctcttcaa

SEQ ID NO: 409195 - DNA, 25 bp, Rattus norvegicus
gctggcttccagaagtagcccaggt

SEQ ID NO: 409196 - DNA, 25 bp, Rattus norvegicus
gctggcttccagattcaggcaggga

SEQ ID NO: 409197 - DNA, 25 bp, Rattus norvegicus
gctggcttccagtaaggctcttcaa

SEQ ID NO: 409198 - DNA, 25 bp, Rattus norvegicus
gctggcttccagtagtagcccaggt

SEQ ID NO: 409199 - DNA, 25 bp, Rattus norvegicus
gctggcttccagtttcaggcaggga

SEQ ID NO: 409200 - DNA, 25 bp, Rattus norvegicus
gctggcttcccaaagaagttgacat

SEQ ID NO: 409201 - DNA, 25 bp, Rattus norvegicus
gctggcttcccaacaacaaattcaa

SEQ ID NO: 409202 - DNA, 25 bp, Rattus norvegicus
gctggcttcccatagaagttgacat

SEQ ID NO: 409203 - DNA, 25 bp, Rattus norvegicus
gctggcttcccatcaacaaattcaa

SEQ ID NO: 409204 - DNA, 25 bp, Rattus norvegicus
gctggcttcctcaccatatataagg

SEQ ID NO: 409205 - DNA, 25 bp, Rattus norvegicus
gctggcttcctctccatatataagg

SEQ ID NO: 409206 - DNA, 25 bp, Rattus norvegicus
gctggcttcgtcctggcgtagccaa

SEQ ID NO: 409207 - DNA, 25 bp, Rattus norvegicus
gctggcttcgtcgtggcgtagccaa

SEQ ID NO: 409208 - DNA, 25 bp, Rattus norvegicus
gctggcttctgacaacactagtttt

SEQ ID NO: 409209 - DNA, 25 bp, Rattus norvegicus
gctggcttctgagaacactagtttt

SEQ ID NO: 409210 - DNA, 25 bp, Rattus norvegicus
gctggcttgaggatacaggcgcaac

SEQ ID NO: 409211 - DNA, 25 bp, Rattus norvegicus
gctggcttgaggttacaggcgcaac

SEQ ID NO: 409212 - DNA, 25 bp, Rattus norvegicus
gctggcttgattctgtaatctgcaa

SEQ ID NO: 409213 - DNA, 25 bp, Rattus norvegicus
gctggcttgattgtgtaatctgcaa

SEQ ID NO: 409214 - DNA, 25 bp, Rattus norvegicus
gctggcttggccatgatgaacaacg

SEQ ID NO: 409215 - DNA, 25 bp, Rattus norvegicus
gctggcttggccttgatgaacaacg

SEQ ID NO: 409216 - DNA, 25 bp, Rattus norvegicus
gctggctttaaaaatacctttcggg

SEQ ID NO: 409217 - DNA, 25 bp, Rattus norvegicus
gctggctttaaatatacctttcggg

SEQ ID NO: 409218 - DNA, 25 bp, Rattus norvegicus
gctggctttaatctaatgcatcccc

SEQ ID NO: 409219 - DNA, 25 bp, Rattus norvegicus
gctggctttaatgtaatgcatcccc

SEQ ID NO: 409220 - DNA, 25 bp, Rattus norvegicus
gctggctttaggattcttctggatt

SEQ ID NO: 409221 - DNA, 25 bp, Rattus norvegicus
gctggctttaggtttcttctggatt

SEQ ID NO: 409222 - DNA, 25 bp, Rattus norvegicus
gctggctttgagctctagcgtttaa

SEQ ID NO: 409223 - DNA, 25 bp, Rattus norvegicus
gctggctttgaggtctagcgtttaa

SEQ ID NO: 409224 - DNA, 25 bp, Rattus norvegicus
gctggcttttctagattctttttga

SEQ ID NO: 409225 - DNA, 25 bp, Rattus norvegicus
gctggcttttcttgattctttttga

SEQ ID NO: 409226 - DNA, 25 bp, Rattus norvegicus
gctgggaaacctccagtatgggttt

SEQ ID NO: 409227 - DNA, 25 bp, Rattus norvegicus
gctgggaaacctgcagtatgggttt

SEQ ID NO: 409228 - DNA, 25 bp, Rattus norvegicus
gctgggaaattgctatggaatctga

SEQ ID NO: 409229 - DNA, 25 bp, Rattus norvegicus
gctgggaaattggtatggaatctga

SEQ ID NO: 409230 - DNA, 25 bp, Rattus norvegicus
gctgggaacacactgcctgttggaa

SEQ ID NO: 409231 - DNA, 25 bp, Rattus norvegicus
gctgggaacacagtgcctgttggaa

SEQ ID NO: 409232 - DNA, 25 bp, Rattus norvegicus
gctgggaaccacactacaaagcgga

SEQ ID NO: 409233 - DNA, 25 bp, Rattus norvegicus
gctgggaaccactctacaaagcgga

SEQ ID NO: 409234 - DNA, 25 bp, Rattus norvegicus
gctgggaacgacatgctaggctttg

SEQ ID NO: 409235 - DNA, 25 bp, Rattus norvegicus
gctgggaacgacttgctaggctttg

SEQ ID NO: 409236 - DNA, 25 bp, Rattus norvegicus
gctgggaacgcaactagccgttgat

SEQ ID NO: 409237 - DNA, 25 bp, Rattus norvegicus
gctgggaacgcatctagccgttgat

SEQ ID NO: 409238 - DNA, 25 bp, Rattus norvegicus
gctgggaactagctgccgtataagt

SEQ ID NO: 409239 - DNA, 25 bp, Rattus norvegicus
gctgggaactaggtgccgtataagt

SEQ ID NO: 409240 - DNA, 25 bp, Rattus norvegicus
gctgggaagagtacgcggacccctt

SEQ ID NO: 409241 - DNA, 25 bp, Rattus norvegicus
gctgggaagagttcgcggacccctt

SEQ ID NO: 409242 - DNA, 25 bp, Rattus norvegicus
gctgggaagatcaaacccggagtcc

SEQ ID NO: 409243 - DNA, 25 bp, Rattus norvegicus
gctgggaagatctaacccggagtcc

SEQ ID NO: 409244 - DNA, 25 bp, Rattus norvegicus
gctgggaatcttacttgcttacgaa

SEQ ID NO: 409245 - DNA, 25 bp, Rattus norvegicus
gctgggaatctttcttgcttacgaa

SEQ ID NO: 409246 - DNA, 25 bp, Rattus norvegicus
gctgggaattaaccctgggttcacg

SEQ ID NO: 409247 - DNA, 25 bp, Rattus norvegicus
gctgggaattaagcctgggttcacg

SEQ ID NO: 409248 - DNA, 25 bp, Rattus norvegicus
gctgggacatatataggttatcttt

SEQ ID NO: 409249 - DNA, 25 bp, Rattus norvegicus
gctgggacatatttaggttatcttt

SEQ ID NO: 409250 - DNA, 25 bp, Rattus norvegicus
gctgggaccaatagacatcacggac

SEQ ID NO: 409251 - DNA, 25 bp, Rattus norvegicus
gctgggaccaattgacatcacggac

SEQ ID NO: 409252 - DNA, 25 bp, Rattus norvegicus
gctgggaccagtcgcagatcacttt

SEQ ID NO: 409253 - DNA, 25 bp, Rattus norvegicus
gctgggaccagtggcagatcacttt

SEQ ID NO: 409254 - DNA, 25 bp, Rattus norvegicus
gctgggaccccaccttatttatttt

SEQ ID NO: 409255 - DNA, 25 bp, Rattus norvegicus
gctgggaccccagcttatttatttt

SEQ ID NO: 409256 - DNA, 25 bp, Rattus norvegicus
gctgggacctctatacttgacatta

SEQ ID NO: 409257 - DNA, 25 bp, Rattus norvegicus
gctgggacctctttacttgacatta

SEQ ID NO: 409258 - DNA, 25 bp, Rattus norvegicus
gctgggacctgcagttatcacttca

SEQ ID NO: 409259 - DNA, 25 bp, Rattus norvegicus
gctgggacctgctgttatcacttca

SEQ ID NO: 409260 - DNA, 25 bp, Rattus norvegicus
gctgggactagcattctacattgac

SEQ ID NO: 409261 - DNA, 25 bp, Rattus norvegicus
gctgggactagctttctacattgac

SEQ ID NO: 409262 - DNA, 25 bp, Rattus norvegicus
gctgggactcacatattagctcatc

SEQ ID NO: 409263 - DNA, 25 bp, Rattus norvegicus
gctgggactcacttattagctcatc

SEQ ID NO: 409264 - DNA, 25 bp, Rattus norvegicus
gctgggacttggaccgtgatcttga

SEQ ID NO: 409265 - DNA, 25 bp, Rattus norvegicus
gctgggacttggtccgtgatcttga

SEQ ID NO: 409266 - DNA, 25 bp, Rattus norvegicus
gctgggagaccacctgctgataaaa

SEQ ID NO: 409267 - DNA, 25 bp, Rattus norvegicus
gctgggagaccagctgctgataaaa

SEQ ID NO: 409268 - DNA, 25 bp, Rattus norvegicus
gctgggagagatcccctggcttgca

SEQ ID NO: 409269 - DNA, 25 bp, Rattus norvegicus
gctgggagagatgccctggcttgca

SEQ ID NO: 409270 - DNA, 25 bp, Rattus norvegicus
gctgggagagcaaacctgaggaact

SEQ ID NO: 409271 - DNA, 25 bp, Rattus norvegicus
gctgggagagcatacctgaggaact

SEQ ID NO: 409272 - DNA, 25 bp, Rattus norvegicus
gctgggagagtcatggtctttgtaa

SEQ ID NO: 409273 - DNA, 25 bp, Rattus norvegicus
gctgggagagtcttggtctttgtaa

SEQ ID NO: 409274 - DNA, 25 bp, Rattus norvegicus
gctgggagccaccaaggataacgct

SEQ ID NO: 409275 - DNA, 25 bp, Rattus norvegicus
gctgggagccacgaaggataacgct

SEQ ID NO: 409276 - DNA, 25 bp, Rattus norvegicus
gctgggagcctgacaacaggaccta

SEQ ID NO: 409277 - DNA, 25 bp, Rattus norvegicus
gctgggagcctgtcaacaggaccta

SEQ ID NO: 409278 - DNA, 25 bp, Rattus norvegicus
gctgggaggagcacgaaactttctt

SEQ ID NO: 409279 - DNA, 25 bp, Rattus norvegicus
gctgggaggagctcgaaactttctt

SEQ ID NO: 409280 - DNA, 25 bp, Rattus norvegicus
gctgggaggtatcgctgatcctcaa

SEQ ID NO: 409281 - DNA, 25 bp, Rattus norvegicus
gctgggaggtatggctgatcctcaa

SEQ ID NO: 409282 - DNA, 25 bp, Rattus norvegicus
gctgggagtgttctcagagcctaaa

SEQ ID NO: 409283 - DNA, 25 bp, Rattus norvegicus
gctgggagtgttgtcagagcctaaa

SEQ ID NO: 409284 - DNA, 25 bp, Rattus norvegicus
gctgggatcagtaattgtgttctct

SEQ ID NO: 409285 - DNA, 25 bp, Rattus norvegicus
gctgggatcagttattgtgttctct

SEQ ID NO: 409286 - DNA, 25 bp, Rattus norvegicus
gctgggatcctacaaaccctggatt

SEQ ID NO: 409287 - DNA, 25 bp, Rattus norvegicus
gctgggatcctagaaaccctggatt

SEQ ID NO: 409288 - DNA, 25 bp, Rattus norvegicus
gctgggatgccacacttttcttcat

SEQ ID NO: 409289 - DNA, 25 bp, Rattus norvegicus
gctgggatgccagacttttcttcat

SEQ ID NO: 409290 - DNA, 25 bp, Rattus norvegicus
gctgggatgtttacatccacctgga

SEQ ID NO: 409291 - DNA, 25 bp, Rattus norvegicus
gctgggatgttttcatccacctgga

SEQ ID NO: 409292 - DNA, 25 bp, Rattus norvegicus
gctgggattctgaccactttttaat

SEQ ID NO: 409293 - DNA, 25 bp, Rattus norvegicus
gctgggattctgtccactttttaat

SEQ ID NO: 409294 - DNA, 25 bp, Rattus norvegicus
gctgggatttccaccacatagaata

SEQ ID NO: 409295 - DNA, 25 bp, Rattus norvegicus
gctgggatttcctccacatagaata

SEQ ID NO: 409296 - DNA, 25 bp, Rattus norvegicus
gctgggatttttccggtggtcctcc

SEQ ID NO: 409297 - DNA, 25 bp, Rattus norvegicus
gctgggatttttgcggtggtcctcc

SEQ ID NO: 409298 - DNA, 25 bp, Rattus norvegicus
gctgggcacaagctagcgcgctcgg

SEQ ID NO: 409299 - DNA, 25 bp, Rattus norvegicus
gctgggcacaaggtagcgcgctcgg

SEQ ID NO: 409300 - DNA, 25 bp, Rattus norvegicus
gctgggcacctaacaacgacataaa

SEQ ID NO: 409301 - DNA, 25 bp, Rattus norvegicus
gctgggcacctatcaacgacataaa

SEQ ID NO: 409302 - DNA, 25 bp, Rattus norvegicus
gctgggcacgttcagtgaatctcag

SEQ ID NO: 409303 - DNA, 25 bp, Rattus norvegicus
gctgggcacgttgagtgaatctcag

SEQ ID NO: 409304 - DNA, 25 bp, Rattus norvegicus
gctgggcacttgagtttgggttatt

SEQ ID NO: 409305 - DNA, 25 bp, Rattus norvegicus
gctgggcacttgtgtttgggttatt

SEQ ID NO: 409306 - DNA, 25 bp, Rattus norvegicus
gctgggcagagcactgatgacatca

SEQ ID NO: 409307 - DNA, 25 bp, Rattus norvegicus
gctgggcagagccaggtttctctct

SEQ ID NO: 409308 - DNA, 25 bp, Rattus norvegicus
gctgggcagagcgaggtttctctct

SEQ ID NO: 409309 - DNA, 25 bp, Rattus norvegicus
gctgggcagagctctgatgacatca

SEQ ID NO: 409310 - DNA, 25 bp, Rattus norvegicus
gctgggcaggaaaattggttttctc

SEQ ID NO: 409311 - DNA, 25 bp, Rattus norvegicus
gctgggcaggaatattggttttctc

SEQ ID NO: 409312 - DNA, 25 bp, Rattus norvegicus
gctgggcaggccattcacacgggac

SEQ ID NO: 409313 - DNA, 25 bp, Rattus norvegicus
gctgggcaggcctttcacacgggac

SEQ ID NO: 409314 - DNA, 25 bp, Rattus norvegicus
gctgggcaggtgagtccaagtccaa

SEQ ID NO: 409315 - DNA, 25 bp, Rattus norvegicus
gctgggcaggtgtgtccaagtccaa

SEQ ID NO: 409316 - DNA, 25 bp, Rattus norvegicus
gctgggcagtagaagggcttaccta

SEQ ID NO: 409317 - DNA, 25 bp, Rattus norvegicus
gctgggcagtagtagggcttaccta

SEQ ID NO: 409318 - DNA, 25 bp, Rattus norvegicus
gctgggcagtgcaccagtgtttatt

SEQ ID NO: 409319 - DNA, 25 bp, Rattus norvegicus
gctgggcagtgctccagtgtttatt

SEQ ID NO: 409320 - DNA, 25 bp, Rattus norvegicus
gctgggcagttcattgatctgtcaa

SEQ ID NO: 409321 - DNA, 25 bp, Rattus norvegicus
gctgggcagttctttgatctgtcaa

SEQ ID NO: 409322 - DNA, 25 bp, Rattus norvegicus
gctgggcatcaaaccaagagtcact

SEQ ID NO: 409323 - DNA, 25 bp, Rattus norvegicus
gctgggcatcaatccaagagtcact

SEQ ID NO: 409324 - DNA, 25 bp, Rattus norvegicus
gctgggcatggacactcacatctgt

SEQ ID NO: 409325 - DNA, 25 bp, Rattus norvegicus
gctgggcatggagactcacatctgt

SEQ ID NO: 409326 - DNA, 25 bp, Rattus norvegicus
gctgggcattaactgcagggtctca

SEQ ID NO: 409327 - DNA, 25 bp, Rattus norvegicus
gctgggcattaagtgcagggtctca

SEQ ID NO: 409328 - DNA, 25 bp, Rattus norvegicus
gctgggccaaggaatttggtatcct

SEQ ID NO: 409329 - DNA, 25 bp, Rattus norvegicus
gctgggccaaggtatttggtatcct

SEQ ID NO: 409330 - DNA, 25 bp, Rattus norvegicus
gctgggcccaggaggttaagaacct

SEQ ID NO: 409331 - DNA, 25 bp, Rattus norvegicus
gctgggcccaggtggttaagaacct

SEQ ID NO: 409332 - DNA, 25 bp, Rattus norvegicus
gctgggccgaagatcaagcgctcta

SEQ ID NO: 409333 - DNA, 25 bp, Rattus norvegicus
gctgggccgaagttcaagcgctcta

SEQ ID NO: 409334 - DNA, 25 bp, Rattus norvegicus
gctgggcctgagattggactgcaac

SEQ ID NO: 409335 - DNA, 25 bp, Rattus norvegicus
gctgggcctgagtttggactgcaac

SEQ ID NO: 409336 - DNA, 25 bp, Rattus norvegicus
gctgggcctggcatggcttaagtac

SEQ ID NO: 409337 - DNA, 25 bp, Rattus norvegicus
gctgggcctggcttggcttaagtac

SEQ ID NO: 409338 - DNA, 25 bp, Rattus norvegicus
gctgggcgtcatccatgactgtaaa

SEQ ID NO: 409339 - DNA, 25 bp, Rattus norvegicus
gctgggcgtcatgcatgactgtaaa

SEQ ID NO: 409340 - DNA, 25 bp, Rattus norvegicus
gctgggctaagtattcttcctgtga

SEQ ID NO: 409341 - DNA, 25 bp, Rattus norvegicus
gctgggctaagttttcttcctgtga

SEQ ID NO: 409342 - DNA, 25 bp, Rattus norvegicus
gctgggctagcaaattaaactgtgg

SEQ ID NO: 409343 - DNA, 25 bp, Rattus norvegicus
gctgggctagcatattaaactgtgg

SEQ ID NO: 409344 - DNA, 25 bp, Rattus norvegicus
gctgggctccagaggtagaaccaaa

SEQ ID NO: 409345 - DNA, 25 bp, Rattus norvegicus
gctgggctccagtggtagaaccaaa

SEQ ID NO: 409346 - DNA, 25 bp, Rattus norvegicus
gctgggctccatatttcaacaattg

SEQ ID NO: 409347 - DNA, 25 bp, Rattus norvegicus
gctgggctccatttttcaacaattg

SEQ ID NO: 409348 - DNA, 25 bp, Rattus norvegicus
gctgggctcctaaaatcgagaactt

SEQ ID NO: 409349 - DNA, 25 bp, Rattus norvegicus
gctgggctcctataatcgagaactt

SEQ ID NO: 409350 - DNA, 25 bp, Rattus norvegicus
gctgggctccttacccagaaattaa

SEQ ID NO: 409351 - DNA, 25 bp, Rattus norvegicus
gctgggctcctttcccagaaattaa

SEQ ID NO: 409352 - DNA, 25 bp, Rattus norvegicus
gctgggctgatgaatctgttcgtga

SEQ ID NO: 409353 - DNA, 25 bp, Rattus norvegicus
gctgggctgatgagtctgatgcact

SEQ ID NO: 409354 - DNA, 25 bp, Rattus norvegicus
gctgggctgatgtatctgttcgtga

SEQ ID NO: 409355 - DNA, 25 bp, Rattus norvegicus
gctgggctgatgtgtctgatgcact

SEQ ID NO: 409356 - DNA, 25 bp, Rattus norvegicus
gctgggctggagagacatccctagc

SEQ ID NO: 409357 - DNA, 25 bp, Rattus norvegicus
gctgggctggagtgacatccctagc

SEQ ID NO: 409358 - DNA, 25 bp, Rattus norvegicus
gctgggcttcatagtttttattctg

SEQ ID NO: 409359 - DNA, 25 bp, Rattus norvegicus
gctgggcttcattgtttttattctg

SEQ ID NO: 409360 - DNA, 25 bp, Rattus norvegicus
gctgggcttcgtaagcatagccgca

SEQ ID NO: 409361 - DNA, 25 bp, Rattus norvegicus
gctgggcttcgttagcatagccgca

SEQ ID NO: 409362 - DNA, 25 bp, Rattus norvegicus
gctgggcttctcctggatctgaaga

SEQ ID NO: 409363 - DNA, 25 bp, Rattus norvegicus
gctgggcttctcgtggatctgaaga

SEQ ID NO: 409364 - DNA, 25 bp, Rattus norvegicus
gctgggcttgaacgtgttcaccacc

SEQ ID NO: 409365 - DNA, 25 bp, Rattus norvegicus
gctgggcttgaaggtgttcaccacc

SEQ ID NO: 409366 - DNA, 25 bp, Rattus norvegicus
gctgggcttgccactaatgctgtga

SEQ ID NO: 409367 - DNA, 25 bp, Rattus norvegicus
gctgggcttgcctctaatgctgtga

SEQ ID NO: 409368 - DNA, 25 bp, Rattus norvegicus
gctgggctttcaacttatatgacct

SEQ ID NO: 409369 - DNA, 25 bp, Rattus norvegicus
gctgggctttcatcttatatgacct

SEQ ID NO: 409370 - DNA, 25 bp, Rattus norvegicus
gctgggcttttccaacgtcagaaag

SEQ ID NO: 409371 - DNA, 25 bp, Rattus norvegicus
gctgggcttttcgaacgtcagaaag

SEQ ID NO: 409372 - DNA, 25 bp, Rattus norvegicus
gctgggtaaactcagtgttgtaacc

SEQ ID NO: 409373 - DNA, 25 bp, Rattus norvegicus
gctgggtaaactgagtgttgtaacc

SEQ ID NO: 409374 - DNA, 25 bp, Rattus norvegicus
gctgggtaacttagcaagatcctgt

SEQ ID NO: 409375 - DNA, 25 bp, Rattus norvegicus
gctgggtaactttgcaagatcctgt

SEQ ID NO: 409376 - DNA, 25 bp, Rattus norvegicus
gctgggtaccttaaagctttacttg

SEQ ID NO: 409377 - DNA, 25 bp, Rattus norvegicus
gctgggtacctttaagctttacttg

SEQ ID NO: 409378 - DNA, 25 bp, Rattus norvegicus
gctgggtactttcagttcctggtaa

SEQ ID NO: 409379 - DNA, 25 bp, Rattus norvegicus
gctgggtactttctggaagctcacc

SEQ ID NO: 409380 - DNA, 25 bp, Rattus norvegicus
gctgggtactttgagttcctggtaa

SEQ ID NO: 409381 - DNA, 25 bp, Rattus norvegicus
gctgggtactttgtggaagctcacc

SEQ ID NO: 409382 - DNA, 25 bp, Rattus norvegicus
gctgggtagtggaagagtactcctt

SEQ ID NO: 409383 - DNA, 25 bp, Rattus norvegicus
gctgggtagtggtagagtactcctt

SEQ ID NO: 409384 - DNA, 25 bp, Rattus norvegicus
gctgggtatgatctcacaaacttat

SEQ ID NO: 409385 - DNA, 25 bp, Rattus norvegicus
gctgggtatgatgtcacaaacttat

SEQ ID NO: 409386 - DNA, 25 bp, Rattus norvegicus
gctgggtcaaacagtgtttccaacc

SEQ ID NO: 409387 - DNA, 25 bp, Rattus norvegicus
gctgggtcaaactgtgtttccaacc

SEQ ID NO: 409388 - DNA, 25 bp, Rattus norvegicus
gctgggtcaagcaagtttacgcaac

SEQ ID NO: 409389 - DNA, 25 bp, Rattus norvegicus
gctgggtcaagctagtttacgcaac

SEQ ID NO: 409390 - DNA, 25 bp, Rattus norvegicus
gctgggtcacaaaccacctgatagg

SEQ ID NO: 409391 - DNA, 25 bp, Rattus norvegicus
gctgggtcacaatccacctgatagg

SEQ ID NO: 409392 - DNA, 25 bp, Rattus norvegicus
gctgggtcacgcatgctgggaacaa

SEQ ID NO: 409393 - DNA, 25 bp, Rattus norvegicus
gctgggtcacgcttgctgggaacaa

SEQ ID NO: 409394 - DNA, 25 bp, Rattus norvegicus
gctgggtcactacatggccatgaat

SEQ ID NO: 409395 - DNA, 25 bp, Rattus norvegicus
gctgggtcactagatggccatgaat

SEQ ID NO: 409396 - DNA, 25 bp, Rattus norvegicus
gctgggtcctgtcacacctggaaag

SEQ ID NO: 409397 - DNA, 25 bp, Rattus norvegicus
gctgggtcctgtgacacctggaaag

SEQ ID NO: 409398 - DNA, 25 bp, Rattus norvegicus
gctgggtctattccaaggtcagaac

SEQ ID NO: 409399 - DNA, 25 bp, Rattus norvegicus
gctgggtctattgcaaggtcagaac

SEQ ID NO: 409400 - DNA, 25 bp, Rattus norvegicus
gctgggtctcacaccttgaagaaag

SEQ ID NO: 409401 - DNA, 25 bp, Rattus norvegicus
gctgggtctcactccttgaagaaag

SEQ ID NO: 409402 - DNA, 25 bp, Rattus norvegicus
gctgggtgaacgactccccgtttga

SEQ ID NO: 409403 - DNA, 25 bp, Rattus norvegicus
gctgggtgaacgtctccccgtttga

SEQ ID NO: 409404 - DNA, 25 bp, Rattus norvegicus
gctgggtgaaggattgcctcttgtt

SEQ ID NO: 409405 - DNA, 25 bp, Rattus norvegicus
gctgggtgaaggtttgcctcttgtt

SEQ ID NO: 409406 - DNA, 25 bp, Rattus norvegicus
gctgggtgaagtacttaccgctcaa

SEQ ID NO: 409407 - DNA, 25 bp, Rattus norvegicus
gctgggtgaagttcttaccgctcaa

SEQ ID NO: 409408 - DNA, 25 bp, Rattus norvegicus
gctgggtgacatagtagactctcaa

SEQ ID NO: 409409 - DNA, 25 bp, Rattus norvegicus
gctgggtgacattgtagactctcaa

SEQ ID NO: 409410 - DNA, 25 bp, Rattus norvegicus
gctgggtgactgatgtttgcttctc

SEQ ID NO: 409411 - DNA, 25 bp, Rattus norvegicus
gctgggtgactgcaggcctggtgat

SEQ ID NO: 409412 - DNA, 25 bp, Rattus norvegicus
gctgggtgactggaggcctggtgat

SEQ ID NO: 409413 - DNA, 25 bp, Rattus norvegicus
gctgggtgactgttgtttgcttctc

SEQ ID NO: 409414 - DNA, 25 bp, Rattus norvegicus
gctgggtgattcaaaacctcctgga

SEQ ID NO: 409415 - DNA, 25 bp, Rattus norvegicus
gctgggtgattctaaacctcctgga

SEQ ID NO: 409416 - DNA, 25 bp, Rattus norvegicus
gctgggtgccggcattgcacaatcc

SEQ ID NO: 409417 - DNA, 25 bp, Rattus norvegicus
gctgggtgccgggattgcacaatcc

SEQ ID NO: 409418 - DNA, 25 bp, Rattus norvegicus
gctgggtgccttcccaggattgata

SEQ ID NO: 409419 - DNA, 25 bp, Rattus norvegicus
gctgggtgccttgccaggattgata

SEQ ID NO: 409420 - DNA, 25 bp, Rattus norvegicus
gctgggtggctgagagactaaggga

SEQ ID NO: 409421 - DNA, 25 bp, Rattus norvegicus
gctgggtggctgtgagactaaggga

SEQ ID NO: 409422 - DNA, 25 bp, Rattus norvegicus
gctgggtgtagcatataccattgta

SEQ ID NO: 409423 - DNA, 25 bp, Rattus norvegicus
gctgggtgtagcttataccattgta

SEQ ID NO: 409424 - DNA, 25 bp, Rattus norvegicus
gctgggtgtctcaatccacaaaagt

SEQ ID NO: 409425 - DNA, 25 bp, Rattus norvegicus
gctgggtgtctctatccacaaaagt

SEQ ID NO: 409426 - DNA, 25 bp, Rattus norvegicus
gctgggttcaaacgtttgcactatc

SEQ ID NO: 409427 - DNA, 25 bp, Rattus norvegicus
gctgggttcaaaggtttgcactatc

SEQ ID NO: 409428 - DNA, 25 bp, Rattus norvegicus
gctgggttccatagcatgatctaga

SEQ ID NO: 409429 - DNA, 25 bp, Rattus norvegicus
gctgggttccattgcatgatctaga

SEQ ID NO: 409430 - DNA, 25 bp, Rattus norvegicus
gctgggttggatctgtgttatctct

SEQ ID NO: 409431 - DNA, 25 bp, Rattus norvegicus
gctgggttggatgtgtgttatctct

SEQ ID NO: 409432 - DNA, 25 bp, Rattus norvegicus
gctgggttgggaaatcacgatgctt

SEQ ID NO: 409433 - DNA, 25 bp, Rattus norvegicus
gctgggttgggatatcacgatgctt

SEQ ID NO: 409434 - DNA, 25 bp, Rattus norvegicus
gctgggtttattcaagcccctggga

SEQ ID NO: 409435 - DNA, 25 bp, Rattus norvegicus
gctgggtttattgaagcccctggga

SEQ ID NO: 409436 - DNA, 25 bp, Rattus norvegicus
gctgggtttccaagtgcatgcttag

SEQ ID NO: 409437 - DNA, 25 bp, Rattus norvegicus
gctgggtttccactgagatctactg

SEQ ID NO: 409438 - DNA, 25 bp, Rattus norvegicus
gctgggtttccagtgagatctactg

SEQ ID NO: 409439 - DNA, 25 bp, Rattus norvegicus
gctgggtttccatgtgcatgcttag

SEQ ID NO: 409440 - DNA, 25 bp, Rattus norvegicus
gctgggtttcccacttgaaaaggtg

SEQ ID NO: 409441 - DNA, 25 bp, Rattus norvegicus
gctgggtttccctcttgaaaaggtg

SEQ ID NO: 409442 - DNA, 25 bp, Rattus norvegicus
gctgggtttcggcttgatcaccttc

SEQ ID NO: 409443 - DNA, 25 bp, Rattus norvegicus
gctgggtttcgggttgatcaccttc

SEQ ID NO: 409444 - DNA, 25 bp, Rattus norvegicus
gctgggtttctaatgatgcctggat

SEQ ID NO: 409445 - DNA, 25 bp, Rattus norvegicus
gctgggtttctattgatgcctggat

SEQ ID NO: 409446 - DNA, 25 bp, Rattus norvegicus
gctgggttttacagaaggtctgatt

SEQ ID NO: 409447 - DNA, 25 bp, Rattus norvegicus
gctgggttttactgaaggtctgatt

SEQ ID NO: 409448 - DNA, 25 bp, Rattus norvegicus
gctgggttttgtctatgggctttta

SEQ ID NO: 409449 - DNA, 25 bp, Rattus norvegicus
gctgggttttgtgtatgggctttta

SEQ ID NO: 409450 - DNA, 25 bp, Rattus norvegicus
gctggtaaacataggcggcgacttc

SEQ ID NO: 409451 - DNA, 25 bp, Rattus norvegicus
gctggtaaacattggcggcgacttc

SEQ ID NO: 409452 - DNA, 25 bp, Rattus norvegicus
gctggtaactggactcagactctct

SEQ ID NO: 409453 - DNA, 25 bp, Rattus norvegicus
gctggtaactggtctcagactctct

SEQ ID NO: 409454 - DNA, 25 bp, Rattus norvegicus
gctggtaatagaaccctgatcattt

SEQ ID NO: 409455 - DNA, 25 bp, Rattus norvegicus
gctggtaatagatccctgatcattt

SEQ ID NO: 409456 - DNA, 25 bp, Rattus norvegicus
gctggtacaatgaaatcttcaaagt

SEQ ID NO: 409457 - DNA, 25 bp, Rattus norvegicus
gctggtacaatgtaatcttcaaagt

SEQ ID NO: 409458 - DNA, 25 bp, Rattus norvegicus
gctggtaccactcgaagggcttcga

SEQ ID NO: 409459 - DNA, 25 bp, Rattus norvegicus
gctggtaccactggaagggcttcga

SEQ ID NO: 409460 - DNA, 25 bp, Rattus norvegicus
gctggtacccccagaggccagaaaa

SEQ ID NO: 409461 - DNA, 25 bp, Rattus norvegicus
gctggtaccccctgaggccagaaaa

SEQ ID NO: 409462 - DNA, 25 bp, Rattus norvegicus
gctggtacgtgacggctttaaaaca

SEQ ID NO: 409463 - DNA, 25 bp, Rattus norvegicus
gctggtacgtgagggctttaaaaca

SEQ ID NO: 409464 - DNA, 25 bp, Rattus norvegicus
gctggtacgtgtagctagaggccat

SEQ ID NO: 409465 - DNA, 25 bp, Rattus norvegicus
gctggtacgtgttgctagaggccat

SEQ ID NO: 409466 - DNA, 25 bp, Rattus norvegicus
gctggtactactcgaatggacatgt

SEQ ID NO: 409467 - DNA, 25 bp, Rattus norvegicus
gctggtactactggaatggacatgt

SEQ ID NO: 409468 - DNA, 25 bp, Rattus norvegicus
gctggtactgatcactgcggaaaag

SEQ ID NO: 409469 - DNA, 25 bp, Rattus norvegicus
gctggtactgatgactgcggaaaag

SEQ ID NO: 409470 - DNA, 25 bp, Rattus norvegicus
gctggtagacacagggcggcccatt

SEQ ID NO: 409471 - DNA, 25 bp, Rattus norvegicus
gctggtagacactgggcggcccatt

SEQ ID NO: 409472 - DNA, 25 bp, Rattus norvegicus
gctggtagcctgagcccagtgacaa

SEQ ID NO: 409473 - DNA, 25 bp, Rattus norvegicus
gctggtagcctgtgcccagtgacaa

SEQ ID NO: 409474 - DNA, 25 bp, Rattus norvegicus
gctggtaggcagaagccatatgtta

SEQ ID NO: 409475 - DNA, 25 bp, Rattus norvegicus
gctggtaggcagtagccatatgtta

SEQ ID NO: 409476 - DNA, 25 bp, Rattus norvegicus
gctggtataaagacaccaaggcgta

SEQ ID NO: 409477 - DNA, 25 bp, Rattus norvegicus
gctggtataaagtcaccaaggcgta

SEQ ID NO: 409478 - DNA, 25 bp, Rattus norvegicus
gctggtatatgcaagatgtctgtaa

SEQ ID NO: 409479 - DNA, 25 bp, Rattus norvegicus
gctggtatatgctagatgtctgtaa

SEQ ID NO: 409480 - DNA, 25 bp, Rattus norvegicus
gctggtatgcgcaggcctatatcgt

SEQ ID NO: 409481 - DNA, 25 bp, Rattus norvegicus
gctggtatgcgctggcctatatcgt

SEQ ID NO: 409482 - DNA, 25 bp, Rattus norvegicus
gctggtatggtgacgcttgaaactt

SEQ ID NO: 409483 - DNA, 25 bp, Rattus norvegicus
gctggtatggtgtcgcttgaaactt

SEQ ID NO: 409484 - DNA, 25 bp, Rattus norvegicus
gctggtatggttccactctggaaat

SEQ ID NO: 409485 - DNA, 25 bp, Rattus norvegicus
gctggtatggttgcactctggaaat

SEQ ID NO: 409486 - DNA, 25 bp, Rattus norvegicus
gctggtcaaatcaagtcactcggcc

SEQ ID NO: 409487 - DNA, 25 bp, Rattus norvegicus
gctggtcaaatctagtcactcggcc

SEQ ID NO: 409488 - DNA, 25 bp, Rattus norvegicus
gctggtcaagtccagtcccaggaga

SEQ ID NO: 409489 - DNA, 25 bp, Rattus norvegicus
gctggtcaagtcgagtcccaggaga

SEQ ID NO: 409490 - DNA, 25 bp, Rattus norvegicus
gctggtcacggcaaggctagtaaag

SEQ ID NO: 409491 - DNA, 25 bp, Rattus norvegicus
gctggtcacggctaggctagtaaag

SEQ ID NO: 409492 - DNA, 25 bp, Rattus norvegicus
gctggtcagaatcgtagccacacgt

SEQ ID NO: 409493 - DNA, 25 bp, Rattus norvegicus
gctggtcagaatggtagccacacgt

SEQ ID NO: 409494 - DNA, 25 bp, Rattus norvegicus
gctggtcagagcacaataattttat

SEQ ID NO: 409495 - DNA, 25 bp, Rattus norvegicus
gctggtcagagcacatcacacaaat

SEQ ID NO: 409496 - DNA, 25 bp, Rattus norvegicus
gctggtcagagctcaataattttat

SEQ ID NO: 409497 - DNA, 25 bp, Rattus norvegicus
gctggtcagagctcatcacacaaat

SEQ ID NO: 409498 - DNA, 25 bp, Rattus norvegicus
gctggtcagcaaagtcctgcattaa

SEQ ID NO: 409499 - DNA, 25 bp, Rattus norvegicus
gctggtcagcaatgtcctgcattaa

SEQ ID NO: 409500 - DNA, 25 bp, Rattus norvegicus
gctggtcagctgaagtcattttgca

SEQ ID NO: 409501 - DNA, 25 bp, Rattus norvegicus
gctggtcagctgtagtcattttgca

SEQ ID NO: 409502 - DNA, 25 bp, Rattus norvegicus
gctggtcatcatcctctaggagcat

SEQ ID NO: 409503 - DNA, 25 bp, Rattus norvegicus
gctggtcatcatgctctaggagcat

SEQ ID NO: 409504 - DNA, 25 bp, Rattus norvegicus
gctggtcatttcctgtaggtatgaa

SEQ ID NO: 409505 - DNA, 25 bp, Rattus norvegicus
gctggtcatttcgtgtaggtatgaa

SEQ ID NO: 409506 - DNA, 25 bp, Rattus norvegicus
gctggtccaagcagtgtgcattgca

SEQ ID NO: 409507 - DNA, 25 bp, Rattus norvegicus
gctggtccaagctgtgtgcattgca

SEQ ID NO: 409508 - DNA, 25 bp, Rattus norvegicus
gctggtccagcaacagtttgcggat

SEQ ID NO: 409509 - DNA, 25 bp, Rattus norvegicus
gctggtccagcatcagtttgcggat

SEQ ID NO: 409510 - DNA, 25 bp, Rattus norvegicus
gctggtccaggaacagaaacctaaa

SEQ ID NO: 409511 - DNA, 25 bp, Rattus norvegicus
gctggtccaggaacttcactggtaa

SEQ ID NO: 409512 - DNA, 25 bp, Rattus norvegicus
gctggtccaggatcagaaacctaaa

SEQ ID NO: 409513 - DNA, 25 bp, Rattus norvegicus
gctggtccaggatcttcactggtaa

SEQ ID NO: 409514 - DNA, 25 bp, Rattus norvegicus
gctggtccatgtcctcatctgctat

SEQ ID NO: 409515 - DNA, 25 bp, Rattus norvegicus
gctggtccatgtgctcatctgctat

SEQ ID NO: 409516 - DNA, 25 bp, Rattus norvegicus
gctggtcccaaaaatgcttccatga

SEQ ID NO: 409517 - DNA, 25 bp, Rattus norvegicus
gctggtcccaaatatgcttccatga

SEQ ID NO: 409518 - DNA, 25 bp, Rattus norvegicus
gctggtcccaacaaaggtcgtactg

SEQ ID NO: 409519 - DNA, 25 bp, Rattus norvegicus
gctggtcccaactaaggtcgtactg

SEQ ID NO: 409520 - DNA, 25 bp, Rattus norvegicus
gctggtcccgccctgagaaagaaac

SEQ ID NO: 409521 - DNA, 25 bp, Rattus norvegicus
gctggtcccgccgtgagaaagaaac

SEQ ID NO: 409522 - DNA, 25 bp, Rattus norvegicus
gctggtcgccgcaattgataatgat

SEQ ID NO: 409523 - DNA, 25 bp, Rattus norvegicus
gctggtcgccgctattgataatgat

SEQ ID NO: 409524 - DNA, 25 bp, Rattus norvegicus
gctggtcgtgccaggtgaattcctg

SEQ ID NO: 409525 - DNA, 25 bp, Rattus norvegicus
gctggtcgtgcctggtgaattcctg

SEQ ID NO: 409526 - DNA, 25 bp, Rattus norvegicus
gctggtctcaaactctgtgtatcta

SEQ ID NO: 409527 - DNA, 25 bp, Rattus norvegicus
gctggtctcaaagtctgtgtatcta

SEQ ID NO: 409528 - DNA, 25 bp, Rattus norvegicus
gctggtctctacagagcctgaatac

SEQ ID NO: 409529 - DNA, 25 bp, Rattus norvegicus
gctggtctctactgagcctgaatac

SEQ ID NO: 409530 - DNA, 25 bp, Rattus norvegicus
gctggtctctgcaaagaagggcaac

SEQ ID NO: 409531 - DNA, 25 bp, Rattus norvegicus
gctggtctctgctaagaagggcaac

SEQ ID NO: 409532 - DNA, 25 bp, Rattus norvegicus
gctggtctctgtccacgagaaacaa

SEQ ID NO: 409533 - DNA, 25 bp, Rattus norvegicus
gctggtctctgtgcacgagaaacaa

SEQ ID NO: 409534 - DNA, 25 bp, Rattus norvegicus
gctggtctcttgaccttgggaaaga

SEQ ID NO: 409535 - DNA, 25 bp, Rattus norvegicus
gctggtctcttgtccttgggaaaga

SEQ ID NO: 409536 - DNA, 25 bp, Rattus norvegicus
gctggtctgaagcagaagctctcat

SEQ ID NO: 409537 - DNA, 25 bp, Rattus norvegicus
gctggtctgaaggagaagctctcat

SEQ ID NO: 409538 - DNA, 25 bp, Rattus norvegicus
gctggtctggaactagctccgtaga

SEQ ID NO: 409539 - DNA, 25 bp, Rattus norvegicus
gctggtctggaagtagctccgtaga

SEQ ID NO: 409540 - DNA, 25 bp, Rattus norvegicus
gctggtctggatccctgaatttata

SEQ ID NO: 409541 - DNA, 25 bp, Rattus norvegicus
gctggtctggatgcctgaatttata

SEQ ID NO: 409542 - DNA, 25 bp, Rattus norvegicus
gctggtctgtccctgaaggtttaga

SEQ ID NO: 409543 - DNA, 25 bp, Rattus norvegicus
gctggtctgtccgtgaaggtttaga

SEQ ID NO: 409544 - DNA, 25 bp, Rattus norvegicus
gctggtctgtgacacactctgcact

SEQ ID NO: 409545 - DNA, 25 bp, Rattus norvegicus
gctggtctgtgagacactctgcact

SEQ ID NO: 409546 - DNA, 25 bp, Rattus norvegicus
gctggtcttatccagtcaggatgta

SEQ ID NO: 409547 - DNA, 25 bp, Rattus norvegicus
gctggtcttatcgagtcaggatgta

SEQ ID NO: 409548 - DNA, 25 bp, Rattus norvegicus
gctggtcttcacaatgcttctttag

SEQ ID NO: 409549 - DNA, 25 bp, Rattus norvegicus
gctggtcttcactatgcttctttag

SEQ ID NO: 409550 - DNA, 25 bp, Rattus norvegicus
gctggtcttccacgagtaaactgca

SEQ ID NO: 409551 - DNA, 25 bp, Rattus norvegicus
gctggtcttccaggagtaaactgca

SEQ ID NO: 409552 - DNA, 25 bp, Rattus norvegicus
gctggtcttgaactggtgaactcaa

SEQ ID NO: 409553 - DNA, 25 bp, Rattus norvegicus
gctggtcttgaagtggtgaactcaa

SEQ ID NO: 409554 - DNA, 25 bp, Rattus norvegicus
gctggtctttgcatcatctttagat

SEQ ID NO: 409555 - DNA, 25 bp, Rattus norvegicus
gctggtctttgcttcatctttagat

SEQ ID NO: 409556 - DNA, 25 bp, Rattus norvegicus
gctggtcttttaagcagatctgtca

SEQ ID NO: 409557 - DNA, 25 bp, Rattus norvegicus
gctggtcttttatgcagatctgtca

SEQ ID NO: 409558 - DNA, 25 bp, Rattus norvegicus
gctggtgaaatacctgctcttcttc

SEQ ID NO: 409559 - DNA, 25 bp, Rattus norvegicus
gctggtgaaatagctgctcttcttc

SEQ ID NO: 409560 - DNA, 25 bp, Rattus norvegicus
gctggtgaacttctgtggccaccac

SEQ ID NO: 409561 - DNA, 25 bp, Rattus norvegicus
gctggtgaacttgtgtggccaccac

SEQ ID NO: 409562 - DNA, 25 bp, Rattus norvegicus
gctggtgaagttccgtacattgcaa

SEQ ID NO: 409563 - DNA, 25 bp, Rattus norvegicus
gctggtgaagttctcatcacaggta

SEQ ID NO: 409564 - DNA, 25 bp, Rattus norvegicus
gctggtgaagttgcgtacattgcaa

SEQ ID NO: 409565 - DNA, 25 bp, Rattus norvegicus
gctggtgaagttgtcatcacaggta

SEQ ID NO: 409566 - DNA, 25 bp, Rattus norvegicus
gctggtgacaaactaacagaggtcc

SEQ ID NO: 409567 - DNA, 25 bp, Rattus norvegicus
gctggtgacaaagtaacagaggtcc

SEQ ID NO: 409568 - DNA, 25 bp, Rattus norvegicus
gctggtgacaacatggtgctgcaag

SEQ ID NO: 409569 - DNA, 25 bp, Rattus norvegicus
gctggtgacaacttggtgctgcaag

SEQ ID NO: 409570 - DNA, 25 bp, Rattus norvegicus
gctggtgacagacaactgagccctg

SEQ ID NO: 409571 - DNA, 25 bp, Rattus norvegicus
gctggtgacagagaactgagccctg

SEQ ID NO: 409572 - DNA, 25 bp, Rattus norvegicus
gctggtgacaggcagtccatgattt

SEQ ID NO: 409573 - DNA, 25 bp, Rattus norvegicus
gctggtgacagggagtccatgattt

SEQ ID NO: 409574 - DNA, 25 bp, Rattus norvegicus
gctggtgacagtcgcttttcggaac

SEQ ID NO: 409575 - DNA, 25 bp, Rattus norvegicus
gctggtgacagtggcttttcggaac

SEQ ID NO: 409576 - DNA, 25 bp, Rattus norvegicus
gctggtgacatgatcctggaagctc

SEQ ID NO: 409577 - DNA, 25 bp, Rattus norvegicus
gctggtgacatgttcctggaagctc

SEQ ID NO: 409578 - DNA, 25 bp, Rattus norvegicus
gctggtgacgatcaggccatgttca

SEQ ID NO: 409579 - DNA, 25 bp, Rattus norvegicus
gctggtgacgatgaggccatgttca

SEQ ID NO: 409580 - DNA, 25 bp, Rattus norvegicus
gctggtgacgtgcttcaggacctca

SEQ ID NO: 409581 - DNA, 25 bp, Rattus norvegicus
gctggtgacgtggttcaggacctca

SEQ ID NO: 409582 - DNA, 25 bp, Rattus norvegicus
gctggtgattggattaaaactgatt

SEQ ID NO: 409583 - DNA, 25 bp, Rattus norvegicus
gctggtgattggtttaaaactgatt

SEQ ID NO: 409584 - DNA, 25 bp, Rattus norvegicus
gctggtgcaaaaaaggcctggcctt

SEQ ID NO: 409585 - DNA, 25 bp, Rattus norvegicus
gctggtgcaaaataggcctggcctt

SEQ ID NO: 409586 - DNA, 25 bp, Rattus norvegicus
gctggtgcaagtcctagatgctcaa

SEQ ID NO: 409587 - DNA, 25 bp, Rattus norvegicus
gctggtgcaagtgctagatgctcaa

SEQ ID NO: 409588 - DNA, 25 bp, Rattus norvegicus
gctggtgcctctcagagtgtttcac

SEQ ID NO: 409589 - DNA, 25 bp, Rattus norvegicus
gctggtgcctctgagagtgtttcac

SEQ ID NO: 409590 - DNA, 25 bp, Rattus norvegicus
gctggtgctgcacgctcacaggaaa

SEQ ID NO: 409591 - DNA, 25 bp, Rattus norvegicus
gctggtgctgcaggctcacaggaaa

SEQ ID NO: 409592 - DNA, 25 bp, Rattus norvegicus
gctggtgctgcccatatttaagata

SEQ ID NO: 409593 - DNA, 25 bp, Rattus norvegicus
gctggtgctgccgatatttaagata

SEQ ID NO: 409594 - DNA, 25 bp, Rattus norvegicus
gctggtggaaggaacctgcttgaaa

SEQ ID NO: 409595 - DNA, 25 bp, Rattus norvegicus
gctggtggaaggtacctgcttgaaa

SEQ ID NO: 409596 - DNA, 25 bp, Rattus norvegicus
gctggtggccgaccgaatcacagaa

SEQ ID NO: 409597 - DNA, 25 bp, Rattus norvegicus
gctggtggccgagcgaatcacagaa

SEQ ID NO: 409598 - DNA, 25 bp, Rattus norvegicus
gctggtggcgaccagcagcaacatt

SEQ ID NO: 409599 - DNA, 25 bp, Rattus norvegicus
gctggtggcgacgagcagcaacatt

SEQ ID NO: 409600 - DNA, 25 bp, Rattus norvegicus
gctggtgggacactttttgtacact

SEQ ID NO: 409601 - DNA, 25 bp, Rattus norvegicus
gctggtgggacagtttttgtacact

SEQ ID NO: 409602 - DNA, 25 bp, Rattus norvegicus
gctggtgggattccagtacacaaga

SEQ ID NO: 409603 - DNA, 25 bp, Rattus norvegicus
gctggtgggattgcagtacacaaga

SEQ ID NO: 409604 - DNA, 25 bp, Rattus norvegicus
gctggtgggcaaagtcctcattgat

SEQ ID NO: 409605 - DNA, 25 bp, Rattus norvegicus
gctggtgggcaatgtcctcattgat

SEQ ID NO: 409606 - DNA, 25 bp, Rattus norvegicus
gctggtgggctacacatgccccaaa

SEQ ID NO: 409607 - DNA, 25 bp, Rattus norvegicus
gctggtgggctagacatgccccaaa

SEQ ID NO: 409608 - DNA, 25 bp, Rattus norvegicus
gctggtgggctgagacatcgtccta

SEQ ID NO: 409609 - DNA, 25 bp, Rattus norvegicus
gctggtgggctgtgacatcgtccta

SEQ ID NO: 409610 - DNA, 25 bp, Rattus norvegicus
gctggtggtcttccaacttacagga

SEQ ID NO: 409611 - DNA, 25 bp, Rattus norvegicus
gctggtggtcttgcaacttacagga

SEQ ID NO: 409612 - DNA, 25 bp, Rattus norvegicus
gctggtgtaagcacgctatccttag

SEQ ID NO: 409613 - DNA, 25 bp, Rattus norvegicus
gctggtgtaagctcgctatccttag

SEQ ID NO: 409614 - DNA, 25 bp, Rattus norvegicus
gctggtgtattcctgtatctaactg

SEQ ID NO: 409615 - DNA, 25 bp, Rattus norvegicus
gctggtgtattcgtgtatctaactg

SEQ ID NO: 409616 - DNA, 25 bp, Rattus norvegicus
gctggtgtcaggcaaaaacactctt

SEQ ID NO: 409617 - DNA, 25 bp, Rattus norvegicus
gctggtgtcagggaaaaacactctt

SEQ ID NO: 409618 - DNA, 25 bp, Rattus norvegicus
gctggtgtcatcatcactgatctca

SEQ ID NO: 409619 - DNA, 25 bp, Rattus norvegicus
gctggtgtcatcttcactgatctca

SEQ ID NO: 409620 - DNA, 25 bp, Rattus norvegicus
gctggtgtccagatgatcttcagaa

SEQ ID NO: 409621 - DNA, 25 bp, Rattus norvegicus
gctggtgtccagttgatcttcagaa

SEQ ID NO: 409622 - DNA, 25 bp, Rattus norvegicus
gctggtgtccgcaggctgctatgcc

SEQ ID NO: 409623 - DNA, 25 bp, Rattus norvegicus
gctggtgtccgctggctgctatgcc

SEQ ID NO: 409624 - DNA, 25 bp, Rattus norvegicus
gctggtgtcttacgcgttctattga

SEQ ID NO: 409625 - DNA, 25 bp, Rattus norvegicus
gctggtgtcttaggcgttctattga

SEQ ID NO: 409626 - DNA, 25 bp, Rattus norvegicus
gctggtgtgagaacacggcccagct

SEQ ID NO: 409627 - DNA, 25 bp, Rattus norvegicus
gctggtgtgagatcacggcccagct

SEQ ID NO: 409628 - DNA, 25 bp, Rattus norvegicus
gctggtgtgcagaacttgtttccta

SEQ ID NO: 409629 - DNA, 25 bp, Rattus norvegicus
gctggtgtgcagtacttgtttccta

SEQ ID NO: 409630 - DNA, 25 bp, Rattus norvegicus
gctggtgtgcatcgacttcggttca

SEQ ID NO: 409631 - DNA, 25 bp, Rattus norvegicus
gctggtgtgcatggacttcggttca

SEQ ID NO: 409632 - DNA, 25 bp, Rattus norvegicus
gctggtgttgctcatgttacaatcc

SEQ ID NO: 409633 - DNA, 25 bp, Rattus norvegicus
gctggtgttgctgatgttacaatcc

SEQ ID NO: 409634 - DNA, 25 bp, Rattus norvegicus
gctggtgtttggattgactgtgtca

SEQ ID NO: 409635 - DNA, 25 bp, Rattus norvegicus
gctggtgtttggtttgactgtgtca

SEQ ID NO: 409636 - DNA, 25 bp, Rattus norvegicus
gctggtgttttgcttatagactcga

SEQ ID NO: 409637 - DNA, 25 bp, Rattus norvegicus
gctggtgttttggttatagactcga

SEQ ID NO: 409638 - DNA, 25 bp, Rattus norvegicus
gctggtgtttttacaccttcatgaa

SEQ ID NO: 409639 - DNA, 25 bp, Rattus norvegicus
gctggtgttttttcaccttcatgaa

SEQ ID NO: 409640 - DNA, 25 bp, Rattus norvegicus
gctggttaaccaatggcaagtccta

SEQ ID NO: 409641 - DNA, 25 bp, Rattus norvegicus
gctggttaaccattggcaagtccta

SEQ ID NO: 409642 - DNA, 25 bp, Rattus norvegicus
gctggttacaggctattttctatat

SEQ ID NO: 409643 - DNA, 25 bp, Rattus norvegicus
gctggttacagggtattttctatat

SEQ ID NO: 409644 - DNA, 25 bp, Rattus norvegicus
gctggttaccctagatgtgttttta

SEQ ID NO: 409645 - DNA, 25 bp, Rattus norvegicus
gctggttacccttgatgtgttttta

SEQ ID NO: 409646 - DNA, 25 bp, Rattus norvegicus
gctggttataccaacattgatgacg

SEQ ID NO: 409647 - DNA, 25 bp, Rattus norvegicus
gctggttatacctacattgatgacg

SEQ ID NO: 409648 - DNA, 25 bp, Rattus norvegicus
gctggttatagtacggagtctggcc

SEQ ID NO: 409649 - DNA, 25 bp, Rattus norvegicus
gctggttatagttcggagtctggcc

SEQ ID NO: 409650 - DNA, 25 bp, Rattus norvegicus
gctggttcaccaaggacgaccggag

SEQ ID NO: 409651 - DNA, 25 bp, Rattus norvegicus
gctggttcaccatggacgaccggag

SEQ ID NO: 409652 - DNA, 25 bp, Rattus norvegicus
gctggttcaggtattttccccatag

SEQ ID NO: 409653 - DNA, 25 bp, Rattus norvegicus
gctggttcaggttttttccccatag

SEQ ID NO: 409654 - DNA, 25 bp, Rattus norvegicus
gctggttcccagagtggcaacatga

SEQ ID NO: 409655 - DNA, 25 bp, Rattus norvegicus
gctggttcccagtgtggcaacatga

SEQ ID NO: 409656 - DNA, 25 bp, Rattus norvegicus
gctggttcccctagcagttggaaaa

SEQ ID NO: 409657 - DNA, 25 bp, Rattus norvegicus
gctggttccccttgcagttggaaaa

SEQ ID NO: 409658 - DNA, 25 bp, Rattus norvegicus
gctggttcctgaccagataccggaa

SEQ ID NO: 409659 - DNA, 25 bp, Rattus norvegicus
gctggttcctgagcagataccggaa

SEQ ID NO: 409660 - DNA, 25 bp, Rattus norvegicus
gctggttccttaagccacgcatggg

SEQ ID NO: 409661 - DNA, 25 bp, Rattus norvegicus
gctggttccttacatgcagggtcta

SEQ ID NO: 409662 - DNA, 25 bp, Rattus norvegicus
gctggttccttagatgcagggtcta

SEQ ID NO: 409663 - DNA, 25 bp, Rattus norvegicus
gctggttccttatgccacgcatggg

SEQ ID NO: 409664 - DNA, 25 bp, Rattus norvegicus
gctggttcgctacccgggaatttgc

SEQ ID NO: 409665 - DNA, 25 bp, Rattus norvegicus
gctggttcgctagccgggaatttgc

SEQ ID NO: 409666 - DNA, 25 bp, Rattus norvegicus
gctggttcgtgacgccggccaacaa

SEQ ID NO: 409667 - DNA, 25 bp, Rattus norvegicus
gctggttcgtgaggccggccaacaa

SEQ ID NO: 409668 - DNA, 25 bp, Rattus norvegicus
gctggttctagcagggtcaaagttc

SEQ ID NO: 409669 - DNA, 25 bp, Rattus norvegicus
gctggttctagccacagtatcgatt

SEQ ID NO: 409670 - DNA, 25 bp, Rattus norvegicus
gctggttctagcgacagtatcgatt

SEQ ID NO: 409671 - DNA, 25 bp, Rattus norvegicus
gctggttctagctgggtcaaagttc

SEQ ID NO: 409672 - DNA, 25 bp, Rattus norvegicus
gctggttctatactgtgaggcgcat

SEQ ID NO: 409673 - DNA, 25 bp, Rattus norvegicus
gctggttctatagtgtgaggcgcat

SEQ ID NO: 409674 - DNA, 25 bp, Rattus norvegicus
gctggttctcagataagtggcatca

SEQ ID NO: 409675 - DNA, 25 bp, Rattus norvegicus
gctggttctcagttaagtggcatca

SEQ ID NO: 409676 - DNA, 25 bp, Rattus norvegicus
gctggttctgtgatccactcaaaga

SEQ ID NO: 409677 - DNA, 25 bp, Rattus norvegicus
gctggttctgtgttccactcaaaga

SEQ ID NO: 409678 - DNA, 25 bp, Rattus norvegicus
gctggttcttgcatgtgtacagtga

SEQ ID NO: 409679 - DNA, 25 bp, Rattus norvegicus
gctggttcttgcttgtgtacagtga

SEQ ID NO: 409680 - DNA, 25 bp, Rattus norvegicus
gctggttgacaaacatggcaggagt

SEQ ID NO: 409681 - DNA, 25 bp, Rattus norvegicus
gctggttgacaatcatggcaggagt

SEQ ID NO: 409682 - DNA, 25 bp, Rattus norvegicus
gctggttgaccacaacagtttcatt

SEQ ID NO: 409683 - DNA, 25 bp, Rattus norvegicus
gctggttgaccagaacagtttcatt

SEQ ID NO: 409684 - DNA, 25 bp, Rattus norvegicus
gctggttgacctaacctttgggcga

SEQ ID NO: 409685 - DNA, 25 bp, Rattus norvegicus
gctggttgaccttacctttgggcga

SEQ ID NO: 409686 - DNA, 25 bp, Rattus norvegicus
gctggttgcagaccccactttgaga

SEQ ID NO: 409687 - DNA, 25 bp, Rattus norvegicus
gctggttgcagagcccactttgaga

SEQ ID NO: 409688 - DNA, 25 bp, Rattus norvegicus
gctggttgccttatcatccatcttt

SEQ ID NO: 409689 - DNA, 25 bp, Rattus norvegicus
gctggttgccttttcatccatcttt

SEQ ID NO: 409690 - DNA, 25 bp, Rattus norvegicus
gctggttgtaatatggctgctggcc

SEQ ID NO: 409691 - DNA, 25 bp, Rattus norvegicus
gctggttgtaatttggctgctggcc

SEQ ID NO: 409692 - DNA, 25 bp, Rattus norvegicus
gctggttgtgtaattttccgtctta

SEQ ID NO: 409693 - DNA, 25 bp, Rattus norvegicus
gctggttgtgtatttttccgtctta

SEQ ID NO: 409694 - DNA, 25 bp, Rattus norvegicus
gctggtttagtacctcagttcttac

SEQ ID NO: 409695 - DNA, 25 bp, Rattus norvegicus
gctggtttagtagctcagttcttac

SEQ ID NO: 409696 - DNA, 25 bp, Rattus norvegicus
gctggtttcaaaattcccatcctta

SEQ ID NO: 409697 - DNA, 25 bp, Rattus norvegicus
gctggtttcaaatttcccatcctta

SEQ ID NO: 409698 - DNA, 25 bp, Rattus norvegicus
gctggtttcaggcttagatgattca

SEQ ID NO: 409699 - DNA, 25 bp, Rattus norvegicus
gctggtttcagggttagatgattca

SEQ ID NO: 409700 - DNA, 25 bp, Rattus norvegicus
gctggtttccagctgctaaggtgca

SEQ ID NO: 409701 - DNA, 25 bp, Rattus norvegicus
gctggtttccaggtgctaaggtgca

SEQ ID NO: 409702 - DNA, 25 bp, Rattus norvegicus
gctggtttccctctaactatgtgga

SEQ ID NO: 409703 - DNA, 25 bp, Rattus norvegicus
gctggtttccctgtaactatgtgga

SEQ ID NO: 409704 - DNA, 25 bp, Rattus norvegicus
gctggtttcctgaaccctttagtag

SEQ ID NO: 409705 - DNA, 25 bp, Rattus norvegicus
gctggtttcctgtaccctttagtag

SEQ ID NO: 409706 - DNA, 25 bp, Rattus norvegicus
gctggtttcttcacttaatctggca

SEQ ID NO: 409707 - DNA, 25 bp, Rattus norvegicus
gctggtttcttctcttaatctggca

SEQ ID NO: 409708 - DNA, 25 bp, Rattus norvegicus
gctggtttgacacatatgttctcgt

SEQ ID NO: 409709 - DNA, 25 bp, Rattus norvegicus
gctggtttgacagatatgttctcgt

SEQ ID NO: 409710 - DNA, 25 bp, Rattus norvegicus
gctggttttatgataagccccgtag

SEQ ID NO: 409711 - DNA, 25 bp, Rattus norvegicus
gctggttttatgttaagccccgtag

SEQ ID NO: 409712 - DNA, 25 bp, Rattus norvegicus
gctggttttccaattacactgaata

SEQ ID NO: 409713 - DNA, 25 bp, Rattus norvegicus
gctggttttccatttacactgaata

SEQ ID NO: 409714 - DNA, 25 bp, Rattus norvegicus
gctggttttctaagatacgggatac

SEQ ID NO: 409715 - DNA, 25 bp, Rattus norvegicus
gctggttttctatgatacgggatac

SEQ ID NO: 409716 - DNA, 25 bp, Rattus norvegicus
gctggttttggcactggactcggaa

SEQ ID NO: 409717 - DNA, 25 bp, Rattus norvegicus
gctggttttggctctggactcggaa

SEQ ID NO: 409718 - DNA, 25 bp, Rattus norvegicus
gctggttttgtgaccgtgaccgtgc

SEQ ID NO: 409719 - DNA, 25 bp, Rattus norvegicus
gctggttttgtgtccgtgaccgtgc

SEQ ID NO: 409720 - DNA, 25 bp, Rattus norvegicus
gctggtttttccagtcacaatggta

SEQ ID NO: 409721 - DNA, 25 bp, Rattus norvegicus
gctggtttttcctgtcacaatggta

SEQ ID NO: 409722 - DNA, 25 bp, Rattus norvegicus
gctgtaaacagcacagaagggtaaa

SEQ ID NO: 409723 - DNA, 25 bp, Rattus norvegicus
gctgtaaacagctcagaagggtaaa

SEQ ID NO: 409724 - DNA, 25 bp, Rattus norvegicus
gctgtaaacgtcagtctgttccgaa

SEQ ID NO: 409725 - DNA, 25 bp, Rattus norvegicus
gctgtaaacgtctgtctgttccgaa

SEQ ID NO: 409726 - DNA, 25 bp, Rattus norvegicus
gctgtaaagacacttcctctgcact

SEQ ID NO: 409727 - DNA, 25 bp, Rattus norvegicus
gctgtaaagacagttcctctgcact

SEQ ID NO: 409728 - DNA, 25 bp, Rattus norvegicus
gctgtaaagctgaagaattttttga

SEQ ID NO: 409729 - DNA, 25 bp, Rattus norvegicus
gctgtaaagctgtagaattttttga

SEQ ID NO: 409730 - DNA, 25 bp, Rattus norvegicus
gctgtaacagcgaaccaaaagtaaa

SEQ ID NO: 409731 - DNA, 25 bp, Rattus norvegicus
gctgtaacagcgtaccaaaagtaaa

SEQ ID NO: 409732 - DNA, 25 bp, Rattus norvegicus
gctgtaacagttatgattctctttc

SEQ ID NO: 409733 - DNA, 25 bp, Rattus norvegicus
gctgtaacagttttgattctctttc

SEQ ID NO: 409734 - DNA, 25 bp, Rattus norvegicus
gctgtaacccaaacgttcttacgtt

SEQ ID NO: 409735 - DNA, 25 bp, Rattus norvegicus
gctgtaacccaatcgttcttacgtt

SEQ ID NO: 409736 - DNA, 25 bp, Rattus norvegicus
gctgtaacctaacctgacctgtaat

SEQ ID NO: 409737 - DNA, 25 bp, Rattus norvegicus
gctgtaacctaagctgacctgtaat

SEQ ID NO: 409738 - DNA, 25 bp, Rattus norvegicus
gctgtaacgataacactcgtcagtg

SEQ ID NO: 409739 - DNA, 25 bp, Rattus norvegicus
gctgtaacgatatcactcgtcagtg

SEQ ID NO: 409740 - DNA, 25 bp, Rattus norvegicus
gctgtaactccgcttcagagagaga

SEQ ID NO: 409741 - DNA, 25 bp, Rattus norvegicus
gctgtaactccggttcagagagaga

SEQ ID NO: 409742 - DNA, 25 bp, Rattus norvegicus
gctgtaactgggatggcctacctag

SEQ ID NO: 409743 - DNA, 25 bp, Rattus norvegicus
gctgtaactgggttggcctacctag

SEQ ID NO: 409744 - DNA, 25 bp, Rattus norvegicus
gctgtaagcataactttaccattga

SEQ ID NO: 409745 - DNA, 25 bp, Rattus norvegicus
gctgtaagcatatctttaccattga

SEQ ID NO: 409746 - DNA, 25 bp, Rattus norvegicus
gctgtaagccggcactcgatgtaaa

SEQ ID NO: 409747 - DNA, 25 bp, Rattus norvegicus
gctgtaagccgggactcgatgtaaa

SEQ ID NO: 409748 - DNA, 25 bp, Rattus norvegicus
gctgtaagctaaaatcaatctcatt

SEQ ID NO: 409749 - DNA, 25 bp, Rattus norvegicus
gctgtaagctaatatcaatctcatt

SEQ ID NO: 409750 - DNA, 25 bp, Rattus norvegicus
gctgtaagctgcacagttggctcct

SEQ ID NO: 409751 - DNA, 25 bp, Rattus norvegicus
gctgtaagctgctcagttggctcct

SEQ ID NO: 409752 - DNA, 25 bp, Rattus norvegicus
gctgtaaggcccatttggctttgaa

SEQ ID NO: 409753 - DNA, 25 bp, Rattus norvegicus
gctgtaaggcccttttggctttgaa

SEQ ID NO: 409754 - DNA, 25 bp, Rattus norvegicus
gctgtaaggcgtctgctagttctcc

SEQ ID NO: 409755 - DNA, 25 bp, Rattus norvegicus
gctgtaaggcgtgtgctagttctcc

SEQ ID NO: 409756 - DNA, 25 bp, Rattus norvegicus
gctgtaatcctgagagatgttttga

SEQ ID NO: 409757 - DNA, 25 bp, Rattus norvegicus
gctgtaatcctgtgagatgttttga

SEQ ID NO: 409758 - DNA, 25 bp, Rattus norvegicus
gctgtaatgaaaagctgccgtcaat

SEQ ID NO: 409759 - DNA, 25 bp, Rattus norvegicus
gctgtaatgaaatgctgccgtcaat

SEQ ID NO: 409760 - DNA, 25 bp, Rattus norvegicus
gctgtacaagaccagaatttaccaa

SEQ ID NO: 409761 - DNA, 25 bp, Rattus norvegicus
gctgtacaagacgagaatttaccaa

SEQ ID NO: 409762 - DNA, 25 bp, Rattus norvegicus
gctgtacaaggaacaacccagtttg

SEQ ID NO: 409763 - DNA, 25 bp, Rattus norvegicus
gctgtacaaggatcaacccagtttg

SEQ ID NO: 409764 - DNA, 25 bp, Rattus norvegicus
gctgtacaccgtacattttctatag

SEQ ID NO: 409765 - DNA, 25 bp, Rattus norvegicus
gctgtacaccgttcattttctatag

SEQ ID NO: 409766 - DNA, 25 bp, Rattus norvegicus
gctgtacagttgaattaaaccgaca

SEQ ID NO: 409767 - DNA, 25 bp, Rattus norvegicus
gctgtacagttgtattaaaccgaca

SEQ ID NO: 409768 - DNA, 25 bp, Rattus norvegicus
gctgtacagtttatatctttggttt

SEQ ID NO: 409769 - DNA, 25 bp, Rattus norvegicus
gctgtacagtttttatctttggttt

SEQ ID NO: 409770 - DNA, 25 bp, Rattus norvegicus
gctgtacattacacatccgtttaat

SEQ ID NO: 409771 - DNA, 25 bp, Rattus norvegicus
gctgtacattactcatccgtttaat

SEQ ID NO: 409772 - DNA, 25 bp, Rattus norvegicus
gctgtacattgtagcttgagaatat

SEQ ID NO: 409773 - DNA, 25 bp, Rattus norvegicus
gctgtacattgttgcttgagaatat

SEQ ID NO: 409774 - DNA, 25 bp, Rattus norvegicus
gctgtacatttcagggaagttctga

SEQ ID NO: 409775 - DNA, 25 bp, Rattus norvegicus
gctgtacatttctgggaagttctga

SEQ ID NO: 409776 - DNA, 25 bp, Rattus norvegicus
gctgtaccagacattgcttattttt

SEQ ID NO: 409777 - DNA, 25 bp, Rattus norvegicus
gctgtaccagactttgcttattttt

SEQ ID NO: 409778 - DNA, 25 bp, Rattus norvegicus
gctgtaccagtcagtaattatgtag

SEQ ID NO: 409779 - DNA, 25 bp, Rattus norvegicus
gctgtaccagtctgtaattatgtag

SEQ ID NO: 409780 - DNA, 25 bp, Rattus norvegicus
gctgtacccaacactacaatgcatt

SEQ ID NO: 409781 - DNA, 25 bp, Rattus norvegicus
gctgtacccaactctacaatgcatt

SEQ ID NO: 409782 - DNA, 25 bp, Rattus norvegicus
gctgtacccatgcatcttgtactat

SEQ ID NO: 409783 - DNA, 25 bp, Rattus norvegicus
gctgtacccatggatcttgtactat

SEQ ID NO: 409784 - DNA, 25 bp, Rattus norvegicus
gctgtaccgttcaggcgaggttaga

SEQ ID NO: 409785 - DNA, 25 bp, Rattus norvegicus
gctgtaccgttctggcgaggttaga

SEQ ID NO: 409786 - DNA, 25 bp, Rattus norvegicus
gctgtacctcaaattgctgaaccaa

SEQ ID NO: 409787 - DNA, 25 bp, Rattus norvegicus
gctgtacctcaatttgctgaaccaa

SEQ ID NO: 409788 - DNA, 25 bp, Rattus norvegicus
gctgtacctgatcccatacattggt

SEQ ID NO: 409789 - DNA, 25 bp, Rattus norvegicus
gctgtacctgatgccatacattggt

SEQ ID NO: 409790 - DNA, 25 bp, Rattus norvegicus
gctgtaccttcaaaccgtctaataa

SEQ ID NO: 409791 - DNA, 25 bp, Rattus norvegicus
gctgtaccttcataccgtctaataa

SEQ ID NO: 409792 - DNA, 25 bp, Rattus norvegicus
gctgtacggcgacagtgacctctaa

SEQ ID NO: 409793 - DNA, 25 bp, Rattus norvegicus
gctgtacggcgagagtgacctctaa

SEQ ID NO: 409794 - DNA, 25 bp, Rattus norvegicus
gctgtacggtttacccgatgaactt

SEQ ID NO: 409795 - DNA, 25 bp, Rattus norvegicus
gctgtacggttttcccgatgaactt

SEQ ID NO: 409796 - DNA, 25 bp, Rattus norvegicus
gctgtacgtcgaacgatactgctgt

SEQ ID NO: 409797 - DNA, 25 bp, Rattus norvegicus
gctgtacgtcgatcgatactgctgt

SEQ ID NO: 409798 - DNA, 25 bp, Rattus norvegicus
gctgtactacttattgtcttccata

SEQ ID NO: 409799 - DNA, 25 bp, Rattus norvegicus
gctgtactactttttgtcttccata

SEQ ID NO: 409800 - DNA, 25 bp, Rattus norvegicus
gctgtactatggctgattttgttta

SEQ ID NO: 409801 - DNA, 25 bp, Rattus norvegicus
gctgtactatgggtgattttgttta

SEQ ID NO: 409802 - DNA, 25 bp, Rattus norvegicus
gctgtactcttcacgttttgattta

SEQ ID NO: 409803 - DNA, 25 bp, Rattus norvegicus
gctgtactcttctcgttttgattta

SEQ ID NO: 409804 - DNA, 25 bp, Rattus norvegicus
gctgtactggaacctatgtggccta

SEQ ID NO: 409805 - DNA, 25 bp, Rattus norvegicus
gctgtactggaagctatgtggccta

SEQ ID NO: 409806 - DNA, 25 bp, Rattus norvegicus
gctgtacttcttcaaaattcccatt

SEQ ID NO: 409807 - DNA, 25 bp, Rattus norvegicus
gctgtacttcttgaaaattcccatt

SEQ ID NO: 409808 - DNA, 25 bp, Rattus norvegicus
gctgtactttcccttcattttttga

SEQ ID NO: 409809 - DNA, 25 bp, Rattus norvegicus
gctgtactttccgttcattttttga

SEQ ID NO: 409810 - DNA, 25 bp, Rattus norvegicus
gctgtagaagccagagactgaagtg

SEQ ID NO: 409811 - DNA, 25 bp, Rattus norvegicus
gctgtagaagcctgagactgaagtg

SEQ ID NO: 409812 - DNA, 25 bp, Rattus norvegicus
gctgtagaatgcatactgtccctga

SEQ ID NO: 409813 - DNA, 25 bp, Rattus norvegicus
gctgtagaatgcttactgtccctga

SEQ ID NO: 409814 - DNA, 25 bp, Rattus norvegicus
gctgtagagctaaaacttgaattat

SEQ ID NO: 409815 - DNA, 25 bp, Rattus norvegicus
gctgtagagctataacttgaattat

SEQ ID NO: 409816 - DNA, 25 bp, Rattus norvegicus
gctgtagcacttatgacctgtctta

SEQ ID NO: 409817 - DNA, 25 bp, Rattus norvegicus
gctgtagcacttttgacctgtctta

SEQ ID NO: 409818 - DNA, 25 bp, Rattus norvegicus
gctgtagcagggaccatcatcttgg

SEQ ID NO: 409819 - DNA, 25 bp, Rattus norvegicus
gctgtagcagggtccatcatcttgg

SEQ ID NO: 409820 - DNA, 25 bp, Rattus norvegicus
gctgtagcagttacctcaagtgatt

SEQ ID NO: 409821 - DNA, 25 bp, Rattus norvegicus
gctgtagcagtttcctcaagtgatt

SEQ ID NO: 409822 - DNA, 25 bp, Rattus norvegicus
gctgtagccatcaatcatttcacat

SEQ ID NO: 409823 - DNA, 25 bp, Rattus norvegicus
gctgtagccatctatcatttcacat

SEQ ID NO: 409824 - DNA, 25 bp, Rattus norvegicus
gctgtagccgctcttctttgaaaaa

SEQ ID NO: 409825 - DNA, 25 bp, Rattus norvegicus
gctgtagccgctgttctttgaaaaa

SEQ ID NO: 409826 - DNA, 25 bp, Rattus norvegicus
gctgtagcctgtccagttgctgtac

SEQ ID NO: 409827 - DNA, 25 bp, Rattus norvegicus
gctgtagcctgtgcagttgctgtac

SEQ ID NO: 409828 - DNA, 25 bp, Rattus norvegicus
gctgtagctcctccttgaaatgtgg

SEQ ID NO: 409829 - DNA, 25 bp, Rattus norvegicus
gctgtagctcctgcttgaaatgtgg

SEQ ID NO: 409830 - DNA, 25 bp, Rattus norvegicus
gctgtagctctaactcttttattgt

SEQ ID NO: 409831 - DNA, 25 bp, Rattus norvegicus
gctgtagctctatctcttttattgt

SEQ ID NO: 409832 - DNA, 25 bp, Rattus norvegicus
gctgtagctgccaccaataacttgt

SEQ ID NO: 409833 - DNA, 25 bp, Rattus norvegicus
gctgtagctgcctccaataacttgt

SEQ ID NO: 409834 - DNA, 25 bp, Rattus norvegicus
gctgtagcttctcttctacgtgaag

SEQ ID NO: 409835 - DNA, 25 bp, Rattus norvegicus
gctgtagcttctgttctacgtgaag

SEQ ID NO: 409836 - DNA, 25 bp, Rattus norvegicus
gctgtaggagaaatccttccccagg

SEQ ID NO: 409837 - DNA, 25 bp, Rattus norvegicus
gctgtaggagaattccttccccagg

SEQ ID NO: 409838 - DNA, 25 bp, Rattus norvegicus
gctgtaggcactaagagtcctctgt

SEQ ID NO: 409839 - DNA, 25 bp, Rattus norvegicus
gctgtaggcacttagagtcctctgt

SEQ ID NO: 409840 - DNA, 25 bp, Rattus norvegicus
gctgtaggcagcaccaaggtttcta

SEQ ID NO: 409841 - DNA, 25 bp, Rattus norvegicus
gctgtaggcagctccaaggtttcta

SEQ ID NO: 409842 - DNA, 25 bp, Rattus norvegicus
gctgtaggccccaagagtcattgat

SEQ ID NO: 409843 - DNA, 25 bp, Rattus norvegicus
gctgtaggcccctagagtcattgat

SEQ ID NO: 409844 - DNA, 25 bp, Rattus norvegicus
gctgtagggattactctgttgtaat

SEQ ID NO: 409845 - DNA, 25 bp, Rattus norvegicus
gctgtagggatttctctgttgtaat

SEQ ID NO: 409846 - DNA, 25 bp, Rattus norvegicus
gctgtagggcttaagcttatacttt

SEQ ID NO: 409847 - DNA, 25 bp, Rattus norvegicus
gctgtagggctttagcttatacttt

SEQ ID NO: 409848 - DNA, 25 bp, Rattus norvegicus
gctgtaggttttatgacacctctga

SEQ ID NO: 409849 - DNA, 25 bp, Rattus norvegicus
gctgtaggttttttgacacctctga

SEQ ID NO: 409850 - DNA, 25 bp, Rattus norvegicus
gctgtagtagagctgacttcccggc

SEQ ID NO: 409851 - DNA, 25 bp, Rattus norvegicus
gctgtagtagaggtgacttcccggc

SEQ ID NO: 409852 - DNA, 25 bp, Rattus norvegicus
gctgtagtcacccaagatgatgaaa

SEQ ID NO: 409853 - DNA, 25 bp, Rattus norvegicus
gctgtagtcaccgaagatgatgaaa

SEQ ID NO: 409854 - DNA, 25 bp, Rattus norvegicus
gctgtagtcatgagttctctctcca

SEQ ID NO: 409855 - DNA, 25 bp, Rattus norvegicus
gctgtagtcatgtgttctctctcca

SEQ ID NO: 409856 - DNA, 25 bp, Rattus norvegicus
gctgtagtcctgctgcaggctcttg

SEQ ID NO: 409857 - DNA, 25 bp, Rattus norvegicus
gctgtagtcctggtgcaggctcttg

SEQ ID NO: 409858 - DNA, 25 bp, Rattus norvegicus
gctgtagtcgccagaggagtcctga

SEQ ID NO: 409859 - DNA, 25 bp, Rattus norvegicus
gctgtagtcgcctgaggagtcctga

SEQ ID NO: 409860 - DNA, 25 bp, Rattus norvegicus
gctgtagtctccacgaaaatgctgt

SEQ ID NO: 409861 - DNA, 25 bp, Rattus norvegicus
gctgtagtctcctcgaaaatgctgt

SEQ ID NO: 409862 - DNA, 25 bp, Rattus norvegicus
gctgtagtgcttactcatgggctat

SEQ ID NO: 409863 - DNA, 25 bp, Rattus norvegicus
gctgtagtgctttctcatgggctat

SEQ ID NO: 409864 - DNA, 25 bp, Rattus norvegicus
gctgtagttccactgcctggctcat

SEQ ID NO: 409865 - DNA, 25 bp, Rattus norvegicus
gctgtagttccagtgcctggctcat

SEQ ID NO: 409866 - DNA, 25 bp, Rattus norvegicus
gctgtagttctcaaggttgctttta

SEQ ID NO: 409867 - DNA, 25 bp, Rattus norvegicus
gctgtagttctctaggttgctttta

SEQ ID NO: 409868 - DNA, 25 bp, Rattus norvegicus
gctgtataatatacgctcctgctac

SEQ ID NO: 409869 - DNA, 25 bp, Rattus norvegicus
gctgtataatattcgctcctgctac

SEQ ID NO: 409870 - DNA, 25 bp, Rattus norvegicus
gctgtatacacaagggtacctgctt

SEQ ID NO: 409871 - DNA, 25 bp, Rattus norvegicus
gctgtatacacatgggtacctgctt

SEQ ID NO: 409872 - DNA, 25 bp, Rattus norvegicus
gctgtatacatgctatatacatgct

SEQ ID NO: 409873 - DNA, 25 bp, Rattus norvegicus
gctgtatacatggtatatacatgct

SEQ ID NO: 409874 - DNA, 25 bp, Rattus norvegicus
gctgtatacctgattagtgtgcact

SEQ ID NO: 409875 - DNA, 25 bp, Rattus norvegicus
gctgtatacctgtttagtgtgcact

SEQ ID NO: 409876 - DNA, 25 bp, Rattus norvegicus
gctgtatactacaggccagccttga

SEQ ID NO: 409877 - DNA, 25 bp, Rattus norvegicus
gctgtatactactggccagccttga

SEQ ID NO: 409878 - DNA, 25 bp, Rattus norvegicus
gctgtatataaactcatcttggcaa

SEQ ID NO: 409879 - DNA, 25 bp, Rattus norvegicus
gctgtatataaagtcatcttggcaa

SEQ ID NO: 409880 - DNA, 25 bp, Rattus norvegicus
gctgtatataagctgacgctgctgt

SEQ ID NO: 409881 - DNA, 25 bp, Rattus norvegicus
gctgtatataaggtgacgctgctgt

SEQ ID NO: 409882 - DNA, 25 bp, Rattus norvegicus
gctgtatcccagacttaagtcgaaa

SEQ ID NO: 409883 - DNA, 25 bp, Rattus norvegicus
gctgtatcccagtcttaagtcgaaa

SEQ ID NO: 409884 - DNA, 25 bp, Rattus norvegicus
gctgtatccgcaacaaccacaagat

SEQ ID NO: 409885 - DNA, 25 bp, Rattus norvegicus
gctgtatccgcatcaaccacaagat

SEQ ID NO: 409886 - DNA, 25 bp, Rattus norvegicus
gctgtatcggacagggagccttcct

SEQ ID NO: 409887 - DNA, 25 bp, Rattus norvegicus
gctgtatcggactgggagccttcct

SEQ ID NO: 409888 - DNA, 25 bp, Rattus norvegicus
gctgtatctgaaccctgagcagtgt

SEQ ID NO: 409889 - DNA, 25 bp, Rattus norvegicus
gctgtatctgaagcctgagcagtgt

SEQ ID NO: 409890 - DNA, 25 bp, Rattus norvegicus
gctgtatgtggtattgctgatcatg

SEQ ID NO: 409891 - DNA, 25 bp, Rattus norvegicus
gctgtatgtggttttgctgatcatg

SEQ ID NO: 409892 - DNA, 25 bp, Rattus norvegicus
gctgtattaagaattcttttctgtg

SEQ ID NO: 409893 - DNA, 25 bp, Rattus norvegicus
gctgtattaagatttcttttctgtg

SEQ ID NO: 409894 - DNA, 25 bp, Rattus norvegicus
gctgtattactgcaacaatgagtac

SEQ ID NO: 409895 - DNA, 25 bp, Rattus norvegicus
gctgtattactggaacaatgagtac

SEQ ID NO: 409896 - DNA, 25 bp, Rattus norvegicus
gctgtattatttacctgcatcttca

SEQ ID NO: 409897 - DNA, 25 bp, Rattus norvegicus
gctgtattattttcctgcatcttca

SEQ ID NO: 409898 - DNA, 25 bp, Rattus norvegicus
gctgtattcatactttggttgcttc

SEQ ID NO: 409899 - DNA, 25 bp, Rattus norvegicus
gctgtattcatagtttggttgcttc

SEQ ID NO: 409900 - DNA, 25 bp, Rattus norvegicus
gctgtattcctaccccttgcatttt

SEQ ID NO: 409901 - DNA, 25 bp, Rattus norvegicus
gctgtattcctagcccttgcatttt

SEQ ID NO: 409902 - DNA, 25 bp, Rattus norvegicus
gctgtattctgtcttctttttgcaa

SEQ ID NO: 409903 - DNA, 25 bp, Rattus norvegicus
gctgtattctgtgttctttttgcaa

SEQ ID NO: 409904 - DNA, 25 bp, Rattus norvegicus
gctgtattgctaaagacacccttta

SEQ ID NO: 409905 - DNA, 25 bp, Rattus norvegicus
gctgtattgctatagacacccttta

SEQ ID NO: 409906 - DNA, 25 bp, Rattus norvegicus
gctgtattggcacaatttcgttgtt

SEQ ID NO: 409907 - DNA, 25 bp, Rattus norvegicus
gctgtattggcagaatttcgttgtt

SEQ ID NO: 409908 - DNA, 25 bp, Rattus norvegicus
gctgtattgtggaaactggtctgga

SEQ ID NO: 409909 - DNA, 25 bp, Rattus norvegicus
gctgtattgtggtaactggtctgga

SEQ ID NO: 409910 - DNA, 25 bp, Rattus norvegicus
gctgtatttgaaagacttcaccctt

SEQ ID NO: 409911 - DNA, 25 bp, Rattus norvegicus
gctgtatttgaatgacttcaccctt

SEQ ID NO: 409912 - DNA, 25 bp, Rattus norvegicus
gctgtatttggacccttctagtcca

SEQ ID NO: 409913 - DNA, 25 bp, Rattus norvegicus
gctgtatttggagccttctagtcca

SEQ ID NO: 409914 - DNA, 25 bp, Rattus norvegicus
gctgtatttgtcaggttgttggcat

SEQ ID NO: 409915 - DNA, 25 bp, Rattus norvegicus
gctgtatttgtctggttgttggcat

SEQ ID NO: 409916 - DNA, 25 bp, Rattus norvegicus
gctgtattttccatgcctagaccat

SEQ ID NO: 409917 - DNA, 25 bp, Rattus norvegicus
gctgtattttccttgcctagaccat

SEQ ID NO: 409918 - DNA, 25 bp, Rattus norvegicus
gctgtcaaccctcttgatgctataa

SEQ ID NO: 409919 - DNA, 25 bp, Rattus norvegicus
gctgtcaaccctgttgatgctataa

SEQ ID NO: 409920 - DNA, 25 bp, Rattus norvegicus
gctgtcaagcccaagatgccaaagg

SEQ ID NO: 409921 - DNA, 25 bp, Rattus norvegicus
gctgtcaagccctagatgccaaagg

SEQ ID NO: 409922 - DNA, 25 bp, Rattus norvegicus
gctgtcaaggatctttctcaatctg

SEQ ID NO: 409923 - DNA, 25 bp, Rattus norvegicus
gctgtcaaggatgtttctcaatctg

SEQ ID NO: 409924 - DNA, 25 bp, Rattus norvegicus
gctgtcaagtatagcgttagtgcca

SEQ ID NO: 409925 - DNA, 25 bp, Rattus norvegicus
gctgtcaagtattgcgttagtgcca

SEQ ID NO: 409926 - DNA, 25 bp, Rattus norvegicus
gctgtcaagtccaagggtgttccca

SEQ ID NO: 409927 - DNA, 25 bp, Rattus norvegicus
gctgtcaagtcctagggtgttccca

SEQ ID NO: 409928 - DNA, 25 bp, Rattus norvegicus
gctgtcaatcataagactgcttata

SEQ ID NO: 409929 - DNA, 25 bp, Rattus norvegicus
gctgtcaatcattagactgcttata

SEQ ID NO: 409930 - DNA, 25 bp, Rattus norvegicus
gctgtcacaaagcactgaaatcctt

SEQ ID NO: 409931 - DNA, 25 bp, Rattus norvegicus
gctgtcacaaaggactgaaatcctt

SEQ ID NO: 409932 - DNA, 25 bp, Rattus norvegicus
gctgtcacacagatgtgcttctcat

SEQ ID NO: 409933 - DNA, 25 bp, Rattus norvegicus
gctgtcacacagttgtgcttctcat

SEQ ID NO: 409934 - DNA, 25 bp, Rattus norvegicus
gctgtcacacttataaaatcccctt

SEQ ID NO: 409935 - DNA, 25 bp, Rattus norvegicus
gctgtcacacttttaaaatcccctt

SEQ ID NO: 409936 - DNA, 25 bp, Rattus norvegicus
gctgtcacagtcagagtcctcagga

SEQ ID NO: 409937 - DNA, 25 bp, Rattus norvegicus
gctgtcacagtctgagtcctcagga

SEQ ID NO: 409938 - DNA, 25 bp, Rattus norvegicus
gctgtcaccacaagctgctggagag

SEQ ID NO: 409939 - DNA, 25 bp, Rattus norvegicus
gctgtcaccacatgctgctggagag

SEQ ID NO: 409940 - DNA, 25 bp, Rattus norvegicus
gctgtcaccactacagaattctgcc

SEQ ID NO: 409941 - DNA, 25 bp, Rattus norvegicus
gctgtcaccacttcagaattctgcc

SEQ ID NO: 409942 - DNA, 25 bp, Rattus norvegicus
gctgtcaccagaagccggctcgagg

SEQ ID NO: 409943 - DNA, 25 bp, Rattus norvegicus
gctgtcaccagatgccggctcgagg

SEQ ID NO: 409944 - DNA, 25 bp, Rattus norvegicus
gctgtcacgcctcccaaagcaaaga

SEQ ID NO: 409945 - DNA, 25 bp, Rattus norvegicus
gctgtcacgcctgccaaagcaaaga

SEQ ID NO: 409946 - DNA, 25 bp, Rattus norvegicus
gctgtcactcctcggaaagccaaat

SEQ ID NO: 409947 - DNA, 25 bp, Rattus norvegicus
gctgtcactcctgggaaagccaaat

SEQ ID NO: 409948 - DNA, 25 bp, Rattus norvegicus
gctgtcactggcaccgctactgtta

SEQ ID NO: 409949 - DNA, 25 bp, Rattus norvegicus
gctgtcactggctccgctactgtta

SEQ ID NO: 409950 - DNA, 25 bp, Rattus norvegicus
gctgtcactgtcattggaggcttaa

SEQ ID NO: 409951 - DNA, 25 bp, Rattus norvegicus
gctgtcactgtctttggaggcttaa

SEQ ID NO: 409952 - DNA, 25 bp, Rattus norvegicus
gctgtcactgtgcatgaccttgaaa

SEQ ID NO: 409953 - DNA, 25 bp, Rattus norvegicus
gctgtcactgtggatgaccttgaaa

SEQ ID NO: 409954 - DNA, 25 bp, Rattus norvegicus
gctgtcacttctcccgttgagaata

SEQ ID NO: 409955 - DNA, 25 bp, Rattus norvegicus
gctgtcacttctgccgttgagaata

SEQ ID NO: 409956 - DNA, 25 bp, Rattus norvegicus
gctgtcactttgcaagattagctga

SEQ ID NO: 409957 - DNA, 25 bp, Rattus norvegicus
gctgtcactttggaagattagctga

SEQ ID NO: 409958 - DNA, 25 bp, Rattus norvegicus
gctgtcagactgatgctacacacaa

SEQ ID NO: 409959 - DNA, 25 bp, Rattus norvegicus
gctgtcagactgttgctacacacaa

SEQ ID NO: 409960 - DNA, 25 bp, Rattus norvegicus
gctgtcagattcattaccagactcc

SEQ ID NO: 409961 - DNA, 25 bp, Rattus norvegicus
gctgtcagattctttaccagactcc

SEQ ID NO: 409962 - DNA, 25 bp, Rattus norvegicus
gctgtcagcacccactttatgagca

SEQ ID NO: 409963 - DNA, 25 bp, Rattus norvegicus
gctgtcagcaccgactttatgagca

SEQ ID NO: 409964 - DNA, 25 bp, Rattus norvegicus
gctgtcagcatcaaggagcggaaat

SEQ ID NO: 409965 - DNA, 25 bp, Rattus norvegicus
gctgtcagcatctaggagcggaaat

SEQ ID NO: 409966 - DNA, 25 bp, Rattus norvegicus
gctgtcagggatcccttttcaaata

SEQ ID NO: 409967 - DNA, 25 bp, Rattus norvegicus
gctgtcagggatgccttttcaaata

SEQ ID NO: 409968 - DNA, 25 bp, Rattus norvegicus
gctgtcagggtgagttctcagtcac

SEQ ID NO: 409969 - DNA, 25 bp, Rattus norvegicus
gctgtcagggtgtgttctcagtcac

SEQ ID NO: 409970 - DNA, 25 bp, Rattus norvegicus
gctgtcagtaacactggaagactta

SEQ ID NO: 409971 - DNA, 25 bp, Rattus norvegicus
gctgtcagtaactctggaagactta

SEQ ID NO: 409972 - DNA, 25 bp, Rattus norvegicus
gctgtcagtattcttcctggtcacg

SEQ ID NO: 409973 - DNA, 25 bp, Rattus norvegicus
gctgtcagtattgttcctggtcacg

SEQ ID NO: 409974 - DNA, 25 bp, Rattus norvegicus
gctgtcagtggcagagatcaccaat

SEQ ID NO: 409975 - DNA, 25 bp, Rattus norvegicus
gctgtcagtggctgagatcaccaat

SEQ ID NO: 409976 - DNA, 25 bp, Rattus norvegicus
gctgtcatagtaattcctgatcttt

SEQ ID NO: 409977 - DNA, 25 bp, Rattus norvegicus
gctgtcatagtatttcctgatcttt

SEQ ID NO: 409978 - DNA, 25 bp, Rattus norvegicus
gctgtcatccatcttcttggtgaag

SEQ ID NO: 409979 - DNA, 25 bp, Rattus norvegicus
gctgtcatccatgttcttggtgaag

SEQ ID NO: 409980 - DNA, 25 bp, Rattus norvegicus
gctgtcatcctgaaagtcccgagaa

SEQ ID NO: 409981 - DNA, 25 bp, Rattus norvegicus
gctgtcatcctgtaagtcccgagaa

SEQ ID NO: 409982 - DNA, 25 bp, Rattus norvegicus
gctgtcatgcatcttgttcatttta

SEQ ID NO: 409983 - DNA, 25 bp, Rattus norvegicus
gctgtcatgcatgttgttcatttta

SEQ ID NO: 409984 - DNA, 25 bp, Rattus norvegicus
gctgtcatgcttagctcaggatgca

SEQ ID NO: 409985 - DNA, 25 bp, Rattus norvegicus
gctgtcatgctttgctcaggatgca

SEQ ID NO: 409986 - DNA, 25 bp, Rattus norvegicus
gctgtcatggccaaaggcttcgata

SEQ ID NO: 409987 - DNA, 25 bp, Rattus norvegicus
gctgtcatggcctaaggcttcgata

SEQ ID NO: 409988 - DNA, 25 bp, Rattus norvegicus
gctgtcatggtcacaaggattccga

SEQ ID NO: 409989 - DNA, 25 bp, Rattus norvegicus
gctgtcatggtctcaaggattccga

SEQ ID NO: 409990 - DNA, 25 bp, Rattus norvegicus
gctgtcattttgcttcggaagttta

SEQ ID NO: 409991 - DNA, 25 bp, Rattus norvegicus
gctgtcattttggttcggaagttta

SEQ ID NO: 409992 - DNA, 25 bp, Rattus norvegicus
gctgtccaagtgatgtccacggcag

SEQ ID NO: 409993 - DNA, 25 bp, Rattus norvegicus
gctgtccaagtgttgtccacggcag

SEQ ID NO: 409994 - DNA, 25 bp, Rattus norvegicus
gctgtccacagcatttcttgatagg

SEQ ID NO: 409995 - DNA, 25 bp, Rattus norvegicus
gctgtccacagcttttcttgatagg

SEQ ID NO: 409996 - DNA, 25 bp, Rattus norvegicus
gctgtccatcaacaaaacattcctt

SEQ ID NO: 409997 - DNA, 25 bp, Rattus norvegicus
gctgtccatcaagaaaacattcctt

SEQ ID NO: 409998 - DNA, 25 bp, Rattus norvegicus
gctgtccatcttccatgggttgtgg

SEQ ID NO: 409999 - DNA, 25 bp, Rattus norvegicus
gctgtccatcttgcatgggttgtgg

SEQ ID NO: 410000 - DNA, 25 bp, Rattus norvegicus
gctgtcccactacaaccgattaatt

SEQ ID NO: 410001 - DNA, 25 bp, Rattus norvegicus
gctgtcccactagaaccgattaatt

SEQ ID NO: 410002 - DNA, 25 bp, Rattus norvegicus
gctgtcccactcatttttcaagaaa

SEQ ID NO: 410003 - DNA, 25 bp, Rattus norvegicus
gctgtcccactcttttttcaagaaa

SEQ ID NO: 410004 - DNA, 25 bp, Rattus norvegicus
gctgtcccatctcatgactcacatg

SEQ ID NO: 410005 - DNA, 25 bp, Rattus norvegicus
gctgtcccatctgatgactcacatg

SEQ ID NO: 410006 - DNA, 25 bp, Rattus norvegicus
gctgtcccatttaaagactgcttga

SEQ ID NO: 410007 - DNA, 25 bp, Rattus norvegicus
gctgtcccattttaagactgcttga

SEQ ID NO: 410008 - DNA, 25 bp, Rattus norvegicus
gctgtccccagccattatgaatagt

SEQ ID NO: 410009 - DNA, 25 bp, Rattus norvegicus
gctgtccccagcgattatgaatagt

SEQ ID NO: 410010 - DNA, 25 bp, Rattus norvegicus
gctgtccccgccacctgaagaatct

SEQ ID NO: 410011 - DNA, 25 bp, Rattus norvegicus
gctgtccccgcctcctgaagaatct

SEQ ID NO: 410012 - DNA, 25 bp, Rattus norvegicus
gctgtcccctttacattatttggca

SEQ ID NO: 410013 - DNA, 25 bp, Rattus norvegicus
gctgtccccttttcattatttggca

SEQ ID NO: 410014 - DNA, 25 bp, Rattus norvegicus
gctgtccctgctattcaactgaaat

SEQ ID NO: 410015 - DNA, 25 bp, Rattus norvegicus
gctgtccctgcttttcaactgaaat

SEQ ID NO: 410016 - DNA, 25 bp, Rattus norvegicus
gctgtcccttacactttgtggagaa

SEQ ID NO: 410017 - DNA, 25 bp, Rattus norvegicus
gctgtcccttactctttgtggagaa

SEQ ID NO: 410018 - DNA, 25 bp, Rattus norvegicus
gctgtccctttgagtgaatgtcacc

SEQ ID NO: 410019 - DNA, 25 bp, Rattus norvegicus
gctgtccctttgtgtgaatgtcacc

SEQ ID NO: 410020 - DNA, 25 bp, Rattus norvegicus
gctgtccgggacagactcagaacag

SEQ ID NO: 410021 - DNA, 25 bp, Rattus norvegicus
gctgtccgggactgactcagaacag

SEQ ID NO: 410022 - DNA, 25 bp, Rattus norvegicus
gctgtccgttacactagttccaggg

SEQ ID NO: 410023 - DNA, 25 bp, Rattus norvegicus
gctgtccgttactctagttccaggg

SEQ ID NO: 410024 - DNA, 25 bp, Rattus norvegicus
gctgtccgttttcagtccagcaaaa

SEQ ID NO: 410025 - DNA, 25 bp, Rattus norvegicus
gctgtccgttttgagtccagcaaaa

SEQ ID NO: 410026 - DNA, 25 bp, Rattus norvegicus
gctgtcctaaatatctcaccatgag

SEQ ID NO: 410027 - DNA, 25 bp, Rattus norvegicus
gctgtcctaaatttctcaccatgag

SEQ ID NO: 410028 - DNA, 25 bp, Rattus norvegicus
gctgtcctaataccagaggcttcca

SEQ ID NO: 410029 - DNA, 25 bp, Rattus norvegicus
gctgtcctaatagcagaggcttcca

SEQ ID NO: 410030 - DNA, 25 bp, Rattus norvegicus
gctgtcctagtaactgatgaaacaa

SEQ ID NO: 410031 - DNA, 25 bp, Rattus norvegicus
gctgtcctagtatctgatgaaacaa

SEQ ID NO: 410032 - DNA, 25 bp, Rattus norvegicus
gctgtcctcctaactttgcagattg

SEQ ID NO: 410033 - DNA, 25 bp, Rattus norvegicus
gctgtcctcctatctttgcagattg

SEQ ID NO: 410034 - DNA, 25 bp, Rattus norvegicus
gctgtcctcgatatgttgtgattga

SEQ ID NO: 410035 - DNA, 25 bp, Rattus norvegicus
gctgtcctcgatttgttgtgattga

SEQ ID NO: 410036 - DNA, 25 bp, Rattus norvegicus
gctgtcctgactcagggctgctgta

SEQ ID NO: 410037 - DNA, 25 bp, Rattus norvegicus
gctgtcctgactgagggctgctgta

SEQ ID NO: 410038 - DNA, 25 bp, Rattus norvegicus
gctgtcctgaggaatttgatttctc

SEQ ID NO: 410039 - DNA, 25 bp, Rattus norvegicus
gctgtcctgaggtatttgatttctc

SEQ ID NO: 410040 - DNA, 25 bp, Rattus norvegicus
gctgtcctggaaataattttgtagt

SEQ ID NO: 410041 - DNA, 25 bp, Rattus norvegicus
gctgtcctggaaattggtccacaga

SEQ ID NO: 410042 - DNA, 25 bp, Rattus norvegicus
gctgtcctggaattaattttgtagt

SEQ ID NO: 410043 - DNA, 25 bp, Rattus norvegicus
gctgtcctggaatttggtccacaga

SEQ ID NO: 410044 - DNA, 25 bp, Rattus norvegicus
gctgtccttaaacccacaactgtgt

SEQ ID NO: 410045 - DNA, 25 bp, Rattus norvegicus
gctgtccttaaagccacaactgtgt

SEQ ID NO: 410046 - DNA, 25 bp, Rattus norvegicus
gctgtcctttcacattacacactga

SEQ ID NO: 410047 - DNA, 25 bp, Rattus norvegicus
gctgtcctttcagattacacactga

SEQ ID NO: 410048 - DNA, 25 bp, Rattus norvegicus
gctgtccttttgattttcgagggat

SEQ ID NO: 410049 - DNA, 25 bp, Rattus norvegicus
gctgtccttttgtttttcgagggat

SEQ ID NO: 410050 - DNA, 25 bp, Rattus norvegicus
gctgtcgattaacaccggagcttgt

SEQ ID NO: 410051 - DNA, 25 bp, Rattus norvegicus
gctgtcgattaagaccggagcttgt

SEQ ID NO: 410052 - DNA, 25 bp, Rattus norvegicus
gctgtcgccgagagtatttctatac

SEQ ID NO: 410053 - DNA, 25 bp, Rattus norvegicus
gctgtcgccgagtgtatttctatac

SEQ ID NO: 410054 - DNA, 25 bp, Rattus norvegicus
gctgtcgcctatatttggtttggat

SEQ ID NO: 410055 - DNA, 25 bp, Rattus norvegicus
gctgtcgcctatttttggtttggat

SEQ ID NO: 410056 - DNA, 25 bp, Rattus norvegicus
gctgtcgccttaactagtgccgaaa

SEQ ID NO: 410057 - DNA, 25 bp, Rattus norvegicus
gctgtcgccttatctagtgccgaaa

SEQ ID NO: 410058 - DNA, 25 bp, Rattus norvegicus
gctgtcgctgacagaatttctttct

SEQ ID NO: 410059 - DNA, 25 bp, Rattus norvegicus
gctgtcgctgactgaatttctttct

SEQ ID NO: 410060 - DNA, 25 bp, Rattus norvegicus
gctgtcgctggcagtggcactgtaa

SEQ ID NO: 410061 - DNA, 25 bp, Rattus norvegicus
gctgtcgctggctgtggcactgtaa

SEQ ID NO: 410062 - DNA, 25 bp, Rattus norvegicus
gctgtcgctgtgcagcctgaacaga

SEQ ID NO: 410063 - DNA, 25 bp, Rattus norvegicus
gctgtcgctgtggagcctgaacaga

SEQ ID NO: 410064 - DNA, 25 bp, Rattus norvegicus
gctgtcgcttgtcctgcatgaccga

SEQ ID NO: 410065 - DNA, 25 bp, Rattus norvegicus
gctgtcgcttgtgctgcatgaccga

SEQ ID NO: 410066 - DNA, 25 bp, Rattus norvegicus
gctgtcgcttttagagatggctttt

SEQ ID NO: 410067 - DNA, 25 bp, Rattus norvegicus
gctgtcgctttttgagatggctttt

SEQ ID NO: 410068 - DNA, 25 bp, Rattus norvegicus
gctgtcggcccaataatcgtggatt

SEQ ID NO: 410069 - DNA, 25 bp, Rattus norvegicus
gctgtcggcccattaatcgtggatt

SEQ ID NO: 410070 - DNA, 25 bp, Rattus norvegicus
gctgtcggcgacagctttgtaagga

SEQ ID NO: 410071 - DNA, 25 bp, Rattus norvegicus
gctgtcggcgactgctttgtaagga

SEQ ID NO: 410072 - DNA, 25 bp, Rattus norvegicus
gctgtcgtgagcaaatagaatccgc

SEQ ID NO: 410073 - DNA, 25 bp, Rattus norvegicus
gctgtcgtgagctaatagaatccgc

SEQ ID NO: 410074 - DNA, 25 bp, Rattus norvegicus
gctgtcgtgaggaaccgtttgctga

SEQ ID NO: 410075 - DNA, 25 bp, Rattus norvegicus
gctgtcgtgaggtaccgtttgctga

SEQ ID NO: 410076 - DNA, 25 bp, Rattus norvegicus
gctgtcgtgtgtctggccctgatct

SEQ ID NO: 410077 - DNA, 25 bp, Rattus norvegicus
gctgtcgtgtgtgtggccctgatct

SEQ ID NO: 410078 - DNA, 25 bp, Rattus norvegicus
gctgtcgttattccttaccatttca

SEQ ID NO: 410079 - DNA, 25 bp, Rattus norvegicus
gctgtcgttattgcttaccatttca

SEQ ID NO: 410080 - DNA, 25 bp, Rattus norvegicus
gctgtcgttttgcagaaaggctctc

SEQ ID NO: 410081 - DNA, 25 bp, Rattus norvegicus
gctgtcgttttggagaaaggctctc

SEQ ID NO: 410082 - DNA, 25 bp, Rattus norvegicus
gctgtctaactccttccattaaatt

SEQ ID NO: 410083 - DNA, 25 bp, Rattus norvegicus
gctgtctaactcgttccattaaatt

SEQ ID NO: 410084 - DNA, 25 bp, Rattus norvegicus
gctgtctaatagacatctccaagtt

SEQ ID NO: 410085 - DNA, 25 bp, Rattus norvegicus
gctgtctaatagtcatctccaagtt

SEQ ID NO: 410086 - DNA, 25 bp, Rattus norvegicus
gctgtctaccagaccaagatgggtg

SEQ ID NO: 410087 - DNA, 25 bp, Rattus norvegicus
gctgtctaccagtccaagatgggtg

SEQ ID NO: 410088 - DNA, 25 bp, Rattus norvegicus
gctgtctacccaatggttggactga

SEQ ID NO: 410089 - DNA, 25 bp, Rattus norvegicus
gctgtctacccattggttggactga

SEQ ID NO: 410090 - DNA, 25 bp, Rattus norvegicus
gctgtctacgagcacctgcgaagga

SEQ ID NO: 410091 - DNA, 25 bp, Rattus norvegicus
gctgtctacgaggacctgcgaagga

SEQ ID NO: 410092 - DNA, 25 bp, Rattus norvegicus
gctgtctacgcacgtatggttttca

SEQ ID NO: 410093 - DNA, 25 bp, Rattus norvegicus
gctgtctacgcaggtatggttttca

SEQ ID NO: 410094 - DNA, 25 bp, Rattus norvegicus
gctgtctacggtctgtccaataagc

SEQ ID NO: 410095 - DNA, 25 bp, Rattus norvegicus
gctgtctacggtgtgtccaataagc

SEQ ID NO: 410096 - DNA, 25 bp, Rattus norvegicus
gctgtctaggagctttggcatatgc

SEQ ID NO: 410097 - DNA, 25 bp, Rattus norvegicus
gctgtctaggaggtttggcatatgc

SEQ ID NO: 410098 - DNA, 25 bp, Rattus norvegicus
gctgtctatcataaatatcctgtcc

SEQ ID NO: 410099 - DNA, 25 bp, Rattus norvegicus
gctgtctatcattaatatcctgtcc

SEQ ID NO: 410100 - DNA, 25 bp, Rattus norvegicus
gctgtctatttcagtgcacttaaca

SEQ ID NO: 410101 - DNA, 25 bp, Rattus norvegicus
gctgtctatttctgtgcacttaaca

SEQ ID NO: 410102 - DNA, 25 bp, Rattus norvegicus
gctgtctcagccatgtttttctaga

SEQ ID NO: 410103 - DNA, 25 bp, Rattus norvegicus
gctgtctcagccttgtttttctaga

SEQ ID NO: 410104 - DNA, 25 bp, Rattus norvegicus
gctgtctcagttctctgacatctgg

SEQ ID NO: 410105 - DNA, 25 bp, Rattus norvegicus
gctgtctcagttgtctgacatctgg

SEQ ID NO: 410106 - DNA, 25 bp, Rattus norvegicus
gctgtctccaatcctacttacttta

SEQ ID NO: 410107 - DNA, 25 bp, Rattus norvegicus
gctgtctccaatgctacttacttta

SEQ ID NO: 410108 - DNA, 25 bp, Rattus norvegicus
gctgtctctgccagtgaaacgtcag

SEQ ID NO: 410109 - DNA, 25 bp, Rattus norvegicus
gctgtctctgcctgtgaaacgtcag

SEQ ID NO: 410110 - DNA, 25 bp, Rattus norvegicus
gctgtctgatgtccagtcgactgga

SEQ ID NO: 410111 - DNA, 25 bp, Rattus norvegicus
gctgtctgatgtgcagtcgactgga

SEQ ID NO: 410112 - DNA, 25 bp, Rattus norvegicus
gctgtctgattacggcgctatttta

SEQ ID NO: 410113 - DNA, 25 bp, Rattus norvegicus
gctgtctgattagggcgctatttta

SEQ ID NO: 410114 - DNA, 25 bp, Rattus norvegicus
gctgtctgcaaaccaaatggccgta

SEQ ID NO: 410115 - DNA, 25 bp, Rattus norvegicus
gctgtctgcaaacgccactggctga

SEQ ID NO: 410116 - DNA, 25 bp, Rattus norvegicus
gctgtctgcaaagcaaatggccgta

SEQ ID NO: 410117 - DNA, 25 bp, Rattus norvegicus
gctgtctgcaaaggccactggctga

SEQ ID NO: 410118 - DNA, 25 bp, Rattus norvegicus
gctgtctgcagcaatacctcagcag

SEQ ID NO: 410119 - DNA, 25 bp, Rattus norvegicus
gctgtctgcagcagaggataccttt

SEQ ID NO: 410120 - DNA, 25 bp, Rattus norvegicus
gctgtctgcagctatacctcagcag

SEQ ID NO: 410121 - DNA, 25 bp, Rattus norvegicus
gctgtctgcagctgaggataccttt

SEQ ID NO: 410122 - DNA, 25 bp, Rattus norvegicus
gctgtctgccttcagggaacggaca

SEQ ID NO: 410123 - DNA, 25 bp, Rattus norvegicus
gctgtctgccttgagggaacggaca

SEQ ID NO: 410124 - DNA, 25 bp, Rattus norvegicus
gctgtctgcttacctgttcaaccag

SEQ ID NO: 410125 - DNA, 25 bp, Rattus norvegicus
gctgtctgcttagctgttcaaccag

SEQ ID NO: 410126 - DNA, 25 bp, Rattus norvegicus
gctgtctgcttcacccagagtagaa

SEQ ID NO: 410127 - DNA, 25 bp, Rattus norvegicus
gctgtctgcttctcccagagtagaa

SEQ ID NO: 410128 - DNA, 25 bp, Rattus norvegicus
gctgtctggagcaaagagttttgta

SEQ ID NO: 410129 - DNA, 25 bp, Rattus norvegicus
gctgtctggagctaagagttttgta

SEQ ID NO: 410130 - DNA, 25 bp, Rattus norvegicus
gctgtctggatccaatattgcctta

SEQ ID NO: 410131 - DNA, 25 bp, Rattus norvegicus
gctgtctggatcgaatattgcctta

SEQ ID NO: 410132 - DNA, 25 bp, Rattus norvegicus
gctgtctggcagctgaggccctcaa

SEQ ID NO: 410133 - DNA, 25 bp, Rattus norvegicus
gctgtctggcaggtgaggccctcaa

SEQ ID NO: 410134 - DNA, 25 bp, Rattus norvegicus
gctgtctgtaacctttcatttttaa

SEQ ID NO: 410135 - DNA, 25 bp, Rattus norvegicus
gctgtctgtaacgtttcatttttaa

SEQ ID NO: 410136 - DNA, 25 bp, Rattus norvegicus
gctgtctgtcagaacgtggccttga

SEQ ID NO: 410137 - DNA, 25 bp, Rattus norvegicus
gctgtctgtcagtacgtggccttga

SEQ ID NO: 410138 - DNA, 25 bp, Rattus norvegicus
gctgtctgtgacagatatcgctgca

SEQ ID NO: 410139 - DNA, 25 bp, Rattus norvegicus
gctgtctgtgactgatatcgctgca

SEQ ID NO: 410140 - DNA, 25 bp, Rattus norvegicus
gctgtctgtgcaatttttgatcatt

SEQ ID NO: 410141 - DNA, 25 bp, Rattus norvegicus
gctgtctgtgcattttttgatcatt

SEQ ID NO: 410142 - DNA, 25 bp, Rattus norvegicus
gctgtctgtgcccttcgagaagcat

SEQ ID NO: 410143 - DNA, 25 bp, Rattus norvegicus
gctgtctgtgccgttcgagaagcat

SEQ ID NO: 410144 - DNA, 25 bp, Rattus norvegicus
gctgtcttagaactcccgcgagtga

SEQ ID NO: 410145 - DNA, 25 bp, Rattus norvegicus
gctgtcttagaagtcccgcgagtga

SEQ ID NO: 410146 - DNA, 25 bp, Rattus norvegicus
gctgtcttccaactattatttttac

SEQ ID NO: 410147 - DNA, 25 bp, Rattus norvegicus
gctgtcttccaagtattatttttac

SEQ ID NO: 410148 - DNA, 25 bp, Rattus norvegicus
gctgtcttccttagtgtatcacata

SEQ ID NO: 410149 - DNA, 25 bp, Rattus norvegicus
gctgtcttcctttgtgtatcacata

SEQ ID NO: 410150 - DNA, 25 bp, Rattus norvegicus
gctgtcttcgagattcaggccagaa

SEQ ID NO: 410151 - DNA, 25 bp, Rattus norvegicus
gctgtcttcgagtttcaggccagaa

SEQ ID NO: 410152 - DNA, 25 bp, Rattus norvegicus
gctgtcttctccagatagtgaacca

SEQ ID NO: 410153 - DNA, 25 bp, Rattus norvegicus
gctgtcttctcctgatagtgaacca

SEQ ID NO: 410154 - DNA, 25 bp, Rattus norvegicus
gctgtcttctcgatttctctaataa

SEQ ID NO: 410155 - DNA, 25 bp, Rattus norvegicus
gctgtcttctcgttttctctaataa

SEQ ID NO: 410156 - DNA, 25 bp, Rattus norvegicus
gctgtcttctgcagatacttttctt

SEQ ID NO: 410157 - DNA, 25 bp, Rattus norvegicus
gctgtcttctgctgatacttttctt

SEQ ID NO: 410158 - DNA, 25 bp, Rattus norvegicus
gctgtcttctggctgaagcagtaga

SEQ ID NO: 410159 - DNA, 25 bp, Rattus norvegicus
gctgtcttctgggtgaagcagtaga

SEQ ID NO: 410160 - DNA, 25 bp, Rattus norvegicus
gctgtcttgacaccctgagcataag

SEQ ID NO: 410161 - DNA, 25 bp, Rattus norvegicus
gctgtcttgacagcctgagcataag

SEQ ID NO: 410162 - DNA, 25 bp, Rattus norvegicus
gctgtcttgactatgctgtttttaa

SEQ ID NO: 410163 - DNA, 25 bp, Rattus norvegicus
gctgtcttgactttgctgtttttaa

SEQ ID NO: 410164 - DNA, 25 bp, Rattus norvegicus
gctgtcttgcacaatattgtctata

SEQ ID NO: 410165 - DNA, 25 bp, Rattus norvegicus
gctgtcttgcactatattgtctata

SEQ ID NO: 410166 - DNA, 25 bp, Rattus norvegicus
gctgtctttacactgaatgttcccc

SEQ ID NO: 410167 - DNA, 25 bp, Rattus norvegicus
gctgtctttacagtgaatgttcccc

SEQ ID NO: 410168 - DNA, 25 bp, Rattus norvegicus
gctgtctttaggcttctggtacaca

SEQ ID NO: 410169 - DNA, 25 bp, Rattus norvegicus
gctgtctttagggttctggtacaca

SEQ ID NO: 410170 - DNA, 25 bp, Rattus norvegicus
gctgtctttggtacagtctttccac

SEQ ID NO: 410171 - DNA, 25 bp, Rattus norvegicus
gctgtctttggttcagtctttccac

SEQ ID NO: 410172 - DNA, 25 bp, Rattus norvegicus
gctgtcttttaaaggttcctctctt

SEQ ID NO: 410173 - DNA, 25 bp, Rattus norvegicus
gctgtcttttaatggttcctctctt

SEQ ID NO: 410174 - DNA, 25 bp, Rattus norvegicus
gctgtcttttacagctgtgggattt

SEQ ID NO: 410175 - DNA, 25 bp, Rattus norvegicus
gctgtcttttactgctgtgggattt

SEQ ID NO: 410176 - DNA, 25 bp, Rattus norvegicus
gctgtctttttaattgctgattatt

SEQ ID NO: 410177 - DNA, 25 bp, Rattus norvegicus
gctgtctttttatttgctgattatt

SEQ ID NO: 410178 - DNA, 25 bp, Rattus norvegicus
gctgtgaaacccaatccatggaata

SEQ ID NO: 410179 - DNA, 25 bp, Rattus norvegicus
gctgtgaaaccctatccatggaata

SEQ ID NO: 410180 - DNA, 25 bp, Rattus norvegicus
gctgtgaaatccagtaagcctcaac

SEQ ID NO: 410181 - DNA, 25 bp, Rattus norvegicus
gctgtgaaatcctgtaagcctcaac

SEQ ID NO: 410182 - DNA, 25 bp, Rattus norvegicus
gctgtgaaccatcagctcttaccta

SEQ ID NO: 410183 - DNA, 25 bp, Rattus norvegicus
gctgtgaaccatgagctcttaccta

SEQ ID NO: 410184 - DNA, 25 bp, Rattus norvegicus
gctgtgaaccctataataagttcct

SEQ ID NO: 410185 - DNA, 25 bp, Rattus norvegicus
gctgtgaaccctttaataagttcct

SEQ ID NO: 410186 - DNA, 25 bp, Rattus norvegicus
gctgtgaacctaaataattgtcctt

SEQ ID NO: 410187 - DNA, 25 bp, Rattus norvegicus
gctgtgaacctatataattgtcctt

SEQ ID NO: 410188 - DNA, 25 bp, Rattus norvegicus
gctgtgaagcttaccagctctcgaa

SEQ ID NO: 410189 - DNA, 25 bp, Rattus norvegicus
gctgtgaagctttccagctctcgaa

SEQ ID NO: 410190 - DNA, 25 bp, Rattus norvegicus
gctgtgaaggaacctctggtcccta

SEQ ID NO: 410191 - DNA, 25 bp, Rattus norvegicus
gctgtgaaggaagctctggtcccta

SEQ ID NO: 410192 - DNA, 25 bp, Rattus norvegicus
gctgtgaataggatgtacatctaca

SEQ ID NO: 410193 - DNA, 25 bp, Rattus norvegicus
gctgtgaataggttgtacatctaca

SEQ ID NO: 410194 - DNA, 25 bp, Rattus norvegicus
gctgtgaatattattaaccctgtaa

SEQ ID NO: 410195 - DNA, 25 bp, Rattus norvegicus
gctgtgaatatttttaaccctgtaa

SEQ ID NO: 410196 - DNA, 25 bp, Rattus norvegicus
gctgtgaatggcctaatcatggaaa

SEQ ID NO: 410197 - DNA, 25 bp, Rattus norvegicus
gctgtgaatggcgtaatcatggaaa

SEQ ID NO: 410198 - DNA, 25 bp, Rattus norvegicus
gctgtgaattctcttgcactgacaa

SEQ ID NO: 410199 - DNA, 25 bp, Rattus norvegicus
gctgtgaattctgttgcactgacaa

SEQ ID NO: 410200 - DNA, 25 bp, Rattus norvegicus
gctgtgaatttcacaggctctatca

SEQ ID NO: 410201 - DNA, 25 bp, Rattus norvegicus
gctgtgaatttctcaggctctatca

SEQ ID NO: 410202 - DNA, 25 bp, Rattus norvegicus
gctgtgacaagcagcccagtattta

SEQ ID NO: 410203 - DNA, 25 bp, Rattus norvegicus
gctgtgacaagctgcccagtattta

SEQ ID NO: 410204 - DNA, 25 bp, Rattus norvegicus
gctgtgacaggcaaattcccctaat

SEQ ID NO: 410205 - DNA, 25 bp, Rattus norvegicus
gctgtgacaggctaattcccctaat

SEQ ID NO: 410206 - DNA, 25 bp, Rattus norvegicus
gctgtgacattccagatgctgccca

SEQ ID NO: 410207 - DNA, 25 bp, Rattus norvegicus
gctgtgacattcgagatgctgccca

SEQ ID NO: 410208 - DNA, 25 bp, Rattus norvegicus
gctgtgaccctcaacagtatatcca

SEQ ID NO: 410209 - DNA, 25 bp, Rattus norvegicus
gctgtgaccctctacagtatatcca

SEQ ID NO: 410210 - DNA, 25 bp, Rattus norvegicus
gctgtgacctggatcgtgaaggcta

SEQ ID NO: 410211 - DNA, 25 bp, Rattus norvegicus
gctgtgacctggttcgtgaaggcta

SEQ ID NO: 410212 - DNA, 25 bp, Rattus norvegicus
gctgtgacggcaactgaggatacct

SEQ ID NO: 410213 - DNA, 25 bp, Rattus norvegicus
gctgtgacggcatctgaggatacct

SEQ ID NO: 410214 - DNA, 25 bp, Rattus norvegicus
gctgtgactatacctatgggccggc

SEQ ID NO: 410215 - DNA, 25 bp, Rattus norvegicus
gctgtgactatagctatgggccggc

SEQ ID NO: 410216 - DNA, 25 bp, Rattus norvegicus
gctgtgactccgaagactgtagtac

SEQ ID NO: 410217 - DNA, 25 bp, Rattus norvegicus
gctgtgactccgtagactgtagtac

SEQ ID NO: 410218 - DNA, 25 bp, Rattus norvegicus
gctgtgactctgcagcccgagaata

SEQ ID NO: 410219 - DNA, 25 bp, Rattus norvegicus
gctgtgactctggagcccgagaata

SEQ ID NO: 410220 - DNA, 25 bp, Rattus norvegicus
gctgtgactgtgaatgcctgtaacc

SEQ ID NO: 410221 - DNA, 25 bp, Rattus norvegicus
gctgtgactgtgtatgcctgtaacc

SEQ ID NO: 410222 - DNA, 25 bp, Rattus norvegicus
gctgtgagacccacattccttgtaa

SEQ ID NO: 410223 - DNA, 25 bp, Rattus norvegicus
gctgtgagaccctcattccttgtaa

SEQ ID NO: 410224 - DNA, 25 bp, Rattus norvegicus
gctgtgagattaatccagagcatta

SEQ ID NO: 410225 - DNA, 25 bp, Rattus norvegicus
gctgtgagattattccagagcatta

SEQ ID NO: 410226 - DNA, 25 bp, Rattus norvegicus
gctgtgagcatactgccttactctg

SEQ ID NO: 410227 - DNA, 25 bp, Rattus norvegicus
gctgtgagcatagtgccttactctg

SEQ ID NO: 410228 - DNA, 25 bp, Rattus norvegicus
gctgtgaggcagctgtgtggttcct

SEQ ID NO: 410229 - DNA, 25 bp, Rattus norvegicus
gctgtgaggcaggtgtgtggttcct

SEQ ID NO: 410230 - DNA, 25 bp, Rattus norvegicus
gctgtgaggtcacgtgacttcacct

SEQ ID NO: 410231 - DNA, 25 bp, Rattus norvegicus
gctgtgaggtcaggtgacttcacct

SEQ ID NO: 410232 - DNA, 25 bp, Rattus norvegicus
gctgtgagtcatagctaagctacaa

SEQ ID NO: 410233 - DNA, 25 bp, Rattus norvegicus
gctgtgagtcattgctaagctacaa

SEQ ID NO: 410234 - DNA, 25 bp, Rattus norvegicus
gctgtgagtctgcaagtcatcttgt

SEQ ID NO: 410235 - DNA, 25 bp, Rattus norvegicus
gctgtgagtctggaagtcatcttgt

SEQ ID NO: 410236 - DNA, 25 bp, Rattus norvegicus
gctgtgagtcttattacacccagtg

SEQ ID NO: 410237 - DNA, 25 bp, Rattus norvegicus
gctgtgagtctttttacacccagtg

SEQ ID NO: 410238 - DNA, 25 bp, Rattus norvegicus
gctgtgagtgagatcgatgccctct

SEQ ID NO: 410239 - DNA, 25 bp, Rattus norvegicus
gctgtgagtgagttcgatgccctct

SEQ ID NO: 410240 - DNA, 25 bp, Rattus norvegicus
gctgtgatacagattacgtggcttt

SEQ ID NO: 410241 - DNA, 25 bp, Rattus norvegicus
gctgtgatacagtttacgtggcttt

SEQ ID NO: 410242 - DNA, 25 bp, Rattus norvegicus
gctgtgatcagtaatctgggtagct

SEQ ID NO: 410243 - DNA, 25 bp, Rattus norvegicus
gctgtgatcagttatctgggtagct

SEQ ID NO: 410244 - DNA, 25 bp, Rattus norvegicus
gctgtgatctggctctgcaggacaa

SEQ ID NO: 410245 - DNA, 25 bp, Rattus norvegicus
gctgtgatctgggtctgcaggacaa

SEQ ID NO: 410246 - DNA, 25 bp, Rattus norvegicus
gctgtgatgacccttccaaagccct

SEQ ID NO: 410247 - DNA, 25 bp, Rattus norvegicus
gctgtgatgaccgttccaaagccct

SEQ ID NO: 410248 - DNA, 25 bp, Rattus norvegicus
gctgtgatgctcaggctgatgtaaa

SEQ ID NO: 410249 - DNA, 25 bp, Rattus norvegicus
gctgtgatgctctggctgatgtaaa

SEQ ID NO: 410250 - DNA, 25 bp, Rattus norvegicus
gctgtgattagactccctatggcaa

SEQ ID NO: 410251 - DNA, 25 bp, Rattus norvegicus
gctgtgattagagtccctatggcaa

SEQ ID NO: 410252 - DNA, 25 bp, Rattus norvegicus
gctgtgatttgaactctcctcaaca

SEQ ID NO: 410253 - DNA, 25 bp, Rattus norvegicus
gctgtgatttgatctctcctcaaca

SEQ ID NO: 410254 - DNA, 25 bp, Rattus norvegicus
gctgtgatttgcaggctgtgtttac

SEQ ID NO: 410255 - DNA, 25 bp, Rattus norvegicus
gctgtgatttgctggctgtgtttac

SEQ ID NO: 410256 - DNA, 25 bp, Rattus norvegicus
gctgtgcaaccgaggctaacctgcg

SEQ ID NO: 410257 - DNA, 25 bp, Rattus norvegicus
gctgtgcaaccgtggctaacctgcg

SEQ ID NO: 410258 - DNA, 25 bp, Rattus norvegicus
gctgtgcaagctcgaggacctcagt

SEQ ID NO: 410259 - DNA, 25 bp, Rattus norvegicus
gctgtgcaagctggaggacctcagt

SEQ ID NO: 410260 - DNA, 25 bp, Rattus norvegicus
gctgtgcacaccatctttactggat

SEQ ID NO: 410261 - DNA, 25 bp, Rattus norvegicus
gctgtgcacaccttctttactggat

SEQ ID NO: 410262 - DNA, 25 bp, Rattus norvegicus
gctgtgcacagccaattagaacttg

SEQ ID NO: 410263 - DNA, 25 bp, Rattus norvegicus
gctgtgcacagcgaattagaacttg

SEQ ID NO: 410264 - DNA, 25 bp, Rattus norvegicus
gctgtgcacagtaccaagtgcctta

SEQ ID NO: 410265 - DNA, 25 bp, Rattus norvegicus
gctgtgcacagttccaagtgcctta

SEQ ID NO: 410266 - DNA, 25 bp, Rattus norvegicus
gctgtgcacttacagttagacccaa

SEQ ID NO: 410267 - DNA, 25 bp, Rattus norvegicus
gctgtgcacttagagttagacccaa

SEQ ID NO: 410268 - DNA, 25 bp, Rattus norvegicus
gctgtgcagcctattaaccacctga

SEQ ID NO: 410269 - DNA, 25 bp, Rattus norvegicus
gctgtgcagccttttaaccacctga

SEQ ID NO: 410270 - DNA, 25 bp, Rattus norvegicus
gctgtgcagctcaaccagggagcat

SEQ ID NO: 410271 - DNA, 25 bp, Rattus norvegicus
gctgtgcagctctaccagggagcat

SEQ ID NO: 410272 - DNA, 25 bp, Rattus norvegicus
gctgtgcagctgattgttttgctta

SEQ ID NO: 410273 - DNA, 25 bp, Rattus norvegicus
gctgtgcagctgtttgttttgctta

SEQ ID NO: 410274 - DNA, 25 bp, Rattus norvegicus
gctgtgcaggccagggctgccatct

SEQ ID NO: 410275 - DNA, 25 bp, Rattus norvegicus
gctgtgcaggcctgggctgccatct

SEQ ID NO: 410276 - DNA, 25 bp, Rattus norvegicus
gctgtgccacatcccattttgattt

SEQ ID NO: 410277 - DNA, 25 bp, Rattus norvegicus
gctgtgccacatgccattttgattt

SEQ ID NO: 410278 - DNA, 25 bp, Rattus norvegicus
gctgtgccacgtcctaatctagttt

SEQ ID NO: 410279 - DNA, 25 bp, Rattus norvegicus
gctgtgccacgtgctaatctagttt

SEQ ID NO: 410280 - DNA, 25 bp, Rattus norvegicus
gctgtgccatcccaaaactctttgg

SEQ ID NO: 410281 - DNA, 25 bp, Rattus norvegicus
gctgtgccatccgaaaactctttgg

SEQ ID NO: 410282 - DNA, 25 bp, Rattus norvegicus
gctgtgcccaggaatttgcaaggtt

SEQ ID NO: 410283 - DNA, 25 bp, Rattus norvegicus
gctgtgcccaggacaaacccagaaa

SEQ ID NO: 410284 - DNA, 25 bp, Rattus norvegicus
gctgtgcccaggtatttgcaaggtt

SEQ ID NO: 410285 - DNA, 25 bp, Rattus norvegicus
gctgtgcccaggtcaaacccagaaa

SEQ ID NO: 410286 - DNA, 25 bp, Rattus norvegicus
gctgtgcccatcaaccagtgaatat

SEQ ID NO: 410287 - DNA, 25 bp, Rattus norvegicus
gctgtgcccatctaccagtgaatat

SEQ ID NO: 410288 - DNA, 25 bp, Rattus norvegicus
gctgtgcccatgaagaacaacttct

SEQ ID NO: 410289 - DNA, 25 bp, Rattus norvegicus
gctgtgcccatgtagaacaacttct

SEQ ID NO: 410290 - DNA, 25 bp, Rattus norvegicus
gctgtgccgaggagaactgcttcat

SEQ ID NO: 410291 - DNA, 25 bp, Rattus norvegicus
gctgtgccgaggtgaactgcttcat

SEQ ID NO: 410292 - DNA, 25 bp, Rattus norvegicus
gctgtgccgttgagaaggtttgtta

SEQ ID NO: 410293 - DNA, 25 bp, Rattus norvegicus
gctgtgccgttgtgaaggtttgtta

SEQ ID NO: 410294 - DNA, 25 bp, Rattus norvegicus
gctgtgcctggcctgatacttagga

SEQ ID NO: 410295 - DNA, 25 bp, Rattus norvegicus
gctgtgcctggcgtgatacttagga

SEQ ID NO: 410296 - DNA, 25 bp, Rattus norvegicus
gctgtgcctgggagagcatccctga

SEQ ID NO: 410297 - DNA, 25 bp, Rattus norvegicus
gctgtgcctgggtgagcatccctga

SEQ ID NO: 410298 - DNA, 25 bp, Rattus norvegicus
gctgtgccttcaatattttgctatg

SEQ ID NO: 410299 - DNA, 25 bp, Rattus norvegicus
gctgtgccttcattattttgctatg

SEQ ID NO: 410300 - DNA, 25 bp, Rattus norvegicus
gctgtgccttgcattctgacagaac

SEQ ID NO: 410301 - DNA, 25 bp, Rattus norvegicus
gctgtgccttgctttctgacagaac

SEQ ID NO: 410302 - DNA, 25 bp, Rattus norvegicus
gctgtgcctttcatataatgttccc

SEQ ID NO: 410303 - DNA, 25 bp, Rattus norvegicus
gctgtgcctttcttataatgttccc

SEQ ID NO: 410304 - DNA, 25 bp, Rattus norvegicus
gctgtgcgcttgacagaccaccaga

SEQ ID NO: 410305 - DNA, 25 bp, Rattus norvegicus
gctgtgcgcttgtcagaccaccaga

SEQ ID NO: 410306 - DNA, 25 bp, Rattus norvegicus
gctgtgctaacgacacactggacgt

SEQ ID NO: 410307 - DNA, 25 bp, Rattus norvegicus
gctgtgctaacgtcacactggacgt

SEQ ID NO: 410308 - DNA, 25 bp, Rattus norvegicus
gctgtgctaagaccgtccctgggaa

SEQ ID NO: 410309 - DNA, 25 bp, Rattus norvegicus
gctgtgctaagagcgtccctgggaa

SEQ ID NO: 410310 - DNA, 25 bp, Rattus norvegicus
gctgtgctcacaatcccttaaatat

SEQ ID NO: 410311 - DNA, 25 bp, Rattus norvegicus
gctgtgctcacacaagagagtttat

SEQ ID NO: 410312 - DNA, 25 bp, Rattus norvegicus
gctgtgctcacagaagagagtttat

SEQ ID NO: 410313 - DNA, 25 bp, Rattus norvegicus
gctgtgctcacattcccttaaatat

SEQ ID NO: 410314 - DNA, 25 bp, Rattus norvegicus
gctgtgctcagacaagctggcttcc

SEQ ID NO: 410315 - DNA, 25 bp, Rattus norvegicus
gctgtgctcagagaagctggcttcc

SEQ ID NO: 410316 - DNA, 25 bp, Rattus norvegicus
gctgtgctcagccaatttcaagcag

SEQ ID NO: 410317 - DNA, 25 bp, Rattus norvegicus
gctgtgctcagccatgatcgaggac

SEQ ID NO: 410318 - DNA, 25 bp, Rattus norvegicus
gctgtgctcagcgaatttcaagcag

SEQ ID NO: 410319 - DNA, 25 bp, Rattus norvegicus
gctgtgctcagcgatgatcgaggac

SEQ ID NO: 410320 - DNA, 25 bp, Rattus norvegicus
gctgtgctcattctttctgttttaa

SEQ ID NO: 410321 - DNA, 25 bp, Rattus norvegicus
gctgtgctcattgtttctgttttaa

SEQ ID NO: 410322 - DNA, 25 bp, Rattus norvegicus
gctgtgctccctctgtggaagatgc

SEQ ID NO: 410323 - DNA, 25 bp, Rattus norvegicus
gctgtgctccctgtgtggaagatgc

SEQ ID NO: 410324 - DNA, 25 bp, Rattus norvegicus
gctgtgctctttcgcattttcttat

SEQ ID NO: 410325 - DNA, 25 bp, Rattus norvegicus
gctgtgctctttggcattttcttat

SEQ ID NO: 410326 - DNA, 25 bp, Rattus norvegicus
gctgtgctgaggagcatcaggccta

SEQ ID NO: 410327 - DNA, 25 bp, Rattus norvegicus
gctgtgctgaggtgcatcaggccta

SEQ ID NO: 410328 - DNA, 25 bp, Rattus norvegicus
gctgtgctgctacaaaataatgatt

SEQ ID NO: 410329 - DNA, 25 bp, Rattus norvegicus
gctgtgctgctagaaaataatgatt

SEQ ID NO: 410330 - DNA, 25 bp, Rattus norvegicus
gctgtgctgctgaagggccaatcca

SEQ ID NO: 410331 - DNA, 25 bp, Rattus norvegicus
gctgtgctgctgagatttgattttt

SEQ ID NO: 410332 - DNA, 25 bp, Rattus norvegicus
gctgtgctgctgattaagccgtaat

SEQ ID NO: 410333 - DNA, 25 bp, Rattus norvegicus
gctgtgctgctgtagggccaatcca

SEQ ID NO: 410334 - DNA, 25 bp, Rattus norvegicus
gctgtgctgctgtgatttgattttt

SEQ ID NO: 410335 - DNA, 25 bp, Rattus norvegicus
gctgtgctgctgtttaagccgtaat

SEQ ID NO: 410336 - DNA, 25 bp, Rattus norvegicus
gctgtgctggccagactgagcattc

SEQ ID NO: 410337 - DNA, 25 bp, Rattus norvegicus
gctgtgctggcctgactgagcattc

SEQ ID NO: 410338 - DNA, 25 bp, Rattus norvegicus
gctgtgctggttcctgactattgta

SEQ ID NO: 410339 - DNA, 25 bp, Rattus norvegicus
gctgtgctggttgctgactattgta

SEQ ID NO: 410340 - DNA, 25 bp, Rattus norvegicus
gctgtgctgtcccttttgagtccag

SEQ ID NO: 410341 - DNA, 25 bp, Rattus norvegicus
gctgtgctgtccgttttgagtccag

SEQ ID NO: 410342 - DNA, 25 bp, Rattus norvegicus
gctgtgctgtgtatgattctgcatt

SEQ ID NO: 410343 - DNA, 25 bp, Rattus norvegicus
gctgtgctgtgtttgattctgcatt

SEQ ID NO: 410344 - DNA, 25 bp, Rattus norvegicus
gctgtgcttaacatctagagaccgg

SEQ ID NO: 410345 - DNA, 25 bp, Rattus norvegicus
gctgtgcttaacttctagagaccgg

SEQ ID NO: 410346 - DNA, 25 bp, Rattus norvegicus
gctgtgcttaggaggcctgaatcca

SEQ ID NO: 410347 - DNA, 25 bp, Rattus norvegicus
gctgtgcttaggtggcctgaatcca

SEQ ID NO: 410348 - DNA, 25 bp, Rattus norvegicus
gctgtgcttgctctttttcagaccc

SEQ ID NO: 410349 - DNA, 25 bp, Rattus norvegicus
gctgtgcttgctgtttttcagaccc

SEQ ID NO: 410350 - DNA, 25 bp, Rattus norvegicus
gctgtgctttggcaagcaactcttc

SEQ ID NO: 410351 - DNA, 25 bp, Rattus norvegicus
gctgtgctttgggaagcaactcttc

SEQ ID NO: 410352 - DNA, 25 bp, Rattus norvegicus
gctgtggaaataaatccctgcctac

SEQ ID NO: 410353 - DNA, 25 bp, Rattus norvegicus
gctgtggaaatatatccctgcctac

SEQ ID NO: 410354 - DNA, 25 bp, Rattus norvegicus
gctgtggaagcccatggttatttca

SEQ ID NO: 410355 - DNA, 25 bp, Rattus norvegicus
gctgtggaagccgatggttatttca

SEQ ID NO: 410356 - DNA, 25 bp, Rattus norvegicus
gctgtggaatctcaactttcaccaa

SEQ ID NO: 410357 - DNA, 25 bp, Rattus norvegicus
gctgtggaatctgaactttcaccaa

SEQ ID NO: 410358 - DNA, 25 bp, Rattus norvegicus
gctgtggacaagcaattggcccaaa

SEQ ID NO: 410359 - DNA, 25 bp, Rattus norvegicus
gctgtggacaaggaattggcccaaa

SEQ ID NO: 410360 - DNA, 25 bp, Rattus norvegicus
gctgtggactcgcagattttgccaa

SEQ ID NO: 410361 - DNA, 25 bp, Rattus norvegicus
gctgtggactcggagattttgccaa

SEQ ID NO: 410362 - DNA, 25 bp, Rattus norvegicus
gctgtggactctcttgagtgcccaa

SEQ ID NO: 410363 - DNA, 25 bp, Rattus norvegicus
gctgtggactctgttgagtgcccaa

SEQ ID NO: 410364 - DNA, 25 bp, Rattus norvegicus
gctgtggactgcatagattagatac

SEQ ID NO: 410365 - DNA, 25 bp, Rattus norvegicus
gctgtggactgcttagattagatac

SEQ ID NO: 410366 - DNA, 25 bp, Rattus norvegicus
gctgtggacttgattttgctgacta

SEQ ID NO: 410367 - DNA, 25 bp, Rattus norvegicus
gctgtggacttgtttttgctgacta

SEQ ID NO: 410368 - DNA, 25 bp, Rattus norvegicus
gctgtggagacccttttagtattgt

SEQ ID NO: 410369 - DNA, 25 bp, Rattus norvegicus
gctgtggagaccgttttagtattgt

SEQ ID NO: 410370 - DNA, 25 bp, Rattus norvegicus
gctgtggagcaaacaaatgggaatc

SEQ ID NO: 410371 - DNA, 25 bp, Rattus norvegicus
gctgtggagcaatcaaatgggaatc

SEQ ID NO: 410372 - DNA, 25 bp, Rattus norvegicus
gctgtggagctgagggacccaaacc

SEQ ID NO: 410373 - DNA, 25 bp, Rattus norvegicus
gctgtggagctgtgggacccaaacc

SEQ ID NO: 410374 - DNA, 25 bp, Rattus norvegicus
gctgtggagtcaactgtgggctttt

SEQ ID NO: 410375 - DNA, 25 bp, Rattus norvegicus
gctgtggagtcatctgtgggctttt

SEQ ID NO: 410376 - DNA, 25 bp, Rattus norvegicus
gctgtggatcagagcttccctagca

SEQ ID NO: 410377 - DNA, 25 bp, Rattus norvegicus
gctgtggatcagtgcttccctagca

SEQ ID NO: 410378 - DNA, 25 bp, Rattus norvegicus
gctgtggatgcccttttgtagattg

SEQ ID NO: 410379 - DNA, 25 bp, Rattus norvegicus
gctgtggatgccgttttgtagattg

SEQ ID NO: 410380 - DNA, 25 bp, Rattus norvegicus
gctgtggattcaagctgtgccatat

SEQ ID NO: 410381 - DNA, 25 bp, Rattus norvegicus
gctgtggattcatgctgtgccatat

SEQ ID NO: 410382 - DNA, 25 bp, Rattus norvegicus
gctgtggcaatcagcaaagggctaa

SEQ ID NO: 410383 - DNA, 25 bp, Rattus norvegicus
gctgtggcaatctgcaaagggctaa

SEQ ID NO: 410384 - DNA, 25 bp, Rattus norvegicus
gctgtggcaatgatggactttcctt

SEQ ID NO: 410385 - DNA, 25 bp, Rattus norvegicus
gctgtggcaatgttggactttcctt

SEQ ID NO: 410386 - DNA, 25 bp, Rattus norvegicus
gctgtggcaccaacttcaagagctt

SEQ ID NO: 410387 - DNA, 25 bp, Rattus norvegicus
gctgtggcaccatcttcaagagctt

SEQ ID NO: 410388 - DNA, 25 bp, Rattus norvegicus
gctgtggcagctatggacaaaaggt

SEQ ID NO: 410389 - DNA, 25 bp, Rattus norvegicus
gctgtggcagctttggacaaaaggt

SEQ ID NO: 410390 - DNA, 25 bp, Rattus norvegicus
gctgtggccacaatttgtcatgtat

SEQ ID NO: 410391 - DNA, 25 bp, Rattus norvegicus
gctgtggccacattttgtcatgtat

SEQ ID NO: 410392 - DNA, 25 bp, Rattus norvegicus
gctgtggccagcaggcaaatccagt

SEQ ID NO: 410393 - DNA, 25 bp, Rattus norvegicus
gctgtggccagctggcaaatccagt

SEQ ID NO: 410394 - DNA, 25 bp, Rattus norvegicus
gctgtggcccacagcaaacgaggaa

SEQ ID NO: 410395 - DNA, 25 bp, Rattus norvegicus
gctgtggcccactgcaaacgaggaa

SEQ ID NO: 410396 - DNA, 25 bp, Rattus norvegicus
gctgtggcccctcgagaagagacaa

SEQ ID NO: 410397 - DNA, 25 bp, Rattus norvegicus
gctgtggcccctggagaagagacaa

SEQ ID NO: 410398 - DNA, 25 bp, Rattus norvegicus
gctgtggccctaaatgtttttattt

SEQ ID NO: 410399 - DNA, 25 bp, Rattus norvegicus
gctgtggccctatatgtttttattt

SEQ ID NO: 410400 - DNA, 25 bp, Rattus norvegicus
gctgtggccctcacaatgggcaaga

SEQ ID NO: 410401 - DNA, 25 bp, Rattus norvegicus
gctgtggccctctcaatgggcaaga

SEQ ID NO: 410402 - DNA, 25 bp, Rattus norvegicus
gctgtggcctgcatcaagttggcat

SEQ ID NO: 410403 - DNA, 25 bp, Rattus norvegicus
gctgtggcctgcttcaagttggcat

SEQ ID NO: 410404 - DNA, 25 bp, Rattus norvegicus
gctgtggcctttaatgacctgtata

SEQ ID NO: 410405 - DNA, 25 bp, Rattus norvegicus
gctgtggccttttatgacctgtata

SEQ ID NO: 410406 - DNA, 25 bp, Rattus norvegicus
gctgtggcggacattagtaagagtt

SEQ ID NO: 410407 - DNA, 25 bp, Rattus norvegicus
gctgtggcggactttagtaagagtt

SEQ ID NO: 410408 - DNA, 25 bp, Rattus norvegicus
gctgtggctacaataccaaccggta

SEQ ID NO: 410409 - DNA, 25 bp, Rattus norvegicus
gctgtggctacattaccaaccggta

SEQ ID NO: 410410 - DNA, 25 bp, Rattus norvegicus
gctgtggctcacaggctgacactca

SEQ ID NO: 410411 - DNA, 25 bp, Rattus norvegicus
gctgtggctcactggctgacactca

SEQ ID NO: 410412 - DNA, 25 bp, Rattus norvegicus
gctgtggctcagatcaatgacaaca

SEQ ID NO: 410413 - DNA, 25 bp, Rattus norvegicus
gctgtggctcagttcaatgacaaca

SEQ ID NO: 410414 - DNA, 25 bp, Rattus norvegicus
gctgtggctctgagaccttctctca

SEQ ID NO: 410415 - DNA, 25 bp, Rattus norvegicus
gctgtggctctgtgaccttctctca

SEQ ID NO: 410416 - DNA, 25 bp, Rattus norvegicus
gctgtggctgagagcgaagtttcaa

SEQ ID NO: 410417 - DNA, 25 bp, Rattus norvegicus
gctgtggctgagtgcgaagtttcaa

SEQ ID NO: 410418 - DNA, 25 bp, Rattus norvegicus
gctgtggctgccattacgtctgtgc

SEQ ID NO: 410419 - DNA, 25 bp, Rattus norvegicus
gctgtggctgcctttacgtctgtgc

SEQ ID NO: 410420 - DNA, 25 bp, Rattus norvegicus
gctgtggcttatatgtgtactgtgt

SEQ ID NO: 410421 - DNA, 25 bp, Rattus norvegicus
gctgtggcttatttgtgtactgtgt

SEQ ID NO: 410422 - DNA, 25 bp, Rattus norvegicus
gctgtggctttaaatccagaggcca

SEQ ID NO: 410423 - DNA, 25 bp, Rattus norvegicus
gctgtggctttatatccagaggcca

SEQ ID NO: 410424 - DNA, 25 bp, Rattus norvegicus
gctgtgggactaacttgatggcatt

SEQ ID NO: 410425 - DNA, 25 bp, Rattus norvegicus
gctgtgggactatcttgatggcatt

SEQ ID NO: 410426 - DNA, 25 bp, Rattus norvegicus
gctgtgggagcgaaatatcaaatct

SEQ ID NO: 410427 - DNA, 25 bp, Rattus norvegicus
gctgtgggagcgtaatatcaaatct

SEQ ID NO: 410428 - DNA, 25 bp, Rattus norvegicus
gctgtgggcacaatggtcttcaata

SEQ ID NO: 410429 - DNA, 25 bp, Rattus norvegicus
gctgtgggcacattggtcttcaata

SEQ ID NO: 410430 - DNA, 25 bp, Rattus norvegicus
gctgtgggccaactattctgttatc

SEQ ID NO: 410431 - DNA, 25 bp, Rattus norvegicus
gctgtgggccaagtattctgttatc

SEQ ID NO: 410432 - DNA, 25 bp, Rattus norvegicus
gctgtgggccagcacaaccaactat

SEQ ID NO: 410433 - DNA, 25 bp, Rattus norvegicus
gctgtgggccaggacaaccaactat

SEQ ID NO: 410434 - DNA, 25 bp, Rattus norvegicus
gctgtgggctttattaccttatgaa

SEQ ID NO: 410435 - DNA, 25 bp, Rattus norvegicus
gctgtgggcttttttaccttatgaa

SEQ ID NO: 410436 - DNA, 25 bp, Rattus norvegicus
gctgtgggtagtccccagccccaaa

SEQ ID NO: 410437 - DNA, 25 bp, Rattus norvegicus
gctgtgggtagtgcccagccccaaa

SEQ ID NO: 410438 - DNA, 25 bp, Rattus norvegicus
gctgtgggtcatcatctaggtttct

SEQ ID NO: 410439 - DNA, 25 bp, Rattus norvegicus
gctgtgggtcatgatctaggtttct

SEQ ID NO: 410440 - DNA, 25 bp, Rattus norvegicus
gctgtgggtgtcctggttcctggga

SEQ ID NO: 410441 - DNA, 25 bp, Rattus norvegicus
gctgtgggtgtcgtggttcctggga

SEQ ID NO: 410442 - DNA, 25 bp, Rattus norvegicus
gctgtgggtttcaaggatggcaaat

SEQ ID NO: 410443 - DNA, 25 bp, Rattus norvegicus
gctgtgggtttctaggatggcaaat

SEQ ID NO: 410444 - DNA, 25 bp, Rattus norvegicus
gctgtggtacagacacgccaccatg

SEQ ID NO: 410445 - DNA, 25 bp, Rattus norvegicus
gctgtggtacagtcacgccaccatg

SEQ ID NO: 410446 - DNA, 25 bp, Rattus norvegicus
gctgtggtaccaatctgtaggtcat

SEQ ID NO: 410447 - DNA, 25 bp, Rattus norvegicus
gctgtggtaccattctgtaggtcat

SEQ ID NO: 410448 - DNA, 25 bp, Rattus norvegicus
gctgtggtcaatcccaccgccaagg

SEQ ID NO: 410449 - DNA, 25 bp, Rattus norvegicus
gctgtggtcaatgccaccgccaagg

SEQ ID NO: 410450 - DNA, 25 bp, Rattus norvegicus
gctgtggtccttaattattgaccag

SEQ ID NO: 410451 - DNA, 25 bp, Rattus norvegicus
gctgtggtcctttattattgaccag

SEQ ID NO: 410452 - DNA, 25 bp, Rattus norvegicus
gctgtggtctccaagcaatccccgg

SEQ ID NO: 410453 - DNA, 25 bp, Rattus norvegicus
gctgtggtctcctagcaatccccgg

SEQ ID NO: 410454 - DNA, 25 bp, Rattus norvegicus
gctgtggtctggattgtatgcttca

SEQ ID NO: 410455 - DNA, 25 bp, Rattus norvegicus
gctgtggtctggtttgtatgcttca

SEQ ID NO: 410456 - DNA, 25 bp, Rattus norvegicus
gctgtggtgaccactgaacataaaa

SEQ ID NO: 410457 - DNA, 25 bp, Rattus norvegicus
gctgtggtgacctctgaacataaaa

SEQ ID NO: 410458 - DNA, 25 bp, Rattus norvegicus
gctgtggtgactcctgacttaagac

SEQ ID NO: 410459 - DNA, 25 bp, Rattus norvegicus
gctgtggtgactcgctcacagtgaa

SEQ ID NO: 410460 - DNA, 25 bp, Rattus norvegicus
gctgtggtgactgctgacttaagac

SEQ ID NO: 410461 - DNA, 25 bp, Rattus norvegicus
gctgtggtgactggctcacagtgaa

SEQ ID NO: 410462 - DNA, 25 bp, Rattus norvegicus
gctgtggtgcaacgccatttttgct

SEQ ID NO: 410463 - DNA, 25 bp, Rattus norvegicus
gctgtggtgcaaggccatttttgct

SEQ ID NO: 410464 - DNA, 25 bp, Rattus norvegicus
gctgtggtgcatactcatcttgcca

SEQ ID NO: 410465 - DNA, 25 bp, Rattus norvegicus
gctgtggtgcattctcatcttgcca

SEQ ID NO: 410466 - DNA, 25 bp, Rattus norvegicus
gctgtggttcggctttagtttgact

SEQ ID NO: 410467 - DNA, 25 bp, Rattus norvegicus
gctgtggttcgggtttagtttgact

SEQ ID NO: 410468 - DNA, 25 bp, Rattus norvegicus
gctgtggttgcacaaggagtcccct

SEQ ID NO: 410469 - DNA, 25 bp, Rattus norvegicus
gctgtggttgcagaaggagtcccct

SEQ ID NO: 410470 - DNA, 25 bp, Rattus norvegicus
gctgtgtaaaaccatgtgccccaag

SEQ ID NO: 410471 - DNA, 25 bp, Rattus norvegicus
gctgtgtaaaacgatgtgccccaag

SEQ ID NO: 410472 - DNA, 25 bp, Rattus norvegicus
gctgtgtaagcaacttctggcaatt

SEQ ID NO: 410473 - DNA, 25 bp, Rattus norvegicus
gctgtgtaagcatcttctggcaatt

SEQ ID NO: 410474 - DNA, 25 bp, Rattus norvegicus
gctgtgtacacaatgtcatcctggg

SEQ ID NO: 410475 - DNA, 25 bp, Rattus norvegicus
gctgtgtacacattgtcatcctggg

SEQ ID NO: 410476 - DNA, 25 bp, Rattus norvegicus
gctgtgtacagaccctttgaaacat

SEQ ID NO: 410477 - DNA, 25 bp, Rattus norvegicus
gctgtgtacagagcctttgaaacat

SEQ ID NO: 410478 - DNA, 25 bp, Rattus norvegicus
gctgtgtaccatagaacttacagta

SEQ ID NO: 410479 - DNA, 25 bp, Rattus norvegicus
gctgtgtaccattgaacttacagta

SEQ ID NO: 410480 - DNA, 25 bp, Rattus norvegicus
gctgtgtagacaagcagtctgcctc

SEQ ID NO: 410481 - DNA, 25 bp, Rattus norvegicus
gctgtgtagacatgcagtctgcctc

SEQ ID NO: 410482 - DNA, 25 bp, Rattus norvegicus
gctgtgtagcaactgtgtattcaac

SEQ ID NO: 410483 - DNA, 25 bp, Rattus norvegicus
gctgtgtagcaagtgtgtattcaac

SEQ ID NO: 410484 - DNA, 25 bp, Rattus norvegicus
gctgtgtagcctactgagtgccttc

SEQ ID NO: 410485 - DNA, 25 bp, Rattus norvegicus
gctgtgtagccttctgagtgccttc

SEQ ID NO: 410486 - DNA, 25 bp, Rattus norvegicus
gctgtgtagtgcaacaaaatctttg

SEQ ID NO: 410487 - DNA, 25 bp, Rattus norvegicus
gctgtgtagtgctacaaaatctttg

SEQ ID NO: 410488 - DNA, 25 bp, Rattus norvegicus
gctgtgtatagcactggagtccata

SEQ ID NO: 410489 - DNA, 25 bp, Rattus norvegicus
gctgtgtatagctctggagtccata

SEQ ID NO: 410490 - DNA, 25 bp, Rattus norvegicus
gctgtgtcaaggacagaccatgttt

SEQ ID NO: 410491 - DNA, 25 bp, Rattus norvegicus
gctgtgtcaaggtcagaccatgttt

SEQ ID NO: 410492 - DNA, 25 bp, Rattus norvegicus
gctgtgtcaatgagccaggtcgctt

SEQ ID NO: 410493 - DNA, 25 bp, Rattus norvegicus
gctgtgtcaatgtgccaggtcgctt

SEQ ID NO: 410494 - DNA, 25 bp, Rattus norvegicus
gctgtgtcacctatgtcctgaatga

SEQ ID NO: 410495 - DNA, 25 bp, Rattus norvegicus
gctgtgtcacctttgtcctgaatga

SEQ ID NO: 410496 - DNA, 25 bp, Rattus norvegicus
gctgtgtcaggcacttatgagctct

SEQ ID NO: 410497 - DNA, 25 bp, Rattus norvegicus
gctgtgtcaggctcttatgagctct

SEQ ID NO: 410498 - DNA, 25 bp, Rattus norvegicus
gctgtgtcatgtattcgaattaact

SEQ ID NO: 410499 - DNA, 25 bp, Rattus norvegicus
gctgtgtcatgttttcgaattaact

SEQ ID NO: 410500 - DNA, 25 bp, Rattus norvegicus
gctgtgtccaagaccaaatcctgaa

SEQ ID NO: 410501 - DNA, 25 bp, Rattus norvegicus
gctgtgtccaagtccaaatcctgaa

SEQ ID NO: 410502 - DNA, 25 bp, Rattus norvegicus
gctgtgtcccagctgatttataaaa

SEQ ID NO: 410503 - DNA, 25 bp, Rattus norvegicus
gctgtgtcccaggtgatttataaaa

SEQ ID NO: 410504 - DNA, 25 bp, Rattus norvegicus
gctgtgtcctatcgcttcaagatat

SEQ ID NO: 410505 - DNA, 25 bp, Rattus norvegicus
gctgtgtcctatggcttcaagatat

SEQ ID NO: 410506 - DNA, 25 bp, Rattus norvegicus
gctgtgtccttgcaactctgaccta

SEQ ID NO: 410507 - DNA, 25 bp, Rattus norvegicus
gctgtgtccttggaactctgaccta

SEQ ID NO: 410508 - DNA, 25 bp, Rattus norvegicus
gctgtgtctacccaacatgattctt

SEQ ID NO: 410509 - DNA, 25 bp, Rattus norvegicus
gctgtgtctaccgaacatgattctt

SEQ ID NO: 410510 - DNA, 25 bp, Rattus norvegicus
gctgtgtctgcaaaggtgcctcgga

SEQ ID NO: 410511 - DNA, 25 bp, Rattus norvegicus
gctgtgtctgcataggtgcctcgga

SEQ ID NO: 410512 - DNA, 25 bp, Rattus norvegicus
gctgtgtgaaggagcccatctcaaa

SEQ ID NO: 410513 - DNA, 25 bp, Rattus norvegicus
gctgtgtgaaggtgcccatctcaaa

SEQ ID NO: 410514 - DNA, 25 bp, Rattus norvegicus
gctgtgtgacacctaccgctgaaag

SEQ ID NO: 410515 - DNA, 25 bp, Rattus norvegicus
gctgtgtgacacgtaccgctgaaag

SEQ ID NO: 410516 - DNA, 25 bp, Rattus norvegicus
gctgtgtgacagatgtgatcattca

SEQ ID NO: 410517 - DNA, 25 bp, Rattus norvegicus
gctgtgtgacagttgtgatcattca

SEQ ID NO: 410518 - DNA, 25 bp, Rattus norvegicus
gctgtgtgacccaaaccatttgaaa

SEQ ID NO: 410519 - DNA, 25 bp, Rattus norvegicus
gctgtgtgaccctaaccatttgaaa

SEQ ID NO: 410520 - DNA, 25 bp, Rattus norvegicus
gctgtgtgagcactagttggcttta

SEQ ID NO: 410521 - DNA, 25 bp, Rattus norvegicus
gctgtgtgagcagtagttggcttta

SEQ ID NO: 410522 - DNA, 25 bp, Rattus norvegicus
gctgtgtgattcagggcatcatcat

SEQ ID NO: 410523 - DNA, 25 bp, Rattus norvegicus
gctgtgtgattctgggcatcatcat

SEQ ID NO: 410524 - DNA, 25 bp, Rattus norvegicus
gctgtgtgatttacagctgaccctg

SEQ ID NO: 410525 - DNA, 25 bp, Rattus norvegicus
gctgtgtgattttcagctgaccctg

SEQ ID NO: 410526 - DNA, 25 bp, Rattus norvegicus
gctgtgtgccaaaaatacctcctat

SEQ ID NO: 410527 - DNA, 25 bp, Rattus norvegicus
gctgtgtgccaataatacctcctat

SEQ ID NO: 410528 - DNA, 25 bp, Rattus norvegicus
gctgtgtgctggcaagctactccta

SEQ ID NO: 410529 - DNA, 25 bp, Rattus norvegicus
gctgtgtgctgggaagctactccta

SEQ ID NO: 410530 - DNA, 25 bp, Rattus norvegicus
gctgtgtggaggcacctgctattat

SEQ ID NO: 410531 - DNA, 25 bp, Rattus norvegicus
gctgtgtggagggacctgctattat

SEQ ID NO: 410532 - DNA, 25 bp, Rattus norvegicus
gctgtgtggcatcacgagagccatt

SEQ ID NO: 410533 - DNA, 25 bp, Rattus norvegicus
gctgtgtggcatgacgagagccatt

SEQ ID NO: 410534 - DNA, 25 bp, Rattus norvegicus
gctgtgtgtctgacacttaggactt

SEQ ID NO: 410535 - DNA, 25 bp, Rattus norvegicus
gctgtgtgtctgtcacttaggactt

SEQ ID NO: 410536 - DNA, 25 bp, Rattus norvegicus
gctgtgtgttcaccgggaagctttc

SEQ ID NO: 410537 - DNA, 25 bp, Rattus norvegicus
gctgtgtgttcagcgggaagctttc

SEQ ID NO: 410538 - DNA, 25 bp, Rattus norvegicus
gctgtgttaaggagacccgtgtcaa

SEQ ID NO: 410539 - DNA, 25 bp, Rattus norvegicus
gctgtgttaaggtgacccgtgtcaa

SEQ ID NO: 410540 - DNA, 25 bp, Rattus norvegicus
gctgtgttaattcaggatgtcccct

SEQ ID NO: 410541 - DNA, 25 bp, Rattus norvegicus
gctgtgttaattgaggatgtcccct

SEQ ID NO: 410542 - DNA, 25 bp, Rattus norvegicus
gctgtgttacatattcaagggaaaa

SEQ ID NO: 410543 - DNA, 25 bp, Rattus norvegicus
gctgtgttacattttcaagggaaaa

SEQ ID NO: 410544 - DNA, 25 bp, Rattus norvegicus
gctgtgttcaggcatggttttactc

SEQ ID NO: 410545 - DNA, 25 bp, Rattus norvegicus
gctgtgttcagggatggttttactc

SEQ ID NO: 410546 - DNA, 25 bp, Rattus norvegicus
gctgtgttcagtacacctttatgaa

SEQ ID NO: 410547 - DNA, 25 bp, Rattus norvegicus
gctgtgttcagttcacctttatgaa

SEQ ID NO: 410548 - DNA, 25 bp, Rattus norvegicus
gctgtgttcctcatgaaaaccctaa

SEQ ID NO: 410549 - DNA, 25 bp, Rattus norvegicus
gctgtgttcctcttgaaaaccctaa

SEQ ID NO: 410550 - DNA, 25 bp, Rattus norvegicus
gctgtgttctctcactgtgttctca

SEQ ID NO: 410551 - DNA, 25 bp, Rattus norvegicus
gctgtgttctctctggattccaagt

SEQ ID NO: 410552 - DNA, 25 bp, Rattus norvegicus
gctgtgttctctgactgtgttctca

SEQ ID NO: 410553 - DNA, 25 bp, Rattus norvegicus
gctgtgttctctgtggattccaagt

SEQ ID NO: 410554 - DNA, 25 bp, Rattus norvegicus
gctgtgttgatgactcttgagcccc

SEQ ID NO: 410555 - DNA, 25 bp, Rattus norvegicus
gctgtgttgatgactttggattccc

SEQ ID NO: 410556 - DNA, 25 bp, Rattus norvegicus
gctgtgttgatgtctcttgagcccc

SEQ ID NO: 410557 - DNA, 25 bp, Rattus norvegicus
gctgtgttgatgtctttggattccc

SEQ ID NO: 410558 - DNA, 25 bp, Rattus norvegicus
gctgtgttgcttagcctattgagat

SEQ ID NO: 410559 - DNA, 25 bp, Rattus norvegicus
gctgtgttgctttgcctattgagat

SEQ ID NO: 410560 - DNA, 25 bp, Rattus norvegicus
gctgtgttgtggaacttttgctgta

SEQ ID NO: 410561 - DNA, 25 bp, Rattus norvegicus
gctgtgttgtggtacttttgctgta

SEQ ID NO: 410562 - DNA, 25 bp, Rattus norvegicus
gctgtgttgtttacaaggcctgata

SEQ ID NO: 410563 - DNA, 25 bp, Rattus norvegicus
gctgtgttgttttcaaggcctgata

SEQ ID NO: 410564 - DNA, 25 bp, Rattus norvegicus
gctgtgtttccgaagagagcaacct

SEQ ID NO: 410565 - DNA, 25 bp, Rattus norvegicus
gctgtgtttccgtagagagcaacct

SEQ ID NO: 410566 - DNA, 25 bp, Rattus norvegicus
gctgtgtttctgataaggttactac

SEQ ID NO: 410567 - DNA, 25 bp, Rattus norvegicus
gctgtgtttctgttaaggttactac

SEQ ID NO: 410568 - DNA, 25 bp, Rattus norvegicus
gctgtgttttgccactatcctgcac

SEQ ID NO: 410569 - DNA, 25 bp, Rattus norvegicus
gctgtgttttgcgactatcctgcac

SEQ ID NO: 410570 - DNA, 25 bp, Rattus norvegicus
gctgttaaactcagatgtccgcgaa

SEQ ID NO: 410571 - DNA, 25 bp, Rattus norvegicus
gctgttaaactctgatgtccgcgaa

SEQ ID NO: 410572 - DNA, 25 bp, Rattus norvegicus
gctgttaacagcagcatggttcctg

SEQ ID NO: 410573 - DNA, 25 bp, Rattus norvegicus
gctgttaacagctgcatggttcctg

SEQ ID NO: 410574 - DNA, 25 bp, Rattus norvegicus
gctgttacaagtcgctgtttataca

SEQ ID NO: 410575 - DNA, 25 bp, Rattus norvegicus
gctgttacaagtggctgtttataca

SEQ ID NO: 410576 - DNA, 25 bp, Rattus norvegicus
gctgttacagttatgagctgctcct

SEQ ID NO: 410577 - DNA, 25 bp, Rattus norvegicus
gctgttacagttttgagctgctcct

SEQ ID NO: 410578 - DNA, 25 bp, Rattus norvegicus
gctgttacctttaagctttgtcaaa

SEQ ID NO: 410579 - DNA, 25 bp, Rattus norvegicus
gctgttaccttttagctttgtcaaa

SEQ ID NO: 410580 - DNA, 25 bp, Rattus norvegicus
gctgttacgggacctgctcattgaa

SEQ ID NO: 410581 - DNA, 25 bp, Rattus norvegicus
gctgttacgggagctgctcattgaa

SEQ ID NO: 410582 - DNA, 25 bp, Rattus norvegicus
gctgttactgctatcagatttttgg

SEQ ID NO: 410583 - DNA, 25 bp, Rattus norvegicus
gctgttactgctttcagatttttgg

SEQ ID NO: 410584 - DNA, 25 bp, Rattus norvegicus
gctgttactgtaccatttctgtgtg

SEQ ID NO: 410585 - DNA, 25 bp, Rattus norvegicus
gctgttactgtagcatttctgtgtg

SEQ ID NO: 410586 - DNA, 25 bp, Rattus norvegicus
gctgttactttcattggcagttgac

SEQ ID NO: 410587 - DNA, 25 bp, Rattus norvegicus
gctgttactttctttggcagttgac

SEQ ID NO: 410588 - DNA, 25 bp, Rattus norvegicus
gctgttagagagactgccttgcacc

SEQ ID NO: 410589 - DNA, 25 bp, Rattus norvegicus
gctgttagagagtctgccttgcacc

SEQ ID NO: 410590 - DNA, 25 bp, Rattus norvegicus
gctgttagcatacgcactttacctt

SEQ ID NO: 410591 - DNA, 25 bp, Rattus norvegicus
gctgttagcataggcactttacctt

SEQ ID NO: 410592 - DNA, 25 bp, Rattus norvegicus
gctgttagcctaaccatgctgtgtg

SEQ ID NO: 410593 - DNA, 25 bp, Rattus norvegicus
gctgttagcctatccatgctgtgtg

SEQ ID NO: 410594 - DNA, 25 bp, Rattus norvegicus
gctgttagctgaaagttctgaagac

SEQ ID NO: 410595 - DNA, 25 bp, Rattus norvegicus
gctgttagctgatagttctgaagac

SEQ ID NO: 410596 - DNA, 25 bp, Rattus norvegicus
gctgttaggatgactgctattcagt

SEQ ID NO: 410597 - DNA, 25 bp, Rattus norvegicus
gctgttaggatgtctgctattcagt

SEQ ID NO: 410598 - DNA, 25 bp, Rattus norvegicus
gctgttagtggtctgtattggtcat

SEQ ID NO: 410599 - DNA, 25 bp, Rattus norvegicus
gctgttagtggtgtgtattggtcat

SEQ ID NO: 410600 - DNA, 25 bp, Rattus norvegicus
gctgttagttgtcatgaaagaagtt

SEQ ID NO: 410601 - DNA, 25 bp, Rattus norvegicus
gctgttagttgtgatgaaagaagtt

SEQ ID NO: 410602 - DNA, 25 bp, Rattus norvegicus
gctgttatccagaagttcctctatc

SEQ ID NO: 410603 - DNA, 25 bp, Rattus norvegicus
gctgttatccagtagttcctctatc

SEQ ID NO: 410604 - DNA, 25 bp, Rattus norvegicus
gctgttatctaactaaccatctctc

SEQ ID NO: 410605 - DNA, 25 bp, Rattus norvegicus
gctgttatctaagtaaccatctctc

SEQ ID NO: 410606 - DNA, 25 bp, Rattus norvegicus
gctgttatctatcttattgttctgg

SEQ ID NO: 410607 - DNA, 25 bp, Rattus norvegicus
gctgttatctatgttattgttctgg

SEQ ID NO: 410608 - DNA, 25 bp, Rattus norvegicus
gctgttatgtgtagcgtggtcccca

SEQ ID NO: 410609 - DNA, 25 bp, Rattus norvegicus
gctgttatgtgttgcgtggtcccca

SEQ ID NO: 410610 - DNA, 25 bp, Rattus norvegicus
gctgttattcaaccaaatcacgatc

SEQ ID NO: 410611 - DNA, 25 bp, Rattus norvegicus
gctgttattcaagcaaatcacgatc

SEQ ID NO: 410612 - DNA, 25 bp, Rattus norvegicus
gctgttattcatcctatgtgggcaa

SEQ ID NO: 410613 - DNA, 25 bp, Rattus norvegicus
gctgttattcatgctatgtgggcaa

SEQ ID NO: 410614 - DNA, 25 bp, Rattus norvegicus
gctgttattctgagtactagtcata

SEQ ID NO: 410615 - DNA, 25 bp, Rattus norvegicus
gctgttattctgtgtactagtcata

SEQ ID NO: 410616 - DNA, 25 bp, Rattus norvegicus
gctgttcaagcacttcctggtggaa

SEQ ID NO: 410617 - DNA, 25 bp, Rattus norvegicus
gctgttcaagcagttcctggtggaa

SEQ ID NO: 410618 - DNA, 25 bp, Rattus norvegicus
gctgttcaagccaagtatggagatt

SEQ ID NO: 410619 - DNA, 25 bp, Rattus norvegicus
gctgttcaagcctagtatggagatt

SEQ ID NO: 410620 - DNA, 25 bp, Rattus norvegicus
gctgttcaatagcacctgcatggag

SEQ ID NO: 410621 - DNA, 25 bp, Rattus norvegicus
gctgttcaataggacctgcatggag

SEQ ID NO: 410622 - DNA, 25 bp, Rattus norvegicus
gctgttcaccagatgtaatgtttta

SEQ ID NO: 410623 - DNA, 25 bp, Rattus norvegicus
gctgttcaccagttgtaatgtttta

SEQ ID NO: 410624 - DNA, 25 bp, Rattus norvegicus
gctgttcacgttacctttgattata

SEQ ID NO: 410625 - DNA, 25 bp, Rattus norvegicus
gctgttcacgtttcctttgattata

SEQ ID NO: 410626 - DNA, 25 bp, Rattus norvegicus
gctgttcacttgaaagataacattt

SEQ ID NO: 410627 - DNA, 25 bp, Rattus norvegicus
gctgttcacttgtaagataacattt

SEQ ID NO: 410628 - DNA, 25 bp, Rattus norvegicus
gctgttcagtagaacctgggaccca

SEQ ID NO: 410629 - DNA, 25 bp, Rattus norvegicus
gctgttcagtagtacctgggaccca

SEQ ID NO: 410630 - DNA, 25 bp, Rattus norvegicus
gctgttcagtgaccattccaagaga

SEQ ID NO: 410631 - DNA, 25 bp, Rattus norvegicus
gctgttcagtgagcattccaagaga

SEQ ID NO: 410632 - DNA, 25 bp, Rattus norvegicus
gctgttcatagcatttgttccattg

SEQ ID NO: 410633 - DNA, 25 bp, Rattus norvegicus
gctgttcatagcctgtgagccgaaa

SEQ ID NO: 410634 - DNA, 25 bp, Rattus norvegicus
gctgttcatagcgtgtgagccgaaa

SEQ ID NO: 410635 - DNA, 25 bp, Rattus norvegicus
gctgttcatagcttttgttccattg

SEQ ID NO: 410636 - DNA, 25 bp, Rattus norvegicus
gctgttcatctgactagtggaggcc

SEQ ID NO: 410637 - DNA, 25 bp, Rattus norvegicus
gctgttcatctgtctagtggaggcc

SEQ ID NO: 410638 - DNA, 25 bp, Rattus norvegicus
gctgttccagcgagtcttagagaca

SEQ ID NO: 410639 - DNA, 25 bp, Rattus norvegicus
gctgttccagcgtgtcttagagaca

SEQ ID NO: 410640 - DNA, 25 bp, Rattus norvegicus
gctgttccagggagagttcgtctga

SEQ ID NO: 410641 - DNA, 25 bp, Rattus norvegicus
gctgttccagggtgagttcgtctga

SEQ ID NO: 410642 - DNA, 25 bp, Rattus norvegicus
gctgttccataactgacaccatgag

SEQ ID NO: 410643 - DNA, 25 bp, Rattus norvegicus
gctgttccataagtgacaccatgag

SEQ ID NO: 410644 - DNA, 25 bp, Rattus norvegicus
gctgttcccagactgttggagagaa

SEQ ID NO: 410645 - DNA, 25 bp, Rattus norvegicus
gctgttcccagagtgttggagagaa

SEQ ID NO: 410646 - DNA, 25 bp, Rattus norvegicus
gctgttccctgcattgagtagtaga

SEQ ID NO: 410647 - DNA, 25 bp, Rattus norvegicus
gctgttccctgctttgagtagtaga

SEQ ID NO: 410648 - DNA, 25 bp, Rattus norvegicus
gctgttcctcgcataacattgtgga

SEQ ID NO: 410649 - DNA, 25 bp, Rattus norvegicus
gctgttcctcgcttaacattgtgga

SEQ ID NO: 410650 - DNA, 25 bp, Rattus norvegicus
gctgttcctgaaagcttagtctgct

SEQ ID NO: 410651 - DNA, 25 bp, Rattus norvegicus
gctgttcctgaatgcttagtctgct

SEQ ID NO: 410652 - DNA, 25 bp, Rattus norvegicus
gctgttcctgatctgtcagtttgta

SEQ ID NO: 410653 - DNA, 25 bp, Rattus norvegicus
gctgttcctgatgtgtcagtttgta

SEQ ID NO: 410654 - DNA, 25 bp, Rattus norvegicus
gctgttccttcactgcaacacaata

SEQ ID NO: 410655 - DNA, 25 bp, Rattus norvegicus
gctgttccttcagtgcaacacaata

SEQ ID NO: 410656 - DNA, 25 bp, Rattus norvegicus
gctgttcgagtaagcgcgccagagc

SEQ ID NO: 410657 - DNA, 25 bp, Rattus norvegicus
gctgttcgagtatgcgcgccagagc

SEQ ID NO: 410658 - DNA, 25 bp, Rattus norvegicus
gctgttcgtttaaggtgtgccccaa

SEQ ID NO: 410659 - DNA, 25 bp, Rattus norvegicus
gctgttcgtttatggtgtgccccaa

SEQ ID NO: 410660 - DNA, 25 bp, Rattus norvegicus
gctgttctacacagcctttaagatt

SEQ ID NO: 410661 - DNA, 25 bp, Rattus norvegicus
gctgttctacactgcctttaagatt

SEQ ID NO: 410662 - DNA, 25 bp, Rattus norvegicus
gctgttctactgaaaaccctcggaa

SEQ ID NO: 410663 - DNA, 25 bp, Rattus norvegicus
gctgttctactgtaaaccctcggaa

SEQ ID NO: 410664 - DNA, 25 bp, Rattus norvegicus
gctgttctagaactctgcctcccaa

SEQ ID NO: 410665 - DNA, 25 bp, Rattus norvegicus
gctgttctagaagtctgcctcccaa

SEQ ID NO: 410666 - DNA, 25 bp, Rattus norvegicus
gctgttctatttcttcacttttgtg

SEQ ID NO: 410667 - DNA, 25 bp, Rattus norvegicus
gctgttctatttgttcacttttgtg

SEQ ID NO: 410668 - DNA, 25 bp, Rattus norvegicus
gctgttctcaccattttgaatgtag

SEQ ID NO: 410669 - DNA, 25 bp, Rattus norvegicus
gctgttctcacctttttgaatgtag

SEQ ID NO: 410670 - DNA, 25 bp, Rattus norvegicus
gctgttctccacagttgggtgatta

SEQ ID NO: 410671 - DNA, 25 bp, Rattus norvegicus
gctgttctccactgttgggtgatta

SEQ ID NO: 410672 - DNA, 25 bp, Rattus norvegicus
gctgttctcccaagcaggaaatgat

SEQ ID NO: 410673 - DNA, 25 bp, Rattus norvegicus
gctgttctcccatgcaggaaatgat

SEQ ID NO: 410674 - DNA, 25 bp, Rattus norvegicus
gctgttctcgaaagacttttcccaa

SEQ ID NO: 410675 - DNA, 25 bp, Rattus norvegicus
gctgttctcgaatgacttttcccaa

SEQ ID NO: 410676 - DNA, 25 bp, Rattus norvegicus
gctgttctctggaaaatattttatt

SEQ ID NO: 410677 - DNA, 25 bp, Rattus norvegicus
gctgttctctggtaaatattttatt

SEQ ID NO: 410678 - DNA, 25 bp, Rattus norvegicus
gctgttctgatgacgtatacctgaa

SEQ ID NO: 410679 - DNA, 25 bp, Rattus norvegicus
gctgttctgatgtcgtatacctgaa

SEQ ID NO: 410680 - DNA, 25 bp, Rattus norvegicus
gctgttctgcgactcttgagagcca

SEQ ID NO: 410681 - DNA, 25 bp, Rattus norvegicus
gctgttctgcgagtcttgagagcca

SEQ ID NO: 410682 - DNA, 25 bp, Rattus norvegicus
gctgttctgcttctgggctatggaa

SEQ ID NO: 410683 - DNA, 25 bp, Rattus norvegicus
gctgttctgcttgtgggctatggaa

SEQ ID NO: 410684 - DNA, 25 bp, Rattus norvegicus
gctgttctggcccacagtatagctt

SEQ ID NO: 410685 - DNA, 25 bp, Rattus norvegicus
gctgttctggccgacagtatagctt

SEQ ID NO: 410686 - DNA, 25 bp, Rattus norvegicus
gctgttctgtccatttagtttacaa

SEQ ID NO: 410687 - DNA, 25 bp, Rattus norvegicus
gctgttctgtccatttcttgtttaa

SEQ ID NO: 410688 - DNA, 25 bp, Rattus norvegicus
gctgttctgtccttttagtttacaa

SEQ ID NO: 410689 - DNA, 25 bp, Rattus norvegicus
gctgttctgtccttttcttgtttaa

SEQ ID NO: 410690 - DNA, 25 bp, Rattus norvegicus
gctgttctgtttctccctatgcaaa

SEQ ID NO: 410691 - DNA, 25 bp, Rattus norvegicus
gctgttctgtttgtccctatgcaaa

SEQ ID NO: 410692 - DNA, 25 bp, Rattus norvegicus
gctgttcttagcctttctgtggttt

SEQ ID NO: 410693 - DNA, 25 bp, Rattus norvegicus
gctgttcttagcgtttctgtggttt

SEQ ID NO: 410694 - DNA, 25 bp, Rattus norvegicus
gctgttcttcgacaacactgagttg

SEQ ID NO: 410695 - DNA, 25 bp, Rattus norvegicus
gctgttcttcgactcttgctgcacg

SEQ ID NO: 410696 - DNA, 25 bp, Rattus norvegicus
gctgttcttcgagaacactgagttg

SEQ ID NO: 410697 - DNA, 25 bp, Rattus norvegicus
gctgttcttcgagtcttgctgcacg

SEQ ID NO: 410698 - DNA, 25 bp, Rattus norvegicus
gctgttcttgccattgggatggctc

SEQ ID NO: 410699 - DNA, 25 bp, Rattus norvegicus
gctgttcttgcctttgggatggctc

SEQ ID NO: 410700 - DNA, 25 bp, Rattus norvegicus
gctgttcttggaaaggaccttggtt

SEQ ID NO: 410701 - DNA, 25 bp, Rattus norvegicus
gctgttcttggataggaccttggtt

SEQ ID NO: 410702 - DNA, 25 bp, Rattus norvegicus
gctgttcttgtgcaaagggacccat

SEQ ID NO: 410703 - DNA, 25 bp, Rattus norvegicus
gctgttcttgtggaaagggacccat

SEQ ID NO: 410704 - DNA, 25 bp, Rattus norvegicus
gctgttgaaagacctaagttaccca

SEQ ID NO: 410705 - DNA, 25 bp, Rattus norvegicus
gctgttgaaagagctaagttaccca

SEQ ID NO: 410706 - DNA, 25 bp, Rattus norvegicus
gctgttgaacccctcagtgctaagg

SEQ ID NO: 410707 - DNA, 25 bp, Rattus norvegicus
gctgttgaacccgtcagtgctaagg

SEQ ID NO: 410708 - DNA, 25 bp, Rattus norvegicus
gctgttgacactcaagtcctgttga

SEQ ID NO: 410709 - DNA, 25 bp, Rattus norvegicus
gctgttgacactgaagtcctgttga

SEQ ID NO: 410710 - DNA, 25 bp, Rattus norvegicus
gctgttgactccaaattgttcttca

SEQ ID NO: 410711 - DNA, 25 bp, Rattus norvegicus
gctgttgactcctaattgttcttca

SEQ ID NO: 410712 - DNA, 25 bp, Rattus norvegicus
gctgttgagtatattcttctatcaa

SEQ ID NO: 410713 - DNA, 25 bp, Rattus norvegicus
gctgttgagtattttcttctatcaa

SEQ ID NO: 410714 - DNA, 25 bp, Rattus norvegicus
gctgttgatatactcgttgcctact

SEQ ID NO: 410715 - DNA, 25 bp, Rattus norvegicus
gctgttgatatagtcgttgcctact

SEQ ID NO: 410716 - DNA, 25 bp, Rattus norvegicus
gctgttgatatcaagaacccgctta

SEQ ID NO: 410717 - DNA, 25 bp, Rattus norvegicus
gctgttgatatctagaacccgctta

SEQ ID NO: 410718 - DNA, 25 bp, Rattus norvegicus
gctgttgatcccacggagagagctc

SEQ ID NO: 410719 - DNA, 25 bp, Rattus norvegicus
gctgttgatccctcggagagagctc

SEQ ID NO: 410720 - DNA, 25 bp, Rattus norvegicus
gctgttgatgtacacttcgcaacgg

SEQ ID NO: 410721 - DNA, 25 bp, Rattus norvegicus
gctgttgatgtagacttcgcaacgg

SEQ ID NO: 410722 - DNA, 25 bp, Rattus norvegicus
gctgttgcaattcagttcttctcgt

SEQ ID NO: 410723 - DNA, 25 bp, Rattus norvegicus
gctgttgcaattgagttcttctcgt

SEQ ID NO: 410724 - DNA, 25 bp, Rattus norvegicus
gctgttgcagcaaaaacgctagcta

SEQ ID NO: 410725 - DNA, 25 bp, Rattus norvegicus
gctgttgcagcacatccttctgaat

SEQ ID NO: 410726 - DNA, 25 bp, Rattus norvegicus
gctgttgcagcagatccttctgaat

SEQ ID NO: 410727 - DNA, 25 bp, Rattus norvegicus
gctgttgcagcataaacgctagcta

SEQ ID NO: 410728 - DNA, 25 bp, Rattus norvegicus
gctgttgccatcactgtttttacta

SEQ ID NO: 410729 - DNA, 25 bp, Rattus norvegicus
gctgttgccatctctgtttttacta

SEQ ID NO: 410730 - DNA, 25 bp, Rattus norvegicus
gctgttgcccttcggacactgtttt

SEQ ID NO: 410731 - DNA, 25 bp, Rattus norvegicus
gctgttgcccttgggacactgtttt

SEQ ID NO: 410732 - DNA, 25 bp, Rattus norvegicus
gctgttgccgaacgccgtggtcacc

SEQ ID NO: 410733 - DNA, 25 bp, Rattus norvegicus
gctgttgccgaaggccgtggtcacc

SEQ ID NO: 410734 - DNA, 25 bp, Rattus norvegicus
gctgttgcctgaatgtggatgccat

SEQ ID NO: 410735 - DNA, 25 bp, Rattus norvegicus
gctgttgcctgattgtggatgccat

SEQ ID NO: 410736 - DNA, 25 bp, Rattus norvegicus
gctgttgcgtttactgcgtctagtc

SEQ ID NO: 410737 - DNA, 25 bp, Rattus norvegicus
gctgttgcgttttctgcgtctagtc

SEQ ID NO: 410738 - DNA, 25 bp, Rattus norvegicus
gctgttgctgaacactatgctggca

SEQ ID NO: 410739 - DNA, 25 bp, Rattus norvegicus
gctgttgctgaagactatgctggca

SEQ ID NO: 410740 - DNA, 25 bp, Rattus norvegicus
gctgttgctgatcttatgaattcca

SEQ ID NO: 410741 - DNA, 25 bp, Rattus norvegicus
gctgttgctgatgttatgaattcca

SEQ ID NO: 410742 - DNA, 25 bp, Rattus norvegicus
gctgttgctgctctgtaagtgttgc

SEQ ID NO: 410743 - DNA, 25 bp, Rattus norvegicus
gctgttgctgctgtgtaagtgttgc

SEQ ID NO: 410744 - DNA, 25 bp, Rattus norvegicus
gctgttgctgttcgcctacgtcctt

SEQ ID NO: 410745 - DNA, 25 bp, Rattus norvegicus
gctgttgctgttggcctacgtcctt

SEQ ID NO: 410746 - DNA, 25 bp, Rattus norvegicus
gctgttgcttggattaatctgacgg

SEQ ID NO: 410747 - DNA, 25 bp, Rattus norvegicus
gctgttgcttggtttaatctgacgg

SEQ ID NO: 410748 - DNA, 25 bp, Rattus norvegicus
gctgttggaataactggagccatcc

SEQ ID NO: 410749 - DNA, 25 bp, Rattus norvegicus
gctgttggaatatctggagccatcc

SEQ ID NO: 410750 - DNA, 25 bp, Rattus norvegicus
gctgttggaccacggccttggacac

SEQ ID NO: 410751 - DNA, 25 bp, Rattus norvegicus
gctgttggaccagggccttggacac

SEQ ID NO: 410752 - DNA, 25 bp, Rattus norvegicus
gctgttggagacatatagctcagat

SEQ ID NO: 410753 - DNA, 25 bp, Rattus norvegicus
gctgttggagacttatagctcagat

SEQ ID NO: 410754 - DNA, 25 bp, Rattus norvegicus
gctgttggcagtctggctatctaat

SEQ ID NO: 410755 - DNA, 25 bp, Rattus norvegicus
gctgttggcagtgtggctatctaat

SEQ ID NO: 410756 - DNA, 25 bp, Rattus norvegicus
gctgttggcctcatggatgagatat

SEQ ID NO: 410757 - DNA, 25 bp, Rattus norvegicus
gctgttggcctcttggatgagatat

SEQ ID NO: 410758 - DNA, 25 bp, Rattus norvegicus
gctgttggctatagagagcccaatc

SEQ ID NO: 410759 - DNA, 25 bp, Rattus norvegicus
gctgttggctattgagagcccaatc

SEQ ID NO: 410760 - DNA, 25 bp, Rattus norvegicus
gctgttggcttgctctttgatgaaa

SEQ ID NO: 410761 - DNA, 25 bp, Rattus norvegicus
gctgttggcttggtctttgatgaaa

SEQ ID NO: 410762 - DNA, 25 bp, Rattus norvegicus
gctgttgggcagatgaatcactcac

SEQ ID NO: 410763 - DNA, 25 bp, Rattus norvegicus
gctgttgggcagttgaatcactcac

SEQ ID NO: 410764 - DNA, 25 bp, Rattus norvegicus
gctgttggttggatatttcctgttt

SEQ ID NO: 410765 - DNA, 25 bp, Rattus norvegicus
gctgttggttggttatttcctgttt

SEQ ID NO: 410766 - DNA, 25 bp, Rattus norvegicus
gctgttgtaaatcgcttcctctatc

SEQ ID NO: 410767 - DNA, 25 bp, Rattus norvegicus
gctgttgtaaatggcttcctctatc

SEQ ID NO: 410768 - DNA, 25 bp, Rattus norvegicus
gctgttgtacagcagactcgagcaa

SEQ ID NO: 410769 - DNA, 25 bp, Rattus norvegicus
gctgttgtacaggagactcgagcaa

SEQ ID NO: 410770 - DNA, 25 bp, Rattus norvegicus
gctgttgtacctaaaaaactcagtg

SEQ ID NO: 410771 - DNA, 25 bp, Rattus norvegicus
gctgttgtaccttaaaaactcagtg

SEQ ID NO: 410772 - DNA, 25 bp, Rattus norvegicus
gctgttgtctgtaagtacagggcac

SEQ ID NO: 410773 - DNA, 25 bp, Rattus norvegicus
gctgttgtctgttagtacagggcac

SEQ ID NO: 410774 - DNA, 25 bp, Rattus norvegicus
gctgttgtgcatcgaatagcttcaa

SEQ ID NO: 410775 - DNA, 25 bp, Rattus norvegicus
gctgttgtgcatggaatagcttcaa

SEQ ID NO: 410776 - DNA, 25 bp, Rattus norvegicus
gctgttgtggccacctcgtgtggcc

SEQ ID NO: 410777 - DNA, 25 bp, Rattus norvegicus
gctgttgtggcctcctcgtgtggcc

SEQ ID NO: 410778 - DNA, 25 bp, Rattus norvegicus
gctgttgtggctattgtttgtgcat

SEQ ID NO: 410779 - DNA, 25 bp, Rattus norvegicus
gctgttgtggcttttgtttgtgcat

SEQ ID NO: 410780 - DNA, 25 bp, Rattus norvegicus
gctgttgtgtatcggcagtctgtcc

SEQ ID NO: 410781 - DNA, 25 bp, Rattus norvegicus
gctgttgtgtatgggcagtctgtcc

SEQ ID NO: 410782 - DNA, 25 bp, Rattus norvegicus
gctgttgtgttaattcgtttgagta

SEQ ID NO: 410783 - DNA, 25 bp, Rattus norvegicus
gctgttgtgttatttcgtttgagta

SEQ ID NO: 410784 - DNA, 25 bp, Rattus norvegicus
gctgttgtgttcattgaggtaatgt

SEQ ID NO: 410785 - DNA, 25 bp, Rattus norvegicus
gctgttgtgttctttgaggtaatgt

SEQ ID NO: 410786 - DNA, 25 bp, Rattus norvegicus
gctgttgtgttgagtaggctgcatt

SEQ ID NO: 410787 - DNA, 25 bp, Rattus norvegicus
gctgttgtgttgtgtaggctgcatt

SEQ ID NO: 410788 - DNA, 25 bp, Rattus norvegicus
gctgttgtgtttaacttacctctat

SEQ ID NO: 410789 - DNA, 25 bp, Rattus norvegicus
gctgttgtgttttacttacctctat

SEQ ID NO: 410790 - DNA, 25 bp, Rattus norvegicus
gctgttgttctactttgctttctgt

SEQ ID NO: 410791 - DNA, 25 bp, Rattus norvegicus
gctgttgttctagtttgctttctgt

SEQ ID NO: 410792 - DNA, 25 bp, Rattus norvegicus
gctgttgttgatcatctgtccatgt

SEQ ID NO: 410793 - DNA, 25 bp, Rattus norvegicus
gctgttgttgatgatctgtccatgt

SEQ ID NO: 410794 - DNA, 25 bp, Rattus norvegicus
gctgttgttgttacgcatttccact

SEQ ID NO: 410795 - DNA, 25 bp, Rattus norvegicus
gctgttgttgttccctcatcaataa

SEQ ID NO: 410796 - DNA, 25 bp, Rattus norvegicus
gctgttgttgttgcctcatcaataa

SEQ ID NO: 410797 - DNA, 25 bp, Rattus norvegicus
gctgttgttgtttcgcatttccact

SEQ ID NO: 410798 - DNA, 25 bp, Rattus norvegicus
gctgtttaactgattcttatcatag

SEQ ID NO: 410799 - DNA, 25 bp, Rattus norvegicus
gctgtttaactgtttcttatcatag

SEQ ID NO: 410800 - DNA, 25 bp, Rattus norvegicus
gctgtttaacttcatcccagctcag

SEQ ID NO: 410801 - DNA, 25 bp, Rattus norvegicus
gctgtttaacttgatcccagctcag

SEQ ID NO: 410802 - DNA, 25 bp, Rattus norvegicus
gctgtttacttcataaggccgcctt

SEQ ID NO: 410803 - DNA, 25 bp, Rattus norvegicus
gctgtttacttcttaaggccgcctt

SEQ ID NO: 410804 - DNA, 25 bp, Rattus norvegicus
gctgtttagcataccctcgaaggga

SEQ ID NO: 410805 - DNA, 25 bp, Rattus norvegicus
gctgtttagcattccctcgaaggga

SEQ ID NO: 410806 - DNA, 25 bp, Rattus norvegicus
gctgtttagccactagcaaccagaa

SEQ ID NO: 410807 - DNA, 25 bp, Rattus norvegicus
gctgtttagccagtagcaaccagaa

SEQ ID NO: 410808 - DNA, 25 bp, Rattus norvegicus
gctgtttatacaaggcttgtaccaa

SEQ ID NO: 410809 - DNA, 25 bp, Rattus norvegicus
gctgtttatacatggcttgtaccaa

SEQ ID NO: 410810 - DNA, 25 bp, Rattus norvegicus
gctgtttatgctcgatttgggtcaa

SEQ ID NO: 410811 - DNA, 25 bp, Rattus norvegicus
gctgtttatgctggatttgggtcaa

SEQ ID NO: 410812 - DNA, 25 bp, Rattus norvegicus
gctgtttcaagtcttttcgagtacg

SEQ ID NO: 410813 - DNA, 25 bp, Rattus norvegicus
gctgtttcaagtgttttcgagtacg

SEQ ID NO: 410814 - DNA, 25 bp, Rattus norvegicus
gctgtttcacccagggagcgacctg

SEQ ID NO: 410815 - DNA, 25 bp, Rattus norvegicus
gctgtttcaccctgggagcgacctg

SEQ ID NO: 410816 - DNA, 25 bp, Rattus norvegicus
gctgtttcactgcttatgcggcgga

SEQ ID NO: 410817 - DNA, 25 bp, Rattus norvegicus
gctgtttcactggttatgcggcgga

SEQ ID NO: 410818 - DNA, 25 bp, Rattus norvegicus
gctgtttcattcctcgtacctaaga

SEQ ID NO: 410819 - DNA, 25 bp, Rattus norvegicus
gctgtttcattcgtcgtacctaaga

SEQ ID NO: 410820 - DNA, 25 bp, Rattus norvegicus
gctgtttccagactcagagcggcca

SEQ ID NO: 410821 - DNA, 25 bp, Rattus norvegicus
gctgtttccagagtcagagcggcca

SEQ ID NO: 410822 - DNA, 25 bp, Rattus norvegicus
gctgtttccagcaggtgcactatga

SEQ ID NO: 410823 - DNA, 25 bp, Rattus norvegicus
gctgtttccagctggtgcactatga

SEQ ID NO: 410824 - DNA, 25 bp, Rattus norvegicus
gctgtttccctactagagtttgtaa

SEQ ID NO: 410825 - DNA, 25 bp, Rattus norvegicus
gctgtttccctagtagagtttgtaa

SEQ ID NO: 410826 - DNA, 25 bp, Rattus norvegicus
gctgtttccctcacagtgagtgttc

SEQ ID NO: 410827 - DNA, 25 bp, Rattus norvegicus
gctgtttccctctcagtgagtgttc

SEQ ID NO: 410828 - DNA, 25 bp, Rattus norvegicus
gctgtttccgtactgctgagcaatg

SEQ ID NO: 410829 - DNA, 25 bp, Rattus norvegicus
gctgtttccgtagtgctgagcaatg

SEQ ID NO: 410830 - DNA, 25 bp, Rattus norvegicus
gctgtttcctagattagctactctt

SEQ ID NO: 410831 - DNA, 25 bp, Rattus norvegicus
gctgtttcctagtttagctactctt

SEQ ID NO: 410832 - DNA, 25 bp, Rattus norvegicus
gctgtttccttgaagaccacattta

SEQ ID NO: 410833 - DNA, 25 bp, Rattus norvegicus
gctgtttccttgtagaccacattta

SEQ ID NO: 410834 - DNA, 25 bp, Rattus norvegicus
gctgtttcctttacatttgtcctga

SEQ ID NO: 410835 - DNA, 25 bp, Rattus norvegicus
gctgtttccttttcatttgtcctga

SEQ ID NO: 410836 - DNA, 25 bp, Rattus norvegicus
gctgtttcggcaaccgagacagatg

SEQ ID NO: 410837 - DNA, 25 bp, Rattus norvegicus
gctgtttcggcatccgagacagatg

SEQ ID NO: 410838 - DNA, 25 bp, Rattus norvegicus
gctgtttctagacccacagggattt

SEQ ID NO: 410839 - DNA, 25 bp, Rattus norvegicus
gctgtttctagaccctgcaattgac

SEQ ID NO: 410840 - DNA, 25 bp, Rattus norvegicus
gctgtttctagagccacagggattt

SEQ ID NO: 410841 - DNA, 25 bp, Rattus norvegicus
gctgtttctagagcctgcaattgac

SEQ ID NO: 410842 - DNA, 25 bp, Rattus norvegicus
gctgtttctataacttactcattcg

SEQ ID NO: 410843 - DNA, 25 bp, Rattus norvegicus
gctgtttctatatcttactcattcg

SEQ ID NO: 410844 - DNA, 25 bp, Rattus norvegicus
gctgtttctgagaccagggagcact

SEQ ID NO: 410845 - DNA, 25 bp, Rattus norvegicus
gctgtttctgagtccagggagcact

SEQ ID NO: 410846 - DNA, 25 bp, Rattus norvegicus
gctgtttctggaatgagtgctgcga

SEQ ID NO: 410847 - DNA, 25 bp, Rattus norvegicus
gctgtttctggattgagtgctgcga

SEQ ID NO: 410848 - DNA, 25 bp, Rattus norvegicus
gctgtttctggcatattactctttg

SEQ ID NO: 410849 - DNA, 25 bp, Rattus norvegicus
gctgtttctggcttattactctttg

SEQ ID NO: 410850 - DNA, 25 bp, Rattus norvegicus
gctgtttctgtgctattgtattctc

SEQ ID NO: 410851 - DNA, 25 bp, Rattus norvegicus
gctgtttctgtggtattgtattctc

SEQ ID NO: 410852 - DNA, 25 bp, Rattus norvegicus
gctgtttcttataaggcacactgca

SEQ ID NO: 410853 - DNA, 25 bp, Rattus norvegicus
gctgtttcttattaggcacactgca

SEQ ID NO: 410854 - DNA, 25 bp, Rattus norvegicus
gctgtttcttccctctgatcaaagg

SEQ ID NO: 410855 - DNA, 25 bp, Rattus norvegicus
gctgtttcttccgtctgatcaaagg

SEQ ID NO: 410856 - DNA, 25 bp, Rattus norvegicus
gctgtttcttgacgcatgtagcctt

SEQ ID NO: 410857 - DNA, 25 bp, Rattus norvegicus
gctgtttcttgaggcatgtagcctt

SEQ ID NO: 410858 - DNA, 25 bp, Rattus norvegicus
gctgtttctttcatagatcatttta

SEQ ID NO: 410859 - DNA, 25 bp, Rattus norvegicus
gctgtttctttcttagatcatttta

SEQ ID NO: 410860 - DNA, 25 bp, Rattus norvegicus
gctgtttctttgaaggagccctttc

SEQ ID NO: 410861 - DNA, 25 bp, Rattus norvegicus
gctgtttctttgtaggagccctttc

SEQ ID NO: 410862 - DNA, 25 bp, Rattus norvegicus
gctgtttgaagactccttaccagga

SEQ ID NO: 410863 - DNA, 25 bp, Rattus norvegicus
gctgtttgaagagtccttaccagga

SEQ ID NO: 410864 - DNA, 25 bp, Rattus norvegicus
gctgtttgaatcaggtgcccaagta

SEQ ID NO: 410865 - DNA, 25 bp, Rattus norvegicus
gctgtttgaatctggtgcccaagta

SEQ ID NO: 410866 - DNA, 25 bp, Rattus norvegicus
gctgtttgacacctcttttttaatc

SEQ ID NO: 410867 - DNA, 25 bp, Rattus norvegicus
gctgtttgacacgtcttttttaatc

SEQ ID NO: 410868 - DNA, 25 bp, Rattus norvegicus
gctgtttgactcattgaactgatac

SEQ ID NO: 410869 - DNA, 25 bp, Rattus norvegicus
gctgtttgactctttgaactgatac

SEQ ID NO: 410870 - DNA, 25 bp, Rattus norvegicus
gctgtttgcaggattctgttcttat

SEQ ID NO: 410871 - DNA, 25 bp, Rattus norvegicus
gctgtttgcaggtttctgttcttat

SEQ ID NO: 410872 - DNA, 25 bp, Rattus norvegicus
gctgtttgccaaactatggacatta

SEQ ID NO: 410873 - DNA, 25 bp, Rattus norvegicus
gctgtttgccaatctatggacatta

SEQ ID NO: 410874 - DNA, 25 bp, Rattus norvegicus
gctgtttgccccattggagtcaaga

SEQ ID NO: 410875 - DNA, 25 bp, Rattus norvegicus
gctgtttgcccctttggagtcaaga

SEQ ID NO: 410876 - DNA, 25 bp, Rattus norvegicus
gctgtttgcttcctcatatctatgt

SEQ ID NO: 410877 - DNA, 25 bp, Rattus norvegicus
gctgtttgcttcgtcatatctatgt

SEQ ID NO: 410878 - DNA, 25 bp, Rattus norvegicus
gctgtttggcaaatgccagtgctga

SEQ ID NO: 410879 - DNA, 25 bp, Rattus norvegicus
gctgtttggcaattgccagtgctga

SEQ ID NO: 410880 - DNA, 25 bp, Rattus norvegicus
gctgtttggcttcctgcaagagagt

SEQ ID NO: 410881 - DNA, 25 bp, Rattus norvegicus
gctgtttggcttgctgcaagagagt

SEQ ID NO: 410882 - DNA, 25 bp, Rattus norvegicus
gctgtttgggcacggacttctgcac

SEQ ID NO: 410883 - DNA, 25 bp, Rattus norvegicus
gctgtttgggcagggacttctgcac

SEQ ID NO: 410884 - DNA, 25 bp, Rattus norvegicus
gctgtttggtttatgtgcattttct

SEQ ID NO: 410885 - DNA, 25 bp, Rattus norvegicus
gctgtttggtttttgtgcattttct

SEQ ID NO: 410886 - DNA, 25 bp, Rattus norvegicus
gctgtttgtaatccagtctcaggga

SEQ ID NO: 410887 - DNA, 25 bp, Rattus norvegicus
gctgtttgtaatgcagtctcaggga

SEQ ID NO: 410888 - DNA, 25 bp, Rattus norvegicus
gctgtttgtacaagaggcctttcca

SEQ ID NO: 410889 - DNA, 25 bp, Rattus norvegicus
gctgtttgtacacactttcaggaca

SEQ ID NO: 410890 - DNA, 25 bp, Rattus norvegicus
gctgtttgtacagactttcaggaca

SEQ ID NO: 410891 - DNA, 25 bp, Rattus norvegicus
gctgtttgtacatgaggcctttcca

SEQ ID NO: 410892 - DNA, 25 bp, Rattus norvegicus
gctgtttgtcctcaagccacacaca

SEQ ID NO: 410893 - DNA, 25 bp, Rattus norvegicus
gctgtttgtcctgaagccacacaca

SEQ ID NO: 410894 - DNA, 25 bp, Rattus norvegicus
gctgtttgtcttcgttgtccaatca

SEQ ID NO: 410895 - DNA, 25 bp, Rattus norvegicus
gctgtttgtcttggttgtccaatca

SEQ ID NO: 410896 - DNA, 25 bp, Rattus norvegicus
gctgttttaaacagttcccactgcc

SEQ ID NO: 410897 - DNA, 25 bp, Rattus norvegicus
gctgttttaaactgttcccactgcc

SEQ ID NO: 410898 - DNA, 25 bp, Rattus norvegicus
gctgttttaccaatttaagtctctg

SEQ ID NO: 410899 - DNA, 25 bp, Rattus norvegicus
gctgttttaccattttaagtctctg

SEQ ID NO: 410900 - DNA, 25 bp, Rattus norvegicus
gctgttttagcactggattctttca

SEQ ID NO: 410901 - DNA, 25 bp, Rattus norvegicus
gctgttttagcagtggattctttca

SEQ ID NO: 410902 - DNA, 25 bp, Rattus norvegicus
gctgttttagccatgcatcatttgt

SEQ ID NO: 410903 - DNA, 25 bp, Rattus norvegicus
gctgttttagccttgcatcatttgt

SEQ ID NO: 410904 - DNA, 25 bp, Rattus norvegicus
gctgttttcattatacgctgttttg

SEQ ID NO: 410905 - DNA, 25 bp, Rattus norvegicus
gctgttttcattctgcatttgtgta

SEQ ID NO: 410906 - DNA, 25 bp, Rattus norvegicus
gctgttttcattgtgcatttgtgta

SEQ ID NO: 410907 - DNA, 25 bp, Rattus norvegicus
gctgttttcattttacgctgttttg

SEQ ID NO: 410908 - DNA, 25 bp, Rattus norvegicus
gctgttttccctacttcagtaaagt

SEQ ID NO: 410909 - DNA, 25 bp, Rattus norvegicus
gctgttttccctcgtgtattatgac

SEQ ID NO: 410910 - DNA, 25 bp, Rattus norvegicus
gctgttttccctggtgtattatgac

SEQ ID NO: 410911 - DNA, 25 bp, Rattus norvegicus
gctgttttcccttcttcagtaaagt

SEQ ID NO: 410912 - DNA, 25 bp, Rattus norvegicus
gctgttttcctcattaggcaaaaat

SEQ ID NO: 410913 - DNA, 25 bp, Rattus norvegicus
gctgttttcctctttaggcaaaaat

SEQ ID NO: 410914 - DNA, 25 bp, Rattus norvegicus
gctgttttcctgaagtgttactagt

SEQ ID NO: 410915 - DNA, 25 bp, Rattus norvegicus
gctgttttcctgtagtgttactagt

SEQ ID NO: 410916 - DNA, 25 bp, Rattus norvegicus
gctgttttcgatctgatgctggtac

SEQ ID NO: 410917 - DNA, 25 bp, Rattus norvegicus
gctgttttcgatgtgatgctggtac

SEQ ID NO: 410918 - DNA, 25 bp, Rattus norvegicus
gctgttttcgctctttgcagctaca

SEQ ID NO: 410919 - DNA, 25 bp, Rattus norvegicus
gctgttttcgctgtttgcagctaca

SEQ ID NO: 410920 - DNA, 25 bp, Rattus norvegicus
gctgttttcttaattggttcttctc

SEQ ID NO: 410921 - DNA, 25 bp, Rattus norvegicus
gctgttttcttatttggttcttctc

SEQ ID NO: 410922 - DNA, 25 bp, Rattus norvegicus
gctgttttctttcatgtaggcaaag

SEQ ID NO: 410923 - DNA, 25 bp, Rattus norvegicus
gctgttttctttgatgtaggcaaag

SEQ ID NO: 410924 - DNA, 25 bp, Rattus norvegicus
gctgttttgcatactttggccatga

SEQ ID NO: 410925 - DNA, 25 bp, Rattus norvegicus
gctgttttgcattctttggccatga

SEQ ID NO: 410926 - DNA, 25 bp, Rattus norvegicus
gctgtttttaccaagttagcttgtg

SEQ ID NO: 410927 - DNA, 25 bp, Rattus norvegicus
gctgtttttacctagttagcttgtg

SEQ ID NO: 410928 - DNA, 25 bp, Rattus norvegicus
gctgtttttagcatctgtattttgg

SEQ ID NO: 410929 - DNA, 25 bp, Rattus norvegicus
gctgtttttagcttctgtattttgg

SEQ ID NO: 410930 - DNA, 25 bp, Rattus norvegicus
gctgtttttataagcatcgttgatg

SEQ ID NO: 410931 - DNA, 25 bp, Rattus norvegicus
gctgtttttatatgcatcgttgatg

SEQ ID NO: 410932 - DNA, 25 bp, Rattus norvegicus
gctgtttttgacacctaaacccaga

SEQ ID NO: 410933 - DNA, 25 bp, Rattus norvegicus
gctgtttttgactcctaaacccaga

SEQ ID NO: 410934 - DNA, 25 bp, Rattus norvegicus
gcttaaaaatccattcactctttgt

SEQ ID NO: 410935 - DNA, 25 bp, Rattus norvegicus
gcttaaaaatcctttcactctttgt

SEQ ID NO: 410936 - DNA, 25 bp, Rattus norvegicus
gcttaaaacacgcacagtgacccgc

SEQ ID NO: 410937 - DNA, 25 bp, Rattus norvegicus
gcttaaaacacggacagtgacccgc

SEQ ID NO: 410938 - DNA, 25 bp, Rattus norvegicus
gcttaaaaggacacagcagctcgtc

SEQ ID NO: 410939 - DNA, 25 bp, Rattus norvegicus
gcttaaaaggactcagcagctcgtc

SEQ ID NO: 410940 - DNA, 25 bp, Rattus norvegicus
gcttaaaccaggcatgacggcacac

SEQ ID NO: 410941 - DNA, 25 bp, Rattus norvegicus
gcttaaaccagggatgacggcacac

SEQ ID NO: 410942 - DNA, 25 bp, Rattus norvegicus
gcttaaactcaacacaggaccactt

SEQ ID NO: 410943 - DNA, 25 bp, Rattus norvegicus
gcttaaactcaagacaggaccactt

SEQ ID NO: 410944 - DNA, 25 bp, Rattus norvegicus
gcttaaagagaacatcgatcgtcgt

SEQ ID NO: 410945 - DNA, 25 bp, Rattus norvegicus
gcttaaagagaagatcgatcgtcgt

SEQ ID NO: 410946 - DNA, 25 bp, Rattus norvegicus
gcttaaagctctagcctcaagtgag

SEQ ID NO: 410947 - DNA, 25 bp, Rattus norvegicus
gcttaaagctcttgcctcaagtgag

SEQ ID NO: 410948 - DNA, 25 bp, Rattus norvegicus
gcttaaaggcggcagagccctctga

SEQ ID NO: 410949 - DNA, 25 bp, Rattus norvegicus
gcttaaaggcgggagagccctctga

SEQ ID NO: 410950 - DNA, 25 bp, Rattus norvegicus
gcttaaagtgttagtagtcttggca

SEQ ID NO: 410951 - DNA, 25 bp, Rattus norvegicus
gcttaaagtgtttgtagtcttggca

SEQ ID NO: 410952 - DNA, 25 bp, Rattus norvegicus
gcttaaatctgtatttccatcacaa

SEQ ID NO: 410953 - DNA, 25 bp, Rattus norvegicus
gcttaaatctgtttttccatcacaa

SEQ ID NO: 410954 - DNA, 25 bp, Rattus norvegicus
gcttaaatgtccctttgcccagtct

SEQ ID NO: 410955 - DNA, 25 bp, Rattus norvegicus
gcttaaatgtccgtttgcccagtct

SEQ ID NO: 410956 - DNA, 25 bp, Rattus norvegicus
gcttaacaacttcagttcgatcccc

SEQ ID NO: 410957 - DNA, 25 bp, Rattus norvegicus
gcttaacaacttgagttcgatcccc

SEQ ID NO: 410958 - DNA, 25 bp, Rattus norvegicus
gcttaacatactccatgattttccc

SEQ ID NO: 410959 - DNA, 25 bp, Rattus norvegicus
gcttaacatactgcatgattttccc

SEQ ID NO: 410960 - DNA, 25 bp, Rattus norvegicus
gcttaacatctgactgctaacttag

SEQ ID NO: 410961 - DNA, 25 bp, Rattus norvegicus
gcttaacatctgtctgctaacttag

SEQ ID NO: 410962 - DNA, 25 bp, Rattus norvegicus
gcttaacatgacagagaccctaggt

SEQ ID NO: 410963 - DNA, 25 bp, Rattus norvegicus
gcttaacatgactgagaccctaggt

SEQ ID NO: 410964 - DNA, 25 bp, Rattus norvegicus
gcttaacatggaaaccacaacagaa

SEQ ID NO: 410965 - DNA, 25 bp, Rattus norvegicus
gcttaacatggataccacaacagaa

SEQ ID NO: 410966 - DNA, 25 bp, Rattus norvegicus
gcttaacccttcaaatttctgtaat

SEQ ID NO: 410967 - DNA, 25 bp, Rattus norvegicus
gcttaacccttctaatttctgtaat

SEQ ID NO: 410968 - DNA, 25 bp, Rattus norvegicus
gcttaacctgtgaccagctctggat

SEQ ID NO: 410969 - DNA, 25 bp, Rattus norvegicus
gcttaacctgtgtccagctctggat

SEQ ID NO: 410970 - DNA, 25 bp, Rattus norvegicus
gcttaacgatgcaaggtggctccat

SEQ ID NO: 410971 - DNA, 25 bp, Rattus norvegicus
gcttaacgatgctaggtggctccat

SEQ ID NO: 410972 - DNA, 25 bp, Rattus norvegicus
gcttaacttaatcttgcacccacaa

SEQ ID NO: 410973 - DNA, 25 bp, Rattus norvegicus
gcttaacttaatgttgcacccacaa

SEQ ID NO: 410974 - DNA, 25 bp, Rattus norvegicus
gcttaacttcatctccattgttcag

SEQ ID NO: 410975 - DNA, 25 bp, Rattus norvegicus
gcttaacttcatgtccattgttcag

SEQ ID NO: 410976 - DNA, 25 bp, Rattus norvegicus
gcttaagaacaaacgaaacccggag

SEQ ID NO: 410977 - DNA, 25 bp, Rattus norvegicus
gcttaagaacaatcgaaacccggag

SEQ ID NO: 410978 - DNA, 25 bp, Rattus norvegicus
gcttaagacttcagagaccacacat

SEQ ID NO: 410979 - DNA, 25 bp, Rattus norvegicus
gcttaagacttctgagaccacacat

SEQ ID NO: 410980 - DNA, 25 bp, Rattus norvegicus
gcttaagagcaccttggtttcgata

SEQ ID NO: 410981 - DNA, 25 bp, Rattus norvegicus
gcttaagagcacgttggtttcgata

SEQ ID NO: 410982 - DNA, 25 bp, Rattus norvegicus
gcttaagcacttcatcatttgtttt

SEQ ID NO: 410983 - DNA, 25 bp, Rattus norvegicus
gcttaagcacttgatcatttgtttt

SEQ ID NO: 410984 - DNA, 25 bp, Rattus norvegicus
gcttaagcagtcaacatctgtccct

SEQ ID NO: 410985 - DNA, 25 bp, Rattus norvegicus
gcttaagcagtctacatctgtccct

SEQ ID NO: 410986 - DNA, 25 bp, Rattus norvegicus
gcttaagcggccacggaaacgcctt

SEQ ID NO: 410987 - DNA, 25 bp, Rattus norvegicus
gcttaagcggcctcggaaacgcctt

SEQ ID NO: 410988 - DNA, 25 bp, Rattus norvegicus
gcttaagcgtgtactgccattgcaa

SEQ ID NO: 410989 - DNA, 25 bp, Rattus norvegicus
gcttaagcgtgttctgccattgcaa

SEQ ID NO: 410990 - DNA, 25 bp, Rattus norvegicus
gcttaagctatgcacggagacacat

SEQ ID NO: 410991 - DNA, 25 bp, Rattus norvegicus
gcttaagctatggacggagacacat

SEQ ID NO: 410992 - DNA, 25 bp, Rattus norvegicus
gcttaagctttcatgaagtatgttc

SEQ ID NO: 410993 - DNA, 25 bp, Rattus norvegicus
gcttaagctttcttgaagtatgttc

SEQ ID NO: 410994 - DNA, 25 bp, Rattus norvegicus
gcttaaggcagcacagacatgacaa

SEQ ID NO: 410995 - DNA, 25 bp, Rattus norvegicus
gcttaaggcagctcagacatgacaa

SEQ ID NO: 410996 - DNA, 25 bp, Rattus norvegicus
gcttaagggcagctcaggacaccac

SEQ ID NO: 410997 - DNA, 25 bp, Rattus norvegicus
gcttaagggcaggtcaggacaccac

SEQ ID NO: 410998 - DNA, 25 bp, Rattus norvegicus
gcttaaggtgtaaacgagtatcgca

SEQ ID NO: 410999 - DNA, 25 bp, Rattus norvegicus
gcttaaggtgtatacgagtatcgca

SEQ ID NO: 411000 - DNA, 25 bp, Rattus norvegicus
gcttaagtcagcattgtcttccagt

SEQ ID NO: 411001 - DNA, 25 bp, Rattus norvegicus
gcttaagtcagctttgtcttccagt

SEQ ID NO: 411002 - DNA, 25 bp, Rattus norvegicus
gcttaagtgagaaacgcgcacctct

SEQ ID NO: 411003 - DNA, 25 bp, Rattus norvegicus
gcttaagtgagatacgcgcacctct

SEQ ID NO: 411004 - DNA, 25 bp, Rattus norvegicus
gcttaagttccaccaaatgccacag

SEQ ID NO: 411005 - DNA, 25 bp, Rattus norvegicus
gcttaagttccagcaaatgccacag

SEQ ID NO: 411006 - DNA, 25 bp, Rattus norvegicus
gcttaatattaaatgccaggtgcat

SEQ ID NO: 411007 - DNA, 25 bp, Rattus norvegicus
gcttaatattaattgccaggtgcat

SEQ ID NO: 411008 - DNA, 25 bp, Rattus norvegicus
gcttaatattgtaactgctttgcag

SEQ ID NO: 411009 - DNA, 25 bp, Rattus norvegicus
gcttaatattgttactgctttgcag

SEQ ID NO: 411010 - DNA, 25 bp, Rattus norvegicus
gcttaatcgttgactgggcctatgc

SEQ ID NO: 411011 - DNA, 25 bp, Rattus norvegicus
gcttaatcgttgtctgggcctatgc

SEQ ID NO: 411012 - DNA, 25 bp, Rattus norvegicus
gcttaatctaagagggtcgtccctc

SEQ ID NO: 411013 - DNA, 25 bp, Rattus norvegicus
gcttaatctaagtgggtcgtccctc

SEQ ID NO: 411014 - DNA, 25 bp, Rattus norvegicus
gcttaatgaggaccttcaccggcgc

SEQ ID NO: 411015 - DNA, 25 bp, Rattus norvegicus
gcttaatgaggagcttcaccggcgc

SEQ ID NO: 411016 - DNA, 25 bp, Rattus norvegicus
gcttaatgccctacgtcaacacttt

SEQ ID NO: 411017 - DNA, 25 bp, Rattus norvegicus
gcttaatgcccttcgtcaacacttt

SEQ ID NO: 411018 - DNA, 25 bp, Rattus norvegicus
gcttaatgtttgattcctctgctgc

SEQ ID NO: 411019 - DNA, 25 bp, Rattus norvegicus
gcttaatgtttgtttcctctgctgc

SEQ ID NO: 411020 - DNA, 25 bp, Rattus norvegicus
gcttaattgctcattttgtataaac

SEQ ID NO: 411021 - DNA, 25 bp, Rattus norvegicus
gcttaattgctctttttgtataaac

SEQ ID NO: 411022 - DNA, 25 bp, Rattus norvegicus
gcttaatttacaatctcaaaggact

SEQ ID NO: 411023 - DNA, 25 bp, Rattus norvegicus
gcttaatttacattctcaaaggact

SEQ ID NO: 411024 - DNA, 25 bp, Rattus norvegicus
gcttacaaactaaacagcctgctaa

SEQ ID NO: 411025 - DNA, 25 bp, Rattus norvegicus
gcttacaaactatacagcctgctaa

SEQ ID NO: 411026 - DNA, 25 bp, Rattus norvegicus
gcttacaagctactcaaagggccag

SEQ ID NO: 411027 - DNA, 25 bp, Rattus norvegicus
gcttacaagctactgggtgaccgac

SEQ ID NO: 411028 - DNA, 25 bp, Rattus norvegicus
gcttacaagctagtcaaagggccag

SEQ ID NO: 411029 - DNA, 25 bp, Rattus norvegicus
gcttacaagctagtgggtgaccgac

SEQ ID NO: 411030 - DNA, 25 bp, Rattus norvegicus
gcttacacacccatttgagaaattg

SEQ ID NO: 411031 - DNA, 25 bp, Rattus norvegicus
gcttacacacccttttgagaaattg

SEQ ID NO: 411032 - DNA, 25 bp, Rattus norvegicus
gcttacacgactcttcattgacatg

SEQ ID NO: 411033 - DNA, 25 bp, Rattus norvegicus
gcttacacgactgttcattgacatg

SEQ ID NO: 411034 - DNA, 25 bp, Rattus norvegicus
gcttacacttccaggtcacaatcca

SEQ ID NO: 411035 - DNA, 25 bp, Rattus norvegicus
gcttacacttcctggtcacaatcca

SEQ ID NO: 411036 - DNA, 25 bp, Rattus norvegicus
gcttacagtccgagacatcagtcta

SEQ ID NO: 411037 - DNA, 25 bp, Rattus norvegicus
gcttacagtccgtgacatcagtcta

SEQ ID NO: 411038 - DNA, 25 bp, Rattus norvegicus
gcttacagtttcagaacgctcactc

SEQ ID NO: 411039 - DNA, 25 bp, Rattus norvegicus
gcttacagtttctgaacgctcactc

SEQ ID NO: 411040 - DNA, 25 bp, Rattus norvegicus
gcttacagtttgaggctacagggaa

SEQ ID NO: 411041 - DNA, 25 bp, Rattus norvegicus
gcttacagtttgtggctacagggaa

SEQ ID NO: 411042 - DNA, 25 bp, Rattus norvegicus
gcttacatccttccgcagtgaggaa

SEQ ID NO: 411043 - DNA, 25 bp, Rattus norvegicus
gcttacatccttgcgcagtgaggaa

SEQ ID NO: 411044 - DNA, 25 bp, Rattus norvegicus
gcttacatctttccaattgaatagg

SEQ ID NO: 411045 - DNA, 25 bp, Rattus norvegicus
gcttacatctttgcaattgaatagg

SEQ ID NO: 411046 - DNA, 25 bp, Rattus norvegicus
gcttacattgggaggctatttctgc

SEQ ID NO: 411047 - DNA, 25 bp, Rattus norvegicus
gcttacattgggtggctatttctgc

SEQ ID NO: 411048 - DNA, 25 bp, Rattus norvegicus
gcttacatttacaatctattctgct

SEQ ID NO: 411049 - DNA, 25 bp, Rattus norvegicus
gcttacatttactatctattctgct

SEQ ID NO: 411050 - DNA, 25 bp, Rattus norvegicus
gcttacatttcacaggtttgcaggg

SEQ ID NO: 411051 - DNA, 25 bp, Rattus norvegicus
gcttacatttcagaggtttgcaggg

SEQ ID NO: 411052 - DNA, 25 bp, Rattus norvegicus
gcttaccaatgcagactataccaca

SEQ ID NO: 411053 - DNA, 25 bp, Rattus norvegicus
gcttaccaatgctgactataccaca

SEQ ID NO: 411054 - DNA, 25 bp, Rattus norvegicus
gcttaccagatccatgatgccatgt

SEQ ID NO: 411055 - DNA, 25 bp, Rattus norvegicus
gcttaccagatcgatgatgccatgt

SEQ ID NO: 411056 - DNA, 25 bp, Rattus norvegicus
gcttacccatgaaactccagcagta

SEQ ID NO: 411057 - DNA, 25 bp, Rattus norvegicus
gcttacccatgatactccagcagta

SEQ ID NO: 411058 - DNA, 25 bp, Rattus norvegicus
gcttacccatttcttactcgtttag

SEQ ID NO: 411059 - DNA, 25 bp, Rattus norvegicus
gcttacccatttgttactcgtttag

SEQ ID NO: 411060 - DNA, 25 bp, Rattus norvegicus
gcttacccctggctaagaacggaag

SEQ ID NO: 411061 - DNA, 25 bp, Rattus norvegicus
gcttacccctgggtaagaacggaag

SEQ ID NO: 411062 - DNA, 25 bp, Rattus norvegicus
gcttaccctatccaagctttggtat

SEQ ID NO: 411063 - DNA, 25 bp, Rattus norvegicus
gcttaccctatcgaagctttggtat

SEQ ID NO: 411064 - DNA, 25 bp, Rattus norvegicus
gcttaccctgggagttttacacatt

SEQ ID NO: 411065 - DNA, 25 bp, Rattus norvegicus
gcttaccctgggtgttttacacatt

SEQ ID NO: 411066 - DNA, 25 bp, Rattus norvegicus
gcttaccgttcccatttgatgtgga

SEQ ID NO: 411067 - DNA, 25 bp, Rattus norvegicus
gcttaccgttccgatttgatgtgga

SEQ ID NO: 411068 - DNA, 25 bp, Rattus norvegicus
gcttaccgttgtccatatactggca

SEQ ID NO: 411069 - DNA, 25 bp, Rattus norvegicus
gcttaccgttgtgcatatactggca

SEQ ID NO: 411070 - DNA, 25 bp, Rattus norvegicus
gcttacctaagcatcggcgacttga

SEQ ID NO: 411071 - DNA, 25 bp, Rattus norvegicus
gcttacctaagcttcggcgacttga

SEQ ID NO: 411072 - DNA, 25 bp, Rattus norvegicus
gcttacctagcaagccccaagggtt

SEQ ID NO: 411073 - DNA, 25 bp, Rattus norvegicus
gcttacctagcaatcacaaaaccac

SEQ ID NO: 411074 - DNA, 25 bp, Rattus norvegicus
gcttacctagcatgccccaagggtt

SEQ ID NO: 411075 - DNA, 25 bp, Rattus norvegicus
gcttacctagcattcacaaaaccac

SEQ ID NO: 411076 - DNA, 25 bp, Rattus norvegicus
gcttacctcccgctatgagtgttgg

SEQ ID NO: 411077 - DNA, 25 bp, Rattus norvegicus
gcttacctcccggtatgagtgttgg

SEQ ID NO: 411078 - DNA, 25 bp, Rattus norvegicus
gcttacctctgacaagctgggcttt

SEQ ID NO: 411079 - DNA, 25 bp, Rattus norvegicus
gcttacctctgagaagctgggcttt

SEQ ID NO: 411080 - DNA, 25 bp, Rattus norvegicus
gcttacctgaatactgccttttata

SEQ ID NO: 411081 - DNA, 25 bp, Rattus norvegicus
gcttacctgaattctgccttttata

SEQ ID NO: 411082 - DNA, 25 bp, Rattus norvegicus
gcttacctgatgaaggtctcacctt

SEQ ID NO: 411083 - DNA, 25 bp, Rattus norvegicus
gcttacctgatgtaggtctcacctt

SEQ ID NO: 411084 - DNA, 25 bp, Rattus norvegicus
gcttacctgtatattaaccttgatt

SEQ ID NO: 411085 - DNA, 25 bp, Rattus norvegicus
gcttacctgtattttaaccttgatt

SEQ ID NO: 411086 - DNA, 25 bp, Rattus norvegicus
gcttaccttcataccttctgataat

SEQ ID NO: 411087 - DNA, 25 bp, Rattus norvegicus
gcttaccttcattccttctgataat

SEQ ID NO: 411088 - DNA, 25 bp, Rattus norvegicus
gcttacgttctgacctagaatcact

SEQ ID NO: 411089 - DNA, 25 bp, Rattus norvegicus
gcttacgttctgtcctagaatcact

SEQ ID NO: 411090 - DNA, 25 bp, Rattus norvegicus
gcttacgtttatactccagttgtca

SEQ ID NO: 411091 - DNA, 25 bp, Rattus norvegicus
gcttacgtttattctccagttgtca

SEQ ID NO: 411092 - DNA, 25 bp, Rattus norvegicus
gcttactaaataatctcggtcttca

SEQ ID NO: 411093 - DNA, 25 bp, Rattus norvegicus
gcttactaaatattctcggtcttca

SEQ ID NO: 411094 - DNA, 25 bp, Rattus norvegicus
gcttactaaatcaccagcacaggat

SEQ ID NO: 411095 - DNA, 25 bp, Rattus norvegicus
gcttactaaatctccagcacaggat

SEQ ID NO: 411096 - DNA, 25 bp, Rattus norvegicus
gcttactcacttcgacgcaacattg

SEQ ID NO: 411097 - DNA, 25 bp, Rattus norvegicus
gcttactcacttggacgcaacattg

SEQ ID NO: 411098 - DNA, 25 bp, Rattus norvegicus
gcttactcagcacagtagcatttat

SEQ ID NO: 411099 - DNA, 25 bp, Rattus norvegicus
gcttactcagcagagtagcatttat

SEQ ID NO: 411100 - DNA, 25 bp, Rattus norvegicus
gcttactcattgctcaactaggacc

SEQ ID NO: 411101 - DNA, 25 bp, Rattus norvegicus
gcttactcattggtcaactaggacc

SEQ ID NO: 411102 - DNA, 25 bp, Rattus norvegicus
gcttactccaggaaccattttcaga

SEQ ID NO: 411103 - DNA, 25 bp, Rattus norvegicus
gcttactccaggtaccattttcaga

SEQ ID NO: 411104 - DNA, 25 bp, Rattus norvegicus
gcttactctgaacgctttctggaca

SEQ ID NO: 411105 - DNA, 25 bp, Rattus norvegicus
gcttactctgaaggctttctggaca

SEQ ID NO: 411106 - DNA, 25 bp, Rattus norvegicus
gcttactctgtgacttggaatcctg

SEQ ID NO: 411107 - DNA, 25 bp, Rattus norvegicus
gcttactctgtgtcttggaatcctg

SEQ ID NO: 411108 - DNA, 25 bp, Rattus norvegicus
gcttactcttgacaccgcattgaag

SEQ ID NO: 411109 - DNA, 25 bp, Rattus norvegicus
gcttactcttgagaccgcattgaag

SEQ ID NO: 411110 - DNA, 25 bp, Rattus norvegicus
gcttactgaactcaatgcctcaact

SEQ ID NO: 411111 - DNA, 25 bp, Rattus norvegicus
gcttactgaactgaatgcctcaact

SEQ ID NO: 411112 - DNA, 25 bp, Rattus norvegicus
gcttactgaagaagaatccccgaaa

SEQ ID NO: 411113 - DNA, 25 bp, Rattus norvegicus
gcttactgaagatgaatccccgaaa

SEQ ID NO: 411114 - DNA, 25 bp, Rattus norvegicus
gcttactgaatgaataaggccctgg

SEQ ID NO: 411115 - DNA, 25 bp, Rattus norvegicus
gcttactgaatgtataaggccctgg

SEQ ID NO: 411116 - DNA, 25 bp, Rattus norvegicus
gcttactgatctattgggattccta

SEQ ID NO: 411117 - DNA, 25 bp, Rattus norvegicus
gcttactgatcttttgggattccta

SEQ ID NO: 411118 - DNA, 25 bp, Rattus norvegicus
gcttactggcctagaataactccta

SEQ ID NO: 411119 - DNA, 25 bp, Rattus norvegicus
gcttactggccttgaataactccta

SEQ ID NO: 411120 - DNA, 25 bp, Rattus norvegicus
gcttacttacacctgggcttttaga

SEQ ID NO: 411121 - DNA, 25 bp, Rattus norvegicus
gcttacttacacgtgggcttttaga

SEQ ID NO: 411122 - DNA, 25 bp, Rattus norvegicus
gcttacttagcaaacagggccctaa

SEQ ID NO: 411123 - DNA, 25 bp, Rattus norvegicus
gcttacttagcatacagggccctaa

SEQ ID NO: 411124 - DNA, 25 bp, Rattus norvegicus
gcttacttagggatttgtgccactt

SEQ ID NO: 411125 - DNA, 25 bp, Rattus norvegicus
gcttacttagggttttgtgccactt

SEQ ID NO: 411126 - DNA, 25 bp, Rattus norvegicus
gcttacttcgggatgtaggcttaca

SEQ ID NO: 411127 - DNA, 25 bp, Rattus norvegicus
gcttacttcgggttgtaggcttaca

SEQ ID NO: 411128 - DNA, 25 bp, Rattus norvegicus
gcttacttgttcctggttagaatag

SEQ ID NO: 411129 - DNA, 25 bp, Rattus norvegicus
gcttacttgttcgtggttagaatag

SEQ ID NO: 411130 - DNA, 25 bp, Rattus norvegicus
gcttacttttcgagtggatctctga

SEQ ID NO: 411131 - DNA, 25 bp, Rattus norvegicus
gcttacttttcgtgtggatctctga

SEQ ID NO: 411132 - DNA, 25 bp, Rattus norvegicus
gcttacttttgtctcttacatgctc

SEQ ID NO: 411133 - DNA, 25 bp, Rattus norvegicus
gcttacttttgtgtcttacatgctc

SEQ ID NO: 411134 - DNA, 25 bp, Rattus norvegicus
gcttagaaatcaatcccactggacc

SEQ ID NO: 411135 - DNA, 25 bp, Rattus norvegicus
gcttagaaatcattcccactggacc

SEQ ID NO: 411136 - DNA, 25 bp, Rattus norvegicus
gcttagaagagtcacaggcccattg

SEQ ID NO: 411137 - DNA, 25 bp, Rattus norvegicus
gcttagaagagtgacaggcccattg

SEQ ID NO: 411138 - DNA, 25 bp, Rattus norvegicus
gcttagaccagaatcctgctgccaa

SEQ ID NO: 411139 - DNA, 25 bp, Rattus norvegicus
gcttagaccagattcctgctgccaa

SEQ ID NO: 411140 - DNA, 25 bp, Rattus norvegicus
gcttagagcttgctggtcaatgctg

SEQ ID NO: 411141 - DNA, 25 bp, Rattus norvegicus
gcttagagcttggtggtcaatgctg

SEQ ID NO: 411142 - DNA, 25 bp, Rattus norvegicus
gcttagagtgttcctgatgccttag

SEQ ID NO: 411143 - DNA, 25 bp, Rattus norvegicus
gcttagagtgttgctgatgccttag

SEQ ID NO: 411144 - DNA, 25 bp, Rattus norvegicus
gcttagatcaaactcactttccttc

SEQ ID NO: 411145 - DNA, 25 bp, Rattus norvegicus
gcttagatcaaagtcactttccttc

SEQ ID NO: 411146 - DNA, 25 bp, Rattus norvegicus
gcttagattgacagactcttggatc

SEQ ID NO: 411147 - DNA, 25 bp, Rattus norvegicus
gcttagattgactgactcttggatc

SEQ ID NO: 411148 - DNA, 25 bp, Rattus norvegicus
gcttagattgttacctttctggctc

SEQ ID NO: 411149 - DNA, 25 bp, Rattus norvegicus
gcttagattgtttcctttctggctc

SEQ ID NO: 411150 - DNA, 25 bp, Rattus norvegicus
gcttagatttaacttggtggtacac

SEQ ID NO: 411151 - DNA, 25 bp, Rattus norvegicus
gcttagatttaagttggtggtacac

SEQ ID NO: 411152 - DNA, 25 bp, Rattus norvegicus
gcttagcactcactgagcacaggct

SEQ ID NO: 411153 - DNA, 25 bp, Rattus norvegicus
gcttagcactcagtgagcacaggct

SEQ ID NO: 411154 - DNA, 25 bp, Rattus norvegicus
gcttagcattgtcggttcagcatga

SEQ ID NO: 411155 - DNA, 25 bp, Rattus norvegicus
gcttagcattgtgggttcagcatga

SEQ ID NO: 411156 - DNA, 25 bp, Rattus norvegicus
gcttagcatttccaaggtgatgcct

SEQ ID NO: 411157 - DNA, 25 bp, Rattus norvegicus
gcttagcatttcgaaggtgatgcct

SEQ ID NO: 411158 - DNA, 25 bp, Rattus norvegicus
gcttagccaatcattgagctccggg

SEQ ID NO: 411159 - DNA, 25 bp, Rattus norvegicus
gcttagccaatctttgagctccggg

SEQ ID NO: 411160 - DNA, 25 bp, Rattus norvegicus
gcttagccagttagcatggtttttt

SEQ ID NO: 411161 - DNA, 25 bp, Rattus norvegicus
gcttagccagtttgcatggtttttt

SEQ ID NO: 411162 - DNA, 25 bp, Rattus norvegicus
gcttagccatctattcctgggcttc

SEQ ID NO: 411163 - DNA, 25 bp, Rattus norvegicus
gcttagccatcttttcctgggcttc

SEQ ID NO: 411164 - DNA, 25 bp, Rattus norvegicus
gcttagccccaacgttggcatggat

SEQ ID NO: 411165 - DNA, 25 bp, Rattus norvegicus
gcttagccccaaggttggcatggat

SEQ ID NO: 411166 - DNA, 25 bp, Rattus norvegicus
gcttagccggctccagggaatgtaa

SEQ ID NO: 411167 - DNA, 25 bp, Rattus norvegicus
gcttagccggctgcagggaatgtaa

SEQ ID NO: 411168 - DNA, 25 bp, Rattus norvegicus
gcttagcctattctttgcagcagaa

SEQ ID NO: 411169 - DNA, 25 bp, Rattus norvegicus
gcttagcctattgtttgcagcagaa

SEQ ID NO: 411170 - DNA, 25 bp, Rattus norvegicus
gcttagcctgcacagagcgagtcag

SEQ ID NO: 411171 - DNA, 25 bp, Rattus norvegicus
gcttagcctgcagagagcgagtcag

SEQ ID NO: 411172 - DNA, 25 bp, Rattus norvegicus
gcttagcctttaaagcagggttcag

SEQ ID NO: 411173 - DNA, 25 bp, Rattus norvegicus
gcttagcctttatagcagggttcag

SEQ ID NO: 411174 - DNA, 25 bp, Rattus norvegicus
gcttagcgggctaaccttgagctcg

SEQ ID NO: 411175 - DNA, 25 bp, Rattus norvegicus
gcttagcgggcttaccttgagctcg

SEQ ID NO: 411176 - DNA, 25 bp, Rattus norvegicus
gcttagcgtgctagatctcagttac

SEQ ID NO: 411177 - DNA, 25 bp, Rattus norvegicus
gcttagcgtgcttgatctcagttac

SEQ ID NO: 411178 - DNA, 25 bp, Rattus norvegicus
gcttagctcatccaatggtaccaat

SEQ ID NO: 411179 - DNA, 25 bp, Rattus norvegicus
gcttagctcatcgaatggtaccaat

SEQ ID NO: 411180 - DNA, 25 bp, Rattus norvegicus
gcttagctccttaagcagtctgagg

SEQ ID NO: 411181 - DNA, 25 bp, Rattus norvegicus
gcttagctcctttagcagtctgagg

SEQ ID NO: 411182 - DNA, 25 bp, Rattus norvegicus
gcttagctgagtatgtcttgctcta

SEQ ID NO: 411183 - DNA, 25 bp, Rattus norvegicus
gcttagctgagtttgtcttgctcta

SEQ ID NO: 411184 - DNA, 25 bp, Rattus norvegicus
gcttagctgccaagggaggtttctt

SEQ ID NO: 411185 - DNA, 25 bp, Rattus norvegicus
gcttagctgccatgggaggtttctt

SEQ ID NO: 411186 - DNA, 25 bp, Rattus norvegicus
gcttagctgctccaaagacatccag

SEQ ID NO: 411187 - DNA, 25 bp, Rattus norvegicus
gcttagctgctccatagtagattat

SEQ ID NO: 411188 - DNA, 25 bp, Rattus norvegicus
gcttagctgctcgaaagacatccag

SEQ ID NO: 411189 - DNA, 25 bp, Rattus norvegicus
gcttagctgctcgatagtagattat

SEQ ID NO: 411190 - DNA, 25 bp, Rattus norvegicus
gcttagctgtgaaagatggtctcat

SEQ ID NO: 411191 - DNA, 25 bp, Rattus norvegicus
gcttagctgtgatagatggtctcat

SEQ ID NO: 411192 - DNA, 25 bp, Rattus norvegicus
gcttagcttcttacacagtcatgga

SEQ ID NO: 411193 - DNA, 25 bp, Rattus norvegicus
gcttagcttcttactatcacactat

SEQ ID NO: 411194 - DNA, 25 bp, Rattus norvegicus
gcttagcttctttcacagtcatgga

SEQ ID NO: 411195 - DNA, 25 bp, Rattus norvegicus
gcttagcttctttctatcacactat

SEQ ID NO: 411196 - DNA, 25 bp, Rattus norvegicus
gcttagctttcccacagcataggaa

SEQ ID NO: 411197 - DNA, 25 bp, Rattus norvegicus
gcttagctttccgacagcataggaa

SEQ ID NO: 411198 - DNA, 25 bp, Rattus norvegicus
gcttaggaatttccctttctctgcc

SEQ ID NO: 411199 - DNA, 25 bp, Rattus norvegicus
gcttaggaatttgcctttctctgcc

SEQ ID NO: 411200 - DNA, 25 bp, Rattus norvegicus
gcttaggacagaccattccgtgcaa

SEQ ID NO: 411201 - DNA, 25 bp, Rattus norvegicus
gcttaggacagagcattccgtgcaa

SEQ ID NO: 411202 - DNA, 25 bp, Rattus norvegicus
gcttaggactcaattatgccacctg

SEQ ID NO: 411203 - DNA, 25 bp, Rattus norvegicus
gcttaggactcatttatgccacctg

SEQ ID NO: 411204 - DNA, 25 bp, Rattus norvegicus
gcttaggactgccatgatgctgtca

SEQ ID NO: 411205 - DNA, 25 bp, Rattus norvegicus
gcttaggactgcgatgatgctgtca

SEQ ID NO: 411206 - DNA, 25 bp, Rattus norvegicus
gcttaggactgtaactgtcaggttc

SEQ ID NO: 411207 - DNA, 25 bp, Rattus norvegicus
gcttaggactgttactgtcaggttc

SEQ ID NO: 411208 - DNA, 25 bp, Rattus norvegicus
gcttaggatagcacagtgctcttga

SEQ ID NO: 411209 - DNA, 25 bp, Rattus norvegicus
gcttaggatagctcagtgctcttga

SEQ ID NO: 411210 - DNA, 25 bp, Rattus norvegicus
gcttaggccttaagcgcaactgttt

SEQ ID NO: 411211 - DNA, 25 bp, Rattus norvegicus
gcttaggccttatgcgcaactgttt

SEQ ID NO: 411212 - DNA, 25 bp, Rattus norvegicus
gcttaggctatcagagactctgtct

SEQ ID NO: 411213 - DNA, 25 bp, Rattus norvegicus
gcttaggctatctgagactctgtct

SEQ ID NO: 411214 - DNA, 25 bp, Rattus norvegicus
gcttaggctgttcaacattccacat

SEQ ID NO: 411215 - DNA, 25 bp, Rattus norvegicus
gcttaggctgttgaacattccacat

SEQ ID NO: 411216 - DNA, 25 bp, Rattus norvegicus
gcttagggacttatgtactttggtg

SEQ ID NO: 411217 - DNA, 25 bp, Rattus norvegicus
gcttagggacttttgtactttggtg

SEQ ID NO: 411218 - DNA, 25 bp, Rattus norvegicus
gcttagggccatattattaaaccag

SEQ ID NO: 411219 - DNA, 25 bp, Rattus norvegicus
gcttagggccattttattaaaccag

SEQ ID NO: 411220 - DNA, 25 bp, Rattus norvegicus
gcttagggcttgatacagggtcatt

SEQ ID NO: 411221 - DNA, 25 bp, Rattus norvegicus
gcttagggcttgttacagggtcatt

SEQ ID NO: 411222 - DNA, 25 bp, Rattus norvegicus
gcttagggttaaacggccatctctt

SEQ ID NO: 411223 - DNA, 25 bp, Rattus norvegicus
gcttagggttaatcggccatctctt

SEQ ID NO: 411224 - DNA, 25 bp, Rattus norvegicus
gcttaggtccctatacttgagtgac

SEQ ID NO: 411225 - DNA, 25 bp, Rattus norvegicus
gcttaggtccctttacttgagtgac

SEQ ID NO: 411226 - DNA, 25 bp, Rattus norvegicus
gcttaggttcctcttgattttgaga

SEQ ID NO: 411227 - DNA, 25 bp, Rattus norvegicus
gcttaggttcctgttgattttgaga

SEQ ID NO: 411228 - DNA, 25 bp, Rattus norvegicus
gcttaggttgccacagaaattcaga

SEQ ID NO: 411229 - DNA, 25 bp, Rattus norvegicus
gcttaggttgcctcagaaattcaga

SEQ ID NO: 411230 - DNA, 25 bp, Rattus norvegicus
gcttaggtttctcagatacccttct

SEQ ID NO: 411231 - DNA, 25 bp, Rattus norvegicus
gcttaggtttctgagatacccttct

SEQ ID NO: 411232 - DNA, 25 bp, Rattus norvegicus
gcttagtacatgactcaagatccta

SEQ ID NO: 411233 - DNA, 25 bp, Rattus norvegicus
gcttagtacatgtctcaagatccta

SEQ ID NO: 411234 - DNA, 25 bp, Rattus norvegicus
gcttagtctaatcgaggcagtttca

SEQ ID NO: 411235 - DNA, 25 bp, Rattus norvegicus
gcttagtctaatggaggcagtttca

SEQ ID NO: 411236 - DNA, 25 bp, Rattus norvegicus
gcttagtgatctcctgtggcccaga

SEQ ID NO: 411237 - DNA, 25 bp, Rattus norvegicus
gcttagtgatctgctgtggcccaga

SEQ ID NO: 411238 - DNA, 25 bp, Rattus norvegicus
gcttagtgctctagctgacctgaaa

SEQ ID NO: 411239 - DNA, 25 bp, Rattus norvegicus
gcttagtgctcttgctgacctgaaa

SEQ ID NO: 411240 - DNA, 25 bp, Rattus norvegicus
gcttagtgttagacctgctcagtaa

SEQ ID NO: 411241 - DNA, 25 bp, Rattus norvegicus
gcttagtgttagtcctgctcagtaa

SEQ ID NO: 411242 - DNA, 25 bp, Rattus norvegicus
gcttagttaactagaggcttctttt

SEQ ID NO: 411243 - DNA, 25 bp, Rattus norvegicus
gcttagttaacttgaggcttctttt

SEQ ID NO: 411244 - DNA, 25 bp, Rattus norvegicus
gcttagttcccaacattcggttaaa

SEQ ID NO: 411245 - DNA, 25 bp, Rattus norvegicus
gcttagttcccatcattcggttaaa

SEQ ID NO: 411246 - DNA, 25 bp, Rattus norvegicus
gcttagtttgagatttccttgttag

SEQ ID NO: 411247 - DNA, 25 bp, Rattus norvegicus
gcttagtttgagttttccttgttag

SEQ ID NO: 411248 - DNA, 25 bp, Rattus norvegicus
gcttataacccaacccagagggaca

SEQ ID NO: 411249 - DNA, 25 bp, Rattus norvegicus
gcttataacccatcccagagggaca

SEQ ID NO: 411250 - DNA, 25 bp, Rattus norvegicus
gcttataactgtcacgatgtcaagt

SEQ ID NO: 411251 - DNA, 25 bp, Rattus norvegicus
gcttataactgtgacgatgtcaagt

SEQ ID NO: 411252 - DNA, 25 bp, Rattus norvegicus
gcttataatggtattttggcttttg

SEQ ID NO: 411253 - DNA, 25 bp, Rattus norvegicus
gcttataatggttttttggcttttg

SEQ ID NO: 411254 - DNA, 25 bp, Rattus norvegicus
gcttatacttataatgccagcacta

SEQ ID NO: 411255 - DNA, 25 bp, Rattus norvegicus
gcttatacttattatgccagcacta

SEQ ID NO: 411256 - DNA, 25 bp, Rattus norvegicus
gcttatacttcaattctttcttgtt

SEQ ID NO: 411257 - DNA, 25 bp, Rattus norvegicus
gcttatacttcatttctttcttgtt

SEQ ID NO: 411258 - DNA, 25 bp, Rattus norvegicus
gcttatagactccactgcaggtgaa

SEQ ID NO: 411259 - DNA, 25 bp, Rattus norvegicus
gcttatagactcgactgcaggtgaa

SEQ ID NO: 411260 - DNA, 25 bp, Rattus norvegicus
gcttatagatcaatttggccccatt

SEQ ID NO: 411261 - DNA, 25 bp, Rattus norvegicus
gcttatagatcattttggccccatt

SEQ ID NO: 411262 - DNA, 25 bp, Rattus norvegicus
gcttatatgcagattacagtcctta

SEQ ID NO: 411263 - DNA, 25 bp, Rattus norvegicus
gcttatatgcagtttacagtcctta

SEQ ID NO: 411264 - DNA, 25 bp, Rattus norvegicus
gcttatcacccaaaggcacctaata

SEQ ID NO: 411265 - DNA, 25 bp, Rattus norvegicus
gcttatcacccataggcacctaata

SEQ ID NO: 411266 - DNA, 25 bp, Rattus norvegicus
gcttatcaccttccacaaaatggat

SEQ ID NO: 411267 - DNA, 25 bp, Rattus norvegicus
gcttatcaccttgcacaaaatggat

SEQ ID NO: 411268 - DNA, 25 bp, Rattus norvegicus
gcttatcagctacaaggcttccagc

SEQ ID NO: 411269 - DNA, 25 bp, Rattus norvegicus
gcttatcagctagaaggcttccagc

SEQ ID NO: 411270 - DNA, 25 bp, Rattus norvegicus
gcttatcagtaacatctatcaggtt

SEQ ID NO: 411271 - DNA, 25 bp, Rattus norvegicus
gcttatcagtaagatctatcaggtt

SEQ ID NO: 411272 - DNA, 25 bp, Rattus norvegicus
gcttatccatacagaaactccaaca

SEQ ID NO: 411273 - DNA, 25 bp, Rattus norvegicus
gcttatccatactgaaactccaaca

SEQ ID NO: 411274 - DNA, 25 bp, Rattus norvegicus
gcttatcctcagaagtctggtttct

SEQ ID NO: 411275 - DNA, 25 bp, Rattus norvegicus
gcttatcctcagtagtctggtttct

SEQ ID NO: 411276 - DNA, 25 bp, Rattus norvegicus
gcttatcgcaaacatttaccacggg

SEQ ID NO: 411277 - DNA, 25 bp, Rattus norvegicus
gcttatcgcaaagatttaccacggg

SEQ ID NO: 411278 - DNA, 25 bp, Rattus norvegicus
gcttatctacctcttcccatgaaga

SEQ ID NO: 411279 - DNA, 25 bp, Rattus norvegicus
gcttatctacctgttcccatgaaga

SEQ ID NO: 411280 - DNA, 25 bp, Rattus norvegicus
gcttatctagataacatccactgtg

SEQ ID NO: 411281 - DNA, 25 bp, Rattus norvegicus
gcttatctagattacatccactgtg

SEQ ID NO: 411282 - DNA, 25 bp, Rattus norvegicus
gcttatctcagaacccaaggctatt

SEQ ID NO: 411283 - DNA, 25 bp, Rattus norvegicus
gcttatctcagatcccaaggctatt

SEQ ID NO: 411284 - DNA, 25 bp, Rattus norvegicus
gcttatctctagaaaggcatgccag

SEQ ID NO: 411285 - DNA, 25 bp, Rattus norvegicus
gcttatctctagtaaggcatgccag

SEQ ID NO: 411286 - DNA, 25 bp, Rattus norvegicus
gcttatctgcagcttgtgtgacaag

SEQ ID NO: 411287 - DNA, 25 bp, Rattus norvegicus
gcttatctgcaggttgtgtgacaag

SEQ ID NO: 411288 - DNA, 25 bp, Rattus norvegicus
gcttatgacattatctcgtgccaaa

SEQ ID NO: 411289 - DNA, 25 bp, Rattus norvegicus
gcttatgacattttctcgtgccaaa

SEQ ID NO: 411290 - DNA, 25 bp, Rattus norvegicus
gcttatgagtcccattgccttgtgc

SEQ ID NO: 411291 - DNA, 25 bp, Rattus norvegicus
gcttatgagtccgattgccttgtgc

SEQ ID NO: 411292 - DNA, 25 bp, Rattus norvegicus
gcttatgagttcaataggacacagt

SEQ ID NO: 411293 - DNA, 25 bp, Rattus norvegicus
gcttatgagttctataggacacagt

SEQ ID NO: 411294 - DNA, 25 bp, Rattus norvegicus
gcttatgatcaaagccccttgggta

SEQ ID NO: 411295 - DNA, 25 bp, Rattus norvegicus
gcttatgatcaatgccccttgggta

SEQ ID NO: 411296 - DNA, 25 bp, Rattus norvegicus
gcttatgccaagaagtggttactga

SEQ ID NO: 411297 - DNA, 25 bp, Rattus norvegicus
gcttatgccaagtagtggttactga

SEQ ID NO: 411298 - DNA, 25 bp, Rattus norvegicus
gcttatgccactctttcaaacgcat

SEQ ID NO: 411299 - DNA, 25 bp, Rattus norvegicus
gcttatgccactgtttcaaacgcat

SEQ ID NO: 411300 - DNA, 25 bp, Rattus norvegicus
gcttatgcccatacatagcctggat

SEQ ID NO: 411301 - DNA, 25 bp, Rattus norvegicus
gcttatgcccattcatagcctggat

SEQ ID NO: 411302 - DNA, 25 bp, Rattus norvegicus
gcttatggcgtgctgtccatgtgca

SEQ ID NO: 411303 - DNA, 25 bp, Rattus norvegicus
gcttatggcgtggtgtccatgtgca

SEQ ID NO: 411304 - DNA, 25 bp, Rattus norvegicus
gcttatgggatacctcagtggtcat

SEQ ID NO: 411305 - DNA, 25 bp, Rattus norvegicus
gcttatgggatagctcagtggtcat

SEQ ID NO: 411306 - DNA, 25 bp, Rattus norvegicus
gcttatgggtgaagtgccagaccgt

SEQ ID NO: 411307 - DNA, 25 bp, Rattus norvegicus
gcttatgggtgatgtgccagaccgt

SEQ ID NO: 411308 - DNA, 25 bp, Rattus norvegicus
gcttatggtccacattacgcagaaa

SEQ ID NO: 411309 - DNA, 25 bp, Rattus norvegicus
gcttatggtccagattacgcagaaa

SEQ ID NO: 411310 - DNA, 25 bp, Rattus norvegicus
gcttatgtcacactgggaacccttt

SEQ ID NO: 411311 - DNA, 25 bp, Rattus norvegicus
gcttatgtcacagtgggaacccttt

SEQ ID NO: 411312 - DNA, 25 bp, Rattus norvegicus
gcttatgtctgaatgtggcctgatc

SEQ ID NO: 411313 - DNA, 25 bp, Rattus norvegicus
gcttatgtctgattgtggcctgatc

SEQ ID NO: 411314 - DNA, 25 bp, Rattus norvegicus
gcttatgtgtgaaacctgttcgttg

SEQ ID NO: 411315 - DNA, 25 bp, Rattus norvegicus
gcttatgtgtgatacctgttcgttg

SEQ ID NO: 411316 - DNA, 25 bp, Rattus norvegicus
gcttattacttaatctcagtttggt

SEQ ID NO: 411317 - DNA, 25 bp, Rattus norvegicus
gcttattacttattctcagtttggt

SEQ ID NO: 411318 - DNA, 25 bp, Rattus norvegicus
gcttattatcagcttcttttctttg

SEQ ID NO: 411319 - DNA, 25 bp, Rattus norvegicus
gcttattatcaggttcttttctttg

SEQ ID NO: 411320 - DNA, 25 bp, Rattus norvegicus
gcttattattctctaggcactgcca

SEQ ID NO: 411321 - DNA, 25 bp, Rattus norvegicus
gcttattattctgtaggcactgcca

SEQ ID NO: 411322 - DNA, 25 bp, Rattus norvegicus
gcttattcgcagctggccggcctgc

SEQ ID NO: 411323 - DNA, 25 bp, Rattus norvegicus
gcttattcgcaggtggccggcctgc

SEQ ID NO: 411324 - DNA, 25 bp, Rattus norvegicus
gcttattctattcctctttgtcgta

SEQ ID NO: 411325 - DNA, 25 bp, Rattus norvegicus
gcttattctattgctctttgtcgta

SEQ ID NO: 411326 - DNA, 25 bp, Rattus norvegicus
gcttattctgatattgctacacagt

SEQ ID NO: 411327 - DNA, 25 bp, Rattus norvegicus
gcttattctgattttgctacacagt

SEQ ID NO: 411328 - DNA, 25 bp, Rattus norvegicus
gcttattcttgaagaccagcccagt

SEQ ID NO: 411329 - DNA, 25 bp, Rattus norvegicus
gcttattcttgatgaccagcccagt

SEQ ID NO: 411330 - DNA, 25 bp, Rattus norvegicus
gcttattgcacacttgctttggaat

SEQ ID NO: 411331 - DNA, 25 bp, Rattus norvegicus
gcttattgcacagttgctttggaat

SEQ ID NO: 411332 - DNA, 25 bp, Rattus norvegicus
gcttattggccacccggagatgtcg

SEQ ID NO: 411333 - DNA, 25 bp, Rattus norvegicus
gcttattggccagccggagatgtcg

SEQ ID NO: 411334 - DNA, 25 bp, Rattus norvegicus
gcttattgtgttaacgactcctcat

SEQ ID NO: 411335 - DNA, 25 bp, Rattus norvegicus
gcttattgtgtttacgactcctcat

SEQ ID NO: 411336 - DNA, 25 bp, Rattus norvegicus
gcttattgttccaagacattgtcaa

SEQ ID NO: 411337 - DNA, 25 bp, Rattus norvegicus
gcttattgttcctagacattgtcaa

SEQ ID NO: 411338 - DNA, 25 bp, Rattus norvegicus
gcttattgttttcctagggccactg

SEQ ID NO: 411339 - DNA, 25 bp, Rattus norvegicus
gcttattgttttgctagggccactg

SEQ ID NO: 411340 - DNA, 25 bp, Rattus norvegicus
gcttatttcagcattccgtgaggct

SEQ ID NO: 411341 - DNA, 25 bp, Rattus norvegicus
gcttatttcagctttccgtgaggct

SEQ ID NO: 411342 - DNA, 25 bp, Rattus norvegicus
gcttatttccttaattgatacttta

SEQ ID NO: 411343 - DNA, 25 bp, Rattus norvegicus
gcttatttcctttattgatacttta

SEQ ID NO: 411344 - DNA, 25 bp, Rattus norvegicus
gcttatttctgtacatgatgagatc

SEQ ID NO: 411345 - DNA, 25 bp, Rattus norvegicus
gcttatttctgttcatgatgagatc

SEQ ID NO: 411346 - DNA, 25 bp, Rattus norvegicus
gcttatttgagcagggtcttgtaac

SEQ ID NO: 411347 - DNA, 25 bp, Rattus norvegicus
gcttatttgagctgggtcttgtaac

SEQ ID NO: 411348 - DNA, 25 bp, Rattus norvegicus
gcttatttgcatctatcggtgccac

SEQ ID NO: 411349 - DNA, 25 bp, Rattus norvegicus
gcttatttgcatgtatcggtgccac

SEQ ID NO: 411350 - DNA, 25 bp, Rattus norvegicus
gcttatttgggtatttcttgcacag

SEQ ID NO: 411351 - DNA, 25 bp, Rattus norvegicus
gcttatttgggtttttcttgcacag

SEQ ID NO: 411352 - DNA, 25 bp, Rattus norvegicus
gcttatttgtacaatggccttttcg

SEQ ID NO: 411353 - DNA, 25 bp, Rattus norvegicus
gcttatttgtactatggccttttcg

SEQ ID NO: 411354 - DNA, 25 bp, Rattus norvegicus
gcttatttgtttctgtgtcacttgg

SEQ ID NO: 411355 - DNA, 25 bp, Rattus norvegicus
gcttatttgtttgtgtgtcacttgg

SEQ ID NO: 411356 - DNA, 25 bp, Rattus norvegicus
gcttattttataacaaacccgccat

SEQ ID NO: 411357 - DNA, 25 bp, Rattus norvegicus
gcttattttatatcaaacccgccat

SEQ ID NO: 411358 - DNA, 25 bp, Rattus norvegicus
gcttattttggaagtgggttcggta

SEQ ID NO: 411359 - DNA, 25 bp, Rattus norvegicus
gcttattttggatgtgggttcggta

SEQ ID NO: 411360 - DNA, 25 bp, Rattus norvegicus
gcttatttttatataatgacctggg

SEQ ID NO: 411361 - DNA, 25 bp, Rattus norvegicus
gcttatttttatttaatgacctggg

SEQ ID NO: 411362 - DNA, 25 bp, Rattus norvegicus
gcttatttttgcagatggttctcgt

SEQ ID NO: 411363 - DNA, 25 bp, Rattus norvegicus
gcttatttttgctgatggttctcgt

SEQ ID NO: 411364 - DNA, 25 bp, Rattus norvegicus
gcttcaaaacagactccaaggtttc

SEQ ID NO: 411365 - DNA, 25 bp, Rattus norvegicus
gcttcaaaacagtctccaaggtttc

SEQ ID NO: 411366 - DNA, 25 bp, Rattus norvegicus
gcttcaaacccaccatagaatgctg

SEQ ID NO: 411367 - DNA, 25 bp, Rattus norvegicus
gcttcaaacccagcatagaatgctg

SEQ ID NO: 411368 - DNA, 25 bp, Rattus norvegicus
gcttcaaactccaatatcctgggat

SEQ ID NO: 411369 - DNA, 25 bp, Rattus norvegicus
gcttcaaactcctatatcctgggat

SEQ ID NO: 411370 - DNA, 25 bp, Rattus norvegicus
gcttcaaatccgacgaggttaccca

SEQ ID NO: 411371 - DNA, 25 bp, Rattus norvegicus
gcttcaaatccgtcgaggttaccca

SEQ ID NO: 411372 - DNA, 25 bp, Rattus norvegicus
gcttcaaatgggactgtctacttcg

SEQ ID NO: 411373 - DNA, 25 bp, Rattus norvegicus
gcttcaaatgggtctgtctacttcg

SEQ ID NO: 411374 - DNA, 25 bp, Rattus norvegicus
gcttcaaattcccagagatcctctt

SEQ ID NO: 411375 - DNA, 25 bp, Rattus norvegicus
gcttcaaattccgagagatcctctt

SEQ ID NO: 411376 - DNA, 25 bp, Rattus norvegicus
gcttcaacacgaatgtatttagatc

SEQ ID NO: 411377 - DNA, 25 bp, Rattus norvegicus
gcttcaacacgattgtatttagatc

SEQ ID NO: 411378 - DNA, 25 bp, Rattus norvegicus
gcttcaactgggagccttggagcaa

SEQ ID NO: 411379 - DNA, 25 bp, Rattus norvegicus
gcttcaactgggtgccttggagcaa

SEQ ID NO: 411380 - DNA, 25 bp, Rattus norvegicus
gcttcaacttcacatctcattcatc

SEQ ID NO: 411381 - DNA, 25 bp, Rattus norvegicus
gcttcaacttcagatctcattcatc

SEQ ID NO: 411382 - DNA, 25 bp, Rattus norvegicus
gcttcaagacccacctcaagagata

SEQ ID NO: 411383 - DNA, 25 bp, Rattus norvegicus
gcttcaagaccctcctcaagagata

SEQ ID NO: 411384 - DNA, 25 bp, Rattus norvegicus
gcttcaagatatcagggagggcttc

SEQ ID NO: 411385 - DNA, 25 bp, Rattus norvegicus
gcttcaagatatgagggagggcttc

SEQ ID NO: 411386 - DNA, 25 bp, Rattus norvegicus
gcttcaagattcagttagacccata

SEQ ID NO: 411387 - DNA, 25 bp, Rattus norvegicus
gcttcaagattctgttagacccata

SEQ ID NO: 411388 - DNA, 25 bp, Rattus norvegicus
gcttcaagcgagagccttctttcaa

SEQ ID NO: 411389 - DNA, 25 bp, Rattus norvegicus
gcttcaagcgagtgccttctttcaa

SEQ ID NO: 411390 - DNA, 25 bp, Rattus norvegicus
gcttcaagctgcctttgagcacaca

SEQ ID NO: 411391 - DNA, 25 bp, Rattus norvegicus
gcttcaagctgcgtttgagcacaca

SEQ ID NO: 411392 - DNA, 25 bp, Rattus norvegicus
gcttcaagctttatgtatcccattt

SEQ ID NO: 411393 - DNA, 25 bp, Rattus norvegicus
gcttcaagctttttgtatcccattt

SEQ ID NO: 411394 - DNA, 25 bp, Rattus norvegicus
gcttcaaggctcaatagctctagat

SEQ ID NO: 411395 - DNA, 25 bp, Rattus norvegicus
gcttcaaggctctatagctctagat

SEQ ID NO: 411396 - DNA, 25 bp, Rattus norvegicus
gcttcaagtacaaatctgtgctggt

SEQ ID NO: 411397 - DNA, 25 bp, Rattus norvegicus
gcttcaagtacatatctgtgctggt

SEQ ID NO: 411398 - DNA, 25 bp, Rattus norvegicus
gcttcaatggccactgctaagtaaa

SEQ ID NO: 411399 - DNA, 25 bp, Rattus norvegicus
gcttcaatggcctctgctaagtaaa

SEQ ID NO: 411400 - DNA, 25 bp, Rattus norvegicus
gcttcacaaattaggcttctgcact

SEQ ID NO: 411401 - DNA, 25 bp, Rattus norvegicus
gcttcacaaatttggcttctgcact

SEQ ID NO: 411402 - DNA, 25 bp, Rattus norvegicus
gcttcacagagcctggcaggactct

SEQ ID NO: 411403 - DNA, 25 bp, Rattus norvegicus
gcttcacagagcgtggcaggactct

SEQ ID NO: 411404 - DNA, 25 bp, Rattus norvegicus
gcttcacagtgtacttttcttctga

SEQ ID NO: 411405 - DNA, 25 bp, Rattus norvegicus
gcttcacagtgttcttttcttctga

SEQ ID NO: 411406 - DNA, 25 bp, Rattus norvegicus
gcttcacatttgatggcacacgagt

SEQ ID NO: 411407 - DNA, 25 bp, Rattus norvegicus
gcttcacatttgttggcacacgagt

SEQ ID NO: 411408 - DNA, 25 bp, Rattus norvegicus
gcttcaccaagaagtcctcattgat

SEQ ID NO: 411409 - DNA, 25 bp, Rattus norvegicus
gcttcaccaagacccagttcagtta

SEQ ID NO: 411410 - DNA, 25 bp, Rattus norvegicus
gcttcaccaagagccagttcagtta

SEQ ID NO: 411411 - DNA, 25 bp, Rattus norvegicus
gcttcaccaagatgtcctcattgat

SEQ ID NO: 411412 - DNA, 25 bp, Rattus norvegicus
gcttcaccaaggacgtgggcaacat

SEQ ID NO: 411413 - DNA, 25 bp, Rattus norvegicus
gcttcaccaaggtcgtgggcaacat

SEQ ID NO: 411414 - DNA, 25 bp, Rattus norvegicus
gcttcaccaattcattctttggcaa

SEQ ID NO: 411415 - DNA, 25 bp, Rattus norvegicus
gcttcaccaattgattctttggcaa

SEQ ID NO: 411416 - DNA, 25 bp, Rattus norvegicus
gcttcaccagccatttctttagcac

SEQ ID NO: 411417 - DNA, 25 bp, Rattus norvegicus
gcttcaccagccttttctttagcac

SEQ ID NO: 411418 - DNA, 25 bp, Rattus norvegicus
gcttcacccaggattccgacgaact

SEQ ID NO: 411419 - DNA, 25 bp, Rattus norvegicus
gcttcacccaggtttccgacgaact

SEQ ID NO: 411420 - DNA, 25 bp, Rattus norvegicus
gcttcaccgtgcagattagcttcgt

SEQ ID NO: 411421 - DNA, 25 bp, Rattus norvegicus
gcttcaccgtgctgattagcttcgt

SEQ ID NO: 411422 - DNA, 25 bp, Rattus norvegicus
gcttcacctaaaagggagggtcaca

SEQ ID NO: 411423 - DNA, 25 bp, Rattus norvegicus
gcttcacctaaatgggagggtcaca

SEQ ID NO: 411424 - DNA, 25 bp, Rattus norvegicus
gcttcacctcacagtatttacatat

SEQ ID NO: 411425 - DNA, 25 bp, Rattus norvegicus
gcttcacctcactgtatttacatat

SEQ ID NO: 411426 - DNA, 25 bp, Rattus norvegicus
gcttcacctgctatctattgcaagt

SEQ ID NO: 411427 - DNA, 25 bp, Rattus norvegicus
gcttcacctgctttctattgcaagt

SEQ ID NO: 411428 - DNA, 25 bp, Rattus norvegicus
gcttcacctggcatctagacactgt

SEQ ID NO: 411429 - DNA, 25 bp, Rattus norvegicus
gcttcacctggcttctagacactgt

SEQ ID NO: 411430 - DNA, 25 bp, Rattus norvegicus
gcttcacgactgacatcttgcagag

SEQ ID NO: 411431 - DNA, 25 bp, Rattus norvegicus
gcttcacgactgtcatcttgcagag

SEQ ID NO: 411432 - DNA, 25 bp, Rattus norvegicus
gcttcacgccgcattggaacaagaa

SEQ ID NO: 411433 - DNA, 25 bp, Rattus norvegicus
gcttcacgccgctttggaacaagaa

SEQ ID NO: 411434 - DNA, 25 bp, Rattus norvegicus
gcttcacgtacactgatttcttcta

SEQ ID NO: 411435 - DNA, 25 bp, Rattus norvegicus
gcttcacgtacagtgatttcttcta

SEQ ID NO: 411436 - DNA, 25 bp, Rattus norvegicus
gcttcacgtggccttgggaaccaac

SEQ ID NO: 411437 - DNA, 25 bp, Rattus norvegicus
gcttcacgtggcgttgggaaccaac

SEQ ID NO: 411438 - DNA, 25 bp, Rattus norvegicus
gcttcactagatattgccaactgca

SEQ ID NO: 411439 - DNA, 25 bp, Rattus norvegicus
gcttcactagattttgccaactgca

SEQ ID NO: 411440 - DNA, 25 bp, Rattus norvegicus
gcttcactcgataccttcggattca

SEQ ID NO: 411441 - DNA, 25 bp, Rattus norvegicus
gcttcactcgattccttcggattca

SEQ ID NO: 411442 - DNA, 25 bp, Rattus norvegicus
gcttcactctgtaaaggccaacacg

SEQ ID NO: 411443 - DNA, 25 bp, Rattus norvegicus
gcttcactctgttaaggccaacacg

SEQ ID NO: 411444 - DNA, 25 bp, Rattus norvegicus
gcttcactgaagagcccacttccaa

SEQ ID NO: 411445 - DNA, 25 bp, Rattus norvegicus
gcttcactgaagtgcccacttccaa

SEQ ID NO: 411446 - DNA, 25 bp, Rattus norvegicus
gcttcactggcacactgggctctaa

SEQ ID NO: 411447 - DNA, 25 bp, Rattus norvegicus
gcttcactggcagactgggctctaa

SEQ ID NO: 411448 - DNA, 25 bp, Rattus norvegicus
gcttcacttaacactctggtggttg

SEQ ID NO: 411449 - DNA, 25 bp, Rattus norvegicus
gcttcacttaactctctggtggttg

SEQ ID NO: 411450 - DNA, 25 bp, Rattus norvegicus
gcttcacttgcaccaggcgtcgcgt

SEQ ID NO: 411451 - DNA, 25 bp, Rattus norvegicus
gcttcacttgcagcaggcgtcgcgt

SEQ ID NO: 411452 - DNA, 25 bp, Rattus norvegicus
gcttcactttttctaacttaactat

SEQ ID NO: 411453 - DNA, 25 bp, Rattus norvegicus
gcttcactttttgtaacttaactat

SEQ ID NO: 411454 - DNA, 25 bp, Rattus norvegicus
gcttcagaaacacatcccaggctat

SEQ ID NO: 411455 - DNA, 25 bp, Rattus norvegicus
gcttcagaaacagatcccaggctat

SEQ ID NO: 411456 - DNA, 25 bp, Rattus norvegicus
gcttcagaacaaacccatgacacag

SEQ ID NO: 411457 - DNA, 25 bp, Rattus norvegicus
gcttcagaacaatcccatgacacag

SEQ ID NO: 411458 - DNA, 25 bp, Rattus norvegicus
gcttcagaactgctaacacagccct

SEQ ID NO: 411459 - DNA, 25 bp, Rattus norvegicus
gcttcagaactggtaacacagccct

SEQ ID NO: 411460 - DNA, 25 bp, Rattus norvegicus
gcttcagaagcaccaagcgctagac

SEQ ID NO: 411461 - DNA, 25 bp, Rattus norvegicus
gcttcagaagcagcaagcgctagac

SEQ ID NO: 411462 - DNA, 25 bp, Rattus norvegicus
gcttcagaccttcctaaatgcacag

SEQ ID NO: 411463 - DNA, 25 bp, Rattus norvegicus
gcttcagaccttgctaaatgcacag

SEQ ID NO: 411464 - DNA, 25 bp, Rattus norvegicus
gcttcagactagagacaggccctcg

SEQ ID NO: 411465 - DNA, 25 bp, Rattus norvegicus
gcttcagactagtgacaggccctcg

SEQ ID NO: 411466 - DNA, 25 bp, Rattus norvegicus
gcttcagagaagagtccgggcagta

SEQ ID NO: 411467 - DNA, 25 bp, Rattus norvegicus
gcttcagagaagtgtccgggcagta

SEQ ID NO: 411468 - DNA, 25 bp, Rattus norvegicus
gcttcagagagtcatcagtacctat

SEQ ID NO: 411469 - DNA, 25 bp, Rattus norvegicus
gcttcagagagtgatcagtacctat

SEQ ID NO: 411470 - DNA, 25 bp, Rattus norvegicus
gcttcagagctgagcatagttgtga

SEQ ID NO: 411471 - DNA, 25 bp, Rattus norvegicus
gcttcagagctgtgcatagttgtga

SEQ ID NO: 411472 - DNA, 25 bp, Rattus norvegicus
gcttcagataccatgggcgtgtgct

SEQ ID NO: 411473 - DNA, 25 bp, Rattus norvegicus
gcttcagataccttgggcgtgtgct

SEQ ID NO: 411474 - DNA, 25 bp, Rattus norvegicus
gcttcagatcccagagctcattgaa

SEQ ID NO: 411475 - DNA, 25 bp, Rattus norvegicus
gcttcagatccctgagctcattgaa

SEQ ID NO: 411476 - DNA, 25 bp, Rattus norvegicus
gcttcagcaaaaagttcttggtcat

SEQ ID NO: 411477 - DNA, 25 bp, Rattus norvegicus
gcttcagcaaaatgttcttggtcat

SEQ ID NO: 411478 - DNA, 25 bp, Rattus norvegicus
gcttcagcaacaccttcatcacaag

SEQ ID NO: 411479 - DNA, 25 bp, Rattus norvegicus
gcttcagcaacagcttcatcacaag

SEQ ID NO: 411480 - DNA, 25 bp, Rattus norvegicus
gcttcagcagctacaatggtcttat

SEQ ID NO: 411481 - DNA, 25 bp, Rattus norvegicus
gcttcagcagctccacagggatacg

SEQ ID NO: 411482 - DNA, 25 bp, Rattus norvegicus
gcttcagcagctctagccaagagtt

SEQ ID NO: 411483 - DNA, 25 bp, Rattus norvegicus
gcttcagcagctgcacagggatacg

SEQ ID NO: 411484 - DNA, 25 bp, Rattus norvegicus
gcttcagcagctgtagccaagagtt

SEQ ID NO: 411485 - DNA, 25 bp, Rattus norvegicus
gcttcagcagcttcaatggtcttat

SEQ ID NO: 411486 - DNA, 25 bp, Rattus norvegicus
gcttcagcagtacagccacgaatca

SEQ ID NO: 411487 - DNA, 25 bp, Rattus norvegicus
gcttcagcagtacaggcagcagatt

SEQ ID NO: 411488 - DNA, 25 bp, Rattus norvegicus
gcttcagcagtagagccacgaatca

SEQ ID NO: 411489 - DNA, 25 bp, Rattus norvegicus
gcttcagcagtagaggcagcagatt

SEQ ID NO: 411490 - DNA, 25 bp, Rattus norvegicus
gcttcagccagtactacagggatga

SEQ ID NO: 411491 - DNA, 25 bp, Rattus norvegicus
gcttcagccagttctacagggatga

SEQ ID NO: 411492 - DNA, 25 bp, Rattus norvegicus
gcttcagcccggaggacgcagtcga

SEQ ID NO: 411493 - DNA, 25 bp, Rattus norvegicus
gcttcagcccggtggacgcagtcga

SEQ ID NO: 411494 - DNA, 25 bp, Rattus norvegicus
gcttcagcgactccgagagtgcaga

SEQ ID NO: 411495 - DNA, 25 bp, Rattus norvegicus
gcttcagcgactgcgagagtgcaga

SEQ ID NO: 411496 - DNA, 25 bp, Rattus norvegicus
gcttcagctctaccagaatcatcat

SEQ ID NO: 411497 - DNA, 25 bp, Rattus norvegicus
gcttcagctctagcagaatcatcat

SEQ ID NO: 411498 - DNA, 25 bp, Rattus norvegicus
gcttcagctgaacagcctgggcagt

SEQ ID NO: 411499 - DNA, 25 bp, Rattus norvegicus
gcttcagctgaagagcctgggcagt

SEQ ID NO: 411500 - DNA, 25 bp, Rattus norvegicus
gcttcaggcatcaggacagctattt

SEQ ID NO: 411501 - DNA, 25 bp, Rattus norvegicus
gcttcaggcatctggacagctattt

SEQ ID NO: 411502 - DNA, 25 bp, Rattus norvegicus
gcttcaggctctccaagatgtaaaa

SEQ ID NO: 411503 - DNA, 25 bp, Rattus norvegicus
gcttcaggctctgcaagatgtaaaa

SEQ ID NO: 411504 - DNA, 25 bp, Rattus norvegicus
gcttcagggaacaatgctgggcctg

SEQ ID NO: 411505 - DNA, 25 bp, Rattus norvegicus
gcttcagggaactatgctgggcctg

SEQ ID NO: 411506 - DNA, 25 bp, Rattus norvegicus
gcttcagggaagaagtgtctccttt

SEQ ID NO: 411507 - DNA, 25 bp, Rattus norvegicus
gcttcagggaagtagtgtctccttt

SEQ ID NO: 411508 - DNA, 25 bp, Rattus norvegicus
gcttcagggtcacagcctgatccat

SEQ ID NO: 411509 - DNA, 25 bp, Rattus norvegicus
gcttcagggtcagagcctgatccat

SEQ ID NO: 411510 - DNA, 25 bp, Rattus norvegicus
gcttcaggtgtaactagaagaccct

SEQ ID NO: 411511 - DNA, 25 bp, Rattus norvegicus
gcttcaggtgtatctagaagaccct

SEQ ID NO: 411512 - DNA, 25 bp, Rattus norvegicus
gcttcagtaagtatcggctctctta

SEQ ID NO: 411513 - DNA, 25 bp, Rattus norvegicus
gcttcagtaagtttcggctctctta

SEQ ID NO: 411514 - DNA, 25 bp, Rattus norvegicus
gcttcagtcaaacctcaaggagaag

SEQ ID NO: 411515 - DNA, 25 bp, Rattus norvegicus
gcttcagtcaaagctcaaggagaag

SEQ ID NO: 411516 - DNA, 25 bp, Rattus norvegicus
gcttcagtctgacctgttggtatgc

SEQ ID NO: 411517 - DNA, 25 bp, Rattus norvegicus
gcttcagtctgagctgttggtatgc

SEQ ID NO: 411518 - DNA, 25 bp, Rattus norvegicus
gcttcagtctgtctactgtggtgat

SEQ ID NO: 411519 - DNA, 25 bp, Rattus norvegicus
gcttcagtctgtgtactgtggtgat

SEQ ID NO: 411520 - DNA, 25 bp, Rattus norvegicus
gcttcagtgaagagactcgtggtgt

SEQ ID NO: 411521 - DNA, 25 bp, Rattus norvegicus
gcttcagtgaagtgactcgtggtgt

SEQ ID NO: 411522 - DNA, 25 bp, Rattus norvegicus
gcttcagtggtaatctggtgcccat

SEQ ID NO: 411523 - DNA, 25 bp, Rattus norvegicus
gcttcagtggtattctggtgcccat

SEQ ID NO: 411524 - DNA, 25 bp, Rattus norvegicus
gcttcagttcagaggctagccagct

SEQ ID NO: 411525 - DNA, 25 bp, Rattus norvegicus
gcttcagttcagtggctagccagct

SEQ ID NO: 411526 - DNA, 25 bp, Rattus norvegicus
gcttcatacatcatgggcggagcca

SEQ ID NO: 411527 - DNA, 25 bp, Rattus norvegicus
gcttcatacatcttgggcggagcca

SEQ ID NO: 411528 - DNA, 25 bp, Rattus norvegicus
gcttcatactttcacaaccaactaa

SEQ ID NO: 411529 - DNA, 25 bp, Rattus norvegicus
gcttcatactttgacaaccaactaa

SEQ ID NO: 411530 - DNA, 25 bp, Rattus norvegicus
gcttcatagattagctactggtgat

SEQ ID NO: 411531 - DNA, 25 bp, Rattus norvegicus
gcttcatagatttgctactggtgat

SEQ ID NO: 411532 - DNA, 25 bp, Rattus norvegicus
gcttcatagtggcatcctcttgcaa

SEQ ID NO: 411533 - DNA, 25 bp, Rattus norvegicus
gcttcatagtgggatcctcttgcaa

SEQ ID NO: 411534 - DNA, 25 bp, Rattus norvegicus
gcttcatattggaacctttgacctt

SEQ ID NO: 411535 - DNA, 25 bp, Rattus norvegicus
gcttcatattggtacctttgacctt

SEQ ID NO: 411536 - DNA, 25 bp, Rattus norvegicus
gcttcatattgtcctgctgatggaa

SEQ ID NO: 411537 - DNA, 25 bp, Rattus norvegicus
gcttcatattgtgctgctgatggaa

SEQ ID NO: 411538 - DNA, 25 bp, Rattus norvegicus
gcttcatcaaagaaggcaatgccga

SEQ ID NO: 411539 - DNA, 25 bp, Rattus norvegicus
gcttcatcaaagtaggcaatgccga

SEQ ID NO: 411540 - DNA, 25 bp, Rattus norvegicus
gcttcatcactgaggacgaggttga

SEQ ID NO: 411541 - DNA, 25 bp, Rattus norvegicus
gcttcatcactgtggacgaggttga

SEQ ID NO: 411542 - DNA, 25 bp, Rattus norvegicus
gcttcatcagatattttccagtttc

SEQ ID NO: 411543 - DNA, 25 bp, Rattus norvegicus
gcttcatcagattttttccagtttc

SEQ ID NO: 411544 - DNA, 25 bp, Rattus norvegicus
gcttcatcagcgacactggcaagat

SEQ ID NO: 411545 - DNA, 25 bp, Rattus norvegicus
gcttcatcagcgtcactggcaagat

SEQ ID NO: 411546 - DNA, 25 bp, Rattus norvegicus
gcttcatctgtcacacaggctggat

SEQ ID NO: 411547 - DNA, 25 bp, Rattus norvegicus
gcttcatctgtctcacaggctggat

SEQ ID NO: 411548 - DNA, 25 bp, Rattus norvegicus
gcttcatctgtgaattcagtcccgg

SEQ ID NO: 411549 - DNA, 25 bp, Rattus norvegicus
gcttcatctgtgtattcagtcccgg

SEQ ID NO: 411550 - DNA, 25 bp, Rattus norvegicus
gcttcatctttgaccatgtgttcgt

SEQ ID NO: 411551 - DNA, 25 bp, Rattus norvegicus
gcttcatctttgtccatgtgttcgt

SEQ ID NO: 411552 - DNA, 25 bp, Rattus norvegicus
gcttcatgcattatggatcccgacc

SEQ ID NO: 411553 - DNA, 25 bp, Rattus norvegicus
gcttcatgcattatttatctcgacc

SEQ ID NO: 411554 - DNA, 25 bp, Rattus norvegicus
gcttcatgcattttggatcccgacc

SEQ ID NO: 411555 - DNA, 25 bp, Rattus norvegicus
gcttcatgcattttttatctcgacc

SEQ ID NO: 411556 - DNA, 25 bp, Rattus norvegicus
gcttcatggacgatattgcctgtat

SEQ ID NO: 411557 - DNA, 25 bp, Rattus norvegicus
gcttcatggacgttattgcctgtat

SEQ ID NO: 411558 - DNA, 25 bp, Rattus norvegicus
gcttcatggtgcagtgggtagaact

SEQ ID NO: 411559 - DNA, 25 bp, Rattus norvegicus
gcttcatggtgctgtgggtagaact

SEQ ID NO: 411560 - DNA, 25 bp, Rattus norvegicus
gcttcatggttcctgaatcccagag

SEQ ID NO: 411561 - DNA, 25 bp, Rattus norvegicus
gcttcatggttcgtgaatcccagag

SEQ ID NO: 411562 - DNA, 25 bp, Rattus norvegicus
gcttcatgtcccagatagtcattat

SEQ ID NO: 411563 - DNA, 25 bp, Rattus norvegicus
gcttcatgtccctgatagtcattat

SEQ ID NO: 411564 - DNA, 25 bp, Rattus norvegicus
gcttcatgtgatcgagcgtcttctc

SEQ ID NO: 411565 - DNA, 25 bp, Rattus norvegicus
gcttcatgtgatggagcgtcttctc

SEQ ID NO: 411566 - DNA, 25 bp, Rattus norvegicus
gcttcatgtgttcttggcctggatc

SEQ ID NO: 411567 - DNA, 25 bp, Rattus norvegicus
gcttcatgtgttgttggcctggatc

SEQ ID NO: 411568 - DNA, 25 bp, Rattus norvegicus
gcttcattaagcacttttcacagta

SEQ ID NO: 411569 - DNA, 25 bp, Rattus norvegicus
gcttcattaagctcttttcacagta

SEQ ID NO: 411570 - DNA, 25 bp, Rattus norvegicus
gcttcattagtaccaatgcctgagg

SEQ ID NO: 411571 - DNA, 25 bp, Rattus norvegicus
gcttcattagtagcaatgcctgagg

SEQ ID NO: 411572 - DNA, 25 bp, Rattus norvegicus
gcttcattatttattactaccctca

SEQ ID NO: 411573 - DNA, 25 bp, Rattus norvegicus
gcttcattattttttactaccctca

SEQ ID NO: 411574 - DNA, 25 bp, Rattus norvegicus
gcttcattcattacaatcaaccaaa

SEQ ID NO: 411575 - DNA, 25 bp, Rattus norvegicus
gcttcattcatttcaatcaaccaaa

SEQ ID NO: 411576 - DNA, 25 bp, Rattus norvegicus
gcttcattcctaagcaagacaggta

SEQ ID NO: 411577 - DNA, 25 bp, Rattus norvegicus
gcttcattcctatgcaagacaggta

SEQ ID NO: 411578 - DNA, 25 bp, Rattus norvegicus
gcttcattcctcaggtccctaacag

SEQ ID NO: 411579 - DNA, 25 bp, Rattus norvegicus
gcttcattcctctggtccctaacag

SEQ ID NO: 411580 - DNA, 25 bp, Rattus norvegicus
gcttcattcctgatcacatctgaga

SEQ ID NO: 411581 - DNA, 25 bp, Rattus norvegicus
gcttcattcctgttcacatctgaga

SEQ ID NO: 411582 - DNA, 25 bp, Rattus norvegicus
gcttcattgatcaggccccagtggt

SEQ ID NO: 411583 - DNA, 25 bp, Rattus norvegicus
gcttcattgatctggccccagtggt

SEQ ID NO: 411584 - DNA, 25 bp, Rattus norvegicus
gcttcattgcttcagtataaaccct

SEQ ID NO: 411585 - DNA, 25 bp, Rattus norvegicus
gcttcattgcttgagtataaaccct

SEQ ID NO: 411586 - DNA, 25 bp, Rattus norvegicus
gcttcattgtttctgcagaggccag

SEQ ID NO: 411587 - DNA, 25 bp, Rattus norvegicus
gcttcattgtttgtgcagaggccag

SEQ ID NO: 411588 - DNA, 25 bp, Rattus norvegicus
gcttcatttggtacagtctgcttca

SEQ ID NO: 411589 - DNA, 25 bp, Rattus norvegicus
gcttcatttggttcagtctgcttca

SEQ ID NO: 411590 - DNA, 25 bp, Rattus norvegicus
gcttcatttgtacctcaaatctcta

SEQ ID NO: 411591 - DNA, 25 bp, Rattus norvegicus
gcttcatttgtaccttaccagcagg

SEQ ID NO: 411592 - DNA, 25 bp, Rattus norvegicus
gcttcatttgtagctcaaatctcta

SEQ ID NO: 411593 - DNA, 25 bp, Rattus norvegicus
gcttcatttgtagcttaccagcagg

SEQ ID NO: 411594 - DNA, 25 bp, Rattus norvegicus
gcttcatttttgctgtgctttaaag

SEQ ID NO: 411595 - DNA, 25 bp, Rattus norvegicus
gcttcatttttggtgtgctttaaag

SEQ ID NO: 411596 - DNA, 25 bp, Rattus norvegicus
gcttccaacagtaaaacttttccag

SEQ ID NO: 411597 - DNA, 25 bp, Rattus norvegicus
gcttccaacagttaaacttttccag

SEQ ID NO: 411598 - DNA, 25 bp, Rattus norvegicus
gcttccaaccacagaactttaccag

SEQ ID NO: 411599 - DNA, 25 bp, Rattus norvegicus
gcttccaaccactgaactttaccag

SEQ ID NO: 411600 - DNA, 25 bp, Rattus norvegicus
gcttccaaccctatcatgggtactt

SEQ ID NO: 411601 - DNA, 25 bp, Rattus norvegicus
gcttccaaccctttcatgggtactt

SEQ ID NO: 411602 - DNA, 25 bp, Rattus norvegicus
gcttccaagaggactgtcactgtgg

SEQ ID NO: 411603 - DNA, 25 bp, Rattus norvegicus
gcttccaagaggtctgtcactgtgg

SEQ ID NO: 411604 - DNA, 25 bp, Rattus norvegicus
gcttccaagtggagtccctgatgaa

SEQ ID NO: 411605 - DNA, 25 bp, Rattus norvegicus
gcttccaagtggtgtccctgatgaa

SEQ ID NO: 411606 - DNA, 25 bp, Rattus norvegicus
gcttccaatttaatactttcagggt

SEQ ID NO: 411607 - DNA, 25 bp, Rattus norvegicus
gcttccaatttattactttcagggt

SEQ ID NO: 411608 - DNA, 25 bp, Rattus norvegicus
gcttccacaaccagtcggagctcaa

SEQ ID NO: 411609 - DNA, 25 bp, Rattus norvegicus
gcttccacaacctgtcggagctcaa

SEQ ID NO: 411610 - DNA, 25 bp, Rattus norvegicus
gcttccacaagccagagttcacagg

SEQ ID NO: 411611 - DNA, 25 bp, Rattus norvegicus
gcttccacaagcgagagttcacagg

SEQ ID NO: 411612 - DNA, 25 bp, Rattus norvegicus
gcttccacaaggaccaggcatgtat

SEQ ID NO: 411613 - DNA, 25 bp, Rattus norvegicus
gcttccacaaggtccaggcatgtat

SEQ ID NO: 411614 - DNA, 25 bp, Rattus norvegicus
gcttccacagctacgtgactgtaga

SEQ ID NO: 411615 - DNA, 25 bp, Rattus norvegicus
gcttccacagcttcgtgactgtaga

SEQ ID NO: 411616 - DNA, 25 bp, Rattus norvegicus
gcttccacatatattttcttaccta

SEQ ID NO: 411617 - DNA, 25 bp, Rattus norvegicus
gcttccacatattttttcttaccta

SEQ ID NO: 411618 - DNA, 25 bp, Rattus norvegicus
gcttccaccaaaactctgtatttcg

SEQ ID NO: 411619 - DNA, 25 bp, Rattus norvegicus
gcttccaccaaatctctgtatttcg

SEQ ID NO: 411620 - DNA, 25 bp, Rattus norvegicus
gcttccaccaagatcaaactctgta

SEQ ID NO: 411621 - DNA, 25 bp, Rattus norvegicus
gcttccaccaagttcaaactctgta

SEQ ID NO: 411622 - DNA, 25 bp, Rattus norvegicus
gcttccaccaggcaggcttttatgt

SEQ ID NO: 411623 - DNA, 25 bp, Rattus norvegicus
gcttccaccagggaggcttttatgt

SEQ ID NO: 411624 - DNA, 25 bp, Rattus norvegicus
gcttccaccatcagtgacttcagtt

SEQ ID NO: 411625 - DNA, 25 bp, Rattus norvegicus
gcttccaccatctgtgacttcagtt

SEQ ID NO: 411626 - DNA, 25 bp, Rattus norvegicus
gcttccacgaacatgtagtccgttt

SEQ ID NO: 411627 - DNA, 25 bp, Rattus norvegicus
gcttccacgaacttgtagtccgttt

SEQ ID NO: 411628 - DNA, 25 bp, Rattus norvegicus
gcttccacggttatagagatgcaca

SEQ ID NO: 411629 - DNA, 25 bp, Rattus norvegicus
gcttccacggttttagagatgcaca

SEQ ID NO: 411630 - DNA, 25 bp, Rattus norvegicus
gcttccacgtcacccaaagtgttaa

SEQ ID NO: 411631 - DNA, 25 bp, Rattus norvegicus
gcttccacgtcagccaaagtgttaa

SEQ ID NO: 411632 - DNA, 25 bp, Rattus norvegicus
gcttccactgtgatcttcaattaaa

SEQ ID NO: 411633 - DNA, 25 bp, Rattus norvegicus
gcttccactgtgttcttcaattaaa

SEQ ID NO: 411634 - DNA, 25 bp, Rattus norvegicus
gcttccagaaacaagggccttgcac

SEQ ID NO: 411635 - DNA, 25 bp, Rattus norvegicus
gcttccagaaactagggccttgcac

SEQ ID NO: 411636 - DNA, 25 bp, Rattus norvegicus
gcttccagaagcagcgcatgcgtaa

SEQ ID NO: 411637 - DNA, 25 bp, Rattus norvegicus
gcttccagaagctgcgcatgcgtaa

SEQ ID NO: 411638 - DNA, 25 bp, Rattus norvegicus
gcttccagagacatccatgaggtgt

SEQ ID NO: 411639 - DNA, 25 bp, Rattus norvegicus
gcttccagagacttccatgaggtgt

SEQ ID NO: 411640 - DNA, 25 bp, Rattus norvegicus
gcttccagagcgacacaaaattcag

SEQ ID NO: 411641 - DNA, 25 bp, Rattus norvegicus
gcttccagagcgtcacaaaattcag

SEQ ID NO: 411642 - DNA, 25 bp, Rattus norvegicus
gcttccagcctgcttcaggtgtaga

SEQ ID NO: 411643 - DNA, 25 bp, Rattus norvegicus
gcttccagcctggttcaggtgtaga

SEQ ID NO: 411644 - DNA, 25 bp, Rattus norvegicus
gcttccagccttcgtgaaacctaga

SEQ ID NO: 411645 - DNA, 25 bp, Rattus norvegicus
gcttccagccttggtgaaacctaga

SEQ ID NO: 411646 - DNA, 25 bp, Rattus norvegicus
gcttccagctgcaccaaacatgaga

SEQ ID NO: 411647 - DNA, 25 bp, Rattus norvegicus
gcttccagctgctccaaacatgaga

SEQ ID NO: 411648 - DNA, 25 bp, Rattus norvegicus
gcttccaggacaaagtctgaggcaa

SEQ ID NO: 411649 - DNA, 25 bp, Rattus norvegicus
gcttccaggacatagtctgaggcaa

SEQ ID NO: 411650 - DNA, 25 bp, Rattus norvegicus
gcttccaggcccaagagtgaacagt

SEQ ID NO: 411651 - DNA, 25 bp, Rattus norvegicus
gcttccaggccctagagtgaacagt

SEQ ID NO: 411652 - DNA, 25 bp, Rattus norvegicus
gcttccagggctcaggtgcaattct

SEQ ID NO: 411653 - DNA, 25 bp, Rattus norvegicus
gcttccagggctgaggtgcaattct

SEQ ID NO: 411654 - DNA, 25 bp, Rattus norvegicus
gcttccagtaatattgttcattctt

SEQ ID NO: 411655 - DNA, 25 bp, Rattus norvegicus
gcttccagtaattttgttcattctt

SEQ ID NO: 411656 - DNA, 25 bp, Rattus norvegicus
gcttccagtgagcacttcatttttc

SEQ ID NO: 411657 - DNA, 25 bp, Rattus norvegicus
gcttccagtgaggacttcatttttc

SEQ ID NO: 411658 - DNA, 25 bp, Rattus norvegicus
gcttccagtgcccttgccagagttc

SEQ ID NO: 411659 - DNA, 25 bp, Rattus norvegicus
gcttccagtgccgttgccagagttc

SEQ ID NO: 411660 - DNA, 25 bp, Rattus norvegicus
gcttccagtgcgagaatcttcgtga

SEQ ID NO: 411661 - DNA, 25 bp, Rattus norvegicus
gcttccagtgcgtgaatcttcgtga

SEQ ID NO: 411662 - DNA, 25 bp, Rattus norvegicus
gcttccataaggcagtctcaggagg

SEQ ID NO: 411663 - DNA, 25 bp, Rattus norvegicus
gcttccataagggagtctcaggagg

SEQ ID NO: 411664 - DNA, 25 bp, Rattus norvegicus
gcttccatagcaaagggtgtatctc

SEQ ID NO: 411665 - DNA, 25 bp, Rattus norvegicus
gcttccatagcatagggtgtatctc

SEQ ID NO: 411666 - DNA, 25 bp, Rattus norvegicus
gcttccatcactaaggagcctggtc

SEQ ID NO: 411667 - DNA, 25 bp, Rattus norvegicus
gcttccatcacttaggagcctggtc

SEQ ID NO: 411668 - DNA, 25 bp, Rattus norvegicus
gcttccatccatactccagagaatc

SEQ ID NO: 411669 - DNA, 25 bp, Rattus norvegicus
gcttccatccattctccagagaatc

SEQ ID NO: 411670 - DNA, 25 bp, Rattus norvegicus
gcttccatgaagctcctggatgttt

SEQ ID NO: 411671 - DNA, 25 bp, Rattus norvegicus
gcttccatgaaggtcctggatgttt

SEQ ID NO: 411672 - DNA, 25 bp, Rattus norvegicus
gcttccatggcaaccttaagggttt

SEQ ID NO: 411673 - DNA, 25 bp, Rattus norvegicus
gcttccatggcatccttaagggttt

SEQ ID NO: 411674 - DNA, 25 bp, Rattus norvegicus
gcttccatgttgaatcttttgccat

SEQ ID NO: 411675 - DNA, 25 bp, Rattus norvegicus
gcttccatgttgtatcttttgccat

SEQ ID NO: 411676 - DNA, 25 bp, Rattus norvegicus
gcttccattggccagatgtgcacta

SEQ ID NO: 411677 - DNA, 25 bp, Rattus norvegicus
gcttccattggcgagatgtgcacta

SEQ ID NO: 411678 - DNA, 25 bp, Rattus norvegicus
gcttccatttctcagtgcattgtgc

SEQ ID NO: 411679 - DNA, 25 bp, Rattus norvegicus
gcttccatttctgagtgcattgtgc

SEQ ID NO: 411680 - DNA, 25 bp, Rattus norvegicus
gcttcccaaacgaacctgttgagta

SEQ ID NO: 411681 - DNA, 25 bp, Rattus norvegicus
gcttcccaaacgtacctgttgagta

SEQ ID NO: 411682 - DNA, 25 bp, Rattus norvegicus
gcttcccaaatgaaggcttctgttg

SEQ ID NO: 411683 - DNA, 25 bp, Rattus norvegicus
gcttcccaaatgattccggcattag

SEQ ID NO: 411684 - DNA, 25 bp, Rattus norvegicus
gcttcccaaatgtaggcttctgttg

SEQ ID NO: 411685 - DNA, 25 bp, Rattus norvegicus
gcttcccaaatgtttccggcattag

SEQ ID NO: 411686 - DNA, 25 bp, Rattus norvegicus
gcttcccaacttattggtcgcgtag

SEQ ID NO: 411687 - DNA, 25 bp, Rattus norvegicus
gcttcccaactttttggtcgcgtag

SEQ ID NO: 411688 - DNA, 25 bp, Rattus norvegicus
gcttcccaagaacttaattcctcgt

SEQ ID NO: 411689 - DNA, 25 bp, Rattus norvegicus
gcttcccaagaagttaattcctcgt

SEQ ID NO: 411690 - DNA, 25 bp, Rattus norvegicus
gcttcccaagctagagtggatggct

SEQ ID NO: 411691 - DNA, 25 bp, Rattus norvegicus
gcttcccaagcttgagtggatggct

SEQ ID NO: 411692 - DNA, 25 bp, Rattus norvegicus
gcttcccaatgcctggatttgatga

SEQ ID NO: 411693 - DNA, 25 bp, Rattus norvegicus
gcttcccaatgcgtggatttgatga

SEQ ID NO: 411694 - DNA, 25 bp, Rattus norvegicus
gcttcccacactctctgtgtagtga

SEQ ID NO: 411695 - DNA, 25 bp, Rattus norvegicus
gcttcccacactgtctgtgtagtga

SEQ ID NO: 411696 - DNA, 25 bp, Rattus norvegicus
gcttcccacgacctttccatagaga

SEQ ID NO: 411697 - DNA, 25 bp, Rattus norvegicus
gcttcccacgacgtttccatagaga

SEQ ID NO: 411698 - DNA, 25 bp, Rattus norvegicus
gcttcccactttcctattttatctt

SEQ ID NO: 411699 - DNA, 25 bp, Rattus norvegicus
gcttcccactttgctattttatctt

SEQ ID NO: 411700 - DNA, 25 bp, Rattus norvegicus
gcttcccagtacatgttcttactaa

SEQ ID NO: 411701 - DNA, 25 bp, Rattus norvegicus
gcttcccagtacttgttcttactaa

SEQ ID NO: 411702 - DNA, 25 bp, Rattus norvegicus
gcttcccagttaccaatagcttgaa

SEQ ID NO: 411703 - DNA, 25 bp, Rattus norvegicus
gcttcccagttagcaatagcttgaa

SEQ ID NO: 411704 - DNA, 25 bp, Rattus norvegicus
gcttcccagttgcttttggactgca

SEQ ID NO: 411705 - DNA, 25 bp, Rattus norvegicus
gcttcccagttggttttggactgca

SEQ ID NO: 411706 - DNA, 25 bp, Rattus norvegicus
gcttcccattctcccgtgaaatgta

SEQ ID NO: 411707 - DNA, 25 bp, Rattus norvegicus
gcttcccattctgccgtgaaatgta

SEQ ID NO: 411708 - DNA, 25 bp, Rattus norvegicus
gcttccccaagtaccaatggtgctt

SEQ ID NO: 411709 - DNA, 25 bp, Rattus norvegicus
gcttccccaagttccaatggtgctt

SEQ ID NO: 411710 - DNA, 25 bp, Rattus norvegicus
gcttccccacacaagatgagatctg

SEQ ID NO: 411711 - DNA, 25 bp, Rattus norvegicus
gcttccccacactagatgagatctg

SEQ ID NO: 411712 - DNA, 25 bp, Rattus norvegicus
gcttccccagcacaggaggttgtag

SEQ ID NO: 411713 - DNA, 25 bp, Rattus norvegicus
gcttccccagcacattatgctatgt

SEQ ID NO: 411714 - DNA, 25 bp, Rattus norvegicus
gcttccccagcagaggaggttgtag

SEQ ID NO: 411715 - DNA, 25 bp, Rattus norvegicus
gcttccccagcagattatgctatgt

SEQ ID NO: 411716 - DNA, 25 bp, Rattus norvegicus
gcttcccgcatgcaagtgtccagaa

SEQ ID NO: 411717 - DNA, 25 bp, Rattus norvegicus
gcttcccgcatggaagtgtccagaa

SEQ ID NO: 411718 - DNA, 25 bp, Rattus norvegicus
gcttcccggaggagctgggttcttc

SEQ ID NO: 411719 - DNA, 25 bp, Rattus norvegicus
gcttcccggaggtgctgggttcttc

SEQ ID NO: 411720 - DNA, 25 bp, Rattus norvegicus
gcttcccggcggagggctatatagc

SEQ ID NO: 411721 - DNA, 25 bp, Rattus norvegicus
gcttcccggcggtgggctatatagc

SEQ ID NO: 411722 - DNA, 25 bp, Rattus norvegicus
gcttcccgggtactggctctcaggc

SEQ ID NO: 411723 - DNA, 25 bp, Rattus norvegicus
gcttcccgggtagtggctctcaggc

SEQ ID NO: 411724 - DNA, 25 bp, Rattus norvegicus
gcttcccgtcacaagcttgaatatt

SEQ ID NO: 411725 - DNA, 25 bp, Rattus norvegicus
gcttcccgtcactagcttgaatatt

SEQ ID NO: 411726 - DNA, 25 bp, Rattus norvegicus
gcttcccgtgccacaagaaggcgga

SEQ ID NO: 411727 - DNA, 25 bp, Rattus norvegicus
gcttcccgtgcctcaagaaggcgga

SEQ ID NO: 411728 - DNA, 25 bp, Rattus norvegicus
gcttccctaagtccaggagcttgaa

SEQ ID NO: 411729 - DNA, 25 bp, Rattus norvegicus
gcttccctaagtgcaggagcttgaa

SEQ ID NO: 411730 - DNA, 25 bp, Rattus norvegicus
gcttccctcactattcttattaatt

SEQ ID NO: 411731 - DNA, 25 bp, Rattus norvegicus
gcttccctcacttttcttattaatt

SEQ ID NO: 411732 - DNA, 25 bp, Rattus norvegicus
gcttccctcattcgtgctcctttgg

SEQ ID NO: 411733 - DNA, 25 bp, Rattus norvegicus
gcttccctcattggtgctcctttgg

SEQ ID NO: 411734 - DNA, 25 bp, Rattus norvegicus
gcttccctccttcataacattagtg

SEQ ID NO: 411735 - DNA, 25 bp, Rattus norvegicus
gcttccctccttgataacattagtg

SEQ ID NO: 411736 - DNA, 25 bp, Rattus norvegicus
gcttccctcggaaacacagtattta

SEQ ID NO: 411737 - DNA, 25 bp, Rattus norvegicus
gcttccctcggatacacagtattta

SEQ ID NO: 411738 - DNA, 25 bp, Rattus norvegicus
gcttccctctgacactttgttgaga

SEQ ID NO: 411739 - DNA, 25 bp, Rattus norvegicus
gcttccctctgagactttgttgaga

SEQ ID NO: 411740 - DNA, 25 bp, Rattus norvegicus
gcttccctgacaaaagatgccggtg

SEQ ID NO: 411741 - DNA, 25 bp, Rattus norvegicus
gcttccctgacataagatgccggtg

SEQ ID NO: 411742 - DNA, 25 bp, Rattus norvegicus
gcttccctgagcatgagtttataaa

SEQ ID NO: 411743 - DNA, 25 bp, Rattus norvegicus
gcttccctgagcttgagtttataaa

SEQ ID NO: 411744 - DNA, 25 bp, Rattus norvegicus
gcttccctgcagatcgttgtgacaa

SEQ ID NO: 411745 - DNA, 25 bp, Rattus norvegicus
gcttccctgcagttcgttgtgacaa

SEQ ID NO: 411746 - DNA, 25 bp, Rattus norvegicus
gcttccctgtgtcatgttgaacaag

SEQ ID NO: 411747 - DNA, 25 bp, Rattus norvegicus
gcttccctgtgtgatgttgaacaag

SEQ ID NO: 411748 - DNA, 25 bp, Rattus norvegicus
gcttcccttatgagcaccatgtgtg

SEQ ID NO: 411749 - DNA, 25 bp, Rattus norvegicus
gcttcccttatgtgcaccatgtgtg

SEQ ID NO: 411750 - DNA, 25 bp, Rattus norvegicus
gcttccgacctcaggtcattgagaa

SEQ ID NO: 411751 - DNA, 25 bp, Rattus norvegicus
gcttccgacctctggtcattgagaa

SEQ ID NO: 411752 - DNA, 25 bp, Rattus norvegicus
gcttccgactcactaggaggctgat

SEQ ID NO: 411753 - DNA, 25 bp, Rattus norvegicus
gcttccgactcagtaggaggctgat

SEQ ID NO: 411754 - DNA, 25 bp, Rattus norvegicus
gcttccgagaagacctaccagtgag

SEQ ID NO: 411755 - DNA, 25 bp, Rattus norvegicus
gcttccgagaagtcctaccagtgag

SEQ ID NO: 411756 - DNA, 25 bp, Rattus norvegicus
gcttccgaggcaataggcgtacaat

SEQ ID NO: 411757 - DNA, 25 bp, Rattus norvegicus
gcttccgaggcattaggcgtacaat

SEQ ID NO: 411758 - DNA, 25 bp, Rattus norvegicus
gcttccgagtccaacagagtgcact

SEQ ID NO: 411759 - DNA, 25 bp, Rattus norvegicus
gcttccgagtcctacagagtgcact

SEQ ID NO: 411760 - DNA, 25 bp, Rattus norvegicus
gcttccgagtgcacagaactgccaa

SEQ ID NO: 411761 - DNA, 25 bp, Rattus norvegicus
gcttccgagtgctcagaactgccaa

SEQ ID NO: 411762 - DNA, 25 bp, Rattus norvegicus
gcttccgatagcaaggatgcttctc

SEQ ID NO: 411763 - DNA, 25 bp, Rattus norvegicus
gcttccgatagctaggatgcttctc

SEQ ID NO: 411764 - DNA, 25 bp, Rattus norvegicus
gcttccgcaaaaacttccaggcttt

SEQ ID NO: 411765 - DNA, 25 bp, Rattus norvegicus
gcttccgcaaaatcttccaggcttt

SEQ ID NO: 411766 - DNA, 25 bp, Rattus norvegicus
gcttccgcaacgactatgctgaaat

SEQ ID NO: 411767 - DNA, 25 bp, Rattus norvegicus
gcttccgcaacgtctatgctgaaat

SEQ ID NO: 411768 - DNA, 25 bp, Rattus norvegicus
gcttccgccgagaggatatcgacga

SEQ ID NO: 411769 - DNA, 25 bp, Rattus norvegicus
gcttccgccgagtggatatcgacga

SEQ ID NO: 411770 - DNA, 25 bp, Rattus norvegicus
gcttccgcctccagaacagtaagtg

SEQ ID NO: 411771 - DNA, 25 bp, Rattus norvegicus
gcttccgcctcctgaacagtaagtg

SEQ ID NO: 411772 - DNA, 25 bp, Rattus norvegicus
gcttccgcgaaaacgactcttgctg

SEQ ID NO: 411773 - DNA, 25 bp, Rattus norvegicus
gcttccgcgaaatcgactcttgctg

SEQ ID NO: 411774 - DNA, 25 bp, Rattus norvegicus
gcttccgcgctcacctgaggcaggg

SEQ ID NO: 411775 - DNA, 25 bp, Rattus norvegicus
gcttccgcgctctcctgaggcaggg

SEQ ID NO: 411776 - DNA, 25 bp, Rattus norvegicus
gcttccgcgtccctcaagaacgttg

SEQ ID NO: 411777 - DNA, 25 bp, Rattus norvegicus
gcttccgcgtccgtcaagaacgttg

SEQ ID NO: 411778 - DNA, 25 bp, Rattus norvegicus
gcttccgctgtaaactgccagattt

SEQ ID NO: 411779 - DNA, 25 bp, Rattus norvegicus
gcttccgctgtatactgccagattt

SEQ ID NO: 411780 - DNA, 25 bp, Rattus norvegicus
gcttccggtgcaacgtttgtaacaa

SEQ ID NO: 411781 - DNA, 25 bp, Rattus norvegicus
gcttccggtgcatcgtttgtaacaa

SEQ ID NO: 411782 - DNA, 25 bp, Rattus norvegicus
gcttccgtatttacaaagactgcca

SEQ ID NO: 411783 - DNA, 25 bp, Rattus norvegicus
gcttccgtattttcaaagactgcca

SEQ ID NO: 411784 - DNA, 25 bp, Rattus norvegicus
gcttccgtgaagagttgcttgccaa

SEQ ID NO: 411785 - DNA, 25 bp, Rattus norvegicus
gcttccgtgaagtgttgcttgccaa

SEQ ID NO: 411786 - DNA, 25 bp, Rattus norvegicus
gcttccgtgagcaccaggcatggac

SEQ ID NO: 411787 - DNA, 25 bp, Rattus norvegicus
gcttccgtgagctccaggcatggac

SEQ ID NO: 411788 - DNA, 25 bp, Rattus norvegicus
gcttccgtggctatttatccattct

SEQ ID NO: 411789 - DNA, 25 bp, Rattus norvegicus
gcttccgtggctttttatccattct

SEQ ID NO: 411790 - DNA, 25 bp, Rattus norvegicus
gcttccgtgtgtctggtcatcagta

SEQ ID NO: 411791 - DNA, 25 bp, Rattus norvegicus
gcttccgtgtgtgtggtcatcagta

SEQ ID NO: 411792 - DNA, 25 bp, Rattus norvegicus
gcttccgtttatagctgagccaaag

SEQ ID NO: 411793 - DNA, 25 bp, Rattus norvegicus
gcttccgtttattgctgagccaaag

SEQ ID NO: 411794 - DNA, 25 bp, Rattus norvegicus
gcttcctaatagctcttatgcttca

SEQ ID NO: 411795 - DNA, 25 bp, Rattus norvegicus
gcttcctaataggtcttatgcttca

SEQ ID NO: 411796 - DNA, 25 bp, Rattus norvegicus
gcttcctacagaccctttgaggtca

SEQ ID NO: 411797 - DNA, 25 bp, Rattus norvegicus
gcttcctacagagcctttgaggtca

SEQ ID NO: 411798 - DNA, 25 bp, Rattus norvegicus
gcttcctacggccagaaagcgtttt

SEQ ID NO: 411799 - DNA, 25 bp, Rattus norvegicus
gcttcctacggcgagaaagcgtttt

SEQ ID NO: 411800 - DNA, 25 bp, Rattus norvegicus
gcttcctaggagatcagtgacaaca

SEQ ID NO: 411801 - DNA, 25 bp, Rattus norvegicus
gcttcctaggagttcagtgacaaca

SEQ ID NO: 411802 - DNA, 25 bp, Rattus norvegicus
gcttcctagggaccaagaatcccca

SEQ ID NO: 411803 - DNA, 25 bp, Rattus norvegicus
gcttcctagggagcaagaatcccca

SEQ ID NO: 411804 - DNA, 25 bp, Rattus norvegicus
gcttcctaggttactgcatgcaagt

SEQ ID NO: 411805 - DNA, 25 bp, Rattus norvegicus
gcttcctaggtttctgcatgcaagt

SEQ ID NO: 411806 - DNA, 25 bp, Rattus norvegicus
gcttcctatagcaagacatgggctt

SEQ ID NO: 411807 - DNA, 25 bp, Rattus norvegicus
gcttcctatagcagctgtttatata

SEQ ID NO: 411808 - DNA, 25 bp, Rattus norvegicus
gcttcctatagcatgagtccctgta

SEQ ID NO: 411809 - DNA, 25 bp, Rattus norvegicus
gcttcctatagctagacatgggctt

SEQ ID NO: 411810 - DNA, 25 bp, Rattus norvegicus
gcttcctatagctgctgtttatata

SEQ ID NO: 411811 - DNA, 25 bp, Rattus norvegicus
gcttcctatagcttgagtccctgta

SEQ ID NO: 411812 - DNA, 25 bp, Rattus norvegicus
gcttcctatcaccttgaggatccaa

SEQ ID NO: 411813 - DNA, 25 bp, Rattus norvegicus
gcttcctatcacgttgaggatccaa

SEQ ID NO: 411814 - DNA, 25 bp, Rattus norvegicus
gcttcctatgtccaccatcaataat

SEQ ID NO: 411815 - DNA, 25 bp, Rattus norvegicus
gcttcctatgtcgaccatcaataat

SEQ ID NO: 411816 - DNA, 25 bp, Rattus norvegicus
gcttcctatgttccctgtcagatta

SEQ ID NO: 411817 - DNA, 25 bp, Rattus norvegicus
gcttcctatgttgcctgtcagatta

SEQ ID NO: 411818 - DNA, 25 bp, Rattus norvegicus
gcttcctcagagacttggtgcctgg

SEQ ID NO: 411819 - DNA, 25 bp, Rattus norvegicus
gcttcctcagagtcttggtgcctgg

SEQ ID NO: 411820 - DNA, 25 bp, Rattus norvegicus
gcttcctcatcaaactgtgtcactg

SEQ ID NO: 411821 - DNA, 25 bp, Rattus norvegicus
gcttcctcatcatactgtgtcactg

SEQ ID NO: 411822 - DNA, 25 bp, Rattus norvegicus
gcttcctcatctacgctgatcaagg

SEQ ID NO: 411823 - DNA, 25 bp, Rattus norvegicus
gcttcctcatcttcgctgatcaagg

SEQ ID NO: 411824 - DNA, 25 bp, Rattus norvegicus
gcttcctccaagactcagataatga

SEQ ID NO: 411825 - DNA, 25 bp, Rattus norvegicus
gcttcctccaagtctcagataatga

SEQ ID NO: 411826 - DNA, 25 bp, Rattus norvegicus
gcttcctccagacagaggccattat

SEQ ID NO: 411827 - DNA, 25 bp, Rattus norvegicus
gcttcctccagagagaggccattat

SEQ ID NO: 411828 - DNA, 25 bp, Rattus norvegicus
gcttcctccatacagtttgatcagt

SEQ ID NO: 411829 - DNA, 25 bp, Rattus norvegicus
gcttcctccatagagtttgatcagt

SEQ ID NO: 411830 - DNA, 25 bp, Rattus norvegicus
gcttcctcctacctgtacagttgaa

SEQ ID NO: 411831 - DNA, 25 bp, Rattus norvegicus
gcttcctcctacgtgtacagttgaa

SEQ ID NO: 411832 - DNA, 25 bp, Rattus norvegicus
gcttcctcgaatagtgctgccagtg

SEQ ID NO: 411833 - DNA, 25 bp, Rattus norvegicus
gcttcctcgaattgtgctgccagtg

SEQ ID NO: 411834 - DNA, 25 bp, Rattus norvegicus
gcttcctcggcaccattagtatgag

SEQ ID NO: 411835 - DNA, 25 bp, Rattus norvegicus
gcttcctcggcagcattagtatgag

SEQ ID NO: 411836 - DNA, 25 bp, Rattus norvegicus
gcttcctctacactgtggattgcag

SEQ ID NO: 411837 - DNA, 25 bp, Rattus norvegicus
gcttcctctacagtgtggattgcag

SEQ ID NO: 411838 - DNA, 25 bp, Rattus norvegicus
gcttcctctcaccatctcgaaaaag

SEQ ID NO: 411839 - DNA, 25 bp, Rattus norvegicus
gcttcctctcacgatctcgaaaaag

SEQ ID NO: 411840 - DNA, 25 bp, Rattus norvegicus
gcttcctctgcaatgtctgatacta

SEQ ID NO: 411841 - DNA, 25 bp, Rattus norvegicus
gcttcctctgcattgtctgatacta

SEQ ID NO: 411842 - DNA, 25 bp, Rattus norvegicus
gcttcctctgtcacagtgttactgt

SEQ ID NO: 411843 - DNA, 25 bp, Rattus norvegicus
gcttcctctgtctcagtgttactgt

SEQ ID NO: 411844 - DNA, 25 bp, Rattus norvegicus
gcttcctgaagccaagtctttgata

SEQ ID NO: 411845 - DNA, 25 bp, Rattus norvegicus
gcttcctgaagcgaagtctttgata

SEQ ID NO: 411846 - DNA, 25 bp, Rattus norvegicus
gcttcctgactgcttatgtaatgtg

SEQ ID NO: 411847 - DNA, 25 bp, Rattus norvegicus
gcttcctgactggttatgtaatgtg

SEQ ID NO: 411848 - DNA, 25 bp, Rattus norvegicus
gcttcctgacttaacccaagaacag

SEQ ID NO: 411849 - DNA, 25 bp, Rattus norvegicus
gcttcctgactttacccaagaacag

SEQ ID NO: 411850 - DNA, 25 bp, Rattus norvegicus
gcttcctgagtcctgcttagagtta

SEQ ID NO: 411851 - DNA, 25 bp, Rattus norvegicus
gcttcctgagtcgtgcttagagtta

SEQ ID NO: 411852 - DNA, 25 bp, Rattus norvegicus
gcttcctgatgtcttttgtttccta

SEQ ID NO: 411853 - DNA, 25 bp, Rattus norvegicus
gcttcctgatgtgttttgtttccta

SEQ ID NO: 411854 - DNA, 25 bp, Rattus norvegicus
gcttcctgcagtagcctgagtgtca

SEQ ID NO: 411855 - DNA, 25 bp, Rattus norvegicus
gcttcctgcagttgcctgagtgtca

SEQ ID NO: 411856 - DNA, 25 bp, Rattus norvegicus
gcttcctgccagattagcatgccgg

SEQ ID NO: 411857 - DNA, 25 bp, Rattus norvegicus
gcttcctgccagtttagcatgccgg

SEQ ID NO: 411858 - DNA, 25 bp, Rattus norvegicus
gcttcctgcccaaacagacactttg

SEQ ID NO: 411859 - DNA, 25 bp, Rattus norvegicus
gcttcctgcccatacagacactttg

SEQ ID NO: 411860 - DNA, 25 bp, Rattus norvegicus
gcttcctgcctgactgtgagtctgt

SEQ ID NO: 411861 - DNA, 25 bp, Rattus norvegicus
gcttcctgcctgtctgtgagtctgt

SEQ ID NO: 411862 - DNA, 25 bp, Rattus norvegicus
gcttcctgccttccactaagaaaga

SEQ ID NO: 411863 - DNA, 25 bp, Rattus norvegicus
gcttcctgccttgcactaagaaaga

SEQ ID NO: 411864 - DNA, 25 bp, Rattus norvegicus
gcttcctgctcactcattttgagag

SEQ ID NO: 411865 - DNA, 25 bp, Rattus norvegicus
gcttcctgctcagtcattttgagag

SEQ ID NO: 411866 - DNA, 25 bp, Rattus norvegicus
gcttcctgctgtcgcttcaagataa

SEQ ID NO: 411867 - DNA, 25 bp, Rattus norvegicus
gcttcctgctgtggcttcaagataa

SEQ ID NO: 411868 - DNA, 25 bp, Rattus norvegicus
gcttcctggaagaacgaccttgacc

SEQ ID NO: 411869 - DNA, 25 bp, Rattus norvegicus
gcttcctggaagtacgaccttgacc

SEQ ID NO: 411870 - DNA, 25 bp, Rattus norvegicus
gcttcctgggacatatagcagcaaa

SEQ ID NO: 411871 - DNA, 25 bp, Rattus norvegicus
gcttcctgggacttatagcagcaaa

SEQ ID NO: 411872 - DNA, 25 bp, Rattus norvegicus
gcttcctgtacaaggtctatgcctc

SEQ ID NO: 411873 - DNA, 25 bp, Rattus norvegicus
gcttcctgtacatggtctatgcctc

SEQ ID NO: 411874 - DNA, 25 bp, Rattus norvegicus
gcttcctgtaccatgacatgcaaaa

SEQ ID NO: 411875 - DNA, 25 bp, Rattus norvegicus
gcttcctgtaccttgacatgcaaaa

SEQ ID NO: 411876 - DNA, 25 bp, Rattus norvegicus
gcttcctgtcagcttatgtcctagt

SEQ ID NO: 411877 - DNA, 25 bp, Rattus norvegicus
gcttcctgtcaggttatgtcctagt

SEQ ID NO: 411878 - DNA, 25 bp, Rattus norvegicus
gcttcctgtctgagttaatacaatc

SEQ ID NO: 411879 - DNA, 25 bp, Rattus norvegicus
gcttcctgtctgtgttaatacaatc

SEQ ID NO: 411880 - DNA, 25 bp, Rattus norvegicus
gcttcctgtggccaattgttgaaag

SEQ ID NO: 411881 - DNA, 25 bp, Rattus norvegicus
gcttcctgtggcgaattgttgaaag

SEQ ID NO: 411882 - DNA, 25 bp, Rattus norvegicus
gcttcctgtgtcattccttaattta

SEQ ID NO: 411883 - DNA, 25 bp, Rattus norvegicus
gcttcctgtgtctttccttaattta

SEQ ID NO: 411884 - DNA, 25 bp, Rattus norvegicus
gcttcctgttacaaagatgtcttca

SEQ ID NO: 411885 - DNA, 25 bp, Rattus norvegicus
gcttcctgttactaagatgtcttca

SEQ ID NO: 411886 - DNA, 25 bp, Rattus norvegicus
gcttcctgttctcgtctcaagacat

SEQ ID NO: 411887 - DNA, 25 bp, Rattus norvegicus
gcttcctgttctggtctcaagacat

SEQ ID NO: 411888 - DNA, 25 bp, Rattus norvegicus
gcttccttacacacagcagatgaga

SEQ ID NO: 411889 - DNA, 25 bp, Rattus norvegicus
gcttccttacactcagcagatgaga

SEQ ID NO: 411890 - DNA, 25 bp, Rattus norvegicus
gcttccttacgtcagcgtcagagaa

SEQ ID NO: 411891 - DNA, 25 bp, Rattus norvegicus
gcttccttacgtgagcgtcagagaa

SEQ ID NO: 411892 - DNA, 25 bp, Rattus norvegicus
gcttccttagaaactgctttttgaa

SEQ ID NO: 411893 - DNA, 25 bp, Rattus norvegicus
gcttccttagaatctgctttttgaa

SEQ ID NO: 411894 - DNA, 25 bp, Rattus norvegicus
gcttccttcctcattgggacagttc

SEQ ID NO: 411895 - DNA, 25 bp, Rattus norvegicus
gcttccttcctctttgggacagttc

SEQ ID NO: 411896 - DNA, 25 bp, Rattus norvegicus
gcttccttcgatatggtttccaaat

SEQ ID NO: 411897 - DNA, 25 bp, Rattus norvegicus
gcttccttcgatttggtttccaaat

SEQ ID NO: 411898 - DNA, 25 bp, Rattus norvegicus
gcttccttctacaaatcgactttac

SEQ ID NO: 411899 - DNA, 25 bp, Rattus norvegicus
gcttccttctactaatcgactttac

SEQ ID NO: 411900 - DNA, 25 bp, Rattus norvegicus
gcttccttctgtctgatggagtttc

SEQ ID NO: 411901 - DNA, 25 bp, Rattus norvegicus
gcttccttctgtgtgatggagtttc

SEQ ID NO: 411902 - DNA, 25 bp, Rattus norvegicus
gcttccttgcggctcatacacatga

SEQ ID NO: 411903 - DNA, 25 bp, Rattus norvegicus
gcttccttgcgggtcatacacatga

SEQ ID NO: 411904 - DNA, 25 bp, Rattus norvegicus
gcttccttggacacatttggcaata

SEQ ID NO: 411905 - DNA, 25 bp, Rattus norvegicus
gcttccttggactcatttggcaata

SEQ ID NO: 411906 - DNA, 25 bp, Rattus norvegicus
gcttccttggcaccagcatatttta

SEQ ID NO: 411907 - DNA, 25 bp, Rattus norvegicus
gcttccttggcagcagcatatttta

SEQ ID NO: 411908 - DNA, 25 bp, Rattus norvegicus
gcttccttgtgccttaaaaaacctg

SEQ ID NO: 411909 - DNA, 25 bp, Rattus norvegicus
gcttccttgtgcgttaaaaaacctg

SEQ ID NO: 411910 - DNA, 25 bp, Rattus norvegicus
gcttcctttatcatcaaccagttta

SEQ ID NO: 411911 - DNA, 25 bp, Rattus norvegicus
gcttcctttatcttcaaccagttta

SEQ ID NO: 411912 - DNA, 25 bp, Rattus norvegicus
gcttcctttctaaccggcattattt

SEQ ID NO: 411913 - DNA, 25 bp, Rattus norvegicus
gcttcctttctatccggcattattt

SEQ ID NO: 411914 - DNA, 25 bp, Rattus norvegicus
gcttcctttcttatgtggtattaat

SEQ ID NO: 411915 - DNA, 25 bp, Rattus norvegicus
gcttcctttcttcgctctgaaatga

SEQ ID NO: 411916 - DNA, 25 bp, Rattus norvegicus
gcttcctttcttggctctgaaatga

SEQ ID NO: 411917 - DNA, 25 bp, Rattus norvegicus
gcttcctttcttttgtggtattaat

SEQ ID NO: 411918 - DNA, 25 bp, Rattus norvegicus
gcttcctttgctcttaaacattggc

SEQ ID NO: 411919 - DNA, 25 bp, Rattus norvegicus
gcttcctttgctgttaaacattggc

SEQ ID NO: 411920 - DNA, 25 bp, Rattus norvegicus
gcttcgaaaccgctactgactgaga

SEQ ID NO: 411921 - DNA, 25 bp, Rattus norvegicus
gcttcgaaaccggtactgactgaga

SEQ ID NO: 411922 - DNA, 25 bp, Rattus norvegicus
gcttcgacaacacctatagcttcgt

SEQ ID NO: 411923 - DNA, 25 bp, Rattus norvegicus
gcttcgacaacagctatagcttcgt

SEQ ID NO: 411924 - DNA, 25 bp, Rattus norvegicus
gcttcgacgcatcggatgatggtct

SEQ ID NO: 411925 - DNA, 25 bp, Rattus norvegicus
gcttcgacgcatgggatgatggtct

SEQ ID NO: 411926 - DNA, 25 bp, Rattus norvegicus
gcttcgacgtgtaaataggcaacaa

SEQ ID NO: 411927 - DNA, 25 bp, Rattus norvegicus
gcttcgacgtgttaataggcaacaa

SEQ ID NO: 411928 - DNA, 25 bp, Rattus norvegicus
gcttcgagctgtaatgttttgccat

SEQ ID NO: 411929 - DNA, 25 bp, Rattus norvegicus
gcttcgagctgttatgttttgccat

SEQ ID NO: 411930 - DNA, 25 bp, Rattus norvegicus
gcttcgaggagcaaaggctgcttat

SEQ ID NO: 411931 - DNA, 25 bp, Rattus norvegicus
gcttcgaggagctaaggctgcttat

SEQ ID NO: 411932 - DNA, 25 bp, Rattus norvegicus
gcttcgagtcaaaggccacggacaa

SEQ ID NO: 411933 - DNA, 25 bp, Rattus norvegicus
gcttcgagtcaatggccacggacaa

SEQ ID NO: 411934 - DNA, 25 bp, Rattus norvegicus
gcttcgccatccacagtgggtttat

SEQ ID NO: 411935 - DNA, 25 bp, Rattus norvegicus
gcttcgccatcctcagtgggtttat

SEQ ID NO: 411936 - DNA, 25 bp, Rattus norvegicus
gcttcgccatctcagagtgggcctg

SEQ ID NO: 411937 - DNA, 25 bp, Rattus norvegicus
gcttcgccatctgagagtgggcctg

SEQ ID NO: 411938 - DNA, 25 bp, Rattus norvegicus
gcttcgccatgtccagaagtcttga

SEQ ID NO: 411939 - DNA, 25 bp, Rattus norvegicus
gcttcgccatgtgcagaagtcttga

SEQ ID NO: 411940 - DNA, 25 bp, Rattus norvegicus
gcttcgcctatgagtacacactgga

SEQ ID NO: 411941 - DNA, 25 bp, Rattus norvegicus
gcttcgcctatgtgtacacactgga

SEQ ID NO: 411942 - DNA, 25 bp, Rattus norvegicus
gcttcgcggttaaggaaaatttcag

SEQ ID NO: 411943 - DNA, 25 bp, Rattus norvegicus
gcttcgcggttatggaaaatttcag

SEQ ID NO: 411944 - DNA, 25 bp, Rattus norvegicus
gcttcgcgttctatcattggatgga

SEQ ID NO: 411945 - DNA, 25 bp, Rattus norvegicus
gcttcgcgttctttcattggatgga

SEQ ID NO: 411946 - DNA, 25 bp, Rattus norvegicus
gcttcgctgctcaggctagacaggg

SEQ ID NO: 411947 - DNA, 25 bp, Rattus norvegicus
gcttcgctgctctggctagacaggg

SEQ ID NO: 411948 - DNA, 25 bp, Rattus norvegicus
gcttcgcttgccatctagggtttag

SEQ ID NO: 411949 - DNA, 25 bp, Rattus norvegicus
gcttcgcttgccttctagggtttag

SEQ ID NO: 411950 - DNA, 25 bp, Rattus norvegicus
gcttcgcttggccttcagagtgtca

SEQ ID NO: 411951 - DNA, 25 bp, Rattus norvegicus
gcttcgcttggcgttcagagtgtca

SEQ ID NO: 411952 - DNA, 25 bp, Rattus norvegicus
gcttcggaactacatggagaggatc

SEQ ID NO: 411953 - DNA, 25 bp, Rattus norvegicus
gcttcggaactagatggagaggatc

SEQ ID NO: 411954 - DNA, 25 bp, Rattus norvegicus
gcttcggaccccaggacaaggaact

SEQ ID NO: 411955 - DNA, 25 bp, Rattus norvegicus
gcttcggacccctggacaaggaact

SEQ ID NO: 411956 - DNA, 25 bp, Rattus norvegicus
gcttcggacttcaccagagcatgat

SEQ ID NO: 411957 - DNA, 25 bp, Rattus norvegicus
gcttcggacttctccagagcatgat

SEQ ID NO: 411958 - DNA, 25 bp, Rattus norvegicus
gcttcggagcacaacaacgcagagt

SEQ ID NO: 411959 - DNA, 25 bp, Rattus norvegicus
gcttcggagcactacaacgcagagt

SEQ ID NO: 411960 - DNA, 25 bp, Rattus norvegicus
gcttcggcaggacaagggcaacccc

SEQ ID NO: 411961 - DNA, 25 bp, Rattus norvegicus
gcttcggcaggagaagggcaacccc

SEQ ID NO: 411962 - DNA, 25 bp, Rattus norvegicus
gcttcggccttcaggatgccagcat

SEQ ID NO: 411963 - DNA, 25 bp, Rattus norvegicus
gcttcggccttctggatgccagcat

SEQ ID NO: 411964 - DNA, 25 bp, Rattus norvegicus
gcttcggcgactagagcaatgctaa

SEQ ID NO: 411965 - DNA, 25 bp, Rattus norvegicus
gcttcggcgacttgagcaatgctaa

SEQ ID NO: 411966 - DNA, 25 bp, Rattus norvegicus
gcttcggcgcagaccccgagggttc

SEQ ID NO: 411967 - DNA, 25 bp, Rattus norvegicus
gcttcggcgcagtccccgagggttc

SEQ ID NO: 411968 - DNA, 25 bp, Rattus norvegicus
gcttcgggacctcgaaaggcagtca

SEQ ID NO: 411969 - DNA, 25 bp, Rattus norvegicus
gcttcgggacctggaaaggcagtca

SEQ ID NO: 411970 - DNA, 25 bp, Rattus norvegicus
gcttcgggtgtgattgatgtctcta

SEQ ID NO: 411971 - DNA, 25 bp, Rattus norvegicus
gcttcgggtgtgtttgatgtctcta

SEQ ID NO: 411972 - DNA, 25 bp, Rattus norvegicus
gcttcggtacggagtttgaagagac

SEQ ID NO: 411973 - DNA, 25 bp, Rattus norvegicus
gcttcggtacggtgtttgaagagac

SEQ ID NO: 411974 - DNA, 25 bp, Rattus norvegicus
gcttcggtgagtccagctaactggt

SEQ ID NO: 411975 - DNA, 25 bp, Rattus norvegicus
gcttcggtgagtgcagctaactggt

SEQ ID NO: 411976 - DNA, 25 bp, Rattus norvegicus
gcttcggtggtcacaggcagacaaa

SEQ ID NO: 411977 - DNA, 25 bp, Rattus norvegicus
gcttcggtggtctcaggcagacaaa

SEQ ID NO: 411978 - DNA, 25 bp, Rattus norvegicus
gcttcgtaatggctctgttcaaact

SEQ ID NO: 411979 - DNA, 25 bp, Rattus norvegicus
gcttcgtaatgggtctgttcaaact

SEQ ID NO: 411980 - DNA, 25 bp, Rattus norvegicus
gcttcgtagtcacaagatggctgct

SEQ ID NO: 411981 - DNA, 25 bp, Rattus norvegicus
gcttcgtagtcagaagatggctgct

SEQ ID NO: 411982 - DNA, 25 bp, Rattus norvegicus
gcttcgtattctcatctctgaacga

SEQ ID NO: 411983 - DNA, 25 bp, Rattus norvegicus
gcttcgtattctgatctctgaacga

SEQ ID NO: 411984 - DNA, 25 bp, Rattus norvegicus
gcttcgtcaaggagccgcgcgagcc

SEQ ID NO: 411985 - DNA, 25 bp, Rattus norvegicus
gcttcgtcaaggtgccgcgcgagcc

SEQ ID NO: 411986 - DNA, 25 bp, Rattus norvegicus
gcttcgtctaacaggagccaggcga

SEQ ID NO: 411987 - DNA, 25 bp, Rattus norvegicus
gcttcgtctaactggagccaggcga

SEQ ID NO: 411988 - DNA, 25 bp, Rattus norvegicus
gcttcgtcttcacctgaagagtgaa

SEQ ID NO: 411989 - DNA, 25 bp, Rattus norvegicus
gcttcgtcttcagctgaagagtgaa

SEQ ID NO: 411990 - DNA, 25 bp, Rattus norvegicus
gcttcgtgactgaaggataggtcca

SEQ ID NO: 411991 - DNA, 25 bp, Rattus norvegicus
gcttcgtgactgtaggataggtcca

SEQ ID NO: 411992 - DNA, 25 bp, Rattus norvegicus
gcttcgtgcgctctgagttttataa

SEQ ID NO: 411993 - DNA, 25 bp, Rattus norvegicus
gcttcgtgcgctgtgagttttataa

SEQ ID NO: 411994 - DNA, 25 bp, Rattus norvegicus
gcttcgttcactccgggcttcggac

SEQ ID NO: 411995 - DNA, 25 bp, Rattus norvegicus
gcttcgttcactgcgggcttcggac

SEQ ID NO: 411996 - DNA, 25 bp, Rattus norvegicus
gcttctaaaatgatgccatgtattg

SEQ ID NO: 411997 - DNA, 25 bp, Rattus norvegicus
gcttctaaaatgttgccatgtattg

SEQ ID NO: 411998 - DNA, 25 bp, Rattus norvegicus
gcttctaacatcattgggacacctg

SEQ ID NO: 411999 - DNA, 25 bp, Rattus norvegicus
gcttctaacatctttgggacacctg

SEQ ID NO: 412000 - DNA, 25 bp, Rattus norvegicus
gcttctaacggtcctgtgctgggca

SEQ ID NO: 412001 - DNA, 25 bp, Rattus norvegicus
gcttctaacggtgctgtgctgggca

SEQ ID NO: 412002 - DNA, 25 bp, Rattus norvegicus
gcttctaagaacacaggatcagcct

SEQ ID NO: 412003 - DNA, 25 bp, Rattus norvegicus
gcttctaagaactcaggatcagcct

SEQ ID NO: 412004 - DNA, 25 bp, Rattus norvegicus
gcttctaataagaatctcaccggat

SEQ ID NO: 412005 - DNA, 25 bp, Rattus norvegicus
gcttctaataagctcattccgatat

SEQ ID NO: 412006 - DNA, 25 bp, Rattus norvegicus
gcttctaataaggtcattccgatat

SEQ ID NO: 412007 - DNA, 25 bp, Rattus norvegicus
gcttctaataagtatctcaccggat

SEQ ID NO: 412008 - DNA, 25 bp, Rattus norvegicus
gcttctaatgagcagctggcctgaa

SEQ ID NO: 412009 - DNA, 25 bp, Rattus norvegicus
gcttctaatgaggagctggcctgaa

SEQ ID NO: 412010 - DNA, 25 bp, Rattus norvegicus
gcttctacaactctgccaggatgag

SEQ ID NO: 412011 - DNA, 25 bp, Rattus norvegicus
gcttctacaactgtgccaggatgag

SEQ ID NO: 412012 - DNA, 25 bp, Rattus norvegicus
gcttctacaattcctcagacggttg

SEQ ID NO: 412013 - DNA, 25 bp, Rattus norvegicus
gcttctacaattgctcagacggttg

SEQ ID NO: 412014 - DNA, 25 bp, Rattus norvegicus
gcttctacagttagggagagcatct

SEQ ID NO: 412015 - DNA, 25 bp, Rattus norvegicus
gcttctacagttccaaggatttttt

SEQ ID NO: 412016 - DNA, 25 bp, Rattus norvegicus
gcttctacagttgcaaggatttttt

SEQ ID NO: 412017 - DNA, 25 bp, Rattus norvegicus
gcttctacagtttgggagagcatct

SEQ ID NO: 412018 - DNA, 25 bp, Rattus norvegicus
gcttctaccacgcactgagatctaa

SEQ ID NO: 412019 - DNA, 25 bp, Rattus norvegicus
gcttctaccacggactgagatctaa

SEQ ID NO: 412020 - DNA, 25 bp, Rattus norvegicus
gcttctaccagaagtgggtgcccag

SEQ ID NO: 412021 - DNA, 25 bp, Rattus norvegicus
gcttctaccagatgtgggtgcccag

SEQ ID NO: 412022 - DNA, 25 bp, Rattus norvegicus
gcttctaccccacgtttggaagatt

SEQ ID NO: 412023 - DNA, 25 bp, Rattus norvegicus
gcttctaccccaggtttggaagatt

SEQ ID NO: 412024 - DNA, 25 bp, Rattus norvegicus
gcttctaccgaacctcgatattgaa

SEQ ID NO: 412025 - DNA, 25 bp, Rattus norvegicus
gcttctaccgaagctcgatattgaa

SEQ ID NO: 412026 - DNA, 25 bp, Rattus norvegicus
gcttctaccgtgacaggttcgggtc

SEQ ID NO: 412027 - DNA, 25 bp, Rattus norvegicus
gcttctaccgtgtcaggttcgggtc

SEQ ID NO: 412028 - DNA, 25 bp, Rattus norvegicus
gcttctacctggcaagcactcagct

SEQ ID NO: 412029 - DNA, 25 bp, Rattus norvegicus
gcttctacctgggaagcactcagct

SEQ ID NO: 412030 - DNA, 25 bp, Rattus norvegicus
gcttctacggttcccattgtggtgt

SEQ ID NO: 412031 - DNA, 25 bp, Rattus norvegicus
gcttctacggttgccattgtggtgt

SEQ ID NO: 412032 - DNA, 25 bp, Rattus norvegicus
gcttctacgtggattgtcattgcca

SEQ ID NO: 412033 - DNA, 25 bp, Rattus norvegicus
gcttctacgtggtttgtcattgcca

SEQ ID NO: 412034 - DNA, 25 bp, Rattus norvegicus
gcttctactcgtcttgtaaacccag

SEQ ID NO: 412035 - DNA, 25 bp, Rattus norvegicus
gcttctactcgtgttgtaaacccag

SEQ ID NO: 412036 - DNA, 25 bp, Rattus norvegicus
gcttctactgtgaatactgaggttt

SEQ ID NO: 412037 - DNA, 25 bp, Rattus norvegicus
gcttctactgtgatgccttctgcaa

SEQ ID NO: 412038 - DNA, 25 bp, Rattus norvegicus
gcttctactgtgtatactgaggttt

SEQ ID NO: 412039 - DNA, 25 bp, Rattus norvegicus
gcttctactgtgttgccttctgcaa

SEQ ID NO: 412040 - DNA, 25 bp, Rattus norvegicus
gcttctacttttatggctaataata

SEQ ID NO: 412041 - DNA, 25 bp, Rattus norvegicus
gcttctacttttttggctaataata

SEQ ID NO: 412042 - DNA, 25 bp, Rattus norvegicus
gcttctagagccaggaataccttct

SEQ ID NO: 412043 - DNA, 25 bp, Rattus norvegicus
gcttctagagccatgtgggtgtcac

SEQ ID NO: 412044 - DNA, 25 bp, Rattus norvegicus
gcttctagagccctactcagtgtat

SEQ ID NO: 412045 - DNA, 25 bp, Rattus norvegicus
gcttctagagccgtactcagtgtat

SEQ ID NO: 412046 - DNA, 25 bp, Rattus norvegicus
gcttctagagcctggaataccttct

SEQ ID NO: 412047 - DNA, 25 bp, Rattus norvegicus
gcttctagagccttgtgggtgtcac

SEQ ID NO: 412048 - DNA, 25 bp, Rattus norvegicus
gcttctagccccaggacttaaagtg

SEQ ID NO: 412049 - DNA, 25 bp, Rattus norvegicus
gcttctagcccctggacttaaagtg

SEQ ID NO: 412050 - DNA, 25 bp, Rattus norvegicus
gcttctagcggcaggagcaagaacg

SEQ ID NO: 412051 - DNA, 25 bp, Rattus norvegicus
gcttctagcggctggagcaagaacg

SEQ ID NO: 412052 - DNA, 25 bp, Rattus norvegicus
gcttctagctgtataaggcttgtct

SEQ ID NO: 412053 - DNA, 25 bp, Rattus norvegicus
gcttctagctgtttaaggcttgtct

SEQ ID NO: 412054 - DNA, 25 bp, Rattus norvegicus
gcttctaggcagagagtgcagtcat

SEQ ID NO: 412055 - DNA, 25 bp, Rattus norvegicus
gcttctaggcagtgagtgcagtcat

SEQ ID NO: 412056 - DNA, 25 bp, Rattus norvegicus
gcttctagtgacaggtacagcaact

SEQ ID NO: 412057 - DNA, 25 bp, Rattus norvegicus
gcttctagtgactggtacagcaact

SEQ ID NO: 412058 - DNA, 25 bp, Rattus norvegicus
gcttctagtttccttattttgtata

SEQ ID NO: 412059 - DNA, 25 bp, Rattus norvegicus
gcttctagtttcgttattttgtata

SEQ ID NO: 412060 - DNA, 25 bp, Rattus norvegicus
gcttctatagacatactctaccatt

SEQ ID NO: 412061 - DNA, 25 bp, Rattus norvegicus
gcttctatagacttactctaccatt

SEQ ID NO: 412062 - DNA, 25 bp, Rattus norvegicus
gcttctatagcactacagcggtgat

SEQ ID NO: 412063 - DNA, 25 bp, Rattus norvegicus
gcttctatagcagtacagcggtgat

SEQ ID NO: 412064 - DNA, 25 bp, Rattus norvegicus
gcttctatatcacggccctatgaca

SEQ ID NO: 412065 - DNA, 25 bp, Rattus norvegicus
gcttctatatcagggccctatgaca

SEQ ID NO: 412066 - DNA, 25 bp, Rattus norvegicus
gcttctatgaatcgcctttaacctt

SEQ ID NO: 412067 - DNA, 25 bp, Rattus norvegicus
gcttctatgaatggcctttaacctt

SEQ ID NO: 412068 - DNA, 25 bp, Rattus norvegicus
gcttctatggctcgtgtacactttc

SEQ ID NO: 412069 - DNA, 25 bp, Rattus norvegicus
gcttctatggctggtgtacactttc

SEQ ID NO: 412070 - DNA, 25 bp, Rattus norvegicus
gcttctatgtcccagagggtgtcag

SEQ ID NO: 412071 - DNA, 25 bp, Rattus norvegicus
gcttctatgtccgagagggtgtcag

SEQ ID NO: 412072 - DNA, 25 bp, Rattus norvegicus
gcttctattggcagtgcaggcaccg

SEQ ID NO: 412073 - DNA, 25 bp, Rattus norvegicus
gcttctattggctgtgcaggcaccg

SEQ ID NO: 412074 - DNA, 25 bp, Rattus norvegicus
gcttctcaaacaatagccagtgact

SEQ ID NO: 412075 - DNA, 25 bp, Rattus norvegicus
gcttctcaaacattagccagtgact

SEQ ID NO: 412076 - DNA, 25 bp, Rattus norvegicus
gcttctcaaagtcagggccaataat

SEQ ID NO: 412077 - DNA, 25 bp, Rattus norvegicus
gcttctcaaagtctccatcattctg

SEQ ID NO: 412078 - DNA, 25 bp, Rattus norvegicus
gcttctcaaagtgagggccaataat

SEQ ID NO: 412079 - DNA, 25 bp, Rattus norvegicus
gcttctcaaagtgtccatcattctg

SEQ ID NO: 412080 - DNA, 25 bp, Rattus norvegicus
gcttctcaagagagccatttacttt

SEQ ID NO: 412081 - DNA, 25 bp, Rattus norvegicus
gcttctcaagagtgccatttacttt

SEQ ID NO: 412082 - DNA, 25 bp, Rattus norvegicus
gcttctcacatcatcaccattttga

SEQ ID NO: 412083 - DNA, 25 bp, Rattus norvegicus
gcttctcacatcttcaccattttga

SEQ ID NO: 412084 - DNA, 25 bp, Rattus norvegicus
gcttctcacttgctgtctagcatag

SEQ ID NO: 412085 - DNA, 25 bp, Rattus norvegicus
gcttctcacttggtgtctagcatag

SEQ ID NO: 412086 - DNA, 25 bp, Rattus norvegicus
gcttctcagaaaaaccagtctcctt

SEQ ID NO: 412087 - DNA, 25 bp, Rattus norvegicus
gcttctcagaaataccagtctcctt

SEQ ID NO: 412088 - DNA, 25 bp, Rattus norvegicus
gcttctcagacaatagttcctgtgc

SEQ ID NO: 412089 - DNA, 25 bp, Rattus norvegicus
gcttctcagacattagttcctgtgc

SEQ ID NO: 412090 - DNA, 25 bp, Rattus norvegicus
gcttctcagaccctaatgtggctga

SEQ ID NO: 412091 - DNA, 25 bp, Rattus norvegicus
gcttctcagaccgtaatgtggctga

SEQ ID NO: 412092 - DNA, 25 bp, Rattus norvegicus
gcttctcagactactgggctacaat

SEQ ID NO: 412093 - DNA, 25 bp, Rattus norvegicus
gcttctcagacttctgggctacaat

SEQ ID NO: 412094 - DNA, 25 bp, Rattus norvegicus
gcttctcaggagatccagctatgat

SEQ ID NO: 412095 - DNA, 25 bp, Rattus norvegicus
gcttctcaggagcttcgtgaacgca

SEQ ID NO: 412096 - DNA, 25 bp, Rattus norvegicus
gcttctcaggaggttcgtgaacgca

SEQ ID NO: 412097 - DNA, 25 bp, Rattus norvegicus
gcttctcaggagttccagctatgat

SEQ ID NO: 412098 - DNA, 25 bp, Rattus norvegicus
gcttctcagtgccaaattcctggga

SEQ ID NO: 412099 - DNA, 25 bp, Rattus norvegicus
gcttctcagtgcgaaattcctggga

SEQ ID NO: 412100 - DNA, 25 bp, Rattus norvegicus
gcttctcagttgactaaatcacgtt

SEQ ID NO: 412101 - DNA, 25 bp, Rattus norvegicus
gcttctcagttgtctaaatcacgtt

SEQ ID NO: 412102 - DNA, 25 bp, Rattus norvegicus
gcttctcatattcctttcagtcatc

SEQ ID NO: 412103 - DNA, 25 bp, Rattus norvegicus
gcttctcatattgctttcagtcatc

SEQ ID NO: 412104 - DNA, 25 bp, Rattus norvegicus
gcttctcatcatcagctaaagggac

SEQ ID NO: 412105 - DNA, 25 bp, Rattus norvegicus
gcttctcatcatgagctaaagggac

SEQ ID NO: 412106 - DNA, 25 bp, Rattus norvegicus
gcttctcattagagccatgctggtg

SEQ ID NO: 412107 - DNA, 25 bp, Rattus norvegicus
gcttctcattagtgccatgctggtg

SEQ ID NO: 412108 - DNA, 25 bp, Rattus norvegicus
gcttctcattgaactctaaagcaga

SEQ ID NO: 412109 - DNA, 25 bp, Rattus norvegicus
gcttctcattgatctctaaagcaga

SEQ ID NO: 412110 - DNA, 25 bp, Rattus norvegicus
gcttctccaggaacagcgacaggag

SEQ ID NO: 412111 - DNA, 25 bp, Rattus norvegicus
gcttctccaggatcagcgacaggag

SEQ ID NO: 412112 - DNA, 25 bp, Rattus norvegicus
gcttctccatgtactgtcacaatga

SEQ ID NO: 412113 - DNA, 25 bp, Rattus norvegicus
gcttctccatgttctgtcacaatga

SEQ ID NO: 412114 - DNA, 25 bp, Rattus norvegicus
gcttctcccattattctgatacgaa

SEQ ID NO: 412115 - DNA, 25 bp, Rattus norvegicus
gcttctcccatttttctgatacgaa

SEQ ID NO: 412116 - DNA, 25 bp, Rattus norvegicus
gcttctccccagctttgcatggaaa

SEQ ID NO: 412117 - DNA, 25 bp, Rattus norvegicus
gcttctccccaggtttgcatggaaa

SEQ ID NO: 412118 - DNA, 25 bp, Rattus norvegicus
gcttctcccctaatattaaacacac

SEQ ID NO: 412119 - DNA, 25 bp, Rattus norvegicus
gcttctcccctattattaaacacac

SEQ ID NO: 412120 - DNA, 25 bp, Rattus norvegicus
gcttctcccctgctcagaaaagaaa

SEQ ID NO: 412121 - DNA, 25 bp, Rattus norvegicus
gcttctcccctggtcagaaaagaaa

SEQ ID NO: 412122 - DNA, 25 bp, Rattus norvegicus
gcttctccctctaaccagaaagtaa

SEQ ID NO: 412123 - DNA, 25 bp, Rattus norvegicus
gcttctccctctatttcagtagtta

SEQ ID NO: 412124 - DNA, 25 bp, Rattus norvegicus
gcttctccctcttaccagaaagtaa

SEQ ID NO: 412125 - DNA, 25 bp, Rattus norvegicus
gcttctccctctttttcagtagtta

SEQ ID NO: 412126 - DNA, 25 bp, Rattus norvegicus
gcttctccgcatcgatagcatttga

SEQ ID NO: 412127 - DNA, 25 bp, Rattus norvegicus
gcttctccgcatggatagcatttga

SEQ ID NO: 412128 - DNA, 25 bp, Rattus norvegicus
gcttctcctaatatagcagccactt

SEQ ID NO: 412129 - DNA, 25 bp, Rattus norvegicus
gcttctcctaatttagcagccactt

SEQ ID NO: 412130 - DNA, 25 bp, Rattus norvegicus
gcttctcctcctacgtgtgacgtca

SEQ ID NO: 412131 - DNA, 25 bp, Rattus norvegicus
gcttctcctcctcataaatgcagat

SEQ ID NO: 412132 - DNA, 25 bp, Rattus norvegicus
gcttctcctcctgataaatgcagat

SEQ ID NO: 412133 - DNA, 25 bp, Rattus norvegicus
gcttctcctccttcgtgtgacgtca

SEQ ID NO: 412134 - DNA, 25 bp, Rattus norvegicus
gcttctcctgatccgtttcgagtaa

SEQ ID NO: 412135 - DNA, 25 bp, Rattus norvegicus
gcttctcctgatgcgtttcgagtaa

SEQ ID NO: 412136 - DNA, 25 bp, Rattus norvegicus
gcttctcctgtgaaccaaaccatta

SEQ ID NO: 412137 - DNA, 25 bp, Rattus norvegicus
gcttctcctgtgtaccaaaccatta

SEQ ID NO: 412138 - DNA, 25 bp, Rattus norvegicus
gcttctccttctaatttcagcatgg

SEQ ID NO: 412139 - DNA, 25 bp, Rattus norvegicus
gcttctccttcttatttcagcatgg

SEQ ID NO: 412140 - DNA, 25 bp, Rattus norvegicus
gcttctcgacggaaatactctattt

SEQ ID NO: 412141 - DNA, 25 bp, Rattus norvegicus
gcttctcgacggtaatactctattt

SEQ ID NO: 412142 - DNA, 25 bp, Rattus norvegicus
gcttctcgccataatggactgagcc

SEQ ID NO: 412143 - DNA, 25 bp, Rattus norvegicus
gcttctcgccattatggactgagcc

SEQ ID NO: 412144 - DNA, 25 bp, Rattus norvegicus
gcttctcggcctaaacaagcagcgt

SEQ ID NO: 412145 - DNA, 25 bp, Rattus norvegicus
gcttctcggccttaacaagcagcgt

SEQ ID NO: 412146 - DNA, 25 bp, Rattus norvegicus
gcttctcgtgacatttaatcgtgct

SEQ ID NO: 412147 - DNA, 25 bp, Rattus norvegicus
gcttctcgtgacttttaatcgtgct

SEQ ID NO: 412148 - DNA, 25 bp, Rattus norvegicus
gcttctctcaacctgacatgggatg

SEQ ID NO: 412149 - DNA, 25 bp, Rattus norvegicus
gcttctctcaacgtgacatgggatg

SEQ ID NO: 412150 - DNA, 25 bp, Rattus norvegicus
gcttctctccggaatggctaataga

SEQ ID NO: 412151 - DNA, 25 bp, Rattus norvegicus
gcttctctccggtatggctaataga

SEQ ID NO: 412152 - DNA, 25 bp, Rattus norvegicus
gcttctctcgatcagcagaaagcac

SEQ ID NO: 412153 - DNA, 25 bp, Rattus norvegicus
gcttctctcgatgagcagaaagcac

SEQ ID NO: 412154 - DNA, 25 bp, Rattus norvegicus
gcttctctcgtgacatccatgtgga

SEQ ID NO: 412155 - DNA, 25 bp, Rattus norvegicus
gcttctctcgtgtcatccatgtgga

SEQ ID NO: 412156 - DNA, 25 bp, Rattus norvegicus
gcttctctctcacattacagtttat

SEQ ID NO: 412157 - DNA, 25 bp, Rattus norvegicus
gcttctctctcagattacagtttat

SEQ ID NO: 412158 - DNA, 25 bp, Rattus norvegicus
gcttctctctgcagttaactttttg

SEQ ID NO: 412159 - DNA, 25 bp, Rattus norvegicus
gcttctctctgctgttaactttttg

SEQ ID NO: 412160 - DNA, 25 bp, Rattus norvegicus
gcttctctctggctctctaacaaaa

SEQ ID NO: 412161 - DNA, 25 bp, Rattus norvegicus
gcttctctctgggtctctaacaaaa

SEQ ID NO: 412162 - DNA, 25 bp, Rattus norvegicus
gcttctctcttcctgaatgacttca

SEQ ID NO: 412163 - DNA, 25 bp, Rattus norvegicus
gcttctctcttcgtgaatgacttca

SEQ ID NO: 412164 - DNA, 25 bp, Rattus norvegicus
gcttctctcttgatttaccacagtt

SEQ ID NO: 412165 - DNA, 25 bp, Rattus norvegicus
gcttctctcttgttttaccacagtt

SEQ ID NO: 412166 - DNA, 25 bp, Rattus norvegicus
gcttctctgagaatcaaaccaaagg

SEQ ID NO: 412167 - DNA, 25 bp, Rattus norvegicus
gcttctctgagattcaaaccaaagg

SEQ ID NO: 412168 - DNA, 25 bp, Rattus norvegicus
gcttctctgaggaatggaatgtttc

SEQ ID NO: 412169 - DNA, 25 bp, Rattus norvegicus
gcttctctgaggtatggaatgtttc

SEQ ID NO: 412170 - DNA, 25 bp, Rattus norvegicus
gcttctctgcaaatttctggtacca

SEQ ID NO: 412171 - DNA, 25 bp, Rattus norvegicus
gcttctctgcaattttctggtacca

SEQ ID NO: 412172 - DNA, 25 bp, Rattus norvegicus
gcttctctgcatcttatcagtgtgt

SEQ ID NO: 412173 - DNA, 25 bp, Rattus norvegicus
gcttctctgcatgttatcagtgtgt

SEQ ID NO: 412174 - DNA, 25 bp, Rattus norvegicus
gcttctctgcggctggtgaatgaat

SEQ ID NO: 412175 - DNA, 25 bp, Rattus norvegicus
gcttctctgcgggtggtgaatgaat

SEQ ID NO: 412176 - DNA, 25 bp, Rattus norvegicus
gcttctctggttccttccgaaagga

SEQ ID NO: 412177 - DNA, 25 bp, Rattus norvegicus
gcttctctggttgcttccgaaagga

SEQ ID NO: 412178 - DNA, 25 bp, Rattus norvegicus
gcttctctgtgcatttagctgggaa

SEQ ID NO: 412179 - DNA, 25 bp, Rattus norvegicus
gcttctctgtgcttttagctgggaa

SEQ ID NO: 412180 - DNA, 25 bp, Rattus norvegicus
gcttctctgttcaagtgttggctga

SEQ ID NO: 412181 - DNA, 25 bp, Rattus norvegicus
gcttctctgttctagtgttggctga

SEQ ID NO: 412182 - DNA, 25 bp, Rattus norvegicus
gcttctcttcccctgtattaaagta

SEQ ID NO: 412183 - DNA, 25 bp, Rattus norvegicus
gcttctcttcccgtgtattaaagta

SEQ ID NO: 412184 - DNA, 25 bp, Rattus norvegicus
gcttctcttgctatcagtaacaagt

SEQ ID NO: 412185 - DNA, 25 bp, Rattus norvegicus
gcttctcttgctttcagtaacaagt

SEQ ID NO: 412186 - DNA, 25 bp, Rattus norvegicus
gcttctgaaaaaagggacttggctg

SEQ ID NO: 412187 - DNA, 25 bp, Rattus norvegicus
gcttctgaaaaatgggacttggctg

SEQ ID NO: 412188 - DNA, 25 bp, Rattus norvegicus
gcttctgaaagactttacattggta

SEQ ID NO: 412189 - DNA, 25 bp, Rattus norvegicus
gcttctgaaagagtttacattggta

SEQ ID NO: 412190 - DNA, 25 bp, Rattus norvegicus
gcttctgaacctcctttgatgacaa

SEQ ID NO: 412191 - DNA, 25 bp, Rattus norvegicus
gcttctgaacctgctttgatgacaa

SEQ ID NO: 412192 - DNA, 25 bp, Rattus norvegicus
gcttctgaagctatgctgtgtggtt

SEQ ID NO: 412193 - DNA, 25 bp, Rattus norvegicus
gcttctgaagctttgctgtgtggtt

SEQ ID NO: 412194 - DNA, 25 bp, Rattus norvegicus
gcttctgacaccagtgaaccacgga

SEQ ID NO: 412195 - DNA, 25 bp, Rattus norvegicus
gcttctgacacctgtgaaccacgga

SEQ ID NO: 412196 - DNA, 25 bp, Rattus norvegicus
gcttctgacactcggctaagttctg

SEQ ID NO: 412197 - DNA, 25 bp, Rattus norvegicus
gcttctgacactgggctaagttctg

SEQ ID NO: 412198 - DNA, 25 bp, Rattus norvegicus
gcttctgactatcttccacaaaggg

SEQ ID NO: 412199 - DNA, 25 bp, Rattus norvegicus
gcttctgactatgttccacaaaggg

SEQ ID NO: 412200 - DNA, 25 bp, Rattus norvegicus
gcttctgagcctcggcgataaggat

SEQ ID NO: 412201 - DNA, 25 bp, Rattus norvegicus
gcttctgagcctgggcgataaggat

SEQ ID NO: 412202 - DNA, 25 bp, Rattus norvegicus
gcttctgaggcccagaggctatgta

SEQ ID NO: 412203 - DNA, 25 bp, Rattus norvegicus
gcttctgaggccgagaggctatgta

SEQ ID NO: 412204 - DNA, 25 bp, Rattus norvegicus
gcttctgaggtacctactcctgtta

SEQ ID NO: 412205 - DNA, 25 bp, Rattus norvegicus
gcttctgaggtagctactcctgtta

SEQ ID NO: 412206 - DNA, 25 bp, Rattus norvegicus
gcttctgattttacattgctctatg

SEQ ID NO: 412207 - DNA, 25 bp, Rattus norvegicus
gcttctgatttttcattgctctatg

SEQ ID NO: 412208 - DNA, 25 bp, Rattus norvegicus
gcttctgcaaagcacttgggttcaa

SEQ ID NO: 412209 - DNA, 25 bp, Rattus norvegicus
gcttctgcaaaggacttgggttcaa

SEQ ID NO: 412210 - DNA, 25 bp, Rattus norvegicus
gcttctgcaactctgtggtcttgaa

SEQ ID NO: 412211 - DNA, 25 bp, Rattus norvegicus
gcttctgcaactgtgtggtcttgaa

SEQ ID NO: 412212 - DNA, 25 bp, Rattus norvegicus
gcttctgcacagagttgtctgctaa

SEQ ID NO: 412213 - DNA, 25 bp, Rattus norvegicus
gcttctgcacagtgttgtctgctaa

SEQ ID NO: 412214 - DNA, 25 bp, Rattus norvegicus
gcttctgcacgaacaaaggaggccc

SEQ ID NO: 412215 - DNA, 25 bp, Rattus norvegicus
gcttctgcacgatcaaaggaggccc

SEQ ID NO: 412216 - DNA, 25 bp, Rattus norvegicus
gcttctgcagctccagaaaaagcaa

SEQ ID NO: 412217 - DNA, 25 bp, Rattus norvegicus
gcttctgcagctgcagaaaaagcaa

SEQ ID NO: 412218 - DNA, 25 bp, Rattus norvegicus
gcttctgccacacctttatttatta

SEQ ID NO: 412219 - DNA, 25 bp, Rattus norvegicus
gcttctgccacactaaccaggagta

SEQ ID NO: 412220 - DNA, 25 bp, Rattus norvegicus
gcttctgccacagctttatttatta

SEQ ID NO: 412221 - DNA, 25 bp, Rattus norvegicus
gcttctgccacagtaaccaggagta

SEQ ID NO: 412222 - DNA, 25 bp, Rattus norvegicus
gcttctgccagacgtactccgggat

SEQ ID NO: 412223 - DNA, 25 bp, Rattus norvegicus
gcttctgccagaggtactccgggat

SEQ ID NO: 412224 - DNA, 25 bp, Rattus norvegicus
gcttctgctacaattttagggtttg

SEQ ID NO: 412225 - DNA, 25 bp, Rattus norvegicus
gcttctgctacactctgtacaggac

SEQ ID NO: 412226 - DNA, 25 bp, Rattus norvegicus
gcttctgctacagtctgtacaggac

SEQ ID NO: 412227 - DNA, 25 bp, Rattus norvegicus
gcttctgctacatttttagggtttg

SEQ ID NO: 412228 - DNA, 25 bp, Rattus norvegicus
gcttctgctcaacttggcgagacat

SEQ ID NO: 412229 - DNA, 25 bp, Rattus norvegicus
gcttctgctcaagttggcgagacat

SEQ ID NO: 412230 - DNA, 25 bp, Rattus norvegicus
gcttctgctcaccaataaacgcttt

SEQ ID NO: 412231 - DNA, 25 bp, Rattus norvegicus
gcttctgctcacgaataaacgcttt

SEQ ID NO: 412232 - DNA, 25 bp, Rattus norvegicus
gcttctgctctcattggtatgtttg

SEQ ID NO: 412233 - DNA, 25 bp, Rattus norvegicus
gcttctgctctctttggtatgtttg

SEQ ID NO: 412234 - DNA, 25 bp, Rattus norvegicus
gcttctgctgttactcatttctgaa

SEQ ID NO: 412235 - DNA, 25 bp, Rattus norvegicus
gcttctgctgtttctcatttctgaa

SEQ ID NO: 412236 - DNA, 25 bp, Rattus norvegicus
gcttctgcttccagaggctgagtta

SEQ ID NO: 412237 - DNA, 25 bp, Rattus norvegicus
gcttctgcttcctgaggctgagtta

SEQ ID NO: 412238 - DNA, 25 bp, Rattus norvegicus
gcttctgctttcaccaagagagtgt

SEQ ID NO: 412239 - DNA, 25 bp, Rattus norvegicus
gcttctgctttctccaagagagtgt

SEQ ID NO: 412240 - DNA, 25 bp, Rattus norvegicus
gcttctggaaacatgtggtccgcct

SEQ ID NO: 412241 - DNA, 25 bp, Rattus norvegicus
gcttctggaaacttgtggtccgcct

SEQ ID NO: 412242 - DNA, 25 bp, Rattus norvegicus
gcttctggaaccacgacggaacata

SEQ ID NO: 412243 - DNA, 25 bp, Rattus norvegicus
gcttctggaacctcgacggaacata

SEQ ID NO: 412244 - DNA, 25 bp, Rattus norvegicus
gcttctggaacgctgtcctcacgga

SEQ ID NO: 412245 - DNA, 25 bp, Rattus norvegicus
gcttctggaacggtgtcctcacgga

SEQ ID NO: 412246 - DNA, 25 bp, Rattus norvegicus
gcttctggaagcatacacgactcag

SEQ ID NO: 412247 - DNA, 25 bp, Rattus norvegicus
gcttctggaagcttacacgactcag

SEQ ID NO: 412248 - DNA, 25 bp, Rattus norvegicus
gcttctggaataccttctatctcac

SEQ ID NO: 412249 - DNA, 25 bp, Rattus norvegicus
gcttctggaatagcttctatctcac

SEQ ID NO: 412250 - DNA, 25 bp, Rattus norvegicus
gcttctggataactacgctgcctgc

SEQ ID NO: 412251 - DNA, 25 bp, Rattus norvegicus
gcttctggataagtacgctgcctgc

SEQ ID NO: 412252 - DNA, 25 bp, Rattus norvegicus
gcttctggctccaacaatgcagtta

SEQ ID NO: 412253 - DNA, 25 bp, Rattus norvegicus
gcttctggctcctacaatgcagtta

SEQ ID NO: 412254 - DNA, 25 bp, Rattus norvegicus
gcttctggctctaatactgcattct

SEQ ID NO: 412255 - DNA, 25 bp, Rattus norvegicus
gcttctggctcttatactgcattct

SEQ ID NO: 412256 - DNA, 25 bp, Rattus norvegicus
gcttctggctttctgtgacagcagg

SEQ ID NO: 412257 - DNA, 25 bp, Rattus norvegicus
gcttctggctttgtgtgacagcagg

SEQ ID NO: 412258 - DNA, 25 bp, Rattus norvegicus
gcttctgggtagagcagctgtccaa

SEQ ID NO: 412259 - DNA, 25 bp, Rattus norvegicus
gcttctgggtagtgcagctgtccaa

SEQ ID NO: 412260 - DNA, 25 bp, Rattus norvegicus
gcttctgggtccctttgtgagccta

SEQ ID NO: 412261 - DNA, 25 bp, Rattus norvegicus
gcttctgggtccgtttgtgagccta

SEQ ID NO: 412262 - DNA, 25 bp, Rattus norvegicus
gcttctggtttgaacttcaggctct

SEQ ID NO: 412263 - DNA, 25 bp, Rattus norvegicus
gcttctggtttgtacttcaggctct

SEQ ID NO: 412264 - DNA, 25 bp, Rattus norvegicus
gcttctgtaaaaatatggtgatctt

SEQ ID NO: 412265 - DNA, 25 bp, Rattus norvegicus
gcttctgtaaaattatggtgatctt

SEQ ID NO: 412266 - DNA, 25 bp, Rattus norvegicus
gcttctgtaaacaggcttcttcatc

SEQ ID NO: 412267 - DNA, 25 bp, Rattus norvegicus
gcttctgtaaactggcttcttcatc

SEQ ID NO: 412268 - DNA, 25 bp, Rattus norvegicus
gcttctgtacaacacagggtctcat

SEQ ID NO: 412269 - DNA, 25 bp, Rattus norvegicus
gcttctgtacaagacagggtctcat

SEQ ID NO: 412270 - DNA, 25 bp, Rattus norvegicus
gcttctgtactgaggctttgttggt

SEQ ID NO: 412271 - DNA, 25 bp, Rattus norvegicus
gcttctgtactgtggctttgttggt

SEQ ID NO: 412272 - DNA, 25 bp, Rattus norvegicus
gcttctgtcacaccacaaacgattt

SEQ ID NO: 412273 - DNA, 25 bp, Rattus norvegicus
gcttctgtcacagcacaaacgattt

SEQ ID NO: 412274 - DNA, 25 bp, Rattus norvegicus
gcttctgtcacgaatgtgtccatgg

SEQ ID NO: 412275 - DNA, 25 bp, Rattus norvegicus
gcttctgtcacgtatgtgtccatgg

SEQ ID NO: 412276 - DNA, 25 bp, Rattus norvegicus
gcttctgtcagaactaccgtgatca

SEQ ID NO: 412277 - DNA, 25 bp, Rattus norvegicus
gcttctgtcagatctaccgtgatca

SEQ ID NO: 412278 - DNA, 25 bp, Rattus norvegicus
gcttctgtccagattcactgtgtga

SEQ ID NO: 412279 - DNA, 25 bp, Rattus norvegicus
gcttctgtccagtttcactgtgtga

SEQ ID NO: 412280 - DNA, 25 bp, Rattus norvegicus
gcttctgtctaaccaccaggtgctg

SEQ ID NO: 412281 - DNA, 25 bp, Rattus norvegicus
gcttctgtctaagcaccaggtgctg

SEQ ID NO: 412282 - DNA, 25 bp, Rattus norvegicus
gcttctgtctccattaggttttctt

SEQ ID NO: 412283 - DNA, 25 bp, Rattus norvegicus
gcttctgtctcctttaggttttctt

SEQ ID NO: 412284 - DNA, 25 bp, Rattus norvegicus
gcttctgtctttccactttaggtgg

SEQ ID NO: 412285 - DNA, 25 bp, Rattus norvegicus
gcttctgtctttgcactttaggtgg

SEQ ID NO: 412286 - DNA, 25 bp, Rattus norvegicus
gcttctgtgacacctgttcatccaa

SEQ ID NO: 412287 - DNA, 25 bp, Rattus norvegicus
gcttctgtgacagctgttcatccaa

SEQ ID NO: 412288 - DNA, 25 bp, Rattus norvegicus
gcttctgtgtaaatgctgcttctgt

SEQ ID NO: 412289 - DNA, 25 bp, Rattus norvegicus
gcttctgtgtaattgctgcttctgt

SEQ ID NO: 412290 - DNA, 25 bp, Rattus norvegicus
gcttctgttcatactggtgccaaac

SEQ ID NO: 412291 - DNA, 25 bp, Rattus norvegicus
gcttctgttcattctggtgccaaac

SEQ ID NO: 412292 - DNA, 25 bp, Rattus norvegicus
gcttctgttcttccctggtaattag

SEQ ID NO: 412293 - DNA, 25 bp, Rattus norvegicus
gcttctgttcttgcctggtaattag

SEQ ID NO: 412294 - DNA, 25 bp, Rattus norvegicus
gcttctgtttgaagaggatgtaata

SEQ ID NO: 412295 - DNA, 25 bp, Rattus norvegicus
gcttctgtttgatgaggatgtaata

SEQ ID NO: 412296 - DNA, 25 bp, Rattus norvegicus
gcttctgtttgtatctgtagcagca

SEQ ID NO: 412297 - DNA, 25 bp, Rattus norvegicus
gcttctgtttgtttctgtagcagca

SEQ ID NO: 412298 - DNA, 25 bp, Rattus norvegicus
gcttcttaccacatggtcttttaat

SEQ ID NO: 412299 - DNA, 25 bp, Rattus norvegicus
gcttcttaccacttggtcttttaat

SEQ ID NO: 412300 - DNA, 25 bp, Rattus norvegicus
gcttcttagacgctggagtatccaa

SEQ ID NO: 412301 - DNA, 25 bp, Rattus norvegicus
gcttcttagacggtggagtatccaa

SEQ ID NO: 412302 - DNA, 25 bp, Rattus norvegicus
gcttcttagagacttctctgtagaa

SEQ ID NO: 412303 - DNA, 25 bp, Rattus norvegicus
gcttcttagagagttctctgtagaa

SEQ ID NO: 412304 - DNA, 25 bp, Rattus norvegicus
gcttcttagatgcaataccccaacc

SEQ ID NO: 412305 - DNA, 25 bp, Rattus norvegicus
gcttcttagatggaataccccaacc

SEQ ID NO: 412306 - DNA, 25 bp, Rattus norvegicus
gcttcttaggacagacttgcctgaa

SEQ ID NO: 412307 - DNA, 25 bp, Rattus norvegicus
gcttcttaggactgacttgcctgaa

SEQ ID NO: 412308 - DNA, 25 bp, Rattus norvegicus
gcttcttatgttatgtttggctcat

SEQ ID NO: 412309 - DNA, 25 bp, Rattus norvegicus
gcttcttatgttttgtttggctcat

SEQ ID NO: 412310 - DNA, 25 bp, Rattus norvegicus
gcttcttattccactattcctttga

SEQ ID NO: 412311 - DNA, 25 bp, Rattus norvegicus
gcttcttattcctctattcctttga

SEQ ID NO: 412312 - DNA, 25 bp, Rattus norvegicus
gcttcttcaagcagtagatggacat

SEQ ID NO: 412313 - DNA, 25 bp, Rattus norvegicus
gcttcttcaagctgtagatggacat

SEQ ID NO: 412314 - DNA, 25 bp, Rattus norvegicus
gcttcttcaaggaagggatgcccac

SEQ ID NO: 412315 - DNA, 25 bp, Rattus norvegicus
gcttcttcaaggagttttgcttctt

SEQ ID NO: 412316 - DNA, 25 bp, Rattus norvegicus
gcttcttcaaggtagggatgcccac

SEQ ID NO: 412317 - DNA, 25 bp, Rattus norvegicus
gcttcttcaaggtgttttgcttctt

SEQ ID NO: 412318 - DNA, 25 bp, Rattus norvegicus
gcttcttcaccaaagaggtgtttca

SEQ ID NO: 412319 - DNA, 25 bp, Rattus norvegicus
gcttcttcaccatagaggtgtttca

SEQ ID NO: 412320 - DNA, 25 bp, Rattus norvegicus
gcttcttcatgaattcctttgctca

SEQ ID NO: 412321 - DNA, 25 bp, Rattus norvegicus
gcttcttcatgatttcctttgctca

SEQ ID NO: 412322 - DNA, 25 bp, Rattus norvegicus
gcttcttcatttaccgactgtgtca

SEQ ID NO: 412323 - DNA, 25 bp, Rattus norvegicus
gcttcttcattttccgactgtgtca

SEQ ID NO: 412324 - DNA, 25 bp, Rattus norvegicus
gcttcttccacaagggcaggcttag

SEQ ID NO: 412325 - DNA, 25 bp, Rattus norvegicus
gcttcttccacatgggcaggcttag

SEQ ID NO: 412326 - DNA, 25 bp, Rattus norvegicus
gcttcttccagtcctggcgctggtg

SEQ ID NO: 412327 - DNA, 25 bp, Rattus norvegicus
gcttcttccagtgctggcgctggtg

SEQ ID NO: 412328 - DNA, 25 bp, Rattus norvegicus
gcttcttccctaattgctagatgtg

SEQ ID NO: 412329 - DNA, 25 bp, Rattus norvegicus
gcttcttccctatttgctagatgtg

SEQ ID NO: 412330 - DNA, 25 bp, Rattus norvegicus
gcttcttccgtgatcgcacagagga

SEQ ID NO: 412331 - DNA, 25 bp, Rattus norvegicus
gcttcttccgtgttcgcacagagga

SEQ ID NO: 412332 - DNA, 25 bp, Rattus norvegicus
gcttcttcctttcaaggatcctgag

SEQ ID NO: 412333 - DNA, 25 bp, Rattus norvegicus
gcttcttcctttgaaggatcctgag

SEQ ID NO: 412334 - DNA, 25 bp, Rattus norvegicus
gcttcttcgtgtacttttttgtatt

SEQ ID NO: 412335 - DNA, 25 bp, Rattus norvegicus
gcttcttcgtgttcttttttgtatt

SEQ ID NO: 412336 - DNA, 25 bp, Rattus norvegicus
gcttcttcgtttctcagtttcataa

SEQ ID NO: 412337 - DNA, 25 bp, Rattus norvegicus
gcttcttcgtttgtcagtttcataa

SEQ ID NO: 412338 - DNA, 25 bp, Rattus norvegicus
gcttcttctagcacgtgactgtgga

SEQ ID NO: 412339 - DNA, 25 bp, Rattus norvegicus
gcttcttctagctcgtgactgtgga

SEQ ID NO: 412340 - DNA, 25 bp, Rattus norvegicus
gcttcttctatacctggccttgaaa

SEQ ID NO: 412341 - DNA, 25 bp, Rattus norvegicus
gcttcttctatagctggccttgaaa

SEQ ID NO: 412342 - DNA, 25 bp, Rattus norvegicus
gcttcttctccgaagcatagactat

SEQ ID NO: 412343 - DNA, 25 bp, Rattus norvegicus
gcttcttctccgtagcatagactat

SEQ ID NO: 412344 - DNA, 25 bp, Rattus norvegicus
gcttcttctctaatttgtctgcata

SEQ ID NO: 412345 - DNA, 25 bp, Rattus norvegicus
gcttcttctctattttgtctgcata

SEQ ID NO: 412346 - DNA, 25 bp, Rattus norvegicus
gcttcttctgtgaggtttaacaact

SEQ ID NO: 412347 - DNA, 25 bp, Rattus norvegicus
gcttcttctgtgtggtttaacaact

SEQ ID NO: 412348 - DNA, 25 bp, Rattus norvegicus
gcttcttgaagacctatgtaaagaa

SEQ ID NO: 412349 - DNA, 25 bp, Rattus norvegicus
gcttcttgaagagctatgtaaagaa

SEQ ID NO: 412350 - DNA, 25 bp, Rattus norvegicus
gcttcttgagcaacttctgcgcaga

SEQ ID NO: 412351 - DNA, 25 bp, Rattus norvegicus
gcttcttgagcatcttctgcgcaga

SEQ ID NO: 412352 - DNA, 25 bp, Rattus norvegicus
gcttcttgatccctactgtggagga

SEQ ID NO: 412353 - DNA, 25 bp, Rattus norvegicus
gcttcttgatccgtactgtggagga

SEQ ID NO: 412354 - DNA, 25 bp, Rattus norvegicus
gcttcttgatgacccttgtcaacca

SEQ ID NO: 412355 - DNA, 25 bp, Rattus norvegicus
gcttcttgatgagccttgtcaacca

SEQ ID NO: 412356 - DNA, 25 bp, Rattus norvegicus
gcttcttgattgaactgaacctgta

SEQ ID NO: 412357 - DNA, 25 bp, Rattus norvegicus
gcttcttgattgtactgaacctgta

SEQ ID NO: 412358 - DNA, 25 bp, Rattus norvegicus
gcttcttgccagaatgtctaagaca

SEQ ID NO: 412359 - DNA, 25 bp, Rattus norvegicus
gcttcttgccagtatgtctaagaca

SEQ ID NO: 412360 - DNA, 25 bp, Rattus norvegicus
gcttcttgcccacggtgccaggaga

SEQ ID NO: 412361 - DNA, 25 bp, Rattus norvegicus
gcttcttgcccagggtgccaggaga

SEQ ID NO: 412362 - DNA, 25 bp, Rattus norvegicus
gcttcttgctgcacatggattacat

SEQ ID NO: 412363 - DNA, 25 bp, Rattus norvegicus
gcttcttgctgctcatggattacat

SEQ ID NO: 412364 - DNA, 25 bp, Rattus norvegicus
gcttcttgcttgaattcttgttctg

SEQ ID NO: 412365 - DNA, 25 bp, Rattus norvegicus
gcttcttgcttgtattcttgttctg

SEQ ID NO: 412366 - DNA, 25 bp, Rattus norvegicus
gcttcttggtgcattgtggtcctgc

SEQ ID NO: 412367 - DNA, 25 bp, Rattus norvegicus
gcttcttggtgctttgtggtcctgc

SEQ ID NO: 412368 - DNA, 25 bp, Rattus norvegicus
gcttcttggtttcgaaatggcgttt

SEQ ID NO: 412369 - DNA, 25 bp, Rattus norvegicus
gcttcttggtttggaaatggcgttt

SEQ ID NO: 412370 - DNA, 25 bp, Rattus norvegicus
gcttcttgtgtcaggtgtattgtat

SEQ ID NO: 412371 - DNA, 25 bp, Rattus norvegicus
gcttcttgtgtctggtgtattgtat

SEQ ID NO: 412372 - DNA, 25 bp, Rattus norvegicus
gcttcttgttaaacctgtcatgctt

SEQ ID NO: 412373 - DNA, 25 bp, Rattus norvegicus
gcttcttgttaacatcatgccctca

SEQ ID NO: 412374 - DNA, 25 bp, Rattus norvegicus
gcttcttgttaacatgcaaggctgt

SEQ ID NO: 412375 - DNA, 25 bp, Rattus norvegicus
gcttcttgttaagatcatgccctca

SEQ ID NO: 412376 - DNA, 25 bp, Rattus norvegicus
gcttcttgttaagatgcaaggctgt

SEQ ID NO: 412377 - DNA, 25 bp, Rattus norvegicus
gcttcttgttaatcctgtcatgctt

SEQ ID NO: 412378 - DNA, 25 bp, Rattus norvegicus
gcttctttaaatatcttgcctggat

SEQ ID NO: 412379 - DNA, 25 bp, Rattus norvegicus
gcttctttaaatttcttgcctggat

SEQ ID NO: 412380 - DNA, 25 bp, Rattus norvegicus
gcttctttacatcattggcaccctt

SEQ ID NO: 412381 - DNA, 25 bp, Rattus norvegicus
gcttctttacatgattggcaccctt

SEQ ID NO: 412382 - DNA, 25 bp, Rattus norvegicus
gcttctttatgaaggtctgtaaatt

SEQ ID NO: 412383 - DNA, 25 bp, Rattus norvegicus
gcttctttatgatggtctgtaaatt

SEQ ID NO: 412384 - DNA, 25 bp, Rattus norvegicus
gcttctttcaaaagtctaactttgc

SEQ ID NO: 412385 - DNA, 25 bp, Rattus norvegicus
gcttctttcaaatgtctaactttgc

SEQ ID NO: 412386 - DNA, 25 bp, Rattus norvegicus
gcttctttcaatattgggggggcga

SEQ ID NO: 412387 - DNA, 25 bp, Rattus norvegicus
gcttctttcaattttgggggggcga

SEQ ID NO: 412388 - DNA, 25 bp, Rattus norvegicus
gcttctttcccaatccaaacaagtt

SEQ ID NO: 412389 - DNA, 25 bp, Rattus norvegicus
gcttctttcccattccaaacaagtt

SEQ ID NO: 412390 - DNA, 25 bp, Rattus norvegicus
gcttctttccctacaattatcatcg

SEQ ID NO: 412391 - DNA, 25 bp, Rattus norvegicus
gcttctttcccttcaattatcatcg

SEQ ID NO: 412392 - DNA, 25 bp, Rattus norvegicus
gcttctttcctaactgttcagtgat

SEQ ID NO: 412393 - DNA, 25 bp, Rattus norvegicus
gcttctttcctatctgttcagtgat

SEQ ID NO: 412394 - DNA, 25 bp, Rattus norvegicus
gcttctttgacaagcatactgcctg

SEQ ID NO: 412395 - DNA, 25 bp, Rattus norvegicus
gcttctttgacatgcatactgcctg

SEQ ID NO: 412396 - DNA, 25 bp, Rattus norvegicus
gcttctttgccaacatcgtgtggca

SEQ ID NO: 412397 - DNA, 25 bp, Rattus norvegicus
gcttctttgccatcatcgtgtggca

SEQ ID NO: 412398 - DNA, 25 bp, Rattus norvegicus
gcttctttggctctgaacccaagat

SEQ ID NO: 412399 - DNA, 25 bp, Rattus norvegicus
gcttctttggctgtgaacccaagat

SEQ ID NO: 412400 - DNA, 25 bp, Rattus norvegicus
gcttctttgtctaatactgaatctg

SEQ ID NO: 412401 - DNA, 25 bp, Rattus norvegicus
gcttctttgtcttatactgaatctg

SEQ ID NO: 412402 - DNA, 25 bp, Rattus norvegicus
gcttctttgtggcttttgaactatc

SEQ ID NO: 412403 - DNA, 25 bp, Rattus norvegicus
gcttctttgtgggttttgaactatc

SEQ ID NO: 412404 - DNA, 25 bp, Rattus norvegicus
gcttctttgtgtacacaggtgcaca

SEQ ID NO: 412405 - DNA, 25 bp, Rattus norvegicus
gcttctttgtgttcacaggtgcaca

SEQ ID NO: 412406 - DNA, 25 bp, Rattus norvegicus
gcttctttgtttcctgaggctggga

SEQ ID NO: 412407 - DNA, 25 bp, Rattus norvegicus
gcttctttgtttgctgaggctggga

SEQ ID NO: 412408 - DNA, 25 bp, Rattus norvegicus
gcttcttttctgagagcaattaaag

SEQ ID NO: 412409 - DNA, 25 bp, Rattus norvegicus
gcttcttttctgtgagcaattaaag

SEQ ID NO: 412410 - DNA, 25 bp, Rattus norvegicus
gcttcttttgtaattgtccttggta

SEQ ID NO: 412411 - DNA, 25 bp, Rattus norvegicus
gcttcttttgtactgttttcataac

SEQ ID NO: 412412 - DNA, 25 bp, Rattus norvegicus
gcttcttttgtagtgttttcataac

SEQ ID NO: 412413 - DNA, 25 bp, Rattus norvegicus
gcttcttttgtatttgtccttggta

SEQ ID NO: 412414 - DNA, 25 bp, Rattus norvegicus
gcttctttttcaaaggagctcccgg

SEQ ID NO: 412415 - DNA, 25 bp, Rattus norvegicus
gcttctttttcataggagctcccgg

SEQ ID NO: 412416 - DNA, 25 bp, Rattus norvegicus
gcttgaaaactgagcccgcgctgac

SEQ ID NO: 412417 - DNA, 25 bp, Rattus norvegicus
gcttgaaaactgtgcccgcgctgac

SEQ ID NO: 412418 - DNA, 25 bp, Rattus norvegicus
gcttgaaaagagcaacccagatcat

SEQ ID NO: 412419 - DNA, 25 bp, Rattus norvegicus
gcttgaaaagaggaacccagatcat

SEQ ID NO: 412420 - DNA, 25 bp, Rattus norvegicus
gcttgaaaagctaatgcaggcaggt

SEQ ID NO: 412421 - DNA, 25 bp, Rattus norvegicus
gcttgaaaagcttatgcaggcaggt

SEQ ID NO: 412422 - DNA, 25 bp, Rattus norvegicus
gcttgaaaatgtatagtctctcaac

SEQ ID NO: 412423 - DNA, 25 bp, Rattus norvegicus
gcttgaaaatgtttagtctctcaac

SEQ ID NO: 412424 - DNA, 25 bp, Rattus norvegicus
gcttgaaatcagactgggccatata

SEQ ID NO: 412425 - DNA, 25 bp, Rattus norvegicus
gcttgaaatcagtctgggccatata

SEQ ID NO: 412426 - DNA, 25 bp, Rattus norvegicus
gcttgaacaacaactctctaacagg

SEQ ID NO: 412427 - DNA, 25 bp, Rattus norvegicus
gcttgaacaacatctctctaacagg

SEQ ID NO: 412428 - DNA, 25 bp, Rattus norvegicus
gcttgaacaactagcattcctttgg

SEQ ID NO: 412429 - DNA, 25 bp, Rattus norvegicus
gcttgaacaacttgcattcctttgg

SEQ ID NO: 412430 - DNA, 25 bp, Rattus norvegicus
gcttgaacacagaattctcccagtc

SEQ ID NO: 412431 - DNA, 25 bp, Rattus norvegicus
gcttgaacacagtattctcccagtc

SEQ ID NO: 412432 - DNA, 25 bp, Rattus norvegicus
gcttgaacagaaacgacccctggat

SEQ ID NO: 412433 - DNA, 25 bp, Rattus norvegicus
gcttgaacagaatcgacccctggat

SEQ ID NO: 412434 - DNA, 25 bp, Rattus norvegicus
gcttgaacatctaccttagggctga

SEQ ID NO: 412435 - DNA, 25 bp, Rattus norvegicus
gcttgaacatcttccttagggctga

SEQ ID NO: 412436 - DNA, 25 bp, Rattus norvegicus
gcttgaactccacggcagcatgact

SEQ ID NO: 412437 - DNA, 25 bp, Rattus norvegicus
gcttgaactccagggcagcatgact

SEQ ID NO: 412438 - DNA, 25 bp, Rattus norvegicus
gcttgaactcttcccagtgaacaga

SEQ ID NO: 412439 - DNA, 25 bp, Rattus norvegicus
gcttgaactcttgccagtgaacaga

SEQ ID NO: 412440 - DNA, 25 bp, Rattus norvegicus
gcttgaactgttacagtattgacta

SEQ ID NO: 412441 - DNA, 25 bp, Rattus norvegicus
gcttgaactgtttcagtattgacta

SEQ ID NO: 412442 - DNA, 25 bp, Rattus norvegicus
gcttgaacttggctctctagaacac

SEQ ID NO: 412443 - DNA, 25 bp, Rattus norvegicus
gcttgaacttgggtctctagaacac

SEQ ID NO: 412444 - DNA, 25 bp, Rattus norvegicus
gcttgaagacacatgctaccctggc

SEQ ID NO: 412445 - DNA, 25 bp, Rattus norvegicus
gcttgaagacacttgctaccctggc

SEQ ID NO: 412446 - DNA, 25 bp, Rattus norvegicus
gcttgaagcgttatattactcatca

SEQ ID NO: 412447 - DNA, 25 bp, Rattus norvegicus
gcttgaagcgttttattactcatca

SEQ ID NO: 412448 - DNA, 25 bp, Rattus norvegicus
gcttgaagctggagctcctcaggaa

SEQ ID NO: 412449 - DNA, 25 bp, Rattus norvegicus
gcttgaagctggtgctcctcaggaa

SEQ ID NO: 412450 - DNA, 25 bp, Rattus norvegicus
gcttgaatacggattctgtagttga

SEQ ID NO: 412451 - DNA, 25 bp, Rattus norvegicus
gcttgaatacggtttctgtagttga

SEQ ID NO: 412452 - DNA, 25 bp, Rattus norvegicus
gcttgaatactaaggcgagtgctct

SEQ ID NO: 412453 - DNA, 25 bp, Rattus norvegicus
gcttgaatactatggcgagtgctct

SEQ ID NO: 412454 - DNA, 25 bp, Rattus norvegicus
gcttgaatagccagcagtgtatgag

SEQ ID NO: 412455 - DNA, 25 bp, Rattus norvegicus
gcttgaatagcctgcagtgtatgag

SEQ ID NO: 412456 - DNA, 25 bp, Rattus norvegicus
gcttgaatgcatcctttcctttttc

SEQ ID NO: 412457 - DNA, 25 bp, Rattus norvegicus
gcttgaatgcatgctttcctttttc

SEQ ID NO: 412458 - DNA, 25 bp, Rattus norvegicus
gcttgaattattattatgtactatg

SEQ ID NO: 412459 - DNA, 25 bp, Rattus norvegicus
gcttgaattatttttatgtactatg

SEQ ID NO: 412460 - DNA, 25 bp, Rattus norvegicus
gcttgaatttggacaacactggact

SEQ ID NO: 412461 - DNA, 25 bp, Rattus norvegicus
gcttgaatttggtcaacactggact

SEQ ID NO: 412462 - DNA, 25 bp, Rattus norvegicus
gcttgacagggtctaatttgttcca

SEQ ID NO: 412463 - DNA, 25 bp, Rattus norvegicus
gcttgacagggtgtaatttgttcca

SEQ ID NO: 412464 - DNA, 25 bp, Rattus norvegicus
gcttgacatctaagacaggcatctg

SEQ ID NO: 412465 - DNA, 25 bp, Rattus norvegicus
gcttgacatctatgacaggcatctg

SEQ ID NO: 412466 - DNA, 25 bp, Rattus norvegicus
gcttgacatttccttacggtctgat

SEQ ID NO: 412467 - DNA, 25 bp, Rattus norvegicus
gcttgacatttcgttacggtctgat

SEQ ID NO: 412468 - DNA, 25 bp, Rattus norvegicus
gcttgaccaagtagtgcaatcatta

SEQ ID NO: 412469 - DNA, 25 bp, Rattus norvegicus
gcttgaccaagttgtgcaatcatta

SEQ ID NO: 412470 - DNA, 25 bp, Rattus norvegicus
gcttgacccaagatagagttatctg

SEQ ID NO: 412471 - DNA, 25 bp, Rattus norvegicus
gcttgacccaagttagagttatctg

SEQ ID NO: 412472 - DNA, 25 bp, Rattus norvegicus
gcttgacctaagcaggagcacagct

SEQ ID NO: 412473 - DNA, 25 bp, Rattus norvegicus
gcttgacctaaggaggagcacagct

SEQ ID NO: 412474 - DNA, 25 bp, Rattus norvegicus
gcttgacctggcatttggactaaca

SEQ ID NO: 412475 - DNA, 25 bp, Rattus norvegicus
gcttgacctggcttttggactaaca

SEQ ID NO: 412476 - DNA, 25 bp, Rattus norvegicus
gcttgaccttcaactctgcgaaatt

SEQ ID NO: 412477 - DNA, 25 bp, Rattus norvegicus
gcttgaccttcatctctgcgaaatt

SEQ ID NO: 412478 - DNA, 25 bp, Rattus norvegicus
gcttgacgtcacagtatgcctaaat

SEQ ID NO: 412479 - DNA, 25 bp, Rattus norvegicus
gcttgacgtcactgtatgcctaaat

SEQ ID NO: 412480 - DNA, 25 bp, Rattus norvegicus
gcttgactcaccatttctgaattta

SEQ ID NO: 412481 - DNA, 25 bp, Rattus norvegicus
gcttgactcaccttttctgaattta

SEQ ID NO: 412482 - DNA, 25 bp, Rattus norvegicus
gcttgactcgcacgactgtttgtta

SEQ ID NO: 412483 - DNA, 25 bp, Rattus norvegicus
gcttgactcgcaggactgtttgtta

SEQ ID NO: 412484 - DNA, 25 bp, Rattus norvegicus
gcttgactctgtagtgtttctaata

SEQ ID NO: 412485 - DNA, 25 bp, Rattus norvegicus
gcttgactctgttgtgtttctaata

SEQ ID NO: 412486 - DNA, 25 bp, Rattus norvegicus
gcttgactgaggaggcttttaattc

SEQ ID NO: 412487 - DNA, 25 bp, Rattus norvegicus
gcttgactgaggtggcttttaattc

SEQ ID NO: 412488 - DNA, 25 bp, Rattus norvegicus
gcttgactttgaaactgtgtgtgca

SEQ ID NO: 412489 - DNA, 25 bp, Rattus norvegicus
gcttgactttgatactgtgtgtgca

SEQ ID NO: 412490 - DNA, 25 bp, Rattus norvegicus
gcttgagaatttagccagcctctga

SEQ ID NO: 412491 - DNA, 25 bp, Rattus norvegicus
gcttgagaattttgccagcctctga

SEQ ID NO: 412492 - DNA, 25 bp, Rattus norvegicus
gcttgagacagcctaagatcataga

SEQ ID NO: 412493 - DNA, 25 bp, Rattus norvegicus
gcttgagacagcgtaagatcataga

SEQ ID NO: 412494 - DNA, 25 bp, Rattus norvegicus
gcttgagacatgagcccgatgggca

SEQ ID NO: 412495 - DNA, 25 bp, Rattus norvegicus
gcttgagacatgtgcccgatgggca

SEQ ID NO: 412496 - DNA, 25 bp, Rattus norvegicus
gcttgagagttgagctgactccttt

SEQ ID NO: 412497 - DNA, 25 bp, Rattus norvegicus
gcttgagagttgtgctgactccttt

SEQ ID NO: 412498 - DNA, 25 bp, Rattus norvegicus
gcttgagcagcgagtacgtgactgt

SEQ ID NO: 412499 - DNA, 25 bp, Rattus norvegicus
gcttgagcagcgtgtacgtgactgt

SEQ ID NO: 412500 - DNA, 25 bp, Rattus norvegicus
gcttgagcccagaataaaacatgtt

SEQ ID NO: 412501 - DNA, 25 bp, Rattus norvegicus
gcttgagcccagtataaaacatgtt

SEQ ID NO: 412502 - DNA, 25 bp, Rattus norvegicus
gcttgaggcacccattagtgtactt

SEQ ID NO: 412503 - DNA, 25 bp, Rattus norvegicus
gcttgaggcaccgattagtgtactt

SEQ ID NO: 412504 - DNA, 25 bp, Rattus norvegicus
gcttgaggcactcctgagttttgta

SEQ ID NO: 412505 - DNA, 25 bp, Rattus norvegicus
gcttgaggcactgctgagttttgta

SEQ ID NO: 412506 - DNA, 25 bp, Rattus norvegicus
gcttgagggctacaggctcctgact

SEQ ID NO: 412507 - DNA, 25 bp, Rattus norvegicus
gcttgagggctagaggctcctgact

SEQ ID NO: 412508 - DNA, 25 bp, Rattus norvegicus
gcttgaggtcagctactctgggatt

SEQ ID NO: 412509 - DNA, 25 bp, Rattus norvegicus
gcttgaggtcaggtactctgggatt

SEQ ID NO: 412510 - DNA, 25 bp, Rattus norvegicus
gcttgaggttgacctcattgtaatt

SEQ ID NO: 412511 - DNA, 25 bp, Rattus norvegicus
gcttgaggttgagctcattgtaatt

SEQ ID NO: 412512 - DNA, 25 bp, Rattus norvegicus
gcttgagtaataccagctgcctgca

SEQ ID NO: 412513 - DNA, 25 bp, Rattus norvegicus
gcttgagtaatagcagctgcctgca

SEQ ID NO: 412514 - DNA, 25 bp, Rattus norvegicus
gcttgagtgatgatggcctttccca

SEQ ID NO: 412515 - DNA, 25 bp, Rattus norvegicus
gcttgagtgatgttggcctttccca

SEQ ID NO: 412516 - DNA, 25 bp, Rattus norvegicus
gcttgagtgtgtagagcccaactgc

SEQ ID NO: 412517 - DNA, 25 bp, Rattus norvegicus
gcttgagtgtgttgagcccaactgc

SEQ ID NO: 412518 - DNA, 25 bp, Rattus norvegicus
gcttgagttataatcttcctttgaa

SEQ ID NO: 412519 - DNA, 25 bp, Rattus norvegicus
gcttgagttatattcttcctttgaa

SEQ ID NO: 412520 - DNA, 25 bp, Rattus norvegicus
gcttgagttcagactaggtacagta

SEQ ID NO: 412521 - DNA, 25 bp, Rattus norvegicus
gcttgagttcagtctaggtacagta

SEQ ID NO: 412522 - DNA, 25 bp, Rattus norvegicus
gcttgagttcccagctgtatggtta

SEQ ID NO: 412523 - DNA, 25 bp, Rattus norvegicus
gcttgagttccctgctgtatggtta

SEQ ID NO: 412524 - DNA, 25 bp, Rattus norvegicus
gcttgagtttctatttgtccatttt

SEQ ID NO: 412525 - DNA, 25 bp, Rattus norvegicus
gcttgagtttctttttgtccatttt

SEQ ID NO: 412526 - DNA, 25 bp, Rattus norvegicus
gcttgatagagaaatgcccactaag

SEQ ID NO: 412527 - DNA, 25 bp, Rattus norvegicus
gcttgatagagatatgcccactaag

SEQ ID NO: 412528 - DNA, 25 bp, Rattus norvegicus
gcttgatagctcacataccactgga

SEQ ID NO: 412529 - DNA, 25 bp, Rattus norvegicus
gcttgatagctctcataccactgga

SEQ ID NO: 412530 - DNA, 25 bp, Rattus norvegicus
gcttgatcaagactcaccagcacaa

SEQ ID NO: 412531 - DNA, 25 bp, Rattus norvegicus
gcttgatcaagagtcaccagcacaa

SEQ ID NO: 412532 - DNA, 25 bp, Rattus norvegicus
gcttgatccctccatgtctcagtag

SEQ ID NO: 412533 - DNA, 25 bp, Rattus norvegicus
gcttgatccctcgatgtctcagtag

SEQ ID NO: 412534 - DNA, 25 bp, Rattus norvegicus
gcttgatcctgaccctactaaaaaa

SEQ ID NO: 412535 - DNA, 25 bp, Rattus norvegicus
gcttgatcctgagcctactaaaaaa

SEQ ID NO: 412536 - DNA, 25 bp, Rattus norvegicus
gcttgatccttactatggttttgta

SEQ ID NO: 412537 - DNA, 25 bp, Rattus norvegicus
gcttgatccttagtatggttttgta

SEQ ID NO: 412538 - DNA, 25 bp, Rattus norvegicus
gcttgatcttcaaggacacctccat

SEQ ID NO: 412539 - DNA, 25 bp, Rattus norvegicus
gcttgatcttcatggacacctccat

SEQ ID NO: 412540 - DNA, 25 bp, Rattus norvegicus
gcttgatgggtacagcgccttcagt

SEQ ID NO: 412541 - DNA, 25 bp, Rattus norvegicus
gcttgatgggtagagcgccttcagt

SEQ ID NO: 412542 - DNA, 25 bp, Rattus norvegicus
gcttgatgtaggagttcttactgct

SEQ ID NO: 412543 - DNA, 25 bp, Rattus norvegicus
gcttgatgtaggtgttcttactgct

SEQ ID NO: 412544 - DNA, 25 bp, Rattus norvegicus
gcttgatgtgaccagattgtgtgat

SEQ ID NO: 412545 - DNA, 25 bp, Rattus norvegicus
gcttgatgtgacgagattgtgtgat

SEQ ID NO: 412546 - DNA, 25 bp, Rattus norvegicus
gcttgattccatctcctaactttag

SEQ ID NO: 412547 - DNA, 25 bp, Rattus norvegicus
gcttgattccatgtcctaactttag

SEQ ID NO: 412548 - DNA, 25 bp, Rattus norvegicus
gcttgattctctacggaaactgtta

SEQ ID NO: 412549 - DNA, 25 bp, Rattus norvegicus
gcttgattctcttcggaaactgtta

SEQ ID NO: 412550 - DNA, 25 bp, Rattus norvegicus
gcttgattgcggcttgttgagctaa

SEQ ID NO: 412551 - DNA, 25 bp, Rattus norvegicus
gcttgattgcgggttgttgagctaa

SEQ ID NO: 412552 - DNA, 25 bp, Rattus norvegicus
gcttgattttagcagcttacagcat

SEQ ID NO: 412553 - DNA, 25 bp, Rattus norvegicus
gcttgattttaggagcttacagcat

SEQ ID NO: 412554 - DNA, 25 bp, Rattus norvegicus
gcttgattttatactgtaactccac

SEQ ID NO: 412555 - DNA, 25 bp, Rattus norvegicus
gcttgattttattctgtaactccac

SEQ ID NO: 412556 - DNA, 25 bp, Rattus norvegicus
gcttgatttttaaaccccttccatg

SEQ ID NO: 412557 - DNA, 25 bp, Rattus norvegicus
gcttgatttttataccccttccatg

SEQ ID NO: 412558 - DNA, 25 bp, Rattus norvegicus
gcttgcaaacaacgcctttccaaaa

SEQ ID NO: 412559 - DNA, 25 bp, Rattus norvegicus
gcttgcaaacaaggcctttccaaaa

SEQ ID NO: 412560 - DNA, 25 bp, Rattus norvegicus
gcttgcaaagtcagggcaggccatt

SEQ ID NO: 412561 - DNA, 25 bp, Rattus norvegicus
gcttgcaaagtctgggcaggccatt

SEQ ID NO: 412562 - DNA, 25 bp, Rattus norvegicus
gcttgcaagcagagagagccctcaa

SEQ ID NO: 412563 - DNA, 25 bp, Rattus norvegicus
gcttgcaagcagtgagagccctcaa

SEQ ID NO: 412564 - DNA, 25 bp, Rattus norvegicus
gcttgcaaggatccatgctgtcagt

SEQ ID NO: 412565 - DNA, 25 bp, Rattus norvegicus
gcttgcaaggatgcatgctgtcagt

SEQ ID NO: 412566 - DNA, 25 bp, Rattus norvegicus
gcttgcaagtccaccaaagagccaa

SEQ ID NO: 412567 - DNA, 25 bp, Rattus norvegicus
gcttgcaagtcctccaaagagccaa

SEQ ID NO: 412568 - DNA, 25 bp, Rattus norvegicus
gcttgcaatcgcctgacgatggatc

SEQ ID NO: 412569 - DNA, 25 bp, Rattus norvegicus
gcttgcaatcgcgtgacgatggatc

SEQ ID NO: 412570 - DNA, 25 bp, Rattus norvegicus
gcttgcacaacaagcatgctcgctt

SEQ ID NO: 412571 - DNA, 25 bp, Rattus norvegicus
gcttgcacaacatgcatgctcgctt

SEQ ID NO: 412572 - DNA, 25 bp, Rattus norvegicus
gcttgcacccagaaaccagcattgt

SEQ ID NO: 412573 - DNA, 25 bp, Rattus norvegicus
gcttgcacccagtaaccagcattgt

SEQ ID NO: 412574 - DNA, 25 bp, Rattus norvegicus
gcttgcaccgttactagctgtgtga

SEQ ID NO: 412575 - DNA, 25 bp, Rattus norvegicus
gcttgcaccgtttctagctgtgtga

SEQ ID NO: 412576 - DNA, 25 bp, Rattus norvegicus
gcttgcacctgtctcttagagtgta

SEQ ID NO: 412577 - DNA, 25 bp, Rattus norvegicus
gcttgcacctgtgtcttagagtgta

SEQ ID NO: 412578 - DNA, 25 bp, Rattus norvegicus
gcttgcacgggcacatacgcatatg

SEQ ID NO: 412579 - DNA, 25 bp, Rattus norvegicus
gcttgcacgggctcatacgcatatg

SEQ ID NO: 412580 - DNA, 25 bp, Rattus norvegicus
gcttgcactaacaaccaacgactgg

SEQ ID NO: 412581 - DNA, 25 bp, Rattus norvegicus
gcttgcactaactaccaacgactgg

SEQ ID NO: 412582 - DNA, 25 bp, Rattus norvegicus
gcttgcactagtagtgccttcatta

SEQ ID NO: 412583 - DNA, 25 bp, Rattus norvegicus
gcttgcactagttgtgccttcatta

SEQ ID NO: 412584 - DNA, 25 bp, Rattus norvegicus
gcttgcagatgcactggtcgagctg

SEQ ID NO: 412585 - DNA, 25 bp, Rattus norvegicus
gcttgcagatgctctggtcgagctg

SEQ ID NO: 412586 - DNA, 25 bp, Rattus norvegicus
gcttgcagccacatggtaactccat

SEQ ID NO: 412587 - DNA, 25 bp, Rattus norvegicus
gcttgcagccacttggtaactccat

SEQ ID NO: 412588 - DNA, 25 bp, Rattus norvegicus
gcttgcagccataggtatagccagc

SEQ ID NO: 412589 - DNA, 25 bp, Rattus norvegicus
gcttgcagccatctataaccgtagt

SEQ ID NO: 412590 - DNA, 25 bp, Rattus norvegicus
gcttgcagccatgtataaccgtagt

SEQ ID NO: 412591 - DNA, 25 bp, Rattus norvegicus
gcttgcagccattggtatagccagc

SEQ ID NO: 412592 - DNA, 25 bp, Rattus norvegicus
gcttgcagctcactacagaacggat

SEQ ID NO: 412593 - DNA, 25 bp, Rattus norvegicus
gcttgcagctcagtacagaacggat

SEQ ID NO: 412594 - DNA, 25 bp, Rattus norvegicus
gcttgcaggattatgattcatttgt

SEQ ID NO: 412595 - DNA, 25 bp, Rattus norvegicus
gcttgcaggattttgattcatttgt

SEQ ID NO: 412596 - DNA, 25 bp, Rattus norvegicus
gcttgcagtctgataatggacccaa

SEQ ID NO: 412597 - DNA, 25 bp, Rattus norvegicus
gcttgcagtctgttaatggacccaa

SEQ ID NO: 412598 - DNA, 25 bp, Rattus norvegicus
gcttgcagtcttataattcctgtga

SEQ ID NO: 412599 - DNA, 25 bp, Rattus norvegicus
gcttgcagtcttttaattcctgtga

SEQ ID NO: 412600 - DNA, 25 bp, Rattus norvegicus
gcttgcagtgcccatagaggtcaga

SEQ ID NO: 412601 - DNA, 25 bp, Rattus norvegicus
gcttgcagtgccgatagaggtcaga

SEQ ID NO: 412602 - DNA, 25 bp, Rattus norvegicus
gcttgcagtgcgacctgctgctctt

SEQ ID NO: 412603 - DNA, 25 bp, Rattus norvegicus
gcttgcagtgcgtcctgctgctctt

SEQ ID NO: 412604 - DNA, 25 bp, Rattus norvegicus
gcttgcagttcgaagggcctgctat

SEQ ID NO: 412605 - DNA, 25 bp, Rattus norvegicus
gcttgcagttcgtagggcctgctat

SEQ ID NO: 412606 - DNA, 25 bp, Rattus norvegicus
gcttgcatactgcattcccaggaga

SEQ ID NO: 412607 - DNA, 25 bp, Rattus norvegicus
gcttgcatactggattcccaggaga

SEQ ID NO: 412608 - DNA, 25 bp, Rattus norvegicus
gcttgcatacttaaaacagacggat

SEQ ID NO: 412609 - DNA, 25 bp, Rattus norvegicus
gcttgcatactttaaacagacggat

SEQ ID NO: 412610 - DNA, 25 bp, Rattus norvegicus
gcttgcatagatctttcccacttcc

SEQ ID NO: 412611 - DNA, 25 bp, Rattus norvegicus
gcttgcatagatgtttcccacttcc

SEQ ID NO: 412612 - DNA, 25 bp, Rattus norvegicus
gcttgcatcatcatgagcccttggc

SEQ ID NO: 412613 - DNA, 25 bp, Rattus norvegicus
gcttgcatcatcttgagcccttggc

SEQ ID NO: 412614 - DNA, 25 bp, Rattus norvegicus
gcttgcatctgtatatgggctgctt

SEQ ID NO: 412615 - DNA, 25 bp, Rattus norvegicus
gcttgcatctgtttatgggctgctt

SEQ ID NO: 412616 - DNA, 25 bp, Rattus norvegicus
gcttgcatcttccttctaaactgga

SEQ ID NO: 412617 - DNA, 25 bp, Rattus norvegicus
gcttgcatcttcgttctaaactgga

SEQ ID NO: 412618 - DNA, 25 bp, Rattus norvegicus
gcttgcatgtctaattggcatctag

SEQ ID NO: 412619 - DNA, 25 bp, Rattus norvegicus
gcttgcatgtcttattggcatctag

SEQ ID NO: 412620 - DNA, 25 bp, Rattus norvegicus
gcttgcattccaaatttcttaccaa

SEQ ID NO: 412621 - DNA, 25 bp, Rattus norvegicus
gcttgcattccatatttcttaccaa

SEQ ID NO: 412622 - DNA, 25 bp, Rattus norvegicus
gcttgcatttcacagtagttaacca

SEQ ID NO: 412623 - DNA, 25 bp, Rattus norvegicus
gcttgcatttcagagtagttaacca

SEQ ID NO: 412624 - DNA, 25 bp, Rattus norvegicus
gcttgcattttcaaagactttcctg

SEQ ID NO: 412625 - DNA, 25 bp, Rattus norvegicus
gcttgcattttctaagactttcctg

SEQ ID NO: 412626 - DNA, 25 bp, Rattus norvegicus
gcttgccaagttcttttgccaaaat

SEQ ID NO: 412627 - DNA, 25 bp, Rattus norvegicus
gcttgccaagttgttttgccaaaat

SEQ ID NO: 412628 - DNA, 25 bp, Rattus norvegicus
gcttgccacagtattacagggtcac

SEQ ID NO: 412629 - DNA, 25 bp, Rattus norvegicus
gcttgccacagttttacagggtcac

SEQ ID NO: 412630 - DNA, 25 bp, Rattus norvegicus
gcttgccatgtgcacgatgagttca

SEQ ID NO: 412631 - DNA, 25 bp, Rattus norvegicus
gcttgccatgtggacgatgagttca

SEQ ID NO: 412632 - DNA, 25 bp, Rattus norvegicus
gcttgcccaaaactaaatgacttct

SEQ ID NO: 412633 - DNA, 25 bp, Rattus norvegicus
gcttgcccaaaagtaaatgacttct

SEQ ID NO: 412634 - DNA, 25 bp, Rattus norvegicus
gcttgccctaggaaacttgatttta

SEQ ID NO: 412635 - DNA, 25 bp, Rattus norvegicus
gcttgccctaggaaagaactttttg

SEQ ID NO: 412636 - DNA, 25 bp, Rattus norvegicus
gcttgccctaggtaacttgatttta

SEQ ID NO: 412637 - DNA, 25 bp, Rattus norvegicus
gcttgccctaggtaagaactttttg

SEQ ID NO: 412638 - DNA, 25 bp, Rattus norvegicus
gcttgccctctcaaagcaacaaaac

SEQ ID NO: 412639 - DNA, 25 bp, Rattus norvegicus
gcttgccctctctaagcaacaaaac

SEQ ID NO: 412640 - DNA, 25 bp, Rattus norvegicus
gcttgccctgacagtgatcctggag

SEQ ID NO: 412641 - DNA, 25 bp, Rattus norvegicus
gcttgccctgactgtgatcctggag

SEQ ID NO: 412642 - DNA, 25 bp, Rattus norvegicus
gcttgccctttgaattcagttgtga

SEQ ID NO: 412643 - DNA, 25 bp, Rattus norvegicus
gcttgccctttgtattcagttgtga

SEQ ID NO: 412644 - DNA, 25 bp, Rattus norvegicus
gcttgccgacagaggacttgtgtgt

SEQ ID NO: 412645 - DNA, 25 bp, Rattus norvegicus
gcttgccgacagtggacttgtgtgt

SEQ ID NO: 412646 - DNA, 25 bp, Rattus norvegicus
gcttgccgactgaaggcccagaaat

SEQ ID NO: 412647 - DNA, 25 bp, Rattus norvegicus
gcttgccgactgtaggcccagaaat

SEQ ID NO: 412648 - DNA, 25 bp, Rattus norvegicus
gcttgcctaagaaaggttccccact

SEQ ID NO: 412649 - DNA, 25 bp, Rattus norvegicus
gcttgcctaagataggttccccact

SEQ ID NO: 412650 - DNA, 25 bp, Rattus norvegicus
gcttgcctagtacccatagaccttg

SEQ ID NO: 412651 - DNA, 25 bp, Rattus norvegicus
gcttgcctagtagccatagaccttg

SEQ ID NO: 412652 - DNA, 25 bp, Rattus norvegicus
gcttgcctatttcctgtatacatgt

SEQ ID NO: 412653 - DNA, 25 bp, Rattus norvegicus
gcttgcctatttgctgtatacatgt

SEQ ID NO: 412654 - DNA, 25 bp, Rattus norvegicus
gcttgcctccaacaactctttagaa

SEQ ID NO: 412655 - DNA, 25 bp, Rattus norvegicus
gcttgcctccaagaactctttagaa

SEQ ID NO: 412656 - DNA, 25 bp, Rattus norvegicus
gcttgcctctataaatgcttgcttg

SEQ ID NO: 412657 - DNA, 25 bp, Rattus norvegicus
gcttgcctctattaatgcttgcttg

SEQ ID NO: 412658 - DNA, 25 bp, Rattus norvegicus
gcttgcctctctcaggaagttcaca

SEQ ID NO: 412659 - DNA, 25 bp, Rattus norvegicus
gcttgcctctctgaggaagttcaca

SEQ ID NO: 412660 - DNA, 25 bp, Rattus norvegicus
gcttgcctctgccaagtcaaaggca

SEQ ID NO: 412661 - DNA, 25 bp, Rattus norvegicus
gcttgcctctgcgaagtcaaaggca

SEQ ID NO: 412662 - DNA, 25 bp, Rattus norvegicus
gcttgcctctggacgtgatgcttgc

SEQ ID NO: 412663 - DNA, 25 bp, Rattus norvegicus
gcttgcctctggtcgtgatgcttgc

SEQ ID NO: 412664 - DNA, 25 bp, Rattus norvegicus
gcttgcctcttccttagcagcggtg

SEQ ID NO: 412665 - DNA, 25 bp, Rattus norvegicus
gcttgcctcttcgttagcagcggtg

SEQ ID NO: 412666 - DNA, 25 bp, Rattus norvegicus
gcttgcctgaaactacagttgccca

SEQ ID NO: 412667 - DNA, 25 bp, Rattus norvegicus
gcttgcctgaaagtacagttgccca

SEQ ID NO: 412668 - DNA, 25 bp, Rattus norvegicus
gcttgcctgcaaacttgtcttagca

SEQ ID NO: 412669 - DNA, 25 bp, Rattus norvegicus
gcttgcctgcaatcttgtcttagca

SEQ ID NO: 412670 - DNA, 25 bp, Rattus norvegicus
gcttgcctgcacagagagcatgagt

SEQ ID NO: 412671 - DNA, 25 bp, Rattus norvegicus
gcttgcctgcactgagagcatgagt

SEQ ID NO: 412672 - DNA, 25 bp, Rattus norvegicus
gcttgcctgttccatgtctgattag

SEQ ID NO: 412673 - DNA, 25 bp, Rattus norvegicus
gcttgcctgttcgatgtctgattag

SEQ ID NO: 412674 - DNA, 25 bp, Rattus norvegicus
gcttgcctgttgcaatgtggtagaa

SEQ ID NO: 412675 - DNA, 25 bp, Rattus norvegicus
gcttgcctgttggaatgtggtagaa

SEQ ID NO: 412676 - DNA, 25 bp, Rattus norvegicus
gcttgccttctgaacagtgcacaaa

SEQ ID NO: 412677 - DNA, 25 bp, Rattus norvegicus
gcttgccttctgtacagtgcacaaa

SEQ ID NO: 412678 - DNA, 25 bp, Rattus norvegicus
gcttgccttgtgcatcaataaacca

SEQ ID NO: 412679 - DNA, 25 bp, Rattus norvegicus
gcttgccttgtggatcaataaacca

SEQ ID NO: 412680 - DNA, 25 bp, Rattus norvegicus
gcttgcctttaacctgacagatgag

SEQ ID NO: 412681 - DNA, 25 bp, Rattus norvegicus
gcttgcctttaagctgacagatgag

SEQ ID NO: 412682 - DNA, 25 bp, Rattus norvegicus
gcttgcctttccatgacagtttggg

SEQ ID NO: 412683 - DNA, 25 bp, Rattus norvegicus
gcttgcctttccttgacagtttggg

SEQ ID NO: 412684 - DNA, 25 bp, Rattus norvegicus
gcttgcctttctagccagtaaatat

SEQ ID NO: 412685 - DNA, 25 bp, Rattus norvegicus
gcttgcctttcttgccagtaaatat

SEQ ID NO: 412686 - DNA, 25 bp, Rattus norvegicus
gcttgcgacttcctataggcacgta

SEQ ID NO: 412687 - DNA, 25 bp, Rattus norvegicus
gcttgcgacttcgtataggcacgta

SEQ ID NO: 412688 - DNA, 25 bp, Rattus norvegicus
gcttgcggtttcatcgaaccaacac

SEQ ID NO: 412689 - DNA, 25 bp, Rattus norvegicus
gcttgcggtttcttcgaaccaacac

SEQ ID NO: 412690 - DNA, 25 bp, Rattus norvegicus
gcttgcgtatctccttgcttaatag

SEQ ID NO: 412691 - DNA, 25 bp, Rattus norvegicus
gcttgcgtatctgcttgcttaatag

SEQ ID NO: 412692 - DNA, 25 bp, Rattus norvegicus
gcttgcgtccatctagtaccctggt

SEQ ID NO: 412693 - DNA, 25 bp, Rattus norvegicus
gcttgcgtccatgtagtaccctggt

SEQ ID NO: 412694 - DNA, 25 bp, Rattus norvegicus
gcttgctaatacaacagctcttcaa

SEQ ID NO: 412695 - DNA, 25 bp, Rattus norvegicus
gcttgctaatactacagctcttcaa

SEQ ID NO: 412696 - DNA, 25 bp, Rattus norvegicus
gcttgctaatagcttggctgtggat

SEQ ID NO: 412697 - DNA, 25 bp, Rattus norvegicus
gcttgctaataggttggctgtggat

SEQ ID NO: 412698 - DNA, 25 bp, Rattus norvegicus
gcttgctactcactgctcagatgga

SEQ ID NO: 412699 - DNA, 25 bp, Rattus norvegicus
gcttgctactcagtgctcagatgga

SEQ ID NO: 412700 - DNA, 25 bp, Rattus norvegicus
gcttgctatcctcgagagttagtgg

SEQ ID NO: 412701 - DNA, 25 bp, Rattus norvegicus
gcttgctatcctggagagttagtgg

SEQ ID NO: 412702 - DNA, 25 bp, Rattus norvegicus
gcttgctatgtcaaataccgttgga

SEQ ID NO: 412703 - DNA, 25 bp, Rattus norvegicus
gcttgctatgtctaataccgttgga

SEQ ID NO: 412704 - DNA, 25 bp, Rattus norvegicus
gcttgctatgttcaccaggtgggcc

SEQ ID NO: 412705 - DNA, 25 bp, Rattus norvegicus
gcttgctatgttgaccaggtgggcc

SEQ ID NO: 412706 - DNA, 25 bp, Rattus norvegicus
gcttgctcagtcactagctaacgta

SEQ ID NO: 412707 - DNA, 25 bp, Rattus norvegicus
gcttgctcagtctctagctaacgta

SEQ ID NO: 412708 - DNA, 25 bp, Rattus norvegicus
gcttgctcccggaagaacctgagtg

SEQ ID NO: 412709 - DNA, 25 bp, Rattus norvegicus
gcttgctcccggtagaacctgagtg

SEQ ID NO: 412710 - DNA, 25 bp, Rattus norvegicus
gcttgctctcatagctggaagcata

SEQ ID NO: 412711 - DNA, 25 bp, Rattus norvegicus
gcttgctctcattgctggaagcata

SEQ ID NO: 412712 - DNA, 25 bp, Rattus norvegicus
gcttgctctctcagttatagacggt

SEQ ID NO: 412713 - DNA, 25 bp, Rattus norvegicus
gcttgctctctctgttatagacggt

SEQ ID NO: 412714 - DNA, 25 bp, Rattus norvegicus
gcttgctctgctcattcacaaaata

SEQ ID NO: 412715 - DNA, 25 bp, Rattus norvegicus
gcttgctctgctgattcacaaaata

SEQ ID NO: 412716 - DNA, 25 bp, Rattus norvegicus
gcttgctctgtaatgctgaaaccat

SEQ ID NO: 412717 - DNA, 25 bp, Rattus norvegicus
gcttgctctgtattgctgaaaccat

SEQ ID NO: 412718 - DNA, 25 bp, Rattus norvegicus
gcttgctgaagccagccactggtat

SEQ ID NO: 412719 - DNA, 25 bp, Rattus norvegicus
gcttgctgaagcgagccactggtat

SEQ ID NO: 412720 - DNA, 25 bp, Rattus norvegicus
gcttgctgactgagaagaactgcat

SEQ ID NO: 412721 - DNA, 25 bp, Rattus norvegicus
gcttgctgactgtgaagaactgcat

SEQ ID NO: 412722 - DNA, 25 bp, Rattus norvegicus
gcttgctgagaacactgtggctact

SEQ ID NO: 412723 - DNA, 25 bp, Rattus norvegicus
gcttgctgagaagactgtggctact

SEQ ID NO: 412724 - DNA, 25 bp, Rattus norvegicus
gcttgctgcaaactctgaacttcat

SEQ ID NO: 412725 - DNA, 25 bp, Rattus norvegicus
gcttgctgcaaagtctgaacttcat

SEQ ID NO: 412726 - DNA, 25 bp, Rattus norvegicus
gcttgctgcaatcctgagaataacc

SEQ ID NO: 412727 - DNA, 25 bp, Rattus norvegicus
gcttgctgcaatgctgagaataacc

SEQ ID NO: 412728 - DNA, 25 bp, Rattus norvegicus
gcttgctgcctgagccagttgactg

SEQ ID NO: 412729 - DNA, 25 bp, Rattus norvegicus
gcttgctgcctgtgccagttgactg

SEQ ID NO: 412730 - DNA, 25 bp, Rattus norvegicus
gcttgctgccttatatttgctttgg

SEQ ID NO: 412731 - DNA, 25 bp, Rattus norvegicus
gcttgctgccttttatttgctttgg

SEQ ID NO: 412732 - DNA, 25 bp, Rattus norvegicus
gcttgctgggcacatccattggatt

SEQ ID NO: 412733 - DNA, 25 bp, Rattus norvegicus
gcttgctgggcagatccattggatt

SEQ ID NO: 412734 - DNA, 25 bp, Rattus norvegicus
gcttgctgtgaaaattggtgcctaa

SEQ ID NO: 412735 - DNA, 25 bp, Rattus norvegicus
gcttgctgtgaatattggtgcctaa

SEQ ID NO: 412736 - DNA, 25 bp, Rattus norvegicus
gcttgctgtgaccagtcttactgaa

SEQ ID NO: 412737 - DNA, 25 bp, Rattus norvegicus
gcttgctgtgacgagtcttactgaa

SEQ ID NO: 412738 - DNA, 25 bp, Rattus norvegicus
gcttgctgtgccagaatacttctga

SEQ ID NO: 412739 - DNA, 25 bp, Rattus norvegicus
gcttgctgtgcctgaatacttctga

SEQ ID NO: 412740 - DNA, 25 bp, Rattus norvegicus
gcttgctgttacaacactagcctag

SEQ ID NO: 412741 - DNA, 25 bp, Rattus norvegicus
gcttgctgttactacactagcctag

SEQ ID NO: 412742 - DNA, 25 bp, Rattus norvegicus
gcttgctgttttacagaccccctta

SEQ ID NO: 412743 - DNA, 25 bp, Rattus norvegicus
gcttgctgtttttcagaccccctta

SEQ ID NO: 412744 - DNA, 25 bp, Rattus norvegicus
gcttgcttaagcaactatctcctag

SEQ ID NO: 412745 - DNA, 25 bp, Rattus norvegicus
gcttgcttaagctactatctcctag

SEQ ID NO: 412746 - DNA, 25 bp, Rattus norvegicus
gcttgcttaatactgtacttcccac

SEQ ID NO: 412747 - DNA, 25 bp, Rattus norvegicus
gcttgcttaatagtgtacttcccac

SEQ ID NO: 412748 - DNA, 25 bp, Rattus norvegicus
gcttgcttacacactggcggaaggc

SEQ ID NO: 412749 - DNA, 25 bp, Rattus norvegicus
gcttgcttacactctggcggaaggc

SEQ ID NO: 412750 - DNA, 25 bp, Rattus norvegicus
gcttgcttacggaaggcgacaggct

SEQ ID NO: 412751 - DNA, 25 bp, Rattus norvegicus
gcttgcttacggtaggcgacaggct

SEQ ID NO: 412752 - DNA, 25 bp, Rattus norvegicus
gcttgcttaggcagtatgttcactt

SEQ ID NO: 412753 - DNA, 25 bp, Rattus norvegicus
gcttgcttaggctgtatgttcactt

SEQ ID NO: 412754 - DNA, 25 bp, Rattus norvegicus
gcttgcttcattcctcaaaggtctc

SEQ ID NO: 412755 - DNA, 25 bp, Rattus norvegicus
gcttgcttcattcctgaggctggga

SEQ ID NO: 412756 - DNA, 25 bp, Rattus norvegicus
gcttgcttcattgctcaaaggtctc

SEQ ID NO: 412757 - DNA, 25 bp, Rattus norvegicus
gcttgcttcattgctgaggctggga

SEQ ID NO: 412758 - DNA, 25 bp, Rattus norvegicus
gcttgcttccaaatataacgccctg

SEQ ID NO: 412759 - DNA, 25 bp, Rattus norvegicus
gcttgcttccaattataacgccctg

SEQ ID NO: 412760 - DNA, 25 bp, Rattus norvegicus
gcttgcttctagagttttgctacat

SEQ ID NO: 412761 - DNA, 25 bp, Rattus norvegicus
gcttgcttctagtgttttgctacat

SEQ ID NO: 412762 - DNA, 25 bp, Rattus norvegicus
gcttgcttgggcactgggctctatg

SEQ ID NO: 412763 - DNA, 25 bp, Rattus norvegicus
gcttgcttgggctctgggctctatg

SEQ ID NO: 412764 - DNA, 25 bp, Rattus norvegicus
gcttgcttgggtactatactgtgac

SEQ ID NO: 412765 - DNA, 25 bp, Rattus norvegicus
gcttgcttgggttctatactgtgac

SEQ ID NO: 412766 - DNA, 25 bp, Rattus norvegicus
gcttgctttaggacacagttgtgtt

SEQ ID NO: 412767 - DNA, 25 bp, Rattus norvegicus
gcttgctttaggtcacagttgtgtt

SEQ ID NO: 412768 - DNA, 25 bp, Rattus norvegicus
gcttgctttagtaagacgtctcata

SEQ ID NO: 412769 - DNA, 25 bp, Rattus norvegicus
gcttgctttagttagacgtctcata

SEQ ID NO: 412770 - DNA, 25 bp, Rattus norvegicus
gcttgctttcttacacgtcttaatt

SEQ ID NO: 412771 - DNA, 25 bp, Rattus norvegicus
gcttgctttctttcacgtcttaatt

SEQ ID NO: 412772 - DNA, 25 bp, Rattus norvegicus
gcttgcttttccagagtacctgagt

SEQ ID NO: 412773 - DNA, 25 bp, Rattus norvegicus
gcttgcttttcctgagtacctgagt

SEQ ID NO: 412774 - DNA, 25 bp, Rattus norvegicus
gcttgcttttctaggtagtcattaa

SEQ ID NO: 412775 - DNA, 25 bp, Rattus norvegicus
gcttgcttttcttggtagtcattaa

SEQ ID NO: 412776 - DNA, 25 bp, Rattus norvegicus
gcttgcttttgtattcctttggtat

SEQ ID NO: 412777 - DNA, 25 bp, Rattus norvegicus
gcttgcttttgttttcctttggtat

SEQ ID NO: 412778 - DNA, 25 bp, Rattus norvegicus
gcttggaaatgtattgtactggcct

SEQ ID NO: 412779 - DNA, 25 bp, Rattus norvegicus
gcttggaaatgttttgtactggcct

SEQ ID NO: 412780 - DNA, 25 bp, Rattus norvegicus
gcttggaagagcacaaagctgacag

SEQ ID NO: 412781 - DNA, 25 bp, Rattus norvegicus
gcttggaagagctcaaagctgacag

SEQ ID NO: 412782 - DNA, 25 bp, Rattus norvegicus
gcttggaagatcacatggccaggat

SEQ ID NO: 412783 - DNA, 25 bp, Rattus norvegicus
gcttggaagatctcatggccaggat

SEQ ID NO: 412784 - DNA, 25 bp, Rattus norvegicus
gcttggaagcctctgacaccagggt

SEQ ID NO: 412785 - DNA, 25 bp, Rattus norvegicus
gcttggaagcctgtgacaccagggt

SEQ ID NO: 412786 - DNA, 25 bp, Rattus norvegicus
gcttggaaggcacctcctggacagt

SEQ ID NO: 412787 - DNA, 25 bp, Rattus norvegicus
gcttggaaggcagctcctggacagt

SEQ ID NO: 412788 - DNA, 25 bp, Rattus norvegicus
gcttggaagtccaccaggtttctat

SEQ ID NO: 412789 - DNA, 25 bp, Rattus norvegicus
gcttggaagtcctccaggtttctat

SEQ ID NO: 412790 - DNA, 25 bp, Rattus norvegicus
gcttggaagtgcacagctggctagt

SEQ ID NO: 412791 - DNA, 25 bp, Rattus norvegicus
gcttggaagtgctcagctggctagt

SEQ ID NO: 412792 - DNA, 25 bp, Rattus norvegicus
gcttggacaaacacccgggagctga

SEQ ID NO: 412793 - DNA, 25 bp, Rattus norvegicus
gcttggacaaactcccgggagctga

SEQ ID NO: 412794 - DNA, 25 bp, Rattus norvegicus
gcttggacaaatacacacccggtga

SEQ ID NO: 412795 - DNA, 25 bp, Rattus norvegicus
gcttggacaaattcacacccggtga

SEQ ID NO: 412796 - DNA, 25 bp, Rattus norvegicus
gcttggacctgaaacacttttgagt

SEQ ID NO: 412797 - DNA, 25 bp, Rattus norvegicus
gcttggacctgatacacttttgagt

SEQ ID NO: 412798 - DNA, 25 bp, Rattus norvegicus
gcttggacgtttagcattctaggtt

SEQ ID NO: 412799 - DNA, 25 bp, Rattus norvegicus
gcttggacgttttgcattctaggtt

SEQ ID NO: 412800 - DNA, 25 bp, Rattus norvegicus
gcttggactcaacaccctggtgata

SEQ ID NO: 412801 - DNA, 25 bp, Rattus norvegicus
gcttggactcaagaccctggtgata

SEQ ID NO: 412802 - DNA, 25 bp, Rattus norvegicus
gcttggactcagcagcagatttcat

SEQ ID NO: 412803 - DNA, 25 bp, Rattus norvegicus
gcttggactcaggagcagatttcat

SEQ ID NO: 412804 - DNA, 25 bp, Rattus norvegicus
gcttggactccaaaagagacagtca

SEQ ID NO: 412805 - DNA, 25 bp, Rattus norvegicus
gcttggactccataagagacagtca

SEQ ID NO: 412806 - DNA, 25 bp, Rattus norvegicus
gcttggacttaaccaggctggaact

SEQ ID NO: 412807 - DNA, 25 bp, Rattus norvegicus
gcttggacttaagcaggctggaact

SEQ ID NO: 412808 - DNA, 25 bp, Rattus norvegicus
gcttggagaacaaggccagcgcatc

SEQ ID NO: 412809 - DNA, 25 bp, Rattus norvegicus
gcttggagaacatggccagcgcatc

SEQ ID NO: 412810 - DNA, 25 bp, Rattus norvegicus
gcttggagaactagctcaccgtcat

SEQ ID NO: 412811 - DNA, 25 bp, Rattus norvegicus
gcttggagaacttgctcaccgtcat

SEQ ID NO: 412812 - DNA, 25 bp, Rattus norvegicus
gcttggagaggcctagaaataccga

SEQ ID NO: 412813 - DNA, 25 bp, Rattus norvegicus
gcttggagaggcgtagaaataccga

SEQ ID NO: 412814 - DNA, 25 bp, Rattus norvegicus
gcttggagcaccagttcgctgtgaa

SEQ ID NO: 412815 - DNA, 25 bp, Rattus norvegicus
gcttggagcacctgttcgctgtgaa

SEQ ID NO: 412816 - DNA, 25 bp, Rattus norvegicus
gcttggaggaatcccgcttactggt

SEQ ID NO: 412817 - DNA, 25 bp, Rattus norvegicus
gcttggaggaatgccgcttactggt

SEQ ID NO: 412818 - DNA, 25 bp, Rattus norvegicus
gcttggatatttacttggctgaact

SEQ ID NO: 412819 - DNA, 25 bp, Rattus norvegicus
gcttggatattttcttggctgaact

SEQ ID NO: 412820 - DNA, 25 bp, Rattus norvegicus
gcttggatgtatagtctcctctttg

SEQ ID NO: 412821 - DNA, 25 bp, Rattus norvegicus
gcttggatgtattgtctcctctttg

SEQ ID NO: 412822 - DNA, 25 bp, Rattus norvegicus
gcttggatgtgtacagtgccttata

SEQ ID NO: 412823 - DNA, 25 bp, Rattus norvegicus
gcttggatgtgttcagtgccttata

SEQ ID NO: 412824 - DNA, 25 bp, Rattus norvegicus
gcttggattacacgcttgaactacc

SEQ ID NO: 412825 - DNA, 25 bp, Rattus norvegicus
gcttggattacaggcttgaactacc

SEQ ID NO: 412826 - DNA, 25 bp, Rattus norvegicus
gcttggatttggacaaagggctcat

SEQ ID NO: 412827 - DNA, 25 bp, Rattus norvegicus
gcttggatttggtcaaagggctcat

SEQ ID NO: 412828 - DNA, 25 bp, Rattus norvegicus
gcttggcaactaagagatcctgtat

SEQ ID NO: 412829 - DNA, 25 bp, Rattus norvegicus
gcttggcaactatgagatcctgtat

SEQ ID NO: 412830 - DNA, 25 bp, Rattus norvegicus
gcttggcagacacttgtaattggaa

SEQ ID NO: 412831 - DNA, 25 bp, Rattus norvegicus
gcttggcagacagttgtaattggaa

SEQ ID NO: 412832 - DNA, 25 bp, Rattus norvegicus
gcttggcagtgcagtagctctgcaa

SEQ ID NO: 412833 - DNA, 25 bp, Rattus norvegicus
gcttggcagtgctgtagctctgcaa

SEQ ID NO: 412834 - DNA, 25 bp, Rattus norvegicus
gcttggcagtgtctcttggcatcga

SEQ ID NO: 412835 - DNA, 25 bp, Rattus norvegicus
gcttggcagtgtgtcttggcatcga

SEQ ID NO: 412836 - DNA, 25 bp, Rattus norvegicus
gcttggcatgccctgcattcggtca

SEQ ID NO: 412837 - DNA, 25 bp, Rattus norvegicus
gcttggcatgccgtgcattcggtca

SEQ ID NO: 412838 - DNA, 25 bp, Rattus norvegicus
gcttggcatgtcattatttcccact

SEQ ID NO: 412839 - DNA, 25 bp, Rattus norvegicus
gcttggcatgtctttatttcccact

SEQ ID NO: 412840 - DNA, 25 bp, Rattus norvegicus
gcttggcattcccatgtacttagga

SEQ ID NO: 412841 - DNA, 25 bp, Rattus norvegicus
gcttggcattccgatgtacttagga

SEQ ID NO: 412842 - DNA, 25 bp, Rattus norvegicus
gcttggccacagcaagaatctgcgt

SEQ ID NO: 412843 - DNA, 25 bp, Rattus norvegicus
gcttggccacaggaagaatctgcgt

SEQ ID NO: 412844 - DNA, 25 bp, Rattus norvegicus
gcttggccatccagactgttagtca

SEQ ID NO: 412845 - DNA, 25 bp, Rattus norvegicus
gcttggccatcctgactgttagtca

SEQ ID NO: 412846 - DNA, 25 bp, Rattus norvegicus
gcttggcccagaacctcgtgagtga

SEQ ID NO: 412847 - DNA, 25 bp, Rattus norvegicus
gcttggcccagacacactgagtcag

SEQ ID NO: 412848 - DNA, 25 bp, Rattus norvegicus
gcttggcccagagacactgagtcag

SEQ ID NO: 412849 - DNA, 25 bp, Rattus norvegicus
gcttggcccagatcctcgtgagtga

SEQ ID NO: 412850 - DNA, 25 bp, Rattus norvegicus
gcttggcccagcctgcaaaggatct

SEQ ID NO: 412851 - DNA, 25 bp, Rattus norvegicus
gcttggcccagcgtgcaaaggatct

SEQ ID NO: 412852 - DNA, 25 bp, Rattus norvegicus
gcttggccccatactgggatatgat

SEQ ID NO: 412853 - DNA, 25 bp, Rattus norvegicus
gcttggccccattctgggatatgat

SEQ ID NO: 412854 - DNA, 25 bp, Rattus norvegicus
gcttggccgattaacctggccaata

SEQ ID NO: 412855 - DNA, 25 bp, Rattus norvegicus
gcttggccgatttacctggccaata

SEQ ID NO: 412856 - DNA, 25 bp, Rattus norvegicus
gcttggcctgccatggtctggtcag

SEQ ID NO: 412857 - DNA, 25 bp, Rattus norvegicus
gcttggcctgccttggtctggtcag

SEQ ID NO: 412858 - DNA, 25 bp, Rattus norvegicus
gcttggcctgcgacatgggagactt

SEQ ID NO: 412859 - DNA, 25 bp, Rattus norvegicus
gcttggcctgcgtcatgggagactt

SEQ ID NO: 412860 - DNA, 25 bp, Rattus norvegicus
gcttggccttgcaaaggtttcacca

SEQ ID NO: 412861 - DNA, 25 bp, Rattus norvegicus
gcttggccttgctaaggtttcacca

SEQ ID NO: 412862 - DNA, 25 bp, Rattus norvegicus
gcttggcgaagcaaggctgtgttta

SEQ ID NO: 412863 - DNA, 25 bp, Rattus norvegicus
gcttggcgaagctaggctgtgttta

SEQ ID NO: 412864 - DNA, 25 bp, Rattus norvegicus
gcttggcgaccaaagatatttcatg

SEQ ID NO: 412865 - DNA, 25 bp, Rattus norvegicus
gcttggcgaccatagatatttcatg

SEQ ID NO: 412866 - DNA, 25 bp, Rattus norvegicus
gcttggctaattatcttatctgggt

SEQ ID NO: 412867 - DNA, 25 bp, Rattus norvegicus
gcttggctaattttcttatctgggt

SEQ ID NO: 412868 - DNA, 25 bp, Rattus norvegicus
gcttggctaccaaagagactgagat

SEQ ID NO: 412869 - DNA, 25 bp, Rattus norvegicus
gcttggctaccatagagactgagat

SEQ ID NO: 412870 - DNA, 25 bp, Rattus norvegicus
gcttggctcaagaaaccagctggag

SEQ ID NO: 412871 - DNA, 25 bp, Rattus norvegicus
gcttggctcaagtaaccagctggag

SEQ ID NO: 412872 - DNA, 25 bp, Rattus norvegicus
gcttggctccgtaagcagtctagag

SEQ ID NO: 412873 - DNA, 25 bp, Rattus norvegicus
gcttggctccgttagcagtctagag

SEQ ID NO: 412874 - DNA, 25 bp, Rattus norvegicus
gcttggctcctcagatgaagtgtga

SEQ ID NO: 412875 - DNA, 25 bp, Rattus norvegicus
gcttggctcctctgatgaagtgtga

SEQ ID NO: 412876 - DNA, 25 bp, Rattus norvegicus
gcttggctgcagcacagcgacttga

SEQ ID NO: 412877 - DNA, 25 bp, Rattus norvegicus
gcttggctgcaggacagcgacttga

SEQ ID NO: 412878 - DNA, 25 bp, Rattus norvegicus
gcttggctgtgtatctgatctacaa

SEQ ID NO: 412879 - DNA, 25 bp, Rattus norvegicus
gcttggctgtgtttctgatctacaa

SEQ ID NO: 412880 - DNA, 25 bp, Rattus norvegicus
gcttggcttcacctgaagttgagtt

SEQ ID NO: 412881 - DNA, 25 bp, Rattus norvegicus
gcttggcttcacgtgaagttgagtt

SEQ ID NO: 412882 - DNA, 25 bp, Rattus norvegicus
gcttggcttctcagcatgtggtcat

SEQ ID NO: 412883 - DNA, 25 bp, Rattus norvegicus
gcttggcttctctgcatgtggtcat

SEQ ID NO: 412884 - DNA, 25 bp, Rattus norvegicus
gcttggcttgcaagaagtgccctgt

SEQ ID NO: 412885 - DNA, 25 bp, Rattus norvegicus
gcttggcttgcactcagacatttca

SEQ ID NO: 412886 - DNA, 25 bp, Rattus norvegicus
gcttggcttgcagtcagacatttca

SEQ ID NO: 412887 - DNA, 25 bp, Rattus norvegicus
gcttggcttgcatgaagtgccctgt

SEQ ID NO: 412888 - DNA, 25 bp, Rattus norvegicus
gcttggctttaaatcttttgtattc

SEQ ID NO: 412889 - DNA, 25 bp, Rattus norvegicus
gcttggctttaattcttttgtattc

SEQ ID NO: 412890 - DNA, 25 bp, Rattus norvegicus
gcttggcttttaatattggactttg

SEQ ID NO: 412891 - DNA, 25 bp, Rattus norvegicus
gcttggcttttattattggactttg

SEQ ID NO: 412892 - DNA, 25 bp, Rattus norvegicus
gcttgggaactacagaagcccttta

SEQ ID NO: 412893 - DNA, 25 bp, Rattus norvegicus
gcttgggaactagagaagcccttta

SEQ ID NO: 412894 - DNA, 25 bp, Rattus norvegicus
gcttgggagtgacccctacactagg

SEQ ID NO: 412895 - DNA, 25 bp, Rattus norvegicus
gcttgggagtgagccctacactagg

SEQ ID NO: 412896 - DNA, 25 bp, Rattus norvegicus
gcttgggataacagtgtgctcacct

SEQ ID NO: 412897 - DNA, 25 bp, Rattus norvegicus
gcttgggataactgtgtgctcacct

SEQ ID NO: 412898 - DNA, 25 bp, Rattus norvegicus
gcttgggatcagctccatgaagatt

SEQ ID NO: 412899 - DNA, 25 bp, Rattus norvegicus
gcttgggatcaggtccatgaagatt

SEQ ID NO: 412900 - DNA, 25 bp, Rattus norvegicus
gcttgggcatcaccgtctctctcag

SEQ ID NO: 412901 - DNA, 25 bp, Rattus norvegicus
gcttgggcatcagcgtctctctcag

SEQ ID NO: 412902 - DNA, 25 bp, Rattus norvegicus
gcttgggcatgcactgtagctcaga

SEQ ID NO: 412903 - DNA, 25 bp, Rattus norvegicus
gcttgggcatgctctgtagctcaga

SEQ ID NO: 412904 - DNA, 25 bp, Rattus norvegicus
gcttgggccattcggaagctgcact

SEQ ID NO: 412905 - DNA, 25 bp, Rattus norvegicus
gcttgggccattgggaagctgcact

SEQ ID NO: 412906 - DNA, 25 bp, Rattus norvegicus
gcttgggcctccatgtcttttgttt

SEQ ID NO: 412907 - DNA, 25 bp, Rattus norvegicus
gcttgggcctccttgtcttttgttt

SEQ ID NO: 412908 - DNA, 25 bp, Rattus norvegicus
gcttgggctgatcgtgttagaactc

SEQ ID NO: 412909 - DNA, 25 bp, Rattus norvegicus
gcttgggctgatggtgttagaactc

SEQ ID NO: 412910 - DNA, 25 bp, Rattus norvegicus
gcttgggctgggagatttcattttc

SEQ ID NO: 412911 - DNA, 25 bp, Rattus norvegicus
gcttgggctgggtgatttcattttc

SEQ ID NO: 412912 - DNA, 25 bp, Rattus norvegicus
gcttgggcttccatatacacatgaa

SEQ ID NO: 412913 - DNA, 25 bp, Rattus norvegicus
gcttgggcttccttatacacatgaa

SEQ ID NO: 412914 - DNA, 25 bp, Rattus norvegicus
gcttgggcttctcttttgatggcat

SEQ ID NO: 412915 - DNA, 25 bp, Rattus norvegicus
gcttgggcttctgttttgatggcat

SEQ ID NO: 412916 - DNA, 25 bp, Rattus norvegicus
gcttgggtaccaaactactctttag

SEQ ID NO: 412917 - DNA, 25 bp, Rattus norvegicus
gcttgggtaccatactactctttag

SEQ ID NO: 412918 - DNA, 25 bp, Rattus norvegicus
gcttgggtctcaccacttagtgcat

SEQ ID NO: 412919 - DNA, 25 bp, Rattus norvegicus
gcttgggtctcagcacttagtgcat

SEQ ID NO: 412920 - DNA, 25 bp, Rattus norvegicus
gcttgggtgagcaacaaactttgct

SEQ ID NO: 412921 - DNA, 25 bp, Rattus norvegicus
gcttgggtgagctacaaactttgct

SEQ ID NO: 412922 - DNA, 25 bp, Rattus norvegicus
gcttgggttagaacaccaggctcca

SEQ ID NO: 412923 - DNA, 25 bp, Rattus norvegicus
gcttgggttagatcaccaggctcca

SEQ ID NO: 412924 - DNA, 25 bp, Rattus norvegicus
gcttgggttccgactgtagatttaa

SEQ ID NO: 412925 - DNA, 25 bp, Rattus norvegicus
gcttgggttccgtctgtagatttaa

SEQ ID NO: 412926 - DNA, 25 bp, Rattus norvegicus
gcttgggttgctattaaacgtggat

SEQ ID NO: 412927 - DNA, 25 bp, Rattus norvegicus
gcttgggttgcttttaaacgtggat

SEQ ID NO: 412928 - DNA, 25 bp, Rattus norvegicus
gcttggtaatagcacgggcacacgt

SEQ ID NO: 412929 - DNA, 25 bp, Rattus norvegicus
gcttggtaataggacgggcacacgt

SEQ ID NO: 412930 - DNA, 25 bp, Rattus norvegicus
gcttggtaatatcatttttgttctg

SEQ ID NO: 412931 - DNA, 25 bp, Rattus norvegicus
gcttggtaatatgatttttgttctg

SEQ ID NO: 412932 - DNA, 25 bp, Rattus norvegicus
gcttggtatacccagtgagactccc

SEQ ID NO: 412933 - DNA, 25 bp, Rattus norvegicus
gcttggtataccgagtgagactccc

SEQ ID NO: 412934 - DNA, 25 bp, Rattus norvegicus
gcttggtcatctacatctgctatac

SEQ ID NO: 412935 - DNA, 25 bp, Rattus norvegicus
gcttggtcatcttcatctgctatac

SEQ ID NO: 412936 - DNA, 25 bp, Rattus norvegicus
gcttggtcccaaccagttcagacat

SEQ ID NO: 412937 - DNA, 25 bp, Rattus norvegicus
gcttggtcccaagcagttcagacat

SEQ ID NO: 412938 - DNA, 25 bp, Rattus norvegicus
gcttggtcccatatgcaaatagtat

SEQ ID NO: 412939 - DNA, 25 bp, Rattus norvegicus
gcttggtcccatttgcaaatagtat

SEQ ID NO: 412940 - DNA, 25 bp, Rattus norvegicus
gcttggtccctaaatgcatgaagta

SEQ ID NO: 412941 - DNA, 25 bp, Rattus norvegicus
gcttggtccctatatgcatgaagta

SEQ ID NO: 412942 - DNA, 25 bp, Rattus norvegicus
gcttggtctttcatgtgtttgcgag

SEQ ID NO: 412943 - DNA, 25 bp, Rattus norvegicus
gcttggtctttcttgtgtttgcgag

SEQ ID NO: 412944 - DNA, 25 bp, Rattus norvegicus
gcttggtgcaagctaaaatttttaa

SEQ ID NO: 412945 - DNA, 25 bp, Rattus norvegicus
gcttggtgcaaggtaaaatttttaa

SEQ ID NO: 412946 - DNA, 25 bp, Rattus norvegicus
gcttggtgcagaagcatagccccta

SEQ ID NO: 412947 - DNA, 25 bp, Rattus norvegicus
gcttggtgcagatgcatagccccta

SEQ ID NO: 412948 - DNA, 25 bp, Rattus norvegicus
gcttggtgcgaacctaggtgcttac

SEQ ID NO: 412949 - DNA, 25 bp, Rattus norvegicus
gcttggtgcgaagctaggtgcttac

SEQ ID NO: 412950 - DNA, 25 bp, Rattus norvegicus
gcttggtggtgaattagcaacatat

SEQ ID NO: 412951 - DNA, 25 bp, Rattus norvegicus
gcttggtggtgatttagcaacatat

SEQ ID NO: 412952 - DNA, 25 bp, Rattus norvegicus
gcttggtggttgaagaccccgtgca

SEQ ID NO: 412953 - DNA, 25 bp, Rattus norvegicus
gcttggtggttgtagaccccgtgca

SEQ ID NO: 412954 - DNA, 25 bp, Rattus norvegicus
gcttggtgtcagatctaggctatca

SEQ ID NO: 412955 - DNA, 25 bp, Rattus norvegicus
gcttggtgtcagttctaggctatca

SEQ ID NO: 412956 - DNA, 25 bp, Rattus norvegicus
gcttggtgtcatacatagttacttg

SEQ ID NO: 412957 - DNA, 25 bp, Rattus norvegicus
gcttggtgtcattcatagttacttg

SEQ ID NO: 412958 - DNA, 25 bp, Rattus norvegicus
gcttggttaaccacctgcagagact

SEQ ID NO: 412959 - DNA, 25 bp, Rattus norvegicus
gcttggttaacctcctgcagagact

SEQ ID NO: 412960 - DNA, 25 bp, Rattus norvegicus
gcttggttaccacggagtgtcaata

SEQ ID NO: 412961 - DNA, 25 bp, Rattus norvegicus
gcttggttaccagggagtgtcaata

SEQ ID NO: 412962 - DNA, 25 bp, Rattus norvegicus
gcttggttagagactgcctagccgt

SEQ ID NO: 412963 - DNA, 25 bp, Rattus norvegicus
gcttggttagagtctgcctagccgt

SEQ ID NO: 412964 - DNA, 25 bp, Rattus norvegicus
gcttggttcaaaatgcatgtggatt

SEQ ID NO: 412965 - DNA, 25 bp, Rattus norvegicus
gcttggttcaaattgcatgtggatt

SEQ ID NO: 412966 - DNA, 25 bp, Rattus norvegicus
gcttggttctgccacgacttcaaaa

SEQ ID NO: 412967 - DNA, 25 bp, Rattus norvegicus
gcttggttctgcgacgacttcaaaa

SEQ ID NO: 412968 - DNA, 25 bp, Rattus norvegicus
gcttggttgcacatccatggaggca

SEQ ID NO: 412969 - DNA, 25 bp, Rattus norvegicus
gcttggttgcacttccatggaggca

SEQ ID NO: 412970 - DNA, 25 bp, Rattus norvegicus
gcttggtttccacatcagaggcttt

SEQ ID NO: 412971 - DNA, 25 bp, Rattus norvegicus
gcttggtttccagatcagaggcttt

SEQ ID NO: 412972 - DNA, 25 bp, Rattus norvegicus
gcttggtttcgtagctgtacctaac

SEQ ID NO: 412973 - DNA, 25 bp, Rattus norvegicus
gcttggtttcgttgctgtacctaac

SEQ ID NO: 412974 - DNA, 25 bp, Rattus norvegicus
gcttggttttgacggtttactgcct

SEQ ID NO: 412975 - DNA, 25 bp, Rattus norvegicus
gcttggttttgagggtttactgcct

SEQ ID NO: 412976 - DNA, 25 bp, Rattus norvegicus
gcttggtttttcactataggccata

SEQ ID NO: 412977 - DNA, 25 bp, Rattus norvegicus
gcttggtttttctctataggccata

SEQ ID NO: 412978 - DNA, 25 bp, Rattus norvegicus
gcttggttttttcagtagtgcacat

SEQ ID NO: 412979 - DNA, 25 bp, Rattus norvegicus
gcttggttttttgagtagtgcacat

SEQ ID NO: 412980 - DNA, 25 bp, Rattus norvegicus
gcttgtaaacacaggaaacgctgtt

SEQ ID NO: 412981 - DNA, 25 bp, Rattus norvegicus
gcttgtaaacactggaaacgctgtt

SEQ ID NO: 412982 - DNA, 25 bp, Rattus norvegicus
gcttgtaacaacatcttctgggaga

SEQ ID NO: 412983 - DNA, 25 bp, Rattus norvegicus
gcttgtaacaacttcttctgggaga

SEQ ID NO: 412984 - DNA, 25 bp, Rattus norvegicus
gcttgtaacaggcatttcatttata

SEQ ID NO: 412985 - DNA, 25 bp, Rattus norvegicus
gcttgtaacaggctctctctgcaga

SEQ ID NO: 412986 - DNA, 25 bp, Rattus norvegicus
gcttgtaacagggatttcatttata

SEQ ID NO: 412987 - DNA, 25 bp, Rattus norvegicus
gcttgtaacagggtctctctgcaga

SEQ ID NO: 412988 - DNA, 25 bp, Rattus norvegicus
gcttgtaaccagaccgggttgacta

SEQ ID NO: 412989 - DNA, 25 bp, Rattus norvegicus
gcttgtaaccagtccgggttgacta

SEQ ID NO: 412990 - DNA, 25 bp, Rattus norvegicus
gcttgtaagcaacggcgggcaatct

SEQ ID NO: 412991 - DNA, 25 bp, Rattus norvegicus
gcttgtaagcaagggcgggcaatct

SEQ ID NO: 412992 - DNA, 25 bp, Rattus norvegicus
gcttgtacacagaggctgtcagcca

SEQ ID NO: 412993 - DNA, 25 bp, Rattus norvegicus
gcttgtacacagtggctgtcagcca

SEQ ID NO: 412994 - DNA, 25 bp, Rattus norvegicus
gcttgtaccaaacactgccatgagt

SEQ ID NO: 412995 - DNA, 25 bp, Rattus norvegicus
gcttgtaccaaagactgccatgagt

SEQ ID NO: 412996 - DNA, 25 bp, Rattus norvegicus
gcttgtaccgcaagaccttgaagaa

SEQ ID NO: 412997 - DNA, 25 bp, Rattus norvegicus
gcttgtaccgcatgaccttgaagaa

SEQ ID NO: 412998 - DNA, 25 bp, Rattus norvegicus
gcttgtacctgcattatgatacgta

SEQ ID NO: 412999 - DNA, 25 bp, Rattus norvegicus
gcttgtacctgctttatgatacgta

SEQ ID NO: 413000 - DNA, 25 bp, Rattus norvegicus
gcttgtacggatacgctactgtgac

SEQ ID NO: 413001 - DNA, 25 bp, Rattus norvegicus
gcttgtacggattcgctactgtgac

SEQ ID NO: 413002 - DNA, 25 bp, Rattus norvegicus
gcttgtactaacatctcatcagaaa

SEQ ID NO: 413003 - DNA, 25 bp, Rattus norvegicus
gcttgtactaacttctcatcagaaa

SEQ ID NO: 413004 - DNA, 25 bp, Rattus norvegicus
gcttgtactcacatgggctttatat

SEQ ID NO: 413005 - DNA, 25 bp, Rattus norvegicus
gcttgtactcacttgggctttatat

SEQ ID NO: 413006 - DNA, 25 bp, Rattus norvegicus
gcttgtagagttccaccctatgtca

SEQ ID NO: 413007 - DNA, 25 bp, Rattus norvegicus
gcttgtagagttgcaccctatgtca

SEQ ID NO: 413008 - DNA, 25 bp, Rattus norvegicus
gcttgtagcaacactaagcccttag

SEQ ID NO: 413009 - DNA, 25 bp, Rattus norvegicus
gcttgtagcaactctaagcccttag

SEQ ID NO: 413010 - DNA, 25 bp, Rattus norvegicus
gcttgtagcactacccaatgttaca

SEQ ID NO: 413011 - DNA, 25 bp, Rattus norvegicus
gcttgtagcacttcccaatgttaca

SEQ ID NO: 413012 - DNA, 25 bp, Rattus norvegicus
gcttgtagccttccaaactgggaga

SEQ ID NO: 413013 - DNA, 25 bp, Rattus norvegicus
gcttgtagccttgcaaactgggaga

SEQ ID NO: 413014 - DNA, 25 bp, Rattus norvegicus
gcttgtagctgcctctgtgtaagat

SEQ ID NO: 413015 - DNA, 25 bp, Rattus norvegicus
gcttgtagctgcgtctgtgtaagat

SEQ ID NO: 413016 - DNA, 25 bp, Rattus norvegicus
gcttgtagggaccacccatgagtat

SEQ ID NO: 413017 - DNA, 25 bp, Rattus norvegicus
gcttgtagggacgacccatgagtat

SEQ ID NO: 413018 - DNA, 25 bp, Rattus norvegicus
gcttgtagggttctcacttctttaa

SEQ ID NO: 413019 - DNA, 25 bp, Rattus norvegicus
gcttgtagggttgtcacttctttaa

SEQ ID NO: 413020 - DNA, 25 bp, Rattus norvegicus
gcttgtaggttgaggtaacttctcc

SEQ ID NO: 413021 - DNA, 25 bp, Rattus norvegicus
gcttgtaggttgtggtaacttctcc

SEQ ID NO: 413022 - DNA, 25 bp, Rattus norvegicus
gcttgtagtcatcatcccagtgaga

SEQ ID NO: 413023 - DNA, 25 bp, Rattus norvegicus
gcttgtagtcatgatcccagtgaga

SEQ ID NO: 413024 - DNA, 25 bp, Rattus norvegicus
gcttgtagtttcatttctcccactg

SEQ ID NO: 413025 - DNA, 25 bp, Rattus norvegicus
gcttgtagtttcttttctcccactg

SEQ ID NO: 413026 - DNA, 25 bp, Rattus norvegicus
gcttgtagttttcgtcacagtaaaa

SEQ ID NO: 413027 - DNA, 25 bp, Rattus norvegicus
gcttgtagttttggtcacagtaaaa

SEQ ID NO: 413028 - DNA, 25 bp, Rattus norvegicus
gcttgtatattcactgtctttcaca

SEQ ID NO: 413029 - DNA, 25 bp, Rattus norvegicus
gcttgtatattctctgtctttcaca

SEQ ID NO: 413030 - DNA, 25 bp, Rattus norvegicus
gcttgtatcccgagtgctgtagcaa

SEQ ID NO: 413031 - DNA, 25 bp, Rattus norvegicus
gcttgtatcccgtgtgctgtagcaa

SEQ ID NO: 413032 - DNA, 25 bp, Rattus norvegicus
gcttgtatgtggaaggccctcattt

SEQ ID NO: 413033 - DNA, 25 bp, Rattus norvegicus
gcttgtatgtggtaggccctcattt

SEQ ID NO: 413034 - DNA, 25 bp, Rattus norvegicus
gcttgtattacaccaaaaatcatta

SEQ ID NO: 413035 - DNA, 25 bp, Rattus norvegicus
gcttgtattacagcaaaaatcatta

SEQ ID NO: 413036 - DNA, 25 bp, Rattus norvegicus
gcttgtattcagagttttgccaatt

SEQ ID NO: 413037 - DNA, 25 bp, Rattus norvegicus
gcttgtattcagtgttttgccaatt

SEQ ID NO: 413038 - DNA, 25 bp, Rattus norvegicus
gcttgtattggccatctggagtata

SEQ ID NO: 413039 - DNA, 25 bp, Rattus norvegicus
gcttgtattggcgatctggagtata

SEQ ID NO: 413040 - DNA, 25 bp, Rattus norvegicus
gcttgtattttgagttccttaggga

SEQ ID NO: 413041 - DNA, 25 bp, Rattus norvegicus
gcttgtattttgtgttccttaggga

SEQ ID NO: 413042 - DNA, 25 bp, Rattus norvegicus
gcttgtcaagccaatgccgtgatga

SEQ ID NO: 413043 - DNA, 25 bp, Rattus norvegicus
gcttgtcaagcctatgccgtgatga

SEQ ID NO: 413044 - DNA, 25 bp, Rattus norvegicus
gcttgtcacaaaacagtcagtggca

SEQ ID NO: 413045 - DNA, 25 bp, Rattus norvegicus
gcttgtcacaaatcagtcagtggca

SEQ ID NO: 413046 - DNA, 25 bp, Rattus norvegicus
gcttgtcacagtaaatgagctaaca

SEQ ID NO: 413047 - DNA, 25 bp, Rattus norvegicus
gcttgtcacagttaatgagctaaca

SEQ ID NO: 413048 - DNA, 25 bp, Rattus norvegicus
gcttgtcacattagcacctatgagt

SEQ ID NO: 413049 - DNA, 25 bp, Rattus norvegicus
gcttgtcacatttgcacctatgagt

SEQ ID NO: 413050 - DNA, 25 bp, Rattus norvegicus
gcttgtcaccagcatccagacattt

SEQ ID NO: 413051 - DNA, 25 bp, Rattus norvegicus
gcttgtcaccaggatccagacattt

SEQ ID NO: 413052 - DNA, 25 bp, Rattus norvegicus
gcttgtcacgccagagaacacttga

SEQ ID NO: 413053 - DNA, 25 bp, Rattus norvegicus
gcttgtcacgcctgagaacacttga

SEQ ID NO: 413054 - DNA, 25 bp, Rattus norvegicus
gcttgtcactctccacctggttgaa

SEQ ID NO: 413055 - DNA, 25 bp, Rattus norvegicus
gcttgtcactctgcacctggttgaa

SEQ ID NO: 413056 - DNA, 25 bp, Rattus norvegicus
gcttgtcactgtatttgcagcatag

SEQ ID NO: 413057 - DNA, 25 bp, Rattus norvegicus
gcttgtcactgtcagagctatcaga

SEQ ID NO: 413058 - DNA, 25 bp, Rattus norvegicus
gcttgtcactgtgagagctatcaga

SEQ ID NO: 413059 - DNA, 25 bp, Rattus norvegicus
gcttgtcactgtttttgcagcatag

SEQ ID NO: 413060 - DNA, 25 bp, Rattus norvegicus
gcttgtcagattcaccatgctactt

SEQ ID NO: 413061 - DNA, 25 bp, Rattus norvegicus
gcttgtcagattgaccatgctactt

SEQ ID NO: 413062 - DNA, 25 bp, Rattus norvegicus
gcttgtcagtacaggctggccagag

SEQ ID NO: 413063 - DNA, 25 bp, Rattus norvegicus
gcttgtcagtactggctggccagag

SEQ ID NO: 413064 - DNA, 25 bp, Rattus norvegicus
gcttgtcatgaactgtctcacactg

SEQ ID NO: 413065 - DNA, 25 bp, Rattus norvegicus
gcttgtcatgaagtgtctcacactg

SEQ ID NO: 413066 - DNA, 25 bp, Rattus norvegicus
gcttgtccctggagctacaggccaa

SEQ ID NO: 413067 - DNA, 25 bp, Rattus norvegicus
gcttgtccctggtgctacaggccaa

SEQ ID NO: 413068 - DNA, 25 bp, Rattus norvegicus
gcttgtcccttgctatttttgtgtt

SEQ ID NO: 413069 - DNA, 25 bp, Rattus norvegicus
gcttgtcccttggtatttttgtgtt

SEQ ID NO: 413070 - DNA, 25 bp, Rattus norvegicus
gcttgtccgtcactggttgatttaa

SEQ ID NO: 413071 - DNA, 25 bp, Rattus norvegicus
gcttgtccgtcagtggttgatttaa

SEQ ID NO: 413072 - DNA, 25 bp, Rattus norvegicus
gcttgtcctaagagctatggcttta

SEQ ID NO: 413073 - DNA, 25 bp, Rattus norvegicus
gcttgtcctaagtgctatggcttta

SEQ ID NO: 413074 - DNA, 25 bp, Rattus norvegicus
gcttgtcctattcgtcctctggaag

SEQ ID NO: 413075 - DNA, 25 bp, Rattus norvegicus
gcttgtcctattggtcctctggaag

SEQ ID NO: 413076 - DNA, 25 bp, Rattus norvegicus
gcttgtccttgtatagatgtgttct

SEQ ID NO: 413077 - DNA, 25 bp, Rattus norvegicus
gcttgtccttgtttagatgtgttct

SEQ ID NO: 413078 - DNA, 25 bp, Rattus norvegicus
gcttgtctaaacctgcttcttttgt

SEQ ID NO: 413079 - DNA, 25 bp, Rattus norvegicus
gcttgtctaaacgtgcttcttttgt

SEQ ID NO: 413080 - DNA, 25 bp, Rattus norvegicus
gcttgtctaaatattctagctcgaa

SEQ ID NO: 413081 - DNA, 25 bp, Rattus norvegicus
gcttgtctaaatctgctaatctggc

SEQ ID NO: 413082 - DNA, 25 bp, Rattus norvegicus
gcttgtctaaatgtgctaatctggc

SEQ ID NO: 413083 - DNA, 25 bp, Rattus norvegicus
gcttgtctaaattttctagctcgaa

SEQ ID NO: 413084 - DNA, 25 bp, Rattus norvegicus
gcttgtctacagatgtctgcagtac

SEQ ID NO: 413085 - DNA, 25 bp, Rattus norvegicus
gcttgtctacagttgtctgcagtac

SEQ ID NO: 413086 - DNA, 25 bp, Rattus norvegicus
gcttgtctcaatcatggtgctcaga

SEQ ID NO: 413087 - DNA, 25 bp, Rattus norvegicus
gcttgtctcaatgatggtgctcaga

SEQ ID NO: 413088 - DNA, 25 bp, Rattus norvegicus
gcttgtctcacaaggctgaataaac

SEQ ID NO: 413089 - DNA, 25 bp, Rattus norvegicus
gcttgtctcacatggctgaataaac

SEQ ID NO: 413090 - DNA, 25 bp, Rattus norvegicus
gcttgtctgagcaaaggatcttcaa

SEQ ID NO: 413091 - DNA, 25 bp, Rattus norvegicus
gcttgtctgagctaaggatcttcaa

SEQ ID NO: 413092 - DNA, 25 bp, Rattus norvegicus
gcttgtctgcaacctcgcacttggt

SEQ ID NO: 413093 - DNA, 25 bp, Rattus norvegicus
gcttgtctgcaagctcgcacttggt

SEQ ID NO: 413094 - DNA, 25 bp, Rattus norvegicus
gcttgtctggtaatatcacttctgt

SEQ ID NO: 413095 - DNA, 25 bp, Rattus norvegicus
gcttgtctggtattatcacttctgt

SEQ ID NO: 413096 - DNA, 25 bp, Rattus norvegicus
gcttgtctggtgattctttgtaatc

SEQ ID NO: 413097 - DNA, 25 bp, Rattus norvegicus
gcttgtctggtgtttctttgtaatc

SEQ ID NO: 413098 - DNA, 25 bp, Rattus norvegicus
gcttgtctgtacagtcatgtctgca

SEQ ID NO: 413099 - DNA, 25 bp, Rattus norvegicus
gcttgtctgtactgtcatgtctgca

SEQ ID NO: 413100 - DNA, 25 bp, Rattus norvegicus
gcttgtgaaacacctgcctctgagt

SEQ ID NO: 413101 - DNA, 25 bp, Rattus norvegicus
gcttgtgaaacagctgcctctgagt

SEQ ID NO: 413102 - DNA, 25 bp, Rattus norvegicus
gcttgtgaaagtaaatctggagtta

SEQ ID NO: 413103 - DNA, 25 bp, Rattus norvegicus
gcttgtgaaagttaatctggagtta

SEQ ID NO: 413104 - DNA, 25 bp, Rattus norvegicus
gcttgtgaatttccaggcagtgcct

SEQ ID NO: 413105 - DNA, 25 bp, Rattus norvegicus
gcttgtgaatttgcaggcagtgcct

SEQ ID NO: 413106 - DNA, 25 bp, Rattus norvegicus
gcttgtgacaagagccttcacacag

SEQ ID NO: 413107 - DNA, 25 bp, Rattus norvegicus
gcttgtgacaagtgccttcacacag

SEQ ID NO: 413108 - DNA, 25 bp, Rattus norvegicus
gcttgtgacatccaattttgcattc

SEQ ID NO: 413109 - DNA, 25 bp, Rattus norvegicus
gcttgtgacatcgaattttgcattc

SEQ ID NO: 413110 - DNA, 25 bp, Rattus norvegicus
gcttgtgaccatattctttttacta

SEQ ID NO: 413111 - DNA, 25 bp, Rattus norvegicus
gcttgtgaccattttctttttacta

SEQ ID NO: 413112 - DNA, 25 bp, Rattus norvegicus
gcttgtgatgcccttcaacatggac

SEQ ID NO: 413113 - DNA, 25 bp, Rattus norvegicus
gcttgtgatgccgttcaacatggac

SEQ ID NO: 413114 - DNA, 25 bp, Rattus norvegicus
gcttgtgcaacccaaatcagatgtt

SEQ ID NO: 413115 - DNA, 25 bp, Rattus norvegicus
gcttgtgcaaccgaaatcagatgtt

SEQ ID NO: 413116 - DNA, 25 bp, Rattus norvegicus
gcttgtgcactgaggatgcgtgaat

SEQ ID NO: 413117 - DNA, 25 bp, Rattus norvegicus
gcttgtgcactgtggatgcgtgaat

SEQ ID NO: 413118 - DNA, 25 bp, Rattus norvegicus
gcttgtgccagcaagacgctgtatt

SEQ ID NO: 413119 - DNA, 25 bp, Rattus norvegicus
gcttgtgccagctagacgctgtatt

SEQ ID NO: 413120 - DNA, 25 bp, Rattus norvegicus
gcttgtgcctaaacatggtgatcga

SEQ ID NO: 413121 - DNA, 25 bp, Rattus norvegicus
gcttgtgcctaatcatggtgatcga

SEQ ID NO: 413122 - DNA, 25 bp, Rattus norvegicus
gcttgtgctaacagcccagcaatga

SEQ ID NO: 413123 - DNA, 25 bp, Rattus norvegicus
gcttgtgctaactgcccagcaatga

SEQ ID NO: 413124 - DNA, 25 bp, Rattus norvegicus
gcttgtgctacaaatgcatcctgga

SEQ ID NO: 413125 - DNA, 25 bp, Rattus norvegicus
gcttgtgctacatatgcatcctgga

SEQ ID NO: 413126 - DNA, 25 bp, Rattus norvegicus
gcttgtgctcaacggaccaaactaa

SEQ ID NO: 413127 - DNA, 25 bp, Rattus norvegicus
gcttgtgctcaagggaccaaactaa

SEQ ID NO: 413128 - DNA, 25 bp, Rattus norvegicus
gcttgtgcttatatcgtaggacgaa

SEQ ID NO: 413129 - DNA, 25 bp, Rattus norvegicus
gcttgtgcttatatttacagtggcc

SEQ ID NO: 413130 - DNA, 25 bp, Rattus norvegicus
gcttgtgcttatttcgtaggacgaa

SEQ ID NO: 413131 - DNA, 25 bp, Rattus norvegicus
gcttgtgcttatttttacagtggcc

SEQ ID NO: 413132 - DNA, 25 bp, Rattus norvegicus
gcttgtgcttgcatagtttctattg

SEQ ID NO: 413133 - DNA, 25 bp, Rattus norvegicus
gcttgtgcttgcttagtttctattg

SEQ ID NO: 413134 - DNA, 25 bp, Rattus norvegicus
gcttgtgcttgtaaaatccttggaa

SEQ ID NO: 413135 - DNA, 25 bp, Rattus norvegicus
gcttgtgcttgttaaatccttggaa

SEQ ID NO: 413136 - DNA, 25 bp, Rattus norvegicus
gcttgtggaagtctcagaatcctgc

SEQ ID NO: 413137 - DNA, 25 bp, Rattus norvegicus
gcttgtggaagtgtcagaatcctgc

SEQ ID NO: 413138 - DNA, 25 bp, Rattus norvegicus
gcttgtggaggacctacactgagca

SEQ ID NO: 413139 - DNA, 25 bp, Rattus norvegicus
gcttgtggaggagctacactgagca

SEQ ID NO: 413140 - DNA, 25 bp, Rattus norvegicus
gcttgtggcaggatcagttactgac

SEQ ID NO: 413141 - DNA, 25 bp, Rattus norvegicus
gcttgtggcaggttcagttactgac

SEQ ID NO: 413142 - DNA, 25 bp, Rattus norvegicus
gcttgtggccgaagtacttggtaca

SEQ ID NO: 413143 - DNA, 25 bp, Rattus norvegicus
gcttgtggccgatgtacttggtaca

SEQ ID NO: 413144 - DNA, 25 bp, Rattus norvegicus
gcttgtggctgtcgtttctaacctt

SEQ ID NO: 413145 - DNA, 25 bp, Rattus norvegicus
gcttgtggctgtggtttctaacctt

SEQ ID NO: 413146 - DNA, 25 bp, Rattus norvegicus
gcttgtgggagtcacttctactttc

SEQ ID NO: 413147 - DNA, 25 bp, Rattus norvegicus
gcttgtgggagtgacttctactttc

SEQ ID NO: 413148 - DNA, 25 bp, Rattus norvegicus
gcttgtgggcagagtcggcttcaac

SEQ ID NO: 413149 - DNA, 25 bp, Rattus norvegicus
gcttgtgggcagtgtcggcttcaac

SEQ ID NO: 413150 - DNA, 25 bp, Rattus norvegicus
gcttgtgggtcacgaactgtcctaa

SEQ ID NO: 413151 - DNA, 25 bp, Rattus norvegicus
gcttgtgggtcaggaactgtcctaa

SEQ ID NO: 413152 - DNA, 25 bp, Rattus norvegicus
gcttgtgggtgtcagaacagttcct

SEQ ID NO: 413153 - DNA, 25 bp, Rattus norvegicus
gcttgtgggtgtgagaacagttcct

SEQ ID NO: 413154 - DNA, 25 bp, Rattus norvegicus
gcttgtggtccaccctagagactca

SEQ ID NO: 413155 - DNA, 25 bp, Rattus norvegicus
gcttgtggtccagcctagagactca

SEQ ID NO: 413156 - DNA, 25 bp, Rattus norvegicus
gcttgtggtcttctgatgcactggt

SEQ ID NO: 413157 - DNA, 25 bp, Rattus norvegicus
gcttgtggtcttgtgatgcactggt

SEQ ID NO: 413158 - DNA, 25 bp, Rattus norvegicus
gcttgtggtgaaatttcccagtcct

SEQ ID NO: 413159 - DNA, 25 bp, Rattus norvegicus
gcttgtggtgaattttcccagtcct

SEQ ID NO: 413160 - DNA, 25 bp, Rattus norvegicus
gcttgtggtggaatgtcttggttac

SEQ ID NO: 413161 - DNA, 25 bp, Rattus norvegicus
gcttgtggtggattgtcttggttac

SEQ ID NO: 413162 - DNA, 25 bp, Rattus norvegicus
gcttgtgtacaacgtaactatctct

SEQ ID NO: 413163 - DNA, 25 bp, Rattus norvegicus
gcttgtgtacaaggtaactatctct

SEQ ID NO: 413164 - DNA, 25 bp, Rattus norvegicus
gcttgtgtccagagtagattttcta

SEQ ID NO: 413165 - DNA, 25 bp, Rattus norvegicus
gcttgtgtccagtgtagattttcta

SEQ ID NO: 413166 - DNA, 25 bp, Rattus norvegicus
gcttgtgtccggacatatacgtcaa

SEQ ID NO: 413167 - DNA, 25 bp, Rattus norvegicus
gcttgtgtccggtcatatacgtcaa

SEQ ID NO: 413168 - DNA, 25 bp, Rattus norvegicus
gcttgtgtcctgactgaatattcat

SEQ ID NO: 413169 - DNA, 25 bp, Rattus norvegicus
gcttgtgtcctgtctgaatattcat

SEQ ID NO: 413170 - DNA, 25 bp, Rattus norvegicus
gcttgtgtctgtcaacatttcgttc

SEQ ID NO: 413171 - DNA, 25 bp, Rattus norvegicus
gcttgtgtctgtgaacatttcgttc

SEQ ID NO: 413172 - DNA, 25 bp, Rattus norvegicus
gcttgtgtgcacatgtacttggata

SEQ ID NO: 413173 - DNA, 25 bp, Rattus norvegicus
gcttgtgtgcacttgtacttggata

SEQ ID NO: 413174 - DNA, 25 bp, Rattus norvegicus
gcttgtgtggaaaacttagttctca

SEQ ID NO: 413175 - DNA, 25 bp, Rattus norvegicus
gcttgtgtggaatacttagttctca

SEQ ID NO: 413176 - DNA, 25 bp, Rattus norvegicus
gcttgtgtgggactatacgctgttc

SEQ ID NO: 413177 - DNA, 25 bp, Rattus norvegicus
gcttgtgtgggagtatacgctgttc

SEQ ID NO: 413178 - DNA, 25 bp, Rattus norvegicus
gcttgtgttacaatattgttgcaaa

SEQ ID NO: 413179 - DNA, 25 bp, Rattus norvegicus
gcttgtgttacattattgttgcaaa

SEQ ID NO: 413180 - DNA, 25 bp, Rattus norvegicus
gcttgtgttgcactgactgtgctga

SEQ ID NO: 413181 - DNA, 25 bp, Rattus norvegicus
gcttgtgttgcagtgactgtgctga

SEQ ID NO: 413182 - DNA, 25 bp, Rattus norvegicus
gcttgtgtttagaagttctgagccc

SEQ ID NO: 413183 - DNA, 25 bp, Rattus norvegicus
gcttgtgtttagtagttctgagccc

SEQ ID NO: 413184 - DNA, 25 bp, Rattus norvegicus
gcttgtgtttgcacacacgcacaaa

SEQ ID NO: 413185 - DNA, 25 bp, Rattus norvegicus
gcttgtgtttgccagaccggcagtc

SEQ ID NO: 413186 - DNA, 25 bp, Rattus norvegicus
gcttgtgtttgcgagaccggcagtc

SEQ ID NO: 413187 - DNA, 25 bp, Rattus norvegicus
gcttgtgtttgctcacacgcacaaa

SEQ ID NO: 413188 - DNA, 25 bp, Rattus norvegicus
gcttgttaaagccatctgccatttt

SEQ ID NO: 413189 - DNA, 25 bp, Rattus norvegicus
gcttgttaaagcgatctgccatttt

SEQ ID NO: 413190 - DNA, 25 bp, Rattus norvegicus
gcttgttaattcagcactggtcttc

SEQ ID NO: 413191 - DNA, 25 bp, Rattus norvegicus
gcttgttaattctgcactggtcttc

SEQ ID NO: 413192 - DNA, 25 bp, Rattus norvegicus
gcttgttaattgagacctaggcgtg

SEQ ID NO: 413193 - DNA, 25 bp, Rattus norvegicus
gcttgttaattgtgacctaggcgtg

SEQ ID NO: 413194 - DNA, 25 bp, Rattus norvegicus
gcttgttactgccttttgtcagata

SEQ ID NO: 413195 - DNA, 25 bp, Rattus norvegicus
gcttgttactgcgttttgtcagata

SEQ ID NO: 413196 - DNA, 25 bp, Rattus norvegicus
gcttgttactgtaacaacttgaaat

SEQ ID NO: 413197 - DNA, 25 bp, Rattus norvegicus
gcttgttactgttacaacttgaaat

SEQ ID NO: 413198 - DNA, 25 bp, Rattus norvegicus
gcttgttagtccctttgaagtcatg

SEQ ID NO: 413199 - DNA, 25 bp, Rattus norvegicus
gcttgttagtccgtttgaagtcatg

SEQ ID NO: 413200 - DNA, 25 bp, Rattus norvegicus
gcttgttagtttcgccgttgacacc

SEQ ID NO: 413201 - DNA, 25 bp, Rattus norvegicus
gcttgttagtttggccgttgacacc

SEQ ID NO: 413202 - DNA, 25 bp, Rattus norvegicus
gcttgttatacacacgttatccttg

SEQ ID NO: 413203 - DNA, 25 bp, Rattus norvegicus
gcttgttatacagacgttatccttg

SEQ ID NO: 413204 - DNA, 25 bp, Rattus norvegicus
gcttgttatattcctgatgtaccag

SEQ ID NO: 413205 - DNA, 25 bp, Rattus norvegicus
gcttgttatattgctgatgtaccag

SEQ ID NO: 413206 - DNA, 25 bp, Rattus norvegicus
gcttgttcatagatggtgacaccct

SEQ ID NO: 413207 - DNA, 25 bp, Rattus norvegicus
gcttgttcatagttggtgacaccct

SEQ ID NO: 413208 - DNA, 25 bp, Rattus norvegicus
gcttgttccatcatgtagtgtccac

SEQ ID NO: 413209 - DNA, 25 bp, Rattus norvegicus
gcttgttccatcttgtagtgtccac

SEQ ID NO: 413210 - DNA, 25 bp, Rattus norvegicus
gcttgttccgtaaccgatagttccg

SEQ ID NO: 413211 - DNA, 25 bp, Rattus norvegicus
gcttgttccgtatccgatagttccg

SEQ ID NO: 413212 - DNA, 25 bp, Rattus norvegicus
gcttgttcgaggatctatttttcta

SEQ ID NO: 413213 - DNA, 25 bp, Rattus norvegicus
gcttgttcgaggttctatttttcta

SEQ ID NO: 413214 - DNA, 25 bp, Rattus norvegicus
gcttgttctaacattccgtaagtat

SEQ ID NO: 413215 - DNA, 25 bp, Rattus norvegicus
gcttgttctaactttccgtaagtat

SEQ ID NO: 413216 - DNA, 25 bp, Rattus norvegicus
gcttgttctcaaacagggctggctt

SEQ ID NO: 413217 - DNA, 25 bp, Rattus norvegicus
gcttgttctcaatcagggctggctt

SEQ ID NO: 413218 - DNA, 25 bp, Rattus norvegicus
gcttgttctgctatcatggcaggat

SEQ ID NO: 413219 - DNA, 25 bp, Rattus norvegicus
gcttgttctgctttcatggcaggat

SEQ ID NO: 413220 - DNA, 25 bp, Rattus norvegicus
gcttgttctgggatgctttgcagta

SEQ ID NO: 413221 - DNA, 25 bp, Rattus norvegicus
gcttgttctgggttgctttgcagta

SEQ ID NO: 413222 - DNA, 25 bp, Rattus norvegicus
gcttgttctgtcagctgttgtcaca

SEQ ID NO: 413223 - DNA, 25 bp, Rattus norvegicus
gcttgttctgtctgctgttgtcaca

SEQ ID NO: 413224 - DNA, 25 bp, Rattus norvegicus
gcttgttcttgaacctataaatatg

SEQ ID NO: 413225 - DNA, 25 bp, Rattus norvegicus
gcttgttcttgacaagttcccatca

SEQ ID NO: 413226 - DNA, 25 bp, Rattus norvegicus
gcttgttcttgagaagttcccatca

SEQ ID NO: 413227 - DNA, 25 bp, Rattus norvegicus
gcttgttcttgatcctataaatatg

SEQ ID NO: 413228 - DNA, 25 bp, Rattus norvegicus
gcttgttgacttaatttgcctggag

SEQ ID NO: 413229 - DNA, 25 bp, Rattus norvegicus
gcttgttgactttatttgcctggag

SEQ ID NO: 413230 - DNA, 25 bp, Rattus norvegicus
gcttgttgagctaagggatccttga

SEQ ID NO: 413231 - DNA, 25 bp, Rattus norvegicus
gcttgttgagcttagggatccttga

SEQ ID NO: 413232 - DNA, 25 bp, Rattus norvegicus
gcttgttgatcaccttgccaaagaa

SEQ ID NO: 413233 - DNA, 25 bp, Rattus norvegicus
gcttgttgatcagcttgccaaagaa

SEQ ID NO: 413234 - DNA, 25 bp, Rattus norvegicus
gcttgttgcaatatcttgcttctat

SEQ ID NO: 413235 - DNA, 25 bp, Rattus norvegicus
gcttgttgcaatttcttgcttctat

SEQ ID NO: 413236 - DNA, 25 bp, Rattus norvegicus
gcttgttgcagtatttcatactaag

SEQ ID NO: 413237 - DNA, 25 bp, Rattus norvegicus
gcttgttgcagtttttcatactaag

SEQ ID NO: 413238 - DNA, 25 bp, Rattus norvegicus
gcttgttgcataccattggtcctat

SEQ ID NO: 413239 - DNA, 25 bp, Rattus norvegicus
gcttgttgcatagcattggtcctat

SEQ ID NO: 413240 - DNA, 25 bp, Rattus norvegicus
gcttgttgtatactgatgtcctcct

SEQ ID NO: 413241 - DNA, 25 bp, Rattus norvegicus
gcttgttgtatagtgatgtcctcct

SEQ ID NO: 413242 - DNA, 25 bp, Rattus norvegicus
gcttgttgtcttattcgctatgtta

SEQ ID NO: 413243 - DNA, 25 bp, Rattus norvegicus
gcttgttgtctttttcgctatgtta

SEQ ID NO: 413244 - DNA, 25 bp, Rattus norvegicus
gcttgttgtggaaacagggctcgcc

SEQ ID NO: 413245 - DNA, 25 bp, Rattus norvegicus
gcttgttgtggatacagggctcgcc

SEQ ID NO: 413246 - DNA, 25 bp, Rattus norvegicus
gcttgttgttttatccttcattctt

SEQ ID NO: 413247 - DNA, 25 bp, Rattus norvegicus
gcttgttgttttttccttcattctt

SEQ ID NO: 413248 - DNA, 25 bp, Rattus norvegicus
gcttgtttaaagctagccgcaccgg

SEQ ID NO: 413249 - DNA, 25 bp, Rattus norvegicus
gcttgtttaaaggtagccgcaccgg

SEQ ID NO: 413250 - DNA, 25 bp, Rattus norvegicus
gcttgtttactaattgttactactt

SEQ ID NO: 413251 - DNA, 25 bp, Rattus norvegicus
gcttgtttactatttgttactactt

SEQ ID NO: 413252 - DNA, 25 bp, Rattus norvegicus
gcttgtttagatatatcccacaccc

SEQ ID NO: 413253 - DNA, 25 bp, Rattus norvegicus
gcttgtttagatttatcccacaccc

SEQ ID NO: 413254 - DNA, 25 bp, Rattus norvegicus
gcttgtttagcccagatttcagaat

SEQ ID NO: 413255 - DNA, 25 bp, Rattus norvegicus
gcttgtttagccgagatttcagaat

SEQ ID NO: 413256 - DNA, 25 bp, Rattus norvegicus
gcttgtttgcgcagtctgattcaga

SEQ ID NO: 413257 - DNA, 25 bp, Rattus norvegicus
gcttgtttgcgctgtctgattcaga

SEQ ID NO: 413258 - DNA, 25 bp, Rattus norvegicus
gcttgtttgtggagacgcccgtcat

SEQ ID NO: 413259 - DNA, 25 bp, Rattus norvegicus
gcttgtttgtggtgacgcccgtcat

SEQ ID NO: 413260 - DNA, 25 bp, Rattus norvegicus
gcttgtttgtttaaagactattcca

SEQ ID NO: 413261 - DNA, 25 bp, Rattus norvegicus
gcttgtttgttttaagactattcca

SEQ ID NO: 413262 - DNA, 25 bp, Rattus norvegicus
gcttgttttccaccacgcaaatggt

SEQ ID NO: 413263 - DNA, 25 bp, Rattus norvegicus
gcttgttttccagcacgcaaatggt

SEQ ID NO: 413264 - DNA, 25 bp, Rattus norvegicus
gcttgttttcgtctggcgccaggaa

SEQ ID NO: 413265 - DNA, 25 bp, Rattus norvegicus
gcttgttttcgtgtggcgccaggaa

SEQ ID NO: 413266 - DNA, 25 bp, Rattus norvegicus
gcttgttttctcatttatcacgtga

SEQ ID NO: 413267 - DNA, 25 bp, Rattus norvegicus
gcttgttttctcttttatcacgtga

SEQ ID NO: 413268 - DNA, 25 bp, Rattus norvegicus
gcttgttttgagctgttggtctttc

SEQ ID NO: 413269 - DNA, 25 bp, Rattus norvegicus
gcttgttttgaggtgttggtctttc

SEQ ID NO: 413270 - DNA, 25 bp, Rattus norvegicus
gcttgttttgcaccttgctcagatt

SEQ ID NO: 413271 - DNA, 25 bp, Rattus norvegicus
gcttgttttgcagcttgctcagatt

SEQ ID NO: 413272 - DNA, 25 bp, Rattus norvegicus
gctttaaaagcactggtacccaata

SEQ ID NO: 413273 - DNA, 25 bp, Rattus norvegicus
gctttaaaagcagtggtacccaata

SEQ ID NO: 413274 - DNA, 25 bp, Rattus norvegicus
gctttaaacatgctcttgaccactg

SEQ ID NO: 413275 - DNA, 25 bp, Rattus norvegicus
gctttaaacatggtcttgaccactg

SEQ ID NO: 413276 - DNA, 25 bp, Rattus norvegicus
gctttaaacgttaatgggaccacag

SEQ ID NO: 413277 - DNA, 25 bp, Rattus norvegicus
gctttaaacgtttatgggaccacag

SEQ ID NO: 413278 - DNA, 25 bp, Rattus norvegicus
gctttaaactccagacttctgagat

SEQ ID NO: 413279 - DNA, 25 bp, Rattus norvegicus
gctttaaactcctgacttctgagat

SEQ ID NO: 413280 - DNA, 25 bp, Rattus norvegicus
gctttaaagaagaaccagttggcaa

SEQ ID NO: 413281 - DNA, 25 bp, Rattus norvegicus
gctttaaagaagtaccagttggcaa

SEQ ID NO: 413282 - DNA, 25 bp, Rattus norvegicus
gctttaaagacgctgaacctgaagt

SEQ ID NO: 413283 - DNA, 25 bp, Rattus norvegicus
gctttaaagacggtgaacctgaagt

SEQ ID NO: 413284 - DNA, 25 bp, Rattus norvegicus
gctttaaagcccagcacttaggttc

SEQ ID NO: 413285 - DNA, 25 bp, Rattus norvegicus
gctttaaagccctgcacttaggttc

SEQ ID NO: 413286 - DNA, 25 bp, Rattus norvegicus
gctttaaataccattggcaccacac

SEQ ID NO: 413287 - DNA, 25 bp, Rattus norvegicus
gctttaaatacctttggcaccacac

SEQ ID NO: 413288 - DNA, 25 bp, Rattus norvegicus
gctttaacaagtacctcttcgatca

SEQ ID NO: 413289 - DNA, 25 bp, Rattus norvegicus
gctttaacaagttcctcttcgatca

SEQ ID NO: 413290 - DNA, 25 bp, Rattus norvegicus
gctttaacagctacccgatatttcc

SEQ ID NO: 413291 - DNA, 25 bp, Rattus norvegicus
gctttaacagcttcccgatatttcc

SEQ ID NO: 413292 - DNA, 25 bp, Rattus norvegicus
gctttaacctagctcgaacctggta

SEQ ID NO: 413293 - DNA, 25 bp, Rattus norvegicus
gctttaacctaggtcgaacctggta

SEQ ID NO: 413294 - DNA, 25 bp, Rattus norvegicus
gctttaacgtaaacactggtgacat

SEQ ID NO: 413295 - DNA, 25 bp, Rattus norvegicus
gctttaacgtaatcactggtgacat

SEQ ID NO: 413296 - DNA, 25 bp, Rattus norvegicus
gctttaagccttataattttgcctc

SEQ ID NO: 413297 - DNA, 25 bp, Rattus norvegicus
gctttaagccttttaattttgcctc

SEQ ID NO: 413298 - DNA, 25 bp, Rattus norvegicus
gctttaagtcttagtgttcacttta

SEQ ID NO: 413299 - DNA, 25 bp, Rattus norvegicus
gctttaagtctttgtgttcacttta

SEQ ID NO: 413300 - DNA, 25 bp, Rattus norvegicus
gctttaataaagacccgactagtag

SEQ ID NO: 413301 - DNA, 25 bp, Rattus norvegicus
gctttaataaagtcccgactagtag

SEQ ID NO: 413302 - DNA, 25 bp, Rattus norvegicus
gctttaatatacaggcccaagtttc

SEQ ID NO: 413303 - DNA, 25 bp, Rattus norvegicus
gctttaatatactggcccaagtttc

SEQ ID NO: 413304 - DNA, 25 bp, Rattus norvegicus
gctttaatatctaatgcttctgagt

SEQ ID NO: 413305 - DNA, 25 bp, Rattus norvegicus
gctttaatatcttatgcttctgagt

SEQ ID NO: 413306 - DNA, 25 bp, Rattus norvegicus
gctttaatcgccatcggcaggaaca

SEQ ID NO: 413307 - DNA, 25 bp, Rattus norvegicus
gctttaatcgccttcggcaggaaca

SEQ ID NO: 413308 - DNA, 25 bp, Rattus norvegicus
gctttaatctagatgcactccacac

SEQ ID NO: 413309 - DNA, 25 bp, Rattus norvegicus
gctttaatctagttgcactccacac

SEQ ID NO: 413310 - DNA, 25 bp, Rattus norvegicus
gctttaatgcccacatttccatatt

SEQ ID NO: 413311 - DNA, 25 bp, Rattus norvegicus
gctttaatgccctcatttccatatt

SEQ ID NO: 413312 - DNA, 25 bp, Rattus norvegicus
gctttaatggctatgggttccgtct

SEQ ID NO: 413313 - DNA, 25 bp, Rattus norvegicus
gctttaatggctcttctgacgatca

SEQ ID NO: 413314 - DNA, 25 bp, Rattus norvegicus
gctttaatggctgttctgacgatca

SEQ ID NO: 413315 - DNA, 25 bp, Rattus norvegicus
gctttaatggctttgggttccgtct

SEQ ID NO: 413316 - DNA, 25 bp, Rattus norvegicus
gctttacactagctttctgcattta

SEQ ID NO: 413317 - DNA, 25 bp, Rattus norvegicus
gctttacactaggtttctgcattta

SEQ ID NO: 413318 - DNA, 25 bp, Rattus norvegicus
gctttacagtatacagccctagact

SEQ ID NO: 413319 - DNA, 25 bp, Rattus norvegicus
gctttacagtattcagccctagact

SEQ ID NO: 413320 - DNA, 25 bp, Rattus norvegicus
gctttaccaccacctttaatgttga

SEQ ID NO: 413321 - DNA, 25 bp, Rattus norvegicus
gctttaccaccagctttaatgttga

SEQ ID NO: 413322 - DNA, 25 bp, Rattus norvegicus
gctttacccatcacttgctaatatt

SEQ ID NO: 413323 - DNA, 25 bp, Rattus norvegicus
gctttacccatctcttgctaatatt

SEQ ID NO: 413324 - DNA, 25 bp, Rattus norvegicus
gctttaccctggactgaagctggga

SEQ ID NO: 413325 - DNA, 25 bp, Rattus norvegicus
gctttaccctggtctgaagctggga

SEQ ID NO: 413326 - DNA, 25 bp, Rattus norvegicus
gctttacctcagattgtgactccaa

SEQ ID NO: 413327 - DNA, 25 bp, Rattus norvegicus
gctttacctcagtttgtgactccaa

SEQ ID NO: 413328 - DNA, 25 bp, Rattus norvegicus
gctttacctgttagtttgctttcag

SEQ ID NO: 413329 - DNA, 25 bp, Rattus norvegicus
gctttacctgtttgtttgctttcag

SEQ ID NO: 413330 - DNA, 25 bp, Rattus norvegicus
gctttacgtgttatgatctctttat

SEQ ID NO: 413331 - DNA, 25 bp, Rattus norvegicus
gctttacgtgttttgatctctttat

SEQ ID NO: 413332 - DNA, 25 bp, Rattus norvegicus
gctttactaaagctccaaatcatag

SEQ ID NO: 413333 - DNA, 25 bp, Rattus norvegicus
gctttactaaaggtccaaatcatag

SEQ ID NO: 413334 - DNA, 25 bp, Rattus norvegicus
gctttactcatacacctcagacaga

SEQ ID NO: 413335 - DNA, 25 bp, Rattus norvegicus
gctttactcatagacctcagacaga

SEQ ID NO: 413336 - DNA, 25 bp, Rattus norvegicus
gctttactctctctgtgatgggtaa

SEQ ID NO: 413337 - DNA, 25 bp, Rattus norvegicus
gctttactctctgtgtgatgggtaa

SEQ ID NO: 413338 - DNA, 25 bp, Rattus norvegicus
gctttactgataacgctgtcctgct

SEQ ID NO: 413339 - DNA, 25 bp, Rattus norvegicus
gctttactgatatcgctgtcctgct

SEQ ID NO: 413340 - DNA, 25 bp, Rattus norvegicus
gctttactgattcgcacttagataa

SEQ ID NO: 413341 - DNA, 25 bp, Rattus norvegicus
gctttactgattggcacttagataa

SEQ ID NO: 413342 - DNA, 25 bp, Rattus norvegicus
gctttactgcttacatggttatcgg

SEQ ID NO: 413343 - DNA, 25 bp, Rattus norvegicus
gctttactgctttcatggttatcgg

SEQ ID NO: 413344 - DNA, 25 bp, Rattus norvegicus
gctttactggcactcttgacttata

SEQ ID NO: 413345 - DNA, 25 bp, Rattus norvegicus
gctttactggcagtcttgacttata

SEQ ID NO: 413346 - DNA, 25 bp, Rattus norvegicus
gctttacttcatacttacagtgcga

SEQ ID NO: 413347 - DNA, 25 bp, Rattus norvegicus
gctttacttcatcgctgttgcagca

SEQ ID NO: 413348 - DNA, 25 bp, Rattus norvegicus
gctttacttcatggctgttgcagca

SEQ ID NO: 413349 - DNA, 25 bp, Rattus norvegicus
gctttacttcattcttacagtgcga

SEQ ID NO: 413350 - DNA, 25 bp, Rattus norvegicus
gctttacttcttcggaactgccagt

SEQ ID NO: 413351 - DNA, 25 bp, Rattus norvegicus
gctttacttcttgggaactgccagt

SEQ ID NO: 413352 - DNA, 25 bp, Rattus norvegicus
gctttacttgacatcatctagtgct

SEQ ID NO: 413353 - DNA, 25 bp, Rattus norvegicus
gctttacttgacttcatctagtgct

SEQ ID NO: 413354 - DNA, 25 bp, Rattus norvegicus
gctttagaaggcctctctgggcaga

SEQ ID NO: 413355 - DNA, 25 bp, Rattus norvegicus
gctttagaaggcgtctctgggcaga

SEQ ID NO: 413356 - DNA, 25 bp, Rattus norvegicus
gctttagaatttagccattgggcga

SEQ ID NO: 413357 - DNA, 25 bp, Rattus norvegicus
gctttagaattttgccattgggcga

SEQ ID NO: 413358 - DNA, 25 bp, Rattus norvegicus
gctttagagacaaacagtgtgctgt

SEQ ID NO: 413359 - DNA, 25 bp, Rattus norvegicus
gctttagagacatacagtgtgctgt

SEQ ID NO: 413360 - DNA, 25 bp, Rattus norvegicus
gctttagatagcacgcagagttctt

SEQ ID NO: 413361 - DNA, 25 bp, Rattus norvegicus
gctttagatagctcgcagagttctt

SEQ ID NO: 413362 - DNA, 25 bp, Rattus norvegicus
gctttagcagacagtggtagcacac

SEQ ID NO: 413363 - DNA, 25 bp, Rattus norvegicus
gctttagcagactgtggtagcacac

SEQ ID NO: 413364 - DNA, 25 bp, Rattus norvegicus
gctttagcagatagcgaactcccgt

SEQ ID NO: 413365 - DNA, 25 bp, Rattus norvegicus
gctttagcagattgcgaactcccgt

SEQ ID NO: 413366 - DNA, 25 bp, Rattus norvegicus
gctttagccaatcttgccagttgtg

SEQ ID NO: 413367 - DNA, 25 bp, Rattus norvegicus
gctttagccaatgttgccagttgtg

SEQ ID NO: 413368 - DNA, 25 bp, Rattus norvegicus
gctttagcccaaccttacattcttc

SEQ ID NO: 413369 - DNA, 25 bp, Rattus norvegicus
gctttagcccaagcttacattcttc

SEQ ID NO: 413370 - DNA, 25 bp, Rattus norvegicus
gctttagctgtaaatatccaccctt

SEQ ID NO: 413371 - DNA, 25 bp, Rattus norvegicus
gctttagctgtatatatccaccctt

SEQ ID NO: 413372 - DNA, 25 bp, Rattus norvegicus
gctttaggaacacctactctgagga

SEQ ID NO: 413373 - DNA, 25 bp, Rattus norvegicus
gctttaggaacagctactctgagga

SEQ ID NO: 413374 - DNA, 25 bp, Rattus norvegicus
gctttaggatctattctaacattct

SEQ ID NO: 413375 - DNA, 25 bp, Rattus norvegicus
gctttaggatcttttctaacattct

SEQ ID NO: 413376 - DNA, 25 bp, Rattus norvegicus
gctttaggatggcttgctggttttt

SEQ ID NO: 413377 - DNA, 25 bp, Rattus norvegicus
gctttaggatgggttgctggttttt

SEQ ID NO: 413378 - DNA, 25 bp, Rattus norvegicus
gctttaggcagcatgttacattctt

SEQ ID NO: 413379 - DNA, 25 bp, Rattus norvegicus
gctttaggcagcttgttacattctt

SEQ ID NO: 413380 - DNA, 25 bp, Rattus norvegicus
gctttagggtctcgcggcgcccaaa

SEQ ID NO: 413381 - DNA, 25 bp, Rattus norvegicus
gctttagggtctggcggcgcccaaa

SEQ ID NO: 413382 - DNA, 25 bp, Rattus norvegicus
gctttaggtatgatggcaggccaat

SEQ ID NO: 413383 - DNA, 25 bp, Rattus norvegicus
gctttaggtatgttggcaggccaat

SEQ ID NO: 413384 - DNA, 25 bp, Rattus norvegicus
gctttaggtgggaagtgttgcttta

SEQ ID NO: 413385 - DNA, 25 bp, Rattus norvegicus
gctttaggtgggtagtgttgcttta

SEQ ID NO: 413386 - DNA, 25 bp, Rattus norvegicus
gctttagtatatacattccatggga

SEQ ID NO: 413387 - DNA, 25 bp, Rattus norvegicus
gctttagtatattcattccatggga

SEQ ID NO: 413388 - DNA, 25 bp, Rattus norvegicus
gctttagtcgtcatttctatgatgc

SEQ ID NO: 413389 - DNA, 25 bp, Rattus norvegicus
gctttagtcgtcttttctatgatgc

SEQ ID NO: 413390 - DNA, 25 bp, Rattus norvegicus
gctttagtctatctgtcttcctgaa

SEQ ID NO: 413391 - DNA, 25 bp, Rattus norvegicus
gctttagtctatgtgtcttcctgaa

SEQ ID NO: 413392 - DNA, 25 bp, Rattus norvegicus
gctttagtgtgtacattacagcgaa

SEQ ID NO: 413393 - DNA, 25 bp, Rattus norvegicus
gctttagtgtgttcattacagcgaa

SEQ ID NO: 413394 - DNA, 25 bp, Rattus norvegicus
gctttagtttgtacttttctctgtg

SEQ ID NO: 413395 - DNA, 25 bp, Rattus norvegicus
gctttagtttgttcttttctctgtg

SEQ ID NO: 413396 - DNA, 25 bp, Rattus norvegicus
gctttataaagcagggccgtttcta

SEQ ID NO: 413397 - DNA, 25 bp, Rattus norvegicus
gctttataaagctgggccgtttcta

SEQ ID NO: 413398 - DNA, 25 bp, Rattus norvegicus
gctttatacttacctacaaacgtaa

SEQ ID NO: 413399 - DNA, 25 bp, Rattus norvegicus
gctttatacttagctacaaacgtaa

SEQ ID NO: 413400 - DNA, 25 bp, Rattus norvegicus
gctttatatctgacacacttccatc

SEQ ID NO: 413401 - DNA, 25 bp, Rattus norvegicus
gctttatatctgtcacacttccatc

SEQ ID NO: 413402 - DNA, 25 bp, Rattus norvegicus
gctttatctccaacatactgctatg

SEQ ID NO: 413403 - DNA, 25 bp, Rattus norvegicus
gctttatctccatcatactgctatg

SEQ ID NO: 413404 - DNA, 25 bp, Rattus norvegicus
gctttatgcagcatcatcactgagg

SEQ ID NO: 413405 - DNA, 25 bp, Rattus norvegicus
gctttatgcagcttcatcactgagg

SEQ ID NO: 413406 - DNA, 25 bp, Rattus norvegicus
gctttatgctttccaatatagtcga

SEQ ID NO: 413407 - DNA, 25 bp, Rattus norvegicus
gctttatgctttgcaatatagtcga

SEQ ID NO: 413408 - DNA, 25 bp, Rattus norvegicus
gctttatggttcctgggctgttgct

SEQ ID NO: 413409 - DNA, 25 bp, Rattus norvegicus
gctttatggttcgtgggctgttgct

SEQ ID NO: 413410 - DNA, 25 bp, Rattus norvegicus
gctttatgtcacagcatcccctaag

SEQ ID NO: 413411 - DNA, 25 bp, Rattus norvegicus
gctttatgtcactgcatcccctaag

SEQ ID NO: 413412 - DNA, 25 bp, Rattus norvegicus
gctttattaagtattctacctctga

SEQ ID NO: 413413 - DNA, 25 bp, Rattus norvegicus
gctttattaagttttctacctctga

SEQ ID NO: 413414 - DNA, 25 bp, Rattus norvegicus
gctttattagctcgcccttgtctag

SEQ ID NO: 413415 - DNA, 25 bp, Rattus norvegicus
gctttattagctggcccttgtctag

SEQ ID NO: 413416 - DNA, 25 bp, Rattus norvegicus
gctttattatagatcctgtatttcg

SEQ ID NO: 413417 - DNA, 25 bp, Rattus norvegicus
gctttattatagttcctgtatttcg

SEQ ID NO: 413418 - DNA, 25 bp, Rattus norvegicus
gctttattcattaatggcttctgag

SEQ ID NO: 413419 - DNA, 25 bp, Rattus norvegicus
gctttattcatttatggcttctgag

SEQ ID NO: 413420 - DNA, 25 bp, Rattus norvegicus
gctttattccccacagctgtggtga

SEQ ID NO: 413421 - DNA, 25 bp, Rattus norvegicus
gctttattcccctcagctgtggtga

SEQ ID NO: 413422 - DNA, 25 bp, Rattus norvegicus
gctttattgcacagaaatggcttcc

SEQ ID NO: 413423 - DNA, 25 bp, Rattus norvegicus
gctttattgcactgaaatggcttcc

SEQ ID NO: 413424 - DNA, 25 bp, Rattus norvegicus
gctttattgggtcggagccctcctg

SEQ ID NO: 413425 - DNA, 25 bp, Rattus norvegicus
gctttattgggtgggagccctcctg

SEQ ID NO: 413426 - DNA, 25 bp, Rattus norvegicus
gctttatttgagatttctgacctta

SEQ ID NO: 413427 - DNA, 25 bp, Rattus norvegicus
gctttatttgagttttctgacctta

SEQ ID NO: 413428 - DNA, 25 bp, Rattus norvegicus
gctttattttagctgaactgtcctg

SEQ ID NO: 413429 - DNA, 25 bp, Rattus norvegicus
gctttattttaggtgaactgtcctg

SEQ ID NO: 413430 - DNA, 25 bp, Rattus norvegicus
gctttcaaaaacaaccttcagggct

SEQ ID NO: 413431 - DNA, 25 bp, Rattus norvegicus
gctttcaaaaactaccttcagggct

SEQ ID NO: 413432 - DNA, 25 bp, Rattus norvegicus
gctttcaaaacccactttatggatg

SEQ ID NO: 413433 - DNA, 25 bp, Rattus norvegicus
gctttcaaaaccgactttatggatg

SEQ ID NO: 413434 - DNA, 25 bp, Rattus norvegicus
gctttcaaaattccctgtctttaat

SEQ ID NO: 413435 - DNA, 25 bp, Rattus norvegicus
gctttcaaaattgcctgtctttaat

SEQ ID NO: 413436 - DNA, 25 bp, Rattus norvegicus
gctttcaaaggcacaagtatccatg

SEQ ID NO: 413437 - DNA, 25 bp, Rattus norvegicus
gctttcaaaggctcaagtatccatg

SEQ ID NO: 413438 - DNA, 25 bp, Rattus norvegicus
gctttcaacagcatcttccagaagg

SEQ ID NO: 413439 - DNA, 25 bp, Rattus norvegicus
gctttcaacagcttcttccagaagg

SEQ ID NO: 413440 - DNA, 25 bp, Rattus norvegicus
gctttcaactctaggcatctgggaa

SEQ ID NO: 413441 - DNA, 25 bp, Rattus norvegicus
gctttcaactcttggcatctgggaa

SEQ ID NO: 413442 - DNA, 25 bp, Rattus norvegicus
gctttcaaggcgatggacttccact

SEQ ID NO: 413443 - DNA, 25 bp, Rattus norvegicus
gctttcaaggcgttggacttccact

SEQ ID NO: 413444 - DNA, 25 bp, Rattus norvegicus
gctttcaatgccaaatccactgctg

SEQ ID NO: 413445 - DNA, 25 bp, Rattus norvegicus
gctttcaatgcctaatccactgctg

SEQ ID NO: 413446 - DNA, 25 bp, Rattus norvegicus
gctttcaattgcattccagaggagt

SEQ ID NO: 413447 - DNA, 25 bp, Rattus norvegicus
gctttcaattgctttccagaggagt

SEQ ID NO: 413448 - DNA, 25 bp, Rattus norvegicus
gctttcaccaaacggcttgttctaa

SEQ ID NO: 413449 - DNA, 25 bp, Rattus norvegicus
gctttcaccaaagggcttgttctaa

SEQ ID NO: 413450 - DNA, 25 bp, Rattus norvegicus
gctttcaccttgactgtggtttgat

SEQ ID NO: 413451 - DNA, 25 bp, Rattus norvegicus
gctttcaccttgtctgtggtttgat

SEQ ID NO: 413452 - DNA, 25 bp, Rattus norvegicus
gctttcacggagctcgtcagatgag

SEQ ID NO: 413453 - DNA, 25 bp, Rattus norvegicus
gctttcacggaggtcgtcagatgag

SEQ ID NO: 413454 - DNA, 25 bp, Rattus norvegicus
gctttcacggtgacagaggcattct

SEQ ID NO: 413455 - DNA, 25 bp, Rattus norvegicus
gctttcacggtgtcagaggcattct

SEQ ID NO: 413456 - DNA, 25 bp, Rattus norvegicus
gctttcactggacatgccctactga

SEQ ID NO: 413457 - DNA, 25 bp, Rattus norvegicus
gctttcactggagatgccctactga

SEQ ID NO: 413458 - DNA, 25 bp, Rattus norvegicus
gctttcactggtcttcttgttgtgt

SEQ ID NO: 413459 - DNA, 25 bp, Rattus norvegicus
gctttcactggtgttcttgttgtgt

SEQ ID NO: 413460 - DNA, 25 bp, Rattus norvegicus
gctttcacttgcatattgattctct

SEQ ID NO: 413461 - DNA, 25 bp, Rattus norvegicus
gctttcacttgcttattgattctct

SEQ ID NO: 413462 - DNA, 25 bp, Rattus norvegicus
gctttcacttgtcagactgtcactc

SEQ ID NO: 413463 - DNA, 25 bp, Rattus norvegicus
gctttcacttgtgagactgtcactc

SEQ ID NO: 413464 - DNA, 25 bp, Rattus norvegicus
gctttcagaaccacttagtcctttt

SEQ ID NO: 413465 - DNA, 25 bp, Rattus norvegicus
gctttcagaacctcttagtcctttt

SEQ ID NO: 413466 - DNA, 25 bp, Rattus norvegicus
gctttcagcatgaggtggactatct

SEQ ID NO: 413467 - DNA, 25 bp, Rattus norvegicus
gctttcagcatgtggtggactatct

SEQ ID NO: 413468 - DNA, 25 bp, Rattus norvegicus
gctttcagctctactccataaccat

SEQ ID NO: 413469 - DNA, 25 bp, Rattus norvegicus
gctttcagctcttctccataaccat

SEQ ID NO: 413470 - DNA, 25 bp, Rattus norvegicus
gctttcagtatcctgccatttgagg

SEQ ID NO: 413471 - DNA, 25 bp, Rattus norvegicus
gctttcagtatcgtgccatttgagg

SEQ ID NO: 413472 - DNA, 25 bp, Rattus norvegicus
gctttcagtctcatggcctagaagg

SEQ ID NO: 413473 - DNA, 25 bp, Rattus norvegicus
gctttcagtctcttggcctagaagg

SEQ ID NO: 413474 - DNA, 25 bp, Rattus norvegicus
gctttcatcagactgcctttccaga

SEQ ID NO: 413475 - DNA, 25 bp, Rattus norvegicus
gctttcatcagagtgcctttccaga

SEQ ID NO: 413476 - DNA, 25 bp, Rattus norvegicus
gctttcatcataaaggatcactccg

SEQ ID NO: 413477 - DNA, 25 bp, Rattus norvegicus
gctttcatcatataggatcactccg

SEQ ID NO: 413478 - DNA, 25 bp, Rattus norvegicus
gctttcatccgcaagcaatgtgaaa

SEQ ID NO: 413479 - DNA, 25 bp, Rattus norvegicus
gctttcatccgctagcaatgtgaaa

SEQ ID NO: 413480 - DNA, 25 bp, Rattus norvegicus
gctttcatgagcaggcgtgatttgt

SEQ ID NO: 413481 - DNA, 25 bp, Rattus norvegicus
gctttcatgagctggcgtgatttgt

SEQ ID NO: 413482 - DNA, 25 bp, Rattus norvegicus
gctttcatgagtatagagcattcca

SEQ ID NO: 413483 - DNA, 25 bp, Rattus norvegicus
gctttcatgagtttagagcattcca

SEQ ID NO: 413484 - DNA, 25 bp, Rattus norvegicus
gctttcattgtgacctgtaagttta

SEQ ID NO: 413485 - DNA, 25 bp, Rattus norvegicus
gctttcattgtgtcctgtaagttta

SEQ ID NO: 413486 - DNA, 25 bp, Rattus norvegicus
gctttcatttccataaaccatctgt

SEQ ID NO: 413487 - DNA, 25 bp, Rattus norvegicus
gctttcatttccttaaaccatctgt

SEQ ID NO: 413488 - DNA, 25 bp, Rattus norvegicus
gctttccaaactatcccatgagatt

SEQ ID NO: 413489 - DNA, 25 bp, Rattus norvegicus
gctttccaaactttcccatgagatt

SEQ ID NO: 413490 - DNA, 25 bp, Rattus norvegicus
gctttccaacgccaggaacaacaag

SEQ ID NO: 413491 - DNA, 25 bp, Rattus norvegicus
gctttccaacgcgaggaacaacaag

SEQ ID NO: 413492 - DNA, 25 bp, Rattus norvegicus
gctttccaaggcactgtccttcatg

SEQ ID NO: 413493 - DNA, 25 bp, Rattus norvegicus
gctttccaaggctctgtccttcatg

SEQ ID NO: 413494 - DNA, 25 bp, Rattus norvegicus
gctttccagagaatgcagcctgaac

SEQ ID NO: 413495 - DNA, 25 bp, Rattus norvegicus
gctttccagagattgcagcctgaac

SEQ ID NO: 413496 - DNA, 25 bp, Rattus norvegicus
gctttccagatgagaggccatttcc

SEQ ID NO: 413497 - DNA, 25 bp, Rattus norvegicus
gctttccagatgtgaggccatttcc

SEQ ID NO: 413498 - DNA, 25 bp, Rattus norvegicus
gctttccagctaagaagcccatgtt

SEQ ID NO: 413499 - DNA, 25 bp, Rattus norvegicus
gctttccagctatgaagcccatgtt

SEQ ID NO: 413500 - DNA, 25 bp, Rattus norvegicus
gctttccatgtcatagtttattcga

SEQ ID NO: 413501 - DNA, 25 bp, Rattus norvegicus
gctttccatgtcttagtttattcga

SEQ ID NO: 413502 - DNA, 25 bp, Rattus norvegicus
gctttcccacttcatagcattgtgt

SEQ ID NO: 413503 - DNA, 25 bp, Rattus norvegicus
gctttcccacttgatagcattgtgt

SEQ ID NO: 413504 - DNA, 25 bp, Rattus norvegicus
gctttcccagagcagcagcttgttg

SEQ ID NO: 413505 - DNA, 25 bp, Rattus norvegicus
gctttcccagaggagcagcttgttg

SEQ ID NO: 413506 - DNA, 25 bp, Rattus norvegicus
gctttcccagctatgaggtgacatt

SEQ ID NO: 413507 - DNA, 25 bp, Rattus norvegicus
gctttcccagctttgaggtgacatt

SEQ ID NO: 413508 - DNA, 25 bp, Rattus norvegicus
gctttcccagtaaatcccaggcaga

SEQ ID NO: 413509 - DNA, 25 bp, Rattus norvegicus
gctttcccagtatatcccaggcaga

SEQ ID NO: 413510 - DNA, 25 bp, Rattus norvegicus
gctttcccatgaagggcattttgga

SEQ ID NO: 413511 - DNA, 25 bp, Rattus norvegicus
gctttcccatgatgggcattttgga

SEQ ID NO: 413512 - DNA, 25 bp, Rattus norvegicus
gctttcccattgcagcgtgcctgat

SEQ ID NO: 413513 - DNA, 25 bp, Rattus norvegicus
gctttcccattggagcgtgcctgat

SEQ ID NO: 413514 - DNA, 25 bp, Rattus norvegicus
gctttccccaggactggctaaggaa

SEQ ID NO: 413515 - DNA, 25 bp, Rattus norvegicus
gctttccccaggataagacaggcat

SEQ ID NO: 413516 - DNA, 25 bp, Rattus norvegicus
gctttccccaggtctggctaaggaa

SEQ ID NO: 413517 - DNA, 25 bp, Rattus norvegicus
gctttccccaggttaagacaggcat

SEQ ID NO: 413518 - DNA, 25 bp, Rattus norvegicus
gctttccccttcaccataggaagaa

SEQ ID NO: 413519 - DNA, 25 bp, Rattus norvegicus
gctttccccttctccataggaagaa

SEQ ID NO: 413520 - DNA, 25 bp, Rattus norvegicus
gctttcccgccaacaatatgtttta

SEQ ID NO: 413521 - DNA, 25 bp, Rattus norvegicus
gctttcccgccatcaatatgtttta

SEQ ID NO: 413522 - DNA, 25 bp, Rattus norvegicus
gctttccctggacgtttgctctgga

SEQ ID NO: 413523 - DNA, 25 bp, Rattus norvegicus
gctttccctggaggtttgctctgga

SEQ ID NO: 413524 - DNA, 25 bp, Rattus norvegicus
gctttccctgtacgaatgctcgtga

SEQ ID NO: 413525 - DNA, 25 bp, Rattus norvegicus
gctttccctgtaggaatgctcgtga

SEQ ID NO: 413526 - DNA, 25 bp, Rattus norvegicus
gctttcccttggactttgcttgtaa

SEQ ID NO: 413527 - DNA, 25 bp, Rattus norvegicus
gctttcccttggtctttgcttgtaa

SEQ ID NO: 413528 - DNA, 25 bp, Rattus norvegicus
gctttccgagacaatggccttaaca

SEQ ID NO: 413529 - DNA, 25 bp, Rattus norvegicus
gctttccgagactatggccttaaca

SEQ ID NO: 413530 - DNA, 25 bp, Rattus norvegicus
gctttccgagggagacaatgtctga

SEQ ID NO: 413531 - DNA, 25 bp, Rattus norvegicus
gctttccgagggtgacaatgtctga

SEQ ID NO: 413532 - DNA, 25 bp, Rattus norvegicus
gctttcctaggaaatggacgacatc

SEQ ID NO: 413533 - DNA, 25 bp, Rattus norvegicus
gctttcctaggatatggacgacatc

SEQ ID NO: 413534 - DNA, 25 bp, Rattus norvegicus
gctttcctattcataatttctgtgt

SEQ ID NO: 413535 - DNA, 25 bp, Rattus norvegicus
gctttcctattcttaatttctgtgt

SEQ ID NO: 413536 - DNA, 25 bp, Rattus norvegicus
gctttcctattgacactgtattaaa

SEQ ID NO: 413537 - DNA, 25 bp, Rattus norvegicus
gctttcctattgtcactgtattaaa

SEQ ID NO: 413538 - DNA, 25 bp, Rattus norvegicus
gctttcctcaagagcagaagacctt

SEQ ID NO: 413539 - DNA, 25 bp, Rattus norvegicus
gctttcctcaagtgcagaagacctt

SEQ ID NO: 413540 - DNA, 25 bp, Rattus norvegicus
gctttcctccatatgggtttcagaa

SEQ ID NO: 413541 - DNA, 25 bp, Rattus norvegicus
gctttcctccatttgggtttcagaa

SEQ ID NO: 413542 - DNA, 25 bp, Rattus norvegicus
gctttcctccttactgtggcaaata

SEQ ID NO: 413543 - DNA, 25 bp, Rattus norvegicus
gctttcctcctttctgtggcaaata

SEQ ID NO: 413544 - DNA, 25 bp, Rattus norvegicus
gctttcctctggcttactgtgtgcc

SEQ ID NO: 413545 - DNA, 25 bp, Rattus norvegicus
gctttcctctgggttactgtgtgcc

SEQ ID NO: 413546 - DNA, 25 bp, Rattus norvegicus
gctttcctgatcctttgttggtcac

SEQ ID NO: 413547 - DNA, 25 bp, Rattus norvegicus
gctttcctgatcgtttgttggtcac

SEQ ID NO: 413548 - DNA, 25 bp, Rattus norvegicus
gctttcctgatgcttggtcacctgc

SEQ ID NO: 413549 - DNA, 25 bp, Rattus norvegicus
gctttcctgatggttggtcacctgc

SEQ ID NO: 413550 - DNA, 25 bp, Rattus norvegicus
gctttcctgcctaacatcaaggtgg

SEQ ID NO: 413551 - DNA, 25 bp, Rattus norvegicus
gctttcctgcctcaatctgattggc

SEQ ID NO: 413552 - DNA, 25 bp, Rattus norvegicus
gctttcctgcctgaatctgattggc

SEQ ID NO: 413553 - DNA, 25 bp, Rattus norvegicus
gctttcctgccttacatcaaggtgg

SEQ ID NO: 413554 - DNA, 25 bp, Rattus norvegicus
gctttccttctcaacatttcatttg

SEQ ID NO: 413555 - DNA, 25 bp, Rattus norvegicus
gctttccttctctacatttcatttg

SEQ ID NO: 413556 - DNA, 25 bp, Rattus norvegicus
gctttccttctgataaaaccacaat

SEQ ID NO: 413557 - DNA, 25 bp, Rattus norvegicus
gctttccttctgttaaaaccacaat

SEQ ID NO: 413558 - DNA, 25 bp, Rattus norvegicus
gctttccttcttatgtgctgaccaa

SEQ ID NO: 413559 - DNA, 25 bp, Rattus norvegicus
gctttccttcttttgtgctgaccaa

SEQ ID NO: 413560 - DNA, 25 bp, Rattus norvegicus
gctttccttgagatgcacttattct

SEQ ID NO: 413561 - DNA, 25 bp, Rattus norvegicus
gctttccttgagttgcacttattct

SEQ ID NO: 413562 - DNA, 25 bp, Rattus norvegicus
gctttcctttccagtccataaggga

SEQ ID NO: 413563 - DNA, 25 bp, Rattus norvegicus
gctttcctttcctgtccataaggga

SEQ ID NO: 413564 - DNA, 25 bp, Rattus norvegicus
gctttcctttgtaataaccgcttgc

SEQ ID NO: 413565 - DNA, 25 bp, Rattus norvegicus
gctttcctttgttataaccgcttgc

SEQ ID NO: 413566 - DNA, 25 bp, Rattus norvegicus
gctttcgaagtgagcagaggtctac

SEQ ID NO: 413567 - DNA, 25 bp, Rattus norvegicus
gctttcgaagtgtgcagaggtctac

SEQ ID NO: 413568 - DNA, 25 bp, Rattus norvegicus
gctttcgacgtcattgttgacacac

SEQ ID NO: 413569 - DNA, 25 bp, Rattus norvegicus
gctttcgacgtctttgttgacacac

SEQ ID NO: 413570 - DNA, 25 bp, Rattus norvegicus
gctttcgcgctcaacaacctgctgg

SEQ ID NO: 413571 - DNA, 25 bp, Rattus norvegicus
gctttcgcgctctacaacctgctgg

SEQ ID NO: 413572 - DNA, 25 bp, Rattus norvegicus
gctttcgcttctattccagattgaa

SEQ ID NO: 413573 - DNA, 25 bp, Rattus norvegicus
gctttcgcttcttttccagattgaa

SEQ ID NO: 413574 - DNA, 25 bp, Rattus norvegicus
gctttcgggctaccttgaacgagat

SEQ ID NO: 413575 - DNA, 25 bp, Rattus norvegicus
gctttcgggctagcttgaacgagat

SEQ ID NO: 413576 - DNA, 25 bp, Rattus norvegicus
gctttcggtctgagcttttgatcaa

SEQ ID NO: 413577 - DNA, 25 bp, Rattus norvegicus
gctttcggtctgtgcttttgatcaa

SEQ ID NO: 413578 - DNA, 25 bp, Rattus norvegicus
gctttcggtgtaaccctttgtgaaa

SEQ ID NO: 413579 - DNA, 25 bp, Rattus norvegicus
gctttcggtgtatccctttgtgaaa

SEQ ID NO: 413580 - DNA, 25 bp, Rattus norvegicus
gctttcgtatctatatgtcccagga

SEQ ID NO: 413581 - DNA, 25 bp, Rattus norvegicus
gctttcgtatctttatgtcccagga

SEQ ID NO: 413582 - DNA, 25 bp, Rattus norvegicus
gctttcgtgacacataggtacagac

SEQ ID NO: 413583 - DNA, 25 bp, Rattus norvegicus
gctttcgtgacagataggtacagac

SEQ ID NO: 413584 - DNA, 25 bp, Rattus norvegicus
gctttcgtggaccaactgtcactta

SEQ ID NO: 413585 - DNA, 25 bp, Rattus norvegicus
gctttcgtggacgaactgtcactta

SEQ ID NO: 413586 - DNA, 25 bp, Rattus norvegicus
gctttctaaacgattcattactact

SEQ ID NO: 413587 - DNA, 25 bp, Rattus norvegicus
gctttctaaacgtttcattactact

SEQ ID NO: 413588 - DNA, 25 bp, Rattus norvegicus
gctttctaactcagtgcccgaagat

SEQ ID NO: 413589 - DNA, 25 bp, Rattus norvegicus
gctttctaactctgtgcccgaagat

SEQ ID NO: 413590 - DNA, 25 bp, Rattus norvegicus
gctttctagaaacacttcaacggtt

SEQ ID NO: 413591 - DNA, 25 bp, Rattus norvegicus
gctttctagaaagacttcaacggtt

SEQ ID NO: 413592 - DNA, 25 bp, Rattus norvegicus
gctttctatgcaaatggttacattg

SEQ ID NO: 413593 - DNA, 25 bp, Rattus norvegicus
gctttctatgcatatggttacattg

SEQ ID NO: 413594 - DNA, 25 bp, Rattus norvegicus
gctttctattgtacagaggtgatcc

SEQ ID NO: 413595 - DNA, 25 bp, Rattus norvegicus
gctttctattgttcagaggtgatcc

SEQ ID NO: 413596 - DNA, 25 bp, Rattus norvegicus
gctttctatttcactttctttgtgt

SEQ ID NO: 413597 - DNA, 25 bp, Rattus norvegicus
gctttctatttctctttctttgtgt

SEQ ID NO: 413598 - DNA, 25 bp, Rattus norvegicus
gctttctcaagcatggaccgttcag

SEQ ID NO: 413599 - DNA, 25 bp, Rattus norvegicus
gctttctcaagcttggaccgttcag

SEQ ID NO: 413600 - DNA, 25 bp, Rattus norvegicus
gctttctcactaattgacaaagaca

SEQ ID NO: 413601 - DNA, 25 bp, Rattus norvegicus
gctttctcactatttgacaaagaca

SEQ ID NO: 413602 - DNA, 25 bp, Rattus norvegicus
gctttctcagtaatccatatggttt

SEQ ID NO: 413603 - DNA, 25 bp, Rattus norvegicus
gctttctcagtattccatatggttt

SEQ ID NO: 413604 - DNA, 25 bp, Rattus norvegicus
gctttctcatcgacaggctttacaa

SEQ ID NO: 413605 - DNA, 25 bp, Rattus norvegicus
gctttctcatcgtcaggctttacaa

SEQ ID NO: 413606 - DNA, 25 bp, Rattus norvegicus
gctttctcatttccttaccatttaa

SEQ ID NO: 413607 - DNA, 25 bp, Rattus norvegicus
gctttctcatttgcttaccatttaa

SEQ ID NO: 413608 - DNA, 25 bp, Rattus norvegicus
gctttctccaagactgttttcacac

SEQ ID NO: 413609 - DNA, 25 bp, Rattus norvegicus
gctttctccaagtctgttttcacac

SEQ ID NO: 413610 - DNA, 25 bp, Rattus norvegicus
gctttctcccgcctgtagaggaagg

SEQ ID NO: 413611 - DNA, 25 bp, Rattus norvegicus
gctttctcccgcgtgtagaggaagg

SEQ ID NO: 413612 - DNA, 25 bp, Rattus norvegicus
gctttctccgaaacaatgaccgtga

SEQ ID NO: 413613 - DNA, 25 bp, Rattus norvegicus
gctttctccgaatcaatgaccgtga

SEQ ID NO: 413614 - DNA, 25 bp, Rattus norvegicus
gctttctcgttgaacagctttaaga

SEQ ID NO: 413615 - DNA, 25 bp, Rattus norvegicus
gctttctcgttgtacagctttaaga

SEQ ID NO: 413616 - DNA, 25 bp, Rattus norvegicus
gctttctctacaacctggcagaata

SEQ ID NO: 413617 - DNA, 25 bp, Rattus norvegicus
gctttctctacatcctggcagaata

SEQ ID NO: 413618 - DNA, 25 bp, Rattus norvegicus
gctttctctgccaattaaagaatta

SEQ ID NO: 413619 - DNA, 25 bp, Rattus norvegicus
gctttctctgcctattaaagaatta

SEQ ID NO: 413620 - DNA, 25 bp, Rattus norvegicus
gctttctcttcactcatttacattt

SEQ ID NO: 413621 - DNA, 25 bp, Rattus norvegicus
gctttctcttcagtcatttacattt

SEQ ID NO: 413622 - DNA, 25 bp, Rattus norvegicus
gctttctcttctcttggttcactcc

SEQ ID NO: 413623 - DNA, 25 bp, Rattus norvegicus
gctttctcttctgttggttcactcc

SEQ ID NO: 413624 - DNA, 25 bp, Rattus norvegicus
gctttctcttgtcccagtgtgtgga

SEQ ID NO: 413625 - DNA, 25 bp, Rattus norvegicus
gctttctcttgtgccagtgtgtgga

SEQ ID NO: 413626 - DNA, 25 bp, Rattus norvegicus
gctttctctttcatttcatttccta

SEQ ID NO: 413627 - DNA, 25 bp, Rattus norvegicus
gctttctctttcttttcatttccta

SEQ ID NO: 413628 - DNA, 25 bp, Rattus norvegicus
gctttctgaatgaaccccagtggat

SEQ ID NO: 413629 - DNA, 25 bp, Rattus norvegicus
gctttctgaatgtaccccagtggat

SEQ ID NO: 413630 - DNA, 25 bp, Rattus norvegicus
gctttctgacccaggctgtgaggaa

SEQ ID NO: 413631 - DNA, 25 bp, Rattus norvegicus
gctttctgaccctggctgtgaggaa

SEQ ID NO: 413632 - DNA, 25 bp, Rattus norvegicus
gctttctgactaaattctgtgcctt

SEQ ID NO: 413633 - DNA, 25 bp, Rattus norvegicus
gctttctgactatattctgtgcctt

SEQ ID NO: 413634 - DNA, 25 bp, Rattus norvegicus
gctttctgactcacagtctgaactt

SEQ ID NO: 413635 - DNA, 25 bp, Rattus norvegicus
gctttctgactctcagtctgaactt

SEQ ID NO: 413636 - DNA, 25 bp, Rattus norvegicus
gctttctgagaacttcgtacgcagt

SEQ ID NO: 413637 - DNA, 25 bp, Rattus norvegicus
gctttctgagaagttcgtacgcagt

SEQ ID NO: 413638 - DNA, 25 bp, Rattus norvegicus
gctttctgcactcgagttcgaactc

SEQ ID NO: 413639 - DNA, 25 bp, Rattus norvegicus
gctttctgcactggagttcgaactc

SEQ ID NO: 413640 - DNA, 25 bp, Rattus norvegicus
gctttctgcagtaaacttctggctt

SEQ ID NO: 413641 - DNA, 25 bp, Rattus norvegicus
gctttctgcagttaacttctggctt

SEQ ID NO: 413642 - DNA, 25 bp, Rattus norvegicus
gctttctgcatgactgtatgtctgt

SEQ ID NO: 413643 - DNA, 25 bp, Rattus norvegicus
gctttctgcatgtctgtatgtctgt

SEQ ID NO: 413644 - DNA, 25 bp, Rattus norvegicus
gctttctgccatactgtgttttcag

SEQ ID NO: 413645 - DNA, 25 bp, Rattus norvegicus
gctttctgccattctgtgttttcag

SEQ ID NO: 413646 - DNA, 25 bp, Rattus norvegicus
gctttctgccctatatttttaaaat

SEQ ID NO: 413647 - DNA, 25 bp, Rattus norvegicus
gctttctgccctttatttttaaaat

SEQ ID NO: 413648 - DNA, 25 bp, Rattus norvegicus
gctttctgccttactagcacataat

SEQ ID NO: 413649 - DNA, 25 bp, Rattus norvegicus
gctttctgcctttctagcacataat

SEQ ID NO: 413650 - DNA, 25 bp, Rattus norvegicus
gctttctgctaaattcttttacagg

SEQ ID NO: 413651 - DNA, 25 bp, Rattus norvegicus
gctttctgctaatttcttttacagg

SEQ ID NO: 413652 - DNA, 25 bp, Rattus norvegicus
gctttctgctctatgccatggacag

SEQ ID NO: 413653 - DNA, 25 bp, Rattus norvegicus
gctttctgctctttgccatggacag

SEQ ID NO: 413654 - DNA, 25 bp, Rattus norvegicus
gctttctgctttcaccttagttcta

SEQ ID NO: 413655 - DNA, 25 bp, Rattus norvegicus
gctttctgctttgaccttagttcta

SEQ ID NO: 413656 - DNA, 25 bp, Rattus norvegicus
gctttctggagcagagtttacataa

SEQ ID NO: 413657 - DNA, 25 bp, Rattus norvegicus
gctttctggagctgagtttacataa

SEQ ID NO: 413658 - DNA, 25 bp, Rattus norvegicus
gctttctggttccaatgtagactga

SEQ ID NO: 413659 - DNA, 25 bp, Rattus norvegicus
gctttctggttcgaatgtagactga

SEQ ID NO: 413660 - DNA, 25 bp, Rattus norvegicus
gctttctgtagaaatacttcctgtg

SEQ ID NO: 413661 - DNA, 25 bp, Rattus norvegicus
gctttctgtagatatacttcctgtg

SEQ ID NO: 413662 - DNA, 25 bp, Rattus norvegicus
gctttctgtttcagtgtgcctgagg

SEQ ID NO: 413663 - DNA, 25 bp, Rattus norvegicus
gctttctgtttctgtgtgcctgagg

SEQ ID NO: 413664 - DNA, 25 bp, Rattus norvegicus
gctttcttagacacactggcaccaa

SEQ ID NO: 413665 - DNA, 25 bp, Rattus norvegicus
gctttcttagactcactggcaccaa

SEQ ID NO: 413666 - DNA, 25 bp, Rattus norvegicus
gctttcttatcaaattggtacccag

SEQ ID NO: 413667 - DNA, 25 bp, Rattus norvegicus
gctttcttatcatattggtacccag

SEQ ID NO: 413668 - DNA, 25 bp, Rattus norvegicus
gctttcttcaaacgtgcttggtcca

SEQ ID NO: 413669 - DNA, 25 bp, Rattus norvegicus
gctttcttcaaaggtgcttggtcca

SEQ ID NO: 413670 - DNA, 25 bp, Rattus norvegicus
gctttcttcagtctgtgtcaaatat

SEQ ID NO: 413671 - DNA, 25 bp, Rattus norvegicus
gctttcttcagtgtgtgtcaaatat

SEQ ID NO: 413672 - DNA, 25 bp, Rattus norvegicus
gctttcttcataaggcttactcatt

SEQ ID NO: 413673 - DNA, 25 bp, Rattus norvegicus
gctttcttcatatggcttactcatt

SEQ ID NO: 413674 - DNA, 25 bp, Rattus norvegicus
gctttcttcattagctttgtatatt

SEQ ID NO: 413675 - DNA, 25 bp, Rattus norvegicus
gctttcttcatttgctttgtatatt

SEQ ID NO: 413676 - DNA, 25 bp, Rattus norvegicus
gctttcttccctcgcaaatcagatt

SEQ ID NO: 413677 - DNA, 25 bp, Rattus norvegicus
gctttcttccctggcaaatcagatt

SEQ ID NO: 413678 - DNA, 25 bp, Rattus norvegicus
gctttcttcctaaaacttgatgcat

SEQ ID NO: 413679 - DNA, 25 bp, Rattus norvegicus
gctttcttcctataacttgatgcat

SEQ ID NO: 413680 - DNA, 25 bp, Rattus norvegicus
gctttcttctcacctgtgacccaga

SEQ ID NO: 413681 - DNA, 25 bp, Rattus norvegicus
gctttcttctcagctgtgacccaga

SEQ ID NO: 413682 - DNA, 25 bp, Rattus norvegicus
gctttcttctctctagactcaatga

SEQ ID NO: 413683 - DNA, 25 bp, Rattus norvegicus
gctttcttctctgtagactcaatga

SEQ ID NO: 413684 - DNA, 25 bp, Rattus norvegicus
gctttcttctgacatctttactagg

SEQ ID NO: 413685 - DNA, 25 bp, Rattus norvegicus
gctttcttctgagatctttactagg

SEQ ID NO: 413686 - DNA, 25 bp, Rattus norvegicus
gctttcttctggatgtgtcgtaggc

SEQ ID NO: 413687 - DNA, 25 bp, Rattus norvegicus
gctttcttctggttgtgtcgtaggc

SEQ ID NO: 413688 - DNA, 25 bp, Rattus norvegicus
gctttcttgctaatatgtctatgtt

SEQ ID NO: 413689 - DNA, 25 bp, Rattus norvegicus
gctttcttgctattatgtctatgtt

SEQ ID NO: 413690 - DNA, 25 bp, Rattus norvegicus
gctttcttgggcacccaaccagtga

SEQ ID NO: 413691 - DNA, 25 bp, Rattus norvegicus
gctttcttgggctcccaaccagtga

SEQ ID NO: 413692 - DNA, 25 bp, Rattus norvegicus
gctttcttggtgcattcactggcca

SEQ ID NO: 413693 - DNA, 25 bp, Rattus norvegicus
gctttcttggtggattcactggcca

SEQ ID NO: 413694 - DNA, 25 bp, Rattus norvegicus
gctttctttatactttgttattgct

SEQ ID NO: 413695 - DNA, 25 bp, Rattus norvegicus
gctttctttatagtttgttattgct

SEQ ID NO: 413696 - DNA, 25 bp, Rattus norvegicus
gctttctttcatctgcaacactgga

SEQ ID NO: 413697 - DNA, 25 bp, Rattus norvegicus
gctttctttcatgtgcaacactgga

SEQ ID NO: 413698 - DNA, 25 bp, Rattus norvegicus
gctttctttgagattgtatttcctt

SEQ ID NO: 413699 - DNA, 25 bp, Rattus norvegicus
gctttctttgagtttgtatttcctt

SEQ ID NO: 413700 - DNA, 25 bp, Rattus norvegicus
gctttctttgctaggttagccgaga

SEQ ID NO: 413701 - DNA, 25 bp, Rattus norvegicus
gctttctttgcttggttagccgaga

SEQ ID NO: 413702 - DNA, 25 bp, Rattus norvegicus
gctttctttggcctctggttttgaa

SEQ ID NO: 413703 - DNA, 25 bp, Rattus norvegicus
gctttctttggcgtctggttttgaa

SEQ ID NO: 413704 - DNA, 25 bp, Rattus norvegicus
gctttctttggtctgctgggctaca

SEQ ID NO: 413705 - DNA, 25 bp, Rattus norvegicus
gctttctttggtgtgctgggctaca

SEQ ID NO: 413706 - DNA, 25 bp, Rattus norvegicus
gctttctttgtcattggctgattta

SEQ ID NO: 413707 - DNA, 25 bp, Rattus norvegicus
gctttctttgtctttggctgattta

SEQ ID NO: 413708 - DNA, 25 bp, Rattus norvegicus
gctttcttttataggtggcccactg

SEQ ID NO: 413709 - DNA, 25 bp, Rattus norvegicus
gctttcttttattggtggcccactg

SEQ ID NO: 413710 - DNA, 25 bp, Rattus norvegicus
gctttctttttcatgtagaccagga

SEQ ID NO: 413711 - DNA, 25 bp, Rattus norvegicus
gctttctttttcttgtagaccagga

SEQ ID NO: 413712 - DNA, 25 bp, Rattus norvegicus
gctttgaaaaccctgaccttctcaa

SEQ ID NO: 413713 - DNA, 25 bp, Rattus norvegicus
gctttgaaaaccgtgaccttctcaa

SEQ ID NO: 413714 - DNA, 25 bp, Rattus norvegicus
gctttgaaaacgacacctcgatcat

SEQ ID NO: 413715 - DNA, 25 bp, Rattus norvegicus
gctttgaaaacgtcacctcgatcat

SEQ ID NO: 413716 - DNA, 25 bp, Rattus norvegicus
gctttgaaacccctttgagactgaa

SEQ ID NO: 413717 - DNA, 25 bp, Rattus norvegicus
gctttgaaacccgtttgagactgaa

SEQ ID NO: 413718 - DNA, 25 bp, Rattus norvegicus
gctttgaaatcaccctggagctgtc

SEQ ID NO: 413719 - DNA, 25 bp, Rattus norvegicus
gctttgaaatcagcctggagctgtc

SEQ ID NO: 413720 - DNA, 25 bp, Rattus norvegicus
gctttgaactcactgatcctcttcc

SEQ ID NO: 413721 - DNA, 25 bp, Rattus norvegicus
gctttgaactcagtgatcctcttcc

SEQ ID NO: 413722 - DNA, 25 bp, Rattus norvegicus
gctttgaacttgagagcctcctaac

SEQ ID NO: 413723 - DNA, 25 bp, Rattus norvegicus
gctttgaacttgctggttaccctag

SEQ ID NO: 413724 - DNA, 25 bp, Rattus norvegicus
gctttgaacttggtggttaccctag

SEQ ID NO: 413725 - DNA, 25 bp, Rattus norvegicus
gctttgaacttgtgagcctcctaac

SEQ ID NO: 413726 - DNA, 25 bp, Rattus norvegicus
gctttgaagatgctctgctggctat

SEQ ID NO: 413727 - DNA, 25 bp, Rattus norvegicus
gctttgaagatggtctgctggctat

SEQ ID NO: 413728 - DNA, 25 bp, Rattus norvegicus
gctttgaagcagacctggcacgtgt

SEQ ID NO: 413729 - DNA, 25 bp, Rattus norvegicus
gctttgaagcagtcctggcacgtgt

SEQ ID NO: 413730 - DNA, 25 bp, Rattus norvegicus
gctttgaagcttcccctgagactca

SEQ ID NO: 413731 - DNA, 25 bp, Rattus norvegicus
gctttgaagcttgccctgagactca

SEQ ID NO: 413732 - DNA, 25 bp, Rattus norvegicus
gctttgaaggttacactgccttgca

SEQ ID NO: 413733 - DNA, 25 bp, Rattus norvegicus
gctttgaaggtttcactgccttgca

SEQ ID NO: 413734 - DNA, 25 bp, Rattus norvegicus
gctttgaattccctatgtagtccag

SEQ ID NO: 413735 - DNA, 25 bp, Rattus norvegicus
gctttgaattccgtatgtagtccag

SEQ ID NO: 413736 - DNA, 25 bp, Rattus norvegicus
gctttgacaaagacgcacactgtta

SEQ ID NO: 413737 - DNA, 25 bp, Rattus norvegicus
gctttgacaaagtcgcacactgtta

SEQ ID NO: 413738 - DNA, 25 bp, Rattus norvegicus
gctttgacctcacaacagctagcaa

SEQ ID NO: 413739 - DNA, 25 bp, Rattus norvegicus
gctttgacctcagaacagctagcaa

SEQ ID NO: 413740 - DNA, 25 bp, Rattus norvegicus
gctttgacgttcatcctcggaaaag

SEQ ID NO: 413741 - DNA, 25 bp, Rattus norvegicus
gctttgacgttcttcctcggaaaag

SEQ ID NO: 413742 - DNA, 25 bp, Rattus norvegicus
gctttgactcccagcgctataaatt

SEQ ID NO: 413743 - DNA, 25 bp, Rattus norvegicus
gctttgactccctgcgctataaatt

SEQ ID NO: 413744 - DNA, 25 bp, Rattus norvegicus
gctttgactgtaagatctgtggcaa

SEQ ID NO: 413745 - DNA, 25 bp, Rattus norvegicus
gctttgactgtatgatctgtggcaa

SEQ ID NO: 413746 - DNA, 25 bp, Rattus norvegicus
gctttgacttatatcttgtgagacc

SEQ ID NO: 413747 - DNA, 25 bp, Rattus norvegicus
gctttgacttatttcttgtgagacc

SEQ ID NO: 413748 - DNA, 25 bp, Rattus norvegicus
gctttgactttccaaacccactaga

SEQ ID NO: 413749 - DNA, 25 bp, Rattus norvegicus
gctttgactttcgaaacccactaga

SEQ ID NO: 413750 - DNA, 25 bp, Rattus norvegicus
gctttgagaaccaatggaccaccgc

SEQ ID NO: 413751 - DNA, 25 bp, Rattus norvegicus
gctttgagaacctatggaccaccgc

SEQ ID NO: 413752 - DNA, 25 bp, Rattus norvegicus
gctttgagactgagaagcctccgcc

SEQ ID NO: 413753 - DNA, 25 bp, Rattus norvegicus
gctttgagactgtgaagcctccgcc

SEQ ID NO: 413754 - DNA, 25 bp, Rattus norvegicus
gctttgagctgaagcgggaaccctg

SEQ ID NO: 413755 - DNA, 25 bp, Rattus norvegicus
gctttgagctgatgcgggaaccctg

SEQ ID NO: 413756 - DNA, 25 bp, Rattus norvegicus
gctttgagctttatatccctgacaa

SEQ ID NO: 413757 - DNA, 25 bp, Rattus norvegicus
gctttgagctttttatccctgacaa

SEQ ID NO: 413758 - DNA, 25 bp, Rattus norvegicus
gctttgaggcggaactcgatcttat

SEQ ID NO: 413759 - DNA, 25 bp, Rattus norvegicus
gctttgaggcggtactcgatcttat

SEQ ID NO: 413760 - DNA, 25 bp, Rattus norvegicus
gctttgagtagtatctggcttgcaa

SEQ ID NO: 413761 - DNA, 25 bp, Rattus norvegicus
gctttgagtagtttctggcttgcaa

SEQ ID NO: 413762 - DNA, 25 bp, Rattus norvegicus
gctttgagtgctccaggagtgccca

SEQ ID NO: 413763 - DNA, 25 bp, Rattus norvegicus
gctttgagtgctgcaggagtgccca

SEQ ID NO: 413764 - DNA, 25 bp, Rattus norvegicus
gctttgatcacacggttctactaat

SEQ ID NO: 413765 - DNA, 25 bp, Rattus norvegicus
gctttgatcacagggttctactaat

SEQ ID NO: 413766 - DNA, 25 bp, Rattus norvegicus
gctttgatctacacagctgtgcaca

SEQ ID NO: 413767 - DNA, 25 bp, Rattus norvegicus
gctttgatctactcagctgtgcaca

SEQ ID NO: 413768 - DNA, 25 bp, Rattus norvegicus
gctttgatctcactacttcgtttaa

SEQ ID NO: 413769 - DNA, 25 bp, Rattus norvegicus
gctttgatctcagtacttcgtttaa

SEQ ID NO: 413770 - DNA, 25 bp, Rattus norvegicus
gctttgatgactcccttaacgtgaa

SEQ ID NO: 413771 - DNA, 25 bp, Rattus norvegicus
gctttgatgactgccttaacgtgaa

SEQ ID NO: 413772 - DNA, 25 bp, Rattus norvegicus
gctttgatggaaatggactgaacct

SEQ ID NO: 413773 - DNA, 25 bp, Rattus norvegicus
gctttgatggaacaacgcttatttt

SEQ ID NO: 413774 - DNA, 25 bp, Rattus norvegicus
gctttgatggaagaacgcttatttt

SEQ ID NO: 413775 - DNA, 25 bp, Rattus norvegicus
gctttgatggaattggactgaacct

SEQ ID NO: 413776 - DNA, 25 bp, Rattus norvegicus
gctttgatggatcaagactgacctt

SEQ ID NO: 413777 - DNA, 25 bp, Rattus norvegicus
gctttgatggatgaagactgacctt

SEQ ID NO: 413778 - DNA, 25 bp, Rattus norvegicus
gctttgatgtatacattactcggta

SEQ ID NO: 413779 - DNA, 25 bp, Rattus norvegicus
gctttgatgtattcattactcggta

SEQ ID NO: 413780 - DNA, 25 bp, Rattus norvegicus
gctttgattacactaatagctagca

SEQ ID NO: 413781 - DNA, 25 bp, Rattus norvegicus
gctttgattacagtaatagctagca

SEQ ID NO: 413782 - DNA, 25 bp, Rattus norvegicus
gctttgattcagacggaatggcgct

SEQ ID NO: 413783 - DNA, 25 bp, Rattus norvegicus
gctttgattcagtcggaatggcgct

SEQ ID NO: 413784 - DNA, 25 bp, Rattus norvegicus
gctttgatttgcactgtattttccc

SEQ ID NO: 413785 - DNA, 25 bp, Rattus norvegicus
gctttgatttgctctgtattttccc

SEQ ID NO: 413786 - DNA, 25 bp, Rattus norvegicus
gctttgatttgtaactcgtgtgttt

SEQ ID NO: 413787 - DNA, 25 bp, Rattus norvegicus
gctttgatttgttactcgtgtgttt

SEQ ID NO: 413788 - DNA, 25 bp, Rattus norvegicus
gctttgcaacaaacgcatattttga

SEQ ID NO: 413789 - DNA, 25 bp, Rattus norvegicus
gctttgcaacaatcgcatattttga

SEQ ID NO: 413790 - DNA, 25 bp, Rattus norvegicus
gctttgcaacggaagtgctgtcact

SEQ ID NO: 413791 - DNA, 25 bp, Rattus norvegicus
gctttgcaacggtagtgctgtcact

SEQ ID NO: 413792 - DNA, 25 bp, Rattus norvegicus
gctttgcacacgctgaaggttgctt

SEQ ID NO: 413793 - DNA, 25 bp, Rattus norvegicus
gctttgcacacggtgaaggttgctt

SEQ ID NO: 413794 - DNA, 25 bp, Rattus norvegicus
gctttgcacaggcatggtacttcat

SEQ ID NO: 413795 - DNA, 25 bp, Rattus norvegicus
gctttgcacagggatggtacttcat

SEQ ID NO: 413796 - DNA, 25 bp, Rattus norvegicus
gctttgcacatactagtcactcagt

SEQ ID NO: 413797 - DNA, 25 bp, Rattus norvegicus
gctttgcacatagtagtcactcagt

SEQ ID NO: 413798 - DNA, 25 bp, Rattus norvegicus
gctttgcacatcacagtacacattt

SEQ ID NO: 413799 - DNA, 25 bp, Rattus norvegicus
gctttgcacatctcagtacacattt

SEQ ID NO: 413800 - DNA, 25 bp, Rattus norvegicus
gctttgcaccctcctaacatgtgtg

SEQ ID NO: 413801 - DNA, 25 bp, Rattus norvegicus
gctttgcaccctgctaacatgtgtg

SEQ ID NO: 413802 - DNA, 25 bp, Rattus norvegicus
gctttgcacctacatacggaaccaa

SEQ ID NO: 413803 - DNA, 25 bp, Rattus norvegicus
gctttgcacctagatacggaaccaa

SEQ ID NO: 413804 - DNA, 25 bp, Rattus norvegicus
gctttgcactctcctgttgtagatt

SEQ ID NO: 413805 - DNA, 25 bp, Rattus norvegicus
gctttgcactctgctgttgtagatt

SEQ ID NO: 413806 - DNA, 25 bp, Rattus norvegicus
gctttgcagagacccatcatggtca

SEQ ID NO: 413807 - DNA, 25 bp, Rattus norvegicus
gctttgcagagagccatcatggtca

SEQ ID NO: 413808 - DNA, 25 bp, Rattus norvegicus
gctttgcagcccagaactcagttcg

SEQ ID NO: 413809 - DNA, 25 bp, Rattus norvegicus
gctttgcagccctgaactcagttcg

SEQ ID NO: 413810 - DNA, 25 bp, Rattus norvegicus
gctttgcagctgaaagcagaccttt

SEQ ID NO: 413811 - DNA, 25 bp, Rattus norvegicus
gctttgcagctgtaagcagaccttt

SEQ ID NO: 413812 - DNA, 25 bp, Rattus norvegicus
gctttgcatagacgcctcgttgatg

SEQ ID NO: 413813 - DNA, 25 bp, Rattus norvegicus
gctttgcatagaggcctcgttgatg

SEQ ID NO: 413814 - DNA, 25 bp, Rattus norvegicus
gctttgcatctgatgctggtgacat

SEQ ID NO: 413815 - DNA, 25 bp, Rattus norvegicus
gctttgcatctgttgctggtgacat

SEQ ID NO: 413816 - DNA, 25 bp, Rattus norvegicus
gctttgcatgttcgccggaattata

SEQ ID NO: 413817 - DNA, 25 bp, Rattus norvegicus
gctttgcatgttggccggaattata

SEQ ID NO: 413818 - DNA, 25 bp, Rattus norvegicus
gctttgcatttgagctaggcgtggt

SEQ ID NO: 413819 - DNA, 25 bp, Rattus norvegicus
gctttgcatttgtgctaggcgtggt

SEQ ID NO: 413820 - DNA, 25 bp, Rattus norvegicus
gctttgccacacctattcagacatt

SEQ ID NO: 413821 - DNA, 25 bp, Rattus norvegicus
gctttgccacacgtattcagacatt

SEQ ID NO: 413822 - DNA, 25 bp, Rattus norvegicus
gctttgccaccacctagatatggga

SEQ ID NO: 413823 - DNA, 25 bp, Rattus norvegicus
gctttgccaccagctagatatggga

SEQ ID NO: 413824 - DNA, 25 bp, Rattus norvegicus
gctttgccagtcaccagctgtgtag

SEQ ID NO: 413825 - DNA, 25 bp, Rattus norvegicus
gctttgccagtctccagctgtgtag

SEQ ID NO: 413826 - DNA, 25 bp, Rattus norvegicus
gctttgccagttctacgttatttac

SEQ ID NO: 413827 - DNA, 25 bp, Rattus norvegicus
gctttgccagttgtacgttatttac

SEQ ID NO: 413828 - DNA, 25 bp, Rattus norvegicus
gctttgccatacagacgtcaatcat

SEQ ID NO: 413829 - DNA, 25 bp, Rattus norvegicus
gctttgccatactgacgtcaatcat

SEQ ID NO: 413830 - DNA, 25 bp, Rattus norvegicus
gctttgcccaatctggtttcacatt

SEQ ID NO: 413831 - DNA, 25 bp, Rattus norvegicus
gctttgcccaatgtggtttcacatt

SEQ ID NO: 413832 - DNA, 25 bp, Rattus norvegicus
gctttgccccggaaacataaaatct

SEQ ID NO: 413833 - DNA, 25 bp, Rattus norvegicus
gctttgccccggtaacataaaatct

SEQ ID NO: 413834 - DNA, 25 bp, Rattus norvegicus
gctttgcccgggagccgcggccaaa

SEQ ID NO: 413835 - DNA, 25 bp, Rattus norvegicus
gctttgcccgggtgccgcggccaaa

SEQ ID NO: 413836 - DNA, 25 bp, Rattus norvegicus
gctttgccctctcttgattactttt

SEQ ID NO: 413837 - DNA, 25 bp, Rattus norvegicus
gctttgccctctgttgattactttt

SEQ ID NO: 413838 - DNA, 25 bp, Rattus norvegicus
gctttgccgtccactacacgaagca

SEQ ID NO: 413839 - DNA, 25 bp, Rattus norvegicus
gctttgccgtcctctacacgaagca

SEQ ID NO: 413840 - DNA, 25 bp, Rattus norvegicus
gctttgcctctgctgaatggcacta

SEQ ID NO: 413841 - DNA, 25 bp, Rattus norvegicus
gctttgcctctggtgaatggcacta

SEQ ID NO: 413842 - DNA, 25 bp, Rattus norvegicus
gctttgcctcttagtatttctcgaa

SEQ ID NO: 413843 - DNA, 25 bp, Rattus norvegicus
gctttgcctctttgtatttctcgaa

SEQ ID NO: 413844 - DNA, 25 bp, Rattus norvegicus
gctttgccttctcgagtggagactc

SEQ ID NO: 413845 - DNA, 25 bp, Rattus norvegicus
gctttgccttctggagtggagactc

SEQ ID NO: 413846 - DNA, 25 bp, Rattus norvegicus
gctttgcctttcatagtccagatgg

SEQ ID NO: 413847 - DNA, 25 bp, Rattus norvegicus
gctttgcctttcttagtccagatgg

SEQ ID NO: 413848 - DNA, 25 bp, Rattus norvegicus
gctttgcctttgatattggttggtc

SEQ ID NO: 413849 - DNA, 25 bp, Rattus norvegicus
gctttgcctttgttattggttggtc

SEQ ID NO: 413850 - DNA, 25 bp, Rattus norvegicus
gctttgcgacacattaagaacctca

SEQ ID NO: 413851 - DNA, 25 bp, Rattus norvegicus
gctttgcgacactttaagaacctca

SEQ ID NO: 413852 - DNA, 25 bp, Rattus norvegicus
gctttgcggaaccagcgaactgcct

SEQ ID NO: 413853 - DNA, 25 bp, Rattus norvegicus
gctttgcggaacgagcgaactgcct

SEQ ID NO: 413854 - DNA, 25 bp, Rattus norvegicus
gctttgctaaagaaaaacggtgaat

SEQ ID NO: 413855 - DNA, 25 bp, Rattus norvegicus
gctttgctaaagtaaaacggtgaat

SEQ ID NO: 413856 - DNA, 25 bp, Rattus norvegicus
gctttgctaaatctgttcctggttt

SEQ ID NO: 413857 - DNA, 25 bp, Rattus norvegicus
gctttgctaaatgtgttcctggttt

SEQ ID NO: 413858 - DNA, 25 bp, Rattus norvegicus
gctttgctagtgaacttctgcttga

SEQ ID NO: 413859 - DNA, 25 bp, Rattus norvegicus
gctttgctagtgtacttctgcttga

SEQ ID NO: 413860 - DNA, 25 bp, Rattus norvegicus
gctttgctcactcctactctgaaaa

SEQ ID NO: 413861 - DNA, 25 bp, Rattus norvegicus
gctttgctcactgctactctgaaaa

SEQ ID NO: 413862 - DNA, 25 bp, Rattus norvegicus
gctttgctcgctacagtccttagat

SEQ ID NO: 413863 - DNA, 25 bp, Rattus norvegicus
gctttgctcgcttcagtccttagat

SEQ ID NO: 413864 - DNA, 25 bp, Rattus norvegicus
gctttgctctcaagcttaggtggac

SEQ ID NO: 413865 - DNA, 25 bp, Rattus norvegicus
gctttgctctcatgcttaggtggac

SEQ ID NO: 413866 - DNA, 25 bp, Rattus norvegicus
gctttgctcttcacctgaataacaa

SEQ ID NO: 413867 - DNA, 25 bp, Rattus norvegicus
gctttgctcttctcctgaataacaa

SEQ ID NO: 413868 - DNA, 25 bp, Rattus norvegicus
gctttgctgagaacgcgggcagccc

SEQ ID NO: 413869 - DNA, 25 bp, Rattus norvegicus
gctttgctgagactggctcctgtgc

SEQ ID NO: 413870 - DNA, 25 bp, Rattus norvegicus
gctttgctgagagtggctcctgtgc

SEQ ID NO: 413871 - DNA, 25 bp, Rattus norvegicus
gctttgctgagatcgcgggcagccc

SEQ ID NO: 413872 - DNA, 25 bp, Rattus norvegicus
gctttgctgcgaaacagtcactctt

SEQ ID NO: 413873 - DNA, 25 bp, Rattus norvegicus
gctttgctgcgatacagtcactctt

SEQ ID NO: 413874 - DNA, 25 bp, Rattus norvegicus
gctttgctgcgtcgatggcttatta

SEQ ID NO: 413875 - DNA, 25 bp, Rattus norvegicus
gctttgctgcgtggatggcttatta

SEQ ID NO: 413876 - DNA, 25 bp, Rattus norvegicus
gctttgctgtccctgcggcttccat

SEQ ID NO: 413877 - DNA, 25 bp, Rattus norvegicus
gctttgctgtccgtgcggcttccat

SEQ ID NO: 413878 - DNA, 25 bp, Rattus norvegicus
gctttgcttacaactacgtctgtgt

SEQ ID NO: 413879 - DNA, 25 bp, Rattus norvegicus
gctttgcttacatctacgtctgtgt

SEQ ID NO: 413880 - DNA, 25 bp, Rattus norvegicus
gctttgcttagtcactgtaactcta

SEQ ID NO: 413881 - DNA, 25 bp, Rattus norvegicus
gctttgcttagtgactgtaactcta

SEQ ID NO: 413882 - DNA, 25 bp, Rattus norvegicus
gctttgcttctgctcctagggagag

SEQ ID NO: 413883 - DNA, 25 bp, Rattus norvegicus
gctttgcttctggtcctagggagag

SEQ ID NO: 413884 - DNA, 25 bp, Rattus norvegicus
gctttgcttgttcgttcatgcgacc

SEQ ID NO: 413885 - DNA, 25 bp, Rattus norvegicus
gctttgcttgttggttcatgcgacc

SEQ ID NO: 413886 - DNA, 25 bp, Rattus norvegicus
gctttgctttacacttttggtttca

SEQ ID NO: 413887 - DNA, 25 bp, Rattus norvegicus
gctttgctttactcttttggtttca

SEQ ID NO: 413888 - DNA, 25 bp, Rattus norvegicus
gctttggaaatgcttgctgcttgac

SEQ ID NO: 413889 - DNA, 25 bp, Rattus norvegicus
gctttggaaatggttgctgcttgac

SEQ ID NO: 413890 - DNA, 25 bp, Rattus norvegicus
gctttggaaccactgctattttaac

SEQ ID NO: 413891 - DNA, 25 bp, Rattus norvegicus
gctttggaaccagtgctattttaac

SEQ ID NO: 413892 - DNA, 25 bp, Rattus norvegicus
gctttggaacctcaaacacatttct

SEQ ID NO: 413893 - DNA, 25 bp, Rattus norvegicus
gctttggaacctgaaacacatttct

SEQ ID NO: 413894 - DNA, 25 bp, Rattus norvegicus
gctttggaatcacgcatctctagat

SEQ ID NO: 413895 - DNA, 25 bp, Rattus norvegicus
gctttggaatcaggcatctctagat

SEQ ID NO: 413896 - DNA, 25 bp, Rattus norvegicus
gctttggaatgtatactctgtggcc

SEQ ID NO: 413897 - DNA, 25 bp, Rattus norvegicus
gctttggaatgtttactctgtggcc

SEQ ID NO: 413898 - DNA, 25 bp, Rattus norvegicus
gctttggacagaaaatcaccgtgct

SEQ ID NO: 413899 - DNA, 25 bp, Rattus norvegicus
gctttggacagataatcaccgtgct

SEQ ID NO: 413900 - DNA, 25 bp, Rattus norvegicus
gctttggacccaactttaattgaga

SEQ ID NO: 413901 - DNA, 25 bp, Rattus norvegicus
gctttggacccatctttaattgaga

SEQ ID NO: 413902 - DNA, 25 bp, Rattus norvegicus
gctttggagcagctctcgagcctca

SEQ ID NO: 413903 - DNA, 25 bp, Rattus norvegicus
gctttggagcaggtctcgagcctca

SEQ ID NO: 413904 - DNA, 25 bp, Rattus norvegicus
gctttggaggcaacgtgatcaggca

SEQ ID NO: 413905 - DNA, 25 bp, Rattus norvegicus
gctttggaggcatcgtgatcaggca

SEQ ID NO: 413906 - DNA, 25 bp, Rattus norvegicus
gctttggatgctcggattaggacac

SEQ ID NO: 413907 - DNA, 25 bp, Rattus norvegicus
gctttggatgctgggattaggacac

SEQ ID NO: 413908 - DNA, 25 bp, Rattus norvegicus
gctttggatggaaatgcacctctga

SEQ ID NO: 413909 - DNA, 25 bp, Rattus norvegicus
gctttggatggactaggcaccccta

SEQ ID NO: 413910 - DNA, 25 bp, Rattus norvegicus
gctttggatggagtaggcaccccta

SEQ ID NO: 413911 - DNA, 25 bp, Rattus norvegicus
gctttggatggatatgcacctctga

SEQ ID NO: 413912 - DNA, 25 bp, Rattus norvegicus
gctttggattacaaaccccatttat

SEQ ID NO: 413913 - DNA, 25 bp, Rattus norvegicus
gctttggattactaaccccatttat

SEQ ID NO: 413914 - DNA, 25 bp, Rattus norvegicus
gctttggcaagcaactcttcacgga

SEQ ID NO: 413915 - DNA, 25 bp, Rattus norvegicus
gctttggcaagctactcttcacgga

SEQ ID NO: 413916 - DNA, 25 bp, Rattus norvegicus
gctttggcacatctacagtacagtt

SEQ ID NO: 413917 - DNA, 25 bp, Rattus norvegicus
gctttggcacatgtacagtacagtt

SEQ ID NO: 413918 - DNA, 25 bp, Rattus norvegicus
gctttggcaccaactctgaagggca

SEQ ID NO: 413919 - DNA, 25 bp, Rattus norvegicus
gctttggcaccatctctgaagggca

SEQ ID NO: 413920 - DNA, 25 bp, Rattus norvegicus
gctttggcacgtcagttggtcaaga

SEQ ID NO: 413921 - DNA, 25 bp, Rattus norvegicus
gctttggcacgtgagttggtcaaga

SEQ ID NO: 413922 - DNA, 25 bp, Rattus norvegicus
gctttggccaccctttgaggcaaaa

SEQ ID NO: 413923 - DNA, 25 bp, Rattus norvegicus
gctttggccaccgtttgaggcaaaa

SEQ ID NO: 413924 - DNA, 25 bp, Rattus norvegicus
gctttggcccatctttcttagggta

SEQ ID NO: 413925 - DNA, 25 bp, Rattus norvegicus
gctttggcccatgtttcttagggta

SEQ ID NO: 413926 - DNA, 25 bp, Rattus norvegicus
gctttggcctcaccatcggctgagt

SEQ ID NO: 413927 - DNA, 25 bp, Rattus norvegicus
gctttggcctcagcatcggctgagt

SEQ ID NO: 413928 - DNA, 25 bp, Rattus norvegicus
gctttggcgatgagccctggccctg

SEQ ID NO: 413929 - DNA, 25 bp, Rattus norvegicus
gctttggcgatgtgccctggccctg

SEQ ID NO: 413930 - DNA, 25 bp, Rattus norvegicus
gctttggcgcaacgtttttaactat

SEQ ID NO: 413931 - DNA, 25 bp, Rattus norvegicus
gctttggcgcaaggtttttaactat

SEQ ID NO: 413932 - DNA, 25 bp, Rattus norvegicus
gctttggcggttaagggactctcgt

SEQ ID NO: 413933 - DNA, 25 bp, Rattus norvegicus
gctttggcggtttagggactctcgt

SEQ ID NO: 413934 - DNA, 25 bp, Rattus norvegicus
gctttggcgttgaagagaactttca

SEQ ID NO: 413935 - DNA, 25 bp, Rattus norvegicus
gctttggcgttgtagagaactttca

SEQ ID NO: 413936 - DNA, 25 bp, Rattus norvegicus
gctttggctcacaaaactggatctc

SEQ ID NO: 413937 - DNA, 25 bp, Rattus norvegicus
gctttggctcactaaactggatctc

SEQ ID NO: 413938 - DNA, 25 bp, Rattus norvegicus
gctttggctccaacgagatccttaa

SEQ ID NO: 413939 - DNA, 25 bp, Rattus norvegicus
gctttggctccatcgagatccttaa

SEQ ID NO: 413940 - DNA, 25 bp, Rattus norvegicus
gctttggctcccaggcttgagtccc

SEQ ID NO: 413941 - DNA, 25 bp, Rattus norvegicus
gctttggctccctggcttgagtccc

SEQ ID NO: 413942 - DNA, 25 bp, Rattus norvegicus
gctttggctgaacccactcagcgaa

SEQ ID NO: 413943 - DNA, 25 bp, Rattus norvegicus
gctttggctgaagccactcagcgaa

SEQ ID NO: 413944 - DNA, 25 bp, Rattus norvegicus
gctttgggaaagatactgtcagaca

SEQ ID NO: 413945 - DNA, 25 bp, Rattus norvegicus
gctttgggaaagttactgtcagaca

SEQ ID NO: 413946 - DNA, 25 bp, Rattus norvegicus
gctttgggaagaacgcctggctttc

SEQ ID NO: 413947 - DNA, 25 bp, Rattus norvegicus
gctttgggaagatcgcctggctttc

SEQ ID NO: 413948 - DNA, 25 bp, Rattus norvegicus
gctttgggaggtcagcaacctgatc

SEQ ID NO: 413949 - DNA, 25 bp, Rattus norvegicus
gctttgggaggtgagcaacctgatc

SEQ ID NO: 413950 - DNA, 25 bp, Rattus norvegicus
gctttgggcgctctttgagtttaaa

SEQ ID NO: 413951 - DNA, 25 bp, Rattus norvegicus
gctttgggcgctgtttgagtttaaa

SEQ ID NO: 413952 - DNA, 25 bp, Rattus norvegicus
gctttgggctatctgaggccacttg

SEQ ID NO: 413953 - DNA, 25 bp, Rattus norvegicus
gctttgggctatgtgaggccacttg

SEQ ID NO: 413954 - DNA, 25 bp, Rattus norvegicus
gctttgggcttaagcagtgctaact

SEQ ID NO: 413955 - DNA, 25 bp, Rattus norvegicus
gctttgggcttatgcagtgctaact

SEQ ID NO: 413956 - DNA, 25 bp, Rattus norvegicus
gctttgggctttaaacacagagaca

SEQ ID NO: 413957 - DNA, 25 bp, Rattus norvegicus
gctttgggcttttaacacagagaca

SEQ ID NO: 413958 - DNA, 25 bp, Rattus norvegicus
gctttgggtcctattacaatcaaga

SEQ ID NO: 413959 - DNA, 25 bp, Rattus norvegicus
gctttgggtccttttacaatcaaga

SEQ ID NO: 413960 - DNA, 25 bp, Rattus norvegicus
gctttggtagacagtttcactgtaa

SEQ ID NO: 413961 - DNA, 25 bp, Rattus norvegicus
gctttggtagactgtttcactgtaa

SEQ ID NO: 413962 - DNA, 25 bp, Rattus norvegicus
gctttggtatcacctgacctttcta

SEQ ID NO: 413963 - DNA, 25 bp, Rattus norvegicus
gctttggtatcagctgacctttcta

SEQ ID NO: 413964 - DNA, 25 bp, Rattus norvegicus
gctttggtcaccagtacatatgcct

SEQ ID NO: 413965 - DNA, 25 bp, Rattus norvegicus
gctttggtcacctgtacatatgcct

SEQ ID NO: 413966 - DNA, 25 bp, Rattus norvegicus
gctttggtccggcaacttcaacaac

SEQ ID NO: 413967 - DNA, 25 bp, Rattus norvegicus
gctttggtccgggaacttcaacaac

SEQ ID NO: 413968 - DNA, 25 bp, Rattus norvegicus
gctttggtcctcatgagtactcaat

SEQ ID NO: 413969 - DNA, 25 bp, Rattus norvegicus
gctttggtcctcttgagtactcaat

SEQ ID NO: 413970 - DNA, 25 bp, Rattus norvegicus
gctttggttggcattggttttgaat

SEQ ID NO: 413971 - DNA, 25 bp, Rattus norvegicus
gctttggttggctttggttttgaat

SEQ ID NO: 413972 - DNA, 25 bp, Rattus norvegicus
gctttggttggtaaactcgactggt

SEQ ID NO: 413973 - DNA, 25 bp, Rattus norvegicus
gctttggttggttaactcgactggt

SEQ ID NO: 413974 - DNA, 25 bp, Rattus norvegicus
gctttggtttttacaacacggactg

SEQ ID NO: 413975 - DNA, 25 bp, Rattus norvegicus
gctttggttttttcaacacggactg

SEQ ID NO: 413976 - DNA, 25 bp, Rattus norvegicus
gctttgtaactgatgatggcacctt

SEQ ID NO: 413977 - DNA, 25 bp, Rattus norvegicus
gctttgtaactgttgatggcacctt

SEQ ID NO: 413978 - DNA, 25 bp, Rattus norvegicus
gctttgtactggcatacagatatta

SEQ ID NO: 413979 - DNA, 25 bp, Rattus norvegicus
gctttgtactgggatacagatatta

SEQ ID NO: 413980 - DNA, 25 bp, Rattus norvegicus
gctttgtagactacaacagtgagga

SEQ ID NO: 413981 - DNA, 25 bp, Rattus norvegicus
gctttgtagacttcaacagtgagga

SEQ ID NO: 413982 - DNA, 25 bp, Rattus norvegicus
gctttgtagattagcttagtggaaa

SEQ ID NO: 413983 - DNA, 25 bp, Rattus norvegicus
gctttgtagatttgcttagtggaaa

SEQ ID NO: 413984 - DNA, 25 bp, Rattus norvegicus
gctttgtagtagctcaccctgccaa

SEQ ID NO: 413985 - DNA, 25 bp, Rattus norvegicus
gctttgtagtaggtcaccctgccaa

SEQ ID NO: 413986 - DNA, 25 bp, Rattus norvegicus
gctttgtagtttccccagaggtgcg

SEQ ID NO: 413987 - DNA, 25 bp, Rattus norvegicus
gctttgtagtttctgctggttcatc

SEQ ID NO: 413988 - DNA, 25 bp, Rattus norvegicus
gctttgtagtttgcccagaggtgcg

SEQ ID NO: 413989 - DNA, 25 bp, Rattus norvegicus
gctttgtagtttgtgctggttcatc

SEQ ID NO: 413990 - DNA, 25 bp, Rattus norvegicus
gctttgtatctcagtaagctgcaaa

SEQ ID NO: 413991 - DNA, 25 bp, Rattus norvegicus
gctttgtatctctgtaagctgcaaa

SEQ ID NO: 413992 - DNA, 25 bp, Rattus norvegicus
gctttgtcaacaaccctaacagtgg

SEQ ID NO: 413993 - DNA, 25 bp, Rattus norvegicus
gctttgtcaacatccctaacagtgg

SEQ ID NO: 413994 - DNA, 25 bp, Rattus norvegicus
gctttgtcacatcagtctgccgcag

SEQ ID NO: 413995 - DNA, 25 bp, Rattus norvegicus
gctttgtcacatgagtctgccgcag

SEQ ID NO: 413996 - DNA, 25 bp, Rattus norvegicus
gctttgtcaccaactctggagacta

SEQ ID NO: 413997 - DNA, 25 bp, Rattus norvegicus
gctttgtcaccatctctggagacta

SEQ ID NO: 413998 - DNA, 25 bp, Rattus norvegicus
gctttgtcagttatagaccttgtga

SEQ ID NO: 413999 - DNA, 25 bp, Rattus norvegicus
gctttgtcagttttagaccttgtga

SEQ ID NO: 414000 - DNA, 25 bp, Rattus norvegicus
gctttgtcatatatctggttccgaa

SEQ ID NO: 414001 - DNA, 25 bp, Rattus norvegicus
gctttgtcatatttctggttccgaa

SEQ ID NO: 414002 - DNA, 25 bp, Rattus norvegicus
gctttgtccctaaaacgcctgaaga

SEQ ID NO: 414003 - DNA, 25 bp, Rattus norvegicus
gctttgtccctataacgcctgaaga

SEQ ID NO: 414004 - DNA, 25 bp, Rattus norvegicus
gctttgtctcaaattgcctttttgg

SEQ ID NO: 414005 - DNA, 25 bp, Rattus norvegicus
gctttgtctcaatttgcctttttgg

SEQ ID NO: 414006 - DNA, 25 bp, Rattus norvegicus
gctttgtctcccattaattgtattc

SEQ ID NO: 414007 - DNA, 25 bp, Rattus norvegicus
gctttgtctccctttaattgtattc

SEQ ID NO: 414008 - DNA, 25 bp, Rattus norvegicus
gctttgtctgctacacgtgtaatga

SEQ ID NO: 414009 - DNA, 25 bp, Rattus norvegicus
gctttgtctgctacctataaacacg

SEQ ID NO: 414010 - DNA, 25 bp, Rattus norvegicus
gctttgtctgcttcacgtgtaatga

SEQ ID NO: 414011 - DNA, 25 bp, Rattus norvegicus
gctttgtctgcttcctataaacacg

SEQ ID NO: 414012 - DNA, 25 bp, Rattus norvegicus
gctttgtctgtgctagccctttcat

SEQ ID NO: 414013 - DNA, 25 bp, Rattus norvegicus
gctttgtctgtggtagccctttcat

SEQ ID NO: 414014 - DNA, 25 bp, Rattus norvegicus
gctttgtcttccctgcagtaagata

SEQ ID NO: 414015 - DNA, 25 bp, Rattus norvegicus
gctttgtcttccgtgcagtaagata

SEQ ID NO: 414016 - DNA, 25 bp, Rattus norvegicus
gctttgtgaatcagtccaagcagag

SEQ ID NO: 414017 - DNA, 25 bp, Rattus norvegicus
gctttgtgaatctgtccaagcagag

SEQ ID NO: 414018 - DNA, 25 bp, Rattus norvegicus
gctttgtgacacaggtgccgtgaaa

SEQ ID NO: 414019 - DNA, 25 bp, Rattus norvegicus
gctttgtgacactggtgccgtgaaa

SEQ ID NO: 414020 - DNA, 25 bp, Rattus norvegicus
gctttgtgactactgctcttatgct

SEQ ID NO: 414021 - DNA, 25 bp, Rattus norvegicus
gctttgtgactagtgctcttatgct

SEQ ID NO: 414022 - DNA, 25 bp, Rattus norvegicus
gctttgtgatctccaggctgactga

SEQ ID NO: 414023 - DNA, 25 bp, Rattus norvegicus
gctttgtgatctgcaggctgactga

SEQ ID NO: 414024 - DNA, 25 bp, Rattus norvegicus
gctttgtgcactcagtgtcttgtat

SEQ ID NO: 414025 - DNA, 25 bp, Rattus norvegicus
gctttgtgcactgagtgtcttgtat

SEQ ID NO: 414026 - DNA, 25 bp, Rattus norvegicus
gctttgtgcctcattgggttttaat

SEQ ID NO: 414027 - DNA, 25 bp, Rattus norvegicus
gctttgtgcctccagctaatacaag

SEQ ID NO: 414028 - DNA, 25 bp, Rattus norvegicus
gctttgtgcctcgagctaatacaag

SEQ ID NO: 414029 - DNA, 25 bp, Rattus norvegicus
gctttgtgcctctttgggttttaat

SEQ ID NO: 414030 - DNA, 25 bp, Rattus norvegicus
gctttgtgctgtatgctagtttaaa

SEQ ID NO: 414031 - DNA, 25 bp, Rattus norvegicus
gctttgtgctgtttgctagtttaaa

SEQ ID NO: 414032 - DNA, 25 bp, Rattus norvegicus
gctttgtgcttcatgagctgtccgt

SEQ ID NO: 414033 - DNA, 25 bp, Rattus norvegicus
gctttgtgcttcttgagctgtccgt

SEQ ID NO: 414034 - DNA, 25 bp, Rattus norvegicus
gctttgtggatcagtatggtgctca

SEQ ID NO: 414035 - DNA, 25 bp, Rattus norvegicus
gctttgtggatctgtatggtgctca

SEQ ID NO: 414036 - DNA, 25 bp, Rattus norvegicus
gctttgtgggtaaggttcattgcca

SEQ ID NO: 414037 - DNA, 25 bp, Rattus norvegicus
gctttgtgggtatggttcattgcca

SEQ ID NO: 414038 - DNA, 25 bp, Rattus norvegicus
gctttgtgggtgagctgtttaatct

SEQ ID NO: 414039 - DNA, 25 bp, Rattus norvegicus
gctttgtgggtgtgctgtttaatct

SEQ ID NO: 414040 - DNA, 25 bp, Rattus norvegicus
gctttgtggtccagctggacagaga

SEQ ID NO: 414041 - DNA, 25 bp, Rattus norvegicus
gctttgtggtcctgctggacagaga

SEQ ID NO: 414042 - DNA, 25 bp, Rattus norvegicus
gctttgtggttaatattgtgacatc

SEQ ID NO: 414043 - DNA, 25 bp, Rattus norvegicus
gctttgtggttattattgtgacatc

SEQ ID NO: 414044 - DNA, 25 bp, Rattus norvegicus
gctttgtgtaagcttctgggtccaa

SEQ ID NO: 414045 - DNA, 25 bp, Rattus norvegicus
gctttgtgtaaggttctgggtccaa

SEQ ID NO: 414046 - DNA, 25 bp, Rattus norvegicus
gctttgtgtcccatatgtttgttat

SEQ ID NO: 414047 - DNA, 25 bp, Rattus norvegicus
gctttgtgtcccttatgtttgttat

SEQ ID NO: 414048 - DNA, 25 bp, Rattus norvegicus
gctttgtgtgcacagcctgcaagaa

SEQ ID NO: 414049 - DNA, 25 bp, Rattus norvegicus
gctttgtgtgcagagcctgcaagaa

SEQ ID NO: 414050 - DNA, 25 bp, Rattus norvegicus
gctttgtgttcaccccaatgaatgg

SEQ ID NO: 414051 - DNA, 25 bp, Rattus norvegicus
gctttgtgttcagcccaatgaatgg

SEQ ID NO: 414052 - DNA, 25 bp, Rattus norvegicus
gctttgttaattcctcagttcctga

SEQ ID NO: 414053 - DNA, 25 bp, Rattus norvegicus
gctttgttaattgctcagttcctga

SEQ ID NO: 414054 - DNA, 25 bp, Rattus norvegicus
gctttgttattcatgtgttgccacg

SEQ ID NO: 414055 - DNA, 25 bp, Rattus norvegicus
gctttgttattcttgtgttgccacg

SEQ ID NO: 414056 - DNA, 25 bp, Rattus norvegicus
gctttgttccgcatccagagggtgg

SEQ ID NO: 414057 - DNA, 25 bp, Rattus norvegicus
gctttgttccgcttccagagggtgg

SEQ ID NO: 414058 - DNA, 25 bp, Rattus norvegicus
gctttgttccttctgttgatctgat

SEQ ID NO: 414059 - DNA, 25 bp, Rattus norvegicus
gctttgttccttgtgttgatctgat

SEQ ID NO: 414060 - DNA, 25 bp, Rattus norvegicus
gctttgttctatactgtggttgtgt

SEQ ID NO: 414061 - DNA, 25 bp, Rattus norvegicus
gctttgttctattctgtggttgtgt

SEQ ID NO: 414062 - DNA, 25 bp, Rattus norvegicus
gctttgttctccataaaatgactcc

SEQ ID NO: 414063 - DNA, 25 bp, Rattus norvegicus
gctttgttctccttaaaatgactcc

SEQ ID NO: 414064 - DNA, 25 bp, Rattus norvegicus
gctttgttgatgaaactccgtgcca

SEQ ID NO: 414065 - DNA, 25 bp, Rattus norvegicus
gctttgttgatgtaactccgtgcca

SEQ ID NO: 414066 - DNA, 25 bp, Rattus norvegicus
gctttgttggacatctttctttgta

SEQ ID NO: 414067 - DNA, 25 bp, Rattus norvegicus
gctttgttggacttctttctttgta

SEQ ID NO: 414068 - DNA, 25 bp, Rattus norvegicus
gctttgtttctcattctactctgga

SEQ ID NO: 414069 - DNA, 25 bp, Rattus norvegicus
gctttgtttctctttctactctgga

SEQ ID NO: 414070 - DNA, 25 bp, Rattus norvegicus
gctttgtttgggatacaacgagggt

SEQ ID NO: 414071 - DNA, 25 bp, Rattus norvegicus
gctttgtttgggttacaacgagggt

SEQ ID NO: 414072 - DNA, 25 bp, Rattus norvegicus
gctttgtttggtacatcttccatgg

SEQ ID NO: 414073 - DNA, 25 bp, Rattus norvegicus
gctttgtttggttcatcttccatgg

SEQ ID NO: 414074 - DNA, 25 bp, Rattus norvegicus
gcttttaaagctcggctctcactat

SEQ ID NO: 414075 - DNA, 25 bp, Rattus norvegicus
gcttttaaagctgggctctcactat

SEQ ID NO: 414076 - DNA, 25 bp, Rattus norvegicus
gcttttaactaactcttgctgtctt

SEQ ID NO: 414077 - DNA, 25 bp, Rattus norvegicus
gcttttaactaagtcttgctgtctt

SEQ ID NO: 414078 - DNA, 25 bp, Rattus norvegicus
gcttttaagttgatctagattccca

SEQ ID NO: 414079 - DNA, 25 bp, Rattus norvegicus
gcttttaagttgttctagattccca

SEQ ID NO: 414080 - DNA, 25 bp, Rattus norvegicus
gcttttaatcctcatgatagtttga

SEQ ID NO: 414081 - DNA, 25 bp, Rattus norvegicus
gcttttaatcctgatgatagtttga

SEQ ID NO: 414082 - DNA, 25 bp, Rattus norvegicus
gcttttaatgcgcgagctgcgattt

SEQ ID NO: 414083 - DNA, 25 bp, Rattus norvegicus
gcttttaatgcgggagctgcgattt

SEQ ID NO: 414084 - DNA, 25 bp, Rattus norvegicus
gcttttaccatgatctctcgattcc

SEQ ID NO: 414085 - DNA, 25 bp, Rattus norvegicus
gcttttaccatgttctctcgattcc

SEQ ID NO: 414086 - DNA, 25 bp, Rattus norvegicus
gcttttactactactctgtgagcta

SEQ ID NO: 414087 - DNA, 25 bp, Rattus norvegicus
gcttttactacttctctgtgagcta

SEQ ID NO: 414088 - DNA, 25 bp, Rattus norvegicus
gcttttatacccattatcatagctt

SEQ ID NO: 414089 - DNA, 25 bp, Rattus norvegicus
gcttttataccctttatcatagctt

SEQ ID NO: 414090 - DNA, 25 bp, Rattus norvegicus
gcttttatcctgagaaacctgcacc

SEQ ID NO: 414091 - DNA, 25 bp, Rattus norvegicus
gcttttatcctgtgaaacctgcacc

SEQ ID NO: 414092 - DNA, 25 bp, Rattus norvegicus
gcttttatgtaacttgtctaggttt

SEQ ID NO: 414093 - DNA, 25 bp, Rattus norvegicus
gcttttatgtaagttgtctaggttt

SEQ ID NO: 414094 - DNA, 25 bp, Rattus norvegicus
gcttttattcagatggccatccgta

SEQ ID NO: 414095 - DNA, 25 bp, Rattus norvegicus
gcttttattcagttggccatccgta

SEQ ID NO: 414096 - DNA, 25 bp, Rattus norvegicus
gcttttattgccacttcataactgt

SEQ ID NO: 414097 - DNA, 25 bp, Rattus norvegicus
gcttttattgcctcttcataactgt

SEQ ID NO: 414098 - DNA, 25 bp, Rattus norvegicus
gcttttcaaaagcttccactgacat

SEQ ID NO: 414099 - DNA, 25 bp, Rattus norvegicus
gcttttcaaaaggttccactgacat

SEQ ID NO: 414100 - DNA, 25 bp, Rattus norvegicus
gcttttcaaatgcttctctaacatg

SEQ ID NO: 414101 - DNA, 25 bp, Rattus norvegicus
gcttttcaaatggttctctaacatg

SEQ ID NO: 414102 - DNA, 25 bp, Rattus norvegicus
gcttttcaacatcggctgtgagcag

SEQ ID NO: 414103 - DNA, 25 bp, Rattus norvegicus
gcttttcaacatgggctgtgagcag

SEQ ID NO: 414104 - DNA, 25 bp, Rattus norvegicus
gcttttcacacactaggcaactgct

SEQ ID NO: 414105 - DNA, 25 bp, Rattus norvegicus
gcttttcacacagtaggcaactgct

SEQ ID NO: 414106 - DNA, 25 bp, Rattus norvegicus
gcttttcacactaacttcattcttg

SEQ ID NO: 414107 - DNA, 25 bp, Rattus norvegicus
gcttttcacacttacttcattcttg

SEQ ID NO: 414108 - DNA, 25 bp, Rattus norvegicus
gcttttcacctcagttcacagacag

SEQ ID NO: 414109 - DNA, 25 bp, Rattus norvegicus
gcttttcacctctgttcacagacag

SEQ ID NO: 414110 - DNA, 25 bp, Rattus norvegicus
gcttttcagactacatactgtgctg

SEQ ID NO: 414111 - DNA, 25 bp, Rattus norvegicus
gcttttcagacttcatactgtgctg

SEQ ID NO: 414112 - DNA, 25 bp, Rattus norvegicus
gcttttcagccaaaaatgtcatgca

SEQ ID NO: 414113 - DNA, 25 bp, Rattus norvegicus
gcttttcagccataaatgtcatgca

SEQ ID NO: 414114 - DNA, 25 bp, Rattus norvegicus
gcttttcagctcaaacattctaggt

SEQ ID NO: 414115 - DNA, 25 bp, Rattus norvegicus
gcttttcagctctaacattctaggt

SEQ ID NO: 414116 - DNA, 25 bp, Rattus norvegicus
gcttttcagggcataggctgctgat

SEQ ID NO: 414117 - DNA, 25 bp, Rattus norvegicus
gcttttcagggcttaggctgctgat

SEQ ID NO: 414118 - DNA, 25 bp, Rattus norvegicus
gcttttcatctcagtggcaattatc

SEQ ID NO: 414119 - DNA, 25 bp, Rattus norvegicus
gcttttcatctccagggccttaata

SEQ ID NO: 414120 - DNA, 25 bp, Rattus norvegicus
gcttttcatctcgagggccttaata

SEQ ID NO: 414121 - DNA, 25 bp, Rattus norvegicus
gcttttcatctctgtggcaattatc

SEQ ID NO: 414122 - DNA, 25 bp, Rattus norvegicus
gcttttcattgacttgtgcttttag

SEQ ID NO: 414123 - DNA, 25 bp, Rattus norvegicus
gcttttcattgagttgtgcttttag

SEQ ID NO: 414124 - DNA, 25 bp, Rattus norvegicus
gcttttcattttactgacggagact

SEQ ID NO: 414125 - DNA, 25 bp, Rattus norvegicus
gcttttcatttttctgacggagact

SEQ ID NO: 414126 - DNA, 25 bp, Rattus norvegicus
gcttttccacacattgttatgtctg

SEQ ID NO: 414127 - DNA, 25 bp, Rattus norvegicus
gcttttccacactttgttatgtctg

SEQ ID NO: 414128 - DNA, 25 bp, Rattus norvegicus
gcttttccagggacagttcactaga

SEQ ID NO: 414129 - DNA, 25 bp, Rattus norvegicus
gcttttccagggtcagttcactaga

SEQ ID NO: 414130 - DNA, 25 bp, Rattus norvegicus
gcttttcccactattgcatttctat

SEQ ID NO: 414131 - DNA, 25 bp, Rattus norvegicus
gcttttcccacttttgcatttctat

SEQ ID NO: 414132 - DNA, 25 bp, Rattus norvegicus
gcttttcccagccttggtctgaaag

SEQ ID NO: 414133 - DNA, 25 bp, Rattus norvegicus
gcttttcccagcgttggtctgaaag

SEQ ID NO: 414134 - DNA, 25 bp, Rattus norvegicus
gcttttccccaaatgtgtaggtaga

SEQ ID NO: 414135 - DNA, 25 bp, Rattus norvegicus
gcttttccccaattgtgtaggtaga

SEQ ID NO: 414136 - DNA, 25 bp, Rattus norvegicus
gcttttccccatagtgtcttcaaaa

SEQ ID NO: 414137 - DNA, 25 bp, Rattus norvegicus
gcttttccccattgtgtcttcaaaa

SEQ ID NO: 414138 - DNA, 25 bp, Rattus norvegicus
gcttttcccctgagtacatatcaaa

SEQ ID NO: 414139 - DNA, 25 bp, Rattus norvegicus
gcttttcccctgtgtacatatcaaa

SEQ ID NO: 414140 - DNA, 25 bp, Rattus norvegicus
gcttttccctaaaagcttacgttct

SEQ ID NO: 414141 - DNA, 25 bp, Rattus norvegicus
gcttttccctaatagcttacgttct

SEQ ID NO: 414142 - DNA, 25 bp, Rattus norvegicus
gcttttcccttacagatttaacatg

SEQ ID NO: 414143 - DNA, 25 bp, Rattus norvegicus
gcttttcccttagagatttaacatg

SEQ ID NO: 414144 - DNA, 25 bp, Rattus norvegicus
gcttttccgggtaaaagcatggaat

SEQ ID NO: 414145 - DNA, 25 bp, Rattus norvegicus
gcttttccgggttaaagcatggaat

SEQ ID NO: 414146 - DNA, 25 bp, Rattus norvegicus
gcttttccgtaacagtcccgagaag

SEQ ID NO: 414147 - DNA, 25 bp, Rattus norvegicus
gcttttccgtaagagtcccgagaag

SEQ ID NO: 414148 - DNA, 25 bp, Rattus norvegicus
gcttttcctacgacacttttgtgga

SEQ ID NO: 414149 - DNA, 25 bp, Rattus norvegicus
gcttttcctacgtcacttttgtgga

SEQ ID NO: 414150 - DNA, 25 bp, Rattus norvegicus
gcttttcctatcctccaaatctaaa

SEQ ID NO: 414151 - DNA, 25 bp, Rattus norvegicus
gcttttcctatcgtccaaatctaaa

SEQ ID NO: 414152 - DNA, 25 bp, Rattus norvegicus
gcttttcctcacacactatgtatat

SEQ ID NO: 414153 - DNA, 25 bp, Rattus norvegicus
gcttttcctcactcactatgtatat

SEQ ID NO: 414154 - DNA, 25 bp, Rattus norvegicus
gcttttcctctgcatatgtctcagt

SEQ ID NO: 414155 - DNA, 25 bp, Rattus norvegicus
gcttttcctctggatatgtctcagt

SEQ ID NO: 414156 - DNA, 25 bp, Rattus norvegicus
gcttttcctgaacagaccacattct

SEQ ID NO: 414157 - DNA, 25 bp, Rattus norvegicus
gcttttcctgaagagaccacattct

SEQ ID NO: 414158 - DNA, 25 bp, Rattus norvegicus
gcttttcctgagctttacccaccag

SEQ ID NO: 414159 - DNA, 25 bp, Rattus norvegicus
gcttttcctgaggtttacccaccag

SEQ ID NO: 414160 - DNA, 25 bp, Rattus norvegicus
gcttttcctgccaaagaaagtcttg

SEQ ID NO: 414161 - DNA, 25 bp, Rattus norvegicus
gcttttcctgcctaagaaagtcttg

SEQ ID NO: 414162 - DNA, 25 bp, Rattus norvegicus
gcttttcgatatccttgccaatttt

SEQ ID NO: 414163 - DNA, 25 bp, Rattus norvegicus
gcttttcgatatgcttgccaatttt

SEQ ID NO: 414164 - DNA, 25 bp, Rattus norvegicus
gcttttcggctacttttgccagcaa

SEQ ID NO: 414165 - DNA, 25 bp, Rattus norvegicus
gcttttcggctagttttgccagcaa

SEQ ID NO: 414166 - DNA, 25 bp, Rattus norvegicus
gcttttcgtttcatcaatcactggg

SEQ ID NO: 414167 - DNA, 25 bp, Rattus norvegicus
gcttttcgtttcttcaatcactggg

SEQ ID NO: 414168 - DNA, 25 bp, Rattus norvegicus
gcttttctatcccttgctctagaaa

SEQ ID NO: 414169 - DNA, 25 bp, Rattus norvegicus
gcttttctatccgttgctctagaaa

SEQ ID NO: 414170 - DNA, 25 bp, Rattus norvegicus
gcttttctcagaactgaacctgctg

SEQ ID NO: 414171 - DNA, 25 bp, Rattus norvegicus
gcttttctcagatctgaacctgctg

SEQ ID NO: 414172 - DNA, 25 bp, Rattus norvegicus
gcttttctcccacattctgaactgt

SEQ ID NO: 414173 - DNA, 25 bp, Rattus norvegicus
gcttttctcccagattctgaactgt

SEQ ID NO: 414174 - DNA, 25 bp, Rattus norvegicus
gcttttctccttatcagtcatatca

SEQ ID NO: 414175 - DNA, 25 bp, Rattus norvegicus
gcttttctccttttcagtcatatca

SEQ ID NO: 414176 - DNA, 25 bp, Rattus norvegicus
gcttttctcggtctcgctgctataa

SEQ ID NO: 414177 - DNA, 25 bp, Rattus norvegicus
gcttttctcggtgtcgctgctataa

SEQ ID NO: 414178 - DNA, 25 bp, Rattus norvegicus
gcttttctctatcgcagtagccaga

SEQ ID NO: 414179 - DNA, 25 bp, Rattus norvegicus
gcttttctctatggcagtagccaga

SEQ ID NO: 414180 - DNA, 25 bp, Rattus norvegicus
gcttttctctgcagtgatccatgaa

SEQ ID NO: 414181 - DNA, 25 bp, Rattus norvegicus
gcttttctctgctgtgatccatgaa

SEQ ID NO: 414182 - DNA, 25 bp, Rattus norvegicus
gcttttctgaccattccttgggaat

SEQ ID NO: 414183 - DNA, 25 bp, Rattus norvegicus
gcttttctgacctttccttgggaat

SEQ ID NO: 414184 - DNA, 25 bp, Rattus norvegicus
gcttttctgactcccgcatgaggaa

SEQ ID NO: 414185 - DNA, 25 bp, Rattus norvegicus
gcttttctgactgccgcatgaggaa

SEQ ID NO: 414186 - DNA, 25 bp, Rattus norvegicus
gcttttctggagctgacctgacaga

SEQ ID NO: 414187 - DNA, 25 bp, Rattus norvegicus
gcttttctggaggtgacctgacaga

SEQ ID NO: 414188 - DNA, 25 bp, Rattus norvegicus
gcttttctgtttcttgcaactccta

SEQ ID NO: 414189 - DNA, 25 bp, Rattus norvegicus
gcttttctgtttgttgcaactccta

SEQ ID NO: 414190 - DNA, 25 bp, Rattus norvegicus
gcttttcttcccataagtagtatct

SEQ ID NO: 414191 - DNA, 25 bp, Rattus norvegicus
gcttttcttcccttaagtagtatct

SEQ ID NO: 414192 - DNA, 25 bp, Rattus norvegicus
gcttttcttcctagctacattgcaa

SEQ ID NO: 414193 - DNA, 25 bp, Rattus norvegicus
gcttttcttccttgctacattgcaa

SEQ ID NO: 414194 - DNA, 25 bp, Rattus norvegicus
gcttttcttgatcctctttgctttg

SEQ ID NO: 414195 - DNA, 25 bp, Rattus norvegicus
gcttttcttgatgctctttgctttg

SEQ ID NO: 414196 - DNA, 25 bp, Rattus norvegicus
gcttttcttgctagtggtcctctat

SEQ ID NO: 414197 - DNA, 25 bp, Rattus norvegicus
gcttttcttgcttgtggtcctctat

SEQ ID NO: 414198 - DNA, 25 bp, Rattus norvegicus
gcttttcttgtgagtgaggtgctaa

SEQ ID NO: 414199 - DNA, 25 bp, Rattus norvegicus
gcttttcttgtgtgtgaggtgctaa

SEQ ID NO: 414200 - DNA, 25 bp, Rattus norvegicus
gcttttcttttaagtggcctgcctc

SEQ ID NO: 414201 - DNA, 25 bp, Rattus norvegicus
gcttttcttttacgtgtccattgat

SEQ ID NO: 414202 - DNA, 25 bp, Rattus norvegicus
gcttttcttttaggtgtccattgat

SEQ ID NO: 414203 - DNA, 25 bp, Rattus norvegicus
gcttttcttttatgtggcctgcctc

SEQ ID NO: 414204 - DNA, 25 bp, Rattus norvegicus
gcttttctttttctaactccagtgt

SEQ ID NO: 414205 - DNA, 25 bp, Rattus norvegicus
gcttttctttttgtaactccagtgt

SEQ ID NO: 414206 - DNA, 25 bp, Rattus norvegicus
gcttttgaacatatgtgcgcctatc

SEQ ID NO: 414207 - DNA, 25 bp, Rattus norvegicus
gcttttgaacatttgtgcgcctatc

SEQ ID NO: 414208 - DNA, 25 bp, Rattus norvegicus
gcttttgaagcacattgtccctggc

SEQ ID NO: 414209 - DNA, 25 bp, Rattus norvegicus
gcttttgaagcagattgtccctggc

SEQ ID NO: 414210 - DNA, 25 bp, Rattus norvegicus
gcttttgaaggcagagctgtgcaga

SEQ ID NO: 414211 - DNA, 25 bp, Rattus norvegicus
gcttttgaaggctgagctgtgcaga

SEQ ID NO: 414212 - DNA, 25 bp, Rattus norvegicus
gcttttgatgtcaacggctcctcat

SEQ ID NO: 414213 - DNA, 25 bp, Rattus norvegicus
gcttttgatgtctacggctcctcat

SEQ ID NO: 414214 - DNA, 25 bp, Rattus norvegicus
gcttttgattctaatgcccagacat

SEQ ID NO: 414215 - DNA, 25 bp, Rattus norvegicus
gcttttgattcttatgcccagacat

SEQ ID NO: 414216 - DNA, 25 bp, Rattus norvegicus
gcttttgcaaacatgtcaatcccag

SEQ ID NO: 414217 - DNA, 25 bp, Rattus norvegicus
gcttttgcaaacttgtcaatcccag

SEQ ID NO: 414218 - DNA, 25 bp, Rattus norvegicus
gcttttgcagacattcaaggactat

SEQ ID NO: 414219 - DNA, 25 bp, Rattus norvegicus
gcttttgcagactttcaaggactat

SEQ ID NO: 414220 - DNA, 25 bp, Rattus norvegicus
gcttttgcagagatacccaggttga

SEQ ID NO: 414221 - DNA, 25 bp, Rattus norvegicus
gcttttgcagagttacccaggttga

SEQ ID NO: 414222 - DNA, 25 bp, Rattus norvegicus
gcttttgcagcaaatcttgggtcta

SEQ ID NO: 414223 - DNA, 25 bp, Rattus norvegicus
gcttttgcagcatatcttgggtcta

SEQ ID NO: 414224 - DNA, 25 bp, Rattus norvegicus
gcttttgccaagagtcagctatttg

SEQ ID NO: 414225 - DNA, 25 bp, Rattus norvegicus
gcttttgccaagtgtcagctatttg

SEQ ID NO: 414226 - DNA, 25 bp, Rattus norvegicus
gcttttgccagtcttatctgtctta

SEQ ID NO: 414227 - DNA, 25 bp, Rattus norvegicus
gcttttgccagtgttatctgtctta

SEQ ID NO: 414228 - DNA, 25 bp, Rattus norvegicus
gcttttgcccaaaaccacaacagta

SEQ ID NO: 414229 - DNA, 25 bp, Rattus norvegicus
gcttttgcccaataccacaacagta

SEQ ID NO: 414230 - DNA, 25 bp, Rattus norvegicus
gcttttgcccatctgacctcatgta

SEQ ID NO: 414231 - DNA, 25 bp, Rattus norvegicus
gcttttgcccatgtgacctcatgta

SEQ ID NO: 414232 - DNA, 25 bp, Rattus norvegicus
gcttttgcctccatagtgctagggt

SEQ ID NO: 414233 - DNA, 25 bp, Rattus norvegicus
gcttttgcctccttagtgctagggt

SEQ ID NO: 414234 - DNA, 25 bp, Rattus norvegicus
gcttttgctctaagatgtccatggt

SEQ ID NO: 414235 - DNA, 25 bp, Rattus norvegicus
gcttttgctctatgatgtccatggt

SEQ ID NO: 414236 - DNA, 25 bp, Rattus norvegicus
gcttttgctgccattgaattcatct

SEQ ID NO: 414237 - DNA, 25 bp, Rattus norvegicus
gcttttgctgcctttgaattcatct

SEQ ID NO: 414238 - DNA, 25 bp, Rattus norvegicus
gcttttgctgtgaaacttgattatc

SEQ ID NO: 414239 - DNA, 25 bp, Rattus norvegicus
gcttttgctgtgtaacttgattatc

SEQ ID NO: 414240 - DNA, 25 bp, Rattus norvegicus
gcttttggaaacctgctgttcctga

SEQ ID NO: 414241 - DNA, 25 bp, Rattus norvegicus
gcttttggaaacgtgctgttcctga

SEQ ID NO: 414242 - DNA, 25 bp, Rattus norvegicus
gcttttggaagtctcatctccctta

SEQ ID NO: 414243 - DNA, 25 bp, Rattus norvegicus
gcttttggaagtgtcatctccctta

SEQ ID NO: 414244 - DNA, 25 bp, Rattus norvegicus
gcttttggccctagtagtttctcca

SEQ ID NO: 414245 - DNA, 25 bp, Rattus norvegicus
gcttttggcccttgtagtttctcca

SEQ ID NO: 414246 - DNA, 25 bp, Rattus norvegicus
gcttttggcgcccacagtgatgatg

SEQ ID NO: 414247 - DNA, 25 bp, Rattus norvegicus
gcttttggcgccgacagtgatgatg

SEQ ID NO: 414248 - DNA, 25 bp, Rattus norvegicus
gcttttgggacgagtagtttgcgac

SEQ ID NO: 414249 - DNA, 25 bp, Rattus norvegicus
gcttttgggacgtgtagtttgcgac

SEQ ID NO: 414250 - DNA, 25 bp, Rattus norvegicus
gcttttgggtacctagaggaactga

SEQ ID NO: 414251 - DNA, 25 bp, Rattus norvegicus
gcttttgggtacgtagaggaactga

SEQ ID NO: 414252 - DNA, 25 bp, Rattus norvegicus
gcttttggtgccatagagtttctgc

SEQ ID NO: 414253 - DNA, 25 bp, Rattus norvegicus
gcttttggtgccttagagtttctgc

SEQ ID NO: 414254 - DNA, 25 bp, Rattus norvegicus
gcttttgtaactctttccttctgaa

SEQ ID NO: 414255 - DNA, 25 bp, Rattus norvegicus
gcttttgtaactgtttccttctgaa

SEQ ID NO: 414256 - DNA, 25 bp, Rattus norvegicus
gcttttgtaccacactgagatctct

SEQ ID NO: 414257 - DNA, 25 bp, Rattus norvegicus
gcttttgtaccagactgagatctct

SEQ ID NO: 414258 - DNA, 25 bp, Rattus norvegicus
gcttttgtacccatcttggactgga

SEQ ID NO: 414259 - DNA, 25 bp, Rattus norvegicus
gcttttgtacccttcttggactgga

SEQ ID NO: 414260 - DNA, 25 bp, Rattus norvegicus
gcttttgtatcacgtcattctttat

SEQ ID NO: 414261 - DNA, 25 bp, Rattus norvegicus
gcttttgtatcactgcagacctctt

SEQ ID NO: 414262 - DNA, 25 bp, Rattus norvegicus
gcttttgtatcaggtcattctttat

SEQ ID NO: 414263 - DNA, 25 bp, Rattus norvegicus
gcttttgtatcagtgcagacctctt

SEQ ID NO: 414264 - DNA, 25 bp, Rattus norvegicus
gcttttgtcaagctctctaagaaga

SEQ ID NO: 414265 - DNA, 25 bp, Rattus norvegicus
gcttttgtcaaggtctctaagaaga

SEQ ID NO: 414266 - DNA, 25 bp, Rattus norvegicus
gcttttgtcactatagggtcagact

SEQ ID NO: 414267 - DNA, 25 bp, Rattus norvegicus
gcttttgtcactttagggtcagact

SEQ ID NO: 414268 - DNA, 25 bp, Rattus norvegicus
gcttttgtctatagtcatgccttca

SEQ ID NO: 414269 - DNA, 25 bp, Rattus norvegicus
gcttttgtctattgtcatgccttca

SEQ ID NO: 414270 - DNA, 25 bp, Rattus norvegicus
gcttttgtctcaagcttctagggaa

SEQ ID NO: 414271 - DNA, 25 bp, Rattus norvegicus
gcttttgtctcatgcttctagggaa

SEQ ID NO: 414272 - DNA, 25 bp, Rattus norvegicus
gcttttgtcttaaaccattactttg

SEQ ID NO: 414273 - DNA, 25 bp, Rattus norvegicus
gcttttgtcttataccattactttg

SEQ ID NO: 414274 - DNA, 25 bp, Rattus norvegicus
gcttttgtgccgcaactatgttggt

SEQ ID NO: 414275 - DNA, 25 bp, Rattus norvegicus
gcttttgtgccggaactatgttggt

SEQ ID NO: 414276 - DNA, 25 bp, Rattus norvegicus
gcttttgtgggcaccatgtttatga

SEQ ID NO: 414277 - DNA, 25 bp, Rattus norvegicus
gcttttgtgggcacctttatctgaa

SEQ ID NO: 414278 - DNA, 25 bp, Rattus norvegicus
gcttttgtgggctccatgtttatga

SEQ ID NO: 414279 - DNA, 25 bp, Rattus norvegicus
gcttttgtgggctcctttatctgaa

SEQ ID NO: 414280 - DNA, 25 bp, Rattus norvegicus
gcttttgtgtccacctatctaaaaa

SEQ ID NO: 414281 - DNA, 25 bp, Rattus norvegicus
gcttttgtgtcctcctatctaaaaa

SEQ ID NO: 414282 - DNA, 25 bp, Rattus norvegicus
gcttttgttaaaagcccttcttctg

SEQ ID NO: 414283 - DNA, 25 bp, Rattus norvegicus
gcttttgttaaatgcccttcttctg

SEQ ID NO: 414284 - DNA, 25 bp, Rattus norvegicus
gcttttgttaatagcctccactcaa

SEQ ID NO: 414285 - DNA, 25 bp, Rattus norvegicus
gcttttgttaattgcctccactcaa

SEQ ID NO: 414286 - DNA, 25 bp, Rattus norvegicus
gcttttgttagcactctcagtgcaa

SEQ ID NO: 414287 - DNA, 25 bp, Rattus norvegicus
gcttttgttagctctctcagtgcaa

SEQ ID NO: 414288 - DNA, 25 bp, Rattus norvegicus
gcttttgttgctcgtgtccctgtaa

SEQ ID NO: 414289 - DNA, 25 bp, Rattus norvegicus
gcttttgttgctggtgtccctgtaa

SEQ ID NO: 414290 - DNA, 25 bp, Rattus norvegicus
gcttttgtttggattacttgtggat

SEQ ID NO: 414291 - DNA, 25 bp, Rattus norvegicus
gcttttgtttggtttacttgtggat

SEQ ID NO: 414292 - DNA, 25 bp, Rattus norvegicus
gcttttgtttttcattctgctttag

SEQ ID NO: 414293 - DNA, 25 bp, Rattus norvegicus
gcttttgtttttgattctgctttag

SEQ ID NO: 414294 - DNA, 25 bp, Rattus norvegicus
gctttttaaagcacagtggtgtccc

SEQ ID NO: 414295 - DNA, 25 bp, Rattus norvegicus
gctttttaaagctcagtggtgtccc

SEQ ID NO: 414296 - DNA, 25 bp, Rattus norvegicus
gctttttaaaggcatttcgtacatt

SEQ ID NO: 414297 - DNA, 25 bp, Rattus norvegicus
gctttttaaagggatttcgtacatt

SEQ ID NO: 414298 - DNA, 25 bp, Rattus norvegicus
gctttttacaaacgtgcatctggat

SEQ ID NO: 414299 - DNA, 25 bp, Rattus norvegicus
gctttttacaaaggtgcatctggat

SEQ ID NO: 414300 - DNA, 25 bp, Rattus norvegicus
gctttttagccccaagttaagtctg

SEQ ID NO: 414301 - DNA, 25 bp, Rattus norvegicus
gctttttagcccgaagttaagtctg

SEQ ID NO: 414302 - DNA, 25 bp, Rattus norvegicus
gctttttagcttaggaaatggtctt

SEQ ID NO: 414303 - DNA, 25 bp, Rattus norvegicus
gctttttagctttggaaatggtctt

SEQ ID NO: 414304 - DNA, 25 bp, Rattus norvegicus
gctttttagtcacacaagtgtccat

SEQ ID NO: 414305 - DNA, 25 bp, Rattus norvegicus
gctttttagtcagacaagtgtccat

SEQ ID NO: 414306 - DNA, 25 bp, Rattus norvegicus
gctttttatcctcatgcactcatga

SEQ ID NO: 414307 - DNA, 25 bp, Rattus norvegicus
gctttttatcctgatgcactcatga

SEQ ID NO: 414308 - DNA, 25 bp, Rattus norvegicus
gctttttatttgagctacgtctcta

SEQ ID NO: 414309 - DNA, 25 bp, Rattus norvegicus
gctttttatttgtgctacgtctcta

SEQ ID NO: 414310 - DNA, 25 bp, Rattus norvegicus
gctttttcatttctaacagaggcaa

SEQ ID NO: 414311 - DNA, 25 bp, Rattus norvegicus
gctttttcatttgtaacagaggcaa

SEQ ID NO: 414312 - DNA, 25 bp, Rattus norvegicus
gctttttccccaacaactatgtaga

SEQ ID NO: 414313 - DNA, 25 bp, Rattus norvegicus
gctttttccccatcaactatgtaga

SEQ ID NO: 414314 - DNA, 25 bp, Rattus norvegicus
gctttttcctgcaagattggtctta

SEQ ID NO: 414315 - DNA, 25 bp, Rattus norvegicus
gctttttcctgcacactaatgtgta

SEQ ID NO: 414316 - DNA, 25 bp, Rattus norvegicus
gctttttcctgctagattggtctta

SEQ ID NO: 414317 - DNA, 25 bp, Rattus norvegicus
gctttttcctgctcactaatgtgta

SEQ ID NO: 414318 - DNA, 25 bp, Rattus norvegicus
gctttttcgtgtatgttttcctctg

SEQ ID NO: 414319 - DNA, 25 bp, Rattus norvegicus
gctttttcgtgtttgttttcctctg

SEQ ID NO: 414320 - DNA, 25 bp, Rattus norvegicus
gctttttcttggcaggctgcttcaa

SEQ ID NO: 414321 - DNA, 25 bp, Rattus norvegicus
gctttttcttgggaggctgcttcaa

SEQ ID NO: 414322 - DNA, 25 bp, Rattus norvegicus
gctttttctttcatggtctcagtac

SEQ ID NO: 414323 - DNA, 25 bp, Rattus norvegicus
gctttttctttcttggtctcagtac

SEQ ID NO: 414324 - DNA, 25 bp, Rattus norvegicus
gctttttgaattctgaggttcctgc

SEQ ID NO: 414325 - DNA, 25 bp, Rattus norvegicus
gctttttgaattgtgaggttcctgc

SEQ ID NO: 414326 - DNA, 25 bp, Rattus norvegicus
gctttttgacctcgtgtgccacgaa

SEQ ID NO: 414327 - DNA, 25 bp, Rattus norvegicus
gctttttgacctggtgtgccacgaa

SEQ ID NO: 414328 - DNA, 25 bp, Rattus norvegicus
gctttttgatgacttcctgctgtat

SEQ ID NO: 414329 - DNA, 25 bp, Rattus norvegicus
gctttttgatgagttcctgctgtat

SEQ ID NO: 414330 - DNA, 25 bp, Rattus norvegicus
gctttttgcagcactgattgcacga

SEQ ID NO: 414331 - DNA, 25 bp, Rattus norvegicus
gctttttgcagctctgattgcacga

SEQ ID NO: 414332 - DNA, 25 bp, Rattus norvegicus
gctttttgcaggaactgaggccttc

SEQ ID NO: 414333 - DNA, 25 bp, Rattus norvegicus
gctttttgcaggtactgaggccttc

SEQ ID NO: 414334 - DNA, 25 bp, Rattus norvegicus
gctttttgcgatctgttgctgacca

SEQ ID NO: 414335 - DNA, 25 bp, Rattus norvegicus
gctttttgcgatgtgttgctgacca

SEQ ID NO: 414336 - DNA, 25 bp, Rattus norvegicus
gctttttgctatcctatgtatcttg

SEQ ID NO: 414337 - DNA, 25 bp, Rattus norvegicus
gctttttgctatgctatgtatcttg

SEQ ID NO: 414338 - DNA, 25 bp, Rattus norvegicus
gctttttgctttcagtgtctcccaa

SEQ ID NO: 414339 - DNA, 25 bp, Rattus norvegicus
gctttttgctttgagtgtctcccaa

SEQ ID NO: 414340 - DNA, 25 bp, Rattus norvegicus
gcttttttcagtccatttcttaata

SEQ ID NO: 414341 - DNA, 25 bp, Rattus norvegicus
gcttttttcagtgcatttcttaata

SEQ ID NO: 414342 - DNA, 25 bp, Rattus norvegicus
gcttttttctccctaggtgttagat

SEQ ID NO: 414343 - DNA, 25 bp, Rattus norvegicus
gcttttttctccgtaggtgttagat

SEQ ID NO: 414344 - DNA, 25 bp, Rattus norvegicus
gcttttttcttgagacagttatgca

SEQ ID NO: 414345 - DNA, 25 bp, Rattus norvegicus
gcttttttcttgtgacagttatgca

SEQ ID NO: 414346 - DNA, 25 bp, Rattus norvegicus
gcttttttgcgtctattttctgtgg

SEQ ID NO: 414347 - DNA, 25 bp, Rattus norvegicus
gcttttttgcgtgtattttctgtgg

SEQ ID NO: 414348 - DNA, 25 bp, Rattus norvegicus
gcttttttgttgaaggtgccacgta

SEQ ID NO: 414349 - DNA, 25 bp, Rattus norvegicus
gcttttttgttgtaggtgccacgta

SEQ ID NO: 414350 - DNA, 25 bp, Rattus norvegicus
ggaaaaaaccaactctgaccacctg

SEQ ID NO: 414351 - DNA, 25 bp, Rattus norvegicus
ggaaaaaaccaagtctgaccacctg

SEQ ID NO: 414352 - DNA, 25 bp, Rattus norvegicus
ggaaaaaatgctatctctctgtgtg

SEQ ID NO: 414353 - DNA, 25 bp, Rattus norvegicus
ggaaaaaatgctttctctctgtgtg

SEQ ID NO: 414354 - DNA, 25 bp, Rattus norvegicus
ggaaaaacaactctgctgcctggca

SEQ ID NO: 414355 - DNA, 25 bp, Rattus norvegicus
ggaaaaacaactgtgctgcctggca

SEQ ID NO: 414356 - DNA, 25 bp, Rattus norvegicus
ggaaaaacatacacagcgccgcaga

SEQ ID NO: 414357 - DNA, 25 bp, Rattus norvegicus
ggaaaaacatactcagcgccgcaga

SEQ ID NO: 414358 - DNA, 25 bp, Rattus norvegicus
ggaaaaacttgcacccactgaggat

SEQ ID NO: 414359 - DNA, 25 bp, Rattus norvegicus
ggaaaaacttgctcccactgaggat

SEQ ID NO: 414360 - DNA, 25 bp, Rattus norvegicus
ggaaaaactttcaatctcttgattt

SEQ ID NO: 414361 - DNA, 25 bp, Rattus norvegicus
ggaaaaactttctatctcttgattt

SEQ ID NO: 414362 - DNA, 25 bp, Rattus norvegicus
ggaaaaagcagcagagcttcatcag

SEQ ID NO: 414363 - DNA, 25 bp, Rattus norvegicus
ggaaaaagcagctgagcttcatcag

SEQ ID NO: 414364 - DNA, 25 bp, Rattus norvegicus
ggaaaaagcctgactgtccttcaag

SEQ ID NO: 414365 - DNA, 25 bp, Rattus norvegicus
ggaaaaagcctgtctgtccttcaag

SEQ ID NO: 414366 - DNA, 25 bp, Rattus norvegicus
ggaaaaagctcccaacggttgtcat

SEQ ID NO: 414367 - DNA, 25 bp, Rattus norvegicus
ggaaaaagctccgaacggttgtcat

SEQ ID NO: 414368 - DNA, 25 bp, Rattus norvegicus
ggaaaaagtcagaaggcagcccacc

SEQ ID NO: 414369 - DNA, 25 bp, Rattus norvegicus
ggaaaaagtcagtaggcagcccacc

SEQ ID NO: 414370 - DNA, 25 bp, Rattus norvegicus
ggaaaaagtccacgccagcactcgt

SEQ ID NO: 414371 - DNA, 25 bp, Rattus norvegicus
ggaaaaagtccaggccagcactcgt

SEQ ID NO: 414372 - DNA, 25 bp, Rattus norvegicus
ggaaaaagtcttcaagtccttcaga

SEQ ID NO: 414373 - DNA, 25 bp, Rattus norvegicus
ggaaaaagtcttgaagtccttcaga

SEQ ID NO: 414374 - DNA, 25 bp, Rattus norvegicus
ggaaaaagtgcgcgatgccgggatc

SEQ ID NO: 414375 - DNA, 25 bp, Rattus norvegicus
ggaaaaagtgcgggatgccgggatc

SEQ ID NO: 414376 - DNA, 25 bp, Rattus norvegicus
ggaaaaataactaccaagtccatgg

SEQ ID NO: 414377 - DNA, 25 bp, Rattus norvegicus
ggaaaaataacttccaagtccatgg

SEQ ID NO: 414378 - DNA, 25 bp, Rattus norvegicus
ggaaaaatacccacaccagatagat

SEQ ID NO: 414379 - DNA, 25 bp, Rattus norvegicus
ggaaaaataccctcaccagatagat

SEQ ID NO: 414380 - DNA, 25 bp, Rattus norvegicus
ggaaaaatctctactgtctcctgct

SEQ ID NO: 414381 - DNA, 25 bp, Rattus norvegicus
ggaaaaatctcttctgtctcctgct

SEQ ID NO: 414382 - DNA, 25 bp, Rattus norvegicus
ggaaaaatgcaacgtccacaccctt

SEQ ID NO: 414383 - DNA, 25 bp, Rattus norvegicus
ggaaaaatgcaaggtccacaccctt

SEQ ID NO: 414384 - DNA, 25 bp, Rattus norvegicus
ggaaaaatgctcactgccactggtc

SEQ ID NO: 414385 - DNA, 25 bp, Rattus norvegicus
ggaaaaatgctctctgccactggtc

SEQ ID NO: 414386 - DNA, 25 bp, Rattus norvegicus
ggaaaaattcaaatctagtgcattt

SEQ ID NO: 414387 - DNA, 25 bp, Rattus norvegicus
ggaaaaattcaattctagtgcattt

SEQ ID NO: 414388 - DNA, 25 bp, Rattus norvegicus
ggaaaacaaaccctgcaagctcctg

SEQ ID NO: 414389 - DNA, 25 bp, Rattus norvegicus
ggaaaacaaaccgtgcaagctcctg

SEQ ID NO: 414390 - DNA, 25 bp, Rattus norvegicus
ggaaaacaaactatcaggctgcagt

SEQ ID NO: 414391 - DNA, 25 bp, Rattus norvegicus
ggaaaacaaactttcaggctgcagt

SEQ ID NO: 414392 - DNA, 25 bp, Rattus norvegicus
ggaaaacaaggaccaatcgtatttt

SEQ ID NO: 414393 - DNA, 25 bp, Rattus norvegicus
ggaaaacaaggagcaatcgtatttt

SEQ ID NO: 414394 - DNA, 25 bp, Rattus norvegicus
ggaaaacaccatcgctgtgatcctt

SEQ ID NO: 414395 - DNA, 25 bp, Rattus norvegicus
ggaaaacaccatggctgtgatcctt

SEQ ID NO: 414396 - DNA, 25 bp, Rattus norvegicus
ggaaaacacccaacattgtccagtg

SEQ ID NO: 414397 - DNA, 25 bp, Rattus norvegicus
ggaaaacacccatcattgtccagtg

SEQ ID NO: 414398 - DNA, 25 bp, Rattus norvegicus
ggaaaacactaaatgcactctgtaa

SEQ ID NO: 414399 - DNA, 25 bp, Rattus norvegicus
ggaaaacactaattgcactctgtaa

SEQ ID NO: 414400 - DNA, 25 bp, Rattus norvegicus
ggaaaacactccctgggcattgtaa

SEQ ID NO: 414401 - DNA, 25 bp, Rattus norvegicus
ggaaaacactccgtgggcattgtaa

SEQ ID NO: 414402 - DNA, 25 bp, Rattus norvegicus
ggaaaacactttctgccttcatttt

SEQ ID NO: 414403 - DNA, 25 bp, Rattus norvegicus
ggaaaacactttgtgccttcatttt

SEQ ID NO: 414404 - DNA, 25 bp, Rattus norvegicus
ggaaaacagcagctacacgcttctt

SEQ ID NO: 414405 - DNA, 25 bp, Rattus norvegicus
ggaaaacagcaggtacacgcttctt

SEQ ID NO: 414406 - DNA, 25 bp, Rattus norvegicus
ggaaaacaggttctctcttagataa

SEQ ID NO: 414407 - DNA, 25 bp, Rattus norvegicus
ggaaaacaggttgtctcttagataa

SEQ ID NO: 414408 - DNA, 25 bp, Rattus norvegicus
ggaaaacagtgtcccaagggcaaca

SEQ ID NO: 414409 - DNA, 25 bp, Rattus norvegicus
ggaaaacagtgtgccaagggcaaca

SEQ ID NO: 414410 - DNA, 25 bp, Rattus norvegicus
ggaaaacatcatagctgtagcgact

SEQ ID NO: 414411 - DNA, 25 bp, Rattus norvegicus
ggaaaacatcatctggtccaacctc

SEQ ID NO: 414412 - DNA, 25 bp, Rattus norvegicus
ggaaaacatcatgtggtccaacctc

SEQ ID NO: 414413 - DNA, 25 bp, Rattus norvegicus
ggaaaacatcattgctgtagcgact

SEQ ID NO: 414414 - DNA, 25 bp, Rattus norvegicus
ggaaaacatgtcatacccggtcagt

SEQ ID NO: 414415 - DNA, 25 bp, Rattus norvegicus
ggaaaacatgtccttgattgcaagt

SEQ ID NO: 414416 - DNA, 25 bp, Rattus norvegicus
ggaaaacatgtcgttgattgcaagt

SEQ ID NO: 414417 - DNA, 25 bp, Rattus norvegicus
ggaaaacatgtcttacccggtcagt

SEQ ID NO: 414418 - DNA, 25 bp, Rattus norvegicus
ggaaaacattctacctgagcctttc

SEQ ID NO: 414419 - DNA, 25 bp, Rattus norvegicus
ggaaaacattcttcctgagcctttc

SEQ ID NO: 414420 - DNA, 25 bp, Rattus norvegicus
ggaaaacattgccatgtacctcacc

SEQ ID NO: 414421 - DNA, 25 bp, Rattus norvegicus
ggaaaacattgcgatgtacctcacc

SEQ ID NO: 414422 - DNA, 25 bp, Rattus norvegicus
ggaaaacattggctatgcccaacat

SEQ ID NO: 414423 - DNA, 25 bp, Rattus norvegicus
ggaaaacattgggtatgcccaacat

SEQ ID NO: 414424 - DNA, 25 bp, Rattus norvegicus
ggaaaacatttaactcggtgtcttt

SEQ ID NO: 414425 - DNA, 25 bp, Rattus norvegicus
ggaaaacatttatctcggtgtcttt

SEQ ID NO: 414426 - DNA, 25 bp, Rattus norvegicus
ggaaaaccaaaactagcttgcatgt

SEQ ID NO: 414427 - DNA, 25 bp, Rattus norvegicus
ggaaaaccaaaagtagcttgcatgt

SEQ ID NO: 414428 - DNA, 25 bp, Rattus norvegicus
ggaaaaccaagtctctgccttacct

SEQ ID NO: 414429 - DNA, 25 bp, Rattus norvegicus
ggaaaaccaagtgtctgccttacct

SEQ ID NO: 414430 - DNA, 25 bp, Rattus norvegicus
ggaaaaccacctatgaatttctatt

SEQ ID NO: 414431 - DNA, 25 bp, Rattus norvegicus
ggaaaaccacctttgaatttctatt

SEQ ID NO: 414432 - DNA, 25 bp, Rattus norvegicus
ggaaaaccactacatttctgtcaga

SEQ ID NO: 414433 - DNA, 25 bp, Rattus norvegicus
ggaaaaccactagatttctgtcaga

SEQ ID NO: 414434 - DNA, 25 bp, Rattus norvegicus
ggaaaaccagcaaccgaatcatcaa

SEQ ID NO: 414435 - DNA, 25 bp, Rattus norvegicus
ggaaaaccagcatccgaatcatcaa

SEQ ID NO: 414436 - DNA, 25 bp, Rattus norvegicus
ggaaaaccagttcccattcctggca

SEQ ID NO: 414437 - DNA, 25 bp, Rattus norvegicus
ggaaaaccagttgccattcctggca

SEQ ID NO: 414438 - DNA, 25 bp, Rattus norvegicus
ggaaaaccattacaacacctctgca

SEQ ID NO: 414439 - DNA, 25 bp, Rattus norvegicus
ggaaaaccattagaacacctctgca

SEQ ID NO: 414440 - DNA, 25 bp, Rattus norvegicus
ggaaaacccaccaaggctatcgatc

SEQ ID NO: 414441 - DNA, 25 bp, Rattus norvegicus
ggaaaacccaccaggacagattctc

SEQ ID NO: 414442 - DNA, 25 bp, Rattus norvegicus
ggaaaacccacctaggctatcgatc

SEQ ID NO: 414443 - DNA, 25 bp, Rattus norvegicus
ggaaaacccacctggacagattctc

SEQ ID NO: 414444 - DNA, 25 bp, Rattus norvegicus
ggaaaacccagtcccagtcagagac

SEQ ID NO: 414445 - DNA, 25 bp, Rattus norvegicus
ggaaaacccagtgccagtcagagac

SEQ ID NO: 414446 - DNA, 25 bp, Rattus norvegicus
ggaaaaccctcaaaaccatggtgac

SEQ ID NO: 414447 - DNA, 25 bp, Rattus norvegicus
ggaaaaccctcataaccatggtgac

SEQ ID NO: 414448 - DNA, 25 bp, Rattus norvegicus
ggaaaaccctggaaggctcacacag

SEQ ID NO: 414449 - DNA, 25 bp, Rattus norvegicus
ggaaaaccctggtaggctcacacag

SEQ ID NO: 414450 - DNA, 25 bp, Rattus norvegicus
ggaaaaccctttccacttcggtgca

SEQ ID NO: 414451 - DNA, 25 bp, Rattus norvegicus
ggaaaaccctttgcacttcggtgca

SEQ ID NO: 414452 - DNA, 25 bp, Rattus norvegicus
ggaaaacctagacaccaccaagcac

SEQ ID NO: 414453 - DNA, 25 bp, Rattus norvegicus
ggaaaacctagagaccaccaagcac

SEQ ID NO: 414454 - DNA, 25 bp, Rattus norvegicus
ggaaaacctcacagtttctcagcac

SEQ ID NO: 414455 - DNA, 25 bp, Rattus norvegicus
ggaaaacctcactgtttctcagcac

SEQ ID NO: 414456 - DNA, 25 bp, Rattus norvegicus
ggaaaacctcctcttgacacaaaag

SEQ ID NO: 414457 - DNA, 25 bp, Rattus norvegicus
ggaaaacctcctgttgacacaaaag

SEQ ID NO: 414458 - DNA, 25 bp, Rattus norvegicus
ggaaaacctcttcatacctgaaaag

SEQ ID NO: 414459 - DNA, 25 bp, Rattus norvegicus
ggaaaacctcttgatacctgaaaag

SEQ ID NO: 414460 - DNA, 25 bp, Rattus norvegicus
ggaaaacctggacaggagctgccct

SEQ ID NO: 414461 - DNA, 25 bp, Rattus norvegicus
ggaaaacctggagaggagctgccct

SEQ ID NO: 414462 - DNA, 25 bp, Rattus norvegicus
ggaaaacctgttcaaatttacacat

SEQ ID NO: 414463 - DNA, 25 bp, Rattus norvegicus
ggaaaacctgttcatctttggcatg

SEQ ID NO: 414464 - DNA, 25 bp, Rattus norvegicus
ggaaaacctgttgaaatttacacat

SEQ ID NO: 414465 - DNA, 25 bp, Rattus norvegicus
ggaaaacctgttgatctttggcatg

SEQ ID NO: 414466 - DNA, 25 bp, Rattus norvegicus
ggaaaaccttttctactgcttctat

SEQ ID NO: 414467 - DNA, 25 bp, Rattus norvegicus
ggaaaaccttttgtactgcttctat

SEQ ID NO: 414468 - DNA, 25 bp, Rattus norvegicus
ggaaaacgactgagcacaccttctg

SEQ ID NO: 414469 - DNA, 25 bp, Rattus norvegicus
ggaaaacgactgtgcacaccttctg

SEQ ID NO: 414470 - DNA, 25 bp, Rattus norvegicus
ggaaaacgccacaaggaccaccaga

SEQ ID NO: 414471 - DNA, 25 bp, Rattus norvegicus
ggaaaacgccactaggaccaccaga

SEQ ID NO: 414472 - DNA, 25 bp, Rattus norvegicus
ggaaaacgcttcaccaaaccacagt

SEQ ID NO: 414473 - DNA, 25 bp, Rattus norvegicus
ggaaaacgcttctccaaaccacagt

SEQ ID NO: 414474 - DNA, 25 bp, Rattus norvegicus
ggaaaactcagcctgtgaccaagga

SEQ ID NO: 414475 - DNA, 25 bp, Rattus norvegicus
ggaaaactcagcgtgtgaccaagga

SEQ ID NO: 414476 - DNA, 25 bp, Rattus norvegicus
ggaaaactcgagaaaagctgctgtt

SEQ ID NO: 414477 - DNA, 25 bp, Rattus norvegicus
ggaaaactcgagtaaagctgctgtt

SEQ ID NO: 414478 - DNA, 25 bp, Rattus norvegicus
ggaaaactcgctcaagctgtcatgt

SEQ ID NO: 414479 - DNA, 25 bp, Rattus norvegicus
ggaaaactcgctgaagctgtcatgt

SEQ ID NO: 414480 - DNA, 25 bp, Rattus norvegicus
ggaaaactctctactgggatatgtc

SEQ ID NO: 414481 - DNA, 25 bp, Rattus norvegicus
ggaaaactctcttctgggatatgtc

SEQ ID NO: 414482 - DNA, 25 bp, Rattus norvegicus
ggaaaactctgcatctaatctttat

SEQ ID NO: 414483 - DNA, 25 bp, Rattus norvegicus
ggaaaactctgcttctaatctttat

SEQ ID NO: 414484 - DNA, 25 bp, Rattus norvegicus
ggaaaactgccaactcactgtttga

SEQ ID NO: 414485 - DNA, 25 bp, Rattus norvegicus
ggaaaactgccaagacacacaccta

SEQ ID NO: 414486 - DNA, 25 bp, Rattus norvegicus
ggaaaactgccatctcactgtttga

SEQ ID NO: 414487 - DNA, 25 bp, Rattus norvegicus
ggaaaactgccatgacacacaccta

SEQ ID NO: 414488 - DNA, 25 bp, Rattus norvegicus
ggaaaactgccgcttgaactgctgc

SEQ ID NO: 414489 - DNA, 25 bp, Rattus norvegicus
ggaaaactgccggttgaactgctgc

SEQ ID NO: 414490 - DNA, 25 bp, Rattus norvegicus
ggaaaactgtcacctgaccactgtg

SEQ ID NO: 414491 - DNA, 25 bp, Rattus norvegicus
ggaaaactgtcagctgaccactgtg

SEQ ID NO: 414492 - DNA, 25 bp, Rattus norvegicus
ggaaaacttcccagtggatgcactc

SEQ ID NO: 414493 - DNA, 25 bp, Rattus norvegicus
ggaaaacttccccaggcaagatctt

SEQ ID NO: 414494 - DNA, 25 bp, Rattus norvegicus
ggaaaacttcccgaggcaagatctt

SEQ ID NO: 414495 - DNA, 25 bp, Rattus norvegicus
ggaaaacttccctgtggatgcactc

SEQ ID NO: 414496 - DNA, 25 bp, Rattus norvegicus
ggaaaacttcctaagcccatgggat

SEQ ID NO: 414497 - DNA, 25 bp, Rattus norvegicus
ggaaaacttccttagcccatgggat

SEQ ID NO: 414498 - DNA, 25 bp, Rattus norvegicus
ggaaaacttgagactctctgttctt

SEQ ID NO: 414499 - DNA, 25 bp, Rattus norvegicus
ggaaaacttgagtctctctgttctt

SEQ ID NO: 414500 - DNA, 25 bp, Rattus norvegicus
ggaaaactttagacctgtggagtgg

SEQ ID NO: 414501 - DNA, 25 bp, Rattus norvegicus
ggaaaactttagtcctgtggagtgg

SEQ ID NO: 414502 - DNA, 25 bp, Rattus norvegicus
ggaaaagaattactggtcccactga

SEQ ID NO: 414503 - DNA, 25 bp, Rattus norvegicus
ggaaaagaattagtggtcccactga

SEQ ID NO: 414504 - DNA, 25 bp, Rattus norvegicus
ggaaaagaattcaggactcaaatca

SEQ ID NO: 414505 - DNA, 25 bp, Rattus norvegicus
ggaaaagaattctggactcaaatca

SEQ ID NO: 414506 - DNA, 25 bp, Rattus norvegicus
ggaaaagactccattaatcaccatc

SEQ ID NO: 414507 - DNA, 25 bp, Rattus norvegicus
ggaaaagactcctttaatcaccatc

SEQ ID NO: 414508 - DNA, 25 bp, Rattus norvegicus
ggaaaagactcgagggcccagaact

SEQ ID NO: 414509 - DNA, 25 bp, Rattus norvegicus
ggaaaagactcgtgggcccagaact

SEQ ID NO: 414510 - DNA, 25 bp, Rattus norvegicus
ggaaaagagtcaccactgtcatcat

SEQ ID NO: 414511 - DNA, 25 bp, Rattus norvegicus
ggaaaagagtcagcactgtcatcat

SEQ ID NO: 414512 - DNA, 25 bp, Rattus norvegicus
ggaaaagatcttcggctctcctgtg

SEQ ID NO: 414513 - DNA, 25 bp, Rattus norvegicus
ggaaaagatcttgggctctcctgtg

SEQ ID NO: 414514 - DNA, 25 bp, Rattus norvegicus
ggaaaagatggcctctgtcctctgt

SEQ ID NO: 414515 - DNA, 25 bp, Rattus norvegicus
ggaaaagatggcgtctgtcctctgt

SEQ ID NO: 414516 - DNA, 25 bp, Rattus norvegicus
ggaaaagatgtcactgccaggcaga

SEQ ID NO: 414517 - DNA, 25 bp, Rattus norvegicus
ggaaaagatgtctctgccaggcaga

SEQ ID NO: 414518 - DNA, 25 bp, Rattus norvegicus
ggaaaagattcaagccaaacccatt

SEQ ID NO: 414519 - DNA, 25 bp, Rattus norvegicus
ggaaaagattcatgccaaacccatt

SEQ ID NO: 414520 - DNA, 25 bp, Rattus norvegicus
ggaaaagcaggccaccaacctcatt

SEQ ID NO: 414521 - DNA, 25 bp, Rattus norvegicus
ggaaaagcaggcgaccaacctcatt

SEQ ID NO: 414522 - DNA, 25 bp, Rattus norvegicus
ggaaaagccagcctgggacactgcc

SEQ ID NO: 414523 - DNA, 25 bp, Rattus norvegicus
ggaaaagccagcgtgggacactgcc

SEQ ID NO: 414524 - DNA, 25 bp, Rattus norvegicus
ggaaaagccatcagacagctactat

SEQ ID NO: 414525 - DNA, 25 bp, Rattus norvegicus
ggaaaagccatctgacagctactat

SEQ ID NO: 414526 - DNA, 25 bp, Rattus norvegicus
ggaaaagccattcaagcctgattat

SEQ ID NO: 414527 - DNA, 25 bp, Rattus norvegicus
ggaaaagccattgaagcctgattat

SEQ ID NO: 414528 - DNA, 25 bp, Rattus norvegicus
ggaaaagccccacacaaaggctgat

SEQ ID NO: 414529 - DNA, 25 bp, Rattus norvegicus
ggaaaagccccagacaaaggctgat

SEQ ID NO: 414530 - DNA, 25 bp, Rattus norvegicus
ggaaaagcccttaagctgtactaga

SEQ ID NO: 414531 - DNA, 25 bp, Rattus norvegicus
ggaaaagccctttagctgtactaga

SEQ ID NO: 414532 - DNA, 25 bp, Rattus norvegicus
ggaaaagccgttacaggacaaacat

SEQ ID NO: 414533 - DNA, 25 bp, Rattus norvegicus
ggaaaagccgtttcaggacaaacat

SEQ ID NO: 414534 - DNA, 25 bp, Rattus norvegicus
ggaaaagcctcgactttgcggtagc

SEQ ID NO: 414535 - DNA, 25 bp, Rattus norvegicus
ggaaaagcctcgtctttgcggtagc

SEQ ID NO: 414536 - DNA, 25 bp, Rattus norvegicus
ggaaaagccttgcattgccctggtt

SEQ ID NO: 414537 - DNA, 25 bp, Rattus norvegicus
ggaaaagccttggattgccctggtt

SEQ ID NO: 414538 - DNA, 25 bp, Rattus norvegicus
ggaaaagcgcttactttgcaagtag

SEQ ID NO: 414539 - DNA, 25 bp, Rattus norvegicus
ggaaaagcgctttctttgcaagtag

SEQ ID NO: 414540 - DNA, 25 bp, Rattus norvegicus
ggaaaagctaaccttacgcaccgtg

SEQ ID NO: 414541 - DNA, 25 bp, Rattus norvegicus
ggaaaagctaacgttacgcaccgtg

SEQ ID NO: 414542 - DNA, 25 bp, Rattus norvegicus
ggaaaagctcaacttccaacctgga

SEQ ID NO: 414543 - DNA, 25 bp, Rattus norvegicus
ggaaaagctcaagttccaacctgga

SEQ ID NO: 414544 - DNA, 25 bp, Rattus norvegicus
ggaaaagctccaataacaagtacaa

SEQ ID NO: 414545 - DNA, 25 bp, Rattus norvegicus
ggaaaagctccattaacaagtacaa

SEQ ID NO: 414546 - DNA, 25 bp, Rattus norvegicus
ggaaaagctctacctgaacaatcag

SEQ ID NO: 414547 - DNA, 25 bp, Rattus norvegicus
ggaaaagctctagctgaacaatcag

SEQ ID NO: 414548 - DNA, 25 bp, Rattus norvegicus
ggaaaagctgaaactctgggtctca

SEQ ID NO: 414549 - DNA, 25 bp, Rattus norvegicus
ggaaaagctgaatctctgggtctca

SEQ ID NO: 414550 - DNA, 25 bp, Rattus norvegicus
ggaaaagctggtaccatccacatgc

SEQ ID NO: 414551 - DNA, 25 bp, Rattus norvegicus
ggaaaagctggttccatccacatgc

SEQ ID NO: 414552 - DNA, 25 bp, Rattus norvegicus
ggaaaagcttcaagtggccacacaa

SEQ ID NO: 414553 - DNA, 25 bp, Rattus norvegicus
ggaaaagcttcatgtggccacacaa

SEQ ID NO: 414554 - DNA, 25 bp, Rattus norvegicus
ggaaaagcttccattggcgcgtcca

SEQ ID NO: 414555 - DNA, 25 bp, Rattus norvegicus
ggaaaagcttcctttggcgcgtcca

SEQ ID NO: 414556 - DNA, 25 bp, Rattus norvegicus
ggaaaagcttttagcccgatggatt

SEQ ID NO: 414557 - DNA, 25 bp, Rattus norvegicus
ggaaaagctttttgcccgatggatt

SEQ ID NO: 414558 - DNA, 25 bp, Rattus norvegicus
ggaaaaggctggactgcacccaaac

SEQ ID NO: 414559 - DNA, 25 bp, Rattus norvegicus
ggaaaaggctggtctgcacccaaac

SEQ ID NO: 414560 - DNA, 25 bp, Rattus norvegicus
ggaaaagggaggctcactcaatcct

SEQ ID NO: 414561 - DNA, 25 bp, Rattus norvegicus
ggaaaagggagggtcactcaatcct

SEQ ID NO: 414562 - DNA, 25 bp, Rattus norvegicus
ggaaaaggtggcatgccatagcccc

SEQ ID NO: 414563 - DNA, 25 bp, Rattus norvegicus
ggaaaaggtggcttgccatagcccc

SEQ ID NO: 414564 - DNA, 25 bp, Rattus norvegicus
ggaaaagtacggcttcgagcccaca

SEQ ID NO: 414565 - DNA, 25 bp, Rattus norvegicus
ggaaaagtacgggttcgagcccaca

SEQ ID NO: 414566 - DNA, 25 bp, Rattus norvegicus
ggaaaagtccccaagcactgaatta

SEQ ID NO: 414567 - DNA, 25 bp, Rattus norvegicus
ggaaaagtcccctagcactgaatta

SEQ ID NO: 414568 - DNA, 25 bp, Rattus norvegicus
ggaaaagtcgatcgccagcagcagc

SEQ ID NO: 414569 - DNA, 25 bp, Rattus norvegicus
ggaaaagtcgatggccagcagcagc

SEQ ID NO: 414570 - DNA, 25 bp, Rattus norvegicus
ggaaaagtctcaaggcctcatctgt

SEQ ID NO: 414571 - DNA, 25 bp, Rattus norvegicus
ggaaaagtctcatggcctcatctgt

SEQ ID NO: 414572 - DNA, 25 bp, Rattus norvegicus
ggaaaagtgaccagctccggactct

SEQ ID NO: 414573 - DNA, 25 bp, Rattus norvegicus
ggaaaagtgacctgctccggactct

SEQ ID NO: 414574 - DNA, 25 bp, Rattus norvegicus
ggaaaagttataccctcctgtggag

SEQ ID NO: 414575 - DNA, 25 bp, Rattus norvegicus
ggaaaagttatagcctcctgtggag

SEQ ID NO: 414576 - DNA, 25 bp, Rattus norvegicus
ggaaaataaccacagctagtaacat

SEQ ID NO: 414577 - DNA, 25 bp, Rattus norvegicus
ggaaaataaccagagctagtaacat

SEQ ID NO: 414578 - DNA, 25 bp, Rattus norvegicus
ggaaaatacacaccttatccctgct

SEQ ID NO: 414579 - DNA, 25 bp, Rattus norvegicus
ggaaaatacacagcttatccctgct

SEQ ID NO: 414580 - DNA, 25 bp, Rattus norvegicus
ggaaaatactgcaaccctggagatt

SEQ ID NO: 414581 - DNA, 25 bp, Rattus norvegicus
ggaaaatactgctaccctggagatt

SEQ ID NO: 414582 - DNA, 25 bp, Rattus norvegicus
ggaaaataggaaacactggctttat

SEQ ID NO: 414583 - DNA, 25 bp, Rattus norvegicus
ggaaaataggaatcactggctttat

SEQ ID NO: 414584 - DNA, 25 bp, Rattus norvegicus
ggaaaataggtcactagcccttcat

SEQ ID NO: 414585 - DNA, 25 bp, Rattus norvegicus
ggaaaataggtctctagcccttcat

SEQ ID NO: 414586 - DNA, 25 bp, Rattus norvegicus
ggaaaatcaccaagatggcagaagt

SEQ ID NO: 414587 - DNA, 25 bp, Rattus norvegicus
ggaaaatcaccatgatggcagaagt

SEQ ID NO: 414588 - DNA, 25 bp, Rattus norvegicus
ggaaaatcagctctcataactaagt

SEQ ID NO: 414589 - DNA, 25 bp, Rattus norvegicus
ggaaaatcagctgtcataactaagt

SEQ ID NO: 414590 - DNA, 25 bp, Rattus norvegicus
ggaaaatcatttcgccccaggtagt

SEQ ID NO: 414591 - DNA, 25 bp, Rattus norvegicus
ggaaaatcatttggccccaggtagt

SEQ ID NO: 414592 - DNA, 25 bp, Rattus norvegicus
ggaaaatccaaccacgaagacttga

SEQ ID NO: 414593 - DNA, 25 bp, Rattus norvegicus
ggaaaatccaacgacgaagacttga

SEQ ID NO: 414594 - DNA, 25 bp, Rattus norvegicus
ggaaaatccactattggccacgaga

SEQ ID NO: 414595 - DNA, 25 bp, Rattus norvegicus
ggaaaatccacttttggccacgaga

SEQ ID NO: 414596 - DNA, 25 bp, Rattus norvegicus
ggaaaatccatcactgtgcacgtat

SEQ ID NO: 414597 - DNA, 25 bp, Rattus norvegicus
ggaaaatccatctctgtgcacgtat

SEQ ID NO: 414598 - DNA, 25 bp, Rattus norvegicus
ggaaaatccatgatgcatacctgta

SEQ ID NO: 414599 - DNA, 25 bp, Rattus norvegicus
ggaaaatccatgttgcatacctgta

SEQ ID NO: 414600 - DNA, 25 bp, Rattus norvegicus
ggaaaatcccctcaaacgtatcatt

SEQ ID NO: 414601 - DNA, 25 bp, Rattus norvegicus
ggaaaatcccctgaaacgtatcatt

SEQ ID NO: 414602 - DNA, 25 bp, Rattus norvegicus
ggaaaatccctgctcttgatgacga

SEQ ID NO: 414603 - DNA, 25 bp, Rattus norvegicus
ggaaaatccctggtcttgatgacga

SEQ ID NO: 414604 - DNA, 25 bp, Rattus norvegicus
ggaaaatcttctccatttaataaat

SEQ ID NO: 414605 - DNA, 25 bp, Rattus norvegicus
ggaaaatcttctgcatttaataaat

SEQ ID NO: 414606 - DNA, 25 bp, Rattus norvegicus
ggaaaatgagccagagccagccacc

SEQ ID NO: 414607 - DNA, 25 bp, Rattus norvegicus
ggaaaatgagcctgagccagccacc

SEQ ID NO: 414608 - DNA, 25 bp, Rattus norvegicus
ggaaaatgatccaactcacatccca

SEQ ID NO: 414609 - DNA, 25 bp, Rattus norvegicus
ggaaaatgatcctactcacatccca

SEQ ID NO: 414610 - DNA, 25 bp, Rattus norvegicus
ggaaaatgcattactccctaccatt

SEQ ID NO: 414611 - DNA, 25 bp, Rattus norvegicus
ggaaaatgcatttctccctaccatt

SEQ ID NO: 414612 - DNA, 25 bp, Rattus norvegicus
ggaaaatgcccaaactatgatacat

SEQ ID NO: 414613 - DNA, 25 bp, Rattus norvegicus
ggaaaatgcccatactatgatacat

SEQ ID NO: 414614 - DNA, 25 bp, Rattus norvegicus
ggaaaatgccgcagctgactgccag

SEQ ID NO: 414615 - DNA, 25 bp, Rattus norvegicus
ggaaaatgccgctgctgactgccag

SEQ ID NO: 414616 - DNA, 25 bp, Rattus norvegicus
ggaaaatgcctcagagtgtctgacc

SEQ ID NO: 414617 - DNA, 25 bp, Rattus norvegicus
ggaaaatgcctctgagtgtctgacc

SEQ ID NO: 414618 - DNA, 25 bp, Rattus norvegicus
ggaaaatgcgcacatcttccagaga

SEQ ID NO: 414619 - DNA, 25 bp, Rattus norvegicus
ggaaaatgcgcagatcttccagaga

SEQ ID NO: 414620 - DNA, 25 bp, Rattus norvegicus
ggaaaatgctacaattgcccaaaat

SEQ ID NO: 414621 - DNA, 25 bp, Rattus norvegicus
ggaaaatgctactattgcccaaaat

SEQ ID NO: 414622 - DNA, 25 bp, Rattus norvegicus
ggaaaatgctatagaagacactatc

SEQ ID NO: 414623 - DNA, 25 bp, Rattus norvegicus
ggaaaatgctattgaagacactatc

SEQ ID NO: 414624 - DNA, 25 bp, Rattus norvegicus
ggaaaatgctgccaaagcgcaaaca

SEQ ID NO: 414625 - DNA, 25 bp, Rattus norvegicus
ggaaaatgctgcgaaagcgcaaaca

SEQ ID NO: 414626 - DNA, 25 bp, Rattus norvegicus
ggaaaatgcttccaccagattggcc

SEQ ID NO: 414627 - DNA, 25 bp, Rattus norvegicus
ggaaaatgcttcgaccagattggcc

SEQ ID NO: 414628 - DNA, 25 bp, Rattus norvegicus
ggaaaatgtgttcccctgcttttgc

SEQ ID NO: 414629 - DNA, 25 bp, Rattus norvegicus
ggaaaatgtgttgccctgcttttgc

SEQ ID NO: 414630 - DNA, 25 bp, Rattus norvegicus
ggaaaattactcacaccattgcttc

SEQ ID NO: 414631 - DNA, 25 bp, Rattus norvegicus
ggaaaattactctcaccattgcttc

SEQ ID NO: 414632 - DNA, 25 bp, Rattus norvegicus
ggaaaattatccatgcaagtacaaa

SEQ ID NO: 414633 - DNA, 25 bp, Rattus norvegicus
ggaaaattatccttgcaagtacaaa

SEQ ID NO: 414634 - DNA, 25 bp, Rattus norvegicus
ggaaaattcctcaagtgcttactca

SEQ ID NO: 414635 - DNA, 25 bp, Rattus norvegicus
ggaaaattcctctagtgcttactca

SEQ ID NO: 414636 - DNA, 25 bp, Rattus norvegicus
ggaaaattctataactggtcacagc

SEQ ID NO: 414637 - DNA, 25 bp, Rattus norvegicus
ggaaaattctattactggtcacagc

SEQ ID NO: 414638 - DNA, 25 bp, Rattus norvegicus
ggaaaattctctcaggcataacttg

SEQ ID NO: 414639 - DNA, 25 bp, Rattus norvegicus
ggaaaattctctgaggcataacttg

SEQ ID NO: 414640 - DNA, 25 bp, Rattus norvegicus
ggaaaattggttacgccagtcacct

SEQ ID NO: 414641 - DNA, 25 bp, Rattus norvegicus
ggaaaattggtttcgccagtcacct

SEQ ID NO: 414642 - DNA, 25 bp, Rattus norvegicus
ggaaaattgtccaactctacttaga

SEQ ID NO: 414643 - DNA, 25 bp, Rattus norvegicus
ggaaaattgtcctactctacttaga

SEQ ID NO: 414644 - DNA, 25 bp, Rattus norvegicus
ggaaaatttcaccacactgagtcaa

SEQ ID NO: 414645 - DNA, 25 bp, Rattus norvegicus
ggaaaatttcacgacactgagtcaa

SEQ ID NO: 414646 - DNA, 25 bp, Rattus norvegicus
ggaaaatttcagcagtggaaccagt

SEQ ID NO: 414647 - DNA, 25 bp, Rattus norvegicus
ggaaaatttcaggagtggaaccagt

SEQ ID NO: 414648 - DNA, 25 bp, Rattus norvegicus
ggaaaatttccacccttctgtgatc

SEQ ID NO: 414649 - DNA, 25 bp, Rattus norvegicus
ggaaaatttccagccttctgtgatc

SEQ ID NO: 414650 - DNA, 25 bp, Rattus norvegicus
ggaaaatttcctctagaacattcag

SEQ ID NO: 414651 - DNA, 25 bp, Rattus norvegicus
ggaaaatttcctgtagaacattcag

SEQ ID NO: 414652 - DNA, 25 bp, Rattus norvegicus
ggaaaatttctccagggcttcccag

SEQ ID NO: 414653 - DNA, 25 bp, Rattus norvegicus
ggaaaatttctcgagggcttcccag

SEQ ID NO: 414654 - DNA, 25 bp, Rattus norvegicus
ggaaaatttgccctcaacttctgta

SEQ ID NO: 414655 - DNA, 25 bp, Rattus norvegicus
ggaaaatttgccgtcaacttctgta

SEQ ID NO: 414656 - DNA, 25 bp, Rattus norvegicus
ggaaaattttgtcgccaccttctgt

SEQ ID NO: 414657 - DNA, 25 bp, Rattus norvegicus
ggaaaattttgtggccaccttctgt

SEQ ID NO: 414658 - DNA, 25 bp, Rattus norvegicus
ggaaacaaagttccctagccccact

SEQ ID NO: 414659 - DNA, 25 bp, Rattus norvegicus
ggaaacaaagttgcctagccccact

SEQ ID NO: 414660 - DNA, 25 bp, Rattus norvegicus
ggaaacaaccctcctttacaaccag

SEQ ID NO: 414661 - DNA, 25 bp, Rattus norvegicus
ggaaacaaccctgctttacaaccag

SEQ ID NO: 414662 - DNA, 25 bp, Rattus norvegicus
ggaaacaactcaccacatttgggtg

SEQ ID NO: 414663 - DNA, 25 bp, Rattus norvegicus
ggaaacaactcagcacatttgggtg

SEQ ID NO: 414664 - DNA, 25 bp, Rattus norvegicus
ggaaacaacttcacctaggaactat

SEQ ID NO: 414665 - DNA, 25 bp, Rattus norvegicus
ggaaacaacttctcctaggaactat

SEQ ID NO: 414666 - DNA, 25 bp, Rattus norvegicus
ggaaacaagaagaagcctgcacctc

SEQ ID NO: 414667 - DNA, 25 bp, Rattus norvegicus
ggaaacaagaagtagcctgcacctc

SEQ ID NO: 414668 - DNA, 25 bp, Rattus norvegicus
ggaaacaagactcagcggctgcact

SEQ ID NO: 414669 - DNA, 25 bp, Rattus norvegicus
ggaaacaagactgagcggctgcact

SEQ ID NO: 414670 - DNA, 25 bp, Rattus norvegicus
ggaaacaagcagctcacgccaactt

SEQ ID NO: 414671 - DNA, 25 bp, Rattus norvegicus
ggaaacaagcaggtcacgccaactt

SEQ ID NO: 414672 - DNA, 25 bp, Rattus norvegicus
ggaaacaagtaaccaagagctataa

SEQ ID NO: 414673 - DNA, 25 bp, Rattus norvegicus
ggaaacaagtaagcaagagctataa

SEQ ID NO: 414674 - DNA, 25 bp, Rattus norvegicus
ggaaacaataccacagcaccattag

SEQ ID NO: 414675 - DNA, 25 bp, Rattus norvegicus
ggaaacaatacctcagcaccattag

SEQ ID NO: 414676 - DNA, 25 bp, Rattus norvegicus
ggaaacaatgtcagagtggccaaat

SEQ ID NO: 414677 - DNA, 25 bp, Rattus norvegicus
ggaaacaatgtctgagtggccaaat

SEQ ID NO: 414678 - DNA, 25 bp, Rattus norvegicus
ggaaacacacacatggcgagaacat

SEQ ID NO: 414679 - DNA, 25 bp, Rattus norvegicus
ggaaacacacacttggcgagaacat

SEQ ID NO: 414680 - DNA, 25 bp, Rattus norvegicus
ggaaacacagcacctctaccagtga

SEQ ID NO: 414681 - DNA, 25 bp, Rattus norvegicus
ggaaacacagcagctctaccagtga

SEQ ID NO: 414682 - DNA, 25 bp, Rattus norvegicus
ggaaacacagtgaaccctgttccct

SEQ ID NO: 414683 - DNA, 25 bp, Rattus norvegicus
ggaaacacagtgtaccctgttccct

SEQ ID NO: 414684 - DNA, 25 bp, Rattus norvegicus
ggaaacacatccagtcagcacagcg

SEQ ID NO: 414685 - DNA, 25 bp, Rattus norvegicus
ggaaacacatcctgtcagcacagcg

SEQ ID NO: 414686 - DNA, 25 bp, Rattus norvegicus
ggaaacaccagccatgctcttaggg

SEQ ID NO: 414687 - DNA, 25 bp, Rattus norvegicus
ggaaacaccagcgatgctcttaggg

SEQ ID NO: 414688 - DNA, 25 bp, Rattus norvegicus
ggaaacaccagtcggcagcaccatg

SEQ ID NO: 414689 - DNA, 25 bp, Rattus norvegicus
ggaaacaccagtgggcagcaccatg

SEQ ID NO: 414690 - DNA, 25 bp, Rattus norvegicus
ggaaacacctcaagagctttgcttt

SEQ ID NO: 414691 - DNA, 25 bp, Rattus norvegicus
ggaaacacctcatgagctttgcttt

SEQ ID NO: 414692 - DNA, 25 bp, Rattus norvegicus
ggaaacacctgaaggcgttgagcct

SEQ ID NO: 414693 - DNA, 25 bp, Rattus norvegicus
ggaaacacctgatggcgttgagcct

SEQ ID NO: 414694 - DNA, 25 bp, Rattus norvegicus
ggaaacacggcccacggatgaccct

SEQ ID NO: 414695 - DNA, 25 bp, Rattus norvegicus
ggaaacacggccgacggatgaccct

SEQ ID NO: 414696 - DNA, 25 bp, Rattus norvegicus
ggaaacactattacgtagctcaaat

SEQ ID NO: 414697 - DNA, 25 bp, Rattus norvegicus
ggaaacactatttcgtagctcaaat

SEQ ID NO: 414698 - DNA, 25 bp, Rattus norvegicus
ggaaacactgacctactttggagat

SEQ ID NO: 414699 - DNA, 25 bp, Rattus norvegicus
ggaaacactgacgtactttggagat

SEQ ID NO: 414700 - DNA, 25 bp, Rattus norvegicus
ggaaacactgctatctactagaaat

SEQ ID NO: 414701 - DNA, 25 bp, Rattus norvegicus
ggaaacactgctttctactagaaat

SEQ ID NO: 414702 - DNA, 25 bp, Rattus norvegicus
ggaaacactgggattgccatccagc

SEQ ID NO: 414703 - DNA, 25 bp, Rattus norvegicus
ggaaacactgggtttgccatccagc

SEQ ID NO: 414704 - DNA, 25 bp, Rattus norvegicus
ggaaacactgtactctggcaccttt

SEQ ID NO: 414705 - DNA, 25 bp, Rattus norvegicus
ggaaacactgtagtctggcaccttt

SEQ ID NO: 414706 - DNA, 25 bp, Rattus norvegicus
ggaaacactgttccctctgagcaac

SEQ ID NO: 414707 - DNA, 25 bp, Rattus norvegicus
ggaaacactgttgcctctgagcaac

SEQ ID NO: 414708 - DNA, 25 bp, Rattus norvegicus
ggaaacacttctccacaaactcgat

SEQ ID NO: 414709 - DNA, 25 bp, Rattus norvegicus
ggaaacacttctgcacaaactcgat

SEQ ID NO: 414710 - DNA, 25 bp, Rattus norvegicus
ggaaacacttggctacccgaggcat

SEQ ID NO: 414711 - DNA, 25 bp, Rattus norvegicus
ggaaacacttgggtacccgaggcat

SEQ ID NO: 414712 - DNA, 25 bp, Rattus norvegicus
ggaaacagaattcatcgccgtgact

SEQ ID NO: 414713 - DNA, 25 bp, Rattus norvegicus
ggaaacagaattgatcgccgtgact

SEQ ID NO: 414714 - DNA, 25 bp, Rattus norvegicus
ggaaacagacagagctctcctagca

SEQ ID NO: 414715 - DNA, 25 bp, Rattus norvegicus
ggaaacagacagtgctctcctagca

SEQ ID NO: 414716 - DNA, 25 bp, Rattus norvegicus
ggaaacagaccacctcagaaacaga

SEQ ID NO: 414717 - DNA, 25 bp, Rattus norvegicus
ggaaacagaccagctcagaaacaga

SEQ ID NO: 414718 - DNA, 25 bp, Rattus norvegicus
ggaaacagactgactcttttaaaag

SEQ ID NO: 414719 - DNA, 25 bp, Rattus norvegicus
ggaaacagactgtctcttttaaaag

SEQ ID NO: 414720 - DNA, 25 bp, Rattus norvegicus
ggaaacagagacaaaacctcccatc

SEQ ID NO: 414721 - DNA, 25 bp, Rattus norvegicus
ggaaacagagactaaacctcccatc

SEQ ID NO: 414722 - DNA, 25 bp, Rattus norvegicus
ggaaacagcaacatgtttgctcata

SEQ ID NO: 414723 - DNA, 25 bp, Rattus norvegicus
ggaaacagcaacttgtttgctcata

SEQ ID NO: 414724 - DNA, 25 bp, Rattus norvegicus
ggaaacagcaatccaccacgggagt

SEQ ID NO: 414725 - DNA, 25 bp, Rattus norvegicus
ggaaacagcaatgcaccacgggagt

SEQ ID NO: 414726 - DNA, 25 bp, Rattus norvegicus
ggaaacagcaccagacttggcctct

SEQ ID NO: 414727 - DNA, 25 bp, Rattus norvegicus
ggaaacagcacctgacttggcctct

SEQ ID NO: 414728 - DNA, 25 bp, Rattus norvegicus
ggaaacagcagcaagccctcaagca

SEQ ID NO: 414729 - DNA, 25 bp, Rattus norvegicus
ggaaacagcagctagccctcaagca

SEQ ID NO: 414730 - DNA, 25 bp, Rattus norvegicus
ggaaacagcccacgctatcttggaa

SEQ ID NO: 414731 - DNA, 25 bp, Rattus norvegicus
ggaaacagcccaggctatcttggaa

SEQ ID NO: 414732 - DNA, 25 bp, Rattus norvegicus
ggaaacagctttacagaagcctcat

SEQ ID NO: 414733 - DNA, 25 bp, Rattus norvegicus
ggaaacagcttttcagaagcctcat

SEQ ID NO: 414734 - DNA, 25 bp, Rattus norvegicus
ggaaacaggctgagggccatatccc

SEQ ID NO: 414735 - DNA, 25 bp, Rattus norvegicus
ggaaacaggctgtgggccatatccc

SEQ ID NO: 414736 - DNA, 25 bp, Rattus norvegicus
ggaaacagggtcaatttatggagcc

SEQ ID NO: 414737 - DNA, 25 bp, Rattus norvegicus
ggaaacagggtctatttatggagcc

SEQ ID NO: 414738 - DNA, 25 bp, Rattus norvegicus
ggaaacagtcccattcagatagtct

SEQ ID NO: 414739 - DNA, 25 bp, Rattus norvegicus
ggaaacagtccctttcagatagtct

SEQ ID NO: 414740 - DNA, 25 bp, Rattus norvegicus
ggaaacagtgcaccggccagtgttc

SEQ ID NO: 414741 - DNA, 25 bp, Rattus norvegicus
ggaaacagtgcagcggccagtgttc

SEQ ID NO: 414742 - DNA, 25 bp, Rattus norvegicus
ggaaacagtgctcccaagatcctgg

SEQ ID NO: 414743 - DNA, 25 bp, Rattus norvegicus
ggaaacagtgctgccaagatcctgg

SEQ ID NO: 414744 - DNA, 25 bp, Rattus norvegicus
ggaaacatagcacgcttaccacagg

SEQ ID NO: 414745 - DNA, 25 bp, Rattus norvegicus
ggaaacatagcaggcttaccacagg

SEQ ID NO: 414746 - DNA, 25 bp, Rattus norvegicus
ggaaacatcggtcgctacattctga

SEQ ID NO: 414747 - DNA, 25 bp, Rattus norvegicus
ggaaacatcggtggctacattctga

SEQ ID NO: 414748 - DNA, 25 bp, Rattus norvegicus
ggaaacatgagcctcttgccacaga

SEQ ID NO: 414749 - DNA, 25 bp, Rattus norvegicus
ggaaacatgagcgtcttgccacaga

SEQ ID NO: 414750 - DNA, 25 bp, Rattus norvegicus
ggaaacatgcacagctccagtcatg

SEQ ID NO: 414751 - DNA, 25 bp, Rattus norvegicus
ggaaacatgcactgctccagtcatg

SEQ ID NO: 414752 - DNA, 25 bp, Rattus norvegicus
ggaaacatgcagattttaactatta

SEQ ID NO: 414753 - DNA, 25 bp, Rattus norvegicus
ggaaacatgcagtttttaactatta

SEQ ID NO: 414754 - DNA, 25 bp, Rattus norvegicus
ggaaacatgcgaagcttttgcccca

SEQ ID NO: 414755 - DNA, 25 bp, Rattus norvegicus
ggaaacatgcgatgcttttgcccca

SEQ ID NO: 414756 - DNA, 25 bp, Rattus norvegicus
ggaaacatgctaaagcgccatcccc

SEQ ID NO: 414757 - DNA, 25 bp, Rattus norvegicus
ggaaacatgctatagcgccatcccc

SEQ ID NO: 414758 - DNA, 25 bp, Rattus norvegicus
ggaaacatggagacgttcctttggc

SEQ ID NO: 414759 - DNA, 25 bp, Rattus norvegicus
ggaaacatggagtcgttcctttggc

SEQ ID NO: 414760 - DNA, 25 bp, Rattus norvegicus
ggaaacatgtccagcttttcagtag

SEQ ID NO: 414761 - DNA, 25 bp, Rattus norvegicus
ggaaacatgtcctgcttttcagtag

SEQ ID NO: 414762 - DNA, 25 bp, Rattus norvegicus
ggaaacattccacatacaaacctca

SEQ ID NO: 414763 - DNA, 25 bp, Rattus norvegicus
ggaaacattccagatacaaacctca

SEQ ID NO: 414764 - DNA, 25 bp, Rattus norvegicus
ggaaacattccccactgagacagtc

SEQ ID NO: 414765 - DNA, 25 bp, Rattus norvegicus
ggaaacattcccgactgagacagtc

SEQ ID NO: 414766 - DNA, 25 bp, Rattus norvegicus
ggaaacattctgcagcctacctgac

SEQ ID NO: 414767 - DNA, 25 bp, Rattus norvegicus
ggaaacattctggagcctacctgac

SEQ ID NO: 414768 - DNA, 25 bp, Rattus norvegicus
ggaaacattgtcactacgtgcctca

SEQ ID NO: 414769 - DNA, 25 bp, Rattus norvegicus
ggaaacattgtcattactcctctgc

SEQ ID NO: 414770 - DNA, 25 bp, Rattus norvegicus
ggaaacattgtctctacgtgcctca

SEQ ID NO: 414771 - DNA, 25 bp, Rattus norvegicus
ggaaacattgtctttactcctctgc

SEQ ID NO: 414772 - DNA, 25 bp, Rattus norvegicus
ggaaacatttcacagttcccatctg

SEQ ID NO: 414773 - DNA, 25 bp, Rattus norvegicus
ggaaacatttcagagttcccatctg

SEQ ID NO: 414774 - DNA, 25 bp, Rattus norvegicus
ggaaacatttccagtgtgtcactct

SEQ ID NO: 414775 - DNA, 25 bp, Rattus norvegicus
ggaaacatttcctgtgtgtcactct

SEQ ID NO: 414776 - DNA, 25 bp, Rattus norvegicus
ggaaaccaaaatattcaccggctca

SEQ ID NO: 414777 - DNA, 25 bp, Rattus norvegicus
ggaaaccaaaattttcaccggctca

SEQ ID NO: 414778 - DNA, 25 bp, Rattus norvegicus
ggaaaccaaatcagaccacgaggaa

SEQ ID NO: 414779 - DNA, 25 bp, Rattus norvegicus
ggaaaccaaatctgaccacgaggaa

SEQ ID NO: 414780 - DNA, 25 bp, Rattus norvegicus
ggaaaccaagctagggccttgcaat

SEQ ID NO: 414781 - DNA, 25 bp, Rattus norvegicus
ggaaaccaagcttgggccttgcaat

SEQ ID NO: 414782 - DNA, 25 bp, Rattus norvegicus
ggaaaccaatacctacctgtgcaaa

SEQ ID NO: 414783 - DNA, 25 bp, Rattus norvegicus
ggaaaccaatacgtacctgtgcaaa

SEQ ID NO: 414784 - DNA, 25 bp, Rattus norvegicus
ggaaaccacagtagaccagaacctt

SEQ ID NO: 414785 - DNA, 25 bp, Rattus norvegicus
ggaaaccacagttgaccagaacctt

SEQ ID NO: 414786 - DNA, 25 bp, Rattus norvegicus
ggaaaccacatgaaacttagccaga

SEQ ID NO: 414787 - DNA, 25 bp, Rattus norvegicus
ggaaaccacatgtaacttagccaga

SEQ ID NO: 414788 - DNA, 25 bp, Rattus norvegicus
ggaaaccacccccaaatgccagaat

SEQ ID NO: 414789 - DNA, 25 bp, Rattus norvegicus
ggaaaccaccccgaaatgccagaat

SEQ ID NO: 414790 - DNA, 25 bp, Rattus norvegicus
ggaaaccacggacaagtcaccattc

SEQ ID NO: 414791 - DNA, 25 bp, Rattus norvegicus
ggaaaccacggagaagtcaccattc

SEQ ID NO: 414792 - DNA, 25 bp, Rattus norvegicus
ggaaaccactcaacagtcagcagca

SEQ ID NO: 414793 - DNA, 25 bp, Rattus norvegicus
ggaaaccactcatcagtcagcagca

SEQ ID NO: 414794 - DNA, 25 bp, Rattus norvegicus
ggaaaccagacacaaaagagcacgt

SEQ ID NO: 414795 - DNA, 25 bp, Rattus norvegicus
ggaaaccagacagaaaagagcacgt

SEQ ID NO: 414796 - DNA, 25 bp, Rattus norvegicus
ggaaaccagagtcgcagctcacaca

SEQ ID NO: 414797 - DNA, 25 bp, Rattus norvegicus
ggaaaccagagtggcagctcacaca

SEQ ID NO: 414798 - DNA, 25 bp, Rattus norvegicus
ggaaaccagcttctagcccagttat

SEQ ID NO: 414799 - DNA, 25 bp, Rattus norvegicus
ggaaaccagcttgtagcccagttat

SEQ ID NO: 414800 - DNA, 25 bp, Rattus norvegicus
ggaaaccaggaccttatgacggctg

SEQ ID NO: 414801 - DNA, 25 bp, Rattus norvegicus
ggaaaccaggacgttatgacggctg

SEQ ID NO: 414802 - DNA, 25 bp, Rattus norvegicus
ggaaaccagtgcaggacatcctcac

SEQ ID NO: 414803 - DNA, 25 bp, Rattus norvegicus
ggaaaccagtgctggacatcctcac

SEQ ID NO: 414804 - DNA, 25 bp, Rattus norvegicus
ggaaaccagttacccacagacagtg

SEQ ID NO: 414805 - DNA, 25 bp, Rattus norvegicus
ggaaaccagttagccacagacagtg

SEQ ID NO: 414806 - DNA, 25 bp, Rattus norvegicus
ggaaaccatagccagggatctgcat

SEQ ID NO: 414807 - DNA, 25 bp, Rattus norvegicus
ggaaaccatagcgagggatctgcat

SEQ ID NO: 414808 - DNA, 25 bp, Rattus norvegicus
ggaaaccatggacctctctagagaa

SEQ ID NO: 414809 - DNA, 25 bp, Rattus norvegicus
ggaaaccatggagctctctagagaa

SEQ ID NO: 414810 - DNA, 25 bp, Rattus norvegicus
ggaaaccatgtgagactgggatcaa

SEQ ID NO: 414811 - DNA, 25 bp, Rattus norvegicus
ggaaaccatgtgtgactgggatcaa

SEQ ID NO: 414812 - DNA, 25 bp, Rattus norvegicus
ggaaaccatttcactaaaggatcac

SEQ ID NO: 414813 - DNA, 25 bp, Rattus norvegicus
ggaaaccatttctctaaaggatcac

SEQ ID NO: 414814 - DNA, 25 bp, Rattus norvegicus
ggaaacccactccttattttcattg

SEQ ID NO: 414815 - DNA, 25 bp, Rattus norvegicus
ggaaacccactcgttattttcattg

SEQ ID NO: 414816 - DNA, 25 bp, Rattus norvegicus
ggaaacccagagaagcccaaagcct

SEQ ID NO: 414817 - DNA, 25 bp, Rattus norvegicus
ggaaacccagagactagcccagagc

SEQ ID NO: 414818 - DNA, 25 bp, Rattus norvegicus
ggaaacccagagtagcccaaagcct

SEQ ID NO: 414819 - DNA, 25 bp, Rattus norvegicus
ggaaacccagagtctagcccagagc

SEQ ID NO: 414820 - DNA, 25 bp, Rattus norvegicus
ggaaacccaggacttgtacacacaa

SEQ ID NO: 414821 - DNA, 25 bp, Rattus norvegicus
ggaaacccaggagttgtacacacaa

SEQ ID NO: 414822 - DNA, 25 bp, Rattus norvegicus
ggaaacccagtaacttatgcaattg

SEQ ID NO: 414823 - DNA, 25 bp, Rattus norvegicus
ggaaacccagtatcttatgcaattg

SEQ ID NO: 414824 - DNA, 25 bp, Rattus norvegicus
ggaaacccataccatttcttataag

SEQ ID NO: 414825 - DNA, 25 bp, Rattus norvegicus
ggaaacccatacgatttcttataag

SEQ ID NO: 414826 - DNA, 25 bp, Rattus norvegicus
ggaaacccatttactgaaacagtgg

SEQ ID NO: 414827 - DNA, 25 bp, Rattus norvegicus
ggaaacccattttctgaaacagtgg

SEQ ID NO: 414828 - DNA, 25 bp, Rattus norvegicus
ggaaaccccattatgaatgctggaa

SEQ ID NO: 414829 - DNA, 25 bp, Rattus norvegicus
ggaaaccccattttgaatgctggaa

SEQ ID NO: 414830 - DNA, 25 bp, Rattus norvegicus
ggaaaccccttccaagtgtcgatgt

SEQ ID NO: 414831 - DNA, 25 bp, Rattus norvegicus
ggaaaccccttcgaagtgtcgatgt

SEQ ID NO: 414832 - DNA, 25 bp, Rattus norvegicus
ggaaacccgacgatcattgccagtt

SEQ ID NO: 414833 - DNA, 25 bp, Rattus norvegicus
ggaaacccgacgttcattgccagtt

SEQ ID NO: 414834 - DNA, 25 bp, Rattus norvegicus
ggaaaccctaagcatctgagccctg

SEQ ID NO: 414835 - DNA, 25 bp, Rattus norvegicus
ggaaaccctaaggatctgagccctg

SEQ ID NO: 414836 - DNA, 25 bp, Rattus norvegicus
ggaaaccctccacaatgtcctgtgt

SEQ ID NO: 414837 - DNA, 25 bp, Rattus norvegicus
ggaaaccctccagaatgtcctgtgt

SEQ ID NO: 414838 - DNA, 25 bp, Rattus norvegicus
ggaaaccctgacacatggcaagtga

SEQ ID NO: 414839 - DNA, 25 bp, Rattus norvegicus
ggaaaccctgactcatggcaagtga

SEQ ID NO: 414840 - DNA, 25 bp, Rattus norvegicus
ggaaaccctgggaaatgcaagtgtg

SEQ ID NO: 414841 - DNA, 25 bp, Rattus norvegicus
ggaaaccctgggtaatgcaagtgtg

SEQ ID NO: 414842 - DNA, 25 bp, Rattus norvegicus
ggaaaccctgtcagccataagaagt

SEQ ID NO: 414843 - DNA, 25 bp, Rattus norvegicus
ggaaaccctgtctgccataagaagt

SEQ ID NO: 414844 - DNA, 25 bp, Rattus norvegicus
ggaaaccctgtgattggaaagtact

SEQ ID NO: 414845 - DNA, 25 bp, Rattus norvegicus
ggaaaccctgtgtttggaaagtact

SEQ ID NO: 414846 - DNA, 25 bp, Rattus norvegicus
ggaaaccctgttcattataggactg

SEQ ID NO: 414847 - DNA, 25 bp, Rattus norvegicus
ggaaaccctgttgattataggactg

SEQ ID NO: 414848 - DNA, 25 bp, Rattus norvegicus
ggaaacccttccagaacacacgtgg

SEQ ID NO: 414849 - DNA, 25 bp, Rattus norvegicus
ggaaacccttcctgaacacacgtgg

SEQ ID NO: 414850 - DNA, 25 bp, Rattus norvegicus
ggaaacccttgacctggaatgacct

SEQ ID NO: 414851 - DNA, 25 bp, Rattus norvegicus
ggaaacccttgagctggaatgacct

SEQ ID NO: 414852 - DNA, 25 bp, Rattus norvegicus
ggaaaccgaagtcgagcctggcatt

SEQ ID NO: 414853 - DNA, 25 bp, Rattus norvegicus
ggaaaccgaagtggagcctggcatt

SEQ ID NO: 414854 - DNA, 25 bp, Rattus norvegicus
ggaaaccggaatagccccatacaga

SEQ ID NO: 414855 - DNA, 25 bp, Rattus norvegicus
ggaaaccggaattgccccatacaga

SEQ ID NO: 414856 - DNA, 25 bp, Rattus norvegicus
ggaaacctcagccttgcaggagtca

SEQ ID NO: 414857 - DNA, 25 bp, Rattus norvegicus
ggaaacctcagcgttgcaggagtca

SEQ ID NO: 414858 - DNA, 25 bp, Rattus norvegicus
ggaaacctcaggatgcctttgatga

SEQ ID NO: 414859 - DNA, 25 bp, Rattus norvegicus
ggaaacctcaggttgcctttgatga

SEQ ID NO: 414860 - DNA, 25 bp, Rattus norvegicus
ggaaacctccatatcatttagatgt

SEQ ID NO: 414861 - DNA, 25 bp, Rattus norvegicus
ggaaacctccatttcatttagatgt

SEQ ID NO: 414862 - DNA, 25 bp, Rattus norvegicus
ggaaacctcttgcagtggtcattgt

SEQ ID NO: 414863 - DNA, 25 bp, Rattus norvegicus
ggaaacctcttggagtggtcattgt

SEQ ID NO: 414864 - DNA, 25 bp, Rattus norvegicus
ggaaacctgagccactggtcttgct

SEQ ID NO: 414865 - DNA, 25 bp, Rattus norvegicus
ggaaacctgagcgactggtcttgct

SEQ ID NO: 414866 - DNA, 25 bp, Rattus norvegicus
ggaaacctgctacccaaaattagct

SEQ ID NO: 414867 - DNA, 25 bp, Rattus norvegicus
ggaaacctgctacttgttctcatta

SEQ ID NO: 414868 - DNA, 25 bp, Rattus norvegicus
ggaaacctgctagccaaaattagct

SEQ ID NO: 414869 - DNA, 25 bp, Rattus norvegicus
ggaaacctgctagttgttctcatta

SEQ ID NO: 414870 - DNA, 25 bp, Rattus norvegicus
ggaaacctggaaaccgtcagctgat

SEQ ID NO: 414871 - DNA, 25 bp, Rattus norvegicus
ggaaacctggaatccgtcagctgat

SEQ ID NO: 414872 - DNA, 25 bp, Rattus norvegicus
ggaaacctggcactgataccatcaa

SEQ ID NO: 414873 - DNA, 25 bp, Rattus norvegicus
ggaaacctggcagtgataccatcaa

SEQ ID NO: 414874 - DNA, 25 bp, Rattus norvegicus
ggaaacctgtaaatttggcatacaa

SEQ ID NO: 414875 - DNA, 25 bp, Rattus norvegicus
ggaaacctgtaattttggcatacaa

SEQ ID NO: 414876 - DNA, 25 bp, Rattus norvegicus
ggaaaccttactctcccagtgagta

SEQ ID NO: 414877 - DNA, 25 bp, Rattus norvegicus
ggaaaccttactgtcccagtgagta

SEQ ID NO: 414878 - DNA, 25 bp, Rattus norvegicus
ggaaaccttccacctgatgaatctc

SEQ ID NO: 414879 - DNA, 25 bp, Rattus norvegicus
ggaaaccttccagctgatgaatctc

SEQ ID NO: 414880 - DNA, 25 bp, Rattus norvegicus
ggaaaccttcgcagaggctgtagat

SEQ ID NO: 414881 - DNA, 25 bp, Rattus norvegicus
ggaaaccttcgctgaggctgtagat

SEQ ID NO: 414882 - DNA, 25 bp, Rattus norvegicus
ggaaaccttgaaaacctgaatattg

SEQ ID NO: 414883 - DNA, 25 bp, Rattus norvegicus
ggaaaccttgaatacctgaatattg

SEQ ID NO: 414884 - DNA, 25 bp, Rattus norvegicus
ggaaaccttgcaacatgcgtcttta

SEQ ID NO: 414885 - DNA, 25 bp, Rattus norvegicus
ggaaaccttgcatcatgcgtcttta

SEQ ID NO: 414886 - DNA, 25 bp, Rattus norvegicus
ggaaacctttggacctctcaaggct

SEQ ID NO: 414887 - DNA, 25 bp, Rattus norvegicus
ggaaacctttggtcctctcaaggct

SEQ ID NO: 414888 - DNA, 25 bp, Rattus norvegicus
ggaaacgacatgcatgcctcactgg

SEQ ID NO: 414889 - DNA, 25 bp, Rattus norvegicus
ggaaacgacatggatgcctcactgg

SEQ ID NO: 414890 - DNA, 25 bp, Rattus norvegicus
ggaaacgacccaccaaggacagcta

SEQ ID NO: 414891 - DNA, 25 bp, Rattus norvegicus
ggaaacgacccagcaaggacagcta

SEQ ID NO: 414892 - DNA, 25 bp, Rattus norvegicus
ggaaacgacgggaatcagcctccag

SEQ ID NO: 414893 - DNA, 25 bp, Rattus norvegicus
ggaaacgacgggtatcagcctccag

SEQ ID NO: 414894 - DNA, 25 bp, Rattus norvegicus
ggaaacgagcttcatggtccaccca

SEQ ID NO: 414895 - DNA, 25 bp, Rattus norvegicus
ggaaacgagcttgatggtccaccca

SEQ ID NO: 414896 - DNA, 25 bp, Rattus norvegicus
ggaaacgaggaactgagcctgctcc

SEQ ID NO: 414897 - DNA, 25 bp, Rattus norvegicus
ggaaacgaggaagtgagcctgctcc

SEQ ID NO: 414898 - DNA, 25 bp, Rattus norvegicus
ggaaacgaggcgctgatcctaaaat

SEQ ID NO: 414899 - DNA, 25 bp, Rattus norvegicus
ggaaacgaggcggtgatcctaaaat

SEQ ID NO: 414900 - DNA, 25 bp, Rattus norvegicus
ggaaacgagtatcagccgagcaaca

SEQ ID NO: 414901 - DNA, 25 bp, Rattus norvegicus
ggaaacgagtatgagccgagcaaca

SEQ ID NO: 414902 - DNA, 25 bp, Rattus norvegicus
ggaaacgcacacatgtcagtaattt

SEQ ID NO: 414903 - DNA, 25 bp, Rattus norvegicus
ggaaacgcacacttgtcagtaattt

SEQ ID NO: 414904 - DNA, 25 bp, Rattus norvegicus
ggaaacgcagcaacaaaagtaccta

SEQ ID NO: 414905 - DNA, 25 bp, Rattus norvegicus
ggaaacgcagcatcaaaagtaccta

SEQ ID NO: 414906 - DNA, 25 bp, Rattus norvegicus
ggaaacgcattaatcagcccattga

SEQ ID NO: 414907 - DNA, 25 bp, Rattus norvegicus
ggaaacgcattattcagcccattga

SEQ ID NO: 414908 - DNA, 25 bp, Rattus norvegicus
ggaaacgccacacatatcaacgaca

SEQ ID NO: 414909 - DNA, 25 bp, Rattus norvegicus
ggaaacgccacagatatcaacgaca

SEQ ID NO: 414910 - DNA, 25 bp, Rattus norvegicus
ggaaacgccagtcacacgtgccatg

SEQ ID NO: 414911 - DNA, 25 bp, Rattus norvegicus
ggaaacgccagtgacacgtgccatg

SEQ ID NO: 414912 - DNA, 25 bp, Rattus norvegicus
ggaaacgctgcgagcattttcttca

SEQ ID NO: 414913 - DNA, 25 bp, Rattus norvegicus
ggaaacgctgcgtgcattttcttca

SEQ ID NO: 414914 - DNA, 25 bp, Rattus norvegicus
ggaaacgctggaacattgccacaga

SEQ ID NO: 414915 - DNA, 25 bp, Rattus norvegicus
ggaaacgctggatcattgccacaga

SEQ ID NO: 414916 - DNA, 25 bp, Rattus norvegicus
ggaaacggatgcatcaacctcagtc

SEQ ID NO: 414917 - DNA, 25 bp, Rattus norvegicus
ggaaacggatgcttcaacctcagtc

SEQ ID NO: 414918 - DNA, 25 bp, Rattus norvegicus
ggaaacgggacaacacctactagga

SEQ ID NO: 414919 - DNA, 25 bp, Rattus norvegicus
ggaaacgggacatcacctactagga

SEQ ID NO: 414920 - DNA, 25 bp, Rattus norvegicus
ggaaacgggttcattctgctccagg

SEQ ID NO: 414921 - DNA, 25 bp, Rattus norvegicus
ggaaacgggttctttctgctccagg

SEQ ID NO: 414922 - DNA, 25 bp, Rattus norvegicus
ggaaacggtcctagttattcaccag

SEQ ID NO: 414923 - DNA, 25 bp, Rattus norvegicus
ggaaacggtccttgttattcaccag

SEQ ID NO: 414924 - DNA, 25 bp, Rattus norvegicus
ggaaacgtactccacatgcatttta

SEQ ID NO: 414925 - DNA, 25 bp, Rattus norvegicus
ggaaacgtactcgacatgcatttta

SEQ ID NO: 414926 - DNA, 25 bp, Rattus norvegicus
ggaaacgtcaccctaggagcattaa

SEQ ID NO: 414927 - DNA, 25 bp, Rattus norvegicus
ggaaacgtcaccgtaggagcattaa

SEQ ID NO: 414928 - DNA, 25 bp, Rattus norvegicus
ggaaacgtccaccaccaagacaatt

SEQ ID NO: 414929 - DNA, 25 bp, Rattus norvegicus
ggaaacgtccacgaccaagacaatt

SEQ ID NO: 414930 - DNA, 25 bp, Rattus norvegicus
ggaaacgtgatgaactccctcccat

SEQ ID NO: 414931 - DNA, 25 bp, Rattus norvegicus
ggaaacgtgatgtactccctcccat

SEQ ID NO: 414932 - DNA, 25 bp, Rattus norvegicus
ggaaacgtgtacatttctcactaat

SEQ ID NO: 414933 - DNA, 25 bp, Rattus norvegicus
ggaaacgtgtacttttctcactaat

SEQ ID NO: 414934 - DNA, 25 bp, Rattus norvegicus
ggaaacgtgttcaaactagccaaag

SEQ ID NO: 414935 - DNA, 25 bp, Rattus norvegicus
ggaaacgtgttctaactagccaaag

SEQ ID NO: 414936 - DNA, 25 bp, Rattus norvegicus
ggaaacgttgggatcgacatgtaat

SEQ ID NO: 414937 - DNA, 25 bp, Rattus norvegicus
ggaaacgttgggttcgacatgtaat

SEQ ID NO: 414938 - DNA, 25 bp, Rattus norvegicus
ggaaacgttttcctctctcattcaa

SEQ ID NO: 414939 - DNA, 25 bp, Rattus norvegicus
ggaaacgttttcgtctctcattcaa

SEQ ID NO: 414940 - DNA, 25 bp, Rattus norvegicus
ggaaactaactccactcgtatggga

SEQ ID NO: 414941 - DNA, 25 bp, Rattus norvegicus
ggaaactaactcgactcgtatggga

SEQ ID NO: 414942 - DNA, 25 bp, Rattus norvegicus
ggaaactaagccactaacaccttca

SEQ ID NO: 414943 - DNA, 25 bp, Rattus norvegicus
ggaaactaagcctctaacaccttca

SEQ ID NO: 414944 - DNA, 25 bp, Rattus norvegicus
ggaaactaatccatttgtgctgtgt

SEQ ID NO: 414945 - DNA, 25 bp, Rattus norvegicus
ggaaactaatccttttgtgctgtgt

SEQ ID NO: 414946 - DNA, 25 bp, Rattus norvegicus
ggaaactacccaacttgtctgagct

SEQ ID NO: 414947 - DNA, 25 bp, Rattus norvegicus
ggaaactacccatcttgtctgagct

SEQ ID NO: 414948 - DNA, 25 bp, Rattus norvegicus
ggaaactactccagaaaagacattg

SEQ ID NO: 414949 - DNA, 25 bp, Rattus norvegicus
ggaaactactcctgaaaagacattg

SEQ ID NO: 414950 - DNA, 25 bp, Rattus norvegicus
ggaaactatgcaatccctagccaac

SEQ ID NO: 414951 - DNA, 25 bp, Rattus norvegicus
ggaaactatgcattccctagccaac

SEQ ID NO: 414952 - DNA, 25 bp, Rattus norvegicus
ggaaactattttcctgactgcccta

SEQ ID NO: 414953 - DNA, 25 bp, Rattus norvegicus
ggaaactattttgctgactgcccta

SEQ ID NO: 414954 - DNA, 25 bp, Rattus norvegicus
ggaaactcaaacaccttgcatcttt

SEQ ID NO: 414955 - DNA, 25 bp, Rattus norvegicus
ggaaactcaaactccttgcatcttt

SEQ ID NO: 414956 - DNA, 25 bp, Rattus norvegicus
ggaaactcacaccaggttgcacaag

SEQ ID NO: 414957 - DNA, 25 bp, Rattus norvegicus
ggaaactcacacgaggttgcacaag

SEQ ID NO: 414958 - DNA, 25 bp, Rattus norvegicus
ggaaactcacagctggaccacagga

SEQ ID NO: 414959 - DNA, 25 bp, Rattus norvegicus
ggaaactcacaggtggaccacagga

SEQ ID NO: 414960 - DNA, 25 bp, Rattus norvegicus
ggaaactcagcgaacacaacatttt

SEQ ID NO: 414961 - DNA, 25 bp, Rattus norvegicus
ggaaactcagcgtacacaacatttt

SEQ ID NO: 414962 - DNA, 25 bp, Rattus norvegicus
ggaaactcatagcacttggtcattt

SEQ ID NO: 414963 - DNA, 25 bp, Rattus norvegicus
ggaaactcataggacttggtcattt

SEQ ID NO: 414964 - DNA, 25 bp, Rattus norvegicus
ggaaactccaagatattcgacactg

SEQ ID NO: 414965 - DNA, 25 bp, Rattus norvegicus
ggaaactccaagttattcgacactg

SEQ ID NO: 414966 - DNA, 25 bp, Rattus norvegicus
ggaaactccatgaacccagagcatg

SEQ ID NO: 414967 - DNA, 25 bp, Rattus norvegicus
ggaaactccatgtacccagagcatg

SEQ ID NO: 414968 - DNA, 25 bp, Rattus norvegicus
ggaaactccgagatcagtgcggcac

SEQ ID NO: 414969 - DNA, 25 bp, Rattus norvegicus
ggaaactccgagttcagtgcggcac

SEQ ID NO: 414970 - DNA, 25 bp, Rattus norvegicus
ggaaactcctctagcctagtattta

SEQ ID NO: 414971 - DNA, 25 bp, Rattus norvegicus
ggaaactcctcttgcctagtattta

SEQ ID NO: 414972 - DNA, 25 bp, Rattus norvegicus
ggaaactcgaatcataccaagtaag

SEQ ID NO: 414973 - DNA, 25 bp, Rattus norvegicus
ggaaactcgaatgataccaagtaag

SEQ ID NO: 414974 - DNA, 25 bp, Rattus norvegicus
ggaaactcgcccatagactttttga

SEQ ID NO: 414975 - DNA, 25 bp, Rattus norvegicus
ggaaactcgcccttagactttttga

SEQ ID NO: 414976 - DNA, 25 bp, Rattus norvegicus
ggaaactcggtcacagaaggcaaga

SEQ ID NO: 414977 - DNA, 25 bp, Rattus norvegicus
ggaaactcggtctcagaaggcaaga

SEQ ID NO: 414978 - DNA, 25 bp, Rattus norvegicus
ggaaactcggtgacaagccttcgca

SEQ ID NO: 414979 - DNA, 25 bp, Rattus norvegicus
ggaaactcggtgtcaagccttcgca

SEQ ID NO: 414980 - DNA, 25 bp, Rattus norvegicus
ggaaactctccactttagacatcta

SEQ ID NO: 414981 - DNA, 25 bp, Rattus norvegicus
ggaaactctccagtttagacatcta

SEQ ID NO: 414982 - DNA, 25 bp, Rattus norvegicus
ggaaactctgcaagacttcgaggca

SEQ ID NO: 414983 - DNA, 25 bp, Rattus norvegicus
ggaaactctgcatgacttcgaggca

SEQ ID NO: 414984 - DNA, 25 bp, Rattus norvegicus
ggaaactcttatctcagtcatgcat

SEQ ID NO: 414985 - DNA, 25 bp, Rattus norvegicus
ggaaactcttatgtcagtcatgcat

SEQ ID NO: 414986 - DNA, 25 bp, Rattus norvegicus
ggaaactgaaagctttctggccttt

SEQ ID NO: 414987 - DNA, 25 bp, Rattus norvegicus
ggaaactgaaaggtttctggccttt

SEQ ID NO: 414988 - DNA, 25 bp, Rattus norvegicus
ggaaactgacatccagactcaacag

SEQ ID NO: 414989 - DNA, 25 bp, Rattus norvegicus
ggaaactgacatgcagactcaacag

SEQ ID NO: 414990 - DNA, 25 bp, Rattus norvegicus
ggaaactgagccagaagcacctgca

SEQ ID NO: 414991 - DNA, 25 bp, Rattus norvegicus
ggaaactgagcctgaagcacctgca

SEQ ID NO: 414992 - DNA, 25 bp, Rattus norvegicus
ggaaactgagctccaggtcctctcg

SEQ ID NO: 414993 - DNA, 25 bp, Rattus norvegicus
ggaaactgagctgcaggtcctctcg

SEQ ID NO: 414994 - DNA, 25 bp, Rattus norvegicus
ggaaactgatgaaactccatcccaa

SEQ ID NO: 414995 - DNA, 25 bp, Rattus norvegicus
ggaaactgatgatactccatcccaa

SEQ ID NO: 414996 - DNA, 25 bp, Rattus norvegicus
ggaaactgatttctcttactatttt

SEQ ID NO: 414997 - DNA, 25 bp, Rattus norvegicus
ggaaactgatttgtcttactatttt

SEQ ID NO: 414998 - DNA, 25 bp, Rattus norvegicus
ggaaactgcacaacggagacctctg

SEQ ID NO: 414999 - DNA, 25 bp, Rattus norvegicus
ggaaactgcacatcggagacctctg

SEQ ID NO: 415000 - DNA, 25 bp, Rattus norvegicus
ggaaactgcagtaactttttctcaa

SEQ ID NO: 415001 - DNA, 25 bp, Rattus norvegicus
ggaaactgcagttactttttctcaa

SEQ ID NO: 415002 - DNA, 25 bp, Rattus norvegicus
ggaaactgcatcaaagctctcagaa

SEQ ID NO: 415003 - DNA, 25 bp, Rattus norvegicus
ggaaactgcatctaagctctcagaa

SEQ ID NO: 415004 - DNA, 25 bp, Rattus norvegicus
ggaaactgccttcctcagtgacgga

SEQ ID NO: 415005 - DNA, 25 bp, Rattus norvegicus
ggaaactgccttgctcagtgacgga

SEQ ID NO: 415006 - DNA, 25 bp, Rattus norvegicus
ggaaactgctaaccctgttccagca

SEQ ID NO: 415007 - DNA, 25 bp, Rattus norvegicus
ggaaactgctaagcctgttccagca

SEQ ID NO: 415008 - DNA, 25 bp, Rattus norvegicus
ggaaactgctgtaataaaccccatc

SEQ ID NO: 415009 - DNA, 25 bp, Rattus norvegicus
ggaaactgctgttataaaccccatc

SEQ ID NO: 415010 - DNA, 25 bp, Rattus norvegicus
ggaaactgcttactactgtctgtat

SEQ ID NO: 415011 - DNA, 25 bp, Rattus norvegicus
ggaaactgcttagtactgtctgtat

SEQ ID NO: 415012 - DNA, 25 bp, Rattus norvegicus
ggaaactggcctactacagtggcgc

SEQ ID NO: 415013 - DNA, 25 bp, Rattus norvegicus
ggaaactggccttctacagtggcgc

SEQ ID NO: 415014 - DNA, 25 bp, Rattus norvegicus
ggaaactggtccagaggcgatctca

SEQ ID NO: 415015 - DNA, 25 bp, Rattus norvegicus
ggaaactggtcctgaggcgatctca

SEQ ID NO: 415016 - DNA, 25 bp, Rattus norvegicus
ggaaactgtaatatctactgtgaca

SEQ ID NO: 415017 - DNA, 25 bp, Rattus norvegicus
ggaaactgtaatttctactgtgaca

SEQ ID NO: 415018 - DNA, 25 bp, Rattus norvegicus
ggaaactgtcaaatcatggcctgaa

SEQ ID NO: 415019 - DNA, 25 bp, Rattus norvegicus
ggaaactgtcaattcatggcctgaa

SEQ ID NO: 415020 - DNA, 25 bp, Rattus norvegicus
ggaaactgtcatccactataccttg

SEQ ID NO: 415021 - DNA, 25 bp, Rattus norvegicus
ggaaactgtcatgcactataccttg

SEQ ID NO: 415022 - DNA, 25 bp, Rattus norvegicus
ggaaactgtgcccactatcagaagg

SEQ ID NO: 415023 - DNA, 25 bp, Rattus norvegicus
ggaaactgtgccgactatcagaagg

SEQ ID NO: 415024 - DNA, 25 bp, Rattus norvegicus
ggaaactgtttcacttcaaactaga

SEQ ID NO: 415025 - DNA, 25 bp, Rattus norvegicus
ggaaactgtttctcttcaaactaga

SEQ ID NO: 415026 - DNA, 25 bp, Rattus norvegicus
ggaaacttacctcaagctctccatc

SEQ ID NO: 415027 - DNA, 25 bp, Rattus norvegicus
ggaaacttacctgaagctctccatc

SEQ ID NO: 415028 - DNA, 25 bp, Rattus norvegicus
ggaaacttagtcattgtcaccaata

SEQ ID NO: 415029 - DNA, 25 bp, Rattus norvegicus
ggaaacttagtctttgtcaccaata

SEQ ID NO: 415030 - DNA, 25 bp, Rattus norvegicus
ggaaacttcacaaagctgtcctcac

SEQ ID NO: 415031 - DNA, 25 bp, Rattus norvegicus
ggaaacttcacatagctgtcctcac

SEQ ID NO: 415032 - DNA, 25 bp, Rattus norvegicus
ggaaacttcatgacattacgcttta

SEQ ID NO: 415033 - DNA, 25 bp, Rattus norvegicus
ggaaacttcatgtcattacgcttta

SEQ ID NO: 415034 - DNA, 25 bp, Rattus norvegicus
ggaaacttccagcaatcatgtattt

SEQ ID NO: 415035 - DNA, 25 bp, Rattus norvegicus
ggaaacttccaggaatcatgtattt

SEQ ID NO: 415036 - DNA, 25 bp, Rattus norvegicus
ggaaacttctggaggtagtacatat

SEQ ID NO: 415037 - DNA, 25 bp, Rattus norvegicus
ggaaacttctggtggtagtacatat

SEQ ID NO: 415038 - DNA, 25 bp, Rattus norvegicus
ggaaacttcttcatgggtggctcag

SEQ ID NO: 415039 - DNA, 25 bp, Rattus norvegicus
ggaaacttcttcttgggtggctcag

SEQ ID NO: 415040 - DNA, 25 bp, Rattus norvegicus
ggaaacttgcaaattcaggaaccaa

SEQ ID NO: 415041 - DNA, 25 bp, Rattus norvegicus
ggaaacttgcaatttcaggaaccaa

SEQ ID NO: 415042 - DNA, 25 bp, Rattus norvegicus
ggaaacttggacattctctctatat

SEQ ID NO: 415043 - DNA, 25 bp, Rattus norvegicus
ggaaacttggactttctctctatat

SEQ ID NO: 415044 - DNA, 25 bp, Rattus norvegicus
ggaaacttggctaccgaggacctgg

SEQ ID NO: 415045 - DNA, 25 bp, Rattus norvegicus
ggaaacttggcttccgaggacctgg

SEQ ID NO: 415046 - DNA, 25 bp, Rattus norvegicus
ggaaacttgtagacttaaccttctg

SEQ ID NO: 415047 - DNA, 25 bp, Rattus norvegicus
ggaaacttgtagtcttaaccttctg

SEQ ID NO: 415048 - DNA, 25 bp, Rattus norvegicus
ggaaacttgtatcctatttgcccag

SEQ ID NO: 415049 - DNA, 25 bp, Rattus norvegicus
ggaaacttgtatgctatttgcccag

SEQ ID NO: 415050 - DNA, 25 bp, Rattus norvegicus
ggaaacttgtgcatggttcactgaa

SEQ ID NO: 415051 - DNA, 25 bp, Rattus norvegicus
ggaaacttgtgcttggttcactgaa

SEQ ID NO: 415052 - DNA, 25 bp, Rattus norvegicus
ggaaacttttctctgccaattgcct

SEQ ID NO: 415053 - DNA, 25 bp, Rattus norvegicus
ggaaacttttctgtgccaattgcct

SEQ ID NO: 415054 - DNA, 25 bp, Rattus norvegicus
ggaaagaaaacacggccatcggatg

SEQ ID NO: 415055 - DNA, 25 bp, Rattus norvegicus
ggaaagaaaacagggccatcggatg

SEQ ID NO: 415056 - DNA, 25 bp, Rattus norvegicus
ggaaagaaagccctgtaatgactca

SEQ ID NO: 415057 - DNA, 25 bp, Rattus norvegicus
ggaaagaaagccgtgtaatgactca

SEQ ID NO: 415058 - DNA, 25 bp, Rattus norvegicus
ggaaagaaattcaagtccagcctct

SEQ ID NO: 415059 - DNA, 25 bp, Rattus norvegicus
ggaaagaaattctagtccagcctct

SEQ ID NO: 415060 - DNA, 25 bp, Rattus norvegicus
ggaaagaacggcatgactcccctgc

SEQ ID NO: 415061 - DNA, 25 bp, Rattus norvegicus
ggaaagaacggcttgactcccctgc

SEQ ID NO: 415062 - DNA, 25 bp, Rattus norvegicus
ggaaagaacttacgtccgactgctt

SEQ ID NO: 415063 - DNA, 25 bp, Rattus norvegicus
ggaaagaacttaggtccgactgctt

SEQ ID NO: 415064 - DNA, 25 bp, Rattus norvegicus
ggaaagaaggaaagacttgcccttt

SEQ ID NO: 415065 - DNA, 25 bp, Rattus norvegicus
ggaaagaaggaatgacttgcccttt

SEQ ID NO: 415066 - DNA, 25 bp, Rattus norvegicus
ggaaagaaggctagctcccaacttc

SEQ ID NO: 415067 - DNA, 25 bp, Rattus norvegicus
ggaaagaaggcttgctcccaacttc

SEQ ID NO: 415068 - DNA, 25 bp, Rattus norvegicus
ggaaagaatgtcctcactgctggcc

SEQ ID NO: 415069 - DNA, 25 bp, Rattus norvegicus
ggaaagaatgtcgtcactgctggcc

SEQ ID NO: 415070 - DNA, 25 bp, Rattus norvegicus
ggaaagacaccccagagcttactca

SEQ ID NO: 415071 - DNA, 25 bp, Rattus norvegicus
ggaaagacacccgagagcttactca

SEQ ID NO: 415072 - DNA, 25 bp, Rattus norvegicus
ggaaagacagctctgtacttctggc

SEQ ID NO: 415073 - DNA, 25 bp, Rattus norvegicus
ggaaagacagctgtgtacttctggc

SEQ ID NO: 415074 - DNA, 25 bp, Rattus norvegicus
ggaaagaccaccaaatcccatcgag

SEQ ID NO: 415075 - DNA, 25 bp, Rattus norvegicus
ggaaagaccaccataaaccacatgc

SEQ ID NO: 415076 - DNA, 25 bp, Rattus norvegicus
ggaaagaccacctaatcccatcgag

SEQ ID NO: 415077 - DNA, 25 bp, Rattus norvegicus
ggaaagaccaccttaaaccacatgc

SEQ ID NO: 415078 - DNA, 25 bp, Rattus norvegicus
ggaaagaccagcatgctcatctatt

SEQ ID NO: 415079 - DNA, 25 bp, Rattus norvegicus
ggaaagaccagcttgctcatctatt

SEQ ID NO: 415080 - DNA, 25 bp, Rattus norvegicus
ggaaagaccagtacacctcattacc

SEQ ID NO: 415081 - DNA, 25 bp, Rattus norvegicus
ggaaagaccagttcacctcattacc

SEQ ID NO: 415082 - DNA, 25 bp, Rattus norvegicus
ggaaagaccatgatcgtaagagtgt

SEQ ID NO: 415083 - DNA, 25 bp, Rattus norvegicus
ggaaagaccatgttcgtaagagtgt

SEQ ID NO: 415084 - DNA, 25 bp, Rattus norvegicus
ggaaagacctacagccatgtggcct

SEQ ID NO: 415085 - DNA, 25 bp, Rattus norvegicus
ggaaagacctactgccatgtggcct

SEQ ID NO: 415086 - DNA, 25 bp, Rattus norvegicus
ggaaagaccttcctctcagttgtaa

SEQ ID NO: 415087 - DNA, 25 bp, Rattus norvegicus
ggaaagaccttcgtctcagttgtaa

SEQ ID NO: 415088 - DNA, 25 bp, Rattus norvegicus
ggaaagacctttcagaccttggcta

SEQ ID NO: 415089 - DNA, 25 bp, Rattus norvegicus
ggaaagacctttgagaccttggcta

SEQ ID NO: 415090 - DNA, 25 bp, Rattus norvegicus
ggaaagacggccatgtttctctgct

SEQ ID NO: 415091 - DNA, 25 bp, Rattus norvegicus
ggaaagacggccttgtttctctgct

SEQ ID NO: 415092 - DNA, 25 bp, Rattus norvegicus
ggaaagactcccagaggaccaccct

SEQ ID NO: 415093 - DNA, 25 bp, Rattus norvegicus
ggaaagactccctgaggaccaccct

SEQ ID NO: 415094 - DNA, 25 bp, Rattus norvegicus
ggaaagactggcctatcagaacccc

SEQ ID NO: 415095 - DNA, 25 bp, Rattus norvegicus
ggaaagactggcgtatcagaacccc

SEQ ID NO: 415096 - DNA, 25 bp, Rattus norvegicus
ggaaagacttccattgctacagctt

SEQ ID NO: 415097 - DNA, 25 bp, Rattus norvegicus
ggaaagacttcctttgctacagctt

SEQ ID NO: 415098 - DNA, 25 bp, Rattus norvegicus
ggaaagacttggaagtcccagcaga

SEQ ID NO: 415099 - DNA, 25 bp, Rattus norvegicus
ggaaagacttggtagtcccagcaga

SEQ ID NO: 415100 - DNA, 25 bp, Rattus norvegicus
ggaaagagactgatccttatctgga

SEQ ID NO: 415101 - DNA, 25 bp, Rattus norvegicus
ggaaagagactgttccttatctgga

SEQ ID NO: 415102 - DNA, 25 bp, Rattus norvegicus
ggaaagagacttctgctacctagag

SEQ ID NO: 415103 - DNA, 25 bp, Rattus norvegicus
ggaaagagacttgtgctacctagag

SEQ ID NO: 415104 - DNA, 25 bp, Rattus norvegicus
ggaaagagagcgaccactgtccttg

SEQ ID NO: 415105 - DNA, 25 bp, Rattus norvegicus
ggaaagagagcgtccactgtccttg

SEQ ID NO: 415106 - DNA, 25 bp, Rattus norvegicus
ggaaagagccgtcattggttcttaa

SEQ ID NO: 415107 - DNA, 25 bp, Rattus norvegicus
ggaaagagccgtgattggttcttaa

SEQ ID NO: 415108 - DNA, 25 bp, Rattus norvegicus
ggaaagagcgcacctcaaggcccag

SEQ ID NO: 415109 - DNA, 25 bp, Rattus norvegicus
ggaaagagcgcagctcaaggcccag

SEQ ID NO: 415110 - DNA, 25 bp, Rattus norvegicus
ggaaagagtctaaccagtgttcagc

SEQ ID NO: 415111 - DNA, 25 bp, Rattus norvegicus
ggaaagagtctatccagtgttcagc

SEQ ID NO: 415112 - DNA, 25 bp, Rattus norvegicus
ggaaagatcaagacttctggcgtat

SEQ ID NO: 415113 - DNA, 25 bp, Rattus norvegicus
ggaaagatcaagtcttctggcgtat

SEQ ID NO: 415114 - DNA, 25 bp, Rattus norvegicus
ggaaagatcgaaagcccaaatatat

SEQ ID NO: 415115 - DNA, 25 bp, Rattus norvegicus
ggaaagatcgaatgcccaaatatat

SEQ ID NO: 415116 - DNA, 25 bp, Rattus norvegicus
ggaaagatctgcaccctgtatgtgc

SEQ ID NO: 415117 - DNA, 25 bp, Rattus norvegicus
ggaaagatctgcacgtgttgtctga

SEQ ID NO: 415118 - DNA, 25 bp, Rattus norvegicus
ggaaagatctgctccctgtatgtgc

SEQ ID NO: 415119 - DNA, 25 bp, Rattus norvegicus
ggaaagatctgctcgtgttgtctga

SEQ ID NO: 415120 - DNA, 25 bp, Rattus norvegicus
ggaaagatctttactaactgcacat

SEQ ID NO: 415121 - DNA, 25 bp, Rattus norvegicus
ggaaagatcttttctaactgcacat

SEQ ID NO: 415122 - DNA, 25 bp, Rattus norvegicus
ggaaagatgctcatcagtggaatct

SEQ ID NO: 415123 - DNA, 25 bp, Rattus norvegicus
ggaaagatgctcttcagtggaatct

SEQ ID NO: 415124 - DNA, 25 bp, Rattus norvegicus
ggaaagatggtgaggcctgcaccca

SEQ ID NO: 415125 - DNA, 25 bp, Rattus norvegicus
ggaaagatggtgtggcctgcaccca

SEQ ID NO: 415126 - DNA, 25 bp, Rattus norvegicus
ggaaagattccaagctgaccctgac

SEQ ID NO: 415127 - DNA, 25 bp, Rattus norvegicus
ggaaagattccatgctgaccctgac

SEQ ID NO: 415128 - DNA, 25 bp, Rattus norvegicus
ggaaagatttgaccagctagagctg

SEQ ID NO: 415129 - DNA, 25 bp, Rattus norvegicus
ggaaagatttgagcagctagagctg

SEQ ID NO: 415130 - DNA, 25 bp, Rattus norvegicus
ggaaagcaaaacacgctgcgtcctg

SEQ ID NO: 415131 - DNA, 25 bp, Rattus norvegicus
ggaaagcaaaactcgctgcgtcctg

SEQ ID NO: 415132 - DNA, 25 bp, Rattus norvegicus
ggaaagcaaacacagctctttgaga

SEQ ID NO: 415133 - DNA, 25 bp, Rattus norvegicus
ggaaagcaaacagagctctttgaga

SEQ ID NO: 415134 - DNA, 25 bp, Rattus norvegicus
ggaaagcaacagatactgtccctgt

SEQ ID NO: 415135 - DNA, 25 bp, Rattus norvegicus
ggaaagcaacagttactgtccctgt

SEQ ID NO: 415136 - DNA, 25 bp, Rattus norvegicus
ggaaagcaatcccatgctggatccc

SEQ ID NO: 415137 - DNA, 25 bp, Rattus norvegicus
ggaaagcaatccgatgctggatccc

SEQ ID NO: 415138 - DNA, 25 bp, Rattus norvegicus
ggaaagcaccccatgagtcagacaa

SEQ ID NO: 415139 - DNA, 25 bp, Rattus norvegicus
ggaaagcaccccttgagtcagacaa

SEQ ID NO: 415140 - DNA, 25 bp, Rattus norvegicus
ggaaagcagaagagtttccctgttg

SEQ ID NO: 415141 - DNA, 25 bp, Rattus norvegicus
ggaaagcagaagtgtttccctgttg

SEQ ID NO: 415142 - DNA, 25 bp, Rattus norvegicus
ggaaagcagagcctgtgacagccac

SEQ ID NO: 415143 - DNA, 25 bp, Rattus norvegicus
ggaaagcagagcgtgtgacagccac

SEQ ID NO: 415144 - DNA, 25 bp, Rattus norvegicus
ggaaagcagcccagttgagcctaaa

SEQ ID NO: 415145 - DNA, 25 bp, Rattus norvegicus
ggaaagcagccctgttgagcctaaa

SEQ ID NO: 415146 - DNA, 25 bp, Rattus norvegicus
ggaaagcaggccacgtggctcagtt

SEQ ID NO: 415147 - DNA, 25 bp, Rattus norvegicus
ggaaagcaggcctcgtggctcagtt

SEQ ID NO: 415148 - DNA, 25 bp, Rattus norvegicus
ggaaagcatgcacacacttcgttgt

SEQ ID NO: 415149 - DNA, 25 bp, Rattus norvegicus
ggaaagcatgcagacacttcgttgt

SEQ ID NO: 415150 - DNA, 25 bp, Rattus norvegicus
ggaaagcatttactccattttagag

SEQ ID NO: 415151 - DNA, 25 bp, Rattus norvegicus
ggaaagcatttagtccattttagag

SEQ ID NO: 415152 - DNA, 25 bp, Rattus norvegicus
ggaaagccaaaacctgtgatcacag

SEQ ID NO: 415153 - DNA, 25 bp, Rattus norvegicus
ggaaagccaaaagctgtgatcacag

SEQ ID NO: 415154 - DNA, 25 bp, Rattus norvegicus
ggaaagccaaagatgtcttctcaag

SEQ ID NO: 415155 - DNA, 25 bp, Rattus norvegicus
ggaaagccaaagttgtcttctcaag

SEQ ID NO: 415156 - DNA, 25 bp, Rattus norvegicus
ggaaagccaccacgatgcagacatt

SEQ ID NO: 415157 - DNA, 25 bp, Rattus norvegicus
ggaaagccaccaggatgcagacatt

SEQ ID NO: 415158 - DNA, 25 bp, Rattus norvegicus
ggaaagccactgagaaacacaccaa

SEQ ID NO: 415159 - DNA, 25 bp, Rattus norvegicus
ggaaagccactgtgaaacacaccaa

SEQ ID NO: 415160 - DNA, 25 bp, Rattus norvegicus
ggaaagccagagattccacacagcc

SEQ ID NO: 415161 - DNA, 25 bp, Rattus norvegicus
ggaaagccagagtttccacacagcc

SEQ ID NO: 415162 - DNA, 25 bp, Rattus norvegicus
ggaaagccagctactaggtcatgaa

SEQ ID NO: 415163 - DNA, 25 bp, Rattus norvegicus
ggaaagccagcttctaggtcatgaa

SEQ ID NO: 415164 - DNA, 25 bp, Rattus norvegicus
ggaaagccagtcctcctacaaaggg

SEQ ID NO: 415165 - DNA, 25 bp, Rattus norvegicus
ggaaagccagtcgtcctacaaaggg

SEQ ID NO: 415166 - DNA, 25 bp, Rattus norvegicus
ggaaagccatgtatgcccggttcac

SEQ ID NO: 415167 - DNA, 25 bp, Rattus norvegicus
ggaaagccatgtttgcccggttcac

SEQ ID NO: 415168 - DNA, 25 bp, Rattus norvegicus
ggaaagcccaacagtgtggttattt

SEQ ID NO: 415169 - DNA, 25 bp, Rattus norvegicus
ggaaagcccaactgtgtggttattt

SEQ ID NO: 415170 - DNA, 25 bp, Rattus norvegicus
ggaaagcccagcagcgctccagatg

SEQ ID NO: 415171 - DNA, 25 bp, Rattus norvegicus
ggaaagcccagctgcgctccagatg

SEQ ID NO: 415172 - DNA, 25 bp, Rattus norvegicus
ggaaagcccggacagcttcccttga

SEQ ID NO: 415173 - DNA, 25 bp, Rattus norvegicus
ggaaagcccggagagcttcccttga

SEQ ID NO: 415174 - DNA, 25 bp, Rattus norvegicus
ggaaagccgcccatcgagagcagca

SEQ ID NO: 415175 - DNA, 25 bp, Rattus norvegicus
ggaaagccgcccttcgagagcagca

SEQ ID NO: 415176 - DNA, 25 bp, Rattus norvegicus
ggaaagcctaagctttctccgtcag

SEQ ID NO: 415177 - DNA, 25 bp, Rattus norvegicus
ggaaagcctaaggtttctccgtcag

SEQ ID NO: 415178 - DNA, 25 bp, Rattus norvegicus
ggaaagcctctcagtaatcacggaa

SEQ ID NO: 415179 - DNA, 25 bp, Rattus norvegicus
ggaaagcctctctgtaatcacggaa

SEQ ID NO: 415180 - DNA, 25 bp, Rattus norvegicus
ggaaagcctctgaaattctcattct

SEQ ID NO: 415181 - DNA, 25 bp, Rattus norvegicus
ggaaagcctctgtaattctcattct

SEQ ID NO: 415182 - DNA, 25 bp, Rattus norvegicus
ggaaagccttcactataacctagag

SEQ ID NO: 415183 - DNA, 25 bp, Rattus norvegicus
ggaaagccttcagtataacctagag

SEQ ID NO: 415184 - DNA, 25 bp, Rattus norvegicus
ggaaagcgatgacgatgacactgca

SEQ ID NO: 415185 - DNA, 25 bp, Rattus norvegicus
ggaaagcgatgaggatgacactgca

SEQ ID NO: 415186 - DNA, 25 bp, Rattus norvegicus
ggaaagcgatgtatgcccgtcagtc

SEQ ID NO: 415187 - DNA, 25 bp, Rattus norvegicus
ggaaagcgatgtttgcccgtcagtc

SEQ ID NO: 415188 - DNA, 25 bp, Rattus norvegicus
ggaaagcgcattcaccgccaagcaa

SEQ ID NO: 415189 - DNA, 25 bp, Rattus norvegicus
ggaaagcgcattgaccgccaagcaa

SEQ ID NO: 415190 - DNA, 25 bp, Rattus norvegicus
ggaaagcgcctccatttcattggga

SEQ ID NO: 415191 - DNA, 25 bp, Rattus norvegicus
ggaaagcgcctcgatttcattggga

SEQ ID NO: 415192 - DNA, 25 bp, Rattus norvegicus
ggaaagcgcgcaaggagtttatcct

SEQ ID NO: 415193 - DNA, 25 bp, Rattus norvegicus
ggaaagcgcgcatggagtttatcct

SEQ ID NO: 415194 - DNA, 25 bp, Rattus norvegicus
ggaaagcgtcaaaccttgagaaact

SEQ ID NO: 415195 - DNA, 25 bp, Rattus norvegicus
ggaaagcgtcaatccttgagaaact

SEQ ID NO: 415196 - DNA, 25 bp, Rattus norvegicus
ggaaagcgttatcctccatccaaga

SEQ ID NO: 415197 - DNA, 25 bp, Rattus norvegicus
ggaaagcgttatgctccatccaaga

SEQ ID NO: 415198 - DNA, 25 bp, Rattus norvegicus
ggaaagctatccaacaatgtgacaa

SEQ ID NO: 415199 - DNA, 25 bp, Rattus norvegicus
ggaaagctatcctacaatgtgacaa

SEQ ID NO: 415200 - DNA, 25 bp, Rattus norvegicus
ggaaagctattccttgccgtctgca

SEQ ID NO: 415201 - DNA, 25 bp, Rattus norvegicus
ggaaagctattcgttgccgtctgca

SEQ ID NO: 415202 - DNA, 25 bp, Rattus norvegicus
ggaaagctccagatcatggttcaag

SEQ ID NO: 415203 - DNA, 25 bp, Rattus norvegicus
ggaaagctccagttcatggttcaag

SEQ ID NO: 415204 - DNA, 25 bp, Rattus norvegicus
ggaaagctgagcaggttttcccaga

SEQ ID NO: 415205 - DNA, 25 bp, Rattus norvegicus
ggaaagctgagctggttttcccaga

SEQ ID NO: 415206 - DNA, 25 bp, Rattus norvegicus
ggaaagctgcagctgtcattacaac

SEQ ID NO: 415207 - DNA, 25 bp, Rattus norvegicus
ggaaagctgcaggtgtcattacaac

SEQ ID NO: 415208 - DNA, 25 bp, Rattus norvegicus
ggaaagctgcctaagttactcactt

SEQ ID NO: 415209 - DNA, 25 bp, Rattus norvegicus
ggaaagctgccttagttactcactt

SEQ ID NO: 415210 - DNA, 25 bp, Rattus norvegicus
ggaaagctgtctaaatgacccactt

SEQ ID NO: 415211 - DNA, 25 bp, Rattus norvegicus
ggaaagctgtcttaatgacccactt

SEQ ID NO: 415212 - DNA, 25 bp, Rattus norvegicus
ggaaagcttctaatcttctgactta

SEQ ID NO: 415213 - DNA, 25 bp, Rattus norvegicus
ggaaagcttctactccgagtcccta

SEQ ID NO: 415214 - DNA, 25 bp, Rattus norvegicus
ggaaagcttctagtccgagtcccta

SEQ ID NO: 415215 - DNA, 25 bp, Rattus norvegicus
ggaaagcttctattcttctgactta

SEQ ID NO: 415216 - DNA, 25 bp, Rattus norvegicus
ggaaagctttatatgaccacctcac

SEQ ID NO: 415217 - DNA, 25 bp, Rattus norvegicus
ggaaagctttatttgaccacctcac

SEQ ID NO: 415218 - DNA, 25 bp, Rattus norvegicus
ggaaagcttttgcttcgtctccctt

SEQ ID NO: 415219 - DNA, 25 bp, Rattus norvegicus
ggaaagcttttggttcgtctccctt

SEQ ID NO: 415220 - DNA, 25 bp, Rattus norvegicus
ggaaaggaaattctcatcagttgtg

SEQ ID NO: 415221 - DNA, 25 bp, Rattus norvegicus
ggaaaggaaattgtcatcagttgtg

SEQ ID NO: 415222 - DNA, 25 bp, Rattus norvegicus
ggaaaggacagcctcatcttcagcc

SEQ ID NO: 415223 - DNA, 25 bp, Rattus norvegicus
ggaaaggacagcgtcatcttcagcc

SEQ ID NO: 415224 - DNA, 25 bp, Rattus norvegicus
ggaaaggacatcagaaggcgacaca

SEQ ID NO: 415225 - DNA, 25 bp, Rattus norvegicus
ggaaaggacatctgaaggcgacaca

SEQ ID NO: 415226 - DNA, 25 bp, Rattus norvegicus
ggaaaggaccttaacacttcaagat

SEQ ID NO: 415227 - DNA, 25 bp, Rattus norvegicus
ggaaaggacctttacacttcaagat

SEQ ID NO: 415228 - DNA, 25 bp, Rattus norvegicus
ggaaaggactctctgttcacttaag

SEQ ID NO: 415229 - DNA, 25 bp, Rattus norvegicus
ggaaaggactctgtgttcacttaag

SEQ ID NO: 415230 - DNA, 25 bp, Rattus norvegicus
ggaaaggacttcagtgacacatcta

SEQ ID NO: 415231 - DNA, 25 bp, Rattus norvegicus
ggaaaggacttctgtgacacatcta

SEQ ID NO: 415232 - DNA, 25 bp, Rattus norvegicus
ggaaaggcacctccctgtttttgat

SEQ ID NO: 415233 - DNA, 25 bp, Rattus norvegicus
ggaaaggcacctgcctgtttttgat

SEQ ID NO: 415234 - DNA, 25 bp, Rattus norvegicus
ggaaaggcactgatttaaatgctgc

SEQ ID NO: 415235 - DNA, 25 bp, Rattus norvegicus
ggaaaggcactgttttaaatgctgc

SEQ ID NO: 415236 - DNA, 25 bp, Rattus norvegicus
ggaaaggcagtcacatttccctacc

SEQ ID NO: 415237 - DNA, 25 bp, Rattus norvegicus
ggaaaggcagtctcatttccctacc

SEQ ID NO: 415238 - DNA, 25 bp, Rattus norvegicus
ggaaaggcccaccagagcataatga

SEQ ID NO: 415239 - DNA, 25 bp, Rattus norvegicus
ggaaaggcccacgagagcataatga

SEQ ID NO: 415240 - DNA, 25 bp, Rattus norvegicus
ggaaaggcgtccagctgcagcatgc

SEQ ID NO: 415241 - DNA, 25 bp, Rattus norvegicus
ggaaaggcgtcctgctgcagcatgc

SEQ ID NO: 415242 - DNA, 25 bp, Rattus norvegicus
ggaaaggctcaaagtgctgaccaat

SEQ ID NO: 415243 - DNA, 25 bp, Rattus norvegicus
ggaaaggctcaatgtgctgaccaat

SEQ ID NO: 415244 - DNA, 25 bp, Rattus norvegicus
ggaaaggctcccatttgaggccatc

SEQ ID NO: 415245 - DNA, 25 bp, Rattus norvegicus
ggaaaggctcccttttgaggccatc

SEQ ID NO: 415246 - DNA, 25 bp, Rattus norvegicus
ggaaaggctcctctgtcaatggcag

SEQ ID NO: 415247 - DNA, 25 bp, Rattus norvegicus
ggaaaggctcctgtgtcaatggcag

SEQ ID NO: 415248 - DNA, 25 bp, Rattus norvegicus
ggaaaggctcgacatgcggcttatc

SEQ ID NO: 415249 - DNA, 25 bp, Rattus norvegicus
ggaaaggctcgagatgcggcttatc

SEQ ID NO: 415250 - DNA, 25 bp, Rattus norvegicus
ggaaaggctgaaccaacctcatgct

SEQ ID NO: 415251 - DNA, 25 bp, Rattus norvegicus
ggaaaggctgaagcaacctcatgct

SEQ ID NO: 415252 - DNA, 25 bp, Rattus norvegicus
ggaaaggctgacaggctgtcccagc

SEQ ID NO: 415253 - DNA, 25 bp, Rattus norvegicus
ggaaaggctgactggctgtcccagc

SEQ ID NO: 415254 - DNA, 25 bp, Rattus norvegicus
ggaaaggctgcgaccgagacaccta

SEQ ID NO: 415255 - DNA, 25 bp, Rattus norvegicus
ggaaaggctgcgtccgagacaccta

SEQ ID NO: 415256 - DNA, 25 bp, Rattus norvegicus
ggaaaggcttcgcactcagggctcc

SEQ ID NO: 415257 - DNA, 25 bp, Rattus norvegicus
ggaaaggcttcggactcagggctcc

SEQ ID NO: 415258 - DNA, 25 bp, Rattus norvegicus
ggaaaggcttgaactccaatttagt

SEQ ID NO: 415259 - DNA, 25 bp, Rattus norvegicus
ggaaaggcttgatctccaatttagt

SEQ ID NO: 415260 - DNA, 25 bp, Rattus norvegicus
ggaaagggaaccaagtcctcagaat

SEQ ID NO: 415261 - DNA, 25 bp, Rattus norvegicus
ggaaagggaacctagtcctcagaat

SEQ ID NO: 415262 - DNA, 25 bp, Rattus norvegicus
ggaaagggacataaaggcaacagac

SEQ ID NO: 415263 - DNA, 25 bp, Rattus norvegicus
ggaaagggacattaaggcaacagac

SEQ ID NO: 415264 - DNA, 25 bp, Rattus norvegicus
ggaaagggacgacagacatctctct

SEQ ID NO: 415265 - DNA, 25 bp, Rattus norvegicus
ggaaagggacgagagacatctctct

SEQ ID NO: 415266 - DNA, 25 bp, Rattus norvegicus
ggaaagggcccacaagtagccatat

SEQ ID NO: 415267 - DNA, 25 bp, Rattus norvegicus
ggaaagggcccagaagtagccatat

SEQ ID NO: 415268 - DNA, 25 bp, Rattus norvegicus
ggaaagggcttcacagaccaccaaa

SEQ ID NO: 415269 - DNA, 25 bp, Rattus norvegicus
ggaaagggcttctcagaccaccaaa

SEQ ID NO: 415270 - DNA, 25 bp, Rattus norvegicus
ggaaagggctttacgatctccgagg

SEQ ID NO: 415271 - DNA, 25 bp, Rattus norvegicus
ggaaagggcttttcgatctccgagg

SEQ ID NO: 415272 - DNA, 25 bp, Rattus norvegicus
ggaaagggtatcaggctcatggatt

SEQ ID NO: 415273 - DNA, 25 bp, Rattus norvegicus
ggaaagggtatctggctcatggatt

SEQ ID NO: 415274 - DNA, 25 bp, Rattus norvegicus
ggaaaggtaccaccatggcagaact

SEQ ID NO: 415275 - DNA, 25 bp, Rattus norvegicus
ggaaaggtaccagcatggcagaact

SEQ ID NO: 415276 - DNA, 25 bp, Rattus norvegicus
ggaaaggtcactacaatcacaccct

SEQ ID NO: 415277 - DNA, 25 bp, Rattus norvegicus
ggaaaggtcacttcaatcacaccct

SEQ ID NO: 415278 - DNA, 25 bp, Rattus norvegicus
ggaaaggtctaacttggctgcaaaa

SEQ ID NO: 415279 - DNA, 25 bp, Rattus norvegicus
ggaaaggtctaagttggctgcaaaa

SEQ ID NO: 415280 - DNA, 25 bp, Rattus norvegicus
ggaaaggtgcccactgacgcctccg

SEQ ID NO: 415281 - DNA, 25 bp, Rattus norvegicus
ggaaaggtgccctctgacgcctccg

SEQ ID NO: 415282 - DNA, 25 bp, Rattus norvegicus
ggaaaggtgcttaacagctttttat

SEQ ID NO: 415283 - DNA, 25 bp, Rattus norvegicus
ggaaaggtgctttacagctttttat

SEQ ID NO: 415284 - DNA, 25 bp, Rattus norvegicus
ggaaaggtggacactccattcactc

SEQ ID NO: 415285 - DNA, 25 bp, Rattus norvegicus
ggaaaggtggactctccattcactc

SEQ ID NO: 415286 - DNA, 25 bp, Rattus norvegicus
ggaaaggtgtcaaccccaagcagac

SEQ ID NO: 415287 - DNA, 25 bp, Rattus norvegicus
ggaaaggtgtcatccccaagcagac

SEQ ID NO: 415288 - DNA, 25 bp, Rattus norvegicus
ggaaaggttccaagtatacgacaag

SEQ ID NO: 415289 - DNA, 25 bp, Rattus norvegicus
ggaaaggttccatgtatacgacaag

SEQ ID NO: 415290 - DNA, 25 bp, Rattus norvegicus
ggaaagtaattaagctgtcccttca

SEQ ID NO: 415291 - DNA, 25 bp, Rattus norvegicus
ggaaagtaattatgctgtcccttca

SEQ ID NO: 415292 - DNA, 25 bp, Rattus norvegicus
ggaaagtaccttcgctctagcatga

SEQ ID NO: 415293 - DNA, 25 bp, Rattus norvegicus
ggaaagtaccttggctctagcatga

SEQ ID NO: 415294 - DNA, 25 bp, Rattus norvegicus
ggaaagtactgaacggttctcctcc

SEQ ID NO: 415295 - DNA, 25 bp, Rattus norvegicus
ggaaagtactgatcggttctcctcc

SEQ ID NO: 415296 - DNA, 25 bp, Rattus norvegicus
ggaaagtaggcccacaccactatat

SEQ ID NO: 415297 - DNA, 25 bp, Rattus norvegicus
ggaaagtaggccgacaccactatat

SEQ ID NO: 415298 - DNA, 25 bp, Rattus norvegicus
ggaaagtaggctcatgacctgccct

SEQ ID NO: 415299 - DNA, 25 bp, Rattus norvegicus
ggaaagtaggctgatgacctgccct

SEQ ID NO: 415300 - DNA, 25 bp, Rattus norvegicus
ggaaagtagtcaacccagctgctgg

SEQ ID NO: 415301 - DNA, 25 bp, Rattus norvegicus
ggaaagtagtcatcccagctgctgg

SEQ ID NO: 415302 - DNA, 25 bp, Rattus norvegicus
ggaaagtatttccttctgctgccta

SEQ ID NO: 415303 - DNA, 25 bp, Rattus norvegicus
ggaaagtatttcgttctgctgccta

SEQ ID NO: 415304 - DNA, 25 bp, Rattus norvegicus
ggaaagtccagcatatcgggagttt

SEQ ID NO: 415305 - DNA, 25 bp, Rattus norvegicus
ggaaagtccagcttatcgggagttt

SEQ ID NO: 415306 - DNA, 25 bp, Rattus norvegicus
ggaaagtccaggagcccgaggaaca

SEQ ID NO: 415307 - DNA, 25 bp, Rattus norvegicus
ggaaagtccaggtgcccgaggaaca

SEQ ID NO: 415308 - DNA, 25 bp, Rattus norvegicus
ggaaagtcccagaaacttactcaag

SEQ ID NO: 415309 - DNA, 25 bp, Rattus norvegicus
ggaaagtcccagtaacttactcaag

SEQ ID NO: 415310 - DNA, 25 bp, Rattus norvegicus
ggaaagtccctgaagactctgacta

SEQ ID NO: 415311 - DNA, 25 bp, Rattus norvegicus
ggaaagtccctgtagactctgacta

SEQ ID NO: 415312 - DNA, 25 bp, Rattus norvegicus
ggaaagtctaatctgaacaacctca

SEQ ID NO: 415313 - DNA, 25 bp, Rattus norvegicus
ggaaagtctaatgtgaacaacctca

SEQ ID NO: 415314 - DNA, 25 bp, Rattus norvegicus
ggaaagtctccgacataccagaaac

SEQ ID NO: 415315 - DNA, 25 bp, Rattus norvegicus
ggaaagtctccgtcataccagaaac

SEQ ID NO: 415316 - DNA, 25 bp, Rattus norvegicus
ggaaagtctctgacataactatcaa

SEQ ID NO: 415317 - DNA, 25 bp, Rattus norvegicus
ggaaagtctctgcaggatgatttat

SEQ ID NO: 415318 - DNA, 25 bp, Rattus norvegicus
ggaaagtctctggaggatgatttat

SEQ ID NO: 415319 - DNA, 25 bp, Rattus norvegicus
ggaaagtctctgtcataactatcaa

SEQ ID NO: 415320 - DNA, 25 bp, Rattus norvegicus
ggaaagtctgttctggttatctgca

SEQ ID NO: 415321 - DNA, 25 bp, Rattus norvegicus
ggaaagtctgttgtggttatctgca

SEQ ID NO: 415322 - DNA, 25 bp, Rattus norvegicus
ggaaagtcttgcatgagggccagaa

SEQ ID NO: 415323 - DNA, 25 bp, Rattus norvegicus
ggaaagtcttgcttgagggccagaa

SEQ ID NO: 415324 - DNA, 25 bp, Rattus norvegicus
ggaaagtgaaaccatccatatcagt

SEQ ID NO: 415325 - DNA, 25 bp, Rattus norvegicus
ggaaagtgaaacgatccatatcagt

SEQ ID NO: 415326 - DNA, 25 bp, Rattus norvegicus
ggaaagtgaatcactccttgcctta

SEQ ID NO: 415327 - DNA, 25 bp, Rattus norvegicus
ggaaagtgaatctctccttgcctta

SEQ ID NO: 415328 - DNA, 25 bp, Rattus norvegicus
ggaaagtgacctactttcagacata

SEQ ID NO: 415329 - DNA, 25 bp, Rattus norvegicus
ggaaagtgaccttctttcagacata

SEQ ID NO: 415330 - DNA, 25 bp, Rattus norvegicus
ggaaagtgtaccaccgcaggttcgg

SEQ ID NO: 415331 - DNA, 25 bp, Rattus norvegicus
ggaaagtgtacctccgcaggttcgg

SEQ ID NO: 415332 - DNA, 25 bp, Rattus norvegicus
ggaaagtgtcctatggctactttgt

SEQ ID NO: 415333 - DNA, 25 bp, Rattus norvegicus
ggaaagtgtcctttggctactttgt

SEQ ID NO: 415334 - DNA, 25 bp, Rattus norvegicus
ggaaagtgtgtacttgcctgtcctt

SEQ ID NO: 415335 - DNA, 25 bp, Rattus norvegicus
ggaaagtgtgtagttgcctgtcctt

SEQ ID NO: 415336 - DNA, 25 bp, Rattus norvegicus
ggaaagtgttcacgcagtcactgcc

SEQ ID NO: 415337 - DNA, 25 bp, Rattus norvegicus
ggaaagtgttcaggcagtcactgcc

SEQ ID NO: 415338 - DNA, 25 bp, Rattus norvegicus
ggaaagttagacctatcacccacac

SEQ ID NO: 415339 - DNA, 25 bp, Rattus norvegicus
ggaaagttagacgtatcacccacac

SEQ ID NO: 415340 - DNA, 25 bp, Rattus norvegicus
ggaaagttcactagggtaccctgat

SEQ ID NO: 415341 - DNA, 25 bp, Rattus norvegicus
ggaaagttcacttgggtaccctgat

SEQ ID NO: 415342 - DNA, 25 bp, Rattus norvegicus
ggaaagttcagactggtcaccactt

SEQ ID NO: 415343 - DNA, 25 bp, Rattus norvegicus
ggaaagttcagagtggtcaccactt

SEQ ID NO: 415344 - DNA, 25 bp, Rattus norvegicus
ggaaagttcttcctttctgatccct

SEQ ID NO: 415345 - DNA, 25 bp, Rattus norvegicus
ggaaagttcttcgtttctgatccct

SEQ ID NO: 415346 - DNA, 25 bp, Rattus norvegicus
ggaaagttgccccaggacatgtgcc

SEQ ID NO: 415347 - DNA, 25 bp, Rattus norvegicus
ggaaagttgcccgaggacatgtgcc

SEQ ID NO: 415348 - DNA, 25 bp, Rattus norvegicus
ggaaagtttcagactacgacccaca

SEQ ID NO: 415349 - DNA, 25 bp, Rattus norvegicus
ggaaagtttcagtctacgacccaca

SEQ ID NO: 415350 - DNA, 25 bp, Rattus norvegicus
ggaaagtttgtgaccctacatacat

SEQ ID NO: 415351 - DNA, 25 bp, Rattus norvegicus
ggaaagtttgtgtccctacatacat

SEQ ID NO: 415352 - DNA, 25 bp, Rattus norvegicus
ggaaataaatccagctgacttgtat

SEQ ID NO: 415353 - DNA, 25 bp, Rattus norvegicus
ggaaataaatcctgctgacttgtat

SEQ ID NO: 415354 - DNA, 25 bp, Rattus norvegicus
ggaaataacaccagcacaacctata

SEQ ID NO: 415355 - DNA, 25 bp, Rattus norvegicus
ggaaataacacctgcacaacctata

SEQ ID NO: 415356 - DNA, 25 bp, Rattus norvegicus
ggaaataagccaacctcatctctag

SEQ ID NO: 415357 - DNA, 25 bp, Rattus norvegicus
ggaaataagccatcctcatctctag

SEQ ID NO: 415358 - DNA, 25 bp, Rattus norvegicus
ggaaataatatcaacctcactgaat

SEQ ID NO: 415359 - DNA, 25 bp, Rattus norvegicus
ggaaataatatctacctcactgaat

SEQ ID NO: 415360 - DNA, 25 bp, Rattus norvegicus
ggaaataatgtcactctggcaagca

SEQ ID NO: 415361 - DNA, 25 bp, Rattus norvegicus
ggaaataatgtcatagcaacccaaa

SEQ ID NO: 415362 - DNA, 25 bp, Rattus norvegicus
ggaaataatgtctctctggcaagca

SEQ ID NO: 415363 - DNA, 25 bp, Rattus norvegicus
ggaaataatgtcttagcaacccaaa

SEQ ID NO: 415364 - DNA, 25 bp, Rattus norvegicus
ggaaatacaagactgtcccctggta

SEQ ID NO: 415365 - DNA, 25 bp, Rattus norvegicus
ggaaatacaagagtgtcccctggta

SEQ ID NO: 415366 - DNA, 25 bp, Rattus norvegicus
ggaaatacaccactttggctggcat

SEQ ID NO: 415367 - DNA, 25 bp, Rattus norvegicus
ggaaatacaccagtttggctggcat

SEQ ID NO: 415368 - DNA, 25 bp, Rattus norvegicus
ggaaatacacggagccatttgctga

SEQ ID NO: 415369 - DNA, 25 bp, Rattus norvegicus
ggaaatacacggtgccatttgctga

SEQ ID NO: 415370 - DNA, 25 bp, Rattus norvegicus
ggaaatacagcacagccttgagaag

SEQ ID NO: 415371 - DNA, 25 bp, Rattus norvegicus
ggaaatacagcagagccttgagaag

SEQ ID NO: 415372 - DNA, 25 bp, Rattus norvegicus
ggaaatacatgtcctccattcatta

SEQ ID NO: 415373 - DNA, 25 bp, Rattus norvegicus
ggaaatacatgtgctccattcatta

SEQ ID NO: 415374 - DNA, 25 bp, Rattus norvegicus
ggaaataccatgactctcaggcaag

SEQ ID NO: 415375 - DNA, 25 bp, Rattus norvegicus
ggaaataccatgtctctcaggcaag

SEQ ID NO: 415376 - DNA, 25 bp, Rattus norvegicus
ggaaatacccaaacgtctgcaaaca

SEQ ID NO: 415377 - DNA, 25 bp, Rattus norvegicus
ggaaatacccaatcgtctgcaaaca

SEQ ID NO: 415378 - DNA, 25 bp, Rattus norvegicus
ggaaatacccatcttatacgcacag

SEQ ID NO: 415379 - DNA, 25 bp, Rattus norvegicus
ggaaatacccatgttatacgcacag

SEQ ID NO: 415380 - DNA, 25 bp, Rattus norvegicus
ggaaataccgtcaacagactcttct

SEQ ID NO: 415381 - DNA, 25 bp, Rattus norvegicus
ggaaataccgtcacgtgtaaatatt

SEQ ID NO: 415382 - DNA, 25 bp, Rattus norvegicus
ggaaataccgtctacagactcttct

SEQ ID NO: 415383 - DNA, 25 bp, Rattus norvegicus
ggaaataccgtctcgtgtaaatatt

SEQ ID NO: 415384 - DNA, 25 bp, Rattus norvegicus
ggaaatacctccatgagtctcggca

SEQ ID NO: 415385 - DNA, 25 bp, Rattus norvegicus
ggaaatacctccttgagtctcggca

SEQ ID NO: 415386 - DNA, 25 bp, Rattus norvegicus
ggaaataccttgatatcaaacttca

SEQ ID NO: 415387 - DNA, 25 bp, Rattus norvegicus
ggaaataccttgttatcaaacttca

SEQ ID NO: 415388 - DNA, 25 bp, Rattus norvegicus
ggaaatactcagcatactgacctaa

SEQ ID NO: 415389 - DNA, 25 bp, Rattus norvegicus
ggaaatactcaggatactgacctaa

SEQ ID NO: 415390 - DNA, 25 bp, Rattus norvegicus
ggaaatactgctcctgccctagcat

SEQ ID NO: 415391 - DNA, 25 bp, Rattus norvegicus
ggaaatactgctgctgccctagcat

SEQ ID NO: 415392 - DNA, 25 bp, Rattus norvegicus
ggaaatagacccagacagcatcccc

SEQ ID NO: 415393 - DNA, 25 bp, Rattus norvegicus
ggaaatagaccctgacagcatcccc

SEQ ID NO: 415394 - DNA, 25 bp, Rattus norvegicus
ggaaatagtcacacccactagtaat

SEQ ID NO: 415395 - DNA, 25 bp, Rattus norvegicus
ggaaatagtcactcccactagtaat

SEQ ID NO: 415396 - DNA, 25 bp, Rattus norvegicus
ggaaatagtctcatccagacactga

SEQ ID NO: 415397 - DNA, 25 bp, Rattus norvegicus
ggaaatagtctcttccagacactga

SEQ ID NO: 415398 - DNA, 25 bp, Rattus norvegicus
ggaaatagtgtcattctcccagcac

SEQ ID NO: 415399 - DNA, 25 bp, Rattus norvegicus
ggaaatagtgtctttctcccagcac

SEQ ID NO: 415400 - DNA, 25 bp, Rattus norvegicus
ggaaatagttgactccagacatctc

SEQ ID NO: 415401 - DNA, 25 bp, Rattus norvegicus
ggaaatagttgagtccagacatctc

SEQ ID NO: 415402 - DNA, 25 bp, Rattus norvegicus
ggaaatatcactaatctttgccaga

SEQ ID NO: 415403 - DNA, 25 bp, Rattus norvegicus
ggaaatatcacttatctttgccaga

SEQ ID NO: 415404 - DNA, 25 bp, Rattus norvegicus
ggaaatatcttacccattgcttgca

SEQ ID NO: 415405 - DNA, 25 bp, Rattus norvegicus
ggaaatatcttagccattgcttgca

SEQ ID NO: 415406 - DNA, 25 bp, Rattus norvegicus
ggaaatatcttcagtgacctcaaga

SEQ ID NO: 415407 - DNA, 25 bp, Rattus norvegicus
ggaaatatcttctgtgacctcaaga

SEQ ID NO: 415408 - DNA, 25 bp, Rattus norvegicus
ggaaatatgtccctacgtgtgcacc

SEQ ID NO: 415409 - DNA, 25 bp, Rattus norvegicus
ggaaatatgtccgtacgtgtgcacc

SEQ ID NO: 415410 - DNA, 25 bp, Rattus norvegicus
ggaaatattgacaaatacctctgat

SEQ ID NO: 415411 - DNA, 25 bp, Rattus norvegicus
ggaaatattgactaatacctctgat

SEQ ID NO: 415412 - DNA, 25 bp, Rattus norvegicus
ggaaatatttgccatgccgagtgct

SEQ ID NO: 415413 - DNA, 25 bp, Rattus norvegicus
ggaaatatttgcgatgccgagtgct

SEQ ID NO: 415414 - DNA, 25 bp, Rattus norvegicus
ggaaatcaaacccagccttgcatgg

SEQ ID NO: 415415 - DNA, 25 bp, Rattus norvegicus
ggaaatcaaaccgagccttgcatgg

SEQ ID NO: 415416 - DNA, 25 bp, Rattus norvegicus
ggaaatcaaagcaaacgtcgccaaa

SEQ ID NO: 415417 - DNA, 25 bp, Rattus norvegicus
ggaaatcaaagctaacgtcgccaaa

SEQ ID NO: 415418 - DNA, 25 bp, Rattus norvegicus
ggaaatcaaaggatcacctgccttt

SEQ ID NO: 415419 - DNA, 25 bp, Rattus norvegicus
ggaaatcaaaggttcacctgccttt

SEQ ID NO: 415420 - DNA, 25 bp, Rattus norvegicus
ggaaatcaaagtcacacccggttca

SEQ ID NO: 415421 - DNA, 25 bp, Rattus norvegicus
ggaaatcaaagtgacacccggttca

SEQ ID NO: 415422 - DNA, 25 bp, Rattus norvegicus
ggaaatcaatacaaaaagactacat

SEQ ID NO: 415423 - DNA, 25 bp, Rattus norvegicus
ggaaatcaatactaaaagactacat

SEQ ID NO: 415424 - DNA, 25 bp, Rattus norvegicus
ggaaatcacaatcaggaactcacca

SEQ ID NO: 415425 - DNA, 25 bp, Rattus norvegicus
ggaaatcacaatgaggaactcacca

SEQ ID NO: 415426 - DNA, 25 bp, Rattus norvegicus
ggaaatcacagcagctggcgaggaa

SEQ ID NO: 415427 - DNA, 25 bp, Rattus norvegicus
ggaaatcacagctgctggcgaggaa

SEQ ID NO: 415428 - DNA, 25 bp, Rattus norvegicus
ggaaatcacattaatgtctcatcaa

SEQ ID NO: 415429 - DNA, 25 bp, Rattus norvegicus
ggaaatcacatttatgtctcatcaa

SEQ ID NO: 415430 - DNA, 25 bp, Rattus norvegicus
ggaaatcagaacatcgcctggagaa

SEQ ID NO: 415431 - DNA, 25 bp, Rattus norvegicus
ggaaatcagaacttcgcctggagaa

SEQ ID NO: 415432 - DNA, 25 bp, Rattus norvegicus
ggaaatcagtcaccttaccctactg

SEQ ID NO: 415433 - DNA, 25 bp, Rattus norvegicus
ggaaatcagtcagcttaccctactg

SEQ ID NO: 415434 - DNA, 25 bp, Rattus norvegicus
ggaaatcagtccactttgtaatcaa

SEQ ID NO: 415435 - DNA, 25 bp, Rattus norvegicus
ggaaatcagtcctctttgtaatcaa

SEQ ID NO: 415436 - DNA, 25 bp, Rattus norvegicus
ggaaatcagtctctgacctacagaa

SEQ ID NO: 415437 - DNA, 25 bp, Rattus norvegicus
ggaaatcagtctgtgacctacagaa

SEQ ID NO: 415438 - DNA, 25 bp, Rattus norvegicus
ggaaatcattccactgttgcactgg

SEQ ID NO: 415439 - DNA, 25 bp, Rattus norvegicus
ggaaatcattcctctgttgcactgg

SEQ ID NO: 415440 - DNA, 25 bp, Rattus norvegicus
ggaaatcccaacagacttgtatgtt

SEQ ID NO: 415441 - DNA, 25 bp, Rattus norvegicus
ggaaatcccaactgacttgtatgtt

SEQ ID NO: 415442 - DNA, 25 bp, Rattus norvegicus
ggaaatcccacaactgaaacccaat

SEQ ID NO: 415443 - DNA, 25 bp, Rattus norvegicus
ggaaatcccacactacttctgtgaa

SEQ ID NO: 415444 - DNA, 25 bp, Rattus norvegicus
ggaaatcccacagtacttctgtgaa

SEQ ID NO: 415445 - DNA, 25 bp, Rattus norvegicus
ggaaatcccacatctgaaacccaat

SEQ ID NO: 415446 - DNA, 25 bp, Rattus norvegicus
ggaaatcccaccagagtcatcctag

SEQ ID NO: 415447 - DNA, 25 bp, Rattus norvegicus
ggaaatcccacctgagtcatcctag

SEQ ID NO: 415448 - DNA, 25 bp, Rattus norvegicus
ggaaatccccgccaaaatcatttat

SEQ ID NO: 415449 - DNA, 25 bp, Rattus norvegicus
ggaaatccccgcgaaaatcatttat

SEQ ID NO: 415450 - DNA, 25 bp, Rattus norvegicus
ggaaatcccgaacccgctccagtga

SEQ ID NO: 415451 - DNA, 25 bp, Rattus norvegicus
ggaaatcccgaagccgctccagtga

SEQ ID NO: 415452 - DNA, 25 bp, Rattus norvegicus
ggaaatccctttcgccacacagttt

SEQ ID NO: 415453 - DNA, 25 bp, Rattus norvegicus
ggaaatccctttggccacacagttt

SEQ ID NO: 415454 - DNA, 25 bp, Rattus norvegicus
ggaaatccggccaaggcgtccgcgt

SEQ ID NO: 415455 - DNA, 25 bp, Rattus norvegicus
ggaaatccggcctaggcgtccgcgt

SEQ ID NO: 415456 - DNA, 25 bp, Rattus norvegicus
ggaaatcctattaactcctgacaag

SEQ ID NO: 415457 - DNA, 25 bp, Rattus norvegicus
ggaaatcctatttactcctgacaag

SEQ ID NO: 415458 - DNA, 25 bp, Rattus norvegicus
ggaaatcctccaacagagtttcatg

SEQ ID NO: 415459 - DNA, 25 bp, Rattus norvegicus
ggaaatcctccatcagagtttcatg

SEQ ID NO: 415460 - DNA, 25 bp, Rattus norvegicus
ggaaatcctggaagacacactatgt

SEQ ID NO: 415461 - DNA, 25 bp, Rattus norvegicus
ggaaatcctggatgacacactatgt

SEQ ID NO: 415462 - DNA, 25 bp, Rattus norvegicus
ggaaatcctgggacatctgcttggc

SEQ ID NO: 415463 - DNA, 25 bp, Rattus norvegicus
ggaaatcctgggtcatctgcttggc

SEQ ID NO: 415464 - DNA, 25 bp, Rattus norvegicus
ggaaatccttacctgctatgagacc

SEQ ID NO: 415465 - DNA, 25 bp, Rattus norvegicus
ggaaatccttacgtgctatgagacc

SEQ ID NO: 415466 - DNA, 25 bp, Rattus norvegicus
ggaaatcgctaacaactgctccgaa

SEQ ID NO: 415467 - DNA, 25 bp, Rattus norvegicus
ggaaatcgctaagaactgctccgaa

SEQ ID NO: 415468 - DNA, 25 bp, Rattus norvegicus
ggaaatcgcttgaacccagagtggg

SEQ ID NO: 415469 - DNA, 25 bp, Rattus norvegicus
ggaaatcgcttgtacccagagtggg

SEQ ID NO: 415470 - DNA, 25 bp, Rattus norvegicus
ggaaatcgtgcgagacattaaagag

SEQ ID NO: 415471 - DNA, 25 bp, Rattus norvegicus
ggaaatcgtgcgtgacattaaagag

SEQ ID NO: 415472 - DNA, 25 bp, Rattus norvegicus
ggaaatcgtttcctttaagatctct

SEQ ID NO: 415473 - DNA, 25 bp, Rattus norvegicus
ggaaatcgtttcgtttaagatctct

SEQ ID NO: 415474 - DNA, 25 bp, Rattus norvegicus
ggaaatctacccaggcagcaaagtg

SEQ ID NO: 415475 - DNA, 25 bp, Rattus norvegicus
ggaaatctaccctggcagcaaagtg

SEQ ID NO: 415476 - DNA, 25 bp, Rattus norvegicus
ggaaatctatatccctattgaaccc

SEQ ID NO: 415477 - DNA, 25 bp, Rattus norvegicus
ggaaatctatatgcctattgaaccc

SEQ ID NO: 415478 - DNA, 25 bp, Rattus norvegicus
ggaaatctcaaaacccagggaccag

SEQ ID NO: 415479 - DNA, 25 bp, Rattus norvegicus
ggaaatctcaaatcccagggaccag

SEQ ID NO: 415480 - DNA, 25 bp, Rattus norvegicus
ggaaatctcctcatggttggcccga

SEQ ID NO: 415481 - DNA, 25 bp, Rattus norvegicus
ggaaatctcctcttggttggcccga

SEQ ID NO: 415482 - DNA, 25 bp, Rattus norvegicus
ggaaatctcggtccctagggaacaa

SEQ ID NO: 415483 - DNA, 25 bp, Rattus norvegicus
ggaaatctcggtgcctagggaacaa

SEQ ID NO: 415484 - DNA, 25 bp, Rattus norvegicus
ggaaatctctctcagactattatta

SEQ ID NO: 415485 - DNA, 25 bp, Rattus norvegicus
ggaaatctctctgagactattatta

SEQ ID NO: 415486 - DNA, 25 bp, Rattus norvegicus
ggaaatctcttcagcaagttcttgc

SEQ ID NO: 415487 - DNA, 25 bp, Rattus norvegicus
ggaaatctcttctgcaagttcttgc

SEQ ID NO: 415488 - DNA, 25 bp, Rattus norvegicus
ggaaatctgataagtcctttacaaa

SEQ ID NO: 415489 - DNA, 25 bp, Rattus norvegicus
ggaaatctgatatgtcctttacaaa

SEQ ID NO: 415490 - DNA, 25 bp, Rattus norvegicus
ggaaatctgatgaagcttcactgtc

SEQ ID NO: 415491 - DNA, 25 bp, Rattus norvegicus
ggaaatctgatgtagcttcactgtc

SEQ ID NO: 415492 - DNA, 25 bp, Rattus norvegicus
ggaaatctgcttacaccatgcttaa

SEQ ID NO: 415493 - DNA, 25 bp, Rattus norvegicus
ggaaatctgctttcaccatgcttaa

SEQ ID NO: 415494 - DNA, 25 bp, Rattus norvegicus
ggaaatctggatatatcccctatag

SEQ ID NO: 415495 - DNA, 25 bp, Rattus norvegicus
ggaaatctggatttatcccctatag

SEQ ID NO: 415496 - DNA, 25 bp, Rattus norvegicus
ggaaatctgtttccttttctgattg

SEQ ID NO: 415497 - DNA, 25 bp, Rattus norvegicus
ggaaatctgtttgcttttctgattg

SEQ ID NO: 415498 - DNA, 25 bp, Rattus norvegicus
ggaaatctttctactgaatttctct

SEQ ID NO: 415499 - DNA, 25 bp, Rattus norvegicus
ggaaatctttcttctgaatttctct

SEQ ID NO: 415500 - DNA, 25 bp, Rattus norvegicus
ggaaatgaaacacttctgccctcat

SEQ ID NO: 415501 - DNA, 25 bp, Rattus norvegicus
ggaaatgaaacagttctgccctcat

SEQ ID NO: 415502 - DNA, 25 bp, Rattus norvegicus
ggaaatgaaaccaactgtcagtcta

SEQ ID NO: 415503 - DNA, 25 bp, Rattus norvegicus
ggaaatgaaacctactgtcagtcta

SEQ ID NO: 415504 - DNA, 25 bp, Rattus norvegicus
ggaaatgaactcatgccctggaata

SEQ ID NO: 415505 - DNA, 25 bp, Rattus norvegicus
ggaaatgaactcttgccctggaata

SEQ ID NO: 415506 - DNA, 25 bp, Rattus norvegicus
ggaaatgaaggcaccctcgagtcca

SEQ ID NO: 415507 - DNA, 25 bp, Rattus norvegicus
ggaaatgaaggcctgtaaggactat

SEQ ID NO: 415508 - DNA, 25 bp, Rattus norvegicus
ggaaatgaaggcgtgtaaggactat

SEQ ID NO: 415509 - DNA, 25 bp, Rattus norvegicus
ggaaatgaaggctccctcgagtcca

SEQ ID NO: 415510 - DNA, 25 bp, Rattus norvegicus
ggaaatgaatcacaggagtttacct

SEQ ID NO: 415511 - DNA, 25 bp, Rattus norvegicus
ggaaatgaatcagaggagtttacct

SEQ ID NO: 415512 - DNA, 25 bp, Rattus norvegicus
ggaaatgaatgtagtcccacgactc

SEQ ID NO: 415513 - DNA, 25 bp, Rattus norvegicus
ggaaatgaatgttgtcccacgactc

SEQ ID NO: 415514 - DNA, 25 bp, Rattus norvegicus
ggaaatgacaccaagccatcgctga

SEQ ID NO: 415515 - DNA, 25 bp, Rattus norvegicus
ggaaatgacacctagccatcgctga

SEQ ID NO: 415516 - DNA, 25 bp, Rattus norvegicus
ggaaatgaccatcgtcctctcaggc

SEQ ID NO: 415517 - DNA, 25 bp, Rattus norvegicus
ggaaatgaccatggtcctctcaggc

SEQ ID NO: 415518 - DNA, 25 bp, Rattus norvegicus
ggaaatgacccacaggaattccagg

SEQ ID NO: 415519 - DNA, 25 bp, Rattus norvegicus
ggaaatgacccagaggaattccagg

SEQ ID NO: 415520 - DNA, 25 bp, Rattus norvegicus
ggaaatgacctgagccagcagcacc

SEQ ID NO: 415521 - DNA, 25 bp, Rattus norvegicus
ggaaatgacctgtgccagcagcacc

SEQ ID NO: 415522 - DNA, 25 bp, Rattus norvegicus
ggaaatgactagctggtcgccacca

SEQ ID NO: 415523 - DNA, 25 bp, Rattus norvegicus
ggaaatgactaggtggtcgccacca

SEQ ID NO: 415524 - DNA, 25 bp, Rattus norvegicus
ggaaatgacttgataacccagcaca

SEQ ID NO: 415525 - DNA, 25 bp, Rattus norvegicus
ggaaatgacttgttaacccagcaca

SEQ ID NO: 415526 - DNA, 25 bp, Rattus norvegicus
ggaaatgagcttactcacctcgagg

SEQ ID NO: 415527 - DNA, 25 bp, Rattus norvegicus
ggaaatgagctttctcacctcgagg

SEQ ID NO: 415528 - DNA, 25 bp, Rattus norvegicus
ggaaatgatcccaaaccccacatgg

SEQ ID NO: 415529 - DNA, 25 bp, Rattus norvegicus
ggaaatgatccctaaccccacatgg

SEQ ID NO: 415530 - DNA, 25 bp, Rattus norvegicus
ggaaatgatgacactggccctaccc

SEQ ID NO: 415531 - DNA, 25 bp, Rattus norvegicus
ggaaatgatgactctggccctaccc

SEQ ID NO: 415532 - DNA, 25 bp, Rattus norvegicus
ggaaatgatggccagaccaccctgc

SEQ ID NO: 415533 - DNA, 25 bp, Rattus norvegicus
ggaaatgatggcgagaccaccctgc

SEQ ID NO: 415534 - DNA, 25 bp, Rattus norvegicus
ggaaatgatgtcaaatcactctgac

SEQ ID NO: 415535 - DNA, 25 bp, Rattus norvegicus
ggaaatgatgtctaatcactctgac

SEQ ID NO: 415536 - DNA, 25 bp, Rattus norvegicus
ggaaatgcccaaatctaaaaagtct

SEQ ID NO: 415537 - DNA, 25 bp, Rattus norvegicus
ggaaatgcccaattctaaaaagtct

SEQ ID NO: 415538 - DNA, 25 bp, Rattus norvegicus
ggaaatgcctaaagtatgcacataa

SEQ ID NO: 415539 - DNA, 25 bp, Rattus norvegicus
ggaaatgcctaatgtatgcacataa

SEQ ID NO: 415540 - DNA, 25 bp, Rattus norvegicus
ggaaatgcctctcctatccatggcc

SEQ ID NO: 415541 - DNA, 25 bp, Rattus norvegicus
ggaaatgcctctgctatccatggcc

SEQ ID NO: 415542 - DNA, 25 bp, Rattus norvegicus
ggaaatgctccaccgctgtgtaaga

SEQ ID NO: 415543 - DNA, 25 bp, Rattus norvegicus
ggaaatgctccagcgctgtgtaaga

SEQ ID NO: 415544 - DNA, 25 bp, Rattus norvegicus
ggaaatgcttccacgagatccagcc

SEQ ID NO: 415545 - DNA, 25 bp, Rattus norvegicus
ggaaatgcttcctcgagatccagcc

SEQ ID NO: 415546 - DNA, 25 bp, Rattus norvegicus
ggaaatgctttcagatccctaaccc

SEQ ID NO: 415547 - DNA, 25 bp, Rattus norvegicus
ggaaatgctttctgatccctaaccc

SEQ ID NO: 415548 - DNA, 25 bp, Rattus norvegicus
ggaaatggaagaccccacccagtgg

SEQ ID NO: 415549 - DNA, 25 bp, Rattus norvegicus
ggaaatggaagagcccacccagtgg

SEQ ID NO: 415550 - DNA, 25 bp, Rattus norvegicus
ggaaatggacgacatcaggccctgc

SEQ ID NO: 415551 - DNA, 25 bp, Rattus norvegicus
ggaaatggacgagatcaggccctgc

SEQ ID NO: 415552 - DNA, 25 bp, Rattus norvegicus
ggaaatggacttccccaatagataa

SEQ ID NO: 415553 - DNA, 25 bp, Rattus norvegicus
ggaaatggacttgcccaatagataa

SEQ ID NO: 415554 - DNA, 25 bp, Rattus norvegicus
ggaaatggatacagtccccagagtc

SEQ ID NO: 415555 - DNA, 25 bp, Rattus norvegicus
ggaaatggatactgtccccagagtc

SEQ ID NO: 415556 - DNA, 25 bp, Rattus norvegicus
ggaaatggcatgacaggctgttaga

SEQ ID NO: 415557 - DNA, 25 bp, Rattus norvegicus
ggaaatggcatgtcaggctgttaga

SEQ ID NO: 415558 - DNA, 25 bp, Rattus norvegicus
ggaaatggccatacagcagtcactg

SEQ ID NO: 415559 - DNA, 25 bp, Rattus norvegicus
ggaaatggccattcagcagtcactg

SEQ ID NO: 415560 - DNA, 25 bp, Rattus norvegicus
ggaaatgggagccactgcaaatctg

SEQ ID NO: 415561 - DNA, 25 bp, Rattus norvegicus
ggaaatgggagcgactgcaaatctg

SEQ ID NO: 415562 - DNA, 25 bp, Rattus norvegicus
ggaaatgggctgctccagcctccaa

SEQ ID NO: 415563 - DNA, 25 bp, Rattus norvegicus
ggaaatgggctggtccagcctccaa

SEQ ID NO: 415564 - DNA, 25 bp, Rattus norvegicus
ggaaatgggtcactggtccttccca

SEQ ID NO: 415565 - DNA, 25 bp, Rattus norvegicus
ggaaatgggtcagtggtccttccca

SEQ ID NO: 415566 - DNA, 25 bp, Rattus norvegicus
ggaaatggtattccccaaagtgcag

SEQ ID NO: 415567 - DNA, 25 bp, Rattus norvegicus
ggaaatggtattgcccaaagtgcag

SEQ ID NO: 415568 - DNA, 25 bp, Rattus norvegicus
ggaaatggtcttcctaacttttgaa

SEQ ID NO: 415569 - DNA, 25 bp, Rattus norvegicus
ggaaatggtcttgctaacttttgaa

SEQ ID NO: 415570 - DNA, 25 bp, Rattus norvegicus
ggaaatggtgccacttactgtgtaa

SEQ ID NO: 415571 - DNA, 25 bp, Rattus norvegicus
ggaaatggtgcctcttactgtgtaa

SEQ ID NO: 415572 - DNA, 25 bp, Rattus norvegicus
ggaaatggtggaccccttgcagtct

SEQ ID NO: 415573 - DNA, 25 bp, Rattus norvegicus
ggaaatggtggacggtcgtgactgt

SEQ ID NO: 415574 - DNA, 25 bp, Rattus norvegicus
ggaaatggtggagcccttgcagtct

SEQ ID NO: 415575 - DNA, 25 bp, Rattus norvegicus
ggaaatggtggagggtcgtgactgt

SEQ ID NO: 415576 - DNA, 25 bp, Rattus norvegicus
ggaaatggttgcagcacagcggccc

SEQ ID NO: 415577 - DNA, 25 bp, Rattus norvegicus
ggaaatggttgctgcacagcggccc

SEQ ID NO: 415578 - DNA, 25 bp, Rattus norvegicus
ggaaatgtaaacacccacagggtga

SEQ ID NO: 415579 - DNA, 25 bp, Rattus norvegicus
ggaaatgtaaactcccacagggtga

SEQ ID NO: 415580 - DNA, 25 bp, Rattus norvegicus
ggaaatgtacctctttcttcagaat

SEQ ID NO: 415581 - DNA, 25 bp, Rattus norvegicus
ggaaatgtacctgtttcttcagaat

SEQ ID NO: 415582 - DNA, 25 bp, Rattus norvegicus
ggaaatgtagccagtttctccacac

SEQ ID NO: 415583 - DNA, 25 bp, Rattus norvegicus
ggaaatgtagcctgtttctccacac

SEQ ID NO: 415584 - DNA, 25 bp, Rattus norvegicus
ggaaatgtagtcattgccaccagcc

SEQ ID NO: 415585 - DNA, 25 bp, Rattus norvegicus
ggaaatgtagtctttgccaccagcc

SEQ ID NO: 415586 - DNA, 25 bp, Rattus norvegicus
ggaaatgtatacatgcaactttgtg

SEQ ID NO: 415587 - DNA, 25 bp, Rattus norvegicus
ggaaatgtatacttgcaactttgtg

SEQ ID NO: 415588 - DNA, 25 bp, Rattus norvegicus
ggaaatgtcaccatttgctctattt

SEQ ID NO: 415589 - DNA, 25 bp, Rattus norvegicus
ggaaatgtcaccttttgctctattt

SEQ ID NO: 415590 - DNA, 25 bp, Rattus norvegicus
ggaaatgtcactattcaggatctga

SEQ ID NO: 415591 - DNA, 25 bp, Rattus norvegicus
ggaaatgtcacttttcaggatctga

SEQ ID NO: 415592 - DNA, 25 bp, Rattus norvegicus
ggaaatgtcccacctagaaaaaggt

SEQ ID NO: 415593 - DNA, 25 bp, Rattus norvegicus
ggaaatgtcccagctagaaaaaggt

SEQ ID NO: 415594 - DNA, 25 bp, Rattus norvegicus
ggaaatgtccccatccctaaatcct

SEQ ID NO: 415595 - DNA, 25 bp, Rattus norvegicus
ggaaatgtccccttccctaaatcct

SEQ ID NO: 415596 - DNA, 25 bp, Rattus norvegicus
ggaaatgtccctcttgctatgcaac

SEQ ID NO: 415597 - DNA, 25 bp, Rattus norvegicus
ggaaatgtccctgttgctatgcaac

SEQ ID NO: 415598 - DNA, 25 bp, Rattus norvegicus
ggaaatgtcctacttgttctttgta

SEQ ID NO: 415599 - DNA, 25 bp, Rattus norvegicus
ggaaatgtcctagttgttctttgta

SEQ ID NO: 415600 - DNA, 25 bp, Rattus norvegicus
ggaaatgtcgttatatttaagcata

SEQ ID NO: 415601 - DNA, 25 bp, Rattus norvegicus
ggaaatgtcgttttatttaagcata

SEQ ID NO: 415602 - DNA, 25 bp, Rattus norvegicus
ggaaatgtctgtccctttaatgaag

SEQ ID NO: 415603 - DNA, 25 bp, Rattus norvegicus
ggaaatgtctgtgcctttaatgaag

SEQ ID NO: 415604 - DNA, 25 bp, Rattus norvegicus
ggaaatgtctttcttcattcagata

SEQ ID NO: 415605 - DNA, 25 bp, Rattus norvegicus
ggaaatgtctttgttcattcagata

SEQ ID NO: 415606 - DNA, 25 bp, Rattus norvegicus
ggaaatgtgaccctaccacctggga

SEQ ID NO: 415607 - DNA, 25 bp, Rattus norvegicus
ggaaatgtgaccgtaccacctggga

SEQ ID NO: 415608 - DNA, 25 bp, Rattus norvegicus
ggaaatgtgcttagttgtagtttaa

SEQ ID NO: 415609 - DNA, 25 bp, Rattus norvegicus
ggaaatgtgctttgttgtagtttaa

SEQ ID NO: 415610 - DNA, 25 bp, Rattus norvegicus
ggaaatgtgggtcagttacttagta

SEQ ID NO: 415611 - DNA, 25 bp, Rattus norvegicus
ggaaatgtgggtgagttacttagta

SEQ ID NO: 415612 - DNA, 25 bp, Rattus norvegicus
ggaaatgttacaaagcccagggcct

SEQ ID NO: 415613 - DNA, 25 bp, Rattus norvegicus
ggaaatgttacatagcccagggcct

SEQ ID NO: 415614 - DNA, 25 bp, Rattus norvegicus
ggaaatgttacgacgctgttaaaat

SEQ ID NO: 415615 - DNA, 25 bp, Rattus norvegicus
ggaaatgttacgtcgctgttaaaat

SEQ ID NO: 415616 - DNA, 25 bp, Rattus norvegicus
ggaaatgttagaacttctgtaccaa

SEQ ID NO: 415617 - DNA, 25 bp, Rattus norvegicus
ggaaatgttagatcttctgtaccaa

SEQ ID NO: 415618 - DNA, 25 bp, Rattus norvegicus
ggaaatgttcagctttagcgtgtag

SEQ ID NO: 415619 - DNA, 25 bp, Rattus norvegicus
ggaaatgttcaggtttagcgtgtag

SEQ ID NO: 415620 - DNA, 25 bp, Rattus norvegicus
ggaaatgttcatacacttctctgtc

SEQ ID NO: 415621 - DNA, 25 bp, Rattus norvegicus
ggaaatgttcattcacttctctgtc

SEQ ID NO: 415622 - DNA, 25 bp, Rattus norvegicus
ggaaatgttcgtcgccttaaatcaa

SEQ ID NO: 415623 - DNA, 25 bp, Rattus norvegicus
ggaaatgttcgtggccttaaatcaa

SEQ ID NO: 415624 - DNA, 25 bp, Rattus norvegicus
ggaaatgttgatcgcaccgtgtaga

SEQ ID NO: 415625 - DNA, 25 bp, Rattus norvegicus
ggaaatgttgatggcaccgtgtaga

SEQ ID NO: 415626 - DNA, 25 bp, Rattus norvegicus
ggaaatgttggcctcctcataggag

SEQ ID NO: 415627 - DNA, 25 bp, Rattus norvegicus
ggaaatgttggcgtcctcataggag

SEQ ID NO: 415628 - DNA, 25 bp, Rattus norvegicus
ggaaatgttgtaactccactcagcc

SEQ ID NO: 415629 - DNA, 25 bp, Rattus norvegicus
ggaaatgttgtatctccactcagcc

SEQ ID NO: 415630 - DNA, 25 bp, Rattus norvegicus
ggaaatgtttacactatgcctttgt

SEQ ID NO: 415631 - DNA, 25 bp, Rattus norvegicus
ggaaatgtttactctatgcctttgt

SEQ ID NO: 415632 - DNA, 25 bp, Rattus norvegicus
ggaaattacatccacagaataacgt

SEQ ID NO: 415633 - DNA, 25 bp, Rattus norvegicus
ggaaattacatcgacagaataacgt

SEQ ID NO: 415634 - DNA, 25 bp, Rattus norvegicus
ggaaattaccggactaatgccacat

SEQ ID NO: 415635 - DNA, 25 bp, Rattus norvegicus
ggaaattaccggtctaatgccacat

SEQ ID NO: 415636 - DNA, 25 bp, Rattus norvegicus
ggaaattactgtccgcaaatgccca

SEQ ID NO: 415637 - DNA, 25 bp, Rattus norvegicus
ggaaattactgtgcgcaaatgccca

SEQ ID NO: 415638 - DNA, 25 bp, Rattus norvegicus
ggaaattagattaggagcaccttga

SEQ ID NO: 415639 - DNA, 25 bp, Rattus norvegicus
ggaaattagatttggagcaccttga

SEQ ID NO: 415640 - DNA, 25 bp, Rattus norvegicus
ggaaattatttcatctgggatagtt

SEQ ID NO: 415641 - DNA, 25 bp, Rattus norvegicus
ggaaattatttcttctgggatagtt

SEQ ID NO: 415642 - DNA, 25 bp, Rattus norvegicus
ggaaattatttgaacccacacactt

SEQ ID NO: 415643 - DNA, 25 bp, Rattus norvegicus
ggaaattatttgtacccacacactt

SEQ ID NO: 415644 - DNA, 25 bp, Rattus norvegicus
ggaaattcaatgatgcccatcttag

SEQ ID NO: 415645 - DNA, 25 bp, Rattus norvegicus
ggaaattcaatgttgcccatcttag

SEQ ID NO: 415646 - DNA, 25 bp, Rattus norvegicus
ggaaattcacagatcagcctcaaat

SEQ ID NO: 415647 - DNA, 25 bp, Rattus norvegicus
ggaaattcacagttcagcctcaaat

SEQ ID NO: 415648 - DNA, 25 bp, Rattus norvegicus
ggaaattcacctatgctgattctca

SEQ ID NO: 415649 - DNA, 25 bp, Rattus norvegicus
ggaaattcacctttgctgattctca

SEQ ID NO: 415650 - DNA, 25 bp, Rattus norvegicus
ggaaattcacgtatttagccaggat

SEQ ID NO: 415651 - DNA, 25 bp, Rattus norvegicus
ggaaattcacgtttttagccaggat

SEQ ID NO: 415652 - DNA, 25 bp, Rattus norvegicus
ggaaattcagctacgttcacgtggg

SEQ ID NO: 415653 - DNA, 25 bp, Rattus norvegicus
ggaaattcagcttcgttcacgtggg

SEQ ID NO: 415654 - DNA, 25 bp, Rattus norvegicus
ggaaattcagtcaagcttgtgatct

SEQ ID NO: 415655 - DNA, 25 bp, Rattus norvegicus
ggaaattcagtctagcttgtgatct

SEQ ID NO: 415656 - DNA, 25 bp, Rattus norvegicus
ggaaattcatgtctctgctaaaacg

SEQ ID NO: 415657 - DNA, 25 bp, Rattus norvegicus
ggaaattcatgtgtctgctaaaacg

SEQ ID NO: 415658 - DNA, 25 bp, Rattus norvegicus
ggaaattcattgaaatcattcactt

SEQ ID NO: 415659 - DNA, 25 bp, Rattus norvegicus
ggaaattcattgtaatcattcactt

SEQ ID NO: 415660 - DNA, 25 bp, Rattus norvegicus
ggaaattccccacttgctaaataat

SEQ ID NO: 415661 - DNA, 25 bp, Rattus norvegicus
ggaaattccccagttgctaaataat

SEQ ID NO: 415662 - DNA, 25 bp, Rattus norvegicus
ggaaattcgcgtcgatcattctgga

SEQ ID NO: 415663 - DNA, 25 bp, Rattus norvegicus
ggaaattcgcgtggatcattctgga

SEQ ID NO: 415664 - DNA, 25 bp, Rattus norvegicus
ggaaattcggagctatacacatgtg

SEQ ID NO: 415665 - DNA, 25 bp, Rattus norvegicus
ggaaattcggaggtatacacatgtg

SEQ ID NO: 415666 - DNA, 25 bp, Rattus norvegicus
ggaaattctaatacacaccagtcag

SEQ ID NO: 415667 - DNA, 25 bp, Rattus norvegicus
ggaaattctaattcacaccagtcag

SEQ ID NO: 415668 - DNA, 25 bp, Rattus norvegicus
ggaaattctaccatgttgtcaggga

SEQ ID NO: 415669 - DNA, 25 bp, Rattus norvegicus
ggaaattctaccttgttgtcaggga

SEQ ID NO: 415670 - DNA, 25 bp, Rattus norvegicus
ggaaattctattcggctccagagtt

SEQ ID NO: 415671 - DNA, 25 bp, Rattus norvegicus
ggaaattctattgggctccagagtt

SEQ ID NO: 415672 - DNA, 25 bp, Rattus norvegicus
ggaaattctcaccaaggccatttgt

SEQ ID NO: 415673 - DNA, 25 bp, Rattus norvegicus
ggaaattctcacgaaggccatttgt

SEQ ID NO: 415674 - DNA, 25 bp, Rattus norvegicus
ggaaattcttgcactgtaccccggt

SEQ ID NO: 415675 - DNA, 25 bp, Rattus norvegicus
ggaaattcttgctctgtaccccggt

SEQ ID NO: 415676 - DNA, 25 bp, Rattus norvegicus
ggaaattgacagcagccacagtgtt

SEQ ID NO: 415677 - DNA, 25 bp, Rattus norvegicus
ggaaattgacaggagccacagtgtt

SEQ ID NO: 415678 - DNA, 25 bp, Rattus norvegicus
ggaaattgactgcaccatgctcacc

SEQ ID NO: 415679 - DNA, 25 bp, Rattus norvegicus
ggaaattgactggaccatgctcacc

SEQ ID NO: 415680 - DNA, 25 bp, Rattus norvegicus
ggaaattgacttactccatttatga

SEQ ID NO: 415681 - DNA, 25 bp, Rattus norvegicus
ggaaattgacttcgttctctttaga

SEQ ID NO: 415682 - DNA, 25 bp, Rattus norvegicus
ggaaattgacttggttctctttaga

SEQ ID NO: 415683 - DNA, 25 bp, Rattus norvegicus
ggaaattgactttctccatttatga

SEQ ID NO: 415684 - DNA, 25 bp, Rattus norvegicus
ggaaattgccacactaacccaagga

SEQ ID NO: 415685 - DNA, 25 bp, Rattus norvegicus
ggaaattgccactctaacccaagga

SEQ ID NO: 415686 - DNA, 25 bp, Rattus norvegicus
ggaaattgccccaaatttgcctggc

SEQ ID NO: 415687 - DNA, 25 bp, Rattus norvegicus
ggaaattgcccctaatttgcctggc

SEQ ID NO: 415688 - DNA, 25 bp, Rattus norvegicus
ggaaattgcctgaagatggctgctt

SEQ ID NO: 415689 - DNA, 25 bp, Rattus norvegicus
ggaaattgcctgtagatggctgctt

SEQ ID NO: 415690 - DNA, 25 bp, Rattus norvegicus
ggaaattgcgttcttaattctaaag

SEQ ID NO: 415691 - DNA, 25 bp, Rattus norvegicus
ggaaattgcgttgttaattctaaag

SEQ ID NO: 415692 - DNA, 25 bp, Rattus norvegicus
ggaaattggtccctcaaactgtcct

SEQ ID NO: 415693 - DNA, 25 bp, Rattus norvegicus
ggaaattggtccgtcaaactgtcct

SEQ ID NO: 415694 - DNA, 25 bp, Rattus norvegicus
ggaaattgtcaaagtctaaaacttg

SEQ ID NO: 415695 - DNA, 25 bp, Rattus norvegicus
ggaaattgtcaatgtctaaaacttg

SEQ ID NO: 415696 - DNA, 25 bp, Rattus norvegicus
ggaaattgtggcaccttcgtaaatg

SEQ ID NO: 415697 - DNA, 25 bp, Rattus norvegicus
ggaaattgtggctccttcgtaaatg

SEQ ID NO: 415698 - DNA, 25 bp, Rattus norvegicus
ggaaatttactgaacacagccccgc

SEQ ID NO: 415699 - DNA, 25 bp, Rattus norvegicus
ggaaatttactgtacacagccccgc

SEQ ID NO: 415700 - DNA, 25 bp, Rattus norvegicus
ggaaatttatctagcagcagaacta

SEQ ID NO: 415701 - DNA, 25 bp, Rattus norvegicus
ggaaatttatcttgcagcagaacta

SEQ ID NO: 415702 - DNA, 25 bp, Rattus norvegicus
ggaaatttcacaacatgaacacaat

SEQ ID NO: 415703 - DNA, 25 bp, Rattus norvegicus
ggaaatttcacatcatgaacacaat

SEQ ID NO: 415704 - DNA, 25 bp, Rattus norvegicus
ggaaatttcaggcaccaatagtttt

SEQ ID NO: 415705 - DNA, 25 bp, Rattus norvegicus
ggaaatttcagggaccaatagtttt

SEQ ID NO: 415706 - DNA, 25 bp, Rattus norvegicus
ggaaatttcagtagagcgccggctc

SEQ ID NO: 415707 - DNA, 25 bp, Rattus norvegicus
ggaaatttcagttgagcgccggctc

SEQ ID NO: 415708 - DNA, 25 bp, Rattus norvegicus
ggaaatttccaaactgccacagcta

SEQ ID NO: 415709 - DNA, 25 bp, Rattus norvegicus
ggaaatttccaatctgccacagcta

SEQ ID NO: 415710 - DNA, 25 bp, Rattus norvegicus
ggaaatttctgacctctgtgtttta

SEQ ID NO: 415711 - DNA, 25 bp, Rattus norvegicus
ggaaatttctgagctctgtgtttta

SEQ ID NO: 415712 - DNA, 25 bp, Rattus norvegicus
ggaaatttgcacagtcgaaaagctt

SEQ ID NO: 415713 - DNA, 25 bp, Rattus norvegicus
ggaaatttgcactgtcgaaaagctt

SEQ ID NO: 415714 - DNA, 25 bp, Rattus norvegicus
ggaaattttaccaactgctgctgtt

SEQ ID NO: 415715 - DNA, 25 bp, Rattus norvegicus
ggaaattttacctactgctgctgtt

SEQ ID NO: 415716 - DNA, 25 bp, Rattus norvegicus
ggaaatttttcaagccactgaactg

SEQ ID NO: 415717 - DNA, 25 bp, Rattus norvegicus
ggaaatttttcatgccactgaactg

SEQ ID NO: 415718 - DNA, 25 bp, Rattus norvegicus
ggaaatttttctatggtagcctagt

SEQ ID NO: 415719 - DNA, 25 bp, Rattus norvegicus
ggaaatttttctttggtagcctagt

SEQ ID NO: 415720 - DNA, 25 bp, Rattus norvegicus
ggaaatttttgcattcactgataca

SEQ ID NO: 415721 - DNA, 25 bp, Rattus norvegicus
ggaaatttttgctttcactgataca

SEQ ID NO: 415722 - DNA, 25 bp, Rattus norvegicus
ggaaatttttgtcctcctttgatat

SEQ ID NO: 415723 - DNA, 25 bp, Rattus norvegicus
ggaaatttttgtgctcctttgatat

SEQ ID NO: 415724 - DNA, 25 bp, Rattus norvegicus
ggaacaaaatgtcgatggatcttaa

SEQ ID NO: 415725 - DNA, 25 bp, Rattus norvegicus
ggaacaaaatgtggatggatcttaa

SEQ ID NO: 415726 - DNA, 25 bp, Rattus norvegicus
ggaacaaacactattgctgccgaat

SEQ ID NO: 415727 - DNA, 25 bp, Rattus norvegicus
ggaacaaacactcggcccattttct

SEQ ID NO: 415728 - DNA, 25 bp, Rattus norvegicus
ggaacaaacactgggcccattttct

SEQ ID NO: 415729 - DNA, 25 bp, Rattus norvegicus
ggaacaaacacttttgctgccgaat

SEQ ID NO: 415730 - DNA, 25 bp, Rattus norvegicus
ggaacaaaccatacatacccaagat

SEQ ID NO: 415731 - DNA, 25 bp, Rattus norvegicus
ggaacaaaccattcatacccaagat

SEQ ID NO: 415732 - DNA, 25 bp, Rattus norvegicus
ggaacaaactccaaaggcctgctga

SEQ ID NO: 415733 - DNA, 25 bp, Rattus norvegicus
ggaacaaactcctaaggcctgctga

SEQ ID NO: 415734 - DNA, 25 bp, Rattus norvegicus
ggaacaaactctctcctaattgtaa

SEQ ID NO: 415735 - DNA, 25 bp, Rattus norvegicus
ggaacaaactctgtcctaattgtaa

SEQ ID NO: 415736 - DNA, 25 bp, Rattus norvegicus
ggaacaaactgcaccagcagacatt

SEQ ID NO: 415737 - DNA, 25 bp, Rattus norvegicus
ggaacaaactgctccagcagacatt

SEQ ID NO: 415738 - DNA, 25 bp, Rattus norvegicus
ggaacaaagaagacctcccactagg

SEQ ID NO: 415739 - DNA, 25 bp, Rattus norvegicus
ggaacaaagaagtcctcccactagg

SEQ ID NO: 415740 - DNA, 25 bp, Rattus norvegicus
ggaacaaagctgaccttgccaacaa

SEQ ID NO: 415741 - DNA, 25 bp, Rattus norvegicus
ggaacaaagctgtccttgccaacaa

SEQ ID NO: 415742 - DNA, 25 bp, Rattus norvegicus
ggaacaaaggaacagccatcaggct

SEQ ID NO: 415743 - DNA, 25 bp, Rattus norvegicus
ggaacaaaggaagagccatcaggct

SEQ ID NO: 415744 - DNA, 25 bp, Rattus norvegicus
ggaacaaatcataacctgcacagaa

SEQ ID NO: 415745 - DNA, 25 bp, Rattus norvegicus
ggaacaaatcattacctgcacagaa

SEQ ID NO: 415746 - DNA, 25 bp, Rattus norvegicus
ggaacaaatcccacatactgcagac

SEQ ID NO: 415747 - DNA, 25 bp, Rattus norvegicus
ggaacaaatccctcatactgcagac

SEQ ID NO: 415748 - DNA, 25 bp, Rattus norvegicus
ggaacaaatgccatctatgtctaaa

SEQ ID NO: 415749 - DNA, 25 bp, Rattus norvegicus
ggaacaaatgccttctatgtctaaa

SEQ ID NO: 415750 - DNA, 25 bp, Rattus norvegicus
ggaacaaatggacaaggactgactc

SEQ ID NO: 415751 - DNA, 25 bp, Rattus norvegicus
ggaacaaatggagaaggactgactc

SEQ ID NO: 415752 - DNA, 25 bp, Rattus norvegicus
ggaacaaattccatcctttagtatg

SEQ ID NO: 415753 - DNA, 25 bp, Rattus norvegicus
ggaacaaattccttcctttagtatg

SEQ ID NO: 415754 - DNA, 25 bp, Rattus norvegicus
ggaacaaattggcacaccatgttaa

SEQ ID NO: 415755 - DNA, 25 bp, Rattus norvegicus
ggaacaaattgggacaccatgttaa

SEQ ID NO: 415756 - DNA, 25 bp, Rattus norvegicus
ggaacaacacaactatgcggcgcca

SEQ ID NO: 415757 - DNA, 25 bp, Rattus norvegicus
ggaacaacacaagtatgcggcgcca

SEQ ID NO: 415758 - DNA, 25 bp, Rattus norvegicus
ggaacaaccgacaacttttggatgc

SEQ ID NO: 415759 - DNA, 25 bp, Rattus norvegicus
ggaacaaccgactacttttggatgc

SEQ ID NO: 415760 - DNA, 25 bp, Rattus norvegicus
ggaacaacctctccccaagatggat

SEQ ID NO: 415761 - DNA, 25 bp, Rattus norvegicus
ggaacaacctctgcccaagatggat

SEQ ID NO: 415762 - DNA, 25 bp, Rattus norvegicus
ggaacaactgctcatggtgcgctag

SEQ ID NO: 415763 - DNA, 25 bp, Rattus norvegicus
ggaacaactgctgatggtgcgctag

SEQ ID NO: 415764 - DNA, 25 bp, Rattus norvegicus
ggaacaactggaccctgactatttc

SEQ ID NO: 415765 - DNA, 25 bp, Rattus norvegicus
ggaacaactggagcctgactatttc

SEQ ID NO: 415766 - DNA, 25 bp, Rattus norvegicus
ggaacaactgtacatttgccaatgg

SEQ ID NO: 415767 - DNA, 25 bp, Rattus norvegicus
ggaacaactgtagatttgccaatgg

SEQ ID NO: 415768 - DNA, 25 bp, Rattus norvegicus
ggaacaacttaaatcaccttaattg

SEQ ID NO: 415769 - DNA, 25 bp, Rattus norvegicus
ggaacaacttaattcaccttaattg

SEQ ID NO: 415770 - DNA, 25 bp, Rattus norvegicus
ggaacaacttagcttcaatcttgca

SEQ ID NO: 415771 - DNA, 25 bp, Rattus norvegicus
ggaacaacttaggttcaatcttgca

SEQ ID NO: 415772 - DNA, 25 bp, Rattus norvegicus
ggaacaacttgtcgacacgtccctc

SEQ ID NO: 415773 - DNA, 25 bp, Rattus norvegicus
ggaacaacttgtggacacgtccctc

SEQ ID NO: 415774 - DNA, 25 bp, Rattus norvegicus
ggaacaagaagcacaacaccctttc

SEQ ID NO: 415775 - DNA, 25 bp, Rattus norvegicus
ggaacaagaagcagccactgaatag

SEQ ID NO: 415776 - DNA, 25 bp, Rattus norvegicus
ggaacaagaagctcaacaccctttc

SEQ ID NO: 415777 - DNA, 25 bp, Rattus norvegicus
ggaacaagaagctgccactgaatag

SEQ ID NO: 415778 - DNA, 25 bp, Rattus norvegicus
ggaacaagaatgacctgcccttgga

SEQ ID NO: 415779 - DNA, 25 bp, Rattus norvegicus
ggaacaagaatgtcctgcccttgga

SEQ ID NO: 415780 - DNA, 25 bp, Rattus norvegicus
ggaacaagcaaaatcaccccaactg

SEQ ID NO: 415781 - DNA, 25 bp, Rattus norvegicus
ggaacaagcaaattcaccccaactg

SEQ ID NO: 415782 - DNA, 25 bp, Rattus norvegicus
ggaacaagccccaacaatgcagctg

SEQ ID NO: 415783 - DNA, 25 bp, Rattus norvegicus
ggaacaagccccaggatacgaagaa

SEQ ID NO: 415784 - DNA, 25 bp, Rattus norvegicus
ggaacaagcccctacaatgcagctg

SEQ ID NO: 415785 - DNA, 25 bp, Rattus norvegicus
ggaacaagcccctggatacgaagaa

SEQ ID NO: 415786 - DNA, 25 bp, Rattus norvegicus
ggaacaagcctcctcatgaaagctt

SEQ ID NO: 415787 - DNA, 25 bp, Rattus norvegicus
ggaacaagcctcgtcatgaaagctt

SEQ ID NO: 415788 - DNA, 25 bp, Rattus norvegicus
ggaacaagccttatcaagacgtgaa

SEQ ID NO: 415789 - DNA, 25 bp, Rattus norvegicus
ggaacaagccttttcaagacgtgaa

SEQ ID NO: 415790 - DNA, 25 bp, Rattus norvegicus
ggaacaagctgaccggcaggtatat

SEQ ID NO: 415791 - DNA, 25 bp, Rattus norvegicus
ggaacaagctgagcggcaggtatat

SEQ ID NO: 415792 - DNA, 25 bp, Rattus norvegicus
ggaacaatacacagcacattataag

SEQ ID NO: 415793 - DNA, 25 bp, Rattus norvegicus
ggaacaatacactgcacattataag

SEQ ID NO: 415794 - DNA, 25 bp, Rattus norvegicus
ggaacaatagtgctcttcctttctc

SEQ ID NO: 415795 - DNA, 25 bp, Rattus norvegicus
ggaacaatagtggtcttcctttctc

SEQ ID NO: 415796 - DNA, 25 bp, Rattus norvegicus
ggaacaatctctctagccctaaatt

SEQ ID NO: 415797 - DNA, 25 bp, Rattus norvegicus
ggaacaatctctgtagccctaaatt

SEQ ID NO: 415798 - DNA, 25 bp, Rattus norvegicus
ggaacaatcttgctgtgttttttca

SEQ ID NO: 415799 - DNA, 25 bp, Rattus norvegicus
ggaacaatcttggtgtgttttttca

SEQ ID NO: 415800 - DNA, 25 bp, Rattus norvegicus
ggaacaatgcagatcttctcggagt

SEQ ID NO: 415801 - DNA, 25 bp, Rattus norvegicus
ggaacaatgcagttcttctcggagt

SEQ ID NO: 415802 - DNA, 25 bp, Rattus norvegicus
ggaacaatgccacctgtcaataaat

SEQ ID NO: 415803 - DNA, 25 bp, Rattus norvegicus
ggaacaatgccagctgtcaataaat

SEQ ID NO: 415804 - DNA, 25 bp, Rattus norvegicus
ggaacaatgcctacatggactctgg

SEQ ID NO: 415805 - DNA, 25 bp, Rattus norvegicus
ggaacaatgccttcatggactctgg

SEQ ID NO: 415806 - DNA, 25 bp, Rattus norvegicus
ggaacaatgctacctctatctggag

SEQ ID NO: 415807 - DNA, 25 bp, Rattus norvegicus
ggaacaatgctagctctatctggag

SEQ ID NO: 415808 - DNA, 25 bp, Rattus norvegicus
ggaacaattccacgaccagatacag

SEQ ID NO: 415809 - DNA, 25 bp, Rattus norvegicus
ggaacaattccaggaccagatacag

SEQ ID NO: 415810 - DNA, 25 bp, Rattus norvegicus
ggaacaattcttaaaattttgtgct

SEQ ID NO: 415811 - DNA, 25 bp, Rattus norvegicus
ggaacaattctttaaattttgtgct

SEQ ID NO: 415812 - DNA, 25 bp, Rattus norvegicus
ggaacaattgtaccgctatcacaca

SEQ ID NO: 415813 - DNA, 25 bp, Rattus norvegicus
ggaacaattgtagcgctatcacaca

SEQ ID NO: 415814 - DNA, 25 bp, Rattus norvegicus
ggaacaatttccaaggctgagctca

SEQ ID NO: 415815 - DNA, 25 bp, Rattus norvegicus
ggaacaatttcctaggctgagctca

SEQ ID NO: 415816 - DNA, 25 bp, Rattus norvegicus
ggaacacaacagaacatccctgaca

SEQ ID NO: 415817 - DNA, 25 bp, Rattus norvegicus
ggaacacaacagtacatccctgaca

SEQ ID NO: 415818 - DNA, 25 bp, Rattus norvegicus
ggaacacaagagaccatcggcacct

SEQ ID NO: 415819 - DNA, 25 bp, Rattus norvegicus
ggaacacaagagtccatcggcacct

SEQ ID NO: 415820 - DNA, 25 bp, Rattus norvegicus
ggaacacactcaactcgggacgggt

SEQ ID NO: 415821 - DNA, 25 bp, Rattus norvegicus
ggaacacactcatctcgggacgggt

SEQ ID NO: 415822 - DNA, 25 bp, Rattus norvegicus
ggaacacagaccatcagcaacaagt

SEQ ID NO: 415823 - DNA, 25 bp, Rattus norvegicus
ggaacacagaccttcagcaacaagt

SEQ ID NO: 415824 - DNA, 25 bp, Rattus norvegicus
ggaacacagagcaaagtcctactct

SEQ ID NO: 415825 - DNA, 25 bp, Rattus norvegicus
ggaacacagagctaagtcctactct

SEQ ID NO: 415826 - DNA, 25 bp, Rattus norvegicus
ggaacacagaggaattcaatacctg

SEQ ID NO: 415827 - DNA, 25 bp, Rattus norvegicus
ggaacacagaggtattcaatacctg

SEQ ID NO: 415828 - DNA, 25 bp, Rattus norvegicus
ggaacacagataaaatgtcagcagt

SEQ ID NO: 415829 - DNA, 25 bp, Rattus norvegicus
ggaacacagatataatgtcagcagt

SEQ ID NO: 415830 - DNA, 25 bp, Rattus norvegicus
ggaacacagcaacctttccctgtaa

SEQ ID NO: 415831 - DNA, 25 bp, Rattus norvegicus
ggaacacagcaagctttccctgtaa

SEQ ID NO: 415832 - DNA, 25 bp, Rattus norvegicus
ggaacacagctacctactctgagat

SEQ ID NO: 415833 - DNA, 25 bp, Rattus norvegicus
ggaacacagctagctactctgagat

SEQ ID NO: 415834 - DNA, 25 bp, Rattus norvegicus
ggaacacagctgctactctatattt

SEQ ID NO: 415835 - DNA, 25 bp, Rattus norvegicus
ggaacacagctggtactctatattt

SEQ ID NO: 415836 - DNA, 25 bp, Rattus norvegicus
ggaacacaggatcttctagctgctg

SEQ ID NO: 415837 - DNA, 25 bp, Rattus norvegicus
ggaacacaggatgttctagctgctg

SEQ ID NO: 415838 - DNA, 25 bp, Rattus norvegicus
ggaacacagtatacctgtcacttga

SEQ ID NO: 415839 - DNA, 25 bp, Rattus norvegicus
ggaacacagtattcctgtcacttga

SEQ ID NO: 415840 - DNA, 25 bp, Rattus norvegicus
ggaacacagtcaagcctgccaggaa

SEQ ID NO: 415841 - DNA, 25 bp, Rattus norvegicus
ggaacacagtcatgcctgccaggaa

SEQ ID NO: 415842 - DNA, 25 bp, Rattus norvegicus
ggaacacagtctatagtaacatcaa

SEQ ID NO: 415843 - DNA, 25 bp, Rattus norvegicus
ggaacacagtctcggcagtcctgaa

SEQ ID NO: 415844 - DNA, 25 bp, Rattus norvegicus
ggaacacagtctgggcagtcctgaa

SEQ ID NO: 415845 - DNA, 25 bp, Rattus norvegicus
ggaacacagtctttagtaacatcaa

SEQ ID NO: 415846 - DNA, 25 bp, Rattus norvegicus
ggaacacagtggacagcctgcagca

SEQ ID NO: 415847 - DNA, 25 bp, Rattus norvegicus
ggaacacagtggtcagcctgcagca

SEQ ID NO: 415848 - DNA, 25 bp, Rattus norvegicus
ggaacacataaaacctagttgtcaa

SEQ ID NO: 415849 - DNA, 25 bp, Rattus norvegicus
ggaacacataaatcctagttgtcaa

SEQ ID NO: 415850 - DNA, 25 bp, Rattus norvegicus
ggaacacatactctgtccggcgctt

SEQ ID NO: 415851 - DNA, 25 bp, Rattus norvegicus
ggaacacatactgtgtccggcgctt

SEQ ID NO: 415852 - DNA, 25 bp, Rattus norvegicus
ggaacacatgctcagaagacttagt

SEQ ID NO: 415853 - DNA, 25 bp, Rattus norvegicus
ggaacacatgctgagaagacttagt

SEQ ID NO: 415854 - DNA, 25 bp, Rattus norvegicus
ggaacacattcccaaagttgtcctg

SEQ ID NO: 415855 - DNA, 25 bp, Rattus norvegicus
ggaacacattccgaaagttgtcctg

SEQ ID NO: 415856 - DNA, 25 bp, Rattus norvegicus
ggaacaccaaaaattgagcccacca

SEQ ID NO: 415857 - DNA, 25 bp, Rattus norvegicus
ggaacaccaaaatttgagcccacca

SEQ ID NO: 415858 - DNA, 25 bp, Rattus norvegicus
ggaacaccatacaagactttttgta

SEQ ID NO: 415859 - DNA, 25 bp, Rattus norvegicus
ggaacaccatactagactttttgta

SEQ ID NO: 415860 - DNA, 25 bp, Rattus norvegicus
ggaacaccatatacaaagacgctca

SEQ ID NO: 415861 - DNA, 25 bp, Rattus norvegicus
ggaacaccatattcaaagacgctca

SEQ ID NO: 415862 - DNA, 25 bp, Rattus norvegicus
ggaacaccatgcacgggctttagtt

SEQ ID NO: 415863 - DNA, 25 bp, Rattus norvegicus
ggaacaccatgctcgggctttagtt

SEQ ID NO: 415864 - DNA, 25 bp, Rattus norvegicus
ggaacacccgcgaacaatgatggaa

SEQ ID NO: 415865 - DNA, 25 bp, Rattus norvegicus
ggaacacccgcgtacaatgatggaa

SEQ ID NO: 415866 - DNA, 25 bp, Rattus norvegicus
ggaacaccctaaaggcagcagcagt

SEQ ID NO: 415867 - DNA, 25 bp, Rattus norvegicus
ggaacaccctaatggcagcagcagt

SEQ ID NO: 415868 - DNA, 25 bp, Rattus norvegicus
ggaacaccctatctgaggagctctt

SEQ ID NO: 415869 - DNA, 25 bp, Rattus norvegicus
ggaacaccctatgtgaggagctctt

SEQ ID NO: 415870 - DNA, 25 bp, Rattus norvegicus
ggaacaccctgaagaaccatgagaa

SEQ ID NO: 415871 - DNA, 25 bp, Rattus norvegicus
ggaacaccctgatgaaccatgagaa

SEQ ID NO: 415872 - DNA, 25 bp, Rattus norvegicus
ggaacacccttgacacctctaggag

SEQ ID NO: 415873 - DNA, 25 bp, Rattus norvegicus
ggaacacccttgtcacctctaggag

SEQ ID NO: 415874 - DNA, 25 bp, Rattus norvegicus
ggaacacctgcactacaaattctta

SEQ ID NO: 415875 - DNA, 25 bp, Rattus norvegicus
ggaacacctgcagtacaaattctta

SEQ ID NO: 415876 - DNA, 25 bp, Rattus norvegicus
ggaacacctgtcaggagaatggctc

SEQ ID NO: 415877 - DNA, 25 bp, Rattus norvegicus
ggaacacctgtctggagaatggctc

SEQ ID NO: 415878 - DNA, 25 bp, Rattus norvegicus
ggaacaccttctcgaaacacctagc

SEQ ID NO: 415879 - DNA, 25 bp, Rattus norvegicus
ggaacaccttctggaaacacctagc

SEQ ID NO: 415880 - DNA, 25 bp, Rattus norvegicus
ggaacacgaagcatactgacttgac

SEQ ID NO: 415881 - DNA, 25 bp, Rattus norvegicus
ggaacacgaagcctctgaccaggta

SEQ ID NO: 415882 - DNA, 25 bp, Rattus norvegicus
ggaacacgaagcgtctgaccaggta

SEQ ID NO: 415883 - DNA, 25 bp, Rattus norvegicus
ggaacacgaagcttactgacttgac

SEQ ID NO: 415884 - DNA, 25 bp, Rattus norvegicus
ggaacacgatttaagaaaccagctt

SEQ ID NO: 415885 - DNA, 25 bp, Rattus norvegicus
ggaacacgattttagaaaccagctt

SEQ ID NO: 415886 - DNA, 25 bp, Rattus norvegicus
ggaacacgccagcagaagtctcatg

SEQ ID NO: 415887 - DNA, 25 bp, Rattus norvegicus
ggaacacgccaggagaagtctcatg

SEQ ID NO: 415888 - DNA, 25 bp, Rattus norvegicus
ggaacacgggcacttatgcgactgt

SEQ ID NO: 415889 - DNA, 25 bp, Rattus norvegicus
ggaacacgggcagttatgcgactgt

SEQ ID NO: 415890 - DNA, 25 bp, Rattus norvegicus
ggaacacgtagcctttttcaagcag

SEQ ID NO: 415891 - DNA, 25 bp, Rattus norvegicus
ggaacacgtagcgtttttcaagcag

SEQ ID NO: 415892 - DNA, 25 bp, Rattus norvegicus
ggaacacgtcctagggtggcccttg

SEQ ID NO: 415893 - DNA, 25 bp, Rattus norvegicus
ggaacacgtccttgggtggcccttg

SEQ ID NO: 415894 - DNA, 25 bp, Rattus norvegicus
ggaacactaaatctatattaccgat

SEQ ID NO: 415895 - DNA, 25 bp, Rattus norvegicus
ggaacactaaatgtatattaccgat

SEQ ID NO: 415896 - DNA, 25 bp, Rattus norvegicus
ggaacactacggcaactatacctgt

SEQ ID NO: 415897 - DNA, 25 bp, Rattus norvegicus
ggaacactacgggaactatacctgt

SEQ ID NO: 415898 - DNA, 25 bp, Rattus norvegicus
ggaacactagatcttcttctagggc

SEQ ID NO: 415899 - DNA, 25 bp, Rattus norvegicus
ggaacactagatgttcttctagggc

SEQ ID NO: 415900 - DNA, 25 bp, Rattus norvegicus
ggaacactagctccactgttactat

SEQ ID NO: 415901 - DNA, 25 bp, Rattus norvegicus
ggaacactagctgcactgttactat

SEQ ID NO: 415902 - DNA, 25 bp, Rattus norvegicus
ggaacactatataccactacactgg

SEQ ID NO: 415903 - DNA, 25 bp, Rattus norvegicus
ggaacactatattccactacactgg

SEQ ID NO: 415904 - DNA, 25 bp, Rattus norvegicus
ggaacactatcactgtgctcctttc

SEQ ID NO: 415905 - DNA, 25 bp, Rattus norvegicus
ggaacactatcagtgtgctcctttc

SEQ ID NO: 415906 - DNA, 25 bp, Rattus norvegicus
ggaacactatttcctgtccaacttc

SEQ ID NO: 415907 - DNA, 25 bp, Rattus norvegicus
ggaacactatttgctgtccaacttc

SEQ ID NO: 415908 - DNA, 25 bp, Rattus norvegicus
ggaacactcacaccaggccctaaga

SEQ ID NO: 415909 - DNA, 25 bp, Rattus norvegicus
ggaacactcacagcaggccctaaga

SEQ ID NO: 415910 - DNA, 25 bp, Rattus norvegicus
ggaacactctacattcactaaattt

SEQ ID NO: 415911 - DNA, 25 bp, Rattus norvegicus
ggaacactctactttcactaaattt

SEQ ID NO: 415912 - DNA, 25 bp, Rattus norvegicus
ggaacactgcacatctggcaaaagt

SEQ ID NO: 415913 - DNA, 25 bp, Rattus norvegicus
ggaacactgcacttctggcaaaagt

SEQ ID NO: 415914 - DNA, 25 bp, Rattus norvegicus
ggaacactgcctcgcgttgaataga

SEQ ID NO: 415915 - DNA, 25 bp, Rattus norvegicus
ggaacactgcctggcgttgaataga

SEQ ID NO: 415916 - DNA, 25 bp, Rattus norvegicus
ggaacactgctaaccatgcagcctt

SEQ ID NO: 415917 - DNA, 25 bp, Rattus norvegicus
ggaacactgctacctgctttacctt

SEQ ID NO: 415918 - DNA, 25 bp, Rattus norvegicus
ggaacactgctagctgctttacctt

SEQ ID NO: 415919 - DNA, 25 bp, Rattus norvegicus
ggaacactgctatccatgcagcctt

SEQ ID NO: 415920 - DNA, 25 bp, Rattus norvegicus
ggaacactggcgatgtctgtatgca

SEQ ID NO: 415921 - DNA, 25 bp, Rattus norvegicus
ggaacactggcgttgtctgtatgca

SEQ ID NO: 415922 - DNA, 25 bp, Rattus norvegicus
ggaacactgggtaactcaatggagt

SEQ ID NO: 415923 - DNA, 25 bp, Rattus norvegicus
ggaacactgggttactcaatggagt

SEQ ID NO: 415924 - DNA, 25 bp, Rattus norvegicus
ggaacactgtctcgatttttacttt

SEQ ID NO: 415925 - DNA, 25 bp, Rattus norvegicus
ggaacactgtctggatttttacttt

SEQ ID NO: 415926 - DNA, 25 bp, Rattus norvegicus
ggaacacttaacagcttggtcactg

SEQ ID NO: 415927 - DNA, 25 bp, Rattus norvegicus
ggaacacttaacatgcatttgaatt

SEQ ID NO: 415928 - DNA, 25 bp, Rattus norvegicus
ggaacacttaactgcttggtcactg

SEQ ID NO: 415929 - DNA, 25 bp, Rattus norvegicus
ggaacacttaacttgcatttgaatt

SEQ ID NO: 415930 - DNA, 25 bp, Rattus norvegicus
ggaacacttcaaaggcatcgccttg

SEQ ID NO: 415931 - DNA, 25 bp, Rattus norvegicus
ggaacacttcaatggcatcgccttg

SEQ ID NO: 415932 - DNA, 25 bp, Rattus norvegicus
ggaacacttcacatcacactatgat

SEQ ID NO: 415933 - DNA, 25 bp, Rattus norvegicus
ggaacacttcacttcacactatgat

SEQ ID NO: 415934 - DNA, 25 bp, Rattus norvegicus
ggaacacttcctcaaatgactagat

SEQ ID NO: 415935 - DNA, 25 bp, Rattus norvegicus
ggaacacttcctgaaatgactagat

SEQ ID NO: 415936 - DNA, 25 bp, Rattus norvegicus
ggaacacttgctcctgggctgcaaa

SEQ ID NO: 415937 - DNA, 25 bp, Rattus norvegicus
ggaacacttgctgctgggctgcaaa

SEQ ID NO: 415938 - DNA, 25 bp, Rattus norvegicus
ggaacactttacaaccatcaatctc

SEQ ID NO: 415939 - DNA, 25 bp, Rattus norvegicus
ggaacactttactaccatcaatctc

SEQ ID NO: 415940 - DNA, 25 bp, Rattus norvegicus
ggaacactttagaccacatgcattt

SEQ ID NO: 415941 - DNA, 25 bp, Rattus norvegicus
ggaacactttagtccacatgcattt

SEQ ID NO: 415942 - DNA, 25 bp, Rattus norvegicus
ggaacagaaaggctcgcctgccaga

SEQ ID NO: 415943 - DNA, 25 bp, Rattus norvegicus
ggaacagaaagggtcgcctgccaga

SEQ ID NO: 415944 - DNA, 25 bp, Rattus norvegicus
ggaacagaacaacggccactacttc

SEQ ID NO: 415945 - DNA, 25 bp, Rattus norvegicus
ggaacagaacaagggccactacttc

SEQ ID NO: 415946 - DNA, 25 bp, Rattus norvegicus
ggaacagaacatccgtcaaatttga

SEQ ID NO: 415947 - DNA, 25 bp, Rattus norvegicus
ggaacagaacatcgcctttaaggca

SEQ ID NO: 415948 - DNA, 25 bp, Rattus norvegicus
ggaacagaacatgcgtcaaatttga

SEQ ID NO: 415949 - DNA, 25 bp, Rattus norvegicus
ggaacagaacatggcctttaaggca

SEQ ID NO: 415950 - DNA, 25 bp, Rattus norvegicus
ggaacagaaccactacctggcccag

SEQ ID NO: 415951 - DNA, 25 bp, Rattus norvegicus
ggaacagaaccactttgtacagaac

SEQ ID NO: 415952 - DNA, 25 bp, Rattus norvegicus
ggaacagaaccagtacctggcccag

SEQ ID NO: 415953 - DNA, 25 bp, Rattus norvegicus
ggaacagaaccagtttgtacagaac

SEQ ID NO: 415954 - DNA, 25 bp, Rattus norvegicus
ggaacagaagtcattctttgccaaa

SEQ ID NO: 415955 - DNA, 25 bp, Rattus norvegicus
ggaacagaagtctttctttgccaaa
